United States Patent 11,640,849 (METHODS FOR HISTOLOGICAL DIAGNOSIS AND TREATMENT OF DISEASES) - sequence listing, part 16

SEQ ID NO: 625343 - protein, 17 aa, Mycobacterium
AAEFATRFAELLGARRG

SEQ ID NO: 625344 - protein, 19 aa, Mycobacterium
AAEFVRGRRAEIFGLHPAT

SEQ ID NO: 625345 - protein, 17 aa, Mycobacterium
AAEGCELVLVLGGDGTF

SEQ ID NO: 625346 - protein, 23 aa, Mycobacterium
AAEGFPSLSCIVLNGGFDLHPSI

SEQ ID NO: 625347 - protein, 24 aa, Mycobacterium
AAEGFPSLSCIVLNGGFELHPSIA

SEQ ID NO: 625348 - protein, 24 aa, Mycobacterium
AAEGFPSLSCIVLNGGFRLHPSIA

SEQ ID NO: 625349 - protein, 18 aa, Mycobacterium
AAEGHLVVGGARRADRLA

SEQ ID NO: 625350 - protein, 25 aa, Mycobacterium
AAEGLCGALRLADFDELELSNLNRV

SEQ ID NO: 625351 - protein, 27 aa, Mycobacterium
AAEGLEWEGSALLELATGIAIETIREN

SEQ ID NO: 625352 - protein, 23 aa, Mycobacterium
AAEGLPDVCRALRDGNVATLIVG

SEQ ID NO: 625353 - protein, 17 aa, Mycobacterium
AAEGPLKGILKYYDAPI

SEQ ID NO: 625354 - protein, 21 aa, Mycobacterium
AAEGRAVIGFGADRDYDFAEF

SEQ ID NO: 625355 - protein, 17 aa, Mycobacterium
AAEGVEYVFGIPGDENL

SEQ ID NO: 625356 - protein, 21 aa, Mycobacterium
AAEHKPDVVILDLGLPDISGI

SEQ ID NO: 625357 - protein, 17 aa, Mycobacterium
AAEHLKKSLDTELVASF

SEQ ID NO: 625358 - protein, 18 aa, Mycobacterium
AAEHLRLAGTDYWFCGPG

SEQ ID NO: 625359 - protein, 26 aa, Mycobacterium
AAEHLYRLALPLGIYGGTLEVFRNMI

SEQ ID NO: 625360 - protein, 20 aa, Mycobacterium
AAEHPERFARIVVANTGLPN

SEQ ID NO: 625361 - protein, 23 aa, Mycobacterium
AAEHPERFARLVVANTGLPNGDQ

SEQ ID NO: 625362 - protein, 19 aa, Mycobacterium
AAEHPRLGPVRNPWNTDHT

SEQ ID NO: 625363 - protein, 34 aa, Mycobacterium
AAEIAEGWQPIFFLPEKAATVWGDALKAGKTKRD

SEQ ID NO: 625364 - protein, 24 aa, Mycobacterium
AAEIAEGWQPIFYLPEKAQDVWGE

SEQ ID NO: 625365 - protein, 34 aa, Mycobacterium
AAEIAEGWQPIFYLPEKAQQVWGEALATGRAKRD

SEQ ID NO: 625366 - protein, 23 aa, Mycobacterium
AAEIAEPVGNAWGVAARIGLEDP

SEQ ID NO: 625367 - protein, 31 aa, Mycobacterium
AAEIGLGRRWVMSAWGRAAAAERWHTGDHGP

SEQ ID NO: 625368 - protein, 24 aa, Mycobacterium
AAEISWPTAPPAAPPVLAAPAPPV

SEQ ID NO: 625369 - protein, 19 aa, Mycobacterium
AAEIVFLVGCFSMVAVTLN

SEQ ID NO: 625370 - protein, 22 aa, Mycobacterium
AAEKAGFGGFGFTDHPAPTQRW

SEQ ID NO: 625371 - protein, 21 aa, Mycobacterium
AAEKARLALTAGQERVDAARG

SEQ ID NO: 625372 - protein, 18 aa, Mycobacterium
AAEKEWRLLVGGESLGDL

SEQ ID NO: 625373 - protein, 35 aa, Mycobacterium
AAEKILRLRVGFAFGRAISRSGDWYGSPVNMASRI

SEQ ID NO: 625374 - protein, 29 aa, Mycobacterium
AAELAERYGMQRFCLGIHACEIPVLDLET

SEQ ID NO: 625375 - protein, 18 aa, Mycobacterium
AAELAPPSVRRELHSKVA

SEQ ID NO: 625376 - protein, 17 aa, Mycobacterium
AAELCAMAKRIATDVGF

SEQ ID NO: 625377 - protein, 26 aa, Mycobacterium
AAELEAITGWAAREPEVWWNTPEGRG

SEQ ID NO: 625378 - protein, 18 aa, Mycobacterium
AAELGAAVPSVYYHVPGK

SEQ ID NO: 625379 - protein, 17 aa, Mycobacterium
AAELGMAAIYCRDDVGG

SEQ ID NO: 625380 - protein, 18 aa, Mycobacterium
AAELGMGAIYCREDVGGS

SEQ ID NO: 625381 - protein, 18 aa, Mycobacterium
AAELGRLAGRLDDDTTER

SEQ ID NO: 625382 - protein, 18 aa, Mycobacterium
AAELGRLAGRLDDETADR

SEQ ID NO: 625383 - protein, 29 aa, Mycobacterium
AAELKYGAVATVWNILDPLQLVHNKDKAV

SEQ ID NO: 625384 - protein, 17 aa, Mycobacterium
AAELMFCDADFRYVAQR

SEQ ID NO: 625385 - protein, 25 aa, Mycobacterium
AAELNLGALLFKRGSVHATNLRRRP

SEQ ID NO: 625386 - protein, 25 aa, Mycobacterium
AAELNPQLFAALDWPTDIGEYQDYL

SEQ ID NO: 625387 - protein, 22 aa, Mycobacterium
AAELPEKVREAALREVGKLERS

SEQ ID NO: 625388 - protein, 24 aa, Mycobacterium
AAELPMQMICILLGVPESERHWLF

SEQ ID NO: 625389 - protein, 21 aa, Mycobacterium
AAELPTARWLVLVGEGTEARQ

SEQ ID NO: 625390 - protein, 17 aa, Mycobacterium
AAELQRPRRGHTLYVLD

SEQ ID NO: 625391 - protein, 21 aa, Mycobacterium
AAELRRFLLQQLPAAMVPAVF

SEQ ID NO: 625392 - protein, 21 aa, Mycobacterium
AAELRRIVGPWGEVHETASTD

SEQ ID NO: 625393 - protein, 21 aa, Mycobacterium
AAELRYLEAHGYRRIGENTLL

SEQ ID NO: 625394 - protein, 33 aa, Mycobacterium
AAELTVSMPMRLRLLEALDLFGIALGVAAVRRG

SEQ ID NO: 625395 - protein, 25 aa, Mycobacterium
AAELVLRRRAEVFGAAGASNDDAAG

SEQ ID NO: 625396 - protein, 19 aa, Mycobacterium
AAELVRFGQAIRRLETGGL

SEQ ID NO: 625397 - protein, 28 aa, Mycobacterium
AAELVRRGCPFSGLLYAGLAITAKGPAV

SEQ ID NO: 625398 - protein, 25 aa, Mycobacterium
AAELVRRGSSFSGLLYAGLAITSNG

SEQ ID NO: 625399 - protein, 28 aa, Mycobacterium
AAELYWDQVAGFARKYLAAATGLDRIAA

SEQ ID NO: 625400 - protein, 24 aa, Mycobacterium
AAEMGAQAVGAWTRSRGEHPDYLT

SEQ ID NO: 625401 - protein, 20 aa, Mycobacterium
AAEMVVEIRQVLGLAGVEIG

SEQ ID NO: 625402 - protein, 21 aa, Mycobacterium
AAEPAVRAPLMSQVVEASSSP

SEQ ID NO: 625403 - protein, 22 aa, Mycobacterium
AAEPDALIGFLGPRVYEHLYGE

SEQ ID NO: 625404 - protein, 20 aa, Mycobacterium
AAEPDFFWSPVNTLEDVVAD

SEQ ID NO: 625405 - protein, 24 aa, Mycobacterium
AAEPFPLAPMQHAMWVGRQDNQQL

SEQ ID NO: 625406 - protein, 18 aa, Mycobacterium
AAEPGGEVTLRLTAASDC

SEQ ID NO: 625407 - protein, 18 aa, Mycobacterium
AAEPGSDHQLAFVNALTG

SEQ ID NO: 625408 - protein, 18 aa, Mycobacterium
AAEPGSDHQLAFVNTLCS

SEQ ID NO: 625409 - protein, 31 aa, Mycobacterium
AAEPLGDPGLLWRAAARLEIGAQAATPAIEA

SEQ ID NO: 625410 - protein, 17 aa, Mycobacterium
AAEPLLLIVDVAKPRPS

SEQ ID NO: 625411 - protein, 22 aa, Mycobacterium
AAEPRLATAAGRRTHEDVIDDH

SEQ ID NO: 625412 - protein, 23 aa, Mycobacterium
AAEPRVEFLRRAIDIAADLGATC

SEQ ID NO: 625413 - protein, 23 aa, Mycobacterium
AAEPSGLGMIVAFEEMFWGDAGI

SEQ ID NO: 625414 - protein, 26 aa, Mycobacterium
AAEPTGDAPLVWRAAARLGIGSDAAA

SEQ ID NO: 625415 - protein, 26 aa, Mycobacterium
AAEPVARWGAAVPWAAILEPAGWTPV

SEQ ID NO: 625416 - protein, 18 aa, Mycobacterium
AAEPVNFLPGQYVSVGVT

SEQ ID NO: 625417 - protein, 25 aa, Mycobacterium
AAEPWEVAATIAFLASDYSSYMTGE

SEQ ID NO: 625418 - protein, 28 aa, Mycobacterium
AAEQFCRRYPTTLIRWVIGTPTERVVPF

SEQ ID NO: 625419 - protein, 22 aa, Mycobacterium
AAEQLFLQFGYRKVTIDEVARR

SEQ ID NO: 625420 - protein, 26 aa, Mycobacterium
AAEQMLRGWEVLWLAQRAATRATLAD

SEQ ID NO: 625421 - protein, 22 aa, Mycobacterium
AAEQRPDVVILDLGLPDMSGIE

SEQ ID NO: 625422 - protein, 23 aa, Mycobacterium
AAEQRWPSSWLNNQAASYVSRTP

SEQ ID NO: 625423 - protein, 23 aa, Mycobacterium
AAEQTPLLGVCLGHQAIGVAFGA

SEQ ID NO: 625424 - protein, 18 aa, Mycobacterium
AAEQVLASRNWKPPHNAL

SEQ ID NO: 625425 - protein, 18 aa, Mycobacterium
AAERACWATRPVRAVQRW

SEQ ID NO: 625426 - protein, 19 aa, Mycobacterium
AAERAFWQFHASLMEPWDG

SEQ ID NO: 625427 - protein, 22 aa, Mycobacterium
AAERARVRLLLVDDAQQLDPQA

SEQ ID NO: 625428 - protein, 22 aa, Mycobacterium
AAERDWLDIRWCADNDDTGFYR

SEQ ID NO: 625429 - protein, 18 aa, Mycobacterium
AAERGFPAVVMNVSNPYG

SEQ ID NO: 625430 - protein, 19 aa, Mycobacterium
AAERGRLAGHLARQLFRSW

SEQ ID NO: 625431 - protein, 23 aa, Mycobacterium
AAERLDVVGALFVLRCRESGDRA

SEQ ID NO: 625432 - protein, 19 aa, Mycobacterium
AAERLFAERGFLAVRLEDI

SEQ ID NO: 625433 - protein, 17 aa, Mycobacterium
AAERLRLPRLAAAVNNE

SEQ ID NO: 625434 - protein, 25 aa, Mycobacterium
AAERLTGVMGYRWTKPVDAALSVAT

SEQ ID NO: 625435 - protein, 23 aa, Mycobacterium
AAERNIPVLAYFVDGETAAVDYV

SEQ ID NO: 625436 - protein, 24 aa, Mycobacterium
AAERPGFDPAYAVDFWDLTNRQDW

SEQ ID NO: 625437 - protein, 22 aa, Mycobacterium
AAERPHYMPLFVAPQPLDSDDD

SEQ ID NO: 625438 - protein, 27 aa, Mycobacterium
AAERRMCGIFARLFGCRDVSVDDSFFG

SEQ ID NO: 625439 - protein, 17 aa, Mycobacterium
AAERRRYVDVFAAGQTG

SEQ ID NO: 625440 - protein, 22 aa, Mycobacterium
AAERRRYVEVFAECQGGGGKGD

SEQ ID NO: 625441 - protein, 23 aa, Mycobacterium
AAERTGLVAFSLHYPWSQRLPVH

SEQ ID NO: 625442 - protein, 19 aa, Mycobacterium
AAERTPPVWKMREHRRHVH

SEQ ID NO: 625443 - protein, 24 aa, Mycobacterium
AAESARFCTQFIKLGIGGCDIGVS

SEQ ID NO: 625444 - protein, 19 aa, Mycobacterium
AAESGRFAVHVLQAHQRGL

SEQ ID NO: 625445 - protein, 18 aa, Mycobacterium
AAESLGYPVVVKAMGLLH

SEQ ID NO: 625446 - protein, 24 aa, Mycobacterium
AAESMEFPVFVKAVAGGGGRGMRR

SEQ ID NO: 625447 - protein, 22 aa, Mycobacterium
AAESRAKIVYEYLKQFTDDPGV

SEQ ID NO: 625448 - protein, 22 aa, Mycobacterium
AAESRPLWYLMPDGVVQYVSKR

SEQ ID NO: 625449 - protein, 18 aa, Mycobacterium
AAESTQWERVIKIFNDRF

SEQ ID NO: 625450 - protein, 24 aa, Mycobacterium
AAETARLAAVFAQLITTGNGEQIN

SEQ ID NO: 625451 - protein, 18 aa, Mycobacterium
AAETCLRAKGIRATTVSE

SEQ ID NO: 625452 - protein, 20 aa, Mycobacterium
AAETFSAWSRSGAGHLPIVL

SEQ ID NO: 625453 - protein, 21 aa, Mycobacterium
AAETGCEWHTCDLSHQDQIAR

SEQ ID NO: 625454 - protein, 22 aa, Mycobacterium
AAETGFPILVKAAFGGGGRGMR

SEQ ID NO: 625455 - protein, 24 aa, Mycobacterium
AAETIIKGIGRRDFVRAVAAMGAG

SEQ ID NO: 625456 - protein, 21 aa, Mycobacterium
AAETILAATLDYVRDRTAFGS

SEQ ID NO: 625457 - protein, 19 aa, Mycobacterium
AAETKEPVTMVGAAAAGGA

SEQ ID NO: 625458 - protein, 26 aa, Mycobacterium
AAEVERPDLVIGWWAVPTILEHGSPE

SEQ ID NO: 625459 - protein, 20 aa, Mycobacterium
AAEVFGGWDAAWGGRGDDAA

SEQ ID NO: 625460 - protein, 19 aa, Mycobacterium
AAEVKRKGVLIGDTVMIRK

SEQ ID NO: 625461 - protein, 17 aa, Mycobacterium
AAEVLAGLCGAVDALSE

SEQ ID NO: 625462 - protein, 27 aa, Mycobacterium
AAEVLRARNLLPVPWVEPVDIANAVLF

SEQ ID NO: 625463 - protein, 18 aa, Mycobacterium
AAEVMRYTALEAIMHPGV

SEQ ID NO: 625464 - protein, 25 aa, Mycobacterium
AAEVPEYLLAVLARFARNLRESNSI

SEQ ID NO: 625465 - protein, 18 aa, Mycobacterium
AAEVRRVAKKGVHALTFT

SEQ ID NO: 625466 - protein, 21 aa, Mycobacterium
AAEWPPVRGVIHAAGVVDDAV

SEQ ID NO: 625467 - protein, 24 aa, Mycobacterium
AAEWREFATRAPLYTATNKARELG

SEQ ID NO: 625468 - protein, 17 aa, Mycobacterium
AAEYARYRAHLHAHATR

SEQ ID NO: 625469 - protein, 26 aa, Mycobacterium
AAEYLKATFDWHIDGCTPLNDECPQK

SEQ ID NO: 625470 - protein, 18 aa, Mycobacterium
AAEYSRRRTFAGFVEVDG

SEQ ID NO: 625471 - protein, 25 aa, Mycobacterium
AAEYVYRFAPLVGIYGGTLEVFRNM

SEQ ID NO: 625472 - protein, 20 aa, Mycobacterium
AAEYWGRTPLLSHADALPRD

SEQ ID NO: 625473 - protein, 25 aa, Mycobacterium
AAFAAACPRVDFTLATGTTAELIDM

SEQ ID NO: 625474 - protein, 32 aa, Mycobacterium
AAFAAAGFEYVWPRIAALVVQPGVEFDHVNVI

SEQ ID NO: 625475 - protein, 19 aa, Mycobacterium
AAFAAMKPYLALYMGGMGA

SEQ ID NO: 625476 - protein, 19 aa, Mycobacterium
AAFALGRPEYFSAAVDCAQ

SEQ ID NO: 625477 - protein, 20 aa, Mycobacterium
AAFARPYLSRLWARLHGRDV

SEQ ID NO: 625478 - protein, 17 aa, Mycobacterium
AAFARRIAGPVVVKAVR

SEQ ID NO: 625479 - protein, 25 aa, Mycobacterium
AAFDGRTGLELTRAHHPDLIVCDIM

SEQ ID NO: 625480 - protein, 17 aa, Mycobacterium
AAFDKLVYGKLRAALGG

SEQ ID NO: 625481 - protein, 19 aa, Mycobacterium
AAFDNGPWPATPPKERAAV

SEQ ID NO: 625482 - protein, 20 aa, Mycobacterium
AAFDNPYLVVACVIGDGEAE

SEQ ID NO: 625483 - protein, 18 aa, Mycobacterium
AAFDQEAICVAIIKHANP

SEQ ID NO: 625484 - protein, 19 aa, Mycobacterium
AAFDVFPDFAFYPQDGSNR

SEQ ID NO: 625485 - protein, 18 aa, Mycobacterium
AAFDVTVTAPAHWQVISN

SEQ ID NO: 625486 - protein, 25 aa, Mycobacterium
AAFEAGWIQPTWPRRHGGRSLGLAE

SEQ ID NO: 625487 - protein, 21 aa, Mycobacterium
AAFEHRAVLIGADRAGLSAGL

SEQ ID NO: 625488 - protein, 19 aa, Mycobacterium
AAFELAGFATFGAAASATD

SEQ ID NO: 625489 - protein, 25 aa, Mycobacterium
AAFERRWELGGVLFGKTFPDQTTDM

SEQ ID NO: 625490 - protein, 17 aa, Mycobacterium
AAFGALAVRRRIERGGP

SEQ ID NO: 625491 - protein, 19 aa, Mycobacterium
AAFGGYKRSGIGRENHKMM

SEQ ID NO: 625492 - protein, 21 aa, Mycobacterium
AAFGKERYSALGIARDDWEAR

SEQ ID NO: 625493 - protein, 19 aa, Mycobacterium
AAFGLARWLSAEGDRAAAV

SEQ ID NO: 625494 - protein, 19 aa, Mycobacterium
AAFGMRPEGAMIYLADHLD

SEQ ID NO: 625495 - protein, 18 aa, Mycobacterium
AAFGPGFGGFGPGGFGPG

SEQ ID NO: 625496 - protein, 17 aa, Mycobacterium
AAFGRLALDQVAHREIA

SEQ ID NO: 625497 - protein, 25 aa, Mycobacterium
AAFGTSPSRFRTMRQLQLARSLIVG

SEQ ID NO: 625498 - protein, 25 aa, Mycobacterium
AAFHFRLTITAGEHRMVIEPIDVMA

SEQ ID NO: 625499 - protein, 20 aa, Mycobacterium
AAFHTEFTRALAAAASAYAQ

SEQ ID NO: 625500 - protein, 24 aa, Mycobacterium
AAFIPRVTAILADLRQLEAVAARA

SEQ ID NO: 625501 - protein, 34 aa, Mycobacterium
AAFLEAHPAVSWVRYPFLPSHPQYNLAKRQMSGG

SEQ ID NO: 625502 - protein, 29 aa, Mycobacterium
AAFLGLLGEELWAMAALVRAELLVRDPDR

SEQ ID NO: 625503 - protein, 19 aa, Mycobacterium
AAFLGRRTGPEFIDGFFDS

SEQ ID NO: 625504 - protein, 27 aa, Mycobacterium
AAFMRECSRFPLSHVAIAGIDWGVLRT

SEQ ID NO: 625505 - protein, 18 aa, Mycobacterium
AAFPAWRDTSLAKRTQVL

SEQ ID NO: 625506 - protein, 33 aa, Mycobacterium
AAFPGEPWAVPKFYWSVFSTRAFEAGLAALTPE

SEQ ID NO: 625507 - protein, 27 aa, Mycobacterium
AAFPKRMGRPIEYAKLAAAIVDNPMLN

SEQ ID NO: 625508 - protein, 24 aa, Mycobacterium
AAFPLGWVHDVVWARDGVTVGGIA

SEQ ID NO: 625509 - protein, 19 aa, Mycobacterium
AAFPPELASANWALIELVE

SEQ ID NO: 625510 - protein, 23 aa, Mycobacterium
AAFPRLNDAIAYCDKYPLDDLPE

SEQ ID NO: 625511 - protein, 30 aa, Mycobacterium
AAFPRYHPRWAWRMTSIPGFREFAVSNLVL

SEQ ID NO: 625512 - protein, 18 aa, Mycobacterium
AAFQFRLTVTAGDDAMRV

SEQ ID NO: 625513 - protein, 24 aa, Mycobacterium
AAFQFRLTVTAGEHRMVIEPIDVM

SEQ ID NO: 625514 - protein, 31 aa, Mycobacterium
AAFQGLKMLFSREMLEGVTADNVFPRALAGA

SEQ ID NO: 625515 - protein, 23 aa, Mycobacterium
AAFQINGAMVFLNDDFPEFCDGR

SEQ ID NO: 625516 - protein, 21 aa, Mycobacterium
AAFQRAISMAAVFSGDAAISA

SEQ ID NO: 625517 - protein, 18 aa, Mycobacterium
AAFRAEYGARGWAMNALF

SEQ ID NO: 625518 - protein, 18 aa, Mycobacterium
AAFRAEYGARGWAMNTLF

SEQ ID NO: 625519 - protein, 19 aa, Mycobacterium
AAFRAEYGARGWAMNTVFD

SEQ ID NO: 625520 - protein, 18 aa, Mycobacterium
AAFRAEYGSRGWAMNTLF

SEQ ID NO: 625521 - protein, 19 aa, Mycobacterium
AAFRPLGRVPDRGRLAREL

SEQ ID NO: 625522 - protein, 18 aa, Mycobacterium
AAFRRAWGTDPIDMGMGG

SEQ ID NO: 625523 - protein, 17 aa, Mycobacterium
AAFSRHVDFLSIGTNDL

SEQ ID NO: 625524 - protein, 17 aa, Mycobacterium
AAFSSVLDVDWRFASPV

SEQ ID NO: 625525 - protein, 17 aa, Mycobacterium
AAFTMLLRQLRGTPTSE

SEQ ID NO: 625526 - protein, 25 aa, Mycobacterium
AAFTPRPVPSVGLDHLHQVSVSVPQ

SEQ ID NO: 625527 - protein, 18 aa, Mycobacterium
AAFVAATRGGWRAGGVRD

SEQ ID NO: 625528 - protein, 19 aa, Mycobacterium
AAFVGRLSVPESWTAATQV

SEQ ID NO: 625529 - protein, 21 aa, Mycobacterium
AAFVLGMKVARTLLASGEGHT

SEQ ID NO: 625530 - protein, 17 aa, Mycobacterium
AAFVRRRRAEVFGAAPA

SEQ ID NO: 625531 - protein, 27 aa, Mycobacterium
AAGAAAWPVSLKAGHPVALESMDTMAD

SEQ ID NO: 625532 - protein, 23 aa, Mycobacterium
AAGAAGIPIRIGVNAGSLDKRFM

SEQ ID NO: 625533 - protein, 17 aa, Mycobacterium
AAGAARHGSVRIATETA

SEQ ID NO: 625534 - protein, 22 aa, Mycobacterium
AAGACRQGRAGVGAVRDAPGEK

SEQ ID NO: 625535 - protein, 19 aa, Mycobacterium
AAGAERIGNVWLVAQRMSS

SEQ ID NO: 625536 - protein, 21 aa, Mycobacterium
AAGAERIWFQRFWAGLEESEC

SEQ ID NO: 625537 - protein, 21 aa, Mycobacterium
AAGAIPVLALYGIPHRDCGSF

SEQ ID NO: 625538 - protein, 24 aa, Mycobacterium
AAGAKFATAFTRRGLIAEYGISWI

SEQ ID NO: 625539 - protein, 28 aa, Mycobacterium
AAGAKVLMLRCVEYARRFNLPIHVRSSY

SEQ ID NO: 625540 - protein, 25 aa, Mycobacterium
AAGAKVLMLRCVEYARRYNVPVHVR

SEQ ID NO: 625541 - protein, 17 aa, Mycobacterium
AAGALAAGCEYDIDAAA

SEQ ID NO: 625542 - protein, 18 aa, Mycobacterium
AAGALATLVPGAGDCAPS

SEQ ID NO: 625543 - protein, 26 aa, Mycobacterium
AAGALICTRAATDTARTAGPARKSGS

SEQ ID NO: 625544 - protein, 30 aa, Mycobacterium
AAGAMLIAVLGFRWQLVIFASPLLGVLCSA

SEQ ID NO: 625545 - protein, 18 aa, Mycobacterium
AAGAMLLGNGGDGGDGGN

SEQ ID NO: 625546 - protein, 24 aa, Mycobacterium
AAGAMPILTLYGIPHRDCGSYASG

SEQ ID NO: 625547 - protein, 17 aa, Mycobacterium
AAGAPRWSGRSARNYAH

SEQ ID NO: 625548 - protein, 18 aa, Mycobacterium
AAGAPWFAVSPLMHAAGM

SEQ ID NO: 625549 - protein, 25 aa, Mycobacterium
AAGARAVVPPAILECGATYHTSDTI

SEQ ID NO: 625550 - protein, 17 aa, Mycobacterium
AAGARFGRLDILVNNAW

SEQ ID NO: 625551 - protein, 18 aa, Mycobacterium
AAGARFVSLIGGAMTSFY

SEQ ID NO: 625552 - protein, 28 aa, Mycobacterium
AAGARLAFVCAVDMPLLTVELIDDLVRR

SEQ ID NO: 625553 - protein, 25 aa, Mycobacterium
AAGARPGSWMALSIRLPAGVSRQSL

SEQ ID NO: 625554 - protein, 20 aa, Mycobacterium
AAGASRWERPAAVSSRPATD

SEQ ID NO: 625555 - protein, 21 aa, Mycobacterium
AAGATAFLGSAGVAGSAGNGG

SEQ ID NO: 625556 - protein, 19 aa, Mycobacterium
AAGATMWSVAPSWEPHALH

SEQ ID NO: 625557 - protein, 18 aa, Mycobacterium
AAGATSWEAMLQPYVPGR

SEQ ID NO: 625558 - protein, 18 aa, Mycobacterium
AAGCERATIFAPGFTSLA

SEQ ID NO: 625559 - protein, 22 aa, Mycobacterium
AAGDAIFGFGRVWRQIREAGAN

SEQ ID NO: 625560 - protein, 19 aa, Mycobacterium
AAGDARVLVATDIAARGVH

SEQ ID NO: 625561 - protein, 19 aa, Mycobacterium
AAGDCLARAVLAGVIAAAP

SEQ ID NO: 625562 - protein, 26 aa, Mycobacterium
AAGDEVSAAIAAVFSAHGQSYQTLSA

SEQ ID NO: 625563 - protein, 32 aa, Mycobacterium
AAGDEVSTAIATLFSEHAQSYQALSAQMAAFH

SEQ ID NO: 625564 - protein, 18 aa, Mycobacterium
AAGDEVYGMFGVQRYAHS

SEQ ID NO: 625565 - protein, 26 aa, Mycobacterium
AAGDGFARFWLHNGWVTMGGEKMSKS

SEQ ID NO: 625566 - protein, 18 aa, Mycobacterium
AAGDGMRSAYQGVQAGTS

SEQ ID NO: 625567 - protein, 27 aa, Mycobacterium
AAGDHAAICWPLLVGMAKAKYYLLTCE

SEQ ID NO: 625568 - protein, 22 aa, Mycobacterium
AAGDLPLRFSAYDGSTAGPENA

SEQ ID NO: 625569 - protein, 31 aa, Mycobacterium
AAGDLWAAPSGWRVGGGSAPVRTAMQTPLRT

SEQ ID NO: 625570 - protein, 23 aa, Mycobacterium
AAGDPWASFVTYGLLGGAPVLCV

SEQ ID NO: 625571 - protein, 17 aa, Mycobacterium
AAGEALDDLGLEQETVH

SEQ ID NO: 625572 - protein, 17 aa, Mycobacterium
AAGEGYSGTALVGASPE

SEQ ID NO: 625573 - protein, 17 aa, Mycobacterium
AAGEHLPSPLAGVPLAL

SEQ ID NO: 625574 - protein, 17 aa, Mycobacterium
AAGELARTLSRSTAVNL

SEQ ID NO: 625575 - protein, 26 aa, Mycobacterium
AAGELGFTYDTGWYLQFRATEPDDFQ

SEQ ID NO: 625576 - protein, 17 aa, Mycobacterium
AAGELIATVALPPQVPR

SEQ ID NO: 625577 - protein, 18 aa, Mycobacterium
AAGELVLFDRSWYNRAGV

SEQ ID NO: 625578 - protein, 23 aa, Mycobacterium
AAGEMFAPFLARLMEDPRARSDY

SEQ ID NO: 625579 - protein, 25 aa, Mycobacterium
AAGEPRLAAAAPFYGPLPDNPDFSR

SEQ ID NO: 625580 - protein, 22 aa, Mycobacterium
AAGERFAGLALEGDVRLDGATS

SEQ ID NO: 625581 - protein, 17 aa, Mycobacterium
AAGERKGAFFPPAVLTG

SEQ ID NO: 625582 - protein, 27 aa, Mycobacterium
AAGESHAAYGWQVRAAAWATNRDIAAA

SEQ ID NO: 625583 - protein, 17 aa, Mycobacterium
AAGESLEDLGLRQETVR

SEQ ID NO: 625584 - protein, 19 aa, Mycobacterium
AAGETRPGFDQQPIEVATL

SEQ ID NO: 625585 - protein, 17 aa, Mycobacterium
AAGFDRPILHGLCTYGI

SEQ ID NO: 625586 - protein, 17 aa, Mycobacterium
AAGFEFLPGEPGQLTGE

SEQ ID NO: 625587 - protein, 17 aa, Mycobacterium
AAGFGPEVKRRIMIGTY

SEQ ID NO: 625588 - protein, 20 aa, Mycobacterium
AAGFKPGVDVALALDAAANE

SEQ ID NO: 625589 - protein, 21 aa, Mycobacterium
AAGFRDEMGIDLHAEVFSGTA

SEQ ID NO: 625590 - protein, 25 aa, Mycobacterium
AAGFSRGALYSNFRSKEDLALAVLD

SEQ ID NO: 625591 - protein, 28 aa, Mycobacterium
AAGGAGGNGGFLFGHGGDGGTGGTGASG

SEQ ID NO: 625592 - protein, 27 aa, Mycobacterium
AAGGAGGNGGWLFGQGGAGGIGGSGAA

SEQ ID NO: 625593 - protein, 27 aa, Mycobacterium
AAGGAKFAAVFARRGLIAEFGISWILP

SEQ ID NO: 625594 - protein, 23 aa, Mycobacterium
AAGGCPLLLMLVSSAISGELISR

SEQ ID NO: 625595 - protein, 21 aa, Mycobacterium
AAGGDGGWLYGNGGNGGSGAA

SEQ ID NO: 625596 - protein, 26 aa, Mycobacterium
AAGGLHPRIALMLDIESGGNPPGDQS

SEQ ID NO: 625597 - protein, 19 aa, Mycobacterium
AAGGLLWGNGGAGGAGTAT

SEQ ID NO: 625598 - protein, 19 aa, Mycobacterium
AAGGLPFEIRTTAPSDFVT

SEQ ID NO: 625599 - protein, 26 aa, Mycobacterium
AAGGNGGAGGWLFGDGGIGGTGGAGA

SEQ ID NO: 625600 - protein, 26 aa, Mycobacterium
AAGGNGGAGGWLFGDGGTGGTGGDAV

SEQ ID NO: 625601 - protein, 26 aa, Mycobacterium
AAGGNGGAGGWLFGNGGNGGTGGDAV

SEQ ID NO: 625602 - protein, 26 aa, Mycobacterium
AAGGNGGAGGWLFGNGGTGGTGGDAV

SEQ ID NO: 625603 - protein, 18 aa, Mycobacterium
AAGGRLTALASTFSGAPA

SEQ ID NO: 625604 - protein, 24 aa, Mycobacterium
AAGGRRPLITEALRGEGAVLIDAQ

SEQ ID NO: 625605 - protein, 18 aa, Mycobacterium
AAGGTPIPLGRKGEASDI

SEQ ID NO: 625606 - protein, 17 aa, Mycobacterium
AAGGVAIGSGYRHIRSG

SEQ ID NO: 625607 - protein, 28 aa, Mycobacterium
AAGGVGQILCQWARYLGATVIGTVGSAA

SEQ ID NO: 625608 - protein, 24 aa, Mycobacterium
AAGGVLLRPFARLIASTGDSVTTY

SEQ ID NO: 625609 - protein, 19 aa, Mycobacterium
AAGGWAELTGIYTAPADGS

SEQ ID NO: 625610 - protein, 26 aa, Mycobacterium
AAGHDFTYRFSVPNSGTYWAHPHTGL

SEQ ID NO: 625611 - protein, 24 aa, Mycobacterium
AAGHPFAATGGRILAQAAKQLAQK

SEQ ID NO: 625612 - protein, 24 aa, Mycobacterium
AAGHPFAATGGRILAQAAKQLAQR

SEQ ID NO: 625613 - protein, 24 aa, Mycobacterium
AAGHPFAATGGRILAQAAKQLSEK

SEQ ID NO: 625614 - protein, 24 aa, Mycobacterium
AAGHPFAATGGRILAQTAKQLAEK

SEQ ID NO: 625615 - protein, 28 aa, Mycobacterium
AAGHSFVIFLREGFPVNILNPVKAVPEV

SEQ ID NO: 625616 - protein, 23 aa, Mycobacterium
AAGIAGLGIRPGDRVLVQLPNTA

SEQ ID NO: 625617 - protein, 17 aa, Mycobacterium
AAGIALLASMAARPGER

SEQ ID NO: 625618 - protein, 22 aa, Mycobacterium
AAGIARRTLFRYYPSKSALPWG

SEQ ID NO: 625619 - protein, 20 aa, Mycobacterium
AAGIASRITVAAGRPVGDVP

SEQ ID NO: 625620 - protein, 20 aa, Mycobacterium
AAGIDCIEHGFLVDDEAIAM

SEQ ID NO: 625621 - protein, 24 aa, Mycobacterium
AAGIESLGYGAAWIGGSPDAELSW

SEQ ID NO: 625622 - protein, 19 aa, Mycobacterium
AAGIGELKFFSKIHYGGGA

SEQ ID NO: 625623 - protein, 37 aa, Mycobacterium
AAGIGPGQAVAICLPRSWQLVCVMLGIRRAGATVVPL

SEQ ID NO: 625624 - protein, 19 aa, Mycobacterium
AAGIPKPGRQAWYFDPASS

SEQ ID NO: 625625 - protein, 19 aa, Mycobacterium
AAGIPKPGRQVWYFDADGN

SEQ ID NO: 625626 - protein, 30 aa, Mycobacterium
AAGIPLPLQWGKYRPGTLVAAEFGLREPPP

SEQ ID NO: 625627 - protein, 20 aa, Mycobacterium
AAGIPWAQGFYLSRPKSHTH

SEQ ID NO: 625628 - protein, 18 aa, Mycobacterium
AAGIPWDVAALSINKMCL

SEQ ID NO: 625629 - protein, 26 aa, Mycobacterium
AAGIRSIPTIMAFRDGVLVYSQAGAL

SEQ ID NO: 625630 - protein, 18 aa, Mycobacterium
AAGISRRTLFRYYASKNA

SEQ ID NO: 625631 - protein, 17 aa, Mycobacterium
AAGISWLTGYPDRNPFE

SEQ ID NO: 625632 - protein, 23 aa, Mycobacterium
AAGITRWALETAVDYAKVREQFG

SEQ ID NO: 625633 - protein, 22 aa, Mycobacterium
AAGIYRLRFDTGEYFAASGTAG

SEQ ID NO: 625634 - protein, 18 aa, Mycobacterium
AAGKEIFTRLVAESDAVF

SEQ ID NO: 625635 - protein, 28 aa, Mycobacterium
AAGKPLLGICGGFQMLGRVIRDPDGVEG

SEQ ID NO: 625636 - protein, 28 aa, Mycobacterium
AAGKRIVAVCPYVAKYVSRHHDFDDVLD

SEQ ID NO: 625637 - protein, 20 aa, Mycobacterium
AAGLAAWGYASGISLGDGSF

SEQ ID NO: 625638 - protein, 20 aa, Mycobacterium
AAGLARWTLNTATEYAKVRE

SEQ ID NO: 625639 - protein, 20 aa, Mycobacterium
AAGLASARIVGWIMRTDSAD

SEQ ID NO: 625640 - protein, 27 aa, Mycobacterium
AAGLCRHVLCFRTVWESTHTALARRAK

SEQ ID NO: 625641 - protein, 30 aa, Mycobacterium; identical to SEQ ID NO: 93033

SEQ ID NO: 625642 - protein, 17 aa, Mycobacterium
AAGLIRLLQPQKYGGYE

SEQ ID NO: 625643 - protein, 29 aa, Mycobacterium
AAGLKAREFPVKFDVWWFRLPHKEDTEYS

SEQ ID NO: 625644 - protein, 18 aa, Mycobacterium
AAGLKLDFFINTSSIAAV

SEQ ID NO: 625645 - protein, 18 aa, Mycobacterium
AAGLLFGVGGAGGVGGSA

SEQ ID NO: 625646 - protein, 32 aa, Mycobacterium
AAGLPAAPARVWSHCHSLAFDFSVWEIFGALL

SEQ ID NO: 625647 - protein, 23 aa, Mycobacterium
AAGLPGCRAFTPAQWRKHPQGAL

SEQ ID NO: 625648 - protein, 25 aa, Mycobacterium
AAGLPGIGGGAAFSAGLGRGVSIGA

SEQ ID NO: 625649 - protein, 18 aa, Mycobacterium
AAGLPLAVFPAGTFNHFA

SEQ ID NO: 625650 - protein, 20 aa, Mycobacterium
AAGLRPGGIGLGMPAVGAPP

SEQ ID NO: 625651 - protein, 26 aa, Mycobacterium
AAGLRPLRPWRAALVAALAASAGARP

SEQ ID NO: 625652 - protein, 17 aa, Mycobacterium
AAGLRRRYIPIVGPPGS

SEQ ID NO: 625653 - protein, 24 aa, Mycobacterium
AAGLRTVFRYHRERSGVAAGHPHA

SEQ ID NO: 625654 - protein, 19 aa, Mycobacterium
AAGLSLRWRDNVNAPLAFQ

SEQ ID NO: 625655 - protein, 23 aa, Mycobacterium
AAGLSSPRIVAWIMRTDSADLPW

SEQ ID NO: 625656 - protein, 24 aa, Mycobacterium
AAGLSSPRIVGWIMRTDSVDLPWH

SEQ ID NO: 625657 - protein, 23 aa, Mycobacterium
AAGLTPRAGLLCVPTLSTHGYEV

SEQ ID NO: 625658 - protein, 21 aa, Mycobacterium
AAGLTRSFMAFLIDAYSEDEA

SEQ ID NO: 625659 - protein, 20 aa, Mycobacterium
AAGLTRSFMAFLIDAYTEDE

SEQ ID NO: 625660 - protein, 23 aa, Mycobacterium
AAGLTRSFMAFLIDAYVEDEAPN

SEQ ID NO: 625661 - protein, 19 aa, Mycobacterium
AAGLWREVAGLPADRIQRR

SEQ ID NO: 625662 - protein, 19 aa, Mycobacterium
AAGMGGLLLVYPNVIAVER

SEQ ID NO: 625663 - protein, 20 aa, Mycobacterium
AAGMLRSHFGASLPVRVSTI

SEQ ID NO: 625664 - protein, 18 aa, Mycobacterium
AAGMMLAAILGGSVGAPI

SEQ ID NO: 625665 - protein, 20 aa, Mycobacterium
AAGMPGMPFSPMGNHGLGRA

SEQ ID NO: 625666 - protein, 20 aa, Mycobacterium
AAGMPRFERRALGAMFNVTV

SEQ ID NO: 625667 - protein, 19 aa, Mycobacterium
AAGNAGGWHICLDTLSLAV

SEQ ID NO: 625668 - protein, 22 aa, Mycobacterium
AAGNCAIDYGFHQIIGDVNTES

SEQ ID NO: 625669 - protein, 18 aa, Mycobacterium
AAGNGPGVHGLWPQALAL

SEQ ID NO: 625670 - protein, 24 aa, Mycobacterium
AAGNVPAGFMAPSLNGIGGDGGDA

SEQ ID NO: 625671 - protein, 25 aa, Mycobacterium
AAGNWACIVPHTWLWTSPLGPEVRA

SEQ ID NO: 625672 - protein, 26 aa, Mycobacterium
AAGNYAQRLFPGMRVKYVSTEEFTND

SEQ ID NO: 625673 - protein, 23 aa, Mycobacterium
AAGPALSTLQGFGISLNAFTTAV

SEQ ID NO: 625674 - protein, 28 aa, Mycobacterium
AAGPEVARAALLFGMRFDAEAAVRHGLA

SEQ ID NO: 625675 - protein, 17 aa, Mycobacterium
AAGPGQLLTGMRCAHVL

SEQ ID NO: 625676 - protein, 18 aa, Mycobacterium
AAGPLAYRLYRPASPGPH

SEQ ID NO: 625677 - protein, 21 aa, Mycobacterium
AAGPLPIPFFFGVLAGEEPID

SEQ ID NO: 625678 - protein, 18 aa, Mycobacterium
AAGPPCRPTLEDRPMLDA

SEQ ID NO: 625679 - protein, 27 aa, Mycobacterium
AAGPYDRWPLGRGFERYYGFLGGDTHQ

SEQ ID NO: 625680 - protein, 20 aa, Mycobacterium
AAGQAGAFVSEFEAVQSAMV

SEQ ID NO: 625681 - protein, 23 aa, Mycobacterium
AAGQAPFNLGLGNIGFGNVGSAN

SEQ ID NO: 625682 - protein, 29 aa, Mycobacterium
AAGQARLAVEIYEAAFAMTVPPPAVAANR

SEQ ID NO: 625683 - protein, 26 aa, Mycobacterium
AAGQCLRTFLREHGHFEVKMGCDAGD

SEQ ID NO: 625684 - protein, 18 aa, Mycobacterium
AAGQIAELLAKWKSTPER

SEQ ID NO: 625685 - protein, 19 aa, Mycobacterium
AAGQRVFLVDSSKFGRHSQ

SEQ ID NO: 625686 - protein, 17 aa, Mycobacterium
AAGRAAVLAAFASVAIN

SEQ ID NO: 625687 - protein, 20 aa, Mycobacterium
AAGRAAVLAPRLSVPDEFGL

SEQ ID NO: 625688 - protein, 19 aa, Mycobacterium
AAGRAPRLQELRLHNGTVY

SEQ ID NO: 625689 - protein, 17 aa, Mycobacterium
AAGRAWARFEQGQVVFK

SEQ ID NO: 625690 - protein, 25 aa, Mycobacterium
AAGRAWPSRRSWEAMARVLAHLRRD

SEQ ID NO: 625691 - protein, 23 aa, Mycobacterium
AAGRGLDVLFANAGGGEFVLLGD

SEQ ID NO: 625692 - protein, 18 aa, Mycobacterium
AAGRKAGSDAGRVPLYCE

SEQ ID NO: 625693 - protein, 27 aa, Mycobacterium
AAGRLALGVGPSHHWIVRDMLGLPYEK

SEQ ID NO: 625694 - protein, 18 aa, Mycobacterium
AAGRLYISGSTEDVVVAR

SEQ ID NO: 625695 - protein, 24 aa, Mycobacterium
AAGRPGPVAVMYLDLDRLKPINDY

SEQ ID NO: 625696 - protein, 22 aa, Mycobacterium
AAGRPMPWGNVAIGVRNAIAPP

SEQ ID NO: 625697 - protein, 25 aa, Mycobacterium
AAGRPRPPSAPAWFVDAAPGLRQFL

SEQ ID NO: 625698 - protein, 23 aa, Mycobacterium
AAGRRAAVVKPDVVVMDMQLPDG

SEQ ID NO: 625699 - protein, 17 aa, Mycobacterium
AAGRRWAERITDTGTHQ

SEQ ID NO: 625700 - protein, 17 aa, Mycobacterium
AAGRWGSLDAQWDDIKA

SEQ ID NO: 625701 - protein, 33 aa, Mycobacterium
AAGSDNQTVLAFRELSVPWGIAVDTVGNVYVTE

SEQ ID NO: 625702 - protein, 19 aa, Mycobacterium
AAGSGGWLAGSGGNGGAGG

SEQ ID NO: 625703 - protein, 26 aa, Mycobacterium
AAGSGLAPWFCWSESAVGTNGIGTAL

SEQ ID NO: 625704 - protein, 17 aa, Mycobacterium
AAGSIPAGFMAPSENGI

SEQ ID NO: 625705 - protein, 18 aa, Mycobacterium
AAGSLWAAPSGWRVGGVT

SEQ ID NO: 625706 - protein, 21 aa, Mycobacterium
AAGSMPGDLHKLWRTRDRKGY

SEQ ID NO: 625707 - protein, 19 aa, Mycobacterium
AAGSMPGDLHKMWRTRDRK

SEQ ID NO: 625708 - protein, 19 aa, Mycobacterium
AAGSRALGVAAWDAAAGQL

SEQ ID NO: 625709 - protein, 25 aa, Mycobacterium
AAGSRAPKVLPFSALDAPNGVAVDS

SEQ ID NO: 625710 - protein, 19 aa, Mycobacterium
AAGSRLACEAIPNRPQQDA

SEQ ID NO: 625711 - protein, 18 aa, Mycobacterium
AAGSSWGNAGWLTPSIAT

SEQ ID NO: 625712 - protein, 25 aa, Mycobacterium
AAGTARCDDGLVLPLAGGVASYAGP

SEQ ID NO: 625713 - protein, 25 aa, Mycobacterium
AAGTFAFAGAEAFRAEENTAKQNVN

SEQ ID NO: 625714 - protein, 17 aa, Mycobacterium
AAGTFTPAVDAWLCGWD

SEQ ID NO: 625715 - protein, 18 aa, Mycobacterium
AAGTGGSGGFGFSIAGGA

SEQ ID NO: 625716 - protein, 20 aa, Mycobacterium
AAGTGKWDQWTLLARARAAD

SEQ ID NO: 625717 - protein, 17 aa, Mycobacterium
AAGTLIRLFHAETVFVD

SEQ ID NO: 625718 - protein, 17 aa, Mycobacterium
AAGTLIRLFHAETVMCE

SEQ ID NO: 625719 - protein, 26 aa, Mycobacterium
AAGTPLRPAILWMDARGAAESEQTAR

SEQ ID NO: 625720 - protein, 22 aa, Mycobacterium
AAGTPPIFFGFGSMPVESPSDT

SEQ ID NO: 625721 - protein, 21 aa, Mycobacterium
AAGTSRWLVAVRMVSEGVDVP

SEQ ID NO: 625722 - protein, 19 aa, Mycobacterium
AAGTVRPYIGAQFPLSETA

SEQ ID NO: 625723 - protein, 18 aa, Mycobacterium
AAGTVRRGAEAAVDYIRT

SEQ ID NO: 625724 - protein, 17 aa, Mycobacterium
AAGTWLREYLRGLIARR

SEQ ID NO: 625725 - protein, 19 aa, Mycobacterium
AAGVAFVIAVPGADDVMLG

SEQ ID NO: 625726 - protein, 27 aa, Mycobacterium
AAGVARPDLVIGWWAAPTILEHGTPEQ

SEQ ID NO: 625727 - protein, 23 aa, Mycobacterium
AAGVCFPDLLLSKGEYQLKLPPP

SEQ ID NO: 625728 - protein, 23 aa, Mycobacterium
AAGVCFPDLLLTKGEYQLKLPPP

SEQ ID NO: 625729 - protein, 18 aa, Mycobacterium
AAGVCGSDLPAFRGARGR

SEQ ID NO: 625730 - protein, 30 aa, Mycobacterium
AAGVERPDLVIGWWAAPTILEHGTPEQIEQ

SEQ ID NO: 625731 - protein, 24 aa, Mycobacterium
AAGVHRGYKCSIRTPWWTTPSLWT

SEQ ID NO: 625732 - protein, 25 aa, Mycobacterium
AAGVKGGEVLRHWATARSALEAWQV

SEQ ID NO: 625733 - protein, 25 aa, Mycobacterium
AAGVLSLNSLRVFSASVASHAGSAI

SEQ ID NO: 625734 - protein, 27 aa, Mycobacterium
AAGVNRPDLVIGWWAAPTILEHGTPEQ

SEQ ID NO: 625735 - protein, 20 aa, Mycobacterium
AAGVPIDWDAPVSRTGVEAF

SEQ ID NO: 625736 - protein, 24 aa, Mycobacterium
AAGVQRYLMISAMGADANTPNDAA

SEQ ID NO: 625737 - protein, 20 aa, Mycobacterium
AAGVRAKPGAAFAGIVAPAV

SEQ ID NO: 625738 - protein, 23 aa, Mycobacterium
AAGVRFGLLSAWRGPAGQDLISN

SEQ ID NO: 625739 - protein, 24 aa, Mycobacterium
AAGVRRIVYLGGFVPDEDSLSEHL

SEQ ID NO: 625740 - protein, 23 aa, Mycobacterium
AAGVRRLVLASSMVVYGQGNYHC

SEQ ID NO: 625741 - protein, 26 aa, Mycobacterium
AAGVRSIPTVMAFRDGVLVYNQPGAM

SEQ ID NO: 625742 - protein, 27 aa, Mycobacterium
AAGVVRPDLVIGWWAAPTILEHGTPEQ

SEQ ID NO: 625743 - protein, 19 aa, Mycobacterium
AAGWLGSRAGLLAEPLEAL

SEQ ID NO: 625744 - protein, 21 aa, Mycobacterium
AAGWRIARRALTINALETRPV

SEQ ID NO: 625745 - protein, 17 aa, Mycobacterium
AAGWRPVTDAVHAAGVP

SEQ ID NO: 625746 - protein, 20 aa, Mycobacterium
AAGWSTLGPIAMNCAAPDEG

SEQ ID NO: 625747 - protein, 23 aa, Mycobacterium
AAGYALGGRRVHVITINDYLARR

SEQ ID NO: 625748 - protein, 18 aa, Mycobacterium
AAGYFDRAVVTRVYGCTE

SEQ ID NO: 625749 - protein, 25 aa, Mycobacterium
AAGYRLPDLAWFQALACFKSAATWS

SEQ ID NO: 625750 - protein, 18 aa, Mycobacterium
AAGYRLWQEQIDEFPDLR

SEQ ID NO: 625751 - protein, 24 aa, Mycobacterium
AAGYRRLRDWLTRLYRIEIDGFIG

SEQ ID NO: 625752 - protein, 24 aa, Mycobacterium
AAGYRRLREWLTRLYRIEFDGFIA

SEQ ID NO: 625753 - protein, 25 aa, Mycobacterium
AAGYRRLRTWLTRLYRTEFDGFIGA

SEQ ID NO: 625754 - protein, 18 aa, Mycobacterium
AAGYTRGAFYSQFDSLEE

SEQ ID NO: 625755 - protein, 22 aa, Mycobacterium
AAHAAQPLSVFFFDILHHDGTD

SEQ ID NO: 625756 - protein, 17 aa, Mycobacterium
AAHAAVWGAMFNAGQTC

SEQ ID NO: 625757 - protein, 17 aa, Mycobacterium
AAHAAVWGSMFNAGQTC

SEQ ID NO: 625758 - protein, 23 aa, Mycobacterium
AAHAGGWLIHLGWARQHGWSPTI

SEQ ID NO: 625759 - protein, 25 aa, Mycobacterium
AAHAGITRKALRVYEAKGLVDEPPR

SEQ ID NO: 625760 - protein, 21 aa, Mycobacterium
AAHARPDVLVPMAALPTTPIG

SEQ ID NO: 625761 - protein, 20 aa, Mycobacterium
AAHARPDVLVPMTTLPTTPI

SEQ ID NO: 625762 - protein, 23 aa, Mycobacterium
AAHATELPYVWGTLGAPKDPTLK

SEQ ID NO: 625763 - protein, 21 aa, Mycobacterium
AAHCRTCGADFTLGDLILLCP

SEQ ID NO: 625764 - protein, 19 aa, Mycobacterium
AAHESRIGVFAMIETAAAL

SEQ ID NO: 625765 - protein, 18 aa, Mycobacterium
AAHFPGVNNTTVWSDPAS

SEQ ID NO: 625766 - protein, 28 aa, Mycobacterium
AAHFTLELLEAAGLPPGVINLLNGDGIA

SEQ ID NO: 625767 - protein, 17 aa, Mycobacterium
AAHGIPRVHKWARGVDV

SEQ ID NO: 625768 - protein, 25 aa, Mycobacterium
AAHHFGCGFAPSGWDSLTKHLQRKG

SEQ ID NO: 625769 - protein, 23 aa, Mycobacterium
AAHHPRLLLANAVHEGLLQGGSK

SEQ ID NO: 625770 - protein, 18 aa, Mycobacterium
AAHHRLFGHVPWLAGQLL

SEQ ID NO: 625771 - protein, 30 aa, Mycobacterium
AAHHRLFSGVGWLTIRLMDTVEQYAKGISI

SEQ ID NO: 625772 - protein, 22 aa, Mycobacterium
AAHIPLRLTVCDVHRGHSKPAP

SEQ ID NO: 625773 - protein, 20 aa, Mycobacterium
AAHIRIDRLVAMPSLPTTPV

SEQ ID NO: 625774 - protein, 25 aa, Mycobacterium
AAHLAGRYPDLGWLIDAPTTHNAPY

SEQ ID NO: 625775 - protein, 17 aa, Mycobacterium
AAHLARRGADFGIGTSE

SEQ ID NO: 625776 - protein, 17 aa, Mycobacterium
AAHLARRGADYGVGTGE

SEQ ID NO: 625777 - protein, 18 aa, Mycobacterium
AAHLARRGADYGVTTGPV

SEQ ID NO: 625778 - protein, 18 aa, Mycobacterium
AAHLFRLALENAPTGSRL

SEQ ID NO: 625779 - protein, 27 aa, Mycobacterium
AAHLIHPGDLVILIAYGMLDDAAARTY

SEQ ID NO: 625780 - protein, 23 aa, Mycobacterium
AAHLPFRSGRSFSASVTDTELAV

SEQ ID NO: 625781 - protein, 18 aa, Mycobacterium
AAHLRRMEEQLAQTRDAV

SEQ ID NO: 625782 - protein, 23 aa, Mycobacterium
AAHLVHPGDLVIIIAYGVMTDEE

SEQ ID NO: 625783 - protein, 23 aa, Mycobacterium
AAHMAREAARWGVVVDGSVSMDM

SEQ ID NO: 625784 - protein, 18 aa, Mycobacterium
AAHMVGALPKNPAQLTIT

SEQ ID NO: 625785 - protein, 20 aa, Mycobacterium
AAHNWCAWEDAVIAHESLGS

SEQ ID NO: 625786 - protein, 26 aa, Mycobacterium
AAHPAWDAVCYRLGLLTTPEAQAILD

SEQ ID NO: 625787 - protein, 20 aa, Mycobacterium
AAHPGLPVWGQGWDESAWPE

SEQ ID NO: 625788 - protein, 19 aa, Mycobacterium
AAHPGQPVWGHGWDETSWP

SEQ ID NO: 625789 - protein, 19 aa, Mycobacterium
AAHPGRPDVLTAWMDGAVL

SEQ ID NO: 625790 - protein, 24 aa, Mycobacterium
AAHPGRPEVLTAWMDAAVIDENDP

SEQ ID NO: 625791 - protein, 21 aa, Mycobacterium
AAHPGSVWWLFTNVLPGLLSR

SEQ ID NO: 625792 - protein, 26 aa, Mycobacterium
AAHPRPDFKNRILAAFNDGMKHRPLT

SEQ ID NO: 625793 - protein, 18 aa, Mycobacterium
AAHQMAGVTIVDPATTWI

SEQ ID NO: 625794 - protein, 18 aa, Mycobacterium
AAHRARVASYVPDGAPVA

SEQ ID NO: 625795 - protein, 30 aa, Mycobacterium
AAHRQLRYFWPRVVGDIGWQLLDSKFAVVA

SEQ ID NO: 625796 - protein, 30 aa, Mycobacterium
AAHRQLRYFWPRVVGDIGWQLLDTKFAVVA

SEQ ID NO: 625797 - protein, 26 aa, Mycobacterium
AAHRQLRYFWPRVVGDTGWQLLDSKF

SEQ ID NO: 625798 - protein, 26 aa, Mycobacterium
AAHRQLRYFWPRVVGDTGWQLLDTKF

SEQ ID NO: 625799 - protein, 25 aa, Mycobacterium
AAHRRAHGLPAISLGWGLWDQASDM

SEQ ID NO: 625800 - protein, 18 aa, Mycobacterium
AAHRRAHGLPGLSVAWGM

SEQ ID NO: 625801 - protein, 23 aa, Mycobacterium
AAHRRGVVINPVLETSEIPENMP

SEQ ID NO: 625802 - protein, 20 aa, Mycobacterium
AAHRVIELLHTIHLPVVCGV

SEQ ID NO: 625803 - protein, 21 aa, Mycobacterium
AAHSPRLLAAIKQAARVVPTN

SEQ ID NO: 625804 - protein, 18 aa, Mycobacterium
AAHTEYDTGLSLAAVCAL

SEQ ID NO: 625805 - protein, 18 aa, Mycobacterium
AAHWGRPLDLEWAIDRDG

SEQ ID NO: 625806 - protein, 20 aa, Mycobacterium
AAHWRLGDACELTLLESVHM

SEQ ID NO: 625807 - protein, 24 aa, Mycobacterium
AAIAAAPFAPGMVVAADGAGAGVG

SEQ ID NO: 625808 - protein, 27 aa, Mycobacterium
AAIAAECDRRGWTVVGWHADEGVSGGK

SEQ ID NO: 625809 - protein, 18 aa, Mycobacterium
AAIAAGIGRPARQRTTTY

SEQ ID NO: 625810 - protein, 17 aa, Mycobacterium
AAIAAWCDASGARLISD

SEQ ID NO: 625811 - protein, 27 aa, Mycobacterium
AAIAEAAQAFSVWRTTPAPVRGALVAR

SEQ ID NO: 625812 - protein, 19 aa, Mycobacterium
AAIAEFKRAGMADADVGTI

SEQ ID NO: 625813 - protein, 30 aa, Mycobacterium
AAIAEVFAGRCGQLISIGGVPAYRGCLQPE

SEQ ID NO: 625814 - protein, 20 aa, Mycobacterium
AAIAGMCLTMARDLGSLGIR

SEQ ID NO: 625815 - protein, 23 aa, Mycobacterium
AAIAKKALPRLVTALEDAGVTVH

SEQ ID NO: 625816 - protein, 26 aa, Mycobacterium
AAIALHGLWKTGLRAGHRVLVIGAGP

SEQ ID NO: 625817 - protein, 24 aa, Mycobacterium
AAIARPELLAELAQRFGSQCIVLS

SEQ ID NO: 625818 - protein, 25 aa, Mycobacterium
AAIARPELLAELSRQFGSQCIVLSV

SEQ ID NO: 625819 - protein, 26 aa, Mycobacterium
AAIARPELLGDMARQFGSQCIVLSVD

SEQ ID NO: 625820 - protein, 18 aa, Mycobacterium
AAIARRFSPHSNRIPGQE

SEQ ID NO: 625821 - protein, 19 aa, Mycobacterium
AAIARWRHRGTFVVEWADI

SEQ ID NO: 625822 - protein, 21 aa, Mycobacterium
AAIASREVVDFGSGVVHALRS

SEQ ID NO: 625823 - protein, 18 aa, Mycobacterium
AAIASSLQDLVSEANAST

SEQ ID NO: 625824 - protein, 24 aa, Mycobacterium
AAIAVARRGGTVFAVARDGEALDQ

SEQ ID NO: 625825 - protein, 19 aa, Mycobacterium
AAIDEFFGGFEAFRAEMTG

SEQ ID NO: 625826 - protein, 21 aa, Mycobacterium
AAIDKAHWFYALSPADRRNYS

SEQ ID NO: 625827 - protein, 19 aa, Mycobacterium
AAIDKAWRDAQREADHYRE

SEQ ID NO: 625828 - protein, 24 aa, Mycobacterium
AAIDYKGGELLPVDIPEMSEPASN

SEQ ID NO: 625829 - protein, 17 aa, Mycobacterium
AAIEAARVAQRAVGHDL

SEQ ID NO: 625830 - protein, 19 aa, Mycobacterium
AAIEGCCYGLVGPGYTSAE

SEQ ID NO: 625831 - protein, 18 aa, Mycobacterium
AAIEPVWYLPGVAARFGC

SEQ ID NO: 625832 - protein, 18 aa, Mycobacterium
AAIERIWQAARYWYQAGM

SEQ ID NO: 625833 - protein, 19 aa, Mycobacterium
AAIERLRPDVAALFATADA

SEQ ID NO: 625834 - protein, 19 aa, Mycobacterium
AAIESCPPGPVEVVANYTA

SEQ ID NO: 625835 - protein, 20 aa, Mycobacterium
AAIETTPARKLREIRMALTL

SEQ ID NO: 625836 - protein, 24 aa, Mycobacterium
AAIFDELQGILGIVTQLIAVTAHL

SEQ ID NO: 625837 - protein, 21 aa, Mycobacterium
AAIGELFAYRLSRCGETEDWA

SEQ ID NO: 625838 - protein, 25 aa, Mycobacterium
AAIGTRLKPGVSLPAPTGVFPKYQV

SEQ ID NO: 625839 - protein, 18 aa, Mycobacterium
AAIHSRVGSVVNANSAGT

SEQ ID NO: 625840 - protein, 18 aa, Mycobacterium
AAIKAARCSPDAFIQLAL

SEQ ID NO: 625841 - protein, 20 aa, Mycobacterium
AAIKADPDWQGGDYHGTGRA

SEQ ID NO: 625842 - protein, 21 aa, Mycobacterium
AAIKADPNWAGGDYHDTGRSP

SEQ ID NO: 625843 - protein, 20 aa, Mycobacterium
AAIKADPNWQGGDYHGTGRT

SEQ ID NO: 625844 - protein, 25 aa, Mycobacterium
AAIKGCEALGFGQFIAAYEDIVRRA

SEQ ID NO: 625845 - protein, 21 aa, Mycobacterium
AAIKGMWTVPVFGNPTGVTYS

SEQ ID NO: 625846 - protein, 29 aa, Mycobacterium
AAIKRAHDEFRWFAGGWPVNADLPTPAGF

SEQ ID NO: 625847 - protein, 25 aa, Mycobacterium
AAIKRPDYSITGWVILTLIQHGTAW

SEQ ID NO: 625848 - protein, 19 aa, Mycobacterium
AAIMGCAVPTGFGSATNVA

SEQ ID NO: 625849 - protein, 24 aa, Mycobacterium
AAIMLSFGDLRPFADRIHAAGVPL

SEQ ID NO: 625850 - protein, 20 aa, Mycobacterium
AAIMQTRAGRGWIAATTSTE

SEQ ID NO: 625851 - protein, 26 aa, Mycobacterium
AAIPDAARYSVRFGKPLVLPATAGLY

SEQ ID NO: 625852 - protein, 25 aa, Mycobacterium
AAIPRADGLLISFERMNAVLEVDVT

SEQ ID NO: 625853 - protein, 25 aa, Mycobacterium
AAIPRSDGLLISFERMNAVLEVDTT

SEQ ID NO: 625854 - protein, 23 aa, Mycobacterium
AAIPTRHGTVFARIYHPPAAGAT

SEQ ID NO: 625855 - protein, 26 aa, Mycobacterium
AAIPVARLRPGFIVQRDAASGLMRYA

SEQ ID NO: 625856 - protein, 24 aa, Mycobacterium
AAIQDAWAATRWVADHGSTIGADL

SEQ ID NO: 625857 - protein, 20 aa, Mycobacterium
AAIQGWCIGGGVDLIAAADI

SEQ ID NO: 625858 - protein, 19 aa, Mycobacterium
AAIQRRLGVDLDDGESMTS

SEQ ID NO: 625859 - protein, 18 aa, Mycobacterium
AAIQTMRSPAARRRAYGD

SEQ ID NO: 625860 - protein, 21 aa, Mycobacterium
AAIRADFPILQRVMRGGNQLA

SEQ ID NO: 625861 - protein, 22 aa, Mycobacterium
AAIRARDGLRVGADAIERAGLE

SEQ ID NO: 625862 - protein, 18 aa, Mycobacterium
AAIRARLGQLGIPVEGED

SEQ ID NO: 625863 - protein, 18 aa, Mycobacterium
AAIREWARRNGHNVSTRG

SEQ ID NO: 625864 - protein, 26 aa, Mycobacterium
AAIRFLVEYCPPPAQPPLCWLASTTL

SEQ ID NO: 625865 - protein, 19 aa, Mycobacterium
AAIRLGRIGPLHSQRTQAR

SEQ ID NO: 625866 - protein, 19 aa, Mycobacterium
AAIRPYRPSLSAALPPSAL

SEQ ID NO: 625867 - protein, 17 aa, Mycobacterium
AAIRRRLSGAVDMDMPP

SEQ ID NO: 625868 - protein, 17 aa, Mycobacterium
AAIRTVVARRIFAEQYG

SEQ ID NO: 625869 - protein, 18 aa, Mycobacterium
AAISQVFGAYGQEFQALN

SEQ ID NO: 625870 - protein, 25 aa, Mycobacterium
AAISRAGGMGVLGCVRFNDPDELDA

SEQ ID NO: 625871 - protein, 26 aa, Mycobacterium
AAISRLPLVPPLLEWLHAVRQPVVMD

SEQ ID NO: 625872 - protein, 27 aa, Mycobacterium
AAISRLPVVPSMLEWLHVARTSVVMDT

SEQ ID NO: 625873 - protein, 17 aa, Mycobacterium
AAITAKLIPPGGAAAAM

SEQ ID NO: 625874 - protein, 19 aa, Mycobacterium
AAITALINSHGLGYQSISQ

SEQ ID NO: 625875 - protein, 19 aa, Mycobacterium
AAITCTRPGAQPPDATELA

SEQ ID NO: 625876 - protein, 22 aa, Mycobacterium
AAITPRTRMIWVETPTNPLLSI

SEQ ID NO: 625877 - protein, 26 aa, Mycobacterium
AAITVGLCRGWPLAESVRLGIAAGAA

SEQ ID NO: 625878 - protein, 19 aa, Mycobacterium
AAIVARELGVPCIVGTRTG

SEQ ID NO: 625879 - protein, 18 aa, Mycobacterium
AAIVDHVRDAASGRESKN

SEQ ID NO: 625880 - protein, 18 aa, Mycobacterium
AAIVPARFSASNFLDDVR

SEQ ID NO: 625881 - protein, 22 aa, Mycobacterium
AAIVRALPRWARWSHKRITAAL

SEQ ID NO: 625882 - protein, 25 aa, Mycobacterium
AAIYLADCRRLGITVLPPDVNESVQ

SEQ ID NO: 625883 - protein, 18 aa, Mycobacterium
AAIYRRWPSKAEVVADAI

SEQ ID NO: 625884 - protein, 19 aa, Mycobacterium
AAIYRRWSSKAALITDALV

SEQ ID NO: 625885 - protein, 18 aa, Mycobacterium
AAKAALWAQTDAVREELA

SEQ ID NO: 625886 - protein, 22 aa, Mycobacterium
AAKAHGFGLILVGHVTKEGSIA

SEQ ID NO: 625887 - protein, 18 aa, Mycobacterium
AAKALEASGIPVIRTYQD

SEQ ID NO: 625888 - protein, 19 aa, Mycobacterium
AAKAMAYASAFIAGSLQDN

SEQ ID NO: 625889 - protein, 23 aa, Mycobacterium
AAKANGVALILVGHVTKDGAIAG

SEQ ID NO: 625890 - protein, 19 aa, Mycobacterium
AAKAPRVIRALKLTLNNTA

SEQ ID NO: 625891 - protein, 19 aa, Mycobacterium
AAKARAWLGREACEPIRYL

SEQ ID NO: 625892 - protein, 25 aa, Mycobacterium
AAKARDGRLPFVFEASGVETHFTNG

SEQ ID NO: 625893 - protein, 25 aa, Mycobacterium
AAKDFRLMWDNAYAVHTLTDEFVEP

SEQ ID NO: 625894 - protein, 24 aa, Mycobacterium
AAKELAYLGVRVNAIAPGLIRSAM

SEQ ID NO: 625895 - protein, 22 aa, Mycobacterium
AAKEVFARNGFHATTIADIAKQ

SEQ ID NO: 625896 - protein, 18 aa, Mycobacterium
AAKFAEGVKSEFPDQMLA

SEQ ID NO: 625897 - protein, 19 aa, Mycobacterium
AAKFAEGVKSEFPDQMLAY

SEQ ID NO: 625898 - protein, 22 aa, Mycobacterium
AAKFGCGYAPSGWDKLTKHLLR

SEQ ID NO: 625899 - protein, 23 aa, Mycobacterium
AAKFGMGFGDTFGTFVGDEVAYA

SEQ ID NO: 625900 - protein, 19 aa, Mycobacterium
AAKGFEPVALCARTPDRLE

SEQ ID NO: 625901 - protein, 24 aa, Mycobacterium
AAKGFEVIGLFSCRGLDTVGPFGY

SEQ ID NO: 625902 - protein, 22 aa, Mycobacterium
AAKGLPYVFAHHFSGNGTEQAL

SEQ ID NO: 625903 - protein, 28 aa, Mycobacterium
AAKGTFRLAFGIGDFRRDTGFGEDPGTL

SEQ ID NO: 625904 - protein, 28 aa, Mycobacterium
AAKGTFRLAFGIGDFRRDTGFGGDALTL

SEQ ID NO: 625905 - protein, 24 aa, Mycobacterium
AAKGTRDAWNTAWGPLVAAATHGA

SEQ ID NO: 625906 - protein, 23 aa, Mycobacterium
AAKHADRVFLRFEGQDITYAQAN

SEQ ID NO: 625907 - protein, 21 aa, Mycobacterium
AAKHLEIVEAFLAASRGGDIA

SEQ ID NO: 625908 - protein, 22 aa, Mycobacterium
AAKICNNMILGVSMIAISEAFV

SEQ ID NO: 625909 - protein, 29 aa, Mycobacterium
AAKIVEYSPRFVLFVARGTSDHAALYGKY

SEQ ID NO: 625910 - protein, 25 aa, Mycobacterium
AAKKFTAEHDAFWSAARKAHGDAAG

SEQ ID NO: 625911 - protein, 18 aa, Mycobacterium
AAKLPGVRIVVAGGPSGS

SEQ ID NO: 625912 - protein, 23 aa, Mycobacterium
AAKLPSFAGRVVIVTGANSGLGE

SEQ ID NO: 625913 - protein, 25 aa, Mycobacterium
AAKLRAAGVPVDLRVQGPLIHGFYN

SEQ ID NO: 625914 - protein, 26 aa, Mycobacterium
AAKLRSYELFAQYVIPHFTGQLSAPI

SEQ ID NO: 625915 - protein, 25 aa, Mycobacterium
AAKNLRIPVLLIRGKLSDVVSPEGV

SEQ ID NO: 625916 - protein, 22 aa, Mycobacterium
AAKPGSYFWFKGGKRAAQLPAE

SEQ ID NO: 625917 - protein, 29 aa, Mycobacterium
AAKRELVEFALRIMLSFFVSPNEATRSRD

SEQ ID NO: 625918 - protein, 17 aa, Mycobacterium
AAKREYEASVGRAQAEA

SEQ ID NO: 625919 - protein, 22 aa, Mycobacterium
AAKRIAPIVVLTAFSQRDLVER

SEQ ID NO: 625920 - protein, 18 aa, Mycobacterium
AAKRIRAFEPFIADTAAR

SEQ ID NO: 625921 - protein, 19 aa, Mycobacterium
AAKRIRARIAPVGEVGYAV

SEQ ID NO: 625922 - protein, 22 aa, Mycobacterium
AAKRLCRSRVGIDAEAGPTEIA

SEQ ID NO: 625923 - protein, 21 aa, Mycobacterium
AAKRSGLYYTLLNTHLSPSEI

SEQ ID NO: 625924 - protein, 20 aa, Mycobacterium
AAKSAEWGLTNGVRVELARQ

SEQ ID NO: 625925 - protein, 21 aa, Mycobacterium
AAKSKPLFRAAIQTMRAPAAR

SEQ ID NO: 625926 - protein, 24 aa, Mycobacterium
AAKTMLDELAWWGAALRTAREHSP

SEQ ID NO: 625927 - protein, 20 aa, Mycobacterium
AAKVTPDFAPYGKRIIRDPG

SEQ ID NO: 625928 - protein, 24 aa, Mycobacterium
AAKWPNRPDPLLAARYPAIAGQNL

SEQ ID NO: 625929 - protein, 24 aa, Mycobacterium
AALAAAWDAARDWDAHITTGKAVL

SEQ ID NO: 625930 - protein, 28 aa, Mycobacterium
AALAALELIDWPVALVIATGHVLASNHH

SEQ ID NO: 625931 - protein, 18 aa, Mycobacterium
AALAAPPERRQWWIDRVK

SEQ ID NO: 625932 - protein, 21 aa, Mycobacterium
AALAARGWLGMTVPTEYGGHG

SEQ ID NO: 625933 - protein, 18 aa, Mycobacterium
AALAARVRAGEVSYTDAV

SEQ ID NO: 625934 - protein, 25 aa, Mycobacterium
AALAARVSRYFPWQFGVDYDAIGHG

SEQ ID NO: 625935 - protein, 23 aa, Mycobacterium
AALACAARLARRDVAVCKPVQTG

SEQ ID NO: 625936 - protein, 24 aa, Mycobacterium
AALACARYALPGRFHGHSIVEYND

SEQ ID NO: 625937 - protein, 20 aa, Mycobacterium
AALADAFGRAAKCVVRTFDE

SEQ ID NO: 625938 - protein, 25 aa, Mycobacterium
AALAEAFAAAGARVVVADLDEPGAA

SEQ ID NO: 625939 - protein, 20 aa, Mycobacterium
AALAEAFARAGAGGGKVAYL

SEQ ID NO: 625940 - protein, 18 aa, Mycobacterium
AALAEGWAVSVPDHEGTT

SEQ ID NO: 625941 - protein, 17 aa, Mycobacterium
AALAEPYPQVVAGTPKF

SEQ ID NO: 625942 - protein, 24 aa, Mycobacterium
AALAERTAELGIRVLRYGSGPGGD

SEQ ID NO: 625943 - protein, 17 aa, Mycobacterium
AALAGLVDRFDLRGQRL

SEQ ID NO: 625944 - protein, 19 aa, Mycobacterium
AALAGRPGLLIADEPTSAL

SEQ ID NO: 625945 - protein, 19 aa, Mycobacterium
AALAGRRAWIGYPKPGRLA

SEQ ID NO: 625946 - protein, 20 aa, Mycobacterium
AALAGYGRRVLLVDLDPQGA

SEQ ID NO: 625947 - protein, 20 aa, Mycobacterium
AALAHCFAHNDGIRVLPDTV

SEQ ID NO: 625948 - protein, 24 aa, Mycobacterium
AALAHPALVCDVAIGQSTLVTQRV

SEQ ID NO: 625949 - protein, 24 aa, Mycobacterium
AALAHPGLVCNAAIGQSTLVTQRV

SEQ ID NO: 625950 - protein, 24 aa, Mycobacterium
AALAIRAGAYWVAANVDATLPTER

SEQ ID NO: 625951 - protein, 18 aa, Mycobacterium
AALAKHPGADLVVFPELF

SEQ ID NO: 625952 - protein, 17 aa, Mycobacterium
AALALPGVHAVFTAADL

SEQ ID NO: 625953 - protein, 26 aa, Mycobacterium
AALAMELGCDAVLLASAVTRAADPAA

SEQ ID NO: 625954 - protein, 27 aa, Mycobacterium
AALAMELGCDAVLLASAVTRAADPPAM

SEQ ID NO: 625955 - protein, 27 aa, Mycobacterium
AALAMELGCDAVLLATAVTRAADPAAM

SEQ ID NO: 625956 - protein, 27 aa, Mycobacterium
AALAMELGCDAVLLATAVTRAADPERM

SEQ ID NO: 625957 - protein, 26 aa, Mycobacterium
AALAMELGCDAVLLATAVTRAADPPA

SEQ ID NO: 625958 - protein, 26 aa, Mycobacterium
AALAMELGCDAVLLATAVTRASDPPT

SEQ ID NO: 625959 - protein, 25 aa, Mycobacterium
AALAPRRVLPAFGLHSALTAERDVF

SEQ ID NO: 625960 - protein, 17 aa, Mycobacterium
AALARAATEAALTEAVR

SEQ ID NO: 625961 - protein, 22 aa, Mycobacterium
AALARAGLRCPPLAVDADGADI

SEQ ID NO: 625962 - protein, 20 aa, Mycobacterium
AALARERVGQLLSLVERRML

SEQ ID NO: 625963 - protein, 23 aa, Mycobacterium
AALARGAVHYVALGDKHSRMSVG

SEQ ID NO: 625964 - protein, 19 aa, Mycobacterium
AALARLAAAVAAELVAGGL

SEQ ID NO: 625965 - protein, 24 aa, Mycobacterium
AALARLEAHIVLRMLLERTTWIDA

SEQ ID NO: 625966 - protein, 18 aa, Mycobacterium
AALARLEAQIVLRLLLER

SEQ ID NO: 625967 - protein, 18 aa, Mycobacterium
AALARLESAIALDKLLDL

SEQ ID NO: 625968 - protein, 18 aa, Mycobacterium
AALARLGAVQNPIIPILR

SEQ ID NO: 625969 - protein, 22 aa, Mycobacterium
AALARRGCVYVSVNYRLGALGC

SEQ ID NO: 625970 - protein, 25 aa, Mycobacterium
AALARSCPDIAVGAVRSEPRPARVG

SEQ ID NO: 625971 - protein, 17 aa, Mycobacterium
AALARVFGSASHARAAT

SEQ ID NO: 625972 - protein, 18 aa, Mycobacterium
AALARYFASEALSAVTSE

SEQ ID NO: 625973 - protein, 17 aa, Mycobacterium
AALARYRTLGFAARAYE

SEQ ID NO: 625974 - protein, 25 aa, Mycobacterium
AALASMPPFCWMTQDGTGWALIYIA

SEQ ID NO: 625975 - protein, 26 aa, Mycobacterium
AALASRARKAPGFALLGEAGAEVDLT

SEQ ID NO: 625976 - protein, 26 aa, Mycobacterium
AALASRARKAPGFALLGEKGQERDLT

SEQ ID NO: 625977 - protein, 25 aa, Mycobacterium
AALASRARKAPGFALLGEPGQARDL

SEQ ID NO: 625978 - protein, 26 aa, Mycobacterium
AALASRARKAPGFALLGEPGQARDLT

SEQ ID NO: 625979 - protein, 26 aa, Mycobacterium
AALASRARKAPGFALLGEQGEARDLT

SEQ ID NO: 625980 - protein, 26 aa, Mycobacterium
AALASRARKAPGFALLGEQGETRDLT

SEQ ID NO: 625981 - protein, 26 aa, Mycobacterium
AALASRARKAPGFALLGEQGEVRELT

SEQ ID NO: 625982 - protein, 25 aa, Mycobacterium
AALAVACDSLGIAAAMLDATVSYAS

SEQ ID NO: 625983 - protein, 18 aa, Mycobacterium
AALAWGHDVAARLPQVIE

SEQ ID NO: 625984 - protein, 24 aa, Mycobacterium
AALAWRSEFGSMHYWDDVVADAAM

SEQ ID NO: 625985 - protein, 24 aa, Mycobacterium
AALAWRSEFGSVHYWDEQVTRAAL

SEQ ID NO: 625986 - protein, 21 aa, Mycobacterium
AALCAFGAALDPQFGADSSAR

SEQ ID NO: 625987 - protein, 18 aa, Mycobacterium
AALCAGVAVGVFADLAEG

SEQ ID NO: 625988 - protein, 18 aa, Mycobacterium
AALCEYENYVIILAQPLP

SEQ ID NO: 625989 - protein, 18 aa, Mycobacterium
AALCRSAATVIGSDIDPV

SEQ ID NO: 625990 - protein, 18 aa, Mycobacterium
AALCSAGRPDDARVVADK

SEQ ID NO: 625991 - protein, 23 aa, Mycobacterium
AALCVPIPVGIVVVLDSCDDGSD

SEQ ID NO: 625992 - protein, 31 aa, Mycobacterium
AALDACLDRYARLFAALVPWDKQTDIAVMPA

SEQ ID NO: 625993 - protein, 23 aa, Mycobacterium
AALDAFAAFRWVVDHAPGLGIDP

SEQ ID NO: 625994 - protein, 20 aa, Mycobacterium
AALDAGIGYIGLVASRRRGS

SEQ ID NO: 625995 - protein, 18 aa, Mycobacterium
AALDAGVGHFGRLDIVCA

SEQ ID NO: 625996 - protein, 25 aa, Mycobacterium
AALDCADLVVLVCPSDVRACAATAA

SEQ ID NO: 625997 - protein, 25 aa, Mycobacterium
AALDEGRIVLVAGFQGVSQDSKDVT

SEQ ID NO: 625998 - protein, 18 aa, Mycobacterium
AALDELRAHIAPLQQLWT

SEQ ID NO: 625999 - protein, 25 aa, Mycobacterium
AALDFPAPQKYVAPIAFNVVPLAGS

SEQ ID NO: 626000 - protein, 25 aa, Mycobacterium
AALDGLGYRGFWMGYFAARSAPLGM

SEQ ID NO: 626001 - protein, 18 aa, Mycobacterium
AALDHFRVAMASAGWMTR

SEQ ID NO: 626002 - protein, 18 aa, Mycobacterium
AALDHPLLVEHPQPKRAG

SEQ ID NO: 626003 - protein, 18 aa, Mycobacterium
AALDHPLLVERPEPKRAG

SEQ ID NO: 626004 - protein, 21 aa, Mycobacterium
AALDIGCRRTREATPPVITAA

SEQ ID NO: 626005 - protein, 25 aa, Mycobacterium
AALDIPILQGLCLTSPRAQWCANDD

SEQ ID NO: 626006 - protein, 25 aa, Mycobacterium
AALDIPILQGLCLTSPRAQWCENDD

SEQ ID NO: 626007 - protein, 23 aa, Mycobacterium
AALDIPILQGLCLTSPRDQWHDN

SEQ ID NO: 626008 - protein, 25 aa, Mycobacterium
AALDIPLGAVAPVDGRAGEFIATLG

SEQ ID NO: 626009 - protein, 20 aa, Mycobacterium
AALDKAKGVLRTKVGAGTGV

SEQ ID NO: 626010 - protein, 26 aa, Mycobacterium
AALDLCPRIRVNAIAPGSILTSALEV

SEQ ID NO: 626011 - protein, 19 aa, Mycobacterium
AALDLSVDIDDRFAEYDRD

SEQ ID NO: 626012 - protein, 18 aa, Mycobacterium
AALDRFGPPAGDAAWVVK

SEQ ID NO: 626013 - protein, 22 aa, Mycobacterium
AALDRFGPPAGDPAWVVKDDRL

SEQ ID NO: 626014 - protein, 20 aa, Mycobacterium
AALDRFGPPAGQAAWVVKDD

SEQ ID NO: 626015 - protein, 22 aa, Mycobacterium
AALDRFGPPAGQAAWVVKDDGL

SEQ ID NO: 626016 - protein, 19 aa, Mycobacterium
AALDRGLPVLGICRGAQVL

SEQ ID NO: 626017 - protein, 17 aa, Mycobacterium
AALDSGRQSGGFQGPAT

SEQ ID NO: 626018 - protein, 17 aa, Mycobacterium
AALDSLDALQAWADACV

SEQ ID NO: 626019 - protein, 19 aa, Mycobacterium
AALDTWRARHPAVADRLQP

SEQ ID NO: 626020 - protein, 17 aa, Mycobacterium
AALDVAIPFWMRAPGEC

SEQ ID NO: 626021 - protein, 17 aa, Mycobacterium
AALEAIDSWIRERLSAE

SEQ ID NO: 626022 - protein, 32 aa, Mycobacterium
AALEANPRITALMCTADILALSAMDYLRAHGI

SEQ ID NO: 626023 - protein, 20 aa, Mycobacterium
AALEDGYRVFAELSPHPLLT

SEQ ID NO: 626024 - protein, 26 aa, Mycobacterium
AALEGLRLPALSTRAGGQGRPARIAY

SEQ ID NO: 626025 - protein, 19 aa, Mycobacterium
AALEGNWLRTSDLGVYLGG

SEQ ID NO: 626026 - protein, 24 aa, Mycobacterium
AALEGRAAALIANHGLVAVGPRPD

SEQ ID NO: 626027 - protein, 18 aa, Mycobacterium
AALEKAKGVLRTKVGAGT

SEQ ID NO: 626028 - protein, 19 aa, Mycobacterium
AALELPAGSLVDVAEFCRE

SEQ ID NO: 626029 - protein, 20 aa, Mycobacterium
AALELPLYRGLVSARGDSQE

SEQ ID NO: 626030 - protein, 20 aa, Mycobacterium
AALERAKGVLRTKVGAGTGV

SEQ ID NO: 626031 - protein, 17 aa, Mycobacterium
AALEREVAEHVVPVVHN

SEQ ID NO: 626032 - protein, 21 aa, Mycobacterium
AALERGSAMLVVKRGPNVGSH

SEQ ID NO: 626033 - protein, 23 aa, Mycobacterium
AALERGWRVLLICGPGQMDTART

SEQ ID NO: 626034 - protein, 23 aa, Mycobacterium
AALERLETLLALVEGWVQTVVSG

SEQ ID NO: 626035 - protein, 23 aa, Mycobacterium
AALERLETMLALIEGWVQTVVTD

SEQ ID NO: 626036 - protein, 18 aa, Mycobacterium
AALERLRSQPALEGAASR

SEQ ID NO: 626037 - protein, 22 aa, Mycobacterium
AALESRVSVFAMIETAAALSGL

SEQ ID NO: 626038 - protein, 17 aa, Mycobacterium
AALETELAKAFKASPRS

SEQ ID NO: 626039 - protein, 18 aa, Mycobacterium
AALEVIADAAGYTRGAIY

SEQ ID NO: 626040 - protein, 20 aa, Mycobacterium
AALEVLQHWLARDRSATLVI

SEQ ID NO: 626041 - protein, 18 aa, Mycobacterium
AALFDVQRAVEATGQPVK

SEQ ID NO: 626042 - protein, 19 aa, Mycobacterium
AALFTRLYPAAAHHHVVAA

SEQ ID NO: 626043 - protein, 19 aa, Mycobacterium
AALFVKQATPERVRRAEAT

SEQ ID NO: 626044 - protein, 17 aa, Mycobacterium
AALFVLDSWLRPVPPGT

SEQ ID NO: 626045 - protein, 25 aa, Mycobacterium
AALGAARWIMEFARTQPEDARLLAA

SEQ ID NO: 626046 - protein, 17 aa, Mycobacterium
AALGARLTPGTVLPPPT

SEQ ID NO: 626047 - protein, 20 aa, Mycobacterium
AALGDKVARRVLETGDREEL

SEQ ID NO: 626048 - protein, 18 aa, Mycobacterium
AALGEAFGTLAEDESVRA

SEQ ID NO: 626049 - protein, 24 aa, Mycobacterium
AALGFGDIEAFGFLDPPDARSIRD

SEQ ID NO: 626050 - protein, 17 aa, Mycobacterium
AALGFPLVTGPAEVSTP

SEQ ID NO: 626051 - protein, 17 aa, Mycobacterium
AALGLPLDEDVVAFVGR

SEQ ID NO: 626052 - protein, 18 aa, Mycobacterium
AALGLPLDGQVVAFVGRI

SEQ ID NO: 626053 - protein, 22 aa, Mycobacterium
AALGNGIGRYALDKASAYARER

SEQ ID NO: 626054 - protein, 24 aa, Mycobacterium
AALGPIIAAVRGWIDGNRPQPNDS

SEQ ID NO: 626055 - protein, 18 aa, Mycobacterium
AALGPWARALENLPGEFA

SEQ ID NO: 626056 - protein, 19 aa, Mycobacterium
AALGQYGGVWAHDETRKSF

SEQ ID NO: 626057 - protein, 18 aa, Mycobacterium
AALGRAFQLTNFLRDIDE

SEQ ID NO: 626058 - protein, 17 aa, Mycobacterium
AALGRAFQLTNFLRDVD

SEQ ID NO: 626059 - protein, 20 aa, Mycobacterium
AALGRPVWEVTAADVDRVVG

SEQ ID NO: 626060 - protein, 19 aa, Mycobacterium
AALGRRYGSTFTLQLPVFG

SEQ ID NO: 626061 - protein, 19 aa, Mycobacterium
AALGTKIAKQVLESGEREE

SEQ ID NO: 626062 - protein, 27 aa, Mycobacterium
AALHFFPARLWASGGMSPLITAAVDEA

SEQ ID NO: 626063 - protein, 19 aa, Mycobacterium
AALHGAGLRRGDGVALVLP

SEQ ID NO: 626064 - protein, 22 aa, Mycobacterium
AALHHPCCGDLTYGADPTLAKK

SEQ ID NO: 626065 - protein, 23 aa, Mycobacterium
AALHHPCCGDLVYGADPKLAKRL

SEQ ID NO: 626066 - protein, 21 aa, Mycobacterium
AALHPKKFIFMNTDTTVRQEP

SEQ ID NO: 626067 - protein, 22 aa, Mycobacterium
AALKAHCPRRVDVYFDNVGGPI

SEQ ID NO: 626068 - protein, 18 aa, Mycobacterium
AALKARYLSRDDVPEDVV

SEQ ID NO: 626069 - protein, 29 aa, Mycobacterium
AALKAVPAGRLWANPDCGLKTRNVDEVTA

SEQ ID NO: 626070 - protein, 30 aa, Mycobacterium
AALKHGLTPIVCIGEALDIREAGDHVQYNV

SEQ ID NO: 626071 - protein, 37 aa, Mycobacterium
AALKPVYRPGLIHIYHGLTWGPLIREIVSAATGRNIR

SEQ ID NO: 626072 - protein, 19 aa, Mycobacterium
AALKREFTVPGVSQTVTLT

SEQ ID NO: 626073 - protein, 17 aa, Mycobacterium
AALKRRPRRVLIVGSGF

SEQ ID NO: 626074 - protein, 17 aa, Mycobacterium
AALKRTALELGGNGPVV

SEQ ID NO: 626075 - protein, 19 aa, Mycobacterium
AALKSAGFDDVRTVPREFL

SEQ ID NO: 626076 - protein, 31 aa, Mycobacterium
AALKSLRPSVGRMYRLEFDSAVNATTVQLGY

SEQ ID NO: 626077 - protein, 17 aa, Mycobacterium
AALLAGFATDWLGAGSV

SEQ ID NO: 626078 - protein, 19 aa, Mycobacterium
AALLCGWSTDDYGLSRVSW

SEQ ID NO: 626079 - protein, 27 aa, Mycobacterium
AALLDRPTLVVGHSFGGALALNLSAAH

SEQ ID NO: 626080 - protein, 19 aa, Mycobacterium
AALLERGAAVLLVDILDQA

SEQ ID NO: 626081 - protein, 18 aa, Mycobacterium
AALLGFAGAGGVGGLGGA

SEQ ID NO: 626082 - protein, 32 aa, Mycobacterium
AALLGLVERVPWLSVIPAYFVGVGVRPEHAPA

SEQ ID NO: 626083 - protein, 31 aa, Mycobacterium
AALLGRAIGDWVGGRGRLVSFSVQNRAVAHP

SEQ ID NO: 626084 - protein, 18 aa, Mycobacterium
AALLKHPALVPLIVGKRS

SEQ ID NO: 626085 - protein, 25 aa, Mycobacterium
AALLPTHCWFEPKGWGFQVYPALDC

SEQ ID NO: 626086 - protein, 18 aa, Mycobacterium
AALLRAAPHAEIVAVDGS

SEQ ID NO: 626087 - protein, 23 aa, Mycobacterium
AALLRERGWAVASISREPAPDND

SEQ ID NO: 626088 - protein, 20 aa, Mycobacterium
AALLREVIDVDFPFLGCCYG

SEQ ID NO: 626089 - protein, 21 aa, Mycobacterium
AALLVRIENLGGFTGSSWNAA

SEQ ID NO: 626090 - protein, 26 aa, Mycobacterium
AALLWSHPGAPAFWYQPSRNGAPPVT

SEQ ID NO: 626091 - protein, 30 aa, Mycobacterium
AALMAVDDWPLLRWRMRQYRHGRWGTEIVK

SEQ ID NO: 626092 - protein, 25 aa, Mycobacterium
AALMCVYRLPAFNEVHDDAAWACDL

SEQ ID NO: 626093 - protein, 20 aa, Mycobacterium
AALMNIDPIYVWTHDSIGLG

SEQ ID NO: 626094 - protein, 19 aa, Mycobacterium
AALNAPGMTNVEDFKFFWV

SEQ ID NO: 626095 - protein, 20 aa, Mycobacterium
AALNLRDWPDYASCGPVGTT

SEQ ID NO: 626096 - protein, 25 aa, Mycobacterium
AALPAPEFDGGVAYRAPRDRLEQLL

SEQ ID NO: 626097 - protein, 25 aa, Mycobacterium
AALPAPTGMLCWTKSAGTVPAGTPI

SEQ ID NO: 626098 - protein, 25 aa, Mycobacterium
AALPDAAAVDIGWIGAPIRLVTACA

SEQ ID NO: 626099 - protein, 25 aa, Mycobacterium
AALPDDITFRLGLSATPERHLDPEG

SEQ ID NO: 626100 - protein, 19 aa, Mycobacterium
AALPDDWLAVLTPGQTDAA

SEQ ID NO: 626101 - protein, 22 aa, Mycobacterium
AALPDRPSTTFAGGRLSGTKVG

SEQ ID NO: 626102 - protein, 17 aa, Mycobacterium
AALPEAVSPVWKAMASG

SEQ ID NO: 626103 - protein, 17 aa, Mycobacterium
AALPELDNAVALPDGGL

SEQ ID NO: 626104 - protein, 18 aa, Mycobacterium
AALPELPAVIAEWDAALA

SEQ ID NO: 626105 - protein, 24 aa, Mycobacterium
AALPEVACTVWSNLVMTAHLAPGQ

SEQ ID NO: 626106 - protein, 25 aa, Mycobacterium
AALPEVACTVWSNLVMTAHLGPGQL

SEQ ID NO: 626107 - protein, 23 aa, Mycobacterium
AALPEVACTVWSNMMMTTKMSAG

SEQ ID NO: 626108 - protein, 33 aa, Mycobacterium
AALPEVPTAFFGHSMGAVLAFEVARRFESLAGR

SEQ ID NO: 626109 - protein, 17 aa, Mycobacterium
AALPGGAGLVVLDGTVT

SEQ ID NO: 626110 - protein, 19 aa, Mycobacterium
AALPHGLWVPVLPGTRQVT

SEQ ID NO: 626111 - protein, 24 aa, Mycobacterium
AALPHMYRNEFGRVINISSIHGLR

SEQ ID NO: 626112 - protein, 23 aa, Mycobacterium
AALPISGLTAWQGLFTHGHLTPG

SEQ ID NO: 626113 - protein, 18 aa, Mycobacterium
AALPKLPTFTLTSESVTD

SEQ ID NO: 626114 - protein, 17 aa, Mycobacterium
AALPLDCTYDFEVAAAK

SEQ ID NO: 626115 - protein, 17 aa, Mycobacterium
AALPLSMIERFEKDFGA

SEQ ID NO: 626116 - protein, 19 aa, Mycobacterium
AALPNYPYAYLITVDDDYR

SEQ ID NO: 626117 - protein, 23 aa, Mycobacterium
AALPRALPGVGVKGRKQPVKDGA

SEQ ID NO: 626118 - protein, 17 aa, Mycobacterium
AALPRLRHACGLGTGGL

SEQ ID NO: 626119 - protein, 17 aa, Mycobacterium
AALPRPATGDELRATLL

SEQ ID NO: 626120 - protein, 20 aa, Mycobacterium
AALPSPFFFDIAQWADEDVE

SEQ ID NO: 626121 - protein, 24 aa, Mycobacterium
AALPSRPVQVIGFTSVPGAGDNFL

SEQ ID NO: 626122 - protein, 19 aa, Mycobacterium
AALPSWEAGLQQWISGLPG

SEQ ID NO: 626123 - protein, 37 aa, Mycobacterium
AALPTAERWQLLAGSWLDLPSRPALIGTRSPDAKPYG

SEQ ID NO: 626124 - protein, 24 aa, Mycobacterium
AALPVSGLTAWQGLFLHGHIVAGQ

SEQ ID NO: 626125 - protein, 19 aa, Mycobacterium
AALPWDLLQRSGISAVSVD

SEQ ID NO: 626126 - protein, 19 aa, Mycobacterium
AALPYKRRLFGQIVAAAVR

SEQ ID NO: 626127 - protein, 24 aa, Mycobacterium
AALPYPVVEELLAIDGARLALVNP

SEQ ID NO: 626128 - protein, 19 aa, Mycobacterium
AALQARVGLDSGKWTKEQM

SEQ ID NO: 626129 - protein, 20 aa, Mycobacterium
AALQDWQMRLTRRILSASGS

SEQ ID NO: 626130 - protein, 19 aa, Mycobacterium
AALQEIQAALGAVKDAQKK

SEQ ID NO: 626131 - protein, 17 aa, Mycobacterium
AALQLAATHPARLVIID

SEQ ID NO: 626132 - protein, 17 aa, Mycobacterium
AALQLAVYRRAWASLRE

SEQ ID NO: 626133 - protein, 25 aa, Mycobacterium
AALQLGWRWLPRRLTLEPLAYNRYQ

SEQ ID NO: 626134 - protein, 26 aa, Mycobacterium
AALQLWGSLQWMWVWFDPADSRTPEE

SEQ ID NO: 626135 - protein, 21 aa, Mycobacterium
AALQRRLGTTTVYVTHDQVEA

SEQ ID NO: 626136 - protein, 22 aa, Mycobacterium
AALQRRLGTTTVYVTHDQVEAM

SEQ ID NO: 626137 - protein, 22 aa, Mycobacterium
AALQRSDLLITLGARFDDRVTG

SEQ ID NO: 626138 - protein, 19 aa, Mycobacterium
AALQSLGLRGPRYLGGAGH

SEQ ID NO: 626139 - protein, 26 aa, Mycobacterium
AALQTGMRLALFEVFDPATTPYAIAA

SEQ ID NO: 626140 - protein, 17 aa, Mycobacterium
AALRAAASFELVHAFAL

SEQ ID NO: 626141 - protein, 17 aa, Mycobacterium
AALRARVVALLRNPVMP

SEQ ID NO: 626142 - protein, 18 aa, Mycobacterium
AALRDGRLIKFTADELQR

SEQ ID NO: 626143 - protein, 17 aa, Mycobacterium
AALRDRLLFALLAETGM

SEQ ID NO: 626144 - protein, 26 aa, Mycobacterium
AALREARPDLDLDRVLTPAGREAADR

SEQ ID NO: 626145 - protein, 18 aa, Mycobacterium
AALREAVRLLEYHSVARM

SEQ ID NO: 626146 - protein, 22 aa, Mycobacterium
AALREFHRVLAPGGLVAVSALS

SEQ ID NO: 626147 - protein, 24 aa, Mycobacterium
AALRELRHPKIRVVSTALRMRRSH

SEQ ID NO: 626148 - protein, 17 aa, Mycobacterium
AALREVGDRVASLRLAL

SEQ ID NO: 626149 - protein, 18 aa, Mycobacterium
AALRGVARLARFPGPNGL

SEQ ID NO: 626150 - protein, 20 aa, Mycobacterium
AALRHARGFGRPVIVHVVTR

SEQ ID NO: 626151 - protein, 23 aa, Mycobacterium
AALRHVPLTVVHMVNAMVPMYPA

SEQ ID NO: 626152 - protein, 19 aa, Mycobacterium
AALRIAFRALTFAGVHGVE

SEQ ID NO: 626153 - protein, 19 aa, Mycobacterium
AALRMKAVRAEGASASGAK

SEQ ID NO: 626154 - protein, 20 aa, Mycobacterium
AALRMPPEIIGTGEHSIRDL

SEQ ID NO: 626155 - protein, 21 aa, Mycobacterium
AALRMPPEIIGTGEHSVRDLI

SEQ ID NO: 626156 - protein, 19 aa, Mycobacterium
AALRNALRAQLFVGAAPAE

SEQ ID NO: 626157 - protein, 20 aa, Mycobacterium
AALRPNFRGLDSFAGEIYHT

SEQ ID NO: 626158 - protein, 27 aa, Mycobacterium
AALRPPALRAICPWEGFTDAYRDLTFP

SEQ ID NO: 626159 - protein, 21 aa, Mycobacterium
AALRPPRRGIYRGVYDAAVDL

SEQ ID NO: 626160 - protein, 26 aa, Mycobacterium
AALRQALSVANGWGAQVTEGKKVLEF

SEQ ID NO: 626161 - protein, 24 aa, Mycobacterium
AALRRAAKYASGWWSFLTPPDKIA

SEQ ID NO: 626162 - protein, 24 aa, Mycobacterium
AALRRAARCDGWMHGGGEPEELDR

SEQ ID NO: 626163 - protein, 26 aa, Mycobacterium
AALRRAARLDGWMHGGGDPEELDALI

SEQ ID NO: 626164 - protein, 24 aa, Mycobacterium
AALRRAARLDGWMHGGGTDPDELD

SEQ ID NO: 626165 - protein, 24 aa, Mycobacterium
AALRRAARLDGWMHGGGTSAEELD

SEQ ID NO: 626166 - protein, 21 aa, Mycobacterium
AALRRAARYASGWWSFLTPPE

SEQ ID NO: 626167 - protein, 25 aa, Mycobacterium
AALRRAATFGSGWWPFLTKPEQIAE

SEQ ID NO: 626168 - protein, 18 aa, Mycobacterium
AALRRRLVDLSDAGMEGV

SEQ ID NO: 626169 - protein, 22 aa, Mycobacterium
AALRRWTEPLTHGGVPSSLRLV

SEQ ID NO: 626170 - protein, 19 aa, Mycobacterium
AALRSEITAALASLNLPFP

SEQ ID NO: 626171 - protein, 20 aa, Mycobacterium
AALRSGGVVLVFPGGDYDAF

SEQ ID NO: 626172 - protein, 19 aa, Mycobacterium
AALRVWGQVVSRPEPRLAL

SEQ ID NO: 626173 - protein, 22 aa, Mycobacterium
AALRYITRLLLRLGADDDAAFL

SEQ ID NO: 626174 - protein, 25 aa, Mycobacterium
AALSAAGVLCWYGKDLSDPRGWMRA

SEQ ID NO: 626175 - protein, 18 aa, Mycobacterium
AALSCRAGAHLLSGEFGT

SEQ ID NO: 626176 - protein, 19 aa, Mycobacterium
AALSGALEVACRIGLCFTA

SEQ ID NO: 626177 - protein, 29 aa, Mycobacterium
AALSGLVPRIAVVRGRCFAGNAVIAGAAD

SEQ ID NO: 626178 - protein, 19 aa, Mycobacterium
AALSLICRTGRQFPSAAPA

SEQ ID NO: 626179 - protein, 17 aa, Mycobacterium
AALSLWNSDFLQLVPDF

SEQ ID NO: 626180 - protein, 19 aa, Mycobacterium
AALSMPGMMDTVLDLGIND

SEQ ID NO: 626181 - protein, 21 aa, Mycobacterium
AALSQRLGVPFMEADTLHPQA

SEQ ID NO: 626182 - protein, 21 aa, Mycobacterium
AALSRLGRPYVWGASGPEAFD

SEQ ID NO: 626183 - protein, 20 aa, Mycobacterium
AALSRLGRPYVWGATGPDRF

SEQ ID NO: 626184 - protein, 17 aa, Mycobacterium
AALSRPVALAISDGVLN

SEQ ID NO: 626185 - protein, 24 aa, Mycobacterium
AALSRRGPHRVLRGDLAYAGLPGV

SEQ ID NO: 626186 - protein, 30 aa, Mycobacterium
AALTADRSRAGGGVCAIAAITGASTGPTIT

SEQ ID NO: 626187 - protein, 24 aa, Mycobacterium
AALTAKLRAHWARRLPPTIVGRTG

SEQ ID NO: 626188 - protein, 19 aa, Mycobacterium
AALTDPWQPAVLALVGTAA

SEQ ID NO: 626189 - protein, 20 aa, Mycobacterium
AALTDQLSRSWRDVRAPDSA

SEQ ID NO: 626190 - protein, 17 aa, Mycobacterium
AALTFRVVRDHVTSVFR

SEQ ID NO: 626191 - protein, 19 aa, Mycobacterium
AALTGEWFGALAVIAPSVS

SEQ ID NO: 626192 - protein, 18 aa, Mycobacterium
AALTGLFTFRELRDPGLR

SEQ ID NO: 626193 - protein, 20 aa, Mycobacterium
AALTPFPLQAAGSVVTANLG

SEQ ID NO: 626194 - protein, 17 aa, Mycobacterium
AALTRAIHKLPIKARII

SEQ ID NO: 626195 - protein, 17 aa, Mycobacterium
AALTRPGWHRRVTGMTC

SEQ ID NO: 626196 - protein, 23 aa, Mycobacterium
AALTRQRLAVMIATVCPDDPRTM

SEQ ID NO: 626197 - protein, 22 aa, Mycobacterium
AALVACRDFCQEAVQRRAGRKK

SEQ ID NO: 626198 - protein, 27 aa, Mycobacterium
AALVGFGLDGSHGWERTHIDSLEAAYN

SEQ ID NO: 626199 - protein, 19 aa, Mycobacterium
AALVGNMSVPQGWTEAAPA

SEQ ID NO: 626200 - protein, 18 aa, Mycobacterium
AALVGREAVRLGFDGRAG

SEQ ID NO: 626201 - protein, 18 aa, Mycobacterium
AALVKRGLEPDRLSWDAW

SEQ ID NO: 626202 - protein, 26 aa, Mycobacterium
AALVLGCQGAWTGSQWLMVEEASNTP

SEQ ID NO: 626203 - protein, 17 aa, Mycobacterium
AALVQAWAELRDSDRSH

SEQ ID NO: 626204 - protein, 29 aa, Mycobacterium
AALVRFSDQFGIPVANTFHGKGVMPDDHA

SEQ ID NO: 626205 - protein, 18 aa, Mycobacterium
AALVSRSGSVDWLCLPRF

SEQ ID NO: 626206 - protein, 18 aa, Mycobacterium
AALWRRARQLGEGPGGEG

SEQ ID NO: 626207 - protein, 18 aa, Mycobacterium
AALYLATDRSRYVTGTVL

SEQ ID NO: 626208 - protein, 30 aa, Mycobacterium
AALYRFQFDQVRRLLAWATPYREMMGPFVS

SEQ ID NO: 626209 - protein, 23 aa, Mycobacterium
AAMAAAVQPYVTWMQTTAAQAEE

SEQ ID NO: 626210 - protein, 22 aa, Mycobacterium
AAMAAKNGWAAMPFDERAGVFL

SEQ ID NO: 626211 - protein, 19 aa, Mycobacterium
AAMAARTRFFDAFFEDAAR

SEQ ID NO: 626212 - protein, 21 aa, Mycobacterium
AAMAARTRFFDSFFQAATQAG

SEQ ID NO: 626213 - protein, 18 aa, Mycobacterium
AAMAPYCPLTAEALHEQA

SEQ ID NO: 626214 - protein, 24 aa, Mycobacterium
AAMDAMCANAWRAVTVDKLCASAG

SEQ ID NO: 626215 - protein, 17 aa, Mycobacterium
AAMDTILELAVEHSSSR

SEQ ID NO: 626216 - protein, 19 aa, Mycobacterium
AAMELFGYVLERFERTSAN

SEQ ID NO: 626217 - protein, 18 aa, Mycobacterium
AAMFPGATPMYLTGGSDG

SEQ ID NO: 626218 - protein, 25 aa, Mycobacterium
AAMFRFGCVCGGASLYAPQAHNNIV

SEQ ID NO: 626219 - protein, 18 aa, Mycobacterium
AAMGARCTAFVVSFGAPI

SEQ ID NO: 626220 - protein, 18 aa, Mycobacterium
AAMGFDWQVRDMRRGSGE

SEQ ID NO: 626221 - protein, 25 aa, Mycobacterium
AAMGKARLTGSLSTPSSWGAGVREF

SEQ ID NO: 626222 - protein, 18 aa, Mycobacterium
AAMKSGLAVTPRWRTDRV

SEQ ID NO: 626223 - protein, 19 aa, Mycobacterium
AAMLAAVTPYVTWLCATAA

SEQ ID NO: 626224 - protein, 25 aa, Mycobacterium
AAMLDRLALDPKRVEGIAAGLRQVA

SEQ ID NO: 626225 - protein, 17 aa, Mycobacterium
AAMLELLLGAWLAQGIT

SEQ ID NO: 626226 - protein, 20 aa, Mycobacterium
AAMLGPLAVPASWTSVIPAA

SEQ ID NO: 626227 - protein, 22 aa, Mycobacterium
AAMLGWPLRTFECAVPPGRLGW

SEQ ID NO: 626228 - protein, 20 aa, Mycobacterium
AAMLHHARCPVAVIHDEEVE

SEQ ID NO: 626229 - protein, 24 aa, Mycobacterium
AAMLPPRWVAVGIGPADGVVDRDA

SEQ ID NO: 626230 - protein, 17 aa, Mycobacterium
AAMLRWLDGQSNTAKAA

SEQ ID NO: 626231 - protein, 19 aa, Mycobacterium
AAMNAIRTATNYVRAHPAM

SEQ ID NO: 626232 - protein, 19 aa, Mycobacterium
AAMNAIRTATNYVRAHPSM

SEQ ID NO: 626233 - protein, 19 aa, Mycobacterium
AAMQGRIAMYHALGDAVQP

SEQ ID NO: 626234 - protein, 18 aa, Mycobacterium
AAMQGRIAMYHALGEAVA

SEQ ID NO: 626235 - protein, 18 aa, Mycobacterium
AAMQGRIAMYHALGEGVS

SEQ ID NO: 626236 - protein, 19 aa, Mycobacterium
AAMQGRIAMYHALGEGVSP

SEQ ID NO: 626237 - protein, 19 aa, Mycobacterium
AAMRCVAEVGYSQATIREI

SEQ ID NO: 626238 - protein, 21 aa, Mycobacterium
AAMRGAPVVICRGHGITSAAA

SEQ ID NO: 626239 - protein, 17 aa, Mycobacterium
AAMRGKDIAMVFQEPGA

SEQ ID NO: 626240 - protein, 17 aa, Mycobacterium
AAMRLRGRLDAQALGAA

SEQ ID NO: 626241 - protein, 18 aa, Mycobacterium
AAMRRYRDVNAWVDRAYS

SEQ ID NO: 626242 - protein, 19 aa, Mycobacterium
AAMRVRLLLAPEVDVRFGI

SEQ ID NO: 626243 - protein, 17 aa, Mycobacterium
AAMSAAAFDRGWVTALV

SEQ ID NO: 626244 - protein, 19 aa, Mycobacterium
AAMSAAWSPPAGMPAGTPA

SEQ ID NO: 626245 - protein, 27 aa, Mycobacterium
AAMSGWQRLHFRFGIPEPLLEPLAVER

SEQ ID NO: 626246 - protein, 20 aa, Mycobacterium
AAMSQLWQRFNAVAVTNGHA

SEQ ID NO: 626247 - protein, 25 aa, Mycobacterium
AAMSTPDMYGRVAIAQTMRDVTPDL

SEQ ID NO: 626248 - protein, 20 aa, Mycobacterium
AAMTHLRANAPVSWVDVEGY

SEQ ID NO: 626249 - protein, 20 aa, Mycobacterium
AAMTKILWSEFFQRETELAM

SEQ ID NO: 626250 - protein, 23 aa, Mycobacterium
AAMVASVLPYVGWLEATAVQAGH

SEQ ID NO: 626251 - protein, 19 aa, Mycobacterium
AAMVDKGRRVLLVDLDPQG

SEQ ID NO: 626252 - protein, 19 aa, Mycobacterium
AAMVDRMDWNVGRVIDYLS

SEQ ID NO: 626253 - protein, 17 aa, Mycobacterium
AAMVHPLAVAANRNGFV

SEQ ID NO: 626254 - protein, 17 aa, Mycobacterium
AAMYCYAAGSTAATTLT

SEQ ID NO: 626255 - protein, 26 aa, Mycobacterium
AANALRPGDLAVWDGHVAMIVGPNTM

SEQ ID NO: 626256 - protein, 21 aa, Mycobacterium
AANALRQFGLRTHVIEMMPRL

SEQ ID NO: 626257 - protein, 22 aa, Mycobacterium
AANALRQFGLRTHVLEMSPHLM

SEQ ID NO: 626258 - protein, 21 aa, Mycobacterium
AANALRQFGLRTHVVEMMPRL

SEQ ID NO: 626259 - protein, 26 aa, Mycobacterium
AANAMGRPGLTLGLGPSHEPIVRNVL

SEQ ID NO: 626260 - protein, 26 aa, Mycobacterium
AANAQEFLRRLGVDAAEVKTLPQRQL

SEQ ID NO: 626261 - protein, 23 aa, Mycobacterium
AANASPLDQLMGVVNAPAQALLG

SEQ ID NO: 626262 - protein, 21 aa, Mycobacterium
AANAYLGAWGIVDCLNAGADV

SEQ ID NO: 626263 - protein, 19 aa, Mycobacterium
AANEALRLGDLELSERLGR

SEQ ID NO: 626264 - protein, 23 aa, Mycobacterium
AANEFPMRLLTVGPLMHGGSQWI

SEQ ID NO: 626265 - protein, 23 aa, Mycobacterium
AANEFPVRVLTVGPLMHGGTQWI

SEQ ID NO: 626266 - protein, 28 aa, Mycobacterium
AANFLVTPSKLWPLTGLDSLSLDKSVAR

SEQ ID NO: 626267 - protein, 24 aa, Mycobacterium
AANFRDIMITLGMFTHDALIGGEG

SEQ ID NO: 626268 - protein, 23 aa, Mycobacterium
AANGCECCNYLLAVDVDMNTVDG

SEQ ID NO: 626269 - protein, 23 aa, Mycobacterium
AANGFNAMRLGVFWTAVEPQPLT

SEQ ID NO: 626270 - protein, 25 aa, Mycobacterium
AANGFPVHFERRIVAVGYRGGSVEV

SEQ ID NO: 626271 - protein, 17 aa, Mycobacterium
AANGVFDGGSWVGESAD

SEQ ID NO: 626272 - protein, 27 aa, Mycobacterium
AANHCFHVFGAYPWTRFLGRGMDEHPL

SEQ ID NO: 626273 - protein, 25 aa, Mycobacterium
AANHCFHVFGVYPWTRFLGRGMDEH

SEQ ID NO: 626274 - protein, 24 aa, Mycobacterium
AANICGRPRITAEINDGKPADQRI

SEQ ID NO: 626275 - protein, 18 aa, Mycobacterium
AANIFGRGSLQQKIVKQV

SEQ ID NO: 626276 - protein, 24 aa, Mycobacterium
AANIIPGRAAMQYTMRAVETASLR

SEQ ID NO: 626277 - protein, 21 aa, Mycobacterium
AANLCWKLAAVLRGRAPDSLL

SEQ ID NO: 626278 - protein, 25 aa, Mycobacterium
AANLGWKLAAVVSGRADDKLLDTYD

SEQ ID NO: 626279 - protein, 24 aa, Mycobacterium
AANLGWKLAAVVSGRADDRLLDTY

SEQ ID NO: 626280 - protein, 20 aa, Mycobacterium
AANLGWKLAAVVTGQARDSL

SEQ ID NO: 626281 - protein, 25 aa, Mycobacterium
AANLGWKLAAVVTGRAGEELLDTYD

SEQ ID NO: 626282 - protein, 27 aa, Mycobacterium
AANLLRLKAFFARQWRQMPAAHFMAVF

SEQ ID NO: 626283 - protein, 18 aa, Mycobacterium
AANLMKWTGVSPESVART

SEQ ID NO: 626284 - protein, 18 aa, Mycobacterium
AANLRGQWIYDEMLESVV

SEQ ID NO: 626285 - protein, 19 aa, Mycobacterium
AANPAPFLHQLIANQMGYA

SEQ ID NO: 626286 - protein, 17 aa, Mycobacterium
AANPGMACLHLDQSDPS

SEQ ID NO: 626287 - protein, 17 aa, Mycobacterium
AANPVEAVAAWIDARLD

SEQ ID NO: 626288 - protein, 17 aa, Mycobacterium
AANQFWMLGEPERATAF

SEQ ID NO: 626289 - protein, 19 aa, Mycobacterium
AANQWKASPTQLALEMLAA

SEQ ID NO: 626290 - protein, 29 aa, Mycobacterium
AANRARLAAAIRLPAERVVWMNQVHSDRI

SEQ ID NO: 626291 - protein, 26 aa, Mycobacterium
AANRARLAATIGMPTERVVWMNQVHG

SEQ ID NO: 626292 - protein, 25 aa, Mycobacterium
AANRARLAMLLATNFFGINAPAIAE

SEQ ID NO: 626293 - protein, 24 aa, Mycobacterium
AANRARLLALVATNFFGQNTPAIM

SEQ ID NO: 626294 - protein, 38 aa, Mycobacterium
AANRGIGGTGAWDPAFTQHYYRPVGFDDGGVLPPGMQV

SEQ ID NO: 626295 - protein, 23 aa, Mycobacterium
AANRIANTVAVSFVQERERIIRQ

SEQ ID NO: 626296 - protein, 23 aa, Mycobacterium
AANRLANLLSVYGAAPGESVALL

SEQ ID NO: 626297 - protein, 22 aa, Mycobacterium
AANRLSYAFDFRGPSMAIDTAC

SEQ ID NO: 626298 - protein, 24 aa, Mycobacterium
AANRSRLAAALGVPDDHLIWMQQV

SEQ ID NO: 626299 - protein, 22 aa, Mycobacterium
AANRSSLVSLVLSNLFGQNAPA

SEQ ID NO: 626300 - protein, 23 aa, Mycobacterium
AANRWDLVYRFDYQSSTAEQTSG

SEQ ID NO: 626301 - protein, 28 aa, Mycobacterium
AANSAALARTTGLLAAAEDEVSTAIASL

SEQ ID NO: 626302 - protein, 18 aa, Mycobacterium
AANSPFLLGRHAWQETRI

SEQ ID NO: 626303 - protein, 23 aa, Mycobacterium
AANSWLDAFTHWRHNQNQPATAI

SEQ ID NO: 626304 - protein, 24 aa, Mycobacterium
AANTDAWRAADFGAVNGHTTARAL

SEQ ID NO: 626305 - protein, 25 aa, Mycobacterium
AANVARATLYRHFPSGNDLLAAAFR

SEQ ID NO: 626306 - protein, 19 aa, Mycobacterium
AANVLPMQVAAAAINDPVQ

SEQ ID NO: 626307 - protein, 26 aa, Mycobacterium
AANWRMQRLPGLPVRPAVAASLRPRN

SEQ ID NO: 626308 - protein, 23 aa, Mycobacterium
AAPAEAIVPVLAFVAGQLPAWAH

SEQ ID NO: 626309 - protein, 17 aa, Mycobacterium
AAPAGAHAAISCGAALD

SEQ ID NO: 626310 - protein, 26 aa, Mycobacterium
AAPAQIGLAWLLAHAPNILLIAGTSS

SEQ ID NO: 626311 - protein, 31 aa, Mycobacterium
AAPASDAAGFKWLAPYTGSAIGQHWMYDGKH

SEQ ID NO: 626312 - protein, 26 aa, Mycobacterium
AAPASDAAGFKWLAPYTGSALGQHWM

SEQ ID NO: 626313 - protein, 26 aa, Mycobacterium
AAPASDSAGFKWLAPYTGSAVAQHWM

SEQ ID NO: 626314 - protein, 20 aa, Mycobacterium
AAPATRWLRDATRGGVGTVC

SEQ ID NO: 626315 - protein, 17 aa, Mycobacterium
AAPAVFADFEISTLADG

SEQ ID NO: 626316 - protein, 19 aa, Mycobacterium
AAPAVLVARPVKAAPDPPA

SEQ ID NO: 626317 - protein, 19 aa, Mycobacterium
AAPAVLVARPVKAAPDPPW

SEQ ID NO: 626318 - protein, 23 aa, Mycobacterium
AAPAYNTGGPWGYTPKGGTGVPA

SEQ ID NO: 626319 - protein, 17 aa, Mycobacterium
AAPDLPCEVEVDSLEQL

SEQ ID NO: 626320 - protein, 25 aa, Mycobacterium
AAPDVLRLAPPLIITDEQIGEFVTA

SEQ ID NO: 626321 - protein, 18 aa, Mycobacterium
AAPDYKGAVTDYKNALNN

SEQ ID NO: 626322 - protein, 29 aa, Mycobacterium
AAPEAVGWTVPKFYWTVTAISAMTAGLQA

SEQ ID NO: 626323 - protein, 21 aa, Mycobacterium
AAPELPCEVEVDSLEQLDAVL

SEQ ID NO: 626324 - protein, 23 aa, Mycobacterium
AAPELRTPWPRQALKDLLVMLAA

SEQ ID NO: 626325 - protein, 32 aa, Mycobacterium
AAPELYSALVTRWAQLELGMSAWDLYGGAGVF

SEQ ID NO: 626326 - protein, 19 aa, Mycobacterium
AAPEPGRIATLAVDLTDDD

SEQ ID NO: 626327 - protein, 21 aa, Mycobacterium
AAPEREAFFFIDELEALLREW

SEQ ID NO: 626328 - protein, 24 aa, Mycobacterium
AAPESSCREFAGLVDDVVCASMPT

SEQ ID NO: 626329 - protein, 19 aa, Mycobacterium
AAPESTCREFAGVVDDVVC

SEQ ID NO: 626330 - protein, 23 aa, Mycobacterium
AAPEVVRLAPPLIITEGQIEAFI

SEQ ID NO: 626331 - protein, 23 aa, Mycobacterium
AAPFELDGRWIGEASFVLPTDLP

SEQ ID NO: 626332 - protein, 21 aa, Mycobacterium
AAPFIGFPIPPMIHGATQAAT

SEQ ID NO: 626333 - protein, 17 aa, Mycobacterium
AAPGFGLVVSYNPGYQS

SEQ ID NO: 626334 - protein, 21 aa, Mycobacterium
AAPGGRTWVPASLVVSGDGEV

SEQ ID NO: 626335 - protein, 17 aa, Mycobacterium
AAPGMCNPADPEPCTAG

SEQ ID NO: 626336 - protein, 17 aa, Mycobacterium
AAPGMCNPADPEPCTYG

SEQ ID NO: 626337 - protein, 18 aa, Mycobacterium
AAPGRASIAVGIPTFNRP

SEQ ID NO: 626338 - protein, 19 aa, Mycobacterium
AAPGSRGRLQAVLADLRQT

SEQ ID NO: 626339 - protein, 20 aa, Mycobacterium
AAPGTRWLRDATRGGVGTVC

SEQ ID NO: 626340 - protein, 21 aa, Mycobacterium
AAPGVRPQLGVLRVLAAPVVM

SEQ ID NO: 626341 - protein, 18 aa, Mycobacterium
AAPHLAKPWGLAATPVQQ

SEQ ID NO: 626342 - protein, 17 aa, Mycobacterium
AAPKADVYEFLIRAGHF

SEQ ID NO: 626343 - protein, 25 aa, Mycobacterium
AAPKLYPHMWSWDAAFVAVGLAPLS

SEQ ID NO: 626344 - protein, 18 aa, Mycobacterium
AAPLALLAPRARRAGATR

SEQ ID NO: 626345 - protein, 17 aa, Mycobacterium
AAPLDPFMMIFTSGTSG

SEQ ID NO: 626346 - protein, 31 aa, Mycobacterium
AAPLDRDLGGWGLSTEEFFDLVMALGEADPD

SEQ ID NO: 626347 - protein, 26 aa, Mycobacterium
AAPLLCAGITLFSPLRHWKAAEGTRL

SEQ ID NO: 626348 - protein, 26 aa, Mycobacterium
AAPLLCAGITLFSPLRHWKAGPGTRL

SEQ ID NO: 626349 - protein, 25 aa, Mycobacterium
AAPLLCAGITLFSPLRHWNAGPGKR

SEQ ID NO: 626350 - protein, 25 aa, Mycobacterium
AAPLLCAGITTFSPLRHWNAGPGKR

SEQ ID NO: 626351 - protein, 24 aa, Mycobacterium
AAPLLCAGVTVFNALRAGDAPPNT

SEQ ID NO: 626352 - protein, 24 aa, Mycobacterium
AAPLPSRLFAGSTLAMPADAAPAD

SEQ ID NO: 626353 - protein, 24 aa, Mycobacterium
AAPLRFCGFVQSMGGTAVVMERFE

SEQ ID NO: 626354 - protein, 21 aa, Mycobacterium
AAPLRRLMIRGSEWSGRGLWA

SEQ ID NO: 626355 - protein, 22 aa, Mycobacterium
AAPLSSCKVVGVRPGQTHSTND

SEQ ID NO: 626356 - protein, 23 aa, Mycobacterium
AAPLVRAVGLEFFRRLVDGELDR

SEQ ID NO: 626357 - protein, 25 aa, Mycobacterium
AAPLYEALLAWGRRRGATRAHLTMP

SEQ ID NO: 626358 - protein, 27 aa, Mycobacterium
AAPMFHLADLMSWSAGLLQGGRHVFIP

SEQ ID NO: 626359 - protein, 25 aa, Mycobacterium
AAPMLDAAAAWAGLAEELSSAASSF

SEQ ID NO: 626360 - protein, 26 aa, Mycobacterium
AAPMPLPLLHRALATWPDTKFVQVYG

SEQ ID NO: 626361 - protein, 35 aa, Mycobacterium
AAPMPLPLLHRALSTWPDTRFVQVYGQTELCGAVT

SEQ ID NO: 626362 - protein, 25 aa, Mycobacterium
AAPPAGWPAALGDFTMVWTAEPGVD

SEQ ID NO: 626363 - protein, 26 aa, Mycobacterium
AAPPDTDGWCSLSLHAGGTVDELRRA

SEQ ID NO: 626364 - protein, 18 aa, Mycobacterium
AAPPEEIAGFAVTVTDLM

SEQ ID NO: 626365 - protein, 23 aa, Mycobacterium
AAPPERLQMAVAYGSAAAALPGT

SEQ ID NO: 626366 - protein, 17 aa, Mycobacterium
AAPPETLAGVAVSVTDI

SEQ ID NO: 626367 - protein, 25 aa, Mycobacterium
AAPPETLRALGLPAMSPTIGGHEGS

SEQ ID NO: 626368 - protein, 31 aa, Mycobacterium
AAPPPGDRRPMLWLEVMKPMASNAVDREAAH

SEQ ID NO: 626369 - protein, 17 aa, Mycobacterium
AAPPPWSIGRPQPELAR

SEQ ID NO: 626370 - protein, 25 aa, Mycobacterium
AAPPRIRRLGPRGAVRGPAGLLVAD

SEQ ID NO: 626371 - protein, 22 aa, Mycobacterium
AAPPRLSTGAAYLQYTSGSTRT

SEQ ID NO: 626372 - protein, 21 aa, Mycobacterium
AAPPRQSLPMGRQVVLNVIAS

SEQ ID NO: 626373 - protein, 19 aa, Mycobacterium
AAPQGTWLIGGFDELAVSV

SEQ ID NO: 626374 - protein, 19 aa, Mycobacterium
AAPQNWRLIVGDVADSDLP

SEQ ID NO: 626375 - protein, 18 aa, Mycobacterium
AAPQRFWVTKPFFDMGDV

SEQ ID NO: 626376 - protein, 34 aa, Mycobacterium
AAPQRRPSAGPAGLPSCTGTASAAVAIQQPAVPA

SEQ ID NO: 626377 - protein, 17 aa, Mycobacterium
AAPQVYSPLVWYVVDGA

SEQ ID NO: 626378 - protein, 17 aa, Mycobacterium
AAPRAARPISRITDPVQ

SEQ ID NO: 626379 - protein, 17 aa, Mycobacterium
AAPRFTVHRQLGAGHNI

SEQ ID NO: 626380 - protein, 23 aa, Mycobacterium
AAPRITISVPDGWTSTPGSGATA

SEQ ID NO: 626381 - protein, 21 aa, Mycobacterium
AAPRRLKLAVAEAAGTIAEVA

SEQ ID NO: 626382 - protein, 25 aa, Mycobacterium
AAPRRWRSQLPLWGDVSFESVAPAL

SEQ ID NO: 626383 - protein, 20 aa, Mycobacterium
AAPRSASVVNRWLRELPASG

SEQ ID NO: 626384 - protein, 23 aa, Mycobacterium
AAPRVSVPILMMCNGTDDAVPTS

SEQ ID NO: 626385 - protein, 24 aa, Mycobacterium
AAPSGLPYRMSCQAGLPLGAQAAE

SEQ ID NO: 626386 - protein, 22 aa, Mycobacterium
AAPSGWRVGGVTAPVRTAMQTP

SEQ ID NO: 626387 - protein, 27 aa, Mycobacterium
AAPSLYCLTEPIPPGSYVGIAGRFGFK

SEQ ID NO: 626388 - protein, 26 aa, Mycobacterium
AAPSSRPVSNWSPHDRDPFSPPAAGV

SEQ ID NO: 626389 - protein, 18 aa, Mycobacterium
AAPSVGLMQPWRFIRITD

SEQ ID NO: 626390 - protein, 17 aa, Mycobacterium
AAPSVGLMQPWRIIRIT

SEQ ID NO: 626391 - protein, 25 aa, Mycobacterium
AAPTGARLLLCEFVIPEHDRDFHGK

SEQ ID NO: 626392 - protein, 17 aa, Mycobacterium
AAPTLGAGLDWKTSLQE

SEQ ID NO: 626393 - protein, 18 aa, Mycobacterium
AAPTWKKSFGHHPLLAFL

SEQ ID NO: 626394 - protein, 18 aa, Mycobacterium
AAPVKWPGSQRCRSFPTL

SEQ ID NO: 626395 - protein, 23 aa, Mycobacterium
AAPVKYPAGFFGVFTGSYDIEAA

SEQ ID NO: 626396 - protein, 22 aa, Mycobacterium
AAPWLGESDFRLDDFRAQVETD

SEQ ID NO: 626397 - protein, 18 aa, Mycobacterium
AAPYAAALGRAFQLTNFI

SEQ ID NO: 626398 - protein, 20 aa, Mycobacterium
AAPYAGWLNVAAARAAGAAD

SEQ ID NO: 626399 - protein, 18 aa, Mycobacterium
AAPYASWLNAAAAGAQSA

SEQ ID NO: 626400 - protein, 21 aa, Mycobacterium
AAPYSAWLSVAAARAQSAAGQ

SEQ ID NO: 626401 - protein, 20 aa, Mycobacterium
AAPYTGWLSAAAARAVGASA

SEQ ID NO: 626402 - protein, 20 aa, Mycobacterium
AAQAAWRRVLAGFDTPTLVG

SEQ ID NO: 626403 - protein, 19 aa, Mycobacterium
AAQAGRLGAYLADHPDLAV

SEQ ID NO: 626404 - protein, 20 aa, Mycobacterium
AAQAIRVAKEFARSAEESGG

SEQ ID NO: 626405 - protein, 17 aa, Mycobacterium
AAQALIERGWRFERTKV

SEQ ID NO: 626406 - protein, 18 aa, Mycobacterium
AAQAWSEGRFARDVVPIK

SEQ ID NO: 626407 - protein, 19 aa, Mycobacterium
AAQDPRIAAAVSMTPATDG

SEQ ID NO: 626408 - protein, 21 aa, Mycobacterium
AAQEACSFSEVTIVPQFGTMP

SEQ ID NO: 626409 - protein, 32 aa, Mycobacterium
AAQFPHLRALAVRPAIIWKIYLASAEQSQLGP

SEQ ID NO: 626410 - protein, 24 aa, Mycobacterium
AAQFSQWGALLARTDPSAPKHSGI

SEQ ID NO: 626411 - protein, 17 aa, Mycobacterium
AAQGHAALREWAQALDV

SEQ ID NO: 626412 - protein, 18 aa, Mycobacterium
AAQGLGLGANELIKHLAT

SEQ ID NO: 626413 - protein, 25 aa, Mycobacterium
AAQGRAVYCWGVDEYEDFDFCRDVG

SEQ ID NO: 626414 - protein, 20 aa, Mycobacterium
AAQGRAVYCWNVDEYDDVEF

SEQ ID NO: 626415 - protein, 19 aa, Mycobacterium
AAQGRLDLGSVLIPMPDGG

SEQ ID NO: 626416 - protein, 20 aa, Mycobacterium
AAQGSYLWDGDGNRLLDFSS

SEQ ID NO: 626417 - protein, 27 aa, Mycobacterium
AAQGVLCGSVLSGLRVQPGHWAGAHNC

SEQ ID NO: 626418 - protein, 26 aa, Mycobacterium
AAQGVSCAGLVIGSWPAHPSLVETSN

SEQ ID NO: 626419 - protein, 25 aa, Mycobacterium
AAQIKRLKVGAARRFSATTPRSLVA

SEQ ID NO: 626420 - protein, 20 aa, Mycobacterium
AAQILVSWSHPGRCRDEAAF

SEQ ID NO: 626421 - protein, 23 aa, Mycobacterium
AAQIRLAGARVRLRALRALVDET

SEQ ID NO: 626422 - protein, 25 aa, Mycobacterium
AAQIRSIPTLMAFKKGKLLFNQPGA

SEQ ID NO: 626423 - protein, 25 aa, Mycobacterium
AAQIRSIPTLMAFKKGQLLFNQPGA

SEQ ID NO: 626424 - protein, 17 aa, Mycobacterium
AAQLGIELLPLDDLLAR

SEQ ID NO: 626425 - protein, 25 aa, Mycobacterium
AAQLIEIGQLFAYRLSRCSETEDWA

SEQ ID NO: 626426 - protein, 22 aa, Mycobacterium
AAQLMIDLFWYGLKGSPEEREA

SEQ ID NO: 626427 - protein, 25 aa, Mycobacterium
AAQLPRIAAMGFDVVYLPPIHPIGK

SEQ ID NO: 626428 - protein, 25 aa, Mycobacterium
AAQLPRIGVDLENIAVALAEAQRSA

SEQ ID NO: 626429 - protein, 23 aa, Mycobacterium
AAQLQAVPGWCWHHQDCPAGHCC

SEQ ID NO: 626430 - protein, 22 aa, Mycobacterium
AAQLRADYFVADFADLSQVRAL

SEQ ID NO: 626431 - protein, 17 aa, Mycobacterium
AAQLRTLLRTVVDGHEV

SEQ ID NO: 626432 - protein, 18 aa, Mycobacterium
AAQLWIGTSWKMNKGLAE

SEQ ID NO: 626433 - protein, 17 aa, Mycobacterium
AAQMTAFHDRFVQALTA

SEQ ID NO: 626434 - protein, 20 aa, Mycobacterium
AAQPPPSFAPGLPSLGAMPG

SEQ ID NO: 626435 - protein, 19 aa, Mycobacterium
AAQPYRLAVIRADITDSET

SEQ ID NO: 626436 - protein, 19 aa, Mycobacterium
AAQQAEWRRGTLPPGQLGW

SEQ ID NO: 626437 - protein, 18 aa, Mycobacterium
AAQQLGIPMHAIAPAEAA

SEQ ID NO: 626438 - protein, 26 aa, Mycobacterium
AAQQSWPTVAAWVKWLSTGGDKPDGI

SEQ ID NO: 626439 - protein, 17 aa, Mycobacterium
AAQRAGIELLALGGRFI

SEQ ID NO: 626440 - protein, 31 aa, Mycobacterium
AAQRANCRLVVLGEGRFREHLEDIAGPETTF

SEQ ID NO: 626441 - protein, 18 aa, Mycobacterium
AAQRDGWPRDGLHGTGPA

SEQ ID NO: 626442 - protein, 22 aa, Mycobacterium
AAQRDWLDIRWCAEDDDSGFYR

SEQ ID NO: 626443 - protein, 20 aa, Mycobacterium
AAQREFAEELGLPVPAGPRV

SEQ ID NO: 626444 - protein, 18 aa, Mycobacterium
AAQREFSEELGLSVPAGH

SEQ ID NO: 626445 - protein, 25 aa, Mycobacterium
AAQRFADAVTAIWQGRIEIDRFNEL

SEQ ID NO: 626446 - protein, 28 aa, Mycobacterium
AAQRFSFCSLCFRGGWRAIVQLRVGRMT

SEQ ID NO: 626447 - protein, 24 aa, Mycobacterium
AAQRFYAQQLSVWQGCKLTDVTVS

SEQ ID NO: 626448 - protein, 23 aa, Mycobacterium
AAQRGLSEAVVRDISAKKNEPEW

SEQ ID NO: 626449 - protein, 17 aa, Mycobacterium
AAQRGRMVGGLIGAAMV

SEQ ID NO: 626450 - protein, 18 aa, Mycobacterium
AAQRGWELRVDSIGNMFA

SEQ ID NO: 626451 - protein, 22 aa, Mycobacterium
AAQRILSLLARHRVDQQEAVAT

SEQ ID NO: 626452 - protein, 22 aa, Mycobacterium
AAQRIPGALAHPGSPADPAVAD

SEQ ID NO: 626453 - protein, 22 aa, Mycobacterium
AAQRLAAEGAHVFLTGRNQATI

SEQ ID NO: 626454 - protein, 22 aa, Mycobacterium
AAQRLGAARAEWEDSVNETRNI

SEQ ID NO: 626455 - protein, 22 aa, Mycobacterium
AAQRLGSRFRLLDFDCNHMVPY

SEQ ID NO: 626456 - protein, 23 aa, Mycobacterium
AAQRLRFPVEVVRAVRAAVGPDF

SEQ ID NO: 626457 - protein, 22 aa, Mycobacterium
AAQRTAASWQEWRNDRVTQAAV

SEQ ID NO: 626458 - protein, 17 aa, Mycobacterium
AAQRVAAVLQEMTTDFE

SEQ ID NO: 626459 - protein, 19 aa, Mycobacterium
AAQRWGIAVGDRVVSEQIV

SEQ ID NO: 626460 - protein, 17 aa, Mycobacterium
AAQRWGVATNHDRILLC

SEQ ID NO: 626461 - protein, 30 aa, Mycobacterium
AAQSARFAESFLRLGLVSGIGGAWFLTRIV

SEQ ID NO: 626462 - protein, 19 aa, Mycobacterium
AAQSHDWDAWVQHYTPDVL

SEQ ID NO: 626463 - protein, 22 aa, Mycobacterium
AAQSWDLVRDGIFTGYQLDRVF

SEQ ID NO: 626464 - protein, 19 aa, Mycobacterium
AAQSWDLVRDGVFVGYQLD

SEQ ID NO: 626465 - protein, 17 aa, Mycobacterium
AAQTAKELFVFQRTANY

SEQ ID NO: 626466 - protein, 19 aa, Mycobacterium
AAQTFKAQALAAASNAAGA

SEQ ID NO: 626467 - protein, 19 aa, Mycobacterium
AAQTWDLVRDGIFVGYQLD

SEQ ID NO: 626468 - protein, 23 aa, Mycobacterium
AAQVCAELALPHIVLARPPWDPG

SEQ ID NO: 626469 - protein, 24 aa, Mycobacterium
AAQVCRDQHRVGGYRRCPHGKQLW

SEQ ID NO: 626470 - protein, 23 aa, Mycobacterium
AAQVCRWLLTSRLEFIEDRNRHP

SEQ ID NO: 626471 - protein, 19 aa, Mycobacterium
AAQVQGWNRRLRCVEETTP

SEQ ID NO: 626472 - protein, 26 aa, Mycobacterium
AAQYCFPHLRFIASVGEPLDPEAVWW

SEQ ID NO: 626473 - protein, 18 aa, Mycobacterium
AAQYLRRALDCFLSCQVR

SEQ ID NO: 626474 - protein, 26 aa, Mycobacterium
AAQYQEVMSTYGIYSIDFDDEGAILT

SEQ ID NO: 626475 - protein, 25 aa, Mycobacterium
AAQYRIRLGGTWKKPGTSDIEIVCA

SEQ ID NO: 626476 - protein, 24 aa, Mycobacterium
AAQYSQWGALLARTDPNAPKHNGI

SEQ ID NO: 626477 - protein, 23 aa, Mycobacterium
AARAAEAVALLALIAGQDVEPVE

SEQ ID NO: 626478 - protein, 23 aa, Mycobacterium
AARAAFESGSWSRLAPAERSRVL

SEQ ID NO: 626479 - protein, 27 aa, Mycobacterium
AARAAGFDAVEFWWPFAEATPSDREVD

SEQ ID NO: 626480 - protein, 22 aa, Mycobacterium
AARAAGVRVVHCLVQRRPDGLG

SEQ ID NO: 626481 - protein, 29 aa, Mycobacterium
AARAANALIRWLAELGVSIAGTHALRVRG

SEQ ID NO: 626482 - protein, 21 aa, Mycobacterium
AARAFRPTSVRKFLTDTVREK

SEQ ID NO: 626483 - protein, 22 aa, Mycobacterium
AARAGEMLDLVAAYAADPLDPA

SEQ ID NO: 626484 - protein, 23 aa, Mycobacterium
AARAKASFESGVWSDLPGRERAK

SEQ ID NO: 626485 - protein, 26 aa, Mycobacterium
AARALIAVRGLHRFAAIEGLAPTDVA

SEQ ID NO: 626486 - protein, 25 aa, Mycobacterium
AARALKELFDQLGLGRVPLVGNSLG

SEQ ID NO: 626487 - protein, 26 aa, Mycobacterium
AARAPRVSTVIKVDWRSGVTDAMTEK

SEQ ID NO: 626488 - protein, 24 aa, Mycobacterium
AARARASFEAGVWSQLPGRERAKV

SEQ ID NO: 626489 - protein, 23 aa, Mycobacterium
AARARLTSDFAWHTVAAETAQVY

SEQ ID NO: 626490 - protein, 23 aa, Mycobacterium
AARAVLAWDGLRITSPGRLRPCA

SEQ ID NO: 626491 - protein, 20 aa, Mycobacterium
AARAWLLQAMTGRRASEILM

SEQ ID NO: 626492 - protein, 20 aa, Mycobacterium
AARAYPDLKRTTLGAELGGA

SEQ ID NO: 626493 - protein, 19 aa, Mycobacterium
AARCGKAASLVEYLLNAGR

SEQ ID NO: 626494 - protein, 19 aa, Mycobacterium
AARDCGAVEITVRGVDLDP

SEQ ID NO: 626495 - protein, 23 aa, Mycobacterium
AARDFATTLQLIGTNALAGATQD

SEQ ID NO: 626496 - protein, 17 aa, Mycobacterium
AARDGGHGWWTLSQLDS

SEQ ID NO: 626497 - protein, 18 aa, Mycobacterium
AARDGGYLPLSFAASNIA

SEQ ID NO: 626498 - protein, 18 aa, Mycobacterium
AARDGLSYFAEFRTQSCI

SEQ ID NO: 626499 - protein, 22 aa, Mycobacterium
AARDLRVVFSRLRRRLRELATD

SEQ ID NO: 626500 - protein, 17 aa, Mycobacterium
AARDRGADRLSIADTIG

SEQ ID NO: 626501 - protein, 19 aa, Mycobacterium
AARDWKIEAVRQHFSEGPV

SEQ ID NO: 626502 - protein, 21 aa, Mycobacterium
AAREARRAQAHISGRARIAGA

SEQ ID NO: 626503 - protein, 20 aa, Mycobacterium
AARECLRTALEYAQTREQFD

SEQ ID NO: 626504 - protein, 20 aa, Mycobacterium
AAREPERFAGLTLMVPATAW

SEQ ID NO: 626505 - protein, 18 aa, Mycobacterium
AARESLRSAHGLLLVVDD

SEQ ID NO: 626506 - protein, 26 aa, Mycobacterium
AAREVAEPLGGLALTCDVSDPDQVNV

SEQ ID NO: 626507 - protein, 18 aa, Mycobacterium
AARFCPPEPCAAGERGQV

SEQ ID NO: 626508 - protein, 25 aa, Mycobacterium
AARFIRTCDCFGIPIITLEDVPGFL

SEQ ID NO: 626509 - protein, 22 aa, Mycobacterium
AARFLAVPAAASWAEAATEVTE

SEQ ID NO: 626510 - protein, 17 aa, Mycobacterium
AARFRLGPQALDAREAL

SEQ ID NO: 626511 - protein, 18 aa, Mycobacterium
AARFVPNPAAAALEAQVY

SEQ ID NO: 626512 - protein, 17 aa, Mycobacterium
AARFVRTCDCFNIPIIM

SEQ ID NO: 626513 - protein, 17 aa, Mycobacterium
AARFVRTCDCFNIPIVM

SEQ ID NO: 626514 - protein, 17 aa, Mycobacterium
AARGELRAGFDAAALLE

SEQ ID NO: 626515 - protein, 19 aa, Mycobacterium
AARGHRYRILGLPKSGAEE

SEQ ID NO: 626516 - protein, 17 aa, Mycobacterium
AARGIAADAARAAHRLV

SEQ ID NO: 626517 - protein, 23 aa, Mycobacterium
AARGLRCIAPTWPLGAHPEPLRR

SEQ ID NO: 626518 - protein, 27 aa, Mycobacterium
AARGLRFAVTVGGLYIDYSKHRVTAET

SEQ ID NO: 626519 - protein, 25 aa, Mycobacterium
AARGNIELMDWIKAVAGTARRLVTV

SEQ ID NO: 626520 - protein, 22 aa, Mycobacterium
AARGYHKLATWLGATADAIDAC

SEQ ID NO: 626521 - protein, 19 aa, Mycobacterium
AARGYKCVLTMPDTMSIER

SEQ ID NO: 626522 - protein, 24 aa, Mycobacterium
AARHGIDAPMHWPGLGEVPTRELV

SEQ ID NO: 626523 - protein, 17 aa, Mycobacterium
AARHIFDGSAGRVLAHA

SEQ ID NO: 626524 - protein, 19 aa, Mycobacterium
AARHIRSAALGLIALGVQA

SEQ ID NO: 626525 - protein, 20 aa, Mycobacterium
AARIDHRWNDFVVGGLGIRC

SEQ ID NO: 626526 - protein, 17 aa, Mycobacterium
AARITLRTVDELEALGK

SEQ ID NO: 626527 - protein, 24 aa, Mycobacterium
AARIVAARVMHEWLVLEVAGDVAG

SEQ ID NO: 626528 - protein, 22 aa, Mycobacterium
AARKLFAERGFHGTTLSDITSA

SEQ ID NO: 626529 - protein, 22 aa, Mycobacterium
AARKRLLEIAGRPGNPVICTQG

SEQ ID NO: 626530 - protein, 18 aa, Mycobacterium
AARKVWDKADKFTRDRLG

SEQ ID NO: 626531 - protein, 18 aa, Mycobacterium
AARKVWDKADKFTRDTLG

SEQ ID NO: 626532 - protein, 18 aa, Mycobacterium
AARKVWDKADKFTRETLG

SEQ ID NO: 626533 - protein, 21 aa, Mycobacterium
AARLAYDVFIHRLRKYIGAYL

SEQ ID NO: 626534 - protein, 20 aa, Mycobacterium
AARLEFVLGDAAPIAAVTTA

SEQ ID NO: 626535 - protein, 20 aa, Mycobacterium
AARLHLPSRIDAIRYALRAQ

SEQ ID NO: 626536 - protein, 22 aa, Mycobacterium
AARLPGYMLPSAIVTVESLPLT

SEQ ID NO: 626537 - protein, 20 aa, Mycobacterium
AARLSGLVVLGPDGESIGRV

SEQ ID NO: 626538 - protein, 26 aa, Mycobacterium
AARLSQLWFEALAGICAHVQAGGGGL

SEQ ID NO: 626539 - protein, 18 aa, Mycobacterium
AARLSVVVEARWRADALA

SEQ ID NO: 626540 - protein, 17 aa, Mycobacterium
AARLTGWRIDIRGDSPE

SEQ ID NO: 626541 - protein, 17 aa, Mycobacterium
AARLTGWRIDIRGDSPG

SEQ ID NO: 626542 - protein, 17 aa, Mycobacterium
AARLTGWRIDIRGDTPG

SEQ ID NO: 626543 - protein, 17 aa, Mycobacterium
AARLTGWRIDIRSDDAD

SEQ ID NO: 626544 - protein, 23 aa, Mycobacterium
AARLTRSYLDLALDGAVADCERA

SEQ ID NO: 626545 - protein, 17 aa, Mycobacterium
AARLTVVSIADWADDAV

SEQ ID NO: 626546 - protein, 18 aa, Mycobacterium
AARMRAAAVAAAVAESGR

SEQ ID NO: 626547 - protein, 24 aa, Mycobacterium
AARNGRISFFGGLPKTDPTITCDS

SEQ ID NO: 626548 - protein, 24 aa, Mycobacterium
AARNSQSWRFAPFFHALLDAGVYP

SEQ ID NO: 626549 - protein, 17 aa, Mycobacterium
AARPARAAADAAGAAVP

SEQ ID NO: 626550 - protein, 22 aa, Mycobacterium
AARPDCVLLDLNLPDASGIDAL

SEQ ID NO: 626551 - protein, 22 aa, Mycobacterium
AARPFAKAAFRVNRIEDIGRGV

SEQ ID NO: 626552 - protein, 24 aa, Mycobacterium
AARPSELAQLMMLSTRLEMASVYA

SEQ ID NO: 626553 - protein, 24 aa, Mycobacterium
AARQAADLFAWLGPAPDAVVGAAE

SEQ ID NO: 626554 - protein, 17 aa, Mycobacterium
AARQLGMGTIFVSRPHE

SEQ ID NO: 626555 - protein, 26 aa, Mycobacterium
AARRAARFGLPFSPPMAMPELAAVYQ

SEQ ID NO: 626556 - protein, 32 aa, Mycobacterium
AARRACEYEDLGLFGWCLIELVEAAARSGQKD

SEQ ID NO: 626557 - protein, 24 aa, Mycobacterium
AARRADVAIVFAIRAEGEGFDIAD

SEQ ID NO: 626558 - protein, 24 aa, Mycobacterium
AARRAEVAIVFAIRPEGEGFDSAD

SEQ ID NO: 626559 - protein, 20 aa, Mycobacterium
AARRFRWDAVIEGRPVITAA

SEQ ID NO: 626560 - protein, 22 aa, Mycobacterium
AARRFYERSGWRADGGCRTGTF

SEQ ID NO: 626561 - protein, 17 aa, Mycobacterium
AARRGGEWLEWFTEQDI

SEQ ID NO: 626562 - protein, 33 aa, Mycobacterium
AARRGLLLLTCGAWGQVVRFIPALVVSADEVEE

SEQ ID NO: 626563 - protein, 22 aa, Mycobacterium
AARRGLVPGPLRFVRAIGNYYR

SEQ ID NO: 626564 - protein, 17 aa, Mycobacterium
AARRIPITAVSTSGRQT

SEQ ID NO: 626565 - protein, 21 aa, Mycobacterium
AARRKCLSWGQIGTILGVSRQ

SEQ ID NO: 626566 - protein, 20 aa, Mycobacterium
AARRLGVDVRFVLRGDSTLR

SEQ ID NO: 626567 - protein, 23 aa, Mycobacterium
AARRLGVPEERWVFLHGHADMVD

SEQ ID NO: 626568 - protein, 18 aa, Mycobacterium
AARRRWAAAHGISESDLP

SEQ ID NO: 626569 - protein, 22 aa, Mycobacterium
AARRSHTKPGLAENAKDIPVQS

SEQ ID NO: 626570 - protein, 24 aa, Mycobacterium
AARRYCERFGFGFVMYVGDSCARD

SEQ ID NO: 626571 - protein, 24 aa, Mycobacterium
AARSCRGCALYADAARTVFGHGTC

SEQ ID NO: 626572 - protein, 20 aa, Mycobacterium
AARSPEGWVTVGDVGYLDDD

SEQ ID NO: 626573 - protein, 25 aa, Mycobacterium
AARSRLPVYGAGYGPKVLDLIGRHA

SEQ ID NO: 626574 - protein, 25 aa, Mycobacterium
AARSWRLVNVLSLTGASLVETARRA

SEQ ID NO: 626575 - protein, 21 aa, Mycobacterium
AARTFKAAALAAAAAAPGAVD

SEQ ID NO: 626576 - protein, 25 aa, Mycobacterium
AARTPRLNCFGLHEWAMVYRTDHVR

SEQ ID NO: 626577 - protein, 18 aa, Mycobacterium
AARTRMAVLDAMGTDERS

SEQ ID NO: 626578 - protein, 25 aa, Mycobacterium
AARTWEVHGGTSLAGYVVPHRPIAE

SEQ ID NO: 626579 - protein, 18 aa, Mycobacterium
AARVDRLGAELATAATGL

SEQ ID NO: 626580 - protein, 23 aa, Mycobacterium
AARVFPRVAAMPCQPTANHPADM

SEQ ID NO: 626581 - protein, 26 aa, Mycobacterium
AARVGIWSPNTWHWVVACLAIHHVGA

SEQ ID NO: 626582 - protein, 26 aa, Mycobacterium
AARVHLPLRIFACGGAAVPRAVMEHS

SEQ ID NO: 626583 - protein, 23 aa, Mycobacterium
AARVKRVTLELGGKSANIVFADC

SEQ ID NO: 626584 - protein, 18 aa, Mycobacterium
AARVLRFNRAMTLLNQPG

SEQ ID NO: 626585 - protein, 24 aa, Mycobacterium
AARVLRPRGRYAIHELALTPDDVP

SEQ ID NO: 626586 - protein, 18 aa, Mycobacterium
AARVPRLLFLGSSCIYPK

SEQ ID NO: 626587 - protein, 17 aa, Mycobacterium
AARVVWLVANGFATPSQ

SEQ ID NO: 626588 - protein, 17 aa, Mycobacterium
AARVVWLVANGYAEPGQ

SEQ ID NO: 626589 - protein, 17 aa, Mycobacterium
AARVVWLVANGYATPGQ

SEQ ID NO: 626590 - protein, 18 aa, Mycobacterium
AARWADVVTGRIHAPAVI

SEQ ID NO: 626591 - protein, 24 aa, Mycobacterium
AARWPRAGALGPLIRDPDGSVYPS

SEQ ID NO: 626592 - protein, 18 aa, Mycobacterium
AARYDGWIGDLIKTDRAI

SEQ ID NO: 626593 - protein, 18 aa, Mycobacterium
AARYDGWIGDLIKTERAI

SEQ ID NO: 626594 - protein, 27 aa, Mycobacterium
AARYLYPRVEVEVGFILAGDLPGADCT

SEQ ID NO: 626595 - protein, 19 aa, Mycobacterium
AARYRRWLAALRGGARLVI

SEQ ID NO: 626596 - protein, 18 aa, Mycobacterium
AARYRRWLAALRGTARLV

SEQ ID NO: 626597 - protein, 19 aa, Mycobacterium
AASAATWCGVLVACGPRDA

SEQ ID NO: 626598 - protein, 19 aa, Mycobacterium
AASACARNAAALFVPCHRV

SEQ ID NO: 626599 - protein, 19 aa, Mycobacterium
AASAPVFLQYPWGVLPENM

SEQ ID NO: 626600 - protein, 24 aa, Mycobacterium
AASARLAGLLIQRGLRPGDRVGVM

SEQ ID NO: 626601 - protein, 18 aa, Mycobacterium
AASARLLAAKGAKVVIAD

SEQ ID NO: 626602 - protein, 25 aa, Mycobacterium
AASARRLTRFGALVRVPRSVEALGR

SEQ ID NO: 626603 - protein, 25 aa, Mycobacterium
AASARRWGLNDGDAVVVYDDWNGQA

SEQ ID NO: 626604 - protein, 19 aa, Mycobacterium
AASASPLAGLLAAINAPVQ

SEQ ID NO: 626605 - protein, 18 aa, Mycobacterium
AASATGWTTGTKTYNGAL

SEQ ID NO: 626606 - protein, 18 aa, Mycobacterium
AASAWGKHLFHHYAGGPV

SEQ ID NO: 626607 - protein, 21 aa, Mycobacterium
AASCFPNLSLVHNWPRIQDGD

SEQ ID NO: 626608 - protein, 17 aa, Mycobacterium
AASCGPGNLHLINGLFD

SEQ ID NO: 626609 - protein, 24 aa, Mycobacterium
AASCSAATILTPFGRPPRITSDGG

SEQ ID NO: 626610 - protein, 23 aa, Mycobacterium
AASDARFAWAKNIEFAIFGLEND

SEQ ID NO: 626611 - protein, 22 aa, Mycobacterium
AASDFRIMWDNAYAVHTLTRDF

SEQ ID NO: 626612 - protein, 17 aa, Mycobacterium
AASDGFKALGGGPGADP

SEQ ID NO: 626613 - protein, 26 aa, Mycobacterium
AASDIEVRWAPSMAHAERELDFARPD

SEQ ID NO: 626614 - protein, 20 aa, Mycobacterium
AASDPRIWPNIVAKKLDWDL

SEQ ID NO: 626615 - protein, 26 aa, Mycobacterium
AASDQAPRAWRMRIFVQKTDGQVKVS

SEQ ID NO: 626616 - protein, 24 aa, Mycobacterium
AASDRPLPWAAMHKLTAPTLLTWG

SEQ ID NO: 626617 - protein, 23 aa, Mycobacterium
AASEGRFGRRYAPHAVGPDPYKG

SEQ ID NO: 626618 - protein, 24 aa, Mycobacterium
AASERKILWCSPTREQAEDAVTNE

SEQ ID NO: 626619 - protein, 18 aa, Mycobacterium
AASFSDLQVSRSLDAFSQ

SEQ ID NO: 626620 - protein, 25 aa, Mycobacterium
AASGIRREAFCPCYGLAEHTVGITV

SEQ ID NO: 626621 - protein, 19 aa, Mycobacterium
AASGLGVRTVFGAELSLGP

SEQ ID NO: 626622 - protein, 21 aa, Mycobacterium
AASGRPGPVLVDIPKDVLQGQ

SEQ ID NO: 626623 - protein, 21 aa, Mycobacterium
AASGVRLVWARSMAHAEQVFA

SEQ ID NO: 626624 - protein, 19 aa, Mycobacterium
AASHADLPPAVIVTAGLDP

SEQ ID NO: 626625 - protein, 22 aa, Mycobacterium
AASHGIPLWRYLIGDKPAAMPL

SEQ ID NO: 626626 - protein, 25 aa, Mycobacterium
AASIATWVGFLGFFVNRFEPLTWVE

SEQ ID NO: 626627 - protein, 19 aa, Mycobacterium
AASICLKQLTGFGAVTAER

SEQ ID NO: 626628 - protein, 19 aa, Mycobacterium
AASIGGLAVPAAWASAAPA

SEQ ID NO: 626629 - protein, 18 aa, Mycobacterium
AASIGTWLIAGFDELAAK

SEQ ID NO: 626630 - protein, 27 aa, Mycobacterium
AASIKEAICKGTLWAIRREAAKPGSYR

SEQ ID NO: 626631 - protein, 18 aa, Mycobacterium
AASKCWASDVAMEVTTDA

SEQ ID NO: 626632 - protein, 22 aa, Mycobacterium
AASKELAYLGVRVNAIQPGLIR

SEQ ID NO: 626633 - protein, 17 aa, Mycobacterium
AASKLVFEVFRDTTPLV

SEQ ID NO: 626634 - protein, 17 aa, Mycobacterium
AASKRARTLTVKFATPK

SEQ ID NO: 626635 - protein, 20 aa, Mycobacterium
AASLAVWGVTCMRPTRPGRR

SEQ ID NO: 626636 - protein, 24 aa, Mycobacterium
AASLELLHAFALLQDDVMDQSPQR

SEQ ID NO: 626637 - protein, 24 aa, Mycobacterium
AASLELLHAFALLQDDVMDRSSQR

SEQ ID NO: 626638 - protein, 24 aa, Mycobacterium
AASLHAGHLVPLLTLSRFQRAGHR

SEQ ID NO: 626639 - protein, 22 aa, Mycobacterium
AASLKLPLVLVIDTAGPALSTE

SEQ ID NO: 626640 - protein, 18 aa, Mycobacterium
AASLLGLVRRERPQLAIV

SEQ ID NO: 626641 - protein, 25 aa, Mycobacterium
AASLLRNRFPAGMPADQVVTIIAAI

SEQ ID NO: 626642 - protein, 25 aa, Mycobacterium
AASLPELLGALAIQSVAGVVDQTQR

SEQ ID NO: 626643 - protein, 24 aa, Mycobacterium
AASLPEWTPVAALPAPTGMLCWTK

SEQ ID NO: 626644 - protein, 20 aa, Mycobacterium
AASLPVEKAWMVPESASHVL

SEQ ID NO: 626645 - protein, 19 aa, Mycobacterium
AASLRDGRATLALPGGLRW

SEQ ID NO: 626646 - protein, 18 aa, Mycobacterium
AASLVHRAEACGFKGIAV

SEQ ID NO: 626647 - protein, 17 aa, Mycobacterium
AASLVRRGAAAAATVAE

SEQ ID NO: 626648 - protein, 33 aa, Mycobacterium
AASMGYESWWRRAESVGFCAHPIQLIGADEYGR

SEQ ID NO: 626649 - protein, 18 aa, Mycobacterium
AASNARRDAASGSAGSAV

SEQ ID NO: 626650 - protein, 17 aa, Mycobacterium
AASNVPVELAWKRVRDG

SEQ ID NO: 626651 - protein, 25 aa, Mycobacterium
AASPAARAVLAWDALRINSPGRLRA

SEQ ID NO: 626652 - protein, 31 aa, Mycobacterium
AASPATWIDWLVNWYLPISQLFYNTVGLPYF

SEQ ID NO: 626653 - protein, 25 aa, Mycobacterium
AASPKETWLRLLLIDAGFPAPETQI

SEQ ID NO: 626654 - protein, 22 aa, Mycobacterium
AASPLTWFANYDIRYVDGAVPA

SEQ ID NO: 626655 - protein, 25 aa, Mycobacterium
AASPRETWLRLLLIDAGFPTPSTQL

SEQ ID NO: 626656 - protein, 27 aa, Mycobacterium
AASPRETWLRMVLIDAGLPVPVTQIPV

SEQ ID NO: 626657 - protein, 29 aa, Mycobacterium
AASPRIVSLPGYPFARQRHWVEPKHMAWA

SEQ ID NO: 626658 - protein, 23 aa, Mycobacterium
AASPRLRLVGVAGYEAAVAQSLD

SEQ ID NO: 626659 - protein, 18 aa, Mycobacterium
AASPTRGLGRRSSDNDDK

SEQ ID NO: 626660 - protein, 21 aa, Mycobacterium
AASPWAPYHVEHGYAPDDSTV

SEQ ID NO: 626661 - protein, 18 aa, Mycobacterium
AASQCGWLKDRYGLSWQV

SEQ ID NO: 626662 - protein, 26 aa, Mycobacterium
AASQSAWPQHLWPALSTAGFANELRN

SEQ ID NO: 626663 - protein, 24 aa, Mycobacterium
AASRAFIPHSVWQQMGDTFLDTAA

SEQ ID NO: 626664 - protein, 25 aa, Mycobacterium
AASRAFIPQSVWRRMGDDFLGETAA

SEQ ID NO: 626665 - protein, 25 aa, Mycobacterium
AASRAFIPRSVWQKMGDDFLSATEA

SEQ ID NO: 626666 - protein, 19 aa, Mycobacterium
AASRAFVAHSVWQRMGDAF

SEQ ID NO: 626667 - protein, 19 aa, Mycobacterium
AASRMTGGPGLCIGTLGPG

SEQ ID NO: 626668 - protein, 17 aa, Mycobacterium
AASRPAKAAPRVVTRPS

SEQ ID NO: 626669 - protein, 17 aa, Mycobacterium
AASRPMAALGYFDAGAL

SEQ ID NO: 626670 - protein, 23 aa, Mycobacterium
AASRPPSSFQWGWNNLPVDVHGV

SEQ ID NO: 626671 - protein, 17 aa, Mycobacterium
AASRWGSQISTLILPAD

SEQ ID NO: 626672 - protein, 28 aa, Mycobacterium
AASSCQSVIWGLAFGQWVGASASLMGAA

SEQ ID NO: 626673 - protein, 18 aa, Mycobacterium
AASSGLWNSGVAAAGNSG

SEQ ID NO: 626674 - protein, 23 aa, Mycobacterium
AASSRAAAQLVIFDLDGTLTDSA

SEQ ID NO: 626675 - protein, 18 aa, Mycobacterium
AASTRLLILAGVLVAEGL

SEQ ID NO: 626676 - protein, 21 aa, Mycobacterium
AASTSRWLVAVRMVSEGVDVP

SEQ ID NO: 626677 - protein, 24 aa, Mycobacterium
AASVEAKAALAQRRLTVTREALNT

SEQ ID NO: 626678 - protein, 21 aa, Mycobacterium
AASVIMEFADQYGLNMPIARE

SEQ ID NO: 626679 - protein, 19 aa, Mycobacterium
AASVLMFAPGVPERWRRRV

SEQ ID NO: 626680 - protein, 20 aa, Mycobacterium
AASVVMEFANEYGLNMPIAR

SEQ ID NO: 626681 - protein, 25 aa, Mycobacterium
AASYPRDIAELFVAFLAAHDIEVVS

SEQ ID NO: 626682 - protein, 21 aa, Mycobacterium
AASYRPGEAVQAAFVSALPSN

SEQ ID NO: 626683 - protein, 27 aa, Mycobacterium
AASYSRYYCRLDRPMAEVAAGPRDIVR

SEQ ID NO: 626684 - protein, 23 aa, Mycobacterium
AATACALAHGFTVPDAVSFAKKW

SEQ ID NO: 626685 - protein, 23 aa, Mycobacterium
AATAHLENACALLDGHQVPEIEA

SEQ ID NO: 626686 - protein, 17 aa, Mycobacterium
AATAIEDMGRWAGKEWD

SEQ ID NO: 626687 - protein, 17 aa, Mycobacterium
AATAKWRRHGFEPDFTV

SEQ ID NO: 626688 - protein, 27 aa, Mycobacterium
AATALLATSRAWAWLSGRNYVTPDDVK

SEQ ID NO: 626689 - protein, 24 aa, Mycobacterium
AATAPCRRIRPDVATGLKPMRWGT

SEQ ID NO: 626690 - protein, 33 aa, Mycobacterium
AATAQRWGRYFARARVDVVARGGLLAGTATVDA

SEQ ID NO: 626691 - protein, 18 aa, Mycobacterium
AATARLAEIIAHCETLVA

SEQ ID NO: 626692 - protein, 23 aa, Mycobacterium
AATARLLASQGARVVIADLQAER

SEQ ID NO: 626693 - protein, 18 aa, Mycobacterium
AATARNWHGPGATGDGHA

SEQ ID NO: 626694 - protein, 25 aa, Mycobacterium
AATARRWQRRLPLSGWTVEESDPGV

SEQ ID NO: 626695 - protein, 19 aa, Mycobacterium
AATCSFEQVAYLLWHGELP

SEQ ID NO: 626696 - protein, 18 aa, Mycobacterium
AATEAALTEAVRTGWSGT

SEQ ID NO: 626697 - protein, 24 aa, Mycobacterium
AATEAHYAEMWAQDAAAMYAYAGS

SEQ ID NO: 626698 - protein, 20 aa, Mycobacterium
AATEDAWRRVFAFFGEHLAA

SEQ ID NO: 626699 - protein, 18 aa, Mycobacterium
AATEFTLQAWSGGAIGIG

SEQ ID NO: 626700 - protein, 19 aa, Mycobacterium
AATEFTLQAWSGGIVGLGR

SEQ ID NO: 626701 - protein, 20 aa, Mycobacterium
AATEFTLQAWSGGIVGLGRG

SEQ ID NO: 626702 - protein, 30 aa, Mycobacterium
AATEKISWGRPVFCAPKMFAIYGGSVKGAD

SEQ ID NO: 626703 - protein, 22 aa, Mycobacterium
AATELFPLLLSVMSTGVTFVRS

SEQ ID NO: 626704 - protein, 17 aa, Mycobacterium
AATELIRYAKRTGDDAV

SEQ ID NO: 626705 - protein, 23 aa, Mycobacterium
AATEPRLWLLGSSMYSAHLAAAK

SEQ ID NO: 626706 - protein, 21 aa, Mycobacterium
AATEWVRYRTVGDMTITGAVR

SEQ ID NO: 626707 - protein, 24 aa, Mycobacterium
AATGARAAFIIRFGTGVLPDAKTV

SEQ ID NO: 626708 - protein, 18 aa, Mycobacterium
AATGARMLVTLVYELRRR

SEQ ID NO: 626709 - protein, 22 aa, Mycobacterium
AATGCALLMMVVSPAINGTIIS

SEQ ID NO: 626710 - protein, 19 aa, Mycobacterium
AATGELASFGELQWHDGYA

SEQ ID NO: 626711 - protein, 17 aa, Mycobacterium
AATGGPMYYRGRDMALT

SEQ ID NO: 626712 - protein, 23 aa, Mycobacterium
AATGLESTVRFILSAKSAYVDGQ

SEQ ID NO: 626713 - protein, 21 aa, Mycobacterium
AATGLGMRWTLEASENVDIDN

SEQ ID NO: 626714 - protein, 25 aa, Mycobacterium
AATGLRLPETVGWDYGSISGLAQYL

SEQ ID NO: 626715 - protein, 23 aa, Mycobacterium
AATGRQPRGWMGPGLTETHHTPE

SEQ ID NO: 626716 - protein, 22 aa, Mycobacterium
AATGWLPSPLILAAAVAGRTRN

SEQ ID NO: 626717 - protein, 18 aa, Mycobacterium
AATIAAKAPRVIRALKLT

SEQ ID NO: 626718 - protein, 25 aa, Mycobacterium
AATIDRAVAVPAILQNNKQHVTVYV

SEQ ID NO: 626719 - protein, 24 aa, Mycobacterium
AATISLIHACLAPRHLPIEAIQRF

SEQ ID NO: 626720 - protein, 24 aa, Mycobacterium
AATKGGEVLRHWAAARTALDAWRA

SEQ ID NO: 626721 - protein, 28 aa, Mycobacterium
AATKNPRRVLGLHFFNPVPVLPLVELVS

SEQ ID NO: 626722 - protein, 21 aa, Mycobacterium
AATKRAAFRQGLSSGELLRLP

SEQ ID NO: 626723 - protein, 32 aa, Mycobacterium
AATLAAEMGGLAFKEAFAAWLAADDEQDLGEL

SEQ ID NO: 626724 - protein, 20 aa, Mycobacterium
AATLASLFSRPARGRPVAAW

SEQ ID NO: 626725 - protein, 24 aa, Mycobacterium
AATLCERFEPSVLYGVPNFFARVV

SEQ ID NO: 626726 - protein, 17 aa, Mycobacterium
AATLFYGQLFGWTPEER

SEQ ID NO: 626727 - protein, 20 aa, Mycobacterium
AATLKDPRKAGVGGMTSGAG

SEQ ID NO: 626728 - protein, 25 aa, Mycobacterium
AATLLGVTCSSFLTGASVAELTSGI

SEQ ID NO: 626729 - protein, 19 aa, Mycobacterium
AATLLRLTQRTATACGLAQ

SEQ ID NO: 626730 - protein, 18 aa, Mycobacterium
AATLRAGDQLVLGASNPV

SEQ ID NO: 626731 - protein, 19 aa, Mycobacterium
AATLREAFGHFPTGVVAIA

SEQ ID NO: 626732 - protein, 28 aa, Mycobacterium
AATLRLAPTPPWHTTRWQVTRIGDALVS

SEQ ID NO: 626733 - protein, 23 aa, Mycobacterium
AATLRLGRRAFSHRFAAVCADRP

SEQ ID NO: 626734 - protein, 21 aa, Mycobacterium
AATLRRWNDNVGRDTDPVDPD

SEQ ID NO: 626735 - protein, 19 aa, Mycobacterium
AATLTRIVFEEAMKPDDTG

SEQ ID NO: 626736 - protein, 17 aa, Mycobacterium
AATLWLELARKFLPEAL

SEQ ID NO: 626737 - protein, 18 aa, Mycobacterium
AATLYNWRRTYGSYGGMD

SEQ ID NO: 626738 - protein, 19 aa, Mycobacterium
AATMARLAADRAARSRLAA

SEQ ID NO: 626739 - protein, 23 aa, Mycobacterium
AATPAGGVAQVWVAAGRATALRR

SEQ ID NO: 626740 - protein, 19 aa, Mycobacterium
AATPGRRVVIVGGGYIGLE

SEQ ID NO: 626741 - protein, 17 aa, Mycobacterium
AATPISLTPGLLAEALV

SEQ ID NO: 626742 - protein, 23 aa, Mycobacterium
AATPNVCPTLHMPLQSGSDRILK

SEQ ID NO: 626743 - protein, 22 aa, Mycobacterium
AATPRGGQRLLFSATLDNGVDK

SEQ ID NO: 626744 - protein, 22 aa, Mycobacterium
AATPRMPFVITGVNLHATGARR

SEQ ID NO: 626745 - protein, 17 aa, Mycobacterium
AATQAYGGLLARIASAT

SEQ ID NO: 626746 - protein, 22 aa, Mycobacterium
AATQGCPWYWDAEYGATELIER

SEQ ID NO: 626747 - protein, 19 aa, Mycobacterium
AATRGGWRAAGDRDGKAGT

SEQ ID NO: 626748 - protein, 25 aa, Mycobacterium
AATRHTPFAWPPRTTNTAGLASHAA

SEQ ID NO: 626749 - protein, 24 aa, Mycobacterium
AATRLDKFVGLVVVDRGHPRVADP

SEQ ID NO: 626750 - protein, 17 aa, Mycobacterium
AATRLGPQISTLILPAD

SEQ ID NO: 626751 - protein, 17 aa, Mycobacterium
AATRLIIQDGIYDEFLS

SEQ ID NO: 626752 - protein, 20 aa, Mycobacterium
AATRLLERALRIGQEKDDAD

SEQ ID NO: 626753 - protein, 17 aa, Mycobacterium
AATRLPSSFQWGWNNIP

SEQ ID NO: 626754 - protein, 17 aa, Mycobacterium
AATRPPTFVLFTSGFLE

SEQ ID NO: 626755 - protein, 18 aa, Mycobacterium
AATRRVAALAARQPSPEI

SEQ ID NO: 626756 - protein, 17 aa, Mycobacterium
AATRWHAAVQLIHTEVY

SEQ ID NO: 626757 - protein, 24 aa, Mycobacterium
AATRYAPGGVRSFGPLRASLGLDP

SEQ ID NO: 626758 - protein, 20 aa, Mycobacterium
AATSFFRRSDRFTVAVDDGH

SEQ ID NO: 626759 - protein, 18 aa, Mycobacterium
AATSGRQALIARIGGEEF

SEQ ID NO: 626760 - protein, 30 aa, Mycobacterium
AATSTRPRLAFRTIHGYRRAYRIAGSGPVL

SEQ ID NO: 626761 - protein, 18 aa, Mycobacterium
AATSVHFVAPASIDAGLA

SEQ ID NO: 626762 - protein, 27 aa, Mycobacterium
AATTAIRYPLRWHHVGLIMWSGDQGFD

SEQ ID NO: 626763 - protein, 18 aa, Mycobacterium
AATTLRFEPGITAVVGPN

SEQ ID NO: 626764 - protein, 26 aa, Mycobacterium
AATTRFSVRMKHEFYSLVERHQDGTP

SEQ ID NO: 626765 - protein, 19 aa, Mycobacterium
AATVIERWVQEYLEATNRL

SEQ ID NO: 626766 - protein, 24 aa, Mycobacterium
AATVLPYRQFHGVAEDFQYDIERL

SEQ ID NO: 626767 - protein, 20 aa, Mycobacterium
AATVLRDWRLSLAPNAHVRE

SEQ ID NO: 626768 - protein, 18 aa, Mycobacterium
AATVPPPLIAANRNQLVS

SEQ ID NO: 626769 - protein, 17 aa, Mycobacterium
AATVRLAPMTLPDSAQV

SEQ ID NO: 626770 - protein, 20 aa, Mycobacterium
AATVSPHFPHHVSALTAQAE

SEQ ID NO: 626771 - protein, 18 aa, Mycobacterium
AATVWRIVDPAPRQLPAP

SEQ ID NO: 626772 - protein, 25 aa, Mycobacterium
AATWARGRGWALWKALVSLRGHLEA

SEQ ID NO: 626773 - protein, 18 aa, Mycobacterium
AATWGIAAAMTRGDISVT

SEQ ID NO: 626774 - protein, 22 aa, Mycobacterium
AATWGIAAAMTRGDITVTGVDP

SEQ ID NO: 626775 - protein, 25 aa, Mycobacterium
AAVAAELRGPIWIVTRGAQRVADTD

SEQ ID NO: 626776 - protein, 25 aa, Mycobacterium
AAVAAEVRAGWGFDPVVIPNGVDAQ

SEQ ID NO: 626777 - protein, 22 aa, Mycobacterium
AAVAALGRRVAASARSMAVALS

SEQ ID NO: 626778 - protein, 18 aa, Mycobacterium
AAVAARRGISVSLPSAGG

SEQ ID NO: 626779 - protein, 18 aa, Mycobacterium
AAVAATVPFAMQRVTEMV

SEQ ID NO: 626780 - protein, 25 aa, Mycobacterium
AAVACAAVPSGWRNLRGPSSGFQTK

SEQ ID NO: 626781 - protein, 17 aa, Mycobacterium
AAVACALAHGFTVPDAV

SEQ ID NO: 626782 - protein, 23 aa, Mycobacterium
AAVACARAAYLAGFESTSNLEAQ

SEQ ID NO: 626783 - protein, 20 aa, Mycobacterium
AAVACWKLGAVPQPLSARLP

SEQ ID NO: 626784 - protein, 23 aa, Mycobacterium
AAVADLFAAFGMEPVGCYDLRSA

SEQ ID NO: 626785 - protein, 25 aa, Mycobacterium
AAVADYPARIVAVGADRDCLATEIA

SEQ ID NO: 626786 - protein, 23 aa, Mycobacterium
AAVAEFKPAGFGDGQDAPPSDPR

SEQ ID NO: 626787 - protein, 20 aa, Mycobacterium
AAVAFTHWTERVLPPGSEVA

SEQ ID NO: 626788 - protein, 18 aa, Mycobacterium
AAVAGGYPLNTFPGEPPF

SEQ ID NO: 626789 - protein, 23 aa, Mycobacterium
AAVAGLRPRPEISLTTNGVGLAR

SEQ ID NO: 626790 - protein, 21 aa, Mycobacterium
AAVAIDTLWRGQRLQTLTSLP

SEQ ID NO: 626791 - protein, 19 aa, Mycobacterium
AAVAKFGGLHVMVNNAGIS

SEQ ID NO: 626792 - protein, 25 aa, Mycobacterium
AAVAKFYKECFGRNSVDDEGMTLVS

SEQ ID NO: 626793 - protein, 18 aa, Mycobacterium
AAVAKYTVGDPWDPATRI

SEQ ID NO: 626794 - protein, 19 aa, Mycobacterium
AAVAPELVNELVLIDVTPS

SEQ ID NO: 626795 - protein, 26 aa, Mycobacterium
AAVAPYPGWLGAAATRAAAAGRHAAT

SEQ ID NO: 626796 - protein, 24 aa, Mycobacterium
AAVAREGSEFAVLSRQVAVGGQLL

SEQ ID NO: 626797 - protein, 19 aa, Mycobacterium
AAVARHGRLDGVLVASGMN

SEQ ID NO: 626798 - protein, 25 aa, Mycobacterium
AAVARLYRRRFSWLSQGTTPTSARR

SEQ ID NO: 626799 - protein, 17 aa, Mycobacterium
AAVARTANDKWFRRHVP

SEQ ID NO: 626800 - protein, 22 aa, Mycobacterium
AAVAVEFARLYAVELEHYEKLE

SEQ ID NO: 626801 - protein, 19 aa, Mycobacterium
AAVDADLAFPRVIRSRIVK

SEQ ID NO: 626802 - protein, 34 aa, Mycobacterium
AAVDARLAIKAPRWPSMTSWKLATEVDRVVAKFD

SEQ ID NO: 626803 - protein, 29 aa, Mycobacterium
AAVDEVSIQIAALFGAHAHSYQQLSAQAA

SEQ ID NO: 626804 - protein, 24 aa, Mycobacterium
AAVDFKRFARDGIVAMSSDEALGL

SEQ ID NO: 626805 - protein, 24 aa, Mycobacterium
AAVDHVWLCGPFGMVTDAQAALRE

SEQ ID NO: 626806 - protein, 17 aa, Mycobacterium
AAVDPALVLPRVVRSRI

SEQ ID NO: 626807 - protein, 20 aa, Mycobacterium
AAVDPEWRRGATQGHSGTHM

SEQ ID NO: 626808 - protein, 24 aa, Mycobacterium
AAVDPLQPWRVRAAIRYWRDIDEE

SEQ ID NO: 626809 - protein, 19 aa, Mycobacterium
AAVDSGYYPGQFQVGQTGK

SEQ ID NO: 626810 - protein, 19 aa, Mycobacterium
AAVDTFGALDIMVNNAGIT

SEQ ID NO: 626811 - protein, 25 aa, Mycobacterium
AAVEAEYEQMWALDVSTMATYHAGA

SEQ ID NO: 626812 - protein, 18 aa, Mycobacterium
AAVEAWTVNYGRDGSPFQ

SEQ ID NO: 626813 - protein, 20 aa, Mycobacterium
AAVEDCWAALQWVHEHAAEI

SEQ ID NO: 626814 - protein, 24 aa, Mycobacterium
AAVEEARFGRAFSSGMAATDCALR

SEQ ID NO: 626815 - protein, 24 aa, Mycobacterium
AAVEEFRFHVGLARLAGNTLLDLF

SEQ ID NO: 626816 - protein, 18 aa, Mycobacterium
AAVEGLILGAYRFSDFRS

SEQ ID NO: 626817 - protein, 20 aa, Mycobacterium
AAVEHLFREGRLLGWSTPAT

SEQ ID NO: 626818 - protein, 19 aa, Mycobacterium
AAVEHLRRGSGKSIVNVAS

SEQ ID NO: 626819 - protein, 18 aa, Mycobacterium
AAVELGLQVGQPATVFIK

SEQ ID NO: 626820 - protein, 28 aa, Mycobacterium
AAVETTARVVLRFDLRKGAAAAQDSPHL

SEQ ID NO: 626821 - protein, 18 aa, Mycobacterium
AAVFAFPYDVEAVTKIAA

SEQ ID NO: 626822 - protein, 26 aa, Mycobacterium
AAVFAPGFGPPRSWQGLLVAARKGLL

SEQ ID NO: 626823 - protein, 27 aa, Mycobacterium
AAVFDRFGKDLPPLDGIYLASLAGGEA

SEQ ID NO: 626824 - protein, 18 aa, Mycobacterium
AAVFPACRAIVHHGGAGT

SEQ ID NO: 626825 - protein, 17 aa, Mycobacterium
AAVFPACRAVVHHGGAG

SEQ ID NO: 626826 - protein, 18 aa, Mycobacterium
AAVFPACRAVVHHGGPGT

SEQ ID NO: 626827 - protein, 17 aa, Mycobacterium
AAVFPACRAVVHHSGAG

SEQ ID NO: 626828 - protein, 18 aa, Mycobacterium
AAVFPGCRAVVHHGGAGT

SEQ ID NO: 626829 - protein, 19 aa, Mycobacterium
AAVGARRGVPVSLPSAAGG

SEQ ID NO: 626830 - protein, 25 aa, Mycobacterium
AAVGDWLAMFSMWPIKQTPGLRCQL

SEQ ID NO: 626831 - protein, 23 aa, Mycobacterium
AAVGDWMLLAAIEAVIEGHEYLA

SEQ ID NO: 626832 - protein, 17 aa, Mycobacterium
AAVGFLCSEEARFITGQ

SEQ ID NO: 626833 - protein, 19 aa, Mycobacterium
AAVGGAFPIAVLNLKGGVG

SEQ ID NO: 626834 - protein, 25 aa, Mycobacterium
AAVGLPMRCVFALTAMGFLPQSPEA

SEQ ID NO: 626835 - protein, 17 aa, Mycobacterium
AAVGMPGIPGMPAGIYG

SEQ ID NO: 626836 - protein, 19 aa, Mycobacterium
AAVGRELLRRGHDVLMAVP

SEQ ID NO: 626837 - protein, 17 aa, Mycobacterium
AAVGRLAFVTTNSVAQG

SEQ ID NO: 626838 - protein, 30 aa, Mycobacterium
AAVGRRARWLVRVMVSLLVFPGVDEADERT

SEQ ID NO: 626839 - protein, 24 aa, Mycobacterium
AAVGTEIGRRGWRLISGGGTIAMM

SEQ ID NO: 626840 - protein, 25 aa, Mycobacterium
AAVGVEGVVMWTGVLGIADLATNKK

SEQ ID NO: 626841 - protein, 25 aa, Mycobacterium
AAVHCAPGHPMLRVDRLYADDEGRP

SEQ ID NO: 626842 - protein, 17 aa, Mycobacterium
AAVIARGPVRERIVADR

SEQ ID NO: 626843 - protein, 22 aa, Mycobacterium
AAVICARAGLKVQVVEAQPTFG

SEQ ID NO: 626844 - protein, 21 aa, Mycobacterium
AAVICARAGVSVRVVEAQPTA

SEQ ID NO: 626845 - protein, 18 aa, Mycobacterium
AAVIDARGASSAASAASA

SEQ ID NO: 626846 - protein, 18 aa, Mycobacterium
AAVIEARGASSAASAASA

SEQ ID NO: 626847 - protein, 17 aa, Mycobacterium
AAVIERWVQEYLEATNT

SEQ ID NO: 626848 - protein, 20 aa, Mycobacterium
AAVIGHDWGAVVAWNAAQLH

SEQ ID NO: 626849 - protein, 21 aa, Mycobacterium
AAVIGLRFGPDMLAALGADVS

SEQ ID NO: 626850 - protein, 19 aa, Mycobacterium
AAVIHLTKAMAVEFAPHNI

SEQ ID NO: 626851 - protein, 17 aa, Mycobacterium
AAVKRLQAADAEVARCA

SEQ ID NO: 626852 - protein, 17 aa, Mycobacterium
AAVKRLQAGTAERFSKV

SEQ ID NO: 626853 - protein, 21 aa, Mycobacterium
AAVKVMGRTGFHQMSMQDLAT

SEQ ID NO: 626854 - protein, 18 aa, Mycobacterium
AAVLAHRGAHVVLAVRNL

SEQ ID NO: 626855 - protein, 18 aa, Mycobacterium
AAVLASFASVAVNAIAHG

SEQ ID NO: 626856 - protein, 18 aa, Mycobacterium
AAVLAWFEHYDALAVAKD

SEQ ID NO: 626857 - protein, 21 aa, Mycobacterium
AAVLCQAAGAAALPYPVVEEL

SEQ ID NO: 626858 - protein, 21 aa, Mycobacterium
AAVLFELGGLGGRDAVAPLPV

SEQ ID NO: 626859 - protein, 25 aa, Mycobacterium
AAVLLRECVDFFKPYLSAARLTGEV

SEQ ID NO: 626860 - protein, 24 aa, Mycobacterium
AAVLPSHYEPFGIVALEAAATGTP

SEQ ID NO: 626861 - protein, 18 aa, Mycobacterium
AAVLREVVSYQFANSLTA

SEQ ID NO: 626862 - protein, 18 aa, Mycobacterium
AAVLRFAATEVVPRLAGT

SEQ ID NO: 626863 - protein, 19 aa, Mycobacterium
AAVLRFNAAAGIVLTAAVG

SEQ ID NO: 626864 - protein, 20 aa, Mycobacterium
AAVLTRCHAIGSSIRWRTRA

SEQ ID NO: 626865 - protein, 21 aa, Mycobacterium
AAVLWRYALRLTGDASQSEDV

SEQ ID NO: 626866 - protein, 22 aa, Mycobacterium
AAVLWRYALRLTGDTSQSEDVV

SEQ ID NO: 626867 - protein, 29 aa, Mycobacterium
AAVNAPAQALFGRPLIGNGSNGAPGTGAP

SEQ ID NO: 626868 - protein, 25 aa, Mycobacterium
AAVNDLRLTLGVLLDVGPRGPERLP

SEQ ID NO: 626869 - protein, 25 aa, Mycobacterium
AAVNDLRLTLGVLLNVGPQGPERLP

SEQ ID NO: 626870 - protein, 31 aa, Mycobacterium
AAVNEPIAALTGRPLIGNGANGTPGLGTDGA

SEQ ID NO: 626871 - protein, 19 aa, Mycobacterium
AAVNFPDVLFIAGKYQIKI

SEQ ID NO: 626872 - protein, 21 aa, Mycobacterium
AAVNFPDVLFIAGKYQVKIPP

SEQ ID NO: 626873 - protein, 23 aa, Mycobacterium
AAVNFPDVLLIAGKYQIRIPVPF

SEQ ID NO: 626874 - protein, 34 aa, Mycobacterium
AAVNGAPALVLVSWPERGPLLGVDLEGSLYTSTD

SEQ ID NO: 626875 - protein, 25 aa, Mycobacterium
AAVNGFCLGGGIGLVGNADVIVAAD

SEQ ID NO: 626876 - protein, 24 aa, Mycobacterium
AAVNGFCVGGGIGLVGNADVIVAS

SEQ ID NO: 626877 - protein, 20 aa, Mycobacterium
AAVNGLRVTTIFGGVPQGRQ

SEQ ID NO: 626878 - protein, 24 aa, Mycobacterium
AAVNLKIPILLIRGKLSDVVSPEG

SEQ ID NO: 626879 - protein, 27 aa, Mycobacterium
AAVNPWQWCRWLLIEPAELADTATDTA

SEQ ID NO: 626880 - protein, 18 aa, Mycobacterium
AAVNQWLMDGLDRIDDYL

SEQ ID NO: 626881 - protein, 23 aa, Mycobacterium
AAVPAVRLLACERWFESDTFARL

SEQ ID NO: 626882 - protein, 19 aa, Mycobacterium
AAVPDRFDLSAGAPGAYDT

SEQ ID NO: 626883 - protein, 19 aa, Mycobacterium
AAVPDWRLVIENVVDDGTG

SEQ ID NO: 626884 - protein, 29 aa, Mycobacterium
AAVPEEQRSLTARPACTAADAAGAAVSAE

SEQ ID NO: 626885 - protein, 17 aa, Mycobacterium
AAVPEWIAGFAVSTAMR

SEQ ID NO: 626886 - protein, 23 aa, Mycobacterium
AAVPEYMVPGAFAVIPEIPMTVS

SEQ ID NO: 626887 - protein, 19 aa, Mycobacterium
AAVPFPLTAWAVRALTRLP

SEQ ID NO: 626888 - protein, 17 aa, Mycobacterium
AAVPGVIGLAVAAPGRT

SEQ ID NO: 626889 - protein, 24 aa, Mycobacterium
AAVPHPIDPILLGRTVLGLLRTPT

SEQ ID NO: 626890 - protein, 24 aa, Mycobacterium
AAVPNFRFLPALGQVLFRKDFPQE

SEQ ID NO: 626891 - protein, 22 aa, Mycobacterium
AAVPRFDGLRALFINTTLKRSP

SEQ ID NO: 626892 - protein, 21 aa, Mycobacterium
AAVPRRPVIRPIPVDETAFSV

SEQ ID NO: 626893 - protein, 27 aa, Mycobacterium
AAVPSWAASIPVSMSIPHSGIQGPCPA

SEQ ID NO: 626894 - protein, 18 aa, Mycobacterium
AAVPTGYFVVDGRHAGFR

SEQ ID NO: 626895 - protein, 24 aa, Mycobacterium
AAVPTTAVQACAGDQVSAAVAALF

SEQ ID NO: 626896 - protein, 17 aa, Mycobacterium
AAVPVVFLTALFGLSDL

SEQ ID NO: 626897 - protein, 19 aa, Mycobacterium
AAVPWDFDGAGLPVAVQLV

SEQ ID NO: 626898 - protein, 17 aa, Mycobacterium
AAVPYLESVVLAAGALA

SEQ ID NO: 626899 - protein, 25 aa, Mycobacterium
AAVQFPAPVKYVAPIAFNVVPLAGS

SEQ ID NO: 626900 - protein, 22 aa, Mycobacterium
AAVQLARLWGAKVFVTASRGKW

SEQ ID NO: 626901 - protein, 18 aa, Mycobacterium
AAVQRFAAEHGIDLKDSY

SEQ ID NO: 626902 - protein, 24 aa, Mycobacterium
AAVQRRVGVEWADNRLTVAAEHAA

SEQ ID NO: 626903 - protein, 26 aa, Mycobacterium
AAVQWHKMGAGWSWSRKVGSDDDHAA

SEQ ID NO: 626904 - protein, 23 aa, Mycobacterium
AAVRAELPRRCVLDGEIVIATGH

SEQ ID NO: 626905 - protein, 19 aa, Mycobacterium
AAVRAFDGKPPVGVTVFVE

SEQ ID NO: 626906 - protein, 17 aa, Mycobacterium
AAVRAFVGPQFRGPGKP

SEQ ID NO: 626907 - protein, 23 aa, Mycobacterium
AAVRAGRRPCCANPAGIAQALDA

SEQ ID NO: 626908 - protein, 24 aa, Mycobacterium
AAVRAHLIDAARPFIFDTGLAPAA

SEQ ID NO: 626909 - protein, 25 aa, Mycobacterium
AAVRAHLIDAARPFIFDTGLAPAAV

SEQ ID NO: 626910 - protein, 23 aa, Mycobacterium
AAVRAHLIDAARTFIFDTGLAPA

SEQ ID NO: 626911 - protein, 22 aa, Mycobacterium
AAVRARAAQIMRLQEQPMVERE

SEQ ID NO: 626912 - protein, 27 aa, Mycobacterium
AAVRDEIWGATGYPQMLLRLGWAPNSA

SEQ ID NO: 626913 - protein, 19 aa, Mycobacterium
AAVRDGRPTVLQSLADDPA

SEQ ID NO: 626914 - protein, 20 aa, Mycobacterium
AAVREGRPTAMISLTEDPAA

SEQ ID NO: 626915 - protein, 19 aa, Mycobacterium
AAVRFGLFGTGIVDEESVN

SEQ ID NO: 626916 - protein, 17 aa, Mycobacterium
AAVRGADGTVWVRAGQR

SEQ ID NO: 626917 - protein, 20 aa, Mycobacterium
AAVRGKLPFYIRGYEAEAVG

SEQ ID NO: 626918 - protein, 23 aa, Mycobacterium
AAVRGRWQLPILIGAAPATDLIA

SEQ ID NO: 626919 - protein, 19 aa, Mycobacterium
AAVRKARTALSEFSIEGVA

SEQ ID NO: 626920 - protein, 30 aa, Mycobacterium
AAVRLIRSYLPGMIEKGWGRAIQIASDSAI

SEQ ID NO: 626921 - protein, 19 aa, Mycobacterium
AAVRMPTPVTINFSIPWTV

SEQ ID NO: 626922 - protein, 17 aa, Mycobacterium
AAVRQWIEAEVPAAWRS

SEQ ID NO: 626923 - protein, 18 aa, Mycobacterium
AAVRRARELPSLEAVLTQ

SEQ ID NO: 626924 - protein, 20 aa, Mycobacterium
AAVRRFGRMFVLGARLTVPL

SEQ ID NO: 626925 - protein, 20 aa, Mycobacterium
AAVRRFGRMFVLGARLTVPV

SEQ ID NO: 626926 - protein, 28 aa, Mycobacterium
AAVRRLAQRLALAVGRRLDDAQPFVDGQ

SEQ ID NO: 626927 - protein, 27 aa, Mycobacterium
AAVRRLAQRLALLAGRRLDEAQPWVDG

SEQ ID NO: 626928 - protein, 25 aa, Mycobacterium
AAVRRLAQRLALTAGRRLDEAQPWV

SEQ ID NO: 626929 - protein, 29 aa, Mycobacterium
AAVRRRYIECATRAVARYDWSVVGKQIMR

SEQ ID NO: 626930 - protein, 18 aa, Mycobacterium
AAVRSMWSTVREKVRQRS

SEQ ID NO: 626931 - protein, 22 aa, Mycobacterium
AAVRTRHGWRLTRRVETKCFSR

SEQ ID NO: 626932 - protein, 17 aa, Mycobacterium
AAVRWAAQEAVLRRRPV

SEQ ID NO: 626933 - protein, 29 aa, Mycobacterium
AAVRWKNILQKAAFYWACRRWPQRMRARL

SEQ ID NO: 626934 - protein, 17 aa, Mycobacterium
AAVSAHTAAAWASSGGP

SEQ ID NO: 626935 - protein, 22 aa, Mycobacterium
AAVSARRDPNFIVCARTDAAGI

SEQ ID NO: 626936 - protein, 18 aa, Mycobacterium
AAVSEFAGPLAMAAAAAA

SEQ ID NO: 626937 - protein, 24 aa, Mycobacterium
AAVSLLGDVWWWSTAVNVDSEDVD

SEQ ID NO: 626938 - protein, 19 aa, Mycobacterium
AAVSSFGLGGTNAHAIVEQ

SEQ ID NO: 626939 - protein, 25 aa, Mycobacterium
AAVTALAARATCRTRGPDLAGPASS

SEQ ID NO: 626940 - protein, 18 aa, Mycobacterium
AAVTDRLVFYNARGDRER

SEQ ID NO: 626941 - protein, 17 aa, Mycobacterium
AAVTFPWYQLGRQVHVR

SEQ ID NO: 626942 - protein, 24 aa, Mycobacterium
AAVTGEGMVPVFQPVVSLPDEAVV

SEQ ID NO: 626943 - protein, 17 aa, Mycobacterium
AAVTGGPLFRNGVAMPP

SEQ ID NO: 626944 - protein, 22 aa, Mycobacterium
AAVTGWLGRLPVAPRSARAAAA

SEQ ID NO: 626945 - protein, 23 aa, Mycobacterium
AAVTPGLGIGDEPAGGTGGTGGH

SEQ ID NO: 626946 - protein, 17 aa, Mycobacterium
AAVTPYVTWLCATAARA

SEQ ID NO: 626947 - protein, 17 aa, Mycobacterium
AAVTRIGTAFAPRPVIY

SEQ ID NO: 626948 - protein, 18 aa, Mycobacterium
AAVTRIGVLPTFRRQGIA

SEQ ID NO: 626949 - protein, 22 aa, Mycobacterium
AAVTRPVITGGETFHPRGRAGA

SEQ ID NO: 626950 - protein, 25 aa, Mycobacterium
AAVTTRLRLGVAVLVTSLHDPLQLA

SEQ ID NO: 626951 - protein, 21 aa, Mycobacterium
AAVTVGEVWVHDNARWAQYLR

SEQ ID NO: 626952 - protein, 20 aa, Mycobacterium
AAVVARELGIPCVMNTARGT

SEQ ID NO: 626953 - protein, 19 aa, Mycobacterium
AAVVDHLLAPVVDLGQRGE

SEQ ID NO: 626954 - protein, 26 aa, Mycobacterium
AAVVDLCSRFLPGMVERRRGAVLNVA

SEQ ID NO: 626955 - protein, 18 aa, Mycobacterium
AAVVGRLRAVVCAPDGTV

SEQ ID NO: 626956 - protein, 18 aa, Mycobacterium
AAVVGRLRGVVCAPDGAV

SEQ ID NO: 626957 - protein, 22 aa, Mycobacterium
AAVVLFGMPNVRAMDFLGEPAV

SEQ ID NO: 626958 - protein, 22 aa, Mycobacterium
AAVVSMPCVEWFESQPKEYRDS

SEQ ID NO: 626959 - protein, 18 aa, Mycobacterium
AAVVTRWTRTTAVVDPSR

SEQ ID NO: 626960 - protein, 22 aa, Mycobacterium
AAWAAEGLIGFLPPEAQDRLLD

SEQ ID NO: 626961 - protein, 18 aa, Mycobacterium
AAWATCFDGQLSMLIHPE

SEQ ID NO: 626962 - protein, 21 aa, Mycobacterium
AAWEDFLFWLASDRKTARRIT

SEQ ID NO: 626963 - protein, 22 aa, Mycobacterium
AAWGPCPSRLLAEYWAHEAALM

SEQ ID NO: 626964 - protein, 17 aa, Mycobacterium
AAWKLASDLDRFDEWMT

SEQ ID NO: 626965 - protein, 19 aa, Mycobacterium
AAWNHDWSTTSVVVGTETT

SEQ ID NO: 626966 - protein, 17 aa, Mycobacterium
AAWNQGSALSFQQAVMV

SEQ ID NO: 626967 - protein, 21 aa, Mycobacterium
AAWRFRLTPRDGGTDLSYWMQ

SEQ ID NO: 626968 - protein, 25 aa, Mycobacterium
AAWTKLCGVCPIPASTGKTVRHLLN

SEQ ID NO: 626969 - protein, 21 aa, Mycobacterium
AAWVGHDWGAVVVWNAPLLHP

SEQ ID NO: 626970 - protein, 19 aa, Mycobacterium
AAWYDREHAALGFPYPPVG

SEQ ID NO: 626971 - protein, 23 aa, Mycobacterium
AAYAAGHLPDFRAFRQPDARKLD

SEQ ID NO: 626972 - protein, 24 aa, Mycobacterium
AAYAECAGLSPALPQQLSFVKLSP

SEQ ID NO: 626973 - protein, 17 aa, Mycobacterium
AAYAHRLPGGYSDTELA

SEQ ID NO: 626974 - protein, 18 aa, Mycobacterium
AAYDPILARELWDHTLTK

SEQ ID NO: 626975 - protein, 18 aa, Mycobacterium
AAYDRLFAALDWLSERLA

SEQ ID NO: 626976 - protein, 18 aa, Mycobacterium
AAYDRLFAALDWVSDRLA

SEQ ID NO: 626977 - protein, 30 aa, Mycobacterium
AAYELMKLGLRPVLYESARIGGRLRSQQFD

SEQ ID NO: 626978 - protein, 24 aa, Mycobacterium
AAYERAFEAKVRWEAGQFAGSDQL

SEQ ID NO: 626979 - protein, 36 aa, Mycobacterium
AAYGASAVPLEWRRLLHGWPDMTARDLVALANTVAR

SEQ ID NO: 626980 - protein, 24 aa, Mycobacterium
AAYHWLDRGFSNGFEADAIVHLGK

SEQ ID NO: 626981 - protein, 26 aa, Mycobacterium
AAYLAGFAWGLSRDYSVLVEMDADGS

SEQ ID NO: 626982 - protein, 27 aa, Mycobacterium
AAYLARAGLRVRVLERLGHVGGAAVSI

SEQ ID NO: 626983 - protein, 31 aa, Mycobacterium
AAYLARAGQRVMLLERLDVFGGAAISAPAFE

SEQ ID NO: 626984 - protein, 22 aa, Mycobacterium
AAYLARAGRRVRVLERLDHVGG

SEQ ID NO: 626985 - protein, 20 aa, Mycobacterium
AAYLCGPTPFMADMREALAA

SEQ ID NO: 626986 - protein, 17 aa, Mycobacterium
AAYLKSSGVQLVPGSVS

SEQ ID NO: 626987 - protein, 23 aa, Mycobacterium
AAYLKWAVEAFRLATSGVEDSTQ

SEQ ID NO: 626988 - protein, 24 aa, Mycobacterium
AAYLLPRLKPGLSVLDVGCGPGTI

SEQ ID NO: 626989 - protein, 19 aa, Mycobacterium
AAYLLTSWHPASRPRELTL

SEQ ID NO: 626990 - protein, 18 aa, Mycobacterium
AAYLRWERPPGLATPQCF

SEQ ID NO: 626991 - protein, 23 aa, Mycobacterium
AAYPPEILLTGIIVNKNGDRFVA

SEQ ID NO: 626992 - protein, 23 aa, Mycobacterium
AAYPPEILLTGIIVNNRGERFVA

SEQ ID NO: 626993 - protein, 22 aa, Mycobacterium
AAYPPEILLTGVIVNKEGKRFV

SEQ ID NO: 626994 - protein, 23 aa, Mycobacterium
AAYPRPTDAVAVFVHGLCQTESS

SEQ ID NO: 626995 - protein, 17 aa, Mycobacterium
AAYRAAPLHIRQQVHAA

SEQ ID NO: 626996 - protein, 19 aa, Mycobacterium
AAYRAKRAPMWTASVPADW

SEQ ID NO: 626997 - protein, 22 aa, Mycobacterium
AAYRERQRLFALARSSWDDYDR

SEQ ID NO: 626998 - protein, 24 aa, Mycobacterium
AAYRRRIERALKAALDTAARAGDI

SEQ ID NO: 626999 - protein, 23 aa, Mycobacterium
AAYSAESARVFGLEETRYEGPTG

SEQ ID NO: 627000 - protein, 24 aa, Mycobacterium
AAYSEMWAQDALAMYDYAANSASA

SEQ ID NO: 627001 - protein, 31 aa, Mycobacterium
AAYSPRLRPGLPVSFPVDWSELDRVTPSDFT

SEQ ID NO: 627002 - protein, 19 aa, Mycobacterium
AAYTARIAALVKGLCDADP

SEQ ID NO: 627003 - protein, 25 aa, Mycobacterium
AAYWRDEFKAGNAVDARIINTSSAA

SEQ ID NO: 627004 - protein, 18 aa, Mycobacterium
AAYYLSDELLPLGDVDNI

SEQ ID NO: 627005 - protein, 21 aa, Mycobacterium
ACAAAGITFVGPRAELLQLTG

SEQ ID NO: 627006 - protein, 19 aa, Mycobacterium
ACAAARVGAIPVLLSPKLD

SEQ ID NO: 627007 - protein, 17 aa, Mycobacterium
ACAAGARIVVLTNAAGG

SEQ ID NO: 627008 - protein, 24 aa, Mycobacterium
ACAAGPESPVGKRRGDTAVAAGAP

SEQ ID NO: 627009 - protein, 24 aa, Mycobacterium
ACAALGERALLCFGGTDFSEVSHS

SEQ ID NO: 627010 - protein, 19 aa, Mycobacterium
ACACDRRLISPDAQIGASE

SEQ ID NO: 627011 - protein, 26 aa, Mycobacterium
ACADMLWSGIPLRFPRLNITLAEGGL

SEQ ID NO: 627012 - protein, 17 aa, Mycobacterium
ACAFINYAQGRYGVAAD

SEQ ID NO: 627013 - protein, 21 aa, Mycobacterium
ACAGAGCPIKVRLLVTAMRHA

SEQ ID NO: 627014 - protein, 19 aa, Mycobacterium
ACAGASKVIVHFYNSTSIL

SEQ ID NO: 627015 - protein, 18 aa, Mycobacterium
ACAGRYARVFTALADGWL

SEQ ID NO: 627016 - protein, 19 aa, Mycobacterium
ACAKGGSGRTFWMRHRVSQ

SEQ ID NO: 627017 - protein, 18 aa, Mycobacterium
ACALANNHILDFGYQGLT

SEQ ID NO: 627018 - protein, 18 aa, Mycobacterium
ACALDPAVAGAMQLALSA

SEQ ID NO: 627019 - protein, 17 aa, Mycobacterium
ACALSKMAPGSVIDAYY

SEQ ID NO: 627020 - protein, 17 aa, Mycobacterium
ACALVCQPDLLVLDEPT

SEQ ID NO: 627021 - protein, 17 aa, Mycobacterium
ACALVGRPELVFLDEPT

SEQ ID NO: 627022 - protein, 26 aa, Mycobacterium
ACAPLAEIALDWVLDGAVAAGLPARE

SEQ ID NO: 627023 - protein, 20 aa, Mycobacterium
ACAPSPLAALSRAVLSEDWA

SEQ ID NO: 627024 - protein, 24 aa, Mycobacterium
ACAQLGERALICFGGTDFSDVPHF

SEQ ID NO: 627025 - protein, 19 aa, Mycobacterium
ACARMGWNVHDTEVISLVT

SEQ ID NO: 627026 - protein, 20 aa, Mycobacterium
ACARRRAEAFTWQQAAAGML

SEQ ID NO: 627027 - protein, 19 aa, Mycobacterium
ACASRILVHESVYDAFTEQ

SEQ ID NO: 627028 - protein, 23 aa, Mycobacterium
ACATGATALRTAIMAVKAGEVDY

SEQ ID NO: 627029 - protein, 26 aa, Mycobacterium
ACATLPRPPLFLMASSAAVYGSRNPF

SEQ ID NO: 627030 - protein, 18 aa, Mycobacterium
ACATVYIPTAIFDFPVTP

SEQ ID NO: 627031 - protein, 27 aa, Mycobacterium
ACAVRRAGGLPLLYYSGRMHDWAATVH

SEQ ID NO: 627032 - protein, 19 aa, Mycobacterium
ACCAAGARFTGGVLACTAL

SEQ ID NO: 627033 - protein, 19 aa, Mycobacterium
ACDEARDALGRAHRHKVNL

SEQ ID NO: 627034 - protein, 21 aa, Mycobacterium
ACDEMHRVGRWVEGVPMADDK

SEQ ID NO: 627035 - protein, 21 aa, Mycobacterium
ACDFAPVVMVNWDFFDNQTPA

SEQ ID NO: 627036 - protein, 20 aa, Mycobacterium
ACDFSTASSWEFEPLDSEVF

SEQ ID NO: 627037 - protein, 20 aa, Mycobacterium
ACDFSTASTWEFEPLDAQVF

SEQ ID NO: 627038 - protein, 23 aa, Mycobacterium
ACDFSTASTWEFLPLDNAVFPAV

SEQ ID NO: 627039 - protein, 25 aa, Mycobacterium
ACDIPSLLYSYSFEPNPGWTRTYSG

SEQ ID NO: 627040 - protein, 26 aa, Mycobacterium
ACDTRRRFCDMYRRIVGGGEQHDVPS

SEQ ID NO: 627041 - protein, 19 aa, Mycobacterium
ACDVLKPLLDELGLVGYPK

SEQ ID NO: 627042 - protein, 18 aa, Mycobacterium
ACDVNAPLLAEVVKTTSD

SEQ ID NO: 627043 - protein, 23 aa, Mycobacterium
ACEAPACAYFFIKEHRREWCSAL

SEQ ID NO: 627044 - protein, 19 aa, Mycobacterium
ACECASCAQLDNLSLKFVV

SEQ ID NO: 627045 - protein, 18 aa, Mycobacterium
ACECPRGCPSCVQSPKCG

SEQ ID NO: 627046 - protein, 21 aa, Mycobacterium
ACEDYRAAATIDLDHDRRDRD

SEQ ID NO: 627047 - protein, 17 aa, Mycobacterium
ACELLGIDPLYVANEGK

SEQ ID NO: 627048 - protein, 17 aa, Mycobacterium
ACELTAWLQMLALHEHP

SEQ ID NO: 627049 - protein, 25 aa, Mycobacterium
ACEYWRAQFKAGNPIDAHVVNTVSG

SEQ ID NO: 627050 - protein, 19 aa, Mycobacterium
ACFATATGMAAVFTALGAL

SEQ ID NO: 627051 - protein, 17 aa, Mycobacterium
ACFGASTALFCYLDRDM

SEQ ID NO: 627052 - protein, 18 aa, Mycobacterium
ACGACTVLLDGAAVRSCL

SEQ ID NO: 627053 - protein, 20 aa, Mycobacterium
ACGADRRLTVVAGTVALWLW

SEQ ID NO: 627054 - protein, 17 aa, Mycobacterium
ACGDARAAAPVAAAVEL

SEQ ID NO: 627055 - protein, 25 aa, Mycobacterium
ACGEPTGFVPGFWGAVLAGLIVVPS

SEQ ID NO: 627056 - protein, 20 aa, Mycobacterium
ACGFAVPYYDLIDERPVLDA

SEQ ID NO: 627057 - protein, 18 aa, Mycobacterium
ACGGICHDGLLIGSNCHD

SEQ ID NO: 627058 - protein, 17 aa, Mycobacterium
ACGHPAPSEPSTTLSTV

SEQ ID NO: 627059 - protein, 18 aa, Mycobacterium
ACGIDCIEHGFLMDDEAI

SEQ ID NO: 627060 - protein, 18 aa, Mycobacterium
ACGIEAMSRVGLGANAGP

SEQ ID NO: 627061 - protein, 17 aa, Mycobacterium
ACGKNLSTERWSTIGEQ

SEQ ID NO: 627062 - protein, 19 aa, Mycobacterium
ACGLAAMSVTAHKFGGPPG

SEQ ID NO: 627063 - protein, 19 aa, Mycobacterium
ACGLANFPPTEHCRQCLAA

SEQ ID NO: 627064 - protein, 31 aa, Mycobacterium
ACGLLHFRTQRWSDVLGLFPIDKRWYRPEYE

SEQ ID NO: 627065 - protein, 19 aa, Mycobacterium
ACGPAPMLTMLRTALVGRD

SEQ ID NO: 627066 - protein, 20 aa, Mycobacterium
ACGPEGMLTQAEKIWSAAGA

SEQ ID NO: 627067 - protein, 20 aa, Mycobacterium
ACGPHHRMLNPGGWTTRKNP

SEQ ID NO: 627068 - protein, 25 aa, Mycobacterium
ACGPHTTLGAAIAWAPAPPDRAPDT

SEQ ID NO: 627069 - protein, 28 aa, Mycobacterium
ACGSVTRIGNGWFRFNGPVIAKGDSGGP

SEQ ID NO: 627070 - protein, 17 aa, Mycobacterium
ACGTCHVVVDPQWSDQV

SEQ ID NO: 627071 - protein, 18 aa, Mycobacterium
ACGTLRLVAEDAEVDGYL

SEQ ID NO: 627072 - protein, 19 aa, Mycobacterium
ACGVNKWLVVMMPFRLDKI

SEQ ID NO: 627073 - protein, 27 aa, Mycobacterium
ACGYWRRAGLTAARFVACPFGGAGTRM

SEQ ID NO: 627074 - protein, 18 aa, Mycobacterium
ACHARLAGLDVAVCKPIQ

SEQ ID NO: 627075 - protein, 21 aa, Mycobacterium
ACHGLRWKSYQEIDRDTERAH

SEQ ID NO: 627076 - protein, 19 aa, Mycobacterium
ACHIYYRGVGWTFVPTTLL

SEQ ID NO: 627077 - protein, 23 aa, Mycobacterium
ACHNLRTLLLQHCSAGCGRLKGS

SEQ ID NO: 627078 - protein, 25 aa, Mycobacterium
ACIACDVCVKVCPTDVFDRGDDGIP

SEQ ID NO: 627079 - protein, 17 aa, Mycobacterium
ACIDEFAVYCGGDVRCT

SEQ ID NO: 627080 - protein, 17 aa, Mycobacterium
ACILCECNCGIVVQTEG

SEQ ID NO: 627081 - protein, 17 aa, Mycobacterium
ACILCECNCGIVVQVED

SEQ ID NO: 627082 - protein, 21 aa, Mycobacterium
ACILHSRLLLPDAMHDDVVDR

SEQ ID NO: 627083 - protein, 24 aa, Mycobacterium
ACIVAAAAGFHWLGLETLHCSPVG

SEQ ID NO: 627084 - protein, 19 aa, Mycobacterium
ACLGLMRELAFELAPKVRV

SEQ ID NO: 627085 - protein, 18 aa, Mycobacterium
ACLHAFPRRELTDAEVVD

SEQ ID NO: 627086 - protein, 21 aa, Mycobacterium
ACLHWPREFGGAAATVTYQAV

SEQ ID NO: 627087 - protein, 19 aa, Mycobacterium
ACLNREMNRFIDALRADID

SEQ ID NO: 627088 - protein, 21 aa, Mycobacterium
ACLNREMTRFIDVLRADIDFR

SEQ ID NO: 627089 - protein, 18 aa, Mycobacterium
ACLNVCPVYERTGGHAYG

SEQ ID NO: 627090 - protein, 17 aa, Mycobacterium
ACLRGCGLVVGIAEGRR

SEQ ID NO: 627091 - protein, 20 aa, Mycobacterium
ACLRRAVSVLSARQTHEPVR

SEQ ID NO: 627092 - protein, 24 aa, Mycobacterium
ACLSEARYGIAWGAMGAARSAWQS

SEQ ID NO: 627093 - protein, 25 aa, Mycobacterium
ACLYQVKGRPPGTMRLATVAEIEQR

SEQ ID NO: 627094 - protein, 19 aa, Mycobacterium
ACMALRAFPTLTLTEEVTT

SEQ ID NO: 627095 - protein, 23 aa, Mycobacterium
ACMDARLDVYRLLGLNEGEAHVI

SEQ ID NO: 627096 - protein, 25 aa, Mycobacterium
ACMDARLNPYGLLGLHEGDAHVIRN

SEQ ID NO: 627097 - protein, 19 aa, Mycobacterium
ACMHRSEIMSRIMIAELTR

SEQ ID NO: 627098 - protein, 22 aa, Mycobacterium
ACNQCWYCDHEMYSCCDTTNPN

SEQ ID NO: 627099 - protein, 19 aa, Mycobacterium
ACPAKLVDQWAPGRTLLNA

SEQ ID NO: 627100 - protein, 17 aa, Mycobacterium
ACPEHTEKVTLWKLLDV

SEQ ID NO: 627101 - protein, 19 aa, Mycobacterium
ACPEVFIAAAAERTRHIRL

SEQ ID NO: 627102 - protein, 19 aa, Mycobacterium
ACPGMRSSLPIPLTKSDGT

SEQ ID NO: 627103 - protein, 21 aa, Mycobacterium
ACPGSVHPSLWRQCGLNIRQG

SEQ ID NO: 627104 - protein, 21 aa, Mycobacterium
ACQEFITQLGRNFQMIYEQAN

SEQ ID NO: 627105 - protein, 19 aa, Mycobacterium
ACQEFITQLGRNFQVIYEQ

SEQ ID NO: 627106 - protein, 22 aa, Mycobacterium
ACQEFITQLGRNFQVIYEQANT

SEQ ID NO: 627107 - protein, 25 aa, Mycobacterium
ACQKWPRRMRKMFMGLAARQLPEGY

SEQ ID NO: 627108 - protein, 22 aa, Mycobacterium
ACQRGSEPWVLLRVQQLGLPDI

SEQ ID NO: 627109 - protein, 24 aa, Mycobacterium
ACRDRGVGFSFGFPVDARIWDAVD

SEQ ID NO: 627110 - protein, 26 aa, Mycobacterium
ACRDTLRWLAERGILVAPGEFYGPAG

SEQ ID NO: 627111 - protein, 26 aa, Mycobacterium
ACREKITELRGFPELVISGLSVPDAR

SEQ ID NO: 627112 - protein, 19 aa, Mycobacterium
ACRELSAAGAHVMGYDPQL

SEQ ID NO: 627113 - protein, 26 aa, Mycobacterium
ACRFPGADGVEAFWDMLLRGRNGTRV

SEQ ID NO: 627114 - protein, 18 aa, Mycobacterium
ACRPESGTDLLVGIGGTP

SEQ ID NO: 627115 - protein, 18 aa, Mycobacterium
ACRPRRRSAGTSPASSGL

SEQ ID NO: 627116 - protein, 19 aa, Mycobacterium
ACRRGCAYTTSVPPHVGGA

SEQ ID NO: 627117 - protein, 18 aa, Mycobacterium
ACRRGRSTIFGSGVSPGF

SEQ ID NO: 627118 - protein, 18 aa, Mycobacterium
ACRRRGCRTVDQLTDHTS

SEQ ID NO: 627119 - protein, 17 aa, Mycobacterium
ACRRWFPSDNAAVPVPA

SEQ ID NO: 627120 - protein, 20 aa, Mycobacterium
ACRSDLGGALVLSEFTGAAA

SEQ ID NO: 627121 - protein, 21 aa, Mycobacterium
ACRSYSGGALVLSEFTGAAAE

SEQ ID NO: 627122 - protein, 18 aa, Mycobacterium
ACSAWPAGAGALLSMAFP

SEQ ID NO: 627123 - protein, 25 aa, Mycobacterium
ACSDGVVIPTECEFFSLRGLALLTD

SEQ ID NO: 627124 - protein, 21 aa, Mycobacterium
ACSDGVVIPTECEYFSLRGLA

SEQ ID NO: 627125 - protein, 17 aa, Mycobacterium
ACSLRLHGLSVRVLDRA

SEQ ID NO: 627126 - protein, 20 aa, Mycobacterium
ACSMSDFVGGAVERTTYPPI

SEQ ID NO: 627127 - protein, 20 aa, Mycobacterium
ACSSSLFAVHMACRSLNDGE

SEQ ID NO: 627128 - protein, 17 aa, Mycobacterium
ACSWLIGDIKTGEIACH

SEQ ID NO: 627129 - protein, 20 aa, Mycobacterium
ACTDGRPGLAEIRLVDGEIR

SEQ ID NO: 627130 - protein, 17 aa, Mycobacterium
ACTFALTEARIGVAPAI

SEQ ID NO: 627131 - protein, 23 aa, Mycobacterium
ACTHCNKCMATIYTRTRCVVTGA

SEQ ID NO: 627132 - protein, 23 aa, Mycobacterium
ACTHCNQCMPTIYSRTHCVVTGA

SEQ ID NO: 627133 - protein, 20 aa, Mycobacterium
ACTHCNQCMPTIYSRTRCVV

SEQ ID NO: 627134 - protein, 17 aa, Mycobacterium
ACTLPPPGWVCSREAGH

SEQ ID NO: 627135 - protein, 24 aa, Mycobacterium
ACTLRNWLGMWSLRHAQTRAERHL

SEQ ID NO: 627136 - protein, 25 aa, Mycobacterium
ACTLRNWLGMWSLRVAQTRAEPHLA

SEQ ID NO: 627137 - protein, 24 aa, Mycobacterium
ACTPEALRALGIRECAEADRALEE

SEQ ID NO: 627138 - protein, 18 aa, Mycobacterium
ACTPWYEPFGIVPLEAMA

SEQ ID NO: 627139 - protein, 20 aa, Mycobacterium
ACTRRGRLRSGRLGRRRLRG

SEQ ID NO: 627140 - protein, 21 aa, Mycobacterium
ACTSCKACVGCIDCEDCIGCV

SEQ ID NO: 627141 - protein, 17 aa, Mycobacterium
ACTVACPEVFVITDDGY

SEQ ID NO: 627142 - protein, 18 aa, Mycobacterium
ACVAGLRAIAKVAGGGPE

SEQ ID NO: 627143 - protein, 19 aa, Mycobacterium
ACVDECPVDCIYEGGRALY

SEQ ID NO: 627144 - protein, 19 aa, Mycobacterium
ACVEECPVDCIYEGGRSLY

SEQ ID NO: 627145 - protein, 20 aa, Mycobacterium
ACVLRPGPDASPGSAPAADI

SEQ ID NO: 627146 - protein, 19 aa, Mycobacterium
ACVLYDCVPSKTFIASTGV

SEQ ID NO: 627147 - protein, 20 aa, Mycobacterium
ACVPEPLTFNAKMIGPVIAE

SEQ ID NO: 627148 - protein, 22 aa, Mycobacterium
ACVPRATTDLVYVRMHGPDQDA

SEQ ID NO: 627149 - protein, 27 aa, Mycobacterium
ACVQAGIPAVTFWAAIPHYVSQPPNPK

SEQ ID NO: 627150 - protein, 19 aa, Mycobacterium
ACVQCSATFKALDKQGIGY

SEQ ID NO: 627151 - protein, 17 aa, Mycobacterium
ACVQNAFNLIHRESAAV

SEQ ID NO: 627152 - protein, 20 aa, Mycobacterium
ACVRATWLRTRPELFDRAIE

SEQ ID NO: 627153 - protein, 22 aa, Mycobacterium
ACVRELMELTLFGPTPAQADAA

SEQ ID NO: 627154 - protein, 22 aa, Mycobacterium
ACVSACPVGAIAPDSKLTPEQL

SEQ ID NO: 627155 - protein, 23 aa, Mycobacterium
ACVSACPVGAIAPDSRLESRQLP

SEQ ID NO: 627156 - protein, 23 aa, Mycobacterium
ACVSACPVGAIAPDTRLDSKQLP

SEQ ID NO: 627157 - protein, 23 aa, Mycobacterium
ACVSACPVGAIAPDTRLDTNQLP

SEQ ID NO: 627158 - protein, 23 aa, Mycobacterium
ACVSACPVGAIAPDTRLEPRQLP

SEQ ID NO: 627159 - protein, 22 aa, Mycobacterium
ACWEARRWLGRPTVEHGASADL

SEQ ID NO: 627160 - protein, 18 aa, Mycobacterium
ACWEHYNPLARYALIADG

SEQ ID NO: 627161 - protein, 22 aa, Mycobacterium
ACYDAGVLRLRIPVAEKAKPRK

SEQ ID NO: 627162 - protein, 37 aa, Mycobacterium
ACYDYLGHVLFAWHLPELWRRFTIALRRAITTHLKAI

SEQ ID NO: 627163 - protein, 21 aa, Mycobacterium
ACYRGAPWLESLAYKIWGRAF

SEQ ID NO: 627164 - protein, 21 aa, Mycobacterium
ADAAAGWAEIARRLAAQEHGF

SEQ ID NO: 627165 - protein, 20 aa, Mycobacterium
ADAAARIELLVGYTRDDAAP

SEQ ID NO: 627166 - protein, 20 aa, Mycobacterium
ADAAASWRRYLDAGVLIRDV

SEQ ID NO: 627167 - protein, 23 aa, Mycobacterium
ADAADLGGPYGFAGTNFCMASGR

SEQ ID NO: 627168 - protein, 18 aa, Mycobacterium
ADAAEWLANHGWQVYSVS

SEQ ID NO: 627169 - protein, 18 aa, Mycobacterium
ADAAGRDKVCERLAQGVR

SEQ ID NO: 627170 - protein, 17 aa, Mycobacterium
ADAAGYFVLPTVVTDLP

SEQ ID NO: 627171 - protein, 30 aa, Mycobacterium
ADAALAAGLCGLRWVGAVGAVASGAALASG

SEQ ID NO: 627172 - protein, 27 aa, Mycobacterium
ADAALKDLLERGGLRAGRTERDVRNEL

SEQ ID NO: 627173 - protein, 19 aa, Mycobacterium
ADAALKVLVRLAENPDTGW

SEQ ID NO: 627174 - protein, 26 aa, Mycobacterium
ADAALPGVRSYISLVVRMNRDNVRST

SEQ ID NO: 627175 - protein, 26 aa, Mycobacterium
ADAALQCIAVLLAARPELDIPPTAHV

SEQ ID NO: 627176 - protein, 19 aa, Mycobacterium
ADAALRGDAKFIELGGDSL

SEQ ID NO: 627177 - protein, 25 aa, Mycobacterium
ADAALRRAARYGSGWWPFLTPPERI

SEQ ID NO: 627178 - protein, 20 aa, Mycobacterium
ADAAMLWSLGLGEPHAISAM

SEQ ID NO: 627179 - protein, 27 aa, Mycobacterium
ADAAQQRWFRLSALAERVSATVRIASE

SEQ ID NO: 627180 - protein, 19 aa, Mycobacterium
ADAAQRWWSVASRLDPEDV

SEQ ID NO: 627181 - protein, 18 aa, Mycobacterium
ADAARELGMAQLDRVGLR

SEQ ID NO: 627182 - protein, 18 aa, Mycobacterium
ADAARPAVAAGVVTVPRT

SEQ ID NO: 627183 - protein, 25 aa, Mycobacterium
ADAARPRGVPVIVLAGQVGLDNATV

SEQ ID NO: 627184 - protein, 19 aa, Mycobacterium
ADAATDWVKQGWLTLTPGN

SEQ ID NO: 627185 - protein, 33 aa, Mycobacterium
ADAAVPRWGKPEEMAELLAFCASEKAGYLTGTD

SEQ ID NO: 627186 - protein, 19 aa, Mycobacterium
ADAAVPWERAHSVPAPGWA

SEQ ID NO: 627187 - protein, 18 aa, Mycobacterium
ADAAWKYLSSGVYEHPAP

SEQ ID NO: 627188 - protein, 21 aa, Mycobacterium
ADAAWPLGMVTEFAANAAEGW

SEQ ID NO: 627189 - protein, 23 aa, Mycobacterium
ADAAWRAAFDHEETCVAIIKHAN

SEQ ID NO: 627190 - protein, 25 aa, Mycobacterium
ADAAWRAAFDHEQICVAIIKHANPC

SEQ ID NO: 627191 - protein, 24 aa, Mycobacterium
ADAAWRAAFDHEQKCVAIIKHANP

SEQ ID NO: 627192 - protein, 24 aa, Mycobacterium
ADAAWRAAFDHEQTCVAIIKHANP

SEQ ID NO: 627193 - protein, 24 aa, Mycobacterium
ADAAWRAAWDQDKACAAIIKHANP

SEQ ID NO: 627194 - protein, 20 aa, Mycobacterium
ADACAHALLDAIARVPEIPE

SEQ ID NO: 627195 - protein, 18 aa, Mycobacterium
ADACVADIDAVYRVGGCI

SEQ ID NO: 627196 - protein, 31 aa, Mycobacterium
ADADAALALLRAELRPGDVVLVKASNAAGLG

SEQ ID NO: 627197 - protein, 21 aa, Mycobacterium
ADADAALALLRDELRPGDVVL

SEQ ID NO: 627198 - protein, 18 aa, Mycobacterium
ADADAALNRALRQLDLVT

SEQ ID NO: 627199 - protein, 19 aa, Mycobacterium
ADADAALTVLRDELQPGDV

SEQ ID NO: 627200 - protein, 23 aa, Mycobacterium
ADADAGVCTGTWSRPHPPLYVGG

SEQ ID NO: 627201 - protein, 25 aa, Mycobacterium
ADADARAGLFPEIERRGLTVDVLVN

SEQ ID NO: 627202 - protein, 21 aa, Mycobacterium
ADADISVFVASTFHSDLVLVP

SEQ ID NO: 627203 - protein, 26 aa, Mycobacterium
ADADLRPGLLVQLAFAAADFAFQQWV

SEQ ID NO: 627204 - protein, 25 aa, Mycobacterium
ADADMWKAFAEIGIEAVHTGPVKRA

SEQ ID NO: 627205 - protein, 17 aa, Mycobacterium
ADADNTYYCFGTAAGPH

SEQ ID NO: 627206 - protein, 26 aa, Mycobacterium
ADADRVRNGWYWSGDLGYVDRDGFLY

SEQ ID NO: 627207 - protein, 23 aa, Mycobacterium
ADADVALAARCGAGSSFGHQGQV

SEQ ID NO: 627208 - protein, 26 aa, Mycobacterium
ADADVVRYLRWFTFLSAEEIGELETA

SEQ ID NO: 627209 - protein, 23 aa, Mycobacterium
ADAEAMAVALARHDELVEQVVTS

SEQ ID NO: 627210 - protein, 26 aa, Mycobacterium
ADAEGCVREALVLAAALSIPDPRERP

SEQ ID NO: 627211 - protein, 24 aa, Mycobacterium
ADAEGRILQRWSQDASAMSHLDRL

SEQ ID NO: 627212 - protein, 27 aa, Mycobacterium
ADAELARGLWRGALHGVPIGVKDLCYT

SEQ ID NO: 627213 - protein, 19 aa, Mycobacterium
ADAEMKVAQMATAQRGGRS

SEQ ID NO: 627214 - protein, 20 aa, Mycobacterium
ADAEVVFPVVQAMPIPYVEP

SEQ ID NO: 627215 - protein, 21 aa, Mycobacterium
ADAFARHDLAHWQRVLADEPG

SEQ ID NO: 627216 - protein, 17 aa, Mycobacterium
ADAFCWNMVRSLVGALL

SEQ ID NO: 627217 - protein, 18 aa, Mycobacterium
ADAFGKLSLLAATTEQAR

SEQ ID NO: 627218 - protein, 19 aa, Mycobacterium
ADAFQEYYHVPSLHSQQVP

SEQ ID NO: 627219 - protein, 21 aa, Mycobacterium
ADAFTAVPVVLARILALPERV

SEQ ID NO: 627220 - protein, 21 aa, Mycobacterium
ADAFTAVPVVLARILELPERV

SEQ ID NO: 627221 - protein, 18 aa, Mycobacterium
ADAFWNLREELLAQATDL

SEQ ID NO: 627222 - protein, 20 aa, Mycobacterium
ADAGARWILDLGPGDLLTRL

SEQ ID NO: 627223 - protein, 24 aa, Mycobacterium
ADAGFRALGLEGFRLEITSLGDET

SEQ ID NO: 627224 - protein, 20 aa, Mycobacterium
ADAGFRSLGLDGFRLEITSL

SEQ ID NO: 627225 - protein, 19 aa, Mycobacterium
ADAGIPVTVVPGVTSAIAV

SEQ ID NO: 627226 - protein, 18 aa, Mycobacterium
ADAGLPAGVLSILPTTNA

SEQ ID NO: 627227 - protein, 18 aa, Mycobacterium
ADAGLPKGVLSVLPTTSP

SEQ ID NO: 627228 - protein, 21 aa, Mycobacterium
ADAGLVLGGRVFRPLDVDLRW

SEQ ID NO: 627229 - protein, 23 aa, Mycobacterium
ADAGRFLSTIKHRLEEGAFEADL

SEQ ID NO: 627230 - protein, 20 aa, Mycobacterium
ADAGRFVTTIKRRLEEGAFE

SEQ ID NO: 627231 - protein, 33 aa, Mycobacterium
ADAGRPAPRIVAGIPVCLCANSEIDAAKDRANR

SEQ ID NO: 627232 - protein, 18 aa, Mycobacterium
ADAGVAVGSCGAAGAAEA

SEQ ID NO: 627233 - protein, 21 aa, Mycobacterium
ADAGVLASLLLNRLTLEPGEG

SEQ ID NO: 627234 - protein, 26 aa, Mycobacterium
ADAGVPWILMHWRSVDGDNPHEVPAY

SEQ ID NO: 627235 - protein, 25 aa, Mycobacterium
ADAGVRPGMTVAWQLPSHVNAAVVM

SEQ ID NO: 627236 - protein, 17 aa, Mycobacterium
ADAGWILRVVPPDRLDE

SEQ ID NO: 627237 - protein, 18 aa, Mycobacterium
ADAGYRWRDQLGDCHAVL

SEQ ID NO: 627238 - protein, 18 aa, Mycobacterium
ADAHPPEWDQFVRFATRL

SEQ ID NO: 627239 - protein, 28 aa, Mycobacterium
ADAIARGDWRAPLVIGDRLDTDIEGAHA

SEQ ID NO: 627240 - protein, 29 aa, Mycobacterium
ADAIGRLCTRGGAGLVPFSDRLAAEEWRS

SEQ ID NO: 627241 - protein, 17 aa, Mycobacterium
ADAIRYPAEFSGGQKQR

SEQ ID NO: 627242 - protein, 23 aa, Mycobacterium
ADAITHFAFGCGDDNPLFHDPTY

SEQ ID NO: 627243 - protein, 25 aa, Mycobacterium
ADAIVKLVAHPKPRVRITKAAGAMV

SEQ ID NO: 627244 - protein, 22 aa, Mycobacterium
ADAKIGYPPTRVWGVPATGLWA

SEQ ID NO: 627245 - protein, 18 aa, Mycobacterium
ADAKLVLREPVSGLEGYP

SEQ ID NO: 627246 - protein, 27 aa, Mycobacterium
ADAKPFDAVVCSLVLCSVDDPEQVVSQ

SEQ ID NO: 627247 - protein, 20 aa, Mycobacterium
ADAKPRIVMRPQEFRVAEAA

SEQ ID NO: 627248 - protein, 22 aa, Mycobacterium
ADAKRMFACFDQPDLKAAFDVT

SEQ ID NO: 627249 - protein, 22 aa, Mycobacterium
ADAKRMFACFDQPDLKATFDLR

SEQ ID NO: 627250 - protein, 22 aa, Mycobacterium
ADAKRMFACFDQPDLKATFDVE

SEQ ID NO: 627251 - protein, 24 aa, Mycobacterium
ADAKVKWSAPLGFLAQTPPAITPQ

SEQ ID NO: 627252 - protein, 19 aa, Mycobacterium
ADALAAKADRKAAAASAAW

SEQ ID NO: 627253 - protein, 17 aa, Mycobacterium
ADALAAQPRTRFVLDGE

SEQ ID NO: 627254 - protein, 18 aa, Mycobacterium
ADALARARIHGVRTNRDL

SEQ ID NO: 627255 - protein, 23 aa, Mycobacterium
ADALARLASRYALGDSALDAAEY

SEQ ID NO: 627256 - protein, 26 aa, Mycobacterium
ADALEDLRLRACEAIAKGARTLVISD

SEQ ID NO: 627257 - protein, 34 aa, Mycobacterium
ADALESILSWQGWEELFDLARFVGVSRPGYELSH

SEQ ID NO: 627258 - protein, 20 aa, Mycobacterium
ADALIALFAETAWDKTNPKP

SEQ ID NO: 627259 - protein, 24 aa, Mycobacterium
ADALKADGIVGVRLNWRHHGEGGE

SEQ ID NO: 627260 - protein, 20 aa, Mycobacterium
ADALKEFAITVVDNSDTTKT

SEQ ID NO: 627261 - protein, 23 aa, Mycobacterium
ADALKGALVSPVITAHPTEIRRR

SEQ ID NO: 627262 - protein, 24 aa, Mycobacterium
ADALKGAVVAPVITAHPTETRRRT

SEQ ID NO: 627263 - protein, 18 aa, Mycobacterium
ADALKWGLINQVVPDGTV

SEQ ID NO: 627264 - protein, 17 aa, Mycobacterium
ADALLVRSATTVDAEVI

SEQ ID NO: 627265 - protein, 21 aa, Mycobacterium
ADALMAVPVMLARILDLPQAV

SEQ ID NO: 627266 - protein, 24 aa, Mycobacterium
ADALMERWRCSAWREYRAAADALA

SEQ ID NO: 627267 - protein, 17 aa, Mycobacterium
ADALMLLYLLSADELGE

SEQ ID NO: 627268 - protein, 20 aa, Mycobacterium
ADALPKSWDPGAVEAELYQG

SEQ ID NO: 627269 - protein, 19 aa, Mycobacterium
ADALPQLLAVVQWDAGPKF

SEQ ID NO: 627270 - protein, 24 aa, Mycobacterium
ADALPRDFCDLLSPAMVDELIAER

SEQ ID NO: 627271 - protein, 34 aa, Mycobacterium
ADALPRQPRFALLKGRRNYLCLNKIHSDGSTGDP

SEQ ID NO: 627272 - protein, 34 aa, Mycobacterium
ADALPRRPQFALLKGRRNYLCLNKIHNGGAADGD

SEQ ID NO: 627273 - protein, 19 aa, Mycobacterium
ADALPWLTALNGKIVVVKY

SEQ ID NO: 627274 - protein, 18 aa, Mycobacterium
ADALRAGLVTEVVPHDEL

SEQ ID NO: 627275 - protein, 19 aa, Mycobacterium
ADALRAGLVTEVVPHDQLL

SEQ ID NO: 627276 - protein, 18 aa, Mycobacterium
ADALRAGLVTEVVPHERL

SEQ ID NO: 627277 - protein, 18 aa, Mycobacterium
ADALRDVKSGWKVAEAFP

SEQ ID NO: 627278 - protein, 17 aa, Mycobacterium
ADALRFTLARGASPGGD

SEQ ID NO: 627279 - protein, 21 aa, Mycobacterium
ADALRGMAFAHPELRIDHTNR

SEQ ID NO: 627280 - protein, 17 aa, Mycobacterium
ADALRRFRSYNRPGFHP

SEQ ID NO: 627281 - protein, 22 aa, Mycobacterium
ADALRSGAVVLVFPGGDYDSYR

SEQ ID NO: 627282 - protein, 17 aa, Mycobacterium
ADALSAFYIPVTPEAGQ

SEQ ID NO: 627283 - protein, 18 aa, Mycobacterium
ADALSAWLDRGRPHLAVP

SEQ ID NO: 627284 - protein, 20 aa, Mycobacterium
ADALTDYPFAYLITVDDDHH

SEQ ID NO: 627285 - protein, 22 aa, Mycobacterium
ADALTFRGAAMSNPAAAGSSGF

SEQ ID NO: 627286 - protein, 25 aa, Mycobacterium
ADALTKLKQNWLPDEAIAMLAHDAL

SEQ ID NO: 627287 - protein, 17 aa, Mycobacterium
ADALTWYRAALESNGSE

SEQ ID NO: 627288 - protein, 28 aa, Mycobacterium
ADALVGCTDCWGRIAADVITMVRPEIAE

SEQ ID NO: 627289 - protein, 19 aa, Mycobacterium
ADALVSWADPRYLNGREPL

SEQ ID NO: 627290 - protein, 18 aa, Mycobacterium
ADALYAYGRDATYDDVFT

SEQ ID NO: 627291 - protein, 22 aa, Mycobacterium
ADAMGIEKLRVIGTGLDPVVAE

SEQ ID NO: 627292 - protein, 23 aa, Mycobacterium
ADAMGITRPALYYYVKSKDDLLA

SEQ ID NO: 627293 - protein, 23 aa, Mycobacterium
ADAMGITRPALYYYVKSKEDLLS

SEQ ID NO: 627294 - protein, 17 aa, Mycobacterium
ADAMPWNQLPGPIRAVV

SEQ ID NO: 627295 - protein, 17 aa, Mycobacterium
ADAMPWNQLPMPVQRVA

SEQ ID NO: 627296 - protein, 20 aa, Mycobacterium
ADANWSLFTRLMPILPTTET

SEQ ID NO: 627297 - protein, 25 aa, Mycobacterium
ADAPDDVCFTWRFGDAPACRALFAS

SEQ ID NO: 627298 - protein, 26 aa, Mycobacterium
ADAPDRLRWVIAQAIGTIEDGIGIGG

SEQ ID NO: 627299 - protein, 17 aa, Mycobacterium
ADAPGALRWLPIDPVSR

SEQ ID NO: 627300 - protein, 24 aa, Mycobacterium
ADAPGPLLRREFRPSRAVMEPLRN

SEQ ID NO: 627301 - protein, 26 aa, Mycobacterium
ADAPPAIELSMMWRNDCESPHLQPLR

SEQ ID NO: 627302 - protein, 24 aa, Mycobacterium
ADAPRGWANCKWVVACNMQDAVTV

SEQ ID NO: 627303 - protein, 21 aa, Mycobacterium
ADAPSALGYLAARTERMLLGS

SEQ ID NO: 627304 - protein, 24 aa, Mycobacterium
ADAPTCPVALAFPDGQQPPLVEEF

SEQ ID NO: 627305 - protein, 26 aa, Mycobacterium
ADAPVDWRFKGLPASWAGRTPADIVG

SEQ ID NO: 627306 - protein, 19 aa, Mycobacterium
ADAQAMAGVMIYVSPTSRL

SEQ ID NO: 627307 - protein, 24 aa, Mycobacterium
ADARAEVARAWYISALPEAPGRDT

SEQ ID NO: 627308 - protein, 21 aa, Mycobacterium
ADARAFLDFAGRHHIEVTTPE

SEQ ID NO: 627309 - protein, 23 aa, Mycobacterium
ADARATHPLLWKCGSAYHSADYA

SEQ ID NO: 627310 - protein, 23 aa, Mycobacterium
ADARFVGGMFACIALAIHELTGA

SEQ ID NO: 627311 - protein, 17 aa, Mycobacterium
ADARLLLNNALEAGETV

SEQ ID NO: 627312 - protein, 18 aa, Mycobacterium
ADARLRVKRRRTERERLQ

SEQ ID NO: 627313 - protein, 17 aa, Mycobacterium
ADARPDLVSHITYLAAA

SEQ ID NO: 627314 - protein, 22 aa, Mycobacterium
ADARPLVPIYLGDDITDEDAFD

SEQ ID NO: 627315 - protein, 17 aa, Mycobacterium
ADARRELARIGVDNLTG

SEQ ID NO: 627316 - protein, 18 aa, Mycobacterium
ADARRIVAFLTDVMRRSP

SEQ ID NO: 627317 - protein, 34 aa, Mycobacterium
ADARTFMGCYAFPNHVLPRYPGRGLGVAVPTVVD

SEQ ID NO: 627318 - protein, 26 aa, Mycobacterium
ADARVDGPMPFPVVPASRPLTAERDR

SEQ ID NO: 627319 - protein, 17 aa, Mycobacterium
ADARVVETFGLIADAVA

SEQ ID NO: 627320 - protein, 24 aa, Mycobacterium
ADARWLRTGDLGVYRDGELYVTGR

SEQ ID NO: 627321 - protein, 27 aa, Mycobacterium
ADASPRCRWTALGVDLTRDWTTALRST

SEQ ID NO: 627322 - protein, 22 aa, Mycobacterium
ADATELLIELGIEPAQNTVHAW

SEQ ID NO: 627323 - protein, 20 aa, Mycobacterium
ADATELLIELGLEPAQNRVH

SEQ ID NO: 627324 - protein, 18 aa, Mycobacterium
ADATELLIEMGLETAQNR

SEQ ID NO: 627325 - protein, 18 aa, Mycobacterium
ADATELLVEIGLEPAQNR

SEQ ID NO: 627326 - protein, 18 aa, Mycobacterium
ADATELLVELGLEPAQNR

SEQ ID NO: 627327 - protein, 20 aa, Mycobacterium
ADATLAWAYTGVVECVAGAD

SEQ ID NO: 627328 - protein, 25 aa, Mycobacterium
ADATLTRFRGIGVRTVLSHGSYLDG

SEQ ID NO: 627329 - protein, 23 aa, Mycobacterium
ADATRLDGFEGRFDTVVDSAFYH

SEQ ID NO: 627330 - protein, 23 aa, Mycobacterium
ADATRLEGLEGRFDTVVDCAFYH

SEQ ID NO: 627331 - protein, 25 aa, Mycobacterium
ADATRRWELRASQGRPICGVEIRLR

SEQ ID NO: 627332 - protein, 25 aa, Mycobacterium
ADATRRWEMRASQGRPICGVEIRLR

SEQ ID NO: 627333 - protein, 26 aa, Mycobacterium
ADATRSGLVPLQWAVACLLADIGSQA

SEQ ID NO: 627334 - protein, 23 aa, Mycobacterium
ADATRVQILWSLATTEMSVNELA

SEQ ID NO: 627335 - protein, 22 aa, Mycobacterium
ADATRVQVLWSLTDHEMSVNEL

SEQ ID NO: 627336 - protein, 23 aa, Mycobacterium
ADATRVQVLWSLTDRELSVNELA

SEQ ID NO: 627337 - protein, 24 aa, Mycobacterium
ADATYMWPWMFSKVADEYDRRYCL

SEQ ID NO: 627338 - protein, 17 aa, Mycobacterium
ADAVALDAFARAGAQGL

SEQ ID NO: 627339 - protein, 21 aa, Mycobacterium
ADAVARFFGNRTWWPRLSSTV

SEQ ID NO: 627340 - protein, 19 aa, Mycobacterium
ADAVFDFLVATTVVRAMTR

SEQ ID NO: 627341 - protein, 26 aa, Mycobacterium
ADAVKARGSLRLSLGHTSTEADVDTA

SEQ ID NO: 627342 - protein, 26 aa, Mycobacterium
ADAVLAGPCAWFFGNEAHGLDGATAA

SEQ ID NO: 627343 - protein, 29 aa, Mycobacterium
ADAVLLIGARLNWLLGHGESPQWSADAKF

SEQ ID NO: 627344 - protein, 29 aa, Mycobacterium
ADAVLLIGARLNWLLGHGESPQWSADTQF

SEQ ID NO: 627345 - protein, 31 aa, Mycobacterium; identical to SEQ ID NO: 93239

SEQ ID NO: 627346 - protein, 34 aa, Mycobacterium
ADAVPQIWPGRAIYRIWPDFDVQPLIDASSRTVK

SEQ ID NO: 627347 - protein, 20 aa, Mycobacterium
ADAVRFAVNYLRGFATDPGE

SEQ ID NO: 627348 - protein, 24 aa, Mycobacterium
ADAVSFRFGDRTQINGVPREAAVA

SEQ ID NO: 627349 - protein, 19 aa, Mycobacterium
ADAVTLYRGVAVAALASAD

SEQ ID NO: 627350 - protein, 22 aa, Mycobacterium
ADAWRAIPSWEFHRANVDPGRA

SEQ ID NO: 627351 - protein, 22 aa, Mycobacterium
ADAWRARYRPILDEVNDGLRPW

SEQ ID NO: 627352 - protein, 19 aa, Mycobacterium
ADAWSLQEVLALGVSAGAP

SEQ ID NO: 627353 - protein, 21 aa, Mycobacterium
ADAYFALSQVEWGCTANERRL

SEQ ID NO: 627354 - protein, 21 aa, Mycobacterium
ADAYKDTWSRALLILLSETLP

SEQ ID NO: 627355 - protein, 28 aa, Mycobacterium
ADAYKHMLDRAGAWDALHAELDDLDADD

SEQ ID NO: 627356 - protein, 18 aa, Mycobacterium
ADAYPFLEFRQSRPAVRR

SEQ ID NO: 627357 - protein, 18 aa, Mycobacterium
ADAYRFLPTLGEVDLHLF

SEQ ID NO: 627358 - protein, 18 aa, Mycobacterium
ADCAVSLNRLRAMPTTAA

SEQ ID NO: 627359 - protein, 32 aa, Mycobacterium
ADCDDTRDSLSFKLRHLLILEAKEVLLHDPFL

SEQ ID NO: 627360 - protein, 32 aa, Mycobacterium
ADCDDTRDSLSFKLRHLLMLEAKEVILHDPFL

SEQ ID NO: 627361 - protein, 22 aa, Mycobacterium
ADCGDKFDIVQSFTDDALTVCQ

SEQ ID NO: 627362 - protein, 17 aa, Mycobacterium
ADCGHVVLVPAISPLAE

SEQ ID NO: 627363 - protein, 23 aa, Mycobacterium
ADCGHVVLVPAISPLAEHRALAR

SEQ ID NO: 627364 - protein, 31 aa, Mycobacterium
ADCGLKVLVETARLWLSLGHHDRHGVWHLDG

SEQ ID NO: 627365 - protein, 24 aa, Mycobacterium
ADCLVVSVGYRLAPEHPCPAALDD

SEQ ID NO: 627366 - protein, 23 aa, Mycobacterium
ADCRELASVGARVRLCKGAYDEP

SEQ ID NO: 627367 - protein, 17 aa, Mycobacterium
ADDAFEFGLAVLLRGLT

SEQ ID NO: 627368 - protein, 21 aa, Mycobacterium
ADDAIGAWLWSGRRGIVTVRA

SEQ ID NO: 627369 - protein, 19 aa, Mycobacterium
ADDALQWFLRSAAADVDGV

SEQ ID NO: 627370 - protein, 19 aa, Mycobacterium
ADDAVAVGFDAKVAIHPTQ

SEQ ID NO: 627371 - protein, 20 aa, Mycobacterium
ADDAVFWEPFLDRGFSPDSG

SEQ ID NO: 627372 - protein, 19 aa, Mycobacterium
ADDDPRWSLDLAGGAVMDL

SEQ ID NO: 627373 - protein, 20 aa, Mycobacterium
ADDFFALSQVEWGCVANERL

SEQ ID NO: 627374 - protein, 30 aa, Mycobacterium
ADDFFPVPCCFPTCRSITYLLTDGEHVVPI

SEQ ID NO: 627375 - protein, 22 aa, Mycobacterium
ADDFGPFVACFSMFGDDLSQWR

SEQ ID NO: 627376 - protein, 38 aa, Mycobacterium
ADDGARIPVSIVHRAGIEFPAPALLYGYGAYEICTDPS

SEQ ID NO: 627377 - protein, 17 aa, Mycobacterium
ADDGELLVRGGVVFSGY

SEQ ID NO: 627378 - protein, 28 aa, Mycobacterium
ADDGFEISPRLAAAITDSAASLALDPEA

SEQ ID NO: 627379 - protein, 23 aa, Mycobacterium
ADDGRIRVGITVNDRSEGDLRAN

SEQ ID NO: 627380 - protein, 23 aa, Mycobacterium
ADDGRWRVIAGRTGRKGQGSRKG

SEQ ID NO: 627381 - protein, 21 aa, Mycobacterium
ADDGSRWGRPVAATTGPDGSV

SEQ ID NO: 627382 - protein, 20 aa, Mycobacterium
ADDIAALMTLEMGKVLAESK

SEQ ID NO: 627383 - protein, 23 aa, Mycobacterium
ADDIAGALAWLVSDEARYITGVA

SEQ ID NO: 627384 - protein, 29 aa, Mycobacterium
ADDIFCVADGPALLDCLEFDDQLRYVDRI

SEQ ID NO: 627385 - protein, 23 aa, Mycobacterium
ADDINFLTLNAFFTSIGGGTDQV

SEQ ID NO: 627386 - protein, 24 aa, Mycobacterium
ADDIRLRRMAVFDVLINNADRKGG

SEQ ID NO: 627387 - protein, 26 aa, Mycobacterium
ADDISAAVAALFSGHALDYQALSTQM

SEQ ID NO: 627388 - protein, 28 aa, Mycobacterium
ADDLAALCGPVFGDLPLPPLGEYFDELT

SEQ ID NO: 627389 - protein, 26 aa, Mycobacterium
ADDLHRAISTFARMDAVLITAVNGVA

SEQ ID NO: 627390 - protein, 22 aa, Mycobacterium
ADDLRWWADRIREWTAQGRDVV

SEQ ID NO: 627391 - protein, 19 aa, Mycobacterium
ADDLYRFVLTNHHIVLDGW

SEQ ID NO: 627392 - protein, 18 aa, Mycobacterium
ADDMMLYKYIVKNTAWQH

SEQ ID NO: 627393 - protein, 21 aa, Mycobacterium
ADDPAPLWLAAPVTEVLPRVV

SEQ ID NO: 627394 - protein, 24 aa, Mycobacterium
ADDPFWPRLATHLDGAARAGADVA

SEQ ID NO: 627395 - protein, 18 aa, Mycobacterium
ADDPLTERVEFVRNAAGD

SEQ ID NO: 627396 - protein, 19 aa, Mycobacterium
ADDPMAIAVADRLFAVPQS

SEQ ID NO: 627397 - protein, 23 aa, Mycobacterium
ADDPRFATGEARLDNRDELVERV

SEQ ID NO: 627398 - protein, 18 aa, Mycobacterium
ADDPRFSDVLPLIQNAGA

SEQ ID NO: 627399 - protein, 24 aa, Mycobacterium
ADDPRRRLAAAMAKASAGECQALV

SEQ ID NO: 627400 - protein, 19 aa, Mycobacterium
ADDPVGFGPALQVVTEHGS

SEQ ID NO: 627401 - protein, 17 aa, Mycobacterium
ADDRYLCINPFFHNFGY

SEQ ID NO: 627402 - protein, 23 aa, Mycobacterium
ADDSAADALAFRGAAISRSAAGG

SEQ ID NO: 627403 - protein, 23 aa, Mycobacterium
ADDSRRLLLMIGKDMGLDTKRHS

SEQ ID NO: 627404 - protein, 21 aa, Mycobacterium
ADDTAHYLWTWTDEAAGELRS

SEQ ID NO: 627405 - protein, 18 aa, Mycobacterium
ADDVDTWMASPYAPQGVA

SEQ ID NO: 627406 - protein, 24 aa, Mycobacterium
ADDVERRGFLALIRDAHLEATGGG

SEQ ID NO: 627407 - protein, 26 aa, Mycobacterium
ADDVLRPLPVTRFDVRRAPAALRYLS

SEQ ID NO: 627408 - protein, 20 aa, Mycobacterium
ADDVRCGFQQVRVVITVTGP

SEQ ID NO: 627409 - protein, 23 aa, Mycobacterium
ADDVRLRRMAVFDVLINNADRKG

SEQ ID NO: 627410 - protein, 35 aa, Mycobacterium
ADDVSAAVSSFFGAYARDYQAFSVQVEALHDQFVR

SEQ ID NO: 627411 - protein, 18 aa, Mycobacterium
ADDVWPTLSQGERGRTLI

SEQ ID NO: 627412 - protein, 22 aa, Mycobacterium
ADDVWRLLARTHVELDESIDEL

SEQ ID NO: 627413 - protein, 17 aa, Mycobacterium
ADDYLLEHLHRLRAGQK

SEQ ID NO: 627414 - protein, 20 aa, Mycobacterium
ADDYLRFVRMLLGGGTIDGV

SEQ ID NO: 627415 - protein, 28 aa, Mycobacterium
ADEACYRAELAGLPGVRVLHGYTRSGGG

SEQ ID NO: 627416 - protein, 19 aa, Mycobacterium
ADEACYRDELDGIRAAIPH

SEQ ID NO: 627417 - protein, 22 aa, Mycobacterium
ADEAFRLLGSVDVVFSNAGIVV

SEQ ID NO: 627418 - protein, 25 aa, Mycobacterium
ADEAHRMGIAWKVCEPDDLLPEARR

SEQ ID NO: 627419 - protein, 17 aa, Mycobacterium
ADEALRWMNEINADATL

SEQ ID NO: 627420 - protein, 25 aa, Mycobacterium
ADEAQDRFGRKVSWGVEVRSGDKTE

SEQ ID NO: 627421 - protein, 17 aa, Mycobacterium
ADEAREGARLGVDSSVN

SEQ ID NO: 627422 - protein, 25 aa, Mycobacterium
ADEATRQALQWAMSVAAKRAAALVA

SEQ ID NO: 627423 - protein, 17 aa, Mycobacterium
ADEAVPFLAAYRYKPSG

SEQ ID NO: 627424 - protein, 17 aa, Mycobacterium
ADEDFHPLWAHNRREER

SEQ ID NO: 627425 - protein, 17 aa, Mycobacterium
ADEEFRVGVLPTLRAVR

SEQ ID NO: 627426 - protein, 18 aa, Mycobacterium
ADEFFALSQAEWGCTTNE

SEQ ID NO: 627427 - protein, 25 aa, Mycobacterium
ADEFTCSSCFLVQHRSRLASEKNGL

SEQ ID NO: 627428 - protein, 31 aa, Mycobacterium
ADEFTCSSCFLVQHRSRLRRSSSGLPVCADC

SEQ ID NO: 627429 - protein, 23 aa, Mycobacterium
ADEFVLLLVVHHICWDDDSWKIF

SEQ ID NO: 627430 - protein, 23 aa, Mycobacterium
ADEGRALYDAALRYLGGGTGVEI

SEQ ID NO: 627431 - protein, 23 aa, Mycobacterium
ADEHGMRTVMCILNGQLRPVQVR

SEQ ID NO: 627432 - protein, 21 aa, Mycobacterium
ADEHLPLLAGMFLAHGEAFHR

SEQ ID NO: 627433 - protein, 26 aa, Mycobacterium
ADEIRELLARLGYRFTPKQIPETVDY

SEQ ID NO: 627434 - protein, 34 aa, Mycobacterium
ADEIRPLFYEWFIRADTSLSFVIYSAQIIIPAIL

SEQ ID NO: 627435 - protein, 18 aa, Mycobacterium
ADELCDRIAFVVDGSIVA

SEQ ID NO: 627436 - protein, 18 aa, Mycobacterium
ADELCDRVAFVVDGSIVV

SEQ ID NO: 627437 - protein, 23 aa, Mycobacterium
ADELGLRVALIGTPAEEAGGGKA

SEQ ID NO: 627438 - protein, 22 aa, Mycobacterium
ADELGLRVALLGTPAEEAGGGK

SEQ ID NO: 627439 - protein, 22 aa, Mycobacterium
ADELKAALDLVGDTVRQFDFES

SEQ ID NO: 627440 - protein, 24 aa, Mycobacterium
ADELKALLKEVGMGLDTADPDSSE

SEQ ID NO: 627441 - protein, 18 aa, Mycobacterium
ADELKYFSRKDARAYLEF

SEQ ID NO: 627442 - protein, 22 aa, Mycobacterium
ADELLELGRYLGAFVQGELIGG

SEQ ID NO: 627443 - protein, 18 aa, Mycobacterium
ADELLQIRGGRGYETAES

SEQ ID NO: 627444 - protein, 23 aa, Mycobacterium
ADELPERHHLLLSRGPYTVAEET

SEQ ID NO: 627445 - protein, 22 aa, Mycobacterium
ADELRGTVFLVDTAELPAIDDP

SEQ ID NO: 627446 - protein, 23 aa, Mycobacterium
ADELRLHAAMTLLRREQPVTKVI

SEQ ID NO: 627447 - protein, 27 aa, Mycobacterium
ADELRRTAGRLAGWVRAHDDLALPDLA

SEQ ID NO: 627448 - protein, 20 aa, Mycobacterium
ADELSGLFVPTDVADEDAVN

SEQ ID NO: 627449 - protein, 28 aa, Mycobacterium
ADELSSRGPTSWPPRVIGRWRHTHSFFD

SEQ ID NO: 627450 - protein, 32 aa, Mycobacterium
ADELTLRYLLPMAHEGLRRWGVAPQVRDRYLG

SEQ ID NO: 627451 - protein, 21 aa, Mycobacterium
ADEMAELLIAGGFSDVSISGL

SEQ ID NO: 627452 - protein, 26 aa, Mycobacterium
ADEMLAMGFAEDVERILSDTPEYKQV

SEQ ID NO: 627453 - protein, 24 aa, Mycobacterium
ADEPASILILFAPGAPREHYFEGL

SEQ ID NO: 627454 - protein, 22 aa, Mycobacterium
ADEPASILMLFAPGAPREAYFE

SEQ ID NO: 627455 - protein, 23 aa, Mycobacterium
ADEPDIWFQPLIAGFERDPGRGF

SEQ ID NO: 627456 - protein, 21 aa, Mycobacterium
ADEPMEFCQRVSRAIAAEVHA

SEQ ID NO: 627457 - protein, 22 aa, Mycobacterium
ADEPRLHAALAELRSQTPVAYV

SEQ ID NO: 627458 - protein, 20 aa, Mycobacterium
ADEPVEFSRRLSRAIAAEVQ

SEQ ID NO: 627459 - protein, 25 aa, Mycobacterium
ADEPYRRAVRVIRARLSATSAAILD

SEQ ID NO: 627460 - protein, 25 aa, Mycobacterium
ADEPYRRAVRVIRARLTATGAEILD

SEQ ID NO: 627461 - protein, 31 aa, Mycobacterium
ADEQARFATYPVLAVQGWAAFHDLKLRAVIG

SEQ ID NO: 627462 - protein, 18 aa, Mycobacterium
ADEQGPGIAVFLVPAKAP

SEQ ID NO: 627463 - protein, 23 aa, Mycobacterium
ADEQLKLVFALRDVRKERGLEIA

SEQ ID NO: 627464 - protein, 19 aa, Mycobacterium
ADERAQWPHWVPVGRMGVP

SEQ ID NO: 627465 - protein, 23 aa, Mycobacterium
ADERASSVLAEYGYPTAHRAAQV

SEQ ID NO: 627466 - protein, 24 aa, Mycobacterium
ADERGMRTVMCIINGQLRPVLVRD

SEQ ID NO: 627467 - protein, 20 aa, Mycobacterium
ADERLRRALTPGYPFRCKRV

SEQ ID NO: 627468 - protein, 27 aa, Mycobacterium
ADESKMPKVFFVNWFRRGDDGGFLWPG

SEQ ID NO: 627469 - protein, 21 aa, Mycobacterium
ADESLQRFGAAIQRELTDAAR

SEQ ID NO: 627470 - protein, 19 aa, Mycobacterium
ADETACLQSSLGEAFDLLA

SEQ ID NO: 627471 - protein, 17 aa, Mycobacterium
ADETELVLGRNPVLECL

SEQ ID NO: 627472 - protein, 24 aa, Mycobacterium
ADETPGLRPGRLFRSGELSRLDDE

SEQ ID NO: 627473 - protein, 20 aa, Mycobacterium
ADETYYCFGTAAGPHPFPLM

SEQ ID NO: 627474 - protein, 18 aa, Mycobacterium
ADEVGHCVVLVAEVSGDL

SEQ ID NO: 627475 - protein, 21 aa, Mycobacterium
ADEVIEGPMFVTGEPRSGTTL

SEQ ID NO: 627476 - protein, 17 aa, Mycobacterium
ADEVLRCPECSAILVRP

SEQ ID NO: 627477 - protein, 30 aa, Mycobacterium
ADEVMAGFGRSGKWFSINHFDVVPDLLTFA

SEQ ID NO: 627478 - protein, 18 aa, Mycobacterium
ADEVNFLTLNAFFTSIGG

SEQ ID NO: 627479 - protein, 23 aa, Mycobacterium
ADEVSAAIAAFFQQHGLNYQALS

SEQ ID NO: 627480 - protein, 23 aa, Mycobacterium
ADEVSAAIAALFGAHGQAYQVLS

SEQ ID NO: 627481 - protein, 23 aa, Mycobacterium
ADEVSAAIAALFNTHAQAYQSLS

SEQ ID NO: 627482 - protein, 27 aa, Mycobacterium
ADEVSAAIASLFAGYARDYQSLSAQAA

SEQ ID NO: 627483 - protein, 24 aa, Mycobacterium
ADEVSAAITALFGAHAQTYQALSA

SEQ ID NO: 627484 - protein, 23 aa, Mycobacterium
ADEVSAAVAALFDAQGQAYQLLS

SEQ ID NO: 627485 - protein, 23 aa, Mycobacterium
ADEVSAAVAALFDGHAQAYQLLG

SEQ ID NO: 627486 - protein, 23 aa, Mycobacterium
ADEVSAAVAAVFGAHAQSYRAVS

SEQ ID NO: 627487 - protein, 21 aa, Mycobacterium
ADEVSEAIATLFDNYAQGYQA

SEQ ID NO: 627488 - protein, 23 aa, Mycobacterium
ADEVSTAIAALFDAHGQAYQRLS

SEQ ID NO: 627489 - protein, 23 aa, Mycobacterium
ADEVSTHIAALFSTHGLQYQLAS

SEQ ID NO: 627490 - protein, 19 aa, Mycobacterium
ADEVTGMFISLMFAGHHTS

SEQ ID NO: 627491 - protein, 17 aa, Mycobacterium
ADEVTWTQFGVRLEAIG

SEQ ID NO: 627492 - protein, 24 aa, Mycobacterium
ADEVVVEWPSRYLAAEVQAGAIDE

SEQ ID NO: 627493 - protein, 21 aa, Mycobacterium
ADEWAAPSGRRMDLPMRGNVL

SEQ ID NO: 627494 - protein, 23 aa, Mycobacterium
ADEYDRRYCLDPAHLRVIAAVNF

SEQ ID NO: 627495 - protein, 22 aa, Mycobacterium
ADEYLAAIIELWTSDTPRFEGR

SEQ ID NO: 627496 - protein, 21 aa, Mycobacterium
ADEYYAIVPIDIRRTEEDFMT

SEQ ID NO: 627497 - protein, 19 aa, Mycobacterium
ADFAALFPVEIISSMLGVP

SEQ ID NO: 627498 - protein, 18 aa, Mycobacterium
ADFADLWQVRALADKIRS

SEQ ID NO: 627499 - protein, 24 aa, Mycobacterium
ADFAKACAESGVIFVGPSPEAIAS

SEQ ID NO: 627500 - protein, 20 aa, Mycobacterium
ADFAKYPFLVRGYIGPKALL

SEQ ID NO: 627501 - protein, 22 aa, Mycobacterium
ADFANAALFAAFSMVTHAGQGC

SEQ ID NO: 627502 - protein, 18 aa, Mycobacterium
ADFAVCGGVEGGIEALPI

SEQ ID NO: 627503 - protein, 17 aa, Mycobacterium
ADFDARWFGWVNPADKA

SEQ ID NO: 627504 - protein, 24 aa, Mycobacterium
ADFDDLRVGMPVTAVFRPVDDTDP

SEQ ID NO: 627505 - protein, 18 aa, Mycobacterium
ADFDTLVGIATRDNPGLK

SEQ ID NO: 627506 - protein, 18 aa, Mycobacterium
ADFDTWKGLGETALAVIK

SEQ ID NO: 627507 - protein, 23 aa, Mycobacterium
ADFDYWRPLMANLPEPLELPGPH

SEQ ID NO: 627508 - protein, 20 aa, Mycobacterium
ADFEAAGLLLSAADAAAQAV

SEQ ID NO: 627509 - protein, 20 aa, Mycobacterium
ADFELWCFAVSSINGCSHCV

SEQ ID NO: 627510 - protein, 18 aa, Mycobacterium
ADFFELWSKFAATRTPTI

SEQ ID NO: 627511 - protein, 23 aa, Mycobacterium
ADFGDDLPIAWRHRSERYTEKLA

SEQ ID NO: 627512 - protein, 17 aa, Mycobacterium
ADFGSLYLADDRPGRVF

SEQ ID NO: 627513 - protein, 25 aa, Mycobacterium
ADFGWEIVDATAWSAGQLDEAIGDA

SEQ ID NO: 627514 - protein, 25 aa, Mycobacterium
ADFKQCPLLYRFRAIDRLPEAPSPA

SEQ ID NO: 627515 - protein, 23 aa, Mycobacterium
ADFKRLVTDWQLRGGPGGVPNTH

SEQ ID NO: 627516 - protein, 17 aa, Mycobacterium
ADFKRPSPHWWFDDDTL

SEQ ID NO: 627517 - protein, 17 aa, Mycobacterium
ADFLQRLTLGPREQAIA

SEQ ID NO: 627518 - protein, 24 aa, Mycobacterium
ADFLRRQAPELLPASFGAVQSESA

SEQ ID NO: 627519 - protein, 21 aa, Mycobacterium
ADFNPRPGIEALLTALVTPPQ

SEQ ID NO: 627520 - protein, 19 aa, Mycobacterium
ADFPLMLKLTQELFGNKDD

SEQ ID NO: 627521 - protein, 19 aa, Mycobacterium
ADFPMTGVFDLWQEDARVL

SEQ ID NO: 627522 - protein, 31 aa, Mycobacterium
ADFPRYPLNFVSDLNAIMGIYYVHTQYPTLT

SEQ ID NO: 627523 - protein, 17 aa, Mycobacterium
ADFRAAWSPAPMRSPRG

SEQ ID NO: 627524 - protein, 17 aa, Mycobacterium
ADFRAVVRPNFDTLYSS

SEQ ID NO: 627525 - protein, 17 aa, Mycobacterium
ADFRRRAEDAGRDPATL

SEQ ID NO: 627526 - protein, 19 aa, Mycobacterium
ADFSTRFLASYAAGKAAVD

SEQ ID NO: 627527 - protein, 19 aa, Mycobacterium
ADFTARWAGPSTRRIGYLT

SEQ ID NO: 627528 - protein, 17 aa, Mycobacterium
ADFVKRQNIGSFTLGPI

SEQ ID NO: 627529 - protein, 18 aa, Mycobacterium
ADFVREMTHRGLADRIIE

SEQ ID NO: 627530 - protein, 19 aa, Mycobacterium
ADFVRKEFRSLRVKVDDDT

SEQ ID NO: 627531 - protein, 23 aa, Mycobacterium
ADFVYLQAWIDGASTYRIAGDRG

SEQ ID NO: 627532 - protein, 21 aa, Mycobacterium
ADFWETVLFRAGLYRGSALHA

SEQ ID NO: 627533 - protein, 24 aa, Mycobacterium
ADFYAPDATYGWNIGPKEDVMCVG

SEQ ID NO: 627534 - protein, 20 aa, Mycobacterium
ADFYTAVAVPLPMMVLCELL

SEQ ID NO: 627535 - protein, 23 aa, Mycobacterium
ADFYVCGPNEFMDTVRTALGAAG

SEQ ID NO: 627536 - protein, 23 aa, Mycobacterium
ADGALDRPALAAIAFQDDEHRAT

SEQ ID NO: 627537 - protein, 26 aa, Mycobacterium
ADGAMAVAIGGAWQAGWAPNDLHEFA

SEQ ID NO: 627538 - protein, 21 aa, Mycobacterium
ADGANAVNIAFTPNEPQATAG

SEQ ID NO: 627539 - protein, 25 aa, Mycobacterium
ADGARFRPVEMESLAHYPLTVVSHM

SEQ ID NO: 627540 - protein, 25 aa, Mycobacterium
ADGASHWYQEFARIVPMMEKDVHYE

SEQ ID NO: 627541 - protein, 26 aa, Mycobacterium
ADGASNWYTEFARIVPLMEKDTHYEV

SEQ ID NO: 627542 - protein, 18 aa, Mycobacterium
ADGAWIVGGLKDLVILKS

SEQ ID NO: 627543 - protein, 18 aa, Mycobacterium
ADGCADVPALKSCTSAGT

SEQ ID NO: 627544 - protein, 17 aa, Mycobacterium
ADGDEWEAFLGKDEDLY

SEQ ID NO: 627545 - protein, 23 aa, Mycobacterium
ADGEAALALLRAELQPGDVVLVK

SEQ ID NO: 627546 - protein, 18 aa, Mycobacterium
ADGEFLVLVGPSGCGKST

SEQ ID NO: 627547 - protein, 19 aa, Mycobacterium
ADGELWPVGPPAGGETVLL

SEQ ID NO: 627548 - protein, 27 aa, Mycobacterium
ADGENWWRVVDLWQRIKAPLLDAMLAP

SEQ ID NO: 627549 - protein, 26 aa, Mycobacterium
ADGENWWRVVKLWERIKAPLLDAMLA

SEQ ID NO: 627550 - protein, 23 aa, Mycobacterium
ADGEPAWLRFLGVNPRHHSLAFM

SEQ ID NO: 627551 - protein, 27 aa, Mycobacterium
ADGEPRWPTFGIRLSARPGIPPTRPVH

SEQ ID NO: 627552 - protein, 26 aa, Mycobacterium
ADGERRPGWVGLPLAGVQTRLVDDNG

SEQ ID NO: 627553 - protein, 23 aa, Mycobacterium
ADGESGPSFGPRMGSATADVVIG

SEQ ID NO: 627554 - protein, 18 aa, Mycobacterium
ADGFGFGAEGDWKTSAMV

SEQ ID NO: 627555 - protein, 17 aa, Mycobacterium
ADGFIVLAQRHWDMLTK

SEQ ID NO: 627556 - protein, 18 aa, Mycobacterium
ADGFIVLAQRHWDMLTPY

SEQ ID NO: 627557 - protein, 17 aa, Mycobacterium
ADGFIVLAQRHWEMLTA

SEQ ID NO: 627558 - protein, 26 aa, Mycobacterium
ADGGDGGAGGFIIGTYGGNGGGAAGA

SEQ ID NO: 627559 - protein, 23 aa, Mycobacterium
ADGGEALTEFAGRACYQSWSKPN

SEQ ID NO: 627560 - protein, 17 aa, Mycobacterium
ADGGGIVNPEYGDGGAG

SEQ ID NO: 627561 - protein, 20 aa, Mycobacterium
ADGGLACWATALLHSRLVSA

SEQ ID NO: 627562 - protein, 19 aa, Mycobacterium
ADGGLDWALVESVCVLEVV

SEQ ID NO: 627563 - protein, 23 aa, Mycobacterium
ADGGLPWRYHPDGSVALASPPKE

SEQ ID NO: 627564 - protein, 20 aa, Mycobacterium
ADGGLVCWATSVLHPRVVKA

SEQ ID NO: 627565 - protein, 18 aa, Mycobacterium
ADGGQAYFYSVVSRDTLD

SEQ ID NO: 627566 - protein, 24 aa, Mycobacterium
ADGGRAALVLGDWPDANDHRAAGG

SEQ ID NO: 627567 - protein, 24 aa, Mycobacterium
ADGGRAALVLSDWPAPDNPAPELP

SEQ ID NO: 627568 - protein, 30 aa, Mycobacterium
ADGGSNWYTEFARLAPLMEKDVHYEVDIKK

SEQ ID NO: 627569 - protein, 25 aa, Mycobacterium
ADGGYRLSKEAIILYGMSKAVELGA

SEQ ID NO: 627570 - protein, 23 aa, Mycobacterium
ADGHAHRGLGRAVGVDHHPPGRP

SEQ ID NO: 627571 - protein, 18 aa, Mycobacterium
ADGHPDFWIADAGAGNVA

SEQ ID NO: 627572 - protein, 19 aa, Mycobacterium
ADGIAALRDELCTAGGTAV

SEQ ID NO: 627573 - protein, 18 aa, Mycobacterium
ADGIIGFGGGSPMDTAKA

SEQ ID NO: 627574 - protein, 24 aa, Mycobacterium
ADGISEFLERIAVQAGRDGAPLPI

SEQ ID NO: 627575 - protein, 20 aa, Mycobacterium
ADGISHVVAFMGEGLFKKFG

SEQ ID NO: 627576 - protein, 24 aa, Mycobacterium
ADGISLDNFVDWLIEAGYPIARID

SEQ ID NO: 627577 - protein, 24 aa, Mycobacterium
ADGITEWLERVAIQAGGQGAPLPL

SEQ ID NO: 627578 - protein, 17 aa, Mycobacterium
ADGIVIAKEAFRLVEQT

SEQ ID NO: 627579 - protein, 25 aa, Mycobacterium
ADGKEIAGRLAARIGSGILSDVVEV

SEQ ID NO: 627580 - protein, 26 aa, Mycobacterium
ADGKEIAGRLAARIGSGLLVDVIEVK

SEQ ID NO: 627581 - protein, 26 aa, Mycobacterium
ADGKEIAGRLAARIGSGLLVDVVEVK

SEQ ID NO: 627582 - protein, 26 aa, Mycobacterium
ADGKEIAGRLAARIGSGLLVDVVEVR

SEQ ID NO: 627583 - protein, 26 aa, Mycobacterium
ADGKEIAGRLAARIGSGLLVDVVGIN

SEQ ID NO: 627584 - protein, 28 aa, Mycobacterium
ADGKEVAGRLAARIGSGLLVDVVGVQDG

SEQ ID NO: 627585 - protein, 22 aa, Mycobacterium
ADGKPLPAIERLRDVAETNGWS

SEQ ID NO: 627586 - protein, 24 aa, Mycobacterium
ADGKRIVPVCSMVVTVLNKHPEYA

SEQ ID NO: 627587 - protein, 24 aa, Mycobacterium
ADGKVKWSAPLGFLAQTPPAVTPA

SEQ ID NO: 627588 - protein, 21 aa, Mycobacterium
ADGKVKWSVPLGFLAQTPPTV

SEQ ID NO: 627589 - protein, 20 aa, Mycobacterium
ADGLAHIPVRMHARSWHRYA

SEQ ID NO: 627590 - protein, 20 aa, Mycobacterium
ADGLGGLAIVVNNAGITRDR

SEQ ID NO: 627591 - protein, 17 aa, Mycobacterium
ADGLGRVVGRGRDADKP

SEQ ID NO: 627592 - protein, 19 aa, Mycobacterium
ADGLICLIEDELPPAELEL

SEQ ID NO: 627593 - protein, 35 aa, Mycobacterium
ADGLKVIATRSRLMKRLSGQGAMALLELDAEAAEK

SEQ ID NO: 627594 - protein, 17 aa, Mycobacterium
ADGLPFAYLDLGWEESL

SEQ ID NO: 627595 - protein, 19 aa, Mycobacterium
ADGLPVFGAFWDRDAELPT

SEQ ID NO: 627596 - protein, 18 aa, Mycobacterium
ADGLPVLFDSGIRNGADI

SEQ ID NO: 627597 - protein, 18 aa, Mycobacterium
ADGLPVLFDSGVRSGADI

SEQ ID NO: 627598 - protein, 18 aa, Mycobacterium
ADGLRGADAVFLNSRALG

SEQ ID NO: 627599 - protein, 20 aa, Mycobacterium
ADGLVPLRHSLVINAITDDG

SEQ ID NO: 627600 - protein, 18 aa, Mycobacterium
ADGMPIAYLDLGWEDYMV

SEQ ID NO: 627601 - protein, 18 aa, Mycobacterium
ADGMPMSVQLVGRPYDEA

SEQ ID NO: 627602 - protein, 20 aa, Mycobacterium
ADGMSAGVIFLDIQTMYFSA

SEQ ID NO: 627603 - protein, 17 aa, Mycobacterium
ADGNAFDENPFHAEDPT

SEQ ID NO: 627604 - protein, 20 aa, Mycobacterium
ADGNSVIRFFMPSKWSMELL

SEQ ID NO: 627605 - protein, 20 aa, Mycobacterium
ADGPAAFWQLLRDGVDAVTE

SEQ ID NO: 627606 - protein, 26 aa, Mycobacterium
ADGPGFVRSRARLELAMPSSRDPGLA

SEQ ID NO: 627607 - protein, 23 aa, Mycobacterium
ADGPHLQANWTWARSALDEKQIG

SEQ ID NO: 627608 - protein, 26 aa, Mycobacterium
ADGPIAEAWLPFHVPMSYHGAFTNRV

SEQ ID NO: 627609 - protein, 23 aa, Mycobacterium
ADGPRGISAFVIEKGTAGLSFGA

SEQ ID NO: 627610 - protein, 17 aa, Mycobacterium
ADGPTECMFIHNQDFKG

SEQ ID NO: 627611 - protein, 21 aa, Mycobacterium
ADGPVAALLRRGDGVTTRTMQ

SEQ ID NO: 627612 - protein, 20 aa, Mycobacterium
ADGPVVLFFYPAAMTPGCTK

SEQ ID NO: 627613 - protein, 18 aa, Mycobacterium
ADGPVVVVGHSFGGAVAL

SEQ ID NO: 627614 - protein, 34 aa, Mycobacterium
ADGQGTFVKFHWKPRLGVHSLVWEECQKVAGKDP

SEQ ID NO: 627615 - protein, 25 aa, Mycobacterium
ADGQLPKMRAIVGFAAETGDANGDV

SEQ ID NO: 627616 - protein, 26 aa, Mycobacterium
ADGQTCYWKRMADLHGGDIIDNAFTK

SEQ ID NO: 627617 - protein, 28 aa, Mycobacterium
ADGQVFLIDCGRGVLQRAAAVGVGAAGL

SEQ ID NO: 627618 - protein, 22 aa, Mycobacterium
ADGQVRLRMPWDPSNATIADMV

SEQ ID NO: 627619 - protein, 17 aa, Mycobacterium
ADGRCKAFAAAADGTGW

SEQ ID NO: 627620 - protein, 17 aa, Mycobacterium
ADGRCKAYAGAADGTGF

SEQ ID NO: 627621 - protein, 23 aa, Mycobacterium
ADGREPLEWLAVAHRLEQSAQRL

SEQ ID NO: 627622 - protein, 25 aa, Mycobacterium
ADGRERRVGYALLRDGVEVEVDGKP

SEQ ID NO: 627623 - protein, 20 aa, Mycobacterium
ADGRGPVLVHALQGFSDSGH

SEQ ID NO: 627624 - protein, 19 aa, Mycobacterium
ADGRGVAVVDGRMVDKPVV

SEQ ID NO: 627625 - protein, 23 aa, Mycobacterium
ADGRIYADYVDWRAKNPSDDLMT

SEQ ID NO: 627626 - protein, 18 aa, Mycobacterium
ADGRIYADYVEWRSKNPS

SEQ ID NO: 627627 - protein, 20 aa, Mycobacterium
ADGRIYADYVQWRSKNPSDD

SEQ ID NO: 627628 - protein, 31 aa, Mycobacterium
ADGRLATLWIPERHFHSFGGLSPNPSVLGAF

SEQ ID NO: 627629 - protein, 25 aa, Mycobacterium
ADGRLSRWTRVSAQPVVTMDPTRRL

SEQ ID NO: 627630 - protein, 17 aa, Mycobacterium
ADGRPAKPLAEVVRDEL

SEQ ID NO: 627631 - protein, 22 aa, Mycobacterium
ADGRPPASVPIWYDYTPGGNIR

SEQ ID NO: 627632 - protein, 20 aa, Mycobacterium
ADGRRGCALAVLPTLTQRSR

SEQ ID NO: 627633 - protein, 17 aa, Mycobacterium
ADGRTGVGWLEWNRNLG

SEQ ID NO: 627634 - protein, 17 aa, Mycobacterium
ADGSGLFMKYLRRGSGY

SEQ ID NO: 627635 - protein, 17 aa, Mycobacterium
ADGSLVMPFDFVLDEGR

SEQ ID NO: 627636 - protein, 23 aa, Mycobacterium
ADGSPAGAVLADFDDELLERRGI

SEQ ID NO: 627637 - protein, 18 aa, Mycobacterium
ADGSPGYQASVDYVAQAL

SEQ ID NO: 627638 - protein, 17 aa, Mycobacterium
ADGSRLIAEVFFSAAAS

SEQ ID NO: 627639 - protein, 29 aa, Mycobacterium
ADGSSNWYTEFARLAPLMEKDTHYEVDLR

SEQ ID NO: 627640 - protein, 18 aa, Mycobacterium
ADGTGEWSAEENYAKDKA

SEQ ID NO: 627641 - protein, 21 aa, Mycobacterium
ADGTLRLFGRDSLVVNTGGEK

SEQ ID NO: 627642 - protein, 21 aa, Mycobacterium
ADGTLRLYGRDSLVVNTGGEK

SEQ ID NO: 627643 - protein, 25 aa, Mycobacterium
ADGTYSLRGHKWFTSAPMCDIFLVL

SEQ ID NO: 627644 - protein, 19 aa, Mycobacterium
ADGVDRVRISGVRGEPPPP

SEQ ID NO: 627645 - protein, 19 aa, Mycobacterium
ADGVMRWLEEHQRGVTVGM

SEQ ID NO: 627646 - protein, 25 aa, Mycobacterium
ADGVMRWLEERERGVAMDGGVVPIV

SEQ ID NO: 627647 - protein, 24 aa, Mycobacterium
ADGVPELWPWPPVDYRRTLTSPIR

SEQ ID NO: 627648 - protein, 21 aa, Mycobacterium
ADGVPLAYSLAAGSFRDGTRV

SEQ ID NO: 627649 - protein, 20 aa, Mycobacterium
ADGVPNFDFKVCGPEPGEPL

SEQ ID NO: 627650 - protein, 17 aa, Mycobacterium
ADGVPRVDAVVFLLRTL

SEQ ID NO: 627651 - protein, 18 aa, Mycobacterium
ADGVRAPVLAWLHPPGFD

SEQ ID NO: 627652 - protein, 17 aa, Mycobacterium
ADGVRASFMPKPFAEHP

SEQ ID NO: 627653 - protein, 26 aa, Mycobacterium
ADGVRRPVVVMAHGFGGTKDSGLEPF

SEQ ID NO: 627654 - protein, 24 aa, Mycobacterium
ADGVSLDNFVDWLIEAGYPIARID

SEQ ID NO: 627655 - protein, 23 aa, Mycobacterium
ADGVTCNAIIPGAVTRMAEGLDT

SEQ ID NO: 627656 - protein, 17 aa, Mycobacterium
ADGVVIAKEAFRLVEQS

SEQ ID NO: 627657 - protein, 23 aa, Mycobacterium
ADGWRLKTRAMTFIRRSGVHDSG

SEQ ID NO: 627658 - protein, 22 aa, Mycobacterium
ADGYGRLRGMAALVTTFGVGEL

SEQ ID NO: 627659 - protein, 20 aa, Mycobacterium
ADGYGYLLGFVFSGIERAFG

SEQ ID NO: 627660 - protein, 17 aa, Mycobacterium
ADGYIDVKGLRLTLTQA

SEQ ID NO: 627661 - protein, 21 aa, Mycobacterium
ADGYLALFITHDGFWKSFADE

SEQ ID NO: 627662 - protein, 21 aa, Mycobacterium
ADGYLALFITHDGFWRSFAGE

SEQ ID NO: 627663 - protein, 21 aa, Mycobacterium
ADGYLRLCGRRHDMVVRGGEN

SEQ ID NO: 627664 - protein, 20 aa, Mycobacterium
ADGYPIVLTHGFVCSIRAWA

SEQ ID NO: 627665 - protein, 17 aa, Mycobacterium
ADGYRIIDFDGNPDDAS

SEQ ID NO: 627666 - protein, 22 aa, Mycobacterium
ADGYRLSGALHIHGTSHQHVID

SEQ ID NO: 627667 - protein, 17 aa, Mycobacterium
ADHAGLSVTGFALDNND

SEQ ID NO: 627668 - protein, 17 aa, Mycobacterium
ADHAPALLWIHGGGTIM

SEQ ID NO: 627669 - protein, 17 aa, Mycobacterium
ADHAVAGTVLFPGAGFV

SEQ ID NO: 627670 - protein, 17 aa, Mycobacterium
ADHAVAGVALFPGAGFA

SEQ ID NO: 627671 - protein, 22 aa, Mycobacterium
ADHAVEIGRRVVFEATGALLPE

SEQ ID NO: 627672 - protein, 22 aa, Mycobacterium
ADHAVGGVVLFPGAGFVELAIR

SEQ ID NO: 627673 - protein, 21 aa, Mycobacterium
ADHAYRFGLARVLDGLEPVIN

SEQ ID NO: 627674 - protein, 26 aa, Mycobacterium
ADHCLDMPGLFVWRRYHPSRPKGKAL

SEQ ID NO: 627675 - protein, 18 aa, Mycobacterium
ADHDRWPQSVGLSVWGTS

SEQ ID NO: 627676 - protein, 24 aa, Mycobacterium
ADHEARAAYRWMRAHQPVFRDRNG

SEQ ID NO: 627677 - protein, 24 aa, Mycobacterium
ADHEKCCEFAAARPGMLGLQTALS

SEQ ID NO: 627678 - protein, 25 aa, Mycobacterium
ADHEWFREQFAALDYLQAQTPNDET

SEQ ID NO: 627679 - protein, 19 aa, Mycobacterium
ADHFARRGFAFYALDLRKC

SEQ ID NO: 627680 - protein, 21 aa, Mycobacterium
ADHFPLLGAVVARRTEASATD

SEQ ID NO: 627681 - protein, 19 aa, Mycobacterium
ADHGAEFTVAVTSGGVGVD

SEQ ID NO: 627682 - protein, 27 aa, Mycobacterium
ADHGARPGECVALLLSRSAEAIVSILA

SEQ ID NO: 627683 - protein, 17 aa, Mycobacterium
ADHGFPLQPQYGGTEMG

SEQ ID NO: 627684 - protein, 21 aa, Mycobacterium
ADHGIGAIIITGSEKAFAAGA

SEQ ID NO: 627685 - protein, 19 aa, Mycobacterium
ADHGNVWASGAAAAALDSF

SEQ ID NO: 627686 - protein, 19 aa, Mycobacterium
ADHHAWSARPWTTRPAIPW

SEQ ID NO: 627687 - protein, 27 aa, Mycobacterium
ADHHNIPAQFAAPIASPFSPQTQFAPE

SEQ ID NO: 627688 - protein, 24 aa, Mycobacterium
ADHIDKGLFALEWSPVTDTPDTAH

SEQ ID NO: 627689 - protein, 19 aa, Mycobacterium
ADHLARVGLYPGAPKLPAV

SEQ ID NO: 627690 - protein, 19 aa, Mycobacterium
ADHLYVFQRTPVYSVPANN

SEQ ID NO: 627691 - protein, 18 aa, Mycobacterium
ADHMGFRIDPNIRTIQDV

SEQ ID NO: 627692 - protein, 18 aa, Mycobacterium
ADHMPTWTPLQQKAGRAF

SEQ ID NO: 627693 - protein, 26 aa, Mycobacterium
ADHPDGVLWGHGWDESGWPDQTPPDT

SEQ ID NO: 627694 - protein, 17 aa, Mycobacterium
ADHPFDLLARLRFRVTV

SEQ ID NO: 627695 - protein, 28 aa, Mycobacterium
ADHPLLASVPMSFDFSPDRIWGNRFSGV

SEQ ID NO: 627696 - protein, 20 aa, Mycobacterium
ADHRGARLAVDWPTELQQQI

SEQ ID NO: 627697 - protein, 21 aa, Mycobacterium
ADHRLKTGLGDKIGRALSAGT

SEQ ID NO: 627698 - protein, 23 aa, Mycobacterium
ADHRPDCVLLDLNLPDAAGIDAL

SEQ ID NO: 627699 - protein, 18 aa, Mycobacterium
ADHRPEGLLYAVLVGAPV

SEQ ID NO: 627700 - protein, 22 aa, Mycobacterium
ADHRPILVRAFNVLRQYPVEDV

SEQ ID NO: 627701 - protein, 23 aa, Mycobacterium
ADHRVPIDVLRRALVDACSPYAP

SEQ ID NO: 627702 - protein, 24 aa, Mycobacterium
ADHTGLERVWRPLADKLDVHAYIE

SEQ ID NO: 627703 - protein, 18 aa, Mycobacterium
ADHVAAVVLFGMPNVRAM

SEQ ID NO: 627704 - protein, 19 aa, Mycobacterium
ADHVRPFGVPFVHIPATRD

SEQ ID NO: 627705 - protein, 20 aa, Mycobacterium
ADHWARLTFDGAAAGRDYPS

SEQ ID NO: 627706 - protein, 19 aa, Mycobacterium
ADHWCRAYDLSSLRVVFAG

SEQ ID NO: 627707 - protein, 17 aa, Mycobacterium
ADIAAALALQSRDGEEF

SEQ ID NO: 627708 - protein, 18 aa, Mycobacterium
ADIAAALALQSRNGEEFL

SEQ ID NO: 627709 - protein, 20 aa, Mycobacterium
ADIAAALAVLSRDGEQFLLQ

SEQ ID NO: 627710 - protein, 17 aa, Mycobacterium
ADIAAALAVQTRNGEEF

SEQ ID NO: 627711 - protein, 18 aa, Mycobacterium
ADIAAFVGADAQELIFTK

SEQ ID NO: 627712 - protein, 17 aa, Mycobacterium
ADIAAFVGADPDELVFT

SEQ ID NO: 627713 - protein, 17 aa, Mycobacterium
ADIAAFVGAEPDELVFT

SEQ ID NO: 627714 - protein, 27 aa, Mycobacterium
ADIAALRLPLIIGESGDLTTLVPATTE

SEQ ID NO: 627715 - protein, 20 aa, Mycobacterium
ADIAEVIGFVASRPPHVNLD

SEQ ID NO: 627716 - protein, 20 aa, Mycobacterium
ADIAEVIGFVASRPSHVNLD

SEQ ID NO: 627717 - protein, 19 aa, Mycobacterium
ADIAGLVLIADDIGIREAQ

SEQ ID NO: 627718 - protein, 20 aa, Mycobacterium
ADIAGVLLIKGGGEFESLAD

SEQ ID NO: 627719 - protein, 19 aa, Mycobacterium
ADIAICGGIEAAIEAAPIA

SEQ ID NO: 627720 - protein, 20 aa, Mycobacterium
ADIAICGGVEARIEAVPIAG

SEQ ID NO: 627721 - protein, 20 aa, Mycobacterium
ADIAICGGVETWIEAVPVGA

SEQ ID NO: 627722 - protein, 18 aa, Mycobacterium
ADIALVVADAGWKYLSTG

SEQ ID NO: 627723 - protein, 23 aa, Mycobacterium
ADIAMAFERYRIVTGDEELEKQC

SEQ ID NO: 627724 - protein, 20 aa, Mycobacterium
ADIAMAFERYRVVTGDDSLE

SEQ ID NO: 627725 - protein, 24 aa, Mycobacterium
ADIARAFAAAGARLVLSGRDVSEL

SEQ ID NO: 627726 - protein, 18 aa, Mycobacterium
ADIARELAARGHGVTLVA

SEQ ID NO: 627727 - protein, 23 aa, Mycobacterium
ADIARLDAVPARVLGHDRYRCDN

SEQ ID NO: 627728 - protein, 29 aa, Mycobacterium
ADIARLKERMDWKMPWYTITDGFDADFGV

SEQ ID NO: 627729 - protein, 28 aa, Mycobacterium
ADIARRARHRPVWIKGFGEHIAFKTPTY

SEQ ID NO: 627730 - protein, 20 aa, Mycobacterium
ADIARRIPVASAAVVALALP

SEQ ID NO: 627731 - protein, 30 aa, Mycobacterium
ADIAWAGPPPEWWAQRFGIEPDLAEALVCA

SEQ ID NO: 627732 - protein, 18 aa, Mycobacterium
ADICVREGGILGLVGESG

SEQ ID NO: 627733 - protein, 24 aa, Mycobacterium
ADIDKRGKISLVLVAEDDDSAAAA

SEQ ID NO: 627734 - protein, 24 aa, Mycobacterium
ADIDKRGKISLVLVAEEESSANAP

SEQ ID NO: 627735 - protein, 24 aa, Mycobacterium
ADIDKRGKISLVLVEDDNSAPADA

SEQ ID NO: 627736 - protein, 24 aa, Mycobacterium
ADIDKRGKISLVLVEEDSAAPADA

SEQ ID NO: 627737 - protein, 22 aa, Mycobacterium
ADIDMRCLLIIGSSQTQWYSTD

SEQ ID NO: 627738 - protein, 23 aa, Mycobacterium
ADIEALQLPTLIGLAEDLESLAP

SEQ ID NO: 627739 - protein, 18 aa, Mycobacterium
ADIEDLRALLARRNELWS

SEQ ID NO: 627740 - protein, 22 aa, Mycobacterium
ADIELAQGFLLTEGVIGGRDDI

SEQ ID NO: 627741 - protein, 19 aa, Mycobacterium
ADIELCWACNGELGDDYVD

SEQ ID NO: 627742 - protein, 21 aa, Mycobacterium
ADIESVVSWSSLHKDAEIVDR

SEQ ID NO: 627743 - protein, 19 aa, Mycobacterium
ADIFARYAVRHRFLARHLL

SEQ ID NO: 627744 - protein, 26 aa, Mycobacterium
ADIFLREVQDVWTWARPYFDDRATAT

SEQ ID NO: 627745 - protein, 26 aa, Mycobacterium
ADIFLREVQDVWTWVRPYYDARAMAA

SEQ ID NO: 627746 - protein, 21 aa, Mycobacterium
ADIGARCELLRGARVWPGITI

SEQ ID NO: 627747 - protein, 21 aa, Mycobacterium
ADIGARCELLRGARVWPGVSI

SEQ ID NO: 627748 - protein, 19 aa, Mycobacterium
ADIGFDVDVGPLFQTPEEV

SEQ ID NO: 627749 - protein, 18 aa, Mycobacterium
ADIGFWCSGSSDYLAGRA

SEQ ID NO: 627750 - protein, 18 aa, Mycobacterium
ADIGRAILERRFAASYRA

SEQ ID NO: 627751 - protein, 17 aa, Mycobacterium
ADIIAIDVCGPIENLAY

SEQ ID NO: 627752 - protein, 18 aa, Mycobacterium
ADIIAIDVCGPISTHTDI

SEQ ID NO: 627753 - protein, 17 aa, Mycobacterium
ADIIAVDICQPIENSAA

SEQ ID NO: 627754 - protein, 18 aa, Mycobacterium
ADIIGWLDQRGWETVALS

SEQ ID NO: 627755 - protein, 18 aa, Mycobacterium
ADIITAFAQRLGDQEIKL

SEQ ID NO: 627756 - protein, 24 aa, Mycobacterium
ADIKARIRTALAREMFTETYSRPP

SEQ ID NO: 627757 - protein, 20 aa, Mycobacterium
ADIKRAYEFGVLATAAQLVG

SEQ ID NO: 627758 - protein, 24 aa, Mycobacterium
ADIKRPGTDVSVIAYGRCVHDALS

SEQ ID NO: 627759 - protein, 18 aa, Mycobacterium
ADILAGRIAPGSRLGFAA

SEQ ID NO: 627760 - protein, 23 aa, Mycobacterium
ADILCPLSLGAQLVIPKPNPFSD

SEQ ID NO: 627761 - protein, 21 aa, Mycobacterium
ADILLPAALWAESDGVSINSE

SEQ ID NO: 627762 - protein, 21 aa, Mycobacterium
ADILLRVALGIIVFPTDRLDT

SEQ ID NO: 627763 - protein, 23 aa, Mycobacterium
ADILRPNIAVGRYGQPRDIASLV

SEQ ID NO: 627764 - protein, 25 aa, Mycobacterium
ADILRRRLPELAVRVINIVDIMRLQ

SEQ ID NO: 627765 - protein, 24 aa, Mycobacterium
ADILTRTGARFGVAPNWATITDAE

SEQ ID NO: 627766 - protein, 34 aa, Mycobacterium
ADINLKLFGFIRMTRAALPHLLKTGSGRIVNVAG

SEQ ID NO: 627767 - protein, 20 aa, Mycobacterium
ADIPMQRPLTGVIHAAGVLD

SEQ ID NO: 627768 - protein, 21 aa, Mycobacterium
ADIPPYWAMMHKIKCPTLLTW

SEQ ID NO: 627769 - protein, 20 aa, Mycobacterium
ADIPQFLAIAREAGERATGL

SEQ ID NO: 627770 - protein, 18 aa, Mycobacterium
ADIPVHRPLSGVIHAAGV

SEQ ID NO: 627771 - protein, 17 aa, Mycobacterium
ADIPYGGTVAVIGLGAV

SEQ ID NO: 627772 - protein, 23 aa, Mycobacterium
ADIRARGYGAWRFDDTHQSLHDR

SEQ ID NO: 627773 - protein, 21 aa, Mycobacterium
ADIRECLRIGLQAANGSNQQS

SEQ ID NO: 627774 - protein, 18 aa, Mycobacterium
ADIRICSAAATFGNAAIL

SEQ ID NO: 627775 - protein, 17 aa, Mycobacterium
ADIRICSETASFANAAI

SEQ ID NO: 627776 - protein, 20 aa, Mycobacterium
ADIRPALLVHTSLATVQFVL

SEQ ID NO: 627777 - protein, 25 aa, Mycobacterium
ADIRSIPTLMAFKKGKLVFNQAGAL

SEQ ID NO: 627778 - protein, 21 aa, Mycobacterium
ADISNAVLFLASDEARYVTGV

SEQ ID NO: 627779 - protein, 17 aa, Mycobacterium
ADISSFTGYDGRFGTIV

SEQ ID NO: 627780 - protein, 18 aa, Mycobacterium
ADIVVVRILGGYRAWEDG

SEQ ID NO: 627781 - protein, 18 aa, Mycobacterium
ADIYRWARRGAIEQRTSA

SEQ ID NO: 627782 - protein, 24 aa, Mycobacterium
ADKAIKSVVPLLVGGLQANADDPD

SEQ ID NO: 627783 - protein, 23 aa, Mycobacterium
ADKCGDIATVLRETRSGQEQVVR

SEQ ID NO: 627784 - protein, 17 aa, Mycobacterium
ADKEMYEIPGATHYYAG

SEQ ID NO: 627785 - protein, 23 aa, Mycobacterium
ADKFAWKDIRDGIYGQTLVLKEP

SEQ ID NO: 627786 - protein, 19 aa, Mycobacterium
ADKFYGFAATEFGNDRDPT

SEQ ID NO: 627787 - protein, 27 aa, Mycobacterium
ADKGFGHVRIEDVCAAAGYTRGAFYSQ

SEQ ID NO: 627788 - protein, 25 aa, Mycobacterium
ADKGRIATIAGFGRAASDGFKALGG

SEQ ID NO: 627789 - protein, 19 aa, Mycobacterium
ADKIACTGWSYGGYLTLAA

SEQ ID NO: 627790 - protein, 25 aa, Mycobacterium
ADKLDLRSGITFNTRVVSAVLDETT

SEQ ID NO: 627791 - protein, 23 aa, Mycobacterium
ADKLDWPPNLWMGVSVENSDALS

SEQ ID NO: 627792 - protein, 17 aa, Mycobacterium
ADKLGLRDAKSVENLLG

SEQ ID NO: 627793 - protein, 23 aa, Mycobacterium
ADKLKARGFAAAAINGDINQSQR

SEQ ID NO: 627794 - protein, 18 aa, Mycobacterium
ADKLMRPGGVVDLLTAPG

SEQ ID NO: 627795 - protein, 24 aa, Mycobacterium
ADKMWKTSEAWRQWINVGDFPDHP

SEQ ID NO: 627796 - protein, 20 aa, Mycobacterium
ADKPAARKALRETPLDPART

SEQ ID NO: 627797 - protein, 22 aa, Mycobacterium
ADKRLAPYALEWDATKHFPVDV

SEQ ID NO: 627798 - protein, 22 aa, Mycobacterium
ADKRTRALLAREFTDHGRPVIE

SEQ ID NO: 627799 - protein, 23 aa, Mycobacterium
ADKRTRALLAREFVDHGRPVIEV

SEQ ID NO: 627800 - protein, 24 aa, Mycobacterium
ADKVAFDYCRYLPGGEEHSRLTYR

SEQ ID NO: 627801 - protein, 25 aa, Mycobacterium
ADKVARFMLGLARRYGPAFYTANQL

SEQ ID NO: 627802 - protein, 20 aa, Mycobacterium
ADKVIGWAIEHDRVPLAGSV

SEQ ID NO: 627803 - protein, 22 aa, Mycobacterium
ADKVVRFMFGLARRYGPAFFTA

SEQ ID NO: 627804 - protein, 18 aa, Mycobacterium
ADLACSVQRVVEDVLLDL

SEQ ID NO: 627805 - protein, 23 aa, Mycobacterium
ADLAEAFAAVAISERPDIIKVVP

SEQ ID NO: 627806 - protein, 25 aa, Mycobacterium
ADLAEARVGWRLMLAGPASVCLRVR

SEQ ID NO: 627807 - protein, 17 aa, Mycobacterium
ADLAKQFQAAHGREPTH

SEQ ID NO: 627808 - protein, 19 aa, Mycobacterium
ADLALAERILLNSKTRRPS

SEQ ID NO: 627809 - protein, 22 aa, Mycobacterium
ADLALSCALWVGMGRVLRTLDI

SEQ ID NO: 627810 - protein, 20 aa, Mycobacterium
ADLANLQAIRAARTTGAAST

SEQ ID NO: 627811 - protein, 19 aa, Mycobacterium
ADLARFGRDGIVAMSSEQA

SEQ ID NO: 627812 - protein, 19 aa, Mycobacterium
ADLARPALARAVLARLNPQ

SEQ ID NO: 627813 - protein, 23 aa, Mycobacterium
ADLARPRTEVMVNLGNPDLAFKT

SEQ ID NO: 627814 - protein, 27 aa, Mycobacterium
ADLARRARHRPVWVKGFGEHVPFKTPT

SEQ ID NO: 627815 - protein, 28 aa, Mycobacterium
ADLARRGRHRPVWIKGFGEHIAFKTPTY

SEQ ID NO: 627816 - protein, 26 aa, Mycobacterium
ADLASVIPALFGVAFFNTGQACALPK

SEQ ID NO: 627817 - protein, 27 aa, Mycobacterium
ADLAYVLMCGMTFDELPLGGGVAQPSL

SEQ ID NO: 627818 - protein, 19 aa, Mycobacterium
ADLCLVWAEQMLRESGVDA

SEQ ID NO: 627819 - protein, 17 aa, Mycobacterium
ADLDAFVLFSSAAGILG

SEQ ID NO: 627820 - protein, 20 aa, Mycobacterium
ADLDALVAAGRIFRDVDGIA

SEQ ID NO: 627821 - protein, 25 aa, Mycobacterium
ADLDCLIRHRVELVITSVGSPAAVV

SEQ ID NO: 627822 - protein, 24 aa, Mycobacterium
ADLDFVLVVGHLFSLVVYGQLILE

SEQ ID NO: 627823 - protein, 20 aa, Mycobacterium
ADLDGAFVAPAFVDSHVHTT

SEQ ID NO: 627824 - protein, 26 aa, Mycobacterium
ADLDHWRWMWETNVIGTLRVTRALLP

SEQ ID NO: 627825 - protein, 26 aa, Mycobacterium
ADLDHWRWMWETNVLGTLRVTRALLP

SEQ ID NO: 627826 - protein, 26 aa, Mycobacterium
ADLDRFTAGFPFEVFDVLRREAPVWW

SEQ ID NO: 627827 - protein, 20 aa, Mycobacterium
ADLEHTWSSGILDRPLVRYT

SEQ ID NO: 627828 - protein, 26 aa, Mycobacterium
ADLEHWRWMWETNVLGTLRVTRALLP

SEQ ID NO: 627829 - protein, 26 aa, Mycobacterium
ADLEHWRWMWETNVVGTLQVTRALLP

SEQ ID NO: 627830 - protein, 20 aa, Mycobacterium
ADLEKFQWFVRAHLENAGGK

SEQ ID NO: 627831 - protein, 20 aa, Mycobacterium
ADLELEWRPADPIHADCGFM

SEQ ID NO: 627832 - protein, 22 aa, Mycobacterium
ADLERFSDWILPTEPERYAKRL

SEQ ID NO: 627833 - protein, 20 aa, Mycobacterium
ADLERIRLHLAQAVEERYLP

SEQ ID NO: 627834 - protein, 23 aa, Mycobacterium
ADLERYPLVYFIDSMLQVDDLDL

SEQ ID NO: 627835 - protein, 18 aa, Mycobacterium
ADLESREVLLAKLAGAMK

SEQ ID NO: 627836 - protein, 18 aa, Mycobacterium
ADLETLFAPPTPVDAEPT

SEQ ID NO: 627837 - protein, 17 aa, Mycobacterium
ADLFARVEALPWDAVHS

SEQ ID NO: 627838 - protein, 18 aa, Mycobacterium
ADLFQWAGAHTGATVSSL

SEQ ID NO: 627839 - protein, 25 aa, Mycobacterium
ADLFYKGGPYLARGAADLVPTAQLL

SEQ ID NO: 627840 - protein, 17 aa, Mycobacterium
ADLGAAGAHAWLEPIPD

SEQ ID NO: 627841 - protein, 23 aa, Mycobacterium
ADLGESFGVWQLGDDEAMLGLVT

SEQ ID NO: 627842 - protein, 23 aa, Mycobacterium
ADLGFPLSIHLEATYGISGPAFQ

SEQ ID NO: 627843 - protein, 17 aa, Mycobacterium
ADLGGRRHTVWTRCNNR

SEQ ID NO: 627844 - protein, 19 aa, Mycobacterium
ADLGGTWLRLRVGGPGTEV

SEQ ID NO: 627845 - protein, 23 aa, Mycobacterium
ADLGLPVVVRPSFTMGGLGSGMA

SEQ ID NO: 627846 - protein, 18 aa, Mycobacterium
ADLGLSVRPIRTMAGHDS

SEQ ID NO: 627847 - protein, 17 aa, Mycobacterium
ADLGQRIVAYVVGSANP

SEQ ID NO: 627848 - protein, 26 aa, Mycobacterium
ADLGRPLTRLRVDGGLTRSEALMQAQ

SEQ ID NO: 627849 - protein, 19 aa, Mycobacterium
ADLHGPFDYHLTRKLCKLA

SEQ ID NO: 627850 - protein, 17 aa, Mycobacterium
ADLIAQAGGDPWAIDRS

SEQ ID NO: 627851 - protein, 18 aa, Mycobacterium
ADLIARAGGDPWAINQSL

SEQ ID NO: 627852 - protein, 17 aa, Mycobacterium
ADLIEWRRKHEKHIERV

SEQ ID NO: 627853 - protein, 17 aa, Mycobacterium
ADLIEWRRKHEKHVERI

SEQ ID NO: 627854 - protein, 17 aa, Mycobacterium
ADLILGGFLHFQEEIEY

SEQ ID NO: 627855 - protein, 18 aa, Mycobacterium
ADLILIYLIQNFPDLGVD

SEQ ID NO: 627856 - protein, 18 aa, Mycobacterium
ADLIMAVDGYRNLKELTI

SEQ ID NO: 627857 - protein, 26 aa, Mycobacterium
ADLITPRPALTVPLADALGLALAADV

SEQ ID NO: 627858 - protein, 21 aa, Mycobacterium
ADLKLGRLLDTFDNWAAETGL

SEQ ID NO: 627859 - protein, 22 aa, Mycobacterium
ADLKPGQPLTVEKIVTLVTGRD

SEQ ID NO: 627860 - protein, 22 aa, Mycobacterium
ADLKSVNPFDFFIEEWAEHIGF

SEQ ID NO: 627861 - protein, 25 aa, Mycobacterium
ADLKTIQRLVGVFKQLAPGADIQGV

SEQ ID NO: 627862 - protein, 21 aa, Mycobacterium
ADLLARFTGVRTCTSRFGATG

SEQ ID NO: 627863 - protein, 18 aa, Mycobacterium
ADLLAVVARLNRLATQRT

SEQ ID NO: 627864 - protein, 35 aa, Mycobacterium
ADLLDEAWWFPAIQWPDGRMQFMLNERMMPAQFIV

SEQ ID NO: 627865 - protein, 24 aa, Mycobacterium
ADLLDIRYQPPFTYFRDSQNAFRV

SEQ ID NO: 627866 - protein, 18 aa, Mycobacterium
ADLLESWVRSKAALGTPA

SEQ ID NO: 627867 - protein, 26 aa, Mycobacterium
ADLLGHLWSIESWVRQILRTRELAEE

SEQ ID NO: 627868 - protein, 17 aa, Mycobacterium
ADLLGQRLHRALGPLVH

SEQ ID NO: 627869 - protein, 23 aa, Mycobacterium
ADLLGRRLHRALGPLVHVNLIPL

SEQ ID NO: 627870 - protein, 27 aa, Mycobacterium
ADLLHLVDFPLALGIRPNIPYEEQRKV

SEQ ID NO: 627871 - protein, 17 aa, Mycobacterium
ADLLLKVKEPIAVEYGL

SEQ ID NO: 627872 - protein, 19 aa, Mycobacterium
ADLLRAYRCRHDGAEVRKR

SEQ ID NO: 627873 - protein, 17 aa, Mycobacterium
ADLLRHAKHSGLSDRQI

SEQ ID NO: 627874 - protein, 23 aa, Mycobacterium
ADLLRHRRLLVDAADEIGVGVVA

SEQ ID NO: 627875 - protein, 17 aa, Mycobacterium
ADLLRRFPTGYRHLGYL

SEQ ID NO: 627876 - protein, 22 aa, Mycobacterium
ADLLRRRHEEIATDLTREEGKT

SEQ ID NO: 627877 - protein, 21 aa, Mycobacterium
ADLLRSLDFARDFAGEGNAIV

SEQ ID NO: 627878 - protein, 27 aa, Mycobacterium
ADLLRTVESLGFDTAWLGGSPPADLPW

SEQ ID NO: 627879 - protein, 17 aa, Mycobacterium
ADLLSGPWRAILNAATM

SEQ ID NO: 627880 - protein, 18 aa, Mycobacterium
ADLLTHLDILKLAEDEAV

SEQ ID NO: 627881 - protein, 17 aa, Mycobacterium
ADLLWNGGIGTYIKAET

SEQ ID NO: 627882 - protein, 17 aa, Mycobacterium
ADLMLAAPPAPRVAVPA

SEQ ID NO: 627883 - protein, 29 aa, Mycobacterium
ADLNLSFPISLPISIDIGKIVIESFTLPK

SEQ ID NO: 627884 - protein, 24 aa, Mycobacterium
ADLNVLERHRFVFVDEDTDELFIR

SEQ ID NO: 627885 - protein, 20 aa, Mycobacterium
ADLPAGSLIIFYTDGLMERA

SEQ ID NO: 627886 - protein, 17 aa, Mycobacterium
ADLPALHTIAAKAISLR

SEQ ID NO: 627887 - protein, 22 aa, Mycobacterium
ADLPARLSLFGHTRLACTDVQL

SEQ ID NO: 627888 - protein, 23 aa, Mycobacterium
ADLPDALRIAVEALRASSADTSG

SEQ ID NO: 627889 - protein, 18 aa, Mycobacterium
ADLPDRFAGVVYGPGTTA

SEQ ID NO: 627890 - protein, 21 aa, Mycobacterium
ADLPEITHFVAGLGSSGTLMG

SEQ ID NO: 627891 - protein, 21 aa, Mycobacterium
ADLPEITHFVAGLGTTGTLMG

SEQ ID NO: 627892 - protein, 17 aa, Mycobacterium
ADLPEKVREAALREVGK

SEQ ID NO: 627893 - protein, 18 aa, Mycobacterium
ADLPGAPISPRRGGKPNP

SEQ ID NO: 627894 - protein, 28 aa, Mycobacterium
ADLPLAVDHFRYFAGCIRAQEGSLSEVD

SEQ ID NO: 627895 - protein, 17 aa, Mycobacterium
ADLPLGAGVTGLLRQPD

SEQ ID NO: 627896 - protein, 23 aa, Mycobacterium
ADLPNLRVESGQGLLVDFVRERG

SEQ ID NO: 627897 - protein, 19 aa, Mycobacterium
ADLPPGVCGQWRQYENEDI

SEQ ID NO: 627898 - protein, 20 aa, Mycobacterium
ADLPRLVAELDRGADLVTGR

SEQ ID NO: 627899 - protein, 22 aa, Mycobacterium
ADLPSIRAGLLAGAPETRVAGI

SEQ ID NO: 627900 - protein, 22 aa, Mycobacterium
ADLPVGAKFGSLVHAVLETADP

SEQ ID NO: 627901 - protein, 17 aa, Mycobacterium
ADLPWHRVIGASGRPAP

SEQ ID NO: 627902 - protein, 26 aa, Mycobacterium
ADLQHWRWMWETNVLGTLRVTRALLP

SEQ ID NO: 627903 - protein, 24 aa, Mycobacterium
ADLQRAGGGLGEYYGEHDTRTPVW

SEQ ID NO: 627904 - protein, 17 aa, Mycobacterium
ADLQRLGLLRTRAGAHA

SEQ ID NO: 627905 - protein, 17 aa, Mycobacterium
ADLQRRLWAVSEELTGV

SEQ ID NO: 627906 - protein, 24 aa, Mycobacterium
ADLQTRLTAVQARIPAADGLFDTD

SEQ ID NO: 627907 - protein, 26 aa, Mycobacterium
ADLRALSLPVLRSWLATAAGAGAART

SEQ ID NO: 627908 - protein, 24 aa, Mycobacterium
ADLRAPRALPVLVIDGRDDTDLAA

SEQ ID NO: 627909 - protein, 19 aa, Mycobacterium
ADLRAWLTTVVSRLGLDKL

SEQ ID NO: 627910 - protein, 19 aa, Mycobacterium
ADLRCARCGSSAVRAVVVG

SEQ ID NO: 627911 - protein, 23 aa, Mycobacterium
ADLRDARLRLAADDLVARKAEFD

SEQ ID NO: 627912 - protein, 24 aa, Mycobacterium
ADLRDARLRLAADDLVGRRAERAS

SEQ ID NO: 627913 - protein, 23 aa, Mycobacterium
ADLRDARLRLAADDLVRRQVEFQ

SEQ ID NO: 627914 - protein, 24 aa, Mycobacterium
ADLRDARLRLAADDVVSRRAEREA

SEQ ID NO: 627915 - protein, 17 aa, Mycobacterium
ADLREALELGYERTNRF

SEQ ID NO: 627916 - protein, 23 aa, Mycobacterium
ADLREWVAMFLDWLAQPVTRAAL

SEQ ID NO: 627917 - protein, 25 aa, Mycobacterium
ADLRFARAGAHTVLTRRRHRWPFVI

SEQ ID NO: 627918 - protein, 24 aa, Mycobacterium
ADLRGRFRWWGLYTQRKQGYDGTW

SEQ ID NO: 627919 - protein, 21 aa, Mycobacterium
ADLRHAGCDIITITQYLRPSA

SEQ ID NO: 627920 - protein, 21 aa, Mycobacterium
ADLRIRPALSPSRATDFKQCP

SEQ ID NO: 627921 - protein, 24 aa, Mycobacterium
ADLRPARLRTLDAIHLAAAQRAGT

SEQ ID NO: 627922 - protein, 24 aa, Mycobacterium
ADLRPEVVSFTFGLPDDDEVKRLR

SEQ ID NO: 627923 - protein, 25 aa, Mycobacterium
ADLRQRLDAALAKPALQQPSWDAGQ

SEQ ID NO: 627924 - protein, 21 aa, Mycobacterium
ADLRRALALVKTRRELDELLD

SEQ ID NO: 627925 - protein, 26 aa, Mycobacterium
ADLRRLLLRFKLLHFDTAADFDAAVR

SEQ ID NO: 627926 - protein, 23 aa, Mycobacterium
ADLRRRGAQVVSRVSGKVGEEMR

SEQ ID NO: 627927 - protein, 26 aa, Mycobacterium
ADLRTDWPARLVGAGFEPAKRTAWLA

SEQ ID NO: 627928 - protein, 21 aa, Mycobacterium
ADLRTLETFGRPVVAAINGAA

SEQ ID NO: 627929 - protein, 17 aa, Mycobacterium
ADLRVVYLFLAGRPDRR

SEQ ID NO: 627930 - protein, 28 aa, Mycobacterium
ADLSDPLLQWCVAGSIGSEYAADPDELS

SEQ ID NO: 627931 - protein, 22 aa, Mycobacterium
ADLSLLGKARKVVVTKDETTIV

SEQ ID NO: 627932 - protein, 20 aa, Mycobacterium
ADLSRTVGWFTSKYPVALDF

SEQ ID NO: 627933 - protein, 19 aa, Mycobacterium
ADLSRTVGWFTSKYPVSLA

SEQ ID NO: 627934 - protein, 19 aa, Mycobacterium
ADLSTEYARTGRTVALEPE

SEQ ID NO: 627935 - protein, 22 aa, Mycobacterium
ADLSWGRLSALRHYGYPDAHLH

SEQ ID NO: 627936 - protein, 26 aa, Mycobacterium
ADLTEAFLWSEFRVVTKTATVSLHSN

SEQ ID NO: 627937 - protein, 25 aa, Mycobacterium
ADLTGACSMAAFTVAMHAGQGCAIT

SEQ ID NO: 627938 - protein, 26 aa, Mycobacterium
ADLTGLPVGTEWLAVSGYRRIDDETA

SEQ ID NO: 627939 - protein, 23 aa, Mycobacterium
ADLTGTSAIDWFALDRLPPLAPS

SEQ ID NO: 627940 - protein, 19 aa, Mycobacterium
ADLTMAVNCYLSLNELAVQ

SEQ ID NO: 627941 - protein, 25 aa, Mycobacterium
ADLTRLSQIIVYRRLEFSLDEIASL

SEQ ID NO: 627942 - protein, 25 aa, Mycobacterium
ADLTRLSQIIVYRRLEMSLDEIASV

SEQ ID NO: 627943 - protein, 19 aa, Mycobacterium
ADLTRLSQVIVYRRLELPL

SEQ ID NO: 627944 - protein, 24 aa, Mycobacterium
ADLTRPAINHYFASKGVLWAEVVE

SEQ ID NO: 627945 - protein, 18 aa, Mycobacterium
ADLTTFCRLDELGLEVTG

SEQ ID NO: 627946 - protein, 22 aa, Mycobacterium
ADLTVAFLLMLARRLPTASAFL

SEQ ID NO: 627947 - protein, 20 aa, Mycobacterium
ADLTVPPPALVTGAVVIGAP

SEQ ID NO: 627948 - protein, 19 aa, Mycobacterium
ADLVAEGWLASRQGAGTWV

SEQ ID NO: 627949 - protein, 18 aa, Mycobacterium
ADLVARARVQREWSSQGV

SEQ ID NO: 627950 - protein, 23 aa, Mycobacterium
ADLVARIGVLVDLGLGYLSLHRR

SEQ ID NO: 627951 - protein, 23 aa, Mycobacterium
ADLVARIGVLVDLGLGYLSLNRR

SEQ ID NO: 627952 - protein, 31 aa, Mycobacterium
ADLVFMSSTARLKCPFTSLGVAPEAASSYLL

SEQ ID NO: 627953 - protein, 26 aa, Mycobacterium
ADLVFTRRRVAVFIDGCFWHGCPQHH

SEQ ID NO: 627954 - protein, 17 aa, Mycobacterium
ADLVGRFLLKGGETVWA

SEQ ID NO: 627955 - protein, 17 aa, Mycobacterium
ADLVGRFLLKGGETVWV

SEQ ID NO: 627956 - protein, 17 aa, Mycobacterium
ADLVKEFTFDYPSQIIA

SEQ ID NO: 627957 - protein, 21 aa, Mycobacterium
ADLVKEFTFDYPSRIIAGLLG

SEQ ID NO: 627958 - protein, 24 aa, Mycobacterium
ADLVKRPEWLAPMLPVIRDDLRMC

SEQ ID NO: 627959 - protein, 18 aa, Mycobacterium
ADLVRKVGLEFFTKLVDG

SEQ ID NO: 627960 - protein, 25 aa, Mycobacterium
ADLWRRLQSACARHEVEWFWVKGHS

SEQ ID NO: 627961 - protein, 17 aa, Mycobacterium
ADLYGRRAHDRFGSLLW

SEQ ID NO: 627962 - protein, 30 aa, Mycobacterium
ADLYLRIAPELFLKRCVVGGFDRVFELNRN

SEQ ID NO: 627963 - protein, 18 aa, Mycobacterium
ADLYRRLSTDLSANGCKV

SEQ ID NO: 627964 - protein, 18 aa, Mycobacterium
ADMAAKVVRAIPARRMGE

SEQ ID NO: 627965 - protein, 20 aa, Mycobacterium
ADMADRIMVMKDGEVVEQGD

SEQ ID NO: 627966 - protein, 27 aa, Mycobacterium
ADMAKKCIAEGWILSLSGTVSFKNARA

SEQ ID NO: 627967 - protein, 18 aa, Mycobacterium
ADMAMKLESARLMVYHAA

SEQ ID NO: 627968 - protein, 18 aa, Mycobacterium
ADMAMKVEAARLMVYSAA

SEQ ID NO: 627969 - protein, 25 aa, Mycobacterium
ADMDQRLVGMIARIVETYGKYNSSR

SEQ ID NO: 627970 - protein, 24 aa, Mycobacterium
ADMDWDDFEWLMGINFWGVAHGTK

SEQ ID NO: 627971 - protein, 17 aa, Mycobacterium
ADMGPLVTKAHRDRVAS

SEQ ID NO: 627972 - protein, 19 aa, Mycobacterium
ADMGRKFLTKLGILSPAAA

SEQ ID NO: 627973 - protein, 17 aa, Mycobacterium
ADMIRLIIRDEAVHGYY

SEQ ID NO: 627974 - protein, 20 aa, Mycobacterium
ADMIRLIIRDEAVHGYYIGY

SEQ ID NO: 627975 - protein, 23 aa, Mycobacterium
ADMKSYRPTADIYRVNSAAAAHR

SEQ ID NO: 627976 - protein, 23 aa, Mycobacterium
ADMLDGVGFVTAFEGGIGPVGGR

SEQ ID NO: 627977 - protein, 24 aa, Mycobacterium
ADMLGRAGALLVDLALDTVPRGYR

SEQ ID NO: 627978 - protein, 17 aa, Mycobacterium
ADMLPLLITEALDELLE

SEQ ID NO: 627979 - protein, 17 aa, Mycobacterium
ADMLRHVHTLLVEQGFQ

SEQ ID NO: 627980 - protein, 17 aa, Mycobacterium
ADMLTSLICHGTLTRFP

SEQ ID NO: 627981 - protein, 23 aa, Mycobacterium
ADMPLLLLDEGHCLRDQALEVCQ

SEQ ID NO: 627982 - protein, 17 aa, Mycobacterium
ADMQLPIGSVIVNRNIP

SEQ ID NO: 627983 - protein, 18 aa, Mycobacterium
ADMRITHPLISRAHLLLR

SEQ ID NO: 627984 - protein, 21 aa, Mycobacterium
ADMRRRIELALDIGSAETVFE

SEQ ID NO: 627985 - protein, 20 aa, Mycobacterium
ADMRRRRGLPPIAPDSKANY

SEQ ID NO: 627986 - protein, 17 aa, Mycobacterium
ADMSLSVTCPRDLVLNA

SEQ ID NO: 627987 - protein, 19 aa, Mycobacterium
ADMSWHVVDARGWTPQHLH

SEQ ID NO: 627988 - protein, 26 aa, Mycobacterium
ADMTLEYGKGFLLALHLGRQKDAGEL

SEQ ID NO: 627989 - protein, 17 aa, Mycobacterium
ADMVLAIYNPASKTRTW

SEQ ID NO: 627990 - protein, 27 aa, Mycobacterium
ADNAIIRRLCEPERQIIFRVPWVDDTG

SEQ ID NO: 627991 - protein, 22 aa, Mycobacterium
ADNAKWFYDFSVPGDVVEVRNS

SEQ ID NO: 627992 - protein, 18 aa, Mycobacterium
ADNFTALLSGLSLANITS

SEQ ID NO: 627993 - protein, 18 aa, Mycobacterium
ADNGWDLTLRNMSKGYPH

SEQ ID NO: 627994 - protein, 20 aa, Mycobacterium
ADNHIKFGMVPGGGSSQRLA

SEQ ID NO: 627995 - protein, 18 aa, Mycobacterium
ADNIWASGAAVSAFDSPF

SEQ ID NO: 627996 - protein, 22 aa, Mycobacterium
ADNPNVDACFIVRSQSVHRIQE

SEQ ID NO: 627997 - protein, 17 aa, Mycobacterium
ADNRCKGGNIGVAIGGC

SEQ ID NO: 627998 - protein, 27 aa, Mycobacterium
ADNTELGWRMEVEQGGEWHFFDDTEGA

SEQ ID NO: 627999 - protein, 17 aa, Mycobacterium
ADNTFVFVEQWEDADAL

SEQ ID NO: 628000 - protein, 19 aa, Mycobacterium
ADNTLVFYIWGDNGASMEG

SEQ ID NO: 628001 - protein, 20 aa, Mycobacterium
ADNTYYCFGTAAGPHPFPMM

SEQ ID NO: 628002 - protein, 27 aa, Mycobacterium
ADNVIREFIETTGIPFLPMSMAKGLLP

SEQ ID NO: 628003 - protein, 19 aa, Mycobacterium
ADPAAAWARAGFTVDDGVC

SEQ ID NO: 628004 - protein, 18 aa, Mycobacterium
ADPACPVQQVAHWPDTHP

SEQ ID NO: 628005 - protein, 18 aa, Mycobacterium
ADPAGWHGLIPVSTTAAL

SEQ ID NO: 628006 - protein, 24 aa, Mycobacterium
ADPAHQGLHLWLAEFPQPRPPRET

SEQ ID NO: 628007 - protein, 24 aa, Mycobacterium
ADPALDELVGFFVNTLVLRVELAG

SEQ ID NO: 628008 - protein, 20 aa, Mycobacterium
ADPAPQWGTHLWISHRPGYS

SEQ ID NO: 628009 - protein, 18 aa, Mycobacterium
ADPARVWSLVSDIKLMPT

SEQ ID NO: 628010 - protein, 26 aa, Mycobacterium
ADPAVALELGTYVGYGALRIARAAPQ

SEQ ID NO: 628011 - protein, 25 aa, Mycobacterium
ADPDASVLVPVHWATFRLAPHPWAE

SEQ ID NO: 628012 - protein, 23 aa, Mycobacterium
ADPDGVAIVVSWLSGELRQRQIG

SEQ ID NO: 628013 - protein, 25 aa, Mycobacterium
ADPDKPWKGGRWVVRTETGSRLPLT

SEQ ID NO: 628014 - protein, 17 aa, Mycobacterium
ADPDLIIGRYIPNLVPR

SEQ ID NO: 628015 - protein, 24 aa, Mycobacterium
ADPDRYADELAHIIGCEPSDVLRV

SEQ ID NO: 628016 - protein, 25 aa, Mycobacterium
ADPDRYAGEIAHIIGCEPHDVLRVS

SEQ ID NO: 628017 - protein, 32 aa, Mycobacterium
ADPDTLADLVFAWRTCRAVKSNAIVLAKDGAT

SEQ ID NO: 628018 - protein, 25 aa, Mycobacterium
ADPDWQRFHLIGATNPVYFALLARR

SEQ ID NO: 628019 - protein, 25 aa, Mycobacterium
ADPDYTLGMSWNFLARSTSGIPEWM

SEQ ID NO: 628020 - protein, 19 aa, Mycobacterium
ADPEALVAEALRLVDDGMR

SEQ ID NO: 628021 - protein, 24 aa, Mycobacterium
ADPEARYALGSVLNHVVLHQTVIG

SEQ ID NO: 628022 - protein, 28 aa, Mycobacterium
ADPEFMKNPEFAAAILPTLRGLKAIANY

SEQ ID NO: 628023 - protein, 23 aa, Mycobacterium
ADPEFPGLRVGLATGMAVSRAGD

SEQ ID NO: 628024 - protein, 18 aa, Mycobacterium
ADPERVRLLRSFDPRASR

SEQ ID NO: 628025 - protein, 31 aa, Mycobacterium
ADPETLADLAFAWRVCRAVKSNAIVIAAGGA

SEQ ID NO: 628026 - protein, 25 aa, Mycobacterium
ADPEYWGAVEELGFGQIALLLPTLP

SEQ ID NO: 628027 - protein, 23 aa, Mycobacterium
ADPFKAGTTWTQRILQQILHNGE

SEQ ID NO: 628028 - protein, 27 aa, Mycobacterium
ADPFPVQGWDSIGWVVGNAAQTAHFFQ

SEQ ID NO: 628029 - protein, 24 aa, Mycobacterium
ADPGADGTVVFGFNRLSIIDIAHS

SEQ ID NO: 628030 - protein, 20 aa, Mycobacterium
ADPGGGFACMVRDPDGQLIE

SEQ ID NO: 628031 - protein, 21 aa, Mycobacterium
ADPGGRVYLSPAGQSWAATAG

SEQ ID NO: 628032 - protein, 18 aa, Mycobacterium
ADPGKLRIGVRVPSAINP

SEQ ID NO: 628033 - protein, 22 aa, Mycobacterium
ADPHAPPWAHRFTPASWAAMLA

SEQ ID NO: 628034 - protein, 26 aa, Mycobacterium
ADPHLTSSEFARYLADYIHEQGWQTY

SEQ ID NO: 628035 - protein, 23 aa, Mycobacterium
ADPHPRHPIALAQQGDDLGGGTH

SEQ ID NO: 628036 - protein, 20 aa, Mycobacterium
ADPIRPTMRINPGARYQAME

SEQ ID NO: 628037 - protein, 17 aa, Mycobacterium
ADPIVGFAGAGAQDSEA

SEQ ID NO: 628038 - protein, 20 aa, Mycobacterium
ADPKGAFVDTFCQMLSEVRA

SEQ ID NO: 628039 - protein, 20 aa, Mycobacterium
ADPKLPDLVVCRRELAEAVL

SEQ ID NO: 628040 - protein, 20 aa, Mycobacterium
ADPLAGLVLKDLPIPTPPSG

SEQ ID NO: 628041 - protein, 21 aa, Mycobacterium
ADPLARLNIMAANGSRLLATT

SEQ ID NO: 628042 - protein, 20 aa, Mycobacterium
ADPLLKFVPLPWPDYYGKAP

SEQ ID NO: 628043 - protein, 22 aa, Mycobacterium
ADPLPINPMPAVPVTVPGSAPN

SEQ ID NO: 628044 - protein, 26 aa, Mycobacterium
ADPLPRTLAWSAAWEMTRDAEMKARD

SEQ ID NO: 628045 - protein, 18 aa, Mycobacterium
ADPLRSGQLVSLSTGAGE

SEQ ID NO: 628046 - protein, 18 aa, Mycobacterium
ADPLRVLAVAKKRMNRIK

SEQ ID NO: 628047 - protein, 27 aa, Mycobacterium
ADPLWLAWPNHMKIFWNNKGVVAKATD

SEQ ID NO: 628048 - protein, 22 aa, Mycobacterium
ADPMIREWLTVLLRRDLGLLLL

SEQ ID NO: 628049 - protein, 23 aa, Mycobacterium
ADPNELWVGDALHGPRVGDRKTY

SEQ ID NO: 628050 - protein, 20 aa, Mycobacterium
ADPNGAWYTSGIRFGSPALT

SEQ ID NO: 628051 - protein, 20 aa, Mycobacterium
ADPNGAWYTSGIRFGTPALT

SEQ ID NO: 628052 - protein, 19 aa, Mycobacterium
ADPNGAWYTSGVRLGTPAL

SEQ ID NO: 628053 - protein, 17 aa, Mycobacterium
ADPPAMLTFGGGVHYCL

SEQ ID NO: 628054 - protein, 21 aa, Mycobacterium
ADPPLKLVLLETAGQGGTLNH

SEQ ID NO: 628055 - protein, 27 aa, Mycobacterium
ADPPPAGSIGLMIAMGPAFCSELVLLT

SEQ ID NO: 628056 - protein, 25 aa, Mycobacterium
ADPPPGLPGVRAFLEGAGVARFKIP

SEQ ID NO: 628057 - protein, 25 aa, Mycobacterium
ADPPRWLFENGPEFTHYEVIDGYTD

SEQ ID NO: 628058 - protein, 24 aa, Mycobacterium
ADPQARRRGLDWSVHQVIAHVLCV

SEQ ID NO: 628059 - protein, 24 aa, Mycobacterium
ADPQCARCKQAIGPGWLYLTAHRR

SEQ ID NO: 628060 - protein, 25 aa, Mycobacterium
ADPQISASMGIQWYRVKLDAEYVAA

SEQ ID NO: 628061 - protein, 25 aa, Mycobacterium
ADPQMAWRYVELDGGDVDGQVDRLC

SEQ ID NO: 628062 - protein, 23 aa, Mycobacterium
ADPQRLLCWGRTSGYRHKRQKRK

SEQ ID NO: 628063 - protein, 22 aa, Mycobacterium
ADPQWGRRVHAVIQRAEADGAE

SEQ ID NO: 628064 - protein, 21 aa, Mycobacterium
ADPRAAGLAARRETTRSAAGV

SEQ ID NO: 628065 - protein, 20 aa, Mycobacterium
ADPRAAPAVDRHRHREPAGL

SEQ ID NO: 628066 - protein, 21 aa, Mycobacterium
ADPRAPIAVKEAVLPFHRFRR

SEQ ID NO: 628067 - protein, 17 aa, Mycobacterium
ADPRARAFFLSMASGGG

SEQ ID NO: 628068 - protein, 19 aa, Mycobacterium
ADPRFANVVKLFSQLFPGR

SEQ ID NO: 628069 - protein, 23 aa, Mycobacterium
ADPRGGIELDELRKRAGRYFDEV

SEQ ID NO: 628070 - protein, 19 aa, Mycobacterium
ADPRIAISQAREAKSRELA

SEQ ID NO: 628071 - protein, 24 aa, Mycobacterium
ADPRIRRIHHDWSEAADRAQRTVR

SEQ ID NO: 628072 - protein, 19 aa, Mycobacterium
ADPRIVPNAARLDKVSFEE

SEQ ID NO: 628073 - protein, 20 aa, Mycobacterium
ADPRLKIAFFDSKPYVEACF

SEQ ID NO: 628074 - protein, 19 aa, Mycobacterium
ADPRLVRDLCDARVPHLPV

SEQ ID NO: 628075 - protein, 20 aa, Mycobacterium
ADPRRARVIATEAMGSQRLT

SEQ ID NO: 628076 - protein, 17 aa, Mycobacterium
ADPRRGGQLVALPPGAG

SEQ ID NO: 628077 - protein, 20 aa, Mycobacterium
ADPRRLEVFLGAMDSASRRN

SEQ ID NO: 628078 - protein, 22 aa, Mycobacterium
ADPRRPATVESRHVGRWRFVTM

SEQ ID NO: 628079 - protein, 18 aa, Mycobacterium
ADPRRSGLGEVRSTRRTA

SEQ ID NO: 628080 - protein, 18 aa, Mycobacterium
ADPRRTRLAAGEHRHRAP

SEQ ID NO: 628081 - protein, 20 aa, Mycobacterium
ADPRVAVFGGTGSIGLYCVD

SEQ ID NO: 628082 - protein, 19 aa, Mycobacterium
ADPRVSLLVDHYSDDWARL

SEQ ID NO: 628083 - protein, 18 aa, Mycobacterium
ADPRVVSVALDVTKSDSV

SEQ ID NO: 628084 - protein, 22 aa, Mycobacterium
ADPRYGDARGRAANAVELIAQL

SEQ ID NO: 628085 - protein, 19 aa, Mycobacterium
ADPSAPWPGKLPDPAPVVL

SEQ ID NO: 628086 - protein, 21 aa, Mycobacterium
ADPSFGERVRRVLADLRTLEA

SEQ ID NO: 628087 - protein, 24 aa, Mycobacterium
ADPSGNCLEVFHGVALEHRRVVSP

SEQ ID NO: 628088 - protein, 26 aa, Mycobacterium
ADPSLRVVVLDARFAGYGASGRNGGW

SEQ ID NO: 628089 - protein, 21 aa, Mycobacterium
ADPSLVPLFFVAREARKHVKV

SEQ ID NO: 628090 - protein, 17 aa, Mycobacterium
ADPSTWMPATRVTRSDW

SEQ ID NO: 628091 - protein, 19 aa, Mycobacterium
ADPSWAWKRIAKSRRPIGA

SEQ ID NO: 628092 - protein, 27 aa, Mycobacterium
ADPSWAYARVALRWAERYYANERELAL

SEQ ID NO: 628093 - protein, 20 aa, Mycobacterium
ADPTFWCPRRNKPIERVARR

SEQ ID NO: 628094 - protein, 19 aa, Mycobacterium
ADPTHQGLHMWLAEFPQPR

SEQ ID NO: 628095 - protein, 19 aa, Mycobacterium
ADPTLLFDGMFALVQHSLG

SEQ ID NO: 628096 - protein, 25 aa, Mycobacterium
ADPTSARGSLRLSLGHTSVDADVDA

SEQ ID NO: 628097 - protein, 23 aa, Mycobacterium
ADPTWSDRCYFFAASPDGTLLLA

SEQ ID NO: 628098 - protein, 23 aa, Mycobacterium
ADPVAIVGIGCRFPGGVDSADSL

SEQ ID NO: 628099 - protein, 17 aa, Mycobacterium
ADPVASLDWPGESAEPV

SEQ ID NO: 628100 - protein, 21 aa, Mycobacterium
ADPVCRPTYIGHDLRSLRQDR

SEQ ID NO: 628101 - protein, 25 aa, Mycobacterium
ADPVIAWRYLDLRGDDLTPDEEIQH

SEQ ID NO: 628102 - protein, 23 aa, Mycobacterium
ADPVRNGQRWTVFAVDPTHDRIA

SEQ ID NO: 628103 - protein, 22 aa, Mycobacterium
ADPVSLGAAAVFSGRGSQHTAA

SEQ ID NO: 628104 - protein, 17 aa, Mycobacterium
ADPVSLQTAAGFSGQGV

SEQ ID NO: 628105 - protein, 17 aa, Mycobacterium
ADPVSMQSAALFSAHGL

SEQ ID NO: 628106 - protein, 20 aa, Mycobacterium
ADPWRWVLGGGEDHALVACF

SEQ ID NO: 628107 - protein, 33 aa, Mycobacterium
ADPWWDIAIRMLIKYKNLRLMTSAWSPKRLPES

SEQ ID NO: 628108 - protein, 21 aa, Mycobacterium
ADPYCPGLRAVSLQPGTIDGG

SEQ ID NO: 628109 - protein, 21 aa, Mycobacterium
ADPYLPLITPFLDDLRGELDE

SEQ ID NO: 628110 - protein, 24 aa, Mycobacterium
ADPYPMFRRLREEAPLYYNAQHGF

SEQ ID NO: 628111 - protein, 17 aa, Mycobacterium
ADPYPVYARLRDEAPLY

SEQ ID NO: 628112 - protein, 18 aa, Mycobacterium
ADQAAFRRTYPFSPALVS

SEQ ID NO: 628113 - protein, 20 aa, Mycobacterium
ADQADFAILLARTDPEQPKH

SEQ ID NO: 628114 - protein, 24 aa, Mycobacterium
ADQAEARGAWDIRMEANIVDAVVR

SEQ ID NO: 628115 - protein, 24 aa, Mycobacterium
ADQARLAQFADLWNTRNHAVTAIV

SEQ ID NO: 628116 - protein, 23 aa, Mycobacterium
ADQCGSCFNGTAAMAAAAEALRD

SEQ ID NO: 628117 - protein, 26 aa, Mycobacterium
ADQDGMLWFEVMAPMASSAAGREAAH

SEQ ID NO: 628118 - protein, 17 aa, Mycobacterium
ADQGIRLTGHRPVSPQA

SEQ ID NO: 628119 - protein, 18 aa, Mycobacterium
ADQGKRNVSHGCPNLSPA

SEQ ID NO: 628120 - protein, 20 aa, Mycobacterium
ADQGLHIVVCVGTFGQQAAD

SEQ ID NO: 628121 - protein, 18 aa, Mycobacterium
ADQGPAWWDGTVIEHTRV

SEQ ID NO: 628122 - protein, 36 aa, Mycobacterium
ADQGTALLCPFDPLIFFRPRVERLFDFHYRIEIYTP

SEQ ID NO: 628123 - protein, 24 aa, Mycobacterium
ADQHCVAVLFAAMFEDTALRATGV

SEQ ID NO: 628124 - protein, 19 aa, Mycobacterium
ADQIRFFAGAARLVEGKSA

SEQ ID NO: 628125 - protein, 24 aa, Mycobacterium
ADQLELKWRGLREQLEEQGVADSV

SEQ ID NO: 628126 - protein, 21 aa, Mycobacterium
ADQLRQAAVIAREGAGTIGAA

SEQ ID NO: 628127 - protein, 18 aa, Mycobacterium
ADQRAKYSLRGHVGTKPG

SEQ ID NO: 628128 - protein, 23 aa, Mycobacterium
ADQRGASVPIDWPADLQQQVAAV

SEQ ID NO: 628129 - protein, 31 aa, Mycobacterium
ADQRGVSVTDWLQSRHSFSFGDYYDPANTHH

SEQ ID NO: 628130 - protein, 27 aa, Mycobacterium
ADQRLAIADWVYWQHLAVIMNDAVNAD

SEQ ID NO: 628131 - protein, 19 aa, Mycobacterium
ADQRVRFVLLGDGNQRVHL

SEQ ID NO: 628132 - protein, 18 aa, Mycobacterium
ADQSGYRLPQLVSDVGAV

SEQ ID NO: 628133 - protein, 21 aa, Mycobacterium
ADQSLGDALTQYQFGSDGQQR

SEQ ID NO: 628134 - protein, 25 aa, Mycobacterium
ADQTATLWFEVAKPLMSTNPQRSAA

SEQ ID NO: 628135 - protein, 26 aa, Mycobacterium
ADRAAAYRAAGYWAGRTLDTILTDAA

SEQ ID NO: 628136 - protein, 21 aa, Mycobacterium
ADRAARMGFGGKLCIHPRQVE

SEQ ID NO: 628137 - protein, 17 aa, Mycobacterium
ADRADWQPPRYAPESAA

SEQ ID NO: 628138 - protein, 21 aa, Mycobacterium
ADRAGIPFAQIDTGNNVVPLT

SEQ ID NO: 628139 - protein, 21 aa, Mycobacterium
ADRAGSAYAELALLRGDPSDG

SEQ ID NO: 628140 - protein, 17 aa, Mycobacterium
ADRALCPEEEGITGYVD

SEQ ID NO: 628141 - protein, 21 aa, Mycobacterium
ADRAQFGALLARTDPDAAKHR

SEQ ID NO: 628142 - protein, 25 aa, Mycobacterium
ADRARVEEALGWVDAVGIADRRLSD

SEQ ID NO: 628143 - protein, 27 aa, Mycobacterium
ADRCAIGVPTPTGWRMLSGDETGWLLG

SEQ ID NO: 628144 - protein, 20 aa, Mycobacterium
ADRCLAVDAHGRVIDGDAIM

SEQ ID NO: 628145 - protein, 17 aa, Mycobacterium
ADRDICLIPSSAHGTNA

SEQ ID NO: 628146 - protein, 26 aa, Mycobacterium
ADRDLMEFRRSVGMLFQRPNPFPMSI

SEQ ID NO: 628147 - protein, 20 aa, Mycobacterium
ADRDPRRPLLIGSAKTNLGH

SEQ ID NO: 628148 - protein, 20 aa, Mycobacterium
ADRDRLAASINDMIEHRQPF

SEQ ID NO: 628149 - protein, 25 aa, Mycobacterium
ADRELRRFVSTAGRYRRVTPRIFAV

SEQ ID NO: 628150 - protein, 25 aa, Mycobacterium
ADREQLRLLLRDVFISAGGTHDNWD

SEQ ID NO: 628151 - protein, 19 aa, Mycobacterium
ADRERAEWLALLRSEGLLP

SEQ ID NO: 628152 - protein, 21 aa, Mycobacterium
ADRFGPLLAGAPVHLVTEKAA

SEQ ID NO: 628153 - protein, 29 aa, Mycobacterium
ADRFLDGYWRSGDVGTIYPNGYLKLTDRL

SEQ ID NO: 628154 - protein, 28 aa, Mycobacterium
ADRFPWSMKFARAMGSAGIDMNDPVTVG

SEQ ID NO: 628155 - protein, 24 aa, Mycobacterium
ADRFVERAGRRWYRTGDLARYWPD

SEQ ID NO: 628156 - protein, 27 aa, Mycobacterium
ADRGEAIGYAVDWARTGDVVLIAGKGH

SEQ ID NO: 628157 - protein, 23 aa, Mycobacterium
ADRGFVGRLRRAFIVAVNCTEPG

SEQ ID NO: 628158 - protein, 22 aa, Mycobacterium
ADRGLRCIAPTWPLGAHPEPLR

SEQ ID NO: 628159 - protein, 18 aa, Mycobacterium
ADRHPGWHALRKIAERIT

SEQ ID NO: 628160 - protein, 23 aa, Mycobacterium
ADRIARGGARFVIANASDTDKFA

SEQ ID NO: 628161 - protein, 20 aa, Mycobacterium
ADRIGCGGDELYLAAESDLH

SEQ ID NO: 628162 - protein, 17 aa, Mycobacterium
ADRIRDWWVAQFAQPRQ

SEQ ID NO: 628163 - protein, 23 aa, Mycobacterium
ADRIRRGGAGYVIANAADAPKFD

SEQ ID NO: 628164 - protein, 22 aa, Mycobacterium
ADRIRRVAERIVETKKAGNDVV

SEQ ID NO: 628165 - protein, 18 aa, Mycobacterium
ADRIRRVAERIVETRKQG

SEQ ID NO: 628166 - protein, 19 aa, Mycobacterium
ADRITHIWTNTKMYLVAVH

SEQ ID NO: 628167 - protein, 23 aa, Mycobacterium
ADRIVLCAGAIETAQLLMLSGVG

SEQ ID NO: 628168 - protein, 21 aa, Mycobacterium
ADRKGGHILCGIDGRVYGVDH

SEQ ID NO: 628169 - protein, 17 aa, Mycobacterium
ADRKIPAITLMSNDVFD

SEQ ID NO: 628170 - protein, 31 aa, Mycobacterium
ADRKRIVLCGKPDLCRRYAAALERHDAHPAA

SEQ ID NO: 628171 - protein, 18 aa, Mycobacterium
ADRLGFEGVLTPTGTWCE

SEQ ID NO: 628172 - protein, 24 aa, Mycobacterium
ADRLKARGFAAAAINGDINQAQRE

SEQ ID NO: 628173 - protein, 20 aa, Mycobacterium
ADRLLPLLYRHWHSAGRQES

SEQ ID NO: 628174 - protein, 32 aa, Mycobacterium
ADRLNALIPTAGLDWRQVAVLRSYSRYLRQLP

SEQ ID NO: 628175 - protein, 17 aa, Mycobacterium
ADRLNLAITALREEAEA

SEQ ID NO: 628176 - protein, 18 aa, Mycobacterium
ADRLPAYMVPAAVVVLDA

SEQ ID NO: 628177 - protein, 18 aa, Mycobacterium
ADRLPAYMVPAAVVVLDR

SEQ ID NO: 628178 - protein, 18 aa, Mycobacterium
ADRLRHVGGMSIASVLIP

SEQ ID NO: 628179 - protein, 19 aa, Mycobacterium
ADRLRLVSAAAHGQFARLV

SEQ ID NO: 628180 - protein, 24 aa, Mycobacterium
ADRLTATDAYDWGLISAVYPADEF

SEQ ID NO: 628181 - protein, 20 aa, Mycobacterium
ADRLWIPVHRDWRLNERHYG

SEQ ID NO: 628182 - protein, 19 aa, Mycobacterium
ADRLWIPVRRSWRLNERHY

SEQ ID NO: 628183 - protein, 23 aa, Mycobacterium
ADRLWIPVVRDWRLNERHYGALQ

SEQ ID NO: 628184 - protein, 17 aa, Mycobacterium
ADRLWTLPGGWCDVLET

SEQ ID NO: 628185 - protein, 22 aa, Mycobacterium
ADRPAPQFEVMYRLDGCDAAAA

SEQ ID NO: 628186 - protein, 18 aa, Mycobacterium
ADRPEVRHRIAFLPDYDM

SEQ ID NO: 628187 - protein, 19 aa, Mycobacterium
ADRPEVRHRIAFLPDYDMS

SEQ ID NO: 628188 - protein, 19 aa, Mycobacterium
ADRPEVRHRIAFLPNYDMS

SEQ ID NO: 628189 - protein, 23 aa, Mycobacterium
ADRPHAYAKLWRHHAAQPQADRI

SEQ ID NO: 628190 - protein, 25 aa, Mycobacterium
ADRPLPWQLPARLLLARAYAALGRA

SEQ ID NO: 628191 - protein, 20 aa, Mycobacterium
ADRPPLLAWMVQALIQPDTA

SEQ ID NO: 628192 - protein, 18 aa, Mycobacterium
ADRPRRVRRPDEPLRIGV

SEQ ID NO: 628193 - protein, 22 aa, Mycobacterium
ADRPTRCRVRHHGVGPSRRNRR

SEQ ID NO: 628194 - protein, 19 aa, Mycobacterium
ADRPWRFWLASTPEVSAYR

SEQ ID NO: 628195 - protein, 18 aa, Mycobacterium
ADRQRVATQLGYSETVFV

SEQ ID NO: 628196 - protein, 23 aa, Mycobacterium
ADRRIAPSAAKLFCTEMAGKVAD

SEQ ID NO: 628197 - protein, 21 aa, Mycobacterium
ADRRLPHDEIRALKESGLLAI

SEQ ID NO: 628198 - protein, 23 aa, Mycobacterium
ADRRLRLASGAQLEYDYLIYAVG

SEQ ID NO: 628199 - protein, 22 aa, Mycobacterium
ADRRLSALLWAVADTAIAEDGN

SEQ ID NO: 628200 - protein, 17 aa, Mycobacterium
ADRRMRLTLRIYAYNSC

SEQ ID NO: 628201 - protein, 24 aa, Mycobacterium
ADRRPELFDSLVLINPLSKNTARR

SEQ ID NO: 628202 - protein, 28 aa, Mycobacterium
ADRRYALEMAPRLVAFSEDVARRVPDSV

SEQ ID NO: 628203 - protein, 20 aa, Mycobacterium
ADRSLQWFIEDVLGLFDVDP

SEQ ID NO: 628204 - protein, 24 aa, Mycobacterium
ADRSLRWFIEDVLGLFDIDPNSHA

SEQ ID NO: 628205 - protein, 24 aa, Mycobacterium
ADRSSGWAWLPFRAAVADAVSKVR

SEQ ID NO: 628206 - protein, 17 aa, Mycobacterium
ADRSWRILNPPHRDRGR

SEQ ID NO: 628207 - protein, 25 aa, Mycobacterium
ADRTGLPWPELEDSGSMSLLQTLRT

SEQ ID NO: 628208 - protein, 21 aa, Mycobacterium
ADRTYYCFGTAAGPHPFPTMV

SEQ ID NO: 628209 - protein, 17 aa, Mycobacterium
ADRVDALKSLDDVKLLD

SEQ ID NO: 628210 - protein, 30 aa, Mycobacterium
ADRVGLTPAPCLRRVRRLEAEGVITGYTAL

SEQ ID NO: 628211 - protein, 21 aa, Mycobacterium
ADRVISTFVFDLLDVDYARDV

SEQ ID NO: 628212 - protein, 24 aa, Mycobacterium
ADRVLCALHGWLAPLPPEGASAIV

SEQ ID NO: 628213 - protein, 19 aa, Mycobacterium
ADRVMGLYGLEVFGAQVTV

SEQ ID NO: 628214 - protein, 20 aa, Mycobacterium
ADRVPVILLHGARVPGIASF

SEQ ID NO: 628215 - protein, 19 aa, Mycobacterium
ADRVRPAYEDPLTRLIAAV

SEQ ID NO: 628216 - protein, 24 aa, Mycobacterium
ADRVSRCAIGLLGLGSTVRRATAA

SEQ ID NO: 628217 - protein, 23 aa, Mycobacterium
ADRVTELLPYYASVHRGAGYASR

SEQ ID NO: 628218 - protein, 21 aa, Mycobacterium
ADRVVRWGTAFSVAAPDAANG

SEQ ID NO: 628219 - protein, 18 aa, Mycobacterium
ADRWDYRRFYDSDKGAAG

SEQ ID NO: 628220 - protein, 21 aa, Mycobacterium
ADRYTGIHFLEDMGAGIFGKA

SEQ ID NO: 628221 - protein, 23 aa, Mycobacterium
ADSAACREAFATLELLVVVDVAM

SEQ ID NO: 628222 - protein, 21 aa, Mycobacterium
ADSADRWWSVSWRHDPEDVRA

SEQ ID NO: 628223 - protein, 19 aa, Mycobacterium
ADSAIASWQLPNINIGTGN

SEQ ID NO: 628224 - protein, 18 aa, Mycobacterium
ADSALKVAVEALYDAADD

SEQ ID NO: 628225 - protein, 17 aa, Mycobacterium
ADSALRPLTRVVRSARM

SEQ ID NO: 628226 - protein, 24 aa, Mycobacterium
ADSARARNVLSFKLNPELIDELPL

SEQ ID NO: 628227 - protein, 26 aa, Mycobacterium
ADSARCKEAFAALELLVVVDVAMTET

SEQ ID NO: 628228 - protein, 26 aa, Mycobacterium
ADSDAQRAAAAWALADIPLATFLTEA

SEQ ID NO: 628229 - protein, 17 aa, Mycobacterium
ADSEAIIARMLAVMLRR

SEQ ID NO: 628230 - protein, 17 aa, Mycobacterium
ADSEFDWKKVADHPAGR

SEQ ID NO: 628231 - protein, 25 aa, Mycobacterium
ADSEMRMMCVFNPPVTGREVHDESG

SEQ ID NO: 628232 - protein, 19 aa, Mycobacterium
ADSFEAWQVDQLTALAKAL

SEQ ID NO: 628233 - protein, 18 aa, Mycobacterium
ADSFRFAHAPHFALNDLA

SEQ ID NO: 628234 - protein, 24 aa, Mycobacterium
ADSFRRLYRMHLMVDVTREVVADQ

SEQ ID NO: 628235 - protein, 19 aa, Mycobacterium
ADSFWNFVLHKGDAVADIP

SEQ ID NO: 628236 - protein, 18 aa, Mycobacterium
ADSGARVLLVGAELRAAA

SEQ ID NO: 628237 - protein, 25 aa, Mycobacterium
ADSGCARLSLQVTIQVRIPLIGGKL

SEQ ID NO: 628238 - protein, 23 aa, Mycobacterium
ADSGFYAVCGWDAVNDAIARPEN

SEQ ID NO: 628239 - protein, 20 aa, Mycobacterium
ADSGMLAALYVLAALGEQSR

SEQ ID NO: 628240 - protein, 18 aa, Mycobacterium
ADSGMLAAMQQQIDELTR

SEQ ID NO: 628241 - protein, 22 aa, Mycobacterium
ADSHAPPWARRFTPTSWAAMLA

SEQ ID NO: 628242 - protein, 31 aa, Mycobacterium
ADSIVIGGGMCFTFLAAQGFSVGKSLLEEEM

SEQ ID NO: 628243 - protein, 31 aa, Mycobacterium; identical to SEQ ID NO: 77568

SEQ ID NO: 628244 - protein, 28 aa, Mycobacterium
ADSIVIGGGMCFTFLAAQGYSVGTSLLE

SEQ ID NO: 628245 - protein, 29 aa, Mycobacterium
ADSIVIGGGMCFTFLAAQGYSVGTSLLEK

SEQ ID NO: 628246 - protein, 26 aa, Mycobacterium
ADSLGGRGGTSWVQAGYGPTTGGKAS

SEQ ID NO: 628247 - protein, 19 aa, Mycobacterium
ADSLPGLLRQAARALPSRR

SEQ ID NO: 628248 - protein, 18 aa, Mycobacterium
ADSLSFVLEDAVLTADSV

SEQ ID NO: 628249 - protein, 28 aa, Mycobacterium
ADSLVIGGGMCFTFLAAQGLPVGKSLVQ

SEQ ID NO: 628250 - protein, 17 aa, Mycobacterium
ADSMIYSAAFVLCAGAD

SEQ ID NO: 628251 - protein, 18 aa, Mycobacterium
ADSMKGLCPFHDEKSPSF

SEQ ID NO: 628252 - protein, 18 aa, Mycobacterium
ADSMKRMFLELGGKSAAI

SEQ ID NO: 628253 - protein, 24 aa, Mycobacterium
ADSMTYSAAFALCIGDTDADIARR

SEQ ID NO: 628254 - protein, 18 aa, Mycobacterium
ADSPCTASASVAKEPCRI

SEQ ID NO: 628255 - protein, 26 aa, Mycobacterium
ADSPLWDRMDFAVAEANFLAAARHGI

SEQ ID NO: 628256 - protein, 22 aa, Mycobacterium
ADSPSKAAGYWGLSAKSRATFQ

SEQ ID NO: 628257 - protein, 22 aa, Mycobacterium
ADSRAAIADWLYWKHLSGLLHA

SEQ ID NO: 628258 - protein, 22 aa, Mycobacterium
ADSRESLFWVSANGVRFGIAND

SEQ ID NO: 628259 - protein, 17 aa, Mycobacterium
ADSRRVLAELGYGPDDI

SEQ ID NO: 628260 - protein, 24 aa, Mycobacterium
ADSSAEALRGGWFHTGDLGRMDAE

SEQ ID NO: 628261 - protein, 24 aa, Mycobacterium
ADSSFYAVCGWDAVHDAISRPEDF

SEQ ID NO: 628262 - protein, 21 aa, Mycobacterium
ADSSRAWLALLSVLYREVSRP

SEQ ID NO: 628263 - protein, 21 aa, Mycobacterium
ADSSRGALLIHGHLDVVPAEP

SEQ ID NO: 628264 - protein, 19 aa, Mycobacterium
ADSTLNRFANIGVTTVFSH

SEQ ID NO: 628265 - protein, 26 aa, Mycobacterium
ADSVGWLRDFLRAHTGGLIIISHNVE

SEQ ID NO: 628266 - protein, 26 aa, Mycobacterium
ADSVRFRPALPVTRAEIDACLDAVRA

SEQ ID NO: 628267 - protein, 20 aa, Mycobacterium
ADSVTSFGAFHCSIDKVDVK

SEQ ID NO: 628268 - protein, 19 aa, Mycobacterium
ADSVTSFGAFHLGIEKVDR

SEQ ID NO: 628269 - protein, 19 aa, Mycobacterium
ADSWLVWNLTGGTRGGVHV

SEQ ID NO: 628270 - protein, 22 aa, Mycobacterium
ADSWPDTKNSLFGEAQERSAAA

SEQ ID NO: 628271 - protein, 19 aa, Mycobacterium
ADSWSTGLLTRVAPTALDE

SEQ ID NO: 628272 - protein, 26 aa, Mycobacterium
ADSYWLPDHLNAFLPRAVMTPKYSGI

SEQ ID NO: 628273 - protein, 24 aa, Mycobacterium
ADTAGKPSLAWRGRRAAEQLSGAV

SEQ ID NO: 628274 - protein, 25 aa, Mycobacterium
ADTAGKPSLGWRGRRAAERLSERVS

SEQ ID NO: 628275 - protein, 20 aa, Mycobacterium
ADTAGRWRALALVATAADLL

SEQ ID NO: 628276 - protein, 26 aa, Mycobacterium
ADTALAARVLLVWDAPNLDMGLGSIL

SEQ ID NO: 628277 - protein, 24 aa, Mycobacterium
ADTAVAAVEAWGEGGSGATAAAAG

SEQ ID NO: 628278 - protein, 17 aa, Mycobacterium
ADTAVDVVIPYHRGDLV

SEQ ID NO: 628279 - protein, 23 aa, Mycobacterium
ADTAVGLLIDVMRKFSASDRYVR

SEQ ID NO: 628280 - protein, 19 aa, Mycobacterium
ADTDRALSIAARVRSGTLG

SEQ ID NO: 628281 - protein, 18 aa, Mycobacterium
ADTDVAWTGRTMKVPWFA

SEQ ID NO: 628282 - protein, 27 aa, Mycobacterium
ADTEIARLVPFIEWLRDAYPDHVISAD

SEQ ID NO: 628283 - protein, 25 aa, Mycobacterium
ADTEIPRELRLAVQESLLGLLSEQS

SEQ ID NO: 628284 - protein, 20 aa, Mycobacterium
ADTFHAQFVQLLNSGASAYT

SEQ ID NO: 628285 - protein, 18 aa, Mycobacterium
ADTFPILRGMSIKRVLIN

SEQ ID NO: 628286 - protein, 27 aa, Mycobacterium
ADTGLLTFLSFFLAYAYYGAAKSIAGD

SEQ ID NO: 628287 - protein, 27 aa, Mycobacterium
ADTGTGWELFGRRAIRQGDWKALHLPA

SEQ ID NO: 628288 - protein, 23 aa, Mycobacterium
ADTGYRIAHELGISLPPRQIRRA

SEQ ID NO: 628289 - protein, 25 aa, Mycobacterium
ADTHLLRYPLPAAWADTVDVQLYLK

SEQ ID NO: 628290 - protein, 20 aa, Mycobacterium
ADTIEFCAAEVPRFNAISVA

SEQ ID NO: 628291 - protein, 20 aa, Mycobacterium
ADTIRRAAGVAARSLGTAEA

SEQ ID NO: 628292 - protein, 24 aa, Mycobacterium
ADTKLGVAVNDHFTARGAVTAAPP

SEQ ID NO: 628293 - protein, 26 aa, Mycobacterium
ADTLAAVAVAGRLRGTARATITAAPA

SEQ ID NO: 628294 - protein, 24 aa, Mycobacterium
ADTLARWIVRINFSLIAEPADPDD

SEQ ID NO: 628295 - protein, 22 aa, Mycobacterium
ADTLECLAELAATEGDRREAAR

SEQ ID NO: 628296 - protein, 23 aa, Mycobacterium
ADTLRAAPALSTFTGTPHTVLLT

SEQ ID NO: 628297 - protein, 18 aa, Mycobacterium
ADTMKRTFLELGGKSAMI

SEQ ID NO: 628298 - protein, 17 aa, Mycobacterium
ADTMLSHAITFPGDPQG

SEQ ID NO: 628299 - protein, 40 aa, Mycobacterium
ADTPDLIPFSGPARKALELTFRQALRLGHNYIGTEHLLLA

SEQ ID NO: 628300 - protein, 18 aa, Mycobacterium
ADTPGAEFHPEFDAGAVE

SEQ ID NO: 628301 - protein, 22 aa, Mycobacterium
ADTPGGSALRLLVRHDDAEREF

SEQ ID NO: 628302 - protein, 25 aa, Mycobacterium
ADTRALTAYSCRWRPWRAYATQHLW

SEQ ID NO: 628303 - protein, 17 aa, Mycobacterium
ADTRGGQLLVYGVDPLI

SEQ ID NO: 628304 - protein, 22 aa, Mycobacterium
ADTRGGQLLVYGVDPLILRQAY

SEQ ID NO: 628305 - protein, 17 aa, Mycobacterium
ADTRIAVLSAMGSDERS

SEQ ID NO: 628306 - protein, 17 aa, Mycobacterium
ADTRLLLNTALESGETV

SEQ ID NO: 628307 - protein, 24 aa, Mycobacterium
ADTRLRAALAGLRTIAWADRSVPS

SEQ ID NO: 628308 - protein, 24 aa, Mycobacterium
ADTRRRLCAALANRGVLAYGRSGL

SEQ ID NO: 628309 - protein, 21 aa, Mycobacterium
ADTRTVLGLALGICANAPLEP

SEQ ID NO: 628310 - protein, 24 aa, Mycobacterium
ADTRVTDFTAFWAGPVATQLLGAL

SEQ ID NO: 628311 - protein, 28 aa, Mycobacterium
ADTVLRYELMGRLLPNSMFLQAAERDLI

SEQ ID NO: 628312 - protein, 18 aa, Mycobacterium
ADTWALQDVMALGVTAGA

SEQ ID NO: 628313 - protein, 17 aa, Mycobacterium
ADTWRDRFQQMLQRAEA

SEQ ID NO: 628314 - protein, 20 aa, Mycobacterium
ADTWVLWNLTGGPRGGVHVT

SEQ ID NO: 628315 - protein, 17 aa, Mycobacterium
ADTWYRIPAFYFACPAT

SEQ ID NO: 628316 - protein, 19 aa, Mycobacterium
ADTYRRGLDYAREGRVVRC

SEQ ID NO: 628317 - protein, 25 aa, Mycobacterium
ADTYRWPMVPALALLAAMPALGSAE

SEQ ID NO: 628318 - protein, 18 aa, Mycobacterium
ADTYYDWETRGYLEYATR

SEQ ID NO: 628319 - protein, 24 aa, Mycobacterium
ADVAAAWDRVYWIMADTLIALERD

SEQ ID NO: 628320 - protein, 17 aa, Mycobacterium
ADVAAMLGYHGGASAAA

SEQ ID NO: 628321 - protein, 19 aa, Mycobacterium
ADVADGLWTLDRDFSDFDI

SEQ ID NO: 628322 - protein, 25 aa, Mycobacterium
ADVAGAKPWFAIGGIDGVRLPEVLA

SEQ ID NO: 628323 - protein, 19 aa, Mycobacterium
ADVAGLLRRLEGVPIATVV

SEQ ID NO: 628324 - protein, 19 aa, Mycobacterium
ADVAGYRLPAGVMVAPGIG

SEQ ID NO: 628325 - protein, 26 aa, Mycobacterium
ADVAHWLEVVGLPGLADARPHELSGG

SEQ ID NO: 628326 - protein, 21 aa, Mycobacterium
ADVAKALGIHGLRVERPDQLD

SEQ ID NO: 628327 - protein, 18 aa, Mycobacterium
ADVALERMREAVAADDPL

SEQ ID NO: 628328 - protein, 31 aa, Mycobacterium
ADVALIVGVPMDFRLGFGAVFGQQTQLVVVD

SEQ ID NO: 628329 - protein, 31 aa, Mycobacterium
ADVALIVGVPMDFRLGFGGVFGPQTQLIVVD

SEQ ID NO: 628330 - protein, 29 aa, Mycobacterium
ADVALIVGVPMDFRLGFGGVFGSQTQLVV

SEQ ID NO: 628331 - protein, 19 aa, Mycobacterium
ADVALRVLAPLGLVFDENS

SEQ ID NO: 628332 - protein, 18 aa, Mycobacterium
ADVALWLELGAPRWVTAE

SEQ ID NO: 628333 - protein, 24 aa, Mycobacterium
ADVAPERKAHLGGGESRGLGPGSV

SEQ ID NO: 628334 - protein, 18 aa, Mycobacterium
ADVAPLEMTKWFDTNYHY

SEQ ID NO: 628335 - protein, 19 aa, Mycobacterium
ADVAVPVPGCYHSEISSDG

SEQ ID NO: 628336 - protein, 27 aa, Mycobacterium
ADVAVVATGAWLPRLAGSRITVPVQAA

SEQ ID NO: 628337 - protein, 17 aa, Mycobacterium
ADVCALADALGLDKFGV

SEQ ID NO: 628338 - protein, 17 aa, Mycobacterium
ADVCAWATGLAKALTTA

SEQ ID NO: 628339 - protein, 21 aa, Mycobacterium
ADVCYLSMPLFHSNGVAAGWA

SEQ ID NO: 628340 - protein, 21 aa, Mycobacterium
ADVDAALRLMKPLRILIKPKV

SEQ ID NO: 628341 - protein, 22 aa, Mycobacterium
ADVDMRCLLIIGSSQTQWYAVD

SEQ ID NO: 628342 - protein, 20 aa, Mycobacterium
ADVDPALIYHYFGSKEGLLD

SEQ ID NO: 628343 - protein, 21 aa, Mycobacterium
ADVDPALVYHYYGSKEGLLDA

SEQ ID NO: 628344 - protein, 23 aa, Mycobacterium
ADVDPSLIYHYFGSKEGLLDAAT

SEQ ID NO: 628345 - protein, 22 aa, Mycobacterium
ADVEGIRWALTQANAAAAGPTT

SEQ ID NO: 628346 - protein, 17 aa, Mycobacterium
ADVELGRGAKIGEAQVL

SEQ ID NO: 628347 - protein, 19 aa, Mycobacterium
ADVEMHFWPLGDRIGVQFV

SEQ ID NO: 628348 - protein, 23 aa, Mycobacterium
ADVEPRQIMALGITNQRETTVVW

SEQ ID NO: 628349 - protein, 19 aa, Mycobacterium
ADVERCLAEFTGLTATAIA

SEQ ID NO: 628350 - protein, 26 aa, Mycobacterium
ADVFGLRSPWNGNWRKAVEGGIQIPV

SEQ ID NO: 628351 - protein, 18 aa, Mycobacterium
ADVFSAKVTGLVRMTDAW

SEQ ID NO: 628352 - protein, 27 aa, Mycobacterium
ADVFSSDFFAAWGKFAATRTPTIAAVA

SEQ ID NO: 628353 - protein, 18 aa, Mycobacterium
ADVGSAFGDRAKSARLRA

SEQ ID NO: 628354 - protein, 26 aa, Mycobacterium
ADVGSRIDPVLARSWLLVNGTHADRF

SEQ ID NO: 628355 - protein, 19 aa, Mycobacterium
ADVGTPVIWAARYLSMNGR

SEQ ID NO: 628356 - protein, 19 aa, Mycobacterium
ADVGYRWYAASGHVPMFAF

SEQ ID NO: 628357 - protein, 23 aa, Mycobacterium
ADVHFPRGPFGKLHVRFGKGAKG

SEQ ID NO: 628358 - protein, 27 aa, Mycobacterium
ADVISTAWTKYFVTVGLVGAQVGQAGA

SEQ ID NO: 628359 - protein, 24 aa, Mycobacterium
ADVKGRLAKYGRRHSDLLILPAAT

SEQ ID NO: 628360 - protein, 17 aa, Mycobacterium
ADVKIFLTASAEVRAQR

SEQ ID NO: 628361 - protein, 17 aa, Mycobacterium
ADVKRAYEFGALATAAQ

SEQ ID NO: 628362 - protein, 25 aa, Mycobacterium
ADVKSRGGQAWGIAAELTDRAAVAD

SEQ ID NO: 628363 - protein, 19 aa, Mycobacterium
ADVLAGLAIDLINEIEPDV

SEQ ID NO: 628364 - protein, 23 aa, Mycobacterium
ADVLELSVALALLPVLPGLAQGR

SEQ ID NO: 628365 - protein, 20 aa, Mycobacterium
ADVLGYLRWFTFLTPDELAE

SEQ ID NO: 628366 - protein, 20 aa, Mycobacterium
ADVLIAFGRYPSLEGRLPET

SEQ ID NO: 628367 - protein, 17 aa, Mycobacterium
ADVLPGAAIRRGLYYRY

SEQ ID NO: 628368 - protein, 21 aa, Mycobacterium
ADVLPGGGDWVVFGSDRVARL

SEQ ID NO: 628369 - protein, 19 aa, Mycobacterium
ADVLPGILASVGDRGVAGR

SEQ ID NO: 628370 - protein, 18 aa, Mycobacterium
ADVLPLTPLQEGLLFHAT

SEQ ID NO: 628371 - protein, 18 aa, Mycobacterium
ADVLPLTPLQQGLLFHTG

SEQ ID NO: 628372 - protein, 18 aa, Mycobacterium
ADVLRAWGKLGYPRRAKR

SEQ ID NO: 628373 - protein, 17 aa, Mycobacterium
ADVLRCIDGPLASVRDI

SEQ ID NO: 628374 - protein, 30 aa, Mycobacterium
ADVLVAFGRYPAFEGRLPALGTDFAGVVTA

SEQ ID NO: 628375 - protein, 26 aa, Mycobacterium
ADVLVRRGRCPPVGRVSDTVAIDGRT

SEQ ID NO: 628376 - protein, 19 aa, Mycobacterium
ADVLWDLASRLEGRMSAIG

SEQ ID NO: 628377 - protein, 18 aa, Mycobacterium
ADVLWDLASRLEGRMTAI

SEQ ID NO: 628378 - protein, 19 aa, Mycobacterium
ADVLWDLASRLEGRMTAIG

SEQ ID NO: 628379 - protein, 19 aa, Mycobacterium
ADVMQRLGLYPPPPGVSEI

SEQ ID NO: 628380 - protein, 20 aa, Mycobacterium
ADVMWRSSRGNPLFLRHLVE

SEQ ID NO: 628381 - protein, 23 aa, Mycobacterium
ADVPELDATFLPAEDPIADPIGV

SEQ ID NO: 628382 - protein, 21 aa, Mycobacterium
ADVPEVRFLRTYVREDMDKCL

SEQ ID NO: 628383 - protein, 27 aa, Mycobacterium
ADVPFFVELCKTLGKPVNFVPVIDKDV

SEQ ID NO: 628384 - protein, 17 aa, Mycobacterium
ADVPFFVTLCKTLGKPV

SEQ ID NO: 628385 - protein, 23 aa, Mycobacterium
ADVPGRPGLDRVLAEAGTGLTWD

SEQ ID NO: 628386 - protein, 17 aa, Mycobacterium
ADVPIIMVGPGTGIAPF

SEQ ID NO: 628387 - protein, 17 aa, Mycobacterium
ADVPPLRGIIYTDSDSS

SEQ ID NO: 628388 - protein, 17 aa, Mycobacterium
ADVPPLRGIIYTDSEHS

SEQ ID NO: 628389 - protein, 18 aa, Mycobacterium
ADVPRLGYTIQVLQEAMR

SEQ ID NO: 628390 - protein, 20 aa, Mycobacterium
ADVPTGWRVVFGAGTRAECL

SEQ ID NO: 628391 - protein, 18 aa, Mycobacterium
ADVPWPCNDTKYITHFPE

SEQ ID NO: 628392 - protein, 21 aa, Mycobacterium
ADVPYLFGTYGVRDWPWTDAD

SEQ ID NO: 628393 - protein, 19 aa, Mycobacterium
ADVRAEPSHSWRDDTDQQR

SEQ ID NO: 628394 - protein, 24 aa, Mycobacterium
ADVRARLRRSCLERGAAEAELGWI

SEQ ID NO: 628395 - protein, 20 aa, Mycobacterium
ADVRARQGVILTELHLGGGQ

SEQ ID NO: 628396 - protein, 17 aa, Mycobacterium
ADVRARVLAVGPNPDLL

SEQ ID NO: 628397 - protein, 17 aa, Mycobacterium
ADVRDGPALQQLVADGI

SEQ ID NO: 628398 - protein, 25 aa, Mycobacterium
ADVRELIKGTIGWIADADEGVQKAV

SEQ ID NO: 628399 - protein, 32 aa, Mycobacterium
ADVRIAGPHAMFDPRFQKLGIHPGGGATWMLQ

SEQ ID NO: 628400 - protein, 20 aa, Mycobacterium
ADVRLRTPVPPGRTRDIQVV

SEQ ID NO: 628401 - protein, 34 aa, Mycobacterium
ADVRMGMRVEAVWKPKEEWGYGIDNIQYFRPTGE

SEQ ID NO: 628402 - protein, 23 aa, Mycobacterium
ADVRPEVVSFTFGAPPPDVIRRL

SEQ ID NO: 628403 - protein, 18 aa, Mycobacterium
ADVRRLATGLVRAGIGVG

SEQ ID NO: 628404 - protein, 23 aa, Mycobacterium
ADVRYRPGDVLLFGPEPTGLDAA

SEQ ID NO: 628405 - protein, 23 aa, Mycobacterium
ADVSCLKALLEIRDEIVAAGHTP

SEQ ID NO: 628406 - protein, 20 aa, Mycobacterium
ADVSEDWFGKAASLVINNAG

SEQ ID NO: 628407 - protein, 21 aa, Mycobacterium
ADVSGVRWVGYGGAPIAPSLV

SEQ ID NO: 628408 - protein, 18 aa, Mycobacterium
ADVSIIFVPPKFAKDAII

SEQ ID NO: 628409 - protein, 23 aa, Mycobacterium
ADVSLPVVRAFISRIKDRAKGVE

SEQ ID NO: 628410 - protein, 22 aa, Mycobacterium
ADVSLPVVRAFVARIKERAKGA

SEQ ID NO: 628411 - protein, 23 aa, Mycobacterium
ADVSLPVVRAFVHRIKERARGAE

SEQ ID NO: 628412 - protein, 23 aa, Mycobacterium
ADVSLPVVRAFVHRIKERARGAV

SEQ ID NO: 628413 - protein, 31 aa, Mycobacterium
ADVSQRLGVPGIWYAGSHGFELTAPDGTHHQ

SEQ ID NO: 628414 - protein, 19 aa, Mycobacterium
ADVSRQVFYRHFRDRDHAV

SEQ ID NO: 628415 - protein, 29 aa, Mycobacterium
ADVSWDGVWWWTRSDGFLQLAPASRFTKQ

SEQ ID NO: 628416 - protein, 22 aa, Mycobacterium
ADVTARILAAVKRHEGVREFLL

SEQ ID NO: 628417 - protein, 23 aa, Mycobacterium
ADVTAWPGDSAWVTLRSQRLSAF

SEQ ID NO: 628418 - protein, 23 aa, Mycobacterium
ADVTPLEMTKWFDTNYHYLVPEI

SEQ ID NO: 628419 - protein, 24 aa, Mycobacterium
ADVTRAVGITGVLKVAALCDARGI

SEQ ID NO: 628420 - protein, 31 aa, Mycobacterium
ADVTTRLGVPGIWYAGSHGFELTAPDGTHHQ

SEQ ID NO: 628421 - protein, 25 aa, Mycobacterium
ADVVASLLRPGGRLFMREGHPFLWS

SEQ ID NO: 628422 - protein, 23 aa, Mycobacterium
ADVVERCRPVFATYADPIVHLGE

SEQ ID NO: 628423 - protein, 26 aa, Mycobacterium
ADVVFASHHWPTWGAENIVEFLSLQR

SEQ ID NO: 628424 - protein, 23 aa, Mycobacterium
ADVVGCGALHVMWSDLGEIRTVA

SEQ ID NO: 628425 - protein, 17 aa, Mycobacterium
ADVVLPWDGRDHYLAGI

SEQ ID NO: 628426 - protein, 20 aa, Mycobacterium
ADVVLWRCEPAGGRVLDQAY

SEQ ID NO: 628427 - protein, 19 aa, Mycobacterium
ADVVMPIVPMFHVNAWGLP

SEQ ID NO: 628428 - protein, 21 aa, Mycobacterium
ADVVNKVWFLDAVRGEVDVYN

SEQ ID NO: 628429 - protein, 20 aa, Mycobacterium
ADVVNRVWFLDAVRGEMDVY

SEQ ID NO: 628430 - protein, 23 aa, Mycobacterium
ADVYLCGPAAMVEATRTWLSANG

SEQ ID NO: 628431 - protein, 26 aa, Mycobacterium
ADWAEMLMRMYIRWAEQHKYPVELFD

SEQ ID NO: 628432 - protein, 26 aa, Mycobacterium
ADWAEMLMRMYIRWAEQHKYPVEVFD

SEQ ID NO: 628433 - protein, 26 aa, Mycobacterium
ADWAEMLMRMYLRWAEQHKYPVEVFD

SEQ ID NO: 628434 - protein, 17 aa, Mycobacterium
ADWAPFDMATVFNDQSE

SEQ ID NO: 628435 - protein, 19 aa, Mycobacterium
ADWASRVRLAHALGPTMIA

SEQ ID NO: 628436 - protein, 17 aa, Mycobacterium
ADWEQIAALKAHVTGIP

SEQ ID NO: 628437 - protein, 19 aa, Mycobacterium
ADWFRPKAMRALKERVDEL

SEQ ID NO: 628438 - protein, 21 aa, Mycobacterium
ADWFRPKAMRALKVRVDELAK

SEQ ID NO: 628439 - protein, 22 aa, Mycobacterium
ADWFRPKAMRDLKVRVDELAKR

SEQ ID NO: 628440 - protein, 22 aa, Mycobacterium
ADWFRPKAMRELKVRVDELARI

SEQ ID NO: 628441 - protein, 19 aa, Mycobacterium
ADWICFLLSDSADFLCGSV

SEQ ID NO: 628442 - protein, 25 aa, Mycobacterium
ADWIRVVCFPERWLDLRYVGPAREP

SEQ ID NO: 628443 - protein, 22 aa, Mycobacterium
ADWLGHGWLALVRKWIDDAEHA

SEQ ID NO: 628444 - protein, 33 aa, Mycobacterium
ADWMRRPHLLRAWDAAWPASRWYRYLQAQLEGD

SEQ ID NO: 628445 - protein, 19 aa, Mycobacterium
ADWNGRWLVVDSDVDPDRL

SEQ ID NO: 628446 - protein, 19 aa, Mycobacterium
ADWQLELYQLVSRAQQAGR

SEQ ID NO: 628447 - protein, 26 aa, Mycobacterium
ADWREILDRIPPWIVSHPYNDLLGDG

SEQ ID NO: 628448 - protein, 18 aa, Mycobacterium
ADWRLFSTIRLRALADSL

SEQ ID NO: 628449 - protein, 24 aa, Mycobacterium
ADWTEEIFKALNFQPDVTFDESAI

SEQ ID NO: 628450 - protein, 19 aa, Mycobacterium
ADYAHMRKVVGYAKRHLAQ

SEQ ID NO: 628451 - protein, 19 aa, Mycobacterium
ADYARMWIQAATTMSAYQV

SEQ ID NO: 628452 - protein, 22 aa, Mycobacterium
ADYAVLDGIFAIYATFSAIDSV

SEQ ID NO: 628453 - protein, 17 aa, Mycobacterium
ADYDAGLHWFRAALATR

SEQ ID NO: 628454 - protein, 23 aa, Mycobacterium
ADYDRPRMAEAMLHSDYPLQALL

SEQ ID NO: 628455 - protein, 23 aa, Mycobacterium
ADYFCAGPCWPTPTKPGRPAPGL

SEQ ID NO: 628456 - protein, 18 aa, Mycobacterium
ADYFSRYDALLAPVLPVP

SEQ ID NO: 628457 - protein, 19 aa, Mycobacterium
ADYGLCLARTDWNVPKHEG

SEQ ID NO: 628458 - protein, 18 aa, Mycobacterium
ADYGLRPRDVTTWVCHPG

SEQ ID NO: 628459 - protein, 17 aa, Mycobacterium
ADYKCPRHMVVVDELPK

SEQ ID NO: 628460 - protein, 18 aa, Mycobacterium
ADYKTLFREYGFTAEAVA

SEQ ID NO: 628461 - protein, 24 aa, Mycobacterium
ADYLDMPPLRVDPATVLTDNPQGI

SEQ ID NO: 628462 - protein, 19 aa, Mycobacterium
ADYLGGPWKALAVARLVPT

SEQ ID NO: 628463 - protein, 17 aa, Mycobacterium
ADYLPRYLRGISDDADA

SEQ ID NO: 628464 - protein, 26 aa, Mycobacterium
ADYLRRMGELFAPFTKIAAGNPFAAA

SEQ ID NO: 628465 - protein, 20 aa, Mycobacterium
ADYMMSFQALLGFRSLFSGD

SEQ ID NO: 628466 - protein, 21 aa, Mycobacterium
ADYNRKVRAPDGFQLPHPPRD

SEQ ID NO: 628467 - protein, 24 aa, Mycobacterium
ADYPEIDLAGLRFRQCQMSDNDAI

SEQ ID NO: 628468 - protein, 17 aa, Mycobacterium
ADYPGLRVRVAVSIGPW

SEQ ID NO: 628469 - protein, 23 aa, Mycobacterium
ADYPPPSSYRVGYPDEPRFPPRE

SEQ ID NO: 628470 - protein, 17 aa, Mycobacterium
ADYPSILAMTSLHDSRV

SEQ ID NO: 628471 - protein, 24 aa, Mycobacterium
ADYRALPDFWVWYVPPNENAAGWG

SEQ ID NO: 628472 - protein, 18 aa, Mycobacterium
ADYRGASHQFSWPPELTT

SEQ ID NO: 628473 - protein, 18 aa, Mycobacterium
ADYRGWIDGIASDVGASR

SEQ ID NO: 628474 - protein, 20 aa, Mycobacterium
ADYRHASAITHDYDGPVLSE

SEQ ID NO: 628475 - protein, 19 aa, Mycobacterium
ADYRLKIASVDGRDVTSSI

SEQ ID NO: 628476 - protein, 19 aa, Mycobacterium
ADYRNASSITHDYDGPVLS

SEQ ID NO: 628477 - protein, 25 aa, Mycobacterium
ADYRREMGELFAPFTKVAAKNPFAS

SEQ ID NO: 628478 - protein, 25 aa, Mycobacterium
ADYVDRLWSIVNWADVAVRFEAARR

SEQ ID NO: 628479 - protein, 24 aa, Mycobacterium
ADYVKAFWNVVNWADVQDRYTAAT

SEQ ID NO: 628480 - protein, 20 aa, Mycobacterium
ADYVKAFWNVVNWDDVQNRF

SEQ ID NO: 628481 - protein, 21 aa, Mycobacterium
ADYYLARGVTWVQDAWVEPAD

SEQ ID NO: 628482 - protein, 18 aa, Mycobacterium
ADYYLRPVPNTAAHTSYE

SEQ ID NO: 628483 - protein, 38 aa, Mycobacterium
AEAAASLAIRAGDPAGIGFYIDHHRVHVGADATAADMA

SEQ ID NO: 628484 - protein, 17 aa, Mycobacterium
AEAAAVFEDALSGVAAG

SEQ ID NO: 628485 - protein, 19 aa, Mycobacterium
AEAADAFEAARIIARASGV

SEQ ID NO: 628486 - protein, 17 aa, Mycobacterium
AEAADLEVGLLIYNAGA

SEQ ID NO: 628487 - protein, 17 aa, Mycobacterium
AEAAEWMVLAARTRVVR

SEQ ID NO: 628488 - protein, 24 aa, Mycobacterium
AEAAEWVARVVISFATVPGEQLDA

SEQ ID NO: 628489 - protein, 19 aa, Mycobacterium
AEAAFGPIDVWVNVAFTSV

SEQ ID NO: 628490 - protein, 18 aa, Mycobacterium
AEAAFGYGDLPVACSSLG

SEQ ID NO: 628491 - protein, 19 aa, Mycobacterium
AEAALEFGESFDGVRPPAV

SEQ ID NO: 628492 - protein, 20 aa, Mycobacterium
AEAALRPGVLAAETDWSVWP

SEQ ID NO: 628493 - protein, 19 aa, Mycobacterium
AEAALTRMRALLGDDDPLA

SEQ ID NO: 628494 - protein, 21 aa, Mycobacterium
AEAALYFATDRSRYVTGAVLP

SEQ ID NO: 628495 - protein, 24 aa, Mycobacterium
AEAANAAPFQGLLGAVNAPVQTLT

SEQ ID NO: 628496 - protein, 20 aa, Mycobacterium
AEAANASFLQDPLQTALNAI

SEQ ID NO: 628497 - protein, 26 aa, Mycobacterium
AEAAPGDGADECWILVPITAAADGEA

SEQ ID NO: 628498 - protein, 26 aa, Mycobacterium
AEAAPLVVARARPFYRLFPYDEGALL

SEQ ID NO: 628499 - protein, 18 aa, Mycobacterium
AEAAPWLRDGDVLVVTSK

SEQ ID NO: 628500 - protein, 26 aa, Mycobacterium
AEAAQFVRRRRVEVFGDGSAGAAPDT

SEQ ID NO: 628501 - protein, 21 aa, Mycobacterium
AEAAQPLYARYWLHNRGPAPL

SEQ ID NO: 628502 - protein, 18 aa, Mycobacterium
AEAARRAAANSMNTTSSK

SEQ ID NO: 628503 - protein, 24 aa, Mycobacterium
AEAATRLRRTQAWVSQRRALLGLA

SEQ ID NO: 628504 - protein, 21 aa, Mycobacterium
AEAAVRELLCAIGEDPDRGGL

SEQ ID NO: 628505 - protein, 20 aa, Mycobacterium
AEAAYHKGLSWAEAADTIDL

SEQ ID NO: 628506 - protein, 23 aa, Mycobacterium
AEAAYRKGLSFVEAVDIIDLGEY

SEQ ID NO: 628507 - protein, 21 aa, Mycobacterium
AEADARLMAHAAFGLLNSTPH

SEQ ID NO: 628508 - protein, 21 aa, Mycobacterium
AEADARLMAHAVFGLLNSTPH

SEQ ID NO: 628509 - protein, 24 aa, Mycobacterium
AEADFYICGPAPFMDTVERVLLDA

SEQ ID NO: 628510 - protein, 22 aa, Mycobacterium
AEADGFAALWYASAVAGDPLVA

SEQ ID NO: 628511 - protein, 21 aa, Mycobacterium
AEADLLYADFVARVADGRNLT

SEQ ID NO: 628512 - protein, 21 aa, Mycobacterium
AEADPPIDLADSFQRPDEYFA

SEQ ID NO: 628513 - protein, 24 aa, Mycobacterium
AEADRAAAELVRYAVRRGPSAAWI

SEQ ID NO: 628514 - protein, 18 aa, Mycobacterium
AEADRPGFRRGKVLDKIG

SEQ ID NO: 628515 - protein, 20 aa, Mycobacterium
AEADSGAALRDVDDRTYVAV

SEQ ID NO: 628516 - protein, 19 aa, Mycobacterium
AEADVRWRMSAGMPATIYR

SEQ ID NO: 628517 - protein, 19 aa, Mycobacterium
AEAEAHWRRHMENASAELL

SEQ ID NO: 628518 - protein, 24 aa, Mycobacterium
AEAEARGAVHGEILLVPQANPIGL

SEQ ID NO: 628519 - protein, 24 aa, Mycobacterium
AEAEDFYLRYNCDTYVMGIAGVDG

SEQ ID NO: 628520 - protein, 19 aa, Mycobacterium
AEAEFGRVQRRARAAQLLR

SEQ ID NO: 628521 - protein, 23 aa, Mycobacterium
AEAEGVLFLAEYVPVTRRFSGAI

SEQ ID NO: 628522 - protein, 18 aa, Mycobacterium
AEAEILRARAAEIASASE

SEQ ID NO: 628523 - protein, 17 aa, Mycobacterium
AEAEILRARSAEIAAAS

SEQ ID NO: 628524 - protein, 23 aa, Mycobacterium
AEAELLTAFSAMCAAEAPDTRGI

SEQ ID NO: 628525 - protein, 25 aa, Mycobacterium
AEAELRRGRRYEVARRLAGLFASYA

SEQ ID NO: 628526 - protein, 22 aa, Mycobacterium
AEAEPWLSAATFTLAEGPCADR

SEQ ID NO: 628527 - protein, 19 aa, Mycobacterium
AEAEWARQNGYTMTLVVDH

SEQ ID NO: 628528 - protein, 26 aa, Mycobacterium
AEAFDAAALMARFTGVRTCTNRLGRK

SEQ ID NO: 628529 - protein, 20 aa, Mycobacterium
AEAFGAALADVMARHESLRT

SEQ ID NO: 628530 - protein, 28 aa, Mycobacterium
AEAFLAGRIRFPAIVRTVAEVLRAADQW

SEQ ID NO: 628531 - protein, 25 aa, Mycobacterium
AEAFLTTRLDRRWGGAFGTMPDGLD

SEQ ID NO: 628532 - protein, 17 aa, Mycobacterium
AEAFMAAAQRLATATSI

SEQ ID NO: 628533 - protein, 18 aa, Mycobacterium
AEAFRYPHDHGWESVTWE

SEQ ID NO: 628534 - protein, 26 aa, Mycobacterium
AEAFRYPLDHTWASVTWQQVGERVSN

SEQ ID NO: 628535 - protein, 20 aa, Mycobacterium
AEAFSGVLRERGVEPYAAEL

SEQ ID NO: 628536 - protein, 19 aa, Mycobacterium
AEAGELVAMLAGAPEDCTH

SEQ ID NO: 628537 - protein, 22 aa, Mycobacterium
AEAGEWMSCWTMGLNQSTHGTW

SEQ ID NO: 628538 - protein, 19 aa, Mycobacterium
AEAGGDPWAINASLQAGSP

SEQ ID NO: 628539 - protein, 20 aa, Mycobacterium
AEAGGLGAFMNWPGPTFTDS

SEQ ID NO: 628540 - protein, 19 aa, Mycobacterium
AEAGIPVTVVPGVTSAIAV

SEQ ID NO: 628541 - protein, 21 aa, Mycobacterium
AEAGISLLYAFDADCRAAGVD

SEQ ID NO: 628542 - protein, 17 aa, Mycobacterium
AEAGITPHVVFEATEIP

SEQ ID NO: 628543 - protein, 18 aa, Mycobacterium
AEAGLKMLDDMFPLMKTL

SEQ ID NO: 628544 - protein, 18 aa, Mycobacterium
AEAGLLLRYDDGRTATLL

SEQ ID NO: 628545 - protein, 17 aa, Mycobacterium
AEAGRRGAITVATNMAG

SEQ ID NO: 628546 - protein, 18 aa, Mycobacterium
AEAGRRGAITVATNMAGR

SEQ ID NO: 628547 - protein, 21 aa, Mycobacterium
AEAGVDCFVAGSAVYSAEDPA

SEQ ID NO: 628548 - protein, 33 aa, Mycobacterium
AEAHGRTAAQVLLRWSIQLGNVVISRSANPERI

SEQ ID NO: 628549 - protein, 18 aa, Mycobacterium
AEAHLAKLATQFRPDQLA

SEQ ID NO: 628550 - protein, 19 aa, Mycobacterium
AEAHLARLAGQFRPDQLAK

SEQ ID NO: 628551 - protein, 19 aa, Mycobacterium
AEAHLARLATQYRPDQLAK

SEQ ID NO: 628552 - protein, 20 aa, Mycobacterium
AEAHLARLATRFRPDQLAKL

SEQ ID NO: 628553 - protein, 33 aa, Mycobacterium
AEAHLISPWGTWEWMWPAAAGVDLPAGGSAEVV

SEQ ID NO: 628554 - protein, 19 aa, Mycobacterium
AEAIAIVGMAVRAPGAPDL

SEQ ID NO: 628555 - protein, 25 aa, Mycobacterium
AEAIGYTGAGTVEFLADDAGEFYFL

SEQ ID NO: 628556 - protein, 17 aa, Mycobacterium
AEAILAQIQRLLGSPWT

SEQ ID NO: 628557 - protein, 19 aa, Mycobacterium
AEAIMRLTAERMRGDQLQT

SEQ ID NO: 628558 - protein, 25 aa, Mycobacterium
AEAIRAAQVAKLYCARAARTVCETA

SEQ ID NO: 628559 - protein, 22 aa, Mycobacterium
AEAIRALSLRAFTAIDCQGLAR

SEQ ID NO: 628560 - protein, 25 aa, Mycobacterium
AEAIVKLVAHPRPRVRVTKTAGAII

SEQ ID NO: 628561 - protein, 19 aa, Mycobacterium
AEAIWEMPPYAGWYQGARD

SEQ ID NO: 628562 - protein, 17 aa, Mycobacterium
AEAIYLTSGYVYESAAE

SEQ ID NO: 628563 - protein, 24 aa, Mycobacterium
AEAKAHRGPLCLGIDPHPELLRAW

SEQ ID NO: 628564 - protein, 24 aa, Mycobacterium
AEAKAQRGPLCVGIDPHPELLRAW

SEQ ID NO: 628565 - protein, 23 aa, Mycobacterium
AEAKAYLAHPVLGPRLRECAELL

SEQ ID NO: 628566 - protein, 23 aa, Mycobacterium
AEAKGAIRQIDFLTRATAHSPDA

SEQ ID NO: 628567 - protein, 24 aa, Mycobacterium
AEAKGAIRQIEFLTRATAQRPDAV

SEQ ID NO: 628568 - protein, 25 aa, Mycobacterium
AEAKIKLADMRSGRMSDDDWTRLAR

SEQ ID NO: 628569 - protein, 21 aa, Mycobacterium
AEAKIKLADMRSGRMSDEDWT

SEQ ID NO: 628570 - protein, 25 aa, Mycobacterium
AEAKIKLADMRSGRMTDDDWTRLAR

SEQ ID NO: 628571 - protein, 23 aa, Mycobacterium
AEAKLRNAPMLVLGGRPEELTEH

SEQ ID NO: 628572 - protein, 38 aa, Mycobacterium
AEAKQALTESVLWPLQHPDTFARLGVDPPRGVLLYGPP

SEQ ID NO: 628573 - protein, 19 aa, Mycobacterium
AEAKRALLVEAEKIDPEAD

SEQ ID NO: 628574 - protein, 28 aa, Mycobacterium
AEAKRARARLAIGSALFGLLRADDQVPA

SEQ ID NO: 628575 - protein, 22 aa, Mycobacterium
AEAKRCGATVCEIRQEVHDEYF

SEQ ID NO: 628576 - protein, 20 aa, Mycobacterium
AEALADFDAVCTMRERMAFP

SEQ ID NO: 628577 - protein, 25 aa, Mycobacterium
AEALADMPHELLVCYDFDEDTTLPA

SEQ ID NO: 628578 - protein, 26 aa, Mycobacterium
AEALAEFAALRWQWHDLEVGRTAIVP

SEQ ID NO: 628579 - protein, 18 aa, Mycobacterium
AEALAEWARTLSGGELAT

SEQ ID NO: 628580 - protein, 20 aa, Mycobacterium
AEALAGSGLDIWIVERRGAG

SEQ ID NO: 628581 - protein, 18 aa, Mycobacterium
AEALALAANVLADRGLAI

SEQ ID NO: 628582 - protein, 19 aa, Mycobacterium
AEALALVGKRGRVVVTAIG

SEQ ID NO: 628583 - protein, 19 aa, Mycobacterium
AEALAPVLADGWHLASAEP

SEQ ID NO: 628584 - protein, 24 aa, Mycobacterium
AEALAQRDIVLWAAHVVDRIAVGG

SEQ ID NO: 628585 - protein, 26 aa, Mycobacterium
AEALARAGARVVLACRNQQTGRAALD

SEQ ID NO: 628586 - protein, 17 aa, Mycobacterium
AEALATVVLRGLDCGAF

SEQ ID NO: 628587 - protein, 17 aa, Mycobacterium
AEALECLGGNGYVEDSG

SEQ ID NO: 628588 - protein, 18 aa, Mycobacterium
AEALECLGGNGYVEDSGM

SEQ ID NO: 628589 - protein, 21 aa, Mycobacterium
AEALEQLGIAAFELVVVNLYP

SEQ ID NO: 628590 - protein, 18 aa, Mycobacterium
AEALGAMKPGSYLINTAR

SEQ ID NO: 628591 - protein, 21 aa, Mycobacterium
AEALGEHVFDYFLRNKRSEWE

SEQ ID NO: 628592 - protein, 21 aa, Mycobacterium
AEALGLREGDPVYVRVTRVPD

SEQ ID NO: 628593 - protein, 30 aa, Mycobacterium
AEALGPGRIHDWFDFSARYWGVLFRVYSRL

SEQ ID NO: 628594 - protein, 25 aa, Mycobacterium
AEALHALGPRWALVKGGHLRSSDRS

SEQ ID NO: 628595 - protein, 17 aa, Mycobacterium
AEALIEFVTPVRDRTNE

SEQ ID NO: 628596 - protein, 26 aa, Mycobacterium
AEALKPYYRFLCKRPCSNDEYLSTFN

SEQ ID NO: 628597 - protein, 25 aa, Mycobacterium
AEALKPYYRFLCKRPCTNDEYLPTF

SEQ ID NO: 628598 - protein, 25 aa, Mycobacterium
AEALKPYYRFMCKRPCSSEQYLDTF

SEQ ID NO: 628599 - protein, 18 aa, Mycobacterium
AEALLALHRPGDPGVLPT

SEQ ID NO: 628600 - protein, 27 aa, Mycobacterium
AEALLLLLCGVGFYAGFVGSYRDMENI

SEQ ID NO: 628601 - protein, 26 aa, Mycobacterium
AEALLLVLCGVGFYAGFVGSYREMAD

SEQ ID NO: 628602 - protein, 17 aa, Mycobacterium
AEALLRERSLLYVASSR

SEQ ID NO: 628603 - protein, 18 aa, Mycobacterium
AEALPAVLDQASAEGLSL

SEQ ID NO: 628604 - protein, 23 aa, Mycobacterium
AEALPRERLVALYSQEQRSLADI

SEQ ID NO: 628605 - protein, 20 aa, Mycobacterium
AEALQLPLWGGLGEEDRLRA

SEQ ID NO: 628606 - protein, 22 aa, Mycobacterium
AEALRAGAVVIDFPGGDYDAYR

SEQ ID NO: 628607 - protein, 20 aa, Mycobacterium
AEALRAGGFAHHAKVEIRWI

SEQ ID NO: 628608 - protein, 26 aa, Mycobacterium
AEALREMFPGTLIMYGAHERHLLEQA

SEQ ID NO: 628609 - protein, 19 aa, Mycobacterium
AEALWKDHEDPLAANIALG

SEQ ID NO: 628610 - protein, 23 aa, Mycobacterium
AEALWRITPQALMRQALARNDPN

SEQ ID NO: 628611 - protein, 17 aa, Mycobacterium
AEALYLTSGYVYESAAM

SEQ ID NO: 628612 - protein, 17 aa, Mycobacterium
AEALYLTSGYVYETAAV

SEQ ID NO: 628613 - protein, 24 aa, Mycobacterium
AEAMAAGALQRFGADTAVAITGIA

SEQ ID NO: 628614 - protein, 25 aa, Mycobacterium
AEAMAAGALQRFGADTAVAITGIAG

SEQ ID NO: 628615 - protein, 21 aa, Mycobacterium
AEAMAGIGGVPARVLADRMAC

SEQ ID NO: 628616 - protein, 24 aa, Mycobacterium
AEAMARLGVDVTVWSLARSGDRGF

SEQ ID NO: 628617 - protein, 20 aa, Mycobacterium
AEAMDFPLFVKAVSGGGGRG

SEQ ID NO: 628618 - protein, 17 aa, Mycobacterium
AEAMECFGGNGYVEDSG

SEQ ID NO: 628619 - protein, 21 aa, Mycobacterium
AEAMGAVAHRFVAAISGTPGA

SEQ ID NO: 628620 - protein, 20 aa, Mycobacterium
AEAMGAVYHRFVAAISGTPG

SEQ ID NO: 628621 - protein, 18 aa, Mycobacterium
AEAMLPNAIGLRAPLACL

SEQ ID NO: 628622 - protein, 28 aa, Mycobacterium
AEAMLRRNCLTLMRLCHHYAGPMVSRGR

SEQ ID NO: 628623 - protein, 18 aa, Mycobacterium
AEAMPCRQVPAPVRALSR

SEQ ID NO: 628624 - protein, 18 aa, Mycobacterium
AEAMSSPDARREAAVSGM

SEQ ID NO: 628625 - protein, 22 aa, Mycobacterium
AEAMWPPRGIPRSVLVEQDALD

SEQ ID NO: 628626 - protein, 17 aa, Mycobacterium
AEAMYLTSGYVYETAAA

SEQ ID NO: 628627 - protein, 18 aa, Mycobacterium
AEAMYLTSGYVYPSAAVA

SEQ ID NO: 628628 - protein, 19 aa, Mycobacterium
AEANCLVIVPSEAEQIRTG

SEQ ID NO: 628629 - protein, 22 aa, Mycobacterium
AEANRFGARYSLEIASVDGRDV

SEQ ID NO: 628630 - protein, 18 aa, Mycobacterium
AEAPEIMEFAEARLTDSV

SEQ ID NO: 628631 - protein, 24 aa, Mycobacterium
AEAPGMLTAMAWVALGGDLEQLPE

SEQ ID NO: 628632 - protein, 19 aa, Mycobacterium
AEAPLIFPVVPDGHNEHIR

SEQ ID NO: 628633 - protein, 21 aa, Mycobacterium
AEAPLPVMVFIHGGGYILGSS

SEQ ID NO: 628634 - protein, 19 aa, Mycobacterium
AEAPNLRFAGLGGATETPV

SEQ ID NO: 628635 - protein, 21 aa, Mycobacterium
AEAPPWIGALDVVVLAGDDPA

SEQ ID NO: 628636 - protein, 17 aa, Mycobacterium
AEAPRVVDRDVLNFVRS

SEQ ID NO: 628637 - protein, 23 aa, Mycobacterium
AEAPTTLTAMAWLSLGPDIEQVP

SEQ ID NO: 628638 - protein, 22 aa, Mycobacterium
AEAPVMAGLRHRTLQVGFPATT

SEQ ID NO: 628639 - protein, 22 aa, Mycobacterium
AEAQAAGVLPTWADCQAFVETL

SEQ ID NO: 628640 - protein, 20 aa, Mycobacterium
AEAQAGWIPYYLQRVDEVWE

SEQ ID NO: 628641 - protein, 25 aa, Mycobacterium
AEAQLELKWRALKEELESRGAAAAV

SEQ ID NO: 628642 - protein, 19 aa, Mycobacterium
AEAQLGYALTGSHIGAVVW

SEQ ID NO: 628643 - protein, 23 aa, Mycobacterium
AEAQLWFDRGLVWAYAFNHEEAI

SEQ ID NO: 628644 - protein, 28 aa, Mycobacterium
AEAQPAWAYSVIALRWAAKYYAAEREFA

SEQ ID NO: 628645 - protein, 26 aa, Mycobacterium
AEAQRRLSTWWADMGAECGRLAQEAT

SEQ ID NO: 628646 - protein, 20 aa, Mycobacterium
AEAQVAAAVRLLDEGATVPF

SEQ ID NO: 628647 - protein, 20 aa, Mycobacterium
AEAQVPCELHVWHGQVHDFP

SEQ ID NO: 628648 - protein, 21 aa, Mycobacterium
AEARAALTDAVIRRGDTPMPV

SEQ ID NO: 628649 - protein, 22 aa, Mycobacterium
AEARAAVAAARRAFDTTAWPTD

SEQ ID NO: 628650 - protein, 19 aa, Mycobacterium
AEARAHFGFADDARVLLVF

SEQ ID NO: 628651 - protein, 24 aa, Mycobacterium
AEARAYKPRIVFVDARNKQIDLGS

SEQ ID NO: 628652 - protein, 24 aa, Mycobacterium
AEARGAIHAPTWRERFRYRPTQWA

SEQ ID NO: 628653 - protein, 30 aa, Mycobacterium
AEARKAGRRFARLAPIVATYRKLESARGDL

SEQ ID NO: 628654 - protein, 17 aa, Mycobacterium
AEARLAAVHTVHESRAV

SEQ ID NO: 628655 - protein, 17 aa, Mycobacterium
AEARLFAQHGAHVYICD

SEQ ID NO: 628656 - protein, 19 aa, Mycobacterium
AEARLHPKDFGPIETVFTD

SEQ ID NO: 628657 - protein, 19 aa, Mycobacterium
AEARLKTDIIGADALLAGP

SEQ ID NO: 628658 - protein, 20 aa, Mycobacterium
AEARPFALLERFELNAWAEA

SEQ ID NO: 628659 - protein, 38 aa, Mycobacterium
AEARQALTEAVLWPLQHPDTFARLGVDPPRGVLLYGPP

SEQ ID NO: 628660 - protein, 38 aa, Mycobacterium
AEARQALTEAVLWPLQHPDTFARLGVEPPRGVLLYGPP

SEQ ID NO: 628661 - protein, 22 aa, Mycobacterium
AEARQLAPTMAWPVVADAYAQL

SEQ ID NO: 628662 - protein, 18 aa, Mycobacterium
AEARRKEALTDWGPGEFE

SEQ ID NO: 628663 - protein, 17 aa, Mycobacterium
AEARSAEQLGRYGQPPH

SEQ ID NO: 628664 - protein, 26 aa, Mycobacterium
AEARSRLNPAAGVLVSAAWAQSTGQL

SEQ ID NO: 628665 - protein, 26 aa, Mycobacterium
AEARYELQLGPLLPRATRVVRETLIA

SEQ ID NO: 628666 - protein, 22 aa, Mycobacterium
AEASAALGRLCGRAARVESFEG

SEQ ID NO: 628667 - protein, 31 aa, Mycobacterium
AEASAALIWRRPRWAKRLQPGPIGDLLAEGH

SEQ ID NO: 628668 - protein, 23 aa, Mycobacterium
AEASEALASFDAVLLGGGPLPAT

SEQ ID NO: 628669 - protein, 20 aa, Mycobacterium
AEASRGNWAPVIDAVHGPAL

SEQ ID NO: 628670 - protein, 18 aa, Mycobacterium
AEASRVLLRDSILDGMRD

SEQ ID NO: 628671 - protein, 18 aa, Mycobacterium
AEASRVLLRDSILDGMRE

SEQ ID NO: 628672 - protein, 22 aa, Mycobacterium
AEASSAGLLAAVNEPIAALTGR

SEQ ID NO: 628673 - protein, 20 aa, Mycobacterium
AEASVPVGFHLSDSGYLHIA

SEQ ID NO: 628674 - protein, 17 aa, Mycobacterium
AEATGLVSVTVAGQPRK

SEQ ID NO: 628675 - protein, 25 aa, Mycobacterium
AEATGSFNRAWAFDQYSDAEVNQAI

SEQ ID NO: 628676 - protein, 20 aa, Mycobacterium
AEATHRARIGSLSPPGGLEL

SEQ ID NO: 628677 - protein, 25 aa, Mycobacterium
AEATLAVSFVRRGEGYRVCPPHPDL

SEQ ID NO: 628678 - protein, 18 aa, Mycobacterium
AEATLAVVQHVLRALEPA

SEQ ID NO: 628679 - protein, 22 aa, Mycobacterium
AEATRVLGQWLTEVIRLNPDNF

SEQ ID NO: 628680 - protein, 23 aa, Mycobacterium
AEAVGADTAWFSTCGSSLSVKAA

SEQ ID NO: 628681 - protein, 23 aa, Mycobacterium
AEAVGADTAWFSTCGSSLSVRAA

SEQ ID NO: 628682 - protein, 18 aa, Mycobacterium
AEAVGVFRAYGFDAALAG

SEQ ID NO: 628683 - protein, 20 aa, Mycobacterium
AEAVPGFADMPLRDKYDAIV

SEQ ID NO: 628684 - protein, 20 aa, Mycobacterium
AEAVQHTWFGLSALAERVGA

SEQ ID NO: 628685 - protein, 24 aa, Mycobacterium
AEAVRRLRDAGAIILGKATTHEYA

SEQ ID NO: 628686 - protein, 23 aa, Mycobacterium
AEAVSRWLVTLGHQVAAPLRFQR

SEQ ID NO: 628687 - protein, 19 aa, Mycobacterium
AEAVYWCLENYEADEEATC

SEQ ID NO: 628688 - protein, 23 aa, Mycobacterium
AEAWRHIPSWEFHRANVDPGRAR

SEQ ID NO: 628689 - protein, 23 aa, Mycobacterium
AEAYAELVAEGWLESRQGSGTRV

SEQ ID NO: 628690 - protein, 23 aa, Mycobacterium
AEAYPFDHLPPLLTDADIVVSCT

SEQ ID NO: 628691 - protein, 20 aa, Mycobacterium
AEAYQGWGMTETSPLCVVGR

SEQ ID NO: 628692 - protein, 19 aa, Mycobacterium
AEAYRDAYLRQGVQDGEAF

SEQ ID NO: 628693 - protein, 20 aa, Mycobacterium
AECAEAAIVRLERVNPTLNA

SEQ ID NO: 628694 - protein, 24 aa, Mycobacterium
AECAPKRWCSAGFRDRRPAVVARL

SEQ ID NO: 628695 - protein, 17 aa, Mycobacterium
AECCRGCQLFADATQTV

SEQ ID NO: 628696 - protein, 21 aa, Mycobacterium
AECERTWMSAHNCYGPTEATV

SEQ ID NO: 628697 - protein, 21 aa, Mycobacterium
AECEVPYELVQPVGVDPADEL

SEQ ID NO: 628698 - protein, 18 aa, Mycobacterium
AECGRLAQEATTFVDAHD

SEQ ID NO: 628699 - protein, 22 aa, Mycobacterium
AECGVGRLGFESHVVTVDGLDA

SEQ ID NO: 628700 - protein, 26 aa, Mycobacterium
AECRRLRPDFAVGLQPARWGTGYILG

SEQ ID NO: 628701 - protein, 23 aa, Mycobacterium
AECVRRLRTAGAVIVGRNVLHEF

SEQ ID NO: 628702 - protein, 17 aa, Mycobacterium
AEDAARAGLKTRVLVDL

SEQ ID NO: 628703 - protein, 19 aa, Mycobacterium
AEDALGREGYRMHGDADAY

SEQ ID NO: 628704 - protein, 28 aa, Mycobacterium
AEDARCAARAFGFSATWLQVELGLITPE

SEQ ID NO: 628705 - protein, 25 aa, Mycobacterium
AEDARRLREFSAFDAFSDAELERVV

SEQ ID NO: 628706 - protein, 17 aa, Mycobacterium
AEDARVLYHAALAHAGN

SEQ ID NO: 628707 - protein, 21 aa, Mycobacterium
AEDAVALGFGGTVCIHPSQIP

SEQ ID NO: 628708 - protein, 22 aa, Mycobacterium
AEDDGGLGLFAVRTGGPGVSIE

SEQ ID NO: 628709 - protein, 23 aa, Mycobacterium
AEDDGPDLLGLVVGSEGTLGIVT

SEQ ID NO: 628710 - protein, 24 aa, Mycobacterium
AEDDRVAGLIARVQLPAAAPGPVQ

SEQ ID NO: 628711 - protein, 25 aa, Mycobacterium
AEDELLRLAEWVADPRATVVVGAQL

SEQ ID NO: 628712 - protein, 25 aa, Mycobacterium
AEDEVSAAIAAFFGAHAQSYQTLSA

SEQ ID NO: 628713 - protein, 25 aa, Mycobacterium
AEDEVSAAIAALFSGHGQAYQQISA

SEQ ID NO: 628714 - protein, 24 aa, Mycobacterium
AEDEVSAAIAAVFSGHAQAYQAAS

SEQ ID NO: 628715 - protein, 23 aa, Mycobacterium
AEDEVSAAIATVLSSHGQGYQVL

SEQ ID NO: 628716 - protein, 31 aa, Mycobacterium
AEDEVSAAVAKLFGGYAQQFQALGAQASLFH

SEQ ID NO: 628717 - protein, 25 aa, Mycobacterium
AEDEVSVAVAALFGSHGETYQVLSA

SEQ ID NO: 628718 - protein, 18 aa, Mycobacterium
AEDEWIWGRATVLAAGYL

SEQ ID NO: 628719 - protein, 23 aa, Mycobacterium
AEDFKARVGEFIGKDVAVVRATA

SEQ ID NO: 628720 - protein, 26 aa, Mycobacterium
AEDGARVPISIVHRAGVQFPAPTLLY

SEQ ID NO: 628721 - protein, 18 aa, Mycobacterium
AEDGHRLFLEVSAHPVVS

SEQ ID NO: 628722 - protein, 26 aa, Mycobacterium
AEDGTRIPISIVYRGGIQLPAPAMIY

SEQ ID NO: 628723 - protein, 24 aa, Mycobacterium
AEDGVKLAAGWLVEQAGFGKGYPG

SEQ ID NO: 628724 - protein, 19 aa, Mycobacterium
AEDHKRREEADVRNQAETL

SEQ ID NO: 628725 - protein, 24 aa, Mycobacterium
AEDHLDWHGSMAAYARDKARVLDG

SEQ ID NO: 628726 - protein, 24 aa, Mycobacterium
AEDHPDLFWALRGGGGGNFGVTTA

SEQ ID NO: 628727 - protein, 26 aa, Mycobacterium
AEDIEVTILSYVRWPDSVRPLLPPVR

SEQ ID NO: 628728 - protein, 17 aa, Mycobacterium
AEDIKALLHNLGREAQA

SEQ ID NO: 628729 - protein, 18 aa, Mycobacterium
AEDILRQELVTAMEPEQF

SEQ ID NO: 628730 - protein, 23 aa, Mycobacterium
AEDIPALRTWTAQLFEAGYVGAD

SEQ ID NO: 628731 - protein, 25 aa, Mycobacterium
AEDIRRYLAELGFRSIDEAVGHAEL

SEQ ID NO: 628732 - protein, 24 aa, Mycobacterium
AEDITARAGIRWLTAYGTTELPVI

SEQ ID NO: 628733 - protein, 19 aa, Mycobacterium
AEDLARGAQNAIRWTKHSL

SEQ ID NO: 628734 - protein, 18 aa, Mycobacterium
AEDLDLFRRLSLDLISIP

SEQ ID NO: 628735 - protein, 21 aa, Mycobacterium
AEDMPAAWLRRVADALRRKGC

SEQ ID NO: 628736 - protein, 21 aa, Mycobacterium
AEDPPALPIDLIITNANIYLP

SEQ ID NO: 628737 - protein, 24 aa, Mycobacterium
AEDPRAAVVFLHGFGEHTGLYHRY

SEQ ID NO: 628738 - protein, 24 aa, Mycobacterium
AEDPRFRFFGNIKVGEQVSATELA

SEQ ID NO: 628739 - protein, 23 aa, Mycobacterium
AEDPRLAAVIAQAPFTDALATLR

SEQ ID NO: 628740 - protein, 22 aa, Mycobacterium
AEDPRTLLLGAIANTKGSYLVY

SEQ ID NO: 628741 - protein, 21 aa, Mycobacterium
AEDQYRLVLTIHHIVADGWSL

SEQ ID NO: 628742 - protein, 23 aa, Mycobacterium
AEDRGASYFSLGDAWDSFTPTEQ

SEQ ID NO: 628743 - protein, 25 aa, Mycobacterium
AEDRPASILRRVREALAKSSVNLGL

SEQ ID NO: 628744 - protein, 26 aa, Mycobacterium
AEDRVWKLTWYLGGHSASLSELLPML

SEQ ID NO: 628745 - protein, 18 aa, Mycobacterium
AEDTIRELHIPSALSGPD

SEQ ID NO: 628746 - protein, 26 aa, Mycobacterium
AEDVLRPLPVTRFDVRRAPAALRYLS

SEQ ID NO: 628747 - protein, 22 aa, Mycobacterium
AEDVPGYVAGLFDNIIADPQGA

SEQ ID NO: 628748 - protein, 27 aa, Mycobacterium
AEDVTLARLCIRPEPAAPALTAVALSD

SEQ ID NO: 628749 - protein, 18 aa, Mycobacterium
AEEAAAWGFVNKLTEPGE

SEQ ID NO: 628750 - protein, 37 aa, Mycobacterium
AEEALRGFERFPAWMWRNTVVRDFVAWLRACNADRRA

SEQ ID NO: 628751 - protein, 24 aa, Mycobacterium
AEEARREALPNIARLLPAARAAGV

SEQ ID NO: 628752 - protein, 34 aa, Mycobacterium
AEEATRVGMPYVNQRWLGGMLTNFSTVHKRLQRL

SEQ ID NO: 628753 - protein, 23 aa, Mycobacterium
AEEAYALDLVTWVVSAAEIDTFV

SEQ ID NO: 628754 - protein, 30 aa, Mycobacterium
AEEDAVFGVFCRRWGVPLIDGGTVRLPRLI

SEQ ID NO: 628755 - protein, 23 aa, Mycobacterium
AEEDIRTAARWIGEAREWMTLWT

SEQ ID NO: 628756 - protein, 22 aa, Mycobacterium
AEEDRRAWRVALIRNLITKNAK

SEQ ID NO: 628757 - protein, 27 aa, Mycobacterium
AEEFGDWWPQQRPFTMRYLDAPPRVAL

SEQ ID NO: 628758 - protein, 23 aa, Mycobacterium
AEEFGHQALRAFESAGGDELLQQ

SEQ ID NO: 628759 - protein, 19 aa, Mycobacterium
AEEFLEVVFGLWERSWQIE

SEQ ID NO: 628760 - protein, 23 aa, Mycobacterium
AEEGKFALADPVTAWLPELSNMR

SEQ ID NO: 628761 - protein, 20 aa, Mycobacterium
AEEGRRILAEMVDGSVRRVS

SEQ ID NO: 628762 - protein, 22 aa, Mycobacterium
AEEGRRIVAAAAQAKVEATVDD

SEQ ID NO: 628763 - protein, 39 aa, Mycobacterium
AEEGTPFIAAHGMRRISLVPGPSGFRFYHTHLNPGAELT

SEQ ID NO: 628764 - protein, 24 aa, Mycobacterium
AEEGVEPWPKCGAQSGLPIGWYSH

SEQ ID NO: 628765 - protein, 25 aa, Mycobacterium
AEEIGRALAPVPWIDHVCAARLLAR

SEQ ID NO: 628766 - protein, 23 aa, Mycobacterium
AEEIGRALAPVPWIDHVVAARLL

SEQ ID NO: 628767 - protein, 19 aa, Mycobacterium
AEEIRRARESKVIRDIEHA

SEQ ID NO: 628768 - protein, 17 aa, Mycobacterium
AEELGVDVIFGYDHFHR

SEQ ID NO: 628769 - protein, 17 aa, Mycobacterium
AEELKAVRPSSGPSALN

SEQ ID NO: 628770 - protein, 23 aa, Mycobacterium
AEELRRQWLPKMASGEMIGAIAM

SEQ ID NO: 628771 - protein, 26 aa, Mycobacterium
AEELRRTAARLADWVAERPEVAPGDV

SEQ ID NO: 628772 - protein, 25 aa, Mycobacterium
AEELVLRYATERGLPAVAMCVSTTY

SEQ ID NO: 628773 - protein, 22 aa, Mycobacterium
AEELWKRLGHDTSLAHGPFPEA

SEQ ID NO: 628774 - protein, 18 aa, Mycobacterium
AEEMRRLRGSNARAVIAR

SEQ ID NO: 628775 - protein, 18 aa, Mycobacterium
AEEPERFSALLSVSAGEG

SEQ ID NO: 628776 - protein, 19 aa, Mycobacterium
AEEPIAFLAQLGRDHRKYG

SEQ ID NO: 628777 - protein, 23 aa, Mycobacterium
AEERCAAAGLTLRVPRPRLCTDN

SEQ ID NO: 628778 - protein, 19 aa, Mycobacterium
AEERRAFITDVSLIGGLII

SEQ ID NO: 628779 - protein, 20 aa, Mycobacterium
AEERRLLLLAVGRAARRVLI

SEQ ID NO: 628780 - protein, 18 aa, Mycobacterium
AEESARLFVSDEAREGML

SEQ ID NO: 628781 - protein, 17 aa, Mycobacterium
AEESPAYCDGTVVETHR

SEQ ID NO: 628782 - protein, 23 aa, Mycobacterium
AEETRRLSVVSIYGGRAYEPQVE

SEQ ID NO: 628783 - protein, 17 aa, Mycobacterium
AEETVVVVAPMFHAWGF

SEQ ID NO: 628784 - protein, 20 aa, Mycobacterium
AEEVERRWGVRAIPVKADMS

SEQ ID NO: 628785 - protein, 22 aa, Mycobacterium
AEEVGLPLTFTLVVANAGDPTW

SEQ ID NO: 628786 - protein, 25 aa, Mycobacterium
AEEVRELMAELGFRTVNEAVGQVGA

SEQ ID NO: 628787 - protein, 24 aa, Mycobacterium
AEEVRRYFGAKVLRTVIPRSVKVS

SEQ ID NO: 628788 - protein, 23 aa, Mycobacterium
AEEWRQVAAIPAVLPAAQPEDTY

SEQ ID NO: 628789 - protein, 23 aa, Mycobacterium
AEEWRRFRLARMVAVEAMPYFAR

SEQ ID NO: 628790 - protein, 23 aa, Mycobacterium
AEEYLQVCYKLWEGSWESGAVVR

SEQ ID NO: 628791 - protein, 21 aa, Mycobacterium
AEEYLRIVSALLRGETVDHDG

SEQ ID NO: 628792 - protein, 17 aa, Mycobacterium
AEEYVFYDGPPFANGLP

SEQ ID NO: 628793 - protein, 24 aa, Mycobacterium
AEFAASGARIRLCKGAYDEPASVA

SEQ ID NO: 628794 - protein, 17 aa, Mycobacterium
AEFADAMINSGVDVKFM

SEQ ID NO: 628795 - protein, 19 aa, Mycobacterium
AEFADGWRALAHTLAGRPA

SEQ ID NO: 628796 - protein, 18 aa, Mycobacterium
AEFADVFFVAVATPQKKG

SEQ ID NO: 628797 - protein, 24 aa, Mycobacterium
AEFAELRASAPIWWNEQAPGHGGG

SEQ ID NO: 628798 - protein, 17 aa, Mycobacterium
AEFAEREGVNLTFLPFI

SEQ ID NO: 628799 - protein, 19 aa, Mycobacterium
AEFAGRLASPGGHVLEVAR

SEQ ID NO: 628800 - protein, 24 aa, Mycobacterium
AEFAHTFSSLGSRVTLVVRGSTLL

SEQ ID NO: 628801 - protein, 20 aa, Mycobacterium
AEFAHVFSALGSRVTIVLRG

SEQ ID NO: 628802 - protein, 19 aa, Mycobacterium
AEFAHVFSTLGARVTLVIR

SEQ ID NO: 628803 - protein, 23 aa, Mycobacterium
AEFARGGFGLVITEGTYTDTTHS

SEQ ID NO: 628804 - protein, 18 aa, Mycobacterium
AEFARPLSPEQARRLLDG

SEQ ID NO: 628805 - protein, 23 aa, Mycobacterium
AEFARQAGRFGLRHTALGAAYGL

SEQ ID NO: 628806 - protein, 24 aa, Mycobacterium
AEFARRFDCRVVDSFGSSEFAVIV

SEQ ID NO: 628807 - protein, 24 aa, Mycobacterium
AEFARTGFTGGLNWYRAEDLVWAQ

SEQ ID NO: 628808 - protein, 24 aa, Mycobacterium
AEFDADLPGGYDWEYLDKGPEVWR

SEQ ID NO: 628809 - protein, 17 aa, Mycobacterium
AEFDEGRSFVLTDTVGF

SEQ ID NO: 628810 - protein, 19 aa, Mycobacterium
AEFDLRFPDLAAIDPAQVG

SEQ ID NO: 628811 - protein, 24 aa, Mycobacterium
AEFDRSGADIVLLDLMLPGMSGTD

SEQ ID NO: 628812 - protein, 21 aa, Mycobacterium
AEFDYDLNMTPSFPLLDPTKP

SEQ ID NO: 628813 - protein, 24 aa, Mycobacterium
AEFEFRSGPVFTNLLLADEINRTP

SEQ ID NO: 628814 - protein, 21 aa, Mycobacterium
AEFEPLLTLWRSAAIQPQARK

SEQ ID NO: 628815 - protein, 21 aa, Mycobacterium
AEFETRLPAAVAHLVSERNRY

SEQ ID NO: 628816 - protein, 17 aa, Mycobacterium
AEFGAAVVQQGVMPGGI

SEQ ID NO: 628817 - protein, 22 aa, Mycobacterium
AEFGARVRFRHPLARSAAYRAA

SEQ ID NO: 628818 - protein, 17 aa, Mycobacterium
AEFGMTVLLTTHYMGEA

SEQ ID NO: 628819 - protein, 20 aa, Mycobacterium
AEFGVRLNVRAVFDTPTPAG

SEQ ID NO: 628820 - protein, 18 aa, Mycobacterium
AEFHGAYDYFLTPTLATP

SEQ ID NO: 628821 - protein, 20 aa, Mycobacterium
AEFHPEFDAGAVEVVFRKGH

SEQ ID NO: 628822 - protein, 27 aa, Mycobacterium
AEFHQRAAVRAHLWPDAMTTLTTHDTK

SEQ ID NO: 628823 - protein, 17 aa, Mycobacterium
AEFKPALLNLATDSVTV

SEQ ID NO: 628824 - protein, 19 aa, Mycobacterium
AEFLAELLGLPSPVTFGPF

SEQ ID NO: 628825 - protein, 21 aa, Mycobacterium
AEFLKRVMAGTLTLGEWLDLT

SEQ ID NO: 628826 - protein, 22 aa, Mycobacterium
AEFLSARRARLTPEEVGLEQPG

SEQ ID NO: 628827 - protein, 18 aa, Mycobacterium
AEFLSMDIALAVVDGLDA

SEQ ID NO: 628828 - protein, 24 aa, Mycobacterium
AEFPEHREVGGRRAGRLVAPDQGF

SEQ ID NO: 628829 - protein, 24 aa, Mycobacterium
AEFPPEKFRSMMALMVEAPFLLIR

SEQ ID NO: 628830 - protein, 27 aa, Mycobacterium
AEFPVDARGGIELSLEGYGYRWLRLLR

SEQ ID NO: 628831 - protein, 17 aa, Mycobacterium
AEFRPDLDTARIDAVFR

SEQ ID NO: 628832 - protein, 22 aa, Mycobacterium
AEFRRAVGALQRVAHPPVQVEA

SEQ ID NO: 628833 - protein, 23 aa, Mycobacterium
AEFRRRFGAELHEGYGSSEGGAV

SEQ ID NO: 628834 - protein, 20 aa, Mycobacterium
AEFSAALSDVQWRDPEVDAN

SEQ ID NO: 628835 - protein, 23 aa, Mycobacterium
AEFSDVAYGWAMQDESGLCKVLA

SEQ ID NO: 628836 - protein, 17 aa, Mycobacterium
AEFSGIVRSALDGARPD

SEQ ID NO: 628837 - protein, 24 aa, Mycobacterium
AEFSRTGFTGGLNWYRNFDRNWET

SEQ ID NO: 628838 - protein, 21 aa, Mycobacterium
AEFTAALGRVLHRPTLLVAPQ

SEQ ID NO: 628839 - protein, 17 aa, Mycobacterium
AEFTHTCFMVVPYEQYV

SEQ ID NO: 628840 - protein, 20 aa, Mycobacterium
AEFTPLVRRLAGFLPADVRV

SEQ ID NO: 628841 - protein, 20 aa, Mycobacterium
AEFVISFGWGPLAVHEPVRI

SEQ ID NO: 628842 - protein, 23 aa, Mycobacterium
AEFVRSRRAELFGAHPAAADESD

SEQ ID NO: 628843 - protein, 31 aa, Mycobacterium
AEFWFDPLCPWCWITSRWILEVQKVRDIEVK

SEQ ID NO: 628844 - protein, 24 aa, Mycobacterium
AEFYRRHVCRVVPTPQDFADSVAQ

SEQ ID NO: 628845 - protein, 17 aa, Mycobacterium
AEFYVEMTAMDAAGSDA

SEQ ID NO: 628846 - protein, 17 aa, Mycobacterium
AEGAAMFVLQRRSAAVR

SEQ ID NO: 628847 - protein, 17 aa, Mycobacterium
AEGAEEWHDPREDGLLP

SEQ ID NO: 628848 - protein, 20 aa, Mycobacterium
AEGAEVVQIFLGNPQSWKAP

SEQ ID NO: 628849 - protein, 18 aa, Mycobacterium
AEGALLLMLAALRQLPRL

SEQ ID NO: 628850 - protein, 18 aa, Mycobacterium
AEGALVFMSGWMGVDLAR

SEQ ID NO: 628851 - protein, 20 aa, Mycobacterium
AEGAPPIYFGFGSTPLTSPA

SEQ ID NO: 628852 - protein, 21 aa, Mycobacterium
AEGARRIKCERARNDAHVAER

SEQ ID NO: 628853 - protein, 23 aa, Mycobacterium
AEGDAWPSLARARDEGAAAISAE

SEQ ID NO: 628854 - protein, 24 aa, Mycobacterium
AEGDEVWPGILGFDDTVLPQLERA

SEQ ID NO: 628855 - protein, 18 aa, Mycobacterium
AEGDLWVRVRIERPGRQI

SEQ ID NO: 628856 - protein, 18 aa, Mycobacterium
AEGDRAAAVRTLDEVPPT

SEQ ID NO: 628857 - protein, 17 aa, Mycobacterium
AEGDVLWTDVSVTFHGY

SEQ ID NO: 628858 - protein, 19 aa, Mycobacterium
AEGEAFGRAAEPWEVAATI

SEQ ID NO: 628859 - protein, 23 aa, Mycobacterium
AEGEATLSPAGRVVVLTHARVHE

SEQ ID NO: 628860 - protein, 22 aa, Mycobacterium
AEGEIRLGFLHTFGPTLIAGLI

SEQ ID NO: 628861 - protein, 25 aa, Mycobacterium
AEGELYFPGSPVLSLHGSFAECVLL

SEQ ID NO: 628862 - protein, 25 aa, Mycobacterium
AEGELYFPGSPVLSVHGSFAECVLL

SEQ ID NO: 628863 - protein, 25 aa, Mycobacterium
AEGELYFPGSPVLSVSGTFAECVVL

SEQ ID NO: 628864 - protein, 24 aa, Mycobacterium
AEGELYFPGSPVLSVTGTFAECVV

SEQ ID NO: 628865 - protein, 18 aa, Mycobacterium
AEGFSYTKVHTMAGPGTS

SEQ ID NO: 628866 - protein, 21 aa, Mycobacterium
AEGGAFYGPRGFYEAAGGGVT

SEQ ID NO: 628867 - protein, 25 aa, Mycobacterium
AEGGIRTPCLIRWPGKVVPRESNEM

SEQ ID NO: 628868 - protein, 19 aa, Mycobacterium
AEGGLAIETTVEWLAARNG

SEQ ID NO: 628869 - protein, 20 aa, Mycobacterium
AEGGPLWPGIAEPVELAKRD

SEQ ID NO: 628870 - protein, 18 aa, Mycobacterium
AEGGSFACGGGRPEGKDR

SEQ ID NO: 628871 - protein, 20 aa, Mycobacterium
AEGGTFACGGGRPAGRDVGY

SEQ ID NO: 628872 - protein, 20 aa, Mycobacterium
AEGGTFACGGGRPAGRQVGY

SEQ ID NO: 628873 - protein, 29 aa, Mycobacterium
AEGGVRPVFVLIHGGGWVIGDLDTHDAVA

SEQ ID NO: 628874 - protein, 22 aa, Mycobacterium
AEGHKWAMLTAYDYSTARIFDE

SEQ ID NO: 628875 - protein, 27 aa, Mycobacterium
AEGHKWAMLTCYDYSSARVFDDAGIPV

SEQ ID NO: 628876 - protein, 26 aa, Mycobacterium
AEGHRVIRINPHLAIVPRIASELTVG

SEQ ID NO: 628877 - protein, 18 aa, Mycobacterium
AEGHRWRNPVWRHADGSF

SEQ ID NO: 628878 - protein, 21 aa, Mycobacterium
AEGIEVMDVISLEVEDNRAVG

SEQ ID NO: 628879 - protein, 19 aa, Mycobacterium
AEGIGVPLVVRYAMTECPT

SEQ ID NO: 628880 - protein, 22 aa, Mycobacterium
AEGIPASLQAPIRGRNAGDAAG

SEQ ID NO: 628881 - protein, 20 aa, Mycobacterium
AEGIRPPAIVVIGAVAGLGG

SEQ ID NO: 628882 - protein, 30 aa, Mycobacterium
AEGISVNVTLIFSVERYRLVMDAYLQGLEK

SEQ ID NO: 628883 - protein, 24 aa, Mycobacterium
AEGISVNVTLIFSVQRHKEVMDAY

SEQ ID NO: 628884 - protein, 22 aa, Mycobacterium
AEGKIYICAVKDVWSNRIVGYS

SEQ ID NO: 628885 - protein, 17 aa, Mycobacterium
AEGKLALVIHHLAVDGV

SEQ ID NO: 628886 - protein, 19 aa, Mycobacterium
AEGKVFCAGVRVQEFTVMD

SEQ ID NO: 628887 - protein, 21 aa, Mycobacterium
AEGLADLALYAAIGPGWGTWA

SEQ ID NO: 628888 - protein, 29 aa, Mycobacterium
AEGLADLALYAAVGPEWGSWASEIYADLG

SEQ ID NO: 628889 - protein, 23 aa, Mycobacterium
AEGLANLGRCLRAEPGCVFNADP

SEQ ID NO: 628890 - protein, 25 aa, Mycobacterium
AEGLARAGAAVAILGRTASRLETAA

SEQ ID NO: 628891 - protein, 20 aa, Mycobacterium
AEGLDGLLPAAGYVATAAHL

SEQ ID NO: 628892 - protein, 19 aa, Mycobacterium
AEGLDVVEFPGWRNRGHGD

SEQ ID NO: 628893 - protein, 26 aa, Mycobacterium
AEGLEAAKPFIAALCTAQEELAGSAA

SEQ ID NO: 628894 - protein, 26 aa, Mycobacterium
AEGLEAAKPFIATLCTAQEELAGAAA

SEQ ID NO: 628895 - protein, 22 aa, Mycobacterium
AEGLIAQQPRRGFMVLPVTGRD

SEQ ID NO: 628896 - protein, 22 aa, Mycobacterium
AEGLIAQQPRRGFVVLPVTGRD

SEQ ID NO: 628897 - protein, 18 aa, Mycobacterium
AEGLLADAELDWRDQEKM

SEQ ID NO: 628898 - protein, 17 aa, Mycobacterium
AEGLLMYLPPDAQDRLF

SEQ ID NO: 628899 - protein, 19 aa, Mycobacterium
AEGLLRRGKLLGMYPEGTR

SEQ ID NO: 628900 - protein, 18 aa, Mycobacterium
AEGLPLRRAVRAAIVEAL

SEQ ID NO: 628901 - protein, 24 aa, Mycobacterium
AEGLPRLPGNAVVDILLRRPPRTR

SEQ ID NO: 628902 - protein, 19 aa, Mycobacterium
AEGLPVLTVGALVTRATTA

SEQ ID NO: 628903 - protein, 22 aa, Mycobacterium
AEGLPWAVFSPFTPYLRSRGVP

SEQ ID NO: 628904 - protein, 18 aa, Mycobacterium
AEGLPYRSVLGLAELGLG

SEQ ID NO: 628905 - protein, 25 aa, Mycobacterium
AEGLPYRWPHPWLVDQQGARQQQAL

SEQ ID NO: 628906 - protein, 18 aa, Mycobacterium
AEGLSRAAEVMRYTALSA

SEQ ID NO: 628907 - protein, 20 aa, Mycobacterium
AEGLVRMGLSTSKVRTYATP

SEQ ID NO: 628908 - protein, 18 aa, Mycobacterium
AEGLYLGYGKPQWESIEA

SEQ ID NO: 628909 - protein, 19 aa, Mycobacterium
AEGMLPHIAGRAVTRKRWP

SEQ ID NO: 628910 - protein, 22 aa, Mycobacterium
AEGNGAGAHAMFVVTLDKPSTQ

SEQ ID NO: 628911 - protein, 20 aa, Mycobacterium
AEGNRLPGLDDRRMGIDEAT

SEQ ID NO: 628912 - protein, 20 aa, Mycobacterium
AEGPEVIPASVLVPQPESVP

SEQ ID NO: 628913 - protein, 25 aa, Mycobacterium
AEGPKPWWYRPMYSLFDQFLGAAET

SEQ ID NO: 628914 - protein, 18 aa, Mycobacterium
AEGPLPAVVRAVLEPLGL

SEQ ID NO: 628915 - protein, 20 aa, Mycobacterium
AEGPPPIYFGFGSTPVSSPP

SEQ ID NO: 628916 - protein, 17 aa, Mycobacterium
AEGQGFIQLMTQLPQER

SEQ ID NO: 628917 - protein, 24 aa, Mycobacterium
AEGQPRGGPALLPGEVLPGQHHLH

SEQ ID NO: 628918 - protein, 19 aa, Mycobacterium
AEGQVLLRFQAAGVCGSDL

SEQ ID NO: 628919 - protein, 20 aa, Mycobacterium
AEGRAAGAQAQWSAAATSVT

SEQ ID NO: 628920 - protein, 24 aa, Mycobacterium
AEGRCWSEFVLGAAYEGPPGLAHG

SEQ ID NO: 628921 - protein, 22 aa, Mycobacterium
AEGRIWCAMVTPANPVADRLAA

SEQ ID NO: 628922 - protein, 24 aa, Mycobacterium
AEGRKAEFAEHGWDADDIPDPQDP

SEQ ID NO: 628923 - protein, 24 aa, Mycobacterium
AEGRKAEFAEHGWDADEIPDPQDP

SEQ ID NO: 628924 - protein, 24 aa, Mycobacterium
AEGRKAEFAGHGWDADEIPDPQDP

SEQ ID NO: 628925 - protein, 28 aa, Mycobacterium
AEGRLALGVGPSHHWIIRDMLGLPYDKP

SEQ ID NO: 628926 - protein, 24 aa, Mycobacterium
AEGRLRNGSLIPLSAAGEYPTTEQ

SEQ ID NO: 628927 - protein, 17 aa, Mycobacterium
AEGRPVAMLVGARGIPR

SEQ ID NO: 628928 - protein, 23 aa, Mycobacterium
AEGRRAHARCVAIAADIAAGQGI

SEQ ID NO: 628929 - protein, 25 aa, Mycobacterium
AEGRSNAGIARRLWVTEGTVEKHVR

SEQ ID NO: 628930 - protein, 20 aa, Mycobacterium
AEGSELWRAKLADALVRRLE

SEQ ID NO: 628931 - protein, 24 aa, Mycobacterium
AEGSLRAAPGSSWCEWKGRATYFD

SEQ ID NO: 628932 - protein, 23 aa, Mycobacterium
AEGSPSRAFWRHQLQGLIPCLFP

SEQ ID NO: 628933 - protein, 25 aa, Mycobacterium
AEGSRPLRGWQRRAIVKYLAAEPRD

SEQ ID NO: 628934 - protein, 19 aa, Mycobacterium
AEGTFFLPDGRRLGYAEFG

SEQ ID NO: 628935 - protein, 23 aa, Mycobacterium
AEGTGASEGWCPYCGSPYSFLPQ

SEQ ID NO: 628936 - protein, 17 aa, Mycobacterium
AEGTKLFSAVANHAVVF

SEQ ID NO: 628937 - protein, 18 aa, Mycobacterium
AEGTRWVGTHVAFATGQD

SEQ ID NO: 628938 - protein, 19 aa, Mycobacterium
AEGVAHWKTRGLDLDPIFA

SEQ ID NO: 628939 - protein, 23 aa, Mycobacterium
AEGVECYRRFISGLLDITDNRDR

SEQ ID NO: 628940 - protein, 19 aa, Mycobacterium
AEGVEIVFAPTAAAMYPDG

SEQ ID NO: 628941 - protein, 21 aa, Mycobacterium
AEGVKAEFPDQMLAYNCSPSF

SEQ ID NO: 628942 - protein, 25 aa, Mycobacterium
AEGVKRALAAWVVFEPGAMFHYSDI

SEQ ID NO: 628943 - protein, 20 aa, Mycobacterium
AEGVPPITSVPWDTKAPKEN

SEQ ID NO: 628944 - protein, 18 aa, Mycobacterium
AEGVRLARELGVDEPTVL

SEQ ID NO: 628945 - protein, 20 aa, Mycobacterium
AEGVVFKGGKDFATEEDLAI

SEQ ID NO: 628946 - protein, 20 aa, Mycobacterium
AEGWSRAQIVGAMQQANNQG

SEQ ID NO: 628947 - protein, 40 aa, Mycobacterium
AEGYFRPDLDVDLVYRFIRDTTWVSVRWYQPGGPLTAEQV

SEQ ID NO: 628948 - protein, 19 aa, Mycobacterium
AEGYKPFWAITRHADVMDI

SEQ ID NO: 628949 - protein, 18 aa, Mycobacterium
AEGYRLALVAAHDDGDAL

SEQ ID NO: 628950 - protein, 18 aa, Mycobacterium
AEGYTGLVFDGCFHGKAN

SEQ ID NO: 628951 - protein, 19 aa, Mycobacterium
AEHAHIWHAFVDRNTYPGK

SEQ ID NO: 628952 - protein, 18 aa, Mycobacterium
AEHAMTFDLSNACAGMLT

SEQ ID NO: 628953 - protein, 21 aa, Mycobacterium
AEHAQRFALDQAHSLAEPADS

SEQ ID NO: 628954 - protein, 21 aa, Mycobacterium
AEHCGDLLLMRAGRLVAQTTP

SEQ ID NO: 628955 - protein, 20 aa, Mycobacterium
AEHFPRPAVVVEPGRAISAR

SEQ ID NO: 628956 - protein, 25 aa, Mycobacterium
AEHGDRFLLGIGVSHAPLIDAGQPG

SEQ ID NO: 628957 - protein, 26 aa, Mycobacterium
AEHGIDTVVVGWGYGGADFSGPAAVV

SEQ ID NO: 628958 - protein, 21 aa, Mycobacterium
AEHGKAPAVTAMFGKVGPLLS

SEQ ID NO: 628959 - protein, 23 aa, Mycobacterium
AEHHGCRAFIEMSPHPVLTHAIT

SEQ ID NO: 628960 - protein, 25 aa, Mycobacterium
AEHIGGRWVVDVASYKRHGRLMTDE

SEQ ID NO: 628961 - protein, 19 aa, Mycobacterium
AEHILLRTVRCVSGTVEVL

SEQ ID NO: 628962 - protein, 24 aa, Mycobacterium
AEHIRADLLAAVDVIRADATEASL

SEQ ID NO: 628963 - protein, 23 aa, Mycobacterium
AEHIVAAFAFELGKVEMPEIRSA

SEQ ID NO: 628964 - protein, 17 aa, Mycobacterium
AEHLGLRASVLSFTDAE

SEQ ID NO: 628965 - protein, 23 aa, Mycobacterium
AEHLLRIIQSFIIDPGRPPRTGA

SEQ ID NO: 628966 - protein, 23 aa, Mycobacterium
AEHLPEDLVFRVNYLGGDMPTFT

SEQ ID NO: 628967 - protein, 21 aa, Mycobacterium
AEHLREPYVLYGHSMGGLLAY

SEQ ID NO: 628968 - protein, 17 aa, Mycobacterium
AEHLRKVGVDVAHLCVC

SEQ ID NO: 628969 - protein, 23 aa, Mycobacterium
AEHLRLGLDAAVRCGNDTDTVAA

SEQ ID NO: 628970 - protein, 23 aa, Mycobacterium
AEHLRVVGLHSHIGSQIFDVAGF

SEQ ID NO: 628971 - protein, 27 aa, Mycobacterium
AEHMLRAALIATRLADRLGLCADERDC

SEQ ID NO: 628972 - protein, 28 aa, Mycobacterium
AEHMLRSALIATRLADRLGLSRQQRDST

SEQ ID NO: 628973 - protein, 22 aa, Mycobacterium
AEHPEWGFAGYVHHFIDKPTIA

SEQ ID NO: 628974 - protein, 18 aa, Mycobacterium
AEHPLTGVIHAAGVLDDA

SEQ ID NO: 628975 - protein, 22 aa, Mycobacterium
AEHPQYRIGYGLSSYLEATGRG

SEQ ID NO: 628976 - protein, 19 aa, Mycobacterium
AEHPRLGAVRNPWNTDHTA

SEQ ID NO: 628977 - protein, 18 aa, Mycobacterium
AEHPRLGPVRNPWDTEYS

SEQ ID NO: 628978 - protein, 20 aa, Mycobacterium
AEHPRLGPVRNPWHTDYTAG

SEQ ID NO: 628979 - protein, 20 aa, Mycobacterium
AEHPRLLATYLTHTFGVDDV

SEQ ID NO: 628980 - protein, 24 aa, Mycobacterium
AEHPSSGVAFVLGERLGRIDVTEL

SEQ ID NO: 628981 - protein, 24 aa, Mycobacterium
AEHPSSGVAFVLGERLGRVDVSEL

SEQ ID NO: 628982 - protein, 25 aa, Mycobacterium
AEHPSTGVAFVLGERLGRVDVSELR

SEQ ID NO: 628983 - protein, 19 aa, Mycobacterium
AEHPVESYGGLSRMVNRND

SEQ ID NO: 628984 - protein, 24 aa, Mycobacterium
AEHRAAGPVRARFAATTWAQHMSI

SEQ ID NO: 628985 - protein, 20 aa, Mycobacterium
AEHRASRALVSPSFRSALLE

SEQ ID NO: 628986 - protein, 20 aa, Mycobacterium
AEHRAVAVATVIAHPDPARV

SEQ ID NO: 628987 - protein, 17 aa, Mycobacterium
AEHREYIEAARDFCVRA

SEQ ID NO: 628988 - protein, 21 aa, Mycobacterium
AEHRKLVEDWARTGDADALSR

SEQ ID NO: 628989 - protein, 29 aa, Mycobacterium
AEHRLGAAVFRDMLGLHFSSSRPVEDELA

SEQ ID NO: 628990 - protein, 21 aa, Mycobacterium
AEHRPGGGWELLTQAGERRLF

SEQ ID NO: 628991 - protein, 21 aa, Mycobacterium
AEHSLYGWLHYSLRRTWDYFV

SEQ ID NO: 628992 - protein, 26 aa, Mycobacterium
AEHVIPELQRRGAYKTEYTEGTLRHK

SEQ ID NO: 628993 - protein, 24 aa, Mycobacterium
AEHVKPRLLGHWGTTPGLNLIYAH

SEQ ID NO: 628994 - protein, 24 aa, Mycobacterium
AEHVLKRRGVRFLTGVTLSRVAAD

SEQ ID NO: 628995 - protein, 17 aa, Mycobacterium
AEHVQLPRGRRVGTQDV

SEQ ID NO: 628996 - protein, 20 aa, Mycobacterium
AEHYMRMVAGADWVIDLGPG

SEQ ID NO: 628997 - protein, 20 aa, Mycobacterium
AEHYWQLHAERPGAWTDEIV

SEQ ID NO: 628998 - protein, 21 aa, Mycobacterium
AEIAACKILASQVLKSIALRA

SEQ ID NO: 628999 - protein, 17 aa, Mycobacterium
AEIAAKLGRLVEIGFGQ

SEQ ID NO: 629000 - protein, 25 aa, Mycobacterium
AEIAARLDLPVGVARVLVGDLVSSD

SEQ ID NO: 629001 - protein, 19 aa, Mycobacterium
AEIACWKPLLFGDDGGRAF

SEQ ID NO: 629002 - protein, 34 aa, Mycobacterium
AEIADGWLPMFYAPRLADMYNEWLDEGFSRPGAR

SEQ ID NO: 629003 - protein, 33 aa, Mycobacterium
AEIAEGWQPIFFLPEKANDVWGAALAEGKAKRD

SEQ ID NO: 629004 - protein, 27 aa, Mycobacterium
AEIAEGWQPVFFLPDQAASVWGDALAA

SEQ ID NO: 629005 - protein, 25 aa, Mycobacterium
AEIAEGWQPVFFYPAKAHGVWGAAL

SEQ ID NO: 629006 - protein, 27 aa, Mycobacterium
AEIAEGWQPVFFYPEKAASAWGEALAS

SEQ ID NO: 629007 - protein, 24 aa, Mycobacterium
AEIAEGWQPVFFYPEKADEVWGDA

SEQ ID NO: 629008 - protein, 22 aa, Mycobacterium
AEIAEGWQPVFYFPEKADDVWG

SEQ ID NO: 629009 - protein, 33 aa, Mycobacterium
AEIAEGWQPVFYLPDKAASIWGEPLAAGAAKRD

SEQ ID NO: 629010 - protein, 26 aa, Mycobacterium
AEIAELKEKYGFLLFVDEAHAIGTVG

SEQ ID NO: 629011 - protein, 18 aa, Mycobacterium
AEIAERFHGLDTLVNNAG

SEQ ID NO: 629012 - protein, 19 aa, Mycobacterium
AEIAERIDYDWSRTAITPS

SEQ ID NO: 629013 - protein, 20 aa, Mycobacterium
AEIAEVLGHVALNVLTNYFN

SEQ ID NO: 629014 - protein, 17 aa, Mycobacterium
AEIAFIVGDAYQHRGVG

SEQ ID NO: 629015 - protein, 17 aa, Mycobacterium
AEIAPLVDRLEEARGVN

SEQ ID NO: 629016 - protein, 17 aa, Mycobacterium
AEIAPQWHLRMQAAVQR

SEQ ID NO: 629017 - protein, 20 aa, Mycobacterium
AEIARGRITAVTGPNGSGKS

SEQ ID NO: 629018 - protein, 24 aa, Mycobacterium
AEIARVASGLIRRGADDVASTKKH

SEQ ID NO: 629019 - protein, 18 aa, Mycobacterium
AEIAVFRAAHNVDPADTR

SEQ ID NO: 629020 - protein, 25 aa, Mycobacterium
AEIDALRSSPDWYRVIGGRGGNGAV

SEQ ID NO: 629021 - protein, 26 aa, Mycobacterium
AEIDARLRLLVGRRAGAVNVENASKV

SEQ ID NO: 629022 - protein, 25 aa, Mycobacterium
AEIDARLRLLVGRRGGMANQENLGK

SEQ ID NO: 629023 - protein, 24 aa, Mycobacterium
AEIDARLRLLVGRRGGNANQENVG

SEQ ID NO: 629024 - protein, 25 aa, Mycobacterium
AEIDARLRLVIGRRGGLADQESAGK

SEQ ID NO: 629025 - protein, 23 aa, Mycobacterium
AEIDARLRLVVGRRGGLADQESA

SEQ ID NO: 629026 - protein, 22 aa, Mycobacterium
AEIDARLRLVVGRRGGLSDQEG

SEQ ID NO: 629027 - protein, 21 aa, Mycobacterium
AEIDARLRLVVGRRGGQADQE

SEQ ID NO: 629028 - protein, 22 aa, Mycobacterium
AEIDLGGPIAHTLAYGNTVPGP

SEQ ID NO: 629029 - protein, 22 aa, Mycobacterium
AEIDMRCLLIVGSSQTQWYSAD

SEQ ID NO: 629030 - protein, 24 aa, Mycobacterium
AEIDNLRAAFAWSRENSDTNGALQ

SEQ ID NO: 629031 - protein, 19 aa, Mycobacterium
AEIDRRATAPPQQDAQAQV

SEQ ID NO: 629032 - protein, 18 aa, Mycobacterium
AEIDWARAVDAAFSAAEA

SEQ ID NO: 629033 - protein, 24 aa, Mycobacterium
AEIFGLLICGGRLVIPRPDGLRDI

SEQ ID NO: 629034 - protein, 21 aa, Mycobacterium
AEIGACKILASQVLKSIGLRA

SEQ ID NO: 629035 - protein, 19 aa, Mycobacterium
AEIGAPISFAQRAQVGLPA

SEQ ID NO: 629036 - protein, 18 aa, Mycobacterium
AEIGLGRRWVMSGEGRAA

SEQ ID NO: 629037 - protein, 17 aa, Mycobacterium
AEIGNRITRMFAEEPDV

SEQ ID NO: 629038 - protein, 17 aa, Mycobacterium
AEIGPFFADRNGGYTRI

SEQ ID NO: 629039 - protein, 19 aa, Mycobacterium
AEIGRAQWVQALAARATPE

SEQ ID NO: 629040 - protein, 17 aa, Mycobacterium
AEIGRRGLAGADVAAIA

SEQ ID NO: 629041 - protein, 17 aa, Mycobacterium
AEIGSFQLVQAMLADQQ

SEQ ID NO: 629042 - protein, 24 aa, Mycobacterium
AEIGWAARMGRIPLGYFNDPEATR

SEQ ID NO: 629043 - protein, 22 aa, Mycobacterium
AEIHATAGPMAAIRAQQLPEAG

SEQ ID NO: 629044 - protein, 27 aa, Mycobacterium
AEIHDRMPLMLAESDWDAWLNPDAPLD

SEQ ID NO: 629045 - protein, 25 aa, Mycobacterium
AEIHDRMPLSISRDDWDRWLDPDAP

SEQ ID NO: 629046 - protein, 21 aa, Mycobacterium
AEIKDFIGVPWQIYRGDDAWR

SEQ ID NO: 629047 - protein, 20 aa, Mycobacterium
AEIKRQALRVSRLHAKLFYQ

SEQ ID NO: 629048 - protein, 18 aa, Mycobacterium
AEILERWTKELFDADGGQ

SEQ ID NO: 629049 - protein, 19 aa, Mycobacterium
AEILKVCKERSQAVTTQGG

SEQ ID NO: 629050 - protein, 20 aa, Mycobacterium
AEILPSLPLMVRADGLIDPA

SEQ ID NO: 629051 - protein, 21 aa, Mycobacterium
AEILRRIRAALTARQSTVRSG

SEQ ID NO: 629052 - protein, 20 aa, Mycobacterium
AEILRYCSDQGIAIVPFGGG

SEQ ID NO: 629053 - protein, 18 aa, Mycobacterium
AEILSRIADPDVRAIAAD

SEQ ID NO: 629054 - protein, 17 aa, Mycobacterium
AEILVQMSRRDDIPYHL

SEQ ID NO: 629055 - protein, 21 aa, Mycobacterium
AEIMGLSFLFVLAGLDTVTAA

SEQ ID NO: 629056 - protein, 23 aa, Mycobacterium
AEIPDIAIPLVFRLLGESGAHAP

SEQ ID NO: 629057 - protein, 18 aa, Mycobacterium
AEIRDFLEGYVIGQDTAK

SEQ ID NO: 629058 - protein, 20 aa, Mycobacterium
AEIRMLRVLGADLVGMSTVH

SEQ ID NO: 629059 - protein, 17 aa, Mycobacterium
AEIRRVLVPAGKLVVLE

SEQ ID NO: 629060 - protein, 24 aa, Mycobacterium
AEISARLDLPLGVTRVLVGDLVLS

SEQ ID NO: 629061 - protein, 18 aa, Mycobacterium
AEISRLLGDVGLDIGIAF

SEQ ID NO: 629062 - protein, 30 aa, Mycobacterium
AEISRPFDKGRNGFVIADGAAFLVLERRSH

SEQ ID NO: 629063 - protein, 17 aa, Mycobacterium
AEITAQFLAAAAGGDVE

SEQ ID NO: 629064 - protein, 19 aa, Mycobacterium
AEITASLGMSEPGAGSDLA

SEQ ID NO: 629065 - protein, 19 aa, Mycobacterium
AEITASLGMSEPSAGSDLA

SEQ ID NO: 629066 - protein, 26 aa, Mycobacterium
AEITTLLGGLGYRGFFELGDARRPIA

SEQ ID NO: 629067 - protein, 20 aa, Mycobacterium
AEIVGAALFLMSDASSFTTG

SEQ ID NO: 629068 - protein, 19 aa, Mycobacterium
AEIVGVPLIAAMRPEPNLA

SEQ ID NO: 629069 - protein, 26 aa, Mycobacterium
AEIVSRVGNHYVVRNAAWNPKIAAGQ

SEQ ID NO: 629070 - protein, 25 aa, Mycobacterium
AEIVSRVGNHYVVRNVSYNAQVAAG

SEQ ID NO: 629071 - protein, 17 aa, Mycobacterium
AEIYDGFLVHSRFASAA

SEQ ID NO: 629072 - protein, 17 aa, Mycobacterium
AEIYPVPPLLRNQVLSI

SEQ ID NO: 629073 - protein, 20 aa, Mycobacterium
AEIYRQSFATIRAEANLARF

SEQ ID NO: 629074 - protein, 23 aa, Mycobacterium
AEKAIKTQLLMDAIADKLEIQVG

SEQ ID NO: 629075 - protein, 21 aa, Mycobacterium
AEKELERARLAGARAAAANAA

SEQ ID NO: 629076 - protein, 17 aa, Mycobacterium
AEKFPGLLEQQLGGSLY

SEQ ID NO: 629077 - protein, 19 aa, Mycobacterium
AEKFRAAVQSARIGATRDV

SEQ ID NO: 629078 - protein, 33 aa, Mycobacterium
AEKFVTWCGRRWYRTGDLARYWPDGTLEFVGRA

SEQ ID NO: 629079 - protein, 21 aa, Mycobacterium
AEKGDLIALGLANRQFHFLTF

SEQ ID NO: 629080 - protein, 19 aa, Mycobacterium
AEKGRRRWEAVAQAASRQS

SEQ ID NO: 629081 - protein, 26 aa, Mycobacterium
AEKIGPALEDWAKWGQARHDYFLRAA

SEQ ID NO: 629082 - protein, 26 aa, Mycobacterium
AEKIGPALEDWAKWGQARHDYFLRAS

SEQ ID NO: 629083 - protein, 24 aa, Mycobacterium
AEKLATLRPVFGVKAGDATMTAGN

SEQ ID NO: 629084 - protein, 20 aa, Mycobacterium
AEKLAYFPLWSYATEPAIEL

SEQ ID NO: 629085 - protein, 24 aa, Mycobacterium
AEKPRGRRKTAIGYVVSDKMQKTI

SEQ ID NO: 629086 - protein, 17 aa, Mycobacterium
AEKRAALDVVKKRLESV

SEQ ID NO: 629087 - protein, 23 aa, Mycobacterium
AEKRLAPHALEWDETHHFPVDVL

SEQ ID NO: 629088 - protein, 22 aa, Mycobacterium
AEKRLAPYALEWDASNHFPVDV

SEQ ID NO: 629089 - protein, 19 aa, Mycobacterium
AEKWFGAAASLVINNAGIG

SEQ ID NO: 629090 - protein, 18 aa, Mycobacterium
AELAAAEPYQEWLEQGLF

SEQ ID NO: 629091 - protein, 17 aa, Mycobacterium
AELAAAEPYQRWLEEGL

SEQ ID NO: 629092 - protein, 23 aa, Mycobacterium
AELAAAGWGGRWLVVDADVDPGA

SEQ ID NO: 629093 - protein, 17 aa, Mycobacterium
AELAAEWEDTVSAAYAV

SEQ ID NO: 629094 - protein, 25 aa, Mycobacterium
AELAARLDIPVSRFVDLPTGSDAFS

SEQ ID NO: 629095 - protein, 22 aa, Mycobacterium
AELAARVAAVVRPDAVISRDEI

SEQ ID NO: 629096 - protein, 19 aa, Mycobacterium
AELAASLIKRAAERDPRGP

SEQ ID NO: 629097 - protein, 20 aa, Mycobacterium
AELADRFATIAARVLGPGDE

SEQ ID NO: 629098 - protein, 23 aa, Mycobacterium
AELADRFATTAARVLGPGDDMIK

SEQ ID NO: 629099 - protein, 24 aa, Mycobacterium
AELAEAASRCTARVAEHTAQLEGE

SEQ ID NO: 629100 - protein, 17 aa, Mycobacterium
AELAEDFVAAGPAPYSV

SEQ ID NO: 629101 - protein, 21 aa, Mycobacterium
AELAEICGHIASLPLDRSRPL

SEQ ID NO: 629102 - protein, 24 aa, Mycobacterium
AELAETIAGITLVALLTRPTELDD

SEQ ID NO: 629103 - protein, 19 aa, Mycobacterium
AELAEWLSKGCESEFVDPF

SEQ ID NO: 629104 - protein, 24 aa, Mycobacterium
AELAGRSRPRIALAAPTGKAAARL

SEQ ID NO: 629105 - protein, 17 aa, Mycobacterium
AELAGRVLRELNLADPL

SEQ ID NO: 629106 - protein, 19 aa, Mycobacterium
AELAGVAAEFGVPMHSDAV

SEQ ID NO: 629107 - protein, 20 aa, Mycobacterium
AELAKLVPIDHLFFGSDYPH

SEQ ID NO: 629108 - protein, 17 aa, Mycobacterium
AELAKQFQVAHGREPTT

SEQ ID NO: 629109 - protein, 24 aa, Mycobacterium
AELANLRLAFRWTADNNDLDDAAS

SEQ ID NO: 629110 - protein, 17 aa, Mycobacterium
AELAPWMGVRDAVEHGP

SEQ ID NO: 629111 - protein, 18 aa, Mycobacterium
AELARLAGRLDDATAQRH

SEQ ID NO: 629112 - protein, 17 aa, Mycobacterium
AELARLAGRLDDATARR

SEQ ID NO: 629113 - protein, 18 aa, Mycobacterium
AELARLDLGSVLIPMPEA

SEQ ID NO: 629114 - protein, 18 aa, Mycobacterium
AELARLDLGSVLIPMPTA

SEQ ID NO: 629115 - protein, 17 aa, Mycobacterium
AELARRAAGLAVAGVGV

SEQ ID NO: 629116 - protein, 20 aa, Mycobacterium
AELARRGLGGVRVLHGGMKR

SEQ ID NO: 629117 - protein, 25 aa, Mycobacterium
AELARSNGWAGLIINGAVRDSAALR

SEQ ID NO: 629118 - protein, 26 aa, Mycobacterium
AELARSNGWAGLVVHGAVRDSAALRG

SEQ ID NO: 629119 - protein, 26 aa, Mycobacterium
AELARSNGWAGLVVHGAVRDSVTLRG

SEQ ID NO: 629120 - protein, 25 aa, Mycobacterium
AELARSNGWAGLVVNGAVRDAAALR

SEQ ID NO: 629121 - protein, 25 aa, Mycobacterium
AELAWSTFIGAHWQVRSKPNVPIVL

SEQ ID NO: 629122 - protein, 30 aa, Mycobacterium
AELAYACDIRIAGAGARFGNPEPGLGILAA

SEQ ID NO: 629123 - protein, 18 aa, Mycobacterium
AELAYHYFECAWAGNAAK

SEQ ID NO: 629124 - protein, 20 aa, Mycobacterium
AELCAAGMEGVVFVGVPRTM

SEQ ID NO: 629125 - protein, 23 aa, Mycobacterium
AELCARFGVPPIDFDGHSDALLH

SEQ ID NO: 629126 - protein, 18 aa, Mycobacterium
AELCDLDNVVLLPHIGSA

SEQ ID NO: 629127 - protein, 27 aa, Mycobacterium
AELCRRAIPRMLRRGAGHIVNVSSMGG

SEQ ID NO: 629128 - protein, 23 aa, Mycobacterium
AELDAACREIGFFQIRNHGISED

SEQ ID NO: 629129 - protein, 23 aa, Mycobacterium
AELDAFWALLRPAGIDFMLGEWK

SEQ ID NO: 629130 - protein, 19 aa, Mycobacterium
AELDAGVPARGLHGEAYRG

SEQ ID NO: 629131 - protein, 22 aa, Mycobacterium
AELDELTHYFAPRGEEETPEQF

SEQ ID NO: 629132 - protein, 19 aa, Mycobacterium
AELDPYLAVDVLDTGITAD

SEQ ID NO: 629133 - protein, 28 aa, Mycobacterium
AELDRAWRHLPFEAEWHSANELARHRAM

SEQ ID NO: 629134 - protein, 21 aa, Mycobacterium
AELDRLCELSFEVLTIPERLR

SEQ ID NO: 629135 - protein, 22 aa, Mycobacterium
AELDRLGLPAAVLDRSLGELSG

SEQ ID NO: 629136 - protein, 21 aa, Mycobacterium
AELDSGPSWQEIPATNMWNGV

SEQ ID NO: 629137 - protein, 24 aa, Mycobacterium
AELEALLRGYGYRPITVAGDDPAD

SEQ ID NO: 629138 - protein, 23 aa, Mycobacterium
AELEAVLARGAERAREVSGQTLR

SEQ ID NO: 629139 - protein, 17 aa, Mycobacterium
AELEAVSGWAAKQPTVW

SEQ ID NO: 629140 - protein, 25 aa, Mycobacterium
AELEGGASFRRLLGPLVERSDDVVA

SEQ ID NO: 629141 - protein, 19 aa, Mycobacterium
AELEGRLAAIKATDPATLI

SEQ ID NO: 629142 - protein, 22 aa, Mycobacterium
AELEQIWRGRIARIDQLISSEP

SEQ ID NO: 629143 - protein, 18 aa, Mycobacterium
AELERAWQHLPFAAQWHS

SEQ ID NO: 629144 - protein, 22 aa, Mycobacterium
AELERVLARSAGILGIELGGDA

SEQ ID NO: 629145 - protein, 23 aa, Mycobacterium
AELFRSTMGWPFDPAEVNARIAG

SEQ ID NO: 629146 - protein, 17 aa, Mycobacterium
AELGAFLRTVPRDTVTV

SEQ ID NO: 629147 - protein, 18 aa, Mycobacterium
AELGAKFGVMDSGAAQGR

SEQ ID NO: 629148 - protein, 22 aa, Mycobacterium
AELGDKLLDMWTGTHHRGVQLN

SEQ ID NO: 629149 - protein, 17 aa, Mycobacterium
AELGDKLVDMWTGTHHR

SEQ ID NO: 629150 - protein, 17 aa, Mycobacterium
AELGDKLVDMWTGTNHR

SEQ ID NO: 629151 - protein, 30 aa, Mycobacterium
AELGELKRPFGIGVIDWVIRKEPELLTTAL

SEQ ID NO: 629152 - protein, 21 aa, Mycobacterium
AELGERALICAGWSDFSDVPL

SEQ ID NO: 629153 - protein, 26 aa, Mycobacterium
AELGEWLHPFEKFWRARLARLAEVAE

SEQ ID NO: 629154 - protein, 20 aa, Mycobacterium
AELGEWLHPFEKLWRDKLSA

SEQ ID NO: 629155 - protein, 17 aa, Mycobacterium
AELGEWTGHDVPDFEKH

SEQ ID NO: 629156 - protein, 25 aa, Mycobacterium
AELGLKPLVRLVSWGSAGVAPDLMG

SEQ ID NO: 629157 - protein, 22 aa, Mycobacterium
AELGLPVVVRPSFTMGGLGSGM

SEQ ID NO: 629158 - protein, 17 aa, Mycobacterium
AELGRLDIIVANAGVTA

SEQ ID NO: 629159 - protein, 18 aa, Mycobacterium
AELGRLSSPIGLDLGART

SEQ ID NO: 629160 - protein, 24 aa, Mycobacterium
AELGRSHIAWTIVRPPKLTNKPLT

SEQ ID NO: 629161 - protein, 25 aa, Mycobacterium
AELGRSNGWSGLIINGAVRDASTLR

SEQ ID NO: 629162 - protein, 17 aa, Mycobacterium
AELGWERNIAALAARYR

SEQ ID NO: 629163 - protein, 18 aa, Mycobacterium
AELGWVCLAIDYRVAPHH

SEQ ID NO: 629164 - protein, 18 aa, Mycobacterium
AELGYFLDCSYRMHPAVC

SEQ ID NO: 629165 - protein, 27 aa, Mycobacterium
AELGYRVRRLAGRVVWLAPPDAPTPAQ

SEQ ID NO: 629166 - protein, 18 aa, Mycobacterium
AELGYTPEQLELFRVSGA

SEQ ID NO: 629167 - protein, 17 aa, Mycobacterium
AELHAHSAYSFLDGAST

SEQ ID NO: 629168 - protein, 32 aa, Mycobacterium
AELHFLGAALWRTGIHRVLREFVLDDDWSERD

SEQ ID NO: 629169 - protein, 21 aa, Mycobacterium
AELHPNSAVVLVFVKQKTASK

SEQ ID NO: 629170 - protein, 28 aa, Mycobacterium
AELHTAAACYRSVIAGLTTGRWLGPSSL

SEQ ID NO: 629171 - protein, 28 aa, Mycobacterium
AELHYLGAALWRRGIHRVLHGFVQSGDW

SEQ ID NO: 629172 - protein, 20 aa, Mycobacterium
AELIAAAGGDPWAVNHSLQA

SEQ ID NO: 629173 - protein, 24 aa, Mycobacterium
AELIAAKWGFSRTELDEFSAGSHE

SEQ ID NO: 629174 - protein, 26 aa, Mycobacterium
AELIAARWGFSRAQLDEFAATSHEKA

SEQ ID NO: 629175 - protein, 26 aa, Mycobacterium
AELIAARWGFSRTQLDEFSARSHDKA

SEQ ID NO: 629176 - protein, 24 aa, Mycobacterium
AELIAARWGLSRTQLDEFSAASHD

SEQ ID NO: 629177 - protein, 24 aa, Mycobacterium
AELIARGATIRFVHAEGLGDEPRY

SEQ ID NO: 629178 - protein, 20 aa, Mycobacterium
AELIEYCRAHLAGYKCPRTV

SEQ ID NO: 629179 - protein, 20 aa, Mycobacterium
AELIGPRESLRFGSGPDADV

SEQ ID NO: 629180 - protein, 28 aa, Mycobacterium
AELIPSLGPELVRACGVRSGDRVLDVAA

SEQ ID NO: 629181 - protein, 22 aa, Mycobacterium
AELITIAHYWKQWADPRLVVAV

SEQ ID NO: 629182 - protein, 20 aa, Mycobacterium
AELIVEPMLAKSVAAEATIS

SEQ ID NO: 629183 - protein, 17 aa, Mycobacterium
AELKAHGLLAARSAPTF

SEQ ID NO: 629184 - protein, 33 aa, Mycobacterium
AELKITEKLLQPWGIVHGGVYCSIVESLASVSG

SEQ ID NO: 629185 - protein, 17 aa, Mycobacterium
AELKQGSTHLVRDLAVA

SEQ ID NO: 629186 - protein, 20 aa, Mycobacterium
AELKRFAGCVGDGNRDPRLA

SEQ ID NO: 629187 - protein, 19 aa, Mycobacterium
AELKRIWTDRAYRRRGYAR

SEQ ID NO: 629188 - protein, 23 aa, Mycobacterium
AELKTALWELIWAGWVTGDTFAP

SEQ ID NO: 629189 - protein, 20 aa, Mycobacterium
AELLAHLALPIPSVVTPQMF

SEQ ID NO: 629190 - protein, 17 aa, Mycobacterium
AELLALAAEGFGLSRQH

SEQ ID NO: 629191 - protein, 19 aa, Mycobacterium
AELLAWAGVHPDYASLPED

SEQ ID NO: 629192 - protein, 19 aa, Mycobacterium
AELLAWAGVHPDYTSLSEP

SEQ ID NO: 629193 - protein, 34 aa, Mycobacterium
AELLAWLRNRLSHFKCPKAIAFEVQLPRTDTGKL

SEQ ID NO: 629194 - protein, 18 aa, Mycobacterium
AELLCELGAGVVVNGRDA

SEQ ID NO: 629195 - protein, 21 aa, Mycobacterium
AELLCGGDPFGPTGLALPPHV

SEQ ID NO: 629196 - protein, 26 aa, Mycobacterium
AELLDFCAARMPYFCVPRYVETVDEL

SEQ ID NO: 629197 - protein, 18 aa, Mycobacterium
AELLDLMLDSVYGQMSRG

SEQ ID NO: 629198 - protein, 33 aa, Mycobacterium
AELLDLRPGQTRWRLAVEKVLRGVGLRLLVPDQ

SEQ ID NO: 629199 - protein, 27 aa, Mycobacterium
AELLDRLSAREAFGRAAEPWEVAATIA

SEQ ID NO: 629200 - protein, 20 aa, Mycobacterium
AELLDTIAYEVVTGPRGRVV

SEQ ID NO: 629201 - protein, 18 aa, Mycobacterium
AELLEIRAALGPLIGRLA

SEQ ID NO: 629202 - protein, 26 aa, Mycobacterium
AELLGRPVPFTAIEFAGPAPASGDAL

SEQ ID NO: 629203 - protein, 20 aa, Mycobacterium
AELLGTIGAVLDRPLQYHEI

SEQ ID NO: 629204 - protein, 19 aa, Mycobacterium
AELLHKCMNDIQQSVLSLY

SEQ ID NO: 629205 - protein, 19 aa, Mycobacterium
AELLHRMRPPDGYRDDVVV

SEQ ID NO: 629206 - protein, 20 aa, Mycobacterium
AELLPELTLAQKWDLTANEL

SEQ ID NO: 629207 - protein, 19 aa, Mycobacterium
AELLRACGDIDGLERVRFT

SEQ ID NO: 629208 - protein, 18 aa, Mycobacterium
AELLRQQLILAIDGELDV

SEQ ID NO: 629209 - protein, 20 aa, Mycobacterium
AELLSAAGLAVPADEVITAA

SEQ ID NO: 629210 - protein, 20 aa, Mycobacterium
AELLSRLAARGFRRAFAAIA

SEQ ID NO: 629211 - protein, 24 aa, Mycobacterium
AELLTAAGIAAEWCNEPNLVHGYV

SEQ ID NO: 629212 - protein, 17 aa, Mycobacterium
AELLTIALTHRSYSYEN

SEQ ID NO: 629213 - protein, 28 aa, Mycobacterium
AELLVGVDEIVEWRAPWVDFEAPELTAS

SEQ ID NO: 629214 - protein, 20 aa, Mycobacterium
AELMAAVFAEHGATEVFSTT

SEQ ID NO: 629215 - protein, 23 aa, Mycobacterium
AELMDRWAPDRVMINAYGATELW

SEQ ID NO: 629216 - protein, 17 aa, Mycobacterium
AELMNRKGIRREDTVVI

SEQ ID NO: 629217 - protein, 22 aa, Mycobacterium
AELMPAHDSMLFAVPDSIPDEA

SEQ ID NO: 629218 - protein, 20 aa, Mycobacterium
AELMRLFAAGVLKPLPVRAF

SEQ ID NO: 629219 - protein, 24 aa, Mycobacterium
AELMRRLTAPTGRSVQMSDEQYHA

SEQ ID NO: 629220 - protein, 20 aa, Mycobacterium
AELNAMLGMERAKREIKLIK

SEQ ID NO: 629221 - protein, 20 aa, Mycobacterium
AELNEIYKLGVVSIPTNRPM

SEQ ID NO: 629222 - protein, 27 aa, Mycobacterium
AELNLGKLLTKRARVIGTTLRARPLQG

SEQ ID NO: 629223 - protein, 27 aa, Mycobacterium
AELNPYLGVRGIRLSLAHPDVFSDQLL

SEQ ID NO: 629224 - protein, 18 aa, Mycobacterium
AELNWQLRGKADKRQVAG

SEQ ID NO: 629225 - protein, 25 aa, Mycobacterium
AELPADRPTLFIGEGLTMYLKKDDG

SEQ ID NO: 629226 - protein, 19 aa, Mycobacterium
AELPAKVGAMRAHATQITV

SEQ ID NO: 629227 - protein, 25 aa, Mycobacterium
AELPEPRPRFEIFVYSPRVEGVHLR

SEQ ID NO: 629228 - protein, 19 aa, Mycobacterium
AELPPGLTVTPIEADEKQV

SEQ ID NO: 629229 - protein, 17 aa, Mycobacterium
AELPPGVCGQWRQYTDR

SEQ ID NO: 629230 - protein, 22 aa, Mycobacterium
AELPQTLPNFFGDVDKANQAVM

SEQ ID NO: 629231 - protein, 17 aa, Mycobacterium
AELPRIARMGFDVVYLP

SEQ ID NO: 629232 - protein, 25 aa, Mycobacterium
AELPRLPRTALIDVLLRCPPRTRSA

SEQ ID NO: 629233 - protein, 27 aa, Mycobacterium
AELPTPWPREVLDDLLVVLLAGPTAVV

SEQ ID NO: 629234 - protein, 20 aa, Mycobacterium
AELPYGAAITASGRVSAVTE

SEQ ID NO: 629235 - protein, 25 aa, Mycobacterium
AELQIRWPNVPMVFCETRQLAQEWT

SEQ ID NO: 629236 - protein, 18 aa, Mycobacterium
AELQIVFHTLLRRIPTLK

SEQ ID NO: 629237 - protein, 18 aa, Mycobacterium
AELQIVFHTLLRRIPTLR

SEQ ID NO: 629238 - protein, 25 aa, Mycobacterium
AELQQRLKVANAMREDAAQSPGWEA

SEQ ID NO: 629239 - protein, 17 aa, Mycobacterium
AELQQRVGALARKHNAT

SEQ ID NO: 629240 - protein, 17 aa, Mycobacterium
AELQQRVRAVAGAHNAT

SEQ ID NO: 629241 - protein, 17 aa, Mycobacterium
AELQRRLWAVSEELTGV

SEQ ID NO: 629242 - protein, 19 aa, Mycobacterium
AELQVRWHSVPIVFCETRP

SEQ ID NO: 629243 - protein, 27 aa, Mycobacterium
AELRAAGLSYLCWSRHAVDDAENRAIM

SEQ ID NO: 629244 - protein, 21 aa, Mycobacterium
AELRAALAKRLPPYMVPAALV

SEQ ID NO: 629245 - protein, 21 aa, Mycobacterium
AELRAGAARRARSVGPEARPV

SEQ ID NO: 629246 - protein, 19 aa, Mycobacterium
AELRARFDGSGVSVVQFDD

SEQ ID NO: 629247 - protein, 27 aa, Mycobacterium
AELRDRMCADAVAFARHIGYSCAGTVE

SEQ ID NO: 629248 - protein, 20 aa, Mycobacterium
AELRDSAALAELRKLAKRGP

SEQ ID NO: 629249 - protein, 23 aa, Mycobacterium
AELRDWVGALVRPLTDHLSALGI

SEQ ID NO: 629250 - protein, 17 aa, Mycobacterium
AELRELLDVSARSVNDF

SEQ ID NO: 629251 - protein, 20 aa, Mycobacterium
AELRESGYLRGRQGARSTTA

SEQ ID NO: 629252 - protein, 22 aa, Mycobacterium
AELRFAEAIPDPVRRFYRETHA

SEQ ID NO: 629253 - protein, 24 aa, Mycobacterium
AELRGRILQGRMLLHAVARQVDTN

SEQ ID NO: 629254 - protein, 21 aa, Mycobacterium
AELRGSGLQADFRFLDVTDAE

SEQ ID NO: 629255 - protein, 25 aa, Mycobacterium
AELRHAWLDLHESWLMAKAAEIGID

SEQ ID NO: 629256 - protein, 23 aa, Mycobacterium
AELRIGESYSRIAGVEHRVENRG

SEQ ID NO: 629257 - protein, 28 aa, Mycobacterium
AELRIKLDRPAYVYPLFEQALRIANGES

SEQ ID NO: 629258 - protein, 34 aa, Mycobacterium
AELRKFLADRVVRWWLPERWAFADQVPRTSVGKY

SEQ ID NO: 629259 - protein, 17 aa, Mycobacterium
AELRLLRGMPSVFVPSA

SEQ ID NO: 629260 - protein, 21 aa, Mycobacterium
AELRLPVFAAQTTRAILPRLF

SEQ ID NO: 629261 - protein, 21 aa, Mycobacterium
AELRLRNLLKPEQFPYTTKTG

SEQ ID NO: 629262 - protein, 32 aa, Mycobacterium
AELRLWEALEQHLLCPFHYFGVHDAVDLGDLQ

SEQ ID NO: 629263 - protein, 20 aa, Mycobacterium
AELRPRVAVVQLGGAVGSLA

SEQ ID NO: 629264 - protein, 24 aa, Mycobacterium
AELRPVDRTMAFALLIGPLAFGRI

SEQ ID NO: 629265 - protein, 26 aa, Mycobacterium
AELRQAWLDLHESWLIAKAAQIGIAD

SEQ ID NO: 629266 - protein, 21 aa, Mycobacterium
AELRQAWLDLHESWLTAKAAE

SEQ ID NO: 629267 - protein, 19 aa, Mycobacterium
AELRRFVAGWLGPAILYPR

SEQ ID NO: 629268 - protein, 17 aa, Mycobacterium
AELRRGRRYSVARRLAG

SEQ ID NO: 629269 - protein, 17 aa, Mycobacterium
AELRRLGTPVVDQVAPM

SEQ ID NO: 629270 - protein, 19 aa, Mycobacterium
AELRRRIDVPIAADESIRK

SEQ ID NO: 629271 - protein, 20 aa, Mycobacterium
AELRRTAPIWWNEQPLGAGG

SEQ ID NO: 629272 - protein, 17 aa, Mycobacterium
AELRRVAALGGVPVLFG

SEQ ID NO: 629273 - protein, 17 aa, Mycobacterium
AELRRVLDAAGISGLRL

SEQ ID NO: 629274 - protein, 29 aa, Mycobacterium
AELRSGRKRTHWMWFVFPQLRGLGHSPMA

SEQ ID NO: 629275 - protein, 19 aa, Mycobacterium
AELRSHVALTLDATAAPRE

SEQ ID NO: 629276 - protein, 22 aa, Mycobacterium
AELRTGGARRARAPGLEARPLP

SEQ ID NO: 629277 - protein, 20 aa, Mycobacterium
AELRTLLADRLPAYMVPAAV

SEQ ID NO: 629278 - protein, 20 aa, Mycobacterium
AELRVIPGIYGHFAGGDANP

SEQ ID NO: 629279 - protein, 17 aa, Mycobacterium
AELRYAQRYRTPRVNPK

SEQ ID NO: 629280 - protein, 28 aa, Mycobacterium
AELSCGPYRFVYRKRFHKKCETELTIQA

SEQ ID NO: 629281 - protein, 20 aa, Mycobacterium
AELSDAAWLQAMLDAEAALA

SEQ ID NO: 629282 - protein, 24 aa, Mycobacterium
AELSIPAEAAAAVGPPRASQPKRR

SEQ ID NO: 629283 - protein, 18 aa, Mycobacterium
AELSKWIDRGEYGAILSG

SEQ ID NO: 629284 - protein, 21 aa, Mycobacterium
AELSMPLILLGGITNRETMDL

SEQ ID NO: 629285 - protein, 20 aa, Mycobacterium
AELSRALGLFEPTEEQAAVI

SEQ ID NO: 629286 - protein, 19 aa, Mycobacterium
AELSRLAARFTGVLRALGI

SEQ ID NO: 629287 - protein, 17 aa, Mycobacterium
AELSRRGHDVLVQAGAG

SEQ ID NO: 629288 - protein, 17 aa, Mycobacterium
AELSRRITATGVTGVTD

SEQ ID NO: 629289 - protein, 21 aa, Mycobacterium
AELSSAALVRNAAFEFAQLTL

SEQ ID NO: 629290 - protein, 25 aa, Mycobacterium
AELTARCRRWPRASGVCDDVLRGVN

SEQ ID NO: 629291 - protein, 17 aa, Mycobacterium
AELTDAVTEHWGPPPGE

SEQ ID NO: 629292 - protein, 29 aa, Mycobacterium
AELTEAVTRHWGPPPGELFVDRANDPDGE

SEQ ID NO: 629293 - protein, 17 aa, Mycobacterium
AELTELLLEAGFAEVTM

SEQ ID NO: 629294 - protein, 23 aa, Mycobacterium
AELTEPTAWLFGPEAHGLSTDLA

SEQ ID NO: 629295 - protein, 30 aa, Mycobacterium
AELTEVANLLRWLVDGNFTLLGYQRCTVEN

SEQ ID NO: 629296 - protein, 17 aa, Mycobacterium
AELTKKVGTIEMFTATT

SEQ ID NO: 629297 - protein, 20 aa, Mycobacterium
AELTLAYILGVLLIGAPGWQ

SEQ ID NO: 629298 - protein, 20 aa, Mycobacterium
AELTLAYILGVLLIGSAGWQ

SEQ ID NO: 629299 - protein, 17 aa, Mycobacterium
AELTMLILGRDRMKHPE

SEQ ID NO: 629300 - protein, 17 aa, Mycobacterium
AELTMLILGRDRMKNPE

SEQ ID NO: 629301 - protein, 21 aa, Mycobacterium
AELTMPLILLGGITNRDTMDL

SEQ ID NO: 629302 - protein, 18 aa, Mycobacterium
AELTPGYVTDLFSSFYPM

SEQ ID NO: 629303 - protein, 18 aa, Mycobacterium
AELTPGYVTDLFSSYYPM

SEQ ID NO: 629304 - protein, 21 aa, Mycobacterium
AELTRRAIIDAARELFAQRGY

SEQ ID NO: 629305 - protein, 26 aa, Mycobacterium
AELTRRGAWSRCVQTIGVLDAAAALS

SEQ ID NO: 629306 - protein, 18 aa, Mycobacterium
AELTWQLRGAADKRQVDR

SEQ ID NO: 629307 - protein, 17 aa, Mycobacterium
AELTWQLRGTAEARQVD

SEQ ID NO: 629308 - protein, 29 aa, Mycobacterium
AELTYACPLHCPYCSNPVALQNYRDELST

SEQ ID NO: 629309 - protein, 20 aa, Mycobacterium
AELVAAGLRRTRWWTDDGGD

SEQ ID NO: 629310 - protein, 26 aa, Mycobacterium
AELVARVKALLRRRGAVATSSTETIT

SEQ ID NO: 629311 - protein, 26 aa, Mycobacterium
AELVARVKALLRRRGSSATFSSETIQ

SEQ ID NO: 629312 - protein, 26 aa, Mycobacterium
AELVARVKALLRRRGSTATFSSETIT

SEQ ID NO: 629313 - protein, 26 aa, Mycobacterium
AELVARVKALLRRRGSTATSSSETIT

SEQ ID NO: 629314 - protein, 18 aa, Mycobacterium
AELVDDFAGLKVAIVADR

SEQ ID NO: 629315 - protein, 23 aa, Mycobacterium
AELVDRWAPGRAMVNQFGPTETM

SEQ ID NO: 629316 - protein, 17 aa, Mycobacterium
AELVGDFTFEFPTRVIA

SEQ ID NO: 629317 - protein, 18 aa, Mycobacterium
AELVHGWHGARQAANLAG

SEQ ID NO: 629318 - protein, 20 aa, Mycobacterium
AELVKLSFFLNVSIDEIVAS

SEQ ID NO: 629319 - protein, 20 aa, Mycobacterium
AELVPRYLDRDAIAVIEGDG

SEQ ID NO: 629320 - protein, 19 aa, Mycobacterium
AELVRRLRAAGAVIVGKTN

SEQ ID NO: 629321 - protein, 19 aa, Mycobacterium
AELVVFPEATMCRFGVPLA

SEQ ID NO: 629322 - protein, 18 aa, Mycobacterium
AELVWLGAAMIIGAGSTS

SEQ ID NO: 629323 - protein, 17 aa, Mycobacterium
AELWERCGSDPVALLGA

SEQ ID NO: 629324 - protein, 18 aa, Mycobacterium
AELWPEITRGFGNPYAGY

SEQ ID NO: 629325 - protein, 34 aa, Mycobacterium
AELWRNEDLEVWKSWARWRVIRARASWLTDELVA

SEQ ID NO: 629326 - protein, 34 aa, Mycobacterium
AELWRSEDLEVWKSWARWRVIRARAAWLTDEVVA

SEQ ID NO: 629327 - protein, 22 aa, Mycobacterium
AELYLDVLQRFARRFDNPMPYI

SEQ ID NO: 629328 - protein, 25 aa, Mycobacterium
AELYLRDIPPFFALTDSNNTVAGHI

SEQ ID NO: 629329 - protein, 22 aa, Mycobacterium
AELYRAAIEMAAFADGIGVDNI

SEQ ID NO: 629330 - protein, 18 aa, Mycobacterium
AELYRQWSAPQHDRNRDI

SEQ ID NO: 629331 - protein, 27 aa, Mycobacterium
AELYWQQIAGFGRRHLAGAAGLDRIAA

SEQ ID NO: 629332 - protein, 20 aa, Mycobacterium
AEMAARVGISKAMMSKIENA

SEQ ID NO: 629333 - protein, 31 aa, Mycobacterium; identical to SEQ ID NO: 86678

SEQ ID NO: 629334 - protein, 24 aa, Mycobacterium
AEMARRIDVARVYSRHVVERQLAG

SEQ ID NO: 629335 - protein, 25 aa, Mycobacterium
AEMARRIDVARVYSRHVVERQLAGE

SEQ ID NO: 629336 - protein, 21 aa, Mycobacterium
AEMARRIDVARVYSRNVVERQ

SEQ ID NO: 629337 - protein, 22 aa, Mycobacterium
AEMARRIDVARVYSRSVVERQL

SEQ ID NO: 629338 - protein, 21 aa, Mycobacterium
AEMARRIDVARVYTHALVDRA

SEQ ID NO: 629339 - protein, 22 aa, Mycobacterium
AEMARRIDVARVYTRHVVERQL

SEQ ID NO: 629340 - protein, 17 aa, Mycobacterium
AEMARWLSDAGIGYLHL

SEQ ID NO: 629341 - protein, 24 aa, Mycobacterium
AEMAWRILKFRPREDSGATASVPQ

SEQ ID NO: 629342 - protein, 17 aa, Mycobacterium
AEMEDAFGFTETIDQLT

SEQ ID NO: 629343 - protein, 18 aa, Mycobacterium
AEMEDAFGFTETVDQLTA

SEQ ID NO: 629344 - protein, 19 aa, Mycobacterium
AEMEDAFGFTETVDQLTAI

SEQ ID NO: 629345 - protein, 24 aa, Mycobacterium
AEMERRFTPNWALLSAGAERELDR

SEQ ID NO: 629346 - protein, 29 aa, Mycobacterium
AEMFAHGVARAGYLEVPRDPDLAYEFLPV

SEQ ID NO: 629347 - protein, 24 aa, Mycobacterium
AEMFPRSRESILAAYQAGVKIAIG

SEQ ID NO: 629348 - protein, 17 aa, Mycobacterium
AEMGDPWAGIDDAVGHL

SEQ ID NO: 629349 - protein, 24 aa, Mycobacterium
AEMGRAAVELAHCAQEVVMTRNTE

SEQ ID NO: 629350 - protein, 26 aa, Mycobacterium
AEMGRPRWKHAFGYLAGPNGPEPDPA

SEQ ID NO: 629351 - protein, 17 aa, Mycobacterium
AEMGRVAVDLGNSAQEV

SEQ ID NO: 629352 - protein, 18 aa, Mycobacterium
AEMGRVAVELGHSAQEVL

SEQ ID NO: 629353 - protein, 18 aa, Mycobacterium
AEMGWVCLSVEYRVAPHN

SEQ ID NO: 629354 - protein, 21 aa, Mycobacterium
AEMHARISGLADYFAQDELDA

SEQ ID NO: 629355 - protein, 20 aa, Mycobacterium
AEMHTRSGLIEEVKASTVDL

SEQ ID NO: 629356 - protein, 19 aa, Mycobacterium
AEMICPYPPGIPVVAPGEL

SEQ ID NO: 629357 - protein, 19 aa, Mycobacterium
AEMKARDFVALVSSGVHAE

SEQ ID NO: 629358 - protein, 21 aa, Mycobacterium
AEMLCDGRLVAVLEGGYDLQA

SEQ ID NO: 629359 - protein, 17 aa, Mycobacterium
AEMLRRNGIPCDEVRKH

SEQ ID NO: 629360 - protein, 17 aa, Mycobacterium
AEMLVPVETAFRQLAPR

SEQ ID NO: 629361 - protein, 23 aa, Mycobacterium
AEMMDRFIHVFASWLGVQPQRVE

SEQ ID NO: 629362 - protein, 20 aa, Mycobacterium
AEMMIDLFWRGLKGAPSDRE

SEQ ID NO: 629363 - protein, 22 aa, Mycobacterium
AEMMPPERVVLITTGTQGEPMS

SEQ ID NO: 629364 - protein, 17 aa, Mycobacterium
AEMNCKLLLEIGPRPVL

SEQ ID NO: 629365 - protein, 24 aa, Mycobacterium
AEMNRRCTPRDPIYPLVDFLTRSA

SEQ ID NO: 629366 - protein, 24 aa, Mycobacterium
AEMPAEPPAGVPLAPPDREVWGGM

SEQ ID NO: 629367 - protein, 18 aa, Mycobacterium
AEMRALFEGAGFTISDQH

SEQ ID NO: 629368 - protein, 22 aa, Mycobacterium
AEMRARYRLGNRPVVACVSRLV

SEQ ID NO: 629369 - protein, 18 aa, Mycobacterium
AEMRLMFETAGFEVTVQR

SEQ ID NO: 629370 - protein, 20 aa, Mycobacterium
AEMRRCAPIWWNEQPIGCGG

SEQ ID NO: 629371 - protein, 17 aa, Mycobacterium
AEMSGGNPFYALELAHT

SEQ ID NO: 629372 - protein, 19 aa, Mycobacterium
AEMSRLRRIVGGELIGSRP

SEQ ID NO: 629373 - protein, 26 aa, Mycobacterium
AEMTGRVEGKVAFVSGAARGQGRSHA

SEQ ID NO: 629374 - protein, 21 aa, Mycobacterium
AEMVRRLRAAGAVIIGKTNVP

SEQ ID NO: 629375 - protein, 17 aa, Mycobacterium
AEMWAQDAAAMYGYAAA

SEQ ID NO: 629376 - protein, 20 aa, Mycobacterium
AEMWAQDAAAMYGYAASSAT

SEQ ID NO: 629377 - protein, 21 aa, Mycobacterium
AEMWRRWIYDDYYRSYLLPLE

SEQ ID NO: 629378 - protein, 17 aa, Mycobacterium
AEMWRSRNKMMATGVQP

SEQ ID NO: 629379 - protein, 25 aa, Mycobacterium
AENALPRRGVSALVRRPKRRPLDEG

SEQ ID NO: 629380 - protein, 23 aa, Mycobacterium
AENAPRAGIRLHTHRNTVLQRVA

SEQ ID NO: 629381 - protein, 25 aa, Mycobacterium
AENGYAIRFFMPEKWTMETLPAPDD

SEQ ID NO: 629382 - protein, 19 aa, Mycobacterium
AENIFGFLAKEDFPGDTAL

SEQ ID NO: 629383 - protein, 17 aa, Mycobacterium
AENIFHLVLARPEGAGP

SEQ ID NO: 629384 - protein, 27 aa, Mycobacterium
AENKVMRRLVGMLARRGYHQSMALDVV

SEQ ID NO: 629385 - protein, 18 aa, Mycobacterium
AENLGRTIGPVAHDMGVQ

SEQ ID NO: 629386 - protein, 24 aa, Mycobacterium
AENLREHRKGLLVDLVTDVSVGGD

SEQ ID NO: 629387 - protein, 24 aa, Mycobacterium
AENLREHRKGLLVDLVTDVSVGND

SEQ ID NO: 629388 - protein, 23 aa, Mycobacterium
AENLRHTVRFAAAVQAALKDGFR

SEQ ID NO: 629389 - protein, 20 aa, Mycobacterium
AENLRRQYGISRLEQDELAV

SEQ ID NO: 629390 - protein, 21 aa, Mycobacterium
AENLRRQYGISRLEQDELAVT

SEQ ID NO: 629391 - protein, 18 aa, Mycobacterium
AENLRRQYGISRQEQDEL

SEQ ID NO: 629392 - protein, 23 aa, Mycobacterium
AENMARLLIVARERYHVFRHQQH

SEQ ID NO: 629393 - protein, 23 aa, Mycobacterium
AENMARLLLVARDRFHVYRHQQH

SEQ ID NO: 629394 - protein, 17 aa, Mycobacterium
AENPIFLEGVVRSIKDI

SEQ ID NO: 629395 - protein, 18 aa, Mycobacterium
AENPVAWVDQAPYRPFWA

SEQ ID NO: 629396 - protein, 26 aa, Mycobacterium
AENQLRFRAPKMLDLSLLVAALPEGY

SEQ ID NO: 629397 - protein, 21 aa, Mycobacterium
AENRGRLASLVATNLLGQNTA

SEQ ID NO: 629398 - protein, 19 aa, Mycobacterium
AENRLNHLLAQQIPPARKV

SEQ ID NO: 629399 - protein, 22 aa, Mycobacterium
AENTDALVRWRRHIHEHPELAR

SEQ ID NO: 629400 - protein, 23 aa, Mycobacterium
AENTRFVTAFARIGVSGDGGGTW

SEQ ID NO: 629401 - protein, 23 aa, Mycobacterium
AENVPLRRVEAFTQIAKNAGAQL

SEQ ID NO: 629402 - protein, 25 aa, Mycobacterium
AENYPLCKTYLWPALLDLADRRAGN

SEQ ID NO: 629403 - protein, 19 aa, Mycobacterium
AEPAAWFTYYYWLDDDRAP

SEQ ID NO: 629404 - protein, 21 aa, Mycobacterium
AEPAGRRWPLYGPAMLGKSIH

SEQ ID NO: 629405 - protein, 23 aa, Mycobacterium
AEPAKRLLSIDLLDADEHSQLDE

SEQ ID NO: 629406 - protein, 22 aa, Mycobacterium
AEPASIPKFFHVVDSIPVTAVG

SEQ ID NO: 629407 - protein, 19 aa, Mycobacterium
AEPASMVVSWVADILSEHG

SEQ ID NO: 629408 - protein, 25 aa, Mycobacterium
AEPATHPALLFRFSAVTANSHRIHY

SEQ ID NO: 629409 - protein, 26 aa, Mycobacterium
AEPDEPWMICELDLHQMLHVTAGTVL

SEQ ID NO: 629410 - protein, 23 aa, Mycobacterium
AEPDGTTMVLDWKTGDPPETPEA

SEQ ID NO: 629411 - protein, 25 aa, Mycobacterium
AEPDLAWQPPLWRALVARVDAVPPH

SEQ ID NO: 629412 - protein, 21 aa, Mycobacterium
AEPDLKCGRGGLRDVQLLNAL

SEQ ID NO: 629413 - protein, 22 aa, Mycobacterium
AEPDSGAGLSVFLMRRHSAMDF

SEQ ID NO: 629414 - protein, 23 aa, Mycobacterium
AEPDTAELLEWLDSQTKRNLVIT

SEQ ID NO: 629415 - protein, 27 aa, Mycobacterium
AEPELAGLPGRFLFGLDDGRGDISGLG

SEQ ID NO: 629416 - protein, 25 aa, Mycobacterium
AEPELRDLWLAIAERFISAGAAEIE

SEQ ID NO: 629417 - protein, 19 aa, Mycobacterium
AEPGLWVAHDRLGSDTLIY

SEQ ID NO: 629418 - protein, 21 aa, Mycobacterium
AEPGMVLTVRYHDTGDTETFL

SEQ ID NO: 629419 - protein, 25 aa, Mycobacterium
AEPGRAATVALHWDKIAAQRLGVVG

SEQ ID NO: 629420 - protein, 31 aa, Mycobacterium
AEPHLIRIGELMGGPVTRWAEETDRNPPQLE

SEQ ID NO: 629421 - protein, 23 aa, Mycobacterium
AEPIAVIGIGCRFPGADGPAAFW

SEQ ID NO: 629422 - protein, 20 aa, Mycobacterium
AEPIDMLRYSPHSWQRVTLF

SEQ ID NO: 629423 - protein, 21 aa, Mycobacterium
AEPKCAALRSAAKAEQRELQR

SEQ ID NO: 629424 - protein, 23 aa, Mycobacterium
AEPKGAYFPSRLVGDQLWISGTT

SEQ ID NO: 629425 - protein, 19 aa, Mycobacterium
AEPLASVPALPYPVIVAEA

SEQ ID NO: 629426 - protein, 20 aa, Mycobacterium
AEPLFSLFQAMPIPYIEPED

SEQ ID NO: 629427 - protein, 18 aa, Mycobacterium
AEPLGFDGIWLPEHCGTP

SEQ ID NO: 629428 - protein, 22 aa, Mycobacterium
AEPLGGPVFHAFPASRWRRYDK

SEQ ID NO: 629429 - protein, 17 aa, Mycobacterium
AEPLGVDGIHLGRPPAD

SEQ ID NO: 629430 - protein, 23 aa, Mycobacterium
AEPLHWLPAEDEWIWGRATVLAA

SEQ ID NO: 629431 - protein, 18 aa, Mycobacterium
AEPLRANTFDQFRKRFGD

SEQ ID NO: 629432 - protein, 18 aa, Mycobacterium
AEPMPLRTLAAITESAAV

SEQ ID NO: 629433 - protein, 23 aa, Mycobacterium
AEPNALWKLVPRPLVGSYSVRIR

SEQ ID NO: 629434 - protein, 21 aa, Mycobacterium
AEPPCPDLAALVSAHGPVEAA

SEQ ID NO: 629435 - protein, 21 aa, Mycobacterium
AEPPFAAPADRAPAPVEEPVE

SEQ ID NO: 629436 - protein, 21 aa, Mycobacterium
AEPPGDILVFLSGEREIRDTA

SEQ ID NO: 629437 - protein, 21 aa, Mycobacterium
AEPPGDVLVFLSGEREIRDTA

SEQ ID NO: 629438 - protein, 21 aa, Mycobacterium
AEPPGEFLLHGDLELLGVTRE

SEQ ID NO: 629439 - protein, 21 aa, Mycobacterium
AEPPHVHHIFCTRERTGYDDL

SEQ ID NO: 629440 - protein, 21 aa, Mycobacterium
AEPPPPRRVRIGGPPQPPGPP

SEQ ID NO: 629441 - protein, 22 aa, Mycobacterium
AEPRAKLSRRGLRWALEAIVCQ

SEQ ID NO: 629442 - protein, 22 aa, Mycobacterium
AEPRAKLSRRGLRWALEAIVCR

SEQ ID NO: 629443 - protein, 21 aa, Mycobacterium
AEPRCRVLTGVGAFDPGLGRK

SEQ ID NO: 629444 - protein, 23 aa, Mycobacterium
AEPRGRKGPWWDRSDTKWVAEAL

SEQ ID NO: 629445 - protein, 23 aa, Mycobacterium
AEPRGYCAGVDRAVETVERALEK

SEQ ID NO: 629446 - protein, 20 aa, Mycobacterium
AEPRIPVAEFVDAKLADGRL

SEQ ID NO: 629447 - protein, 17 aa, Mycobacterium
AEPRKSCPDERLGRPRV

SEQ ID NO: 629448 - protein, 22 aa, Mycobacterium
AEPRPCWGHPMYNPIWAAATKH

SEQ ID NO: 629449 - protein, 21 aa, Mycobacterium
AEPRPSWGDPKYDPLWAAATK

SEQ ID NO: 629450 - protein, 21 aa, Mycobacterium
AEPRRGVAIVSSPLVHIGGVF

SEQ ID NO: 629451 - protein, 21 aa, Mycobacterium
AEPRTYPVIARLSSTSGVRRS

SEQ ID NO: 629452 - protein, 19 aa, Mycobacterium
AEPRWLRFTPAGFDAGESG

SEQ ID NO: 629453 - protein, 17 aa, Mycobacterium
AEPRYRDRIPILIGGGG

SEQ ID NO: 629454 - protein, 25 aa, Mycobacterium
AEPRYRDRIPILIGGGGEKKTFAIA

SEQ ID NO: 629455 - protein, 23 aa, Mycobacterium
AEPRYTPSAGLADFVRCRDLTCR

SEQ ID NO: 629456 - protein, 23 aa, Mycobacterium
AEPSEIASAVIFLSSPDASYVNG

SEQ ID NO: 629457 - protein, 22 aa, Mycobacterium
AEPSERRLLIVLGDGLISDEGY

SEQ ID NO: 629458 - protein, 25 aa, Mycobacterium
AEPSQRLRMAVAYGSAAAALPGSAL

SEQ ID NO: 629459 - protein, 20 aa, Mycobacterium
AEPSRGGLLIHGHLDVVPAE

SEQ ID NO: 629460 - protein, 23 aa, Mycobacterium
AEPTAHGALHWAPHHDAGYGARM

SEQ ID NO: 629461 - protein, 20 aa, Mycobacterium
AEPTGVAAWQLAKLNLAKMT

SEQ ID NO: 629462 - protein, 22 aa, Mycobacterium
AEPTGVTAWELARMKLAKMTHQ

SEQ ID NO: 629463 - protein, 19 aa, Mycobacterium
AEPTIKLAARLGHLDQGRL

SEQ ID NO: 629464 - protein, 22 aa, Mycobacterium
AEPTLRIAVPIPNVRGEKRTAV

SEQ ID NO: 629465 - protein, 20 aa, Mycobacterium
AEPTPAPGWTIAHQIGHLLW

SEQ ID NO: 629466 - protein, 23 aa, Mycobacterium
AEPTRKLAVEWVGTGTVESWTTP

SEQ ID NO: 629467 - protein, 41 aa, Mycobacterium
AEPTTWAYYPWRRCVVHLVGPRAFHRLRLDRNRNLISADEQ

SEQ ID NO: 629468 - protein, 23 aa, Mycobacterium
AEPVAVVGIGCRFPGDATDPDSF

SEQ ID NO: 629469 - protein, 24 aa, Mycobacterium
AEPVAVVGIGCRFPGNVTGPDSFW

SEQ ID NO: 629470 - protein, 20 aa, Mycobacterium
AEPVFPLVQAMPVPYVEPED

SEQ ID NO: 629471 - protein, 25 aa, Mycobacterium
AEPVIRRIDVLAAQGHQGAQELATY

SEQ ID NO: 629472 - protein, 27 aa, Mycobacterium
AEPVLARSGARWMPNFIELLQHNLTRI

SEQ ID NO: 629473 - protein, 23 aa, Mycobacterium
AEPVSIPVVFAVQVERAPETVAL

SEQ ID NO: 629474 - protein, 19 aa, Mycobacterium
AEPWAYLIVGGVQLATHSW

SEQ ID NO: 629475 - protein, 26 aa, Mycobacterium
AEPWIPRSRSHVVTFPRDLTDRAEMD

SEQ ID NO: 629476 - protein, 19 aa, Mycobacterium
AEPYQEMMGPFAGVYAHCF

SEQ ID NO: 629477 - protein, 18 aa, Mycobacterium
AEQAALWAIDEAVSRDIP

SEQ ID NO: 629478 - protein, 26 aa, Mycobacterium
AEQAFGVFRARYDGVWSSGMRAKLGL

SEQ ID NO: 629479 - protein, 17 aa, Mycobacterium
AEQAYVAAAAYEAAFAM

SEQ ID NO: 629480 - protein, 24 aa, Mycobacterium
AEQCRGNCGAIVCRLVVDDDDLEL

SEQ ID NO: 629481 - protein, 30 aa, Mycobacterium
AEQDAVFGVFCRRWGVPLIDGGTVRLPRLI

SEQ ID NO: 629482 - protein, 26 aa, Mycobacterium
AEQEPSADELIAWCRERLAHFKCPRE

SEQ ID NO: 629483 - protein, 17 aa, Mycobacterium
AEQFLELDLQVVAAGRD

SEQ ID NO: 629484 - protein, 19 aa, Mycobacterium
AEQGLSFAREAALAKKLGA

SEQ ID NO: 629485 - protein, 19 aa, Mycobacterium
AEQGPAWWNGTVVEHARVS

SEQ ID NO: 629486 - protein, 22 aa, Mycobacterium
AEQGPCLDCYATGEPISVADVH

SEQ ID NO: 629487 - protein, 20 aa, Mycobacterium
AEQGRPLWYLMPDGVVQYVS

SEQ ID NO: 629488 - protein, 19 aa, Mycobacterium
AEQGWVCLAVDYRVAPHHR

SEQ ID NO: 629489 - protein, 36 aa, Mycobacterium
AEQIGAPVYKVFNGIFWKHLLERGIPAGSPGRIALP

SEQ ID NO: 629490 - protein, 20 aa, Mycobacterium
AEQIPALLGILSVGAVYLPI

SEQ ID NO: 629491 - protein, 32 aa, Mycobacterium
AEQISWGRPVFKAGKIFAMFGGNAKGATKGTM

SEQ ID NO: 629492 - protein, 19 aa, Mycobacterium
AEQKLRGSHHLGHNCVLAF

SEQ ID NO: 629493 - protein, 18 aa, Mycobacterium
AEQLLRQRDQVLGQLADI

SEQ ID NO: 629494 - protein, 19 aa, Mycobacterium
AEQLRGWLDQILSATAGKL

SEQ ID NO: 629495 - protein, 22 aa, Mycobacterium
AEQLRSYWARPLPATIVARAGA

SEQ ID NO: 629496 - protein, 19 aa, Mycobacterium
AEQLVAPLYYRVIVTGETV

SEQ ID NO: 629497 - protein, 21 aa, Mycobacterium
AEQLVWREVPDVAAGPGEVLV

SEQ ID NO: 629498 - protein, 25 aa, Mycobacterium
AEQQRLKVLVSIFGRETPVELNFTQ

SEQ ID NO: 629499 - protein, 23 aa, Mycobacterium
AEQRAASSIKEKNDWSYEKWTKQ

SEQ ID NO: 629500 - protein, 21 aa, Mycobacterium
AEQRERYLIPAARGDRRDAVA

SEQ ID NO: 629501 - protein, 21 aa, Mycobacterium
AEQRGTVALMHGEREFPSFQA

SEQ ID NO: 629502 - protein, 25 aa, Mycobacterium
AEQRGVTEFMVYQAALAVVLHRLGG

SEQ ID NO: 629503 - protein, 19 aa, Mycobacterium
AEQRRRWAARPTHENPLVW

SEQ ID NO: 629504 - protein, 23 aa, Mycobacterium
AEQRRWLAPWYSLVPLQAGQAEL

SEQ ID NO: 629505 - protein, 22 aa, Mycobacterium
AEQRRWLAPWYSSVPLQSGPAE

SEQ ID NO: 629506 - protein, 21 aa, Mycobacterium
AEQRVALDILLDESVGIVSLG

SEQ ID NO: 629507 - protein, 21 aa, Mycobacterium
AEQRVALDLLLDESVGIVSMG

SEQ ID NO: 629508 - protein, 18 aa, Mycobacterium
AEQSLCFAGANLIPLRGA

SEQ ID NO: 629509 - protein, 20 aa, Mycobacterium
AEQSRPIWYLVPDGVVQYVA

SEQ ID NO: 629510 - protein, 17 aa, Mycobacterium
AEQTCVIDDEIYDEVIA

SEQ ID NO: 629511 - protein, 25 aa, Mycobacterium
AEQTPVSVLYLFSLIGDLLPAGVVN

SEQ ID NO: 629512 - protein, 31 aa, Mycobacterium
AEQVLRPGLHLSEAIAALMTGYAERPALGER

SEQ ID NO: 629513 - protein, 17 aa, Mycobacterium
AEQVWGEADLLLKVKEP

SEQ ID NO: 629514 - protein, 19 aa, Mycobacterium
AEQYCLPAIQSNALYMDRY

SEQ ID NO: 629515 - protein, 19 aa, Mycobacterium
AEQYEWHRGYLRRHAVSRR

SEQ ID NO: 629516 - protein, 17 aa, Mycobacterium
AERAALYRDVVMAGRSH

SEQ ID NO: 629517 - protein, 19 aa, Mycobacterium
AERAAVCRLGDQPPFRAAV

SEQ ID NO: 629518 - protein, 17 aa, Mycobacterium
AERAAWVGHDWGAVVVW

SEQ ID NO: 629519 - protein, 25 aa, Mycobacterium
AERAEVYASLGLRLDYDPQLREVKA

SEQ ID NO: 629520 - protein, 19 aa, Mycobacterium
AERAGAAYAELALLRGDPS

SEQ ID NO: 629521 - protein, 24 aa, Mycobacterium
AERAGFRMVVEVDLPGATVKILVC

SEQ ID NO: 629522 - protein, 21 aa, Mycobacterium
AERALALMVDRVQNRVAFGRP

SEQ ID NO: 629523 - protein, 17 aa, Mycobacterium
AERALALMVDRVQTRIA

SEQ ID NO: 629524 - protein, 24 aa, Mycobacterium
AERALREAFGYEAWVLVYDLGQLA

SEQ ID NO: 629525 - protein, 19 aa, Mycobacterium
AERALRIAVDHVSVRVQFG

SEQ ID NO: 629526 - protein, 20 aa, Mycobacterium
AERAQAYRAAGYWRDQLLDS

SEQ ID NO: 629527 - protein, 18 aa, Mycobacterium
AERARLTAAARKRGDDAA

SEQ ID NO: 629528 - protein, 22 aa, Mycobacterium
AERARLVALATRIAKEDHEIMG

SEQ ID NO: 629529 - protein, 19 aa, Mycobacterium
AERAVACGVARDRVLIDPT

SEQ ID NO: 629530 - protein, 24 aa, Mycobacterium
AERAYCVPKAVLLTAACRAAGIPA

SEQ ID NO: 629531 - protein, 25 aa, Mycobacterium
AERAYCVPKAVLLTAACRAAGIPAR

SEQ ID NO: 629532 - protein, 21 aa, Mycobacterium
AERAYQIWGNHAFELPATDTM

SEQ ID NO: 629533 - protein, 19 aa, Mycobacterium
AERCGLDIMAADVVDEPNA

SEQ ID NO: 629534 - protein, 20 aa, Mycobacterium
AERDWKHAVAHQTRNVPHTG

SEQ ID NO: 629535 - protein, 19 aa, Mycobacterium
AEREAFVVPAGRRGAVFDE

SEQ ID NO: 629536 - protein, 18 aa, Mycobacterium
AEREARLTKPQFVMPTTG

SEQ ID NO: 629537 - protein, 18 aa, Mycobacterium
AEREEIRRAAGLKDPGAG

SEQ ID NO: 629538 - protein, 17 aa, Mycobacterium
AEREGARVLIYDAEYAE

SEQ ID NO: 629539 - protein, 21 aa, Mycobacterium
AERENRIVIAYSPLEQGLLGG

SEQ ID NO: 629540 - protein, 24 aa, Mycobacterium
AERFADAVTAIWQGRLEIDRFNEL

SEQ ID NO: 629541 - protein, 18 aa, Mycobacterium
AERFGVGLGETYGRNSDE

SEQ ID NO: 629542 - protein, 18 aa, Mycobacterium
AERFGVGLGETYGRNSDQ

SEQ ID NO: 629543 - protein, 17 aa, Mycobacterium
AERFIEVLRRWPHELSL

SEQ ID NO: 629544 - protein, 19 aa, Mycobacterium
AERFLAAAGVTDWLVDTGI

SEQ ID NO: 629545 - protein, 25 aa, Mycobacterium
AERFLAEGAERVFITGRRQTELDTA

SEQ ID NO: 629546 - protein, 23 aa, Mycobacterium
AERFTVLRPLLFTIAYEMLGSAT

SEQ ID NO: 629547 - protein, 19 aa, Mycobacterium
AERGAEAALEFGESFDGVR

SEQ ID NO: 629548 - protein, 32 aa, Mycobacterium
AERGAEAALEFGESFDGVRPAAVRVPEAALDK

SEQ ID NO: 629549 - protein, 25 aa, Mycobacterium
AERGDRRFGSPLKRFSSPINPSAGQ

SEQ ID NO: 629550 - protein, 25 aa, Mycobacterium
AERGLPITMTKLRFMKFIMDEIFPG

SEQ ID NO: 629551 - protein, 24 aa, Mycobacterium
AERGRVLGEAVALLRDMLNPDELV

SEQ ID NO: 629552 - protein, 22 aa, Mycobacterium
AERHFAAALAMDRRMGSVVHIN

SEQ ID NO: 629553 - protein, 19 aa, Mycobacterium
AERHLRWLAALGGIDGGRV

SEQ ID NO: 629554 - protein, 24 aa, Mycobacterium
AERHRWVHYPWRRTVVGVLGPHAF

SEQ ID NO: 629555 - protein, 24 aa, Mycobacterium
AERIGAACRAVWNTGLEQRREYRR

SEQ ID NO: 629556 - protein, 21 aa, Mycobacterium
AERIGFVLADAAPIAAITTAA

SEQ ID NO: 629557 - protein, 18 aa, Mycobacterium
AERIGIRHALLGADVTVV

SEQ ID NO: 629558 - protein, 17 aa, Mycobacterium
AERIGVVQVLFVGGLDT

SEQ ID NO: 629559 - protein, 24 aa, Mycobacterium
AERIPELPEGPTLPLVPRAEQQDP

SEQ ID NO: 629560 - protein, 22 aa, Mycobacterium
AERIRRVAERIVETKKQGNDVV

SEQ ID NO: 629561 - protein, 29 aa, Mycobacterium
AERKVGGAEVVEWLRLRESLGHSAYQLGV

SEQ ID NO: 629562 - protein, 17 aa, Mycobacterium
AERLAAGGLKLNRFHTT

SEQ ID NO: 629563 - protein, 24 aa, Mycobacterium
AERLAFVLHDVFAVPFDQIAPILE

SEQ ID NO: 629564 - protein, 24 aa, Mycobacterium
AERLAFVLHDVFSVPFDQIATIVD

SEQ ID NO: 629565 - protein, 26 aa, Mycobacterium
AERLAVGPQPGWRVEVGERAVTVSGD

SEQ ID NO: 629566 - protein, 18 aa, Mycobacterium
AERLFAERGFLAVRLEDI

SEQ ID NO: 629567 - protein, 25 aa, Mycobacterium
AERLGIPWIELNPHPLYRPSKGLPP

SEQ ID NO: 629568 - protein, 21 aa, Mycobacterium
AERLLRDWARPLREISVLFDD

SEQ ID NO: 629569 - protein, 21 aa, Mycobacterium
AERLPAYMIPTAVVTLDALPL

SEQ ID NO: 629570 - protein, 20 aa, Mycobacterium
AERLPAYMVPAAVVVLDALP

SEQ ID NO: 629571 - protein, 22 aa, Mycobacterium
AERLPGYMVPAAIVALPELPMT

SEQ ID NO: 629572 - protein, 18 aa, Mycobacterium
AERLRAALIQQLGNTADA

SEQ ID NO: 629573 - protein, 27 aa, Mycobacterium
AERLRAGGMGIPAFYTPAGVGTAVANG

SEQ ID NO: 629574 - protein, 30 aa, Mycobacterium
AERLRAGGMGIPAFYTPAGVGTQIADGGLP

SEQ ID NO: 629575 - protein, 30 aa, Mycobacterium
AERLRAGGMGIPGFYTPAGVGTQIADGGLP

SEQ ID NO: 629576 - protein, 23 aa, Mycobacterium
AERLRIAIMRGVLAPGAQLGEAS

SEQ ID NO: 629577 - protein, 36 aa, Mycobacterium
AERLRRPGVAVAPRKQWPSGLASLGLQLSGRIADGA

SEQ ID NO: 629578 - protein, 21 aa, Mycobacterium
AERLYRLPVQVDPLAAVAVLH

SEQ ID NO: 629579 - protein, 26 aa, Mycobacterium
AERMPRRFYCRARWRTGGVDSETQVF

SEQ ID NO: 629580 - protein, 23 aa, Mycobacterium
AERMRHGMYWSGDLAYRDAEGWI

SEQ ID NO: 629581 - protein, 23 aa, Mycobacterium
AERMRHGMYWSGDLAYRDSDGWI

SEQ ID NO: 629582 - protein, 29 aa, Mycobacterium
AERMRLIAIPLWHSYMFAIRKDWGYMTSQ

SEQ ID NO: 629583 - protein, 17 aa, Mycobacterium
AERNLLCMAWPEEFGGS

SEQ ID NO: 629584 - protein, 19 aa, Mycobacterium
AERPARLAAAIAGEIRAVL

SEQ ID NO: 629585 - protein, 25 aa, Mycobacterium
AERPPRVAEGWSLTRLTAPSRLFGA

SEQ ID NO: 629586 - protein, 18 aa, Mycobacterium
AERPRLIAEVNFLGVVEL

SEQ ID NO: 629587 - protein, 19 aa, Mycobacterium
AERPTMAALLVKDSVNAAS

SEQ ID NO: 629588 - protein, 20 aa, Mycobacterium
AERQRYPIVRCKDGYVRICV

SEQ ID NO: 629589 - protein, 19 aa, Mycobacterium
AERRAILSFLESGVDLDDV

SEQ ID NO: 629590 - protein, 24 aa, Mycobacterium
AERRDVWPGILGFEDTVIPQLERA

SEQ ID NO: 629591 - protein, 24 aa, Mycobacterium
AERREVWRLLASFRTEPATEIIAR

SEQ ID NO: 629592 - protein, 21 aa, Mycobacterium
AERRFGAPMLEAYGMTETTHQ

SEQ ID NO: 629593 - protein, 20 aa, Mycobacterium
AERRGNVMVITINRPEARNA

SEQ ID NO: 629594 - protein, 26 aa, Mycobacterium
AERRILAAAGLRDGRTVDDTSIGLAL

SEQ ID NO: 629595 - protein, 28 aa, Mycobacterium
AERRLGDAVFRDMLGLHFSSTRPVEDEL

SEQ ID NO: 629596 - protein, 24 aa, Mycobacterium
AERRLGTVVFRDMLGLHFSSTRPG

SEQ ID NO: 629597 - protein, 31 aa, Mycobacterium
AERRTPPAFYAWRAFARYSPVLPAGRIVAAG

SEQ ID NO: 629598 - protein, 25 aa, Mycobacterium
AERRWLRYRRMALEQTPIRSILSFE

SEQ ID NO: 629599 - protein, 31 aa, Mycobacterium
AERRYCFDLETDWPIRAAVLTTAEHHVLSLV

SEQ ID NO: 629600 - protein, 17 aa, Mycobacterium
AERSIDVSFHELNGNEM

SEQ ID NO: 629601 - protein, 29 aa, Mycobacterium
AERSLFASLCSFAGIALARASEFSSNTEQ

SEQ ID NO: 629602 - protein, 20 aa, Mycobacterium
AERSLPLVVELVAQQSEWGL

SEQ ID NO: 629603 - protein, 18 aa, Mycobacterium
AERSNVWVGARPIAADGR

SEQ ID NO: 629604 - protein, 20 aa, Mycobacterium
AERTPLLGVCLGHQAIGVAF

SEQ ID NO: 629605 - protein, 21 aa, Mycobacterium
AERVADTFVAMGWELAEGPEV

SEQ ID NO: 629606 - protein, 17 aa, Mycobacterium
AERVAEAGGIVIVTGRR

SEQ ID NO: 629607 - protein, 25 aa, Mycobacterium
AERVARLEATPGWTWSDRLDEQWER

SEQ ID NO: 629608 - protein, 17 aa, Mycobacterium
AERVELCLIAKDGTETR

SEQ ID NO: 629609 - protein, 24 aa, Mycobacterium
AERVRGALMGGYFAGLLDRRVLDS

SEQ ID NO: 629610 - protein, 22 aa, Mycobacterium
AERWGYRRFWVAEHHFVAVASA

SEQ ID NO: 629611 - protein, 24 aa, Mycobacterium
AERYGMDRFCLGVHACEIPVLDLE

SEQ ID NO: 629612 - protein, 29 aa, Mycobacterium
AERYLAALMPMVWVACEREDFVVEVQAMR

SEQ ID NO: 629613 - protein, 18 aa, Mycobacterium
AERYLRPGQIEEHLIYPV

SEQ ID NO: 629614 - protein, 18 aa, Mycobacterium
AERYLRPGQIEEHLVYPV

SEQ ID NO: 629615 - protein, 24 aa, Mycobacterium
AERYSVILPEVFKQNVPPAEAIAD

SEQ ID NO: 629616 - protein, 23 aa, Mycobacterium
AESAECRSGEVLQGLLKPNECPA

SEQ ID NO: 629617 - protein, 25 aa, Mycobacterium
AESAELPLFRYIGGPNAHILPVPMM

SEQ ID NO: 629618 - protein, 24 aa, Mycobacterium
AESAEVACGYYVFEAENLDEALAL

SEQ ID NO: 629619 - protein, 22 aa, Mycobacterium
AESAGFAAFWIPQVPGYLDAMT

SEQ ID NO: 629620 - protein, 25 aa, Mycobacterium
AESAGLPLFRYIGGPNAHILPVPMM

SEQ ID NO: 629621 - protein, 17 aa, Mycobacterium
AESAILWGNEAVGARMS

SEQ ID NO: 629622 - protein, 18 aa, Mycobacterium
AESALGTVGRQFGFVPNM

SEQ ID NO: 629623 - protein, 23 aa, Mycobacterium
AESARLLGSLAAYLVVNVSSPNT

SEQ ID NO: 629624 - protein, 24 aa, Mycobacterium
AESARLRLADVMAEARERIGEEAP

SEQ ID NO: 629625 - protein, 20 aa, Mycobacterium
AESARTLLLQTVRDVEDKLR

SEQ ID NO: 629626 - protein, 17 aa, Mycobacterium
AESAVLWGDESVGARMS

SEQ ID NO: 629627 - protein, 21 aa, Mycobacterium
AESCAIGSVEHCADRLAEYRA

SEQ ID NO: 629628 - protein, 19 aa, Mycobacterium
AESCTAGLLAARLTDQPGA

SEQ ID NO: 629629 - protein, 19 aa, Mycobacterium
AESCTAGLLAARLTDRPGS

SEQ ID NO: 629630 - protein, 42 aa, Mycobacterium
AESDALLVQPAHTLSQAWITSPLGQVVDPVINAPFEAAIGRD

SEQ ID NO: 629631 - protein, 20 aa, Mycobacterium
AESDPWTLWWMHVTGSDSAE

SEQ ID NO: 629632 - protein, 27 aa, Mycobacterium
AESERAMGFCLFNNISIGARHAQRKHG

SEQ ID NO: 629633 - protein, 25 aa, Mycobacterium
AESFLPNRFRLLVRCARVAAVRRAV

SEQ ID NO: 629634 - protein, 24 aa, Mycobacterium
AESGELTAVLGLIADGRFSRGDTE

SEQ ID NO: 629635 - protein, 20 aa, Mycobacterium
AESGFPMMPMMVPPPTASAG

SEQ ID NO: 629636 - protein, 17 aa, Mycobacterium
AESGLRFSGTSPDGHLV

SEQ ID NO: 629637 - protein, 19 aa, Mycobacterium
AESGLRFSGTSPDGHLVEF

SEQ ID NO: 629638 - protein, 21 aa, Mycobacterium
AESGLTLTGLHHFDLLNHPDI

SEQ ID NO: 629639 - protein, 18 aa, Mycobacterium
AESGRPGERYLISEKLIS

SEQ ID NO: 629640 - protein, 17 aa, Mycobacterium
AESIAAALTPFPLQAAG

SEQ ID NO: 629641 - protein, 19 aa, Mycobacterium
AESIARGWSASRPADTVRL

SEQ ID NO: 629642 - protein, 21 aa, Mycobacterium
AESIRKFRILPVDFTEDTGEL

SEQ ID NO: 629643 - protein, 21 aa, Mycobacterium
AESIRWLHAHTAELFDEGLPW

SEQ ID NO: 629644 - protein, 23 aa, Mycobacterium
AESISRTGRCVVMHEGPRNVGYG

SEQ ID NO: 629645 - protein, 19 aa, Mycobacterium
AESLALFAEYIEWRSTHPS

SEQ ID NO: 629646 - protein, 22 aa, Mycobacterium
AESLDALADVLVRRGRCPPVGR

SEQ ID NO: 629647 - protein, 19 aa, Mycobacterium
AESLDVCFELADRILKSMA

SEQ ID NO: 629648 - protein, 19 aa, Mycobacterium
AESLDVCFELADRILKSMG

SEQ ID NO: 629649 - protein, 20 aa, Mycobacterium
AESLGAQILMPGEETPYGTL

SEQ ID NO: 629650 - protein, 27 aa, Mycobacterium
AESLHRLRGMFAFALWDTVEQELFCAR

SEQ ID NO: 629651 - protein, 17 aa, Mycobacterium
AESLLALGLPGLSVNVR

SEQ ID NO: 629652 - protein, 23 aa, Mycobacterium
AESLLPSYTRFYLDESYSEDGDL

SEQ ID NO: 629653 - protein, 20 aa, Mycobacterium
AESLPMFLSGRLYDDGVIDP

SEQ ID NO: 629654 - protein, 22 aa, Mycobacterium
AESLPREYARVLAPLHDLIRGI

SEQ ID NO: 629655 - protein, 22 aa, Mycobacterium
AESLQQLLRFLRTVPSSVNVQA

SEQ ID NO: 629656 - protein, 31 aa, Mycobacterium
AESLRAALRAVPAQRLWVNPDCGLKTRNADE

SEQ ID NO: 629657 - protein, 24 aa, Mycobacterium
AESLRAGRRVDWSIEDRNRTIADG

SEQ ID NO: 629658 - protein, 21 aa, Mycobacterium
AESLRKVFRPKVQGALNLDKV

SEQ ID NO: 629659 - protein, 18 aa, Mycobacterium
AESLRRLIDISIRTEAGA

SEQ ID NO: 629660 - protein, 22 aa, Mycobacterium
AESLTNWYVRRSRSRFWDEDPD

SEQ ID NO: 629661 - protein, 17 aa, Mycobacterium
AESLTWAQMHHRVQVVA

SEQ ID NO: 629662 - protein, 18 aa, Mycobacterium
AESLTWSQVYGRACIIAE

SEQ ID NO: 629663 - protein, 17 aa, Mycobacterium
AESLWAVLARALPEPWR

SEQ ID NO: 629664 - protein, 23 aa, Mycobacterium
AESLWHVDYFMRVMAGAAIEANQ

SEQ ID NO: 629665 - protein, 21 aa, Mycobacterium
AESMDVCFELATKLVEAMSGA

SEQ ID NO: 629666 - protein, 21 aa, Mycobacterium
AESMTFPLFVKAVAGGGGRGM

SEQ ID NO: 629667 - protein, 28 aa, Mycobacterium
AESPKETWLRLLLMREFPRPQTQIPLVD

SEQ ID NO: 629668 - protein, 27 aa, Mycobacterium
AESPRETWLRLLLIRAGFPRPQTQIPV

SEQ ID NO: 629669 - protein, 26 aa, Mycobacterium
AESPRETWLRLVVVRAGYPPPQTQYA

SEQ ID NO: 629670 - protein, 21 aa, Mycobacterium
AESPRLAAFLDHVDVAVSLHG

SEQ ID NO: 629671 - protein, 20 aa, Mycobacterium
AESPTAKRKPALHVLLWQRA

SEQ ID NO: 629672 - protein, 30 aa, Mycobacterium
AESQRAGLGIRFVAVLPRLTPATDLGAEAV

SEQ ID NO: 629673 - protein, 19 aa, Mycobacterium
AESRAKVVYEYLKQFTDDP

SEQ ID NO: 629674 - protein, 21 aa, Mycobacterium
AESRATVQFMVPAMWSALTQV

SEQ ID NO: 629675 - protein, 19 aa, Mycobacterium
AESRAYFDLAWAHAGGLPR

SEQ ID NO: 629676 - protein, 22 aa, Mycobacterium
AESREVSTFVLFLASDESSYAT

SEQ ID NO: 629677 - protein, 21 aa, Mycobacterium
AESREVSTFVVFLASDDASYA

SEQ ID NO: 629678 - protein, 21 aa, Mycobacterium
AESRKPPSRRSGPVDTETPTT

SEQ ID NO: 629679 - protein, 17 aa, Mycobacterium
AESRLGPDDVFLINSTS

SEQ ID NO: 629680 - protein, 22 aa, Mycobacterium
AESRLGYPLDRSHTAAIIWSDR

SEQ ID NO: 629681 - protein, 23 aa, Mycobacterium
AESRSAIVCPIHLGLMQGALESW

SEQ ID NO: 629682 - protein, 19 aa, Mycobacterium
AESSADLFTVLPLGELWIA

SEQ ID NO: 629683 - protein, 17 aa, Mycobacterium
AESSALFAMLSGQHVGN

SEQ ID NO: 629684 - protein, 18 aa, Mycobacterium
AESTAEILVDLLVGDEPG

SEQ ID NO: 629685 - protein, 21 aa, Mycobacterium
AESTWHRWIAQYGGMNANEAK

SEQ ID NO: 629686 - protein, 21 aa, Mycobacterium
AESVCKNFGALKVLRGVTLNV

SEQ ID NO: 629687 - protein, 33 aa, Mycobacterium
AESVKLHPADVPFFVALCKTLGKPVNFVPVIDK

SEQ ID NO: 629688 - protein, 17 aa, Mycobacterium
AESVLRLAQACHDDGVA

SEQ ID NO: 629689 - protein, 18 aa, Mycobacterium
AESVLRMARECHHDHVGL

SEQ ID NO: 629690 - protein, 20 aa, Mycobacterium
AESVQHTWFGLSALAERVGT

SEQ ID NO: 629691 - protein, 24 aa, Mycobacterium
AESVQRMALALGFDLDEMEFVVEH

SEQ ID NO: 629692 - protein, 17 aa, Mycobacterium
AESVSMALANRIRAWMR

SEQ ID NO: 629693 - protein, 20 aa, Mycobacterium
AESVVGRWFTPGFLAADPGR

SEQ ID NO: 629694 - protein, 25 aa, Mycobacterium
AESWKALGKQVTHWDEWGKNPDEAL

SEQ ID NO: 629695 - protein, 19 aa, Mycobacterium
AESWTGATGDAFRREQKIW

SEQ ID NO: 629696 - protein, 31 aa, Mycobacterium
AETAAALRASAAWMRTMFAILPLSVGVKNAD

SEQ ID NO: 629697 - protein, 17 aa, Mycobacterium
AETAARINDAWRRESRE

SEQ ID NO: 629698 - protein, 25 aa, Mycobacterium
AETAARLRAVATWLQTMFAIVPLAV

SEQ ID NO: 629699 - protein, 26 aa, Mycobacterium
AETAARLRAVTTWMRTMFAIVPLAVG

SEQ ID NO: 629700 - protein, 18 aa, Mycobacterium
AETARSLLGFDFCGVLLP

SEQ ID NO: 629701 - protein, 23 aa, Mycobacterium
AETARVAAVFAQLITPDGMNHGV

SEQ ID NO: 629702 - protein, 23 aa, Mycobacterium
AETARVAAVFAQLITPDGVKHGV

SEQ ID NO: 629703 - protein, 18 aa, Mycobacterium
AETCPQTEMVLGGYSQGA

SEQ ID NO: 629704 - protein, 19 aa, Mycobacterium
AETDLPLMVKGVCHPDDVR

SEQ ID NO: 629705 - protein, 21 aa, Mycobacterium
AETDLYFGNIVKDGGFGTFHH

SEQ ID NO: 629706 - protein, 17 aa, Mycobacterium
AETDSGVAVFLVAAADA

SEQ ID NO: 629707 - protein, 24 aa, Mycobacterium
AETDVKRQLLLDALADQLEVQVGQ

SEQ ID NO: 629708 - protein, 27 aa, Mycobacterium
AETEGCVREMLVLAAALSIPDPRERPS

SEQ ID NO: 629709 - protein, 26 aa, Mycobacterium
AETEGCVREVLVLAAALTIHDPRERP

SEQ ID NO: 629710 - protein, 28 aa, Mycobacterium
AETERAMGFCLFNNISIGARHAQLKHGL

SEQ ID NO: 629711 - protein, 19 aa, Mycobacterium
AETFAARTTQEWLDLLEEL

SEQ ID NO: 629712 - protein, 20 aa, Mycobacterium
AETFRLPAPLYADPATVVSM

SEQ ID NO: 629713 - protein, 24 aa, Mycobacterium
AETGLLAPHWPKPYGRAAGPAEQL

SEQ ID NO: 629714 - protein, 23 aa, Mycobacterium
AETHGQAALVRREPCRHQPPARG

SEQ ID NO: 629715 - protein, 29 aa, Mycobacterium
AETHLRLPFRQFRYRLGFESLGRGVSDSI

SEQ ID NO: 629716 - protein, 24 aa, Mycobacterium
AETIAQRTTREWLDLFRELEIPAS

SEQ ID NO: 629717 - protein, 22 aa, Mycobacterium
AETIRGRVPFFAGVTTLNTRDT

SEQ ID NO: 629718 - protein, 32 aa, Mycobacterium
AETKAVEGLSLFRRRLVTPFIRAGAAVLSCDH

SEQ ID NO: 629719 - protein, 22 aa, Mycobacterium
AETKDLPGFERGRVLEKVGQHG

SEQ ID NO: 629720 - protein, 21 aa, Mycobacterium
AETKLSGGLGGRTAAVVGAGA

SEQ ID NO: 629721 - protein, 24 aa, Mycobacterium
AETLAERTTEEWLNLFRELEIPAA

SEQ ID NO: 629722 - protein, 19 aa, Mycobacterium
AETLAGILRDADHAGTPVF

SEQ ID NO: 629723 - protein, 21 aa, Mycobacterium
AETLARSGARVAINGRTASRV

SEQ ID NO: 629724 - protein, 22 aa, Mycobacterium
AETLDFRSYRYFTANGGACPTD

SEQ ID NO: 629725 - protein, 22 aa, Mycobacterium
AETLHTLGLSAPVIESAISDAI

SEQ ID NO: 629726 - protein, 25 aa, Mycobacterium
AETLNLALLRGYRTGGTIHIIVNNQ

SEQ ID NO: 629727 - protein, 24 aa, Mycobacterium
AETLNLALLRGYRTGGTIHIVVNN

SEQ ID NO: 629728 - protein, 24 aa, Mycobacterium
AETLRAAGYRIIEIGESWPELAAT

SEQ ID NO: 629729 - protein, 26 aa, Mycobacterium
AETLRVGPQPEWRVEVDSDRVEVYST

SEQ ID NO: 629730 - protein, 21 aa, Mycobacterium
AETLTTLVLRGEGGFGGQPGS

SEQ ID NO: 629731 - protein, 23 aa, Mycobacterium
AETLWACVDVFLRSKGVIVDPDR

SEQ ID NO: 629732 - protein, 19 aa, Mycobacterium
AETMAALARELRYLDVSAL

SEQ ID NO: 629733 - protein, 21 aa, Mycobacterium
AETNRFFSMIFDRDGLVPGSE

SEQ ID NO: 629734 - protein, 17 aa, Mycobacterium
AETPARVARAWREMLWG

SEQ ID NO: 629735 - protein, 21 aa, Mycobacterium
AETPAVCPHLHMPLQSGSDQI

SEQ ID NO: 629736 - protein, 25 aa, Mycobacterium
AETPDVVHAYGWLGGLAAQLAARRQ

SEQ ID NO: 629737 - protein, 33 aa, Mycobacterium
AETPEAPSVFAPVPGFRGQQRFSDPAQAGVSTP

SEQ ID NO: 629738 - protein, 22 aa, Mycobacterium
AETPISLECRLHTTVQPGSDRL

SEQ ID NO: 629739 - protein, 20 aa, Mycobacterium
AETPRGGFIANLEIQPEAPL

SEQ ID NO: 629740 - protein, 18 aa, Mycobacterium
AETPRGGFIANMELQPEA

SEQ ID NO: 629741 - protein, 20 aa, Mycobacterium
AETPRGGFIASMELQPEAPL

SEQ ID NO: 629742 - protein, 21 aa, Mycobacterium
AETPRGGFVVNMELQPEAPLA

SEQ ID NO: 629743 - protein, 18 aa, Mycobacterium
AETQLRAAREGKLLSPTR

SEQ ID NO: 629744 - protein, 18 aa, Mycobacterium
AETQPDGWVRLRGEAALV

SEQ ID NO: 629745 - protein, 20 aa, Mycobacterium
AETQPGGWVRLRGDAALVLP

SEQ ID NO: 629746 - protein, 24 aa, Mycobacterium
AETQTVLWARMLDRLAGDTPPAIV

SEQ ID NO: 629747 - protein, 21 aa, Mycobacterium
AETQVKFAMHWIDEIRSGRMQ

SEQ ID NO: 629748 - protein, 25 aa, Mycobacterium
AETREMIKTGGFDAVCFTSSSTVRN

SEQ ID NO: 629749 - protein, 20 aa, Mycobacterium
AETRGGGTRHRGVVINPVLE

SEQ ID NO: 629750 - protein, 26 aa, Mycobacterium
AETRLYLPMPFFWVGGFGSGILSTLL

SEQ ID NO: 629751 - protein, 20 aa, Mycobacterium
AETRTPVVLLDFDGTLSDIV

SEQ ID NO: 629752 - protein, 19 aa, Mycobacterium
AETSRLRGLGDTRLAAEAK

SEQ ID NO: 629753 - protein, 25 aa, Mycobacterium
AETSVATVMRFCRTVGLTSYSQLRL

SEQ ID NO: 629754 - protein, 25 aa, Mycobacterium
AETTAQRILAHFGLDGHFEVIAGAS

SEQ ID NO: 629755 - protein, 44 aa, Mycobacterium
AETTGTSPLQLAINAVSAPAQSLLARPIIGNGANATTPGGNGGD

SEQ ID NO: 629756 - protein, 26 aa, Mycobacterium
AETTIGIPYLEGWVPRVMADGRTASV

SEQ ID NO: 629757 - protein, 17 aa, Mycobacterium
AETTLDVAFSIVVRPGV

SEQ ID NO: 629758 - protein, 17 aa, Mycobacterium
AETTWKLLLDSQSGIRT

SEQ ID NO: 629759 - protein, 26 aa, Mycobacterium
AETVKLHPADVPFFVTLCKKPGKPVN

SEQ ID NO: 629760 - protein, 33 aa, Mycobacterium; identical to SEQ ID NO: 77665

SEQ ID NO: 629761 - protein, 34 aa, Mycobacterium
AETVLHEMAHMWFGDLVTMKWWDDLWLNESFATF

SEQ ID NO: 629762 - protein, 32 aa, Mycobacterium
AETVLHEMAHMWFGDLVTMQWWDDLWLNESFA

SEQ ID NO: 629763 - protein, 34 aa, Mycobacterium
AETVLHEMAHMWFGDLVTMRWWDDLWLNESFATF

SEQ ID NO: 629764 - protein, 43 aa, Mycobacterium
AETVLHEMAHMWFGDLVTMRWWDDLWLNESFATFASVLCQAEA

SEQ ID NO: 629765 - protein, 25 aa, Mycobacterium
AETVRHWLEVVGLQEFADHRPRQVS

SEQ ID NO: 629766 - protein, 21 aa, Mycobacterium
AETYAVLRFSGDRGAGAVAAR

SEQ ID NO: 629767 - protein, 17 aa, Mycobacterium
AEVAAAIGTDAPTTAPT

SEQ ID NO: 629768 - protein, 25 aa, Mycobacterium
AEVAANRTMLSWLVATNALGQNITA

SEQ ID NO: 629769 - protein, 23 aa, Mycobacterium
AEVAARWVLDADPPVTAYIECAQ

SEQ ID NO: 629770 - protein, 20 aa, Mycobacterium
AEVADALGLTVVVIGTPAEE

SEQ ID NO: 629771 - protein, 21 aa, Mycobacterium
AEVADAVAFLVSENSSFITGS

SEQ ID NO: 629772 - protein, 20 aa, Mycobacterium
AEVADTYFALVDRLGADGLL

SEQ ID NO: 629773 - protein, 21 aa, Mycobacterium
AEVAEGWQPIFYLPEKAHDVW

SEQ ID NO: 629774 - protein, 23 aa, Mycobacterium
AEVAERAGAIAIQTRQRIAGVVE

SEQ ID NO: 629775 - protein, 22 aa, Mycobacterium
AEVAERAGAIALQTRQRIAGVV

SEQ ID NO: 629776 - protein, 23 aa, Mycobacterium
AEVAERAGSIAMQTRQRIAGVVE

SEQ ID NO: 629777 - protein, 24 aa, Mycobacterium
AEVAEWLAAHGWTAQAVPSQDAMR

SEQ ID NO: 629778 - protein, 19 aa, Mycobacterium
AEVAHALGVDGGPEVVWLG

SEQ ID NO: 629779 - protein, 17 aa, Mycobacterium
AEVAHRNGIPLIVDNTI

SEQ ID NO: 629780 - protein, 17 aa, Mycobacterium
AEVAHRNGLPLIVDNTI

SEQ ID NO: 629781 - protein, 21 aa, Mycobacterium
AEVALLKILALQFIMSDPRHQ

SEQ ID NO: 629782 - protein, 18 aa, Mycobacterium
AEVAPLEMTKWFDTNYHY

SEQ ID NO: 629783 - protein, 28 aa, Mycobacterium
AEVARLLRPGGVFAFSAWVRDDRDGAEN

SEQ ID NO: 629784 - protein, 19 aa, Mycobacterium
AEVARQGFEAMMRGDRKVV

SEQ ID NO: 629785 - protein, 19 aa, Mycobacterium
AEVARRLHNKGAKLVLTDI

SEQ ID NO: 629786 - protein, 19 aa, Mycobacterium
AEVARRLHNMGAKLVLADL

SEQ ID NO: 629787 - protein, 21 aa, Mycobacterium
AEVARRLRKKGAKLVLTDLND

SEQ ID NO: 629788 - protein, 18 aa, Mycobacterium
AEVASAWQAAMWGKKPGH

SEQ ID NO: 629789 - protein, 28 aa, Mycobacterium
AEVCHRRGKPLILDEAWGAHLPFHEDLP

SEQ ID NO: 629790 - protein, 23 aa, Mycobacterium
AEVDAGVFMDTFSKWVSPARLAV

SEQ ID NO: 629791 - protein, 17 aa, Mycobacterium
AEVDAHYSVSVGIIGDI

SEQ ID NO: 629792 - protein, 22 aa, Mycobacterium
AEVDLGLPVRRILTTAAAPIRA

SEQ ID NO: 629793 - protein, 22 aa, Mycobacterium
AEVDPQLVIMLGEYPGRAMLTV

SEQ ID NO: 629794 - protein, 19 aa, Mycobacterium
AEVEIACGRAQSVTGELEG

SEQ ID NO: 629795 - protein, 21 aa, Mycobacterium
AEVELAWEILDPALDNWASSG

SEQ ID NO: 629796 - protein, 26 aa, Mycobacterium
AEVELAWEILDPVLDYWAAHGKPDPY

SEQ ID NO: 629797 - protein, 25 aa, Mycobacterium
AEVELSWEILDPVLENWAQNDDASA

SEQ ID NO: 629798 - protein, 25 aa, Mycobacterium
AEVERRREITGGKRSFILVPGIDVP

SEQ ID NO: 629799 - protein, 17 aa, Mycobacterium
AEVFAFDWLARQFAVTT

SEQ ID NO: 629800 - protein, 29 aa, Mycobacterium
AEVFAQGHIDFRLMAAVVYRTELIEDPEL

SEQ ID NO: 629801 - protein, 20 aa, Mycobacterium
AEVFDYYLSIAQVMVPHIAG

SEQ ID NO: 629802 - protein, 23 aa, Mycobacterium
AEVFPELLRRGVPIDLVTDQTSA

SEQ ID NO: 629803 - protein, 17 aa, Mycobacterium
AEVGAQCVALQRSAAML

SEQ ID NO: 629804 - protein, 20 aa, Mycobacterium
AEVGFGISMVSAIATRGQRL

SEQ ID NO: 629805 - protein, 21 aa, Mycobacterium
AEVGPRISAALSSAAAALAAP

SEQ ID NO: 629806 - protein, 20 aa, Mycobacterium
AEVGRATFFRYFSAKEDAVV

SEQ ID NO: 629807 - protein, 18 aa, Mycobacterium
AEVGRRVKNLCVDRTRGE

SEQ ID NO: 629808 - protein, 18 aa, Mycobacterium
AEVGSRAWAAMYLGTPRT

SEQ ID NO: 629809 - protein, 19 aa, Mycobacterium
AEVGVWPQTVCKWRARFVK

SEQ ID NO: 629810 - protein, 18 aa, Mycobacterium
AEVHQALCANGIRQKVVL

SEQ ID NO: 629811 - protein, 24 aa, Mycobacterium
AEVIADPSIVAWGSARPDQVWAVL

SEQ ID NO: 629812 - protein, 24 aa, Mycobacterium
AEVICLGCGGMAELEEKVRAATGV

SEQ ID NO: 629813 - protein, 20 aa, Mycobacterium
AEVKAAAAAQGLWYPPDPSS

SEQ ID NO: 629814 - protein, 21 aa, Mycobacterium
AEVKAVLRAREQVFKQYRVGS

SEQ ID NO: 629815 - protein, 19 aa, Mycobacterium
AEVKERYYGRKRWNIASRF

SEQ ID NO: 629816 - protein, 19 aa, Mycobacterium
AEVKGSLKILDVLKAAVAD

SEQ ID NO: 629817 - protein, 24 aa, Mycobacterium
AEVKKAVAEHGLWYPPDPSSFEIC

SEQ ID NO: 629818 - protein, 25 aa, Mycobacterium
AEVKKVVAEHGLWYPPDPSSFEICS

SEQ ID NO: 629819 - protein, 23 aa, Mycobacterium
AEVKLIGERDVEVTLTGPIAAKY

SEQ ID NO: 629820 - protein, 18 aa, Mycobacterium
AEVKRKGVLIGDTVMIRK

SEQ ID NO: 629821 - protein, 31 aa, Mycobacterium
AEVKRMWVDDRWRGAGLGSRILRHLETLAAE

SEQ ID NO: 629822 - protein, 19 aa, Mycobacterium
AEVLAGWSADQRFLLNVPL

SEQ ID NO: 629823 - protein, 29 aa, Mycobacterium
AEVLAPLAGPRVRVVVRAGAYVIHDDGFY

SEQ ID NO: 629824 - protein, 19 aa, Mycobacterium
AEVLARAVLVAVLAAERVA

SEQ ID NO: 629825 - protein, 19 aa, Mycobacterium
AEVLCLPYFLGEKSPLHDP

SEQ ID NO: 629826 - protein, 18 aa, Mycobacterium
AEVLELLEAAKLPAAPMH

SEQ ID NO: 629827 - protein, 20 aa, Mycobacterium
AEVLGALGLSAQEIAALREQ

SEQ ID NO: 629828 - protein, 27 aa, Mycobacterium
AEVLGVPRLVVHPGELVNGQAARPRQR

SEQ ID NO: 629829 - protein, 26 aa, Mycobacterium
AEVLRARNLLPVPWVEPVDVANAVVF

SEQ ID NO: 629830 - protein, 19 aa, Mycobacterium
AEVLRGAAITTEIPSVRVE

SEQ ID NO: 629831 - protein, 18 aa, Mycobacterium
AEVLRLAPEAIRVVVPNV

SEQ ID NO: 629832 - protein, 24 aa, Mycobacterium
AEVMPEDLIKFGLIPEFIGRLPIV

SEQ ID NO: 629833 - protein, 21 aa, Mycobacterium
AEVMRAAALAAVLEPGASELE

SEQ ID NO: 629834 - protein, 27 aa, Mycobacterium
AEVNEWARRALGLLVHDHFGQTELGMV

SEQ ID NO: 629835 - protein, 17 aa, Mycobacterium
AEVPFGPDLLFAASDVP

SEQ ID NO: 629836 - protein, 22 aa, Mycobacterium
AEVPLDCVMELVPWLREGQWGA

SEQ ID NO: 629837 - protein, 28 aa, Mycobacterium
AEVPLELRIRAAWLWSGRRAVIGGAAAA

SEQ ID NO: 629838 - protein, 17 aa, Mycobacterium
AEVPRQLNITGADLVGP

SEQ ID NO: 629839 - protein, 18 aa, Mycobacterium
AEVPVLLLTGWQDLFVDQ

SEQ ID NO: 629840 - protein, 20 aa, Mycobacterium
AEVPWLEPLPDLMADPADPS

SEQ ID NO: 629841 - protein, 19 aa, Mycobacterium
AEVQVAYAIGKAAPVGLFV

SEQ ID NO: 629842 - protein, 22 aa, Mycobacterium
AEVRARTGVMLQGGGAYPAARA

SEQ ID NO: 629843 - protein, 21 aa, Mycobacterium
AEVRELWSTFMQKWIAYTAKI

SEQ ID NO: 629844 - protein, 17 aa, Mycobacterium
AEVRFAPELHIDRGMSF

SEQ ID NO: 629845 - protein, 20 aa, Mycobacterium
AEVRKSGFAISRQESEEGVA

SEQ ID NO: 629846 - protein, 20 aa, Mycobacterium
AEVRLRNLLKPEQFPYTTKT

SEQ ID NO: 629847 - protein, 20 aa, Mycobacterium
AEVRLRNLLKPNQFPYTTKT

SEQ ID NO: 629848 - protein, 21 aa, Mycobacterium
AEVRNFLVANALYWLQEYHID

SEQ ID NO: 629849 - protein, 17 aa, Mycobacterium
AEVRRIEHQVAHEVVAE

SEQ ID NO: 629850 - protein, 18 aa, Mycobacterium
AEVRRIEHQVAHEVVAEV

SEQ ID NO: 629851 - protein, 23 aa, Mycobacterium
AEVRRIEHQVAREVVAEVDMRPR

SEQ ID NO: 629852 - protein, 23 aa, Mycobacterium
AEVRRIEHQVAREVVAEVDVRPR

SEQ ID NO: 629853 - protein, 17 aa, Mycobacterium
AEVRRLLGIPDTYVQGC

SEQ ID NO: 629854 - protein, 17 aa, Mycobacterium
AEVRRRVSVMSSPRTQL

SEQ ID NO: 629855 - protein, 24 aa, Mycobacterium
AEVRRTAAPGQRWAPPPTAVHTVE

SEQ ID NO: 629856 - protein, 22 aa, Mycobacterium
AEVSARAGVDVLVFETTEALTT

SEQ ID NO: 629857 - protein, 20 aa, Mycobacterium
AEVSGLEVGDLVFAPEPRCS

SEQ ID NO: 629858 - protein, 23 aa, Mycobacterium
AEVSGLIWLPIGPPIDVAAYVEE

SEQ ID NO: 629859 - protein, 20 aa, Mycobacterium
AEVSGPLLRRKFRPGNAAME

SEQ ID NO: 629860 - protein, 18 aa, Mycobacterium
AEVSRIALVDMYNLAGSS

SEQ ID NO: 629861 - protein, 18 aa, Mycobacterium
AEVTALWHDGLVARVDVQ

SEQ ID NO: 629862 - protein, 25 aa, Mycobacterium
AEVTKRFEAELGRRSGLATEGLSAV

SEQ ID NO: 629863 - protein, 18 aa, Mycobacterium
AEVTLRRNGRVLVGPVTW

SEQ ID NO: 629864 - protein, 25 aa, Mycobacterium
AEVTYAAEFFRWFSEEAVRTDGAFG

SEQ ID NO: 629865 - protein, 24 aa, Mycobacterium
AEVVDRWAPGRVMVNVYGPTETTI

SEQ ID NO: 629866 - protein, 19 aa, Mycobacterium
AEVVEAELLRLENRLPGLE

SEQ ID NO: 629867 - protein, 22 aa, Mycobacterium
AEVVEAWTGIPSGRMLEGETAK

SEQ ID NO: 629868 - protein, 17 aa, Mycobacterium
AEVVFRIDAGVYTNHQG

SEQ ID NO: 629869 - protein, 22 aa, Mycobacterium
AEVVHGFGWTGPLGVTYPGVVT

SEQ ID NO: 629870 - protein, 28 aa, Mycobacterium
AEVVTRFAGLVDRFTLLTPYPLGDEAAA

SEQ ID NO: 629871 - protein, 21 aa, Mycobacterium
AEVVTRWRAGYFTTLKAAPSE

SEQ ID NO: 629872 - protein, 17 aa, Mycobacterium
AEVVVCYRAFNERSGMR

SEQ ID NO: 629873 - protein, 18 aa, Mycobacterium
AEVVVCYRAFNERSGMRF

SEQ ID NO: 629874 - protein, 26 aa, Mycobacterium
AEVWPLRPDCRILACSSVFGTWGGYG

SEQ ID NO: 629875 - protein, 19 aa, Mycobacterium
AEVYLDLVRKVPFFTDVNV

SEQ ID NO: 629876 - protein, 25 aa, Mycobacterium
AEVYPTHGFGSFCSATPASGDSSTI

SEQ ID NO: 629877 - protein, 17 aa, Mycobacterium
AEVYYQHLVPEGSPPKA

SEQ ID NO: 629878 - protein, 18 aa, Mycobacterium
AEWACPNRALTVRRAGAD

SEQ ID NO: 629879 - protein, 17 aa, Mycobacterium
AEWARSQGWTVLDDTKG

SEQ ID NO: 629880 - protein, 22 aa, Mycobacterium
AEWEVESAIYVYAPEVIPKIKD

SEQ ID NO: 629881 - protein, 26 aa, Mycobacterium
AEWGSRAIAVFGHRAYVGVSVNMVAA

SEQ ID NO: 629882 - protein, 17 aa, Mycobacterium
AEWIARITMSLATVPGE

SEQ ID NO: 629883 - protein, 20 aa, Mycobacterium
AEWILRIILSLLAVRGPRHR

SEQ ID NO: 629884 - protein, 19 aa, Mycobacterium
AEWIVPPMVAMQGTKFTYE

SEQ ID NO: 629885 - protein, 25 aa, Mycobacterium
AEWKPEADGGFSRVRRRIWELEKRR

SEQ ID NO: 629886 - protein, 26 aa, Mycobacterium
AEWLVPFDGDGHWDLCLDYRRSTTDP

SEQ ID NO: 629887 - protein, 18 aa, Mycobacterium
AEWMGRPHLVEAWESHWP

SEQ ID NO: 629888 - protein, 18 aa, Mycobacterium
AEWMLPRDAIADFAAGRN

SEQ ID NO: 629889 - protein, 32 aa, Mycobacterium
AEWMRRPHLAEAWEYVWPVSRWQRYLRAQLDG

SEQ ID NO: 629890 - protein, 25 aa, Mycobacterium
AEWMSRPHLARAWERVWPASRWQRY

SEQ ID NO: 629891 - protein, 19 aa, Mycobacterium
AEWMSRPHLVEAWESAWPV

SEQ ID NO: 629892 - protein, 20 aa, Mycobacterium
AEYAKVFGMEVIAWSQNLTA

SEQ ID NO: 629893 - protein, 23 aa, Mycobacterium
AEYASFRTAMRLLTGPSLVEALA

SEQ ID NO: 629894 - protein, 24 aa, Mycobacterium
AEYEKRFGYVYLVFANGRPAEELL

SEQ ID NO: 629895 - protein, 20 aa, Mycobacterium
AEYERLVGLGVVFTLQPTNM

SEQ ID NO: 629896 - protein, 26 aa, Mycobacterium
AEYGLRPLVRLVSWGLAGVAPDIMGI

SEQ ID NO: 629897 - protein, 25 aa, Mycobacterium
AEYHPPAAPPWVWVAASALLDGQSG

SEQ ID NO: 629898 - protein, 25 aa, Mycobacterium
AEYLARHGYGFLGWNTRFRGFESQF

SEQ ID NO: 629899 - protein, 24 aa, Mycobacterium
AEYLKGSLFWHFDGSLQPYPNLAT

SEQ ID NO: 629900 - protein, 17 aa, Mycobacterium
AEYLRLLRRHNVAATLS

SEQ ID NO: 629901 - protein, 30 aa, Mycobacterium
AEYLSGRWALKFGFPLMPVDGILVGTAAMA

SEQ ID NO: 629902 - protein, 17 aa, Mycobacterium
AEYPDALLVEVGPGHTL

SEQ ID NO: 629903 - protein, 21 aa, Mycobacterium
AEYPEALVFGEDVARKGGVYG

SEQ ID NO: 629904 - protein, 17 aa, Mycobacterium
AEYPGAEGYIGDVYENP

SEQ ID NO: 629905 - protein, 21 aa, Mycobacterium
AEYPRWLHTYNYHRGHTALGG

SEQ ID NO: 629906 - protein, 26 aa, Mycobacterium
AEYQDFAAPVFEEFRSPGMVTTPDEV

SEQ ID NO: 629907 - protein, 17 aa, Mycobacterium
AEYRRRAGITTETGTHL

SEQ ID NO: 629908 - protein, 22 aa, Mycobacterium
AEYRSRCAADPLSVPRYTEAAS

SEQ ID NO: 629909 - protein, 19 aa, Mycobacterium
AEYSIDLYSLLPLGELWVA

SEQ ID NO: 629910 - protein, 19 aa, Mycobacterium
AEYTFRAQIADQWRRGNIF

SEQ ID NO: 629911 - protein, 20 aa, Mycobacterium
AEYVDAMAPMTGWAGSEDEL

SEQ ID NO: 629912 - protein, 20 aa, Mycobacterium
AEYVDAMAPTTGWAGTEDDL

SEQ ID NO: 629913 - protein, 18 aa, Mycobacterium
AFAADMAFLRNCGIHPVV

SEQ ID NO: 629914 - protein, 20 aa, Mycobacterium
AFAADYGLCLARTDWDVPKH

SEQ ID NO: 629915 - protein, 20 aa, Mycobacterium
AFAADYGLCLARTNWDVPKH

SEQ ID NO: 629916 - protein, 23 aa, Mycobacterium
AFAADYGLCLARTNWDVPKHDGL

SEQ ID NO: 629917 - protein, 21 aa, Mycobacterium
AFAADYGLCLARTNWDVPKHE

SEQ ID NO: 629918 - protein, 22 aa, Mycobacterium
AFAADYGLCLARTNWDVPKHEG

SEQ ID NO: 629919 - protein, 18 aa, Mycobacterium
AFAAEGAAMLALNTAAQE

SEQ ID NO: 629920 - protein, 18 aa, Mycobacterium
AFAAFTWAYEHAGELGAV

SEQ ID NO: 629921 - protein, 20 aa, Mycobacterium
AFAAGDYGFQRWIRQPDTHP

SEQ ID NO: 629922 - protein, 18 aa, Mycobacterium
AFAAGRGVDLNWADTDRM

SEQ ID NO: 629923 - protein, 17 aa, Mycobacterium
AFAALPFDHLFFTGSPS

SEQ ID NO: 629924 - protein, 20 aa, Mycobacterium
AFAAMCVATVKLLDLDPDTV

SEQ ID NO: 629925 - protein, 19 aa, Mycobacterium
AFAAPEVARALKAEVVANQ

SEQ ID NO: 629926 - protein, 26 aa, Mycobacterium
AFAAQALACLREWKFTETDLERTNVH

SEQ ID NO: 629927 - protein, 18 aa, Mycobacterium
AFAAQVLAVLAEWKIDPL

SEQ ID NO: 629928 - protein, 17 aa, Mycobacterium
AFAARHADAVFTLHASL

SEQ ID NO: 629929 - protein, 18 aa, Mycobacterium
AFAARLGLRRTWHQHPGR

SEQ ID NO: 629930 - protein, 20 aa, Mycobacterium
AFAARWRQLLVAAGLIAVSW

SEQ ID NO: 629931 - protein, 25 aa, Mycobacterium
AFAATENWPPIPLPFGTYPVDIALG

SEQ ID NO: 629932 - protein, 19 aa, Mycobacterium
AFADAWKFAEDGIYVSPYF

SEQ ID NO: 629933 - protein, 27 aa, Mycobacterium
AFADGFSHIYQRAALLENLRRQRDHIR

SEQ ID NO: 629934 - protein, 26 aa, Mycobacterium
AFADHGWRWGGAWTTPIGYQHFERRF

SEQ ID NO: 629935 - protein, 23 aa, Mycobacterium
AFADIAASLSREFGGSNRLYGYA

SEQ ID NO: 629936 - protein, 21 aa, Mycobacterium
AFADLRMKVVDELTDWPDTGH

SEQ ID NO: 629937 - protein, 18 aa, Mycobacterium
AFADPYCPTLRSAVTDLP

SEQ ID NO: 629938 - protein, 21 aa, Mycobacterium
AFADRLAREFPAVDVDPDPIF

SEQ ID NO: 629939 - protein, 21 aa, Mycobacterium
AFADSRLVRFGPRRNAQVTSV

SEQ ID NO: 629940 - protein, 17 aa, Mycobacterium
AFADVPAGWRVVHGEAD

SEQ ID NO: 629941 - protein, 24 aa, Mycobacterium
AFAEAVGEFAARRWQWHDLAVGRT

SEQ ID NO: 629942 - protein, 21 aa, Mycobacterium
AFAEFVDWSLIDVLRGAPGAP

SEQ ID NO: 629943 - protein, 32 aa, Mycobacterium
AFAEIIRLAGPFGGNAPRPWMIDRALRHLLTD

SEQ ID NO: 629944 - protein, 17 aa, Mycobacterium
AFAELRAAVAMVAGPRD

SEQ ID NO: 629945 - protein, 21 aa, Mycobacterium
AFAEPGACRLFLPDPVVPERN

SEQ ID NO: 629946 - protein, 19 aa, Mycobacterium
AFAEVMFSAAMWSSNQDKL

SEQ ID NO: 629947 - protein, 20 aa, Mycobacterium
AFAEVMFSAAVWSSNQDKLR

SEQ ID NO: 629948 - protein, 25 aa, Mycobacterium
AFAGDRPALFEAISLSYLGPLGLFP

SEQ ID NO: 629949 - protein, 17 aa, Mycobacterium
AFAGMKLLEIYTTEEQK

SEQ ID NO: 629950 - protein, 23 aa, Mycobacterium
AFAGPRFLMRIAELEMHPLDTRD

SEQ ID NO: 629951 - protein, 18 aa, Mycobacterium
AFAIVWDGQQLHGLNASG

SEQ ID NO: 629952 - protein, 23 aa, Mycobacterium
AFAKAWYKLLHRDMGPISRYLGP

SEQ ID NO: 629953 - protein, 24 aa, Mycobacterium
AFAKAYRNDPHFAVPAIIASAPKV

SEQ ID NO: 629954 - protein, 22 aa, Mycobacterium
AFALRLGRPRSNGCSYADSPHH

SEQ ID NO: 629955 - protein, 24 aa, Mycobacterium
AFANALAGFQYVHVPGYNEIDLDT

SEQ ID NO: 629956 - protein, 21 aa, Mycobacterium
AFAPMRAGLAVADAGIGVARS

SEQ ID NO: 629957 - protein, 25 aa, Mycobacterium
AFAPRGAERLRALVIQIIDGLVDPL

SEQ ID NO: 629958 - protein, 23 aa, Mycobacterium
AFAPRGAERLRTLVVDIITGLVD

SEQ ID NO: 629959 - protein, 18 aa, Mycobacterium
AFARAAAILAALPQPFTV

SEQ ID NO: 629960 - protein, 21 aa, Mycobacterium
AFARAFGLQTAWRSPDELRLR

SEQ ID NO: 629961 - protein, 20 aa, Mycobacterium
AFARALALEVDRDGIAVHIV

SEQ ID NO: 629962 - protein, 19 aa, Mycobacterium
AFARALALEVDRDGISVHI

SEQ ID NO: 629963 - protein, 21 aa, Mycobacterium
AFARDRCGFLAVATKASAPRL

SEQ ID NO: 629964 - protein, 22 aa, Mycobacterium
AFARLLRACGNIDGLERVRFTS

SEQ ID NO: 629965 - protein, 19 aa, Mycobacterium
AFARREFERAFTPGAATAL

SEQ ID NO: 629966 - protein, 21 aa, Mycobacterium
AFARRTGALTTDFTEYNGYWL

SEQ ID NO: 629967 - protein, 20 aa, Mycobacterium
AFARTLRAVVDWRGQVVTML

SEQ ID NO: 629968 - protein, 18 aa, Mycobacterium
AFARYYRYPFRPANVDAY

SEQ ID NO: 629969 - protein, 23 aa, Mycobacterium
AFASAPFSWVHWLTESRATLTAA

SEQ ID NO: 629970 - protein, 23 aa, Mycobacterium
AFASAREAIACALDLQRSPLGPI

SEQ ID NO: 629971 - protein, 24 aa, Mycobacterium
AFASGMAATDCALRAMLRPGDHVI

SEQ ID NO: 629972 - protein, 30 aa, Mycobacterium
AFASGMAATDCALRTVLRPGDHVVIPNDAY

SEQ ID NO: 629973 - protein, 24 aa, Mycobacterium
AFASMCVATVKLLELDADRVNVSG

SEQ ID NO: 629974 - protein, 18 aa, Mycobacterium
AFASTGGWQSFRVPCLPS

SEQ ID NO: 629975 - protein, 17 aa, Mycobacterium
AFASWPQETVLRGTLAD

SEQ ID NO: 629976 - protein, 17 aa, Mycobacterium
AFASWPQQVVLRGTLAD

SEQ ID NO: 629977 - protein, 18 aa, Mycobacterium
AFATIRTDRIIAVDANPD

SEQ ID NO: 629978 - protein, 20 aa, Mycobacterium
AFATMACLYPDRVFLGVGTG

SEQ ID NO: 629979 - protein, 24 aa, Mycobacterium
AFATMGCLYPDRIFLGVGTGEALN

SEQ ID NO: 629980 - protein, 23 aa, Mycobacterium
AFATMGCLYPGRIFLGVGTGEAL

SEQ ID NO: 629981 - protein, 20 aa, Mycobacterium
AFATMGCLYPNRIFLGVGTG

SEQ ID NO: 629982 - protein, 26 aa, Mycobacterium
AFAVTGLRPEAFCPAYGLAEHTVAVT

SEQ ID NO: 629983 - protein, 23 aa, Mycobacterium
AFCDAMIAIRAEIDRVGSGEWPV

SEQ ID NO: 629984 - protein, 18 aa, Mycobacterium
AFCRYRAGATTIRDLQRL

SEQ ID NO: 629985 - protein, 20 aa, Mycobacterium
AFCSAHPLAKVHILSRLAGT

SEQ ID NO: 629986 - protein, 23 aa, Mycobacterium
AFCSAHPLVKVQILSRLAATELY

SEQ ID NO: 629987 - protein, 19 aa, Mycobacterium
AFCSTCDRSRLTADGQVRN

SEQ ID NO: 629988 - protein, 19 aa, Mycobacterium
AFCSTCDRTRLTADGQIRS

SEQ ID NO: 629989 - protein, 19 aa, Mycobacterium
AFCSTCDRTRLTADGQVRS

SEQ ID NO: 629990 - protein, 23 aa, Mycobacterium
AFDADFFAPWAKLAAVRTPTIAA

SEQ ID NO: 629991 - protein, 19 aa, Mycobacterium
AFDDGWYRTGDIGFLDDDG

SEQ ID NO: 629992 - protein, 24 aa, Mycobacterium
AFDDIDAILALPVVDGIFIGPSDL

SEQ ID NO: 629993 - protein, 18 aa, Mycobacterium
AFDEDWPNALPWHVTSRG

SEQ ID NO: 629994 - protein, 18 aa, Mycobacterium
AFDEGPWPRMTPQEREAV

SEQ ID NO: 629995 - protein, 24 aa, Mycobacterium
AFDELRQVCGLARPTTVDTAMAPA

SEQ ID NO: 629996 - protein, 25 aa, Mycobacterium
AFDFGDYRWAATLLDHAVFTDSAHA

SEQ ID NO: 629997 - protein, 26 aa, Mycobacterium
AFDFRATNPSAWWRVPVTIQNFAQDH

SEQ ID NO: 629998 - protein, 25 aa, Mycobacterium
AFDFRVMTPTAWWRVPMQSLVGGLA

SEQ ID NO: 629999 - protein, 23 aa, Mycobacterium
AFDGAWCLGVLCTTDAQQQVLTE

SEQ ID NO: 630000 - protein, 19 aa, Mycobacterium
AFDGFWAAGALRLPTDDGL

SEQ ID NO: 630001 - protein, 18 aa, Mycobacterium
AFDGLPFFEAKRAAKEIL

SEQ ID NO: 630002 - protein, 17 aa, Mycobacterium
AFDGSAHRAVWQEAREW

SEQ ID NO: 630003 - protein, 17 aa, Mycobacterium
AFDHGRGGGSIGNALNL

SEQ ID NO: 630004 - protein, 21 aa, Mycobacterium
AFDHVGLDWQEYVKFDDRYLR

SEQ ID NO: 630005 - protein, 17 aa, Mycobacterium
AFDIGRRTPVDLAVQHL

SEQ ID NO: 630006 - protein, 21 aa, Mycobacterium
AFDKRCQKMGFAGYATDNLHQ

SEQ ID NO: 630007 - protein, 22 aa, Mycobacterium
AFDLAEAFLAANLRHRLQMLNE

SEQ ID NO: 630008 - protein, 17 aa, Mycobacterium
AFDLRWEPIDSGHPAAE

SEQ ID NO: 630009 - protein, 17 aa, Mycobacterium
AFDNGPWPSTPPKERAT

SEQ ID NO: 630010 - protein, 17 aa, Mycobacterium
AFDNYEFNRACEALYHF

SEQ ID NO: 630011 - protein, 18 aa, Mycobacterium
AFDPKYPFDPAVDVPGQR

SEQ ID NO: 630012 - protein, 24 aa, Mycobacterium
AFDPSCPFGGYKQSGIGRENGPEG

SEQ ID NO: 630013 - protein, 18 aa, Mycobacterium
AFDRFNVKHYLKMVPAAV

SEQ ID NO: 630014 - protein, 18 aa, Mycobacterium
AFDRIGYAFAGIEEQSAV

SEQ ID NO: 630015 - protein, 18 aa, Mycobacterium
AFDTWRLAPPAGSAPLPE

SEQ ID NO: 630016 - protein, 17 aa, Mycobacterium
AFDYAFLAAEAELADIE

SEQ ID NO: 630017 - protein, 17 aa, Mycobacterium
AFDYAFLAAEAELAEAE

SEQ ID NO: 630018 - protein, 18 aa, Mycobacterium
AFEAARIIARASGVEVRL

SEQ ID NO: 630019 - protein, 21 aa, Mycobacterium
AFEAFGRWDILINTAGMIVRK

SEQ ID NO: 630020 - protein, 18 aa, Mycobacterium
AFEAFKMERYAAFFERSY

SEQ ID NO: 630021 - protein, 19 aa, Mycobacterium
AFEAFKMERYPAFFDLAYD

SEQ ID NO: 630022 - protein, 19 aa, Mycobacterium
AFEAIPWTMHYITNIEVLE

SEQ ID NO: 630023 - protein, 17 aa, Mycobacterium
AFEATGMRRTVPPRTPR

SEQ ID NO: 630024 - protein, 26 aa, Mycobacterium
AFEEVLKRWPDWEVDYANAERAHTAS

SEQ ID NO: 630025 - protein, 24 aa, Mycobacterium
AFEGCTLPGATEPLFHVEKGWMGV

SEQ ID NO: 630026 - protein, 23 aa, Mycobacterium
AFEGKWDGYRLILECDRGQLRAL

SEQ ID NO: 630027 - protein, 17 aa, Mycobacterium
AFEGKWDGYRLLIEADH

SEQ ID NO: 630028 - protein, 17 aa, Mycobacterium
AFEGKWDGYRLLVEADH

SEQ ID NO: 630029 - protein, 17 aa, Mycobacterium
AFEGKWDGYRLLVEIDH

SEQ ID NO: 630030 - protein, 18 aa, Mycobacterium
AFEGKWDGYRVIIDADHG

SEQ ID NO: 630031 - protein, 27 aa, Mycobacterium
AFEKGRSWPRERTRLKLEEVLRWPPGT

SEQ ID NO: 630032 - protein, 18 aa, Mycobacterium
AFEKRWQLGGVLFSKTFP

SEQ ID NO: 630033 - protein, 20 aa, Mycobacterium
AFEQDVVWPKLEAAVDRDKL

SEQ ID NO: 630034 - protein, 17 aa, Mycobacterium
AFEQFALDYLRIRKITC

SEQ ID NO: 630035 - protein, 25 aa, Mycobacterium
AFEREVDELIGPDVTRSWERDLPSY

SEQ ID NO: 630036 - protein, 18 aa, Mycobacterium
AFERRWQLGGVLFSKTFS

SEQ ID NO: 630037 - protein, 17 aa, Mycobacterium
AFESELYPPPGSAARTE

SEQ ID NO: 630038 - protein, 19 aa, Mycobacterium
AFETLLRYDRPYSGYAPIM

SEQ ID NO: 630039 - protein, 18 aa, Mycobacterium
AFETSWLDPFTEFRFPRI

SEQ ID NO: 630040 - protein, 28 aa, Mycobacterium
AFEVARRFESLAGRRPVVVFASGSRAPS

SEQ ID NO: 630041 - protein, 22 aa, Mycobacterium
AFEVNEAFAPVPLAWIAETGAD

SEQ ID NO: 630042 - protein, 20 aa, Mycobacterium
AFEYVRELLSYLPPNNATDA

SEQ ID NO: 630043 - protein, 26 aa, Mycobacterium
AFFALPWFFRNGYDVLLYTLPFHGRR

SEQ ID NO: 630044 - protein, 20 aa, Mycobacterium
AFFCVVDLHAITVAQDPEAL

SEQ ID NO: 630045 - protein, 18 aa, Mycobacterium
AFFGLPLAEKNRWRRPAS

SEQ ID NO: 630046 - protein, 26 aa, Mycobacterium
AFFGRSGLRRNIRWDPLDSVYFAGYA

SEQ ID NO: 630047 - protein, 19 aa, Mycobacterium
AFFLCRRASRLRAHAAQWA

SEQ ID NO: 630048 - protein, 18 aa, Mycobacterium
AFFMLAFTKIGLMPDGGA

SEQ ID NO: 630049 - protein, 17 aa, Mycobacterium
AFFPFPDGLEVLSQAGV

SEQ ID NO: 630050 - protein, 25 aa, Mycobacterium
AFGAGIGCAFARPGRTVVIAGDGAF

SEQ ID NO: 630051 - protein, 17 aa, Mycobacterium
AFGAPLRDAYAEGRLPR

SEQ ID NO: 630052 - protein, 18 aa, Mycobacterium
AFGAQWAAFARSALFPAL

SEQ ID NO: 630053 - protein, 18 aa, Mycobacterium
AFGARAISVDGHRLEAID

SEQ ID NO: 630054 - protein, 23 aa, Mycobacterium
AFGASPRASLGIIAAARSLALVR

SEQ ID NO: 630055 - protein, 23 aa, Mycobacterium
AFGASPRASLGIIAASRALALVR

SEQ ID NO: 630056 - protein, 26 aa, Mycobacterium
AFGCGGEVFAGLTLEPVVVLQRGAQR

SEQ ID NO: 630057 - protein, 26 aa, Mycobacterium
AFGDHAVELGSRFAVPAAVSVYNARL

SEQ ID NO: 630058 - protein, 19 aa, Mycobacterium
AFGDKVAPLYFPVGDGESC

SEQ ID NO: 630059 - protein, 24 aa, Mycobacterium
AFGDSIPGPVLRASIGDQVVVTVK

SEQ ID NO: 630060 - protein, 20 aa, Mycobacterium
AFGELFLRHQRQLHRLARLT

SEQ ID NO: 630061 - protein, 24 aa, Mycobacterium
AFGEVVALMPGWGVREVLRSPKAR

SEQ ID NO: 630062 - protein, 19 aa, Mycobacterium
AFGFCGDGEGGPFVADGHI

SEQ ID NO: 630063 - protein, 20 aa, Mycobacterium
AFGGCIALLSGRRSAAVHPD

SEQ ID NO: 630064 - protein, 24 aa, Mycobacterium
AFGGDFIFGSAVWQIAHAHSAFAP

SEQ ID NO: 630065 - protein, 19 aa, Mycobacterium
AFGGFPLPSAVRIPTQYLI

SEQ ID NO: 630066 - protein, 21 aa, Mycobacterium
AFGGFVFYFGVPDDDWYPISM

SEQ ID NO: 630067 - protein, 19 aa, Mycobacterium
AFGGMKSWVARAADGSGDY

SEQ ID NO: 630068 - protein, 29 aa, Mycobacterium
AFGGMPVMPGSGVGRGMAAHFAAPRYGFK

SEQ ID NO: 630069 - protein, 24 aa, Mycobacterium
AFGGNGGNGGFIWGNGGVGGDAGD

SEQ ID NO: 630070 - protein, 18 aa, Mycobacterium
AFGGSLCHGLLHGWSLEK

SEQ ID NO: 630071 - protein, 18 aa, Mycobacterium
AFGGTFLQFSDYMRPAVR

SEQ ID NO: 630072 - protein, 17 aa, Mycobacterium
AFGGTPPPYPGWPNYAG

SEQ ID NO: 630073 - protein, 17 aa, Mycobacterium
AFGHRGAVRLSFTEPPE

SEQ ID NO: 630074 - protein, 18 aa, Mycobacterium
AFGKQWITECLKAAYPLG

SEQ ID NO: 630075 - protein, 19 aa, Mycobacterium
AFGMRSVLRGVDLEVPAGS

SEQ ID NO: 630076 - protein, 24 aa, Mycobacterium
AFGNLDKSPGIHVYGVVQAALAGA

SEQ ID NO: 630077 - protein, 23 aa, Mycobacterium
AFGPVCPQPVLANMPIDLGAPQD

SEQ ID NO: 630078 - protein, 18 aa, Mycobacterium
AFGPVLGERVMLGMDEPV

SEQ ID NO: 630079 - protein, 17 aa, Mycobacterium
AFGPVSTVIGYRDLDDA

SEQ ID NO: 630080 - protein, 20 aa, Mycobacterium
AFGQRFPDRLFDVGIAEQHA

SEQ ID NO: 630081 - protein, 21 aa, Mycobacterium
AFGQRFPDRLFDVGIAEQHAI

SEQ ID NO: 630082 - protein, 17 aa, Mycobacterium
AFGRAPADVSVNFVAGA

SEQ ID NO: 630083 - protein, 23 aa, Mycobacterium
AFGRGRPPVLYRASRRMDPSGPT

SEQ ID NO: 630084 - protein, 19 aa, Mycobacterium
AFGSFHMVDGFFLNNQLTD

SEQ ID NO: 630085 - protein, 20 aa, Mycobacterium
AFGSFHMVDGFLLNNQLSDF

SEQ ID NO: 630086 - protein, 20 aa, Mycobacterium
AFGSFHMVDGFLLNNQLTDF

SEQ ID NO: 630087 - protein, 22 aa, Mycobacterium
AFGSGALIRAAKWTNTTTLSAA

SEQ ID NO: 630088 - protein, 28 aa, Mycobacterium
AFGTELLAALGLHRVWERADAVMASAVP

SEQ ID NO: 630089 - protein, 20 aa, Mycobacterium
AFGVLGCYAEKVAVPVSNVV

SEQ ID NO: 630090 - protein, 18 aa, Mycobacterium
AFHAAGRCSTAAQEEFEQ

SEQ ID NO: 630091 - protein, 25 aa, Mycobacterium
AFHAPEFDGAWPYLRAIAHAIGAEP

SEQ ID NO: 630092 - protein, 17 aa, Mycobacterium
AFHDQFVQNLAASAGSY

SEQ ID NO: 630093 - protein, 23 aa, Mycobacterium
AFHGDFAFGQALFSYDLKAYRER

SEQ ID NO: 630094 - protein, 18 aa, Mycobacterium
AFHGRSGYTMSLTNTDPN

SEQ ID NO: 630095 - protein, 18 aa, Mycobacterium
AFHKIQTPWCLSHHPPSP

SEQ ID NO: 630096 - protein, 19 aa, Mycobacterium
AFHPAQVWDEIRAHGAVGF

SEQ ID NO: 630097 - protein, 18 aa, Mycobacterium
AFHPLGVGSPFWQEIDLQ

SEQ ID NO: 630098 - protein, 19 aa, Mycobacterium
AFHTSRWDYGYTGKNLERL

SEQ ID NO: 630099 - protein, 25 aa, Mycobacterium
AFHYLDPRGGYVNDHAWIVFDSAHL

SEQ ID NO: 630100 - protein, 24 aa, Mycobacterium
AFHYLDPRGGYVNDRGWMVFDSVH

SEQ ID NO: 630101 - protein, 19 aa, Mycobacterium
AFIEKAGTGGGLFRTLQAD

SEQ ID NO: 630102 - protein, 19 aa, Mycobacterium
AFIEKAGTGGGLFRTLQAQ

SEQ ID NO: 630103 - protein, 17 aa, Mycobacterium
AFIELAVKDALYGRASV

SEQ ID NO: 630104 - protein, 18 aa, Mycobacterium
AFIICASLVRQFEFAQNV

SEQ ID NO: 630105 - protein, 17 aa, Mycobacterium
AFILGHSKVTGFVVETA

SEQ ID NO: 630106 - protein, 29 aa, Mycobacterium
AFIPACGKCPPCMRGYRSLCDRGAILLGG

SEQ ID NO: 630107 - protein, 17 aa, Mycobacterium
AFIPWFPLASGPLAAPD

SEQ ID NO: 630108 - protein, 17 aa, Mycobacterium
AFIRRPQRWIKALSDGC

SEQ ID NO: 630109 - protein, 18 aa, Mycobacterium
AFISEGFVSPTRAGFNNL

SEQ ID NO: 630110 - protein, 18 aa, Mycobacterium
AFITGVARGQGRSHAIRL

SEQ ID NO: 630111 - protein, 23 aa, Mycobacterium
AFKEFYGHVLSWTFEPGRIADGW

SEQ ID NO: 630112 - protein, 35 aa, Mycobacterium
AFKLADMKSRIDAARLLVWRAGWMARNNQQFDSAE

SEQ ID NO: 630113 - protein, 36 aa, Mycobacterium
AFKLADMKSRIDAARLLVWRAGWMARNNQSFDAAEG

SEQ ID NO: 630114 - protein, 36 aa, Mycobacterium
AFKLADMKSRIDAARLLVWRAGWMARNNQSFDSAEG

SEQ ID NO: 630115 - protein, 27 aa, Mycobacterium
AFKPLSRYFDRVWRPEQLPAALLGAMR

SEQ ID NO: 630116 - protein, 24 aa, Mycobacterium
AFKVHVKGPFILTAALAPLMAQRG

SEQ ID NO: 630117 - protein, 20 aa, Mycobacterium
AFKVLYRLRALMQTGEVPTV

SEQ ID NO: 630118 - protein, 18 aa, Mycobacterium
AFLAAAYASRGIKMRFTS

SEQ ID NO: 630119 - protein, 18 aa, Mycobacterium
AFLASRLDGQWGGAFGTL

SEQ ID NO: 630120 - protein, 19 aa, Mycobacterium
AFLASRLGGQWGSAFGTLP

SEQ ID NO: 630121 - protein, 19 aa, Mycobacterium
AFLATRLGGQWGGAFGTLP

SEQ ID NO: 630122 - protein, 17 aa, Mycobacterium
AFLAYAAAPPKVDINPK

SEQ ID NO: 630123 - protein, 28 aa, Mycobacterium
AFLDALAYRRCRDHLPATSLAWGYWQNS

SEQ ID NO: 630124 - protein, 23 aa, Mycobacterium
AFLDGARRWRNLDGLLITVPHKA

SEQ ID NO: 630125 - protein, 23 aa, Mycobacterium
AFLDGRIGFRSIVRTIADVLDVA

SEQ ID NO: 630126 - protein, 27 aa, Mycobacterium
AFLDRFEARYGRRPGHSMPGLSHDAAT

SEQ ID NO: 630127 - protein, 22 aa, Mycobacterium
AFLEAGAGWVPFFIDRLHEHYE

SEQ ID NO: 630128 - protein, 17 aa, Mycobacterium
AFLELRRLLAVHETAEE

SEQ ID NO: 630129 - protein, 17 aa, Mycobacterium
AFLERVQHWQGWADEMS

SEQ ID NO: 630130 - protein, 19 aa, Mycobacterium
AFLGGPVIKDGKPVDFGSF

SEQ ID NO: 630131 - protein, 18 aa, Mycobacterium
AFLGIPITVRAANFGNLY

SEQ ID NO: 630132 - protein, 27 aa, Mycobacterium
AFLGMPVIIRGAVYGSLYVTDDRPGRG

SEQ ID NO: 630133 - protein, 25 aa, Mycobacterium
AFLGSRRDTPVWVNALENEIERDED

SEQ ID NO: 630134 - protein, 26 aa, Mycobacterium
AFLGWARPGSDWERRFSAADGPASAL

SEQ ID NO: 630135 - protein, 23 aa, Mycobacterium
AFLHCAFIKAGMPSPLRDEQLET

SEQ ID NO: 630136 - protein, 25 aa, Mycobacterium
AFLHPLPVRRLWGVGAVTADKLHAH

SEQ ID NO: 630137 - protein, 21 aa, Mycobacterium
AFLHRALVDAVAWKYITDNPA

SEQ ID NO: 630138 - protein, 22 aa, Mycobacterium
AFLLNEMLVWGFTGQVICAMLD

SEQ ID NO: 630139 - protein, 23 aa, Mycobacterium
AFLLNEMLVWGFTGQVISAMLDV

SEQ ID NO: 630140 - protein, 29 aa, Mycobacterium
AFLMSCRVIGRGVEFAVWRAILDDTRIRG

SEQ ID NO: 630141 - protein, 19 aa, Mycobacterium
AFLNVCRHRGAQLCSESEG

SEQ ID NO: 630142 - protein, 19 aa, Mycobacterium
AFLPAMIDRHAGAIVNVSS

SEQ ID NO: 630143 - protein, 17 aa, Mycobacterium
AFLPAMVDRHAGAIVNV

SEQ ID NO: 630144 - protein, 19 aa, Mycobacterium
AFLPFPFDSVIAGGPSMAY

SEQ ID NO: 630145 - protein, 20 aa, Mycobacterium
AFLPGAIAKPMMKKAGVDRL

SEQ ID NO: 630146 - protein, 18 aa, Mycobacterium
AFLPGLLEHGGHIAFTAS

SEQ ID NO: 630147 - protein, 17 aa, Mycobacterium
AFLPYLIASGDGHVINI

SEQ ID NO: 630148 - protein, 23 aa, Mycobacterium
AFLPYSGVLLNWGKLPKRDTELV

SEQ ID NO: 630149 - protein, 23 aa, Mycobacterium
AFLQRPARWMQLLGRHRGQISSA

SEQ ID NO: 630150 - protein, 28 aa, Mycobacterium
AFLQRPARWMQLMGKFRGQISCAPNFGF

SEQ ID NO: 630151 - protein, 18 aa, Mycobacterium
AFLREALGVEVLSHVISI

SEQ ID NO: 630152 - protein, 17 aa, Mycobacterium
AFLRFSRTEIERIEDVR

SEQ ID NO: 630153 - protein, 22 aa, Mycobacterium
AFLRSGSDFITRGWAEKSATLT

SEQ ID NO: 630154 - protein, 18 aa, Mycobacterium
AFLTDWAAPVIEKAYAAG

SEQ ID NO: 630155 - protein, 19 aa, Mycobacterium
AFMALAARFLGPALTGVQP

SEQ ID NO: 630156 - protein, 20 aa, Mycobacterium
AFMGNPILCDLILIRSALSP

SEQ ID NO: 630157 - protein, 28 aa, Mycobacterium
AFMSATARLKCPFTSLGVAPEAASSYLL

SEQ ID NO: 630158 - protein, 17 aa, Mycobacterium
AFNAMPMRRAVHAVFEC

SEQ ID NO: 630159 - protein, 17 aa, Mycobacterium
AFNAQWVGVRTRFFDNF

SEQ ID NO: 630160 - protein, 24 aa, Mycobacterium
AFNERSEFRFGQVMTGLSSTADSR

SEQ ID NO: 630161 - protein, 24 aa, Mycobacterium
AFNERSEFRFGQVMTGLTTNADSR

SEQ ID NO: 630162 - protein, 22 aa, Mycobacterium
AFNERSGFRFGGAGRQPGVTPL

SEQ ID NO: 630163 - protein, 21 aa, Mycobacterium
AFNERSGMRFGGSGRTSGETP

SEQ ID NO: 630164 - protein, 21 aa, Mycobacterium
AFNERSGMRFGGSGRTSTETP

SEQ ID NO: 630165 - protein, 23 aa, Mycobacterium
AFNGEGKAAIAIGNPDYARNTAV

SEQ ID NO: 630166 - protein, 17 aa, Mycobacterium
AFNGVTVHGVLARTVVD

SEQ ID NO: 630167 - protein, 17 aa, Mycobacterium
AFNNIGFGNVGDTNIGF

SEQ ID NO: 630168 - protein, 26 aa, Mycobacterium
AFNRELCARFGVPPIEFDGQRDAMLH

SEQ ID NO: 630169 - protein, 25 aa, Mycobacterium
AFNRPEFLDYFAAHHVQVPLRRGDA

SEQ ID NO: 630170 - protein, 23 aa, Mycobacterium
AFNSWKALSWLDANVMRHVAPKG

SEQ ID NO: 630171 - protein, 20 aa, Mycobacterium
AFPEDYKQAFAPQDAIADIS

SEQ ID NO: 630172 - protein, 23 aa, Mycobacterium
AFPEGTTWCGLAHGPFRPAMFQA

SEQ ID NO: 630173 - protein, 23 aa, Mycobacterium
AFPKLFRSEVDWDYTTEPEPQLG

SEQ ID NO: 630174 - protein, 17 aa, Mycobacterium
AFPKRCGHLPDKELVSA

SEQ ID NO: 630175 - protein, 18 aa, Mycobacterium
AFPPMAVSLSLADEIDIS

SEQ ID NO: 630176 - protein, 19 aa, Mycobacterium
AFPRTFGLGERYRHALHLD

SEQ ID NO: 630177 - protein, 24 aa, Mycobacterium
AFQALRGRGRRPLIANPFQSCAGR

SEQ ID NO: 630178 - protein, 27 aa, Mycobacterium
AFQGLTAVWKRGEDVFAEIAVSEDLDV

SEQ ID NO: 630179 - protein, 28 aa, Mycobacterium
AFQGVSMPLWLSRLVALLIPEHDDRTEA

SEQ ID NO: 630180 - protein, 25 aa, Mycobacterium
AFQQARARFEAAWNHHDGGGHPIND

SEQ ID NO: 630181 - protein, 20 aa, Mycobacterium
AFQRQRFWLPPAPTGSVDPA

SEQ ID NO: 630182 - protein, 19 aa, Mycobacterium
AFQSGLSWLTILRKRENFR

SEQ ID NO: 630183 - protein, 22 aa, Mycobacterium
AFRAALRDLTLMLVYEATRDAP

SEQ ID NO: 630184 - protein, 19 aa, Mycobacterium
AFRAFSYGSLYPALRRMQT

SEQ ID NO: 630185 - protein, 19 aa, Mycobacterium
AFRDAGYVVVLFDYRHFGA

SEQ ID NO: 630186 - protein, 26 aa, Mycobacterium
AFRDRIIPAVDRFEPELIIVSAGFDA

SEQ ID NO: 630187 - protein, 18 aa, Mycobacterium
AFRDRLHRFSAQRRQRLT

SEQ ID NO: 630188 - protein, 18 aa, Mycobacterium
AFREELRAFLAQIVTEDV

SEQ ID NO: 630189 - protein, 24 aa, Mycobacterium
AFREINCLPFAPARDNPYSGAGIL

SEQ ID NO: 630190 - protein, 25 aa, Mycobacterium
AFRERLRTWLTLHVKEFCATGDEYW

SEQ ID NO: 630191 - protein, 17 aa, Mycobacterium
AFRGHATLILIGDPKQA

SEQ ID NO: 630192 - protein, 29 aa, Mycobacterium
AFRGSAPQGPGFWFPPTVLTPARDDRTVV

SEQ ID NO: 630193 - protein, 19 aa, Mycobacterium
AFRLDVPVFGRLVIVADPR

SEQ ID NO: 630194 - protein, 18 aa, Mycobacterium
AFRLRWREVKRANKSRLA

SEQ ID NO: 630195 - protein, 24 aa, Mycobacterium
AFRNCTFERTALWHSTFQQCSLLG

SEQ ID NO: 630196 - protein, 18 aa, Mycobacterium
AFRNDYRALQAYHRGTEV

SEQ ID NO: 630197 - protein, 28 aa, Mycobacterium
AFRNELWQQRFPGLDWKVTAGNSSPIND

SEQ ID NO: 630198 - protein, 18 aa, Mycobacterium
AFRPLGRVPDRGRLAREL

SEQ ID NO: 630199 - protein, 24 aa, Mycobacterium
AFRQRFGEHFFYILYFQQPGVADA

SEQ ID NO: 630200 - protein, 24 aa, Mycobacterium
AFRQRYWARNHVGWRHMADTLPNA

SEQ ID NO: 630201 - protein, 18 aa, Mycobacterium
AFRRGDAVMGLFPNNAFA

SEQ ID NO: 630202 - protein, 18 aa, Mycobacterium
AFRRTYPFSPALVSTLRT

SEQ ID NO: 630203 - protein, 20 aa, Mycobacterium
AFRTALRDLTLMLVYEATGS

SEQ ID NO: 630204 - protein, 20 aa, Mycobacterium
AFRTLCRELELATTGTVSGL

SEQ ID NO: 630205 - protein, 18 aa, Mycobacterium
AFRTVRRDGIGIVVVTHA

SEQ ID NO: 630206 - protein, 20 aa, Mycobacterium
AFRVLRPGGRYAIHELGLMP

SEQ ID NO: 630207 - protein, 20 aa, Mycobacterium
AFRVLRPGGRYAIHELGLSP

SEQ ID NO: 630208 - protein, 20 aa, Mycobacterium
AFRVVRDHVTAVFRHDDLAS

SEQ ID NO: 630209 - protein, 18 aa, Mycobacterium
AFRVVRDHVTSVFRHDDL

SEQ ID NO: 630210 - protein, 22 aa, Mycobacterium
AFSAGGDMVMFGRLIEDPVARQ

SEQ ID NO: 630211 - protein, 28 aa, Mycobacterium
AFSDGRVAARVCIWVNKFQEETTVTASF

SEQ ID NO: 630212 - protein, 20 aa, Mycobacterium
AFSGEAGVFGQMALSSLAGR

SEQ ID NO: 630213 - protein, 19 aa, Mycobacterium
AFSGFAVVKPQVAFFEPYG

SEQ ID NO: 630214 - protein, 27 aa, Mycobacterium
AFSHFAFAHSLPFDIDRHGGLSGLEAR

SEQ ID NO: 630215 - protein, 24 aa, Mycobacterium
AFSKLFRSDVDWDYLTEPQPQLNN

SEQ ID NO: 630216 - protein, 17 aa, Mycobacterium
AFSKRPAFFGGVTNVAW

SEQ ID NO: 630217 - protein, 20 aa, Mycobacterium
AFSLHYPWSQRLPVHSLDGT

SEQ ID NO: 630218 - protein, 17 aa, Mycobacterium
AFSPARQVMYVTRNPEH

SEQ ID NO: 630219 - protein, 21 aa, Mycobacterium
AFSPLRLGPLTLKNRFIKAAT

SEQ ID NO: 630220 - protein, 20 aa, Mycobacterium
AFSQIGAGFKSMFGGELQGM

SEQ ID NO: 630221 - protein, 17 aa, Mycobacterium
AFSRYGAHLPKVNVLPI

SEQ ID NO: 630222 - protein, 24 aa, Mycobacterium
AFSYSHLFAAMAFAKGIGGDSHFF

SEQ ID NO: 630223 - protein, 27 aa, Mycobacterium
AFTAAFMVATAWEWELADRLRLASACA

SEQ ID NO: 630224 - protein, 20 aa, Mycobacterium
AFTAEAAQLLALNQAAQEEL

SEQ ID NO: 630225 - protein, 22 aa, Mycobacterium
AFTAHFDRLYTRLARPYDLAVK

SEQ ID NO: 630226 - protein, 19 aa, Mycobacterium
AFTELRGGLTGTATYRDET

SEQ ID NO: 630227 - protein, 18 aa, Mycobacterium
AFTEVAERIIGARATGSD

SEQ ID NO: 630228 - protein, 19 aa, Mycobacterium
AFTGFRAGQHINLSVEING

SEQ ID NO: 630229 - protein, 25 aa, Mycobacterium
AFTHSLALEYARDGLRAVCVAPGSI

SEQ ID NO: 630230 - protein, 24 aa, Mycobacterium
AFTHSLALEYAREGLRAVCVAPGS

SEQ ID NO: 630231 - protein, 43 aa, Mycobacterium
AFTISGKYGYSYKVLGIKFNYPFKYSFDIPAITIPSIQIGGSS

SEQ ID NO: 630232 - protein, 26 aa, Mycobacterium
AFTLSILKFRGHRVLHRMITEEPGLV

SEQ ID NO: 630233 - protein, 24 aa, Mycobacterium
AFTLSILRFRRHRVLNQMMKDEPA

SEQ ID NO: 630234 - protein, 20 aa, Mycobacterium
AFTPNEPQATAGNPGGSGIT

SEQ ID NO: 630235 - protein, 18 aa, Mycobacterium
AFTPRPVPTVATDHVHAP

SEQ ID NO: 630236 - protein, 23 aa, Mycobacterium
AFTPRRIAALTCAIEDLADQLTA

SEQ ID NO: 630237 - protein, 18 aa, Mycobacterium
AFTPRRVAALTSAIEDLA

SEQ ID NO: 630238 - protein, 19 aa, Mycobacterium
AFTPWYLVRYFRLLKFKLA

SEQ ID NO: 630239 - protein, 21 aa, Mycobacterium
AFTQRRLFAVVTLTVREGLVL

SEQ ID NO: 630240 - protein, 26 aa, Mycobacterium
AFTRPDARSALARRKVWTLIPHLQEF

SEQ ID NO: 630241 - protein, 23 aa, Mycobacterium
AFTRPRLTGYVGQVAPCVRAAVP

SEQ ID NO: 630242 - protein, 19 aa, Mycobacterium
AFTWQGRRELVGQMHDQLD

SEQ ID NO: 630243 - protein, 32 aa, Mycobacterium
AFVAARRFAIPAVEAKGSLLLEDVGVPLPALA

SEQ ID NO: 630244 - protein, 32 aa, Mycobacterium
AFVAARRFAIPAVEAKGSLLLEDVGVPLPKLA

SEQ ID NO: 630245 - protein, 22 aa, Mycobacterium
AFVAAYGPYLAWLAQASADTAT

SEQ ID NO: 630246 - protein, 22 aa, Mycobacterium
AFVAGLICALREGASPSQAGRR

SEQ ID NO: 630247 - protein, 19 aa, Mycobacterium
AFVARARELAAKYGDRFLP

SEQ ID NO: 630248 - protein, 29 aa, Mycobacterium
AFVASQADVIWKLRYTMRSQIFSRGLPWP

SEQ ID NO: 630249 - protein, 26 aa, Mycobacterium
AFVAWQSARCVARWDGPKADKGLRRW

SEQ ID NO: 630250 - protein, 23 aa, Mycobacterium
AFVEDAIACGHSVGEYTALACVT

SEQ ID NO: 630251 - protein, 26 aa, Mycobacterium
AFVEFTFPIAAHFHSLIPVSDLMEEA

SEQ ID NO: 630252 - protein, 24 aa, Mycobacterium
AFVFDPRTPYVVFWVVDPDTGERV

SEQ ID NO: 630253 - protein, 18 aa, Mycobacterium
AFVGRAALRRMVTEEEVA

SEQ ID NO: 630254 - protein, 21 aa, Mycobacterium
AFVHAHPRWIAQAFADALGPS

SEQ ID NO: 630255 - protein, 21 aa, Mycobacterium
AFVHAHPRWIAQAFADALGTA

SEQ ID NO: 630256 - protein, 23 aa, Mycobacterium
AFVPERRIGIVMLANKNFPIPAR

SEQ ID NO: 630257 - protein, 20 aa, Mycobacterium
AFVPNIERNGGGAILNVLSV

SEQ ID NO: 630258 - protein, 18 aa, Mycobacterium
AFVQAANMAVLWHLPVVI

SEQ ID NO: 630259 - protein, 19 aa, Mycobacterium
AFVRDLRGGVVLVSHDREF

SEQ ID NO: 630260 - protein, 17 aa, Mycobacterium
AFVRLMFRHRHRRWRKL

SEQ ID NO: 630261 - protein, 18 aa, Mycobacterium
AFVSFPVTQWTRWRRPVI

SEQ ID NO: 630262 - protein, 19 aa, Mycobacterium
AFVSLPWPVPPGADVEATA

SEQ ID NO: 630263 - protein, 21 aa, Mycobacterium
AFVVSADWSIGGWNRAYELLY

SEQ ID NO: 630264 - protein, 19 aa, Mycobacterium
AFVVSGARPERWVRQTNFD

SEQ ID NO: 630265 - protein, 22 aa, Mycobacterium
AFWGLDWPREISIVAAGTDEEF

SEQ ID NO: 630266 - protein, 22 aa, Mycobacterium
AFYAGDPFPAYRELRATDPVTW

SEQ ID NO: 630267 - protein, 26 aa, Mycobacterium
AFYDALDFAERVLAEAAVQGYATDDI

SEQ ID NO: 630268 - protein, 19 aa, Mycobacterium
AFYDRLRELFAAKKSITTF

SEQ ID NO: 630269 - protein, 18 aa, Mycobacterium
AFYERLRELFAANKSITT

SEQ ID NO: 630270 - protein, 20 aa, Mycobacterium
AFYERLRELFAQKKSITTFG

SEQ ID NO: 630271 - protein, 19 aa, Mycobacterium
AFYFACPATVLGPYDDAPM

SEQ ID NO: 630272 - protein, 19 aa, Mycobacterium
AFYGPQFALTFPILTHYGV

SEQ ID NO: 630273 - protein, 20 aa, Mycobacterium
AFYNLCRHRGNKLVWNDYPG

SEQ ID NO: 630274 - protein, 19 aa, Mycobacterium
AFYNMGLRLLRHVQDAVRA

SEQ ID NO: 630275 - protein, 27 aa, Mycobacterium
AFYPIPRPRPALGAATIWAIDDFTAAN

SEQ ID NO: 630276 - protein, 19 aa, Mycobacterium
AFYPYAIEHMRRGAEKANR

SEQ ID NO: 630277 - protein, 27 aa, Mycobacterium
AFYQFLGPPGSMWSQWLTLPAAAGPIV

SEQ ID NO: 630278 - protein, 17 aa, Mycobacterium
AFYRDALGFEVRLDVGH

SEQ ID NO: 630279 - protein, 21 aa, Mycobacterium
AFYRWRKAPVSQRDWDDAHLI

SEQ ID NO: 630280 - protein, 27 aa, Mycobacterium
AFYSEAMKALFPQINWSITPGNSSPLS

SEQ ID NO: 630281 - protein, 18 aa, Mycobacterium
AGAAAAFAHALRREDADA

SEQ ID NO: 630282 - protein, 18 aa, Mycobacterium
AGAAAFKVLYRLRALMQT

SEQ ID NO: 630283 - protein, 19 aa, Mycobacterium
AGAAAPPRPRWCRVPGRRP

SEQ ID NO: 630284 - protein, 19 aa, Mycobacterium
AGAAAPYAAWMSTTAAQAE

SEQ ID NO: 630285 - protein, 19 aa, Mycobacterium
AGAAAQARAAAAVFEAALG

SEQ ID NO: 630286 - protein, 20 aa, Mycobacterium
AGAAARFTELTTRATVLQNA

SEQ ID NO: 630287 - protein, 31 aa, Mycobacterium
AGAAATPWLAATVGFAWRTRLSVSASVDARV

SEQ ID NO: 630288 - protein, 30 aa, Mycobacterium
AGAADPACGAGRAALTPGAPSADVSARSAG

SEQ ID NO: 630289 - protein, 18 aa, Mycobacterium
AGAAEGFALLSNLRPARA

SEQ ID NO: 630290 - protein, 24 aa, Mycobacterium
AGAAELGAQCWLVDDARLAMLIED

SEQ ID NO: 630291 - protein, 26 aa, Mycobacterium
AGAAESRPALMLSWIRDVPALGAAAR

SEQ ID NO: 630292 - protein, 18 aa, Mycobacterium
AGAAFFTPTLVKGGEMIV

SEQ ID NO: 630293 - protein, 18 aa, Mycobacterium
AGAAFFVPTIIKGGELVV

SEQ ID NO: 630294 - protein, 28 aa, Mycobacterium
AGAAFSRGLWWSALRATDWAAADRQRLA

SEQ ID NO: 630295 - protein, 21 aa, Mycobacterium
AGAAGDLWSLCQIYSHQATVG

SEQ ID NO: 630296 - protein, 21 aa, Mycobacterium
AGAAGGILWGNGGSGGSGAAG

SEQ ID NO: 630297 - protein, 19 aa, Mycobacterium
AGAAGRPVINVETAILDDD

SEQ ID NO: 630298 - protein, 20 aa, Mycobacterium
AGAAGWCTAAPNLRPQPCID

SEQ ID NO: 630299 - protein, 19 aa, Mycobacterium
AGAAIKQLWLPGPDPEPHY

SEQ ID NO: 630300 - protein, 27 aa, Mycobacterium
AGAAPMLDAAVAWGGLAEELGTAARSF

SEQ ID NO: 630301 - protein, 18 aa, Mycobacterium
AGAAPWLRDGDVIVITSK

SEQ ID NO: 630302 - protein, 22 aa, Mycobacterium
AGAAPYTSWLTLAAAHAQRAAE

SEQ ID NO: 630303 - protein, 20 aa, Mycobacterium
AGAARWLVLSGPPGIGKTRL

SEQ ID NO: 630304 - protein, 17 aa, Mycobacterium
AGAATDLAGLGSTLQIA

SEQ ID NO: 630305 - protein, 24 aa, Mycobacterium
AGAAWIDPRVRAHVDALADPDTGY

SEQ ID NO: 630306 - protein, 24 aa, Mycobacterium
AGAAWIDPRVRGHVEALANPETGY

SEQ ID NO: 630307 - protein, 18 aa, Mycobacterium
AGAAWKDNLRTVGAATGR

SEQ ID NO: 630308 - protein, 21 aa, Mycobacterium
AGACPEHVLIIGGTGNLGLEF

SEQ ID NO: 630309 - protein, 22 aa, Mycobacterium
AGACPHVVYHLAARTEHDAVAP

SEQ ID NO: 630310 - protein, 29 aa, Mycobacterium
AGADAFLGWQAARCVARWDGAAKVDKGLR

SEQ ID NO: 630311 - protein, 19 aa, Mycobacterium
AGADAIYPGYGFLSENPDL

SEQ ID NO: 630312 - protein, 18 aa, Mycobacterium
AGADAVIYHARFGPTLAE

SEQ ID NO: 630313 - protein, 21 aa, Mycobacterium
AGADCGRCRRTVRAIIASSSG

SEQ ID NO: 630314 - protein, 30 aa, Mycobacterium
AGADEVSAAIAALFDEHALGYQTISAQASA

SEQ ID NO: 630315 - protein, 25 aa, Mycobacterium
AGADEVSAAISFLFGAHAQAYQALS

SEQ ID NO: 630316 - protein, 27 aa, Mycobacterium
AGADEVSALIAGLFDAHAQAYQALSAQ

SEQ ID NO: 630317 - protein, 27 aa, Mycobacterium
AGADEVSAVIAALFAAHGQAYQTLSAQ

SEQ ID NO: 630318 - protein, 34 aa, Mycobacterium
AGADEVSAVIAALFGTHALEYQAISTQLSVFHEQ

SEQ ID NO: 630319 - protein, 30 aa, Mycobacterium
AGADEVSVGIAALFTDHAQQYDVVLREFLD

SEQ ID NO: 630320 - protein, 18 aa, Mycobacterium
AGADIAICDRCENSDVVG

SEQ ID NO: 630321 - protein, 23 aa, Mycobacterium
AGADIPVNRLRAGQVDVAELAEL

SEQ ID NO: 630322 - protein, 19 aa, Mycobacterium
AGADISLHRGGTVSSESVD

SEQ ID NO: 630323 - protein, 17 aa, Mycobacterium
AGADLALEAHLISPWGT

SEQ ID NO: 630324 - protein, 18 aa, Mycobacterium
AGADLKAMNKRAPGDQFS

SEQ ID NO: 630325 - protein, 18 aa, Mycobacterium
AGADLLAISRRENIYHPD

SEQ ID NO: 630326 - protein, 18 aa, Mycobacterium
AGADLSALGAAGGDKAET

SEQ ID NO: 630327 - protein, 17 aa, Mycobacterium
AGADQWQPGVLIDDDTV

SEQ ID NO: 630328 - protein, 19 aa, Mycobacterium
AGADSEFDGGNGGNGGSAQ

SEQ ID NO: 630329 - protein, 25 aa, Mycobacterium
AGADSGWSASSPNGGDGGVGGDGGR

SEQ ID NO: 630330 - protein, 23 aa, Mycobacterium
AGADSLKGLCPFHDEKTPSFHVR

SEQ ID NO: 630331 - protein, 23 aa, Mycobacterium
AGADSLKGLCPFHNEKSPSFHVR

SEQ ID NO: 630332 - protein, 25 aa, Mycobacterium
AGAEAFATPGYRGWAAHARGAVLVR

SEQ ID NO: 630333 - protein, 24 aa, Mycobacterium
AGAEAKGSGLLRGIPLSGTGRGAG

SEQ ID NO: 630334 - protein, 19 aa, Mycobacterium
AGAEHWDGRAGDLIEIPDA

SEQ ID NO: 630335 - protein, 18 aa, Mycobacterium
AGAENFFLFGLTESQVEK

SEQ ID NO: 630336 - protein, 24 aa, Mycobacterium
AGAEPRLTFEVIEVLRSGEPTVLM

SEQ ID NO: 630337 - protein, 29 aa, Mycobacterium
AGAFGGAGSSPGFLSPAGNGGAGGDAGTA

SEQ ID NO: 630338 - protein, 26 aa, Mycobacterium
AGAFLRAGAINRILAYVAPILLGGPV

SEQ ID NO: 630339 - protein, 19 aa, Mycobacterium
AGAFRRGRLLLAGDAAHLM

SEQ ID NO: 630340 - protein, 17 aa, Mycobacterium
AGAGALLSMAFPTALVG

SEQ ID NO: 630341 - protein, 18 aa, Mycobacterium
AGAGAVHLAAPGRIHRRR

SEQ ID NO: 630342 - protein, 18 aa, Mycobacterium
AGAGDIWVVGGGDLAGQF

SEQ ID NO: 630343 - protein, 17 aa, Mycobacterium
AGAGGFGGYGTTGGGTG

SEQ ID NO: 630344 - protein, 24 aa, Mycobacterium
AGAGGNGGSALLFGSGGAGGQGGT

SEQ ID NO: 630345 - protein, 23 aa, Mycobacterium
AGAGLSIGDLVARLALALEHAAG

SEQ ID NO: 630346 - protein, 25 aa, Mycobacterium
AGAGMLRFAPLNSFPDNRNLDKARR

SEQ ID NO: 630347 - protein, 24 aa, Mycobacterium
AGAGPRHFGFVIGGSLPAALGADW

SEQ ID NO: 630348 - protein, 24 aa, Mycobacterium
AGAHARLIVATAYFPQSEDARAAD

SEQ ID NO: 630349 - protein, 18 aa, Mycobacterium
AGAHCVQMLLAVPAAAGL

SEQ ID NO: 630350 - protein, 17 aa, Mycobacterium
AGAHFSLVLTKTRAVAA

SEQ ID NO: 630351 - protein, 20 aa, Mycobacterium
AGAIASRLAFTATVEVRVPL

SEQ ID NO: 630352 - protein, 17 aa, Mycobacterium
AGAIAYRALAREFIDRF

SEQ ID NO: 630353 - protein, 17 aa, Mycobacterium
AGAIGLGVMKRCAQLIY

SEQ ID NO: 630354 - protein, 23 aa, Mycobacterium
AGAIGYKIHEDWGATPAAIRASL

SEQ ID NO: 630355 - protein, 27 aa, Mycobacterium
AGAIGYLLKDRVMALTQFLDAVQRVAS

SEQ ID NO: 630356 - protein, 17 aa, Mycobacterium
AGAILGVVGVHKEPVPV

SEQ ID NO: 630357 - protein, 18 aa, Mycobacterium
AGAILRKSVEDLGIGVHT

SEQ ID NO: 630358 - protein, 23 aa, Mycobacterium
AGAIPVLAIYGIPHRDCGSFAAG

SEQ ID NO: 630359 - protein, 20 aa, Mycobacterium
AGAIQALWASRLGSLFYDNA

SEQ ID NO: 630360 - protein, 18 aa, Mycobacterium
AGAIRRFTFPFAVVHEEI

SEQ ID NO: 630361 - protein, 22 aa, Mycobacterium
AGAKAVAAGRAWGQKLDSSLEA

SEQ ID NO: 630362 - protein, 23 aa, Mycobacterium
AGAKERPLWHALRTVAGRITTPL

SEQ ID NO: 630363 - protein, 22 aa, Mycobacterium
AGAKFTTAFSRRGLIAEYGISW

SEQ ID NO: 630364 - protein, 22 aa, Mycobacterium
AGAKGMRNRVTWTVKQFDPPSA

SEQ ID NO: 630365 - protein, 17 aa, Mycobacterium
AGAKIGAFFDLDGTLVA

SEQ ID NO: 630366 - protein, 20 aa, Mycobacterium
AGAKSVEWIDFDALDTENHP

SEQ ID NO: 630367 - protein, 21 aa, Mycobacterium
AGAKYRGEFEERLKAVLDDIK

SEQ ID NO: 630368 - protein, 23 aa, Mycobacterium
AGALCVYLEPIALYHTKDLHEDG

SEQ ID NO: 630369 - protein, 20 aa, Mycobacterium
AGALGALIDAPAFVANGFLN

SEQ ID NO: 630370 - protein, 24 aa, Mycobacterium
AGALGRSAAGLSLLGKGVEGFDAL

SEQ ID NO: 630371 - protein, 21 aa, Mycobacterium
AGALKAGRLVVMPTDTVYGIG

SEQ ID NO: 630372 - protein, 22 aa, Mycobacterium
AGALKCWTHVQNQARNCGSLAE

SEQ ID NO: 630373 - protein, 17 aa, Mycobacterium
AGALKGPLHGGANEAVM

SEQ ID NO: 630374 - protein, 18 aa, Mycobacterium
AGALKLGPELGAGSVIVV

SEQ ID NO: 630375 - protein, 20 aa, Mycobacterium
AGALLLPYLRFLEAAEDVRY

SEQ ID NO: 630376 - protein, 25 aa, Mycobacterium
AGALPFRVVASYAIKSPPPGGRFED

SEQ ID NO: 630377 - protein, 18 aa, Mycobacterium
AGALPRHTVAPLIIRTFE

SEQ ID NO: 630378 - protein, 17 aa, Mycobacterium
AGALRAALAAVREADSP

SEQ ID NO: 630379 - protein, 18 aa, Mycobacterium
AGALRAATHADLQTTSAA

SEQ ID NO: 630380 - protein, 24 aa, Mycobacterium
AGALRFSDRVGALAHAVALQGQGK

SEQ ID NO: 630381 - protein, 22 aa, Mycobacterium
AGALRGSRKMMLAGAAMSAIGV

SEQ ID NO: 630382 - protein, 20 aa, Mycobacterium
AGALRLGIARALIVASPDDR

SEQ ID NO: 630383 - protein, 20 aa, Mycobacterium
AGALRVRMFAANLGVAEDEA

SEQ ID NO: 630384 - protein, 22 aa, Mycobacterium
AGALSDTVSLPFVTATRAPVWV

SEQ ID NO: 630385 - protein, 18 aa, Mycobacterium
AGALVVLIDGELTWFVER

SEQ ID NO: 630386 - protein, 18 aa, Mycobacterium
AGALVVLVDGHLAWFLER

SEQ ID NO: 630387 - protein, 22 aa, Mycobacterium
AGAMPARYVIHAATMEPGGPTS

SEQ ID NO: 630388 - protein, 18 aa, Mycobacterium
AGAMQVLRLVLSQVGDDL

SEQ ID NO: 630389 - protein, 17 aa, Mycobacterium
AGAMVRAIWFRGTEHRA

SEQ ID NO: 630390 - protein, 24 aa, Mycobacterium
AGANEQWIPGGFLPDGASEAVVDG

SEQ ID NO: 630391 - protein, 18 aa, Mycobacterium
AGANLQLPPLGSPVSSPM

SEQ ID NO: 630392 - protein, 23 aa, Mycobacterium
AGAPEAPTRIVAWTDTAAHDVTV

SEQ ID NO: 630393 - protein, 21 aa, Mycobacterium
AGAPFCGYSSELLTGTLQGPS

SEQ ID NO: 630394 - protein, 21 aa, Mycobacterium
AGAPGGWLLGDGGAGGSAAAT

SEQ ID NO: 630395 - protein, 17 aa, Mycobacterium
AGAPLGHDYAVISLSDR

SEQ ID NO: 630396 - protein, 19 aa, Mycobacterium
AGAPLPAGVLIHPRVEPEL

SEQ ID NO: 630397 - protein, 32 aa, Mycobacterium
AGAPPCAPRWRWWRSSWWRVFSPAASCGTPCS

SEQ ID NO: 630398 - protein, 25 aa, Mycobacterium
AGAPPRPSVGYLIYGIGRHANDKVR

SEQ ID NO: 630399 - protein, 18 aa, Mycobacterium
AGAQFSLVLTKTRAVAAA

SEQ ID NO: 630400 - protein, 25 aa, Mycobacterium
AGAQRFAIGMAEVMVATAAGDYPAA

SEQ ID NO: 630401 - protein, 19 aa, Mycobacterium
AGAQWRAVVEKAADEALTL

SEQ ID NO: 630402 - protein, 20 aa, Mycobacterium
AGARCATVAYAVVDPEPDTG

SEQ ID NO: 630403 - protein, 17 aa, Mycobacterium
AGARCVTEKLAGGQLAC

SEQ ID NO: 630404 - protein, 22 aa, Mycobacterium
AGARFSGGVFGCAGLTHRELTG

SEQ ID NO: 630405 - protein, 17 aa, Mycobacterium
AGARFTGGVLACTALAE

SEQ ID NO: 630406 - protein, 18 aa, Mycobacterium
AGARGAAVTACASTATVA

SEQ ID NO: 630407 - protein, 24 aa, Mycobacterium
AGARGWRLAGARAQLERAAARWAD

SEQ ID NO: 630408 - protein, 25 aa, Mycobacterium
AGARISVVVDQPWRALALAEMITET

SEQ ID NO: 630409 - protein, 23 aa, Mycobacterium
AGARLQAQFPVSIVIDGVGVNLT

SEQ ID NO: 630410 - protein, 26 aa, Mycobacterium
AGARLSVVVGESWRAEALAEMMREAG

SEQ ID NO: 630411 - protein, 31 aa, Mycobacterium
AGARPAVVPLSFAQSRLWFTGQLQGPSPVYN

SEQ ID NO: 630412 - protein, 28 aa, Mycobacterium
AGARRLYTSRGWLPWHGPTSVLSPTGPT

SEQ ID NO: 630413 - protein, 25 aa, Mycobacterium
AGARRSGGALAAFAAVAAESAGAAV

SEQ ID NO: 630414 - protein, 17 aa, Mycobacterium
AGARVAVTGTKPAADDY

SEQ ID NO: 630415 - protein, 17 aa, Mycobacterium
AGARWRSQIRAIAHATR

SEQ ID NO: 630416 - protein, 20 aa, Mycobacterium
AGASCDRPDIPGFAMSASND

SEQ ID NO: 630417 - protein, 19 aa, Mycobacterium
AGASCNGGAGGAGGNPGAP

SEQ ID NO: 630418 - protein, 24 aa, Mycobacterium
AGASFLRRDGSVWTTDKDGIIAAL

SEQ ID NO: 630419 - protein, 22 aa, Mycobacterium
AGASGFQIAPAIAEEVERLTVF

SEQ ID NO: 630420 - protein, 17 aa, Mycobacterium
AGASGFQIAPAIAPDVE

SEQ ID NO: 630421 - protein, 25 aa, Mycobacterium
AGASGWCTAAPCLAPQPCLDLYEAV

SEQ ID NO: 630422 - protein, 27 aa, Mycobacterium
AGASPAYWYRAVLWNVLMSADQTLGEF

SEQ ID NO: 630423 - protein, 18 aa, Mycobacterium
AGASPPAPIYGIYGPTGN

SEQ ID NO: 630424 - protein, 17 aa, Mycobacterium
AGASYRLADLVGKSVAK

SEQ ID NO: 630425 - protein, 26 aa, Mycobacterium
AGATAAYWLGRHGYSVTVVERHPGPR

SEQ ID NO: 630426 - protein, 26 aa, Mycobacterium
AGATCYLRVNVPGALFSLGDGHYRQG

SEQ ID NO: 630427 - protein, 22 aa, Mycobacterium
AGATGRAGTGGFGGNGGLGSAF

SEQ ID NO: 630428 - protein, 21 aa, Mycobacterium
AGATGTVRWTGQVGTTYDIGA

SEQ ID NO: 630429 - protein, 26 aa, Mycobacterium
AGATPSFLGYHGFPASICASVNDRVV

SEQ ID NO: 630430 - protein, 22 aa, Mycobacterium
AGATRLGVSGSRALLGTAEPQV

SEQ ID NO: 630431 - protein, 17 aa, Mycobacterium
AGATVHWARDAEEANLI

SEQ ID NO: 630432 - protein, 17 aa, Mycobacterium
AGAVAIGPVLQGLRKPV

SEQ ID NO: 630433 - protein, 25 aa, Mycobacterium
AGAVDRARVATLLLPGIGSVANLED

SEQ ID NO: 630434 - protein, 17 aa, Mycobacterium
AGAVGGRLGVKASGGIR

SEQ ID NO: 630435 - protein, 25 aa, Mycobacterium
AGAVGRAAIRIAQHLGAEVFATADP

SEQ ID NO: 630436 - protein, 33 aa, Mycobacterium
AGAVIRCGGKPLAGPGWYYPPTVITDITKDMNL

SEQ ID NO: 630437 - protein, 21 aa, Mycobacterium
AGAVLADWGADVVKIEHPVTG

SEQ ID NO: 630438 - protein, 20 aa, Mycobacterium
AGAVLGEWGADVIKVEHAVT

SEQ ID NO: 630439 - protein, 21 aa, Mycobacterium
AGAVLKVIVESAVLLDRAGEH

SEQ ID NO: 630440 - protein, 25 aa, Mycobacterium
AGAVLRWRRVDLALFGRIRQHVDAW

SEQ ID NO: 630441 - protein, 18 aa, Mycobacterium
AGAVPAVLSTAFILEEGT

SEQ ID NO: 630442 - protein, 21 aa, Mycobacterium
AGAVPLAAGHRKEGKTVSIGW

SEQ ID NO: 630443 - protein, 24 aa, Mycobacterium
AGAVPSWISAAFVLEEGFPIEELK

SEQ ID NO: 630444 - protein, 21 aa, Mycobacterium
AGAVPVMCLPGHRAAELGHFA

SEQ ID NO: 630445 - protein, 22 aa, Mycobacterium
AGAVRWLIPRLDLPATQLEQIT

SEQ ID NO: 630446 - protein, 18 aa, Mycobacterium
AGAVSFLIGDDARFITGT

SEQ ID NO: 630447 - protein, 24 aa, Mycobacterium
AGAVSFRFGDRTQINGVPRDGAVD

SEQ ID NO: 630448 - protein, 34 aa, Mycobacterium
AGAYERRSLAIGSHWPFQEWGRFLPEQTTAVSIL

SEQ ID NO: 630449 - protein, 19 aa, Mycobacterium
AGAYFKGGINPVSVWVSTD

SEQ ID NO: 630450 - protein, 21 aa, Mycobacterium
AGAYFKGGVNPVTVWVSTEYV

SEQ ID NO: 630451 - protein, 27 aa, Mycobacterium
AGAYFPRGIKPVSVWLSHEYVRASPGG

SEQ ID NO: 630452 - protein, 17 aa, Mycobacterium
AGAYGASKAAIWSVSNT

SEQ ID NO: 630453 - protein, 25 aa, Mycobacterium
AGAYLTCYLGAFGADVIKVESIQRP

SEQ ID NO: 630454 - protein, 25 aa, Mycobacterium
AGAYLTCYLGAFGADVVKVESIQRP

SEQ ID NO: 630455 - protein, 21 aa, Mycobacterium
AGAYVAALVRRYVQQRHPDNY

SEQ ID NO: 630456 - protein, 20 aa, Mycobacterium
AGCAAALVGVVPMGEVADSA

SEQ ID NO: 630457 - protein, 28 aa, Mycobacterium
AGCAVLLKPAEWTPLTTIRIGEIARESG

SEQ ID NO: 630458 - protein, 18 aa, Mycobacterium
AGCAVLLKPSERTPLTAE

SEQ ID NO: 630459 - protein, 19 aa, Mycobacterium
AGCCDLAFAAPDAARAIKS

SEQ ID NO: 630460 - protein, 18 aa, Mycobacterium
AGCDGCIASHAQGAARAG

SEQ ID NO: 630461 - protein, 21 aa, Mycobacterium
AGCDLAMMCDIRIASQRASFA

SEQ ID NO: 630462 - protein, 22 aa, Mycobacterium
AGCELAFVCAVDMPYLSAELID

SEQ ID NO: 630463 - protein, 18 aa, Mycobacterium
AGCEVHLLAAHSGAAEAL

SEQ ID NO: 630464 - protein, 19 aa, Mycobacterium
AGCEYKKLRDVLGLLRDAY

SEQ ID NO: 630465 - protein, 24 aa, Mycobacterium
AGCGEAAVSLFLAERGFTTVGLDQ

SEQ ID NO: 630466 - protein, 22 aa, Mycobacterium
AGCGPGRLGGYLAAAGHHVVGV

SEQ ID NO: 630467 - protein, 24 aa, Mycobacterium
AGCGPGRLGGYLAGAGHRVVGVDV

SEQ ID NO: 630468 - protein, 24 aa, Mycobacterium
AGCGPGRLGGYLAGVGHRVVGVDV

SEQ ID NO: 630469 - protein, 17 aa, Mycobacterium
AGCHLDASMVHRAIDAL

SEQ ID NO: 630470 - protein, 26 aa, Mycobacterium
AGCIGCGCLSLKICALANPGDVLADE

SEQ ID NO: 630471 - protein, 23 aa, Mycobacterium
AGCPADDLLPLAARLAPLRAAAG

SEQ ID NO: 630472 - protein, 17 aa, Mycobacterium
AGCPGEFVVTTSNGEVA

SEQ ID NO: 630473 - protein, 25 aa, Mycobacterium
AGCRGEVPLGTLIELLAGYHGVDAD

SEQ ID NO: 630474 - protein, 18 aa, Mycobacterium
AGCRPGGTVHILALSDAG

SEQ ID NO: 630475 - protein, 17 aa, Mycobacterium
AGCSRATLYRYFENRDA

SEQ ID NO: 630476 - protein, 24 aa, Mycobacterium
AGCVIGGTAWDFANGKRVPPGSLD

SEQ ID NO: 630477 - protein, 20 aa, Mycobacterium
AGCVYEWGHHAAMGLLAGLT

SEQ ID NO: 630478 - protein, 23 aa, Mycobacterium
AGDAAHLMPVWQGQGYNSGIRDA

SEQ ID NO: 630479 - protein, 23 aa, Mycobacterium
AGDAEAAYAHFGRRFDDLQTEVV

SEQ ID NO: 630480 - protein, 24 aa, Mycobacterium
AGDAEPVEGWGLFEHAALGRHDPS

SEQ ID NO: 630481 - protein, 17 aa, Mycobacterium
AGDAGAIQALWASRLGS

SEQ ID NO: 630482 - protein, 24 aa, Mycobacterium
AGDALRPLISVVRSARLAAVDAIL

SEQ ID NO: 630483 - protein, 25 aa, Mycobacterium
AGDALRYPARYLFVFLEHHGMLSVF

SEQ ID NO: 630484 - protein, 21 aa, Mycobacterium
AGDARAVASLLGLDEEAVAVL

SEQ ID NO: 630485 - protein, 18 aa, Mycobacterium
AGDARRLAPLLGNELQAA

SEQ ID NO: 630486 - protein, 18 aa, Mycobacterium
AGDARRLGIADGDLVEVS

SEQ ID NO: 630487 - protein, 23 aa, Mycobacterium
AGDARYPVEMQVMNMRDGGMLST

SEQ ID NO: 630488 - protein, 18 aa, Mycobacterium
AGDATALLELVRTESPNL

SEQ ID NO: 630489 - protein, 26 aa, Mycobacterium
AGDAWDSLWVYDHFHTVPVPTDEATH

SEQ ID NO: 630490 - protein, 19 aa, Mycobacterium
AGDDARWVNGQAIAVDGGI

SEQ ID NO: 630491 - protein, 26 aa, Mycobacterium
AGDDCPDWVAGELWVSGRGIARGYRG

SEQ ID NO: 630492 - protein, 20 aa, Mycobacterium
AGDDEWCVVTICSDNEWRCA

SEQ ID NO: 630493 - protein, 27 aa, Mycobacterium
AGDEISAAVAALFGSYAQGYQSLSAQA

SEQ ID NO: 630494 - protein, 24 aa, Mycobacterium
AGDERWPVCRIGMTASTGTREFNA

SEQ ID NO: 630495 - protein, 42 aa, Mycobacterium
AGDEVSAAVAALFSDHAHNYQALGRQAAAFHDQFVAALSAGG

SEQ ID NO: 630496 - protein, 24 aa, Mycobacterium
AGDFRLVRSPIRIAGYTPEYRPAP

SEQ ID NO: 630497 - protein, 24 aa, Mycobacterium
AGDFVKIDFGALVAGYHSDMTRTF

SEQ ID NO: 630498 - protein, 24 aa, Mycobacterium
AGDFVKIDFGALVAGYHSDMTRTL

SEQ ID NO: 630499 - protein, 25 aa, Mycobacterium
AGDFVKIDFGALVGGYHSDMTRTFV

SEQ ID NO: 630500 - protein, 18 aa, Mycobacterium
AGDFWGGAGSAACQEFIT

SEQ ID NO: 630501 - protein, 18 aa, Mycobacterium
AGDFWGGAGSLACQEFIT

SEQ ID NO: 630502 - protein, 20 aa, Mycobacterium
AGDFWGGAGSSACQEFITQL

SEQ ID NO: 630503 - protein, 22 aa, Mycobacterium
AGDFWGGAGSVACQEFITQLGR

SEQ ID NO: 630504 - protein, 27 aa, Mycobacterium
AGDGEPLFMAGLWTTWRPKPADTDAPK

SEQ ID NO: 630505 - protein, 20 aa, Mycobacterium
AGDGFARYWMHNGWVTMGGE

SEQ ID NO: 630506 - protein, 19 aa, Mycobacterium
AGDGFWIGRVCTAEAERGR

SEQ ID NO: 630507 - protein, 28 aa, Mycobacterium
AGDGGMGGAAGWLGFGGAGGAGGFGGVV

SEQ ID NO: 630508 - protein, 22 aa, Mycobacterium
AGDGPFTYRCHAWLEQQTGCRK

SEQ ID NO: 630509 - protein, 19 aa, Mycobacterium
AGDGVWAIFTVDGEGGARI

SEQ ID NO: 630510 - protein, 17 aa, Mycobacterium
AGDGVWAIYTVDSGGGA

SEQ ID NO: 630511 - protein, 30 aa, Mycobacterium
AGDGWLRLQMITNRGVKVWPDGFPETFCTD

SEQ ID NO: 630512 - protein, 27 aa, Mycobacterium
AGDGYPELLPRITAMTVRDGKVCAVWD

SEQ ID NO: 630513 - protein, 17 aa, Mycobacterium
AGDGYVLSGRKFYSTGA

SEQ ID NO: 630514 - protein, 25 aa, Mycobacterium
AGDHAAICWPLLVGMAKAKYYLLTC

SEQ ID NO: 630515 - protein, 24 aa, Mycobacterium
AGDHRFSYDPTFLLRGLSELRIEY

SEQ ID NO: 630516 - protein, 18 aa, Mycobacterium
AGDHSLAAMASRAAVSER

SEQ ID NO: 630517 - protein, 24 aa, Mycobacterium
AGDIDFRFVATIVYRTDLIEDREV

SEQ ID NO: 630518 - protein, 18 aa, Mycobacterium
AGDIDVLVCTTVIEVGVD

SEQ ID NO: 630519 - protein, 18 aa, Mycobacterium
AGDIQWNFEKFLLAPDGA

SEQ ID NO: 630520 - protein, 18 aa, Mycobacterium
AGDIQWNFEKFLLSPGGE

SEQ ID NO: 630521 - protein, 18 aa, Mycobacterium
AGDISALLGPAASGRNYE

SEQ ID NO: 630522 - protein, 31 aa, Mycobacterium
AGDIWRMPIVRDEAIRDWVKLAVTRARNSGM

SEQ ID NO: 630523 - protein, 24 aa, Mycobacterium
AGDKGAVGDSGFAGGTGGAGGTGG

SEQ ID NO: 630524 - protein, 22 aa, Mycobacterium
AGDKLWARMDIHSVDERFGADI

SEQ ID NO: 630525 - protein, 24 aa, Mycobacterium
AGDKRGPLTVPIWYQYSPGGEPWV

SEQ ID NO: 630526 - protein, 18 aa, Mycobacterium
AGDLCANTKVFILAESLG

SEQ ID NO: 630527 - protein, 18 aa, Mycobacterium
AGDLDFPNGMVITPDRRT

SEQ ID NO: 630528 - protein, 18 aa, Mycobacterium
AGDLGDWAGPDALADLDA

SEQ ID NO: 630529 - protein, 25 aa, Mycobacterium
AGDLGRSAAGFALWHNDIGGFDELR

SEQ ID NO: 630530 - protein, 26 aa, Mycobacterium
AGDLGRSAAGYALWAKGIDEYPELRE

SEQ ID NO: 630531 - protein, 17 aa, Mycobacterium
AGDLKLDTWRRAIATAP

SEQ ID NO: 630532 - protein, 21 aa, Mycobacterium
AGDLPRLVAALGQGADLVTGR

SEQ ID NO: 630533 - protein, 26 aa, Mycobacterium
AGDLRARLASVIAEHGVDWHVVSVGA

SEQ ID NO: 630534 - protein, 23 aa, Mycobacterium
AGDLRGRVLLAERLGRNIELTVT

SEQ ID NO: 630535 - protein, 21 aa, Mycobacterium
AGDLRLPGSVAEIMASPAGPK

SEQ ID NO: 630536 - protein, 17 aa, Mycobacterium
AGDLRRVTGMDRRLSEA

SEQ ID NO: 630537 - protein, 18 aa, Mycobacterium
AGDLWPLRDERIPADVPM

SEQ ID NO: 630538 - protein, 20 aa, Mycobacterium
AGDMGFPGFSVYAATKAAVR

SEQ ID NO: 630539 - protein, 17 aa, Mycobacterium
AGDMVIWDSGSYETEKF

SEQ ID NO: 630540 - protein, 25 aa, Mycobacterium
AGDPDALRPFLLVASFVNPHDIVLF

SEQ ID NO: 630541 - protein, 20 aa, Mycobacterium
AGDPHIDFVVVREGTEGPYT

SEQ ID NO: 630542 - protein, 24 aa, Mycobacterium
AGDPRAPAALLLHGFPTSSYMFRG

SEQ ID NO: 630543 - protein, 23 aa, Mycobacterium
AGDPRKLAAMVLLITQSTIQSVD

SEQ ID NO: 630544 - protein, 21 aa, Mycobacterium
AGDPWPHLFLPFREGASQESE

SEQ ID NO: 630545 - protein, 24 aa, Mycobacterium
AGDPWPVLRRWAATQPRAAIVERA

SEQ ID NO: 630546 - protein, 26 aa, Mycobacterium
AGDQELLVRGGVVFSGYWRNEQATEE

SEQ ID NO: 630547 - protein, 17 aa, Mycobacterium
AGDQLVLGASNPVRDAA

SEQ ID NO: 630548 - protein, 20 aa, Mycobacterium
AGDQRGMWAGFDERAVPVLA

SEQ ID NO: 630549 - protein, 30 aa, Mycobacterium
AGDRAARIAPEIDELGPTLAEHVRRRDGLP

SEQ ID NO: 630550 - protein, 21 aa, Mycobacterium
AGDRIPAYRLSAGSKLPGRPT

SEQ ID NO: 630551 - protein, 18 aa, Mycobacterium
AGDRLAEFEDVMAVMRSL

SEQ ID NO: 630552 - protein, 33 aa, Mycobacterium
AGDRLLDVGCGWGGMVRYAARRGVRATGATLSA

SEQ ID NO: 630553 - protein, 33 aa, Mycobacterium
AGDRLLDVGCGWGSMVRYAARRGVRATGVTLSA

SEQ ID NO: 630554 - protein, 17 aa, Mycobacterium
AGDRLRAELARVLDGGG

SEQ ID NO: 630555 - protein, 20 aa, Mycobacterium
AGDRVCIFSATRYEWAIVDL

SEQ ID NO: 630556 - protein, 25 aa, Mycobacterium
AGDRWILHCGDAFYHVGTLDGQSKV

SEQ ID NO: 630557 - protein, 22 aa, Mycobacterium
AGDRYTVWAPRWRDSGDEWEAF

SEQ ID NO: 630558 - protein, 21 aa, Mycobacterium
AGDSEFTAVIWMPPDGDRAGD

SEQ ID NO: 630559 - protein, 27 aa, Mycobacterium
AGDTALRRHFNWVRSWYDFAVPDIGRS

SEQ ID NO: 630560 - protein, 27 aa, Mycobacterium
AGDTDLAWSRITYWRALLTSAVDQPPH

SEQ ID NO: 630561 - protein, 22 aa, Mycobacterium
AGDTLWQLALRFYGDAELYRLI

SEQ ID NO: 630562 - protein, 23 aa, Mycobacterium
AGDVAECITLTPGKRAPSVIEID

SEQ ID NO: 630563 - protein, 20 aa, Mycobacterium
AGDVLLFMGGIAYAAQHGTR

SEQ ID NO: 630564 - protein, 21 aa, Mycobacterium
AGDVRGRWIINAAGLGADHLD

SEQ ID NO: 630565 - protein, 22 aa, Mycobacterium
AGDVRSRIVALCDARPSVAEIA

SEQ ID NO: 630566 - protein, 23 aa, Mycobacterium
AGEAAPYAAAWSVVTGTFASISR

SEQ ID NO: 630567 - protein, 17 aa, Mycobacterium
AGEAGLVYFEREELPFS

SEQ ID NO: 630568 - protein, 20 aa, Mycobacterium
AGEALMPLVRQVVAGIDQIA

SEQ ID NO: 630569 - protein, 30 aa, Mycobacterium
AGEARPVLREFPAKVPVGVAFAKRSGMVRD

SEQ ID NO: 630570 - protein, 25 aa, Mycobacterium
AGEAVAARIAALIRTTPDAVIGVAT

SEQ ID NO: 630571 - protein, 17 aa, Mycobacterium
AGEAWRRGPVAALNELD

SEQ ID NO: 630572 - protein, 24 aa, Mycobacterium
AGEDGLRLPVVVTERGDTLVEPTD

SEQ ID NO: 630573 - protein, 23 aa, Mycobacterium
AGEDGLRLPVVVTQRGDTLVEPT

SEQ ID NO: 630574 - protein, 22 aa, Mycobacterium
AGEDRLTSALVRRDDELVPAPV

SEQ ID NO: 630575 - protein, 22 aa, Mycobacterium
AGEEGLRIAEAIGDRTTSRECR

SEQ ID NO: 630576 - protein, 24 aa, Mycobacterium
AGEEGRYLLAATFGNVHGVYKPGN

SEQ ID NO: 630577 - protein, 21 aa, Mycobacterium
AGEESYVLLVRVASARALEDL

SEQ ID NO: 630578 - protein, 21 aa, Mycobacterium
AGEESYVLLVRVESARALEDL

SEQ ID NO: 630579 - protein, 20 aa, Mycobacterium
AGEEVPFRLVYGGRTRASMA

SEQ ID NO: 630580 - protein, 23 aa, Mycobacterium
AGEFLAGRGWRVTSETAVALLGR

SEQ ID NO: 630581 - protein, 21 aa, Mycobacterium
AGEFRQIMVQFGLTPMARRTL

SEQ ID NO: 630582 - protein, 23 aa, Mycobacterium
AGEGAGWLRQQLDSERHYSFQLD

SEQ ID NO: 630583 - protein, 22 aa, Mycobacterium
AGEGDRAPVRYVATGPVPEGDA

SEQ ID NO: 630584 - protein, 29 aa, Mycobacterium
AGEGKRLFAAGLWSVWKPAKGAVPLLSCT

SEQ ID NO: 630585 - protein, 28 aa, Mycobacterium
AGEGLVRTCIFEVPKYLLSGGKGRSFET

SEQ ID NO: 630586 - protein, 32 aa, Mycobacterium
AGEGLVRTCIFEVPKYLLSGGRARSWETVTEA

SEQ ID NO: 630587 - protein, 24 aa, Mycobacterium
AGEGPALVLLPGWSLTAQIFRHQL

SEQ ID NO: 630588 - protein, 22 aa, Mycobacterium
AGEGPVGVVQAVIGAESDALLV

SEQ ID NO: 630589 - protein, 24 aa, Mycobacterium
AGEGSFLEQWWATRGDRKLQTPAS

SEQ ID NO: 630590 - protein, 30 aa, Mycobacterium
AGEGVFVKFHWKPLLGVHSLLWDECQQIAG

SEQ ID NO: 630591 - protein, 24 aa, Mycobacterium
AGEIARCLAELVTLDTPTVSVLMG

SEQ ID NO: 630592 - protein, 25 aa, Mycobacterium
AGEIERARAAAELAVAAASEHGFNS

SEQ ID NO: 630593 - protein, 18 aa, Mycobacterium
AGEIPPFAPFLVTPIAEE

SEQ ID NO: 630594 - protein, 17 aa, Mycobacterium
AGEIVMLVGPSGCGKTT

SEQ ID NO: 630595 - protein, 33 aa, Mycobacterium
AGEKRRWLRDRGLKIFPLVGWAERGGYGAQGHG

SEQ ID NO: 630596 - protein, 23 aa, Mycobacterium
AGEKVWCGSLGYDGRQGATAELV

SEQ ID NO: 630597 - protein, 20 aa, Mycobacterium
AGELCERFDRLYLVRGAQIV

SEQ ID NO: 630598 - protein, 17 aa, Mycobacterium
AGELCGIAPVGVVATQD

SEQ ID NO: 630599 - protein, 17 aa, Mycobacterium
AGELCGIDPLGVAATND

SEQ ID NO: 630600 - protein, 20 aa, Mycobacterium
AGELCGKPPIGVLATDDKAA

SEQ ID NO: 630601 - protein, 18 aa, Mycobacterium
AGELCGKPPTGVRATTDK

SEQ ID NO: 630602 - protein, 22 aa, Mycobacterium
AGELCGMAPLGITASNDVEALL

SEQ ID NO: 630603 - protein, 18 aa, Mycobacterium
AGELCGVGLEPGVVTGVA

SEQ ID NO: 630604 - protein, 24 aa, Mycobacterium
AGELGASHALTFLREVDSINMRRR

SEQ ID NO: 630605 - protein, 22 aa, Mycobacterium
AGELGIGIGRYIHSVGSLHIYE

SEQ ID NO: 630606 - protein, 25 aa, Mycobacterium
AGELGRSAAGYALWHNEIAGFDELR

SEQ ID NO: 630607 - protein, 17 aa, Mycobacterium
AGELLEWAYQMVASSGA

SEQ ID NO: 630608 - protein, 20 aa, Mycobacterium
AGELLLEFNRAMKALSDGQA

SEQ ID NO: 630609 - protein, 29 aa, Mycobacterium
AGELRYQRCRACGAAHFPPAEHCRQCLTG

SEQ ID NO: 630610 - protein, 26 aa, Mycobacterium
AGELTPMHAGLVWASLFSHPGLTWAD

SEQ ID NO: 630611 - protein, 19 aa, Mycobacterium
AGELTRGQLRWNYTAIHPN

SEQ ID NO: 630612 - protein, 18 aa, Mycobacterium
AGELVAVAEPAAWFTYYY

SEQ ID NO: 630613 - protein, 19 aa, Mycobacterium
AGELVNWVRLVKSPYEIGQ

SEQ ID NO: 630614 - protein, 24 aa, Mycobacterium
AGELVSRLGAQRVIDTRTEAFERT

SEQ ID NO: 630615 - protein, 22 aa, Mycobacterium
AGEMPARYVIHAATMELGGPTS

SEQ ID NO: 630616 - protein, 25 aa, Mycobacterium
AGEMSDRLVGHGALPIEVPTIAVEP

SEQ ID NO: 630617 - protein, 25 aa, Mycobacterium
AGEPAEVGRLCVFLAGGQADFVNGT

SEQ ID NO: 630618 - protein, 27 aa, Mycobacterium
AGEPFDAVVCSLVLCSVNDPVGVLRHL

SEQ ID NO: 630619 - protein, 27 aa, Mycobacterium
AGEPFDAVVCSLVLCSVRDPGAVLRRL

SEQ ID NO: 630620 - protein, 18 aa, Mycobacterium
AGEPHRLRTAIAGLLEQF

SEQ ID NO: 630621 - protein, 21 aa, Mycobacterium
AGEPRFAVGDAVVVRELPVLF

SEQ ID NO: 630622 - protein, 22 aa, Mycobacterium
AGEPRLWLLGSSMYSAHLAAAK

SEQ ID NO: 630623 - protein, 22 aa, Mycobacterium
AGEPRVGFAQLYGAPGTAAATI

SEQ ID NO: 630624 - protein, 19 aa, Mycobacterium
AGEPVGWAELPAGTRATIS

SEQ ID NO: 630625 - protein, 21 aa, Mycobacterium
AGERGLCAGGDVVAIYHDAKV

SEQ ID NO: 630626 - protein, 21 aa, Mycobacterium
AGERGLCAGGDVVALYHSAKA

SEQ ID NO: 630627 - protein, 20 aa, Mycobacterium
AGERGLCAGGDVVAVYHSAR

SEQ ID NO: 630628 - protein, 18 aa, Mycobacterium
AGERGVMGDEMFHEAITS

SEQ ID NO: 630629 - protein, 24 aa, Mycobacterium
AGERIVGPARRYAVNVDDGGLVFV

SEQ ID NO: 630630 - protein, 19 aa, Mycobacterium
AGERLARYGNRVRLVQGSA

SEQ ID NO: 630631 - protein, 17 aa, Mycobacterium
AGERLRLEIAAAAREVQ

SEQ ID NO: 630632 - protein, 29 aa, Mycobacterium
AGERLWRPEPCWDPTAADWWSYEEYLDEN

SEQ ID NO: 630633 - protein, 18 aa, Mycobacterium
AGERPVVVPLSFAQSRLW

SEQ ID NO: 630634 - protein, 23 aa, Mycobacterium
AGERRFGPLEARDELAACEILAD

SEQ ID NO: 630635 - protein, 25 aa, Mycobacterium
AGESAAGLARVWSRHLGRPLAADSS

SEQ ID NO: 630636 - protein, 17 aa, Mycobacterium
AGESGLRAARRMLRAGK

SEQ ID NO: 630637 - protein, 22 aa, Mycobacterium
AGESIGAVAFDPGYVVNGDIAD

SEQ ID NO: 630638 - protein, 22 aa, Mycobacterium
AGESLPTMPPWHVQENKWRSAR

SEQ ID NO: 630639 - protein, 21 aa, Mycobacterium
AGESVASWAVCEPGQGWAPLA

SEQ ID NO: 630640 - protein, 18 aa, Mycobacterium
AGETGCRIVLPDDADPFV

SEQ ID NO: 630641 - protein, 18 aa, Mycobacterium
AGETGCRIVLPEGADPFV

SEQ ID NO: 630642 - protein, 22 aa, Mycobacterium
AGETGCRIVLPEGFHDGTGVFV

SEQ ID NO: 630643 - protein, 27 aa, Mycobacterium
AGETMCFPGNVPHVYRAVNGPAEAVLT

SEQ ID NO: 630644 - protein, 20 aa, Mycobacterium
AGEVALLRLACEAADAALKD

SEQ ID NO: 630645 - protein, 21 aa, Mycobacterium
AGEVALLRLACEAADAALTDL

SEQ ID NO: 630646 - protein, 21 aa, Mycobacterium
AGEVESGSWLGLRYQGNGLGT

SEQ ID NO: 630647 - protein, 21 aa, Mycobacterium
AGEVLPVPLIIGTNSHEASMF

SEQ ID NO: 630648 - protein, 23 aa, Mycobacterium
AGEWKHLVRFAFCKRDETLDEAI

SEQ ID NO: 630649 - protein, 19 aa, Mycobacterium
AGEWLPADHPLTGMPNVVL

SEQ ID NO: 630650 - protein, 23 aa, Mycobacterium
AGEWLPADHPLVGMANVVLTPHI

SEQ ID NO: 630651 - protein, 24 aa, Mycobacterium
AGEWSQRSATLAALTPPSPGQPFQ

SEQ ID NO: 630652 - protein, 25 aa, Mycobacterium
AGFAARGFRTLARWWEATASAIEAC

SEQ ID NO: 630653 - protein, 20 aa, Mycobacterium
AGFADPSAQFGFGARLLVDG

SEQ ID NO: 630654 - protein, 19 aa, Mycobacterium
AGFADRIATDWAGPASRVI

SEQ ID NO: 630655 - protein, 19 aa, Mycobacterium
AGFADRIATDWAGPGSRVV

SEQ ID NO: 630656 - protein, 19 aa, Mycobacterium
AGFADRIATDWAGPSSRVV

SEQ ID NO: 630657 - protein, 22 aa, Mycobacterium
AGFARSACYAVFPTKADLLRSL

SEQ ID NO: 630658 - protein, 20 aa, Mycobacterium
AGFDAARPTAWLAEGVLIGF

SEQ ID NO: 630659 - protein, 19 aa, Mycobacterium
AGFDAEFFGISAREAITMD

SEQ ID NO: 630660 - protein, 18 aa, Mycobacterium
AGFDAEFFGITPREAAAM

SEQ ID NO: 630661 - protein, 20 aa, Mycobacterium
AGFDALWISDHYHPWNDEQG

SEQ ID NO: 630662 - protein, 19 aa, Mycobacterium
AGFDASRPAVWSAEGLVRY

SEQ ID NO: 630663 - protein, 27 aa, Mycobacterium
AGFDATRPTAWLAEGLLIYLPPEAQDA

SEQ ID NO: 630664 - protein, 22 aa, Mycobacterium
AGFDIRPTIAITKAHVILPEIA

SEQ ID NO: 630665 - protein, 19 aa, Mycobacterium
AGFDWEGWVTGMGSTPQSL

SEQ ID NO: 630666 - protein, 19 aa, Mycobacterium
AGFEFKKTIIAHLEKNGHE

SEQ ID NO: 630667 - protein, 22 aa, Mycobacterium
AGFEPIELVMGVSVYHVGFQFS

SEQ ID NO: 630668 - protein, 23 aa, Mycobacterium
AGFEPIELVMGVSVYHVGYQFTG

SEQ ID NO: 630669 - protein, 18 aa, Mycobacterium
AGFERWLKALDYLQTDVQ

SEQ ID NO: 630670 - protein, 19 aa, Mycobacterium
AGFGAMYFPGVKSFVQGDT

SEQ ID NO: 630671 - protein, 43 aa, Mycobacterium
AGFGGSVNERAVSVSAWGISPGRVTICCRIPTHGTPPRVGVAF

SEQ ID NO: 630672 - protein, 17 aa, Mycobacterium
AGFGVTFGSMFKKPVTE

SEQ ID NO: 630673 - protein, 19 aa, Mycobacterium
AGFGVTFGSMFKKTVTEEY

SEQ ID NO: 630674 - protein, 22 aa, Mycobacterium
AGFGVTFGSMFKRNVTEEYPEK

SEQ ID NO: 630675 - protein, 20 aa, Mycobacterium
AGFHTLKLQTFLTAGPKESR

SEQ ID NO: 630676 - protein, 20 aa, Mycobacterium
AGFIGSPAMNMFILPIVDSS

SEQ ID NO: 630677 - protein, 22 aa, Mycobacterium
AGFLAPHWPAPYGLGAGAAQQL

SEQ ID NO: 630678 - protein, 19 aa, Mycobacterium
AGFLLGPTLFNIGFANDGV

SEQ ID NO: 630679 - protein, 24 aa, Mycobacterium
AGFLNRRPGVCLTTSGPGFLNGLP

SEQ ID NO: 630680 - protein, 17 aa, Mycobacterium
AGFLSAWSGDPGAVTRY

SEQ ID NO: 630681 - protein, 26 aa, Mycobacterium
AGFNLPAVAFGHDWLTGTDKYRATLE

SEQ ID NO: 630682 - protein, 19 aa, Mycobacterium
AGFNLYAYLYAFNKILPGV

SEQ ID NO: 630683 - protein, 18 aa, Mycobacterium
AGFPEPRTFTLRAARLLA

SEQ ID NO: 630684 - protein, 21 aa, Mycobacterium
AGFPLGWVHDVVWAPRKAPVT

SEQ ID NO: 630685 - protein, 19 aa, Mycobacterium
AGFPLGWVHDVVWAPRPAA

SEQ ID NO: 630686 - protein, 21 aa, Mycobacterium
AGFPLGWVHDVVWAPRPVPVP

SEQ ID NO: 630687 - protein, 17 aa, Mycobacterium
AGFPNLFTIQGPGSPSA

SEQ ID NO: 630688 - protein, 24 aa, Mycobacterium
AGFPRPQTQIAIRNEWGWAEAYLD

SEQ ID NO: 630689 - protein, 18 aa, Mycobacterium
AGFPWLSHELLAARRSDV

SEQ ID NO: 630690 - protein, 21 aa, Mycobacterium
AGFRACKRCRPDASPGSPEWN

SEQ ID NO: 630691 - protein, 22 aa, Mycobacterium
AGFRACKRCRPDASPGSPEWNV

SEQ ID NO: 630692 - protein, 19 aa, Mycobacterium
AGFRAKVGRLFPEEAERAS

SEQ ID NO: 630693 - protein, 20 aa, Mycobacterium
AGFRGLRLPSPFDYSKQSLV

SEQ ID NO: 630694 - protein, 19 aa, Mycobacterium
AGFRSGYLDVVQWTFERKD

SEQ ID NO: 630695 - protein, 18 aa, Mycobacterium
AGFRSLGLDGFRLEVTSL

SEQ ID NO: 630696 - protein, 25 aa, Mycobacterium
AGFSHFTLLLVHALRQQFSRVRVFA

SEQ ID NO: 630697 - protein, 18 aa, Mycobacterium
AGFSRPGIELTKRTIWSG

SEQ ID NO: 630698 - protein, 18 aa, Mycobacterium
AGFSTVWLTEHHFLEEYC

SEQ ID NO: 630699 - protein, 25 aa, Mycobacterium
AGFTAIRRWAKQFYPDGIGGSAAEV

SEQ ID NO: 630700 - protein, 18 aa, Mycobacterium
AGFVPGLEIAGVVSELGD

SEQ ID NO: 630701 - protein, 20 aa, Mycobacterium
AGGAAGMWGTGGSGGAGAAG

SEQ ID NO: 630702 - protein, 28 aa, Mycobacterium
AGGAAQPAGWFRFYFTDQRWEWSEQVQR

SEQ ID NO: 630703 - protein, 26 aa, Mycobacterium
AGGADFLLALAVAYEVQCRFSAQVPV

SEQ ID NO: 630704 - protein, 17 aa, Mycobacterium
AGGAGGAAGLWGSGGAG

SEQ ID NO: 630705 - protein, 17 aa, Mycobacterium
AGGAGGAAGLWGSGGTG

SEQ ID NO: 630706 - protein, 25 aa, Mycobacterium
AGGAGGAGGWLFGAGGTGGAGGLTV

SEQ ID NO: 630707 - protein, 25 aa, Mycobacterium
AGGAGGAGGWLFGNGGAGGTGGTSI

SEQ ID NO: 630708 - protein, 24 aa, Mycobacterium
AGGAGGDGGWAFGSGGTGGTGGYG

SEQ ID NO: 630709 - protein, 18 aa, Mycobacterium
AGGAGGFGGFGSGTGGAG

SEQ ID NO: 630710 - protein, 27 aa, Mycobacterium
AGGAGGGGPVLFGHGGAGGLGGQGGTG

SEQ ID NO: 630711 - protein, 23 aa, Mycobacterium
AGGAGGHGGWLYGNGGVGGVGGT

SEQ ID NO: 630712 - protein, 24 aa, Mycobacterium
AGGAGGLGGMLFGTGGSGGAGGVA

SEQ ID NO: 630713 - protein, 26 aa, Mycobacterium
AGGAGGLWGGGGIGGTGGFGALNGAA

SEQ ID NO: 630714 - protein, 26 aa, Mycobacterium
AGGAGGNGGWLFGAGGNGGFGGAATG

SEQ ID NO: 630715 - protein, 24 aa, Mycobacterium
AGGAGGNGGWLYGDGGAGGQGGAA

SEQ ID NO: 630716 - protein, 25 aa, Mycobacterium
AGGAGGPGLFGFNGGAGGAGGAGGL

SEQ ID NO: 630717 - protein, 25 aa, Mycobacterium
AGGAGGRAGLAIGGGGAGGAGGEGA

SEQ ID NO: 630718 - protein, 25 aa, Mycobacterium
AGGAGGRGGLLYGSGGAGGSGGEGV

SEQ ID NO: 630719 - protein, 28 aa, Mycobacterium
AGGAGGRGGLVFGGGGAGGAGGDGGTAT

SEQ ID NO: 630720 - protein, 23 aa, Mycobacterium
AGGAGGSAFLFGSGGHGGSGGTA

SEQ ID NO: 630721 - protein, 24 aa, Mycobacterium
AGGAGGSGGWLIGTGGTGGTGGFG

SEQ ID NO: 630722 - protein, 24 aa, Mycobacterium
AGGAGGSGGWLYGTGGAGGSGGAG

SEQ ID NO: 630723 - protein, 24 aa, Mycobacterium
AGGAGGTGAWLFGNGGSGGAGGAG

SEQ ID NO: 630724 - protein, 21 aa, Mycobacterium
AGGAGGWLSGNAGVGGAGGAS

SEQ ID NO: 630725 - protein, 20 aa, Mycobacterium
AGGAGGWLSGTGGAGGSGGA

SEQ ID NO: 630726 - protein, 20 aa, Mycobacterium
AGGAGGWLTGTGGAGGSGGY

SEQ ID NO: 630727 - protein, 20 aa, Mycobacterium
AGGAGRPASFNSNGGPGGNG

SEQ ID NO: 630728 - protein, 23 aa, Mycobacterium
AGGAGWRPVETCVIAEELGRAND

SEQ ID NO: 630729 - protein, 24 aa, Mycobacterium
AGGALDIAVVYAFLQQSLPPTLPD

SEQ ID NO: 630730 - protein, 18 aa, Mycobacterium
AGGALITIAEPPRVIPEG

SEQ ID NO: 630731 - protein, 19 aa, Mycobacterium
AGGAPDFPALEVEVLDYWA

SEQ ID NO: 630732 - protein, 19 aa, Mycobacterium
AGGARDVMRAMGDRLASWG

SEQ ID NO: 630733 - protein, 18 aa, Mycobacterium
AGGARGAVMLGDEMIDEA

SEQ ID NO: 630734 - protein, 22 aa, Mycobacterium
AGGASLLFGNGGAGGLGGGGAT

SEQ ID NO: 630735 - protein, 17 aa, Mycobacterium
AGGATCRVLVRAGVPDE

SEQ ID NO: 630736 - protein, 20 aa, Mycobacterium
AGGATRPAGPPAGPAGAGGS

SEQ ID NO: 630737 - protein, 21 aa, Mycobacterium
AGGCVLACACDRRLISPDAQI

SEQ ID NO: 630738 - protein, 20 aa, Mycobacterium
AGGDAARMFLARHGDSSAVA

SEQ ID NO: 630739 - protein, 20 aa, Mycobacterium
AGGDAGWFGNGGIGGAGGAG

SEQ ID NO: 630740 - protein, 20 aa, Mycobacterium
AGGDAHLLGTGGAGGHGGLG

SEQ ID NO: 630741 - protein, 24 aa, Mycobacterium
AGGDCGRCRRTIRAIISAHLGGHT

SEQ ID NO: 630742 - protein, 24 aa, Mycobacterium
AGGDCGRCRRTLRAIIAASANLET

SEQ ID NO: 630743 - protein, 23 aa, Mycobacterium
AGGDGGAGYVLANAGAAGNGGDA

SEQ ID NO: 630744 - protein, 24 aa, Mycobacterium
AGGDGGFGLSVVGGHGGDGGNAGL

SEQ ID NO: 630745 - protein, 25 aa, Mycobacterium
AGGDGGLHLSSFVGPGGSGGDGGAG

SEQ ID NO: 630746 - protein, 25 aa, Mycobacterium
AGGDGGRAGLLFGSAGVGGQGGDGG

SEQ ID NO: 630747 - protein, 19 aa, Mycobacterium
AGGDGGRYGNGGDGGAGGD

SEQ ID NO: 630748 - protein, 30 aa, Mycobacterium
AGGDGMGGASGFSIVFPPGQDGGGGGIGGS

SEQ ID NO: 630749 - protein, 23 aa, Mycobacterium
AGGDGSFLWDSPPNTNVYIGDAG

SEQ ID NO: 630750 - protein, 18 aa, Mycobacterium
AGGDLAWELTATRLGRFV

SEQ ID NO: 630751 - protein, 19 aa, Mycobacterium
AGGDLGWITTFLDDPVARD

SEQ ID NO: 630752 - protein, 25 aa, Mycobacterium
AGGDSGLLSGLFGTGGGHGGLGGAG

SEQ ID NO: 630753 - protein, 18 aa, Mycobacterium
AGGDVLRLRQLAGAVTPP

SEQ ID NO: 630754 - protein, 20 aa, Mycobacterium
AGGEILRLLLGHPARTAGRL

SEQ ID NO: 630755 - protein, 20 aa, Mycobacterium
AGGEILRLLLGHPAYTDGRL

SEQ ID NO: 630756 - protein, 20 aa, Mycobacterium
AGGEILRLLLGHPAYTSGRL

SEQ ID NO: 630757 - protein, 19 aa, Mycobacterium
AGGELAWDLAASKLDRFIG

SEQ ID NO: 630758 - protein, 33 aa, Mycobacterium
AGGELAWELAATRLGRFAGLVAIDRGHPRVADV

SEQ ID NO: 630759 - protein, 18 aa, Mycobacterium
AGGELGWIIPGLVDAHCH

SEQ ID NO: 630760 - protein, 24 aa, Mycobacterium
AGGEPRLAVVTGDFSMSAGKLTGR

SEQ ID NO: 630761 - protein, 22 aa, Mycobacterium
AGGESFGFGAGVGGAGGNGGNG

SEQ ID NO: 630762 - protein, 17 aa, Mycobacterium
AGGEVRATMALTEPGGG

SEQ ID NO: 630763 - protein, 18 aa, Mycobacterium
AGGFAHRTLFEGLDLTVA

SEQ ID NO: 630764 - protein, 18 aa, Mycobacterium
AGGFDLQSACAVAGSADT

SEQ ID NO: 630765 - protein, 23 aa, Mycobacterium
AGGFGLCGIPEKLIRALVDSGIK

SEQ ID NO: 630766 - protein, 21 aa, Mycobacterium
AGGFTEIDSSASVLAATGGAG

SEQ ID NO: 630767 - protein, 19 aa, Mycobacterium
AGGFVPFIAERIATCVPIE

SEQ ID NO: 630768 - protein, 26 aa, Mycobacterium
AGGGDGGRGGWLYGNGGVGGTGGTGG

SEQ ID NO: 630769 - protein, 26 aa, Mycobacterium
AGGGEFPDPGGGGGRGGSGGAAGLVG

SEQ ID NO: 630770 - protein, 18 aa, Mycobacterium
AGGGGFGFREDFINNTGL

SEQ ID NO: 630771 - protein, 24 aa, Mycobacterium
AGGGGLLLPLGVRSLRIYGPTRNA

SEQ ID NO: 630772 - protein, 26 aa, Mycobacterium
AGGGGRGMRVVRELSSLAGEVEAARR

SEQ ID NO: 630773 - protein, 18 aa, Mycobacterium
AGGGGRTGGVGGDGVTGA

SEQ ID NO: 630774 - protein, 18 aa, Mycobacterium
AGGGILRVRDRGSRGREQ

SEQ ID NO: 630775 - protein, 19 aa, Mycobacterium
AGGGPRPVHDWFVAVSEAM

SEQ ID NO: 630776 - protein, 28 aa, Mycobacterium
AGGGRPLLAIARFGRFLAEVDIEDISRI

SEQ ID NO: 630777 - protein, 20 aa, Mycobacterium
AGGGTGLWGTGGVGGNGGTG

SEQ ID NO: 630778 - protein, 18 aa, Mycobacterium
AGGGYFFVVELLDAASFW

SEQ ID NO: 630779 - protein, 18 aa, Mycobacterium
AGGHFATLYTHIDDLTES

SEQ ID NO: 630780 - protein, 20 aa, Mycobacterium
AGGHGGWLVGNGGIGGDGGS

SEQ ID NO: 630781 - protein, 24 aa, Mycobacterium
AGGHSLLPMMKLRIANPEYLVDIN

SEQ ID NO: 630782 - protein, 25 aa, Mycobacterium
AGGHSLLPMMKLRIANPEYLVDIND

SEQ ID NO: 630783 - protein, 23 aa, Mycobacterium
AGGIAAGCLVGFASQTSIHPPRF

SEQ ID NO: 630784 - protein, 26 aa, Mycobacterium
AGGICGSDLPGFRGARGRLAFDTGRQ

SEQ ID NO: 630785 - protein, 18 aa, Mycobacterium
AGGIDYGLLRYLRPDTSE

SEQ ID NO: 630786 - protein, 24 aa, Mycobacterium
AGGKARPDIGPLFYEPTVLTDVTP

SEQ ID NO: 630787 - protein, 24 aa, Mycobacterium
AGGKARPDVGPLFYEPTVLTDVTH

SEQ ID NO: 630788 - protein, 34 aa, Mycobacterium
AGGKEAPSMPGGLGGRGGLLWGDGGKGGDGGAPV

SEQ ID NO: 630789 - protein, 23 aa, Mycobacterium
AGGKGVNVAKVLTMAGVDTVAVL

SEQ ID NO: 630790 - protein, 23 aa, Mycobacterium
AGGKRFRPLFTVLSAQLGPEPDA

SEQ ID NO: 630791 - protein, 23 aa, Mycobacterium
AGGKRFRPLFTVLSAQVGPDPEA

SEQ ID NO: 630792 - protein, 18 aa, Mycobacterium
AGGLALAAALRRATAVLS

SEQ ID NO: 630793 - protein, 25 aa, Mycobacterium
AGGLARAGATVAILGRNAQRLDDAA

SEQ ID NO: 630794 - protein, 19 aa, Mycobacterium
AGGLARIGHEVAIIDKEAA

SEQ ID NO: 630795 - protein, 20 aa, Mycobacterium
AGGLDVDWRGWYRGRIAAWT

SEQ ID NO: 630796 - protein, 21 aa, Mycobacterium
AGGLFGGIFGAGGGDGGAGGF

SEQ ID NO: 630797 - protein, 17 aa, Mycobacterium
AGGLFGHTGASGAGGSA

SEQ ID NO: 630798 - protein, 22 aa, Mycobacterium
AGGLGGLGLFLAEKMATPGSGA

SEQ ID NO: 630799 - protein, 19 aa, Mycobacterium
AGGLGLFGAGGAGGAGGMA

SEQ ID NO: 630800 - protein, 22 aa, Mycobacterium
AGGLHRRVALMLDVESGGNPPG

SEQ ID NO: 630801 - protein, 21 aa, Mycobacterium
AGGLIDFVGALGLDEIDLLGW

SEQ ID NO: 630802 - protein, 21 aa, Mycobacterium
AGGLLIGNGGNGWNSTTGGAA

SEQ ID NO: 630803 - protein, 17 aa, Mycobacterium
AGGLLYGNGGAGFNNGA

SEQ ID NO: 630804 - protein, 17 aa, Mycobacterium
AGGLMSALTPEFDGKTI

SEQ ID NO: 630805 - protein, 26 aa, Mycobacterium
AGGLPGMFGGLPGVAGAWGGEVPTAL

SEQ ID NO: 630806 - protein, 18 aa, Mycobacterium
AGGLRCQNSLIPDLGIFC

SEQ ID NO: 630807 - protein, 17 aa, Mycobacterium
AGGLRIVGITGSSGKTS

SEQ ID NO: 630808 - protein, 18 aa, Mycobacterium
AGGLRPEYTVGQPVLISD

SEQ ID NO: 630809 - protein, 21 aa, Mycobacterium
AGGLRRLVLIHAPSGFGKSTL

SEQ ID NO: 630810 - protein, 26 aa, Mycobacterium
AGGLVPRYWCVAAAGRYTIRAVARQL

SEQ ID NO: 630811 - protein, 20 aa, Mycobacterium
AGGMCVPLVPGMPPERVTSI

SEQ ID NO: 630812 - protein, 24 aa, Mycobacterium
AGGMGGSAGMLFGNGGDGGAGAAA

SEQ ID NO: 630813 - protein, 20 aa, Mycobacterium
AGGNAGFLFGSGGIGGPGGF

SEQ ID NO: 630814 - protein, 19 aa, Mycobacterium
AGGNAGLLFGDGGVGGTGG

SEQ ID NO: 630815 - protein, 21 aa, Mycobacterium
AGGNAGLLIGVGGAGGEGGIG

SEQ ID NO: 630816 - protein, 27 aa, Mycobacterium
AGGNAGVLFGPGGIGGSGGQGMASGGA

SEQ ID NO: 630817 - protein, 22 aa, Mycobacterium
AGGNALGLFGHGGAGGAGGYDV

SEQ ID NO: 630818 - protein, 25 aa, Mycobacterium
AGGNGGAGGWIYGHGGDGGIGGAGG

SEQ ID NO: 630819 - protein, 21 aa, Mycobacterium
AGGNGGLSIIFDGGVGGAGGA

SEQ ID NO: 630820 - protein, 18 aa, Mycobacterium
AGGNGGNGGLLFGNGGAG

SEQ ID NO: 630821 - protein, 24 aa, Mycobacterium
AGGNGGTGGFSLVTGGAGGAGGAS

SEQ ID NO: 630822 - protein, 19 aa, Mycobacterium
AGGNGGWLFGSGGIGGTGG

SEQ ID NO: 630823 - protein, 26 aa, Mycobacterium
AGGNGVDGADANVFTGDNGGDGTAGG

SEQ ID NO: 630824 - protein, 22 aa, Mycobacterium
AGGNMPLMGAVPMVLGALAAAD

SEQ ID NO: 630825 - protein, 23 aa, Mycobacterium
AGGPAGAPPRVWAETQVEVEFLV

SEQ ID NO: 630826 - protein, 23 aa, Mycobacterium
AGGPAVVEFNCRFGDPETQAVLA

SEQ ID NO: 630827 - protein, 26 aa, Mycobacterium
AGGPGDFRVGFNASHMQATLPGGTPF

SEQ ID NO: 630828 - protein, 23 aa, Mycobacterium
AGGPGGPARAWIQFRKGALPGEE

SEQ ID NO: 630829 - protein, 21 aa, Mycobacterium
AGGPMRYRLLETIRQYAQEKL

SEQ ID NO: 630830 - protein, 21 aa, Mycobacterium
AGGPPGALFGYLAAGKKSVIN

SEQ ID NO: 630831 - protein, 27 aa, Mycobacterium
AGGPVEWHKMGSGWSWTRKHGSDDDHA

SEQ ID NO: 630832 - protein, 19 aa, Mycobacterium
AGGPVLWPDLEAIIVVPNN

SEQ ID NO: 630833 - protein, 17 aa, Mycobacterium
AGGQGGIGFGGSGGSGG

SEQ ID NO: 630834 - protein, 23 aa, Mycobacterium
AGGQGGNSFQFVPSAAGGAGQSG

SEQ ID NO: 630835 - protein, 17 aa, Mycobacterium
AGGQGMFNGGSGGAGGW

SEQ ID NO: 630836 - protein, 18 aa, Mycobacterium
AGGQSFSGTGGKGGDGGS

SEQ ID NO: 630837 - protein, 18 aa, Mycobacterium
AGGQVWLMPHNPSFDPIP

SEQ ID NO: 630838 - protein, 17 aa, Mycobacterium
AGGRALLVPPFGQGEHQ

SEQ ID NO: 630839 - protein, 24 aa, Mycobacterium
AGGRCLDVVRLLRITTDSPAVEAT

SEQ ID NO: 630840 - protein, 24 aa, Mycobacterium
AGGRGVGSAENFKIVEELADSLGG

SEQ ID NO: 630841 - protein, 29 aa, Mycobacterium
AGGRPQEWLDQRFVPPPAVGERMAHDEGI

SEQ ID NO: 630842 - protein, 40 aa, Mycobacterium
AGGRPTTHLDWYIAMACFKLAIVIEGTWSRYLAGRASAEA

SEQ ID NO: 630843 - protein, 17 aa, Mycobacterium
AGGRRWTYAELDAEIDT

SEQ ID NO: 630844 - protein, 21 aa, Mycobacterium
AGGSAAMLFGNGGAGGNGGSG

SEQ ID NO: 630845 - protein, 20 aa, Mycobacterium
AGGSAYGRGGITTGGNGGAG

SEQ ID NO: 630846 - protein, 29 aa, Mycobacterium
AGGSGGAARLFGIGGAGGAGGHGVAGTAG

SEQ ID NO: 630847 - protein, 25 aa, Mycobacterium
AGGSGGAGGWLIGNGGNGGVGGIGS

SEQ ID NO: 630848 - protein, 24 aa, Mycobacterium
AGGSGGNAAMLFGNGGAGGTGAVG

SEQ ID NO: 630849 - protein, 19 aa, Mycobacterium
AGGSGGWLAGSGGNGGAGG

SEQ ID NO: 630850 - protein, 22 aa, Mycobacterium
AGGSHGGLLVRLLSEERLPCAH

SEQ ID NO: 630851 - protein, 17 aa, Mycobacterium
AGGSIVLTSSVAGLTGM

SEQ ID NO: 630852 - protein, 29 aa, Mycobacterium
AGGSMARRLRLNSRMGLLADDARVVDTLS

SEQ ID NO: 630853 - protein, 21 aa, Mycobacterium
AGGSVTRIWLGPKRLVPPMVM

SEQ ID NO: 630854 - protein, 21 aa, Mycobacterium
AGGTDIRWTGSFTEGVRGTGP

SEQ ID NO: 630855 - protein, 24 aa, Mycobacterium
AGGTDLRGVPQFDNVKMVGAVNYA

SEQ ID NO: 630856 - protein, 24 aa, Mycobacterium
AGGTGGAGGMLFGNGGNGGAGGVG

SEQ ID NO: 630857 - protein, 24 aa, Mycobacterium
AGGTGGAGGWLYGNGGAGGAGGAS

SEQ ID NO: 630858 - protein, 24 aa, Mycobacterium
AGGTGGAGGWLYGNGGAGGAGGVG

SEQ ID NO: 630859 - protein, 24 aa, Mycobacterium
AGGTGGAGGWLYGNGGAGGSGGAG

SEQ ID NO: 630860 - protein, 25 aa, Mycobacterium
AGGTGGNGGWLYGSGGAGGAGGNAL

SEQ ID NO: 630861 - protein, 18 aa, Mycobacterium
AGGTLIRLFHAETVMCEM

SEQ ID NO: 630862 - protein, 17 aa, Mycobacterium
AGGTLVRTPLIGGLLDK

SEQ ID NO: 630863 - protein, 17 aa, Mycobacterium
AGGTLWVELTGMGVTWM

SEQ ID NO: 630864 - protein, 22 aa, Mycobacterium
AGGTNTGWFNAGIVNTGIGNTG

SEQ ID NO: 630865 - protein, 22 aa, Mycobacterium
AGGTPPIFFGFGSMPVESPSAA

SEQ ID NO: 630866 - protein, 22 aa, Mycobacterium
AGGTSFLRWSKRLADHAHTAEV

SEQ ID NO: 630867 - protein, 21 aa, Mycobacterium
AGGVCAALFHRERTGEPCIVD

SEQ ID NO: 630868 - protein, 30 aa, Mycobacterium
AGGVFRIAQQLPRKVAMQLLLTGEPLTAAA

SEQ ID NO: 630869 - protein, 18 aa, Mycobacterium
AGGVGAPRLRDVELVQMV

SEQ ID NO: 630870 - protein, 28 aa, Mycobacterium
AGGVGLCPLRPAILGALAQRDRYGKVTL

SEQ ID NO: 630871 - protein, 18 aa, Mycobacterium
AGGVLEFGTTVLAAADGS

SEQ ID NO: 630872 - protein, 17 aa, Mycobacterium
AGGVPAYGNQRTEWDAG

SEQ ID NO: 630873 - protein, 24 aa, Mycobacterium
AGGVRAGHELKFWTPGGSSTPLLT

SEQ ID NO: 630874 - protein, 23 aa, Mycobacterium
AGGVRAGHQLKFWTPGGSSTPLL

SEQ ID NO: 630875 - protein, 21 aa, Mycobacterium
AGGVRDGRALKFWTPGGSSTP

SEQ ID NO: 630876 - protein, 18 aa, Mycobacterium
AGGVRKTLSDFAEGAGLK

SEQ ID NO: 630877 - protein, 20 aa, Mycobacterium
AGGVSGWPRRRLTRAAMSLL

SEQ ID NO: 630878 - protein, 21 aa, Mycobacterium
AGGVTHLRRIFALAELYGVRT

SEQ ID NO: 630879 - protein, 25 aa, Mycobacterium
AGGWLYDRVTAGWEVTVLLPRGDGT

SEQ ID NO: 630880 - protein, 23 aa, Mycobacterium
AGGWQRRIDSVIGRDKDSAEALA

SEQ ID NO: 630881 - protein, 23 aa, Mycobacterium
AGGYGLDPERLWATVYLDDDEAA

SEQ ID NO: 630882 - protein, 18 aa, Mycobacterium
AGGYRTADQFADDISAAR

SEQ ID NO: 630883 - protein, 17 aa, Mycobacterium
AGGYVIKDIKGMELISA

SEQ ID NO: 630884 - protein, 18 aa, Mycobacterium
AGHAAAATDGEWDQVARC

SEQ ID NO: 630885 - protein, 22 aa, Mycobacterium
AGHAAGMPLVLAGKCSEPPEIA

SEQ ID NO: 630886 - protein, 17 aa, Mycobacterium
AGHAERCGTESGTELVS

SEQ ID NO: 630887 - protein, 31 aa, Mycobacterium
AGHAGAATDGEWDRVASCESGGNWAINTGNG

SEQ ID NO: 630888 - protein, 21 aa, Mycobacterium
AGHAQAAGYSDGVQGVGGAGG

SEQ ID NO: 630889 - protein, 18 aa, Mycobacterium
AGHAVWVRMRTLGGDAPD

SEQ ID NO: 630890 - protein, 25 aa, Mycobacterium
AGHDIAWPKVHLFWGDERYVPENDD

SEQ ID NO: 630891 - protein, 18 aa, Mycobacterium
AGHEHALQRACAAGALAT

SEQ ID NO: 630892 - protein, 24 aa, Mycobacterium
AGHEVRLLVAPGCEGEPVIDKLAE

SEQ ID NO: 630893 - protein, 19 aa, Mycobacterium
AGHFFTRWQLPTGTASAPF

SEQ ID NO: 630894 - protein, 18 aa, Mycobacterium
AGHFGWVACNNRTTRAVA

SEQ ID NO: 630895 - protein, 17 aa, Mycobacterium
AGHGDRVAIHWEGEPTD

SEQ ID NO: 630896 - protein, 22 aa, Mycobacterium
AGHGDRVAIHWEGEPVGDHRSL

SEQ ID NO: 630897 - protein, 19 aa, Mycobacterium
AGHGFLFQHLPDFAREVTE

SEQ ID NO: 630898 - protein, 19 aa, Mycobacterium
AGHGLHLFATLLAAAEHAS

SEQ ID NO: 630899 - protein, 17 aa, Mycobacterium
AGHGLKLTGTHGSYAIG

SEQ ID NO: 630900 - protein, 18 aa, Mycobacterium
AGHGMMWGPAVAQVAADL

SEQ ID NO: 630901 - protein, 24 aa, Mycobacterium
AGHGRSGFLLAPWTAEQIMCELAA

SEQ ID NO: 630902 - protein, 24 aa, Mycobacterium
AGHGRSGFLLAPWTAEQIVSELAP

SEQ ID NO: 630903 - protein, 26 aa, Mycobacterium
AGHHCAQPILRRLGLEQTVRPSFAFY

SEQ ID NO: 630904 - protein, 18 aa, Mycobacterium
AGHIRVALDLGVSPEEVL

SEQ ID NO: 630905 - protein, 21 aa, Mycobacterium
AGHIVVCSGPDAWLLHADAWG

SEQ ID NO: 630906 - protein, 17 aa, Mycobacterium
AGHKGFTLLVVEAGMEG

SEQ ID NO: 630907 - protein, 27 aa, Mycobacterium
AGHLAAELMGRFAFDRPGLAAISLPDA

SEQ ID NO: 630908 - protein, 28 aa, Mycobacterium
AGHLAAELMGRFAFDRPGLAAISLPDAT

SEQ ID NO: 630909 - protein, 24 aa, Mycobacterium
AGHLARAFGAHAFVADFRLAPEHP

SEQ ID NO: 630910 - protein, 26 aa, Mycobacterium
AGHLLEIRGTCVLVDGVVKSLSPAGM

SEQ ID NO: 630911 - protein, 19 aa, Mycobacterium
AGHLLPVPRTRVAIDVLVD

SEQ ID NO: 630912 - protein, 18 aa, Mycobacterium
AGHLPIVLGLNLTEHAEM

SEQ ID NO: 630913 - protein, 29 aa, Mycobacterium
AGHLRAAIMSGALRPGTFIRLDETAAELG

SEQ ID NO: 630914 - protein, 30 aa, Mycobacterium
AGHLRAAIMSGTLRPGTFIRLDETAAELGV

SEQ ID NO: 630915 - protein, 18 aa, Mycobacterium
AGHLRHRIPPVAQHVPEF

SEQ ID NO: 630916 - protein, 21 aa, Mycobacterium
AGHLRIGDRADLFVIDPEKLD

SEQ ID NO: 630917 - protein, 18 aa, Mycobacterium
AGHLWWIRSQLRSLLVDD

SEQ ID NO: 630918 - protein, 19 aa, Mycobacterium
AGHLWWIRSQLRSLLVDDV

SEQ ID NO: 630919 - protein, 17 aa, Mycobacterium
AGHPEYLTVQAIAALNE

SEQ ID NO: 630920 - protein, 23 aa, Mycobacterium
AGHPTLGSAHAWLEHRESPGCAD

SEQ ID NO: 630921 - protein, 22 aa, Mycobacterium
AGHPTVGASWWLREQGTPINTL

SEQ ID NO: 630922 - protein, 22 aa, Mycobacterium
AGHPTVGASWWLREQGTPVNTL

SEQ ID NO: 630923 - protein, 17 aa, Mycobacterium
AGHPVALESMDTMADGI

SEQ ID NO: 630924 - protein, 25 aa, Mycobacterium
AGHRHFRFFLNVEVGRHLSHADLLA

SEQ ID NO: 630925 - protein, 26 aa, Mycobacterium
AGHRKEGKTVSIGWLRQELDDLPEDI

SEQ ID NO: 630926 - protein, 17 aa, Mycobacterium
AGHRLRLTITTYDFPHL

SEQ ID NO: 630927 - protein, 22 aa, Mycobacterium
AGHRRGRLGAVATSCEMFGLEE

SEQ ID NO: 630928 - protein, 20 aa, Mycobacterium
AGHRRGRLGNVETSYEMFGL

SEQ ID NO: 630929 - protein, 20 aa, Mycobacterium
AGHRSAERFAEDIAAARAAT

SEQ ID NO: 630930 - protein, 22 aa, Mycobacterium
AGHRTAVAWAREQFGDELLWGI

SEQ ID NO: 630931 - protein, 18 aa, Mycobacterium
AGHRVRLLAEPGWNNPPL

SEQ ID NO: 630932 - protein, 22 aa, Mycobacterium
AGHSMGGIAISAWSERYRHKVH

SEQ ID NO: 630933 - protein, 23 aa, Mycobacterium
AGHSMGGITISAWSERYRHKVLR

SEQ ID NO: 630934 - protein, 22 aa, Mycobacterium
AGHSRYATYFAQGIISSQQREI

SEQ ID NO: 630935 - protein, 19 aa, Mycobacterium
AGHVAAVRFTINGVYQGET

SEQ ID NO: 630936 - protein, 22 aa, Mycobacterium
AGHVRDVLNFYAATPERLSGKQ

SEQ ID NO: 630937 - protein, 23 aa, Mycobacterium
AGHVYLCEFAHRWVDDLTIVISV

SEQ ID NO: 630938 - protein, 17 aa, Mycobacterium
AGIAAKVVTGRALRRSP

SEQ ID NO: 630939 - protein, 19 aa, Mycobacterium
AGIADARRRAGLISYLDRL

SEQ ID NO: 630940 - protein, 17 aa, Mycobacterium
AGIALSILGTGLAAAAL

SEQ ID NO: 630941 - protein, 21 aa, Mycobacterium
AGIAQCEDCPVDLSPLKDTDP

SEQ ID NO: 630942 - protein, 19 aa, Mycobacterium
AGIAQRFALFTDLEADQID

SEQ ID NO: 630943 - protein, 19 aa, Mycobacterium
AGIARHFAAILGSGSLRHH

SEQ ID NO: 630944 - protein, 33 aa, Mycobacterium
AGIATREVDGVYDLGGQAARVVGKLRETLPGSP

SEQ ID NO: 630945 - protein, 19 aa, Mycobacterium
AGIAVLGARIVPPIVETRL

SEQ ID NO: 630946 - protein, 21 aa, Mycobacterium
AGIAYRARMGGGVAEGTDEVD

SEQ ID NO: 630947 - protein, 19 aa, Mycobacterium
AGICFPREYGGLGLDHAYQ

SEQ ID NO: 630948 - protein, 27 aa, Mycobacterium
AGICFPREYGGLGLDYAYQRAFNAECR

SEQ ID NO: 630949 - protein, 19 aa, Mycobacterium
AGICFPREYGGLGLGYEYK

SEQ ID NO: 630950 - protein, 17 aa, Mycobacterium
AGICGSDIPGFRGTQGK

SEQ ID NO: 630951 - protein, 19 aa, Mycobacterium
AGICGWGASSRNGGYLTDA

SEQ ID NO: 630952 - protein, 29 aa, Mycobacterium
AGIDDAWIFARTAIRTRRWADPEQATSDL

SEQ ID NO: 630953 - protein, 25 aa, Mycobacterium
AGIDEFRAPLPLGIDPAAGDHTAAI

SEQ ID NO: 630954 - protein, 21 aa, Mycobacterium
AGIDFARALPVPSVFTSRPQV

SEQ ID NO: 630955 - protein, 17 aa, Mycobacterium
AGIDLDDVFEVLETEGV

SEQ ID NO: 630956 - protein, 27 aa, Mycobacterium
AGIDLPRRVFAHGFLLNRGEKMSKSVG

SEQ ID NO: 630957 - protein, 26 aa, Mycobacterium
AGIDPGIVDDVIWGCVMQAGEQALDI

SEQ ID NO: 630958 - protein, 24 aa, Mycobacterium
AGIDRFPVDLVRRYFGESGDSTLL

SEQ ID NO: 630959 - protein, 22 aa, Mycobacterium
AGIDVAVCKPVQTGTGAGDDDL

SEQ ID NO: 630960 - protein, 18 aa, Mycobacterium
AGIDVRWTGRAGGRDVID

SEQ ID NO: 630961 - protein, 25 aa, Mycobacterium
AGIEDSWAALRWVGEHAHELGGDPN

SEQ ID NO: 630962 - protein, 28 aa, Mycobacterium
AGIELPKKVFAHGFLFNRGEKMSKSVGN

SEQ ID NO: 630963 - protein, 25 aa, Mycobacterium
AGIELPRRVFAHGFLHNRGEKMSKS

SEQ ID NO: 630964 - protein, 27 aa, Mycobacterium
AGIELPRRVFAHGFLLNRGEKMSKSVG

SEQ ID NO: 630965 - protein, 17 aa, Mycobacterium
AGIEVWYFHEPQNMSKP

SEQ ID NO: 630966 - protein, 17 aa, Mycobacterium
AGIFARVLGMERVSVDD

SEQ ID NO: 630967 - protein, 22 aa, Mycobacterium
AGIGFYIDHHRIHVGTDETAAD

SEQ ID NO: 630968 - protein, 18 aa, Mycobacterium
AGIGKTTLWLSLLQTARM

SEQ ID NO: 630969 - protein, 24 aa, Mycobacterium
AGIGRACADLLAREGARVTITGRD

SEQ ID NO: 630970 - protein, 18 aa, Mycobacterium
AGIGSAVSTASRAAAGPT

SEQ ID NO: 630971 - protein, 26 aa, Mycobacterium
AGIGSRLNHQIGWLSPRTRTLVLGLP

SEQ ID NO: 630972 - protein, 17 aa, Mycobacterium
AGIGYDLVEQAYVGYVY

SEQ ID NO: 630973 - protein, 19 aa, Mycobacterium
AGIHVRWKGIVAGREVIEI

SEQ ID NO: 630974 - protein, 28 aa, Mycobacterium
AGIICVTRNLAVKWAGKGIRVNAVAPGA

SEQ ID NO: 630975 - protein, 26 aa, Mycobacterium
AGIKLCQRRHNLPGLDFVRGDAENLP

SEQ ID NO: 630976 - protein, 18 aa, Mycobacterium
AGIKQAVILASGLDARAY

SEQ ID NO: 630977 - protein, 17 aa, Mycobacterium
AGIKRISRRAMSAPSSG

SEQ ID NO: 630978 - protein, 19 aa, Mycobacterium
AGILAEVAQPFAVIGVGLN

SEQ ID NO: 630979 - protein, 18 aa, Mycobacterium
AGILAEWRGLEFDVAVAQ

SEQ ID NO: 630980 - protein, 24 aa, Mycobacterium
AGILDVLDNYAFVRTSGYLAGPND

SEQ ID NO: 630981 - protein, 17 aa, Mycobacterium
AGILGLTEREWSRIRGT

SEQ ID NO: 630982 - protein, 18 aa, Mycobacterium
AGILRDGFIAGLEEEQWD

SEQ ID NO: 630983 - protein, 17 aa, Mycobacterium
AGILRDGFIAGMDESQW

SEQ ID NO: 630984 - protein, 19 aa, Mycobacterium
AGIMQWCVRTVTEHLRTRE

SEQ ID NO: 630985 - protein, 19 aa, Mycobacterium
AGINDAGRVVGGLRAKGPY

SEQ ID NO: 630986 - protein, 17 aa, Mycobacterium
AGIPFLLIRNHSGRPIL

SEQ ID NO: 630987 - protein, 17 aa, Mycobacterium
AGIPGRGVTAVFGPSGS

SEQ ID NO: 630988 - protein, 19 aa, Mycobacterium
AGIPKPHRRNSWYFDADTG

SEQ ID NO: 630989 - protein, 18 aa, Mycobacterium
AGIPLGTLQYVFPSKQGL

SEQ ID NO: 630990 - protein, 23 aa, Mycobacterium
AGIPPFHVMDVWLAAAERQRTHG

SEQ ID NO: 630991 - protein, 22 aa, Mycobacterium
AGIPPFYVMDVWLAAAERQRSH

SEQ ID NO: 630992 - protein, 17 aa, Mycobacterium
AGIPPGSRYDHFESKEA

SEQ ID NO: 630993 - protein, 20 aa, Mycobacterium
AGIPRAIRPPSDVLRLGYNF

SEQ ID NO: 630994 - protein, 25 aa, Mycobacterium
AGIPVRRVRAGHAFHTSAMDPMLDE

SEQ ID NO: 630995 - protein, 18 aa, Mycobacterium
AGIRECTAILVGESGTPV

SEQ ID NO: 630996 - protein, 17 aa, Mycobacterium
AGIRERVVAQLNLVEHD

SEQ ID NO: 630997 - protein, 17 aa, Mycobacterium
AGIRHLAPYVGYPTAAV

SEQ ID NO: 630998 - protein, 17 aa, Mycobacterium
AGIRLCQKRHHLPGLDF

SEQ ID NO: 630999 - protein, 18 aa, Mycobacterium
AGIRNLRIRRFPFTPQIS

SEQ ID NO: 631000 - protein, 21 aa, Mycobacterium
AGIRSLLAYQWAHPGKQLLFM

SEQ ID NO: 631001 - protein, 23 aa, Mycobacterium
AGIRVLELGNFIAAPTAGRILAD

SEQ ID NO: 631002 - protein, 19 aa, Mycobacterium
AGISKAWLGETLHINDMPW

SEQ ID NO: 631003 - protein, 23 aa, Mycobacterium
AGISKLPLGGMVGRESDGAVHRI

SEQ ID NO: 631004 - protein, 19 aa, Mycobacterium
AGISRASFYIYFDDKGHLL

SEQ ID NO: 631005 - protein, 19 aa, Mycobacterium
AGISRASFYIYFEDKGHLL

SEQ ID NO: 631006 - protein, 20 aa, Mycobacterium
AGISRASFYIYFEDKGHLLR

SEQ ID NO: 631007 - protein, 24 aa, Mycobacterium
AGISREEMDAWALRSHRNAIAAID

SEQ ID NO: 631008 - protein, 18 aa, Mycobacterium
AGISRPKLYRFFTDKEAL

SEQ ID NO: 631009 - protein, 25 aa, Mycobacterium
AGISRPTFYFYFPSKEAVLLTLLDR

SEQ ID NO: 631010 - protein, 24 aa, Mycobacterium
AGISRPTFYFYFRSKNAVLLSLLD

SEQ ID NO: 631011 - protein, 17 aa, Mycobacterium
AGISRQTIYNEFGSRQG

SEQ ID NO: 631012 - protein, 17 aa, Mycobacterium
AGISRRTLFRYYASKSA

SEQ ID NO: 631013 - protein, 19 aa, Mycobacterium
AGITCAVLIPQGKIAMGKL

SEQ ID NO: 631014 - protein, 17 aa, Mycobacterium
AGITDVYLAGPEKAVAE

SEQ ID NO: 631015 - protein, 24 aa, Mycobacterium
AGITELFALLAYGEVAAFYRLAEE

SEQ ID NO: 631016 - protein, 22 aa, Mycobacterium
AGITNNGQFTPSIYGNGGNGGN

SEQ ID NO: 631017 - protein, 21 aa, Mycobacterium
AGITQVKVRSVLTCTTGTGVC

SEQ ID NO: 631018 - protein, 22 aa, Mycobacterium
AGITRGALYFYFASKNDVLAAL

SEQ ID NO: 631019 - protein, 21 aa, Mycobacterium
AGITRGALYFYFGSKQEVITA

SEQ ID NO: 631020 - protein, 23 aa, Mycobacterium
AGITRTSEFLTHPAFTQYRTETA

SEQ ID NO: 631021 - protein, 18 aa, Mycobacterium
AGITTYSPLHHWNAGPGK

SEQ ID NO: 631022 - protein, 19 aa, Mycobacterium
AGIVMPIFVMMREHGQLWR

SEQ ID NO: 631023 - protein, 24 aa, Mycobacterium
AGIVRPESRGSVRLTGCSPDDPVR

SEQ ID NO: 631024 - protein, 25 aa, Mycobacterium
AGIYPPCSAFEAWFVSTALDDDAFD

SEQ ID NO: 631025 - protein, 22 aa, Mycobacterium
AGKADYTLRIGHSQVEVAPGKH

SEQ ID NO: 631026 - protein, 20 aa, Mycobacterium
AGKALREWDALMVVEEGKPV

SEQ ID NO: 631027 - protein, 20 aa, Mycobacterium
AGKARLVLRRETVDDLLSLE

SEQ ID NO: 631028 - protein, 27 aa, Mycobacterium
AGKAVWPEIWTAIGPMLAGVVATGKAT

SEQ ID NO: 631029 - protein, 24 aa, Mycobacterium
AGKDLSFVPLRPERLVEVRYDHME

SEQ ID NO: 631030 - protein, 23 aa, Mycobacterium
AGKDLSFVPLRPERVVEVRYDHM

SEQ ID NO: 631031 - protein, 26 aa, Mycobacterium
AGKDTWRFVVDFPFDDQGHSVRDDDK

SEQ ID NO: 631032 - protein, 21 aa, Mycobacterium
AGKEIPFDLRARARRDQVRAT

SEQ ID NO: 631033 - protein, 26 aa, Mycobacterium
AGKERRGDGLGALSTMVLPELRALAS

SEQ ID NO: 631034 - protein, 30 aa, Mycobacterium
AGKGIGCGIARRFAREGAKVVVAELDSDAG

SEQ ID NO: 631035 - protein, 24 aa, Mycobacterium
AGKGTRVGLFFANDTEWVTWWLAV

SEQ ID NO: 631036 - protein, 23 aa, Mycobacterium
AGKHAASAFALFFPIEGDVDYGQ

SEQ ID NO: 631037 - protein, 17 aa, Mycobacterium
AGKHLARPKRYAAGFSR

SEQ ID NO: 631038 - protein, 20 aa, Mycobacterium
AGKIVAVKGIGGYHLACDAT

SEQ ID NO: 631039 - protein, 21 aa, Mycobacterium
AGKLLALLGAEVIKVETAALP

SEQ ID NO: 631040 - protein, 20 aa, Mycobacterium
AGKLWSRIVAEVGRDYPDVE

SEQ ID NO: 631041 - protein, 19 aa, Mycobacterium
AGKMPFPILGVDSDNGSEF

SEQ ID NO: 631042 - protein, 32 aa, Mycobacterium
AGKPAKLVSKRGWRRWVHSITRINVGLSPDEK

SEQ ID NO: 631043 - protein, 19 aa, Mycobacterium
AGKPFGLRPEAILPAYGMA

SEQ ID NO: 631044 - protein, 24 aa, Mycobacterium
AGKPYAFERGRFYALDANAVIAAD

SEQ ID NO: 631045 - protein, 17 aa, Mycobacterium
AGKRIATSFPNLVRKDL

SEQ ID NO: 631046 - protein, 23 aa, Mycobacterium
AGKRLAAEGAKKVICVIQEQGHV

SEQ ID NO: 631047 - protein, 20 aa, Mycobacterium
AGKSPAAFYRYFSDKEDLLA

SEQ ID NO: 631048 - protein, 21 aa, Mycobacterium
AGKSPAVFYRYFDDKEDLLAA

SEQ ID NO: 631049 - protein, 24 aa, Mycobacterium
AGKTTLLNAFTWVLYGQFTKDFEK

SEQ ID NO: 631050 - protein, 21 aa, Mycobacterium
AGKVIRVAREFARSAEESGGR

SEQ ID NO: 631051 - protein, 26 aa, Mycobacterium
AGLAAWIVEKMRAWSDCGGDVESVFS

SEQ ID NO: 631052 - protein, 25 aa, Mycobacterium
AGLAAWLVLCCRAMEAGAQEALAIA

SEQ ID NO: 631053 - protein, 18 aa, Mycobacterium
AGLAAWWNLLEETNTGWT

SEQ ID NO: 631054 - protein, 19 aa, Mycobacterium
AGLAAWWTLLEHTGTGWTQ

SEQ ID NO: 631055 - protein, 23 aa, Mycobacterium
AGLACSGGSPGLRAVADTDATVV

SEQ ID NO: 631056 - protein, 25 aa, Mycobacterium
AGLADRGRIAVGFKADLNVIDHDAL

SEQ ID NO: 631057 - protein, 23 aa, Mycobacterium
AGLAEAGARVVLNGVDGPRLEHT

SEQ ID NO: 631058 - protein, 18 aa, Mycobacterium
AGLAEGDAVAILMENNEH

SEQ ID NO: 631059 - protein, 19 aa, Mycobacterium
AGLALAVGVIAGRWQLIAF

SEQ ID NO: 631060 - protein, 21 aa, Mycobacterium
AGLALKYGHLTARQAARVAAE

SEQ ID NO: 631061 - protein, 25 aa, Mycobacterium
AGLAMDRAAFSIGVEPIAARPDDSA

SEQ ID NO: 631062 - protein, 25 aa, Mycobacterium
AGLAMGFPMLCAGVSAGTVVRRRGD

SEQ ID NO: 631063 - protein, 23 aa, Mycobacterium
AGLAMLAPIWGFEPLLDTEDSVA

SEQ ID NO: 631064 - protein, 18 aa, Mycobacterium
AGLAMLAPIWGYAPMLDI

SEQ ID NO: 631065 - protein, 19 aa, Mycobacterium
AGLAQRCRDGGTALVSYGF

SEQ ID NO: 631066 - protein, 18 aa, Mycobacterium
AGLARALVLDPEIILCDE

SEQ ID NO: 631067 - protein, 26 aa, Mycobacterium
AGLARGRTGVFWIREMLPIGELREIL

SEQ ID NO: 631068 - protein, 17 aa, Mycobacterium
AGLARYLHQQGIEVLEV

SEQ ID NO: 631069 - protein, 17 aa, Mycobacterium
AGLAVLGARVVPPIVTT

SEQ ID NO: 631070 - protein, 19 aa, Mycobacterium
AGLAVLGGRLVPPIVETAL

SEQ ID NO: 631071 - protein, 20 aa, Mycobacterium
AGLAVRLAQRLGRVTADGSV

SEQ ID NO: 631072 - protein, 21 aa, Mycobacterium
AGLAVRPGYVLSDGFRVPGLP

SEQ ID NO: 631073 - protein, 21 aa, Mycobacterium
AGLCNSAGFGTSGRFYELSPE

SEQ ID NO: 631074 - protein, 27 aa, Mycobacterium
AGLCRHVLCFRTVWESTYAALRLHGGG

SEQ ID NO: 631075 - protein, 20 aa, Mycobacterium
AGLCTPGSRLVLDHIAAGVV

SEQ ID NO: 631076 - protein, 24 aa, Mycobacterium
AGLDADVYWVRYVCNSHGYYRSQL

SEQ ID NO: 631077 - protein, 26 aa, Mycobacterium
AGLDARAWRLGWPDGTTVYELDQPRV

SEQ ID NO: 631078 - protein, 30 aa, Mycobacterium
AGLDARAWRLPWPGGTVVYELDQPKVLDFK

SEQ ID NO: 631079 - protein, 26 aa, Mycobacterium
AGLDARAYRLGWPPGSVVYEVDQPKV

SEQ ID NO: 631080 - protein, 24 aa, Mycobacterium
AGLDARAYRLSWPGDSVVYEVDQP

SEQ ID NO: 631081 - protein, 28 aa, Mycobacterium
AGLDARAYRLSWPPGSVVYEVDQPKVVD

SEQ ID NO: 631082 - protein, 26 aa, Mycobacterium
AGLDARSWRLAWPAGTTVYELDQPRV

SEQ ID NO: 631083 - protein, 19 aa, Mycobacterium
AGLDGLVWMSRQCNDAKAY

SEQ ID NO: 631084 - protein, 18 aa, Mycobacterium
AGLDGYSAADCVALLREA

SEQ ID NO: 631085 - protein, 19 aa, Mycobacterium
AGLDGYSAADCVALLRESA

SEQ ID NO: 631086 - protein, 22 aa, Mycobacterium
AGLDLGDVLGIISGAERVEAAT

SEQ ID NO: 631087 - protein, 17 aa, Mycobacterium
AGLDLGGVLGIISGAER

SEQ ID NO: 631088 - protein, 17 aa, Mycobacterium
AGLDLRAGIAAQMRGLG

SEQ ID NO: 631089 - protein, 17 aa, Mycobacterium
AGLDPRFVSAGERNAGA

SEQ ID NO: 631090 - protein, 21 aa, Mycobacterium
AGLDRKALPALRHIVRIPIEE

SEQ ID NO: 631091 - protein, 17 aa, Mycobacterium
AGLDRLAELSIRTVHSI

SEQ ID NO: 631092 - protein, 29 aa, Mycobacterium
AGLDSRAWRLPWPAGTTVFELDQPRVLEF

SEQ ID NO: 631093 - protein, 29 aa, Mycobacterium
AGLDSRAYRLGWPAGTVVYEIDQPRVIEA

SEQ ID NO: 631094 - protein, 25 aa, Mycobacterium
AGLDVPTFRVLAGLSGRVPLVAIVS

SEQ ID NO: 631095 - protein, 33 aa, Mycobacterium
AGLELLTRVWADEFGRSGVRVNAIAPGPTDTPG

SEQ ID NO: 631096 - protein, 24 aa, Mycobacterium
AGLELPLGCTFRLAAAEGASIGLP

SEQ ID NO: 631097 - protein, 19 aa, Mycobacterium
AGLELSDRSLICLPSTFEK

SEQ ID NO: 631098 - protein, 26 aa, Mycobacterium
AGLEPDLKWERFVNAIRLLAEQLGVR

SEQ ID NO: 631099 - protein, 25 aa, Mycobacterium
AGLEPDLRWERFITAVRLLAEQLGV

SEQ ID NO: 631100 - protein, 25 aa, Mycobacterium
AGLERLGAQLSQWSSATVDIAVAMR

SEQ ID NO: 631101 - protein, 29 aa, Mycobacterium
AGLFGVGGDGGLGGTGFFGVGGAGGAAGN

SEQ ID NO: 631102 - protein, 34 aa, Mycobacterium
AGLGAAGTRLRGLVFPTPPAPIVAAGTDALSVAI

SEQ ID NO: 631103 - protein, 17 aa, Mycobacterium
AGLGFRRSRSVVIVHIF

SEQ ID NO: 631104 - protein, 17 aa, Mycobacterium
AGLGGAQRKIEQALKPG

SEQ ID NO: 631105 - protein, 21 aa, Mycobacterium
AGLGGPFVVVFDGARQRQDIE

SEQ ID NO: 631106 - protein, 30 aa, Mycobacterium
AGLGKARMVGAVSVPPTWEGSMPTRMASSA

SEQ ID NO: 631107 - protein, 21 aa, Mycobacterium
AGLGLSCQLSAAAVDAAHGEV

SEQ ID NO: 631108 - protein, 23 aa, Mycobacterium
AGLGNRYLFVLPFLTPAIASLWV

SEQ ID NO: 631109 - protein, 23 aa, Mycobacterium
AGLGQRWLHAGIRPLDVDVAPPT

SEQ ID NO: 631110 - protein, 25 aa, Mycobacterium
AGLGRASLVGPLSVPPSWAPPAPVA

SEQ ID NO: 631111 - protein, 17 aa, Mycobacterium
AGLGRILAGEIVRTITG

SEQ ID NO: 631112 - protein, 18 aa, Mycobacterium
AGLGSIPGALGGAAGSLP

SEQ ID NO: 631113 - protein, 30 aa, Mycobacterium
AGLGTARFVGAITVPPTWQGSMPVPAVLTS

SEQ ID NO: 631114 - protein, 18 aa, Mycobacterium
AGLGTAWGTQLAVAMLGD

SEQ ID NO: 631115 - protein, 18 aa, Mycobacterium
AGLGVGESGVSYLAGDAV

SEQ ID NO: 631116 - protein, 24 aa, Mycobacterium
AGLHAPSWCDPVWLDFPGIAFGRP

SEQ ID NO: 631117 - protein, 22 aa, Mycobacterium
AGLHAPTWCDPAWLDFPGIAFG

SEQ ID NO: 631118 - protein, 24 aa, Mycobacterium
AGLHAYRGPWQYETLSREILLDIA

SEQ ID NO: 631119 - protein, 24 aa, Mycobacterium
AGLHEVDGYLALRPRAEAVRHQLL

SEQ ID NO: 631120 - protein, 25 aa, Mycobacterium
AGLHGPSWCDPVWLDQPGIAFPFPD

SEQ ID NO: 631121 - protein, 21 aa, Mycobacterium
AGLHRRYLIVLPFLTPTIASL

SEQ ID NO: 631122 - protein, 24 aa, Mycobacterium
AGLIAPHWPAPWGVDAGPLKQLII

SEQ ID NO: 631123 - protein, 18 aa, Mycobacterium
AGLIARRIVCHAKVGDQL

SEQ ID NO: 631124 - protein, 20 aa, Mycobacterium
AGLIDRLGDLAIRGLVSSPL

SEQ ID NO: 631125 - protein, 20 aa, Mycobacterium
AGLIRTEFLFLGRRQAPDVD

SEQ ID NO: 631126 - protein, 24 aa, Mycobacterium
AGLISRRLRGIAALAGVGAGLAIA

SEQ ID NO: 631127 - protein, 27 aa, Mycobacterium
AGLISRRLRVLAGLAGLGAGLAIADDC

SEQ ID NO: 631128 - protein, 17 aa, Mycobacterium
AGLITSLGFGHVSGLIA

SEQ ID NO: 631129 - protein, 18 aa, Mycobacterium
AGLKAIYLSGWQVAGDAN

SEQ ID NO: 631130 - protein, 17 aa, Mycobacterium
AGLKIGSDVALALDVAA

SEQ ID NO: 631131 - protein, 22 aa, Mycobacterium
AGLKLAYGCRIGICHTCTGTVR

SEQ ID NO: 631132 - protein, 17 aa, Mycobacterium
AGLKPPAPLVLVPRRQR

SEQ ID NO: 631133 - protein, 28 aa, Mycobacterium
AGLKRWNAIGEIIGRGWDDVLGAIDGIV

SEQ ID NO: 631134 - protein, 25 aa, Mycobacterium
AGLKWWTSEVQWEIIDRCLQLHGGY

SEQ ID NO: 631135 - protein, 17 aa, Mycobacterium
AGLLAARLTDRAGSSAY

SEQ ID NO: 631136 - protein, 26 aa, Mycobacterium
AGLLAGRRATTHWRHAGLLQRAYRDV

SEQ ID NO: 631137 - protein, 20 aa, Mycobacterium
AGLLALGGRCESGAAIIAEH

SEQ ID NO: 631138 - protein, 21 aa, Mycobacterium
AGLLAPHWPAPYGRGASPAEQ

SEQ ID NO: 631139 - protein, 22 aa, Mycobacterium
AGLLDAMGWLAANVPIYAVNVL

SEQ ID NO: 631140 - protein, 19 aa, Mycobacterium
AGLLDRIGFRDEAYARIAE

SEQ ID NO: 631141 - protein, 24 aa, Mycobacterium
AGLLDRLDHMLSYHAMYGTWQALG

SEQ ID NO: 631142 - protein, 18 aa, Mycobacterium
AGLLDRLDHMLSYHQMYG

SEQ ID NO: 631143 - protein, 20 aa, Mycobacterium
AGLLDSYPLVSIEDPLSEDD

SEQ ID NO: 631144 - protein, 25 aa, Mycobacterium
AGLLELRPPALLVGRDHVEFPCVPA

SEQ ID NO: 631145 - protein, 29 aa, Mycobacterium
AGLLFSDAGGGGFGGFGLAGGGGTGGSGG

SEQ ID NO: 631146 - protein, 19 aa, Mycobacterium
AGLLFSSAGAGGFGGFGVA

SEQ ID NO: 631147 - protein, 17 aa, Mycobacterium
AGLLGARIADVPGSSAY

SEQ ID NO: 631148 - protein, 19 aa, Mycobacterium
AGLLGCERRGTWVYYWVIP

SEQ ID NO: 631149 - protein, 18 aa, Mycobacterium
AGLLGCGGAGGAGGLGIA

SEQ ID NO: 631150 - protein, 23 aa, Mycobacterium
AGLLGGCARRLLAAPAVLGLAID

SEQ ID NO: 631151 - protein, 17 aa, Mycobacterium
AGLLKPRTVQALLPGIG

SEQ ID NO: 631152 - protein, 22 aa, Mycobacterium
AGLLLRARHALFDRLVYEKLRS

SEQ ID NO: 631153 - protein, 23 aa, Mycobacterium
AGLLPAITFVFSRAGCDAAVKQC

SEQ ID NO: 631154 - protein, 22 aa, Mycobacterium
AGLLPDPLDTVFLVNSGSEASD

SEQ ID NO: 631155 - protein, 18 aa, Mycobacterium
AGLLRAPAAATLVSALKS

SEQ ID NO: 631156 - protein, 27 aa, Mycobacterium
AGLLRGLAQWDRLVIVETFAPENADAT

SEQ ID NO: 631157 - protein, 20 aa, Mycobacterium
AGLLRTRLFGQRTVVLTSAT

SEQ ID NO: 631158 - protein, 23 aa, Mycobacterium
AGLLSLPQPEQWGGGGQPYEVYL

SEQ ID NO: 631159 - protein, 24 aa, Mycobacterium
AGLLSLPYPEEWGGGGQPYEVYLQ

SEQ ID NO: 631160 - protein, 24 aa, Mycobacterium
AGLMAPHWPAPWGVDADPLKQLII

SEQ ID NO: 631161 - protein, 19 aa, Mycobacterium
AGLMGRRIAGVLASAGLEV

SEQ ID NO: 631162 - protein, 25 aa, Mycobacterium
AGLMQLALAAGRNFPWVERRQGIRG

SEQ ID NO: 631163 - protein, 19 aa, Mycobacterium
AGLMRRAAEMAALRVETVT

SEQ ID NO: 631164 - protein, 17 aa, Mycobacterium
AGLNAPDARFFVSVARR

SEQ ID NO: 631165 - protein, 23 aa, Mycobacterium
AGLNERYVREWLGGVTAAQVVDY

SEQ ID NO: 631166 - protein, 18 aa, Mycobacterium
AGLPADLVPAGITAISVS

SEQ ID NO: 631167 - protein, 25 aa, Mycobacterium
AGLPAPRYGTATTFAQARRIAEDIG

SEQ ID NO: 631168 - protein, 17 aa, Mycobacterium
AGLPDANAMVVGTVDAD

SEQ ID NO: 631169 - protein, 24 aa, Mycobacterium
AGLPDPFPASLRVTAIPSEYGPSN

SEQ ID NO: 631170 - protein, 30 aa, Mycobacterium; identical to SEQ ID NO: 93653

SEQ ID NO: 631171 - protein, 21 aa, Mycobacterium
AGLPESLTWSQLYRRTLNVAR

SEQ ID NO: 631172 - protein, 24 aa, Mycobacterium
AGLPEVACTVWSNVVLIAGLSRGQ

SEQ ID NO: 631173 - protein, 17 aa, Mycobacterium
AGLPGADVRVCAVAAVA

SEQ ID NO: 631174 - protein, 22 aa, Mycobacterium
AGLPGFAARLWLPMLRAERSAR

SEQ ID NO: 631175 - protein, 21 aa, Mycobacterium
AGLPGGMPAGFPDLSGMPEGL

SEQ ID NO: 631176 - protein, 17 aa, Mycobacterium
AGLPGRVVIDCSHANSG

SEQ ID NO: 631177 - protein, 23 aa, Mycobacterium
AGLPGVWLIDVERVQREPSAHAA

SEQ ID NO: 631178 - protein, 18 aa, Mycobacterium
AGLPILGHIIEMFRGGPD

SEQ ID NO: 631179 - protein, 17 aa, Mycobacterium
AGLPMRRDTLFRIASMT

SEQ ID NO: 631180 - protein, 25 aa, Mycobacterium
AGLPNLLCGNIGSPVLDVLDQPAEL

SEQ ID NO: 631181 - protein, 25 aa, Mycobacterium
AGLPPLSGGMVGFFAYDLVRRLERL

SEQ ID NO: 631182 - protein, 25 aa, Mycobacterium
AGLPRAGVWSQWHSLAFDVSVHEIF

SEQ ID NO: 631183 - protein, 25 aa, Mycobacterium
AGLPRLPGSAVVDVLLRRAPRTRSG

SEQ ID NO: 631184 - protein, 23 aa, Mycobacterium
AGLPRPRRGSGHFRGPFDDLPRT

SEQ ID NO: 631185 - protein, 17 aa, Mycobacterium
AGLPSPLPYLLGELPAG

SEQ ID NO: 631186 - protein, 27 aa, Mycobacterium
AGLPSSPWYELGRKLAPKGTGAVLAFE

SEQ ID NO: 631187 - protein, 25 aa, Mycobacterium
AGLPSSPWYGLGKKLAPKGTGAVLA

SEQ ID NO: 631188 - protein, 23 aa, Mycobacterium
AGLPTEIGSVVAFLASRRNSYMT

SEQ ID NO: 631189 - protein, 30 aa, Mycobacterium
AGLPTWKGLLDRFAEEAGFDKATRERLTER

SEQ ID NO: 631190 - protein, 17 aa, Mycobacterium
AGLPVDFTGFVTHRDTV

SEQ ID NO: 631191 - protein, 17 aa, Mycobacterium
AGLPVSIDGVYPRAVPA

SEQ ID NO: 631192 - protein, 22 aa, Mycobacterium
AGLPYLGHVRRVAAYVDPANAE

SEQ ID NO: 631193 - protein, 19 aa, Mycobacterium
AGLPYSRHASVAKLVATDA

SEQ ID NO: 631194 - protein, 23 aa, Mycobacterium
AGLPYYLASMAIRVVTIAPGLFK

SEQ ID NO: 631195 - protein, 21 aa, Mycobacterium
AGLQARIGLDSGKWTEEQMAR

SEQ ID NO: 631196 - protein, 24 aa, Mycobacterium
AGLQARIGLDTGKWNEEQMARVAF

SEQ ID NO: 631197 - protein, 24 aa, Mycobacterium
AGLQARLGLDSGKWNELQMARVAF

SEQ ID NO: 631198 - protein, 24 aa, Mycobacterium
AGLQARLGLDSGKWTHEQMAQVAL

SEQ ID NO: 631199 - protein, 33 aa, Mycobacterium
AGLQPEFGCRMGICFACTAVKTSGCTRNLRTGD

SEQ ID NO: 631200 - protein, 24 aa, Mycobacterium
AGLQPVDCRFCHVTVTVKQLGPGH

SEQ ID NO: 631201 - protein, 21 aa, Mycobacterium
AGLRAAGKRVGLIGTVGVRID

SEQ ID NO: 631202 - protein, 28 aa, Mycobacterium
AGLRAAGRVAGLIGTIGIRIDGADIPST

SEQ ID NO: 631203 - protein, 22 aa, Mycobacterium
AGLRAARPTLILWVGADQPVWA

SEQ ID NO: 631204 - protein, 20 aa, Mycobacterium
AGLRCCVVGGAALRRLTRVV

SEQ ID NO: 631205 - protein, 21 aa, Mycobacterium
AGLRCPRDMAVMGVNAIELGA

SEQ ID NO: 631206 - protein, 17 aa, Mycobacterium
AGLRDAMNLSWKIAAVR

SEQ ID NO: 631207 - protein, 19 aa, Mycobacterium
AGLRDWATYCALAERHGGR

SEQ ID NO: 631208 - protein, 22 aa, Mycobacterium
AGLRGLVGVAHYTAAKHGVVGL

SEQ ID NO: 631209 - protein, 21 aa, Mycobacterium
AGLRGLVGVSHYVAAKHGVVG

SEQ ID NO: 631210 - protein, 19 aa, Mycobacterium
AGLRGVEKGYVLGPQAEDN

SEQ ID NO: 631211 - protein, 18 aa, Mycobacterium
AGLRHAVAPLSFGGAGVE

SEQ ID NO: 631212 - protein, 20 aa, Mycobacterium
AGLRIPGLVLTDPGDRMTLR

SEQ ID NO: 631213 - protein, 20 aa, Mycobacterium
AGLRLAFLKRDGEVLQSVLD

SEQ ID NO: 631214 - protein, 17 aa, Mycobacterium
AGLRLLADLRRSLHDPP

SEQ ID NO: 631215 - protein, 25 aa, Mycobacterium
AGLRPLRPWRPALVAALAAADRPLP

SEQ ID NO: 631216 - protein, 17 aa, Mycobacterium
AGLRPVLVRAFNVLRQY

SEQ ID NO: 631217 - protein, 23 aa, Mycobacterium
AGLRRRRPPVLGELGAHGREELL

SEQ ID NO: 631218 - protein, 25 aa, Mycobacterium
AGLRTLCLDAKLYAGGMASTVELFD

SEQ ID NO: 631219 - protein, 24 aa, Mycobacterium
AGLRTVCLDFKLYAGGMASTVELF

SEQ ID NO: 631220 - protein, 17 aa, Mycobacterium
AGLRVVDVFEAPTITGL

SEQ ID NO: 631221 - protein, 17 aa, Mycobacterium
AGLSALQIMDKIVGYAG

SEQ ID NO: 631222 - protein, 19 aa, Mycobacterium
AGLSDRGRIAVGYKADLNV

SEQ ID NO: 631223 - protein, 43 aa, Mycobacterium
AGLSEALRGFPPVPSRWIDPGSLPEWLVPPGFSDGTGGVVITP

SEQ ID NO: 631224 - protein, 19 aa, Mycobacterium
AGLSEVLRAAAQHRGAALV

SEQ ID NO: 631225 - protein, 26 aa, Mycobacterium
AGLSFVGLPWMHTWGSGRFLGIDRDA

SEQ ID NO: 631226 - protein, 18 aa, Mycobacterium
AGLSGAHPVGRLADAVQN

SEQ ID NO: 631227 - protein, 24 aa, Mycobacterium
AGLSGRAEWLPAWEDGLQRASAAI

SEQ ID NO: 631228 - protein, 29 aa, Mycobacterium
AGLSHPMGPLRLSDLIGLDTMKLIADSMY

SEQ ID NO: 631229 - protein, 17 aa, Mycobacterium
AGLSISDVDLFEINEAF

SEQ ID NO: 631230 - protein, 17 aa, Mycobacterium
AGLSLPDVDLFEINEAF

SEQ ID NO: 631231 - protein, 31 aa, Mycobacterium
AGLSPPAADRSWPWPEPRLTYANAVLAEAII

SEQ ID NO: 631232 - protein, 24 aa, Mycobacterium
AGLSRGQLLLAHGGASGIGSHAIQ

SEQ ID NO: 631233 - protein, 19 aa, Mycobacterium
AGLSRIVYVGGITPDGQKL

SEQ ID NO: 631234 - protein, 26 aa, Mycobacterium
AGLSRPTFYFYFPSKDAVLFTLFERV

SEQ ID NO: 631235 - protein, 19 aa, Mycobacterium
AGLSRSALYRGARAGRLDR

SEQ ID NO: 631236 - protein, 22 aa, Mycobacterium
AGLSVSWYLVRAGIEHIVIESK

SEQ ID NO: 631237 - protein, 17 aa, Mycobacterium
AGLSYGLGEYVRMLELI

SEQ ID NO: 631238 - protein, 19 aa, Mycobacterium
AGLTASRFVACPFGAFGSR

SEQ ID NO: 631239 - protein, 20 aa, Mycobacterium
AGLTEAFNNIGFGNVGDTNI

SEQ ID NO: 631240 - protein, 20 aa, Mycobacterium
AGLTGMPVMPMMAPSTNSAG

SEQ ID NO: 631241 - protein, 18 aa, Mycobacterium
AGLTGSRFVACPFGAAGL

SEQ ID NO: 631242 - protein, 19 aa, Mycobacterium
AGLTGSRFVACPFGEPGAR

SEQ ID NO: 631243 - protein, 20 aa, Mycobacterium
AGLTIPVIAAVAVFTDTASA

SEQ ID NO: 631244 - protein, 19 aa, Mycobacterium
AGLTRFVFTSSIGTIGLRA

SEQ ID NO: 631245 - protein, 20 aa, Mycobacterium
AGLTRLKQRFLITTLSNGNV

SEQ ID NO: 631246 - protein, 18 aa, Mycobacterium
AGLTRSGGVGAVAASTTI

SEQ ID NO: 631247 - protein, 25 aa, Mycobacterium
AGLTSGWRGPAAVPVMRVIAPHWAL

SEQ ID NO: 631248 - protein, 24 aa, Mycobacterium
AGLTYREVVELAEYGQLALAVRKA

SEQ ID NO: 631249 - protein, 17 aa, Mycobacterium
AGLVCSHTGNAQPRTRP

SEQ ID NO: 631250 - protein, 19 aa, Mycobacterium
AGLVDAMFTRFAQAVDRLA

SEQ ID NO: 631251 - protein, 19 aa, Mycobacterium
AGLVGGLAVPPSWAVATPA

SEQ ID NO: 631252 - protein, 24 aa, Mycobacterium
AGLVGGMAVPPSWATATPAIRTVA

SEQ ID NO: 631253 - protein, 19 aa, Mycobacterium
AGLVIPVLAAVAVFTDDVS

SEQ ID NO: 631254 - protein, 27 aa, Mycobacterium
AGLVKEIKINWVWVPPWGPDKITDDGR

SEQ ID NO: 631255 - protein, 18 aa, Mycobacterium
AGLVRAGGRFEVVSPHDP

SEQ ID NO: 631256 - protein, 20 aa, Mycobacterium
AGLVTELLDLLEFLSPVDLG

SEQ ID NO: 631257 - protein, 17 aa, Mycobacterium
AGLWEWAECLGDGVTLD

SEQ ID NO: 631258 - protein, 17 aa, Mycobacterium
AGLWEWAQRLGDDVTLD

SEQ ID NO: 631259 - protein, 23 aa, Mycobacterium
AGLYPANCRLLDPAEAFLNAGTT

SEQ ID NO: 631260 - protein, 17 aa, Mycobacterium
AGMAPPAPPRPGLGAGP

SEQ ID NO: 631261 - protein, 20 aa, Mycobacterium
AGMCKAVLVYRSLNGRSGYR

SEQ ID NO: 631262 - protein, 28 aa, Mycobacterium
AGMDARAFRLAWPAGTVVYELDQPEVIA

SEQ ID NO: 631263 - protein, 18 aa, Mycobacterium
AGMDEPIAVIGLGLRLPG

SEQ ID NO: 631264 - protein, 26 aa, Mycobacterium
AGMDLLPRLLFRAGELDTSVVRSILE

SEQ ID NO: 631265 - protein, 17 aa, Mycobacterium
AGMEGVVFVGVPRTMND

SEQ ID NO: 631266 - protein, 17 aa, Mycobacterium
AGMEVCCGGILGMGESL

SEQ ID NO: 631267 - protein, 17 aa, Mycobacterium
AGMEVCCGGILGMGETL

SEQ ID NO: 631268 - protein, 23 aa, Mycobacterium
AGMFPGDGVGVVLLKRLSDALAD

SEQ ID NO: 631269 - protein, 24 aa, Mycobacterium
AGMFRTGRAWGFEHCDIEPDMVVM

SEQ ID NO: 631270 - protein, 25 aa, Mycobacterium
AGMFTGVAVADAFLQAGLVERAMVV

SEQ ID NO: 631271 - protein, 23 aa, Mycobacterium
AGMGAGLYRHHPVFTTAIDEICA

SEQ ID NO: 631272 - protein, 19 aa, Mycobacterium
AGMGAIAFTALAQGLLTDR

SEQ ID NO: 631273 - protein, 22 aa, Mycobacterium
AGMGKRVLSWQGGERLMTDLAH

SEQ ID NO: 631274 - protein, 17 aa, Mycobacterium
AGMGPPFSCEAGNCGTC

SEQ ID NO: 631275 - protein, 25 aa, Mycobacterium
AGMGRAGSIGALSVPHSWGAAAPNI

SEQ ID NO: 631276 - protein, 20 aa, Mycobacterium
AGMHPGWTRPSSAGRVAIAF

SEQ ID NO: 631277 - protein, 20 aa, Mycobacterium
AGMHPWGKWGTDFTEYGVVA

SEQ ID NO: 631278 - protein, 19 aa, Mycobacterium
AGMHYCLGANLARRELTEA

SEQ ID NO: 631279 - protein, 27 aa, Mycobacterium
AGMIICPVGPDMSFLRPWQATTPLVFV

SEQ ID NO: 631280 - protein, 19 aa, Mycobacterium
AGMLKYGFDDARPVLERAS

SEQ ID NO: 631281 - protein, 23 aa, Mycobacterium
AGMPAKLAAVAAIFPSVTSPPAQ

SEQ ID NO: 631282 - protein, 18 aa, Mycobacterium
AGMPCAPGALGQLALTGG

SEQ ID NO: 631283 - protein, 20 aa, Mycobacterium
AGMQAEIRDGYWACFDTEDL

SEQ ID NO: 631284 - protein, 22 aa, Mycobacterium
AGMQRFAPLNSWPDNASLDKAR

SEQ ID NO: 631285 - protein, 24 aa, Mycobacterium
AGMQRFAPLNSWPDNVLLDRARRL

SEQ ID NO: 631286 - protein, 17 aa, Mycobacterium
AGMRAAVEAGPRARTAV

SEQ ID NO: 631287 - protein, 26 aa, Mycobacterium
AGMRAGVPMLLLWLWLDQPIWASAVS

SEQ ID NO: 631288 - protein, 17 aa, Mycobacterium
AGMRATEIWLRDQGYLD

SEQ ID NO: 631289 - protein, 17 aa, Mycobacterium
AGMRDAMNLSWKLDAVL

SEQ ID NO: 631290 - protein, 18 aa, Mycobacterium
AGMREGRLSLDQIGVIAA

SEQ ID NO: 631291 - protein, 20 aa, Mycobacterium
AGMRSHPGVTATFCEALANA

SEQ ID NO: 631292 - protein, 17 aa, Mycobacterium
AGMRVDAGLSRLLGLSR

SEQ ID NO: 631293 - protein, 17 aa, Mycobacterium
AGMSADFETAVKHGSTC

SEQ ID NO: 631294 - protein, 22 aa, Mycobacterium
AGMSGGIAFVLGLDPARVNTEM

SEQ ID NO: 631295 - protein, 17 aa, Mycobacterium
AGMSGGIAFVLGLDPRR

SEQ ID NO: 631296 - protein, 22 aa, Mycobacterium
AGMVMPILVMLREHGELWHTMD

SEQ ID NO: 631297 - protein, 23 aa, Mycobacterium
AGNASLVLSFLGEFFVEANRGAC

SEQ ID NO: 631298 - protein, 17 aa, Mycobacterium
AGNCALESFGFKTFGFA

SEQ ID NO: 631299 - protein, 23 aa, Mycobacterium
AGNCLPDVLVLRSLTKTWSLAGL

SEQ ID NO: 631300 - protein, 25 aa, Mycobacterium
AGNDLKLTAGMAFSIEPGIYVPGRW

SEQ ID NO: 631301 - protein, 18 aa, Mycobacterium
AGNERDRFGRLFGGQLLA

SEQ ID NO: 631302 - protein, 18 aa, Mycobacterium
AGNGCEFVRAAGTVEGLR

SEQ ID NO: 631303 - protein, 23 aa, Mycobacterium
AGNGDRVAIHWVGEPIEDSRTLT

SEQ ID NO: 631304 - protein, 23 aa, Mycobacterium
AGNGDRVAIHWVGEPVEHSRDIT

SEQ ID NO: 631305 - protein, 21 aa, Mycobacterium
AGNGGNALVMAAGTTGVATGN

SEQ ID NO: 631306 - protein, 17 aa, Mycobacterium
AGNGGVGGNAFGGGSSG

SEQ ID NO: 631307 - protein, 19 aa, Mycobacterium
AGNGLRPEIWDEFTKRFGI

SEQ ID NO: 631308 - protein, 34 aa, Mycobacterium
AGNGLRPEIWDEFTNRFEIPRVCEFYASSEGNTA

SEQ ID NO: 631309 - protein, 24 aa, Mycobacterium
AGNKFRHQTCLELFDALQKFRLDR

SEQ ID NO: 631310 - protein, 21 aa, Mycobacterium
AGNLARIGSAISEANSAAVAQ

SEQ ID NO: 631311 - protein, 22 aa, Mycobacterium
AGNLEKFQWFVRAHLENAGGKL

SEQ ID NO: 631312 - protein, 24 aa, Mycobacterium
AGNLHVRMGWAFAADIPVASIKSA

SEQ ID NO: 631313 - protein, 18 aa, Mycobacterium
AGNLRLVGLHSHIGSQIF

SEQ ID NO: 631314 - protein, 17 aa, Mycobacterium
AGNNGIRNFGFGNTGNN

SEQ ID NO: 631315 - protein, 25 aa, Mycobacterium
AGNPEIRPAHLLMALLTQNDGIAAP

SEQ ID NO: 631316 - protein, 25 aa, Mycobacterium
AGNPEIRPAHLLVALLGQTDGIAAP

SEQ ID NO: 631317 - protein, 18 aa, Mycobacterium
AGNQGGWVPVHVTINRVP

SEQ ID NO: 631318 - protein, 27 aa, Mycobacterium
AGNSSGSSAGFGFGGGGGGGGAGGHGG

SEQ ID NO: 631319 - protein, 20 aa, Mycobacterium
AGNTEFRILSTTGRDVSSVS

SEQ ID NO: 631320 - protein, 19 aa, Mycobacterium
AGNVWEWTVDWYTDTPSAR

SEQ ID NO: 631321 - protein, 28 aa, Mycobacterium
AGNWAHGWANDTLISWTFQGPNWTFGGA

SEQ ID NO: 631322 - protein, 22 aa, Mycobacterium
AGPACFTGDMLAVGRELPPVHA

SEQ ID NO: 631323 - protein, 22 aa, Mycobacterium
AGPACPAMWVTRTAPAVVEAPA

SEQ ID NO: 631324 - protein, 19 aa, Mycobacterium
AGPADGWAVVVDGAGAPVG

SEQ ID NO: 631325 - protein, 24 aa, Mycobacterium
AGPAECPGRNLVLFTTSTLAANLL

SEQ ID NO: 631326 - protein, 24 aa, Mycobacterium
AGPAEVTRLVLVDVVPRFEKGGSA

SEQ ID NO: 631327 - protein, 26 aa, Mycobacterium
AGPAFLLNHMLVWGFTGQVISAVLDV

SEQ ID NO: 631328 - protein, 23 aa, Mycobacterium
AGPAFNTGSPWGYTPKGGTGVPT

SEQ ID NO: 631329 - protein, 18 aa, Mycobacterium
AGPAMAFMSGNLCHQIEH

SEQ ID NO: 631330 - protein, 20 aa, Mycobacterium
AGPAMIDVVFSWFETGTLQR

SEQ ID NO: 631331 - protein, 20 aa, Mycobacterium
AGPASACGATGAACSTVTAA

SEQ ID NO: 631332 - protein, 20 aa, Mycobacterium
AGPASVCLRVRAKALECNIA

SEQ ID NO: 631333 - protein, 19 aa, Mycobacterium
AGPDARLAGAAGFQAFREL

SEQ ID NO: 631334 - protein, 21 aa, Mycobacterium
AGPDGCSLVDVAVLDTPALEP

SEQ ID NO: 631335 - protein, 25 aa, Mycobacterium
AGPDGVVGYGGWTWHYTLEPIGPAQ

SEQ ID NO: 631336 - protein, 20 aa, Mycobacterium
AGPDRGLIRASSWDIDMPNQ

SEQ ID NO: 631337 - protein, 17 aa, Mycobacterium
AGPDRIAQILAELAALF

SEQ ID NO: 631338 - protein, 25 aa, Mycobacterium
AGPDRSILRPASWDIDLPDQFTAAE

SEQ ID NO: 631339 - protein, 21 aa, Mycobacterium
AGPDRSLIRASSWDIDMPNQF

SEQ ID NO: 631340 - protein, 25 aa, Mycobacterium
AGPDVLRLFSALELLQACALIHDDV

SEQ ID NO: 631341 - protein, 21 aa, Mycobacterium
AGPECGAPVVLLPGRNAAAPM

SEQ ID NO: 631342 - protein, 19 aa, Mycobacterium
AGPEIGVAATKTFLAQIAA

SEQ ID NO: 631343 - protein, 18 aa, Mycobacterium
AGPEIGVASTKTFLAQVA

SEQ ID NO: 631344 - protein, 17 aa, Mycobacterium
AGPENFFLFGLTVEEVQ

SEQ ID NO: 631345 - protein, 25 aa, Mycobacterium
AGPERTGCIGCAACMTGCKHNAKNT

SEQ ID NO: 631346 - protein, 17 aa, Mycobacterium
AGPEVIVAVALPRSARL

SEQ ID NO: 631347 - protein, 17 aa, Mycobacterium
AGPEVVTRLVLVDVVPR

SEQ ID NO: 631348 - protein, 29 aa, Mycobacterium
AGPFDNWPLGWGFDHFWGFPSGAAGQYDP

SEQ ID NO: 631349 - protein, 26 aa, Mycobacterium
AGPFDNWPLGWGFDHYWGFLSGAAGQ

SEQ ID NO: 631350 - protein, 20 aa, Mycobacterium
AGPFDRWPTGMGFEEFYGFM

SEQ ID NO: 631351 - protein, 26 aa, Mycobacterium
AGPFENWPTGLGFEYFYGFLAGEASQ

SEQ ID NO: 631352 - protein, 20 aa, Mycobacterium
AGPFLTDVSRAWNMSGDPFS

SEQ ID NO: 631353 - protein, 23 aa, Mycobacterium
AGPGERVALLFSRSADAIVSILA

SEQ ID NO: 631354 - protein, 19 aa, Mycobacterium
AGPGERVALLIPRSAGAVA

SEQ ID NO: 631355 - protein, 24 aa, Mycobacterium
AGPGERVAVLFPRTAEAVVAILAV

SEQ ID NO: 631356 - protein, 24 aa, Mycobacterium
AGPGGYCGYLMYNLTTNGFRPATF

SEQ ID NO: 631357 - protein, 24 aa, Mycobacterium
AGPGHPTGGWWDGMVGPGAPIDTD

SEQ ID NO: 631358 - protein, 17 aa, Mycobacterium
AGPGHTVALLFNRSAEA

SEQ ID NO: 631359 - protein, 21 aa, Mycobacterium
AGPGMGLRVLGFNVLGAIDTG

SEQ ID NO: 631360 - protein, 19 aa, Mycobacterium
AGPGMGVGPAYSARSQTPD

SEQ ID NO: 631361 - protein, 25 aa, Mycobacterium
AGPGQRVAVVIPRSAEAVIAIFAVL

SEQ ID NO: 631362 - protein, 25 aa, Mycobacterium
AGPGRRAIVRQVSWAEQVEAVRSGD

SEQ ID NO: 631363 - protein, 22 aa, Mycobacterium
AGPGRRAVIVGGGYIGLETAAS

SEQ ID NO: 631364 - protein, 25 aa, Mycobacterium
AGPGTRVALLLPRTPEAVVAMLAVL

SEQ ID NO: 631365 - protein, 28 aa, Mycobacterium
AGPIERFLEWWAPFANFLYDTAGLPFFG

SEQ ID NO: 631366 - protein, 23 aa, Mycobacterium
AGPIGLFAIQWAKLHGADQVVAV

SEQ ID NO: 631367 - protein, 23 aa, Mycobacterium
AGPIGLGAVLAFKSAGAAHVAVV

SEQ ID NO: 631368 - protein, 20 aa, Mycobacterium
AGPKESRAWVIHQGDTAPKA

SEQ ID NO: 631369 - protein, 20 aa, Mycobacterium
AGPLAGVPFLLKDLGAALAG

SEQ ID NO: 631370 - protein, 19 aa, Mycobacterium
AGPLLDGGIAFTFAIYYLP

SEQ ID NO: 631371 - protein, 18 aa, Mycobacterium
AGPLLGRRCGACRLEIDR

SEQ ID NO: 631372 - protein, 17 aa, Mycobacterium
AGPLNRFYKGIAAGSNV

SEQ ID NO: 631373 - protein, 23 aa, Mycobacterium
AGPLPLQIICDMMGIPEDDHQRI

SEQ ID NO: 631374 - protein, 22 aa, Mycobacterium
AGPLPLQIICDMMGIPEEDHEQ

SEQ ID NO: 631375 - protein, 22 aa, Mycobacterium
AGPLPLQIICDMMGIPEEDHHR

SEQ ID NO: 631376 - protein, 24 aa, Mycobacterium
AGPLPLQIICDMMGIPESDHQQIF

SEQ ID NO: 631377 - protein, 24 aa, Mycobacterium
AGPLPLQIICDMMGIPPRDHQKIF

SEQ ID NO: 631378 - protein, 24 aa, Mycobacterium
AGPLRRTLAHWAIGVGRRKARASS

SEQ ID NO: 631379 - protein, 27 aa, Mycobacterium
AGPLWDHCQRYLKPRGLFLANTSHGDA

SEQ ID NO: 631380 - protein, 19 aa, Mycobacterium
AGPLWGIPVAVKDIYDVAG

SEQ ID NO: 631381 - protein, 17 aa, Mycobacterium
AGPMLAAAAAWDALAAE

SEQ ID NO: 631382 - protein, 17 aa, Mycobacterium
AGPMLAAAAAWEALAAQ

SEQ ID NO: 631383 - protein, 17 aa, Mycobacterium
AGPPCFLDPELRELNDD

SEQ ID NO: 631384 - protein, 29 aa, Mycobacterium
AGPPPPMLWRVVELFVGDLWPNGDVAGLH

SEQ ID NO: 631385 - protein, 31 aa, Mycobacterium
AGPPRFADELAWWVYICWREGLCRIDPGDLK

SEQ ID NO: 631386 - protein, 26 aa, Mycobacterium
AGPQPMLAAATAWDGLAGELAGAASS

SEQ ID NO: 631387 - protein, 22 aa, Mycobacterium
AGPQSWPGIHSSLRNHLQTGQP

SEQ ID NO: 631388 - protein, 25 aa, Mycobacterium
AGPREPKFMWLTGLTTDGTIVVANN

SEQ ID NO: 631389 - protein, 23 aa, Mycobacterium
AGPRGRNLLALREMGDVTYLAVD

SEQ ID NO: 631390 - protein, 27 aa, Mycobacterium
AGPRIAELQAYWELPAMVFQFVRNGTR

SEQ ID NO: 631391 - protein, 24 aa, Mycobacterium
AGPRIIVLAARSWQVTHIDWKRRR

SEQ ID NO: 631392 - protein, 19 aa, Mycobacterium
AGPRILAYLQRQGGGVVDE

SEQ ID NO: 631393 - protein, 22 aa, Mycobacterium
AGPRLRASIRASQNLIPRAFWL

SEQ ID NO: 631394 - protein, 31 aa, Mycobacterium
AGPRPAVLPLSFAQSRLWFIDQLHGPSPVYN

SEQ ID NO: 631395 - protein, 31 aa, Mycobacterium
AGPRPPRVPLSFAQSRLWFLEQLQGPSAVYN

SEQ ID NO: 631396 - protein, 18 aa, Mycobacterium
AGPRVQALVLGPGDMAAS

SEQ ID NO: 631397 - protein, 30 aa, Mycobacterium
AGPSASFGTLWIKSPANMLGYWSNPQRTQE

SEQ ID NO: 631398 - protein, 26 aa, Mycobacterium
AGPSMFRRWCRLVGRPELFDDPRFAD

SEQ ID NO: 631399 - protein, 19 aa, Mycobacterium
AGPTAIAFVTGEPVDAAKA

SEQ ID NO: 631400 - protein, 22 aa, Mycobacterium
AGPTEVLAALSIESGGQAPAPR

SEQ ID NO: 631401 - protein, 17 aa, Mycobacterium
AGPTGWRTRVRLEVGAD

SEQ ID NO: 631402 - protein, 18 aa, Mycobacterium
AGPTRLRVPDLLHATDRA

SEQ ID NO: 631403 - protein, 25 aa, Mycobacterium
AGPTSMGGMGMMPPGAMGGHGEGGN

SEQ ID NO: 631404 - protein, 33 aa, Mycobacterium
AGPVEGWMPFGRVFETLAWGRRHVVMGANQVDR

SEQ ID NO: 631405 - protein, 24 aa, Mycobacterium
AGPVLRASATLVRRTREFAEVSAD

SEQ ID NO: 631406 - protein, 23 aa, Mycobacterium
AGPVRRDHVLGIGGASVSLAHAV

SEQ ID NO: 631407 - protein, 20 aa, Mycobacterium
AGPVVRMRRTLLRVSDHPET

SEQ ID NO: 631408 - protein, 18 aa, Mycobacterium
AGPYARWNDEYSDEHGTI

SEQ ID NO: 631409 - protein, 25 aa, Mycobacterium
AGQAARLGRWVLTRSFTDYASLGRD

SEQ ID NO: 631410 - protein, 23 aa, Mycobacterium
AGQACAATSRMLIHRSLYDQAVA

SEQ ID NO: 631411 - protein, 17 aa, Mycobacterium
AGQADLLITPELFVTGY

SEQ ID NO: 631412 - protein, 21 aa, Mycobacterium
AGQAGGWLFGDGGPGAAATAT

SEQ ID NO: 631413 - protein, 18 aa, Mycobacterium
AGQARFAVHAAMALVIDL

SEQ ID NO: 631414 - protein, 17 aa, Mycobacterium
AGQARLAVEVFEAAFAM

SEQ ID NO: 631415 - protein, 22 aa, Mycobacterium
AGQCGSCFNGTAAMAAAAGALR

SEQ ID NO: 631416 - protein, 23 aa, Mycobacterium
AGQCGSCFNGTAAMAAAAGALRD

SEQ ID NO: 631417 - protein, 24 aa, Mycobacterium
AGQCGSCFNGTAAMAAVASALRDS

SEQ ID NO: 631418 - protein, 24 aa, Mycobacterium
AGQCGSCFNGTAAMAAVATALRDG

SEQ ID NO: 631419 - protein, 23 aa, Mycobacterium
AGQCGSCFNGTAAMAAVGGALRD

SEQ ID NO: 631420 - protein, 18 aa, Mycobacterium
AGQCPQTKMVLGGYSQGA

SEQ ID NO: 631421 - protein, 25 aa, Mycobacterium
AGQDPRYILWAAWHRSGLQNRWLAA

SEQ ID NO: 631422 - protein, 26 aa, Mycobacterium
AGQDPRYTLWAAWHRSGLQRRWLSAA

SEQ ID NO: 631423 - protein, 29 aa, Mycobacterium
AGQELYTWCALDTLIFPTILDRPASIESE

SEQ ID NO: 631424 - protein, 18 aa, Mycobacterium
AGQEWRIGDRIPNETVLV

SEQ ID NO: 631425 - protein, 22 aa, Mycobacterium
AGQFRRSFARYEPMPESAAARL

SEQ ID NO: 631426 - protein, 20 aa, Mycobacterium
AGQFTALAWSLMKLTTLHRT

SEQ ID NO: 631427 - protein, 24 aa, Mycobacterium
AGQGCAITTRLVVPRAKYDEAVSV

SEQ ID NO: 631428 - protein, 27 aa, Mycobacterium
AGQGCAITTRLVVPRARYDEAVAIAAA

SEQ ID NO: 631429 - protein, 27 aa, Mycobacterium
AGQGCAITTRLVVPRARYDEAVEIAAG

SEQ ID NO: 631430 - protein, 23 aa, Mycobacterium
AGQGCAITTRLVVPRERYDDAVA

SEQ ID NO: 631431 - protein, 26 aa, Mycobacterium
AGQGCALTSRLLVPRAHHDEIVELIA

SEQ ID NO: 631432 - protein, 24 aa, Mycobacterium
AGQGCALTSRLLVPRQHHDEIVEL

SEQ ID NO: 631433 - protein, 26 aa, Mycobacterium
AGQGCALTSRLLVPRSHHDEIVDLIA

SEQ ID NO: 631434 - protein, 17 aa, Mycobacterium
AGQGCATVHGALPPARR

SEQ ID NO: 631435 - protein, 19 aa, Mycobacterium
AGQIDRLHVGTARPFSSTT

SEQ ID NO: 631436 - protein, 24 aa, Mycobacterium
AGQIELPAGVGLISDPEMLVVNVV

SEQ ID NO: 631437 - protein, 24 aa, Mycobacterium
AGQIELPSGVTLIADPETLVVNVV

SEQ ID NO: 631438 - protein, 24 aa, Mycobacterium
AGQISFRQARGFTLDEYVGLPADH

SEQ ID NO: 631439 - protein, 25 aa, Mycobacterium
AGQKPRTGVGLGMPRIGAPAPSATA

SEQ ID NO: 631440 - protein, 26 aa, Mycobacterium
AGQLEKFQWFVRAHLESAGGQLAHAG

SEQ ID NO: 631441 - protein, 19 aa, Mycobacterium
AGQLLYALVRATRPGTVVE

SEQ ID NO: 631442 - protein, 17 aa, Mycobacterium
AGQLQGHRCGACRIEIG

SEQ ID NO: 631443 - protein, 23 aa, Mycobacterium
AGQLRMLPVTAFSLDHAVDAFEL

SEQ ID NO: 631444 - protein, 25 aa, Mycobacterium
AGQLRVPIAASFPLAQIRRAVELQA

SEQ ID NO: 631445 - protein, 25 aa, Mycobacterium
AGQLTRAGLLPGDRVALRSGSNAEF

SEQ ID NO: 631446 - protein, 17 aa, Mycobacterium
AGQLVQWSDDYRISASL

SEQ ID NO: 631447 - protein, 24 aa, Mycobacterium
AGQLWRARHGVYAFTDESADKYPY

SEQ ID NO: 631448 - protein, 22 aa, Mycobacterium
AGQLYPRMPVPVSWFEARIAYR

SEQ ID NO: 631449 - protein, 17 aa, Mycobacterium
AGQPALAVRAMLGAFHD

SEQ ID NO: 631450 - protein, 23 aa, Mycobacterium
AGQPGRCGFCGGQLSSHAKGRPQ

SEQ ID NO: 631451 - protein, 24 aa, Mycobacterium
AGQPIPLLWMHKADDPRNYVGDVI

SEQ ID NO: 631452 - protein, 20 aa, Mycobacterium
AGQPPAGGVILSMPAPMNCG

SEQ ID NO: 631453 - protein, 17 aa, Mycobacterium
AGQQLADLFGGLIGSAA

SEQ ID NO: 631454 - protein, 19 aa, Mycobacterium
AGQRAHAVGDVFVMTLTTG

SEQ ID NO: 631455 - protein, 17 aa, Mycobacterium
AGQRFVVDITMWIDLAD

SEQ ID NO: 631456 - protein, 23 aa, Mycobacterium
AGQSPLCRELDLLTDSGVVTVVS

SEQ ID NO: 631457 - protein, 24 aa, Mycobacterium
AGQTLDWLAARGMTTLLQHTVVVL

SEQ ID NO: 631458 - protein, 25 aa, Mycobacterium
AGQTLDWLSANGMTRLLQRTVVVLN

SEQ ID NO: 631459 - protein, 24 aa, Mycobacterium
AGQVDRLKVGVARPFSQTTRESLV

SEQ ID NO: 631460 - protein, 19 aa, Mycobacterium
AGQVIAWNGVDYAPADFNP

SEQ ID NO: 631461 - protein, 19 aa, Mycobacterium
AGQVLPMPPGVSLIDAAAL

SEQ ID NO: 631462 - protein, 18 aa, Mycobacterium
AGQVVLRPADLRPVQNRP

SEQ ID NO: 631463 - protein, 19 aa, Mycobacterium
AGQWSRSRWMELINSVTDH

SEQ ID NO: 631464 - protein, 24 aa, Mycobacterium
AGQYKDVVLGLVFLEHAGEAEWKS

SEQ ID NO: 631465 - protein, 23 aa, Mycobacterium
AGRAADIDTVYGLIGDALRERTT

SEQ ID NO: 631466 - protein, 23 aa, Mycobacterium
AGRAATLRAVRSLTGVPIDYFAE

SEQ ID NO: 631467 - protein, 18 aa, Mycobacterium
AGRAERRASAAAEPAAPA

SEQ ID NO: 631468 - protein, 18 aa, Mycobacterium
AGRAFCAGADFSGGTSPF

SEQ ID NO: 631469 - protein, 24 aa, Mycobacterium
AGRAFGTNGVHGFDLMFAAPKSVS

SEQ ID NO: 631470 - protein, 17 aa, Mycobacterium
AGRAFVCAVDMPLVAPA

SEQ ID NO: 631471 - protein, 24 aa, Mycobacterium
AGRAGRFGFVVGVDRVGQAGQLRR

SEQ ID NO: 631472 - protein, 18 aa, Mycobacterium
AGRAGRPAPRIVAGVPVA

SEQ ID NO: 631473 - protein, 25 aa, Mycobacterium
AGRALDLAKSWARERETFGRPLTGR

SEQ ID NO: 631474 - protein, 21 aa, Mycobacterium
AGRAQPGYLPVLRAYDYAGDE

SEQ ID NO: 631475 - protein, 28 aa, Mycobacterium
AGRATCPPAALTCWADFLARLREERDFS

SEQ ID NO: 631476 - protein, 19 aa, Mycobacterium
AGRAVDLLEEFARSGRCVP

SEQ ID NO: 631477 - protein, 34 aa, Mycobacterium
AGRAWDLAERYGMSRFCRGVHGCDIAVLDLEQNP

SEQ ID NO: 631478 - protein, 24 aa, Mycobacterium
AGRDFTDPVGLNWSQDGTDVDFGE

SEQ ID NO: 631479 - protein, 23 aa, Mycobacterium
AGRDHRASFVQIHFALDALPEFA

SEQ ID NO: 631480 - protein, 20 aa, Mycobacterium
AGRDKVCERLAQGVRVLVNN

SEQ ID NO: 631481 - protein, 22 aa, Mycobacterium
AGRDMPVIWVATIDEYKRKGSA

SEQ ID NO: 631482 - protein, 25 aa, Mycobacterium
AGRDWKAFEPMIGHGGSLLARRVGG

SEQ ID NO: 631483 - protein, 25 aa, Mycobacterium
AGRFPAELYAALGMDDLIDKLPDEI

SEQ ID NO: 631484 - protein, 21 aa, Mycobacterium
AGRFPDIRFTASEIDKTEDGY

SEQ ID NO: 631485 - protein, 23 aa, Mycobacterium
AGRFPEIRFSTRAIEKAGDGYRL

SEQ ID NO: 631486 - protein, 20 aa, Mycobacterium
AGRFRGAIRRRLGSRRMQRM

SEQ ID NO: 631487 - protein, 25 aa, Mycobacterium
AGRFRWPEAAVMEWTPDEFWPAHST

SEQ ID NO: 631488 - protein, 23 aa, Mycobacterium
AGRGARFLLGMVVSTGVGGGLVL

SEQ ID NO: 631489 - protein, 22 aa, Mycobacterium
AGRGLGRAMAKGLVDAGAAVTV

SEQ ID NO: 631490 - protein, 22 aa, Mycobacterium
AGRGLRCLAPTWPLGAHPEPLR

SEQ ID NO: 631491 - protein, 18 aa, Mycobacterium
AGRGMRRILTEGGPTLFG

SEQ ID NO: 631492 - protein, 21 aa, Mycobacterium
AGRGRPAKRYRLTAAGRGKLD

SEQ ID NO: 631493 - protein, 18 aa, Mycobacterium
AGRGRPAKRYRLTPGGRA

SEQ ID NO: 631494 - protein, 17 aa, Mycobacterium
AGRGVGLGYVRRAGLTG

SEQ ID NO: 631495 - protein, 17 aa, Mycobacterium
AGRHAATAAAAYETART

SEQ ID NO: 631496 - protein, 22 aa, Mycobacterium
AGRHADGWWPAGAWTPEHYAEM

SEQ ID NO: 631497 - protein, 27 aa, Mycobacterium
AGRHADGWWPAGAWTPGHYAEMLTAVR

SEQ ID NO: 631498 - protein, 17 aa, Mycobacterium
AGRHLARPKRYIPGFAI

SEQ ID NO: 631499 - protein, 27 aa, Mycobacterium
AGRHLLESWIRLVALTAHRPGTDWTAV

SEQ ID NO: 631500 - protein, 20 aa, Mycobacterium
AGRHPLDRIEHAAVVPDGSV

SEQ ID NO: 631501 - protein, 24 aa, Mycobacterium
AGRHPRTGFARAFSDAMKYESLQR

SEQ ID NO: 631502 - protein, 23 aa, Mycobacterium
AGRHRCVGAAFATMQIKAIFSVL

SEQ ID NO: 631503 - protein, 18 aa, Mycobacterium
AGRIELRTALATYLSRAR

SEQ ID NO: 631504 - protein, 20 aa, Mycobacterium
AGRIKDLVIIDGRNHYPQDL

SEQ ID NO: 631505 - protein, 21 aa, Mycobacterium
AGRIKDLVIIDGRNHYPQDLE

SEQ ID NO: 631506 - protein, 22 aa, Mycobacterium
AGRIPSLLVERINGVAVLDPDV

SEQ ID NO: 631507 - protein, 25 aa, Mycobacterium
AGRIVSFDAAGGWNIEEEGYQSVGS

SEQ ID NO: 631508 - protein, 25 aa, Mycobacterium
AGRIVSFDAAGGWNLEEEEGYQSVG

SEQ ID NO: 631509 - protein, 25 aa, Mycobacterium
AGRIVSFDAAGGWNLEEEGYQSVGS

SEQ ID NO: 631510 - protein, 24 aa, Mycobacterium
AGRKFHWEALVGGQPVVRVTVNWL

SEQ ID NO: 631511 - protein, 25 aa, Mycobacterium
AGRKRSHWMWFVFPQLRGLGGSPTA

SEQ ID NO: 631512 - protein, 19 aa, Mycobacterium
AGRKSRWLRNAGVASAAAN

SEQ ID NO: 631513 - protein, 18 aa, Mycobacterium
AGRLAADVERLMRGAEPV

SEQ ID NO: 631514 - protein, 21 aa, Mycobacterium
AGRLFFDAPMSFLHVPADTLN

SEQ ID NO: 631515 - protein, 21 aa, Mycobacterium
AGRLGHVFGLTGPIMHVDTAC

SEQ ID NO: 631516 - protein, 21 aa, Mycobacterium
AGRLHILEVQRLIRFMPKPVI

SEQ ID NO: 631517 - protein, 32 aa, Mycobacterium
AGRLHILEVQRLIRFMPKVVIALVNGWAAGGG

SEQ ID NO: 631518 - protein, 30 aa, Mycobacterium
AGRLIERSPLPFGRHRWVAAPGPAAPLDFA

SEQ ID NO: 631519 - protein, 20 aa, Mycobacterium
AGRLLYALVRATRPATVVEF

SEQ ID NO: 631520 - protein, 20 aa, Mycobacterium
AGRLMYALVRAIRPTTVVEF

SEQ ID NO: 631521 - protein, 21 aa, Mycobacterium
AGRLPEDWFEGAPAVVVDREE

SEQ ID NO: 631522 - protein, 20 aa, Mycobacterium
AGRLQRWRTATALPAGPDAA

SEQ ID NO: 631523 - protein, 24 aa, Mycobacterium
AGRLRAAGWRRGDAVVLAAAGSSD

SEQ ID NO: 631524 - protein, 21 aa, Mycobacterium
AGRLRFACIPTPATLADFDVD

SEQ ID NO: 631525 - protein, 20 aa, Mycobacterium
AGRLRFACLPTPATLADFDV

SEQ ID NO: 631526 - protein, 22 aa, Mycobacterium
AGRLRFACLPTPATLADFDVDA

SEQ ID NO: 631527 - protein, 20 aa, Mycobacterium
AGRMGAPMVERLVQAGHEVR

SEQ ID NO: 631528 - protein, 28 aa, Mycobacterium
AGRMGTGIGLCLLRQGAKLRVIANKDRS

SEQ ID NO: 631529 - protein, 25 aa, Mycobacterium
AGRNPDDIKVCVGAPAYIGDDLEHQ

SEQ ID NO: 631530 - protein, 23 aa, Mycobacterium
AGRPAIVVPAFLSRGYHVRADLP

SEQ ID NO: 631531 - protein, 18 aa, Mycobacterium
AGRPEHIATIFVGGLKHL

SEQ ID NO: 631532 - protein, 24 aa, Mycobacterium
AGRPMAEFESAVGMFANTVLLPVD

SEQ ID NO: 631533 - protein, 19 aa, Mycobacterium
AGRPPCPLCEEPLDPAGHI

SEQ ID NO: 631534 - protein, 19 aa, Mycobacterium
AGRPPRLLAALGPKMIELS

SEQ ID NO: 631535 - protein, 24 aa, Mycobacterium
AGRPVPVRIYRAAPTPAPVVVYCH

SEQ ID NO: 631536 - protein, 24 aa, Mycobacterium
AGRQGAQHIAYWTTDYQDLYDRVL

SEQ ID NO: 631537 - protein, 18 aa, Mycobacterium
AGRQRALDVFSWESVAAQ

SEQ ID NO: 631538 - protein, 20 aa, Mycobacterium
AGRQVRRPDLTIATEDHNVP

SEQ ID NO: 631539 - protein, 19 aa, Mycobacterium
AGRRCYRQFITGLLEITDN

SEQ ID NO: 631540 - protein, 21 aa, Mycobacterium
AGRRKLLGRRQVLPGVGLYLD

SEQ ID NO: 631541 - protein, 23 aa, Mycobacterium
AGRRLELLAALATGRTRVPASIL

SEQ ID NO: 631542 - protein, 21 aa, Mycobacterium
AGRRLLSWALAAGFDDITPTG

SEQ ID NO: 631543 - protein, 17 aa, Mycobacterium
AGRRMRFMLKAEMQEVP

SEQ ID NO: 631544 - protein, 17 aa, Mycobacterium
AGRRPTWSPLPVQYIDY

SEQ ID NO: 631545 - protein, 19 aa, Mycobacterium
AGRRRAVMRLLRASPEPMS

SEQ ID NO: 631546 - protein, 31 aa, Mycobacterium
AGRRTQIRAVWRAVAAVDEIFARSGGNAARM

SEQ ID NO: 631547 - protein, 31 aa, Mycobacterium
AGRRTQIRAVWRAVSAVDEIFARCGGNAARM

SEQ ID NO: 631548 - protein, 35 aa, Mycobacterium
AGRRTQVRAAWRAVMAVDQIFSRSGGNAMRLDKPL

SEQ ID NO: 631549 - protein, 17 aa, Mycobacterium
AGRRTQVRAVWRAVSAV

SEQ ID NO: 631550 - protein, 19 aa, Mycobacterium
AGRRVALALAPAGTGKTTA

SEQ ID NO: 631551 - protein, 28 aa, Mycobacterium
AGRRVQLEIFTKFSIPINIARVMHRDQK

SEQ ID NO: 631552 - protein, 20 aa, Mycobacterium
AGRRVRRPDLTIATEDHNVP

SEQ ID NO: 631553 - protein, 17 aa, Mycobacterium
AGRSLPEYRALRAQHDM

SEQ ID NO: 631554 - protein, 17 aa, Mycobacterium
AGRSLPEYRALRAQSDM

SEQ ID NO: 631555 - protein, 17 aa, Mycobacterium
AGRSLPEYRALRQQHSM

SEQ ID NO: 631556 - protein, 23 aa, Mycobacterium
AGRSLPEYRALRRQHSMLAACFE

SEQ ID NO: 631557 - protein, 24 aa, Mycobacterium
AGRSRALSRYAWDRIALDCLNIYR

SEQ ID NO: 631558 - protein, 25 aa, Mycobacterium
AGRSRGAAAIGAWARIENAAVAQRL

SEQ ID NO: 631559 - protein, 21 aa, Mycobacterium
AGRSTLLATLFGDRTATLDLT

SEQ ID NO: 631560 - protein, 26 aa, Mycobacterium
AGRSTRLATVLGRCSYLRDGIAVRND

SEQ ID NO: 631561 - protein, 17 aa, Mycobacterium
AGRTWLRVLADQVDADE

SEQ ID NO: 631562 - protein, 17 aa, Mycobacterium
AGRTWLRVLADRVDVAE

SEQ ID NO: 631563 - protein, 18 aa, Mycobacterium
AGRTWLRVLANHVDVDEV

SEQ ID NO: 631564 - protein, 24 aa, Mycobacterium
AGRVGAEGSGGLAAGDNGGAGQAG

SEQ ID NO: 631565 - protein, 26 aa, Mycobacterium
AGRVKRPQMGIATWIIPSIVAFGTEE

SEQ ID NO: 631566 - protein, 17 aa, Mycobacterium
AGRVVCLIDPVGDVYAC

SEQ ID NO: 631567 - protein, 23 aa, Mycobacterium
AGRVVSVDGIFYLTHREDVLAAL

SEQ ID NO: 631568 - protein, 19 aa, Mycobacterium
AGRVVWHAAAIVAVGAACT

SEQ ID NO: 631569 - protein, 28 aa, Mycobacterium
AGRWAREGRFPYARDVSGLQVGILGLGR

SEQ ID NO: 631570 - protein, 26 aa, Mycobacterium
AGRYLRRWHRRRALWVGVAIGGTVDD

SEQ ID NO: 631571 - protein, 27 aa, Mycobacterium
AGRYRKVILSRCVDVPFELDFPSTYRV

SEQ ID NO: 631572 - protein, 26 aa, Mycobacterium
AGSAEKLEFCRELGAEITINYRDEDF

SEQ ID NO: 631573 - protein, 18 aa, Mycobacterium
AGSAHRWPPHDMRGRIIR

SEQ ID NO: 631574 - protein, 18 aa, Mycobacterium
AGSALAAIRARQAELARQ

SEQ ID NO: 631575 - protein, 19 aa, Mycobacterium
AGSALMIMTLGAGKGAEVT

SEQ ID NO: 631576 - protein, 26 aa, Mycobacterium
AGSAPMLEAAVAWDSLAAELGSAAES

SEQ ID NO: 631577 - protein, 26 aa, Mycobacterium
AGSAPMLSAAAAWDGLAGELESAAES

SEQ ID NO: 631578 - protein, 30 aa, Mycobacterium
AGSAQRYLARWHRRRPLWVGVATGGVVDGP

SEQ ID NO: 631579 - protein, 19 aa, Mycobacterium
AGSDFAGLRTRAELDGALF

SEQ ID NO: 631580 - protein, 18 aa, Mycobacterium
AGSDFAGLRTRAERDGDV

SEQ ID NO: 631581 - protein, 21 aa, Mycobacterium
AGSDRARWTPFQKLVILDVAD

SEQ ID NO: 631582 - protein, 18 aa, Mycobacterium
AGSELKIARTDTWDGFPC

SEQ ID NO: 631583 - protein, 25 aa, Mycobacterium
AGSEPMLTAAAAWDGLADELSMAAL

SEQ ID NO: 631584 - protein, 17 aa, Mycobacterium
AGSEQWCDADVLRVLRR

SEQ ID NO: 631585 - protein, 18 aa, Mycobacterium
AGSFFSDRRMVALRDAEP

SEQ ID NO: 631586 - protein, 28 aa, Mycobacterium
AGSFPRRCPSRRPNLMGCNDLGDLLGNF

SEQ ID NO: 631587 - protein, 18 aa, Mycobacterium
AGSFREGRLMLAGDAAHL

SEQ ID NO: 631588 - protein, 26 aa, Mycobacterium
AGSFVVRLKGGDPFVFARGYEEVLAC

SEQ ID NO: 631589 - protein, 17 aa, Mycobacterium
AGSGAKVLLAYADAATQ

SEQ ID NO: 631590 - protein, 28 aa, Mycobacterium
AGSGAPAGWSWVAPYIGMIWPTGDSAKL

SEQ ID NO: 631591 - protein, 21 aa, Mycobacterium
AGSGGMFGQMGDAGDGGDAGT

SEQ ID NO: 631592 - protein, 24 aa, Mycobacterium
AGSGIQLLGKEGAYASLRMPSGEI

SEQ ID NO: 631593 - protein, 17 aa, Mycobacterium
AGSGIVIEVRGTAHAAG

SEQ ID NO: 631594 - protein, 26 aa, Mycobacterium
AGSGLHWTCAKWLHRHEVAAVASDNL

SEQ ID NO: 631595 - protein, 18 aa, Mycobacterium
AGSGLRVIAVARRQLSAA

SEQ ID NO: 631596 - protein, 26 aa, Mycobacterium
AGSGPMLSAAMAWDGLAVELGSAAES

SEQ ID NO: 631597 - protein, 17 aa, Mycobacterium
AGSGQAVLASWRMLLDA

SEQ ID NO: 631598 - protein, 22 aa, Mycobacterium
AGSHGIRVIVDFVMNHTSDAHP

SEQ ID NO: 631599 - protein, 23 aa, Mycobacterium
AGSHWSYGELLGYFRQIEDVTAA

SEQ ID NO: 631600 - protein, 18 aa, Mycobacterium
AGSIGQLSVPASWAAPAT

SEQ ID NO: 631601 - protein, 18 aa, Mycobacterium
AGSIGQLSVPPSWAAPSS

SEQ ID NO: 631602 - protein, 18 aa, Mycobacterium
AGSIGSLSTPSSWDASVR

SEQ ID NO: 631603 - protein, 19 aa, Mycobacterium
AGSIMGIVADIERYPEWNE

SEQ ID NO: 631604 - protein, 23 aa, Mycobacterium
AGSIRIPAAWTHLVGIKPQRGRI

SEQ ID NO: 631605 - protein, 21 aa, Mycobacterium
AGSKMLWTNAIARIRSTDRSG

SEQ ID NO: 631606 - protein, 21 aa, Mycobacterium
AGSKWLFPLLEQLADVYKKTP

SEQ ID NO: 631607 - protein, 19 aa, Mycobacterium
AGSLGERLAGARLRAMDDT

SEQ ID NO: 631608 - protein, 20 aa, Mycobacterium
AGSLPAEWWGADAPGSPPSH

SEQ ID NO: 631609 - protein, 27 aa, Mycobacterium
AGSLPEWLRRWDVRGGQACEEAIELFH

SEQ ID NO: 631610 - protein, 18 aa, Mycobacterium
AGSLPMDALGGLGGLSGL

SEQ ID NO: 631611 - protein, 21 aa, Mycobacterium
AGSLPVEWWGADAPGSPPSHS

SEQ ID NO: 631612 - protein, 21 aa, Mycobacterium
AGSLRARMFAANLGVPEDEAT

SEQ ID NO: 631613 - protein, 23 aa, Mycobacterium
AGSLSINGGGYGGLGGNGGTGGA

SEQ ID NO: 631614 - protein, 19 aa, Mycobacterium
AGSLTRQLLYVALTRGRIE

SEQ ID NO: 631615 - protein, 22 aa, Mycobacterium
AGSPPPRRAVLAAEVGDVTFRP

SEQ ID NO: 631616 - protein, 24 aa, Mycobacterium
AGSPWRVGDDVTHPQLGHGWVQGA

SEQ ID NO: 631617 - protein, 21 aa, Mycobacterium
AGSRATHIVVWASLDKSKGRA

SEQ ID NO: 631618 - protein, 20 aa, Mycobacterium
AGSRATHIVVWATLDKSLGR

SEQ ID NO: 631619 - protein, 20 aa, Mycobacterium
AGSRATHIVVWATLDKTKGR

SEQ ID NO: 631620 - protein, 18 aa, Mycobacterium
AGSRLVFVSQAAGRPELY

SEQ ID NO: 631621 - protein, 22 aa, Mycobacterium
AGSRPTAPFLIRPAENADDLAS

SEQ ID NO: 631622 - protein, 19 aa, Mycobacterium
AGSSIQLLGKEGTYASLRM

SEQ ID NO: 631623 - protein, 18 aa, Mycobacterium
AGSVAVNMFAHMRLTMGC

SEQ ID NO: 631624 - protein, 20 aa, Mycobacterium
AGSVESFKALYGVKPNVDLA

SEQ ID NO: 631625 - protein, 24 aa, Mycobacterium
AGSVWRTDQSWHLLMNTVASQITV

SEQ ID NO: 631626 - protein, 18 aa, Mycobacterium
AGSWAKDRIQAVRRAAGV

SEQ ID NO: 631627 - protein, 18 aa, Mycobacterium
AGSYGRLIVTPDMEPPDA

SEQ ID NO: 631628 - protein, 23 aa, Mycobacterium
AGTAEPRGSSILNVTSAQFRELL

SEQ ID NO: 631629 - protein, 26 aa, Mycobacterium
AGTAGRASAAAAVFEAAQAAIVHPAM

SEQ ID NO: 631630 - protein, 19 aa, Mycobacterium
AGTAPDVFAVHRIDEQLAK

SEQ ID NO: 631631 - protein, 22 aa, Mycobacterium
AGTAWQIFPNFQIGQGLTSALC

SEQ ID NO: 631632 - protein, 22 aa, Mycobacterium
AGTAWQIFPNFQIGQGLTTALC

SEQ ID NO: 631633 - protein, 20 aa, Mycobacterium
AGTCEPGDGLGIAGDEVLIV

SEQ ID NO: 631634 - protein, 20 aa, Mycobacterium
AGTDDVRYSPALAVVEGLVA

SEQ ID NO: 631635 - protein, 43 aa, Mycobacterium
AGTDEVSEAIASLFSGHALDYQNLGARMTAFHDQFVAALTAGG

SEQ ID NO: 631636 - protein, 24 aa, Mycobacterium
AGTENLPMIGLNFMPMSHIMGRGT

SEQ ID NO: 631637 - protein, 25 aa, Mycobacterium
AGTEPIAVVGMGCRFPGGVDNPEQF

SEQ ID NO: 631638 - protein, 26 aa, Mycobacterium
AGTERRTNWLNNFYFGGEHGVADSVA

SEQ ID NO: 631639 - protein, 17 aa, Mycobacterium
AGTEVLPLYARLPTAEQ

SEQ ID NO: 631640 - protein, 23 aa, Mycobacterium
AGTGAEMWLKLNPQAYRDLAQRH

SEQ ID NO: 631641 - protein, 17 aa, Mycobacterium
AGTGARIVAPVDAAGAA

SEQ ID NO: 631642 - protein, 19 aa, Mycobacterium
AGTGARIVREGTREGHEYQ

SEQ ID NO: 631643 - protein, 27 aa, Mycobacterium
AGTGDLVSPTAGYQGGQGGMGGKGGDG

SEQ ID NO: 631644 - protein, 24 aa, Mycobacterium
AGTGGAGGAAWLVGAGGAGGVGGF

SEQ ID NO: 631645 - protein, 19 aa, Mycobacterium
AGTGGGLFRTLQAQGCQSI

SEQ ID NO: 631646 - protein, 19 aa, Mycobacterium
AGTGLAAISWGLAHERMSI

SEQ ID NO: 631647 - protein, 20 aa, Mycobacterium
AGTGLAAISWGLAHERMSIA

SEQ ID NO: 631648 - protein, 19 aa, Mycobacterium
AGTGLPRQPGGAITAGAAL

SEQ ID NO: 631649 - protein, 20 aa, Mycobacterium
AGTGNAIRVLSRDGVFPLAA

SEQ ID NO: 631650 - protein, 26 aa, Mycobacterium
AGTGPMLAAAAAWDRLASELDTAARS

SEQ ID NO: 631651 - protein, 19 aa, Mycobacterium
AGTGVPTWRRSGPDTITID

SEQ ID NO: 631652 - protein, 20 aa, Mycobacterium
AGTGVRFTPTLAFVRDTVPD

SEQ ID NO: 631653 - protein, 19 aa, Mycobacterium
AGTGVRFTPTLTFTRDTTL

SEQ ID NO: 631654 - protein, 19 aa, Mycobacterium
AGTGVRFTPTLTFTRDVTS

SEQ ID NO: 631655 - protein, 20 aa, Mycobacterium
AGTGVRFTPTLTFVLDTMAD

SEQ ID NO: 631656 - protein, 19 aa, Mycobacterium
AGTHPGALAEQWAGLERLL

SEQ ID NO: 631657 - protein, 17 aa, Mycobacterium
AGTHVAFVMGGTAIPWP

SEQ ID NO: 631658 - protein, 26 aa, Mycobacterium
AGTIGWGGVYGHSWFVDAARGLSVLL

SEQ ID NO: 631659 - protein, 28 aa, Mycobacterium
AGTILDSWCAALGRAFVADGFDESTAAS

SEQ ID NO: 631660 - protein, 17 aa, Mycobacterium
AGTIVIEAMNPRLMADV

SEQ ID NO: 631661 - protein, 25 aa, Mycobacterium
AGTKIWGYPKVMGDFTVAEGREFGF

SEQ ID NO: 631662 - protein, 24 aa, Mycobacterium
AGTKPKVAFIATHYQIDFSEHYIA

SEQ ID NO: 631663 - protein, 23 aa, Mycobacterium
AGTLCPNPLLPEGQRLDAVIGTR

SEQ ID NO: 631664 - protein, 20 aa, Mycobacterium
AGTLLREHGLLLPMEPNARL

SEQ ID NO: 631665 - protein, 26 aa, Mycobacterium
AGTLSTAIRAARRWIRAPASTSSSVA

SEQ ID NO: 631666 - protein, 19 aa, Mycobacterium
AGTMGFAGTVIKTGATASG

SEQ ID NO: 631667 - protein, 31 aa, Mycobacterium
AGTMYRAGRAWRGKEVEVCIVAGSVQMTHHG

SEQ ID NO: 631668 - protein, 23 aa, Mycobacterium
AGTNGSNPLVFDTANPGAAGQDV

SEQ ID NO: 631669 - protein, 19 aa, Mycobacterium
AGTNPGLIHYHFGGLPGLH

SEQ ID NO: 631670 - protein, 17 aa, Mycobacterium
AGTPARVARAWREMLWG

SEQ ID NO: 631671 - protein, 28 aa, Mycobacterium
AGTPKFWAFRRGEFQLSYTTERADHHGS

SEQ ID NO: 631672 - protein, 17 aa, Mycobacterium
AGTPNFHALMLHSVTAA

SEQ ID NO: 631673 - protein, 19 aa, Mycobacterium
AGTPPALLAACFHRAVADA

SEQ ID NO: 631674 - protein, 17 aa, Mycobacterium
AGTPPIYFGFGSTPIER

SEQ ID NO: 631675 - protein, 27 aa, Mycobacterium
AGTPRRYGVRWHFRVPAWSEFVEVHWS

SEQ ID NO: 631676 - protein, 23 aa, Mycobacterium
AGTQKRLAVWLVEDPRQVPGIAT

SEQ ID NO: 631677 - protein, 24 aa, Mycobacterium
AGTQKRLAVWVVRDPAAVPQIASL

SEQ ID NO: 631678 - protein, 23 aa, Mycobacterium
AGTQKRLAVWVVRDPMDVPQIAS

SEQ ID NO: 631679 - protein, 20 aa, Mycobacterium
AGTRAECLDYVEANWTDLRP

SEQ ID NO: 631680 - protein, 24 aa, Mycobacterium
AGTRAHSARPWLGDNAIHKLGAVL

SEQ ID NO: 631681 - protein, 23 aa, Mycobacterium
AGTRAHSARSWLGDNAIHKLGAV

SEQ ID NO: 631682 - protein, 23 aa, Mycobacterium
AGTRATAGLVLWGEPGIGKSRLA

SEQ ID NO: 631683 - protein, 22 aa, Mycobacterium
AGTRLPTHRALAARHGIAVATA

SEQ ID NO: 631684 - protein, 17 aa, Mycobacterium
AGTRMKLARNMLTFTSY

SEQ ID NO: 631685 - protein, 18 aa, Mycobacterium
AGTRRFEHTVAQLREERA

SEQ ID NO: 631686 - protein, 19 aa, Mycobacterium
AGTRVAALGRVHLRNVVAP

SEQ ID NO: 631687 - protein, 19 aa, Mycobacterium
AGTRWRPAFTPADPDEFTA

SEQ ID NO: 631688 - protein, 28 aa, Mycobacterium
AGTSGGMGGTGGWLWGNGGAGGGGGVGT

SEQ ID NO: 631689 - protein, 25 aa, Mycobacterium
AGTTGAWRAGGDGGSGGDGGDGFGL

SEQ ID NO: 631690 - protein, 20 aa, Mycobacterium
AGTVAEWKLQATKSRSRDVK

SEQ ID NO: 631691 - protein, 21 aa, Mycobacterium
AGTVARAFLREALGVEVLSHV

SEQ ID NO: 631692 - protein, 21 aa, Mycobacterium
AGTVARAFLRQALGVEIVSHV

SEQ ID NO: 631693 - protein, 24 aa, Mycobacterium
AGTVARAFLRQALGVEVLSHVVSI

SEQ ID NO: 631694 - protein, 23 aa, Mycobacterium
AGTVCLRLPVRTPFAYEGLFGHL

SEQ ID NO: 631695 - protein, 25 aa, Mycobacterium
AGTVDRLTFDPAGFGFPRADLDDLL

SEQ ID NO: 631696 - protein, 18 aa, Mycobacterium
AGTVERLTFDPAAFGFAR

SEQ ID NO: 631697 - protein, 30 aa, Mycobacterium
AGTVGPATFGFNWQQSPGFFNSSDTPSSGF

SEQ ID NO: 631698 - protein, 18 aa, Mycobacterium
AGTVIMLCLGAANRDPRK

SEQ ID NO: 631699 - protein, 25 aa, Mycobacterium
AGTVKRAKVATLLLPGVGTVRHLKD

SEQ ID NO: 631700 - protein, 17 aa, Mycobacterium
AGTVLFPGAGFVELALR

SEQ ID NO: 631701 - protein, 18 aa, Mycobacterium
AGTVLMLCLGAANRDPRK

SEQ ID NO: 631702 - protein, 24 aa, Mycobacterium
AGTVRFAAAHGFRVTVQATGHGAV

SEQ ID NO: 631703 - protein, 20 aa, Mycobacterium
AGTWGGGGATDWAAAAERAG

SEQ ID NO: 631704 - protein, 30 aa, Mycobacterium
AGTWLQDHFNRIDAVLCSTATRTRATLTQT

SEQ ID NO: 631705 - protein, 17 aa, Mycobacterium
AGTWSTGLLPRIAPTAR

SEQ ID NO: 631706 - protein, 18 aa, Mycobacterium
AGTYCLVGVYAMHRDPAL

SEQ ID NO: 631707 - protein, 18 aa, Mycobacterium
AGTYFGRLLSNLVAGPGG

SEQ ID NO: 631708 - protein, 18 aa, Mycobacterium
AGTYRLPWEDEVRHVDGT

SEQ ID NO: 631709 - protein, 31 aa, Mycobacterium
AGTYRSAGGDSCYWERLRGVGGTLDEVIANG

SEQ ID NO: 631710 - protein, 23 aa, Mycobacterium
AGVACANILLADGINDVTVLDSK

SEQ ID NO: 631711 - protein, 24 aa, Mycobacterium
AGVACANILLAKGITDITVLDSKG

SEQ ID NO: 631712 - protein, 25 aa, Mycobacterium
AGVACTNLLLAMGVLDITVLDSRGI

SEQ ID NO: 631713 - protein, 22 aa, Mycobacterium
AGVACTNLLLAMGVSDITVLDS

SEQ ID NO: 631714 - protein, 24 aa, Mycobacterium
AGVACTNLLMAMGVSDITVLDSRG

SEQ ID NO: 631715 - protein, 21 aa, Mycobacterium
AGVADIAFAFGSGSSASATGG

SEQ ID NO: 631716 - protein, 26 aa, Mycobacterium
AGVAELLSGPYLAGVQRWCPPRRWVD

SEQ ID NO: 631717 - protein, 23 aa, Mycobacterium
AGVAKPKLYRYFEDKADLHSAVL

SEQ ID NO: 631718 - protein, 18 aa, Mycobacterium
AGVALGWLASRWPGLLPD

SEQ ID NO: 631719 - protein, 24 aa, Mycobacterium
AGVAPRLRNAGMMMVDVRDVAEVH

SEQ ID NO: 631720 - protein, 18 aa, Mycobacterium
AGVARATLYRHFATKTDL

SEQ ID NO: 631721 - protein, 22 aa, Mycobacterium
AGVARGRQAIRRVFAQLLADIP

SEQ ID NO: 631722 - protein, 28 aa, Mycobacterium
AGVARTPAFWRFARRHWRTGITEMYGSL

SEQ ID NO: 631723 - protein, 24 aa, Mycobacterium
AGVARTPLARALRSAQRHDYLGNY

SEQ ID NO: 631724 - protein, 19 aa, Mycobacterium
AGVASRYGQQYFLQRARGG

SEQ ID NO: 631725 - protein, 17 aa, Mycobacterium
AGVAVVHCLIEKRPDNR

SEQ ID NO: 631726 - protein, 22 aa, Mycobacterium
AGVAWKDIQFGFGGSHEVSNPD

SEQ ID NO: 631727 - protein, 23 aa, Mycobacterium
AGVAYLRLLQRAGLTVAEALEQI

SEQ ID NO: 631728 - protein, 18 aa, Mycobacterium
AGVCFPDYLMTKGEYQLK

SEQ ID NO: 631729 - protein, 18 aa, Mycobacterium
AGVCRTRNLPLVGAPSNP

SEQ ID NO: 631730 - protein, 19 aa, Mycobacterium
AGVDARFSAIGAVSGKGSQ

SEQ ID NO: 631731 - protein, 25 aa, Mycobacterium
AGVDDAWAALQWVAANAAELGGDPG

SEQ ID NO: 631732 - protein, 26 aa, Mycobacterium
AGVDPGIVDDVIWGCVMQAGEQALDI

SEQ ID NO: 631733 - protein, 19 aa, Mycobacterium
AGVDRYVMVSALAADDRSL

SEQ ID NO: 631734 - protein, 18 aa, Mycobacterium
AGVDSGLLATVDTAVREL

SEQ ID NO: 631735 - protein, 21 aa, Mycobacterium
AGVDWKDIQFGFGGSYEVSNP

SEQ ID NO: 631736 - protein, 18 aa, Mycobacterium
AGVELGLLGTAVREGPLA

SEQ ID NO: 631737 - protein, 21 aa, Mycobacterium
AGVELWAAMHGFVMLEMTGFM

SEQ ID NO: 631738 - protein, 23 aa, Mycobacterium
AGVEPGLPYVLGRNEQAMVHTAV

SEQ ID NO: 631739 - protein, 26 aa, Mycobacterium
AGVERLPFRLVESVIMLRADGDSIAP

SEQ ID NO: 631740 - protein, 39 aa, Mycobacterium
AGVEVGDLHWFYVYSGVMWACVFMRTGARRVHFGETEKP

SEQ ID NO: 631741 - protein, 23 aa, Mycobacterium
AGVGAHARFLVGHRNLYRYLAHC

SEQ ID NO: 631742 - protein, 20 aa, Mycobacterium
AGVGCTRLAIHAVTANGEER

SEQ ID NO: 631743 - protein, 18 aa, Mycobacterium
AGVGGALETGGMLDVSAV

SEQ ID NO: 631744 - protein, 18 aa, Mycobacterium
AGVGILILTHYVPTLQPG

SEQ ID NO: 631745 - protein, 20 aa, Mycobacterium
AGVGKAAIYRRWRSKQALAA

SEQ ID NO: 631746 - protein, 29 aa, Mycobacterium
AGVGKGTLFRRFGSRAGLMMVLLDEDERA

SEQ ID NO: 631747 - protein, 33 aa, Mycobacterium
AGVGKGTLFRRFGSRTGLLLALLDHEEHIEQQA

SEQ ID NO: 631748 - protein, 24 aa, Mycobacterium
AGVGKLSVPVGWSSAAPALTSGTT

SEQ ID NO: 631749 - protein, 19 aa, Mycobacterium
AGVGKPTIYRRWSTKEDLI

SEQ ID NO: 631750 - protein, 18 aa, Mycobacterium
AGVGKPVLYTAYRTRAEL

SEQ ID NO: 631751 - protein, 19 aa, Mycobacterium
AGVGPGRTRLISGRAQEVL

SEQ ID NO: 631752 - protein, 19 aa, Mycobacterium
AGVGRLDLGSVLIPVPETG

SEQ ID NO: 631753 - protein, 23 aa, Mycobacterium
AGVGRSAFYFYFENKAAAVAALL

SEQ ID NO: 631754 - protein, 18 aa, Mycobacterium
AGVGRWLHTLGYRGHITS

SEQ ID NO: 631755 - protein, 18 aa, Mycobacterium
AGVHARSAVGVAELPINA

SEQ ID NO: 631756 - protein, 19 aa, Mycobacterium
AGVHRCLGSNLARLEFRVG

SEQ ID NO: 631757 - protein, 18 aa, Mycobacterium
AGVHSVVVAADWPLLAAA

SEQ ID NO: 631758 - protein, 19 aa, Mycobacterium
AGVILAMICDLRVVVPEAY

SEQ ID NO: 631759 - protein, 32 aa, Mycobacterium
AGVILSMICDLRVVAPDAYFQFPVAKYGIALD

SEQ ID NO: 631760 - protein, 18 aa, Mycobacterium
AGVKPALVHYYFPTMDDL

SEQ ID NO: 631761 - protein, 18 aa, Mycobacterium
AGVKQALVYYYFPTMDDL

SEQ ID NO: 631762 - protein, 17 aa, Mycobacterium
AGVKRFVYTSSNSVVMG

SEQ ID NO: 631763 - protein, 22 aa, Mycobacterium
AGVKVDLGATWVAKRHTAIRDL

SEQ ID NO: 631764 - protein, 17 aa, Mycobacterium
AGVLAMRPGLILLDEPT

SEQ ID NO: 631765 - protein, 25 aa, Mycobacterium
AGVLARAIVRLALSYVSMPPEADHD

SEQ ID NO: 631766 - protein, 23 aa, Mycobacterium
AGVLARAIVRLAMSYVSMPPEAD

SEQ ID NO: 631767 - protein, 18 aa, Mycobacterium
AGVLELASRLGISRNTVQ

SEQ ID NO: 631768 - protein, 19 aa, Mycobacterium
AGVLIGTRFQAAIEALVDP

SEQ ID NO: 631769 - protein, 23 aa, Mycobacterium
AGVLKERLKALVAEPDLARKAEL

SEQ ID NO: 631770 - protein, 19 aa, Mycobacterium
AGVLLRYIPLTVNRVTGIV

SEQ ID NO: 631771 - protein, 21 aa, Mycobacterium
AGVLRKEDLHLAFASGAGNKI

SEQ ID NO: 631772 - protein, 22 aa, Mycobacterium
AGVLRLDGKRALITGATKGIGA

SEQ ID NO: 631773 - protein, 17 aa, Mycobacterium
AGVLRRVATEDGQLRDV

SEQ ID NO: 631774 - protein, 18 aa, Mycobacterium
AGVLSLRITPGASASATQ

SEQ ID NO: 631775 - protein, 24 aa, Mycobacterium
AGVLSRAIVRLCLSYVPMPPEADH

SEQ ID NO: 631776 - protein, 18 aa, Mycobacterium
AGVLSWDARMEVLPLLPK

SEQ ID NO: 631777 - protein, 17 aa, Mycobacterium
AGVLSWGRLWELTDEQW

SEQ ID NO: 631778 - protein, 27 aa, Mycobacterium
AGVNDCGLHPAWPMAMSIATRERFVDA

SEQ ID NO: 631779 - protein, 19 aa, Mycobacterium
AGVNHQAWVLRWERNGQNL

SEQ ID NO: 631780 - protein, 26 aa, Mycobacterium
AGVNRPGDCLVKLGGAGDILAASERP

SEQ ID NO: 631781 - protein, 26 aa, Mycobacterium
AGVPAVQALRSWQRRALVKYLTARPR

SEQ ID NO: 631782 - protein, 18 aa, Mycobacterium
AGVPENMKMYLLETRRQL

SEQ ID NO: 631783 - protein, 21 aa, Mycobacterium
AGVPIIPLIVWGAQRIWTKDH

SEQ ID NO: 631784 - protein, 19 aa, Mycobacterium
AGVPIKVQVGAPVRAADDI

SEQ ID NO: 631785 - protein, 19 aa, Mycobacterium
AGVPLIEIVTKPIVGAGAR

SEQ ID NO: 631786 - protein, 19 aa, Mycobacterium
AGVPLIEIVTKPIVGAGDR

SEQ ID NO: 631787 - protein, 17 aa, Mycobacterium
AGVPLMVQREFGIPDDK

SEQ ID NO: 631788 - protein, 18 aa, Mycobacterium
AGVPLQIADGYHRVCASY

SEQ ID NO: 631789 - protein, 20 aa, Mycobacterium
AGVPMGLAIPHHIGRHSHPK

SEQ ID NO: 631790 - protein, 25 aa, Mycobacterium
AGVPPHPCPLSFILAPTLIAHGTQQ

SEQ ID NO: 631791 - protein, 19 aa, Mycobacterium
AGVPRRRIHLEVFQSLSGD

SEQ ID NO: 631792 - protein, 18 aa, Mycobacterium
AGVPRVDIAAMLLDRVGD

SEQ ID NO: 631793 - protein, 18 aa, Mycobacterium
AGVPSLVPLVAQNRMRLN

SEQ ID NO: 631794 - protein, 23 aa, Mycobacterium
AGVPSRWLPYFVVTDIAETGAAA

SEQ ID NO: 631795 - protein, 18 aa, Mycobacterium
AGVPVAFLTAWYGLADLA

SEQ ID NO: 631796 - protein, 17 aa, Mycobacterium
AGVPVGFHLSDSGYLAI

SEQ ID NO: 631797 - protein, 17 aa, Mycobacterium
AGVPVLVGGAGFGPDGR

SEQ ID NO: 631798 - protein, 17 aa, Mycobacterium
AGVQFPAPAMLYGYGAY

SEQ ID NO: 631799 - protein, 17 aa, Mycobacterium
AGVQFPAPTLLYGYGAY

SEQ ID NO: 631800 - protein, 19 aa, Mycobacterium
AGVQHLALRALELSPAGLT

SEQ ID NO: 631801 - protein, 27 aa, Mycobacterium
AGVQPKGWTLRLDQVIPAGMAEASVPG

SEQ ID NO: 631802 - protein, 18 aa, Mycobacterium
AGVRAVVEPAFWLGQPRT

SEQ ID NO: 631803 - protein, 17 aa, Mycobacterium
AGVRAVVEPAFWMGQPR

SEQ ID NO: 631804 - protein, 21 aa, Mycobacterium
AGVREAACYEIPDEEFGALVG

SEQ ID NO: 631805 - protein, 25 aa, Mycobacterium
AGVREICDRYGLVFIADEVMVGFGR

SEQ ID NO: 631806 - protein, 26 aa, Mycobacterium
AGVRELCTRYGIVFIADEVMAGFGRS

SEQ ID NO: 631807 - protein, 20 aa, Mycobacterium
AGVRGFEVLEQLAFDERRLR

SEQ ID NO: 631808 - protein, 26 aa, Mycobacterium
AGVRKGLEFVRPVAVDLTYIPLVGWA

SEQ ID NO: 631809 - protein, 21 aa, Mycobacterium
AGVRLLAPIPRPPSIRDSLCF

SEQ ID NO: 631810 - protein, 22 aa, Mycobacterium
AGVRPRMCEAAGRVADGLAGHP

SEQ ID NO: 631811 - protein, 22 aa, Mycobacterium
AGVRRRLDIDLSEVADLRPEIA

SEQ ID NO: 631812 - protein, 19 aa, Mycobacterium
AGVRVDWAAAFGGLEAQRV

SEQ ID NO: 631813 - protein, 18 aa, Mycobacterium
AGVSIQLLGKEGTYAALR

SEQ ID NO: 631814 - protein, 28 aa, Mycobacterium
AGVSKALFYFYFPRKEDVLFEVGVMSTR

SEQ ID NO: 631815 - protein, 17 aa, Mycobacterium
AGVSLDWELLAQGAQAA

SEQ ID NO: 631816 - protein, 18 aa, Mycobacterium
AGVSLDWELLAQGAQATR

SEQ ID NO: 631817 - protein, 27 aa, Mycobacterium
AGVSPSLRFGLAFCEASGPRLVRRSGN

SEQ ID NO: 631818 - protein, 18 aa, Mycobacterium
AGVSRAVLYRHFGGRDEL

SEQ ID NO: 631819 - protein, 26 aa, Mycobacterium
AGVSRGWLYRHFPDKSELLGAAIVRL

SEQ ID NO: 631820 - protein, 19 aa, Mycobacterium
AGVSRPTLHYYFATREDLY

SEQ ID NO: 631821 - protein, 24 aa, Mycobacterium
AGVSRPTLYRWFADKQELLEAFGN

SEQ ID NO: 631822 - protein, 24 aa, Mycobacterium
AGVSRPTLYRWFASKEELLATFSR

SEQ ID NO: 631823 - protein, 25 aa, Mycobacterium
AGVSRPTLYRWFASKEELLSAFSAY

SEQ ID NO: 631824 - protein, 18 aa, Mycobacterium
AGVSRQVFYQHFGDRDEA

SEQ ID NO: 631825 - protein, 21 aa, Mycobacterium
AGVSRRTLYRRFPTKEALFEH

SEQ ID NO: 631826 - protein, 18 aa, Mycobacterium
AGVSWKVYNSKLLGGLND

SEQ ID NO: 631827 - protein, 18 aa, Mycobacterium
AGVTAAFNRNVLAVVNRE

SEQ ID NO: 631828 - protein, 18 aa, Mycobacterium
AGVTARFNRNVLAVINRE

SEQ ID NO: 631829 - protein, 18 aa, Mycobacterium
AGVTARFNRNVLAVVNRK

SEQ ID NO: 631830 - protein, 18 aa, Mycobacterium
AGVTDWLVDTGINGDVAG

SEQ ID NO: 631831 - protein, 18 aa, Mycobacterium
AGVTDWVRQSCSYTAELF

SEQ ID NO: 631832 - protein, 19 aa, Mycobacterium
AGVTGQIGGFGGAGGTGGA

SEQ ID NO: 631833 - protein, 18 aa, Mycobacterium
AGVTHLFTGDSLFPGGPG

SEQ ID NO: 631834 - protein, 21 aa, Mycobacterium
AGVTIRWSGDIGDLDLTDYRK

SEQ ID NO: 631835 - protein, 19 aa, Mycobacterium
AGVTPAGLLHHFESKEQLL

SEQ ID NO: 631836 - protein, 20 aa, Mycobacterium
AGVTPAGLLHHFESKEQLLH

SEQ ID NO: 631837 - protein, 19 aa, Mycobacterium
AGVTPWITLSCRDRNRVVL

SEQ ID NO: 631838 - protein, 23 aa, Mycobacterium
AGVTRSAFYFYFENKAAAVAALL

SEQ ID NO: 631839 - protein, 24 aa, Mycobacterium
AGVTRWALDTAVAYAKVREQFGKP

SEQ ID NO: 631840 - protein, 24 aa, Mycobacterium
AGVTRWALETAVAYAKVREQFGKP

SEQ ID NO: 631841 - protein, 24 aa, Mycobacterium
AGVVMDLLFRVCIEEKLTVVCTLH

SEQ ID NO: 631842 - protein, 24 aa, Mycobacterium
AGVVRLRFGLTDGQPRTLDEIGQV

SEQ ID NO: 631843 - protein, 18 aa, Mycobacterium
AGVWSQWHSYGFDVSVWE

SEQ ID NO: 631844 - protein, 26 aa, Mycobacterium
AGVYPPCSAFEAWFVSAALDDAAFDR

SEQ ID NO: 631845 - protein, 26 aa, Mycobacterium
AGVYPPCSAFEAWFVSAALDDAAFER

SEQ ID NO: 631846 - protein, 26 aa, Mycobacterium
AGVYPPCSAFEAWFVSAALDDTAFER

SEQ ID NO: 631847 - protein, 26 aa, Mycobacterium
AGWATPLRCAGAWAAWAASARSARLA

SEQ ID NO: 631848 - protein, 29 aa, Mycobacterium
AGWDAIFGWEPVWGVDAWVALTAAAMRTS

SEQ ID NO: 631849 - protein, 31 aa, Mycobacterium
AGWDMWPGPYGQLGSRAYVLASLDESLDRMG

SEQ ID NO: 631850 - protein, 19 aa, Mycobacterium
AGWEQPWELARPAYQDSTG

SEQ ID NO: 631851 - protein, 22 aa, Mycobacterium
AGWGEGLGLLLLERLSDARRNQ

SEQ ID NO: 631852 - protein, 20 aa, Mycobacterium
AGWIDRLGTVWVEGQLAQIS

SEQ ID NO: 631853 - protein, 19 aa, Mycobacterium
AGWKWKTGRYPGEDQDPAH

SEQ ID NO: 631854 - protein, 21 aa, Mycobacterium
AGWLPSFGILEHVGRRSGKPY

SEQ ID NO: 631855 - protein, 23 aa, Mycobacterium
AGWMAVRAMPEFAARSAFDAGAR

SEQ ID NO: 631856 - protein, 21 aa, Mycobacterium
AGWNLGFGNDGSFNIGLGNTG

SEQ ID NO: 631857 - protein, 17 aa, Mycobacterium
AGWSPHWLRHTHASALL

SEQ ID NO: 631858 - protein, 26 aa, Mycobacterium
AGWVHLPCLPMVAALDRNLGVPSMSV

SEQ ID NO: 631859 - protein, 25 aa, Mycobacterium
AGYAADGPAGPAIGNGGDGGRGGAG

SEQ ID NO: 631860 - protein, 17 aa, Mycobacterium
AGYACAIESHYGRPMDI

SEQ ID NO: 631861 - protein, 26 aa, Mycobacterium
AGYAKIANCALGFPVVNIARSSAKLL

SEQ ID NO: 631862 - protein, 23 aa, Mycobacterium
AGYAVPHWPAEWGGGMSVPQQIV

SEQ ID NO: 631863 - protein, 25 aa, Mycobacterium
AGYAYFAGRLGDWMRVDGENLGAAP

SEQ ID NO: 631864 - protein, 18 aa, Mycobacterium
AGYCTRGNRGGVFEDLTV

SEQ ID NO: 631865 - protein, 28 aa, Mycobacterium
AGYEDLAWFCVRAWRFGAPASYGAGGLG

SEQ ID NO: 631866 - protein, 18 aa, Mycobacterium
AGYEEALVRYGLVVCEEW

SEQ ID NO: 631867 - protein, 17 aa, Mycobacterium
AGYELFTRYAFPPNELG

SEQ ID NO: 631868 - protein, 17 aa, Mycobacterium
AGYFAWEAAGLQWLSNV

SEQ ID NO: 631869 - protein, 19 aa, Mycobacterium
AGYGRLPTYPGMVAHQYTD

SEQ ID NO: 631870 - protein, 18 aa, Mycobacterium
AGYIPERAGHGWFTSLAL

SEQ ID NO: 631871 - protein, 17 aa, Mycobacterium
AGYKCPRSVEFDAELPR

SEQ ID NO: 631872 - protein, 23 aa, Mycobacterium
AGYKCPRTVEFVPELPRDPNGKL

SEQ ID NO: 631873 - protein, 21 aa, Mycobacterium
AGYKVPRSLWFVDEVKRSPAG

SEQ ID NO: 631874 - protein, 17 aa, Mycobacterium
AGYLAGRGAKHLVLTSR

SEQ ID NO: 631875 - protein, 30 aa, Mycobacterium
AGYLPDQWTAQAFSDGWYRTGDVGTLDGEG

SEQ ID NO: 631876 - protein, 23 aa, Mycobacterium
AGYLRPYYESSRAIDPSTFELKL

SEQ ID NO: 631877 - protein, 20 aa, Mycobacterium
AGYLRRFYPPGDDEVHYEVT

SEQ ID NO: 631878 - protein, 19 aa, Mycobacterium
AGYPHICVPAGYFCGLPVG

SEQ ID NO: 631879 - protein, 25 aa, Mycobacterium
AGYPKEMRDFLKANAGLAGRFHFTL

SEQ ID NO: 631880 - protein, 18 aa, Mycobacterium
AGYPLSQVTEALCKRWQP

SEQ ID NO: 631881 - protein, 18 aa, Mycobacterium
AGYPPSRHLDAFEYMRSN

SEQ ID NO: 631882 - protein, 18 aa, Mycobacterium
AGYPPTRHLDAFEYMRNA

SEQ ID NO: 631883 - protein, 19 aa, Mycobacterium
AGYRAGFVAGDPELIAELL

SEQ ID NO: 631884 - protein, 18 aa, Mycobacterium
AGYRAPMWDLSWRTPALL

SEQ ID NO: 631885 - protein, 22 aa, Mycobacterium
AGYRARVSVISMVGLTNEQQRE

SEQ ID NO: 631886 - protein, 23 aa, Mycobacterium
AGYRGEIKVALINLDPTTPIVVH

SEQ ID NO: 631887 - protein, 17 aa, Mycobacterium
AGYRRFLERKLRETFGF

SEQ ID NO: 631888 - protein, 17 aa, Mycobacterium
AGYRRFLERRLRESFGF

SEQ ID NO: 631889 - protein, 21 aa, Mycobacterium
AGYRTEAGFEPAVDAGGWLAT

SEQ ID NO: 631890 - protein, 18 aa, Mycobacterium
AGYSVGVIECGPPRSQNR

SEQ ID NO: 631891 - protein, 19 aa, Mycobacterium
AGYTGLWTAYYLKKADPSL

SEQ ID NO: 631892 - protein, 19 aa, Mycobacterium
AGYTGLWTAYYLKRADPSL

SEQ ID NO: 631893 - protein, 20 aa, Mycobacterium
AGYYCARTLLRREFGIAEMP

SEQ ID NO: 631894 - protein, 25 aa, Mycobacterium
AHAAILPLYYLRRADIAETDLHVIR

SEQ ID NO: 631895 - protein, 17 aa, Mycobacterium
AHAARAADALGAVRESR

SEQ ID NO: 631896 - protein, 22 aa, Mycobacterium
AHAAWPLGRFWPVVSRPRMRGH

SEQ ID NO: 631897 - protein, 17 aa, Mycobacterium
AHACCVIADKYVCDDDS

SEQ ID NO: 631898 - protein, 24 aa, Mycobacterium
AHACFKALCAAGVPAVYTGNTDVF

SEQ ID NO: 631899 - protein, 21 aa, Mycobacterium
AHADAVFFMFDPLRVKTIRDQ

SEQ ID NO: 631900 - protein, 17 aa, Mycobacterium
AHADLANLQAIRAARTT

SEQ ID NO: 631901 - protein, 20 aa, Mycobacterium
AHADVAWLLCDRHPAQRIAF

SEQ ID NO: 631902 - protein, 26 aa, Mycobacterium
AHAEDFCLRIGFGGAKQEKLQELLAA

SEQ ID NO: 631903 - protein, 30 aa, Mycobacterium
AHAELTLAAVHRGLPTFCEKPIAATAAESA

SEQ ID NO: 631904 - protein, 21 aa, Mycobacterium
AHAEVFPFVFTAARLTEHHTA

SEQ ID NO: 631905 - protein, 18 aa, Mycobacterium
AHAFDLKSGILAARATLE

SEQ ID NO: 631906 - protein, 21 aa, Mycobacterium
AHAFLRLGIAPGDRVLLQLPN

SEQ ID NO: 631907 - protein, 18 aa, Mycobacterium
AHAFPCDLTDYAAVDDTV

SEQ ID NO: 631908 - protein, 18 aa, Mycobacterium
AHAGDFAGAAAMRWGGRP

SEQ ID NO: 631909 - protein, 17 aa, Mycobacterium
AHAGGGLVLKVGVHAGP

SEQ ID NO: 631910 - protein, 21 aa, Mycobacterium
AHAGGRLALMTKVHHASVDGV

SEQ ID NO: 631911 - protein, 26 aa, Mycobacterium
AHAGILPPLFSGLIRMPAKRARAAAT

SEQ ID NO: 631912 - protein, 25 aa, Mycobacterium
AHAGRVGAKLGIVPRTIDAMVAAGA

SEQ ID NO: 631913 - protein, 18 aa, Mycobacterium
AHAGRVGAQIGIVPRTLE

SEQ ID NO: 631914 - protein, 18 aa, Mycobacterium
AHAHPGELIGLATGPLTN

SEQ ID NO: 631915 - protein, 23 aa, Mycobacterium
AHAHTRLAAKMSYTNIGFALAPQ

SEQ ID NO: 631916 - protein, 24 aa, Mycobacterium
AHAIRELVERAGIDPALIDDVISG

SEQ ID NO: 631917 - protein, 21 aa, Mycobacterium
AHAKDVFFYEPIILPEKSSRE

SEQ ID NO: 631918 - protein, 20 aa, Mycobacterium
AHALGMHGCTVYVTGRTVDP

SEQ ID NO: 631919 - protein, 25 aa, Mycobacterium
AHALHSPFWWLKCAVGVSNADHPLV

SEQ ID NO: 631920 - protein, 17 aa, Mycobacterium
AHALRFRPFASVREVVR

SEQ ID NO: 631921 - protein, 19 aa, Mycobacterium
AHALRLARDGADVIAVDLC

SEQ ID NO: 631922 - protein, 21 aa, Mycobacterium
AHANGGLLLKDLRLPDFREYA

SEQ ID NO: 631923 - protein, 23 aa, Mycobacterium
AHAPDAIPVLFGHIGEGNLHLNV

SEQ ID NO: 631924 - protein, 20 aa, Mycobacterium
AHAPGGHWTTAYPFVRLHQP

SEQ ID NO: 631925 - protein, 39 aa, Mycobacterium
AHAPRRVVAEIPLWSTRAKRWLRARSRPTAGRAPVTLAE

SEQ ID NO: 631926 - protein, 17 aa, Mycobacterium
AHAPVSWVEAEGYKPFW

SEQ ID NO: 631927 - protein, 25 aa, Mycobacterium
AHAQAGRLTEWLKLALDQPELLEKL

SEQ ID NO: 631928 - protein, 27 aa, Mycobacterium
AHARATWPLPEPTLAYFPNARFVPSDR

SEQ ID NO: 631929 - protein, 26 aa, Mycobacterium
AHARGRLTAWFKEFVLTGVPWGLRRE

SEQ ID NO: 631930 - protein, 20 aa, Mycobacterium
AHARIVVWELIDALRRDGVT

SEQ ID NO: 631931 - protein, 21 aa, Mycobacterium
AHARIVVWELIDALRRDGVTV

SEQ ID NO: 631932 - protein, 26 aa, Mycobacterium
AHARLPGSAFTPVWKDPAAAALRNRR

SEQ ID NO: 631933 - protein, 24 aa, Mycobacterium
AHARRRFDWGVPLGVEVPLLASAV

SEQ ID NO: 631934 - protein, 21 aa, Mycobacterium
AHARSGLNVWVPVPDETVAIT

SEQ ID NO: 631935 - protein, 29 aa, Mycobacterium
AHARWAAGCPAPRADWVARLAERRELAAA

SEQ ID NO: 631936 - protein, 24 aa, Mycobacterium
AHARYEGAAVRVGRTMAVADAQAV

SEQ ID NO: 631937 - protein, 19 aa, Mycobacterium
AHASARMEFVLADAAPTAV

SEQ ID NO: 631938 - protein, 20 aa, Mycobacterium
AHASSRMDFVLSDAAPSAVI

SEQ ID NO: 631939 - protein, 20 aa, Mycobacterium
AHATAWYGLHDLARIKAGDK

SEQ ID NO: 631940 - protein, 19 aa, Mycobacterium
AHATAWYGLHDLGRIRAGD

SEQ ID NO: 631941 - protein, 22 aa, Mycobacterium
AHATELPYVWGNLGGPQDPTLR

SEQ ID NO: 631942 - protein, 24 aa, Mycobacterium
AHATLRLASKLRLLTLAAGDDSSP

SEQ ID NO: 631943 - protein, 20 aa, Mycobacterium
AHAVRDLWASRLLPYAHNLR

SEQ ID NO: 631944 - protein, 25 aa, Mycobacterium
AHAVRRLRPTIAGFADALLDDIAAS

SEQ ID NO: 631945 - protein, 20 aa, Mycobacterium
AHAYLGMAMPDFPNFFMLYG

SEQ ID NO: 631946 - protein, 20 aa, Mycobacterium
AHAYQRLGVRQGDLVTIGLP

SEQ ID NO: 631947 - protein, 31 aa, Mycobacterium
AHAYSAANWLALNCRRHMELYGTTKEQLGWI

SEQ ID NO: 631948 - protein, 25 aa, Mycobacterium
AHCARELAAIGELYARRAPDDDADR

SEQ ID NO: 631949 - protein, 18 aa, Mycobacterium
AHCNEIPVVSSLASTPQE

SEQ ID NO: 631950 - protein, 19 aa, Mycobacterium
AHCPAYFQLLIKSLLQPGL

SEQ ID NO: 631951 - protein, 19 aa, Mycobacterium
AHCRSDPASGYARDKRSGL

SEQ ID NO: 631952 - protein, 22 aa, Mycobacterium
AHCTRGLGIWEWAGSEELGTDP

SEQ ID NO: 631953 - protein, 24 aa, Mycobacterium
AHDAATMPVRFVKSIGDAVMLVCP

SEQ ID NO: 631954 - protein, 20 aa, Mycobacterium
AHDAEFPWHDVIDTTRPALR

SEQ ID NO: 631955 - protein, 27 aa, Mycobacterium
AHDCNRISGGLAVRFARPGETVVTLDD

SEQ ID NO: 631956 - protein, 19 aa, Mycobacterium
AHDDARVHAGLTCYASAIR

SEQ ID NO: 631957 - protein, 20 aa, Mycobacterium
AHDDLLLVAGMRTSQRARLI

SEQ ID NO: 631958 - protein, 20 aa, Mycobacterium
AHDDRAWISLCSPESVQPLQ

SEQ ID NO: 631959 - protein, 25 aa, Mycobacterium
AHDECLQRLGWFRVRVVPRHSPRSI

SEQ ID NO: 631960 - protein, 27 aa, Mycobacterium
AHDETRKSFGIAGARVVESIKLSVPFK

SEQ ID NO: 631961 - protein, 17 aa, Mycobacterium
AHDETRKSFGIAGPRVV

SEQ ID NO: 631962 - protein, 17 aa, Mycobacterium
AHDFAAVLRHSGTNAIL

SEQ ID NO: 631963 - protein, 22 aa, Mycobacterium
AHDGGDHFVVFGAVQSLSEAPK

SEQ ID NO: 631964 - protein, 20 aa, Mycobacterium
AHDGLWMFTNMGVFFNSMDY

SEQ ID NO: 631965 - protein, 18 aa, Mycobacterium
AHDIPMSAPLGAHRQVAE

SEQ ID NO: 631966 - protein, 20 aa, Mycobacterium
AHDKLGRLDIMINNPVMVAA

SEQ ID NO: 631967 - protein, 24 aa, Mycobacterium
AHDLKDWFGFLAERGLDWRGVRLD

SEQ ID NO: 631968 - protein, 25 aa, Mycobacterium
AHDLKDWFTFLGGRGLDWQSVSLED

SEQ ID NO: 631969 - protein, 24 aa, Mycobacterium
AHDLSSLRLLGSVGEPINPEAWRW

SEQ ID NO: 631970 - protein, 23 aa, Mycobacterium
AHDLSSLRLLGTVGEPINPEAWR

SEQ ID NO: 631971 - protein, 24 aa, Mycobacterium
AHDLTSLRLLGSVGEPINPEAWRW

SEQ ID NO: 631972 - protein, 18 aa, Mycobacterium
AHDPRLLREPDLGELERL

SEQ ID NO: 631973 - protein, 26 aa, Mycobacterium
AHDPRPRLIGALAMAAVRIALDDWLS

SEQ ID NO: 631974 - protein, 21 aa, Mycobacterium
AHDQCDAWIGLAAAGEVTPAV

SEQ ID NO: 631975 - protein, 17 aa, Mycobacterium
AHDRAHWTKVFEGTDAC

SEQ ID NO: 631976 - protein, 27 aa, Mycobacterium
AHDRCGLPVAVFRCDMILADTTWAGQL

SEQ ID NO: 631977 - protein, 21 aa, Mycobacterium
AHDSGIPVICYNTCVTESDAR

SEQ ID NO: 631978 - protein, 24 aa, Mycobacterium
AHDSRLPVLLGIDGSPASEVATSH

SEQ ID NO: 631979 - protein, 26 aa, Mycobacterium
AHDTAALLRRCRAERTTVHAAIVTAA

SEQ ID NO: 631980 - protein, 25 aa, Mycobacterium
AHDVARCWLYLGFTRLASGALQAAD

SEQ ID NO: 631981 - protein, 22 aa, Mycobacterium
AHDVARCWLYLGLTRLASGALE

SEQ ID NO: 631982 - protein, 22 aa, Mycobacterium
AHDVARCWLYLGLTRLGAGALE

SEQ ID NO: 631983 - protein, 19 aa, Mycobacterium
AHDVGQCRGQRVGVEVPAQ

SEQ ID NO: 631984 - protein, 34 aa, Mycobacterium
AHDVRSACLRREVPVDLRQDWPAALQREGFDVAE

SEQ ID NO: 631985 - protein, 26 aa, Mycobacterium
AHDWPVSLFAERTWHVARPVPERSVI

SEQ ID NO: 631986 - protein, 18 aa, Mycobacterium
AHEALMAMTYRFVGTKGT

SEQ ID NO: 631987 - protein, 25 aa, Mycobacterium
AHEARLRQAPILALGGRPEELTDAA

SEQ ID NO: 631988 - protein, 17 aa, Mycobacterium
AHEARTDARLEILPDVG

SEQ ID NO: 631989 - protein, 23 aa, Mycobacterium
AHEARTGVDVVRLVAGDPLSNDS

SEQ ID NO: 631990 - protein, 17 aa, Mycobacterium
AHECDPLSAFGGVIAAN

SEQ ID NO: 631991 - protein, 23 aa, Mycobacterium
AHEGSLRFGDKVVLGRDNVINAY

SEQ ID NO: 631992 - protein, 24 aa, Mycobacterium
AHEGSLRFGDKVVLGRDNVINAYL

SEQ ID NO: 631993 - protein, 18 aa, Mycobacterium
AHEPRGDGGFGYDPVFVP

SEQ ID NO: 631994 - protein, 18 aa, Mycobacterium
AHEREVFNRDGMLLTPGP

SEQ ID NO: 631995 - protein, 18 aa, Mycobacterium
AHESRSRAAAGEAGGSYV

SEQ ID NO: 631996 - protein, 18 aa, Mycobacterium
AHESRWCTLYARTDPAAP

SEQ ID NO: 631997 - protein, 18 aa, Mycobacterium
AHESRWCTLYARTDPDAP

SEQ ID NO: 631998 - protein, 18 aa, Mycobacterium
AHESSVWSDEYHPSDPME

SEQ ID NO: 631999 - protein, 26 aa, Mycobacterium
AHEVREILAALGMRTLREARGRSDLL

SEQ ID NO: 632000 - protein, 22 aa, Mycobacterium
AHEYPGHTVIRAFRPHAVKVTA

SEQ ID NO: 632001 - protein, 24 aa, Mycobacterium
AHEYPVNFDVWWFKLPRDGAADHS

SEQ ID NO: 632002 - protein, 17 aa, Mycobacterium
AHFAAWESRGRRPLTVL

SEQ ID NO: 632003 - protein, 19 aa, Mycobacterium
AHFELWCFAVSSINGCPDC

SEQ ID NO: 632004 - protein, 23 aa, Mycobacterium
AHFGGGRPTTWLTPNGPIDAKII

SEQ ID NO: 632005 - protein, 21 aa, Mycobacterium
AHFHATRFVQIGAMTGETISV

SEQ ID NO: 632006 - protein, 17 aa, Mycobacterium
AHFKKFIEETSAYLAAA

SEQ ID NO: 632007 - protein, 27 aa, Mycobacterium
AHFKVPGWRDMLTRMGVVEGTREIASE

SEQ ID NO: 632008 - protein, 17 aa, Mycobacterium
AHFLRRSGMVAGDTVAV

SEQ ID NO: 632009 - protein, 18 aa, Mycobacterium
AHGAAWAAAPRAYRAAGA

SEQ ID NO: 632010 - protein, 23 aa, Mycobacterium
AHGADLQRSWLRTGDLGVYLDGE

SEQ ID NO: 632011 - protein, 28 aa, Mycobacterium
AHGASSKEARSWWGNFLVQKANEAGIGL

SEQ ID NO: 632012 - protein, 20 aa, Mycobacterium
AHGAVQGHEALRRWAGSVMV

SEQ ID NO: 632013 - protein, 28 aa, Mycobacterium
AHGERPLFPFLRGCLAGGAPITPELGRQ

SEQ ID NO: 632014 - protein, 25 aa, Mycobacterium
AHGFLCFASPLGQWRWLTASDGKPR

SEQ ID NO: 632015 - protein, 19 aa, Mycobacterium
AHGGHLDWASLRKLHRTLV

SEQ ID NO: 632016 - protein, 19 aa, Mycobacterium
AHGGMVACIEDGYLQGLIA

SEQ ID NO: 632017 - protein, 17 aa, Mycobacterium
AHGGPGGAPGCWQPITR

SEQ ID NO: 632018 - protein, 18 aa, Mycobacterium
AHGGPLLMFSNPDCQVLL

SEQ ID NO: 632019 - protein, 25 aa, Mycobacterium
AHGIDTVVVGWGYGKADFAAGTHSG

SEQ ID NO: 632020 - protein, 25 aa, Mycobacterium
AHGIDTVVVGWGYGQDDFGHDTDAT

SEQ ID NO: 632021 - protein, 25 aa, Mycobacterium
AHGIDTVVVGWGYGRADFPDGAAAA

SEQ ID NO: 632022 - protein, 26 aa, Mycobacterium
AHGIDTVVVGWGYGRADTFSGVTHAA

SEQ ID NO: 632023 - protein, 21 aa, Mycobacterium
AHGIHKAFGMRSVLRGVDLEV

SEQ ID NO: 632024 - protein, 23 aa, Mycobacterium
AHGIPGMPGMPVGSSSRASSVVP

SEQ ID NO: 632025 - protein, 23 aa, Mycobacterium
AHGLDVADALGISRPATNRLRSI

SEQ ID NO: 632026 - protein, 17 aa, Mycobacterium
AHGLLAARSAPTFDTTV

SEQ ID NO: 632027 - protein, 23 aa, Mycobacterium
AHGLPAYGACAGMILLASEILDA

SEQ ID NO: 632028 - protein, 22 aa, Mycobacterium
AHGLPGLSVAWGLWEQASAMTR

SEQ ID NO: 632029 - protein, 18 aa, Mycobacterium
AHGLRTRVEWSRGDEGTP

SEQ ID NO: 632030 - protein, 19 aa, Mycobacterium
AHGLTLLSLDRAVLEEVLR

SEQ ID NO: 632031 - protein, 18 aa, Mycobacterium
AHGLTVPEAVGFGKRWVT

SEQ ID NO: 632032 - protein, 19 aa, Mycobacterium
AHGLVPFVDDMAGNNGSGG

SEQ ID NO: 632033 - protein, 27 aa, Mycobacterium
AHGMALPGRHQLFLLGCDISRTATGDF

SEQ ID NO: 632034 - protein, 17 aa, Mycobacterium
AHGMLTMGLGGGYLTEW

SEQ ID NO: 632035 - protein, 25 aa, Mycobacterium
AHGMPDPRAWPALLTATAATDPRRW

SEQ ID NO: 632036 - protein, 22 aa, Mycobacterium
AHGNFTLGLGLGARVIEHYAFG

SEQ ID NO: 632037 - protein, 18 aa, Mycobacterium
AHGNLGFCNFYEGKEPRR

SEQ ID NO: 632038 - protein, 31 aa, Mycobacterium
AHGNPARIAQRWASAWVNPGKAGLMGWGLTL

SEQ ID NO: 632039 - protein, 17 aa, Mycobacterium
AHGPGRMLVAAKLGSTR

SEQ ID NO: 632040 - protein, 18 aa, Mycobacterium
AHGPYFTRNLVKLTDSDG

SEQ ID NO: 632041 - protein, 19 aa, Mycobacterium
AHGQIHDWVLLTLDGPRYL

SEQ ID NO: 632042 - protein, 27 aa, Mycobacterium
AHGSEASKMLVLWAVVVLRSPVGTHIA

SEQ ID NO: 632043 - protein, 27 aa, Mycobacterium
AHGSPGHGADHVMPALVAPSVTVPVSG

SEQ ID NO: 632044 - protein, 21 aa, Mycobacterium
AHGSPGHGADHVMPGLVSPSV

SEQ ID NO: 632045 - protein, 27 aa, Mycobacterium
AHGTAGEDFVRFAIAGSDGLDRTTVEV

SEQ ID NO: 632046 - protein, 18 aa, Mycobacterium
AHGVALLLIDSRARHRHA

SEQ ID NO: 632047 - protein, 25 aa, Mycobacterium
AHGVWLRPFGKLIYAMPPFICTPEE

SEQ ID NO: 632048 - protein, 18 aa, Mycobacterium
AHHARLGKDAVLRHVAVM

SEQ ID NO: 632049 - protein, 19 aa, Mycobacterium
AHHEPRGAQYMGVNWVGPI

SEQ ID NO: 632050 - protein, 17 aa, Mycobacterium
AHHIAGLQVLVRSTVAG

SEQ ID NO: 632051 - protein, 17 aa, Mycobacterium
AHHNVCMHRGRRLVDTP

SEQ ID NO: 632052 - protein, 20 aa, Mycobacterium
AHHPDLIVCDIMMPQLSGDE

SEQ ID NO: 632053 - protein, 17 aa, Mycobacterium
AHHPRFLGVRRAYESRS

SEQ ID NO: 632054 - protein, 24 aa, Mycobacterium
AHHPVRLFIGSGMPAGLWRRVTEK

SEQ ID NO: 632055 - protein, 33 aa, Mycobacterium
AHHRESFLYTHFDELCDIFARYDVTFSLGDGLR

SEQ ID NO: 632056 - protein, 21 aa, Mycobacterium
AHHRESFLYTHFEELCEILAR

SEQ ID NO: 632057 - protein, 21 aa, Mycobacterium
AHHRESFLYTNFEELCDILAR

SEQ ID NO: 632058 - protein, 21 aa, Mycobacterium
AHHRESFLYTNFEELCEIFAR

SEQ ID NO: 632059 - protein, 17 aa, Mycobacterium
AHHRLFSHVPWLSSQLL

SEQ ID NO: 632060 - protein, 17 aa, Mycobacterium
AHHRLFSHVPWLSSQVL

SEQ ID NO: 632061 - protein, 27 aa, Mycobacterium
AHHRVRHPLVATVCARERAQALVGLQA

SEQ ID NO: 632062 - protein, 22 aa, Mycobacterium
AHHRYAPVYFYRYDYAPGALRI

SEQ ID NO: 632063 - protein, 31 aa, Mycobacterium
AHHTRTADEFSWRAGELINAIADGSIKITVG

SEQ ID NO: 632064 - protein, 32 aa, Mycobacterium
AHHTRTPDEFSWRAGELLTAIADGALTVTVSN

SEQ ID NO: 632065 - protein, 24 aa, Mycobacterium
AHHVAAWRAARLLVLDAFTGAEGA

SEQ ID NO: 632066 - protein, 17 aa, Mycobacterium
AHHVSRVLGRRVGPSTG

SEQ ID NO: 632067 - protein, 26 aa, Mycobacterium
AHIEKRFSMSWSHPARRMREFVAALH

SEQ ID NO: 632068 - protein, 24 aa, Mycobacterium
AHIELRRSEGLAALVVASADGQAF

SEQ ID NO: 632069 - protein, 24 aa, Mycobacterium
AHIELRRTEGLAALVVASADGQAF

SEQ ID NO: 632070 - protein, 17 aa, Mycobacterium
AHIIPLMRAQLEKLLPG

SEQ ID NO: 632071 - protein, 23 aa, Mycobacterium
AHIITLRDGRWLHFRDFMNSALT

SEQ ID NO: 632072 - protein, 24 aa, Mycobacterium
AHINDVKTAIAWARANVDKFGGNR

SEQ ID NO: 632073 - protein, 19 aa, Mycobacterium
AHIRKYLWGEHFWSPSYFA

SEQ ID NO: 632074 - protein, 19 aa, Mycobacterium
AHIRPEFADRAQILAIATD

SEQ ID NO: 632075 - protein, 23 aa, Mycobacterium
AHISGESLGGWVAARIAADRPER

SEQ ID NO: 632076 - protein, 23 aa, Mycobacterium
AHISGESLGGWVAARVAVDHPDR

SEQ ID NO: 632077 - protein, 18 aa, Mycobacterium
AHISRVFIDDCVARHLRG

SEQ ID NO: 632078 - protein, 25 aa, Mycobacterium
AHIVDVKRALAWVKENIAAYGGDPD

SEQ ID NO: 632079 - protein, 24 aa, Mycobacterium
AHIVDVKRALAWVKENIADYGGDP

SEQ ID NO: 632080 - protein, 17 aa, Mycobacterium
AHKAQLLASGVSMPDAL

SEQ ID NO: 632081 - protein, 22 aa, Mycobacterium
AHKHGLTPIVCIGEQLEVREAG

SEQ ID NO: 632082 - protein, 20 aa, Mycobacterium
AHLADYCFLLTRSQRGSVGP

SEQ ID NO: 632083 - protein, 20 aa, Mycobacterium
AHLAIAGPAWRNEIDATVGT

SEQ ID NO: 632084 - protein, 25 aa, Mycobacterium
AHLARRTGSVLARRIASETADFMIA

SEQ ID NO: 632085 - protein, 17 aa, Mycobacterium
AHLDLCMVLPLDRPILA

SEQ ID NO: 632086 - protein, 22 aa, Mycobacterium
AHLEMAMTLAVPAAALAGRPAV

SEQ ID NO: 632087 - protein, 25 aa, Mycobacterium
AHLFVPDLLECLAQLAHLAGSHPEA

SEQ ID NO: 632088 - protein, 18 aa, Mycobacterium
AHLGCRRVASDTAHHTIL

SEQ ID NO: 632089 - protein, 28 aa, Mycobacterium
AHLGGTCPDCARGAFRADRPYEAEALRP

SEQ ID NO: 632090 - protein, 19 aa, Mycobacterium
AHLGRALRWRRYAHTPMNA

SEQ ID NO: 632091 - protein, 25 aa, Mycobacterium
AHLHLRRALVIAALFGGDGPARDVF

SEQ ID NO: 632092 - protein, 23 aa, Mycobacterium
AHLIRAAAIQAMLDGTEQVSRAL

SEQ ID NO: 632093 - protein, 18 aa, Mycobacterium
AHLLGFVQHGVMNHASTM

SEQ ID NO: 632094 - protein, 25 aa, Mycobacterium
AHLLREFADVFGIEGETKMRYDAAY

SEQ ID NO: 632095 - protein, 23 aa, Mycobacterium
AHLLRRKLVNAGFTRKRVKEKEP

SEQ ID NO: 632096 - protein, 31 aa, Mycobacterium
AHLMAAARLDLPAIVVIGGYQRGGTWSGCSV

SEQ ID NO: 632097 - protein, 18 aa, Mycobacterium
AHLPGLERTLAFHLAGHA

SEQ ID NO: 632098 - protein, 18 aa, Mycobacterium
AHLPRAGLPTEIGSVVAF

SEQ ID NO: 632099 - protein, 20 aa, Mycobacterium
AHLQAARPGEDWTGSEEFSG

SEQ ID NO: 632100 - protein, 20 aa, Mycobacterium
AHLQAARPGEDWTGSEQFSG

SEQ ID NO: 632101 - protein, 24 aa, Mycobacterium
AHLQARLSTLTGRGVVAVRGKGLW

SEQ ID NO: 632102 - protein, 23 aa, Mycobacterium
AHLQSARPGEDWNGAQRFSGDDP

SEQ ID NO: 632103 - protein, 17 aa, Mycobacterium
AHLRAAHHLSLCPQCAA

SEQ ID NO: 632104 - protein, 17 aa, Mycobacterium
AHLRADVVMAREGNVDG

SEQ ID NO: 632105 - protein, 30 aa, Mycobacterium
AHLRDARPLVRLRVPFTVNRTDVDDVERGS

SEQ ID NO: 632106 - protein, 20 aa, Mycobacterium
AHLRGRALNVQRYPRGIAET

SEQ ID NO: 632107 - protein, 21 aa, Mycobacterium
AHLRHALELSDYTTASIRNSG

SEQ ID NO: 632108 - protein, 17 aa, Mycobacterium
AHLRKHAPWGARVSVER

SEQ ID NO: 632109 - protein, 25 aa, Mycobacterium
AHLRNMAFYNFGLRLLRHVREAQQA

SEQ ID NO: 632110 - protein, 20 aa, Mycobacterium
AHLRPPIYLVGRSADLEDEY

SEQ ID NO: 632111 - protein, 20 aa, Mycobacterium
AHLRRPWAARAARTAPAGRV

SEQ ID NO: 632112 - protein, 23 aa, Mycobacterium
AHLSRAGIAQVHVLNRSLSRAQR

SEQ ID NO: 632113 - protein, 24 aa, Mycobacterium
AHLTREFVRFVGVPPRRWLADEFR

SEQ ID NO: 632114 - protein, 19 aa, Mycobacterium
AHLWSRDGVPLATSHQYVY

SEQ ID NO: 632115 - protein, 29 aa, Mycobacterium
AHLWWIRSQLRAALIADVRARVRRSWLER

SEQ ID NO: 632116 - protein, 19 aa, Mycobacterium
AHLYFKRATTDAALLGTAE

SEQ ID NO: 632117 - protein, 26 aa, Mycobacterium
AHLYLRRARTLAALMADGVDPLIDIV

SEQ ID NO: 632118 - protein, 17 aa, Mycobacterium
AHLYLRRAYALQSFVGK

SEQ ID NO: 632119 - protein, 19 aa, Mycobacterium
AHMARRYAEVIPEPDVVML

SEQ ID NO: 632120 - protein, 17 aa, Mycobacterium
AHMCCIHGAHVGSEALI

SEQ ID NO: 632121 - protein, 17 aa, Mycobacterium
AHMVFLDPAGRDFYVDW

SEQ ID NO: 632122 - protein, 29 aa, Mycobacterium
AHNALNLAAWRRLKLLFDDLARESDLRVV

SEQ ID NO: 632123 - protein, 19 aa, Mycobacterium
AHNATSFMVIQAGLAVLLA

SEQ ID NO: 632124 - protein, 19 aa, Mycobacterium
AHNATSFMVVQAVLAVLLA

SEQ ID NO: 632125 - protein, 17 aa, Mycobacterium
AHNEAIGQLMAHAQAMT

SEQ ID NO: 632126 - protein, 20 aa, Mycobacterium
AHNIGHFRFVECSRLVDGRP

SEQ ID NO: 632127 - protein, 20 aa, Mycobacterium
AHNPRWARYQSWTDRVIPVV

SEQ ID NO: 632128 - protein, 22 aa, Mycobacterium
AHNRLVLDMVRKLKAEVGDRVD

SEQ ID NO: 632129 - protein, 20 aa, Mycobacterium
AHNTYYCFGTAAGPHPFPVM

SEQ ID NO: 632130 - protein, 17 aa, Mycobacterium
AHPAFDWYSERISEQQA

SEQ ID NO: 632131 - protein, 18 aa, Mycobacterium
AHPAFDWYTERISEQQAV

SEQ ID NO: 632132 - protein, 25 aa, Mycobacterium
AHPAGSKAIAGWLSRPQAFTAAELD

SEQ ID NO: 632133 - protein, 17 aa, Mycobacterium
AHPALDRASQLALTLRL

SEQ ID NO: 632134 - protein, 21 aa, Mycobacterium
AHPAMKALVVCIELCSVNAVF

SEQ ID NO: 632135 - protein, 18 aa, Mycobacterium
AHPARRGARVLGVDGTYS

SEQ ID NO: 632136 - protein, 19 aa, Mycobacterium
AHPASWRLLAGSVTLPDPQ

SEQ ID NO: 632137 - protein, 30 aa, Mycobacterium
AHPAVSWVRYPYLPSHPQYDLARRQMSGGG

SEQ ID NO: 632138 - protein, 27 aa, Mycobacterium
AHPAWDAVCFRLGLLSTLEARAVLNGI

SEQ ID NO: 632139 - protein, 17 aa, Mycobacterium
AHPDAIAAFAAQGVTAP

SEQ ID NO: 632140 - protein, 21 aa, Mycobacterium
AHPDLLISVDTWRAEVAAKAC

SEQ ID NO: 632141 - protein, 23 aa, Mycobacterium
AHPDSRVDFVLGDAAPIVAVTTA

SEQ ID NO: 632142 - protein, 32 aa, Mycobacterium
AHPDVAGPYAWWSWRGKAFDNDAGWRIDYHLA

SEQ ID NO: 632143 - protein, 28 aa, Mycobacterium
AHPEAALADLCFTAGVGRAHLEHRAALV

SEQ ID NO: 632144 - protein, 24 aa, Mycobacterium
AHPEEPHWYLAVIGSDPGVRGRGF

SEQ ID NO: 632145 - protein, 21 aa, Mycobacterium
AHPEHGYMGIAPGSYEIRRQR

SEQ ID NO: 632146 - protein, 26 aa, Mycobacterium
AHPELLSGPVVTRFELQVSPERRRAV

SEQ ID NO: 632147 - protein, 22 aa, Mycobacterium
AHPEVLSCLAVGIPHTDLGQVP

SEQ ID NO: 632148 - protein, 17 aa, Mycobacterium
AHPFRRNTPELSRRDAI

SEQ ID NO: 632149 - protein, 24 aa, Mycobacterium
AHPGMPRMINMYGITETTVHASFR

SEQ ID NO: 632150 - protein, 18 aa, Mycobacterium
AHPGRPDVLTAWMDAAVV

SEQ ID NO: 632151 - protein, 23 aa, Mycobacterium
AHPGRPDVLTAWMDAAVVDENDP

SEQ ID NO: 632152 - protein, 18 aa, Mycobacterium
AHPGRPDVLTAWMDASVV

SEQ ID NO: 632153 - protein, 18 aa, Mycobacterium
AHPGRPEVLTAWMDAAVV

SEQ ID NO: 632154 - protein, 19 aa, Mycobacterium
AHPGVGYRAFDLMEAGPDR

SEQ ID NO: 632155 - protein, 19 aa, Mycobacterium
AHPGWPMLLGKLRVPAGVV

SEQ ID NO: 632156 - protein, 20 aa, Mycobacterium
AHPKAVGKFPSFESIEDAAD

SEQ ID NO: 632157 - protein, 24 aa, Mycobacterium
AHPKVVDVMHGFKVAQRVEEAGAV

SEQ ID NO: 632158 - protein, 18 aa, Mycobacterium
AHPLLARLGAPGGALRAS

SEQ ID NO: 632159 - protein, 23 aa, Mycobacterium
AHPLSYGQRSLWFLYQLAPDNPA

SEQ ID NO: 632160 - protein, 20 aa, Mycobacterium
AHPLVRRIGFIGSPGTGRHI

SEQ ID NO: 632161 - protein, 19 aa, Mycobacterium
AHPMGCKRLVFSSDYLPAL

SEQ ID NO: 632162 - protein, 17 aa, Mycobacterium
AHPQSQYFVVGRLAQDQ

SEQ ID NO: 632163 - protein, 26 aa, Mycobacterium
AHPQSWRLLHGDVRLPSARELRETFD

SEQ ID NO: 632164 - protein, 21 aa, Mycobacterium
AHPRAGALELSRNLHVARATV

SEQ ID NO: 632165 - protein, 23 aa, Mycobacterium
AHPRPLSPPPIWIGGNTRAARRR

SEQ ID NO: 632166 - protein, 23 aa, Mycobacterium
AHPRPVNPPPIWIGGNTAAARAR

SEQ ID NO: 632167 - protein, 21 aa, Mycobacterium
AHPRVFPSDHFGLRCVLVRNT

SEQ ID NO: 632168 - protein, 19 aa, Mycobacterium
AHPSDWLQPGTVMLTTGLL

SEQ ID NO: 632169 - protein, 19 aa, Mycobacterium
AHPSLPRGALLQVALGERP

SEQ ID NO: 632170 - protein, 21 aa, Mycobacterium
AHPTIEHFAPLFVALGASDDP

SEQ ID NO: 632171 - protein, 27 aa, Mycobacterium
AHQAALDWLNFVAFRGRELAPDGRLVV

SEQ ID NO: 632172 - protein, 20 aa, Mycobacterium
AHQAQYIWLACRTDPSAPKH

SEQ ID NO: 632173 - protein, 28 aa, Mycobacterium
AHQDRRGLVPGSARNAARWLAEAAEQLR

SEQ ID NO: 632174 - protein, 26 aa, Mycobacterium
AHQIPRAGNMLSVFFSDTPITDFGSA

SEQ ID NO: 632175 - protein, 26 aa, Mycobacterium
AHQIPRAGNMLSVFFSETPVTDFAAA

SEQ ID NO: 632176 - protein, 23 aa, Mycobacterium
AHQLKLGLYPSREDWAEARTAAG

SEQ ID NO: 632177 - protein, 26 aa, Mycobacterium
AHQLSRAGNMLSVFFSDPPVTDFASA

SEQ ID NO: 632178 - protein, 20 aa, Mycobacterium
AHQRVNLDWLVRESNPDRRH

SEQ ID NO: 632179 - protein, 25 aa, Mycobacterium
AHQSWPTVADWVRWISSDGDKPANI

SEQ ID NO: 632180 - protein, 26 aa, Mycobacterium
AHQVQRAGNMLSVFFTDAPVHDFAAA

SEQ ID NO: 632181 - protein, 19 aa, Mycobacterium
AHRAAIEFDPPLPPQYLEL

SEQ ID NO: 632182 - protein, 17 aa, Mycobacterium
AHRAAMSPRHFTRVFTG

SEQ ID NO: 632183 - protein, 18 aa, Mycobacterium
AHRADAIVLAGSRQSGDL

SEQ ID NO: 632184 - protein, 22 aa, Mycobacterium
AHRCAREGADLVLAARSADRLD

SEQ ID NO: 632185 - protein, 19 aa, Mycobacterium
AHRDMLAADVIVIADSDNW

SEQ ID NO: 632186 - protein, 24 aa, Mycobacterium
AHREGFGLAALRDWLRTQRSERGG

SEQ ID NO: 632187 - protein, 25 aa, Mycobacterium
AHREQYSLPALRDWLRAQRDDRGGL

SEQ ID NO: 632188 - protein, 24 aa, Mycobacterium
AHRILRHRLILGFEAVAENVTAEV

SEQ ID NO: 632189 - protein, 26 aa, Mycobacterium
AHRKGLAAFRRAGGRIVETVPPTTDL

SEQ ID NO: 632190 - protein, 29 aa, Mycobacterium
AHRLALLWPEMYPRLLRIMDADPIYQDRI

SEQ ID NO: 632191 - protein, 17 aa, Mycobacterium
AHRLGAVGDGWRVAMTT

SEQ ID NO: 632192 - protein, 20 aa, Mycobacterium
AHRLPWPAGTKVFELDQPQV

SEQ ID NO: 632193 - protein, 19 aa, Mycobacterium
AHRMFRREFGLAVDVVRGV

SEQ ID NO: 632194 - protein, 35 aa, Mycobacterium
AHRPKKCVFETLYLGHPRTRFHGETHWETRRKIGF

SEQ ID NO: 632195 - protein, 18 aa, Mycobacterium
AHRQSLAASASWAANGKI

SEQ ID NO: 632196 - protein, 21 aa, Mycobacterium
AHRRGIRIITDLVMNHTSDQH

SEQ ID NO: 632197 - protein, 21 aa, Mycobacterium
AHRRIAITGVNEFPNLDEPPL

SEQ ID NO: 632198 - protein, 26 aa, Mycobacterium
AHRRIPIITVINKWDRPGRHALELMD

SEQ ID NO: 632199 - protein, 21 aa, Mycobacterium
AHRRLAITGVNEFPNLDEPPL

SEQ ID NO: 632200 - protein, 21 aa, Mycobacterium
AHRRVQRVWAAIRTEVLGGQY

SEQ ID NO: 632201 - protein, 17 aa, Mycobacterium
AHRSGGIGVDLGGLDHH

SEQ ID NO: 632202 - protein, 19 aa, Mycobacterium
AHRYFLAAKEIEFALGGAT

SEQ ID NO: 632203 - protein, 18 aa, Mycobacterium
AHRYRIGTNYAQLPPNAP

SEQ ID NO: 632204 - protein, 19 aa, Mycobacterium
AHSATVDWLTTVLAEDALG

SEQ ID NO: 632205 - protein, 19 aa, Mycobacterium
AHSAVLLLFGAANRDPLRY

SEQ ID NO: 632206 - protein, 26 aa, Mycobacterium
AHSCLGSWLARLETRVALHAIRERWP

SEQ ID NO: 632207 - protein, 25 aa, Mycobacterium
AHSDFAHPRFRAMRDATPELAWGLM

SEQ ID NO: 632208 - protein, 20 aa, Mycobacterium
AHSFAFPAINCVGSESINAA

SEQ ID NO: 632209 - protein, 30 aa, Mycobacterium
AHSFGRIASYISEFIPLSAGDMILSGTPAG

SEQ ID NO: 632210 - protein, 17 aa, Mycobacterium
AHSGKWRAALSPTEDQP

SEQ ID NO: 632211 - protein, 26 aa, Mycobacterium
AHSGLTRAVLRGGDYVGVHAIGDLGA

SEQ ID NO: 632212 - protein, 24 aa, Mycobacterium
AHSGRLRVAGTFYSLGAQLLYEVT

SEQ ID NO: 632213 - protein, 19 aa, Mycobacterium
AHSGWWDHIAPFFTRTHRV

SEQ ID NO: 632214 - protein, 18 aa, Mycobacterium
AHSGWWDHIAPLLSSTHR

SEQ ID NO: 632215 - protein, 20 aa, Mycobacterium
AHSIGRSCVPLLEAAAANNK

SEQ ID NO: 632216 - protein, 20 aa, Mycobacterium
AHSLPGVPRDGVVGHGLNSV

SEQ ID NO: 632217 - protein, 24 aa, Mycobacterium
AHSLPRSPGVYLFRGPSAEVLYVG

SEQ ID NO: 632218 - protein, 22 aa, Mycobacterium
AHSLRELISRTGVDSAQVDDVI

SEQ ID NO: 632219 - protein, 23 aa, Mycobacterium
AHSLRELVARTGVDPAQVDDVIA

SEQ ID NO: 632220 - protein, 23 aa, Mycobacterium
AHSLRELVGRTGVDPAEVDDVIA

SEQ ID NO: 632221 - protein, 23 aa, Mycobacterium
AHSLRELVTRTGVDPAQVDDVIA

SEQ ID NO: 632222 - protein, 24 aa, Mycobacterium
AHSPARLRSELTWIEQQTGGKPYG

SEQ ID NO: 632223 - protein, 24 aa, Mycobacterium
AHSPKRLDSELTWIEEQTGGKPYG

SEQ ID NO: 632224 - protein, 24 aa, Mycobacterium
AHSPKRLESELTWIEEQTRGKPYG

SEQ ID NO: 632225 - protein, 17 aa, Mycobacterium
AHSRAVYITAQRRRNAA

SEQ ID NO: 632226 - protein, 23 aa, Mycobacterium
AHSRPDALVPMPSLPTTAVGKID

SEQ ID NO: 632227 - protein, 19 aa, Mycobacterium
AHSSVAWNSARREAQFRRA

SEQ ID NO: 632228 - protein, 24 aa, Mycobacterium
AHSTLAYLGLRLGYRSIAEAVHDS

SEQ ID NO: 632229 - protein, 18 aa, Mycobacterium
AHSTVALSVGGLRTNFET

SEQ ID NO: 632230 - protein, 20 aa, Mycobacterium
AHSTVAMIVGMVALRSTFFG

SEQ ID NO: 632231 - protein, 18 aa, Mycobacterium
AHTADFGALLARTDPDAA

SEQ ID NO: 632232 - protein, 18 aa, Mycobacterium
AHTAFPMDRVIAQELAIF

SEQ ID NO: 632233 - protein, 34 aa, Mycobacterium
AHTEFPYVFCDATFCKARIGAHVVSQALVVATGV

SEQ ID NO: 632234 - protein, 25 aa, Mycobacterium
AHTERLRIGHLVLCDAFRHPAVLAK

SEQ ID NO: 632235 - protein, 24 aa, Mycobacterium
AHTGDGIDVLWRKLAELAAPTDTA

SEQ ID NO: 632236 - protein, 17 aa, Mycobacterium
AHTGIGFRGWVAAADGW

SEQ ID NO: 632237 - protein, 19 aa, Mycobacterium
AHTGKAALYRRWANKHDLV

SEQ ID NO: 632238 - protein, 19 aa, Mycobacterium
AHTGKAALYRRWATKCELV

SEQ ID NO: 632239 - protein, 30 aa, Mycobacterium
AHTGTPWRVGFCGFAPGFAYLVDGDARLQV

SEQ ID NO: 632240 - protein, 18 aa, Mycobacterium
AHTIRLMAGHELVTEGFA

SEQ ID NO: 632241 - protein, 19 aa, Mycobacterium
AHTIRLMAGHELVTEGFAP

SEQ ID NO: 632242 - protein, 20 aa, Mycobacterium
AHTIRLMAGHELVTEGFAPG

SEQ ID NO: 632243 - protein, 23 aa, Mycobacterium
AHTIRPAFEVIRTTSGVSTVSSI

SEQ ID NO: 632244 - protein, 21 aa, Mycobacterium
AHTPGGEGFWVLSRHADIVAA

SEQ ID NO: 632245 - protein, 24 aa, Mycobacterium
AHTREMIKTGGFDAVCFTSSSTVR

SEQ ID NO: 632246 - protein, 18 aa, Mycobacterium
AHTRRIRLATAVLVLSYH

SEQ ID NO: 632247 - protein, 20 aa, Mycobacterium
AHTSELLDWLDKMTKRNLVI

SEQ ID NO: 632248 - protein, 20 aa, Mycobacterium
AHTSEVLRELGFDSEAENEL

SEQ ID NO: 632249 - protein, 23 aa, Mycobacterium
AHTVRPAFEIIKTLPDVSTVSSI

SEQ ID NO: 632250 - protein, 17 aa, Mycobacterium
AHTWLRGLLIESFARLP

SEQ ID NO: 632251 - protein, 21 aa, Mycobacterium
AHVDGVPCCTHIGPDGSGHFV

SEQ ID NO: 632252 - protein, 18 aa, Mycobacterium
AHVDWTWGAVAALGLADI

SEQ ID NO: 632253 - protein, 24 aa, Mycobacterium
AHVIPIMRARLLKLLSGPNAAVKA

SEQ ID NO: 632254 - protein, 20 aa, Mycobacterium
AHVLGGSVFAVFPVGGSHGA

SEQ ID NO: 632255 - protein, 17 aa, Mycobacterium
AHVLLHFGSDEQKRMLL

SEQ ID NO: 632256 - protein, 19 aa, Mycobacterium
AHVNLGLAIDLPGKDGNRT

SEQ ID NO: 632257 - protein, 19 aa, Mycobacterium
AHVPIVFVCSNRATREAIT

SEQ ID NO: 632258 - protein, 18 aa, Mycobacterium
AHVPLVLNADGARLAKRD

SEQ ID NO: 632259 - protein, 22 aa, Mycobacterium
AHVPQCPRRWRYLSPAIPADPG

SEQ ID NO: 632260 - protein, 21 aa, Mycobacterium
AHVRTGRWASIVPQPWIHTLG

SEQ ID NO: 632261 - protein, 18 aa, Mycobacterium
AHVSCIGVGPGREQTIVR

SEQ ID NO: 632262 - protein, 18 aa, Mycobacterium
AHVTFFYHHLMVVTERLH

SEQ ID NO: 632263 - protein, 24 aa, Mycobacterium
AHVVDVKRAIAWVRENIAAYGGNP

SEQ ID NO: 632264 - protein, 32 aa, Mycobacterium
AHVVLKIRSSVWLGEDGWVIDRFLGGNAPLVL

SEQ ID NO: 632265 - protein, 17 aa, Mycobacterium
AHWAELGVTEVLFGLPD

SEQ ID NO: 632266 - protein, 24 aa, Mycobacterium
AHWARRTGDPLARRITDETARFLL

SEQ ID NO: 632267 - protein, 20 aa, Mycobacterium
AHWKAHKLDLAPVLHEPESA

SEQ ID NO: 632268 - protein, 21 aa, Mycobacterium
AHYAERLEALYAELADKQADE

SEQ ID NO: 632269 - protein, 20 aa, Mycobacterium
AHYDARFVIVTTGPINDALA

SEQ ID NO: 632270 - protein, 18 aa, Mycobacterium
AHYDGIVAFSQTDFTEDL

SEQ ID NO: 632271 - protein, 25 aa, Mycobacterium
AHYDKIHLYDAFGFTESRTVAPGHE

SEQ ID NO: 632272 - protein, 21 aa, Mycobacterium
AHYGPRLEQMYAEIAEQQAAE

SEQ ID NO: 632273 - protein, 25 aa, Mycobacterium
AHYHKIHLYDAFGFTESRTVAPGHE

SEQ ID NO: 632274 - protein, 17 aa, Mycobacterium
AHYKCPKSIAFEAQLPR

SEQ ID NO: 632275 - protein, 25 aa, Mycobacterium
AHYPGDVFAGFGIGATIAILGARIV

SEQ ID NO: 632276 - protein, 24 aa, Mycobacterium
AHYPGDVLAGFGLGAGIAVLGARI

SEQ ID NO: 632277 - protein, 24 aa, Mycobacterium
AHYPGDVVAGFGIGAGLAVLGGRL

SEQ ID NO: 632278 - protein, 26 aa, Mycobacterium
AHYPKIVLVTGACRFLGGYLTARLAQ

SEQ ID NO: 632279 - protein, 19 aa, Mycobacterium
AHYRREWVPSPGMGLSGIW

SEQ ID NO: 632280 - protein, 20 aa, Mycobacterium
AIAAAGRRTGNPPWVMAPMI

SEQ ID NO: 632281 - protein, 20 aa, Mycobacterium
AIAAARRARRTITLAGPISD

SEQ ID NO: 632282 - protein, 29 aa, Mycobacterium
AIAADRTRAGGGVCAIAAITGASTGPTIA

SEQ ID NO: 632283 - protein, 20 aa, Mycobacterium
AIAAEIGRLLGASWTDEHGR

SEQ ID NO: 632284 - protein, 21 aa, Mycobacterium
AIAAELKRSGVRANVICPGAR

SEQ ID NO: 632285 - protein, 31 aa, Mycobacterium
AIAAGHCFVIFLREGFPVSVLNPVKAVPEVC

SEQ ID NO: 632286 - protein, 19 aa, Mycobacterium
AIAAIGAGCKICDRPSCPQ

SEQ ID NO: 632287 - protein, 18 aa, Mycobacterium
AIAAIKAIFAAWENQGRL

SEQ ID NO: 632288 - protein, 27 aa, Mycobacterium
AIAAKQDWAALPFDQRAAVFLRAADLL

SEQ ID NO: 632289 - protein, 17 aa, Mycobacterium
AIAALEFAFHRVLNQSS

SEQ ID NO: 632290 - protein, 19 aa, Mycobacterium
AIAALLTHIGVYRCDYPGL

SEQ ID NO: 632291 - protein, 18 aa, Mycobacterium
AIAALNLDRLPHHIVGKR

SEQ ID NO: 632292 - protein, 21 aa, Mycobacterium
AIAASEGRPAATAGSAVADQP

SEQ ID NO: 632293 - protein, 27 aa, Mycobacterium
AIAAVEARYGEMWAQDAAAMYGYAAAS

SEQ ID NO: 632294 - protein, 19 aa, Mycobacterium
AIAAVVWEALGRAGFSGGK

SEQ ID NO: 632295 - protein, 18 aa, Mycobacterium
AIAAWLWSGKEAVVAGTS

SEQ ID NO: 632296 - protein, 18 aa, Mycobacterium
AIAAYAMDCCGLTATRQG

SEQ ID NO: 632297 - protein, 19 aa, Mycobacterium
AIADAGLAFRVEDTVHLSI

SEQ ID NO: 632298 - protein, 17 aa, Mycobacterium
AIADAIAAFRVGRHRAE

SEQ ID NO: 632299 - protein, 17 aa, Mycobacterium
AIADGFFEREITPVTLA

SEQ ID NO: 632300 - protein, 24 aa, Mycobacterium
AIAEALIGTMLFRALTHGGATDFA

SEQ ID NO: 632301 - protein, 24 aa, Mycobacterium
AIAEALKYLAVHAGYTRVHNPTTG

SEQ ID NO: 632302 - protein, 33 aa, Mycobacterium
AIAECAVPVIGCIHGYCVGLGVLLAGTCDVLIG

SEQ ID NO: 632303 - protein, 25 aa, Mycobacterium
AIAEHLCATLGPRFTPPKLLRAKVA

SEQ ID NO: 632304 - protein, 22 aa, Mycobacterium
AIAEHLDELLVWDRAVRADAED

SEQ ID NO: 632305 - protein, 22 aa, Mycobacterium
AIAERRPDVVFIASPNNPSGQS

SEQ ID NO: 632306 - protein, 25 aa, Mycobacterium
AIAFSPRPVPTVSIGHLHQVSVSVP

SEQ ID NO: 632307 - protein, 27 aa, Mycobacterium
AIAGGLFVHVPMMFSDYEAVTPEENIT

SEQ ID NO: 632308 - protein, 17 aa, Mycobacterium
AIAGRRVQLEIFTKFSI

SEQ ID NO: 632309 - protein, 23 aa, Mycobacterium
AIAGRVAFALGLEGPAVAVDTAC

SEQ ID NO: 632310 - protein, 29 aa, Mycobacterium
AIAGSGRWVPEFLSLPIAIENSLKNQTYN

SEQ ID NO: 632311 - protein, 18 aa, Mycobacterium
AIAKAGAVYLPIDPEYPP

SEQ ID NO: 632312 - protein, 18 aa, Mycobacterium
AIAKEINVQFVLAYTPDE

SEQ ID NO: 632313 - protein, 27 aa, Mycobacterium
AIAKFLQKRGPGIQQFACRVADLDALS

SEQ ID NO: 632314 - protein, 17 aa, Mycobacterium
AIAKLGFGYDDVAAINP

SEQ ID NO: 632315 - protein, 20 aa, Mycobacterium
AIAKPMMKKAGVDRLDALYT

SEQ ID NO: 632316 - protein, 23 aa, Mycobacterium
AIAKSCAPAGITVADVTLDTSGP

SEQ ID NO: 632317 - protein, 23 aa, Mycobacterium
AIALRAAEYGRTVVVLTIDPAKR

SEQ ID NO: 632318 - protein, 17 aa, Mycobacterium
AIANRLGGDFRFQHLPV

SEQ ID NO: 632319 - protein, 18 aa, Mycobacterium
AIAPIPLLSSIGMAAGVL

SEQ ID NO: 632320 - protein, 37 aa, Mycobacterium
AIAPLWKGSRFPIGSCISGWAMLNRDAAVIPDIYGDP

SEQ ID NO: 632321 - protein, 21 aa, Mycobacterium
AIAQRGRPGLDRLLDRVHTLV

SEQ ID NO: 632322 - protein, 26 aa, Mycobacterium
AIAQYWPGFRELRTTIGRERGWPAPR

SEQ ID NO: 632323 - protein, 17 aa, Mycobacterium
AIARAEAALAHQNSVSS

SEQ ID NO: 632324 - protein, 28 aa, Mycobacterium
AIARAHDQFRWFAGGWAVNADLPTPAGF

SEQ ID NO: 632325 - protein, 25 aa, Mycobacterium
AIARFKRLDGYDVRYLTGTDVHGQK

SEQ ID NO: 632326 - protein, 25 aa, Mycobacterium
AIARGDASAGWCVSIAITSALLVAY

SEQ ID NO: 632327 - protein, 32 aa, Mycobacterium
AIARPDRTFSLGSWWSGVAWSTIKVPLAVAAL

SEQ ID NO: 632328 - protein, 31 aa, Mycobacterium
AIARPDRTYSLGRWWSGVAWSTIKVPLAIAA

SEQ ID NO: 632329 - protein, 18 aa, Mycobacterium
AIARQFHLSRQWWSYLAD

SEQ ID NO: 632330 - protein, 17 aa, Mycobacterium
AIARRLGGLGATVREVV

SEQ ID NO: 632331 - protein, 20 aa, Mycobacterium
AIARWVRQANIRWGFDQEHR

SEQ ID NO: 632332 - protein, 26 aa, Mycobacterium
AIARYCLGRPGWRDDVHQAVQTAGAT

SEQ ID NO: 632333 - protein, 20 aa, Mycobacterium
AIASCPPGHVEVLANYTAFL

SEQ ID NO: 632334 - protein, 21 aa, Mycobacterium
AIASFARLWVADAHWRAAERV

SEQ ID NO: 632335 - protein, 21 aa, Mycobacterium
AIASFARLWVEDAHWQAAERV

SEQ ID NO: 632336 - protein, 22 aa, Mycobacterium
AIASGCRNVRFVVSASDGHSHA

SEQ ID NO: 632337 - protein, 27 aa, Mycobacterium
AIASGPSMVRWARANGWSAPPGAGARD

SEQ ID NO: 632338 - protein, 20 aa, Mycobacterium
AIASLSRYGYGWVDSDVAGA

SEQ ID NO: 632339 - protein, 19 aa, Mycobacterium
AIATARLAAIMAAKRTSEL

SEQ ID NO: 632340 - protein, 17 aa, Mycobacterium
AIATDFATAGAKVTVTG

SEQ ID NO: 632341 - protein, 19 aa, Mycobacterium
AIATEIARLIGSDWTDESG

SEQ ID NO: 632342 - protein, 18 aa, Mycobacterium
AIATLGAAAADGFSTYHV

SEQ ID NO: 632343 - protein, 20 aa, Mycobacterium
AIATRYGGPIAVHPTAGHDI

SEQ ID NO: 632344 - protein, 25 aa, Mycobacterium
AIATTLAERGWRVVATDVDVAAADE

SEQ ID NO: 632345 - protein, 18 aa, Mycobacterium
AIAVAPAVTTRAASTTFA

SEQ ID NO: 632346 - protein, 20 aa, Mycobacterium
AIAVAQRGATVFALARNADA

SEQ ID NO: 632347 - protein, 18 aa, Mycobacterium
AIAVLRVSDRWQDLEPGG

SEQ ID NO: 632348 - protein, 20 aa, Mycobacterium
AIAVPWQFGPVIETRKNVGD

SEQ ID NO: 632349 - protein, 26 aa, Mycobacterium
AIAYMLEILPALGFLHSVGLTYNDLK

SEQ ID NO: 632350 - protein, 28 aa, Mycobacterium
AICAEPRLAGLGGRFWFSLDDGRGDVSG

SEQ ID NO: 632351 - protein, 19 aa, Mycobacterium
AICAGLAADGHRVAVLDLD

SEQ ID NO: 632352 - protein, 23 aa, Mycobacterium
AICARFALDDTRPFHGAEVSLRW

SEQ ID NO: 632353 - protein, 17 aa, Mycobacterium
AICATAFERGVLMETSG

SEQ ID NO: 632354 - protein, 19 aa, Mycobacterium
AICDGGFVLDVRYAPTRLR

SEQ ID NO: 632355 - protein, 18 aa, Mycobacterium
AICLAMAGARATGKSLYM

SEQ ID NO: 632356 - protein, 18 aa, Mycobacterium
AICLLEPATGVIVAEHEL

SEQ ID NO: 632357 - protein, 20 aa, Mycobacterium
AICRRLGVPATRTIGHKEYA

SEQ ID NO: 632358 - protein, 25 aa, Mycobacterium
AICSARTAAQFGIEPRVAMLSYSTG

SEQ ID NO: 632359 - protein, 21 aa, Mycobacterium
AICVLCGDTVCSECGRDPQVH

SEQ ID NO: 632360 - protein, 19 aa, Mycobacterium
AIDAERWLAEHAEPGERTS

SEQ ID NO: 632361 - protein, 17 aa, Mycobacterium
AIDAERWLAEHAESSTP

SEQ ID NO: 632362 - protein, 18 aa, Mycobacterium
AIDAERWLAEHAESSTPA

SEQ ID NO: 632363 - protein, 18 aa, Mycobacterium
AIDAHLLGSVAVVDGARL

SEQ ID NO: 632364 - protein, 19 aa, Mycobacterium
AIDCVRRGGTLSVIGVYGG

SEQ ID NO: 632365 - protein, 19 aa, Mycobacterium
AIDDAFAAFEWAHAHAAEL

SEQ ID NO: 632366 - protein, 19 aa, Mycobacterium
AIDDARLVLFDGMGHDLPE

SEQ ID NO: 632367 - protein, 23 aa, Mycobacterium
AIDDFPLSRVLKTESLDLDYLSD

SEQ ID NO: 632368 - protein, 18 aa, Mycobacterium
AIDDRLAGNGGNGGTGGD

SEQ ID NO: 632369 - protein, 27 aa, Mycobacterium
AIDELCAAGYGFSCLVVDTIFSSDGIY

SEQ ID NO: 632370 - protein, 17 aa, Mycobacterium
AIDEVYALITTVEPARV

SEQ ID NO: 632371 - protein, 21 aa, Mycobacterium
AIDGARLVLFDGMGHDLPQQL

SEQ ID NO: 632372 - protein, 26 aa, Mycobacterium
AIDGHVRAGGFGLVGACDIVVAGPRS

SEQ ID NO: 632373 - protein, 25 aa, Mycobacterium
AIDGHVRAGGLGLVGACDIVVAGRA

SEQ ID NO: 632374 - protein, 20 aa, Mycobacterium
AIDGIELFDATFFGYPPAEA

SEQ ID NO: 632375 - protein, 19 aa, Mycobacterium
AIDGPGYYFKPTILADVAE

SEQ ID NO: 632376 - protein, 17 aa, Mycobacterium
AIDICYPAPGAESVCTT

SEQ ID NO: 632377 - protein, 19 aa, Mycobacterium
AIDLRDDWASALQAAGFDP

SEQ ID NO: 632378 - protein, 23 aa, Mycobacterium
AIDLREDWPTALRDAGFDPSVPT

SEQ ID NO: 632379 - protein, 18 aa, Mycobacterium
AIDLSCRLSIVASSDAFP

SEQ ID NO: 632380 - protein, 26 aa, Mycobacterium
AIDMLRGGFELAYRLLSYPKPVVMAC

SEQ ID NO: 632381 - protein, 27 aa, Mycobacterium
AIDPLLPEVAWSWLVEALESRTEHMTA

SEQ ID NO: 632382 - protein, 19 aa, Mycobacterium
AIDPVLLDLLRLGAYQLLR

SEQ ID NO: 632383 - protein, 24 aa, Mycobacterium
AIDQRFAYVDGIQRIPRALARLEV

SEQ ID NO: 632384 - protein, 22 aa, Mycobacterium
AIDQWAFCALSTSPGARAFYDQ

SEQ ID NO: 632385 - protein, 19 aa, Mycobacterium
AIDRDICDPYSLYDALATE

SEQ ID NO: 632386 - protein, 23 aa, Mycobacterium
AIDRFEREAGEPHGRPRAKVASL

SEQ ID NO: 632387 - protein, 19 aa, Mycobacterium
AIDRIARAKALVEATDDAT

SEQ ID NO: 632388 - protein, 18 aa, Mycobacterium
AIDRICSETLELLLRPTG

SEQ ID NO: 632389 - protein, 21 aa, Mycobacterium
AIDSDRRWVVLSADDVTLDSQ

SEQ ID NO: 632390 - protein, 22 aa, Mycobacterium
AIDSGDEWVVLRAEQLEIEPVR

SEQ ID NO: 632391 - protein, 19 aa, Mycobacterium
AIDSGEEWVVVRAEELEIE

SEQ ID NO: 632392 - protein, 18 aa, Mycobacterium
AIDSGWRQLDVVDETGST

SEQ ID NO: 632393 - protein, 25 aa, Mycobacterium
AIDTIKFSVAAARTLGSESVPLDAT

SEQ ID NO: 632394 - protein, 19 aa, Mycobacterium
AIDVCGPIENLAYPHSTPE

SEQ ID NO: 632395 - protein, 18 aa, Mycobacterium
AIDWARSSGGLILEDDYD

SEQ ID NO: 632396 - protein, 18 aa, Mycobacterium
AIDYLRSRLSDIANTGNK

SEQ ID NO: 632397 - protein, 17 aa, Mycobacterium
AIEAALEKPGLRLPQVI

SEQ ID NO: 632398 - protein, 23 aa, Mycobacterium
AIEAAWRTAMWGKPAGHGINDPN

SEQ ID NO: 632399 - protein, 19 aa, Mycobacterium
AIEACARALFVHPNTVRYR

SEQ ID NO: 632400 - protein, 18 aa, Mycobacterium
AIEACARKLFVHPNTVRY

SEQ ID NO: 632401 - protein, 23 aa, Mycobacterium
AIEAEMLYALAILEASEGEYKTD

SEQ ID NO: 632402 - protein, 19 aa, Mycobacterium
AIEAEVPIVPVIVWGAHRI

SEQ ID NO: 632403 - protein, 17 aa, Mycobacterium
AIEAGFDAVEIHLGHGY

SEQ ID NO: 632404 - protein, 17 aa, Mycobacterium
AIEAGFDAVEIHLGHNY

SEQ ID NO: 632405 - protein, 19 aa, Mycobacterium
AIEAGRKAIANALLTGAEI

SEQ ID NO: 632406 - protein, 24 aa, Mycobacterium
AIEAPGQILLPGFVDLHTHLREPG

SEQ ID NO: 632407 - protein, 21 aa, Mycobacterium
AIEAVEFGVRINAVSPSIARH

SEQ ID NO: 632408 - protein, 23 aa, Mycobacterium
AIEDCRHLSARLERDLLSADQKV

SEQ ID NO: 632409 - protein, 26 aa, Mycobacterium
AIEDPRVAGLIARVQIPPAAAGAVQE

SEQ ID NO: 632410 - protein, 27 aa, Mycobacterium
AIEELMAGSGLRVGRLTLDILGAIPVA

SEQ ID NO: 632411 - protein, 23 aa, Mycobacterium
AIEEMLRWTAPVKNMCRMLTADT

SEQ ID NO: 632412 - protein, 19 aa, Mycobacterium
AIEIGIKHLTVYAFSTENW

SEQ ID NO: 632413 - protein, 25 aa, Mycobacterium
AIEIGIKWLSLYAFSTENWKRSPEE

SEQ ID NO: 632414 - protein, 18 aa, Mycobacterium
AIEIMRMRLTRAAFQRAI

SEQ ID NO: 632415 - protein, 19 aa, Mycobacterium
AIELAEHGIDVLVVGKRPK

SEQ ID NO: 632416 - protein, 17 aa, Mycobacterium
AIELLREVGPLAVSSAN

SEQ ID NO: 632417 - protein, 17 aa, Mycobacterium
AIELLRQVGPMAVSSAN

SEQ ID NO: 632418 - protein, 20 aa, Mycobacterium
AIELPSWAFGNSGTRFKVFG

SEQ ID NO: 632419 - protein, 29 aa, Mycobacterium
AIELQRRGCSIARLILLDALLTVPNSDVL

SEQ ID NO: 632420 - protein, 17 aa, Mycobacterium
AIELSALGALRLIQGFT

SEQ ID NO: 632421 - protein, 18 aa, Mycobacterium
AIEMGGFIDMHVDLIKGG

SEQ ID NO: 632422 - protein, 17 aa, Mycobacterium
AIEMGGFIDVHVDVIKG

SEQ ID NO: 632423 - protein, 20 aa, Mycobacterium
AIEPETEFYLGLVHAEDGAA

SEQ ID NO: 632424 - protein, 19 aa, Mycobacterium
AIEPGRHGALFSFLAGGKR

SEQ ID NO: 632425 - protein, 22 aa, Mycobacterium
AIEQAKGVLMFVYRVSAEQAFR

SEQ ID NO: 632426 - protein, 27 aa, Mycobacterium
AIEQAVAAPLCSRHLADLGADVIKIER

SEQ ID NO: 632427 - protein, 22 aa, Mycobacterium
AIEQFLYREARYLDDREFEKWL

SEQ ID NO: 632428 - protein, 25 aa, Mycobacterium
AIERADMGITGWVALTIAQAGTDEQ

SEQ ID NO: 632429 - protein, 19 aa, Mycobacterium
AIERGMKLIVIDPRRSQTA

SEQ ID NO: 632430 - protein, 18 aa, Mycobacterium
AIERIWQAARHWYRAGMH

SEQ ID NO: 632431 - protein, 19 aa, Mycobacterium
AIERLTFDEAAGLQWGLVV

SEQ ID NO: 632432 - protein, 24 aa, Mycobacterium
AIERPPEDWLFKARTGDTLVDVLH

SEQ ID NO: 632433 - protein, 19 aa, Mycobacterium
AIERRGSGISGVDVLAVPA

SEQ ID NO: 632434 - protein, 19 aa, Mycobacterium
AIERRGTGISAIDVLAVPA

SEQ ID NO: 632435 - protein, 23 aa, Mycobacterium
AIESIKQLKARYCRYLDTKDWAA

SEQ ID NO: 632436 - protein, 17 aa, Mycobacterium
AIEVLLWSGDLFERAAT

SEQ ID NO: 632437 - protein, 25 aa, Mycobacterium
AIEWLDSKHSFSFGSHYDPDNTHHG

SEQ ID NO: 632438 - protein, 17 aa, Mycobacterium
AIFAYWVANPSAYGVVD

SEQ ID NO: 632439 - protein, 24 aa, Mycobacterium
AIFEARSALELGALELTMGRLSSA

SEQ ID NO: 632440 - protein, 19 aa, Mycobacterium
AIFQLKAPLERDGGFRHRI

SEQ ID NO: 632441 - protein, 23 aa, Mycobacterium
AIGAKSWPLVLATRLGISSKEAR

SEQ ID NO: 632442 - protein, 24 aa, Mycobacterium
AIGARADLLAAVRLPSGYFGGVGT

SEQ ID NO: 632443 - protein, 17 aa, Mycobacterium
AIGAYWGAAMHRGGAEV

SEQ ID NO: 632444 - protein, 23 aa, Mycobacterium
AIGDLPLIYPFLVNDPGEGTQAK

SEQ ID NO: 632445 - protein, 17 aa, Mycobacterium
AIGEVLLADVLIVRGQL

SEQ ID NO: 632446 - protein, 17 aa, Mycobacterium
AIGEVLLGHVMLTKGEF

SEQ ID NO: 632447 - protein, 23 aa, Mycobacterium
AIGEVYYRLGGTYTGKIMNLSQF

SEQ ID NO: 632448 - protein, 24 aa, Mycobacterium
AIGFPRGVLLYAERRVIDTVGGMD

SEQ ID NO: 632449 - protein, 25 aa, Mycobacterium
AIGGDCLADIAMLRSEPGVFGSVAS

SEQ ID NO: 632450 - protein, 19 aa, Mycobacterium
AIGGEIRRLTSLSEDELYV

SEQ ID NO: 632451 - protein, 19 aa, Mycobacterium
AIGGFSGLLASGDGGAGGA

SEQ ID NO: 632452 - protein, 32 aa, Mycobacterium
AIGGNARYAGSLGTQVVKIFDLVAARTGLREH

SEQ ID NO: 632453 - protein, 26 aa, Mycobacterium
AIGGVIIDGGTFDWTQGRHPGFTTPD

SEQ ID NO: 632454 - protein, 18 aa, Mycobacterium
AIGKAAPVGLFVETFGSE

SEQ ID NO: 632455 - protein, 19 aa, Mycobacterium
AIGKAAPVGLFVETFGTAT

SEQ ID NO: 632456 - protein, 19 aa, Mycobacterium
AIGKAAPVGLFVETFGTET

SEQ ID NO: 632457 - protein, 19 aa, Mycobacterium
AIGLQWGLVARRYGELAAS

SEQ ID NO: 632458 - protein, 18 aa, Mycobacterium
AIGLRGESALRCSAELPF

SEQ ID NO: 632459 - protein, 18 aa, Mycobacterium
AIGLRPGLINTVPVGRKE

SEQ ID NO: 632460 - protein, 17 aa, Mycobacterium
AIGMFFPGPYRIPKASF

SEQ ID NO: 632461 - protein, 19 aa, Mycobacterium
AIGMTLPIAAIEIMRMRLT

SEQ ID NO: 632462 - protein, 29 aa, Mycobacterium
AIGMVIPYAALEIMKLRLTPSGYQQAAGL

SEQ ID NO: 632463 - protein, 30 aa, Mycobacterium
AIGMVIPYAALEIMKLRLTRSAYQQAAGLA

SEQ ID NO: 632464 - protein, 20 aa, Mycobacterium
AIGPGDRWIVDQIRSTAPKT

SEQ ID NO: 632465 - protein, 26 aa, Mycobacterium
AIGPLPELTYRVDFTNVVYNRKTNQR

SEQ ID NO: 632466 - protein, 21 aa, Mycobacterium
AIGRARAGLINVRQDAALMLH

SEQ ID NO: 632467 - protein, 19 aa, Mycobacterium
AIGRCARAVAGPGTEITAV

SEQ ID NO: 632468 - protein, 20 aa, Mycobacterium
AIGRLCTRGTAGLVPFSSRL

SEQ ID NO: 632469 - protein, 18 aa, Mycobacterium
AIGRLVTRQLIAAGHTVS

SEQ ID NO: 632470 - protein, 17 aa, Mycobacterium
AIGRPRVPVEVNHEPFL

SEQ ID NO: 632471 - protein, 17 aa, Mycobacterium
AIGRPRVPVEVNHEPFV

SEQ ID NO: 632472 - protein, 18 aa, Mycobacterium
AIGRPRVPVEVNHEPFVT

SEQ ID NO: 632473 - protein, 19 aa, Mycobacterium
AIGRPRVPVEVNHEPYLTL

SEQ ID NO: 632474 - protein, 19 aa, Mycobacterium
AIGRRFGDNLAELHRYAGT

SEQ ID NO: 632475 - protein, 31 aa, Mycobacterium
AIGRSELLSTVWRFAFEDPLTGIANRRAIDQ

SEQ ID NO: 632476 - protein, 19 aa, Mycobacterium
AIGVVDGREAIVIEHVTRL

SEQ ID NO: 632477 - protein, 26 aa, Mycobacterium
AIGYMLEILPALGYLHSIGLAYNDLK

SEQ ID NO: 632478 - protein, 18 aa, Mycobacterium
AIHAEFPDQMLAYNLSPS

SEQ ID NO: 632479 - protein, 25 aa, Mycobacterium
AIHFRPGGAFPFLGIPLGDLADGPV

SEQ ID NO: 632480 - protein, 17 aa, Mycobacterium
AIHGRVCYHPCESVCNR

SEQ ID NO: 632481 - protein, 19 aa, Mycobacterium
AIHGVDWRGVGLGFLDAPE

SEQ ID NO: 632482 - protein, 23 aa, Mycobacterium
AIHGYCMGGGIYLGLLTDFCVAS

SEQ ID NO: 632483 - protein, 18 aa, Mycobacterium
AIHPSRWRDTSIPVSPHP

SEQ ID NO: 632484 - protein, 22 aa, Mycobacterium
AIHRFPGSMAKRIQALAQVVVD

SEQ ID NO: 632485 - protein, 23 aa, Mycobacterium
AIHRFPGSMAKRVQTLAQIVVDR

SEQ ID NO: 632486 - protein, 24 aa, Mycobacterium
AIHRLFPPWQPLRIEAEAASLADG

SEQ ID NO: 632487 - protein, 33 aa, Mycobacterium
AIHYARARGLPVLGLCLGLQCIVIEAARSAGLT

SEQ ID NO: 632488 - protein, 32 aa, Mycobacterium
AIHYRVDQGFDHFKVALSIGIMKMVRSDLASS

SEQ ID NO: 632489 - protein, 18 aa, Mycobacterium
AIIALHMAAANRDPRRFD

SEQ ID NO: 632490 - protein, 17 aa, Mycobacterium
AIIAMLACARLGAMHSV

SEQ ID NO: 632491 - protein, 19 aa, Mycobacterium
AIIDFASSFGTLVLTRAYA

SEQ ID NO: 632492 - protein, 17 aa, Mycobacterium
AIIDGQHRWEAAKCLVD

SEQ ID NO: 632493 - protein, 20 aa, Mycobacterium
AIIDPADCDGEFGFDAFRRH

SEQ ID NO: 632494 - protein, 20 aa, Mycobacterium
AIIDTALRTWGRVDILINNA

SEQ ID NO: 632495 - protein, 24 aa, Mycobacterium
AIIERGRMLGGVCVNTGTIPSKTL

SEQ ID NO: 632496 - protein, 22 aa, Mycobacterium
AIIESRGGTAVSDFSDVGDEEQ

SEQ ID NO: 632497 - protein, 25 aa, Mycobacterium
AIIGIAVGFAIRGFVPVPEIQFDGF

SEQ ID NO: 632498 - protein, 17 aa, Mycobacterium
AIIGRPDLELVGVHASG

SEQ ID NO: 632499 - protein, 21 aa, Mycobacterium
AIILNCAFNAGGFATARDGNK

SEQ ID NO: 632500 - protein, 17 aa, Mycobacterium
AIINVTSALAFVPKAVA

SEQ ID NO: 632501 - protein, 28 aa, Mycobacterium
AIIRQPVPPFKWWRGLRARQLLEDYFNE

SEQ ID NO: 632502 - protein, 28 aa, Mycobacterium
AIIRQPVPPFKWWRGLRARTLLEEYFAD

SEQ ID NO: 632503 - protein, 26 aa, Mycobacterium
AIIVSLRAGGKVIFFGNGGSAQDAGH

SEQ ID NO: 632504 - protein, 27 aa, Mycobacterium
AIKDAEWWRLGLAEEIGGMPAPAPLVW

SEQ ID NO: 632505 - protein, 27 aa, Mycobacterium
AIKDAEWWRLGLAEEIGGMPAPPPLTW

SEQ ID NO: 632506 - protein, 18 aa, Mycobacterium
AIKDWIDMFTLWPEPASG

SEQ ID NO: 632507 - protein, 26 aa, Mycobacterium
AIKEAKRRGIACVEMEAAALYAYAAA

SEQ ID NO: 632508 - protein, 24 aa, Mycobacterium
AIKEGGRFACGGGRPADMDKGFWI

SEQ ID NO: 632509 - protein, 22 aa, Mycobacterium
AIKHRCADMLVDVESARSVVYH

SEQ ID NO: 632510 - protein, 18 aa, Mycobacterium
AIKRWKPFVDEIVRASID

SEQ ID NO: 632511 - protein, 18 aa, Mycobacterium
AIKTGSRVHVHWVDEPVG

SEQ ID NO: 632512 - protein, 23 aa, Mycobacterium
AIKVEGRRAYRLVREGQAVELAA

SEQ ID NO: 632513 - protein, 20 aa, Mycobacterium
AILAAYHFWGPDALHRLRGM

SEQ ID NO: 632514 - protein, 18 aa, Mycobacterium
AILADWGADVIKIEPQAG

SEQ ID NO: 632515 - protein, 23 aa, Mycobacterium
AILAGEVHFAIGYSEPEAGTDLA

SEQ ID NO: 632516 - protein, 24 aa, Mycobacterium
AILAHPTLHIGMRANWFGLAGEAV

SEQ ID NO: 632517 - protein, 17 aa, Mycobacterium
AILARELELCYAAIALV

SEQ ID NO: 632518 - protein, 20 aa, Mycobacterium
AILAREVFDVVAARLRAEYS

SEQ ID NO: 632519 - protein, 18 aa, Mycobacterium
AILDEERPLFSISGSTCT

SEQ ID NO: 632520 - protein, 21 aa, Mycobacterium
AILDERLRDSLARAAQLHATI

SEQ ID NO: 632521 - protein, 18 aa, Mycobacterium
AILDEWKSIHGVDRKTDD

SEQ ID NO: 632522 - protein, 18 aa, Mycobacterium
AILDFASSFGTLVLTRAY

SEQ ID NO: 632523 - protein, 20 aa, Mycobacterium
AILELYKLGQLNLDDMVTRE

SEQ ID NO: 632524 - protein, 24 aa, Mycobacterium
AILHERGWAAPAWPVAHGGCDWSL

SEQ ID NO: 632525 - protein, 25 aa, Mycobacterium
AILHRKGWAAPAWPVKYGGQPWSLA

SEQ ID NO: 632526 - protein, 24 aa, Mycobacterium
AILHRPGPELKRLTPRNNDALLFD

SEQ ID NO: 632527 - protein, 18 aa, Mycobacterium
AILIPADTVVDWPDAPGT

SEQ ID NO: 632528 - protein, 19 aa, Mycobacterium
AILLGDLSLVWADDIIAEA

SEQ ID NO: 632529 - protein, 23 aa, Mycobacterium
AILNRPDLVILRGRTYRPNQLGH

SEQ ID NO: 632530 - protein, 17 aa, Mycobacterium
AILNRTFDYGFATGLMV

SEQ ID NO: 632531 - protein, 19 aa, Mycobacterium
AILNVLSVAAWRTVDGNTS

SEQ ID NO: 632532 - protein, 17 aa, Mycobacterium
AILPRTFDYGFATGLMV

SEQ ID NO: 632533 - protein, 21 aa, Mycobacterium
AILRACVDFGISALACATPYT

SEQ ID NO: 632534 - protein, 18 aa, Mycobacterium
AILREKIVALAAHHLKVA

SEQ ID NO: 632535 - protein, 17 aa, Mycobacterium
AILRGGVPMLLVRGQMS

SEQ ID NO: 632536 - protein, 17 aa, Mycobacterium
AILRQAPELAAWPRSPE

SEQ ID NO: 632537 - protein, 17 aa, Mycobacterium
AILSAPVDLLFNGGIGT

SEQ ID NO: 632538 - protein, 21 aa, Mycobacterium
AILSFMQRSGFEPHYGRQVVA

SEQ ID NO: 632539 - protein, 24 aa, Mycobacterium
AILSRGKPDLAWFPELARRLDGAA

SEQ ID NO: 632540 - protein, 24 aa, Mycobacterium
AILTARHLDCWVLGTVGKGGKAGP

SEQ ID NO: 632541 - protein, 24 aa, Mycobacterium
AILTARHLNCWTLGTVKKGGKDSV

SEQ ID NO: 632542 - protein, 23 aa, Mycobacterium
AILTARHLNCWVLGTVRKGGKDG

SEQ ID NO: 632543 - protein, 25 aa, Mycobacterium
AILTGWRMLLDAGRLQDGEPHLAGT

SEQ ID NO: 632544 - protein, 25 aa, Mycobacterium
AILTGWRMLLDAGRLQDGEPHLSGT

SEQ ID NO: 632545 - protein, 18 aa, Mycobacterium
AIMINTFNRISILSRHPI

SEQ ID NO: 632546 - protein, 31 aa, Mycobacterium
AIMKAGAGYFPIDPGYPLARKQFMLEDVAPP

SEQ ID NO: 632547 - protein, 22 aa, Mycobacterium
AIMKAGGGYFPIDPGYPRARKQ

SEQ ID NO: 632548 - protein, 23 aa, Mycobacterium
AIMNPGFRVRRGGAGELLDVAPV

SEQ ID NO: 632549 - protein, 24 aa, Mycobacterium
AIMPDLTRRAVLRMGASAGLGAAG

SEQ ID NO: 632550 - protein, 27 aa, Mycobacterium
AIMRIGWLTACDYEWTQHWRVASRLGV

SEQ ID NO: 632551 - protein, 22 aa, Mycobacterium
AIMRRIYPYIGRLFARQTAEIG

SEQ ID NO: 632552 - protein, 24 aa, Mycobacterium
AIMSGFERRGRWNVPGKLTSFALW

SEQ ID NO: 632553 - protein, 28 aa, Mycobacterium
AIMTKSLRAGKVFLDWSQNNGSKTTIAP

SEQ ID NO: 632554 - protein, 25 aa, Mycobacterium
AINAELRQKCPVAWNENYGGFWFLS

SEQ ID NO: 632555 - protein, 30 aa, Mycobacterium
AINAPFLQFTGRPLVGPGTDGAPGTGQAGG

SEQ ID NO: 632556 - protein, 17 aa, Mycobacterium
AINATRIPMTWFEVDQV

SEQ ID NO: 632557 - protein, 17 aa, Mycobacterium
AINGARMVEFDGMGHDL

SEQ ID NO: 632558 - protein, 25 aa, Mycobacterium
AINGHVRAGGFGLVGACDIAVAGPR

SEQ ID NO: 632559 - protein, 26 aa, Mycobacterium
AINGHVRAGGFGLVGACDIVVAGPAC

SEQ ID NO: 632560 - protein, 24 aa, Mycobacterium
AINGICCGAGLDWVTTGDIVIASD

SEQ ID NO: 632561 - protein, 25 aa, Mycobacterium
AINGSLRFGALLLHPTSFAASLEGE

SEQ ID NO: 632562 - protein, 32 aa, Mycobacterium
AINLELRYRGLRAPHKIKMGVSGCARECAEAR

SEQ ID NO: 632563 - protein, 24 aa, Mycobacterium
AINLTRPGGVVLYATCSPHLAETV

SEQ ID NO: 632564 - protein, 23 aa, Mycobacterium
AINNAVRFAFWGAEETGLEGSSQ

SEQ ID NO: 632565 - protein, 22 aa, Mycobacterium
AINQRLALDVARYEKSVDLRVV

SEQ ID NO: 632566 - protein, 17 aa, Mycobacterium
AINRARLPIAARSWIDN

SEQ ID NO: 632567 - protein, 18 aa, Mycobacterium
AINRRLAQTSARTIGHKE

SEQ ID NO: 632568 - protein, 20 aa, Mycobacterium
AINTGFGNTGAWNVGIGNIG

SEQ ID NO: 632569 - protein, 21 aa, Mycobacterium
AINVNGPRAWDLDLAIDVTFA

SEQ ID NO: 632570 - protein, 18 aa, Mycobacterium
AIPAALAALRPGGRIVVM

SEQ ID NO: 632571 - protein, 18 aa, Mycobacterium
AIPCGPDLDAIVAAVDEY

SEQ ID NO: 632572 - protein, 26 aa, Mycobacterium
AIPCPNGLLCWAKPAGSVPFGAPGSA

SEQ ID NO: 632573 - protein, 21 aa, Mycobacterium
AIPDARFVVVDGMGHDLPQPV

SEQ ID NO: 632574 - protein, 29 aa, Mycobacterium
AIPDEKFRYGFAIAPELVRTVLRDGEPDW

SEQ ID NO: 632575 - protein, 23 aa, Mycobacterium
AIPDEQLRVVLARRDGRWASAVR

SEQ ID NO: 632576 - protein, 17 aa, Mycobacterium
AIPDLRVLHYLADEIGV

SEQ ID NO: 632577 - protein, 25 aa, Mycobacterium
AIPDMTEWWAYLDSVQATYPLSYGP

SEQ ID NO: 632578 - protein, 20 aa, Mycobacterium
AIPDRTDVVWLEHEENRGAP

SEQ ID NO: 632579 - protein, 27 aa, Mycobacterium
AIPFLLKMRPDIPVVGSAFTLALVEAK

SEQ ID NO: 632580 - protein, 27 aa, Mycobacterium
AIPGCMLWAELDAGWCHSHHRRWRLRG

SEQ ID NO: 632581 - protein, 21 aa, Mycobacterium
AIPGLRQALGLAEDGTDERTS

SEQ ID NO: 632582 - protein, 20 aa, Mycobacterium
AIPHYLRTGVMIEFGPPELR

SEQ ID NO: 632583 - protein, 24 aa, Mycobacterium
AIPKLRHGSYFPEWLLERRKRAER

SEQ ID NO: 632584 - protein, 28 aa, Mycobacterium
AIPLAKACARVMLGASISQLREEGLLAA

SEQ ID NO: 632585 - protein, 23 aa, Mycobacterium
AIPLPPDDNGYVFIETKSGQTRC

SEQ ID NO: 632586 - protein, 22 aa, Mycobacterium
AIPLPPDENGYVFIETKSGSTR

SEQ ID NO: 632587 - protein, 19 aa, Mycobacterium
AIPLWKRAQDGAIITGWDY

SEQ ID NO: 632588 - protein, 19 aa, Mycobacterium
AIPLWKRPQDGAIITGWDY

SEQ ID NO: 632589 - protein, 19 aa, Mycobacterium
AIPLWKRPQDGAVITGWDY

SEQ ID NO: 632590 - protein, 25 aa, Mycobacterium
AIPNPLEWGCFTFGVIQSENHFTFF

SEQ ID NO: 632591 - protein, 23 aa, Mycobacterium
AIPPERAWGIWMTRQLIARLMGT

SEQ ID NO: 632592 - protein, 23 aa, Mycobacterium
AIPPERAWGMWLTRQLIARLLGT

SEQ ID NO: 632593 - protein, 21 aa, Mycobacterium
AIPRDPRLSAVPSTNLLDHRS

SEQ ID NO: 632594 - protein, 24 aa, Mycobacterium
AIPRYPGDVTPQWLSAALSGHGAP

SEQ ID NO: 632595 - protein, 19 aa, Mycobacterium
AIQAQFRRIQCTPDLLPSD

SEQ ID NO: 632596 - protein, 27 aa, Mycobacterium
AIQGPPRWHGPEVLLRQTSFRALAEPR

SEQ ID NO: 632597 - protein, 24 aa, Mycobacterium
AIQLCGRLEAMITDPVYEGKSMAG

SEQ ID NO: 632598 - protein, 24 aa, Mycobacterium
AIQLTRPGGVIVYSTCSPHLAETV

SEQ ID NO: 632599 - protein, 18 aa, Mycobacterium
AIQREVGITFVIVTHDQD

SEQ ID NO: 632600 - protein, 23 aa, Mycobacterium
AIQRSREVWLIVSGRAKAEAVAA

SEQ ID NO: 632601 - protein, 24 aa, Mycobacterium
AIQRSREVWLMVSGGTKAEAVAAA

SEQ ID NO: 632602 - protein, 20 aa, Mycobacterium
AIQSHGGIGFTWEHPAHLYY

SEQ ID NO: 632603 - protein, 24 aa, Mycobacterium
AIQTAPKLDIGWFVQGGCRRQMSD

SEQ ID NO: 632604 - protein, 25 aa, Mycobacterium
AIQVAKRFGAAEVIAAGRNRQRLSE

SEQ ID NO: 632605 - protein, 24 aa, Mycobacterium
AIQVCAALDQILHLSVEHVSSRVQ

SEQ ID NO: 632606 - protein, 25 aa, Mycobacterium
AIQVCLRHRGKVILNRAIGHGWGNA

SEQ ID NO: 632607 - protein, 19 aa, Mycobacterium
AIQVPPNGLPVILGPDHPI

SEQ ID NO: 632608 - protein, 19 aa, Mycobacterium
AIQVPPNGLPVILGPDHPL

SEQ ID NO: 632609 - protein, 19 aa, Mycobacterium
AIRAAHAVAELIGPRESLR

SEQ ID NO: 632610 - protein, 27 aa, Mycobacterium
AIRADFPILKRVMRGGNQLAYLDSGAT

SEQ ID NO: 632611 - protein, 24 aa, Mycobacterium
AIRAECGVELGIRDVFELATVGLL

SEQ ID NO: 632612 - protein, 17 aa, Mycobacterium
AIRAGLSGIGFAENPIF

SEQ ID NO: 632613 - protein, 20 aa, Mycobacterium
AIRAGMVDEFNFFVVPKVVG

SEQ ID NO: 632614 - protein, 24 aa, Mycobacterium
AIRAITCLPALVGAWRHVGGGTME

SEQ ID NO: 632615 - protein, 23 aa, Mycobacterium
AIRARDAVTLKSLWNQLVTEWDD

SEQ ID NO: 632616 - protein, 19 aa, Mycobacterium
AIRARNSIDTAAGWLAPLG

SEQ ID NO: 632617 - protein, 25 aa, Mycobacterium
AIRASGLPYALYRLAGVISPDTQAG

SEQ ID NO: 632618 - protein, 18 aa, Mycobacterium
AIRASRAPARIVEVTRAA

SEQ ID NO: 632619 - protein, 19 aa, Mycobacterium
AIRDFILPDGEWVLLMLAA

SEQ ID NO: 632620 - protein, 19 aa, Mycobacterium
AIRDLAIRAFKAIDCQGLA

SEQ ID NO: 632621 - protein, 25 aa, Mycobacterium
AIRDNWWLHLQVFSIQRAPRKLKYL

SEQ ID NO: 632622 - protein, 20 aa, Mycobacterium
AIREFIYWQHVGQLTADALS

SEQ ID NO: 632623 - protein, 26 aa, Mycobacterium
AIRERPARRPAWRPAASIRSHSVHGH

SEQ ID NO: 632624 - protein, 18 aa, Mycobacterium
AIREWARKNGHNVSSRGR

SEQ ID NO: 632625 - protein, 20 aa, Mycobacterium
AIRGARMVLIDGMGHELPEP

SEQ ID NO: 632626 - protein, 18 aa, Mycobacterium
AIRGYRSLRDLVLPLRRL

SEQ ID NO: 632627 - protein, 18 aa, Mycobacterium
AIRICEDDDYLAILDIRP

SEQ ID NO: 632628 - protein, 19 aa, Mycobacterium
AIRIDAPRVRVWDGLRRYV

SEQ ID NO: 632629 - protein, 18 aa, Mycobacterium
AIRKARAALRAGEIDQAE

SEQ ID NO: 632630 - protein, 23 aa, Mycobacterium
AIRKTRITLEWLRNNGYHKLLAT

SEQ ID NO: 632631 - protein, 19 aa, Mycobacterium
AIRLLPGMLTGPVRLAEVA

SEQ ID NO: 632632 - protein, 23 aa, Mycobacterium
AIRLTRPGGVVLYATCSPHLAET

SEQ ID NO: 632633 - protein, 24 aa, Mycobacterium
AIRLTRPGGVVLYATCSPHLAETA

SEQ ID NO: 632634 - protein, 17 aa, Mycobacterium
AIRNFVHGMGFQRDILG

SEQ ID NO: 632635 - protein, 23 aa, Mycobacterium
AIRNIEAPLIFPVLPDGHAEHIR

SEQ ID NO: 632636 - protein, 24 aa, Mycobacterium
AIRPDGQGLLAFVGVTHTDDRDKA

SEQ ID NO: 632637 - protein, 24 aa, Mycobacterium
AIRPEGQGLLAFVGVTHSDDPDKA

SEQ ID NO: 632638 - protein, 18 aa, Mycobacterium
AIRPERQGLLAFVGATHT

SEQ ID NO: 632639 - protein, 18 aa, Mycobacterium
AIRQALRIGMSERPPSPS

SEQ ID NO: 632640 - protein, 28 aa, Mycobacterium
AIRRCRRCDPCGWLLGPDHTPIDPAVRC

SEQ ID NO: 632641 - protein, 21 aa, Mycobacterium
AIRRFSRLKAPLVLDLGGLDF

SEQ ID NO: 632642 - protein, 20 aa, Mycobacterium
AIRRHCAIAAFADIDELEET

SEQ ID NO: 632643 - protein, 23 aa, Mycobacterium
AIRRLGFGLLNKVVLRFDEPFWT

SEQ ID NO: 632644 - protein, 23 aa, Mycobacterium
AIRRVRREIPAAAAVIEQHCTAH

SEQ ID NO: 632645 - protein, 22 aa, Mycobacterium
AIRRYRLAGPREVVHLALRTLL

SEQ ID NO: 632646 - protein, 26 aa, Mycobacterium
AIRSAVVRPRGSWRSFDVVAETGSTN

SEQ ID NO: 632647 - protein, 23 aa, Mycobacterium
AIRSGAKITPLWLPGPDPEPHYR

SEQ ID NO: 632648 - protein, 23 aa, Mycobacterium
AIRTDFALVHAWKGDRHGNLVYR

SEQ ID NO: 632649 - protein, 20 aa, Mycobacterium
AIRVAGWIDKLGAVWVEGQI

SEQ ID NO: 632650 - protein, 23 aa, Mycobacterium
AIRVAGWIDKLGTVWVEGQLAQV

SEQ ID NO: 632651 - protein, 20 aa, Mycobacterium
AIRVHCSRATIYRYVGGKTE

SEQ ID NO: 632652 - protein, 18 aa, Mycobacterium
AIRVWSFIDPQVHEVQAA

SEQ ID NO: 632653 - protein, 19 aa, Mycobacterium
AIRYAEAPLIFPVVPDGHN

SEQ ID NO: 632654 - protein, 22 aa, Mycobacterium
AIRYPCRVRSLVLLDPALTFAP

SEQ ID NO: 632655 - protein, 24 aa, Mycobacterium
AISAALMLIWACDLIVAADDARFS

SEQ ID NO: 632656 - protein, 24 aa, Mycobacterium
AISAALMLIWACDLIVAADNAKFS

SEQ ID NO: 632657 - protein, 24 aa, Mycobacterium
AISAALMLIWACDLIVASDDAKFS

SEQ ID NO: 632658 - protein, 20 aa, Mycobacterium
AISADWGLDEILLPTTGPAE

SEQ ID NO: 632659 - protein, 25 aa, Mycobacterium
AISAEALGGGWFWPAAAAHPSLPRG

SEQ ID NO: 632660 - protein, 24 aa, Mycobacterium
AISAGLMLIWACDLIVAADNAKFS

SEQ ID NO: 632661 - protein, 25 aa, Mycobacterium
AISAGLMLIWACDLIVAADNAKFSD

SEQ ID NO: 632662 - protein, 25 aa, Mycobacterium
AISAGLMLIWACDLIVAADNARFSD

SEQ ID NO: 632663 - protein, 26 aa, Mycobacterium
AISALKEGRLVVMPTDTVYGIGADAF

SEQ ID NO: 632664 - protein, 19 aa, Mycobacterium
AISALRQGLLTAKAHTAGS

SEQ ID NO: 632665 - protein, 27 aa, Mycobacterium
AISAQAAAFHDQFLRALTGAGGAYAAA

SEQ ID NO: 632666 - protein, 30 aa, Mycobacterium
AISARAAFAAATRGAWRAGGVRDGVTGTLV

SEQ ID NO: 632667 - protein, 24 aa, Mycobacterium
AISARAEWAPELAIHHLDSLDALA

SEQ ID NO: 632668 - protein, 18 aa, Mycobacterium
AISARAGVTLYRVVSVKT

SEQ ID NO: 632669 - protein, 23 aa, Mycobacterium
AISCVSAGSILRNLDQAVYEVVA

SEQ ID NO: 632670 - protein, 17 aa, Mycobacterium
AISEGFRTMLLHRGEQP

SEQ ID NO: 632671 - protein, 22 aa, Mycobacterium
AISELRLAGVDGPYSVLLSADV

SEQ ID NO: 632672 - protein, 23 aa, Mycobacterium
AISELRLAGVDGPYSVLLSADVY

SEQ ID NO: 632673 - protein, 29 aa, Mycobacterium
AISFKIARMEARAHVARTAYYDAAAKMLA

SEQ ID NO: 632674 - protein, 30 aa, Mycobacterium
AISFKIARMEARAHVARTAYYDAAAKMLAG

SEQ ID NO: 632675 - protein, 19 aa, Mycobacterium
AISGLRPPVLDDLGLAGGL

SEQ ID NO: 632676 - protein, 19 aa, Mycobacterium
AISGLRPPVLDDLGLSGGL

SEQ ID NO: 632677 - protein, 28 aa, Mycobacterium
AISGTDFRRPGCLCADQPQPCQWCRQLA

SEQ ID NO: 632678 - protein, 18 aa, Mycobacterium
AISKVIWSEYFQRYTELA

SEQ ID NO: 632679 - protein, 21 aa, Mycobacterium
AISLSYLGPLGLFPADTAAAE

SEQ ID NO: 632680 - protein, 20 aa, Mycobacterium
AISMSTPVIFCDEILGESVP

SEQ ID NO: 632681 - protein, 22 aa, Mycobacterium
AISPERAAAMVVRGLVEKPARI

SEQ ID NO: 632682 - protein, 26 aa, Mycobacterium
AISPIARPREVHVVPELPKTRSGKIM

SEQ ID NO: 632683 - protein, 18 aa, Mycobacterium
AISQLFGAHGQEFQVVSA

SEQ ID NO: 632684 - protein, 17 aa, Mycobacterium
AISRLLGAGWAAAPGAR

SEQ ID NO: 632685 - protein, 18 aa, Mycobacterium
AISRRWLSSVAQRVSTSQ

SEQ ID NO: 632686 - protein, 27 aa, Mycobacterium
AISRVPLMPAMLEWLHTARTSMVMDTT

SEQ ID NO: 632687 - protein, 18 aa, Mycobacterium
AISRVRRAVNNIGFALAS

SEQ ID NO: 632688 - protein, 25 aa, Mycobacterium
AISSARTAAQFGIDPRVAMLSYSTG

SEQ ID NO: 632689 - protein, 18 aa, Mycobacterium
AISTAQWYGARLADVLGA

SEQ ID NO: 632690 - protein, 27 aa, Mycobacterium
AISVPRWLPERVCWLLSDEYHSNEGGH

SEQ ID NO: 632691 - protein, 33 aa, Mycobacterium
AISYARARGLPVLGLCLGLQCIVIEAARSVGLS

SEQ ID NO: 632692 - protein, 27 aa, Mycobacterium
AISYARSRGLPVFGLCLGLQCIVIEAA

SEQ ID NO: 632693 - protein, 18 aa, Mycobacterium
AITCGDRSFTYREVEESA

SEQ ID NO: 632694 - protein, 28 aa, Mycobacterium
AITDELWDLLPGYLIFRSIIPNRPPTPH

SEQ ID NO: 632695 - protein, 24 aa, Mycobacterium
AITDGALFARCLQQGFDEVLALGG

SEQ ID NO: 632696 - protein, 19 aa, Mycobacterium
AITEAWQLTDYRMLTHDRG

SEQ ID NO: 632697 - protein, 17 aa, Mycobacterium
AITELFLQALRAPGEQG

SEQ ID NO: 632698 - protein, 22 aa, Mycobacterium
AITGCARRAGARPAATVGKPSS

SEQ ID NO: 632699 - protein, 23 aa, Mycobacterium
AITGETDLPCATRIDDTGVPQEI

SEQ ID NO: 632700 - protein, 19 aa, Mycobacterium
AITGTEWHRVDVVDETGST

SEQ ID NO: 632701 - protein, 23 aa, Mycobacterium
AITLGDYVKLGFEQDVEIWRHKA

SEQ ID NO: 632702 - protein, 21 aa, Mycobacterium
AITPAKMVVCLIGEPDELREI

SEQ ID NO: 632703 - protein, 23 aa, Mycobacterium
AITPRAEEALSFCDKFSLDDLPD

SEQ ID NO: 632704 - protein, 28 aa, Mycobacterium
AITPWNFPLGLAMWKIAPALLAGNTVVV

SEQ ID NO: 632705 - protein, 26 aa, Mycobacterium
AITPWNFPLLLTLWKVGPAIAAGNSV

SEQ ID NO: 632706 - protein, 23 aa, Mycobacterium
AITQARIALDLARQHGGSIGPDQ

SEQ ID NO: 632707 - protein, 22 aa, Mycobacterium
AITRGVGWLRLNRADKRNALSQ

SEQ ID NO: 632708 - protein, 18 aa, Mycobacterium
AITRTVVLSQGWDVMDFI

SEQ ID NO: 632709 - protein, 25 aa, Mycobacterium
AITTRHLRRVWGLPGTQLGVVAWPA

SEQ ID NO: 632710 - protein, 20 aa, Mycobacterium
AITVCRDLAPGPLIAGGHSY

SEQ ID NO: 632711 - protein, 19 aa, Mycobacterium
AITVPAVRSVLVVTPDDGA

SEQ ID NO: 632712 - protein, 21 aa, Mycobacterium
AITVWAGGFGVPALAAHSGLS

SEQ ID NO: 632713 - protein, 21 aa, Mycobacterium
AIVAAVGKWPPASGRASALVD

SEQ ID NO: 632714 - protein, 18 aa, Mycobacterium
AIVARELGVPCVVGARSA

SEQ ID NO: 632715 - protein, 18 aa, Mycobacterium
AIVDFAGQRLKGLGEAAW

SEQ ID NO: 632716 - protein, 17 aa, Mycobacterium
AIVDHVRDAVTGRGKDN

SEQ ID NO: 632717 - protein, 18 aa, Mycobacterium
AIVDIYLPYVRDTAVSFE

SEQ ID NO: 632718 - protein, 17 aa, Mycobacterium
AIVEFPPAGTLTGIAKR

SEQ ID NO: 632719 - protein, 20 aa, Mycobacterium
AIVGALSRLGHPGISDVRQG

SEQ ID NO: 632720 - protein, 25 aa, Mycobacterium
AIVGGRWKFLIVWQLAVQGAQRYGQ

SEQ ID NO: 632721 - protein, 20 aa, Mycobacterium
AIVGSLVLGKPVKWMEDRSE

SEQ ID NO: 632722 - protein, 25 aa, Mycobacterium
AIVIPEEMIHYGVSKTALLAVSRGF

SEQ ID NO: 632723 - protein, 30 aa, Mycobacterium
AIVKEFQPGPGRRLGVLVDHLVKGSKESRI

SEQ ID NO: 632724 - protein, 18 aa, Mycobacterium
AIVKTIRCADRFGDHGLV

SEQ ID NO: 632725 - protein, 24 aa, Mycobacterium
AIVNIHSVLSWLGGAGAYGASKAA

SEQ ID NO: 632726 - protein, 17 aa, Mycobacterium
AIVPRAGAELTPDDFGR

SEQ ID NO: 632727 - protein, 18 aa, Mycobacterium
AIVPRIASELTVGVEPVG

SEQ ID NO: 632728 - protein, 28 aa, Mycobacterium
AIVPRLLKWEKQRIAARVDELLDLVNLE

SEQ ID NO: 632729 - protein, 17 aa, Mycobacterium
AIVPVLPAPMCFDPTAR

SEQ ID NO: 632730 - protein, 17 aa, Mycobacterium
AIVPWNVPQFLIMPKLI

SEQ ID NO: 632731 - protein, 22 aa, Mycobacterium
AIVTEIRRLLGAAWTDAASTDT

SEQ ID NO: 632732 - protein, 18 aa, Mycobacterium
AIVTPAMLSAHYRLGQHR

SEQ ID NO: 632733 - protein, 20 aa, Mycobacterium
AIVTSAGFAGEFGAAIRESG

SEQ ID NO: 632734 - protein, 19 aa, Mycobacterium
AIVWEHGRRNFGLRDEGVL

SEQ ID NO: 632735 - protein, 24 aa, Mycobacterium
AIWTCWRDGTSLRFEGEFYTHKIM

SEQ ID NO: 632736 - protein, 26 aa, Mycobacterium
AIYGRITDRGIIHWADPRAQHPGEIN

SEQ ID NO: 632737 - protein, 19 aa, Mycobacterium
AIYHEGWIASCFHGRLPWV

SEQ ID NO: 632738 - protein, 25 aa, Mycobacterium
AIYLQHGIEVSRKVILKLFGPLLDA

SEQ ID NO: 632739 - protein, 17 aa, Mycobacterium
AIYPRQSPGGWQIIGHT

SEQ ID NO: 632740 - protein, 17 aa, Mycobacterium
AIYRRWPSKIEMTAAAM

SEQ ID NO: 632741 - protein, 18 aa, Mycobacterium
AIYSRFDGMVAWQTCINP

SEQ ID NO: 632742 - protein, 21 aa, Mycobacterium
AKAAAALAKKWLGLRYTMNVI

SEQ ID NO: 632743 - protein, 18 aa, Mycobacterium
AKAAEWDAEPVVKRTYGS

SEQ ID NO: 632744 - protein, 17 aa, Mycobacterium
AKAAGIEEVVFDRGGYT

SEQ ID NO: 632745 - protein, 17 aa, Mycobacterium
AKAAHLVDWADDIDPAW

SEQ ID NO: 632746 - protein, 21 aa, Mycobacterium
AKAALALGVRFWPHTTVTKLI

SEQ ID NO: 632747 - protein, 19 aa, Mycobacterium
AKAALLFALETDLPVIVDA

SEQ ID NO: 632748 - protein, 18 aa, Mycobacterium
AKAALPYLGPGSSIIGSS

SEQ ID NO: 632749 - protein, 19 aa, Mycobacterium
AKAALRYTDTLIWTPAHLA

SEQ ID NO: 632750 - protein, 20 aa, Mycobacterium
AKAAMVGFGRSLAKEVARDH

SEQ ID NO: 632751 - protein, 20 aa, Mycobacterium
AKAARGIRGLLRINDGSHRL

SEQ ID NO: 632752 - protein, 17 aa, Mycobacterium
AKAARPLEEHLGLHTVG

SEQ ID NO: 632753 - protein, 20 aa, Mycobacterium
AKAARVFARAGLRRGDRVAG

SEQ ID NO: 632754 - protein, 17 aa, Mycobacterium
AKACAIEPTGMSAVLGG

SEQ ID NO: 632755 - protein, 19 aa, Mycobacterium
AKACALDPTGMSAVLGGDE

SEQ ID NO: 632756 - protein, 23 aa, Mycobacterium
AKACWLRSRRRGVLAGFSASAMH

SEQ ID NO: 632757 - protein, 22 aa, Mycobacterium
AKACWLRSRRRGVLAGYSAAAL

SEQ ID NO: 632758 - protein, 26 aa, Mycobacterium
AKADAAGVPRMVSAPVSAGVGRAGLV

SEQ ID NO: 632759 - protein, 19 aa, Mycobacterium
AKADARRKVRDSGEREMRQ

SEQ ID NO: 632760 - protein, 23 aa, Mycobacterium
AKADASAGWTVMIGADFAPVFGR

SEQ ID NO: 632761 - protein, 24 aa, Mycobacterium
AKADLEACWNLGATVAAHLMDARS

SEQ ID NO: 632762 - protein, 27 aa, Mycobacterium
AKAEAIVHLGFGFGIVFINPALAAVDW

SEQ ID NO: 632763 - protein, 27 aa, Mycobacterium
AKAEAIVHLGFGFGIVFINPALEALGW

SEQ ID NO: 632764 - protein, 23 aa, Mycobacterium
AKAEALSAGGALFGLHATTEGME

SEQ ID NO: 632765 - protein, 20 aa, Mycobacterium
AKAETLKCAKGFRYYARNAE

SEQ ID NO: 632766 - protein, 25 aa, Mycobacterium
AKAEVLKCAKGFRFYAENAEAMLAP

SEQ ID NO: 632767 - protein, 25 aa, Mycobacterium
AKAEVLKCAKGFRYYAEHAEQLLAD

SEQ ID NO: 632768 - protein, 24 aa, Mycobacterium
AKAEYLKLINWELASTTDAAPSPA

SEQ ID NO: 632769 - protein, 18 aa, Mycobacterium
AKAFAAKPVDYWRQHLKT

SEQ ID NO: 632770 - protein, 24 aa, Mycobacterium
AKAFARLGIRCFGFAPLKLPPELD

SEQ ID NO: 632771 - protein, 24 aa, Mycobacterium
AKAFNLKTCEMVWSLPKEANSFGR

SEQ ID NO: 632772 - protein, 24 aa, Mycobacterium
AKAFPHVYCELDFTNPLELTVATI

SEQ ID NO: 632773 - protein, 22 aa, Mycobacterium
AKAFYGAVFGWTFETGGPEYGG

SEQ ID NO: 632774 - protein, 20 aa, Mycobacterium
AKAGATIELLAVYRSADASP

SEQ ID NO: 632775 - protein, 20 aa, Mycobacterium
AKAGDLALLIGYGAGLSYAA

SEQ ID NO: 632776 - protein, 21 aa, Mycobacterium
AKAGDLALLIGYGAGLSYAAQ

SEQ ID NO: 632777 - protein, 27 aa, Mycobacterium
AKAGELAAGLARIWSELLGRRIGAESS

SEQ ID NO: 632778 - protein, 18 aa, Mycobacterium
AKAGLRLADIDLIELNEA

SEQ ID NO: 632779 - protein, 20 aa, Mycobacterium
AKAIELWRAELNAMRDIGGA

SEQ ID NO: 632780 - protein, 24 aa, Mycobacterium
AKAKARRGPLCLGIDPHPELLRAW

SEQ ID NO: 632781 - protein, 17 aa, Mycobacterium
AKAKGINLWRVDDDHVS

SEQ ID NO: 632782 - protein, 24 aa, Mycobacterium
AKAKKAVAHPVARKAGQNATAKTA

SEQ ID NO: 632783 - protein, 18 aa, Mycobacterium
AKALAAAGRTWLRVLADR

SEQ ID NO: 632784 - protein, 20 aa, Mycobacterium
AKALAALILAVLRGMEALRK

SEQ ID NO: 632785 - protein, 23 aa, Mycobacterium
AKALAEKGARVVIAVRNTDKGAQ

SEQ ID NO: 632786 - protein, 27 aa, Mycobacterium
AKALAPVRFFNPIGMRFAKKATREDID

SEQ ID NO: 632787 - protein, 20 aa, Mycobacterium
AKALCRACPCRWLCAREAVE

SEQ ID NO: 632788 - protein, 20 aa, Mycobacterium
AKALEALELVALPDPKRRMK

SEQ ID NO: 632789 - protein, 24 aa, Mycobacterium
AKALEFRPKVIIAGWSAYPRILDF

SEQ ID NO: 632790 - protein, 17 aa, Mycobacterium
AKALGLKPRARIVSQAL

SEQ ID NO: 632791 - protein, 20 aa, Mycobacterium
AKALGLRPRARIVSQALVGA

SEQ ID NO: 632792 - protein, 21 aa, Mycobacterium
AKALGLRPRARIVSQALVGAE

SEQ ID NO: 632793 - protein, 19 aa, Mycobacterium
AKALGLRVAVTAGTPEKLD

SEQ ID NO: 632794 - protein, 38 aa, Mycobacterium
AKALGYDGVVLFLDELVLWLAFSVRDTEFFARESQKIT

SEQ ID NO: 632795 - protein, 27 aa, Mycobacterium
AKALHALGPRWVLVKGGHLRSSDRSCD

SEQ ID NO: 632796 - protein, 20 aa, Mycobacterium
AKALLAHGARVVIGDRDVAL

SEQ ID NO: 632797 - protein, 17 aa, Mycobacterium
AKALPLSGIRVLDMTTF

SEQ ID NO: 632798 - protein, 22 aa, Mycobacterium
AKAMAGPLLAMMSQMGGMAFGS

SEQ ID NO: 632799 - protein, 23 aa, Mycobacterium
AKAMLPKAIAAGVRIACGTDAPA

SEQ ID NO: 632800 - protein, 24 aa, Mycobacterium
AKAMLPKAIAAGVRIACGTDAPAI

SEQ ID NO: 632801 - protein, 21 aa, Mycobacterium
AKANCPLVLEGYGPPPDPRLE

SEQ ID NO: 632802 - protein, 19 aa, Mycobacterium
AKANLNWTPQPAMPGQLRA

SEQ ID NO: 632803 - protein, 19 aa, Mycobacterium
AKAPAGLTPHLLVMTATPI

SEQ ID NO: 632804 - protein, 29 aa, Mycobacterium
AKAPSGAMANCLVAIGMHLDIPAVRARLD

SEQ ID NO: 632805 - protein, 18 aa, Mycobacterium
AKARELATYFVGQVVGSL

SEQ ID NO: 632806 - protein, 22 aa, Mycobacterium
AKARGAPILARLMGAGMTNDCY

SEQ ID NO: 632807 - protein, 21 aa, Mycobacterium
AKARGATPLARLMGASITSDG

SEQ ID NO: 632808 - protein, 23 aa, Mycobacterium
AKARGNCAVDYGFHQILGGVDTD

SEQ ID NO: 632809 - protein, 17 aa, Mycobacterium
AKARKAILEGCDEQVHV

SEQ ID NO: 632810 - protein, 17 aa, Mycobacterium
AKARYILLTTFTKDGRP

SEQ ID NO: 632811 - protein, 17 aa, Mycobacterium
AKASMTLDVYADLFDED

SEQ ID NO: 632812 - protein, 29 aa, Mycobacterium
AKATGTTPIRWLIEQRIQASLALLESSDH

SEQ ID NO: 632813 - protein, 17 aa, Mycobacterium
AKATLAALVARHSVELI

SEQ ID NO: 632814 - protein, 25 aa, Mycobacterium
AKATLGALIARHGVELIAIGNGTAS

SEQ ID NO: 632815 - protein, 24 aa, Mycobacterium
AKAVAEALGLPVVEKQGIAEHTVR

SEQ ID NO: 632816 - protein, 30 aa, Mycobacterium
AKAVAGAFEVARAAMIHPLEVLANRNVFVQ

SEQ ID NO: 632817 - protein, 28 aa, Mycobacterium
AKAVAPRLFWRRKYRLLQRLGKSSPDAR

SEQ ID NO: 632818 - protein, 17 aa, Mycobacterium
AKAVFLPEITLLRYPAD

SEQ ID NO: 632819 - protein, 20 aa, Mycobacterium
AKAVGGLSVPQAWTVAASEL

SEQ ID NO: 632820 - protein, 17 aa, Mycobacterium
AKAVSKRVRTRWINFAA

SEQ ID NO: 632821 - protein, 17 aa, Mycobacterium
AKAWYKLIHRDLGPLSR

SEQ ID NO: 632822 - protein, 21 aa, Mycobacterium
AKAWYKLLHRDMGPISRYLGP

SEQ ID NO: 632823 - protein, 25 aa, Mycobacterium
AKAYEGHPHFAIPHVVASAPKVVVQ

SEQ ID NO: 632824 - protein, 19 aa, Mycobacterium
AKCPVAWTDTYDGHWVAAG

SEQ ID NO: 632825 - protein, 24 aa, Mycobacterium
AKCREYRIKPVFVEVAEGQSSRHG

SEQ ID NO: 632826 - protein, 20 aa, Mycobacterium
AKCRTLRKAGHESLYSAWPL

SEQ ID NO: 632827 - protein, 17 aa, Mycobacterium
AKDAGGTVFGRLVNTAS

SEQ ID NO: 632828 - protein, 18 aa, Mycobacterium
AKDARLTILDVMAEAIDR

SEQ ID NO: 632829 - protein, 26 aa, Mycobacterium
AKDESVEFVDVRFCDLPGVMQHFTIP

SEQ ID NO: 632830 - protein, 23 aa, Mycobacterium
AKDFAFRAADWLTAMAPAVTGYA

SEQ ID NO: 632831 - protein, 23 aa, Mycobacterium
AKDFRFGLSVRFIKSRAALQELA

SEQ ID NO: 632832 - protein, 22 aa, Mycobacterium
AKDIEAGPVYQGRLRHHLPLTF

SEQ ID NO: 632833 - protein, 23 aa, Mycobacterium
AKDKSSERYVFYTGAREAVRASK

SEQ ID NO: 632834 - protein, 18 aa, Mycobacterium
AKDLGLDGTEVFDITGIE

SEQ ID NO: 632835 - protein, 25 aa, Mycobacterium
AKDRAFEVLDRLRLIDISNNLGDAK

SEQ ID NO: 632836 - protein, 25 aa, Mycobacterium
AKDRGCTRPGCDVAGYQCEVHHVAA

SEQ ID NO: 632837 - protein, 24 aa, Mycobacterium
AKDSLTYSAAFVVCVGRDDAEIAR

SEQ ID NO: 632838 - protein, 25 aa, Mycobacterium
AKDVILEMLRRHDVKGGLNRILEYH

SEQ ID NO: 632839 - protein, 18 aa, Mycobacterium
AKDWPLIVADASQPSTIN

SEQ ID NO: 632840 - protein, 18 aa, Mycobacterium
AKEALNFIDVQRVNASYR

SEQ ID NO: 632841 - protein, 18 aa, Mycobacterium
AKEAPGWKVTAGGEDGVH

SEQ ID NO: 632842 - protein, 18 aa, Mycobacterium
AKEAYGWRVETSMHETHT

SEQ ID NO: 632843 - protein, 25 aa, Mycobacterium
AKEELARYGVQPDWFGLGDRDLGTH

SEQ ID NO: 632844 - protein, 34 aa, Mycobacterium
AKEHAAVQLAVYRLAWAAMRGCPPESVRAAFHYV

SEQ ID NO: 632845 - protein, 24 aa, Mycobacterium
AKEHKALVIKGGYMDGRALTVAEV

SEQ ID NO: 632846 - protein, 18 aa, Mycobacterium
AKEHSFAFPAINCVGSES

SEQ ID NO: 632847 - protein, 18 aa, Mycobacterium
AKEKLFLAVVDRQRERFL

SEQ ID NO: 632848 - protein, 17 aa, Mycobacterium
AKELAISFQRLGAEVIV

SEQ ID NO: 632849 - protein, 24 aa, Mycobacterium
AKELARVCGLNALAAVHALVGIDS

SEQ ID NO: 632850 - protein, 18 aa, Mycobacterium
AKELFTRDKDYIVREGEV

SEQ ID NO: 632851 - protein, 18 aa, Mycobacterium
AKELGALVQRGMTPAQAI

SEQ ID NO: 632852 - protein, 20 aa, Mycobacterium
AKELITIAGRNIFPTEIETV

SEQ ID NO: 632853 - protein, 23 aa, Mycobacterium
AKELKKRGFRFVGPTTAYALMQA

SEQ ID NO: 632854 - protein, 21 aa, Mycobacterium
AKELKRRGFRFVGPTTAYALM

SEQ ID NO: 632855 - protein, 22 aa, Mycobacterium
AKELKRRGFRFVGPTTAYALMQ

SEQ ID NO: 632856 - protein, 19 aa, Mycobacterium
AKELRRLKSILRRRDRTLQ

SEQ ID NO: 632857 - protein, 18 aa, Mycobacterium
AKERGLWNLFLPAESGLT

SEQ ID NO: 632858 - protein, 18 aa, Mycobacterium
AKERGLWNLFLPSVSGLS

SEQ ID NO: 632859 - protein, 30 aa, Mycobacterium
AKERYEGFMRDIPCPVCEGTRLKPEILSVT

SEQ ID NO: 632860 - protein, 19 aa, Mycobacterium
AKESDRIAAENDLAETQRD

SEQ ID NO: 632861 - protein, 23 aa, Mycobacterium
AKESRGVHALRARGALIRIGHDA

SEQ ID NO: 632862 - protein, 22 aa, Mycobacterium
AKESRGVHALRARGASIRIGHD

SEQ ID NO: 632863 - protein, 19 aa, Mycobacterium
AKETAAEMMTAYEDRPTLV

SEQ ID NO: 632864 - protein, 22 aa, Mycobacterium
AKEVKRLAGKGCHAVTFSENPE

SEQ ID NO: 632865 - protein, 20 aa, Mycobacterium
AKEVMRLAALQDRPPGVREL

SEQ ID NO: 632866 - protein, 20 aa, Mycobacterium
AKEWPAVRVRVIPAMTAAQA

SEQ ID NO: 632867 - protein, 18 aa, Mycobacterium
AKFAHPLRFDVPITGQPS

SEQ ID NO: 632868 - protein, 17 aa, Mycobacterium
AKFARLAAATVEGEANE

SEQ ID NO: 632869 - protein, 19 aa, Mycobacterium
AKFGFSVITCRDITKLGSD

SEQ ID NO: 632870 - protein, 20 aa, Mycobacterium
AKFGMTLCALGIAEELRDAR

SEQ ID NO: 632871 - protein, 20 aa, Mycobacterium
AKFGMTLCALGIAEEMREAG

SEQ ID NO: 632872 - protein, 28 aa, Mycobacterium
AKFKIPRYLRLVDEFPMTVTGKVRKVEM

SEQ ID NO: 632873 - protein, 26 aa, Mycobacterium
AKFKSEPWARLGVNVDADFEPLYIIS

SEQ ID NO: 632874 - protein, 30 aa, Mycobacterium
AKFKSEPWARLGVNVDQNFEPLYIVSPEKK

SEQ ID NO: 632875 - protein, 20 aa, Mycobacterium
AKFLADFPFDDELRQKVAAG

SEQ ID NO: 632876 - protein, 19 aa, Mycobacterium
AKFRDAEKLTFPLLSDPDR

SEQ ID NO: 632877 - protein, 19 aa, Mycobacterium
AKFRDAEKLTFPLLSDPEK

SEQ ID NO: 632878 - protein, 18 aa, Mycobacterium
AKFREILETEYLKRPLID

SEQ ID NO: 632879 - protein, 18 aa, Mycobacterium
AKFREILETEYLQRRLID

SEQ ID NO: 632880 - protein, 18 aa, Mycobacterium
AKFRNWDGSYWVAPRDTG

SEQ ID NO: 632881 - protein, 18 aa, Mycobacterium
AKFSFPEVEIGLAPVLVL

SEQ ID NO: 632882 - protein, 17 aa, Mycobacterium
AKFVKFILTEIFPGGQL

SEQ ID NO: 632883 - protein, 20 aa, Mycobacterium
AKGALIHRLIRTGRALFTAH

SEQ ID NO: 632884 - protein, 23 aa, Mycobacterium
AKGARPGCRRCPTIRALETPWSL

SEQ ID NO: 632885 - protein, 21 aa, Mycobacterium
AKGCSHFLGPCVVTVDGDSAV

SEQ ID NO: 632886 - protein, 17 aa, Mycobacterium
AKGDAALARTIRTKQLI

SEQ ID NO: 632887 - protein, 17 aa, Mycobacterium
AKGDRAGAVRTLDEVPP

SEQ ID NO: 632888 - protein, 19 aa, Mycobacterium
AKGDTEWIPPAHLDHGQPR

SEQ ID NO: 632889 - protein, 25 aa, Mycobacterium
AKGERLRLIHKFGAGVNTIALDAAV

SEQ ID NO: 632890 - protein, 23 aa, Mycobacterium
AKGESPGRWMGRGLAALSNTGRF

SEQ ID NO: 632891 - protein, 23 aa, Mycobacterium
AKGESPGTWMGRGLAALGQPVSR

SEQ ID NO: 632892 - protein, 17 aa, Mycobacterium
AKGFAGTIFLTTGDCHA

SEQ ID NO: 632893 - protein, 20 aa, Mycobacterium
AKGFGGFPVGGAFLRTNKQH

SEQ ID NO: 632894 - protein, 18 aa, Mycobacterium
AKGGAAVFQMMGLCQMLR

SEQ ID NO: 632895 - protein, 21 aa, Mycobacterium
AKGGIVFRVQQELGVPVKLVG

SEQ ID NO: 632896 - protein, 19 aa, Mycobacterium
AKGGYWRSHIRSVITVQTV

SEQ ID NO: 632897 - protein, 26 aa, Mycobacterium
AKGHDTFCPVGPWIVTDLDPLDPTDL

SEQ ID NO: 632898 - protein, 26 aa, Mycobacterium
AKGHDTFCPVGPWIVTDVDPADLEIR

SEQ ID NO: 632899 - protein, 26 aa, Mycobacterium
AKGHDTFCPVGPWIVTDVDPADLELR

SEQ ID NO: 632900 - protein, 27 aa, Mycobacterium
AKGIFTSNFGYRWGVLHAGIDLANSIG

SEQ ID NO: 632901 - protein, 23 aa, Mycobacterium
AKGLEFPVVFVTGWEDGMFPHMR

SEQ ID NO: 632902 - protein, 24 aa, Mycobacterium
AKGLEFPVVFVTGWEDGMFPHMRA

SEQ ID NO: 632903 - protein, 17 aa, Mycobacterium
AKGLNAFITATRRVARV

SEQ ID NO: 632904 - protein, 27 aa, Mycobacterium
AKGLQFPIVYVPFLFNRNVRREDIMLY

SEQ ID NO: 632905 - protein, 23 aa, Mycobacterium
AKGRKADVLLRYNFPATGIDDDD

SEQ ID NO: 632906 - protein, 22 aa, Mycobacterium
AKGRPADALREWAAERAPALGI

SEQ ID NO: 632907 - protein, 19 aa, Mycobacterium
AKGTGTLRLSGSRAGEIDH

SEQ ID NO: 632908 - protein, 24 aa, Mycobacterium
AKGTRAHSARSWLGDNAIHKLAPV

SEQ ID NO: 632909 - protein, 17 aa, Mycobacterium
AKGTSLLGVRAVITESF

SEQ ID NO: 632910 - protein, 19 aa, Mycobacterium
AKGVPVEMIRHSNLDMLED

SEQ ID NO: 632911 - protein, 18 aa, Mycobacterium
AKGVRVGPILNHDESEFQ

SEQ ID NO: 632912 - protein, 19 aa, Mycobacterium
AKHAPSYFSLDDWGYACLV

SEQ ID NO: 632913 - protein, 19 aa, Mycobacterium
AKHGAPARRQYHYEPTFLL

SEQ ID NO: 632914 - protein, 20 aa, Mycobacterium
AKHLELLGGHLIGHDVSELL

SEQ ID NO: 632915 - protein, 28 aa, Mycobacterium
AKHLEVLEAAGLVTVQWEGRQKLHHLDT

SEQ ID NO: 632916 - protein, 23 aa, Mycobacterium
AKHLLQSWIPLVALSAHDHQRDW

SEQ ID NO: 632917 - protein, 28 aa, Mycobacterium
AKHVANFKKPRFVDFLDELPRNLGGKVV

SEQ ID NO: 632918 - protein, 17 aa, Mycobacterium
AKIAAKLAIGYSLDEIV

SEQ ID NO: 632919 - protein, 20 aa, Mycobacterium
AKIDRWMVGTVWTTQCSNYF

SEQ ID NO: 632920 - protein, 18 aa, Mycobacterium
AKIELPILAKLMVLEDQW

SEQ ID NO: 632921 - protein, 19 aa, Mycobacterium
AKIGAFFDLDGTLVAGFTA

SEQ ID NO: 632922 - protein, 18 aa, Mycobacterium
AKIGKIVTRRGGFLDQID

SEQ ID NO: 632923 - protein, 18 aa, Mycobacterium
AKIGQAWDRALAASTPVV

SEQ ID NO: 632924 - protein, 35 aa, Mycobacterium
AKILDPFGLENMRFKWRKWLDFDCNWKVALEAFNE

SEQ ID NO: 632925 - protein, 21 aa, Mycobacterium
AKILDPFGLENMRYKWRKWLY

SEQ ID NO: 632926 - protein, 17 aa, Mycobacterium
AKILLAQHVGSSPLQDR

SEQ ID NO: 632927 - protein, 21 aa, Mycobacterium
AKINRFRWIRDKDLRAKFTPD

SEQ ID NO: 632928 - protein, 19 aa, Mycobacterium
AKIPGRYFAGPVLPMPPDS

SEQ ID NO: 632929 - protein, 21 aa, Mycobacterium
AKIRLLENFSRKTLNDDTAVA

SEQ ID NO: 632930 - protein, 23 aa, Mycobacterium
AKISEEFTRWLWSDETRRDTLVA

SEQ ID NO: 632931 - protein, 18 aa, Mycobacterium
AKISLPKIHARVKELAAA

SEQ ID NO: 632932 - protein, 17 aa, Mycobacterium
AKISSGLSLFASNYLLN

SEQ ID NO: 632933 - protein, 23 aa, Mycobacterium
AKIVAERRLWIAVLKAQAELGVP

SEQ ID NO: 632934 - protein, 24 aa, Mycobacterium
AKIVAERRLWLAVLRAQAELGVAV

SEQ ID NO: 632935 - protein, 22 aa, Mycobacterium
AKKAGVRRIVYLSGLHPDRKEL

SEQ ID NO: 632936 - protein, 20 aa, Mycobacterium
AKKAPARKAATKAPAKKAAT

SEQ ID NO: 632937 - protein, 17 aa, Mycobacterium
AKKAVKRNGWGVPGLSW

SEQ ID NO: 632938 - protein, 23 aa, Mycobacterium
AKKHMAFGVGMHRCLGSHYAKLM

SEQ ID NO: 632939 - protein, 26 aa, Mycobacterium
AKKISRLSAVVVRWSRSRNRYERQGI

SEQ ID NO: 632940 - protein, 21 aa, Mycobacterium
AKKLRCPLLVQIADFDQYVPA

SEQ ID NO: 632941 - protein, 22 aa, Mycobacterium
AKKPGFSVDSWGPLAELVAVGE

SEQ ID NO: 632942 - protein, 21 aa, Mycobacterium
AKKVDGGWRVTGQKVWTSLAH

SEQ ID NO: 632943 - protein, 18 aa, Mycobacterium
AKLAANQGVIASFSRALT

SEQ ID NO: 632944 - protein, 23 aa, Mycobacterium
AKLARPNLKAHYGPRLEQMYAEI

SEQ ID NO: 632945 - protein, 17 aa, Mycobacterium
AKLAVKINDLLLPVVKG

SEQ ID NO: 632946 - protein, 19 aa, Mycobacterium
AKLDECLDRYARLFAALTT

SEQ ID NO: 632947 - protein, 18 aa, Mycobacterium
AKLDLERAGAEVILVDFP

SEQ ID NO: 632948 - protein, 23 aa, Mycobacterium
AKLDRISRMLGMDVRDPEHQFTV

SEQ ID NO: 632949 - protein, 23 aa, Mycobacterium
AKLFAEAGFPPGVINVVTGWGPE

SEQ ID NO: 632950 - protein, 18 aa, Mycobacterium
AKLFLADRPDEFIQVPFG

SEQ ID NO: 632951 - protein, 18 aa, Mycobacterium
AKLFLADRPDEFVQVPFG

SEQ ID NO: 632952 - protein, 20 aa, Mycobacterium
AKLFSRQGATVFGIGRDAGR

SEQ ID NO: 632953 - protein, 25 aa, Mycobacterium
AKLGAKPALFVWGMKDFAFRQGPTL

SEQ ID NO: 632954 - protein, 20 aa, Mycobacterium
AKLGAWGVIASVQPSFDALW

SEQ ID NO: 632955 - protein, 17 aa, Mycobacterium
AKLGDWTASRLVQPKSK

SEQ ID NO: 632956 - protein, 20 aa, Mycobacterium
AKLGESVLFPHRLGKPEELA

SEQ ID NO: 632957 - protein, 17 aa, Mycobacterium
AKLGGPVDHDEWFMTPQ

SEQ ID NO: 632958 - protein, 19 aa, Mycobacterium
AKLGKSVAIIERGRMLGGV

SEQ ID NO: 632959 - protein, 19 aa, Mycobacterium
AKLGLSAGVDAEFATALVE

SEQ ID NO: 632960 - protein, 19 aa, Mycobacterium
AKLGPITLRNRIIKAATFE

SEQ ID NO: 632961 - protein, 23 aa, Mycobacterium
AKLGSTRSAAAVDLWADRIPGAV

SEQ ID NO: 632962 - protein, 25 aa, Mycobacterium
AKLHKRLQEELAWVRSGAKARQAKN

SEQ ID NO: 632963 - protein, 21 aa, Mycobacterium
AKLIARYRAAGVTEIVYQPAG

SEQ ID NO: 632964 - protein, 18 aa, Mycobacterium
AKLILGREATIVAGGADR

SEQ ID NO: 632965 - protein, 17 aa, Mycobacterium
AKLKRFREEAGKTGPFE

SEQ ID NO: 632966 - protein, 19 aa, Mycobacterium
AKLKRLVPLVKELIAEGYH

SEQ ID NO: 632967 - protein, 31 aa, Mycobacterium
AKLLERFRAMEPWLDGSRVYAPFWEVHATRV

SEQ ID NO: 632968 - protein, 19 aa, Mycobacterium
AKLLHAFGECTVPRVTLVT

SEQ ID NO: 632969 - protein, 21 aa, Mycobacterium
AKLLKSCDVMPESLTARRNLS

SEQ ID NO: 632970 - protein, 27 aa, Mycobacterium
AKLLQIRSGAPLLLLHRLTHLEDGTPF

SEQ ID NO: 632971 - protein, 26 aa, Mycobacterium
AKLLRACGGIDGLERVRFTSPHPAEF

SEQ ID NO: 632972 - protein, 27 aa, Mycobacterium
AKLLRSPRGGYCYEHVALFGAVLQRLG

SEQ ID NO: 632973 - protein, 23 aa, Mycobacterium
AKLLRVRLGEPFLARQGSMVAYQ

SEQ ID NO: 632974 - protein, 21 aa, Mycobacterium
AKLMEWVAMVGCPIIGINDSA

SEQ ID NO: 632975 - protein, 24 aa, Mycobacterium
AKLMRKGKWGRIVSVSSMAVSLEP

SEQ ID NO: 632976 - protein, 19 aa, Mycobacterium
AKLNLWAAANHMRAGDFAR

SEQ ID NO: 632977 - protein, 26 aa, Mycobacterium
AKLNPRIPRIWNVVGLPPEMALASSE

SEQ ID NO: 632978 - protein, 28 aa, Mycobacterium
AKLPDCLRAVLTAALCAPVPVTVVVVLD

SEQ ID NO: 632979 - protein, 22 aa, Mycobacterium
AKLPFIEVYIATPLAECEKRDP

SEQ ID NO: 632980 - protein, 17 aa, Mycobacterium
AKLPGVRVLIAGGPSGS

SEQ ID NO: 632981 - protein, 19 aa, Mycobacterium
AKLPGVRVVVAGGPSGSGL

SEQ ID NO: 632982 - protein, 19 aa, Mycobacterium
AKLPKSTFKRLERTRISGV

SEQ ID NO: 632983 - protein, 19 aa, Mycobacterium
AKLPLPRTPHCDSSQGDKP

SEQ ID NO: 632984 - protein, 21 aa, Mycobacterium
AKLPVAEAIGYMLEILPALGY

SEQ ID NO: 632985 - protein, 17 aa, Mycobacterium
AKLPWSEWLPQQRWYAG

SEQ ID NO: 632986 - protein, 25 aa, Mycobacterium
AKLQKRLQDELAWVRSGAKARQAKS

SEQ ID NO: 632987 - protein, 25 aa, Mycobacterium
AKLQKRLQEELAWVRSGAKARQAKS

SEQ ID NO: 632988 - protein, 25 aa, Mycobacterium
AKLQKRLTEELAWVRQGAKARQAKN

SEQ ID NO: 632989 - protein, 25 aa, Mycobacterium
AKLQKRLTEELAWVRSGAKARQAKS

SEQ ID NO: 632990 - protein, 23 aa, Mycobacterium
AKLRAAFTASPWAARTPIAVEVP

SEQ ID NO: 632991 - protein, 22 aa, Mycobacterium
AKLRAARQLWARIAEVVGEPDA

SEQ ID NO: 632992 - protein, 21 aa, Mycobacterium
AKLRDYLRWRDLTCRFPGCDA

SEQ ID NO: 632993 - protein, 21 aa, Mycobacterium
AKLRERAHLAAHWLSHGQWTD

SEQ ID NO: 632994 - protein, 20 aa, Mycobacterium
AKLSCLPMTGAPALVASQIE

SEQ ID NO: 632995 - protein, 25 aa, Mycobacterium
AKLSSEYPGRFGALASLPLPHVPAA

SEQ ID NO: 632996 - protein, 36 aa, Mycobacterium
AKLSVPRFASAWLWRLRWPLPLLGMGADIPDGQLCL

SEQ ID NO: 632997 - protein, 17 aa, Mycobacterium
AKLTGTIQNDILKEYAS

SEQ ID NO: 632998 - protein, 17 aa, Mycobacterium
AKLVGLFANMVALRNDL

SEQ ID NO: 632999 - protein, 18 aa, Mycobacterium
AKLVKTVDQIACVRRACQ

SEQ ID NO: 633000 - protein, 23 aa, Mycobacterium
AKMACAKAKVTIENLVSRSGWQL

SEQ ID NO: 633001 - protein, 32 aa, Mycobacterium
AKMFNATGWKIGWACGAPELIAGVRAAKQYLT

SEQ ID NO: 633002 - protein, 22 aa, Mycobacterium
AKMFNCTGWKIGWACGPAQLIA

SEQ ID NO: 633003 - protein, 22 aa, Mycobacterium
AKMFNCTGWKIGWACGPAQLIS

SEQ ID NO: 633004 - protein, 30 aa, Mycobacterium
AKMGHRLTIAVQWRATVEWDGDRPVSVEMT

SEQ ID NO: 633005 - protein, 18 aa, Mycobacterium
AKMGPEYKELKALVRREG

SEQ ID NO: 633006 - protein, 18 aa, Mycobacterium
AKMGVPYNRVVVKEPMGV

SEQ ID NO: 633007 - protein, 23 aa, Mycobacterium
AKMPNDQFLLYAFDGRPAEPECA

SEQ ID NO: 633008 - protein, 18 aa, Mycobacterium
AKMPVLGLGVAKLSDEET

SEQ ID NO: 633009 - protein, 19 aa, Mycobacterium
AKMRAARQLWARVAEVAGD

SEQ ID NO: 633010 - protein, 26 aa, Mycobacterium
AKNDGVCMVTFLPAFVSPAVARWHAE

SEQ ID NO: 633011 - protein, 21 aa, Mycobacterium
AKNGLPIRAGWIHLPCLPSVA

SEQ ID NO: 633012 - protein, 19 aa, Mycobacterium
AKNILPMAFGNLDKSPGIH

SEQ ID NO: 633013 - protein, 29 aa, Mycobacterium
AKNLIRARCEGRFATSVMRPLAVVKADLT

SEQ ID NO: 633014 - protein, 22 aa, Mycobacterium
AKNLRDGRPVTALVRGKRLEGT

SEQ ID NO: 633015 - protein, 18 aa, Mycobacterium
AKNRQPWDFVIVTDRAQL

SEQ ID NO: 633016 - protein, 18 aa, Mycobacterium
AKPAAVVMSMERYNALLD

SEQ ID NO: 633017 - protein, 21 aa, Mycobacterium
AKPADIGWAAAFLASDAASYI

SEQ ID NO: 633018 - protein, 20 aa, Mycobacterium
AKPALFVWGMKDFAFRPGPC

SEQ ID NO: 633019 - protein, 21 aa, Mycobacterium
AKPAVPVRFYRGGSAPAPAVV

SEQ ID NO: 633020 - protein, 20 aa, Mycobacterium
AKPDCAVYCAMGDTRGPDAI

SEQ ID NO: 633021 - protein, 26 aa, Mycobacterium
AKPDFPIPRAARWALKYIPGLQSLIR

SEQ ID NO: 633022 - protein, 21 aa, Mycobacterium
AKPDFRISLVSPVTVREGCGY

SEQ ID NO: 633023 - protein, 21 aa, Mycobacterium
AKPEALAALVRSRRPEAVDAA

SEQ ID NO: 633024 - protein, 17 aa, Mycobacterium
AKPELLGAFVEEVLRYE

SEQ ID NO: 633025 - protein, 19 aa, Mycobacterium
AKPEYWLSQQGRLTHPMVL

SEQ ID NO: 633026 - protein, 20 aa, Mycobacterium
AKPFRLEDLVSRVRTRLSPG

SEQ ID NO: 633027 - protein, 18 aa, Mycobacterium
AKPGDIWLSDRSWNRPRW

SEQ ID NO: 633028 - protein, 21 aa, Mycobacterium
AKPGDLALLIGYGAGLSYAAQ

SEQ ID NO: 633029 - protein, 22 aa, Mycobacterium
AKPGDLALLIGYGAGLSYAAQV

SEQ ID NO: 633030 - protein, 20 aa, Mycobacterium
AKPGTICGPVISARQRDRVQ

SEQ ID NO: 633031 - protein, 17 aa, Mycobacterium
AKPGVSNLLSIQSAVSR

SEQ ID NO: 633032 - protein, 22 aa, Mycobacterium
AKPIVPGLMPITSLRSVRRQVE

SEQ ID NO: 633033 - protein, 18 aa, Mycobacterium
AKPKAPRVEVAADLRTDW

SEQ ID NO: 633034 - protein, 23 aa, Mycobacterium
AKPKLPGIAGIASFGGKTFHTSR

SEQ ID NO: 633035 - protein, 31 aa, Mycobacterium
AKPKRVAIMVSRTDHCLLDLLWRNRRGELDM

SEQ ID NO: 633036 - protein, 23 aa, Mycobacterium
AKPKRYIPGLPIDIEDESQLPEY

SEQ ID NO: 633037 - protein, 24 aa, Mycobacterium
AKPKRYIPGLPLDIEDDAQLPEAV

SEQ ID NO: 633038 - protein, 17 aa, Mycobacterium
AKPLALFHTKRFASLAQ

SEQ ID NO: 633039 - protein, 26 aa, Mycobacterium
AKPLARQCALNALAAVHALTGIESVV

SEQ ID NO: 633040 - protein, 18 aa, Mycobacterium
AKPLAVAAAPEFRDAIRG

SEQ ID NO: 633041 - protein, 27 aa, Mycobacterium
AKPPRFHARLVSVDALRVASGRDFDSL

SEQ ID NO: 633042 - protein, 25 aa, Mycobacterium
AKPRAGLIGCAWGDLAEVMAGVFAT

SEQ ID NO: 633043 - protein, 20 aa, Mycobacterium
AKPREIHVVPELPKTRSGKI

SEQ ID NO: 633044 - protein, 31 aa, Mycobacterium
AKPREIHVVPELPKTRSGKIMRRLLRDVAEG

SEQ ID NO: 633045 - protein, 19 aa, Mycobacterium
AKPRLVAYVVTSTGEQLPI

SEQ ID NO: 633046 - protein, 24 aa, Mycobacterium
AKPRPLATARWAAAVDCVGGATLA

SEQ ID NO: 633047 - protein, 19 aa, Mycobacterium
AKPRWRDYFAAARRGLVPG

SEQ ID NO: 633048 - protein, 26 aa, Mycobacterium
AKPTVVYCAGGYRSSVAASLLRGNGF

SEQ ID NO: 633049 - protein, 23 aa, Mycobacterium
AKPTVVYCAGGYRSSVAASVLRR

SEQ ID NO: 633050 - protein, 24 aa, Mycobacterium
AKPVEVYAIFGGQWPHSSFMVPGG

SEQ ID NO: 633051 - protein, 19 aa, Mycobacterium
AKPYCVALVSLDREAITDW

SEQ ID NO: 633052 - protein, 18 aa, Mycobacterium
AKPYCVALVSLDSEAITE

SEQ ID NO: 633053 - protein, 21 aa, Mycobacterium
AKPYSGAPMVLWARGPARLDE

SEQ ID NO: 633054 - protein, 22 aa, Mycobacterium
AKQDGRCPLCGDHLLTVDQPPQ

SEQ ID NO: 633055 - protein, 22 aa, Mycobacterium
AKQGRVPFLADYVASKFGVLGL

SEQ ID NO: 633056 - protein, 20 aa, Mycobacterium
AKQLRQVRELGFDHIDPTDA

SEQ ID NO: 633057 - protein, 20 aa, Mycobacterium
AKQQLDHWARVGRAVSSHQT

SEQ ID NO: 633058 - protein, 27 aa, Mycobacterium
AKQQPLWRVLVALSIRHVGPTAARALA

SEQ ID NO: 633059 - protein, 25 aa, Mycobacterium
AKQRAFEVLDKLALIDISNNLGDAK

SEQ ID NO: 633060 - protein, 25 aa, Mycobacterium
AKQRAFEVLDKLTLIDISNNLGDAK

SEQ ID NO: 633061 - protein, 24 aa, Mycobacterium
AKQRFLETFQRAILQPRNLDYKVQ

SEQ ID NO: 633062 - protein, 22 aa, Mycobacterium
AKQRISPGLIKSAGYDGVVNYV

SEQ ID NO: 633063 - protein, 24 aa, Mycobacterium
AKQVRLPGFRPGKAPAKLLEARFG

SEQ ID NO: 633064 - protein, 18 aa, Mycobacterium
AKQVRLPGFRPGKAPIRL

SEQ ID NO: 633065 - protein, 35 aa, Mycobacterium
AKQVRLPGFRPGKAPRKLLEARIGRGAVLEQVVND

SEQ ID NO: 633066 - protein, 25 aa, Mycobacterium
AKQVRLPGFRPGRAPVKLLEARFGR

SEQ ID NO: 633067 - protein, 17 aa, Mycobacterium
AKQVTRVLVAIENAVWP

SEQ ID NO: 633068 - protein, 21 aa, Mycobacterium
AKQWLSRRVTLQADGEWHDEF

SEQ ID NO: 633069 - protein, 22 aa, Mycobacterium
AKQWPGVPVRVIPAMTAAQAVA

SEQ ID NO: 633070 - protein, 20 aa, Mycobacterium
AKQWPGVQIRVIPAMTAAQA

SEQ ID NO: 633071 - protein, 17 aa, Mycobacterium
AKRALGERATVVAGGAD

SEQ ID NO: 633072 - protein, 17 aa, Mycobacterium
AKRARRPMFSSKLTGIP

SEQ ID NO: 633073 - protein, 20 aa, Mycobacterium
AKRAVDCGVSAISVSNHGGN

SEQ ID NO: 633074 - protein, 20 aa, Mycobacterium
AKREPGQLVDMAWDPITRIV

SEQ ID NO: 633075 - protein, 22 aa, Mycobacterium
AKRFARDDYDILLIGHEGHEEV

SEQ ID NO: 633076 - protein, 20 aa, Mycobacterium
AKRFARDDYDILLVGHEGHE

SEQ ID NO: 633077 - protein, 18 aa, Mycobacterium
AKRFGITIRTLHHYDHIG

SEQ ID NO: 633078 - protein, 19 aa, Mycobacterium
AKRFSCPYHAWTYDNSGRL

SEQ ID NO: 633079 - protein, 22 aa, Mycobacterium
AKRFTSELSRTGVCQAVVPVSG

SEQ ID NO: 633080 - protein, 25 aa, Mycobacterium
AKRGGQHLHSWMAPLMGGFFGYTPV

SEQ ID NO: 633081 - protein, 21 aa, Mycobacterium
AKRGLEVHVFYVGLDSADTCI

SEQ ID NO: 633082 - protein, 19 aa, Mycobacterium
AKRINTIVASAIEFEIKDP

SEQ ID NO: 633083 - protein, 19 aa, Mycobacterium
AKRKPALHVLLWQRALEPE

SEQ ID NO: 633084 - protein, 17 aa, Mycobacterium
AKRLAATVDARLIDLLP

SEQ ID NO: 633085 - protein, 19 aa, Mycobacterium
AKRLEEVWVPNLDGTAPDP

SEQ ID NO: 633086 - protein, 21 aa, Mycobacterium
AKRLPGVPIVALVETARGLER

SEQ ID NO: 633087 - protein, 21 aa, Mycobacterium
AKRLRMVLMGMFSMACRFDVM

SEQ ID NO: 633088 - protein, 17 aa, Mycobacterium
AKRMVGSAAAVYEHNDP

SEQ ID NO: 633089 - protein, 19 aa, Mycobacterium
AKRNPRLIFARMTGWGQHG

SEQ ID NO: 633090 - protein, 21 aa, Mycobacterium
AKRPLVLDIPLFVSDMSFGAL

SEQ ID NO: 633091 - protein, 19 aa, Mycobacterium
AKRPPRWVVVAELVETSRL

SEQ ID NO: 633092 - protein, 18 aa, Mycobacterium
AKRPRRVLLVSGGSGITP

SEQ ID NO: 633093 - protein, 21 aa, Mycobacterium
AKRPVIMAGTNVWWGHGEAAL

SEQ ID NO: 633094 - protein, 24 aa, Mycobacterium
AKRRAFEVLDKLRLIDISNNLGDT

SEQ ID NO: 633095 - protein, 25 aa, Mycobacterium
AKRRRRGRRGRGRGRGEQNGDEPSD

SEQ ID NO: 633096 - protein, 19 aa, Mycobacterium
AKRSLAQIGQYIRDAVPGT

SEQ ID NO: 633097 - protein, 22 aa, Mycobacterium
AKRTLAVAVYNHYKRIQAGEKA

SEQ ID NO: 633098 - protein, 25 aa, Mycobacterium
AKRVQPGVVGRLGRPGSGLLPALRQ

SEQ ID NO: 633099 - protein, 25 aa, Mycobacterium
AKRVVDFAAGLAFALRGSFDKVATK

SEQ ID NO: 633100 - protein, 25 aa, Mycobacterium
AKRWHAIAEIIGRSWDDVLGAIDDI

SEQ ID NO: 633101 - protein, 22 aa, Mycobacterium
AKSALRALIPHLRRKEDRSWRE

SEQ ID NO: 633102 - protein, 20 aa, Mycobacterium
AKSARLRAGLTQQQLCDRLG

SEQ ID NO: 633103 - protein, 19 aa, Mycobacterium
AKSDVRRKVRDGGEREMRQ

SEQ ID NO: 633104 - protein, 20 aa, Mycobacterium
AKSDVRRKVRDGGEREMRQL

SEQ ID NO: 633105 - protein, 27 aa, Mycobacterium
AKSEAIVHLGFGFGIVFINPALEAVDW

SEQ ID NO: 633106 - protein, 30 aa, Mycobacterium; identical to SEQ ID NO: 15118

SEQ ID NO: 633107 - protein, 25 aa, Mycobacterium
AKSFQRLGIRCFGFAPLRLPPDLDF

SEQ ID NO: 633108 - protein, 19 aa, Mycobacterium
AKSGPFGGTIVHGYLTLAL

SEQ ID NO: 633109 - protein, 18 aa, Mycobacterium
AKSGQGWIYSITPNQPGI

SEQ ID NO: 633110 - protein, 20 aa, Mycobacterium
AKSGRLKRLYGGAMLTSGSR

SEQ ID NO: 633111 - protein, 24 aa, Mycobacterium
AKSLSGHHIELWAAHVVDRVAPGG

SEQ ID NO: 633112 - protein, 26 aa, Mycobacterium
AKSMPYKHGFGPFAPEIYRAPMSYPF

SEQ ID NO: 633113 - protein, 18 aa, Mycobacterium
AKSPEWAAHISGLSADTL

SEQ ID NO: 633114 - protein, 17 aa, Mycobacterium
AKSPILVGGQMLNLQEP

SEQ ID NO: 633115 - protein, 18 aa, Mycobacterium
AKSRRLAYIANFTDLCPE

SEQ ID NO: 633116 - protein, 19 aa, Mycobacterium
AKSRRQWYGPTVFEVLKSS

SEQ ID NO: 633117 - protein, 20 aa, Mycobacterium
AKSRVCFTMEEVRETVADLG

SEQ ID NO: 633118 - protein, 24 aa, Mycobacterium
AKSVRIRNLAGFTGLYSEGDGGSA

SEQ ID NO: 633119 - protein, 22 aa, Mycobacterium
AKSWDIDMPNQFEAAERIAKRR

SEQ ID NO: 633120 - protein, 18 aa, Mycobacterium
AKSYPTFTPVGPELVLLT

SEQ ID NO: 633121 - protein, 23 aa, Mycobacterium
AKTAEAFRGGWFHSGDLGYYDEH

SEQ ID NO: 633122 - protein, 28 aa, Mycobacterium
AKTAHFCSMCGPKFCSMRISRDVRDAYE

SEQ ID NO: 633123 - protein, 20 aa, Mycobacterium
AKTAPVECRFIFSETTTFGP

SEQ ID NO: 633124 - protein, 19 aa, Mycobacterium
AKTCDSIRTDSRFTEDGRR

SEQ ID NO: 633125 - protein, 22 aa, Mycobacterium
AKTEFMAPPGVPWETDADGGEA

SEQ ID NO: 633126 - protein, 22 aa, Mycobacterium
AKTFNCTGWKIGWACGTPELVA

SEQ ID NO: 633127 - protein, 24 aa, Mycobacterium
AKTGDVMLRYNFPGGGLTDDALRT

SEQ ID NO: 633128 - protein, 24 aa, Mycobacterium
AKTGKLRPALFVVPTDTPGFTYTA

SEQ ID NO: 633129 - protein, 23 aa, Mycobacterium
AKTGLRALIPHLRRKEDRSWRET

SEQ ID NO: 633130 - protein, 19 aa, Mycobacterium
AKTGTLFRLACSYGGTAGG

SEQ ID NO: 633131 - protein, 20 aa, Mycobacterium
AKTIFWNGPMGVFEFPAYAT

SEQ ID NO: 633132 - protein, 20 aa, Mycobacterium
AKTIFWNGPMGVFEFPGYAA

SEQ ID NO: 633133 - protein, 20 aa, Mycobacterium
AKTIKGYSLGAHFQGRNATH

SEQ ID NO: 633134 - protein, 24 aa, Mycobacterium
AKTLPDFPSMWVDMLAGEPGRNQQ

SEQ ID NO: 633135 - protein, 25 aa, Mycobacterium
AKTLPGMLAGVVPLVLRLSPELTVA

SEQ ID NO: 633136 - protein, 26 aa, Mycobacterium
AKTLRADEALPLFAISVGAALVRTDE

SEQ ID NO: 633137 - protein, 21 aa, Mycobacterium
AKTLWAHRITVESGEFVEGDT

SEQ ID NO: 633138 - protein, 18 aa, Mycobacterium
AKTQALAAERGFEVSEVA

SEQ ID NO: 633139 - protein, 19 aa, Mycobacterium
AKTQISWVDADTVYVGTDF

SEQ ID NO: 633140 - protein, 20 aa, Mycobacterium
AKTQTVLPFDGLKNPDGVAV

SEQ ID NO: 633141 - protein, 17 aa, Mycobacterium
AKTRHNLGFMVADLLAA

SEQ ID NO: 633142 - protein, 19 aa, Mycobacterium
AKTVFWNGPMGVFEFPAFA

SEQ ID NO: 633143 - protein, 20 aa, Mycobacterium
AKTVFWNGPMGVFEFPAFAA

SEQ ID NO: 633144 - protein, 18 aa, Mycobacterium
AKTWEFQALLKARPCAGD

SEQ ID NO: 633145 - protein, 25 aa, Mycobacterium
AKTYQCARRLPAPIKVAITGTPMEN

SEQ ID NO: 633146 - protein, 20 aa, Mycobacterium
AKVAEILHRVQAGGPFSSRH

SEQ ID NO: 633147 - protein, 19 aa, Mycobacterium
AKVAGWRVVAKVDEKFRIP

SEQ ID NO: 633148 - protein, 20 aa, Mycobacterium
AKVAGYLRAAELMFCDADFR

SEQ ID NO: 633149 - protein, 31 aa, Mycobacterium
AKVAMNVMLRRTFKATLDFTAPAALVEDSDP

SEQ ID NO: 633150 - protein, 18 aa, Mycobacterium
AKVAVALQRVVREEAGVL

SEQ ID NO: 633151 - protein, 26 aa, Mycobacterium
AKVAYRAGSLLLRGGPLALGFFTGWL

SEQ ID NO: 633152 - protein, 18 aa, Mycobacterium
AKVDAAWNLHELTCDLDV

SEQ ID NO: 633153 - protein, 18 aa, Mycobacterium
AKVDAAWNLHELTRDLDL

SEQ ID NO: 633154 - protein, 18 aa, Mycobacterium
AKVDAAWNLHELTRDLGV

SEQ ID NO: 633155 - protein, 18 aa, Mycobacterium
AKVDAAWNLHELTRDMDL

SEQ ID NO: 633156 - protein, 19 aa, Mycobacterium
AKVDCIRFTQGQRSAAGRA

SEQ ID NO: 633157 - protein, 19 aa, Mycobacterium
AKVDLPQALAFAAAHGLDI

SEQ ID NO: 633158 - protein, 18 aa, Mycobacterium
AKVDRTQFDLGWNRLGMI

SEQ ID NO: 633159 - protein, 38 aa, Mycobacterium
AKVEGLFRIAEAWPRRPGARMLVCSSVSGLWGGRGHAA

SEQ ID NO: 633160 - protein, 17 aa, Mycobacterium
AKVGRPDIMIVVGGVIP

SEQ ID NO: 633161 - protein, 25 aa, Mycobacterium
AKVGRPDIMIVVGGVIPPGDFDELY

SEQ ID NO: 633162 - protein, 19 aa, Mycobacterium
AKVGSNCRIHHGVTIGEGR

SEQ ID NO: 633163 - protein, 18 aa, Mycobacterium
AKVICIGLNYLKHVAEGS

SEQ ID NO: 633164 - protein, 25 aa, Mycobacterium
AKVIEELREARALGIPARPVVVGPI

SEQ ID NO: 633165 - protein, 21 aa, Mycobacterium
AKVLCVLGFADSVTAAECVPV

SEQ ID NO: 633166 - protein, 17 aa, Mycobacterium
AKVLPYSNFWHIKNYSR

SEQ ID NO: 633167 - protein, 17 aa, Mycobacterium
AKVLRRQPLPLSLLATH

SEQ ID NO: 633168 - protein, 17 aa, Mycobacterium
AKVLVREAARARKLPVL

SEQ ID NO: 633169 - protein, 20 aa, Mycobacterium
AKVMPPFLAEWVEQGNDDDA

SEQ ID NO: 633170 - protein, 18 aa, Mycobacterium
AKVMRIGTMIKQLLEEVR

SEQ ID NO: 633171 - protein, 23 aa, Mycobacterium
AKVMRIGTMIKQLLEEVRAAPLD

SEQ ID NO: 633172 - protein, 20 aa, Mycobacterium
AKVPGVVKKLFAKVPRTQKI

SEQ ID NO: 633173 - protein, 17 aa, Mycobacterium
AKVPRALARYLQRDGTD

SEQ ID NO: 633174 - protein, 38 aa, Mycobacterium
AKVPYYRVLELAPWLSRPRPNFPVTNFLHADAAPMNAV

SEQ ID NO: 633175 - protein, 29 aa, Mycobacterium
AKVPYYRVLELAPWLSWPQPNFPVSNFFH

SEQ ID NO: 633176 - protein, 20 aa, Mycobacterium
AKVRFFGNVRRYGMVSPTVF

SEQ ID NO: 633177 - protein, 19 aa, Mycobacterium
AKVRHGMGLSMADALAKLG

SEQ ID NO: 633178 - protein, 18 aa, Mycobacterium
AKVSLPVALVVDGAAVTS

SEQ ID NO: 633179 - protein, 18 aa, Mycobacterium
AKVSLPVALVVDGATVTS

SEQ ID NO: 633180 - protein, 25 aa, Mycobacterium
AKVTCAIVSVGAWVEGASQVYSSLT

SEQ ID NO: 633181 - protein, 22 aa, Mycobacterium
AKVTCPILFCVCEADSVAPAGP

SEQ ID NO: 633182 - protein, 24 aa, Mycobacterium
AKVTGIAVGAGWNLALGCDLVVAT

SEQ ID NO: 633183 - protein, 21 aa, Mycobacterium
AKVTGLVRMTDAWPLRPDARI

SEQ ID NO: 633184 - protein, 24 aa, Mycobacterium
AKVTGVAVGAGWNLALGCDFVVAT

SEQ ID NO: 633185 - protein, 24 aa, Mycobacterium
AKVTGVAVGAGWNLALGCDLVVAT

SEQ ID NO: 633186 - protein, 28 aa, Mycobacterium
AKVTLWLDPVCPFSWNTARWLRAVAEKA

SEQ ID NO: 633187 - protein, 24 aa, Mycobacterium
AKVVAERRLWLAVLRAQAELGVDV

SEQ ID NO: 633188 - protein, 25 aa, Mycobacterium
AKVVAERRLWLAVLRAQRELGAKGT

SEQ ID NO: 633189 - protein, 17 aa, Mycobacterium
AKVVAMCNQKGGVGKTT

SEQ ID NO: 633190 - protein, 18 aa, Mycobacterium
AKVVLDVVHFFRSGDAAA

SEQ ID NO: 633191 - protein, 26 aa, Mycobacterium
AKVVRRMRLQPGRMFLVDTAQGRIVS

SEQ ID NO: 633192 - protein, 26 aa, Mycobacterium
AKVVRRMRLQPGRMFLVDTTQGRIVA

SEQ ID NO: 633193 - protein, 20 aa, Mycobacterium
AKVWDWKRESGGTIGGQMRR

SEQ ID NO: 633194 - protein, 24 aa, Mycobacterium
AKVWRGETKLGESYETVEIPADLA

SEQ ID NO: 633195 - protein, 25 aa, Mycobacterium
AKVWSRLGSELGVLGMAVPESAGGA

SEQ ID NO: 633196 - protein, 24 aa, Mycobacterium
AKVWTNELMPDFADTPVFNVNFMP

SEQ ID NO: 633197 - protein, 17 aa, Mycobacterium
AKVYSYWVTRNYREAYG

SEQ ID NO: 633198 - protein, 19 aa, Mycobacterium
AKWAPSIVVGLGRLAGRTI

SEQ ID NO: 633199 - protein, 20 aa, Mycobacterium
AKWGQLSEVVLLLPHGHEGQ

SEQ ID NO: 633200 - protein, 21 aa, Mycobacterium
AKWIDRLGVVWVEGQLTELKI

SEQ ID NO: 633201 - protein, 17 aa, Mycobacterium
AKWKDQRPFVGTLTMEL

SEQ ID NO: 633202 - protein, 20 aa, Mycobacterium
AKWMPTLRKPLIDTLNTVGV

SEQ ID NO: 633203 - protein, 20 aa, Mycobacterium
AKWNEGGFHFANECFNDLAT

SEQ ID NO: 633204 - protein, 25 aa, Mycobacterium
AKWVVRIVLSLMYWPAESEDVERLM

SEQ ID NO: 633205 - protein, 21 aa, Mycobacterium
AKWYRNRWVRTDSFIESFPVY

SEQ ID NO: 633206 - protein, 21 aa, Mycobacterium
AKYAEEIEELYALDPPPEVYE

SEQ ID NO: 633207 - protein, 30 aa, Mycobacterium
AKYAMVLLLRRVWTATLGLAGRVAMLEDSD

SEQ ID NO: 633208 - protein, 28 aa, Mycobacterium
AKYFGLDGAWGTWVGRWTAEENRHGIVI

SEQ ID NO: 633209 - protein, 17 aa, Mycobacterium
AKYGDEQFMAWRRSYDT

SEQ ID NO: 633210 - protein, 25 aa, Mycobacterium
AKYGLRRYIEFGAHVDRAHWDDAEM

SEQ ID NO: 633211 - protein, 17 aa, Mycobacterium
AKYIVFRNGEPVPAVTH

SEQ ID NO: 633212 - protein, 26 aa, Mycobacterium
AKYKSEPWARLGVNVDADFEPLYIIS

SEQ ID NO: 633213 - protein, 26 aa, Mycobacterium
AKYKSEPWARLGVNVDADFEPLYIVS

SEQ ID NO: 633214 - protein, 17 aa, Mycobacterium
AKYLAITGGGGFLLYIQ

SEQ ID NO: 633215 - protein, 17 aa, Mycobacterium
AKYLAITGGGGFLLYLQ

SEQ ID NO: 633216 - protein, 26 aa, Mycobacterium
AKYLNRLSDLLFILARAANPEGDVLW

SEQ ID NO: 633217 - protein, 25 aa, Mycobacterium
AKYLNRLSDLLFILSRVANPDGDVL

SEQ ID NO: 633218 - protein, 26 aa, Mycobacterium
AKYLNRLSDLLFILSRVANPDGDVLW

SEQ ID NO: 633219 - protein, 25 aa, Mycobacterium
AKYLNRLSDLLFILSRVANPEGDVL

SEQ ID NO: 633220 - protein, 21 aa, Mycobacterium
AKYPDRLTVIHWLESVQGLPS

SEQ ID NO: 633221 - protein, 21 aa, Mycobacterium
AKYPDRLTVVHWLESLQGLPS

SEQ ID NO: 633222 - protein, 21 aa, Mycobacterium
AKYPDRLTVVHWLETVQGLPT

SEQ ID NO: 633223 - protein, 24 aa, Mycobacterium
AKYPVALRFGKPQWAKIVSGEAEL

SEQ ID NO: 633224 - protein, 23 aa, Mycobacterium
AKYRIQLLRVFDQVIEHGRTNAL

SEQ ID NO: 633225 - protein, 24 aa, Mycobacterium
AKYRRDKVGIVFQAFNLVPSLTAL

SEQ ID NO: 633226 - protein, 19 aa, Mycobacterium
ALAADLCFDLPVIGEVARK

SEQ ID NO: 633227 - protein, 17 aa, Mycobacterium
ALAADVGAEFVVVAGDV

SEQ ID NO: 633228 - protein, 20 aa, Mycobacterium
ALAADWRISGDNVKFGATEI

SEQ ID NO: 633229 - protein, 24 aa, Mycobacterium
ALAAEGLCGLIFPTHLGGTGDTNV

SEQ ID NO: 633230 - protein, 26 aa, Mycobacterium
ALAAEICDGWLPIFYTPRMADTYNAW

SEQ ID NO: 633231 - protein, 26 aa, Mycobacterium
ALAAEICDGWLPIFYTPRMADTYNEW

SEQ ID NO: 633232 - protein, 18 aa, Mycobacterium
ALAAELGTAASFYREVVA

SEQ ID NO: 633233 - protein, 25 aa, Mycobacterium
ALAAELRLPLVLMIDTAGPALSAEA

SEQ ID NO: 633234 - protein, 24 aa, Mycobacterium
ALAAEPWADCWKAIPMTDAGTGEM

SEQ ID NO: 633235 - protein, 25 aa, Mycobacterium
ALAAEYKKLLLAMLQRREAWEIVDY

SEQ ID NO: 633236 - protein, 19 aa, Mycobacterium
ALAAFRRAGGQIVQTVNPA

SEQ ID NO: 633237 - protein, 19 aa, Mycobacterium
ALAAGLCAAAADLGATARV

SEQ ID NO: 633238 - protein, 18 aa, Mycobacterium
ALAAGRRAVGWWLVGTGR

SEQ ID NO: 633239 - protein, 23 aa, Mycobacterium
ALAAGRRPRAIIRGSAVNHNGRG

SEQ ID NO: 633240 - protein, 25 aa, Mycobacterium
ALAAGRSAVGWWLAGASRAMLELAR

SEQ ID NO: 633241 - protein, 19 aa, Mycobacterium
ALAAGYSRWIDLVEKAIQR

SEQ ID NO: 633242 - protein, 28 aa, Mycobacterium
ALAAHGLSCAGLVIGAWPAEPGVAELDN

SEQ ID NO: 633243 - protein, 19 aa, Mycobacterium
ALAAIRARQAELARQHDVL

SEQ ID NO: 633244 - protein, 36 aa, Mycobacterium
ALAALPETFAVAWTCLFRNLDLKAGQTLVLRGATSS

SEQ ID NO: 633245 - protein, 24 aa, Mycobacterium
ALAALPWQQACITFAQHMFDALRR

SEQ ID NO: 633246 - protein, 18 aa, Mycobacterium
ALAALRKGDIITITHGRR

SEQ ID NO: 633247 - protein, 22 aa, Mycobacterium
ALAALRPGGRIVVMAYQSLEDR

SEQ ID NO: 633248 - protein, 18 aa, Mycobacterium
ALAALVLLHDSRRTTRVD

SEQ ID NO: 633249 - protein, 19 aa, Mycobacterium
ALAARASAELKAMLAQFDA

SEQ ID NO: 633250 - protein, 22 aa, Mycobacterium
ALAARGWLGMTVPKEYGGQGRS

SEQ ID NO: 633251 - protein, 26 aa, Mycobacterium
ALAARMACPYANPGRFVSGRPLVQGM

SEQ ID NO: 633252 - protein, 21 aa, Mycobacterium
ALAATSWALLGMMSYEEEVSG

SEQ ID NO: 633253 - protein, 17 aa, Mycobacterium
ALAAVDWDPPRFTTTAF

SEQ ID NO: 633254 - protein, 18 aa, Mycobacterium
ALAAVLVRGPDGLTDTWV

SEQ ID NO: 633255 - protein, 18 aa, Mycobacterium
ALAAWSMVHGFSLLWLND

SEQ ID NO: 633256 - protein, 24 aa, Mycobacterium
ALAAYPAHIHRLSPALTLQGAVAH

SEQ ID NO: 633257 - protein, 22 aa, Mycobacterium
ALACGIGSFAHHTVVHEASCVK

SEQ ID NO: 633258 - protein, 23 aa, Mycobacterium
ALADACGTLEGFAAEATPRRVYL

SEQ ID NO: 633259 - protein, 21 aa, Mycobacterium
ALADAGLDWQQIQLVAGADTI

SEQ ID NO: 633260 - protein, 17 aa, Mycobacterium
ALADCLRGGFGTPDDGK

SEQ ID NO: 633261 - protein, 22 aa, Mycobacterium
ALADDRPAPGLVRGESHDTPKT

SEQ ID NO: 633262 - protein, 22 aa, Mycobacterium
ALADDRPAPGLVRGESHEAPKT

SEQ ID NO: 633263 - protein, 27 aa, Mycobacterium
ALADEWFKRYAAGYDVTQWYTAPVQQL

SEQ ID NO: 633264 - protein, 22 aa, Mycobacterium
ALADGVVRPVMFMAYSGEARWR

SEQ ID NO: 633265 - protein, 22 aa, Mycobacterium
ALADLCRTRDILLIVDDVQMGC

SEQ ID NO: 633266 - protein, 25 aa, Mycobacterium
ALADLLWRMGIRTLGQFAALSRTDV

SEQ ID NO: 633267 - protein, 23 aa, Mycobacterium
ALADLPLAAPVTVVGGGLTGIET

SEQ ID NO: 633268 - protein, 17 aa, Mycobacterium
ALADPFVALIMGGSGTP

SEQ ID NO: 633269 - protein, 23 aa, Mycobacterium
ALAEAGLDWRQIQLVAGADTIRN

SEQ ID NO: 633270 - protein, 22 aa, Mycobacterium
ALAEAGLDWTQIQLVAGADTIR

SEQ ID NO: 633271 - protein, 26 aa, Mycobacterium
ALAEARPLSRVRIWDGSTPWLVTGYE

SEQ ID NO: 633272 - protein, 17 aa, Mycobacterium
ALAEELVALLGAENPAR

SEQ ID NO: 633273 - protein, 23 aa, Mycobacterium
ALAEERPAPGLYRGESHDTPKTA

SEQ ID NO: 633274 - protein, 17 aa, Mycobacterium
ALAEFKALFQMKFYGVA

SEQ ID NO: 633275 - protein, 18 aa, Mycobacterium
ALAEFKRNGIAAADTAAI

SEQ ID NO: 633276 - protein, 18 aa, Mycobacterium
ALAEFLRRRREAIRPQDV

SEQ ID NO: 633277 - protein, 28 aa, Mycobacterium
ALAEFSHPGLDRILQWDLRYGAEVVATL

SEQ ID NO: 633278 - protein, 24 aa, Mycobacterium
ALAEGGPGARIWAHGNIAAAQAMA

SEQ ID NO: 633279 - protein, 18 aa, Mycobacterium
ALAEGGPQTRVWAHGNLV

SEQ ID NO: 633280 - protein, 17 aa, Mycobacterium
ALAEGKNAVARSLLSTG

SEQ ID NO: 633281 - protein, 26 aa, Mycobacterium
ALAEGRRLGCACGQADCPTRAGEHAR

SEQ ID NO: 633282 - protein, 18 aa, Mycobacterium
ALAEIGYRGTDPRPQAAG

SEQ ID NO: 633283 - protein, 17 aa, Mycobacterium
ALAEIIAAAAIPEGVVN

SEQ ID NO: 633284 - protein, 19 aa, Mycobacterium
ALAEIKSRWTEIIDTYGSQ

SEQ ID NO: 633285 - protein, 18 aa, Mycobacterium
ALAEIKTRWTEIIDTHGA

SEQ ID NO: 633286 - protein, 23 aa, Mycobacterium
ALAEKEVRLMWDAASAGEPISPL

SEQ ID NO: 633287 - protein, 19 aa, Mycobacterium
ALAELAPRFGLGVVATTAA

SEQ ID NO: 633288 - protein, 17 aa, Mycobacterium
ALAELRATHPLAPTLPL

SEQ ID NO: 633289 - protein, 19 aa, Mycobacterium
ALAELRTDLQAVLEEHGAG

SEQ ID NO: 633290 - protein, 24 aa, Mycobacterium
ALAEQCRRLDALGIGYEIVPGVPA

SEQ ID NO: 633291 - protein, 27 aa, Mycobacterium
ALAERAGAVVVNFNYRLGAFGFSGHPA

SEQ ID NO: 633292 - protein, 23 aa, Mycobacterium
ALAERSAELGIRVLRYGSAGHAE

SEQ ID NO: 633293 - protein, 24 aa, Mycobacterium
ALAERVGAEIAIALDPDADRCAVG

SEQ ID NO: 633294 - protein, 19 aa, Mycobacterium
ALAERWAQRQFPHDLWCDV

SEQ ID NO: 633295 - protein, 17 aa, Mycobacterium
ALAERYGDDWHRWPKPL

SEQ ID NO: 633296 - protein, 17 aa, Mycobacterium
ALAESGVSMSPRKVSKI

SEQ ID NO: 633297 - protein, 23 aa, Mycobacterium
ALAETFTAMAWTIVKLTTLHRTI

SEQ ID NO: 633298 - protein, 24 aa, Mycobacterium
ALAEVCLGELKAQRAHTAAIVANR

SEQ ID NO: 633299 - protein, 31 aa, Mycobacterium
ALAGDGKGGLLLSTRGGYFRVDLTAATPAPA

SEQ ID NO: 633300 - protein, 28 aa, Mycobacterium
ALAGEIDRGLNFMSACGVADRNLQTAEI

SEQ ID NO: 633301 - protein, 21 aa, Mycobacterium
ALAGICARVRNGGGGLTPSDI

SEQ ID NO: 633302 - protein, 18 aa, Mycobacterium
ALAGKAPPTWLADFAEAD

SEQ ID NO: 633303 - protein, 18 aa, Mycobacterium
ALAGKRKGLDRVTVVSFG

SEQ ID NO: 633304 - protein, 19 aa, Mycobacterium
ALAGLAWADAQLVAAAVSF

SEQ ID NO: 633305 - protein, 18 aa, Mycobacterium
ALAGLLLPDGGRVLADGD

SEQ ID NO: 633306 - protein, 18 aa, Mycobacterium
ALAGPRAEFHAEIKRMQN

SEQ ID NO: 633307 - protein, 18 aa, Mycobacterium
ALAGPVFDSLTAESFTHP

SEQ ID NO: 633308 - protein, 17 aa, Mycobacterium
ALAGRDPWADAMPAPTR

SEQ ID NO: 633309 - protein, 23 aa, Mycobacterium
ALAGRVLLGAAISDVRRFPHSFI

SEQ ID NO: 633310 - protein, 19 aa, Mycobacterium
ALAGRVTRALAEFSHPGLD

SEQ ID NO: 633311 - protein, 19 aa, Mycobacterium
ALAGYPGFHVTTPPKDGEP

SEQ ID NO: 633312 - protein, 19 aa, Mycobacterium
ALAHAWRSSGGHVIGLAPT

SEQ ID NO: 633313 - protein, 18 aa, Mycobacterium
ALAHCLAIEDALGVELPD

SEQ ID NO: 633314 - protein, 19 aa, Mycobacterium
ALAHLGGHPVAVVANQPRV

SEQ ID NO: 633315 - protein, 17 aa, Mycobacterium
ALAHPYLTPPSHTRWAR

SEQ ID NO: 633316 - protein, 25 aa, Mycobacterium
ALAIELGRSGALVAISDVDTEGLAV

SEQ ID NO: 633317 - protein, 25 aa, Mycobacterium
ALAIPPKVVERLGVDMAELEELHRV

SEQ ID NO: 633318 - protein, 19 aa, Mycobacterium
ALAKALSERGLSFDEIYDL

SEQ ID NO: 633319 - protein, 31 aa, Mycobacterium
ALAKGRRTVWIPWALGPAAAVMRVLPQSVWR

SEQ ID NO: 633320 - protein, 19 aa, Mycobacterium
ALAKIFSGLIRTWDDPILL

SEQ ID NO: 633321 - protein, 17 aa, Mycobacterium
ALAKLAAGCPVAVLSGR

SEQ ID NO: 633322 - protein, 27 aa, Mycobacterium
ALAKLLAQHRFDAVIADYGFFGILPFL

SEQ ID NO: 633323 - protein, 18 aa, Mycobacterium
ALAKLWAQACHWEPVTPK

SEQ ID NO: 633324 - protein, 24 aa, Mycobacterium
ALAKPALANRDWPQRVRMGRPLSP

SEQ ID NO: 633325 - protein, 22 aa, Mycobacterium
ALALAARVVGAGALARNESRGC

SEQ ID NO: 633326 - protein, 22 aa, Mycobacterium
ALALFGRPWIGNGADGGTVGGI

SEQ ID NO: 633327 - protein, 24 aa, Mycobacterium
ALALRLLDRGYFRAGGEQYAEEHE

SEQ ID NO: 633328 - protein, 27 aa, Mycobacterium
ALALSRECWRSVGGMDLRTFGRYGWGV

SEQ ID NO: 633329 - protein, 17 aa, Mycobacterium
ALALSRRSLAEVGNVSS

SEQ ID NO: 633330 - protein, 22 aa, Mycobacterium
ALALTGRPLIGNGANGAPGTGA

SEQ ID NO: 633331 - protein, 28 aa, Mycobacterium
ALANAKRWGVLHVIWRQKIYPGIGAPSW

SEQ ID NO: 633332 - protein, 22 aa, Mycobacterium
ALANARLAYAVFRDVFHDGTRY

SEQ ID NO: 633333 - protein, 20 aa, Mycobacterium
ALANFFRIKPAYFTDDEYYE

SEQ ID NO: 633334 - protein, 18 aa, Mycobacterium
ALANGVRVADVFTTVRAI

SEQ ID NO: 633335 - protein, 23 aa, Mycobacterium
ALANKIRAVAVFGNPGNRFDTPL

SEQ ID NO: 633336 - protein, 18 aa, Mycobacterium
ALANLTDRVFAIVIQDFQ

SEQ ID NO: 633337 - protein, 18 aa, Mycobacterium
ALAPELAALMVGKGREDS

SEQ ID NO: 633338 - protein, 20 aa, Mycobacterium
ALAPGAARVVGVDWRTSLAD

SEQ ID NO: 633339 - protein, 21 aa, Mycobacterium
ALAPHRLRRLVGRITTRLDAT

SEQ ID NO: 633340 - protein, 25 aa, Mycobacterium
ALAPLPLIPAYSISKAAAFSLTQSL

SEQ ID NO: 633341 - protein, 18 aa, Mycobacterium
ALAPYGIVCGTGNVRGTE

SEQ ID NO: 633342 - protein, 19 aa, Mycobacterium
ALAQCLRAGTPDEVAKLVL

SEQ ID NO: 633343 - protein, 19 aa, Mycobacterium
ALAQCLRGGSADEVATLVL

SEQ ID NO: 633344 - protein, 24 aa, Mycobacterium
ALAQLRPLPERVLMVGDRNHDVEG

SEQ ID NO: 633345 - protein, 25 aa, Mycobacterium
ALAQLRRALPKALFVSAHTGEGIAT

SEQ ID NO: 633346 - protein, 24 aa, Mycobacterium
ALAQQAGALGIRFVDAPVTRSPEH

SEQ ID NO: 633347 - protein, 17 aa, Mycobacterium
ALAQRLAAQEAHTCAQL

SEQ ID NO: 633348 - protein, 17 aa, Mycobacterium
ALAQYLLNIAHEVREIL

SEQ ID NO: 633349 - protein, 18 aa, Mycobacterium
ALARAGFHTLKLQTFLTA

SEQ ID NO: 633350 - protein, 24 aa, Mycobacterium
ALARAGFHTLKLQTFLTAGPKEAR

SEQ ID NO: 633351 - protein, 18 aa, Mycobacterium
ALARAGFHTLNLQTYLTV

SEQ ID NO: 633352 - protein, 18 aa, Mycobacterium
ALARAMVNLHRRYRITTA

SEQ ID NO: 633353 - protein, 18 aa, Mycobacterium
ALARAMVNLHRRYRITTT

SEQ ID NO: 633354 - protein, 26 aa, Mycobacterium
ALARANWEAAGWGDVADGMVAVTSVM

SEQ ID NO: 633355 - protein, 24 aa, Mycobacterium
ALARAPRSAGHWLAVAEAAVRGPI

SEQ ID NO: 633356 - protein, 18 aa, Mycobacterium
ALARASGADGAWALAATL

SEQ ID NO: 633357 - protein, 26 aa, Mycobacterium
ALARATELGVRFEVVYGGITTLQSRS

SEQ ID NO: 633358 - protein, 19 aa, Mycobacterium
ALARAWTLAAARDLRGAVA

SEQ ID NO: 633359 - protein, 23 aa, Mycobacterium
ALARDFLTIWFAQLYQHVADARQ

SEQ ID NO: 633360 - protein, 21 aa, Mycobacterium
ALAREDLSVWVVTGDGDALSI

SEQ ID NO: 633361 - protein, 25 aa, Mycobacterium
ALARELTEAILVRRVDWVEEISSVH

SEQ ID NO: 633362 - protein, 26 aa, Mycobacterium
ALAREPRHRSAFCHRDAAFGVTAIGV

SEQ ID NO: 633363 - protein, 17 aa, Mycobacterium
ALARGYHVLAFDGPGQG

SEQ ID NO: 633364 - protein, 20 aa, Mycobacterium
ALARHGLRRRVPVVVPSHTS

SEQ ID NO: 633365 - protein, 18 aa, Mycobacterium
ALARHVAEELPLLGSCTV

SEQ ID NO: 633366 - protein, 27 aa, Mycobacterium
ALARLEARTAINLLLDRTREFAIKPDG

SEQ ID NO: 633367 - protein, 18 aa, Mycobacterium
ALARLGPVRAALPAGAGT

SEQ ID NO: 633368 - protein, 21 aa, Mycobacterium
ALARPEWLVEIDATAVVSEAR

SEQ ID NO: 633369 - protein, 22 aa, Mycobacterium
ALARPTRNCVVFAFEDKSGVTG

SEQ ID NO: 633370 - protein, 20 aa, Mycobacterium
ALARRGCVYVSVNYRLGALG

SEQ ID NO: 633371 - protein, 21 aa, Mycobacterium
ALARRGCVYVSVNYRLGALGC

SEQ ID NO: 633372 - protein, 21 aa, Mycobacterium
ALARRGCVYVSVNYRLGVLGA

SEQ ID NO: 633373 - protein, 20 aa, Mycobacterium
ALARRGCVYVSVNYRVGALG

SEQ ID NO: 633374 - protein, 20 aa, Mycobacterium
ALARRIRVGDPLSERTQMGA

SEQ ID NO: 633375 - protein, 20 aa, Mycobacterium
ALARRLRTPVVVQFDEPSLP

SEQ ID NO: 633376 - protein, 23 aa, Mycobacterium
ALARRRVLLCDELGLGKTLQALT

SEQ ID NO: 633377 - protein, 25 aa, Mycobacterium
ALARSRRALDEFHVEGLATVIPFHR

SEQ ID NO: 633378 - protein, 27 aa, Mycobacterium
ALARSWRWLPPWPDSVDGIAVMKRHVI

SEQ ID NO: 633379 - protein, 20 aa, Mycobacterium
ALARVAHAFVAFARDNPALF

SEQ ID NO: 633380 - protein, 18 aa, Mycobacterium
ALARVFDYVLAIKKTPIV

SEQ ID NO: 633381 - protein, 24 aa, Mycobacterium
ALARVPDRLEVVSVEAADTGHGVG

SEQ ID NO: 633382 - protein, 19 aa, Mycobacterium
ALASALWLKCNVLAERNSR

SEQ ID NO: 633383 - protein, 24 aa, Mycobacterium
ALASELTVGQWVMRGLADLVPNME

SEQ ID NO: 633384 - protein, 24 aa, Mycobacterium
ALASGELIATVALPPQVPRAVDAD

SEQ ID NO: 633385 - protein, 19 aa, Mycobacterium
ALASLIRRHSVAQVTAVPS

SEQ ID NO: 633386 - protein, 19 aa, Mycobacterium
ALASLKPVLDGGIHTAGTS

SEQ ID NO: 633387 - protein, 18 aa, Mycobacterium
ALASLKPVMEGAMHTAGT

SEQ ID NO: 633388 - protein, 19 aa, Mycobacterium
ALASLRDAWAKSPQAAGLL

SEQ ID NO: 633389 - protein, 18 aa, Mycobacterium
ALASRGFDDAVARARSYV

SEQ ID NO: 633390 - protein, 20 aa, Mycobacterium
ALASRLAERIVRGDVKADAL

SEQ ID NO: 633391 - protein, 18 aa, Mycobacterium
ALASRLGYEYTPEVAERT

SEQ ID NO: 633392 - protein, 18 aa, Mycobacterium
ALASSIGGRVLLPSNGAS

SEQ ID NO: 633393 - protein, 31 aa, Mycobacterium
ALASSYIWFFLCPVVPELAIRSRATGKVFAA

SEQ ID NO: 633394 - protein, 20 aa, Mycobacterium
ALATQGWRMLAAALGESRPE

SEQ ID NO: 633395 - protein, 20 aa, Mycobacterium
ALATRISWLRPFGVTDAGQL

SEQ ID NO: 633396 - protein, 19 aa, Mycobacterium
ALAVCDRIGIASTDLDALV

SEQ ID NO: 633397 - protein, 18 aa, Mycobacterium
ALAVCDRIGLAAKDIDLL

SEQ ID NO: 633398 - protein, 18 aa, Mycobacterium
ALAVDGWARTSADSHAGH

SEQ ID NO: 633399 - protein, 19 aa, Mycobacterium
ALAVGCADAALAASDEAPW

SEQ ID NO: 633400 - protein, 20 aa, Mycobacterium
ALAVGIHRLLSWGVVDAPLT

SEQ ID NO: 633401 - protein, 22 aa, Mycobacterium
ALAVGRRLRERYGIDEKPTASD

SEQ ID NO: 633402 - protein, 21 aa, Mycobacterium
ALAVGRRLRERYGLDEKPTAS

SEQ ID NO: 633403 - protein, 25 aa, Mycobacterium
ALAVKDGRIVAVGNWSDVEGWVGSD

SEQ ID NO: 633404 - protein, 17 aa, Mycobacterium
ALAWPLFDAIVDQSAFK

SEQ ID NO: 633405 - protein, 23 aa, Mycobacterium
ALAWQEISAAFAEVHENSLQVGE

SEQ ID NO: 633406 - protein, 21 aa, Mycobacterium
ALAYMDLRPGTAMRDIAVDAV

SEQ ID NO: 633407 - protein, 21 aa, Mycobacterium
ALAYMDLRPGTPMRDIAVDTV

SEQ ID NO: 633408 - protein, 18 aa, Mycobacterium
ALCAAALADAADWVVWAG

SEQ ID NO: 633409 - protein, 17 aa, Mycobacterium
ALCAAALEEILGGRVAE

SEQ ID NO: 633410 - protein, 23 aa, Mycobacterium
ALCADIGAAFARLMRGEGARQVV

SEQ ID NO: 633411 - protein, 19 aa, Mycobacterium
ALCAEARVSITTATLLSIA

SEQ ID NO: 633412 - protein, 20 aa, Mycobacterium
ALCATFDGFYTLLVSNRDSF

SEQ ID NO: 633413 - protein, 18 aa, Mycobacterium
ALCDAAFVREPFIGSEAI

SEQ ID NO: 633414 - protein, 17 aa, Mycobacterium
ALCDAVLDHDRPIHVPC

SEQ ID NO: 633415 - protein, 18 aa, Mycobacterium
ALCDRVALMHHGRLQAVG

SEQ ID NO: 633416 - protein, 24 aa, Mycobacterium
ALCGPGRTLVAHGVRARYRDIRAA

SEQ ID NO: 633417 - protein, 17 aa, Mycobacterium
ALCGSIAGRGWPDDEPV

SEQ ID NO: 633418 - protein, 22 aa, Mycobacterium
ALCRATRQVIANGLAILGVSAP

SEQ ID NO: 633419 - protein, 20 aa, Mycobacterium
ALCRFVLRLPPVVEMTRDEI

SEQ ID NO: 633420 - protein, 20 aa, Mycobacterium
ALCRPIEHGADIVVHSATKF

SEQ ID NO: 633421 - protein, 21 aa, Mycobacterium
ALCSPTRQALLTGRNHHSVGM

SEQ ID NO: 633422 - protein, 23 aa, Mycobacterium
ALCVGMCGQLIYINRAAQVVGAK

SEQ ID NO: 633423 - protein, 19 aa, Mycobacterium
ALCYSARPDPSYDPNKCIF

SEQ ID NO: 633424 - protein, 23 aa, Mycobacterium
ALDAACAVQAEWAGTAPRKRGEI

SEQ ID NO: 633425 - protein, 30 aa, Mycobacterium
ALDACLDKYARLFAWLGLWERHTDLAVIPA

SEQ ID NO: 633426 - protein, 30 aa, Mycobacterium
ALDACLDRYARLFAWLGLWERHTDLAVIPA

SEQ ID NO: 633427 - protein, 18 aa, Mycobacterium
ALDAFRFGPDELAALGNF

SEQ ID NO: 633428 - protein, 25 aa, Mycobacterium
ALDAGVMRPGVKYSVYQLADALQVS

SEQ ID NO: 633429 - protein, 26 aa, Mycobacterium
ALDAHGWLRRAHELEDACGRTREQHW

SEQ ID NO: 633430 - protein, 18 aa, Mycobacterium
ALDALAWRMYEQPPDRWP

SEQ ID NO: 633431 - protein, 24 aa, Mycobacterium
ALDALPPRQRRLVILRDLLGISAE

SEQ ID NO: 633432 - protein, 20 aa, Mycobacterium
ALDALRPRLAPAQSSATAAS

SEQ ID NO: 633433 - protein, 18 aa, Mycobacterium
ALDARLRELAIMRIGWLT

SEQ ID NO: 633434 - protein, 33 aa, Mycobacterium
ALDARVAGRLGLRPDVRRVPLFGLGCVAGAAGV

SEQ ID NO: 633435 - protein, 22 aa, Mycobacterium
ALDASLLLAVLTRFLPADDPRI

SEQ ID NO: 633436 - protein, 19 aa, Mycobacterium
ALDAVGLGAWLAALPQGLS

SEQ ID NO: 633437 - protein, 29 aa, Mycobacterium
ALDAVRESRGLRQPSRAAVAAGPTDAASA

SEQ ID NO: 633438 - protein, 27 aa, Mycobacterium
ALDAYRAAWREAVRVFGRNQVSTYLLV

SEQ ID NO: 633439 - protein, 19 aa, Mycobacterium
ALDDAHRWIDQNSIAEGVE

SEQ ID NO: 633440 - protein, 19 aa, Mycobacterium
ALDDFKRSFDVAVGAQWTG

SEQ ID NO: 633441 - protein, 19 aa, Mycobacterium
ALDDGYRVFGELAPHPLLV

SEQ ID NO: 633442 - protein, 19 aa, Mycobacterium
ALDDGYRVFGELSPHPLLT

SEQ ID NO: 633443 - protein, 19 aa, Mycobacterium
ALDDLRWLLDNAADVGVLA

SEQ ID NO: 633444 - protein, 18 aa, Mycobacterium
ALDDYRRVLAAGVNIVGS

SEQ ID NO: 633445 - protein, 24 aa, Mycobacterium
ALDEGRVVLVAGFQGVSQDTRDVT

SEQ ID NO: 633446 - protein, 23 aa, Mycobacterium
ALDEIRPASVVNLGVGMADGVAT

SEQ ID NO: 633447 - protein, 23 aa, Mycobacterium
ALDEKLRQAYFWIVNQAIISPHY

SEQ ID NO: 633448 - protein, 27 aa, Mycobacterium
ALDEMGRMLGITGRVLPMCPIPLQIEA

SEQ ID NO: 633449 - protein, 23 aa, Mycobacterium
ALDESKAALARRMHAAGEPVSTI

SEQ ID NO: 633450 - protein, 32 aa, Mycobacterium
ALDFMRSCSIKHGHASVIFSLEMSKSEIVMRL

SEQ ID NO: 633451 - protein, 19 aa, Mycobacterium
ALDFPDRAGRLVLMGPGGL

SEQ ID NO: 633452 - protein, 18 aa, Mycobacterium
ALDGLGYRTTSSVDGVLF

SEQ ID NO: 633453 - protein, 21 aa, Mycobacterium
ALDGWPMNILMLGKGNTVNPD

SEQ ID NO: 633454 - protein, 17 aa, Mycobacterium
ALDGWRRIDEFFATHLK

SEQ ID NO: 633455 - protein, 25 aa, Mycobacterium
ALDHISLALAGGRFVSVVGPSGAGK

SEQ ID NO: 633456 - protein, 18 aa, Mycobacterium
ALDHLLKLAADELGPSWV

SEQ ID NO: 633457 - protein, 20 aa, Mycobacterium
ALDHVRCLLVLDDFRDLAAA

SEQ ID NO: 633458 - protein, 24 aa, Mycobacterium
ALDHWTARIGRMAVRLEDATDFLV

SEQ ID NO: 633459 - protein, 22 aa, Mycobacterium
ALDIPILQGLCLTSPREDWDAN

SEQ ID NO: 633460 - protein, 23 aa, Mycobacterium
ALDIPILQGLCLTSSRSDWSDND

SEQ ID NO: 633461 - protein, 31 aa, Mycobacterium
ALDISPLQARCGWAIGWKKDAFFGRDALLAE

SEQ ID NO: 633462 - protein, 27 aa, Mycobacterium
ALDKAIRLFWERGFEATSTRDLSSALG

SEQ ID NO: 633463 - protein, 27 aa, Mycobacterium
ALDKAWESMPFESQWYARNELRRHHEL

SEQ ID NO: 633464 - protein, 20 aa, Mycobacterium
ALDKFGRALADNGFTPLNFE

SEQ ID NO: 633465 - protein, 22 aa, Mycobacterium
ALDKLHLEPGMTLLDVGCGWGG

SEQ ID NO: 633466 - protein, 23 aa, Mycobacterium
ALDKLHLEPGMTLLDVGCGWGGA

SEQ ID NO: 633467 - protein, 23 aa, Mycobacterium
ALDKLRIEAFRNKDLEVDTSDLH

SEQ ID NO: 633468 - protein, 23 aa, Mycobacterium
ALDKLRLEAFRNKELDVDTSDLH

SEQ ID NO: 633469 - protein, 18 aa, Mycobacterium
ALDLACWHPMTTAVAALD

SEQ ID NO: 633470 - protein, 20 aa, Mycobacterium
ALDLARGHADYIWVMDADDL

SEQ ID NO: 633471 - protein, 25 aa, Mycobacterium
ALDLARLMRLPVMFAQLDDQLIGVL

SEQ ID NO: 633472 - protein, 17 aa, Mycobacterium
ALDLARRYPVGVAVAAI

SEQ ID NO: 633473 - protein, 17 aa, Mycobacterium
ALDLCLSSPYGDHNHAG

SEQ ID NO: 633474 - protein, 25 aa, Mycobacterium
ALDLCPRIRVNAIAPGSILTSALDV

SEQ ID NO: 633475 - protein, 20 aa, Mycobacterium
ALDLGCWYPITTAVAAIDAL

SEQ ID NO: 633476 - protein, 26 aa, Mycobacterium
ALDLLSEGRLELGLGTGYVREEFDAA

SEQ ID NO: 633477 - protein, 25 aa, Mycobacterium
ALDNGKRAGKLVLMGPGGLSVNLFS

SEQ ID NO: 633478 - protein, 25 aa, Mycobacterium
ALDNMRIHGGIGFTWEHDAHLYVRR

SEQ ID NO: 633479 - protein, 24 aa, Mycobacterium
ALDNPRAAAIALFGAVTTSALTYL

SEQ ID NO: 633480 - protein, 17 aa, Mycobacterium
ALDPLFTIGYQVAEAVR

SEQ ID NO: 633481 - protein, 22 aa, Mycobacterium
ALDPRLVDAVIFGSADMAADLG

SEQ ID NO: 633482 - protein, 21 aa, Mycobacterium
ALDPRVAVAITDTALQEPHSI

SEQ ID NO: 633483 - protein, 33 aa, Mycobacterium
ALDPSGAVLPELIRRAVVVKAEVVAADEKESQL

SEQ ID NO: 633484 - protein, 24 aa, Mycobacterium
ALDPSTRCWELGPDGQWIASPQDG

SEQ ID NO: 633485 - protein, 23 aa, Mycobacterium
ALDPSTRCWELGPDGQWTAAPHD

SEQ ID NO: 633486 - protein, 24 aa, Mycobacterium
ALDQPARWALLYGSPVPGYHAPAE

SEQ ID NO: 633487 - protein, 23 aa, Mycobacterium
ALDQRIAVRYALPGMSPADTADY

SEQ ID NO: 633488 - protein, 17 aa, Mycobacterium
ALDRAKGALRTMVGAGT

SEQ ID NO: 633489 - protein, 18 aa, Mycobacterium
ALDRAKGVLRTKVGAGTG

SEQ ID NO: 633490 - protein, 19 aa, Mycobacterium
ALDRFPISRVVSSPQRRAV

SEQ ID NO: 633491 - protein, 22 aa, Mycobacterium
ALDRKAEAVQWFLHAADADVEG

SEQ ID NO: 633492 - protein, 24 aa, Mycobacterium
ALDRLLDFMPRYEVLFDECRRVSA

SEQ ID NO: 633493 - protein, 25 aa, Mycobacterium
ALDRLRAATVQLVIVGGGPGTGKTT

SEQ ID NO: 633494 - protein, 19 aa, Mycobacterium
ALDRLRRRGLLLAVVTNQS

SEQ ID NO: 633495 - protein, 18 aa, Mycobacterium
ALDRRAWDALQIPVGVAF

SEQ ID NO: 633496 - protein, 30 aa, Mycobacterium
ALDRRAWEALQIPVGVAFFFTNSALGRTVA

SEQ ID NO: 633497 - protein, 19 aa, Mycobacterium
ALDRWDRVASEVAAAQGIT

SEQ ID NO: 633498 - protein, 20 aa, Mycobacterium
ALDSFPGWLHDGDVVTLRVQ

SEQ ID NO: 633499 - protein, 24 aa, Mycobacterium
ALDSFTLRVGRPIGPMLAQSAGSI

SEQ ID NO: 633500 - protein, 18 aa, Mycobacterium
ALDTGRGLLYVSVEGSNE

SEQ ID NO: 633501 - protein, 18 aa, Mycobacterium
ALDTRWSPESGSLLDEWS

SEQ ID NO: 633502 - protein, 25 aa, Mycobacterium
ALDVARRIAGLGVDEIACFVDFGVA

SEQ ID NO: 633503 - protein, 22 aa, Mycobacterium
ALDVASTKLVWCDSDATVDQVA

SEQ ID NO: 633504 - protein, 24 aa, Mycobacterium
ALDVPILQGLCLTSSKAQWESNDD

SEQ ID NO: 633505 - protein, 17 aa, Mycobacterium
ALDVVKKRLESVGLGEL

SEQ ID NO: 633506 - protein, 24 aa, Mycobacterium
ALDVWSLTDIVAFSRDSVGACSIV

SEQ ID NO: 633507 - protein, 26 aa, Mycobacterium
ALDVYRVGQNVAWQRWTDIVFGLTTD

SEQ ID NO: 633508 - protein, 19 aa, Mycobacterium
ALDYEIWDDGWTVVTKDRK

SEQ ID NO: 633509 - protein, 19 aa, Mycobacterium
ALEAAGFDVERPSAWSVEG

SEQ ID NO: 633510 - protein, 18 aa, Mycobacterium
ALEAAGIVRARERADLIK

SEQ ID NO: 633511 - protein, 17 aa, Mycobacterium
ALEAARMLAEHRLPGLL

SEQ ID NO: 633512 - protein, 21 aa, Mycobacterium
ALEADCVMYSPLMANDAEVKA

SEQ ID NO: 633513 - protein, 20 aa, Mycobacterium
ALEADGMRLAGVLVTHHHPD

SEQ ID NO: 633514 - protein, 25 aa, Mycobacterium
ALEAHRFDFCFIGAGYEDQVDEFLS

SEQ ID NO: 633515 - protein, 25 aa, Mycobacterium
ALEAHRFDFCFIGAGYEDQVDEFLT

SEQ ID NO: 633516 - protein, 23 aa, Mycobacterium
ALEALRIPIEYLAGLFTAGDTAV

SEQ ID NO: 633517 - protein, 17 aa, Mycobacterium
ALEAVDWDPPRFTTTAF

SEQ ID NO: 633518 - protein, 30 aa, Mycobacterium
ALEDFARARGLGMLSMWSLNRDYPGNIGQA

SEQ ID NO: 633519 - protein, 23 aa, Mycobacterium
ALEDGFRVFAELAPHPLLTRALE

SEQ ID NO: 633520 - protein, 24 aa, Mycobacterium
ALEDGFRVFAELSPHPLLTHAVDQ

SEQ ID NO: 633521 - protein, 18 aa, Mycobacterium
ALEDGHRVFAELSPHPLL

SEQ ID NO: 633522 - protein, 20 aa, Mycobacterium
ALEDGYRVFAELSPHPLLTR

SEQ ID NO: 633523 - protein, 27 aa, Mycobacterium
ALEDKFWRRFCESLDRMDLYEPGRQKP

SEQ ID NO: 633524 - protein, 18 aa, Mycobacterium
ALEDRGWIVIRVVAEDDI

SEQ ID NO: 633525 - protein, 21 aa, Mycobacterium
ALEDYRRVLAAGINIVGSGPV

SEQ ID NO: 633526 - protein, 20 aa, Mycobacterium
ALEDYRRVLAAGINVVGSGP

SEQ ID NO: 633527 - protein, 17 aa, Mycobacterium
ALEEAWEAAGLRNDGRV

SEQ ID NO: 633528 - protein, 17 aa, Mycobacterium
ALEEAWETAGLRGGGRV

SEQ ID NO: 633529 - protein, 17 aa, Mycobacterium
ALEEAWETAGLRGSGQV

SEQ ID NO: 633530 - protein, 18 aa, Mycobacterium
ALEEFKGIIRWIQTQGQY

SEQ ID NO: 633531 - protein, 18 aa, Mycobacterium
ALEEGLVCEVARVITAED

SEQ ID NO: 633532 - protein, 19 aa, Mycobacterium
ALEEGVRATFMPKPFGQHA

SEQ ID NO: 633533 - protein, 26 aa, Mycobacterium
ALEEILKRFPAWEVDWANAVPSETAA

SEQ ID NO: 633534 - protein, 26 aa, Mycobacterium
ALEEILKRFPTWEVDWPNAVPSQTTA

SEQ ID NO: 633535 - protein, 17 aa, Mycobacterium
ALEEIRKILTDAGIDID

SEQ ID NO: 633536 - protein, 18 aa, Mycobacterium
ALEEIRKILTNAGVEIDY

SEQ ID NO: 633537 - protein, 19 aa, Mycobacterium
ALEELRKILTDAGIEISYD

SEQ ID NO: 633538 - protein, 18 aa, Mycobacterium
ALEERGFESLFLAEHTHI

SEQ ID NO: 633539 - protein, 28 aa, Mycobacterium
ALEETFMFYLPRICEHCLNPSCVASCPS

SEQ ID NO: 633540 - protein, 26 aa, Mycobacterium
ALEEVLKRFPEWTIDMDNARRSRTST

SEQ ID NO: 633541 - protein, 32 aa, Mycobacterium
ALEEVLKRWPEWDIDMSGARRSRTSTVRGWDS

SEQ ID NO: 633542 - protein, 17 aa, Mycobacterium
ALEFGRQALHAFENAGG

SEQ ID NO: 633543 - protein, 24 aa, Mycobacterium
ALEGKGRRALPVGLGAPSSDPTAE

SEQ ID NO: 633544 - protein, 18 aa, Mycobacterium
ALEHAGGLGASRIVVAGD

SEQ ID NO: 633545 - protein, 24 aa, Mycobacterium
ALEHARAAGALTVAIVNNAGSEAS

SEQ ID NO: 633546 - protein, 23 aa, Mycobacterium
ALEHLLDFMPRYEVDFDGLQRVS

SEQ ID NO: 633547 - protein, 18 aa, Mycobacterium
ALEHRAVLVGSDRDTLRA

SEQ ID NO: 633548 - protein, 18 aa, Mycobacterium
ALEHYLIHRECLTPFNIE

SEQ ID NO: 633549 - protein, 21 aa, Mycobacterium
ALEIADRLGAQRVPAVMILDL

SEQ ID NO: 633550 - protein, 19 aa, Mycobacterium
ALEIIDSRIADWRISVADT

SEQ ID NO: 633551 - protein, 17 aa, Mycobacterium
ALEKAGLDLDDVDYIDI

SEQ ID NO: 633552 - protein, 22 aa, Mycobacterium
ALEKHGAPIYVRHEIVHNRYVV

SEQ ID NO: 633553 - protein, 21 aa, Mycobacterium
ALEKHGPPVYVRHEIVHNRHV

SEQ ID NO: 633554 - protein, 19 aa, Mycobacterium
ALEKLPMYEGAVVRGTNLP

SEQ ID NO: 633555 - protein, 19 aa, Mycobacterium
ALEKPGLRLPQVIRTVLAG

SEQ ID NO: 633556 - protein, 19 aa, Mycobacterium
ALELACWDLNAKLGSEPAY

SEQ ID NO: 633557 - protein, 19 aa, Mycobacterium
ALELACWDLNAKLRDEPAC

SEQ ID NO: 633558 - protein, 17 aa, Mycobacterium
ALELARRGAAVVVNDIG

SEQ ID NO: 633559 - protein, 20 aa, Mycobacterium
ALELARSGVRVALIESGSQR

SEQ ID NO: 633560 - protein, 18 aa, Mycobacterium
ALELDWYEHLGLCAKGEA

SEQ ID NO: 633561 - protein, 24 aa, Mycobacterium
ALELDWYEHLGLCAKGEAEHLLRS

SEQ ID NO: 633562 - protein, 18 aa, Mycobacterium
ALELDWYEHLGLCAKGEG

SEQ ID NO: 633563 - protein, 18 aa, Mycobacterium
ALELDWYEHLGLCEKGEA

SEQ ID NO: 633564 - protein, 19 aa, Mycobacterium
ALELDWYEHLGLCPRGDAE

SEQ ID NO: 633565 - protein, 23 aa, Mycobacterium
ALELEHFPLLGVSQGGAVAVAYA

SEQ ID NO: 633566 - protein, 17 aa, Mycobacterium
ALELIKVHRPAVALLDY

SEQ ID NO: 633567 - protein, 27 aa, Mycobacterium
ALELLPTVRGAFCLTFMDENTLYAARD

SEQ ID NO: 633568 - protein, 26 aa, Mycobacterium
ALELLPTVRGAFCLTFMDENTLYACR

SEQ ID NO: 633569 - protein, 17 aa, Mycobacterium
ALELLWRADGRPDPLDG

SEQ ID NO: 633570 - protein, 23 aa, Mycobacterium
ALELPGAPFVLAVQWHPEQSLDD

SEQ ID NO: 633571 - protein, 18 aa, Mycobacterium
ALELPGFTGGAGHWALTR

SEQ ID NO: 633572 - protein, 17 aa, Mycobacterium
ALELRVTHDADLLRTKL

SEQ ID NO: 633573 - protein, 18 aa, Mycobacterium
ALELSWRSLAEIGNLSSS

SEQ ID NO: 633574 - protein, 24 aa, Mycobacterium
ALELSYRTVRHWFGTRTVIRDVQG

SEQ ID NO: 633575 - protein, 18 aa, Mycobacterium
ALELTWRSLGEIANLSSA

SEQ ID NO: 633576 - protein, 17 aa, Mycobacterium
ALELTWRSLGEIGNLSS

SEQ ID NO: 633577 - protein, 18 aa, Mycobacterium
ALELTWRSLGEIGNLSSA

SEQ ID NO: 633578 - protein, 29 aa, Mycobacterium
ALENMASGLALEWSRYGIRTLCVAPGTIA

SEQ ID NO: 633579 - protein, 22 aa, Mycobacterium
ALENRARRVLPAGLGEGSMDPD

SEQ ID NO: 633580 - protein, 24 aa, Mycobacterium
ALENTRFWAPLSLTPEQKHSIDDP

SEQ ID NO: 633581 - protein, 24 aa, Mycobacterium
ALENTRFWAPLSLTPEQKHSIHDP

SEQ ID NO: 633582 - protein, 18 aa, Mycobacterium
ALEPIGLMRRIGLGETLR

SEQ ID NO: 633583 - protein, 18 aa, Mycobacterium
ALEPLFAKTLKWASTTPL

SEQ ID NO: 633584 - protein, 26 aa, Mycobacterium
ALEPYGGAWLNSWLDRDLGVSGRLSV

SEQ ID NO: 633585 - protein, 17 aa, Mycobacterium
ALEQHPAPALPPRPRAP

SEQ ID NO: 633586 - protein, 23 aa, Mycobacterium
ALEQRGFESLFLAEHSHIPVDAK

SEQ ID NO: 633587 - protein, 18 aa, Mycobacterium
ALEQRGFESLFLAEHTHI

SEQ ID NO: 633588 - protein, 20 aa, Mycobacterium
ALERAGIDPFALRGTATGVF

SEQ ID NO: 633589 - protein, 17 aa, Mycobacterium
ALERAGVVTGVITQNVD

SEQ ID NO: 633590 - protein, 17 aa, Mycobacterium
ALERAKGALRTMVGAGT

SEQ ID NO: 633591 - protein, 26 aa, Mycobacterium
ALERLRRLGLPFLFYVDAAQGRASVL

SEQ ID NO: 633592 - protein, 23 aa, Mycobacterium
ALERWGESMGCEIAPFGLGVTVL

SEQ ID NO: 633593 - protein, 27 aa, Mycobacterium
ALESAFHFPSRIDFFREALRVLKPGGR

SEQ ID NO: 633594 - protein, 21 aa, Mycobacterium
ALETELLWPRVWQMACRLEEI

SEQ ID NO: 633595 - protein, 19 aa, Mycobacterium
ALETFKRPVLVHEPTSHAA

SEQ ID NO: 633596 - protein, 18 aa, Mycobacterium
ALETGRPAFIRGSEHYVG

SEQ ID NO: 633597 - protein, 25 aa, Mycobacterium
ALETHRFDFCFIGAGYEDQVDQFLT

SEQ ID NO: 633598 - protein, 19 aa, Mycobacterium
ALETLEWARMALSACQLTA

SEQ ID NO: 633599 - protein, 19 aa, Mycobacterium
ALETLRAGLTNTWCPDRPR

SEQ ID NO: 633600 - protein, 20 aa, Mycobacterium
ALETMCIGGGQGIAAIFRGA

SEQ ID NO: 633601 - protein, 22 aa, Mycobacterium
ALETRIPLSYEHYRRLHNLTLP

SEQ ID NO: 633602 - protein, 24 aa, Mycobacterium
ALEVACRIGLCFTALASPHEQTFD

SEQ ID NO: 633603 - protein, 18 aa, Mycobacterium
ALEVGGRLVLAASSRRSA

SEQ ID NO: 633604 - protein, 30 aa, Mycobacterium
ALEVKEGPAALPWGDLGVDVVVESTGIFTN

SEQ ID NO: 633605 - protein, 28 aa, Mycobacterium
ALEVNPRITALMCTADVLALSAMDHLRS

SEQ ID NO: 633606 - protein, 27 aa, Mycobacterium
ALEVPGDWEPLGAIAIGYGTDPVTPRE

SEQ ID NO: 633607 - protein, 18 aa, Mycobacterium
ALEVREGPAAMPWGDLGV

SEQ ID NO: 633608 - protein, 18 aa, Mycobacterium
ALEVRLQAWALILEAVAG

SEQ ID NO: 633609 - protein, 20 aa, Mycobacterium
ALEVSGRLLLAASSRRSAWW

SEQ ID NO: 633610 - protein, 17 aa, Mycobacterium
ALEYAKQGLRAACVAPG

SEQ ID NO: 633611 - protein, 17 aa, Mycobacterium
ALFAAIITSAGGVPQDE

SEQ ID NO: 633612 - protein, 17 aa, Mycobacterium
ALFADAYRVPPWWDPEK

SEQ ID NO: 633613 - protein, 18 aa, Mycobacterium
ALFADIQLIALIAQNPEA

SEQ ID NO: 633614 - protein, 26 aa, Mycobacterium
ALFAFGVALQPRFGAGSAQRHRESGA

SEQ ID NO: 633615 - protein, 17 aa, Mycobacterium
ALFAFGVAMHAVLTQAG

SEQ ID NO: 633616 - protein, 19 aa, Mycobacterium
ALFAFGVPLQPRFGADSAT

SEQ ID NO: 633617 - protein, 17 aa, Mycobacterium
ALFALGIALAALWQSFG

SEQ ID NO: 633618 - protein, 18 aa, Mycobacterium
ALFARLVANNLFGQNTSA

SEQ ID NO: 633619 - protein, 19 aa, Mycobacterium
ALFCVVDLHAITVAQDPEE

SEQ ID NO: 633620 - protein, 20 aa, Mycobacterium
ALFDFGERYLLLQAEPLDSD

SEQ ID NO: 633621 - protein, 24 aa, Mycobacterium
ALFEARQALELGALELTIGRLSTA

SEQ ID NO: 633622 - protein, 21 aa, Mycobacterium
ALFGCAHYEAILAGYQQLRPM

SEQ ID NO: 633623 - protein, 22 aa, Mycobacterium
ALFGCPHYDAILAGYQRVRSLK

SEQ ID NO: 633624 - protein, 25 aa, Mycobacterium
ALFGEPSSGFSTMLWGGQPLPTINP

SEQ ID NO: 633625 - protein, 19 aa, Mycobacterium
ALFGHSMGGMLAFEVALRF

SEQ ID NO: 633626 - protein, 17 aa, Mycobacterium
ALFGRGLISNGAAGTAA

SEQ ID NO: 633627 - protein, 18 aa, Mycobacterium
ALFGSDANWGRVLAAVGI

SEQ ID NO: 633628 - protein, 23 aa, Mycobacterium
ALFPGRMFGGGALAVYIDGVQVV

SEQ ID NO: 633629 - protein, 25 aa, Mycobacterium
ALFPKAAVWSPMFMKPPDQDGPGWR

SEQ ID NO: 633630 - protein, 25 aa, Mycobacterium
ALFPNAHAWIAHIWQPPFAGKRLRR

SEQ ID NO: 633631 - protein, 17 aa, Mycobacterium
ALFQANLETAFFMSQAI

SEQ ID NO: 633632 - protein, 24 aa, Mycobacterium
ALFQMKFYGVALFRSRGVLPTRLR

SEQ ID NO: 633633 - protein, 18 aa, Mycobacterium
ALFRMFQDRVTWLENTIR

SEQ ID NO: 633634 - protein, 24 aa, Mycobacterium
ALFRRIGLAASKYWVCKRSTPHAA

SEQ ID NO: 633635 - protein, 23 aa, Mycobacterium
ALFRRLAADRLKVVAGDKGEPHL

SEQ ID NO: 633636 - protein, 26 aa, Mycobacterium
ALFRSWKLHRELGLNIVMPVLPMHGP

SEQ ID NO: 633637 - protein, 19 aa, Mycobacterium
ALFRSWRLHEDLGLNVVMP

SEQ ID NO: 633638 - protein, 20 aa, Mycobacterium
ALFTPCRGQEAAQVGAAACL

SEQ ID NO: 633639 - protein, 19 aa, Mycobacterium
ALFTSLIAMHGLKAGDQNG

SEQ ID NO: 633640 - protein, 20 aa, Mycobacterium
ALFVLDGWLRPVAAGVVGEL

SEQ ID NO: 633641 - protein, 25 aa, Mycobacterium
ALFVLDGWLRPVAPGVVGELYVAGS

SEQ ID NO: 633642 - protein, 17 aa, Mycobacterium
ALFVLDGWLRPVPPGTV

SEQ ID NO: 633643 - protein, 29 aa, Mycobacterium
ALGAAARRLQLEFMESFIVLVQALCNTDA

SEQ ID NO: 633644 - protein, 21 aa, Mycobacterium
ALGAAGYRFPRVAGTSAGAIV

SEQ ID NO: 633645 - protein, 23 aa, Mycobacterium
ALGAALRIAWRALTLAGVDGVDL

SEQ ID NO: 633646 - protein, 20 aa, Mycobacterium
ALGAARRGANVVLLAKTAEP

SEQ ID NO: 633647 - protein, 19 aa, Mycobacterium
ALGACGASVVVSSRKSDAC

SEQ ID NO: 633648 - protein, 17 aa, Mycobacterium
ALGAGLGALGFSRGTLF

SEQ ID NO: 633649 - protein, 18 aa, Mycobacterium
ALGAGSRAAHLVDYAEDI

SEQ ID NO: 633650 - protein, 19 aa, Mycobacterium
ALGALRFASSTGYGRRAVA

SEQ ID NO: 633651 - protein, 23 aa, Mycobacterium
ALGALRLIQGFTRALAETHGCIV

SEQ ID NO: 633652 - protein, 24 aa, Mycobacterium
ALGALRVIAGFTRALAETNGSIVN

SEQ ID NO: 633653 - protein, 21 aa, Mycobacterium
ALGAQGAWTGSQWLMVEEAAN

SEQ ID NO: 633654 - protein, 21 aa, Mycobacterium
ALGAQGAWTGSQWVIVEESEN

SEQ ID NO: 633655 - protein, 27 aa, Mycobacterium
ALGATCGGVRVWSLYVPNGRSIDSPHY

SEQ ID NO: 633656 - protein, 21 aa, Mycobacterium
ALGAVPYNPGRFIRLEKEPTN

SEQ ID NO: 633657 - protein, 21 aa, Mycobacterium
ALGAVPYNPGRFIRLEKEPTT

SEQ ID NO: 633658 - protein, 23 aa, Mycobacterium
ALGCTPSAVSQHIAVLQREIGLT

SEQ ID NO: 633659 - protein, 18 aa, Mycobacterium
ALGDAGASKVLWENSAAF

SEQ ID NO: 633660 - protein, 24 aa, Mycobacterium
ALGDGVGALGCLDDGGSVGAALSA

SEQ ID NO: 633661 - protein, 23 aa, Mycobacterium
ALGDGVSGWSVGQPVCALLAGGG

SEQ ID NO: 633662 - protein, 21 aa, Mycobacterium
ALGDLPGIAAVLVDGVPLVKT

SEQ ID NO: 633663 - protein, 22 aa, Mycobacterium
ALGDRLVLIVGDVVGHGVEAAA

SEQ ID NO: 633664 - protein, 34 aa, Mycobacterium
ALGEADVALILGVPMDFRLGFGAVFGPQTRLIVV

SEQ ID NO: 633665 - protein, 23 aa, Mycobacterium
ALGEARISPYPVSTHTARMDLVI

SEQ ID NO: 633666 - protein, 19 aa, Mycobacterium
ALGECGRVRLIDIGLDLPD

SEQ ID NO: 633667 - protein, 24 aa, Mycobacterium
ALGEGWFINQHIIWQVGDEDVAEM

SEQ ID NO: 633668 - protein, 18 aa, Mycobacterium
ALGEIRVAGVRGREDSFY

SEQ ID NO: 633669 - protein, 18 aa, Mycobacterium
ALGERLGEAVAVISDVTA

SEQ ID NO: 633670 - protein, 24 aa, Mycobacterium
ALGFPDVVAPLTFTSAPGMQCNRR

SEQ ID NO: 633671 - protein, 18 aa, Mycobacterium
ALGFPGERNDVAAHLEEA

SEQ ID NO: 633672 - protein, 24 aa, Mycobacterium
ALGGCLTAGIASIAQRRGIQLRSV

SEQ ID NO: 633673 - protein, 21 aa, Mycobacterium
ALGGFAWQVVLAMVRRTGGTV

SEQ ID NO: 633674 - protein, 23 aa, Mycobacterium
ALGGFRNQMTFVLTGLDIDAKAD

SEQ ID NO: 633675 - protein, 30 aa, Mycobacterium
ALGGKARSGPEFDKGYWIEPTIYLDVTNDM

SEQ ID NO: 633676 - protein, 24 aa, Mycobacterium
ALGGLPDMPWRLSIFGDGPDREAL

SEQ ID NO: 633677 - protein, 26 aa, Mycobacterium
ALGGNGGAGGWLFGQGGAGGNGGTAT

SEQ ID NO: 633678 - protein, 24 aa, Mycobacterium
ALGGPERRTLFLLSSTEAYPQRLI

SEQ ID NO: 633679 - protein, 18 aa, Mycobacterium
ALGGRPVRVPAAAASAAS

SEQ ID NO: 633680 - protein, 30 aa, Mycobacterium
ALGGTSLRRSYALLRPGGRLVGYGVSNLQH

SEQ ID NO: 633681 - protein, 24 aa, Mycobacterium
ALGGVDVCLNAPVYEPLSGADFPA

SEQ ID NO: 633682 - protein, 25 aa, Mycobacterium
ALGHLFPFCAVLQELARRGHDIHVR

SEQ ID NO: 633683 - protein, 17 aa, Mycobacterium
ALGHQLAAVPYLESVML

SEQ ID NO: 633684 - protein, 24 aa, Mycobacterium
ALGHWLRRWWPASLREGVGPLDRA

SEQ ID NO: 633685 - protein, 18 aa, Mycobacterium
ALGIGWAVVMGDRAGGDL

SEQ ID NO: 633686 - protein, 20 aa, Mycobacterium
ALGILERFDMASLPPDSADS

SEQ ID NO: 633687 - protein, 21 aa, Mycobacterium
ALGIREWDAVSLIGSRTTAAV

SEQ ID NO: 633688 - protein, 26 aa, Mycobacterium
ALGIRGCSVSMPFKEDVLALVDEIEP

SEQ ID NO: 633689 - protein, 26 aa, Mycobacterium
ALGIRGCSVSMPFKQDVMALVDEIEP

SEQ ID NO: 633690 - protein, 17 aa, Mycobacterium
ALGIRGDWSRPEARVTI

SEQ ID NO: 633691 - protein, 17 aa, Mycobacterium
ALGISRVALAAAYHSTR

SEQ ID NO: 633692 - protein, 26 aa, Mycobacterium
ALGIWRGEPFPALDTPWINSLRSTLL

SEQ ID NO: 633693 - protein, 17 aa, Mycobacterium
ALGKAFLLQGGDCAETF

SEQ ID NO: 633694 - protein, 17 aa, Mycobacterium
ALGKLPLGDDVDAVLIS

SEQ ID NO: 633695 - protein, 17 aa, Mycobacterium
ALGKLYVQRHFPPEAKA

SEQ ID NO: 633696 - protein, 27 aa, Mycobacterium
ALGKPVLWSMPLHWAGVHAGILANSPG

SEQ ID NO: 633697 - protein, 19 aa, Mycobacterium
ALGKRFCGNGDLLGFALPD

SEQ ID NO: 633698 - protein, 26 aa, Mycobacterium
ALGKTVLPLSFDVRDWARLGFCDGLL

SEQ ID NO: 633699 - protein, 18 aa, Mycobacterium
ALGLARAGATVVVNDIAA

SEQ ID NO: 633700 - protein, 18 aa, Mycobacterium
ALGLPWGAVLGAWRADTL

SEQ ID NO: 633701 - protein, 18 aa, Mycobacterium
ALGLTGWTYDRIECDADQ

SEQ ID NO: 633702 - protein, 18 aa, Mycobacterium
ALGMGGAASRQMTFQTSS

SEQ ID NO: 633703 - protein, 21 aa, Mycobacterium
ALGMPLSRVRFALGDSSFPPA

SEQ ID NO: 633704 - protein, 20 aa, Mycobacterium
ALGNARRALVESLCYARQRR

SEQ ID NO: 633705 - protein, 18 aa, Mycobacterium
ALGPKWALVKGGHLRTSA

SEQ ID NO: 633706 - protein, 19 aa, Mycobacterium
ALGPNRYESLAALDDSKKL

SEQ ID NO: 633707 - protein, 17 aa, Mycobacterium
ALGPQWALVKGGHLRSS

SEQ ID NO: 633708 - protein, 23 aa, Mycobacterium
ALGPVIRPAIRALLDVQRRLEHR

SEQ ID NO: 633709 - protein, 20 aa, Mycobacterium
ALGQALPGVEGFRRAHRQAR

SEQ ID NO: 633710 - protein, 26 aa, Mycobacterium
ALGQLWWNKEFCRIVVIDGQHRAMAL

SEQ ID NO: 633711 - protein, 18 aa, Mycobacterium
ALGQPLGLIGFWEGQPGR

SEQ ID NO: 633712 - protein, 27 aa, Mycobacterium
ALGQVSGFNSGFFNWGTANSGLFSLSK

SEQ ID NO: 633713 - protein, 26 aa, Mycobacterium
ALGREAALYPGSWSEWSSDPSRPVER

SEQ ID NO: 633714 - protein, 22 aa, Mycobacterium
ALGRHFPFDPSQAVIPEPAPVD

SEQ ID NO: 633715 - protein, 20 aa, Mycobacterium
ALGRHFPFDPSQVVIPEPVP

SEQ ID NO: 633716 - protein, 18 aa, Mycobacterium
ALGRISLVLISHRHGDHT

SEQ ID NO: 633717 - protein, 19 aa, Mycobacterium
ALGRRRWRRTLGANVVANG

SEQ ID NO: 633718 - protein, 19 aa, Mycobacterium
ALGRWLLERTAAYSADHAD

SEQ ID NO: 633719 - protein, 18 aa, Mycobacterium
ALGTRLLATVSRIVEGWD

SEQ ID NO: 633720 - protein, 20 aa, Mycobacterium
ALGVAAWDAAAGQLVRVARG

SEQ ID NO: 633721 - protein, 17 aa, Mycobacterium
ALGVCGVMGHPGVVAAA

SEQ ID NO: 633722 - protein, 26 aa, Mycobacterium
ALGVFGVPSTPGWLKGISQLIGGISI

SEQ ID NO: 633723 - protein, 20 aa, Mycobacterium
ALGVFSPFVCYGPLARSVRD

SEQ ID NO: 633724 - protein, 19 aa, Mycobacterium
ALGVLPVLATDVLRQLRMV

SEQ ID NO: 633725 - protein, 17 aa, Mycobacterium
ALGVNWRVRCEVGAAAP

SEQ ID NO: 633726 - protein, 19 aa, Mycobacterium
ALGVPYVINARMVRGLDYY

SEQ ID NO: 633727 - protein, 27 aa, Mycobacterium
ALGVSEIKGRFGIQLTKDDVFECKTLG

SEQ ID NO: 633728 - protein, 17 aa, Mycobacterium
ALGYPVLLKEVGHGIGG

SEQ ID NO: 633729 - protein, 17 aa, Mycobacterium
ALGYRWDIVLSGDYRTP

SEQ ID NO: 633730 - protein, 19 aa, Mycobacterium
ALHAARLRCGDIVSLPHAP

SEQ ID NO: 633731 - protein, 27 aa, Mycobacterium
ALHAARLRPGDMVDVPAAPYLHLFVTR

SEQ ID NO: 633732 - protein, 17 aa, Mycobacterium
ALHALFIAIERCGAVVV

SEQ ID NO: 633733 - protein, 23 aa, Mycobacterium
ALHALGPRWALVKGGHLRSSERS

SEQ ID NO: 633734 - protein, 18 aa, Mycobacterium
ALHALGPSWALVKGGHLR

SEQ ID NO: 633735 - protein, 18 aa, Mycobacterium
ALHALRAYLRTQLKHARA

SEQ ID NO: 633736 - protein, 24 aa, Mycobacterium
ALHALRIPLEYLAGLFTAGDTRVV

SEQ ID NO: 633737 - protein, 19 aa, Mycobacterium
ALHATGYAMGVKFDGSDTA

SEQ ID NO: 633738 - protein, 19 aa, Mycobacterium
ALHAVGLMFEAMIRASGYV

SEQ ID NO: 633739 - protein, 36 aa, Mycobacterium
ALHAWSDMGPLDFPSTNWAPIEWRNIEDQEKEVLAE

SEQ ID NO: 633740 - protein, 24 aa, Mycobacterium
ALHAWTDMGPLDFPSINWAPIEWS

SEQ ID NO: 633741 - protein, 23 aa, Mycobacterium
ALHCARLRPGDTIDLPSASYLHL

SEQ ID NO: 633742 - protein, 18 aa, Mycobacterium
ALHCKSVFAAAPAIVPET

SEQ ID NO: 633743 - protein, 18 aa, Mycobacterium
ALHDGEWEFAEQAPQSHR

SEQ ID NO: 633744 - protein, 19 aa, Mycobacterium
ALHDIYRDLGHTVDLVPPR

SEQ ID NO: 633745 - protein, 26 aa, Mycobacterium
ALHEREWLRSDALRYGADPQEVDDAL

SEQ ID NO: 633746 - protein, 18 aa, Mycobacterium
ALHERGVGFGDRVLILML

SEQ ID NO: 633747 - protein, 18 aa, Mycobacterium
ALHEVWGVRVHDVTASMD

SEQ ID NO: 633748 - protein, 19 aa, Mycobacterium
ALHGARYSGWQGLIDTQRS

SEQ ID NO: 633749 - protein, 19 aa, Mycobacterium
ALHGARYSGWQGLLDAQRA

SEQ ID NO: 633750 - protein, 19 aa, Mycobacterium
ALHGAWGVRVHDVRASVDA

SEQ ID NO: 633751 - protein, 19 aa, Mycobacterium
ALHGAWGVRVHDVRATVDA

SEQ ID NO: 633752 - protein, 20 aa, Mycobacterium
ALHGAWGVRVHDVRATVDAL

SEQ ID NO: 633753 - protein, 19 aa, Mycobacterium
ALHGGRYSGWQGLLDSQRK

SEQ ID NO: 633754 - protein, 19 aa, Mycobacterium
ALHHPDSWTIGGMAKGAGM

SEQ ID NO: 633755 - protein, 21 aa, Mycobacterium
ALHIYRVLFGYLYGHILTELQ

SEQ ID NO: 633756 - protein, 19 aa, Mycobacterium
ALHKHWYAAMEVLAEYSID

SEQ ID NO: 633757 - protein, 18 aa, Mycobacterium
ALHLARRGIEVEIFTRAT

SEQ ID NO: 633758 - protein, 18 aa, Mycobacterium
ALHLGRLKDRVGLRPEQV

SEQ ID NO: 633759 - protein, 17 aa, Mycobacterium
ALHLRTGGRLGLVLPAE

SEQ ID NO: 633760 - protein, 20 aa, Mycobacterium
ALHLSMPISLRSEGDAPGGN

SEQ ID NO: 633761 - protein, 19 aa, Mycobacterium
ALHPAELLFTATLAGARAL

SEQ ID NO: 633762 - protein, 20 aa, Mycobacterium
ALHPEAPLPAVHKSDQLLHD

SEQ ID NO: 633763 - protein, 17 aa, Mycobacterium
ALHPGFVTMMKQLDADL

SEQ ID NO: 633764 - protein, 17 aa, Mycobacterium
ALHPGPWLSTAVAAPQA

SEQ ID NO: 633765 - protein, 21 aa, Mycobacterium
ALHPRAHLTLAELDLSSLVSI

SEQ ID NO: 633766 - protein, 21 aa, Mycobacterium
ALHPVLDRYDYVLIDCQPSLG

SEQ ID NO: 633767 - protein, 22 aa, Mycobacterium
ALHRARRLAGRVVHDATCSVGT

SEQ ID NO: 633768 - protein, 19 aa, Mycobacterium
ALHRARRPPTWLTIETADV

SEQ ID NO: 633769 - protein, 25 aa, Mycobacterium
ALHRATRPGARWFIACFGDGSVNGI

SEQ ID NO: 633770 - protein, 27 aa, Mycobacterium
ALHRAVAFRRFRAADVRSILAAGTGTP

SEQ ID NO: 633771 - protein, 23 aa, Mycobacterium
ALHRDHVLVLAGLDLAATVEDEP

SEQ ID NO: 633772 - protein, 19 aa, Mycobacterium
ALHRGRGIALMKALMQDVT

SEQ ID NO: 633773 - protein, 17 aa, Mycobacterium
ALHRLMHRVAVPRDDQL

SEQ ID NO: 633774 - protein, 24 aa, Mycobacterium
ALHRRCADVRYLGSWPTGQTYAGQ

SEQ ID NO: 633775 - protein, 25 aa, Mycobacterium
ALHRRCADVRYLGSWPTGSPAGALP

SEQ ID NO: 633776 - protein, 25 aa, Mycobacterium
ALHRRCADVRYLGSWPTGSPAGVLP

SEQ ID NO: 633777 - protein, 17 aa, Mycobacterium
ALHRRGPHRVLRGDLAF

SEQ ID NO: 633778 - protein, 18 aa, Mycobacterium
ALHRSRWLDPRAPAELIH

SEQ ID NO: 633779 - protein, 18 aa, Mycobacterium
ALHRVGVSVWERYTGPYT

SEQ ID NO: 633780 - protein, 20 aa, Mycobacterium
ALHSEGWVGPSAVTMAAAVA

SEQ ID NO: 633781 - protein, 18 aa, Mycobacterium
ALHTEFWLHAIRNPGAMD

SEQ ID NO: 633782 - protein, 25 aa, Mycobacterium
ALHVYRALFGFLYGHVLTELQEIVE

SEQ ID NO: 633783 - protein, 18 aa, Mycobacterium
ALIAFSNVHYYGGQLASF

SEQ ID NO: 633784 - protein, 26 aa, Mycobacterium
ALIAKRRLRFPVGHSVDADKVAATVG

SEQ ID NO: 633785 - protein, 19 aa, Mycobacterium
ALIARRIATRQGIDPDSGV

SEQ ID NO: 633786 - protein, 20 aa, Mycobacterium
ALIARWLATPGVRIVRVTGT

SEQ ID NO: 633787 - protein, 19 aa, Mycobacterium
ALICRDHLLGSLDERSLRI

SEQ ID NO: 633788 - protein, 17 aa, Mycobacterium
ALICSLKPSPAESSSAL

SEQ ID NO: 633789 - protein, 18 aa, Mycobacterium
ALIDLGIGLWLSEPAAKT

SEQ ID NO: 633790 - protein, 19 aa, Mycobacterium
ALIDLPKPLICAVNGVGLG

SEQ ID NO: 633791 - protein, 19 aa, Mycobacterium
ALIDPRILLGGVLYVPLLT

SEQ ID NO: 633792 - protein, 18 aa, Mycobacterium
ALIDRKGTAVARGVGTTM

SEQ ID NO: 633793 - protein, 20 aa, Mycobacterium
ALIDRVERRGAVEHVGGSPL

SEQ ID NO: 633794 - protein, 18 aa, Mycobacterium
ALIDRWSNRPALAEPAPP

SEQ ID NO: 633795 - protein, 25 aa, Mycobacterium
ALIEAARLSAVFAEGAGARDADRRL

SEQ ID NO: 633796 - protein, 17 aa, Mycobacterium
ALIEFPLLGVIIHAATG

SEQ ID NO: 633797 - protein, 25 aa, Mycobacterium
ALIEGPAGWGEFGAFVEYQPPEAAH

SEQ ID NO: 633798 - protein, 29 aa, Mycobacterium
ALIEGVCLRLGPGLPVVLGGGLLVNQPGL

SEQ ID NO: 633799 - protein, 24 aa, Mycobacterium
ALIEIPDCSAFVMIDAPAKLAEAI

SEQ ID NO: 633800 - protein, 20 aa, Mycobacterium
ALIERGWRFERTKVGGRNEH

SEQ ID NO: 633801 - protein, 17 aa, Mycobacterium
ALIFGPLRLQFWVCGVF

SEQ ID NO: 633802 - protein, 18 aa, Mycobacterium
ALIFSTRYADWIDAHVQK

SEQ ID NO: 633803 - protein, 18 aa, Mycobacterium
ALIGCGMSSVYSSELAQP

SEQ ID NO: 633804 - protein, 17 aa, Mycobacterium
ALIGYATKRRDVVAITA

SEQ ID NO: 633805 - protein, 18 aa, Mycobacterium
ALIGYGTKRRDIVAITAA

SEQ ID NO: 633806 - protein, 18 aa, Mycobacterium
ALIHAHLLAAARRREYRR

SEQ ID NO: 633807 - protein, 27 aa, Mycobacterium
ALIKSIGLRLGVPWYAYDTVTFSGEVT

SEQ ID NO: 633808 - protein, 22 aa, Mycobacterium
ALIKVCADLGLDTVRVPGRSGV

SEQ ID NO: 633809 - protein, 26 aa, Mycobacterium
ALIKVKGFRNVIHWEVTQYDEPRRIE

SEQ ID NO: 633810 - protein, 17 aa, Mycobacterium
ALILARSRRSVVVIDSG

SEQ ID NO: 633811 - protein, 26 aa, Mycobacterium
ALINRYPRVCGMTGTALAAGEQLRQF

SEQ ID NO: 633812 - protein, 24 aa, Mycobacterium
ALINRYPRVSGMTGTALAAGEQLR

SEQ ID NO: 633813 - protein, 24 aa, Mycobacterium
ALINRYVTVCGMTGTALAAGEQLR

SEQ ID NO: 633814 - protein, 18 aa, Mycobacterium
ALIPRPGLSAVEVASVLM

SEQ ID NO: 633815 - protein, 17 aa, Mycobacterium
ALIQLFVTHARDVSEVD

SEQ ID NO: 633816 - protein, 24 aa, Mycobacterium
ALIRDVWQPLYLLDPAPRPRIDLE

SEQ ID NO: 633817 - protein, 19 aa, Mycobacterium
ALIRGELAGGYGLANATRT

SEQ ID NO: 633818 - protein, 24 aa, Mycobacterium
ALIRRANARLVVFPELSLTGYQLK

SEQ ID NO: 633819 - protein, 30 aa, Mycobacterium
ALIRRLDEWRSLECIRALRANRQAAQRLRG

SEQ ID NO: 633820 - protein, 19 aa, Mycobacterium
ALISFPSDMAGTILNGNPT

SEQ ID NO: 633821 - protein, 19 aa, Mycobacterium
ALISRGTLLVAQRDRPAEL

SEQ ID NO: 633822 - protein, 21 aa, Mycobacterium
ALITKVWKTPSFFLTHPQGIA

SEQ ID NO: 633823 - protein, 29 aa, Mycobacterium
ALIVDEPFLLPAHIDLAALRVKFDGGTLP

SEQ ID NO: 633824 - protein, 29 aa, Mycobacterium
ALIVDEPFMLPAHIDLAALRVKFDSGTLP

SEQ ID NO: 633825 - protein, 21 aa, Mycobacterium
ALIWEFNQPWSVEDIEIGDPV

SEQ ID NO: 633826 - protein, 25 aa, Mycobacterium
ALIYDLRLGPAWQGLGFGIGMITEA

SEQ ID NO: 633827 - protein, 20 aa, Mycobacterium
ALKAHCPQRVDVYFDNVGGP

SEQ ID NO: 633828 - protein, 25 aa, Mycobacterium
ALKALAGFVRPVFGTVRLDGEDVTD

SEQ ID NO: 633829 - protein, 29 aa, Mycobacterium
ALKECHGLQCGFCTPGFVTSITALLRDNP

SEQ ID NO: 633830 - protein, 23 aa, Mycobacterium
ALKECLPYYVDLFRQMKSEVKAG

SEQ ID NO: 633831 - protein, 21 aa, Mycobacterium
ALKEGHSAVVPGLAPADTIKA

SEQ ID NO: 633832 - protein, 25 aa, Mycobacterium
ALKELLNRRAGLLSGGQRQQLAIAR

SEQ ID NO: 633833 - protein, 23 aa, Mycobacterium
ALKGPVEFEWKVPRHGSNTIERD

SEQ ID NO: 633834 - protein, 23 aa, Mycobacterium
ALKGRGLRPGDRVALRCGSNAEF

SEQ ID NO: 633835 - protein, 19 aa, Mycobacterium
ALKHSVQGFAFYRSPDRKL

SEQ ID NO: 633836 - protein, 25 aa, Mycobacterium
ALKIHRLHLKPGIAPQVLRGSEFRR

SEQ ID NO: 633837 - protein, 29 aa, Mycobacterium
ALKKELRLKPGDWYVIHSYAGYENKVKAN

SEQ ID NO: 633838 - protein, 18 aa, Mycobacterium
ALKLARKVTGRESIINFT

SEQ ID NO: 633839 - protein, 21 aa, Mycobacterium
ALKLLSLCEPLDIDAFAELAG

SEQ ID NO: 633840 - protein, 27 aa, Mycobacterium
ALKPIEWRYDNDPAWVLKAKSQRLEHN

SEQ ID NO: 633841 - protein, 20 aa, Mycobacterium
ALKPRKAFGPIRVAATGTTV

SEQ ID NO: 633842 - protein, 18 aa, Mycobacterium
ALKRHKNKPVLFLGDTTL

SEQ ID NO: 633843 - protein, 18 aa, Mycobacterium
ALKRHKSKPVLFLGDTTL

SEQ ID NO: 633844 - protein, 18 aa, Mycobacterium
ALKRRWEAVMMNNYGTPA

SEQ ID NO: 633845 - protein, 27 aa, Mycobacterium
ALKSGSGCRVAILVPIFCDAKVTTVYR

SEQ ID NO: 633846 - protein, 18 aa, Mycobacterium
ALKSLRADRFPRIEFAAD

SEQ ID NO: 633847 - protein, 18 aa, Mycobacterium
ALKTAHRLWANEGLPGQT

SEQ ID NO: 633848 - protein, 23 aa, Mycobacterium
ALKTGVLERIWPGIYCLGEPTEP

SEQ ID NO: 633849 - protein, 20 aa, Mycobacterium
ALKVSVLWYKPALVAKVRTN

SEQ ID NO: 633850 - protein, 19 aa, Mycobacterium
ALKVVGAWTQTDTQQTELA

SEQ ID NO: 633851 - protein, 24 aa, Mycobacterium
ALLAALCADAGFSPRIRDEVDETS

SEQ ID NO: 633852 - protein, 19 aa, Mycobacterium
ALLADRGRHAEALGHCSAV

SEQ ID NO: 633853 - protein, 18 aa, Mycobacterium
ALLAELGLAERQRATTGV

SEQ ID NO: 633854 - protein, 18 aa, Mycobacterium
ALLAELGLSGLQRSTTGA

SEQ ID NO: 633855 - protein, 26 aa, Mycobacterium
ALLAFRDRMGWDLPWVSSGATTFNED

SEQ ID NO: 633856 - protein, 20 aa, Mycobacterium
ALLAGLLSHVGMRREDGREY

SEQ ID NO: 633857 - protein, 17 aa, Mycobacterium
ALLAGRTTKIFGDGSDT

SEQ ID NO: 633858 - protein, 20 aa, Mycobacterium
ALLAHPGIEVILEITGNPLV

SEQ ID NO: 633859 - protein, 19 aa, Mycobacterium
ALLAIGFEWGIALRHLEAR

SEQ ID NO: 633860 - protein, 25 aa, Mycobacterium
ALLAKRMGKGRVIAETGAGQHGVAT

SEQ ID NO: 633861 - protein, 19 aa, Mycobacterium
ALLAPAWVPWEQRVRPGDL

SEQ ID NO: 633862 - protein, 18 aa, Mycobacterium
ALLARGWNVADARGLQLI

SEQ ID NO: 633863 - protein, 19 aa, Mycobacterium
ALLARLPQQYPLTGVIHAA

SEQ ID NO: 633864 - protein, 18 aa, Mycobacterium
ALLARLQLLTTLVAGNPD

SEQ ID NO: 633865 - protein, 26 aa, Mycobacterium
ALLATARAWAWLSGRGYVTPDDVKAM

SEQ ID NO: 633866 - protein, 27 aa, Mycobacterium
ALLATSRSWAWLCGRNYVTPDDVKAMA

SEQ ID NO: 633867 - protein, 17 aa, Mycobacterium
ALLAYRLSLKGEPAPVI

SEQ ID NO: 633868 - protein, 18 aa, Mycobacterium
ALLCIKVARTMLGDIPHV

SEQ ID NO: 633869 - protein, 19 aa, Mycobacterium
ALLDACFQSVIAHPEVQNI

SEQ ID NO: 633870 - protein, 19 aa, Mycobacterium
ALLDACFQSVIALPDVQEA

SEQ ID NO: 633871 - protein, 18 aa, Mycobacterium
ALLDACFQSVLAHPVVRE

SEQ ID NO: 633872 - protein, 18 aa, Mycobacterium
ALLDGGAKVVVAAHLGRP

SEQ ID NO: 633873 - protein, 24 aa, Mycobacterium
ALLDLFLRIIVELFQRHWSSTEHQ

SEQ ID NO: 633874 - protein, 24 aa, Mycobacterium
ALLDLFLRIIVELFRRHWSSTGQA

SEQ ID NO: 633875 - protein, 19 aa, Mycobacterium
ALLDMPAYVLDGFLNGETV

SEQ ID NO: 633876 - protein, 23 aa, Mycobacterium
ALLDPRSWPSIVRGVALTTAGRF

SEQ ID NO: 633877 - protein, 18 aa, Mycobacterium
ALLDRAAAELARRFAAGG

SEQ ID NO: 633878 - protein, 29 aa, Mycobacterium
ALLDYEIPGLADAIRRSGLPKVPTSVLSR

SEQ ID NO: 633879 - protein, 18 aa, Mycobacterium
ALLEADVALPVVRTFITR

SEQ ID NO: 633880 - protein, 19 aa, Mycobacterium
ALLEAKRQGPARFSTGMST

SEQ ID NO: 633881 - protein, 36 aa, Mycobacterium
ALLEAVLWFLARKLPGFIKWLLRRIAIKNLPAGYDV

SEQ ID NO: 633882 - protein, 19 aa, Mycobacterium
ALLEGARKVAADAGIPDPT

SEQ ID NO: 633883 - protein, 17 aa, Mycobacterium
ALLEHRDELAALTTAEV

SEQ ID NO: 633884 - protein, 17 aa, Mycobacterium
ALLEIPLLDGYGSTEAG

SEQ ID NO: 633885 - protein, 17 aa, Mycobacterium
ALLERVRGWACFSRKQL

SEQ ID NO: 633886 - protein, 18 aa, Mycobacterium
ALLERVRGWACFSRKQLR

SEQ ID NO: 633887 - protein, 18 aa, Mycobacterium
ALLETCHLSASGFADLYC

SEQ ID NO: 633888 - protein, 18 aa, Mycobacterium
ALLEVFADDGIRVVRRAT

SEQ ID NO: 633889 - protein, 17 aa, Mycobacterium
ALLEVLRSLSPGERVAF

SEQ ID NO: 633890 - protein, 32 aa, Mycobacterium
ALLEVRDLLFARLLQYRAFKHVAEMFAELEAA

SEQ ID NO: 633891 - protein, 33 aa, Mycobacterium
ALLEVRDLLFARLLQYRAFKHVAEMFAELEATA

SEQ ID NO: 633892 - protein, 18 aa, Mycobacterium
ALLEWLKAQGVPFRGGAG

SEQ ID NO: 633893 - protein, 17 aa, Mycobacterium
ALLEYVWALMGMPCGKY

SEQ ID NO: 633894 - protein, 17 aa, Mycobacterium
ALLFNMGELLESTRGVV

SEQ ID NO: 633895 - protein, 24 aa, Mycobacterium
ALLGFCLENGYQLRIIEQMPLDAG

SEQ ID NO: 633896 - protein, 25 aa, Mycobacterium
ALLGGYEFTMLWGGDEAPRFPDDGS

SEQ ID NO: 633897 - protein, 17 aa, Mycobacterium
ALLGHPIIGTGGSGSQS

SEQ ID NO: 633898 - protein, 19 aa, Mycobacterium
ALLGISFGGYFVARAAAHE

SEQ ID NO: 633899 - protein, 17 aa, Mycobacterium
ALLGRAYLALGRESEAD

SEQ ID NO: 633900 - protein, 18 aa, Mycobacterium
ALLGRPLIGDGAAGAPGQ

SEQ ID NO: 633901 - protein, 18 aa, Mycobacterium
ALLGRPLIGDGVDGGAGQ

SEQ ID NO: 633902 - protein, 19 aa, Mycobacterium
ALLGRPLIGNGANGTTVNG

SEQ ID NO: 633903 - protein, 18 aa, Mycobacterium
ALLGRPLVGDGVNGASGT

SEQ ID NO: 633904 - protein, 18 aa, Mycobacterium
ALLGTGFGYSRQRRAAQA

SEQ ID NO: 633905 - protein, 23 aa, Mycobacterium
ALLHKRAHGAAVVVFEGRPIGLV

SEQ ID NO: 633906 - protein, 23 aa, Mycobacterium
ALLHLEPICAGMCASREDRATEV

SEQ ID NO: 633907 - protein, 23 aa, Mycobacterium
ALLHPRLVRAIALISSPHPAALR

SEQ ID NO: 633908 - protein, 26 aa, Mycobacterium
ALLHRGCAGLAEVARPAPHSVDADGL

SEQ ID NO: 633909 - protein, 24 aa, Mycobacterium
ALLHRLGFAAATVFVGVDGTFHGQ

SEQ ID NO: 633910 - protein, 18 aa, Mycobacterium
ALLIRGQAPILWDIGSAA

SEQ ID NO: 633911 - protein, 23 aa, Mycobacterium
ALLKAADAYGRYPTPVDDIVSAR

SEQ ID NO: 633912 - protein, 17 aa, Mycobacterium
ALLKGALSIPDKYLVSV

SEQ ID NO: 633913 - protein, 17 aa, Mycobacterium
ALLKGYNMICVMPENTS

SEQ ID NO: 633914 - protein, 28 aa, Mycobacterium
ALLKWLDEPCTFYDWRGSETGKPKVHPD

SEQ ID NO: 633915 - protein, 19 aa, Mycobacterium
ALLLERGFDGLSIEAVAAK

SEQ ID NO: 633916 - protein, 19 aa, Mycobacterium
ALLLGAFDLGGLGYVVEEF

SEQ ID NO: 633917 - protein, 20 aa, Mycobacterium
ALLLPYRMFLAAAEELRYDI

SEQ ID NO: 633918 - protein, 17 aa, Mycobacterium
ALLMALMATNFLGQNTG

SEQ ID NO: 633919 - protein, 20 aa, Mycobacterium
ALLMRHHLVLMSRFDPERFL

SEQ ID NO: 633920 - protein, 21 aa, Mycobacterium
ALLMRRIAADDVLGFTWGPEQ

SEQ ID NO: 633921 - protein, 25 aa, Mycobacterium
ALLMTAAATPYVEWLTTAAAEAAQT

SEQ ID NO: 633922 - protein, 25 aa, Mycobacterium
ALLNGPRYWLMSRIEKVGGTETPRE

SEQ ID NO: 633923 - protein, 21 aa, Mycobacterium
ALLNWMVPLGTHFPAEVPAAI

SEQ ID NO: 633924 - protein, 18 aa, Mycobacterium
ALLNYYPHLLALSASSPW

SEQ ID NO: 633925 - protein, 20 aa, Mycobacterium
ALLPAHCWFERNGWGFRVYP

SEQ ID NO: 633926 - protein, 23 aa, Mycobacterium
ALLPETRFAAPLLARGLPACPGV

SEQ ID NO: 633927 - protein, 17 aa, Mycobacterium
ALLPETRTRAVLMIAIE

SEQ ID NO: 633928 - protein, 26 aa, Mycobacterium
ALLPGYRLKHRVQFERLGSGNTLYIP

SEQ ID NO: 633929 - protein, 22 aa, Mycobacterium
ALLPKLVRMFGTMAVPMTLAHE

SEQ ID NO: 633930 - protein, 17 aa, Mycobacterium
ALLPLLLFSSARANTAF

SEQ ID NO: 633931 - protein, 20 aa, Mycobacterium
ALLPLLRPSDFATLPDHLPE

SEQ ID NO: 633932 - protein, 20 aa, Mycobacterium
ALLPPSARVRGSVKLNGAEL

SEQ ID NO: 633933 - protein, 21 aa, Mycobacterium
ALLPVLRPGEHVLLTDQLAQG

SEQ ID NO: 633934 - protein, 26 aa, Mycobacterium
ALLPWRTALKNVQFPLKLRGMRGKEL

SEQ ID NO: 633935 - protein, 19 aa, Mycobacterium
ALLPWRTVQANVEFALSLA

SEQ ID NO: 633936 - protein, 25 aa, Mycobacterium
ALLQLRRPALLVGRTDPTGLTAGTT

SEQ ID NO: 633937 - protein, 20 aa, Mycobacterium
ALLQRVQRAIGLARVDDPDA

SEQ ID NO: 633938 - protein, 17 aa, Mycobacterium
ALLRAGMIDPALRDRRS

SEQ ID NO: 633939 - protein, 25 aa, Mycobacterium
ALLRDFDARLGWGPAAPAGDDLLAR

SEQ ID NO: 633940 - protein, 23 aa, Mycobacterium
ALLRDPYPIFARYRAQAGVFRGS

SEQ ID NO: 633941 - protein, 22 aa, Mycobacterium
ALLREAVHVFGFHLCGLDLRQN

SEQ ID NO: 633942 - protein, 40 aa, Mycobacterium
ALLRECAEKMLVRHPNLRASFFSRGIPRPVQIVPSRVELP

SEQ ID NO: 633943 - protein, 18 aa, Mycobacterium
ALLREFVGMTLNLPTPEE

SEQ ID NO: 633944 - protein, 18 aa, Mycobacterium
ALLREFVRLWEHLLTDGG

SEQ ID NO: 633945 - protein, 23 aa, Mycobacterium
ALLREGVRVFGFHLCGLDMRQNS

SEQ ID NO: 633946 - protein, 24 aa, Mycobacterium
ALLRGVERLARFPGPNGLAQEIFT

SEQ ID NO: 633947 - protein, 25 aa, Mycobacterium
ALLRHPRIGGAVVIPANGSLRALVQ

SEQ ID NO: 633948 - protein, 21 aa, Mycobacterium
ALLRKAPWVDVVFGTHNIGSL

SEQ ID NO: 633949 - protein, 17 aa, Mycobacterium
ALLRRLVEAGTRVVQYG

SEQ ID NO: 633950 - protein, 26 aa, Mycobacterium
ALLRSCTGWPSGVWIDEPRRTAPDGS

SEQ ID NO: 633951 - protein, 19 aa, Mycobacterium
ALLSAAGFDVWLLNWRGSI

SEQ ID NO: 633952 - protein, 18 aa, Mycobacterium
ALLSGWRAPDPAQDSLRH

SEQ ID NO: 633953 - protein, 26 aa, Mycobacterium
ALLSHNCWQYAALVFATARVGVVLVP

SEQ ID NO: 633954 - protein, 20 aa, Mycobacterium
ALLTEHQWKIGVVAQSHAVV

SEQ ID NO: 633955 - protein, 17 aa, Mycobacterium
ALLTGFGYAGYFEFDGA

SEQ ID NO: 633956 - protein, 19 aa, Mycobacterium
ALLTHKVIFFRSQHHLDDQ

SEQ ID NO: 633957 - protein, 18 aa, Mycobacterium
ALLTLAPPVAAAWNPLVD

SEQ ID NO: 633958 - protein, 25 aa, Mycobacterium
ALLTQLRLKAALVRSIQVSAALDRI

SEQ ID NO: 633959 - protein, 20 aa, Mycobacterium
ALLVAGWRALDTVGPQPLAP

SEQ ID NO: 633960 - protein, 20 aa, Mycobacterium
ALLVAGWRALHALSPQPLVR

SEQ ID NO: 633961 - protein, 18 aa, Mycobacterium
ALLVEFMAYTGLRAAEVS

SEQ ID NO: 633962 - protein, 19 aa, Mycobacterium
ALLVNRIALVYSELSSGAP

SEQ ID NO: 633963 - protein, 24 aa, Mycobacterium
ALLVRLFIRLSMALWGRRDGRAVQ

SEQ ID NO: 633964 - protein, 29 aa, Mycobacterium
ALLYAVVLHRYLGWRLSGYDPATHLGGVL

SEQ ID NO: 633965 - protein, 24 aa, Mycobacterium
ALLYRLCGDRNPLHSDPAFAAAAG

SEQ ID NO: 633966 - protein, 24 aa, Mycobacterium
ALLYRLCGDRNPLHSDPTFAKAAG

SEQ ID NO: 633967 - protein, 20 aa, Mycobacterium
ALLYRMCGDRNPLHSDPEFA

SEQ ID NO: 633968 - protein, 32 aa, Mycobacterium
ALLYSVVLHRFLSWRLPGYRPEEHLGGAVYLF

SEQ ID NO: 633969 - protein, 21 aa, Mycobacterium
ALMAMTYRFVGTKGTLKERLD

SEQ ID NO: 633970 - protein, 19 aa, Mycobacterium
ALMAPRIAAYHAGDPEPGP

SEQ ID NO: 633971 - protein, 29 aa, Mycobacterium
ALMAVDDWPLLRWRMRQYRHGRWGIHIVK

SEQ ID NO: 633972 - protein, 20 aa, Mycobacterium
ALMCDIRFAAAGAKFATAFP

SEQ ID NO: 633973 - protein, 19 aa, Mycobacterium
ALMCDVRIAAQSARFAESF

SEQ ID NO: 633974 - protein, 20 aa, Mycobacterium
ALMDHCLSVLLQAWGDDPFE

SEQ ID NO: 633975 - protein, 28 aa, Mycobacterium
ALMDLLGSPQLAYPCIHIAGTNGKTSVA

SEQ ID NO: 633976 - protein, 19 aa, Mycobacterium
ALMDLLGSPQLAYPSIHVA

SEQ ID NO: 633977 - protein, 23 aa, Mycobacterium
ALMDQAWWFPAIAPLPGKAPAVM

SEQ ID NO: 633978 - protein, 22 aa, Mycobacterium
ALMERLSLRPDDSVYALADDHV

SEQ ID NO: 633979 - protein, 26 aa, Mycobacterium
ALMFRQWSPRITLFLNGAVDPSEPER

SEQ ID NO: 633980 - protein, 31 aa, Mycobacterium
ALMGMPCGKYLVVMVGLWLPLLAESGDLDRP

SEQ ID NO: 633981 - protein, 29 aa, Mycobacterium
ALMIPFVRTRWELEECLSLVDASPLGRQR

SEQ ID NO: 633982 - protein, 17 aa, Mycobacterium
ALMLARDELHALVTAYC

SEQ ID NO: 633983 - protein, 19 aa, Mycobacterium
ALMLRGWSDDVVLLTDGPS

SEQ ID NO: 633984 - protein, 26 aa, Mycobacterium
ALMNLRLARPGVIVDIGRLDELRRIF

SEQ ID NO: 633985 - protein, 19 aa, Mycobacterium
ALMPMVWTACEREDFVPEV

SEQ ID NO: 633986 - protein, 18 aa, Mycobacterium
ALMQGFNTLEQWGRFDEA

SEQ ID NO: 633987 - protein, 25 aa, Mycobacterium
ALMQPRARGRLTLVSADPDVAPRIE

SEQ ID NO: 633988 - protein, 18 aa, Mycobacterium
ALMTARFISFAEIAGQLD

SEQ ID NO: 633989 - protein, 18 aa, Mycobacterium
ALMTFAGPDFRRFANSSG

SEQ ID NO: 633990 - protein, 17 aa, Mycobacterium
ALMTLEMGKVLPESKGE

SEQ ID NO: 633991 - protein, 24 aa, Mycobacterium
ALNAELKHGCEFNWDSDGPEYSED

SEQ ID NO: 633992 - protein, 18 aa, Mycobacterium
ALNAPGWSGQLLSVRVND

SEQ ID NO: 633993 - protein, 23 aa, Mycobacterium
ALNAPLAVLVVRKLGVPGHEEYA

SEQ ID NO: 633994 - protein, 19 aa, Mycobacterium
ALNAQRHFHRYGTTKETLG

SEQ ID NO: 633995 - protein, 18 aa, Mycobacterium
ALNAYKMAVICLIGAMLI

SEQ ID NO: 633996 - protein, 20 aa, Mycobacterium
ALNAYLRRHDTFRSWFERTD

SEQ ID NO: 633997 - protein, 18 aa, Mycobacterium
ALNCGAALSAVLLECTLA

SEQ ID NO: 633998 - protein, 27 aa, Mycobacterium
ALNDPAVGVVCEWACAMFQQPGETAAR

SEQ ID NO: 633999 - protein, 22 aa, Mycobacterium
ALNEAGLDWRQIQLVAGADTIR

SEQ ID NO: 634000 - protein, 24 aa, Mycobacterium
ALNEAWNGLQALRLDAQILGSKYS

SEQ ID NO: 634001 - protein, 22 aa, Mycobacterium
ALNEIHHAIGLDRLFDTLFVYE

SEQ ID NO: 634002 - protein, 19 aa, Mycobacterium
ALNEIKPLNLVVGLIEEIR

SEQ ID NO: 634003 - protein, 18 aa, Mycobacterium
ALNEIKPVNLVVGLIDEL

SEQ ID NO: 634004 - protein, 27 aa, Mycobacterium
ALNEPRLRPNIPIMIGGSGEKKTFGLA

SEQ ID NO: 634005 - protein, 17 aa, Mycobacterium
ALNEYFWTAGRDGVLRI

SEQ ID NO: 634006 - protein, 21 aa, Mycobacterium
ALNIARECRTLLGASGITLEY

SEQ ID NO: 634007 - protein, 20 aa, Mycobacterium
ALNILERFYSMVLTDCGTGM

SEQ ID NO: 634008 - protein, 28 aa, Mycobacterium
ALNKLPEEFRMAVYYADVEGFPYKEIAE

SEQ ID NO: 634009 - protein, 18 aa, Mycobacterium
ALNLFSFRPNVWDTEAET

SEQ ID NO: 634010 - protein, 23 aa, Mycobacterium
ALNLRSGAPLLREKAALPTGRAG

SEQ ID NO: 634011 - protein, 21 aa, Mycobacterium
ALNLRSGPPLLRGTSMLPPAR

SEQ ID NO: 634012 - protein, 21 aa, Mycobacterium
ALNNTRFWAPLSLSAEQKRSI

SEQ ID NO: 634013 - protein, 24 aa, Mycobacterium
ALNQKPGAVVIDFTEVEFLASAGM

SEQ ID NO: 634014 - protein, 17 aa, Mycobacterium
ALNRALRQLDLVTSGLA

SEQ ID NO: 634015 - protein, 22 aa, Mycobacterium
ALNRLLAERALSQEVHVMRYST

SEQ ID NO: 634016 - protein, 20 aa, Mycobacterium
ALNRLLFPGPTKEFLAHREQ

SEQ ID NO: 634017 - protein, 18 aa, Mycobacterium
ALNRPALAAIAFPDDEKR

SEQ ID NO: 634018 - protein, 23 aa, Mycobacterium
ALNSGKLTFGIVYTYVRPQTWQS

SEQ ID NO: 634019 - protein, 19 aa, Mycobacterium
ALNSRLGGHIVQGHVDGTG

SEQ ID NO: 634020 - protein, 19 aa, Mycobacterium
ALNVARMRLLGASVVSVES

SEQ ID NO: 634021 - protein, 25 aa, Mycobacterium
ALNVCAHRAAKVCRFEAGNAKTFQC

SEQ ID NO: 634022 - protein, 21 aa, Mycobacterium
ALPADMPRVLTWVDDGTEVPP

SEQ ID NO: 634023 - protein, 19 aa, Mycobacterium
ALPAELRLPLVDLAIPQLA

SEQ ID NO: 634024 - protein, 23 aa, Mycobacterium
ALPAGSKVTLWYGSANRDETKFD

SEQ ID NO: 634025 - protein, 18 aa, Mycobacterium
ALPAILGFVPEKSLVLVS

SEQ ID NO: 634026 - protein, 27 aa, Mycobacterium
ALPAKAADSLTEWMLGYVRFHRTYRGV

SEQ ID NO: 634027 - protein, 19 aa, Mycobacterium
ALPALGRSGSLDILLAAYS

SEQ ID NO: 634028 - protein, 27 aa, Mycobacterium
ALPALLRRLVIMGGCYDGTAAAEWNIS

SEQ ID NO: 634029 - protein, 23 aa, Mycobacterium
ALPANRPNLLAGRTSATYYPSHV

SEQ ID NO: 634030 - protein, 22 aa, Mycobacterium
ALPAPARWAMRIPGGKVLQRLL

SEQ ID NO: 634031 - protein, 18 aa, Mycobacterium
ALPAPDFESAEHYRAPGD

SEQ ID NO: 634032 - protein, 19 aa, Mycobacterium
ALPARGGLALHFEVAPPVG

SEQ ID NO: 634033 - protein, 26 aa, Mycobacterium
ALPARPELRLLWKVIGLAATVEGALP

SEQ ID NO: 634034 - protein, 27 aa, Mycobacterium
ALPAVRSRWPGVAPLRVRPRRAATAAH

SEQ ID NO: 634035 - protein, 22 aa, Mycobacterium
ALPCRVRPGTLRVFEADPMDTT

SEQ ID NO: 634036 - protein, 24 aa, Mycobacterium
ALPDARPTVWGAVPRVWEKLKAGI

SEQ ID NO: 634037 - protein, 32 aa, Mycobacterium
ALPDGISRLRFRLRWRDFRVTIDVNHVDVTYT

SEQ ID NO: 634038 - protein, 37 aa, Mycobacterium
ALPDKRWPRLRAEQGEVLKAWFARRTERDLVIKQNTG

SEQ ID NO: 634039 - protein, 24 aa, Mycobacterium
ALPDPRLTELARMFGSEKIVPAPV

SEQ ID NO: 634040 - protein, 22 aa, Mycobacterium
ALPDRPLRAMVPVSIRTGDEAD

SEQ ID NO: 634041 - protein, 17 aa, Mycobacterium
ALPDRQRHSSLLPLLHN

SEQ ID NO: 634042 - protein, 25 aa, Mycobacterium
ALPDVMTVVGSVFRPHGNLSQALDA

SEQ ID NO: 634043 - protein, 18 aa, Mycobacterium
ALPDWQIIARIACEMGFS

SEQ ID NO: 634044 - protein, 17 aa, Mycobacterium
ALPEAKSQLAWVDIDTV

SEQ ID NO: 634045 - protein, 24 aa, Mycobacterium
ALPEDARLLLTIRPGDLLDEEPDA

SEQ ID NO: 634046 - protein, 23 aa, Mycobacterium
ALPEIGHACGHNIIAASAVGAAL

SEQ ID NO: 634047 - protein, 23 aa, Mycobacterium
ALPEIGHACGHNIIASSAVGTAL

SEQ ID NO: 634048 - protein, 19 aa, Mycobacterium
ALPEIPLVASGGIRTGMDA

SEQ ID NO: 634049 - protein, 21 aa, Mycobacterium
ALPEKPWFGPTSWAGRQQDNS

SEQ ID NO: 634050 - protein, 24 aa, Mycobacterium
ALPELNSEVGLQWLQAHVEVLLAQ

SEQ ID NO: 634051 - protein, 27 aa, Mycobacterium
ALPELRPVPGRPFGVYIHVPFCITRCG

SEQ ID NO: 634052 - protein, 18 aa, Mycobacterium
ALPETLKDAVSFIHRHAG

SEQ ID NO: 634053 - protein, 17 aa, Mycobacterium
ALPEYAKDLKLNLGSIS

SEQ ID NO: 634054 - protein, 26 aa, Mycobacterium
ALPFIDFPPGYGLRHETDRGFANVTR

SEQ ID NO: 634055 - protein, 23 aa, Mycobacterium
ALPGAEVLFVYDFRSSALRETWS

SEQ ID NO: 634056 - protein, 22 aa, Mycobacterium
ALPGDLNQGVLINIPEGTMRFG

SEQ ID NO: 634057 - protein, 19 aa, Mycobacterium
ALPGELADRFHATFDALLH

SEQ ID NO: 634058 - protein, 20 aa, Mycobacterium
ALPGEVADRFAGYFDAELRN

SEQ ID NO: 634059 - protein, 23 aa, Mycobacterium
ALPGLDLARLDLVIIENVGNLVC

SEQ ID NO: 634060 - protein, 18 aa, Mycobacterium
ALPGLTARESVWPHTLQP

SEQ ID NO: 634061 - protein, 22 aa, Mycobacterium
ALPGRGAATVDEIAVASGLVPE

SEQ ID NO: 634062 - protein, 23 aa, Mycobacterium
ALPHLRATGGRVVTCASTLGIKA

SEQ ID NO: 634063 - protein, 23 aa, Mycobacterium
ALPKFPLELGEAAADTPGAIDVF

SEQ ID NO: 634064 - protein, 23 aa, Mycobacterium
ALPKLAAQFVKAWAPEVGGGIPW

SEQ ID NO: 634065 - protein, 21 aa, Mycobacterium
ALPKLAHEFLEAWVPEDGGGI

SEQ ID NO: 634066 - protein, 19 aa, Mycobacterium
ALPKLVERFSDVQLLIVGR

SEQ ID NO: 634067 - protein, 18 aa, Mycobacterium
ALPKRIYVPDGVYAEAIE

SEQ ID NO: 634068 - protein, 20 aa, Mycobacterium
ALPKRPVQSSVLIVPVVSGD

SEQ ID NO: 634069 - protein, 18 aa, Mycobacterium
ALPLTVTEWDEWGNPLRD

SEQ ID NO: 634070 - protein, 20 aa, Mycobacterium
ALPLTYRFEPGAADDGVTVH

SEQ ID NO: 634071 - protein, 18 aa, Mycobacterium
ALPNIKRLLPAARAASVH

SEQ ID NO: 634072 - protein, 33 aa, Mycobacterium
ALPNISRLLPVARRAGVDVVHCLVQRRADGRGA

SEQ ID NO: 634073 - protein, 19 aa, Mycobacterium
ALPPFNQRLVNSMFTLSTV

SEQ ID NO: 634074 - protein, 29 aa, Mycobacterium
ALPPGGTSFARWAALLAEHAHAPDVAGQA

SEQ ID NO: 634075 - protein, 24 aa, Mycobacterium
ALPPPRAGSVFGAIDGGYQVLLDE

SEQ ID NO: 634076 - protein, 26 aa, Mycobacterium
ALPPSADEALRWLARVRDGKPEDPAG

SEQ ID NO: 634077 - protein, 17 aa, Mycobacterium
ALPQLPAVVQWDAGPKF

SEQ ID NO: 634078 - protein, 19 aa, Mycobacterium
ALPQPVLRPPTRVDDVAGE

SEQ ID NO: 634079 - protein, 18 aa, Mycobacterium
ALPRANMAAQIIEVAPGL

SEQ ID NO: 634080 - protein, 23 aa, Mycobacterium
ALPRGSAVVDLGCGPGIPLTEVM

SEQ ID NO: 634081 - protein, 24 aa, Mycobacterium
ALPRLAPDRVRPYISPQLHNHMLN

SEQ ID NO: 634082 - protein, 19 aa, Mycobacterium
ALPRLVKALQDAGVTVHAD

SEQ ID NO: 634083 - protein, 19 aa, Mycobacterium
ALPRPGETVLASSMTQAPG

SEQ ID NO: 634084 - protein, 24 aa, Mycobacterium
ALPRRFGNVYPLRYRLDRDGDDQF

SEQ ID NO: 634085 - protein, 19 aa, Mycobacterium
ALPRYRLADYDNPRAPHTE

SEQ ID NO: 634086 - protein, 19 aa, Mycobacterium
ALPSAFFFEIARLADGGGE

SEQ ID NO: 634087 - protein, 17 aa, Mycobacterium
ALPSFAVTALRHRQGRD

SEQ ID NO: 634088 - protein, 23 aa, Mycobacterium
ALPSRPVQVIGFTSVPGAGDNFL

SEQ ID NO: 634089 - protein, 23 aa, Mycobacterium
ALPSRPVQVVGFTSVPGAGDNFL

SEQ ID NO: 634090 - protein, 18 aa, Mycobacterium
ALPSYVIAELLGIPLEDG

SEQ ID NO: 634091 - protein, 24 aa, Mycobacterium
ALPTALWTGWALRLSPPALAHSSS

SEQ ID NO: 634092 - protein, 20 aa, Mycobacterium
ALPTMRIVTEEVFGPLVAFQ

SEQ ID NO: 634093 - protein, 23 aa, Mycobacterium
ALPVLRSVALFGLDRLDPVGDGA

SEQ ID NO: 634094 - protein, 21 aa, Mycobacterium
ALPVPERLGGDGVGLLEVGTV

SEQ ID NO: 634095 - protein, 21 aa, Mycobacterium
ALPVPERLGGDGVGLPEVATV

SEQ ID NO: 634096 - protein, 17 aa, Mycobacterium
ALPWLKQLHGKIIVIKY

SEQ ID NO: 634097 - protein, 24 aa, Mycobacterium
ALPYDKLALCTGARPRRLPTPGAD

SEQ ID NO: 634098 - protein, 25 aa, Mycobacterium
ALPYDKLALCTGARPRRLSIPGADL

SEQ ID NO: 634099 - protein, 18 aa, Mycobacterium
ALPYRPAAEFEELTGAKI

SEQ ID NO: 634100 - protein, 20 aa, Mycobacterium
ALQAASGWEALGAALEAQAD

SEQ ID NO: 634101 - protein, 19 aa, Mycobacterium
ALQAEFHLSYVFVSHNLAV

SEQ ID NO: 634102 - protein, 19 aa, Mycobacterium
ALQAGTLAPWLAENSDGRR

SEQ ID NO: 634103 - protein, 17 aa, Mycobacterium
ALQAPGLTAHRPAVFFD

SEQ ID NO: 634104 - protein, 17 aa, Mycobacterium
ALQAVVRGKATPDVLQR

SEQ ID NO: 634105 - protein, 24 aa, Mycobacterium
ALQCGYCTPGQIMSGVACIAEGHA

SEQ ID NO: 634106 - protein, 24 aa, Mycobacterium
ALQEVKRALDAAGVPHKQLSLAEA

SEQ ID NO: 634107 - protein, 17 aa, Mycobacterium
ALQFGNGTHLDSREGIG

SEQ ID NO: 634108 - protein, 24 aa, Mycobacterium
ALQFTCPYHGWSYSMDGSLVSTPG

SEQ ID NO: 634109 - protein, 20 aa, Mycobacterium
ALQGALLVRHGHPAVAEAFL

SEQ ID NO: 634110 - protein, 20 aa, Mycobacterium
ALQGALLVRHGHPAVAQAFL

SEQ ID NO: 634111 - protein, 22 aa, Mycobacterium
ALQHPRGVLVIWIELAENRPFT

SEQ ID NO: 634112 - protein, 21 aa, Mycobacterium
ALQHRARRVLPAGVIEGSIDP

SEQ ID NO: 634113 - protein, 23 aa, Mycobacterium
ALQKFRLDREVRAAILTGAGEKF

SEQ ID NO: 634114 - protein, 19 aa, Mycobacterium
ALQKMAAVEVFTRTDGVML

SEQ ID NO: 634115 - protein, 24 aa, Mycobacterium
ALQKMSFEVAWRILRATPMTATGL

SEQ ID NO: 634116 - protein, 17 aa, Mycobacterium
ALQKYHFVEKINHVHTG

SEQ ID NO: 634117 - protein, 18 aa, Mycobacterium
ALQKYHFVEKINHVHTGG

SEQ ID NO: 634118 - protein, 19 aa, Mycobacterium
ALQKYHWVEKINHVHTGGN

SEQ ID NO: 634119 - protein, 19 aa, Mycobacterium
ALQLLAWAGNAGRLDVEGW

SEQ ID NO: 634120 - protein, 21 aa, Mycobacterium
ALQNTRFWAPLSLTAEQKHSI

SEQ ID NO: 634121 - protein, 19 aa, Mycobacterium
ALQPACEYDDLGIVGWNLS

SEQ ID NO: 634122 - protein, 24 aa, Mycobacterium
ALQPEIRLAAPLLAKGLPACPGVA

SEQ ID NO: 634123 - protein, 24 aa, Mycobacterium
ALQPEVRLAAKLLARGLPACPGVA

SEQ ID NO: 634124 - protein, 19 aa, Mycobacterium
ALQPHMPIWVGGRTKRSLR

SEQ ID NO: 634125 - protein, 21 aa, Mycobacterium
ALQPLQSMMGMFASPGALGMS

SEQ ID NO: 634126 - protein, 17 aa, Mycobacterium
ALQPWEAARPVAPRGAL

SEQ ID NO: 634127 - protein, 26 aa, Mycobacterium
ALQQLSGRHDLMWAMVSDMPAVGSAE

SEQ ID NO: 634128 - protein, 24 aa, Mycobacterium
ALQRACAAGALATLVRGAGDCAPS

SEQ ID NO: 634129 - protein, 19 aa, Mycobacterium
ALQRAGRYLVIGGLGGVGR

SEQ ID NO: 634130 - protein, 27 aa, Mycobacterium
ALQRARPVLEPMAGKIIHCGAAGAGQA

SEQ ID NO: 634131 - protein, 18 aa, Mycobacterium
ALQRCEVPVIAAVNGAAI

SEQ ID NO: 634132 - protein, 25 aa, Mycobacterium
ALQRDNCKLIDWPIATLSPVGVRTS

SEQ ID NO: 634133 - protein, 17 aa, Mycobacterium
ALQRLAGEREVIFWDQL

SEQ ID NO: 634134 - protein, 19 aa, Mycobacterium
ALQRRLGTTTVYVTHDQVE

SEQ ID NO: 634135 - protein, 19 aa, Mycobacterium
ALQRRPAAVMLSFGELQPF

SEQ ID NO: 634136 - protein, 23 aa, Mycobacterium
ALQRYRPWRGLRRTMAEADRLLY

SEQ ID NO: 634137 - protein, 27 aa, Mycobacterium
ALQVCPVPPPRELDMLLTAGERISNAL

SEQ ID NO: 634138 - protein, 18 aa, Mycobacterium
ALQVCQPDPALGVRPPDP

SEQ ID NO: 634139 - protein, 17 aa, Mycobacterium
ALQVMFVLRELRGGVHF

SEQ ID NO: 634140 - protein, 19 aa, Mycobacterium
ALQVSRWTREMFCLMEGRH

SEQ ID NO: 634141 - protein, 25 aa, Mycobacterium
ALQVSRWTREMFCLMEGRHVHPSTL

SEQ ID NO: 634142 - protein, 25 aa, Mycobacterium
ALQWLPQHRDLISAWAHQLNPGGWL

SEQ ID NO: 634143 - protein, 19 aa, Mycobacterium
ALQYMFRRHLEMTPMEYLR

SEQ ID NO: 634144 - protein, 23 aa, Mycobacterium
ALQYWHVLGLWKLAIIAEGVMRR

SEQ ID NO: 634145 - protein, 22 aa, Mycobacterium
ALRAAELVKAYPGSDARAVDGL

SEQ ID NO: 634146 - protein, 18 aa, Mycobacterium
ALRACARLQPNDPAFTFM

SEQ ID NO: 634147 - protein, 18 aa, Mycobacterium
ALRACARLQPNDPAFTYI

SEQ ID NO: 634148 - protein, 24 aa, Mycobacterium
ALRACLEPFASIYDAWKVESLRTE

SEQ ID NO: 634149 - protein, 19 aa, Mycobacterium
ALRAEGVEIVFTPTGSDMY

SEQ ID NO: 634150 - protein, 34 aa, Mycobacterium
ALRAESALPRLLKRLVIMGGAFDYRGNTTPVAEW

SEQ ID NO: 634151 - protein, 27 aa, Mycobacterium
ALRAGGFKHRAKVEILWVGSDDCQTDG

SEQ ID NO: 634152 - protein, 26 aa, Mycobacterium
ALRAGLDHLLTWGVLAAPLTLVPAPT

SEQ ID NO: 634153 - protein, 21 aa, Mycobacterium
ALRAICPWEGFTDAYRDLAFP

SEQ ID NO: 634154 - protein, 20 aa, Mycobacterium
ALRALGVRKGDRVGGLLINS

SEQ ID NO: 634155 - protein, 18 aa, Mycobacterium
ALRAPRIVVRTDRHTAVG

SEQ ID NO: 634156 - protein, 24 aa, Mycobacterium
ALRAQGFTILLSRDVPVNNDAIRP

SEQ ID NO: 634157 - protein, 28 aa, Mycobacterium
ALRAQLRLAGAGLRNTRIDECVDELVAC

SEQ ID NO: 634158 - protein, 21 aa, Mycobacterium
ALRAQQRWTEPRSWETLQRGW

SEQ ID NO: 634159 - protein, 17 aa, Mycobacterium
ALRARIAAFQDQLAQTV

SEQ ID NO: 634160 - protein, 18 aa, Mycobacterium
ALRARIVAMLNNPVMPTP

SEQ ID NO: 634161 - protein, 17 aa, Mycobacterium
ALRARIVDFQQQLAETV

SEQ ID NO: 634162 - protein, 17 aa, Mycobacterium
ALRARMFASNLGVEEDE

SEQ ID NO: 634163 - protein, 17 aa, Mycobacterium
ALRARRMAVGLIDDHRP

SEQ ID NO: 634164 - protein, 18 aa, Mycobacterium
ALRATGYRALSNELAGRP

SEQ ID NO: 634165 - protein, 21 aa, Mycobacterium
ALRAWPTPLGVAINSADPIWD

SEQ ID NO: 634166 - protein, 18 aa, Mycobacterium
ALRAWPVHVPAAVLGLLA

SEQ ID NO: 634167 - protein, 20 aa, Mycobacterium
ALRDCAPSVILTTASAAGEV

SEQ ID NO: 634168 - protein, 27 aa, Mycobacterium
ALRDGRASWYRNRWVRSMPVCAALGES

SEQ ID NO: 634169 - protein, 19 aa, Mycobacterium
ALRDMPWRDAHQVDDPLDY

SEQ ID NO: 634170 - protein, 28 aa, Mycobacterium
ALRDRGSLRRFIPFDVDSSVLTAAGAAI

SEQ ID NO: 634171 - protein, 18 aa, Mycobacterium
ALRDRRSRKWKRWERGAP

SEQ ID NO: 634172 - protein, 23 aa, Mycobacterium
ALREAGLEWRQIQLVAGADTIRN

SEQ ID NO: 634173 - protein, 22 aa, Mycobacterium
ALREASYRLGARTLYHQFGAPL

SEQ ID NO: 634174 - protein, 18 aa, Mycobacterium
ALRECRILGVRGSDGRVH

SEQ ID NO: 634175 - protein, 19 aa, Mycobacterium
ALREFHRVLAPGGLVAVSS

SEQ ID NO: 634176 - protein, 18 aa, Mycobacterium
ALREGIACAVLRRADHRD

SEQ ID NO: 634177 - protein, 17 aa, Mycobacterium
ALRELAHRCPVAVLSGR

SEQ ID NO: 634178 - protein, 19 aa, Mycobacterium
ALRESRDALASALERPDCP

SEQ ID NO: 634179 - protein, 22 aa, Mycobacterium
ALRETSARRALVLNLAAEPGET

SEQ ID NO: 634180 - protein, 23 aa, Mycobacterium
ALREVHAPTLLIVGGRDEAVLEL

SEQ ID NO: 634181 - protein, 23 aa, Mycobacterium
ALREVPGIQPGILYVERQFGVLE

SEQ ID NO: 634182 - protein, 17 aa, Mycobacterium
ALRFARRAIDEIAKIEQ

SEQ ID NO: 634183 - protein, 17 aa, Mycobacterium
ALRFTHGPISWGTAAAV

SEQ ID NO: 634184 - protein, 32 aa, Mycobacterium
ALRGFERFPAWMWRNTVVRDFVDWLRERNQRC

SEQ ID NO: 634185 - protein, 19 aa, Mycobacterium
ALRGHSVVVCIDDEAGRAM

SEQ ID NO: 634186 - protein, 27 aa, Mycobacterium
ALRGLDFFVRRGEIFGFLGPSGAGKST

SEQ ID NO: 634187 - protein, 18 aa, Mycobacterium
ALRGRKLVVQIAQTFQKG

SEQ ID NO: 634188 - protein, 27 aa, Mycobacterium
ALRHGTPRISLQVLHYAPLDLVTPTRD

SEQ ID NO: 634189 - protein, 20 aa, Mycobacterium
ALRHPRWWFDLLTTEPLAFA

SEQ ID NO: 634190 - protein, 18 aa, Mycobacterium
ALRICKRAETPLRLVSLV

SEQ ID NO: 634191 - protein, 18 aa, Mycobacterium
ALRIIRTANELGIATVAV

SEQ ID NO: 634192 - protein, 19 aa, Mycobacterium
ALRIPIEYLAGLFTAGDTT

SEQ ID NO: 634193 - protein, 19 aa, Mycobacterium
ALRIVRTATELGMRTVAVY

SEQ ID NO: 634194 - protein, 20 aa, Mycobacterium
ALRKNHPVFRRRRFFEGEPI

SEQ ID NO: 634195 - protein, 20 aa, Mycobacterium
ALRKQHPVFRRRRFFEGEPI

SEQ ID NO: 634196 - protein, 24 aa, Mycobacterium
ALRKSDSWQGFAWFVEQQCQLTVT

SEQ ID NO: 634197 - protein, 22 aa, Mycobacterium
ALRLCPPGSGTMRMLNEEMTVD

SEQ ID NO: 634198 - protein, 22 aa, Mycobacterium
ALRLEFKRVQFTPDLMPGDVTG

SEQ ID NO: 634199 - protein, 19 aa, Mycobacterium
ALRLNECDLALAGGANVLL

SEQ ID NO: 634200 - protein, 21 aa, Mycobacterium
ALRLPRDAELIVDGRNVVEDV

SEQ ID NO: 634201 - protein, 21 aa, Mycobacterium
ALRLRLPVIALTRNVILNSAW

SEQ ID NO: 634202 - protein, 20 aa, Mycobacterium
ALRMGDPRGRLELRSALAEY

SEQ ID NO: 634203 - protein, 19 aa, Mycobacterium
ALRMIMCYRAAYAGEDPER

SEQ ID NO: 634204 - protein, 35 aa, Mycobacterium
ALRNKTRLAALRVKDFGERQVMIIHTLLWPDEIRE

SEQ ID NO: 634205 - protein, 17 aa, Mycobacterium
ALRNWLLSRGEPVTPST

SEQ ID NO: 634206 - protein, 17 aa, Mycobacterium
ALRPAPRSSAAHSIASS

SEQ ID NO: 634207 - protein, 22 aa, Mycobacterium
ALRPELRALAPAGDRRMSANPH

SEQ ID NO: 634208 - protein, 19 aa, Mycobacterium
ALRPFDVVCTLRERMAFPS

SEQ ID NO: 634209 - protein, 20 aa, Mycobacterium
ALRPLNAVVRSARMAAISAI

SEQ ID NO: 634210 - protein, 18 aa, Mycobacterium
ALRPLRFLQQSALLESLF

SEQ ID NO: 634211 - protein, 20 aa, Mycobacterium
ALRPLTSVVRSARMAAVTAI

SEQ ID NO: 634212 - protein, 18 aa, Mycobacterium
ALRPPRRGVYDASVDLGD

SEQ ID NO: 634213 - protein, 17 aa, Mycobacterium
ALRPRHWDVEPDLTNAV

SEQ ID NO: 634214 - protein, 22 aa, Mycobacterium
ALRQRIGMVFQQFQLFPHKSVL

SEQ ID NO: 634215 - protein, 20 aa, Mycobacterium
ALRQRLGIHPVFKTVDTCAA

SEQ ID NO: 634216 - protein, 24 aa, Mycobacterium
ALRRAARLDGWMHGGGDPEELDQL

SEQ ID NO: 634217 - protein, 25 aa, Mycobacterium
ALRRAGHTVAPFKVGPDFIDPGYHG

SEQ ID NO: 634218 - protein, 18 aa, Mycobacterium
ALRRAMRALEPCAQNTAR

SEQ ID NO: 634219 - protein, 27 aa, Mycobacterium
ALRRARLSLANGRPVILDGTWRDPQLR

SEQ ID NO: 634220 - protein, 25 aa, Mycobacterium
ALRRARPGTRLVVAGVCMQADTMHP

SEQ ID NO: 634221 - protein, 17 aa, Mycobacterium
ALRRARRSLPGDPYFGD

SEQ ID NO: 634222 - protein, 24 aa, Mycobacterium
ALRRCAARVLLPVARVAADKVPLP

SEQ ID NO: 634223 - protein, 23 aa, Mycobacterium
ALRREMLRDGQAFYIHNRVRTID

SEQ ID NO: 634224 - protein, 17 aa, Mycobacterium
ALRRGDPDAGVTALSAV

SEQ ID NO: 634225 - protein, 17 aa, Mycobacterium
ALRRHDIDHGTAFVDTV

SEQ ID NO: 634226 - protein, 17 aa, Mycobacterium
ALRRITEGAAMIRSKGE

SEQ ID NO: 634227 - protein, 30 aa, Mycobacterium
ALRRLALGHWLRRWWPASIREGIAELDPAL

SEQ ID NO: 634228 - protein, 20 aa, Mycobacterium
ALRRLHQMRRALADLPAIRV

SEQ ID NO: 634229 - protein, 21 aa, Mycobacterium
ALRRPCGRIHWAGTETSAKMC

SEQ ID NO: 634230 - protein, 22 aa, Mycobacterium
ALRRPCGRIHWAGTETSATMCG

SEQ ID NO: 634231 - protein, 19 aa, Mycobacterium
ALRRQAIAEGRSMQAVALS

SEQ ID NO: 634232 - protein, 23 aa, Mycobacterium
ALRRRAVKIPPAVVARLGVELPE

SEQ ID NO: 634233 - protein, 25 aa, Mycobacterium
ALRRRVMLERAAWRLQHGEPVSAVA

SEQ ID NO: 634234 - protein, 19 aa, Mycobacterium
ALRRRVREETGLVASVGAG

SEQ ID NO: 634235 - protein, 18 aa, Mycobacterium
ALRRWMDRYASFVAAKRG

SEQ ID NO: 634236 - protein, 19 aa, Mycobacterium
ALRSAGFEHVRIDLSRDGG

SEQ ID NO: 634237 - protein, 19 aa, Mycobacterium
ALRSAGIVCFGPGKDAARI

SEQ ID NO: 634238 - protein, 17 aa, Mycobacterium
ALRSGGVRIALDDIGAH

SEQ ID NO: 634239 - protein, 24 aa, Mycobacterium
ALRSLKRRLARVVFNRLRADQSRV

SEQ ID NO: 634240 - protein, 20 aa, Mycobacterium
ALRSRLGVTTGRAASPRRLR

SEQ ID NO: 634241 - protein, 18 aa, Mycobacterium
ALRSSVITAARLVTDGVN

SEQ ID NO: 634242 - protein, 24 aa, Mycobacterium
ALRTCLQHPQIARSAVIISAEAIE

SEQ ID NO: 634243 - protein, 27 aa, Mycobacterium
ALRTCLQHPRIARPAVIISAEAIEDDA

SEQ ID NO: 634244 - protein, 18 aa, Mycobacterium
ALRTEWDGLDLGRQQAII

SEQ ID NO: 634245 - protein, 18 aa, Mycobacterium
ALRTPGGAGIRLDGSTNL

SEQ ID NO: 634246 - protein, 24 aa, Mycobacterium
ALRTRLGKITAITVNWSSLESSPD

SEQ ID NO: 634247 - protein, 18 aa, Mycobacterium
ALRVAERGLASALAELAP

SEQ ID NO: 634248 - protein, 24 aa, Mycobacterium
ALRVGADLAHRVRVARRRDEESVV

SEQ ID NO: 634249 - protein, 24 aa, Mycobacterium
ALRVGITAGHCFNGDGIIRNGDGA

SEQ ID NO: 634250 - protein, 23 aa, Mycobacterium
ALRVPLVSVILRRGYGLGAQAMT

SEQ ID NO: 634251 - protein, 23 aa, Mycobacterium
ALRVPRTELRLFGKPESFITRRM

SEQ ID NO: 634252 - protein, 25 aa, Mycobacterium
ALRVSRLHAKLFYQPLLESVTEFDK

SEQ ID NO: 634253 - protein, 25 aa, Mycobacterium
ALRVTRPRMAVLSAVGQHPHADTEV

SEQ ID NO: 634254 - protein, 20 aa, Mycobacterium
ALRVVGHGHGMRVECRAPGG

SEQ ID NO: 634255 - protein, 24 aa, Mycobacterium
ALRWLPADINAGAALPTGDPVAES

SEQ ID NO: 634256 - protein, 20 aa, Mycobacterium
ALRYFWPRLTPGAFVLLDDY

SEQ ID NO: 634257 - protein, 21 aa, Mycobacterium
ALRYPEQIAGIAYMDALVQPR

SEQ ID NO: 634258 - protein, 22 aa, Mycobacterium
ALRYRPGLTFADVDSRATPGFD

SEQ ID NO: 634259 - protein, 22 aa, Mycobacterium
ALSAELRSTFFRALSDAQNDDD

SEQ ID NO: 634260 - protein, 24 aa, Mycobacterium
ALSALSAGVSPEFVLVHDAARALT

SEQ ID NO: 634261 - protein, 18 aa, Mycobacterium
ALSDIGFDVFDSFGTYFL

SEQ ID NO: 634262 - protein, 17 aa, Mycobacterium
ALSDLGWMVVRVTVEDV

SEQ ID NO: 634263 - protein, 23 aa, Mycobacterium
ALSDLQPGDVITFYNDASHSGLY

SEQ ID NO: 634264 - protein, 23 aa, Mycobacterium
ALSDRPGVMAMRVVESEPGRSTI

SEQ ID NO: 634265 - protein, 25 aa, Mycobacterium
ALSDVPAELAALVGRDDDRGTEVVA

SEQ ID NO: 634266 - protein, 26 aa, Mycobacterium
ALSDVPPELAPLVGRDDDRGTETIAV

SEQ ID NO: 634267 - protein, 26 aa, Mycobacterium
ALSDVPPELTALIGRDDDRGTETVAV

SEQ ID NO: 634268 - protein, 21 aa, Mycobacterium
ALSEAGVSVWLDDLSRERLQT

SEQ ID NO: 634269 - protein, 32 aa, Mycobacterium
ALSEKPELAQFTWRTRHNWVSGTHSRATVDTF

SEQ ID NO: 634270 - protein, 24 aa, Mycobacterium
ALSEPYPRAFAFYNTERIEVLEAR

SEQ ID NO: 634271 - protein, 17 aa, Mycobacterium
ALSEWQRIIDINLTGVF

SEQ ID NO: 634272 - protein, 17 aa, Mycobacterium
ALSEWQRILDINLTGVF

SEQ ID NO: 634273 - protein, 28 aa, Mycobacterium
ALSFIPACGNCRFCVNGQSYICDIGASL

SEQ ID NO: 634274 - protein, 19 aa, Mycobacterium
ALSFRLARIYAEYNAIHPF

SEQ ID NO: 634275 - protein, 32 aa, Mycobacterium
ALSGFERFPAWMWRNTVVRDFVEWLRTRNRQH

SEQ ID NO: 634276 - protein, 33 aa, Mycobacterium
ALSGFERFPAWMWRNVVVRDFVDWLRARNQRHR

SEQ ID NO: 634277 - protein, 17 aa, Mycobacterium
ALSGGFLAHGLQAQRIV

SEQ ID NO: 634278 - protein, 25 aa, Mycobacterium
ALSGLAEMPWRLSIFGDGPDRERLQ

SEQ ID NO: 634279 - protein, 23 aa, Mycobacterium
ALSGLQIPNFLPADYAVLDGIFA

SEQ ID NO: 634280 - protein, 25 aa, Mycobacterium
ALSGMDAVSGWRGAPRPVSSRELLP

SEQ ID NO: 634281 - protein, 18 aa, Mycobacterium
ALSGRPASTILRLERLAE

SEQ ID NO: 634282 - protein, 18 aa, Mycobacterium
ALSGRPGIVLSRRQLLEI

SEQ ID NO: 634283 - protein, 18 aa, Mycobacterium
ALSGRPGNVLSRRQLLEI

SEQ ID NO: 634284 - protein, 25 aa, Mycobacterium
ALSGRWPADLLSAATIPSSHDWGYR

SEQ ID NO: 634285 - protein, 17 aa, Mycobacterium
ALSGTAMALPFSAPSTP

SEQ ID NO: 634286 - protein, 25 aa, Mycobacterium
ALSKARFEFRWHDQFALSLDPDTAR

SEQ ID NO: 634287 - protein, 19 aa, Mycobacterium
ALSKRLLWDTAINGYAPQQ

SEQ ID NO: 634288 - protein, 18 aa, Mycobacterium
ALSKRLLWDTAINGYTPR

SEQ ID NO: 634289 - protein, 17 aa, Mycobacterium
ALSKRLLWDTLINGYTP

SEQ ID NO: 634290 - protein, 21 aa, Mycobacterium
ALSLFSAVSVYCRRVLSPDAI

SEQ ID NO: 634291 - protein, 19 aa, Mycobacterium
ALSLPDRVLAAAVSYQCAC

SEQ ID NO: 634292 - protein, 20 aa, Mycobacterium
ALSLSRAWDAATLRIVSKAR

SEQ ID NO: 634293 - protein, 24 aa, Mycobacterium
ALSLSRLSSVVLRSNLAARTLHVL

SEQ ID NO: 634294 - protein, 17 aa, Mycobacterium
ALSMKYFRDQWRDYQST

SEQ ID NO: 634295 - protein, 22 aa, Mycobacterium
ALSPAGEQFINFEAASDAGPYL

SEQ ID NO: 634296 - protein, 24 aa, Mycobacterium
ALSPEGLDAVALVIGGEPCPDELV

SEQ ID NO: 634297 - protein, 24 aa, Mycobacterium
ALSPFGELAFPLAADDLPYLHPVT

SEQ ID NO: 634298 - protein, 22 aa, Mycobacterium
ALSPFGEVVFPLAADDLPYLHP

SEQ ID NO: 634299 - protein, 25 aa, Mycobacterium
ALSPIRFFNPLGMKFARRASASDID

SEQ ID NO: 634300 - protein, 24 aa, Mycobacterium
ALSPRVAATIPQLVQLAPQAGQMA

SEQ ID NO: 634301 - protein, 25 aa, Mycobacterium
ALSPYRFPTGWFIVAFSSELGAGEV

SEQ ID NO: 634302 - protein, 18 aa, Mycobacterium
ALSQAILRNARHHEAAAQ

SEQ ID NO: 634303 - protein, 20 aa, Mycobacterium
ALSQAWRSSGGIVLGLAPTA

SEQ ID NO: 634304 - protein, 18 aa, Mycobacterium
ALSQRIDAGTVWINTHGV

SEQ ID NO: 634305 - protein, 24 aa, Mycobacterium
ALSQRLGVKVAVVITDTMGRAWRN

SEQ ID NO: 634306 - protein, 25 aa, Mycobacterium
ALSRAPLVPSMLEWLHTARTSMVMD

SEQ ID NO: 634307 - protein, 23 aa, Mycobacterium
ALSRASGCWAAMKIVADVADGLW

SEQ ID NO: 634308 - protein, 21 aa, Mycobacterium
ALSRGAVHYVALGDKHSLTQV

SEQ ID NO: 634309 - protein, 23 aa, Mycobacterium
ALSRGIGVLAVCPAAVETPILDK

SEQ ID NO: 634310 - protein, 24 aa, Mycobacterium
ALSRGVPLRLIYAVHPDDNGADHE

SEQ ID NO: 634311 - protein, 21 aa, Mycobacterium
ALSRKDVEDIFALQSHLAVEL

SEQ ID NO: 634312 - protein, 19 aa, Mycobacterium
ALSRLGRPYVWGATGPDRF

SEQ ID NO: 634313 - protein, 26 aa, Mycobacterium
ALSRNAYRYEFGWRSTAVDGLLGAAH

SEQ ID NO: 634314 - protein, 19 aa, Mycobacterium
ALSRPQLPTGALTSMSAAD

SEQ ID NO: 634315 - protein, 24 aa, Mycobacterium
ALSRPRPAAPMLLADSRASARRID

SEQ ID NO: 634316 - protein, 20 aa, Mycobacterium
ALSRSVARLDARRDIEHALA

SEQ ID NO: 634317 - protein, 18 aa, Mycobacterium
ALSSIGLAVEPVRIPALE

SEQ ID NO: 634318 - protein, 27 aa, Mycobacterium
ALSSTPAGAVWRIGDDVTHRELGHGWV

SEQ ID NO: 634319 - protein, 19 aa, Mycobacterium
ALSTILLECTMAGLATCPL

SEQ ID NO: 634320 - protein, 20 aa, Mycobacterium
ALSTLRDIYGAALGYQVDAT

SEQ ID NO: 634321 - protein, 19 aa, Mycobacterium
ALSTLRDIYGATLGYQVDT

SEQ ID NO: 634322 - protein, 19 aa, Mycobacterium
ALSTLRGIYGAALGYQVDA

SEQ ID NO: 634323 - protein, 17 aa, Mycobacterium
ALSTLVVNAIRKTLKAV

SEQ ID NO: 634324 - protein, 24 aa, Mycobacterium
ALSTPEMFGRVAIAQTLRDITPDL

SEQ ID NO: 634325 - protein, 19 aa, Mycobacterium
ALSTRFPYTGFRSKLHPEI

SEQ ID NO: 634326 - protein, 30 aa, Mycobacterium
ALSTRLEATVLRDGYEWFQYYDRSVPGKLK

SEQ ID NO: 634327 - protein, 24 aa, Mycobacterium
ALSTRLEVDIARDGYEWSQFYDHA

SEQ ID NO: 634328 - protein, 18 aa, Mycobacterium
ALSVCSRAPLEPVSYGVF

SEQ ID NO: 634329 - protein, 24 aa, Mycobacterium
ALSYGDMGLALPILAPSGVASALT

SEQ ID NO: 634330 - protein, 17 aa, Mycobacterium
ALTAAALNLHSVGAGMS

SEQ ID NO: 634331 - protein, 25 aa, Mycobacterium
ALTADWRIAGDNVKVGSPEILVGMI

SEQ ID NO: 634332 - protein, 25 aa, Mycobacterium
ALTAEYKKLLLAMLQRREAWEIIDY

SEQ ID NO: 634333 - protein, 18 aa, Mycobacterium
ALTAIRCDPDSKAYYQRK

SEQ ID NO: 634334 - protein, 25 aa, Mycobacterium
ALTAKLRSHWARRLPATIVGRTGEQ

SEQ ID NO: 634335 - protein, 26 aa, Mycobacterium
ALTAKVMPYKDGFGPFAPEIYRAPLS

SEQ ID NO: 634336 - protein, 18 aa, Mycobacterium
ALTALGFDAEELGRKFAE

SEQ ID NO: 634337 - protein, 17 aa, Mycobacterium
ALTAPAPHHTHPVRFVW

SEQ ID NO: 634338 - protein, 17 aa, Mycobacterium
ALTAPAPHHTRPVRFVW

SEQ ID NO: 634339 - protein, 17 aa, Mycobacterium
ALTAPLLLVHGANDTNV

SEQ ID NO: 634340 - protein, 24 aa, Mycobacterium
ALTARRLACVAALLRRRSGAERRD

SEQ ID NO: 634341 - protein, 21 aa, Mycobacterium
ALTAVGIEWLARRLADTADPT

SEQ ID NO: 634342 - protein, 19 aa, Mycobacterium
ALTCRSRGTVLVVDNTTAT

SEQ ID NO: 634343 - protein, 17 aa, Mycobacterium
ALTDFPDQRAWLMEDFD

SEQ ID NO: 634344 - protein, 26 aa, Mycobacterium
ALTDGWGLAGARGWQGVGHTRMATES

SEQ ID NO: 634345 - protein, 18 aa, Mycobacterium
ALTDLKDSLRAAAVAVNV

SEQ ID NO: 634346 - protein, 19 aa, Mycobacterium
ALTDLKLRALAWGDTTVRI

SEQ ID NO: 634347 - protein, 26 aa, Mycobacterium
ALTDVRPTLFLGVPRVWVKAKMGLDA

SEQ ID NO: 634348 - protein, 26 aa, Mycobacterium
ALTDWRGEPPVDDWSMPPIRIAVDLP

SEQ ID NO: 634349 - protein, 19 aa, Mycobacterium
ALTEAFLWEEHRRVTKTAT

SEQ ID NO: 634350 - protein, 21 aa, Mycobacterium
ALTEARIGVAPAIISLTLLPK

SEQ ID NO: 634351 - protein, 24 aa, Mycobacterium
ALTEARIGVAPAIISLTLLPKLSP

SEQ ID NO: 634352 - protein, 24 aa, Mycobacterium
ALTEARIGVAPSIISLTLLPRLTS

SEQ ID NO: 634353 - protein, 20 aa, Mycobacterium
ALTEARIGVAPSIISLTVLP

SEQ ID NO: 634354 - protein, 23 aa, Mycobacterium
ALTELINALPFLIGKRAGAPQGS

SEQ ID NO: 634355 - protein, 22 aa, Mycobacterium
ALTELRLAGVDGPYSVLLAADV

SEQ ID NO: 634356 - protein, 17 aa, Mycobacterium
ALTETRGDWALRGIATG

SEQ ID NO: 634357 - protein, 19 aa, Mycobacterium
ALTFLRGPQTWVLKSPQHC

SEQ ID NO: 634358 - protein, 24 aa, Mycobacterium
ALTFLRGPRTWVLKSPQHCEQLGP

SEQ ID NO: 634359 - protein, 22 aa, Mycobacterium
ALTGARIPAQRAVELGLANHLS

SEQ ID NO: 634360 - protein, 17 aa, Mycobacterium
ALTGDWFGALAVIAPSV

SEQ ID NO: 634361 - protein, 18 aa, Mycobacterium
ALTGEWFGALAVIAPSVS

SEQ ID NO: 634362 - protein, 20 aa, Mycobacterium
ALTGGMCWEALNNIAASGRP

SEQ ID NO: 634363 - protein, 20 aa, Mycobacterium
ALTGGMCWEALNNIAASHRP

SEQ ID NO: 634364 - protein, 20 aa, Mycobacterium
ALTGGMCWEALNNIAASQRP

SEQ ID NO: 634365 - protein, 20 aa, Mycobacterium
ALTGGMCWEALNNIAASRRP

SEQ ID NO: 634366 - protein, 20 aa, Mycobacterium
ALTGGMCWEALNNIAGSHRP

SEQ ID NO: 634367 - protein, 20 aa, Mycobacterium
ALTGGMCWEALNNIATSRRP

SEQ ID NO: 634368 - protein, 20 aa, Mycobacterium
ALTGGMFDKGFWVAPTILTG

SEQ ID NO: 634369 - protein, 18 aa, Mycobacterium
ALTGGSPTAWALPTLPAP

SEQ ID NO: 634370 - protein, 18 aa, Mycobacterium
ALTGRPLIGDGANGSPGT

SEQ ID NO: 634371 - protein, 22 aa, Mycobacterium
ALTGTRIKAPRAVELGLANHVV

SEQ ID NO: 634372 - protein, 17 aa, Mycobacterium
ALTGWLYGRDVLDLLAL

SEQ ID NO: 634373 - protein, 25 aa, Mycobacterium
ALTHESWHAVVLVCPPRSADEALAD

SEQ ID NO: 634374 - protein, 19 aa, Mycobacterium
ALTKRHFRDLVEVTGTHAA

SEQ ID NO: 634375 - protein, 24 aa, Mycobacterium
ALTKRPGDVVARSELLNVLPGNGD

SEQ ID NO: 634376 - protein, 20 aa, Mycobacterium
ALTKYHWVEKINHVHTGGNS

SEQ ID NO: 634377 - protein, 26 aa, Mycobacterium
ALTLAELDGFLTARLARYKHPKDLVI

SEQ ID NO: 634378 - protein, 25 aa, Mycobacterium
ALTLFSAWTGVDWSRYGQDADVEYF

SEQ ID NO: 634379 - protein, 20 aa, Mycobacterium
ALTLRLPVRAPFAYEGLFGH

SEQ ID NO: 634380 - protein, 18 aa, Mycobacterium
ALTLVPDHHICVVRTDQI

SEQ ID NO: 634381 - protein, 17 aa, Mycobacterium
ALTLVTIGLDLSKMNAV

SEQ ID NO: 634382 - protein, 27 aa, Mycobacterium
ALTPDYPFRCKRVLLGDDYYRALQRDN

SEQ ID NO: 634383 - protein, 18 aa, Mycobacterium
ALTPEWGIAGWNAAYQRL

SEQ ID NO: 634384 - protein, 17 aa, Mycobacterium
ALTPLARLICQRASEDA

SEQ ID NO: 634385 - protein, 19 aa, Mycobacterium
ALTPLSWPTQTLAGLAAPA

SEQ ID NO: 634386 - protein, 28 aa, Mycobacterium
ALTPTLLFPFAAPRVGGDLSEAGARAEM

SEQ ID NO: 634387 - protein, 25 aa, Mycobacterium
ALTQLAVRAVRAWIADGGVLVLARH

SEQ ID NO: 634388 - protein, 24 aa, Mycobacterium
ALTRAQAQVVAWWSPAYFEPNGGL

SEQ ID NO: 634389 - protein, 24 aa, Mycobacterium
ALTRAQSQVVAWWAPSFDEPNGGL

SEQ ID NO: 634390 - protein, 24 aa, Mycobacterium
ALTRAQSQVVAWWAPSYDEPNGGL

SEQ ID NO: 634391 - protein, 24 aa, Mycobacterium
ALTRAQSQVVAWWAPTIDEVNGGL

SEQ ID NO: 634392 - protein, 24 aa, Mycobacterium
ALTRAQSQVVAWWSPAFDEPNGGL

SEQ ID NO: 634393 - protein, 18 aa, Mycobacterium
ALTRAVLTDEEFTGGRAT

SEQ ID NO: 634394 - protein, 19 aa, Mycobacterium
ALTRERVGQLLSLVERRML

SEQ ID NO: 634395 - protein, 19 aa, Mycobacterium
ALTRLKLHLLETVGSPERM

SEQ ID NO: 634396 - protein, 21 aa, Mycobacterium
ALTRLPGERSRLHVDLDMQAA

SEQ ID NO: 634397 - protein, 26 aa, Mycobacterium
ALTRLSMRTLLLDLWREHGFGVLLVT

SEQ ID NO: 634398 - protein, 21 aa, Mycobacterium
ALTRQRLAVMIATVCPDDPRT

SEQ ID NO: 634399 - protein, 17 aa, Mycobacterium
ALTRRNLVLDTMIENIP

SEQ ID NO: 634400 - protein, 20 aa, Mycobacterium
ALTRVAHAFIGFARDNPALF

SEQ ID NO: 634401 - protein, 18 aa, Mycobacterium
ALTSACRYAFFLTATPVQ

SEQ ID NO: 634402 - protein, 25 aa, Mycobacterium
ALTSQWPNWGKIFFNNKGVVAKGTE

SEQ ID NO: 634403 - protein, 19 aa, Mycobacterium
ALTSRGFGADEFDKVAELV

SEQ ID NO: 634404 - protein, 19 aa, Mycobacterium
ALTSTGWRDPYAGTPWHKH

SEQ ID NO: 634405 - protein, 33 aa, Mycobacterium
ALTSWARERGLSVRWRHGDTWAIVEGPPADMAA

SEQ ID NO: 634406 - protein, 34 aa, Mycobacterium
ALTTCGKCSGRLRKLFNSVGVVFKGSGFYRTDSR

SEQ ID NO: 634407 - protein, 18 aa, Mycobacterium
ALTTRLELVTGIIVPTTR

SEQ ID NO: 634408 - protein, 37 aa, Mycobacterium
ALTVCQKCSGKLRKLFNSVGIVFKGSGFYRTDSRSGS

SEQ ID NO: 634409 - protein, 19 aa, Mycobacterium
ALTVWTAGFGVPRLAIDSG

SEQ ID NO: 634410 - protein, 19 aa, Mycobacterium
ALTWQNARTLATMVGKCGA

SEQ ID NO: 634411 - protein, 30 aa, Mycobacterium
ALTWYHCARKLPVYRRVTAVSEARTAVVEA

SEQ ID NO: 634412 - protein, 21 aa, Mycobacterium
ALVAEALRLVDDGMRVKDACA

SEQ ID NO: 634413 - protein, 17 aa, Mycobacterium
ALVAIPVAAALAERDAI

SEQ ID NO: 634414 - protein, 19 aa, Mycobacterium
ALVALRVLRCEGVAATAEA

SEQ ID NO: 634415 - protein, 17 aa, Mycobacterium
ALVALTRRYQKWLTTHP

SEQ ID NO: 634416 - protein, 21 aa, Mycobacterium
ALVAPPTFLAVAGRRVQMEIF

SEQ ID NO: 634417 - protein, 18 aa, Mycobacterium
ALVAPTFVRDFPVETTPL

SEQ ID NO: 634418 - protein, 23 aa, Mycobacterium
ALVAQHRGYKCVFVCPDKVSEDK

SEQ ID NO: 634419 - protein, 20 aa, Mycobacterium
ALVAQRRGYRCVFVCPDKVS

SEQ ID NO: 634420 - protein, 21 aa, Mycobacterium
ALVARAGAPVQVRNPDGAGVR

SEQ ID NO: 634421 - protein, 17 aa, Mycobacterium
ALVARAVEELGGVDILV

SEQ ID NO: 634422 - protein, 19 aa, Mycobacterium
ALVARLIADAGVFITNVAG

SEQ ID NO: 634423 - protein, 17 aa, Mycobacterium
ALVARLVSEAAFKQYPE

SEQ ID NO: 634424 - protein, 27 aa, Mycobacterium
ALVCDAARRSAIAWRAYRDGSGVDSAI

SEQ ID NO: 634425 - protein, 28 aa, Mycobacterium
ALVCTRAVYRHMAKRGGGAIVNQSSTAA

SEQ ID NO: 634426 - protein, 34 aa, Mycobacterium
ALVCYSHGLASYLERVTATWPRRQQPAYVGEFHA

SEQ ID NO: 634427 - protein, 28 aa, Mycobacterium
ALVDAPAVLGWARWTEIGNRYNLGLVRA

SEQ ID NO: 634428 - protein, 21 aa, Mycobacterium
ALVDDEWRGPASVSMAAAAEP

SEQ ID NO: 634429 - protein, 24 aa, Mycobacterium
ALVDLFVDLRCGYAPSGDVYLQRR

SEQ ID NO: 634430 - protein, 19 aa, Mycobacterium
ALVDRFGTKAGRPVDYVEQ

SEQ ID NO: 634431 - protein, 17 aa, Mycobacterium
ALVEAFGADILLPDGSL

SEQ ID NO: 634432 - protein, 17 aa, Mycobacterium
ALVERFGAKAAKPIDYF

SEQ ID NO: 634433 - protein, 23 aa, Mycobacterium
ALVGALGLRPTLAALKSGARLAL

SEQ ID NO: 634434 - protein, 18 aa, Mycobacterium
ALVGALSVPHNWTLAAPE

SEQ ID NO: 634435 - protein, 29 aa, Mycobacterium
ALVGFEIPNEFVVGYGLDYGERYRDLPFI

SEQ ID NO: 634436 - protein, 18 aa, Mycobacterium
ALVGFGLPVRGESRAGKV

SEQ ID NO: 634437 - protein, 17 aa, Mycobacterium
ALVGGTLPQAWPERLAA

SEQ ID NO: 634438 - protein, 18 aa, Mycobacterium
ALVGRLAGFLLESMPVQI

SEQ ID NO: 634439 - protein, 19 aa, Mycobacterium
ALVGVPRGKLVLVNDDDLT

SEQ ID NO: 634440 - protein, 24 aa, Mycobacterium
ALVKVFPHGISFQLHGAVALTMDA

SEQ ID NO: 634441 - protein, 18 aa, Mycobacterium
ALVLAFNKWDLVDEDRRY

SEQ ID NO: 634442 - protein, 21 aa, Mycobacterium
ALVLGCGPIGIAIIAALRMRG

SEQ ID NO: 634443 - protein, 23 aa, Mycobacterium
ALVLGCGPIGIAIVAALRSKGVE

SEQ ID NO: 634444 - protein, 19 aa, Mycobacterium
ALVLPQFVSPPAIAAPGGV

SEQ ID NO: 634445 - protein, 17 aa, Mycobacterium
ALVLSRLTDTHDVTFGV

SEQ ID NO: 634446 - protein, 26 aa, Mycobacterium
ALVNAWSAAFARYGRTVGQVLLTAHD

SEQ ID NO: 634447 - protein, 26 aa, Mycobacterium
ALVNSWSAAFARYGRTVGQVLLSAHD

SEQ ID NO: 634448 - protein, 24 aa, Mycobacterium
ALVNSWSAAFGRYDRTVGQVLLTA

SEQ ID NO: 634449 - protein, 18 aa, Mycobacterium
ALVPDLLWHARFPAPEEF

SEQ ID NO: 634450 - protein, 19 aa, Mycobacterium
ALVPFDGRAKKALELTFRH

SEQ ID NO: 634451 - protein, 20 aa, Mycobacterium
ALVPGRPAPRLVTAAAATGM

SEQ ID NO: 634452 - protein, 21 aa, Mycobacterium
ALVPGRPAPRLVTAAAVESMK

SEQ ID NO: 634453 - protein, 21 aa, Mycobacterium
ALVPGRPAPRLVTAAAVQGMK

SEQ ID NO: 634454 - protein, 17 aa, Mycobacterium
ALVPLYFIAKEARKHVK

SEQ ID NO: 634455 - protein, 23 aa, Mycobacterium
ALVPRAHGSALFERGETQILGVT

SEQ ID NO: 634456 - protein, 25 aa, Mycobacterium
ALVPSVVAGLRWRAPARFPEFTLPT

SEQ ID NO: 634457 - protein, 17 aa, Mycobacterium
ALVPTGVAVAIPFGMVG

SEQ ID NO: 634458 - protein, 19 aa, Mycobacterium
ALVQLAMLLAGSRRMVFGT

SEQ ID NO: 634459 - protein, 21 aa, Mycobacterium
ALVQLCGVLGYDARRDTEPAA

SEQ ID NO: 634460 - protein, 21 aa, Mycobacterium
ALVQLRAGATLSLEQLQDHSR

SEQ ID NO: 634461 - protein, 19 aa, Mycobacterium
ALVRAGGTLVTLAEPPKTQ

SEQ ID NO: 634462 - protein, 19 aa, Mycobacterium
ALVRAIRPTTVVEFGMSFG

SEQ ID NO: 634463 - protein, 23 aa, Mycobacterium
ALVRENRTFPSFAAMLDVTVQAA

SEQ ID NO: 634464 - protein, 17 aa, Mycobacterium
ALVRGGAADKLMRPGGI

SEQ ID NO: 634465 - protein, 17 aa, Mycobacterium
ALVRGLQVCAALDRIVA

SEQ ID NO: 634466 - protein, 23 aa, Mycobacterium
ALVRKQVESFRDWGRDCYCAPGN

SEQ ID NO: 634467 - protein, 19 aa, Mycobacterium
ALVRLGLAVIRGLLLDLVA

SEQ ID NO: 634468 - protein, 20 aa, Mycobacterium
ALVRLRCELGLPELSPAHRL

SEQ ID NO: 634469 - protein, 22 aa, Mycobacterium
ALVRLRCELGLPELSPAHRLDR

SEQ ID NO: 634470 - protein, 17 aa, Mycobacterium
ALVRPGGVVLYATCSPH

SEQ ID NO: 634471 - protein, 17 aa, Mycobacterium
ALVRREGLHTVCEEAGC

SEQ ID NO: 634472 - protein, 25 aa, Mycobacterium
ALVRTRLVELFELFDPADPEVVVGR

SEQ ID NO: 634473 - protein, 20 aa, Mycobacterium
ALVRVPEGFDALTAAPLLCA

SEQ ID NO: 634474 - protein, 18 aa, Mycobacterium
ALVRVPVAFMLLPKTVRP

SEQ ID NO: 634475 - protein, 17 aa, Mycobacterium
ALVSARPGGAVPDVSRL

SEQ ID NO: 634476 - protein, 17 aa, Mycobacterium
ALVSFWMNPDSIYLSPA

SEQ ID NO: 634477 - protein, 23 aa, Mycobacterium
ALVSGEALSAVLLECTMANLATC

SEQ ID NO: 634478 - protein, 24 aa, Mycobacterium
ALVSGELVASWAVYEPRRPFAPSQ

SEQ ID NO: 634479 - protein, 25 aa, Mycobacterium
ALVSGLRLRLPIIATTLGTYETASA

SEQ ID NO: 634480 - protein, 25 aa, Mycobacterium
ALVSPRFAIELGKAGGLGVINGEGL

SEQ ID NO: 634481 - protein, 18 aa, Mycobacterium
ALVTLEFQSIEYRREAVD

SEQ ID NO: 634482 - protein, 24 aa, Mycobacterium
ALVTLRAGAGFDVEDPRGMVEQIL

SEQ ID NO: 634483 - protein, 23 aa, Mycobacterium
ALVVFSSIAGWRVRRANYVYGSA

SEQ ID NO: 634484 - protein, 21 aa, Mycobacterium
ALVVRAGRDYRLREIARADIA

SEQ ID NO: 634485 - protein, 19 aa, Mycobacterium
ALVVRCRQGAGVELAVGRQ

SEQ ID NO: 634486 - protein, 20 aa, Mycobacterium
ALVYHAHCPVAVIRDGQEPA

SEQ ID NO: 634487 - protein, 24 aa, Mycobacterium
ALVYRHGTDWGWVCSAWELERRFS

SEQ ID NO: 634488 - protein, 18 aa, Mycobacterium
ALVYYYFPTMDDLFVEVL

SEQ ID NO: 634489 - protein, 24 aa, Mycobacterium
ALWAATFLRRRGAGACAVLLDPER

SEQ ID NO: 634490 - protein, 19 aa, Mycobacterium
ALWALSFGVLAWRHNNLTY

SEQ ID NO: 634491 - protein, 24 aa, Mycobacterium
ALWAQVCAVGARLQQVTRPRDRVA

SEQ ID NO: 634492 - protein, 30 aa, Mycobacterium
ALWDLKGKLLGLPVCRLLGMAHPAVPIYGS

SEQ ID NO: 634493 - protein, 18 aa, Mycobacterium
ALWGDEWPWGLNRTISPV

SEQ ID NO: 634494 - protein, 19 aa, Mycobacterium
ALWPNWTPAPLTRRVTEDS

SEQ ID NO: 634495 - protein, 21 aa, Mycobacterium
ALWQFLCDRKSSIGRVPDERW

SEQ ID NO: 634496 - protein, 23 aa, Mycobacterium
ALWRLELTELAALIRTRQVSSAE

SEQ ID NO: 634497 - protein, 19 aa, Mycobacterium
ALWRRFKAAQDAFFTARNA

SEQ ID NO: 634498 - protein, 20 aa, Mycobacterium
ALWRRPAFDTDRFVREFFGP

SEQ ID NO: 634499 - protein, 18 aa, Mycobacterium
ALWRSWGVTPDVVIGHSV

SEQ ID NO: 634500 - protein, 26 aa, Mycobacterium
ALWSATLRRLACDHGHGMVVVHPSWW

SEQ ID NO: 634501 - protein, 23 aa, Mycobacterium
ALWTALKTLYPVGIKADTLMRRD

SEQ ID NO: 634502 - protein, 20 aa, Mycobacterium
ALWWDEGRRQWQIHAVGPDG

SEQ ID NO: 634503 - protein, 17 aa, Mycobacterium
ALYAGRFTLPQALTAVR

SEQ ID NO: 634504 - protein, 24 aa, Mycobacterium
ALYDAGWSRYGWPEHAGGLGGPAI

SEQ ID NO: 634505 - protein, 23 aa, Mycobacterium
ALYDEIPFGLTIEEFQQYAADKG

SEQ ID NO: 634506 - protein, 28 aa, Mycobacterium
ALYDNGFFGLSWPREWGGQDLAPVYDVI

SEQ ID NO: 634507 - protein, 18 aa, Mycobacterium
ALYELGHTGIPIYNVNSN

SEQ ID NO: 634508 - protein, 18 aa, Mycobacterium
ALYESGFAPRWYVERDDI

SEQ ID NO: 634509 - protein, 30 aa, Mycobacterium
ALYFHFRSKHALACAIVEYHAAQARDTTED

SEQ ID NO: 634510 - protein, 23 aa, Mycobacterium
ALYGPRFVLGLGRGVPLPDMPEL

SEQ ID NO: 634511 - protein, 24 aa, Mycobacterium
ALYGSLCAIALARAHAQSGVPGVI

SEQ ID NO: 634512 - protein, 26 aa, Mycobacterium
ALYMDRYPLVSAISRPLIAKHLVAAA

SEQ ID NO: 634513 - protein, 28 aa, Mycobacterium
ALYMDRYPLVSAISRPLIVKHLVEAARE

SEQ ID NO: 634514 - protein, 30 aa, Mycobacterium
ALYMDRYPLVSAISRPLIVKHLVKAAREHG

SEQ ID NO: 634515 - protein, 30 aa, Mycobacterium
ALYMDRYPLVSALSRPLIVKHLVDAAREHG

SEQ ID NO: 634516 - protein, 19 aa, Mycobacterium
ALYPRLLPIARDWWAKLGR

SEQ ID NO: 634517 - protein, 25 aa, Mycobacterium
ALYPRLLTIARDWWAKLGRDSAWPD

SEQ ID NO: 634518 - protein, 19 aa, Mycobacterium
ALYPRLSPGGFCIIDDYHA

SEQ ID NO: 634519 - protein, 19 aa, Mycobacterium
ALYQRGLQAGQEFLQTWNY

SEQ ID NO: 634520 - protein, 26 aa, Mycobacterium
ALYRHIGGRWQLERLVGESLLADLEL

SEQ ID NO: 634521 - protein, 32 aa, Mycobacterium
ALYRPIRPEAWPNRRLVPAPADWVNDDDPFGH

SEQ ID NO: 634522 - protein, 18 aa, Mycobacterium
ALYRRGLQAGRKFLQSWN

SEQ ID NO: 634523 - protein, 23 aa, Mycobacterium
ALYRRRDDLWDRLADACRPGRPT

SEQ ID NO: 634524 - protein, 21 aa, Mycobacterium
ALYRVAFECVEDLAADSVVYA

SEQ ID NO: 634525 - protein, 26 aa, Mycobacterium
ALYTPQHWKYLTSGLLGLQHGTDAGD

SEQ ID NO: 634526 - protein, 19 aa, Mycobacterium
ALYWIGRYVERADDTARIL

SEQ ID NO: 634527 - protein, 21 aa, Mycobacterium
AMAAAAAPYVAWINATGAQAE

SEQ ID NO: 634528 - protein, 21 aa, Mycobacterium
AMAAAGWSITVERLPEPSDPR

SEQ ID NO: 634529 - protein, 17 aa, Mycobacterium
AMAAAIDAAERARPHSG

SEQ ID NO: 634530 - protein, 18 aa, Mycobacterium
AMAAAVAPYTSWLSAAAA

SEQ ID NO: 634531 - protein, 20 aa, Mycobacterium
AMAAGALSYLVKPFPTTELA

SEQ ID NO: 634532 - protein, 17 aa, Mycobacterium
AMAAGRLALGVGPSHHW

SEQ ID NO: 634533 - protein, 21 aa, Mycobacterium
AMAAKNAWAALPFDERAAVFL

SEQ ID NO: 634534 - protein, 25 aa, Mycobacterium
AMAAKRVWAAMPFDERAAVFLRAAD

SEQ ID NO: 634535 - protein, 21 aa, Mycobacterium
AMAAKSGWAAMPFDERAAVFL

SEQ ID NO: 634536 - protein, 18 aa, Mycobacterium
AMAALDIWRERYPEVSKK

SEQ ID NO: 634537 - protein, 19 aa, Mycobacterium
AMAANAGYIRGKLAQESAA

SEQ ID NO: 634538 - protein, 19 aa, Mycobacterium
AMAAPCPDAEVIFARGTTE

SEQ ID NO: 634539 - protein, 24 aa, Mycobacterium
AMAARGPRWQTWVDGLAKLVRTQI

SEQ ID NO: 634540 - protein, 26 aa, Mycobacterium
AMAARLKGYRLICVLPENTSVERRQL

SEQ ID NO: 634541 - protein, 19 aa, Mycobacterium
AMAAWCADNGIDLAPHGKT

SEQ ID NO: 634542 - protein, 24 aa, Mycobacterium
AMADAVKGYAAFAVDSMRRQRRFE

SEQ ID NO: 634543 - protein, 23 aa, Mycobacterium
AMADIRARHGVILGELNIGGGHG

SEQ ID NO: 634544 - protein, 27 aa, Mycobacterium
AMADPGSVSYLFSRKGVVTLEKNGLTE

SEQ ID NO: 634545 - protein, 28 aa, Mycobacterium
AMAEAAAWNHDWPQTSVVIGADIEESRH

SEQ ID NO: 634546 - protein, 25 aa, Mycobacterium
AMAEARLRQAPVLVLGDRREGDAFI

SEQ ID NO: 634547 - protein, 17 aa, Mycobacterium
AMAEMFVEAGLPEGVLS

SEQ ID NO: 634548 - protein, 23 aa, Mycobacterium
AMAERRFLAEVAHPSIVKIFNFV

SEQ ID NO: 634549 - protein, 33 aa, Mycobacterium
AMAGAAEELRRLWRARRVLAVTFPTRSEAADVE

SEQ ID NO: 634550 - protein, 20 aa, Mycobacterium
AMAGAELLLGMRRFAPGSST

SEQ ID NO: 634551 - protein, 22 aa, Mycobacterium
AMAGAELLLGMRRFLPSSPTSL

SEQ ID NO: 634552 - protein, 19 aa, Mycobacterium
AMAGARAHNRWLAELCSHS

SEQ ID NO: 634553 - protein, 21 aa, Mycobacterium
AMAGFWVTFSSMFKKRLTEQY

SEQ ID NO: 634554 - protein, 20 aa, Mycobacterium
AMAGGGLLIRPDAMTGPPSA

SEQ ID NO: 634555 - protein, 18 aa, Mycobacterium
AMAGHATRVDVTLLADGG

SEQ ID NO: 634556 - protein, 20 aa, Mycobacterium
AMAGIKPAFKEDGVIHAGNS

SEQ ID NO: 634557 - protein, 25 aa, Mycobacterium
AMAGRRLDGAAVRFLAACRNEVPNA

SEQ ID NO: 634558 - protein, 18 aa, Mycobacterium
AMAIPALLPPSARVRGSV

SEQ ID NO: 634559 - protein, 23 aa, Mycobacterium
AMAKELYLAPSTVKTHVQRLYEK

SEQ ID NO: 634560 - protein, 23 aa, Mycobacterium
AMALRAAEYGRTVVVLTIDPAKR

SEQ ID NO: 634561 - protein, 20 aa, Mycobacterium
AMAPFRLTRELLMSIPGFSG

SEQ ID NO: 634562 - protein, 22 aa, Mycobacterium
AMAPWCGGELAPGPAVADDESL

SEQ ID NO: 634563 - protein, 23 aa, Mycobacterium
AMAQAAAPYAAWLSTTAAQAELA

SEQ ID NO: 634564 - protein, 24 aa, Mycobacterium
AMAQRPAVCRALIGELGRAARMPA

SEQ ID NO: 634565 - protein, 17 aa, Mycobacterium
AMARRARGILARAQGVN

SEQ ID NO: 634566 - protein, 22 aa, Mycobacterium
AMARSTLRHRVMLRPEAELEGA

SEQ ID NO: 634567 - protein, 18 aa, Mycobacterium
AMASEYRALAALPGVDQA

SEQ ID NO: 634568 - protein, 23 aa, Mycobacterium
AMASGDMRATMALTEPGGGSDLQ

SEQ ID NO: 634569 - protein, 22 aa, Mycobacterium
AMATAAAPYVAWLATAGAQAEQ

SEQ ID NO: 634570 - protein, 24 aa, Mycobacterium
AMATGARRLLRLSIPSPMKTVERG

SEQ ID NO: 634571 - protein, 25 aa, Mycobacterium
AMATWRPRKDPIIWATAEIDASRLL

SEQ ID NO: 634572 - protein, 17 aa, Mycobacterium
AMAVRFIAEISGRSPVQ

SEQ ID NO: 634573 - protein, 27 aa, Mycobacterium
AMCDNLWWRIGHHFKVRAVPEKFQVLE

SEQ ID NO: 634574 - protein, 19 aa, Mycobacterium
AMDAFRLLCRTEGIIPAIE

SEQ ID NO: 634575 - protein, 23 aa, Mycobacterium
AMDIFPLARRVLLTAYADTHAAI

SEQ ID NO: 634576 - protein, 27 aa, Mycobacterium
AMDPRQRLALELAWELFEDARIVAESV

SEQ ID NO: 634577 - protein, 33 aa, Mycobacterium
AMDPRQRLALELAWELLEDAFIVPETVRARQVS

SEQ ID NO: 634578 - protein, 24 aa, Mycobacterium
AMDRLGAELSQWSRAAAEIAVALR

SEQ ID NO: 634579 - protein, 20 aa, Mycobacterium
AMDRLGLLAMLTRALERAGT

SEQ ID NO: 634580 - protein, 18 aa, Mycobacterium
AMDRLLRGEIPPGGNCDI

SEQ ID NO: 634581 - protein, 22 aa, Mycobacterium
AMEARFPQINWEITAGNSSPLS

SEQ ID NO: 634582 - protein, 33 aa, Mycobacterium
AMESELGYDPNLWRLLCEQVGAAALVIPEEFGG

SEQ ID NO: 634583 - protein, 18 aa, Mycobacterium
AMESSIDILIDFTIANRR

SEQ ID NO: 634584 - protein, 17 aa, Mycobacterium
AMETWSRGLERFNTARA

SEQ ID NO: 634585 - protein, 17 aa, Mycobacterium
AMETWSRGLQRFDSART

SEQ ID NO: 634586 - protein, 24 aa, Mycobacterium
AMFADVRRGLTVAAVVYAATVTDT

SEQ ID NO: 634587 - protein, 17 aa, Mycobacterium
AMFALPICRRPGAKTVT

SEQ ID NO: 634588 - protein, 22 aa, Mycobacterium
AMFDLWFPAALGARAVITEEQA

SEQ ID NO: 634589 - protein, 20 aa, Mycobacterium
AMFDLWFPAALGARAVVAED

SEQ ID NO: 634590 - protein, 21 aa, Mycobacterium
AMFDLWFPAALGARAVVTDDG

SEQ ID NO: 634591 - protein, 19 aa, Mycobacterium
AMFGDSFADYGFIPDLYAT

SEQ ID NO: 634592 - protein, 26 aa, Mycobacterium
AMFPHLEVVIAYRLLFGIYSGIVPDG

SEQ ID NO: 634593 - protein, 24 aa, Mycobacterium
AMFQMKFYAVALLRSRGVPPTRLR

SEQ ID NO: 634594 - protein, 24 aa, Mycobacterium
AMFQMKFYAVALLRTRGVPPTRLR

SEQ ID NO: 634595 - protein, 26 aa, Mycobacterium
AMFYPEFSLWCGTTATADWHTRYNAI

SEQ ID NO: 634596 - protein, 26 aa, Mycobacterium
AMFYPEFSLWCGTTATADWHTRYNAV

SEQ ID NO: 634597 - protein, 17 aa, Mycobacterium
AMGAALRVAERGLASAL

SEQ ID NO: 634598 - protein, 24 aa, Mycobacterium
AMGALGFISVWGHLAAGQLRDMLT

SEQ ID NO: 634599 - protein, 20 aa, Mycobacterium
AMGARPAAFVVSFGAPSDTP

SEQ ID NO: 634600 - protein, 24 aa, Mycobacterium
AMGAVGFISVWGHLAASQLRDMLS

SEQ ID NO: 634601 - protein, 24 aa, Mycobacterium
AMGDALLAMLCREGVDVGGLVRTT

SEQ ID NO: 634602 - protein, 18 aa, Mycobacterium
AMGGSFGGYMANWVAGHT

SEQ ID NO: 634603 - protein, 35 aa, Mycobacterium
AMGLLRGGDAWLFVGWCRLREGIRGFQLNRIRHLE

SEQ ID NO: 634604 - protein, 26 aa, Mycobacterium
AMGMPLSGLRVGDWVVDPRWWDGRRE

SEQ ID NO: 634605 - protein, 33 aa, Mycobacterium
AMGMVRCVRAALPLLRAAEWARIVNFSAHSTQR

SEQ ID NO: 634606 - protein, 26 aa, Mycobacterium
AMGPEGRAAIGLGDGVVRISIGLEGT

SEQ ID NO: 634607 - protein, 25 aa, Mycobacterium
AMGPEGRAAIGLSDGVVRLSVGLES

SEQ ID NO: 634608 - protein, 19 aa, Mycobacterium
AMGRAIVRRPRVFLMDEPL

SEQ ID NO: 634609 - protein, 23 aa, Mycobacterium
AMGRRFGHEGMRVVLADVLAEPL

SEQ ID NO: 634610 - protein, 19 aa, Mycobacterium
AMGSSYLRYAMAMRNRLPK

SEQ ID NO: 634611 - protein, 17 aa, Mycobacterium
AMGYPMTAYVTARIDQH

SEQ ID NO: 634612 - protein, 20 aa, Mycobacterium
AMHALGIPTTRALAVVATGK

SEQ ID NO: 634613 - protein, 20 aa, Mycobacterium
AMHALGIPTTRSLAVVATGR

SEQ ID NO: 634614 - protein, 20 aa, Mycobacterium
AMHALGIPTTRSLAVVGTGR

SEQ ID NO: 634615 - protein, 23 aa, Mycobacterium
AMHEMDLPLSPEWAIVGQSQGGG

SEQ ID NO: 634616 - protein, 24 aa, Mycobacterium
AMHETRDALAWLRHAGYQRLLDTA

SEQ ID NO: 634617 - protein, 22 aa, Mycobacterium
AMHGFIRGAAAYGARRGDVQAR

SEQ ID NO: 634618 - protein, 18 aa, Mycobacterium
AMHGYCSIVVPVRDRDGA

SEQ ID NO: 634619 - protein, 19 aa, Mycobacterium
AMHPFDLGSVSGFVRRVDG

SEQ ID NO: 634620 - protein, 17 aa, Mycobacterium
AMHPKALIDYTGVVGQL

SEQ ID NO: 634621 - protein, 22 aa, Mycobacterium
AMHRRIPGSRFEFFESSAHMPF

SEQ ID NO: 634622 - protein, 20 aa, Mycobacterium
AMHTEMWLHPATQQNVATLR

SEQ ID NO: 634623 - protein, 19 aa, Mycobacterium
AMHTEMWLHPATVDNVATL

SEQ ID NO: 634624 - protein, 26 aa, Mycobacterium
AMIAEAGDWISCWTMGLNQSTHGTWN

SEQ ID NO: 634625 - protein, 20 aa, Mycobacterium
AMICDLRVVVPEAYFQFPVA

SEQ ID NO: 634626 - protein, 17 aa, Mycobacterium
AMIDCRVLPGRKEAFER

SEQ ID NO: 634627 - protein, 19 aa, Mycobacterium
AMIDRVCQVVGDGTAALAV

SEQ ID NO: 634628 - protein, 27 aa, Mycobacterium
AMIDVIRFWLGLGIDGFRLDAVPYLFE

SEQ ID NO: 634629 - protein, 27 aa, Mycobacterium
AMIDVMRFWLGLGIDGFRLDAVPYLFE

SEQ ID NO: 634630 - protein, 23 aa, Mycobacterium
AMIGEPGQGWAIANATLGHERTS

SEQ ID NO: 634631 - protein, 32 aa, Mycobacterium
AMIGRGLQALPPRRSGPDGARTELLKVRRATI

SEQ ID NO: 634632 - protein, 25 aa, Mycobacterium
AMIPQRSGVVFFIAFSPRRGIPTFV

SEQ ID NO: 634633 - protein, 27 aa, Mycobacterium
AMITAVLEKRARLPVGTNDIYLSTVGG

SEQ ID NO: 634634 - protein, 17 aa, Mycobacterium
AMIYSFQSAGAIAADVE

SEQ ID NO: 634635 - protein, 21 aa, Mycobacterium
AMKELTLDIASLVFMGHEPGS

SEQ ID NO: 634636 - protein, 26 aa, Mycobacterium
AMKKRTLPEWSERFATLAGPWAPVQD

SEQ ID NO: 634637 - protein, 21 aa, Mycobacterium
AMKRITLNVILRAVFGAEGDD

SEQ ID NO: 634638 - protein, 26 aa, Mycobacterium
AMLAAKTWWRGVKWSADVATTTGTKI

SEQ ID NO: 634639 - protein, 31 aa, Mycobacterium
AMLAARLVPHPDWHGDWSAARGYEIGEKIAA

SEQ ID NO: 634640 - protein, 23 aa, Mycobacterium
AMLAEAFYGPTLVSLRHVQEGHP

SEQ ID NO: 634641 - protein, 19 aa, Mycobacterium
AMLAEEREVLGPFPTDRGW

SEQ ID NO: 634642 - protein, 17 aa, Mycobacterium
AMLCARGSQTVRYLQRA

SEQ ID NO: 634643 - protein, 24 aa, Mycobacterium
AMLFPHLYGPLPVDAVMIVTAYLP

SEQ ID NO: 634644 - protein, 17 aa, Mycobacterium
AMLGYTACRTKFFDDYF

SEQ ID NO: 634645 - protein, 24 aa, Mycobacterium
AMLIRPDAHLAWRGAPDDTAGLDH

SEQ ID NO: 634646 - protein, 22 aa, Mycobacterium
AMLLMRAGREYALKRALAKLAD

SEQ ID NO: 634647 - protein, 23 aa, Mycobacterium
AMLLMRAGREYALKRALAKLSDD

SEQ ID NO: 634648 - protein, 23 aa, Mycobacterium
AMLLMRAGREYALKRALAKLSDQ

SEQ ID NO: 634649 - protein, 22 aa, Mycobacterium
AMLLMRAGREYALKRALESLGD

SEQ ID NO: 634650 - protein, 18 aa, Mycobacterium
AMLNRQVFPNVYDRTTRR

SEQ ID NO: 634651 - protein, 17 aa, Mycobacterium
AMLPAHAVVLHPGPMLR

SEQ ID NO: 634652 - protein, 18 aa, Mycobacterium
AMLPELPESFVIKPTHGS

SEQ ID NO: 634653 - protein, 17 aa, Mycobacterium
AMLPRIGPSSSPQPYGV

SEQ ID NO: 634654 - protein, 17 aa, Mycobacterium
AMLPRITAMTVRDGKVC

SEQ ID NO: 634655 - protein, 24 aa, Mycobacterium
AMLQARGGGQWATFSELVADCQAP

SEQ ID NO: 634656 - protein, 18 aa, Mycobacterium
AMLQRLDGLDVERLKDID

SEQ ID NO: 634657 - protein, 21 aa, Mycobacterium
AMLRAECARLNRAGLTMCSEM

SEQ ID NO: 634658 - protein, 21 aa, Mycobacterium
AMLRAECARLNRAGLTTCSEM

SEQ ID NO: 634659 - protein, 17 aa, Mycobacterium
AMLREIVDDPAFVLHGN

SEQ ID NO: 634660 - protein, 27 aa, Mycobacterium
AMLREMRPDLTIGFFLHIPFPPVELFM

SEQ ID NO: 634661 - protein, 29 aa, Mycobacterium
AMLSYGSGCVAELFAGTVTPGYQQHLRTD

SEQ ID NO: 634662 - protein, 22 aa, Mycobacterium
AMLTAVTPYVSWLTTMATRAEQ

SEQ ID NO: 634663 - protein, 21 aa, Mycobacterium
AMLVRREFVAKLLARKTPPKG

SEQ ID NO: 634664 - protein, 27 aa, Mycobacterium
AMMALRLGCQTDIFAAIAPVAGALVTD

SEQ ID NO: 634665 - protein, 22 aa, Mycobacterium
AMMARGAGRVRMFSDDGKCVHD

SEQ ID NO: 634666 - protein, 18 aa, Mycobacterium
AMMARVPYFASVVPHVHR

SEQ ID NO: 634667 - protein, 27 aa, Mycobacterium
AMMCSESVWWRCHRRLVADVAELRCHT

SEQ ID NO: 634668 - protein, 21 aa, Mycobacterium
AMMLQGSWTYGGMATDGGDFV

SEQ ID NO: 634669 - protein, 18 aa, Mycobacterium
AMMRLPFGQTLQRFLSQA

SEQ ID NO: 634670 - protein, 21 aa, Mycobacterium
AMMRPSLSRDTAFFWEGVAAH

SEQ ID NO: 634671 - protein, 18 aa, Mycobacterium
AMNAHCCSGVNGLGPAQG

SEQ ID NO: 634672 - protein, 18 aa, Mycobacterium
AMNFFPATLTPIGLTLPF

SEQ ID NO: 634673 - protein, 25 aa, Mycobacterium
AMNLAVVLRATWAVARVLAEQTPAG

SEQ ID NO: 634674 - protein, 19 aa, Mycobacterium
AMPAAIAYFSMEFGVAEVL

SEQ ID NO: 634675 - protein, 17 aa, Mycobacterium
AMPAEVVQPVVLYYNKE

SEQ ID NO: 634676 - protein, 19 aa, Mycobacterium
AMPAQRYMHDFSLTREHLG

SEQ ID NO: 634677 - protein, 17 aa, Mycobacterium
AMPATMCDGLWDTPASR

SEQ ID NO: 634678 - protein, 19 aa, Mycobacterium
AMPECSGQVGIAGFCMGGQ

SEQ ID NO: 634679 - protein, 28 aa, Mycobacterium
AMPGQTGMTGMPMMPPGAMGAGGEGGNK

SEQ ID NO: 634680 - protein, 17 aa, Mycobacterium
AMPMIRERCDGITDPVQ

SEQ ID NO: 634681 - protein, 22 aa, Mycobacterium
AMPPCTGTGMGIDRLLMTLTGL

SEQ ID NO: 634682 - protein, 23 aa, Mycobacterium
AMPPSELVNFVLFGDGAGAAVLA

SEQ ID NO: 634683 - protein, 20 aa, Mycobacterium
AMPRHVGTILSWQLSQVTEA

SEQ ID NO: 634684 - protein, 24 aa, Mycobacterium
AMPRLRRAAEGGGNIVDRIEAVLD

SEQ ID NO: 634685 - protein, 23 aa, Mycobacterium
AMPRVNKSTGLPWVLSARSAPAL

SEQ ID NO: 634686 - protein, 26 aa, Mycobacterium
AMPTLRATVVVPRLGLPAGDGAVPWA

SEQ ID NO: 634687 - protein, 18 aa, Mycobacterium
AMPTLRIPDFHMSSVSQA

SEQ ID NO: 634688 - protein, 18 aa, Mycobacterium
AMPVREPLPGLGHAVEIR

SEQ ID NO: 634689 - protein, 25 aa, Mycobacterium
AMPWQWAGQELPTFSSAPTDHAGML

SEQ ID NO: 634690 - protein, 17 aa, Mycobacterium
AMQGRIAMYHALGEGVS

SEQ ID NO: 634691 - protein, 24 aa, Mycobacterium
AMQKMAFEVAWRILQVTPVNATAL

SEQ ID NO: 634692 - protein, 24 aa, Mycobacterium
AMQKMAIEVAWRILRVTPVNATNL

SEQ ID NO: 634693 - protein, 18 aa, Mycobacterium
AMQKRMAKMLQRAVDEVA

SEQ ID NO: 634694 - protein, 18 aa, Mycobacterium
AMQMHWRSAMDVLAESSA

SEQ ID NO: 634695 - protein, 19 aa, Mycobacterium
AMQPRELAEALAAARTYPR

SEQ ID NO: 634696 - protein, 33 aa, Mycobacterium
AMRAEPALPRLMRRLVIMGGAFDYKGNTTPVAE

SEQ ID NO: 634697 - protein, 18 aa, Mycobacterium
AMRAHGCGSIVNISSAAG

SEQ ID NO: 634698 - protein, 26 aa, Mycobacterium
AMRARGWRGSIQIPRYAYTTRFRAEI

SEQ ID NO: 634699 - protein, 19 aa, Mycobacterium
AMRASGFSGLGPNLGSGSP

SEQ ID NO: 634700 - protein, 19 aa, Mycobacterium
AMRDHICAAIKVDATELPY

SEQ ID NO: 634701 - protein, 23 aa, Mycobacterium
AMREMADLDLLFAEELCPADDVL

SEQ ID NO: 634702 - protein, 19 aa, Mycobacterium
AMRGYRPVCEIQFDGFVYP

SEQ ID NO: 634703 - protein, 19 aa, Mycobacterium
AMRIPGGKAVQRWLSQAFV

SEQ ID NO: 634704 - protein, 21 aa, Mycobacterium
AMRLCHHLHGGMGMDITYPMD

SEQ ID NO: 634705 - protein, 25 aa, Mycobacterium
AMRPPGALPREWPIDYDDFRPFYAR

SEQ ID NO: 634706 - protein, 18 aa, Mycobacterium
AMRRRGVTDFSLAMIDPW

SEQ ID NO: 634707 - protein, 29 aa, Mycobacterium
AMRRRVRLASVLRRCIVVDASLRGSQLTV

SEQ ID NO: 634708 - protein, 26 aa, Mycobacterium
AMRYCVTGDAMVRLPFGQSVRIADIV

SEQ ID NO: 634709 - protein, 18 aa, Mycobacterium
AMSAAVRAGHLARHAGRI

SEQ ID NO: 634710 - protein, 17 aa, Mycobacterium
AMSALILSGDRDELGAR

SEQ ID NO: 634711 - protein, 20 aa, Mycobacterium
AMSAVLSWTACVDARRSGAK

SEQ ID NO: 634712 - protein, 20 aa, Mycobacterium
AMSGELQRRRGLPAPVAYGR

SEQ ID NO: 634713 - protein, 20 aa, Mycobacterium
AMSGELVEHLFLPAFGSAAE

SEQ ID NO: 634714 - protein, 26 aa, Mycobacterium
AMSGESDPVVLLAIAFVVRALRGGSV

SEQ ID NO: 634715 - protein, 25 aa, Mycobacterium
AMSGSSPALALRVFKAIGRADLVSD

SEQ ID NO: 634716 - protein, 27 aa, Mycobacterium
AMSGSSPALALRVFRAIGRHDLLDDAD

SEQ ID NO: 634717 - protein, 21 aa, Mycobacterium
AMSIWGLRHLPDFVAASAKSR

SEQ ID NO: 634718 - protein, 18 aa, Mycobacterium
AMSNVCGWSNVPVARRAG

SEQ ID NO: 634719 - protein, 25 aa, Mycobacterium
AMSPEEWRTFAARASLYAARQKAKE

SEQ ID NO: 634720 - protein, 20 aa, Mycobacterium
AMSPLDFLKRPSSWLRLISD

SEQ ID NO: 634721 - protein, 17 aa, Mycobacterium
AMSPRHFTRVFTEEVGQ

SEQ ID NO: 634722 - protein, 24 aa, Mycobacterium
AMSRFRGKAVGMVFQDPMSALTPV

SEQ ID NO: 634723 - protein, 20 aa, Mycobacterium
AMSRFRGKVIGTVFQDPMSA

SEQ ID NO: 634724 - protein, 33 aa, Mycobacterium
AMSSRGYRAMTHIPRLQFAHIDRLVRAFGSLQG

SEQ ID NO: 634725 - protein, 24 aa, Mycobacterium
AMTAELRFPAGHTGRVRCSMWSPR

SEQ ID NO: 634726 - protein, 19 aa, Mycobacterium
AMTAEVLGAVIPGSVAEVI

SEQ ID NO: 634727 - protein, 21 aa, Mycobacterium
AMTAGGSWRKVIVSGASAVAG

SEQ ID NO: 634728 - protein, 19 aa, Mycobacterium
AMTALVHRINLFVHTDRAY

SEQ ID NO: 634729 - protein, 23 aa, Mycobacterium
AMTARAVGLLMRLPQRGIVTVAT

SEQ ID NO: 634730 - protein, 17 aa, Mycobacterium
AMTDLAYFLGCALPTED

SEQ ID NO: 634731 - protein, 28 aa, Mycobacterium
AMTDLQCWRAPWKTLVDLGWTELAASDC

SEQ ID NO: 634732 - protein, 24 aa, Mycobacterium
AMTERAHLAFGEIMDLAVGLGGTI

SEQ ID NO: 634733 - protein, 19 aa, Mycobacterium
AMTGLGSRYFRLLPQRLVE

SEQ ID NO: 634734 - protein, 21 aa, Mycobacterium
AMTGTLRWGDLVQQVSGSSGH

SEQ ID NO: 634735 - protein, 28 aa, Mycobacterium
AMTHAWALEFAKAGIRFNCVQPGSISSG

SEQ ID NO: 634736 - protein, 24 aa, Mycobacterium
AMTHAWALEFAKAGIRFNSVQPGS

SEQ ID NO: 634737 - protein, 24 aa, Mycobacterium
AMTHHFFCVDGPQAKKELVHRLAA

SEQ ID NO: 634738 - protein, 24 aa, Mycobacterium
AMTIWQFLHFKFGLPKPLLEPLAV

SEQ ID NO: 634739 - protein, 19 aa, Mycobacterium
AMTNFAWTFDDDVELDYHF

SEQ ID NO: 634740 - protein, 20 aa, Mycobacterium
AMTPWIWPTMHLNPPNWIEP

SEQ ID NO: 634741 - protein, 20 aa, Mycobacterium
AMTPWVWPTMHLNPPNWIAP

SEQ ID NO: 634742 - protein, 19 aa, Mycobacterium
AMTPWVWPTMHLNPPNWIE

SEQ ID NO: 634743 - protein, 24 aa, Mycobacterium
AMTRAQSQVVAWWAPSRDELNGGL

SEQ ID NO: 634744 - protein, 24 aa, Mycobacterium
AMTRAQSQVVAWWSPAYDEPNGGL

SEQ ID NO: 634745 - protein, 24 aa, Mycobacterium
AMTRGYIATWLRRWQERGELAADL

SEQ ID NO: 634746 - protein, 29 aa, Mycobacterium
AMTRPDLAFEMVRPGISLYGLSPIPERGD

SEQ ID NO: 634747 - protein, 26 aa, Mycobacterium
AMTRRQLLRHTAWFGAAVGLTVAGGE

SEQ ID NO: 634748 - protein, 18 aa, Mycobacterium
AMTVPPSIVFANREQLLL

SEQ ID NO: 634749 - protein, 27 aa, Mycobacterium
AMVAIRGEIDLVMWGEWPLEASPLRQA

SEQ ID NO: 634750 - protein, 17 aa, Mycobacterium
AMVAKAEMLVPVETAFR

SEQ ID NO: 634751 - protein, 20 aa, Mycobacterium
AMVARLWTMSFITGDPTPVI

SEQ ID NO: 634752 - protein, 20 aa, Mycobacterium
AMVASVLPFVSWLSTTAALA

SEQ ID NO: 634753 - protein, 18 aa, Mycobacterium
AMVCALVETVVRDQPSEP

SEQ ID NO: 634754 - protein, 27 aa, Mycobacterium
AMVDHCLGVVFYPVIPMGSWVATTEFK

SEQ ID NO: 634755 - protein, 26 aa, Mycobacterium
AMVDHCLGVVFYPVIPPGSWVATTEF

SEQ ID NO: 634756 - protein, 17 aa, Mycobacterium
AMVDKGRRVLLVDLDPQ

SEQ ID NO: 634757 - protein, 18 aa, Mycobacterium
AMVGCPIVGIQDSGGARI

SEQ ID NO: 634758 - protein, 19 aa, Mycobacterium
AMVGFGLPVRRSRRATAPL

SEQ ID NO: 634759 - protein, 25 aa, Mycobacterium
AMVKNLSIRLGVPCFPDDPLRFTGS

SEQ ID NO: 634760 - protein, 18 aa, Mycobacterium
AMVKRGQGGVIINTASMS

SEQ ID NO: 634761 - protein, 30 aa, Mycobacterium
AMVLGEPFMLPAHIDFAALRVKFDGGTLPP

SEQ ID NO: 634762 - protein, 29 aa, Mycobacterium
AMVQRLLGLQLMKGHGAADWSKRPLPDEW

SEQ ID NO: 634763 - protein, 40 aa, Mycobacterium
AMVQRNCMVPMQLCHHFAPAMVRRGSGGIVLFGSGAGLAG

SEQ ID NO: 634764 - protein, 19 aa, Mycobacterium
AMVRARFHLWESGETAQMV

SEQ ID NO: 634765 - protein, 19 aa, Mycobacterium
AMVRGQVAAVFGIGVANVD

SEQ ID NO: 634766 - protein, 17 aa, Mycobacterium
AMVRQWALRFRDEVNQR

SEQ ID NO: 634767 - protein, 18 aa, Mycobacterium
AMVTDRRVLLTLPISHVY

SEQ ID NO: 634768 - protein, 17 aa, Mycobacterium
AMVTGSCKWSLKIAREW

SEQ ID NO: 634769 - protein, 24 aa, Mycobacterium
AMYFHFKSKHALAVELIDKQIAAA

SEQ ID NO: 634770 - protein, 25 aa, Mycobacterium
AMYFHFRSKHALAVAIIEQHTAAGR

SEQ ID NO: 634771 - protein, 24 aa, Mycobacterium
AMYGTLRLARQIARSAELLVIGPP

SEQ ID NO: 634772 - protein, 19 aa, Mycobacterium
AMYLCRELTDLSLPKIGQA

SEQ ID NO: 634773 - protein, 24 aa, Mycobacterium
ANAAALKRWTVDYWDATHPYSAGG

SEQ ID NO: 634774 - protein, 25 aa, Mycobacterium
ANAADEADLLWALRGGGANFGVVTH

SEQ ID NO: 634775 - protein, 18 aa, Mycobacterium
ANAAFYYGLVRAIADSDR

SEQ ID NO: 634776 - protein, 17 aa, Mycobacterium
ANAALSFDRAAAHGYRL

SEQ ID NO: 634777 - protein, 18 aa, Mycobacterium
ANAARDFLLQRGFGEEAA

SEQ ID NO: 634778 - protein, 18 aa, Mycobacterium
ANAARLAIDSGFDAVEIH

SEQ ID NO: 634779 - protein, 19 aa, Mycobacterium
ANAARLGLTGWPRAAEESI

SEQ ID NO: 634780 - protein, 17 aa, Mycobacterium
ANAARMAYGGAAAQPAL

SEQ ID NO: 634781 - protein, 19 aa, Mycobacterium
ANACAESLWESGVDIAIST

SEQ ID NO: 634782 - protein, 20 aa, Mycobacterium
ANADAGLLEFTRTVSALRAE

SEQ ID NO: 634783 - protein, 19 aa, Mycobacterium
ANADLWLTFAQDYRDETGS

SEQ ID NO: 634784 - protein, 22 aa, Mycobacterium
ANAEGIAAVVAQQFEVARQVLA

SEQ ID NO: 634785 - protein, 23 aa, Mycobacterium
ANAFGELFARQGHLGAMPATVHE

SEQ ID NO: 634786 - protein, 18 aa, Mycobacterium
ANAFKAHLPDATTVNLVT

SEQ ID NO: 634787 - protein, 20 aa, Mycobacterium
ANAFPEVYKQAVSPADAIDH

SEQ ID NO: 634788 - protein, 23 aa, Mycobacterium
ANAGICPLGAHLPVQAFADAFDV

SEQ ID NO: 634789 - protein, 25 aa, Mycobacterium
ANAGIFPEARLDTMTPEQLSEVLDV

SEQ ID NO: 634790 - protein, 25 aa, Mycobacterium
ANAGLAGRFHFTLTFNSYTPDEIVA

SEQ ID NO: 634791 - protein, 21 aa, Mycobacterium
ANAGLARYAAADAMQKGAMSL

SEQ ID NO: 634792 - protein, 20 aa, Mycobacterium
ANAGPPWFAVSPLMHAAGLW

SEQ ID NO: 634793 - protein, 20 aa, Mycobacterium
ANAICPGFIATPMTESVFGM

SEQ ID NO: 634794 - protein, 20 aa, Mycobacterium
ANAITFLLSDQADWITGAIL

SEQ ID NO: 634795 - protein, 24 aa, Mycobacterium
ANAKARGLWNLFLPAESGLTNLEY

SEQ ID NO: 634796 - protein, 19 aa, Mycobacterium
ANALPRRGFAALRRPVRRP

SEQ ID NO: 634797 - protein, 20 aa, Mycobacterium
ANALTGLGLVAGDRVAIYLP

SEQ ID NO: 634798 - protein, 26 aa, Mycobacterium
ANALWRFLPDRVRVLDFPTNFHYDFR

SEQ ID NO: 634799 - protein, 24 aa, Mycobacterium
ANAMGRPGLTLGLGPSHEPVVRGV

SEQ ID NO: 634800 - protein, 18 aa, Mycobacterium
ANAPAEFFGHSWHAMQHV

SEQ ID NO: 634801 - protein, 18 aa, Mycobacterium
ANAPAFQPYLGVMEQAYR

SEQ ID NO: 634802 - protein, 18 aa, Mycobacterium
ANAPEHWPGGLAGTDLHA

SEQ ID NO: 634803 - protein, 25 aa, Mycobacterium
ANAPGTKGGSVFRNVTPDGQHPLPT

SEQ ID NO: 634804 - protein, 26 aa, Mycobacterium
ANAPMVGVAYGYPGAPGQWWQQQVVL

SEQ ID NO: 634805 - protein, 17 aa, Mycobacterium
ANAPVSWVDVEGYNPFW

SEQ ID NO: 634806 - protein, 20 aa, Mycobacterium
ANAQAALRIEQLEQMVLEQF

SEQ ID NO: 634807 - protein, 22 aa, Mycobacterium
ANAQGWRFVVLRSPEQRAVVAA

SEQ ID NO: 634808 - protein, 24 aa, Mycobacterium
ANAQRAGGIAAFIDAEHALDPEYA

SEQ ID NO: 634809 - protein, 19 aa, Mycobacterium
ANAQTWRKIPADVLARQQA

SEQ ID NO: 634810 - protein, 22 aa, Mycobacterium
ANARLAAALVRASLDADVRQRV

SEQ ID NO: 634811 - protein, 24 aa, Mycobacterium
ANARNHISFGFGVHRCMGNRLAEM

SEQ ID NO: 634812 - protein, 17 aa, Mycobacterium
ANARPGYLEYLTPVVER

SEQ ID NO: 634813 - protein, 18 aa, Mycobacterium
ANARVCVFGLPDDRLGEV

SEQ ID NO: 634814 - protein, 20 aa, Mycobacterium
ANASGQCWALTSNCPVPGPV

SEQ ID NO: 634815 - protein, 18 aa, Mycobacterium
ANASPCRPSNSRCSPLST

SEQ ID NO: 634816 - protein, 17 aa, Mycobacterium
ANASPFQTVLDAVNAPT

SEQ ID NO: 634817 - protein, 21 aa, Mycobacterium
ANASPLQELLNAVNAPTQALL

SEQ ID NO: 634818 - protein, 22 aa, Mycobacterium
ANATANCFPMIQISGSSNRALV

SEQ ID NO: 634819 - protein, 23 aa, Mycobacterium
ANATANCFPMIQISGSSQRAIVD

SEQ ID NO: 634820 - protein, 19 aa, Mycobacterium
ANATIGRAIRLIMLTVGGG

SEQ ID NO: 634821 - protein, 17 aa, Mycobacterium
ANATKFERECLDLLVIE

SEQ ID NO: 634822 - protein, 18 aa, Mycobacterium
ANAVAWLVSDEARYITGV

SEQ ID NO: 634823 - protein, 18 aa, Mycobacterium
ANAVAWLVSDQARYVTGV

SEQ ID NO: 634824 - protein, 21 aa, Mycobacterium
ANAVEELMRYLSIIQNGQRRV

SEQ ID NO: 634825 - protein, 25 aa, Mycobacterium
ANAVRDIAARAGIVVVAGMFVPSDD

SEQ ID NO: 634826 - protein, 21 aa, Mycobacterium
ANAVRPRGRFESTPELNYHLP

SEQ ID NO: 634827 - protein, 24 aa, Mycobacterium
ANDAELRSPIWLVTRDGQRVTDTD

SEQ ID NO: 634828 - protein, 24 aa, Mycobacterium
ANDFADRITHVWTNTQAYLVVVHL

SEQ ID NO: 634829 - protein, 22 aa, Mycobacterium
ANDGLCAMGLRFSEDKMAPRER

SEQ ID NO: 634830 - protein, 22 aa, Mycobacterium
ANDGLCAMGLRFSEDSAVPRER

SEQ ID NO: 634831 - protein, 17 aa, Mycobacterium
ANDLALRLNDWREKTLD

SEQ ID NO: 634832 - protein, 22 aa, Mycobacterium
ANDLPDLLSRWGSRTGSELERT

SEQ ID NO: 634833 - protein, 19 aa, Mycobacterium
ANDLVTWAKLLGFADQPKI

SEQ ID NO: 634834 - protein, 17 aa, Mycobacterium
ANDPLIWAQHPSSDRYE

SEQ ID NO: 634835 - protein, 19 aa, Mycobacterium
ANDPTVFRAEGRFKSTSAV

SEQ ID NO: 634836 - protein, 22 aa, Mycobacterium
ANDVALSYGFWLGDAFASGGSV

SEQ ID NO: 634837 - protein, 25 aa, Mycobacterium
ANDVFNMALALRFDGPLDTAALLEA

SEQ ID NO: 634838 - protein, 17 aa, Mycobacterium
ANDYGIERFYDVGRHGI

SEQ ID NO: 634839 - protein, 17 aa, Mycobacterium
ANEAQYAQMWAQDATAM

SEQ ID NO: 634840 - protein, 21 aa, Mycobacterium
ANEAWAGPSAVAMAAAAAQYV

SEQ ID NO: 634841 - protein, 25 aa, Mycobacterium
ANEFGLPMPIAREVDAVINHGSTVE

SEQ ID NO: 634842 - protein, 26 aa, Mycobacterium
ANEGLRGRFAHRFKFETYSAGELVAI

SEQ ID NO: 634843 - protein, 22 aa, Mycobacterium
ANEGLRSRFTRSIDFPSYSPKE

SEQ ID NO: 634844 - protein, 23 aa, Mycobacterium
ANEIHRKLSLRASVTSELVLDNV

SEQ ID NO: 634845 - protein, 23 aa, Mycobacterium
ANELRELKVYEFSFVPVGANQDT

SEQ ID NO: 634846 - protein, 23 aa, Mycobacterium
ANERLDLLLPRGSFDLTQDYGGV

SEQ ID NO: 634847 - protein, 28 aa, Mycobacterium
ANERQLFDWYDMDAGMDLNTLGGDLELF

SEQ ID NO: 634848 - protein, 21 aa, Mycobacterium
ANERVPYWITDLLARVDMSVI

SEQ ID NO: 634849 - protein, 19 aa, Mycobacterium
ANESLCFAGPNLIPLRGGA

SEQ ID NO: 634850 - protein, 21 aa, Mycobacterium
ANETAYAWATVLERQSSTGPV

SEQ ID NO: 634851 - protein, 17 aa, Mycobacterium
ANETFTLTLSNPAGATI

SEQ ID NO: 634852 - protein, 18 aa, Mycobacterium
ANETLVFALPRELRASRR

SEQ ID NO: 634853 - protein, 19 aa, Mycobacterium
ANEVARKEYLRVLVEKYYA

SEQ ID NO: 634854 - protein, 24 aa, Mycobacterium
ANEVKGQVLPWVLADVDLGDNVLE

SEQ ID NO: 634855 - protein, 18 aa, Mycobacterium
ANEYLYRRVDLADVVDAH

SEQ ID NO: 634856 - protein, 21 aa, Mycobacterium
ANFDAGPALRFMSGNLCHQIE

SEQ ID NO: 634857 - protein, 21 aa, Mycobacterium
ANFDAGPALRFMSGTLSHQIE

SEQ ID NO: 634858 - protein, 23 aa, Mycobacterium
ANFEAGPALRFMSGNLCHQIEHH

SEQ ID NO: 634859 - protein, 21 aa, Mycobacterium
ANFEAGPALRFMSGNLSHQIE

SEQ ID NO: 634860 - protein, 24 aa, Mycobacterium
ANFEGGPLLRFMSGNLSQQIEHHL

SEQ ID NO: 634861 - protein, 23 aa, Mycobacterium
ANFGAWNAGGGNFGFGNGGGGNF

SEQ ID NO: 634862 - protein, 21 aa, Mycobacterium
ANFHAGPVLAFLSGNLCYQIE

SEQ ID NO: 634863 - protein, 27 aa, Mycobacterium
ANFIPLPWLGTNGFQEACWAWRRLRIP

SEQ ID NO: 634864 - protein, 19 aa, Mycobacterium
ANFMLIGAAFYRDQYRRTA

SEQ ID NO: 634865 - protein, 21 aa, Mycobacterium
ANFNAGTAMRFMSGSLSHQIE

SEQ ID NO: 634866 - protein, 21 aa, Mycobacterium
ANFPYRYPWRDVERQLQRMAG

SEQ ID NO: 634867 - protein, 20 aa, Mycobacterium
ANFRDVMIALGLYPDPDAAM

SEQ ID NO: 634868 - protein, 20 aa, Mycobacterium
ANFRDVMIALGLYPDPDAIM

SEQ ID NO: 634869 - protein, 20 aa, Mycobacterium
ANFRDVMIALGLYPDPDAVM

SEQ ID NO: 634870 - protein, 20 aa, Mycobacterium
ANFRDVMIALGLYPDPEAVM

SEQ ID NO: 634871 - protein, 20 aa, Mycobacterium
ANFTDGWLRTGDLGTLSAAG

SEQ ID NO: 634872 - protein, 17 aa, Mycobacterium
ANFWPATPQQLYRELDR

SEQ ID NO: 634873 - protein, 25 aa, Mycobacterium
ANGAFPAGMPPEFTARARRALGPDK

SEQ ID NO: 634874 - protein, 20 aa, Mycobacterium
ANGCDYCLAVHSYVSAELGG

SEQ ID NO: 634875 - protein, 19 aa, Mycobacterium
ANGCGDRLVLLLNEDGSTL

SEQ ID NO: 634876 - protein, 18 aa, Mycobacterium
ANGCLVDGPIGRVGLEIE

SEQ ID NO: 634877 - protein, 17 aa, Mycobacterium
ANGELKAAMQYFTQAFV

SEQ ID NO: 634878 - protein, 24 aa, Mycobacterium
ANGELPNMRAIVGFAAETGDANGD

SEQ ID NO: 634879 - protein, 20 aa, Mycobacterium
ANGGLLIGHGGAGGGGGTGG

SEQ ID NO: 634880 - protein, 20 aa, Mycobacterium
ANGGRALCQGKIFTQSGEMV

SEQ ID NO: 634881 - protein, 29 aa, Mycobacterium
ANGGRKPWLPHFYLGHGIGTYPAEAPMIG

SEQ ID NO: 634882 - protein, 26 aa, Mycobacterium
ANGGYRAVARASAWLLATSVTADKAS

SEQ ID NO: 634883 - protein, 18 aa, Mycobacterium
ANGHHWDPRMPDFPGEFT

SEQ ID NO: 634884 - protein, 24 aa, Mycobacterium
ANGHPFLYPRLVCPVCHDGELAWE

SEQ ID NO: 634885 - protein, 19 aa, Mycobacterium
ANGIALILVGHVTKDGAIA

SEQ ID NO: 634886 - protein, 27 aa, Mycobacterium
ANGIDAPALWPGLPVRPVKGEVLRLRW

SEQ ID NO: 634887 - protein, 26 aa, Mycobacterium
ANGIEIPGRHQLFLHGCDISRNGTGD

SEQ ID NO: 634888 - protein, 18 aa, Mycobacterium
ANGKLLRSALRAESPAKP

SEQ ID NO: 634889 - protein, 20 aa, Mycobacterium
ANGLCTSCALTVERPNDVDT

SEQ ID NO: 634890 - protein, 23 aa, Mycobacterium
ANGPAVVEFNCRFGDPETQAVLA

SEQ ID NO: 634891 - protein, 18 aa, Mycobacterium
ANGPLALGPYGPEILGYE

SEQ ID NO: 634892 - protein, 17 aa, Mycobacterium
ANGPLAMAECSTVNPDL

SEQ ID NO: 634893 - protein, 23 aa, Mycobacterium
ANGPRIGLIVSKAVGNAVERHRV

SEQ ID NO: 634894 - protein, 18 aa, Mycobacterium
ANGRLTLDAPPVRNVIAG

SEQ ID NO: 634895 - protein, 22 aa, Mycobacterium
ANGRLYCCAHCARQAGHSGITD

SEQ ID NO: 634896 - protein, 24 aa, Mycobacterium
ANGSEGRALGGLEVAVLEQSRPRR

SEQ ID NO: 634897 - protein, 25 aa, Mycobacterium
ANGTGRLALDPGIAIALVPGDDPAS

SEQ ID NO: 634898 - protein, 17 aa, Mycobacterium
ANGVRPGDRVGMLSLNS

SEQ ID NO: 634899 - protein, 19 aa, Mycobacterium
ANGVRRIAAQTGITVVAGM

SEQ ID NO: 634900 - protein, 26 aa, Mycobacterium
ANGYLGRFLALEWLERLDKTDGKLIA

SEQ ID NO: 634901 - protein, 26 aa, Mycobacterium
ANGYTRLDWAVLDWNTPSIKFYDSLG

SEQ ID NO: 634902 - protein, 18 aa, Mycobacterium
ANHAFIYLRGEVVPVLRR

SEQ ID NO: 634903 - protein, 19 aa, Mycobacterium
ANHGVHCFLVPIRDEDGND

SEQ ID NO: 634904 - protein, 23 aa, Mycobacterium
ANHPPMRTFLGVPVQVRGEVFGR

SEQ ID NO: 634905 - protein, 23 aa, Mycobacterium
ANHPPMRTFLGVPVRVHDMSLGT

SEQ ID NO: 634906 - protein, 19 aa, Mycobacterium
ANHRVFRRNALVAALDKSS

SEQ ID NO: 634907 - protein, 22 aa, Mycobacterium
ANHTTGWVRMDFVVPSRGLIGW

SEQ ID NO: 634908 - protein, 25 aa, Mycobacterium
ANIAARVGFSLALGEHLAYGPAAVC

SEQ ID NO: 634909 - protein, 18 aa, Mycobacterium
ANIAEWPVGESFPVAPRT

SEQ ID NO: 634910 - protein, 17 aa, Mycobacterium
ANIALITRFLRAGIDVC

SEQ ID NO: 634911 - protein, 20 aa, Mycobacterium
ANIAPWLRAADLFGAQVKWA

SEQ ID NO: 634912 - protein, 26 aa, Mycobacterium
ANIAPWLRAANRYGAKVKWAEVDIET

SEQ ID NO: 634913 - protein, 28 aa, Mycobacterium
ANIDRSTAFLGPRVKPLIITNEPDNFGP

SEQ ID NO: 634914 - protein, 21 aa, Mycobacterium
ANIDSGVYYYGLVQERRQNPQ

SEQ ID NO: 634915 - protein, 20 aa, Mycobacterium
ANIFPAIWSALLAARAEGVG

SEQ ID NO: 634916 - protein, 19 aa, Mycobacterium
ANIFPAIWSVLLAARAEGV

SEQ ID NO: 634917 - protein, 29 aa, Mycobacterium
ANIGGTWDLFKYPGIRSDSDMFTLGFRFK

SEQ ID NO: 634918 - protein, 19 aa, Mycobacterium
ANIGSIFGIGFPAWTGGVH

SEQ ID NO: 634919 - protein, 18 aa, Mycobacterium
ANIHMIGKDIIRFHTVYW

SEQ ID NO: 634920 - protein, 17 aa, Mycobacterium
ANILHWSDYAQMARDTA

SEQ ID NO: 634921 - protein, 19 aa, Mycobacterium
ANIRRLRKSDPYKGKGIRY

SEQ ID NO: 634922 - protein, 26 aa, Mycobacterium
ANIRRLRRPDPYKGKGVRYEGEQIRR

SEQ ID NO: 634923 - protein, 25 aa, Mycobacterium
ANIRSIPTLMAFKQGQLVFNQAGAL

SEQ ID NO: 634924 - protein, 24 aa, Mycobacterium
ANIRWGFDQEHRRPYHVDFVHNTW

SEQ ID NO: 634925 - protein, 22 aa, Mycobacterium
ANISLAGLMHYFPTRDVILTEI

SEQ ID NO: 634926 - protein, 17 aa, Mycobacterium
ANIVRRVVNGGHECVVY

SEQ ID NO: 634927 - protein, 25 aa, Mycobacterium
ANKALRPGYVAAFSVPANQLPQVVF

SEQ ID NO: 634928 - protein, 19 aa, Mycobacterium
ANKLCAQILLLTAEDPTKD

SEQ ID NO: 634929 - protein, 22 aa, Mycobacterium
ANKRPEVVRVYLPPDANTLLAV

SEQ ID NO: 634930 - protein, 20 aa, Mycobacterium
ANKTKLEWEHELSAQDVGCV

SEQ ID NO: 634931 - protein, 27 aa, Mycobacterium
ANKVPGARCALAWSEQTASLAREHNNA

SEQ ID NO: 634932 - protein, 25 aa, Mycobacterium
ANKVPGARCALAWSTETATLAREHN

SEQ ID NO: 634933 - protein, 20 aa, Mycobacterium
ANLAAAVPTTGVLAAGADEV

SEQ ID NO: 634934 - protein, 18 aa, Mycobacterium
ANLAAELERLRQRRDRLE

SEQ ID NO: 634935 - protein, 17 aa, Mycobacterium
ANLADFIAGLVVANDVS

SEQ ID NO: 634936 - protein, 25 aa, Mycobacterium
ANLAQDRIRTWSAWFENNTRSARYR

SEQ ID NO: 634937 - protein, 18 aa, Mycobacterium
ANLARGWWELVPDDADLD

SEQ ID NO: 634938 - protein, 18 aa, Mycobacterium
ANLARLTITLMFNAIADH

SEQ ID NO: 634939 - protein, 17 aa, Mycobacterium
ANLARMTIDLMFNAIAD

SEQ ID NO: 634940 - protein, 26 aa, Mycobacterium
ANLARREIAEALNVVAGRLLNPRTAG

SEQ ID NO: 634941 - protein, 26 aa, Mycobacterium
ANLARRELAEALAILTRRLSAPNRIG

SEQ ID NO: 634942 - protein, 26 aa, Mycobacterium
ANLARRELAEALTVLARRLTGPHRVG

SEQ ID NO: 634943 - protein, 19 aa, Mycobacterium
ANLARRSRFAEAFRYDGVQ

SEQ ID NO: 634944 - protein, 24 aa, Mycobacterium
ANLAVPWIAAERGFIDGVIEPHET

SEQ ID NO: 634945 - protein, 17 aa, Mycobacterium
ANLCWKLAAVLNGNAPD

SEQ ID NO: 634946 - protein, 19 aa, Mycobacterium
ANLDAAMRSMPPGYEGPVA

SEQ ID NO: 634947 - protein, 19 aa, Mycobacterium
ANLDAWLTTVVARICLNML

SEQ ID NO: 634948 - protein, 17 aa, Mycobacterium
ANLEGGFFIGPTLFDHV

SEQ ID NO: 634949 - protein, 18 aa, Mycobacterium
ANLFKALAHPARIRILEI

SEQ ID NO: 634950 - protein, 27 aa, Mycobacterium
ANLFVAGFIGSPAMNFFPATRTDVGVR

SEQ ID NO: 634951 - protein, 18 aa, Mycobacterium
ANLFWGLRGGAGCVGIVT

SEQ ID NO: 634952 - protein, 21 aa, Mycobacterium
ANLHVAECNWLVSGASAGTLC

SEQ ID NO: 634953 - protein, 23 aa, Mycobacterium
ANLLDLLAALGLPVEPMGVDDDG

SEQ ID NO: 634954 - protein, 17 aa, Mycobacterium
ANLLDRHRPLWETHVIE

SEQ ID NO: 634955 - protein, 21 aa, Mycobacterium
ANLLLDAGCRVDVWETTYLHQ

SEQ ID NO: 634956 - protein, 24 aa, Mycobacterium
ANLLPQVFEWARLVDPRQPLTSGV

SEQ ID NO: 634957 - protein, 19 aa, Mycobacterium
ANLPAGVSVFTGYLGANSP

SEQ ID NO: 634958 - protein, 22 aa, Mycobacterium
ANLPDGQWFPGQRLSRDFSSQP

SEQ ID NO: 634959 - protein, 25 aa, Mycobacterium
ANLPLRPESVFAFGTIAELAAEYGQ

SEQ ID NO: 634960 - protein, 18 aa, Mycobacterium
ANLPRLVAHESYPGHHTE

SEQ ID NO: 634961 - protein, 18 aa, Mycobacterium
ANLPRPGQTVLASSLASA

SEQ ID NO: 634962 - protein, 19 aa, Mycobacterium
ANLQVAECNWLVPVNTPRL

SEQ ID NO: 634963 - protein, 36 aa, Mycobacterium
ANLRARPQIAVTFQRGWQWATVEGRAELAGPDDPQP

SEQ ID NO: 634964 - protein, 18 aa, Mycobacterium
ANLRARPQLAVTFRNGWR

SEQ ID NO: 634965 - protein, 20 aa, Mycobacterium
ANLRDLGCEYAICYFPEAAY

SEQ ID NO: 634966 - protein, 20 aa, Mycobacterium
ANLRHVLLCTQRVARDMVAA

SEQ ID NO: 634967 - protein, 21 aa, Mycobacterium
ANLRVGQDVVAIGSPLGLEGT

SEQ ID NO: 634968 - protein, 23 aa, Mycobacterium
ANLSCPLLGLFGVEDRFPAPAGV

SEQ ID NO: 634969 - protein, 21 aa, Mycobacterium
ANLSFFAANGYLVYDDINKQS

SEQ ID NO: 634970 - protein, 17 aa, Mycobacterium
ANLSRFLVQQAVGLAAV

SEQ ID NO: 634971 - protein, 21 aa, Mycobacterium
ANLVAYWAILATRVEAPALAD

SEQ ID NO: 634972 - protein, 21 aa, Mycobacterium
ANLVAYWAILATRVEAPGLAE

SEQ ID NO: 634973 - protein, 20 aa, Mycobacterium
ANLVGDLNDRCDIAMGGISI

SEQ ID NO: 634974 - protein, 23 aa, Mycobacterium
ANMAPDLFAGILAQVPFVDALTT

SEQ ID NO: 634975 - protein, 24 aa, Mycobacterium
ANMAPERFAGILAAVPFVDPLTTI

SEQ ID NO: 634976 - protein, 19 aa, Mycobacterium
ANMGEAWWVPIVQIPGDTF

SEQ ID NO: 634977 - protein, 20 aa, Mycobacterium
ANMGEAWWVPVVQIPGDTID

SEQ ID NO: 634978 - protein, 29 aa, Mycobacterium
ANMGFRAESYWRVGGFRALKSSEDVDLVR

SEQ ID NO: 634979 - protein, 18 aa, Mycobacterium
ANMSEYFRASERGIISIR

SEQ ID NO: 634980 - protein, 18 aa, Mycobacterium
ANMVYKLVEVDGMPVQKR

SEQ ID NO: 634981 - protein, 25 aa, Mycobacterium
ANNFVICNFVPRKVDYHPLSVPVPY

SEQ ID NO: 634982 - protein, 19 aa, Mycobacterium
ANNPLRLGGCLNSESAEKA

SEQ ID NO: 634983 - protein, 19 aa, Mycobacterium
ANNPLRLGGCLNSESAEKS

SEQ ID NO: 634984 - protein, 21 aa, Mycobacterium
ANNPLRLGGCLNSESAEKSAR

SEQ ID NO: 634985 - protein, 24 aa, Mycobacterium
ANNSCYGLSGAVWGSDVDRAVGIA

SEQ ID NO: 634986 - protein, 20 aa, Mycobacterium
ANNSGFWNTGFGDIGSSGLQ

SEQ ID NO: 634987 - protein, 21 aa, Mycobacterium
ANNTPVGFLFMLPDVNEITGQ

SEQ ID NO: 634988 - protein, 29 aa, Mycobacterium
ANNYGAKGIRSNCVMPGLVWGETQEKANL

SEQ ID NO: 634989 - protein, 17 aa, Mycobacterium
ANPAALVQALFNLGEMV

SEQ ID NO: 634990 - protein, 24 aa, Mycobacterium
ANPAEGWAGAAAETCAEAQRRLST

SEQ ID NO: 634991 - protein, 25 aa, Mycobacterium
ANPAGTEWQAAAVARATSAVAGMQT

SEQ ID NO: 634992 - protein, 22 aa, Mycobacterium
ANPAVWMYAGGAGFANILYHLG

SEQ ID NO: 634993 - protein, 20 aa, Mycobacterium
ANPAVWMYASGGGFSNILYH

SEQ ID NO: 634994 - protein, 25 aa, Mycobacterium
ANPDMSLRLMRWVFEDWQRVTSEPE

SEQ ID NO: 634995 - protein, 21 aa, Mycobacterium
ANPDYLPGTVLPAGVRATTDA

SEQ ID NO: 634996 - protein, 23 aa, Mycobacterium
ANPESFLRFGYDVLTDLQLHNPW

SEQ ID NO: 634997 - protein, 23 aa, Mycobacterium
ANPGAVPAIAAWYQRRGLAGRLC

SEQ ID NO: 634998 - protein, 19 aa, Mycobacterium
ANPGEPVLRLLAGEGAEFD

SEQ ID NO: 634999 - protein, 28 aa, Mycobacterium
ANPGLRSRFPFQLEFTSCDTDDLVRIAE

SEQ ID NO: 635000 - protein, 21 aa, Mycobacterium
ANPGRPIWGHGWDESAWPERS

SEQ ID NO: 635001 - protein, 29 aa, Mycobacterium
ANPKIALELGAYCGYSGLRIARAAPGAKF

SEQ ID NO: 635002 - protein, 17 aa, Mycobacterium
ANPLAFLSAVRERFDGP

SEQ ID NO: 635003 - protein, 26 aa, Mycobacterium
ANPLPAPRISPFPAVHQDVSLVVTET

SEQ ID NO: 635004 - protein, 39 aa, Mycobacterium
ANPLVNLAVGPLQFDPKFSRSPVLASPFTIVNAPFQLLT

SEQ ID NO: 635005 - protein, 23 aa, Mycobacterium
ANPLVYLAQAWDWIFPLGPDANY

SEQ ID NO: 635006 - protein, 27 aa, Mycobacterium
ANPMRPNGGVLGRFPALTIPILGITFH

SEQ ID NO: 635007 - protein, 36 aa, Mycobacterium
ANPNRPNGGFLERFHGLYIPILDLPFFGATPANAYP

SEQ ID NO: 635008 - protein, 32 aa, Mycobacterium
ANPPEDRRKLLWDNVWKPLASRSTKRGERHLA

SEQ ID NO: 635009 - protein, 20 aa, Mycobacterium
ANPPLRRPSGPKALHTLWRM

SEQ ID NO: 635010 - protein, 20 aa, Mycobacterium
ANPQYDIVRLLRLYDAGQLK

SEQ ID NO: 635011 - protein, 18 aa, Mycobacterium
ANPRDCTCPAQLRRRYLG

SEQ ID NO: 635012 - protein, 19 aa, Mycobacterium
ANPREAEWLDVPHRRPLLA

SEQ ID NO: 635013 - protein, 25 aa, Mycobacterium
ANPRFRDHIPLMIGGSGEKKTIPMA

SEQ ID NO: 635014 - protein, 28 aa, Mycobacterium
ANPRGLIRMKFALACYGTRGDVEPSVAV

SEQ ID NO: 635015 - protein, 17 aa, Mycobacterium
ANPRLPVLGDYYEPWTY

SEQ ID NO: 635016 - protein, 17 aa, Mycobacterium
ANPRPGQIDVLLSQTHA

SEQ ID NO: 635017 - protein, 26 aa, Mycobacterium
ANPRTRSGIMALELLDATPDWDRFRT

SEQ ID NO: 635018 - protein, 26 aa, Mycobacterium
ANPRTRSGIMALELLDTTPDWDKFLT

SEQ ID NO: 635019 - protein, 26 aa, Mycobacterium
ANPRTRSGIMALELLDTTPDWERFRT

SEQ ID NO: 635020 - protein, 25 aa, Mycobacterium
ANPRTRSGIMALELLDTTPDWQQFR

SEQ ID NO: 635021 - protein, 22 aa, Mycobacterium
ANPSDVRAIIAYEEANKNRQRV

SEQ ID NO: 635022 - protein, 22 aa, Mycobacterium
ANPSHGVLWGLGRTITLEHPEI

SEQ ID NO: 635023 - protein, 25 aa, Mycobacterium
ANPTPKGCIFEYVYLARPDSTLAGR

SEQ ID NO: 635024 - protein, 25 aa, Mycobacterium
ANPTPKGCVFEYVYLARPDSMLNGR

SEQ ID NO: 635025 - protein, 25 aa, Mycobacterium
ANPTPKGCVFEYVYLARPDSTIVGR

SEQ ID NO: 635026 - protein, 24 aa, Mycobacterium
ANPYRVVSNLGVFDFGGPDHTMRA

SEQ ID NO: 635027 - protein, 25 aa, Mycobacterium
ANQCPVKRQWPRLLSHIQQGYLTPS

SEQ ID NO: 635028 - protein, 31 aa, Mycobacterium
ANQGDAVGGVGGRGGAGFASSAAGGAGGTGG

SEQ ID NO: 635029 - protein, 24 aa, Mycobacterium
ANQRVKAGAALRAMRDRGETLREI

SEQ ID NO: 635030 - protein, 23 aa, Mycobacterium
ANQRVRMPVPFAQARLLSTIEDR

SEQ ID NO: 635031 - protein, 27 aa, Mycobacterium
ANQVTIWKGMELLGPVPVLPGLGTLFE

SEQ ID NO: 635032 - protein, 17 aa, Mycobacterium
ANQVTIWSALRAAGHKA

SEQ ID NO: 635033 - protein, 18 aa, Mycobacterium
ANQWPADVVEYFGDATTG

SEQ ID NO: 635034 - protein, 19 aa, Mycobacterium
ANQWPADVVEYFGDPSTGG

SEQ ID NO: 635035 - protein, 19 aa, Mycobacterium
ANQWPADVVEYFGDPTTGG

SEQ ID NO: 635036 - protein, 18 aa, Mycobacterium
ANQWPADVVEYFGEASTG

SEQ ID NO: 635037 - protein, 17 aa, Mycobacterium
ANRASVFVRGRAGVDSG

SEQ ID NO: 635038 - protein, 23 aa, Mycobacterium
ANRDRLGVTYVIWQQRYNDGNGW

SEQ ID NO: 635039 - protein, 27 aa, Mycobacterium
ANREAFDRWGLVPRMFVGAATRDLSTE

SEQ ID NO: 635040 - protein, 17 aa, Mycobacterium
ANRELFGMIAVNARRNA

SEQ ID NO: 635041 - protein, 17 aa, Mycobacterium
ANRFRWSRCTTGDTRAG

SEQ ID NO: 635042 - protein, 28 aa, Mycobacterium
ANRHGLAVAEVRLLPAGAIPRTTSGKLA

SEQ ID NO: 635043 - protein, 25 aa, Mycobacterium
ANRHRELHNAIALNSSYPSPGSAAA

SEQ ID NO: 635044 - protein, 22 aa, Mycobacterium
ANRIANTVAVSFVQERERIIRQ

SEQ ID NO: 635045 - protein, 17 aa, Mycobacterium
ANRKVFLAVVAYQPGVI

SEQ ID NO: 635046 - protein, 25 aa, Mycobacterium
ANRLAHFWYAAGLREGDTVAALLEN

SEQ ID NO: 635047 - protein, 19 aa, Mycobacterium
ANRLARLLISQGAGPGTRV

SEQ ID NO: 635048 - protein, 24 aa, Mycobacterium
ANRLARWFIGQGFGPEDIIGLRMA

SEQ ID NO: 635049 - protein, 24 aa, Mycobacterium
ANRLARWLIRHGIGAEDIVGLRMA

SEQ ID NO: 635050 - protein, 18 aa, Mycobacterium
ANRLDWVDTYIGDVETEL

SEQ ID NO: 635051 - protein, 20 aa, Mycobacterium
ANRLKLGHEVVVIGRDTAKG

SEQ ID NO: 635052 - protein, 18 aa, Mycobacterium
ANRLLAWAEPYQEMMGPF

SEQ ID NO: 635053 - protein, 17 aa, Mycobacterium
ANRLLNSGILRLRCEVV

SEQ ID NO: 635054 - protein, 19 aa, Mycobacterium
ANRLYRGRRDLVLLRIDPA

SEQ ID NO: 635055 - protein, 19 aa, Mycobacterium
ANRPLIPRHLRLHSLFPRD

SEQ ID NO: 635056 - protein, 26 aa, Mycobacterium
ANRPWYRAFNAYKMAVICLIGAMLVE

SEQ ID NO: 635057 - protein, 24 aa, Mycobacterium
ANRRAALLPALRSAGFAVDHSEAG

SEQ ID NO: 635058 - protein, 25 aa, Mycobacterium
ANRRRFPVEIVRRTRAAVGADFIIC

SEQ ID NO: 635059 - protein, 40 aa, Mycobacterium
ANRRRFPVEIVRRVREAVGPDFIVCYRMSMADYVEDGQSW

SEQ ID NO: 635060 - protein, 21 aa, Mycobacterium
ANRSRAVLREALRYYGASRSV

SEQ ID NO: 635061 - protein, 20 aa, Mycobacterium
ANRTPVEWDGYTPPVPAQGL

SEQ ID NO: 635062 - protein, 22 aa, Mycobacterium
ANRTRLAQLLATNRFGQNTAAI

SEQ ID NO: 635063 - protein, 22 aa, Mycobacterium
ANRTRLRQLLATNRFGTNTAAI

SEQ ID NO: 635064 - protein, 17 aa, Mycobacterium
ANRTRYVLYPGTQAIPA

SEQ ID NO: 635065 - protein, 24 aa, Mycobacterium
ANRWYRRRSEMGGFDEEVYYSLTR

SEQ ID NO: 635066 - protein, 24 aa, Mycobacterium
ANRYRLACVLGERIRVLQWLDDAP

SEQ ID NO: 635067 - protein, 17 aa, Mycobacterium
ANSALAFDRAAAHGYRL

SEQ ID NO: 635068 - protein, 29 aa, Mycobacterium
ANSEAFKRWGLYPRMGIAPEERDMSVELF

SEQ ID NO: 635069 - protein, 23 aa, Mycobacterium
ANSEPRTGLSMGDHAAITAKQMG

SEQ ID NO: 635070 - protein, 17 aa, Mycobacterium
ANSEWLHRETTRIGRTL

SEQ ID NO: 635071 - protein, 25 aa, Mycobacterium
ANSFRCPYHGWTFGNTGALQGVPMR

SEQ ID NO: 635072 - protein, 17 aa, Mycobacterium
ANSGLGFGLARRLAAAG

SEQ ID NO: 635073 - protein, 17 aa, Mycobacterium
ANSGMRANDAVLIGCPG

SEQ ID NO: 635074 - protein, 19 aa, Mycobacterium
ANSHMWCEVEGIRMESNGS

SEQ ID NO: 635075 - protein, 18 aa, Mycobacterium
ANSIPRRGISALRRTVRR

SEQ ID NO: 635076 - protein, 24 aa, Mycobacterium
ANSLPRRGLAALRRPVRRPLDEGV

SEQ ID NO: 635077 - protein, 21 aa, Mycobacterium
ANSLRAGECDLALAGGSTVLA

SEQ ID NO: 635078 - protein, 25 aa, Mycobacterium
ANSMAIGGEGGVGGRGGDAGTSGLL

SEQ ID NO: 635079 - protein, 20 aa, Mycobacterium
ANSTPFVWDGVTSVNYQDPA

SEQ ID NO: 635080 - protein, 21 aa, Mycobacterium
ANSWRTQRWDSLRLLTPNWMT

SEQ ID NO: 635081 - protein, 19 aa, Mycobacterium
ANTAAWARALGRVVAAVPG

SEQ ID NO: 635082 - protein, 24 aa, Mycobacterium
ANTAGKPWILPAWSEAEQRLALED

SEQ ID NO: 635083 - protein, 19 aa, Mycobacterium
ANTALRGRLLSVIGSSLAL

SEQ ID NO: 635084 - protein, 17 aa, Mycobacterium
ANTECQLFLIDRSKPNN

SEQ ID NO: 635085 - protein, 21 aa, Mycobacterium
ANTIAGFLPVEMVVAPGDQEV

SEQ ID NO: 635086 - protein, 33 aa, Mycobacterium
ANTPATPWLASTVRVAWRAKLMFSASVDARLKL

SEQ ID NO: 635087 - protein, 24 aa, Mycobacterium
ANTREVLELTGLDRYVEVRVDGVT

SEQ ID NO: 635088 - protein, 17 aa, Mycobacterium
ANTSLAFGTEQLKADLL

SEQ ID NO: 635089 - protein, 21 aa, Mycobacterium
ANTYARLALGIGVHDITAGYR

SEQ ID NO: 635090 - protein, 24 aa, Mycobacterium
ANTYRVVSNLGVFDFGGPDRTMRA

SEQ ID NO: 635091 - protein, 17 aa, Mycobacterium
ANVAAPINAGVSANIGS

SEQ ID NO: 635092 - protein, 26 aa, Mycobacterium
ANVAGYPGVRWDDLRVQAEESLSERL

SEQ ID NO: 635093 - protein, 24 aa, Mycobacterium
ANVARATLYRHFPSANDLVAAAFV

SEQ ID NO: 635094 - protein, 24 aa, Mycobacterium
ANVARATLYRHFPSGNDLLAAAFN

SEQ ID NO: 635095 - protein, 24 aa, Mycobacterium
ANVASGYLGWLASTGVQAGQAASQ

SEQ ID NO: 635096 - protein, 18 aa, Mycobacterium
ANVEAAAPDDRWQGSGAN

SEQ ID NO: 635097 - protein, 27 aa, Mycobacterium
ANVEAFKRWGVFPRMGIAPTERDLSIE

SEQ ID NO: 635098 - protein, 18 aa, Mycobacterium
ANVFLDWSATETEFGWRP

SEQ ID NO: 635099 - protein, 19 aa, Mycobacterium
ANVGLWVHTDEQWRWLANT

SEQ ID NO: 635100 - protein, 19 aa, Mycobacterium
ANVGVWVRTDEEYRWLAHA

SEQ ID NO: 635101 - protein, 19 aa, Mycobacterium
ANVGVWVRTDEQWRWLAHT

SEQ ID NO: 635102 - protein, 18 aa, Mycobacterium
ANVIAIDLCEQIASVPYP

SEQ ID NO: 635103 - protein, 31 aa, Mycobacterium
ANVKGCIQVLGGIGCTWEHHAHLYLRRAHAN

SEQ ID NO: 635104 - protein, 22 aa, Mycobacterium
ANVKRWVDDILPLLTDEDPLGV

SEQ ID NO: 635105 - protein, 23 aa, Mycobacterium
ANVKRWVDDIMPLLGDDDPLGVD

SEQ ID NO: 635106 - protein, 19 aa, Mycobacterium
ANVMFSWTGPDVVAIVDWE

SEQ ID NO: 635107 - protein, 18 aa, Mycobacterium
ANVPASMVEYVIMGQVLT

SEQ ID NO: 635108 - protein, 18 aa, Mycobacterium
ANVPIAREEMIRFCAPAQ

SEQ ID NO: 635109 - protein, 23 aa, Mycobacterium
ANVPLGIIPLLLVDMWEHAYYLQ

SEQ ID NO: 635110 - protein, 23 aa, Mycobacterium
ANVPTPFGLFPPVSPLTVAEHLA

SEQ ID NO: 635111 - protein, 24 aa, Mycobacterium
ANVRARSGLRTTIVRPGGLTNDAG

SEQ ID NO: 635112 - protein, 19 aa, Mycobacterium
ANVRTRSTIILNTFYSDRQ

SEQ ID NO: 635113 - protein, 32 aa, Mycobacterium
ANVRVDVPLPQGWENLGALDPAYLIADKPSGA

SEQ ID NO: 635114 - protein, 20 aa, Mycobacterium
ANVRWGNNVAILAGDYLFAT

SEQ ID NO: 635115 - protein, 19 aa, Mycobacterium
ANVSVGLIYTYFGGKEELL

SEQ ID NO: 635116 - protein, 22 aa, Mycobacterium
ANVTRRVAFEVTRVDEVTHFVR

SEQ ID NO: 635117 - protein, 24 aa, Mycobacterium
ANVVGKLSVPPAWASATPAIRLAS

SEQ ID NO: 635118 - protein, 19 aa, Mycobacterium
ANWDKWFTVHEKWLSDVPE

SEQ ID NO: 635119 - protein, 25 aa, Mycobacterium
ANWIGVNASHYFWRYGGDRASTLAP

SEQ ID NO: 635120 - protein, 17 aa, Mycobacterium
ANWMKHLHHANWKMVVE

SEQ ID NO: 635121 - protein, 17 aa, Mycobacterium
ANWREQPLPFGFASRSA

SEQ ID NO: 635122 - protein, 18 aa, Mycobacterium
ANWSLPMKLFERGLDKGS

SEQ ID NO: 635123 - protein, 21 aa, Mycobacterium
ANYDARFVIVTAGPIEEALAY

SEQ ID NO: 635124 - protein, 19 aa, Mycobacterium
ANYFGAAGFVPLANAVEGA

SEQ ID NO: 635125 - protein, 19 aa, Mycobacterium
ANYFGAAGFVPLANSVEGT

SEQ ID NO: 635126 - protein, 19 aa, Mycobacterium
ANYFGAAGFVPLSNQAEGG

SEQ ID NO: 635127 - protein, 27 aa, Mycobacterium
ANYLYPRVEVEVGFILADDLPGAGCTE

SEQ ID NO: 635128 - protein, 18 aa, Mycobacterium
ANYSMVFDSYAEVPANVS

SEQ ID NO: 635129 - protein, 31 aa, Mycobacterium
ANYVSLELGPWLINWVPFGYLISDQILIWYP

SEQ ID NO: 635130 - protein, 24 aa, Mycobacterium
ANYYRPLIEHPKVMRVVALSGGYS

SEQ ID NO: 635131 - protein, 19 aa, Mycobacterium
APAAAPAAESFVFDRPIQT

SEQ ID NO: 635132 - protein, 29 aa, Mycobacterium
APAADPAAEWRRLGTAIADTRRTIGALRA

SEQ ID NO: 635133 - protein, 36 aa, Mycobacterium
APAAEARVDCGLAGTVLRFVPPIAALSAQTVTFDGD

SEQ ID NO: 635134 - protein, 18 aa, Mycobacterium
APAAEFVVGMSLGGLTAI

SEQ ID NO: 635135 - protein, 27 aa, Mycobacterium
APAAFADRVADGWIKAQAYRLQTFGTV

SEQ ID NO: 635136 - protein, 18 aa, Mycobacterium
APAAFVLLTQLSAKYRQV

SEQ ID NO: 635137 - protein, 36 aa, Mycobacterium
APAAIEGWMPFGRVFETLSWGRRHVVMGANQIDRYG

SEQ ID NO: 635138 - protein, 19 aa, Mycobacterium
APAALIFRALTEPELVTRW

SEQ ID NO: 635139 - protein, 17 aa, Mycobacterium
APAALIVAASWSPRMRP

SEQ ID NO: 635140 - protein, 26 aa, Mycobacterium
APAAPSLRPISGLLSVVTLGTTLIPN

SEQ ID NO: 635141 - protein, 26 aa, Mycobacterium
APAARPRIRLAYRLTPTRVLGEQRVS

SEQ ID NO: 635142 - protein, 20 aa, Mycobacterium
APAARRRAYDDLAYADIDEL

SEQ ID NO: 635143 - protein, 21 aa, Mycobacterium
APAAVSCARPQAGAKRRGSSH

SEQ ID NO: 635144 - protein, 28 aa, Mycobacterium
APADARIAALIRRVCAQTVSLPPLPSAV

SEQ ID NO: 635145 - protein, 18 aa, Mycobacterium
APADFTATIALSYLDDMQ

SEQ ID NO: 635146 - protein, 17 aa, Mycobacterium
APADLAGALAQEIPERH

SEQ ID NO: 635147 - protein, 22 aa, Mycobacterium
APADPSHLVPGEIAQFKSRDPV

SEQ ID NO: 635148 - protein, 31 aa, Mycobacterium
APADPWDVPSGWRIAGRAPTSIRLHAGERTD

SEQ ID NO: 635149 - protein, 23 aa, Mycobacterium
APAEHAFRPAVEALRGVLEDVLS

SEQ ID NO: 635150 - protein, 28 aa, Mycobacterium
APAEIAEAAAWLLSDRASYVTGVTLRVD

SEQ ID NO: 635151 - protein, 17 aa, Mycobacterium
APAEIEFGEAHRAILDT

SEQ ID NO: 635152 - protein, 34 aa, Mycobacterium
APAEIEGWMPFGRVFETLSWGRRHVVMGANQIDR

SEQ ID NO: 635153 - protein, 18 aa, Mycobacterium
APAEIRVCRTPTGDQVTI

SEQ ID NO: 635154 - protein, 24 aa, Mycobacterium
APAEIWRDYIRTVGRTPNGIWGGK

SEQ ID NO: 635155 - protein, 26 aa, Mycobacterium
APAELRAAWKDIPEVVGAATVTGTAD

SEQ ID NO: 635156 - protein, 24 aa, Mycobacterium
APAELRPALERAFASGLPAVVNVL

SEQ ID NO: 635157 - protein, 17 aa, Mycobacterium
APAEPRPASTAGPGLPE

SEQ ID NO: 635158 - protein, 17 aa, Mycobacterium
APAEPRRGVAIVSSPLV

SEQ ID NO: 635159 - protein, 27 aa, Mycobacterium
APAEVPARLEALGALGGLDRAALHSQF

SEQ ID NO: 635160 - protein, 22 aa, Mycobacterium
APAEVRSSGWSTDPLALGSYSF

SEQ ID NO: 635161 - protein, 26 aa, Mycobacterium
APAGDPLRRWGPFPGGMADPERGGLF

SEQ ID NO: 635162 - protein, 25 aa, Mycobacterium
APAGFKAAGISAGIKASGKPDLALI

SEQ ID NO: 635163 - protein, 25 aa, Mycobacterium
APAGFRAAGIAAGIKASGKLDLALV

SEQ ID NO: 635164 - protein, 19 aa, Mycobacterium
APAGFRATGIAAGIKASGA

SEQ ID NO: 635165 - protein, 24 aa, Mycobacterium
APAGKVACCGWSYGGYLTQAALAF

SEQ ID NO: 635166 - protein, 18 aa, Mycobacterium
APAGLRGSLQVRHVDAGS

SEQ ID NO: 635167 - protein, 18 aa, Mycobacterium
APAGPFCTAEHIRLLSAI

SEQ ID NO: 635168 - protein, 18 aa, Mycobacterium
APAGPGLHAGFVDPVALQ

SEQ ID NO: 635169 - protein, 19 aa, Mycobacterium
APAGQDWQIADLAGRRIAT

SEQ ID NO: 635170 - protein, 17 aa, Mycobacterium
APAGRAGFESHVVTVDG

SEQ ID NO: 635171 - protein, 28 aa, Mycobacterium
APAGRPRRAGISSFGFGGTNAHVVIEQA

SEQ ID NO: 635172 - protein, 17 aa, Mycobacterium
APAGTRARERWEALVAL

SEQ ID NO: 635173 - protein, 25 aa, Mycobacterium
APAGYALGGGDPIVGLQRAVADHHQ

SEQ ID NO: 635174 - protein, 24 aa, Mycobacterium
APAHKIPLVIGGTGRRTMGLVRRY

SEQ ID NO: 635175 - protein, 19 aa, Mycobacterium
APAIAGLLDIYAHASSALP

SEQ ID NO: 635176 - protein, 22 aa, Mycobacterium
APAIAVGNCAVVKPADETPRTA

SEQ ID NO: 635177 - protein, 17 aa, Mycobacterium
APAIGWADLSMTYRELD

SEQ ID NO: 635178 - protein, 18 aa, Mycobacterium
APALAAGCSAVLKPAEET

SEQ ID NO: 635179 - protein, 24 aa, Mycobacterium
APALAAGCSVVLKASPETSLDALV

SEQ ID NO: 635180 - protein, 18 aa, Mycobacterium
APALAAGCTVVLKGAPDT

SEQ ID NO: 635181 - protein, 18 aa, Mycobacterium
APALAAGCTVVLKSAPDT

SEQ ID NO: 635182 - protein, 17 aa, Mycobacterium
APALAAGNAVVFKPSEL

SEQ ID NO: 635183 - protein, 24 aa, Mycobacterium
APALAVGCPVVLKPATQTPLSALL

SEQ ID NO: 635184 - protein, 20 aa, Mycobacterium
APALLWIHGGGTIMGHAAQD

SEQ ID NO: 635185 - protein, 18 aa, Mycobacterium
APALRWGMGSLQEIDHVP

SEQ ID NO: 635186 - protein, 23 aa, Mycobacterium
APALYRRWENLWDRLLSACQPGA

SEQ ID NO: 635187 - protein, 25 aa, Mycobacterium
APAMVERGRGGIVLFGSGAGLAGGA

SEQ ID NO: 635188 - protein, 23 aa, Mycobacterium
APANFALHVMRYLHESPATKEHM

SEQ ID NO: 635189 - protein, 21 aa, Mycobacterium
APANLSGLFNVGTDLAGVLRD

SEQ ID NO: 635190 - protein, 21 aa, Mycobacterium
APANRIGIQPVDFKQDSGAPP

SEQ ID NO: 635191 - protein, 19 aa, Mycobacterium
APAPAMGAMGPMMPPMRGG

SEQ ID NO: 635192 - protein, 17 aa, Mycobacterium
APAPFASVYFDDSHDTH

SEQ ID NO: 635193 - protein, 19 aa, Mycobacterium
APAPRRAAAVRVFVNRHGW

SEQ ID NO: 635194 - protein, 28 aa, Mycobacterium
APAPVLELRTSWRNPPRALHLANAISAE

SEQ ID NO: 635195 - protein, 17 aa, Mycobacterium
APAQALLGHPIIGTGGS

SEQ ID NO: 635196 - protein, 21 aa, Mycobacterium
APAQMTHHVFHVGGVQEKKDL

SEQ ID NO: 635197 - protein, 17 aa, Mycobacterium
APAQVWAVGHSRAVLRE

SEQ ID NO: 635198 - protein, 24 aa, Mycobacterium
APARAAYVAGDWGAVASLSPELFL

SEQ ID NO: 635199 - protein, 17 aa, Mycobacterium
APARAEPRPAPIRPAPG

SEQ ID NO: 635200 - protein, 24 aa, Mycobacterium
APARARAAVLAAMRAAHPYEEPAF

SEQ ID NO: 635201 - protein, 19 aa, Mycobacterium
APARARAAVLSAMRAAHPY

SEQ ID NO: 635202 - protein, 24 aa, Mycobacterium
APARIRAAVLAAMRAAHPYEEPAF

SEQ ID NO: 635203 - protein, 17 aa, Mycobacterium
APARPVLRSNSAPDGDR

SEQ ID NO: 635204 - protein, 20 aa, Mycobacterium
APARSARRFGGRAVVLSRNA

SEQ ID NO: 635205 - protein, 24 aa, Mycobacterium
APARVGWFRYYFADDRWEWSDEVA

SEQ ID NO: 635206 - protein, 17 aa, Mycobacterium
APARVWAVAQSRAVLRG

SEQ ID NO: 635207 - protein, 22 aa, Mycobacterium
APARWPTTLLGGGLPVVVDVQN

SEQ ID NO: 635208 - protein, 19 aa, Mycobacterium
APASAMPHLAGSRSTPSDV

SEQ ID NO: 635209 - protein, 17 aa, Mycobacterium
APASDAAGFKWLAPYTG

SEQ ID NO: 635210 - protein, 25 aa, Mycobacterium
APASDSAGFKWLAPYTGSAIAQHWM

SEQ ID NO: 635211 - protein, 23 aa, Mycobacterium
APASGGVVPLVFGLPDGTTEHRR

SEQ ID NO: 635212 - protein, 21 aa, Mycobacterium
APASRPASIAYRSSLGAQLAA

SEQ ID NO: 635213 - protein, 19 aa, Mycobacterium
APATDLIVNGLRFGDAAPV

SEQ ID NO: 635214 - protein, 18 aa, Mycobacterium
APATGGFVLFYHVLWELT

SEQ ID NO: 635215 - protein, 18 aa, Mycobacterium
APATRLPWFGPPMSAVSS

SEQ ID NO: 635216 - protein, 29 aa, Mycobacterium
APAVCGVIRRYQLPFGMNRAAAVAVAASY

SEQ ID NO: 635217 - protein, 20 aa, Mycobacterium
APAVEGLGWSPKWTLEDGLH

SEQ ID NO: 635218 - protein, 17 aa, Mycobacterium
APAVGLASHLGRGVRRI

SEQ ID NO: 635219 - protein, 18 aa, Mycobacterium
APAVKLLVRKAGARSADM

SEQ ID NO: 635220 - protein, 23 aa, Mycobacterium
APAVRAIGLLDVFTPRTPRIASL

SEQ ID NO: 635221 - protein, 18 aa, Mycobacterium
APAVRTKLLYMYFPDEFV

SEQ ID NO: 635222 - protein, 20 aa, Mycobacterium
APAVWGSIFARCSHSDIHRD

SEQ ID NO: 635223 - protein, 17 aa, Mycobacterium
APAWWHAERDAVVGPAL

SEQ ID NO: 635224 - protein, 26 aa, Mycobacterium
APAYAELRPDAWLSETVRAEMVRLGR

SEQ ID NO: 635225 - protein, 22 aa, Mycobacterium
APAYNSGGPWGYTPKGGTGVPT

SEQ ID NO: 635226 - protein, 20 aa, Mycobacterium
APCEAACVLGINQDPVTIKQ

SEQ ID NO: 635227 - protein, 18 aa, Mycobacterium
APCGHVRQVLHSRLDEVR

SEQ ID NO: 635228 - protein, 17 aa, Mycobacterium
APCGNIFSSPSASEVYS

SEQ ID NO: 635229 - protein, 18 aa, Mycobacterium
APCREVHVGDELQIGELT

SEQ ID NO: 635230 - protein, 19 aa, Mycobacterium
APDAAGYWPAPAVANHALA

SEQ ID NO: 635231 - protein, 24 aa, Mycobacterium
APDAGLPLYAGWRTMPLADDAPAR

SEQ ID NO: 635232 - protein, 24 aa, Mycobacterium
APDAGRLLYSLVRAIKPRTIVEYG

SEQ ID NO: 635233 - protein, 17 aa, Mycobacterium
APDALSLPEAEMRETFR

SEQ ID NO: 635234 - protein, 29 aa, Mycobacterium
APDARCPTCPDWTAADLLWHLTEVHLFWA

SEQ ID NO: 635235 - protein, 20 aa, Mycobacterium
APDASWIPVFEHMTRNNRLP

SEQ ID NO: 635236 - protein, 27 aa, Mycobacterium
APDAVAITCAQRSWTYGELDEASNRLA

SEQ ID NO: 635237 - protein, 26 aa, Mycobacterium
APDAVAITCAQRSWTYGELDETSNRL

SEQ ID NO: 635238 - protein, 21 aa, Mycobacterium
APDAYKRAGVRSRLTPLKDLK

SEQ ID NO: 635239 - protein, 24 aa, Mycobacterium
APDDAVLIGHDWGGFTAAGIAAYP

SEQ ID NO: 635240 - protein, 22 aa, Mycobacterium
APDDLLDALSLWAPTQSVTAYD

SEQ ID NO: 635241 - protein, 26 aa, Mycobacterium
APDDPKAWLITTAWRRFIDVARAEAA

SEQ ID NO: 635242 - protein, 23 aa, Mycobacterium
APDDPRWPPIPAQDFSNLPRQQK

SEQ ID NO: 635243 - protein, 24 aa, Mycobacterium
APDDPRWPPIPAQDFSNLPRQQKG

SEQ ID NO: 635244 - protein, 19 aa, Mycobacterium
APDEAPGGHDWVFEVVGSA

SEQ ID NO: 635245 - protein, 24 aa, Mycobacterium
APDFIRLGLMLALERRPTEPRART

SEQ ID NO: 635246 - protein, 20 aa, Mycobacterium
APDFRLFWDNAYAVHTLTHD

SEQ ID NO: 635247 - protein, 22 aa, Mycobacterium
APDFRLFWDNAYAVHTLTHDFP

SEQ ID NO: 635248 - protein, 22 aa, Mycobacterium
APDFRLFWDNAYMVHTLTPDFI

SEQ ID NO: 635249 - protein, 27 aa, Mycobacterium
APDGAGWRVGEGMALAMIATLPPGGHF

SEQ ID NO: 635250 - protein, 17 aa, Mycobacterium
APDGQRELDGWAAQVPM

SEQ ID NO: 635251 - protein, 18 aa, Mycobacterium
APDGRCKVYAGAADGTSW

SEQ ID NO: 635252 - protein, 24 aa, Mycobacterium
APDGRCRPFAKSGGGIGRGEGVGA

SEQ ID NO: 635253 - protein, 17 aa, Mycobacterium
APDGVEMTGHFSRFHVG

SEQ ID NO: 635254 - protein, 17 aa, Mycobacterium
APDGVVFYQLPGIAMAL

SEQ ID NO: 635255 - protein, 22 aa, Mycobacterium
APDHFGRLAAAMGEFTPAERDT

SEQ ID NO: 635256 - protein, 21 aa, Mycobacterium
APDHLPVVLEFAATVDAEIGR

SEQ ID NO: 635257 - protein, 19 aa, Mycobacterium
APDHLPVVLEFAATVDPGA

SEQ ID NO: 635258 - protein, 19 aa, Mycobacterium
APDILLRAAAKLPGVRVLI

SEQ ID NO: 635259 - protein, 24 aa, Mycobacterium
APDIPKERFSALTRLDHNRAISQL

SEQ ID NO: 635260 - protein, 24 aa, Mycobacterium
APDIPRDRFTALTRLDHNRAVAAM

SEQ ID NO: 635261 - protein, 18 aa, Mycobacterium
APDLGRWQPPAVLPQHLG

SEQ ID NO: 635262 - protein, 24 aa, Mycobacterium
APDLPRWALTLGFGSQCVPMQLVG

SEQ ID NO: 635263 - protein, 20 aa, Mycobacterium
APDLPRWRSAIEAATRRWCA

SEQ ID NO: 635264 - protein, 24 aa, Mycobacterium
APDLPSPWPREALDDLLVVLLAGP

SEQ ID NO: 635265 - protein, 23 aa, Mycobacterium
APDLQICFGEVPLSSSANAAAYG

SEQ ID NO: 635266 - protein, 17 aa, Mycobacterium
APDNGLAFFEDLGWRTV

SEQ ID NO: 635267 - protein, 18 aa, Mycobacterium
APDPALVMIVVSWLSGEL

SEQ ID NO: 635268 - protein, 20 aa, Mycobacterium
APDPPGVVAGDLIGYRLISV

SEQ ID NO: 635269 - protein, 22 aa, Mycobacterium
APDPRWPARYRRLAEQIRAALG

SEQ ID NO: 635270 - protein, 25 aa, Mycobacterium
APDPYCARGALRRVSQRLADAGISA

SEQ ID NO: 635271 - protein, 23 aa, Mycobacterium
APDPYCSRYALQRVADRLETAGL

SEQ ID NO: 635272 - protein, 24 aa, Mycobacterium
APDQAAYRVLWFVSSPSNISGATI

SEQ ID NO: 635273 - protein, 19 aa, Mycobacterium
APDQFDWLATRLEIARKLR

SEQ ID NO: 635274 - protein, 20 aa, Mycobacterium
APDQFDWLATRLEIARKLRN

SEQ ID NO: 635275 - protein, 19 aa, Mycobacterium
APDRARFVWGGRYEPRTLI

SEQ ID NO: 635276 - protein, 19 aa, Mycobacterium
APDRARLASVAVQASLIAA

SEQ ID NO: 635277 - protein, 19 aa, Mycobacterium
APDRFRAWNRRRLGRWRTE

SEQ ID NO: 635278 - protein, 22 aa, Mycobacterium
APDRLRAAWVDMPEVVSAATVT

SEQ ID NO: 635279 - protein, 18 aa, Mycobacterium
APDRLWVADFTYCRTRAG

SEQ ID NO: 635280 - protein, 18 aa, Mycobacterium
APDRNLALELVRVTEAGA

SEQ ID NO: 635281 - protein, 19 aa, Mycobacterium
APDRNLALELVRVTEAGAM

SEQ ID NO: 635282 - protein, 20 aa, Mycobacterium
APDRNLAMELVRVTEAGAMA

SEQ ID NO: 635283 - protein, 24 aa, Mycobacterium
APDRNVCTWLCFVTIGPLFVFGLH

SEQ ID NO: 635284 - protein, 25 aa, Mycobacterium
APDRSTVRFRTRTMWGLVPVNGTFT

SEQ ID NO: 635285 - protein, 22 aa, Mycobacterium
APDSALSWCNPGGRALGTPPTT

SEQ ID NO: 635286 - protein, 24 aa, Mycobacterium
APDTDVRFGIGWGAVTILDADAGI

SEQ ID NO: 635287 - protein, 17 aa, Mycobacterium
APDTFGFLSEGQAGDTA

SEQ ID NO: 635288 - protein, 19 aa, Mycobacterium
APDVARSVTIWAANPANAD

SEQ ID NO: 635289 - protein, 18 aa, Mycobacterium
APDVARSVTVWAANPANS

SEQ ID NO: 635290 - protein, 23 aa, Mycobacterium
APDVIRLAPPLIITEAQLDGFVH

SEQ ID NO: 635291 - protein, 22 aa, Mycobacterium
APDVIRLAPPLIITEDQLDGFI

SEQ ID NO: 635292 - protein, 22 aa, Mycobacterium
APDVIRLAPPLIVTEAQLDGFV

SEQ ID NO: 635293 - protein, 23 aa, Mycobacterium
APDVLRHVMGFGETPDKALTGPM

SEQ ID NO: 635294 - protein, 23 aa, Mycobacterium
APDVLRHVMGFGEVPDKALSGPM

SEQ ID NO: 635295 - protein, 21 aa, Mycobacterium
APDVLRYVMGFGGTPDSALTG

SEQ ID NO: 635296 - protein, 24 aa, Mycobacterium
APDVPKLGSFEVMNRTIDIAQAAL

SEQ ID NO: 635297 - protein, 18 aa, Mycobacterium
APDYPLWTACTSLAGGTP

SEQ ID NO: 635298 - protein, 19 aa, Mycobacterium
APEAFRLDDVDGHASPVSE

SEQ ID NO: 635299 - protein, 21 aa, Mycobacterium
APEALRPNDIVWRDDIGEGKL

SEQ ID NO: 635300 - protein, 18 aa, Mycobacterium
APEAPGWYHNLKANPDVE

SEQ ID NO: 635301 - protein, 21 aa, Mycobacterium
APEARAAADLIATRSPVALAV

SEQ ID NO: 635302 - protein, 18 aa, Mycobacterium
APEATRLTMEFMGLANHR

SEQ ID NO: 635303 - protein, 18 aa, Mycobacterium
APECAYAPGLEHDYAAAG

SEQ ID NO: 635304 - protein, 18 aa, Mycobacterium
APECAYAPGMEEGYAAAG

SEQ ID NO: 635305 - protein, 18 aa, Mycobacterium
APECDLVLVVGSRNSSNS

SEQ ID NO: 635306 - protein, 23 aa, Mycobacterium
APECGHCGCRILGHGIETDEGIF

SEQ ID NO: 635307 - protein, 28 aa, Mycobacterium
APEEIAQAVLFLASPRASFVTGSTLYVD

SEQ ID NO: 635308 - protein, 22 aa, Mycobacterium
APEETRNALLVALHQGLYSRQA

SEQ ID NO: 635309 - protein, 18 aa, Mycobacterium
APEFLRPNGAAFLKVDVQ

SEQ ID NO: 635310 - protein, 18 aa, Mycobacterium
APEFRAMMRLDWSQSQQS

SEQ ID NO: 635311 - protein, 20 aa, Mycobacterium
APEFRREAHRQSELVAAGEH

SEQ ID NO: 635312 - protein, 23 aa, Mycobacterium
APEGDLILFSHVCQKSGLDPFRR

SEQ ID NO: 635313 - protein, 22 aa, Mycobacterium
APEGKGPLLINARAETVATSPA

SEQ ID NO: 635314 - protein, 18 aa, Mycobacterium
APEGLFAVECDVTDSDAV

SEQ ID NO: 635315 - protein, 20 aa, Mycobacterium
APEGLFGVECDVTDNDAVDR

SEQ ID NO: 635316 - protein, 21 aa, Mycobacterium
APEGLFGVVCDVTDNEAIDRA

SEQ ID NO: 635317 - protein, 21 aa, Mycobacterium
APEGLFGVVCDVTDNEAVDRA

SEQ ID NO: 635318 - protein, 19 aa, Mycobacterium
APEGRMCLEAQVMDWADDI

SEQ ID NO: 635319 - protein, 20 aa, Mycobacterium
APEHPYPAAVEDCWAALQWV

SEQ ID NO: 635320 - protein, 25 aa, Mycobacterium
APEHVKPRLLGHWGTTPALNLIYAH

SEQ ID NO: 635321 - protein, 25 aa, Mycobacterium
APEIYRAPLSYPFRDAEFGKELATD

SEQ ID NO: 635322 - protein, 25 aa, Mycobacterium
APEIYRAPLSYPYRDGLLDKELATD

SEQ ID NO: 635323 - protein, 24 aa, Mycobacterium
APEIYRAPVSYPYRDNLLDKDIAT

SEQ ID NO: 635324 - protein, 28 aa, Mycobacterium
APEKPSWWRRLLSNRSFQSFLSALGKQL

SEQ ID NO: 635325 - protein, 24 aa, Mycobacterium
APEKPWFSYVCPGAGHAPHHVFKQ

SEQ ID NO: 635326 - protein, 19 aa, Mycobacterium
APELLRLGSKPASTLAQLR

SEQ ID NO: 635327 - protein, 17 aa, Mycobacterium
APELRLYTAAIDSGLND

SEQ ID NO: 635328 - protein, 20 aa, Mycobacterium
APEPCVRFYAEHVEADAVHE

SEQ ID NO: 635329 - protein, 21 aa, Mycobacterium
APEPGPAMLGDIVLCPEFAAE

SEQ ID NO: 635330 - protein, 19 aa, Mycobacterium
APEPLPMPLQNILVSEAHQ

SEQ ID NO: 635331 - protein, 18 aa, Mycobacterium
APEPLRHFYIAYRALVRA

SEQ ID NO: 635332 - protein, 22 aa, Mycobacterium
APEPMVRPPVGGGYSHELAEVT

SEQ ID NO: 635333 - protein, 19 aa, Mycobacterium
APEQILLCRMLSGVFEETH

SEQ ID NO: 635334 - protein, 25 aa, Mycobacterium
APEQMSALLMAIFWRGMDSGETARW

SEQ ID NO: 635335 - protein, 22 aa, Mycobacterium
APEQMSALLMAIVLQGMDRGET

SEQ ID NO: 635336 - protein, 18 aa, Mycobacterium
APEQPRQLVLIADDNADM

SEQ ID NO: 635337 - protein, 23 aa, Mycobacterium
APERAAEIFLRVKPGILEAHPNT

SEQ ID NO: 635338 - protein, 18 aa, Mycobacterium
APERAVAAVADFVRSRPD

SEQ ID NO: 635339 - protein, 18 aa, Mycobacterium
APERMRLGALARHITDEL

SEQ ID NO: 635340 - protein, 23 aa, Mycobacterium
APERPLVGPLLWDLEAGTATDTT

SEQ ID NO: 635341 - protein, 24 aa, Mycobacterium
APERPRLSVLGGDRPRWQTTGEDG

SEQ ID NO: 635342 - protein, 18 aa, Mycobacterium
APERSRPVVLIADDNADM

SEQ ID NO: 635343 - protein, 21 aa, Mycobacterium
APERVAGLIAEIVGVPQPPSK

SEQ ID NO: 635344 - protein, 27 aa, Mycobacterium
APESGCRMGICFSCTRRKTSGVVRNVV

SEQ ID NO: 635345 - protein, 24 aa, Mycobacterium
APESGEEIILFRASFAQQRMWFLS

SEQ ID NO: 635346 - protein, 18 aa, Mycobacterium
APESTCREFAAIVDDVVC

SEQ ID NO: 635347 - protein, 18 aa, Mycobacterium
APESTCREFAGQVDDVVC

SEQ ID NO: 635348 - protein, 21 aa, Mycobacterium
APETPRNWSPFALARTLWHLA

SEQ ID NO: 635349 - protein, 21 aa, Mycobacterium
APEVAEAYAAINTAETADAVM

SEQ ID NO: 635350 - protein, 24 aa, Mycobacterium
APEVFKLVGEEALAYDPNPDDSQR

SEQ ID NO: 635351 - protein, 17 aa, Mycobacterium
APEVFPSDPVEMVKSRI

SEQ ID NO: 635352 - protein, 24 aa, Mycobacterium
APEVLIPIQCEYYALEGVSQLMRN

SEQ ID NO: 635353 - protein, 19 aa, Mycobacterium
APEVRVCGMAAGLQAVLEL

SEQ ID NO: 635354 - protein, 26 aa, Mycobacterium
APEVWIGELPEWIVAPEYGISQHQAL

SEQ ID NO: 635355 - protein, 25 aa, Mycobacterium
APEVYRAPVSYPYRDGLLDKELATD

SEQ ID NO: 635356 - protein, 18 aa, Mycobacterium
APEWIDFDLVREGARQER

SEQ ID NO: 635357 - protein, 22 aa, Mycobacterium
APEYLLRSALEYQRCQRERRRS

SEQ ID NO: 635358 - protein, 18 aa, Mycobacterium
APFDLHIYPWTERDPASP

SEQ ID NO: 635359 - protein, 25 aa, Mycobacterium
APFFCAECGYSYCGTHWKLNPVFDE

SEQ ID NO: 635360 - protein, 19 aa, Mycobacterium
APFFDAPDVFAGFNDGSSV

SEQ ID NO: 635361 - protein, 19 aa, Mycobacterium
APFGLRFGPDPSSLSRCTI

SEQ ID NO: 635362 - protein, 17 aa, Mycobacterium
APFKFAPDNGLAFFEAL

SEQ ID NO: 635363 - protein, 18 aa, Mycobacterium
APFLRQIVANQMAYGQTI

SEQ ID NO: 635364 - protein, 34 aa, Mycobacterium
APFNVSLRQARDWLSRFDLGPGFDVILPTPSLLD

SEQ ID NO: 635365 - protein, 23 aa, Mycobacterium
APFPLAGMQLAYWIGRSDEQELG

SEQ ID NO: 635366 - protein, 22 aa, Mycobacterium
APFPLAPMQHAMWVGREDDQQL

SEQ ID NO: 635367 - protein, 22 aa, Mycobacterium
APFPLATMQHAYWIGRSDEQEL

SEQ ID NO: 635368 - protein, 23 aa, Mycobacterium
APFPLATMQHAYWIGRSEDQELG

SEQ ID NO: 635369 - protein, 17 aa, Mycobacterium
APFRGFLQERRALGHHG

SEQ ID NO: 635370 - protein, 17 aa, Mycobacterium
APFRLAYVGQCLSLGRR

SEQ ID NO: 635371 - protein, 20 aa, Mycobacterium
APFSAFVFKVQAGMDSAHRD

SEQ ID NO: 635372 - protein, 18 aa, Mycobacterium
APFSLAWMTAVGERTKNL

SEQ ID NO: 635373 - protein, 18 aa, Mycobacterium
APFSLAWMTAVGERTKRI

SEQ ID NO: 635374 - protein, 18 aa, Mycobacterium
APFSLAWMTAVGERTKRM

SEQ ID NO: 635375 - protein, 18 aa, Mycobacterium
APFWFAGSVGELEAVGAH

SEQ ID NO: 635376 - protein, 17 aa, Mycobacterium
APFYPKDYVPYCFDPTA

SEQ ID NO: 635377 - protein, 18 aa, Mycobacterium
APGACVVVNPCLSGGALE

SEQ ID NO: 635378 - protein, 18 aa, Mycobacterium
APGACVVVNPCLSGGSLE

SEQ ID NO: 635379 - protein, 24 aa, Mycobacterium
APGADGQAGGLLIGNGGAGGGGTA

SEQ ID NO: 635380 - protein, 19 aa, Mycobacterium
APGAHKLDMGPIIDDIRAA

SEQ ID NO: 635381 - protein, 17 aa, Mycobacterium
APGALRWLPIDPVSRVS

SEQ ID NO: 635382 - protein, 17 aa, Mycobacterium
APGALRWSPVDPVSSVG

SEQ ID NO: 635383 - protein, 23 aa, Mycobacterium
APGAMARMGLAPADLAERHPQVI

SEQ ID NO: 635384 - protein, 18 aa, Mycobacterium
APGAPGMPGMPGAPGAPG

SEQ ID NO: 635385 - protein, 19 aa, Mycobacterium
APGARAWWQAGHRSTEPAH

SEQ ID NO: 635386 - protein, 19 aa, Mycobacterium
APGARLAWREDATLAPHGG

SEQ ID NO: 635387 - protein, 24 aa, Mycobacterium
APGARLAWREDATWAPHGGESRVD

SEQ ID NO: 635388 - protein, 25 aa, Mycobacterium
APGARLAWRENAEWAPHGGESRIDV

SEQ ID NO: 635389 - protein, 20 aa, Mycobacterium
APGATGYWPAPAVANYALAG

SEQ ID NO: 635390 - protein, 21 aa, Mycobacterium
APGDHKSLCAVMTTIYSAQLE

SEQ ID NO: 635391 - protein, 19 aa, Mycobacterium
APGDLCILATPPPQALAEL

SEQ ID NO: 635392 - protein, 23 aa, Mycobacterium
APGDLPGLLAKAKLRTWLDTINN

SEQ ID NO: 635393 - protein, 24 aa, Mycobacterium
APGDRVALISATRYEWTIIDYAVL

SEQ ID NO: 635394 - protein, 17 aa, Mycobacterium
APGDVKRAHYFGEELVL

SEQ ID NO: 635395 - protein, 23 aa, Mycobacterium
APGECPGTYAAEVAMDELAVAAG

SEQ ID NO: 635396 - protein, 22 aa, Mycobacterium
APGECPGTYAAEVAMDELAVAC

SEQ ID NO: 635397 - protein, 23 aa, Mycobacterium
APGEGGLFEVVWPPTTLVDNGIG

SEQ ID NO: 635398 - protein, 26 aa, Mycobacterium
APGEGPRFNGDWSLDDPRVNPIAGDN

SEQ ID NO: 635399 - protein, 18 aa, Mycobacterium
APGEHPMFKAMAAGSSLG

SEQ ID NO: 635400 - protein, 17 aa, Mycobacterium
APGEHPMFKAMAASSSS

SEQ ID NO: 635401 - protein, 18 aa, Mycobacterium
APGEIFGSNVFTKAEMQS

SEQ ID NO: 635402 - protein, 24 aa, Mycobacterium
APGELRPALERAFASGMPAVVNVL

SEQ ID NO: 635403 - protein, 23 aa, Mycobacterium
APGEYLTRPGFWHGAVGVAACWL

SEQ ID NO: 635404 - protein, 24 aa, Mycobacterium
APGFDWSGWLSALGAGAGQVTELV

SEQ ID NO: 635405 - protein, 24 aa, Mycobacterium
APGFGARVLDRFVQRPSDLEASDA

SEQ ID NO: 635406 - protein, 28 aa, Mycobacterium
APGFLAMVADFCRARGILLVADEVQTGI

SEQ ID NO: 635407 - protein, 17 aa, Mycobacterium
APGFVHVPWDAVDTWFE

SEQ ID NO: 635408 - protein, 27 aa, Mycobacterium
APGGGRPRVRLAYRLTPNRVLGEQRAT

SEQ ID NO: 635409 - protein, 19 aa, Mycobacterium
APGGHWTMAYPFVRLHQPS

SEQ ID NO: 635410 - protein, 17 aa, Mycobacterium
APGGIIYALRSSYAVPP

SEQ ID NO: 635411 - protein, 19 aa, Mycobacterium
APGGLSCFLLPRILPDGSR

SEQ ID NO: 635412 - protein, 19 aa, Mycobacterium
APGGLSCFMLPRILPDGTR

SEQ ID NO: 635413 - protein, 19 aa, Mycobacterium
APGGLSCFMLPRVLPDGSR

SEQ ID NO: 635414 - protein, 20 aa, Mycobacterium
APGGRIIAGRIVFDGRDLTS

SEQ ID NO: 635415 - protein, 26 aa, Mycobacterium
APGGRLVFNVFMPRPGFMSDDAVNEL

SEQ ID NO: 635416 - protein, 19 aa, Mycobacterium
APGGYSERMLLSEPLLIEV

SEQ ID NO: 635417 - protein, 26 aa, Mycobacterium
APGHYTLRASVDWQQHKPGASHVVNY

SEQ ID NO: 635418 - protein, 24 aa, Mycobacterium
APGIDVRFGIGWGAVSVLDEATGI

SEQ ID NO: 635419 - protein, 17 aa, Mycobacterium
APGIFKRSMQWPYAPSV

SEQ ID NO: 635420 - protein, 20 aa, Mycobacterium
APGIGKMKINGVYGSVHLEE

SEQ ID NO: 635421 - protein, 20 aa, Mycobacterium
APGKAGRLNSIFDPADPASV

SEQ ID NO: 635422 - protein, 22 aa, Mycobacterium
APGKGEFIKGFASPFTLLVIAD

SEQ ID NO: 635423 - protein, 21 aa, Mycobacterium
APGKRLLRVVTWCQDGGSLFR

SEQ ID NO: 635424 - protein, 26 aa, Mycobacterium
APGLAERVWYGGGLASAIWAGTQGLN

SEQ ID NO: 635425 - protein, 25 aa, Mycobacterium
APGLARALCWMIERTFYQASKISPD

SEQ ID NO: 635426 - protein, 18 aa, Mycobacterium
APGLGRTAAEILVRHPRS

SEQ ID NO: 635427 - protein, 20 aa, Mycobacterium
APGLKITGCDFLHFNDDGLI

SEQ ID NO: 635428 - protein, 28 aa, Mycobacterium
APGLSGLGGAGGRGGYLIGSGGNGGAGA

SEQ ID NO: 635429 - protein, 21 aa, Mycobacterium
APGLWCSPGLSNSYLLTTAQG

SEQ ID NO: 635430 - protein, 25 aa, Mycobacterium
APGMIKRNYGRIVTVSSMLGHSANF

SEQ ID NO: 635431 - protein, 17 aa, Mycobacterium
APGNARFSSAELTEVAN

SEQ ID NO: 635432 - protein, 24 aa, Mycobacterium
APGNFALPVPHRFRPDITDELGEL

SEQ ID NO: 635433 - protein, 17 aa, Mycobacterium
APGNIPTPILASSATDE

SEQ ID NO: 635434 - protein, 21 aa, Mycobacterium
APGPAAQLCLERAGMTVADID

SEQ ID NO: 635435 - protein, 23 aa, Mycobacterium
APGPDIDGGIDLTDDEFQAFLEA

SEQ ID NO: 635436 - protein, 25 aa, Mycobacterium
APGPRPRLARPLSWGRAAPADTGSF

SEQ ID NO: 635437 - protein, 18 aa, Mycobacterium
APGPVSFNGNNGGNGGNG

SEQ ID NO: 635438 - protein, 23 aa, Mycobacterium
APGQAGADGGLLFGNGGNGGSGL

SEQ ID NO: 635439 - protein, 25 aa, Mycobacterium
APGQAGGAGGLLIGNGGNGAPGAVG

SEQ ID NO: 635440 - protein, 22 aa, Mycobacterium
APGQAGGDGGLLYGNGGAGGPG

SEQ ID NO: 635441 - protein, 21 aa, Mycobacterium
APGQAGGDGGLLYGNGGNGGT

SEQ ID NO: 635442 - protein, 17 aa, Mycobacterium
APGQLGLHAALTGAPFS

SEQ ID NO: 635443 - protein, 27 aa, Mycobacterium
APGQNGGDGGLLWGNGGAGGVGTAAHP

SEQ ID NO: 635444 - protein, 19 aa, Mycobacterium
APGQPRLVAYYTTTSGTRL

SEQ ID NO: 635445 - protein, 19 aa, Mycobacterium
APGQPRLVAYYTTTTGGGG

SEQ ID NO: 635446 - protein, 17 aa, Mycobacterium
APGQVKRAHYFGEELVL

SEQ ID NO: 635447 - protein, 20 aa, Mycobacterium
APGRAVICPPGMQLELTPDG

SEQ ID NO: 635448 - protein, 18 aa, Mycobacterium
APGREGTSPAALDEIEAL

SEQ ID NO: 635449 - protein, 18 aa, Mycobacterium
APGREWLEIAVTPQDGRG

SEQ ID NO: 635450 - protein, 19 aa, Mycobacterium
APGRIGAMSVRNRVVMSPM

SEQ ID NO: 635451 - protein, 23 aa, Mycobacterium
APGRMTTKWGGFVPDVAGFDAEF

SEQ ID NO: 635452 - protein, 17 aa, Mycobacterium
APGRVGVRMLLHDEGNA

SEQ ID NO: 635453 - protein, 19 aa, Mycobacterium
APGSFSWHVLTSLADDVQT

SEQ ID NO: 635454 - protein, 17 aa, Mycobacterium
APGSLLGGMPLAGPGAA

SEQ ID NO: 635455 - protein, 18 aa, Mycobacterium
APGTNWKSNPNAMRTIAA

SEQ ID NO: 635456 - protein, 18 aa, Mycobacterium
APGTNWKSNPNAMRTIEA

SEQ ID NO: 635457 - protein, 24 aa, Mycobacterium
APGTRLPTVRELAGQVNLAVNTVA

SEQ ID NO: 635458 - protein, 23 aa, Mycobacterium
APGVEIVPLLAFDMTRPLADVVF

SEQ ID NO: 635459 - protein, 20 aa, Mycobacterium
APGVIEWPLAGPEIVTRLSR

SEQ ID NO: 635460 - protein, 25 aa, Mycobacterium
APGVPMVFPPWFENFQIKYINPALK

SEQ ID NO: 635461 - protein, 18 aa, Mycobacterium
APGVRMLIVPGSMRVRAQ

SEQ ID NO: 635462 - protein, 27 aa, Mycobacterium
APGVTWLPRWVSAHLNGQLRAVVVDER

SEQ ID NO: 635463 - protein, 19 aa, Mycobacterium
APGVVAAWLQAGGRLESEE

SEQ ID NO: 635464 - protein, 29 aa, Mycobacterium
APGVVRTRLAEALWKDHEDPLASSIALGR

SEQ ID NO: 635465 - protein, 17 aa, Mycobacterium
APGVWHLVSTVAAQVPA

SEQ ID NO: 635466 - protein, 17 aa, Mycobacterium
APGVWHLVSTVSAQVPV

SEQ ID NO: 635467 - protein, 17 aa, Mycobacterium
APGYKLVDFSGAVVRTI

SEQ ID NO: 635468 - protein, 18 aa, Mycobacterium
APGYMMAKLIIKLINSVA

SEQ ID NO: 635469 - protein, 24 aa, Mycobacterium
APGYSQTVLRCWFAEPPGWLEHRI

SEQ ID NO: 635470 - protein, 18 aa, Mycobacterium
APGYVTVPWDAVEVWMEE

SEQ ID NO: 635471 - protein, 22 aa, Mycobacterium
APHARLLIIAFVPGGRVGVRGI

SEQ ID NO: 635472 - protein, 18 aa, Mycobacterium
APHARLVIEAWRHRTGDL

SEQ ID NO: 635473 - protein, 24 aa, Mycobacterium
APHATTATVTWFLPYFQEVVSGPT

SEQ ID NO: 635474 - protein, 22 aa, Mycobacterium
APHIAMTVAMLRQAGVDVDDSV

SEQ ID NO: 635475 - protein, 19 aa, Mycobacterium
APHLAIAAARRARRTITLA

SEQ ID NO: 635476 - protein, 24 aa, Mycobacterium
APHLRVGLDLPVRVDPTDHSKVLI

SEQ ID NO: 635477 - protein, 21 aa, Mycobacterium
APHLTLWTGLTCTEIVTTAAG

SEQ ID NO: 635478 - protein, 26 aa, Mycobacterium
APHMAEELWLRLGHTTSLAHGPFPHA

SEQ ID NO: 635479 - protein, 25 aa, Mycobacterium
APHNEPFRLRVCTRDQFRVRPDRMI

SEQ ID NO: 635480 - protein, 18 aa, Mycobacterium
APHPAELRQAWLDLHESW

SEQ ID NO: 635481 - protein, 21 aa, Mycobacterium
APHRCLVLIPRVMQRHADRVG

SEQ ID NO: 635482 - protein, 18 aa, Mycobacterium
APHRGRAAIGRFYDTFIA

SEQ ID NO: 635483 - protein, 26 aa, Mycobacterium
APHTGLRPAWIADLHNVFGSATAQSI

SEQ ID NO: 635484 - protein, 21 aa, Mycobacterium
APHVRGAACRRSHSRNPFVVG

SEQ ID NO: 635485 - protein, 25 aa, Mycobacterium
APHVTVKGFSLWGGVNVKRKRRKRR

SEQ ID NO: 635486 - protein, 24 aa, Mycobacterium
APHVWAIGDVASWRDHVGGQVRVE

SEQ ID NO: 635487 - protein, 25 aa, Mycobacterium
APHVWAIGDVASWRDTVGGQVRVEH

SEQ ID NO: 635488 - protein, 17 aa, Mycobacterium
APIALGPLGPEILSYEL

SEQ ID NO: 635489 - protein, 23 aa, Mycobacterium
APIASELILPIALAVQNGIPVSE

SEQ ID NO: 635490 - protein, 24 aa, Mycobacterium
APIASELILPIALAVQNRISVTDL

SEQ ID NO: 635491 - protein, 19 aa, Mycobacterium
APIASELILPIAVAVQNRI

SEQ ID NO: 635492 - protein, 24 aa, Mycobacterium
APIASELILPIAVAVQNRITVNEL

SEQ ID NO: 635493 - protein, 18 aa, Mycobacterium
APICLTWELTYACNLACV

SEQ ID NO: 635494 - protein, 17 aa, Mycobacterium
APIEGRLSGVVDIPNAC

SEQ ID NO: 635495 - protein, 19 aa, Mycobacterium
APIEGWRGGVAHIYGHGNA

SEQ ID NO: 635496 - protein, 27 aa, Mycobacterium
APIERLEELVGIYAELLALLAENGAQW

SEQ ID NO: 635497 - protein, 22 aa, Mycobacterium
APIERLEELVPIYSELLSLLAD

SEQ ID NO: 635498 - protein, 36 aa, Mycobacterium
APIGAPSFKEALRWGAEVYHSLKSVLKNQGLATGLG

SEQ ID NO: 635499 - protein, 17 aa, Mycobacterium
APIGRPIANACLYVVDP

SEQ ID NO: 635500 - protein, 28 aa, Mycobacterium
APIGVPVPRAALFVLDGWLRPVPAGVAG

SEQ ID NO: 635501 - protein, 26 aa, Mycobacterium
APILDLASCKGFSRWYVGDLDLSGPS

SEQ ID NO: 635502 - protein, 18 aa, Mycobacterium
APILHGLCTYGMACKAIT

SEQ ID NO: 635503 - protein, 24 aa, Mycobacterium
APIPEPGQVIALGFNYPTHSDTDS

SEQ ID NO: 635504 - protein, 24 aa, Mycobacterium
APIPGRLFAGPGLAQPSGVSPAAD

SEQ ID NO: 635505 - protein, 25 aa, Mycobacterium
APIPLPLKTSYAWAETDFHRGQPLR

SEQ ID NO: 635506 - protein, 17 aa, Mycobacterium
APIPLRVAAHEGWVALR

SEQ ID NO: 635507 - protein, 18 aa, Mycobacterium
APIPLTFGDVAVVARRSR

SEQ ID NO: 635508 - protein, 21 aa, Mycobacterium
APIRDSWEFALLRGALQRGLP

SEQ ID NO: 635509 - protein, 29 aa, Mycobacterium
APIRQKIEMQRVIPVIKELASHGINISVD

SEQ ID NO: 635510 - protein, 18 aa, Mycobacterium
APIRSGSRGIQWHMVGQI

SEQ ID NO: 635511 - protein, 20 aa, Mycobacterium
APIRVPVAVSRRVLKLHRQH

SEQ ID NO: 635512 - protein, 20 aa, Mycobacterium
APIRYHSLILAAWRGSEPTA

SEQ ID NO: 635513 - protein, 17 aa, Mycobacterium
APISFWPPIELAGLTAG

SEQ ID NO: 635514 - protein, 25 aa, Mycobacterium
APISMFRANLGWMFGNRLLLLHHIG

SEQ ID NO: 635515 - protein, 24 aa, Mycobacterium
APISRLGELVSVYGQLLELLADEG

SEQ ID NO: 635516 - protein, 20 aa, Mycobacterium
APISWGVCEVPGWGHQLDRQ

SEQ ID NO: 635517 - protein, 26 aa, Mycobacterium
APITLIPNWACRAFLFTQVRDRELRK

SEQ ID NO: 635518 - protein, 17 aa, Mycobacterium
APIVRWAVAPKVRGGMQ

SEQ ID NO: 635519 - protein, 18 aa, Mycobacterium
APIWEGEDGVIAWMLAGP

SEQ ID NO: 635520 - protein, 17 aa, Mycobacterium
APKDRDIAMVFQSYALY

SEQ ID NO: 635521 - protein, 18 aa, Mycobacterium
APKHPVWYHNVVKNPRVE

SEQ ID NO: 635522 - protein, 23 aa, Mycobacterium
APKIDRATTVFVIVPRNLEAVTQ

SEQ ID NO: 635523 - protein, 20 aa, Mycobacterium
APKLKLALTAGIGSDHVDLD

SEQ ID NO: 635524 - protein, 19 aa, Mycobacterium
APKLLCDGGSLLLVHSALA

SEQ ID NO: 635525 - protein, 19 aa, Mycobacterium
APKLPGTPFASAVGADPGK

SEQ ID NO: 635526 - protein, 20 aa, Mycobacterium
APKPAPRRKPMQMPGLQDVA

SEQ ID NO: 635527 - protein, 30 aa, Mycobacterium
APKPKLHPNIRTFREWSPRIAGDKSVLDAL

SEQ ID NO: 635528 - protein, 19 aa, Mycobacterium
APKRMAGGESFTFHLPAYH

SEQ ID NO: 635529 - protein, 23 aa, Mycobacterium
APKRMAGGESFTFHLPAYHRDDV

SEQ ID NO: 635530 - protein, 17 aa, Mycobacterium
APKTYVAPIAFNVVPLA

SEQ ID NO: 635531 - protein, 19 aa, Mycobacterium
APKVRNCATHTLTDLVPLI

SEQ ID NO: 635532 - protein, 25 aa, Mycobacterium
APLADLRGGAVWDAAAIRKFSSDWK

SEQ ID NO: 635533 - protein, 17 aa, Mycobacterium
APLAEVLEFLGVPPSAR

SEQ ID NO: 635534 - protein, 25 aa, Mycobacterium
APLAHCALALMGEGEVRDASGTLRP

SEQ ID NO: 635535 - protein, 19 aa, Mycobacterium
APLAHLGFFVLDEWLHPVP

SEQ ID NO: 635536 - protein, 24 aa, Mycobacterium
APLAHPGLVCDVAIGQSTLVTQRV

SEQ ID NO: 635537 - protein, 21 aa, Mycobacterium
APLALNWLKNRFRGTGTSNAQ

SEQ ID NO: 635538 - protein, 24 aa, Mycobacterium
APLARCLPAGALAVGFDISEPMLT

SEQ ID NO: 635539 - protein, 25 aa, Mycobacterium
APLARLEAAVALTALTSRFPGAQLA

SEQ ID NO: 635540 - protein, 19 aa, Mycobacterium
APLARRGYETVAIDNLGYG

SEQ ID NO: 635541 - protein, 20 aa, Mycobacterium
APLARYGHMSVLSKLADIAT

SEQ ID NO: 635542 - protein, 25 aa, Mycobacterium
APLATRYAERLKIVMRVYFEKPRTT

SEQ ID NO: 635543 - protein, 19 aa, Mycobacterium
APLDARWGSRLSHGAGLAG

SEQ ID NO: 635544 - protein, 24 aa, Mycobacterium
APLDATVCAASWRSAGDDTALTGL

SEQ ID NO: 635545 - protein, 19 aa, Mycobacterium
APLDDWVWTLGINLWGSIH

SEQ ID NO: 635546 - protein, 17 aa, Mycobacterium
APLDGGADWVPRAWRDM

SEQ ID NO: 635547 - protein, 21 aa, Mycobacterium
APLDMLSPIAWITDKLRRSDL

SEQ ID NO: 635548 - protein, 17 aa, Mycobacterium
APLDRRLLLGMLAELPA

SEQ ID NO: 635549 - protein, 21 aa, Mycobacterium
APLDRRLLLGMLAQLPPGAGV

SEQ ID NO: 635550 - protein, 17 aa, Mycobacterium
APLDRRLLLGMLSGLPP

SEQ ID NO: 635551 - protein, 19 aa, Mycobacterium
APLEGARLGQHERIGLHGS

SEQ ID NO: 635552 - protein, 21 aa, Mycobacterium
APLEGPGMWALESAMNELADE

SEQ ID NO: 635553 - protein, 24 aa, Mycobacterium
APLEPAAILGMVRLIISAGHETTV

SEQ ID NO: 635554 - protein, 19 aa, Mycobacterium
APLFDFLSLHGRPPRTGEL

SEQ ID NO: 635555 - protein, 30 aa, Mycobacterium
APLFHTRYEPLWALCAELDLTVVQHAGAGS

SEQ ID NO: 635556 - protein, 20 aa, Mycobacterium
APLFPLVVVVHADMEVRLRR

SEQ ID NO: 635557 - protein, 18 aa, Mycobacterium
APLFPLVVVVHADVEVRV

SEQ ID NO: 635558 - protein, 26 aa, Mycobacterium
APLFRKRPASFQGVLTNLGWSVDDDI

SEQ ID NO: 635559 - protein, 23 aa, Mycobacterium
APLGAALRIAFRALTLAGVHDVA

SEQ ID NO: 635560 - protein, 19 aa, Mycobacterium
APLGGRVFDAEWLAAAADR

SEQ ID NO: 635561 - protein, 25 aa, Mycobacterium
APLHDLRTLVGPGWVATDPPVAALS

SEQ ID NO: 635562 - protein, 21 aa, Mycobacterium
APLHILHALPTLGRNLTESAG

SEQ ID NO: 635563 - protein, 17 aa, Mycobacterium
APLHLITHLSRAGWLRW

SEQ ID NO: 635564 - protein, 27 aa, Mycobacterium
APLHLLRLATMLPLAPLVPFVHDGVIS

SEQ ID NO: 635565 - protein, 25 aa, Mycobacterium
APLHPRSSPTIATGIDFWLREDTEL

SEQ ID NO: 635566 - protein, 17 aa, Mycobacterium
APLISFDEAFGLVKVNP

SEQ ID NO: 635567 - protein, 17 aa, Mycobacterium
APLISFDEAFKLVKVNP

SEQ ID NO: 635568 - protein, 17 aa, Mycobacterium
APLKQIAFNGGLEPGVV

SEQ ID NO: 635569 - protein, 17 aa, Mycobacterium
APLKQIAFNSGLEPGVV

SEQ ID NO: 635570 - protein, 17 aa, Mycobacterium
APLLAAVDSIRVVHMLS

SEQ ID NO: 635571 - protein, 17 aa, Mycobacterium
APLLCAGITLYSPLRHW

SEQ ID NO: 635572 - protein, 17 aa, Mycobacterium
APLLDFYSADLKTVDAV

SEQ ID NO: 635573 - protein, 18 aa, Mycobacterium
APLLKLGGSPLRLSASLL

SEQ ID NO: 635574 - protein, 18 aa, Mycobacterium
APLLPGQCRALARRVPLG

SEQ ID NO: 635575 - protein, 24 aa, Mycobacterium
APLLPVRSLVAICGGGEIQRNEHM

SEQ ID NO: 635576 - protein, 22 aa, Mycobacterium
APLLQAATAWERLANGLNATAA

SEQ ID NO: 635577 - protein, 18 aa, Mycobacterium
APLLRAAGIEELVGVAVG

SEQ ID NO: 635578 - protein, 28 aa, Mycobacterium
APLLVQLYLHFKIVWPAFGKQFVIRARK

SEQ ID NO: 635579 - protein, 20 aa, Mycobacterium
APLLWAERLVSTWLADVGCG

SEQ ID NO: 635580 - protein, 25 aa, Mycobacterium
APLLYPHMWSWDAAFVAIGLAPLSV

SEQ ID NO: 635581 - protein, 17 aa, Mycobacterium
APLNIGAMVAVKDRLNG

SEQ ID NO: 635582 - protein, 23 aa, Mycobacterium
APLPAERSLAVLIVIGNGHDPVQ

SEQ ID NO: 635583 - protein, 22 aa, Mycobacterium
APLPALCDRLERHLYQLPRPDR

SEQ ID NO: 635584 - protein, 20 aa, Mycobacterium
APLPDRPSTSFAGGRLSGTK

SEQ ID NO: 635585 - protein, 17 aa, Mycobacterium
APLPFPVLHVDTGHNFP

SEQ ID NO: 635586 - protein, 27 aa, Mycobacterium
APLPGGYPIELGMTIRLARDKNYDLLL

SEQ ID NO: 635587 - protein, 18 aa, Mycobacterium
APLPPGYAVGHEGVAEVV

SEQ ID NO: 635588 - protein, 17 aa, Mycobacterium
APLPRYSGGTSPRALAM

SEQ ID NO: 635589 - protein, 17 aa, Mycobacterium
APLPVAGAWSHSHSLVF

SEQ ID NO: 635590 - protein, 20 aa, Mycobacterium
APLPVYEVVTAVLGAIRREM

SEQ ID NO: 635591 - protein, 24 aa, Mycobacterium
APLQGLSRRFWFAHLRSDPDDVAI

SEQ ID NO: 635592 - protein, 25 aa, Mycobacterium
APLQGLSRRFWFGHLSDPVEELRRA

SEQ ID NO: 635593 - protein, 21 aa, Mycobacterium
APLRGHFKVGVMGKGGVGKTT

SEQ ID NO: 635594 - protein, 22 aa, Mycobacterium
APLRHIPILIGGAGERRTMPLV

SEQ ID NO: 635595 - protein, 28 aa, Mycobacterium
APLRPDKYLRIVAAMARENMSVTSGFAS

SEQ ID NO: 635596 - protein, 18 aa, Mycobacterium
APLRPGKGPIALRVHLGI

SEQ ID NO: 635597 - protein, 19 aa, Mycobacterium
APLRPGKGPIALRVHLGTP

SEQ ID NO: 635598 - protein, 17 aa, Mycobacterium
APLRRGGIDPCYRVDAA

SEQ ID NO: 635599 - protein, 17 aa, Mycobacterium
APLRRKAAGDGRQRGGH

SEQ ID NO: 635600 - protein, 19 aa, Mycobacterium
APLRRPGTRVGELSAAAAD

SEQ ID NO: 635601 - protein, 18 aa, Mycobacterium
APLRRRGDARARAAALAT

SEQ ID NO: 635602 - protein, 29 aa, Mycobacterium
APLSCLNEARFGIVFGALGAARDSLETTI

SEQ ID NO: 635603 - protein, 20 aa, Mycobacterium
APLTALACQALLTRAAADVG

SEQ ID NO: 635604 - protein, 27 aa, Mycobacterium
APLTMKPDVCWQLPIRRSQEWVTRPDG

SEQ ID NO: 635605 - protein, 28 aa, Mycobacterium
APLTMKPDVCWQLPIRRSQEWVTRPDGS

SEQ ID NO: 635606 - protein, 28 aa, Mycobacterium
APLTMKPDVCWQLPIRRSQEWVTRPDGT

SEQ ID NO: 635607 - protein, 17 aa, Mycobacterium
APLVLGKPVSHPETIAT

SEQ ID NO: 635608 - protein, 18 aa, Mycobacterium
APLVRHGANLHGRYLLPH

SEQ ID NO: 635609 - protein, 28 aa, Mycobacterium
APLVRSAMTAIEWLFWRSTMKVDNAQRQ

SEQ ID NO: 635610 - protein, 27 aa, Mycobacterium
APLVRSGMAALDWVQWRVTKRAEDAQR

SEQ ID NO: 635611 - protein, 36 aa, Mycobacterium
APLWKGSRFPMEICISGWAMLNREAAIIPDIYLDGR

SEQ ID NO: 635612 - protein, 19 aa, Mycobacterium
APLWPSRRNGGGHRAVGQR

SEQ ID NO: 635613 - protein, 38 aa, Mycobacterium
APLYRAAARNELALPFCAACALPLELDQEVCDQCGNAE

SEQ ID NO: 635614 - protein, 23 aa, Mycobacterium
APMAKRLADWPGGLTVFDVRAEA

SEQ ID NO: 635615 - protein, 17 aa, Mycobacterium
APMAPVLSAREREVLHR

SEQ ID NO: 635616 - protein, 18 aa, Mycobacterium
APMARLETQIALTALVRR

SEQ ID NO: 635617 - protein, 19 aa, Mycobacterium
APMDAWGAAGTTLLRYEPL

SEQ ID NO: 635618 - protein, 20 aa, Mycobacterium
APMGMMPMPMGMGGAGAGMP

SEQ ID NO: 635619 - protein, 17 aa, Mycobacterium
APMIAQMAKAHALAEQQ

SEQ ID NO: 635620 - protein, 20 aa, Mycobacterium
APMKHLGIVVGVDGSAASYA

SEQ ID NO: 635621 - protein, 19 aa, Mycobacterium
APMKVRRFAKDKARENALA

SEQ ID NO: 635622 - protein, 18 aa, Mycobacterium
APMLAGAFAVAWEWDNNR

SEQ ID NO: 635623 - protein, 25 aa, Mycobacterium
APMLITRAFLKPMREQGGGRIIQIS

SEQ ID NO: 635624 - protein, 19 aa, Mycobacterium
APMLWHRFDDLAGNVRDGV

SEQ ID NO: 635625 - protein, 18 aa, Mycobacterium
APMPPDIADHVAAVALLG

SEQ ID NO: 635626 - protein, 19 aa, Mycobacterium
APMRPDRYLKMAAAMRREG

SEQ ID NO: 635627 - protein, 18 aa, Mycobacterium
APMSCIGVGPGRDQTIVR

SEQ ID NO: 635628 - protein, 18 aa, Mycobacterium
APMSFALEPGGIHDWVLL

SEQ ID NO: 635629 - protein, 18 aa, Mycobacterium
APMVFHSFGRDPVAGSPG

SEQ ID NO: 635630 - protein, 17 aa, Mycobacterium
APMVISYLAKKDHDEKR

SEQ ID NO: 635631 - protein, 19 aa, Mycobacterium
APMVIWLRGAAQVAHTRAA

SEQ ID NO: 635632 - protein, 19 aa, Mycobacterium
APMYRAFRPDLPNPKRADA

SEQ ID NO: 635633 - protein, 18 aa, Mycobacterium
APNALLLKLTGGCNIACT

SEQ ID NO: 635634 - protein, 25 aa, Mycobacterium
APNALRYARRARTGFYQAATPQQGF

SEQ ID NO: 635635 - protein, 22 aa, Mycobacterium
APNARPPVCKIMDYGKYKYEAA

SEQ ID NO: 635636 - protein, 18 aa, Mycobacterium
APNAWRLPFEREWRHARP

SEQ ID NO: 635637 - protein, 18 aa, Mycobacterium
APNCAEWIMTQFAAAKVG

SEQ ID NO: 635638 - protein, 18 aa, Mycobacterium
APNFAFGLIADRLAETPD

SEQ ID NO: 635639 - protein, 28 aa, Mycobacterium
APNFAIGAVLSMKFAQQAARFFESVEII

SEQ ID NO: 635640 - protein, 19 aa, Mycobacterium
APNFAYALLAKRLRRNAKP

SEQ ID NO: 635641 - protein, 26 aa, Mycobacterium
APNKHHFAYDLSRFGLENNNEVFHAD

SEQ ID NO: 635642 - protein, 18 aa, Mycobacterium
APNLARFVELAGGHCAIL

SEQ ID NO: 635643 - protein, 25 aa, Mycobacterium
APNLERGTIDWSRAGAAYAEGLVAH

SEQ ID NO: 635644 - protein, 25 aa, Mycobacterium
APNLVIRIAPPVGRHLDWMVCRTVA

SEQ ID NO: 635645 - protein, 25 aa, Mycobacterium
APNLWPQPCIDLYEAVCAGDLEKAQ

SEQ ID NO: 635646 - protein, 33 aa, Mycobacterium
APNNPDGGLLARFPGFYIPFLDVSFNGATPAAN

SEQ ID NO: 635647 - protein, 17 aa, Mycobacterium
APNNRFIAPTTFPGIHT

SEQ ID NO: 635648 - protein, 29 aa, Mycobacterium
APNPLYWRGARLVGNYPLSIALDGQAMNI

SEQ ID NO: 635649 - protein, 21 aa, Mycobacterium
APNPRFLQRMTLVLNQIQRRG

SEQ ID NO: 635650 - protein, 18 aa, Mycobacterium
APNQAMKSVHRILRNFKM

SEQ ID NO: 635651 - protein, 19 aa, Mycobacterium
APNQAMRSVHRILRNFKMP

SEQ ID NO: 635652 - protein, 18 aa, Mycobacterium
APNSVLLVNHGLHIEILI

SEQ ID NO: 635653 - protein, 18 aa, Mycobacterium
APNTLLIPGTRSIAHLEE

SEQ ID NO: 635654 - protein, 24 aa, Mycobacterium
APNVWALGDVASWRDATGHQARVE

SEQ ID NO: 635655 - protein, 24 aa, Mycobacterium
APNVWALGDVASWRDATGHQGRVE

SEQ ID NO: 635656 - protein, 24 aa, Mycobacterium
APNVWALGDVASWRDPMGHQVRVE

SEQ ID NO: 635657 - protein, 24 aa, Mycobacterium
APNVWALGDVASWRDQMGHQVRVE

SEQ ID NO: 635658 - protein, 20 aa, Mycobacterium
APPACGGQLPVGLRGLVANV

SEQ ID NO: 635659 - protein, 20 aa, Mycobacterium
APPAIWGKGHDVLWAEDESL

SEQ ID NO: 635660 - protein, 22 aa, Mycobacterium
APPAPRLAPRRVTRQLMVGNVG

SEQ ID NO: 635661 - protein, 25 aa, Mycobacterium
APPARAGSCRRCFVTLPTSAAGPLC

SEQ ID NO: 635662 - protein, 20 aa, Mycobacterium
APPARARMWWRPEGQVPDDP

SEQ ID NO: 635663 - protein, 19 aa, Mycobacterium
APPARLRLVNGLRDAISHG

SEQ ID NO: 635664 - protein, 24 aa, Mycobacterium
APPARPRLQNHFREFVMLESEAEA

SEQ ID NO: 635665 - protein, 28 aa, Mycobacterium
APPARVPRPGFCAICRTLSERLPAVRTS

SEQ ID NO: 635666 - protein, 19 aa, Mycobacterium
APPASRYEPVWKPETETTT

SEQ ID NO: 635667 - protein, 22 aa, Mycobacterium
APPDKLLRCIEAVLECREALAV

SEQ ID NO: 635668 - protein, 17 aa, Mycobacterium
APPDLWQAVVLVDVTPR

SEQ ID NO: 635669 - protein, 23 aa, Mycobacterium
APPDPFGSWAQRCRVDPAKTFPV

SEQ ID NO: 635670 - protein, 22 aa, Mycobacterium
APPDRLLRCIEAVLECREALAI

SEQ ID NO: 635671 - protein, 17 aa, Mycobacterium
APPEFIVLAGRVEVGTI

SEQ ID NO: 635672 - protein, 23 aa, Mycobacterium
APPEHRWKFRYLIVRDHTHRVVA

SEQ ID NO: 635673 - protein, 17 aa, Mycobacterium
APPEIALAWAVHDIGIW

SEQ ID NO: 635674 - protein, 22 aa, Mycobacterium
APPEIGAAISVLGGGSLLPGLF

SEQ ID NO: 635675 - protein, 21 aa, Mycobacterium
APPEIWRDYVRTVGRTPNGVW

SEQ ID NO: 635676 - protein, 17 aa, Mycobacterium
APPELAEFIAAMEAAPE

SEQ ID NO: 635677 - protein, 18 aa, Mycobacterium
APPERVWESLTSDESLAA

SEQ ID NO: 635678 - protein, 27 aa, Mycobacterium
APPEVAALRFFWPRLTPGAFVLLDDYA

SEQ ID NO: 635679 - protein, 20 aa, Mycobacterium
APPEVAALRYFWPRLTPGAF

SEQ ID NO: 635680 - protein, 19 aa, Mycobacterium
APPEVLAYAPIRGLVSMIN

SEQ ID NO: 635681 - protein, 17 aa, Mycobacterium
APPFFVLHGEKDELVPS

SEQ ID NO: 635682 - protein, 24 aa, Mycobacterium
APPFRDCFEPFASIYDAWKVESLR

SEQ ID NO: 635683 - protein, 19 aa, Mycobacterium
APPGIPVDIGPGATVAHLC

SEQ ID NO: 635684 - protein, 18 aa, Mycobacterium
APPGIPVDIGPGATVAHM

SEQ ID NO: 635685 - protein, 27 aa, Mycobacterium
APPGKHAASAFAMWFPIEGEQDSHEYG

SEQ ID NO: 635686 - protein, 18 aa, Mycobacterium
APPGLAINPLVNRYKTKD

SEQ ID NO: 635687 - protein, 19 aa, Mycobacterium
APPGLGRFVDAMRRLQDLT

SEQ ID NO: 635688 - protein, 17 aa, Mycobacterium
APPGVTAVHVFRVPIDE

SEQ ID NO: 635689 - protein, 30 aa, Mycobacterium
APPHAMTGTLVWFLPPFVDDISGPPVSGIL

SEQ ID NO: 635690 - protein, 24 aa, Mycobacterium
APPHGGIAFGWDRINALLSGVDSI

SEQ ID NO: 635691 - protein, 31 aa, Mycobacterium; identical to SEQ ID NO: 78072

SEQ ID NO: 635692 - protein, 25 aa, Mycobacterium
APPHGGIAFGWDRITALLAGADSIR

SEQ ID NO: 635693 - protein, 27 aa, Mycobacterium
APPHGGIAFGWDRIVALLAGLDSIREV

SEQ ID NO: 635694 - protein, 24 aa, Mycobacterium
APPHGGIAFGWDRVSTLLAGADSI

SEQ ID NO: 635695 - protein, 17 aa, Mycobacterium
APPLFSLWTPENGRTGY

SEQ ID NO: 635696 - protein, 26 aa, Mycobacterium
APPLLALPAEEAWRLAAGGGGTLEDL

SEQ ID NO: 635697 - protein, 28 aa, Mycobacterium
APPLPPWPPAPPIPERPPPPPIPPAPPS

SEQ ID NO: 635698 - protein, 19 aa, Mycobacterium
APPLSCPITALGGVGDVTF

SEQ ID NO: 635699 - protein, 19 aa, Mycobacterium
APPMPVARGLGMGFDPPVI

SEQ ID NO: 635700 - protein, 26 aa, Mycobacterium
APPPDCAHDARWIYYSSGTTAAPKGI

SEQ ID NO: 635701 - protein, 24 aa, Mycobacterium
APPPETLRSLGLPAMSPTIGGHEG

SEQ ID NO: 635702 - protein, 19 aa, Mycobacterium
APPPLAWGVNEMIICANPS

SEQ ID NO: 635703 - protein, 21 aa, Mycobacterium
APPPQRFEAGVPMTSQVVGLG

SEQ ID NO: 635704 - protein, 22 aa, Mycobacterium
APPPREMDMLLTAGERISNALV

SEQ ID NO: 635705 - protein, 22 aa, Mycobacterium
APPPRRKPRRPARAVTGGIRTP

SEQ ID NO: 635706 - protein, 22 aa, Mycobacterium
APPPWIDIFIARNFHYLTELHC

SEQ ID NO: 635707 - protein, 17 aa, Mycobacterium
APPPWVAPGEWWALIRV

SEQ ID NO: 635708 - protein, 26 aa, Mycobacterium
APPQRKPWVGDFWDMFGAGHMLELLN

SEQ ID NO: 635709 - protein, 23 aa, Mycobacterium
APPRAVPRAHRFPTAPVSADAVL

SEQ ID NO: 635710 - protein, 21 aa, Mycobacterium
APPRIGEFNLPAPLAAVSDLL

SEQ ID NO: 635711 - protein, 25 aa, Mycobacterium
APPRLRGAITAMLSGVVVVNDLAEA

SEQ ID NO: 635712 - protein, 22 aa, Mycobacterium
APPRPSVGYLVFGIGRHGSEAL

SEQ ID NO: 635713 - protein, 20 aa, Mycobacterium
APPRPSVGYLVYGIGEHAND

SEQ ID NO: 635714 - protein, 22 aa, Mycobacterium
APPRRRLLELSERLRTFTRPVL

SEQ ID NO: 635715 - protein, 18 aa, Mycobacterium
APPRSVPRAVRFPTGPVS

SEQ ID NO: 635716 - protein, 41 aa, Mycobacterium
APPRVPPSPVTWGWMLQLYALRSAHSWGIGDLGDLRAFVDW

SEQ ID NO: 635717 - protein, 26 aa, Mycobacterium
APPTAPRPGAMPPWDSTPVTGIPRVD

SEQ ID NO: 635718 - protein, 19 aa, Mycobacterium
APPTELEWREWELELLEAG

SEQ ID NO: 635719 - protein, 18 aa, Mycobacterium
APPTGGMFVGLLAGEPVT

SEQ ID NO: 635720 - protein, 20 aa, Mycobacterium
APPTVWRMLIQADLGARPEG

SEQ ID NO: 635721 - protein, 20 aa, Mycobacterium
APPTVWRMLIQSDLGERPEG

SEQ ID NO: 635722 - protein, 17 aa, Mycobacterium
APPVMQLCHHLHGGMGM

SEQ ID NO: 635723 - protein, 20 aa, Mycobacterium
APPYPPSILLTGIIVNKLGQ

SEQ ID NO: 635724 - protein, 20 aa, Mycobacterium
APPYPPSILLTGVIVNKLGQ

SEQ ID NO: 635725 - protein, 27 aa, Mycobacterium
APQCPESAEALALLFAEAGLPAGAYLN

SEQ ID NO: 635726 - protein, 21 aa, Mycobacterium
APQEGCIGCVGTLEKVADIDD

SEQ ID NO: 635727 - protein, 18 aa, Mycobacterium
APQGIDYVVGFFAAIEAG

SEQ ID NO: 635728 - protein, 18 aa, Mycobacterium
APQGLDYVIGFFAAIKAG

SEQ ID NO: 635729 - protein, 21 aa, Mycobacterium
APQGLGGWFRLGRIADQHTAW

SEQ ID NO: 635730 - protein, 18 aa, Mycobacterium
APQGLTFMASIVVPRAHS

SEQ ID NO: 635731 - protein, 20 aa, Mycobacterium
APQGRLEEGTLIPLASAGAY

SEQ ID NO: 635732 - protein, 23 aa, Mycobacterium
APQHREFVQAATITDLPGELMTA

SEQ ID NO: 635733 - protein, 24 aa, Mycobacterium
APQIAAFDIGWSLFTGDPATIVNA

SEQ ID NO: 635734 - protein, 18 aa, Mycobacterium
APQISFFFYTHGDFFEEI

SEQ ID NO: 635735 - protein, 20 aa, Mycobacterium
APQLALPLRRTRHHRLRPRR

SEQ ID NO: 635736 - protein, 18 aa, Mycobacterium
APQLPGRGWVEYEPYGTV

SEQ ID NO: 635737 - protein, 18 aa, Mycobacterium
APQLPGRGWVQYEPYGTV

SEQ ID NO: 635738 - protein, 22 aa, Mycobacterium
APQLRSGGLGVREVKRLAKATG

SEQ ID NO: 635739 - protein, 26 aa, Mycobacterium
APQLVGGCRPVSLTALLGDDWQIHQH

SEQ ID NO: 635740 - protein, 18 aa, Mycobacterium
APQMWGWASRQGVHHRTA

SEQ ID NO: 635741 - protein, 27 aa, Mycobacterium
APQPGQCLRTFLRDHGHFEVKKGCDAG

SEQ ID NO: 635742 - protein, 21 aa, Mycobacterium
APQPHEPWVAPVAPKAPWIPQ

SEQ ID NO: 635743 - protein, 19 aa, Mycobacterium
APQRLAECGAREVIVTNTL

SEQ ID NO: 635744 - protein, 25 aa, Mycobacterium
APQRPRKHVASALSEREREELEKLR

SEQ ID NO: 635745 - protein, 21 aa, Mycobacterium
APRARTAMTADVFGDAPEDSI

SEQ ID NO: 635746 - protein, 23 aa, Mycobacterium
APRARTAMTAGVFGDAPELADGA

SEQ ID NO: 635747 - protein, 23 aa, Mycobacterium
APRARTAMTAGVFGDAPELAEGQ

SEQ ID NO: 635748 - protein, 20 aa, Mycobacterium
APRAWCEKAYNVTHFTMMPR

SEQ ID NO: 635749 - protein, 17 aa, Mycobacterium
APRCGQCPLAECAWRRA

SEQ ID NO: 635750 - protein, 34 aa, Mycobacterium
APREDWPLFADWTEEVFKAFNFQPELTFDEAQIM

SEQ ID NO: 635751 - protein, 20 aa, Mycobacterium
APREFDRPAPARLGAMRGST

SEQ ID NO: 635752 - protein, 17 aa, Mycobacterium
APRERFSTLKARLGDAF

SEQ ID NO: 635753 - protein, 28 aa, Mycobacterium
APRFRDAYRTALDCLHRRGARATLRALI

SEQ ID NO: 635754 - protein, 20 aa, Mycobacterium
APRGAPFRLRVVRRPTVGYD

SEQ ID NO: 635755 - protein, 19 aa, Mycobacterium
APRGFIRDLYEAVSQLAFL

SEQ ID NO: 635756 - protein, 18 aa, Mycobacterium
APRGHGMRDIVATIQAEQ

SEQ ID NO: 635757 - protein, 27 aa, Mycobacterium
APRGHRPGRGFSIGRWHSRVSGYPEVL

SEQ ID NO: 635758 - protein, 18 aa, Mycobacterium
APRGLLYHRYEIGHDGLV

SEQ ID NO: 635759 - protein, 22 aa, Mycobacterium
APRGSAPAQRWLVNGGPATVGI

SEQ ID NO: 635760 - protein, 21 aa, Mycobacterium
APRHPGYRLHPSMLDAALQSL

SEQ ID NO: 635761 - protein, 20 aa, Mycobacterium
APRHRRWVSPAARRLAQSLH

SEQ ID NO: 635762 - protein, 26 aa, Mycobacterium
APRIGAPRWDTAIIGLDCDTTILDDR

SEQ ID NO: 635763 - protein, 27 aa, Mycobacterium
APRIGRPRWDTAIVGLDCETAVLDQRL

SEQ ID NO: 635764 - protein, 20 aa, Mycobacterium
APRILRPGPVSAERIADVLG

SEQ ID NO: 635765 - protein, 25 aa, Mycobacterium
APRIMPRIQALAVRDGLVVAIYDVA

SEQ ID NO: 635766 - protein, 21 aa, Mycobacterium
APRISVAYFFNPRLDARIPVL

SEQ ID NO: 635767 - protein, 22 aa, Mycobacterium
APRKLIPLRALDVVSPRLLNGV

SEQ ID NO: 635768 - protein, 23 aa, Mycobacterium
APRLDYADIVALFATHLGGTAQE

SEQ ID NO: 635769 - protein, 20 aa, Mycobacterium
APRLEFRTIHGYQRAYRIAG

SEQ ID NO: 635770 - protein, 19 aa, Mycobacterium
APRLELMDELGIDQCVMYP

SEQ ID NO: 635771 - protein, 19 aa, Mycobacterium
APRLLAQGTPAWGTLLGED

SEQ ID NO: 635772 - protein, 20 aa, Mycobacterium
APRLLAVVVDDVQWADTTSA

SEQ ID NO: 635773 - protein, 28 aa, Mycobacterium
APRLLLEVMCARLLLPSAADTESALLQR

SEQ ID NO: 635774 - protein, 18 aa, Mycobacterium
APRLPIRTMAIICGGGEI

SEQ ID NO: 635775 - protein, 21 aa, Mycobacterium
APRLTPPPLRIAGTPKHNLMP

SEQ ID NO: 635776 - protein, 22 aa, Mycobacterium
APRPPELLPPGAIHVDRTTVWI

SEQ ID NO: 635777 - protein, 22 aa, Mycobacterium
APRPRIDLEVGSWYVSTFPRSG

SEQ ID NO: 635778 - protein, 19 aa, Mycobacterium
APRRAVSGIDHARAAMISA

SEQ ID NO: 635779 - protein, 23 aa, Mycobacterium
APRRLDVLDGPGLGGPALVLPLR

SEQ ID NO: 635780 - protein, 19 aa, Mycobacterium
APRRLRGLSGDAARDMALG

SEQ ID NO: 635781 - protein, 19 aa, Mycobacterium
APRRVGRAALYDDYHLSQL

SEQ ID NO: 635782 - protein, 19 aa, Mycobacterium
APRRWQAPRRTVLVGTSTA

SEQ ID NO: 635783 - protein, 27 aa, Mycobacterium
APRSFKEAHLRLVLRSGRTDVEQIRAM

SEQ ID NO: 635784 - protein, 19 aa, Mycobacterium
APRSIEVGYCLGRQWWDMG

SEQ ID NO: 635785 - protein, 19 aa, Mycobacterium
APRSNVWSFSTVRGVLERE

SEQ ID NO: 635786 - protein, 25 aa, Mycobacterium
APRSRPCVATALTLYSEILDRIEDD

SEQ ID NO: 635787 - protein, 18 aa, Mycobacterium
APRSVDFVDELPRTATGK

SEQ ID NO: 635788 - protein, 18 aa, Mycobacterium
APRSVPLADVHRAAATVR

SEQ ID NO: 635789 - protein, 25 aa, Mycobacterium
APRVLRVGWCTVVRSAGDSAERLAA

SEQ ID NO: 635790 - protein, 23 aa, Mycobacterium
APRVRRPIRRGGIGVLTVSGNDA

SEQ ID NO: 635791 - protein, 23 aa, Mycobacterium
APRVTVNCGIFGWTPTVQLTTYL

SEQ ID NO: 635792 - protein, 17 aa, Mycobacterium
APRVVKMTVDGQIRSEL

SEQ ID NO: 635793 - protein, 20 aa, Mycobacterium
APRWEQWCVNVAAAWLMSGE

SEQ ID NO: 635794 - protein, 20 aa, Mycobacterium
APRWKGCERYDAAAEYQVVR

SEQ ID NO: 635795 - protein, 28 aa, Mycobacterium
APRYPVAEVREALTLPPHIPVITVDARD

SEQ ID NO: 635796 - protein, 17 aa, Mycobacterium
APSAAKLFCTEMAGNVA

SEQ ID NO: 635797 - protein, 25 aa, Mycobacterium
APSAGWRKWVYRASGRLINPGESPK

SEQ ID NO: 635798 - protein, 25 aa, Mycobacterium
APSANARWGNNIAILAGDYLFATAS

SEQ ID NO: 635799 - protein, 26 aa, Mycobacterium
APSAPMWTSRAGWLDGLSRWVHSPAF

SEQ ID NO: 635800 - protein, 23 aa, Mycobacterium
APSAQLLAKWNRREGALIATDPD

SEQ ID NO: 635801 - protein, 26 aa, Mycobacterium
APSAQRWRTIPSWEFHRANVDPRRAQ

SEQ ID NO: 635802 - protein, 19 aa, Mycobacterium
APSCDAVLVGEHQNRPDFP

SEQ ID NO: 635803 - protein, 17 aa, Mycobacterium
APSDEWAPAVEAARAQR

SEQ ID NO: 635804 - protein, 22 aa, Mycobacterium
APSDKRVALVFSAYPTKHARIG

SEQ ID NO: 635805 - protein, 23 aa, Mycobacterium
APSDLPARLSLFGHTRLSRTDSE

SEQ ID NO: 635806 - protein, 24 aa, Mycobacterium
APSDLPPRISLFGHTRLPVTDIEL

SEQ ID NO: 635807 - protein, 23 aa, Mycobacterium
APSDVAAVCSFLCSDAAGYVTGQ

SEQ ID NO: 635808 - protein, 17 aa, Mycobacterium
APSELWQAVVLVDITPR

SEQ ID NO: 635809 - protein, 19 aa, Mycobacterium
APSEPYRMRVIVHEDDNGH

SEQ ID NO: 635810 - protein, 19 aa, Mycobacterium
APSERSAGFLAHLTGTLDM

SEQ ID NO: 635811 - protein, 19 aa, Mycobacterium
APSHIASGLGAMFPGLMCH

SEQ ID NO: 635812 - protein, 26 aa, Mycobacterium
APSHSALLGRWVALRAAAERVGDDVV

SEQ ID NO: 635813 - protein, 19 aa, Mycobacterium
APSLAHKGIGYGMGSEQVD

SEQ ID NO: 635814 - protein, 22 aa, Mycobacterium
APSLCLPEAAAASVFAAARQRG

SEQ ID NO: 635815 - protein, 19 aa, Mycobacterium
APSLGGPVAPCHHTAYDPD

SEQ ID NO: 635816 - protein, 27 aa, Mycobacterium
APSLHAGHLIPLLTLRRFQQAGHRPIV

SEQ ID NO: 635817 - protein, 24 aa, Mycobacterium
APSLHRPPPLFALVNFFDAQASPL

SEQ ID NO: 635818 - protein, 20 aa, Mycobacterium
APSLRRKAILMAKVQDEAGH

SEQ ID NO: 635819 - protein, 17 aa, Mycobacterium
APSNRVAVATTFALYEL

SEQ ID NO: 635820 - protein, 24 aa, Mycobacterium
APSPAAWALLAFARREFERAFTPG

SEQ ID NO: 635821 - protein, 26 aa, Mycobacterium
APSPDRATGQFLWQNIFGVWPVTGEV

SEQ ID NO: 635822 - protein, 23 aa, Mycobacterium
APSPGGAPVLEWTGESAPAEFRE

SEQ ID NO: 635823 - protein, 28 aa, Mycobacterium
APSPLVERIPGMRAKLFDAARLAASAIG

SEQ ID NO: 635824 - protein, 28 aa, Mycobacterium
APSPLVQRIPGMRAKLFDAARLAAEAIG

SEQ ID NO: 635825 - protein, 24 aa, Mycobacterium
APSRFVNPTSFAYCRAITRSEIAM

SEQ ID NO: 635826 - protein, 17 aa, Mycobacterium
APSRFVNPTSFAYCRQI

SEQ ID NO: 635827 - protein, 22 aa, Mycobacterium
APSRLFGANGLRTGPDGRVYIA

SEQ ID NO: 635828 - protein, 20 aa, Mycobacterium
APSRRRIAFYRSLLGEVDDP

SEQ ID NO: 635829 - protein, 19 aa, Mycobacterium
APSRSRLHRAASLLEDAAL

SEQ ID NO: 635830 - protein, 18 aa, Mycobacterium
APSSMAVIKRQLHKDALR

SEQ ID NO: 635831 - protein, 20 aa, Mycobacterium
APSSRWCEACATELAVRPDE

SEQ ID NO: 635832 - protein, 23 aa, Mycobacterium
APSSTVLFLGRHVGYPVALEGAL

SEQ ID NO: 635833 - protein, 18 aa, Mycobacterium
APSTELRAGAQHWSQSCA

SEQ ID NO: 635834 - protein, 24 aa, Mycobacterium
APSTGACRRLRELAGAAAALKGVR

SEQ ID NO: 635835 - protein, 19 aa, Mycobacterium
APSTPWPTYPLMYRVSAAH

SEQ ID NO: 635836 - protein, 17 aa, Mycobacterium
APSTRIATSPTIAASQP

SEQ ID NO: 635837 - protein, 18 aa, Mycobacterium
APSTRWLRDATRGGVGTV

SEQ ID NO: 635838 - protein, 19 aa, Mycobacterium
APSTRWMRDATRGGVGTVS

SEQ ID NO: 635839 - protein, 17 aa, Mycobacterium
APSTVRRLFALTDQLDT

SEQ ID NO: 635840 - protein, 17 aa, Mycobacterium
APSVAWPVVADAYAALA

SEQ ID NO: 635841 - protein, 22 aa, Mycobacterium
APSVRFNPILLKPGGDRTSQLV

SEQ ID NO: 635842 - protein, 17 aa, Mycobacterium
APSVRRVVLKSTSEVYG

SEQ ID NO: 635843 - protein, 19 aa, Mycobacterium
APSWRNAVAPRFLLHAPRY

SEQ ID NO: 635844 - protein, 19 aa, Mycobacterium
APSYFVYDAILNRKDRDLL

SEQ ID NO: 635845 - protein, 18 aa, Mycobacterium
APTADDLWHSQGALHVPG

SEQ ID NO: 635846 - protein, 18 aa, Mycobacterium
APTAILLDGSKFGGLITG

SEQ ID NO: 635847 - protein, 24 aa, Mycobacterium
APTALRAQHEYMIKAFGGKGYQAT

SEQ ID NO: 635848 - protein, 20 aa, Mycobacterium
APTAVLIRPDGYVAWTGEGT

SEQ ID NO: 635849 - protein, 19 aa, Mycobacterium
APTAYDYGPLFVAPQAPEP

SEQ ID NO: 635850 - protein, 19 aa, Mycobacterium
APTCGSYAPADRFQAAVRR

SEQ ID NO: 635851 - protein, 18 aa, Mycobacterium
APTFEQWLGSPLVNDIMY

SEQ ID NO: 635852 - protein, 29 aa, Mycobacterium
APTGAFSAAPLRWADWLSASAATFTAGPN

SEQ ID NO: 635853 - protein, 23 aa, Mycobacterium
APTGAVLLQVRWLCLEGRDDPVD

SEQ ID NO: 635854 - protein, 25 aa, Mycobacterium
APTGAVLLQVRWLCLEGSGDRVDDL

SEQ ID NO: 635855 - protein, 25 aa, Mycobacterium
APTGDRWDAAFAYWQQLRTDPGAVF

SEQ ID NO: 635856 - protein, 19 aa, Mycobacterium
APTGFDWTRPWQLHSQVSL

SEQ ID NO: 635857 - protein, 20 aa, Mycobacterium
APTHRRWSQYLNWVADNIGM

SEQ ID NO: 635858 - protein, 20 aa, Mycobacterium
APTHVAAAFDVSRKTFRSDR

SEQ ID NO: 635859 - protein, 21 aa, Mycobacterium
APTIRRLAARLGTDGGARAPL

SEQ ID NO: 635860 - protein, 24 aa, Mycobacterium
APTKAARCALQLVPALAALNIAIR

SEQ ID NO: 635861 - protein, 25 aa, Mycobacterium
APTKRELMSSAFLDHLRHLGRIPAT

SEQ ID NO: 635862 - protein, 29 aa, Mycobacterium
APTLFPDQRFAAIVAVGVFTFAHAGPEDL

SEQ ID NO: 635863 - protein, 24 aa, Mycobacterium
APTLIRTFMKWGRAIPDAHDLSSL

SEQ ID NO: 635864 - protein, 30 aa, Mycobacterium
APTLIRTFMKWGREIPDAHDLSSLRLLGTV

SEQ ID NO: 635865 - protein, 27 aa, Mycobacterium
APTLIRTFMKWGREIPDSHDLSSLRLL

SEQ ID NO: 635866 - protein, 30 aa, Mycobacterium
APTLIRTFMKWGREVPDAHDLTSLRLLGSV

SEQ ID NO: 635867 - protein, 17 aa, Mycobacterium
APTLLTWGRDDRVSPPD

SEQ ID NO: 635868 - protein, 18 aa, Mycobacterium
APTLSGFWHWAVANLPAD

SEQ ID NO: 635869 - protein, 25 aa, Mycobacterium
APTLVRTFMRWGRQIPAEHDLSSLR

SEQ ID NO: 635870 - protein, 25 aa, Mycobacterium
APTLYCISEPIPPGSYVGVEGRLGL

SEQ ID NO: 635871 - protein, 26 aa, Mycobacterium
APTLYCISEPIPPGSYVGVSGRFGLR

SEQ ID NO: 635872 - protein, 35 aa, Mycobacterium
APTLYCISEPLPPGSYVGVTGRFGLRGGPVLIGRS

SEQ ID NO: 635873 - protein, 27 aa, Mycobacterium
APTNALLGRPLIGNGTDGLAGTGAAGG

SEQ ID NO: 635874 - protein, 18 aa, Mycobacterium
APTPFVWIIGRTQTNGPA

SEQ ID NO: 635875 - protein, 19 aa, Mycobacterium
APTPLFAKPGSYYGDITAL

SEQ ID NO: 635876 - protein, 20 aa, Mycobacterium
APTPMAIGISGPTARMGKDL

SEQ ID NO: 635877 - protein, 25 aa, Mycobacterium
APTQALLGRPIIGNGADGAPGSGAN

SEQ ID NO: 635878 - protein, 25 aa, Mycobacterium
APTQALLNRPLIGNGANGAAGTGAS

SEQ ID NO: 635879 - protein, 18 aa, Mycobacterium
APTRANAPLISWDKAFGL

SEQ ID NO: 635880 - protein, 25 aa, Mycobacterium
APTRANAPLISWDNAFGLVKINPIA

SEQ ID NO: 635881 - protein, 25 aa, Mycobacterium
APTRFARGWHCLGLIRELGDGKPHA

SEQ ID NO: 635882 - protein, 17 aa, Mycobacterium
APTRLRELAKMDGAVVL

SEQ ID NO: 635883 - protein, 25 aa, Mycobacterium
APTRRAKCLLQTLAFGLGAGLPEAE

SEQ ID NO: 635884 - protein, 25 aa, Mycobacterium
APTSFAQVRYRAGDVLMFGPEPTGL

SEQ ID NO: 635885 - protein, 19 aa, Mycobacterium
APTSLRAIKQVVTRTAHLS

SEQ ID NO: 635886 - protein, 20 aa, Mycobacterium
APTTALLSALGADEVSAAVT

SEQ ID NO: 635887 - protein, 18 aa, Mycobacterium
APTTGWAGSEDELLAVLR

SEQ ID NO: 635888 - protein, 18 aa, Mycobacterium
APTTVRRAAQILGLEETA

SEQ ID NO: 635889 - protein, 18 aa, Mycobacterium
APTTVWAVGASRAIVDGK

SEQ ID NO: 635890 - protein, 24 aa, Mycobacterium
APTVELVELLGPRAIVTVRSGELR

SEQ ID NO: 635891 - protein, 18 aa, Mycobacterium
APTVKRTSMELGGNAPFI

SEQ ID NO: 635892 - protein, 19 aa, Mycobacterium
APTVLKVIIESAALTDAEI

SEQ ID NO: 635893 - protein, 27 aa, Mycobacterium
APTVSGFWHWAVFNLPATVTELPAGVG

SEQ ID NO: 635894 - protein, 17 aa, Mycobacterium
APTWKKSFGHHPLLAFL

SEQ ID NO: 635895 - protein, 17 aa, Mycobacterium
APTWPAWASEELCQRWP

SEQ ID NO: 635896 - protein, 23 aa, Mycobacterium
APTYRYVGATAKNRDGWDSLGDL

SEQ ID NO: 635897 - protein, 23 aa, Mycobacterium
APTYRYVGATAKSRDGWDSLGDL

SEQ ID NO: 635898 - protein, 18 aa, Mycobacterium
APVAEYWREFGVNGKSTI

SEQ ID NO: 635899 - protein, 19 aa, Mycobacterium
APVAGLFVVFARTRPADEQ

SEQ ID NO: 635900 - protein, 18 aa, Mycobacterium
APVALPFGIAPTGFTRLM

SEQ ID NO: 635901 - protein, 17 aa, Mycobacterium
APVAPKAPWIPQASFGV

SEQ ID NO: 635902 - protein, 23 aa, Mycobacterium
APVARRLRESFGGGKSAPAKGSD

SEQ ID NO: 635903 - protein, 28 aa, Mycobacterium
APVARVATVKAGLGGAVEPVSASAAGSA

SEQ ID NO: 635904 - protein, 20 aa, Mycobacterium
APVARYWPEFGANGKSSITV

SEQ ID NO: 635905 - protein, 20 aa, Mycobacterium
APVARYWPQFAANGKESITV

SEQ ID NO: 635906 - protein, 21 aa, Mycobacterium
APVAVGAFAPVLDRLIAFTGR

SEQ ID NO: 635907 - protein, 17 aa, Mycobacterium
APVDALVSLAEEAKADL

SEQ ID NO: 635908 - protein, 17 aa, Mycobacterium
APVDGRRAGKPAKLVSK

SEQ ID NO: 635909 - protein, 22 aa, Mycobacterium
APVDGWDFSWLDGRATEERPSW

SEQ ID NO: 635910 - protein, 25 aa, Mycobacterium
APVDLPALLPSPGRPFGLYLHVPFC

SEQ ID NO: 635911 - protein, 17 aa, Mycobacterium
APVDLVFQSIAGTEGAN

SEQ ID NO: 635912 - protein, 18 aa, Mycobacterium
APVDRIRVDSIIDASQLS

SEQ ID NO: 635913 - protein, 17 aa, Mycobacterium
APVDTLAALPMNLPPSL

SEQ ID NO: 635914 - protein, 19 aa, Mycobacterium
APVEGDWLLLVELAADHDQ

SEQ ID NO: 635915 - protein, 24 aa, Mycobacterium
APVEGWDFSWLDGRATEERPSWGY

SEQ ID NO: 635916 - protein, 17 aa, Mycobacterium
APVFRDALGLTWGDGRQ

SEQ ID NO: 635917 - protein, 21 aa, Mycobacterium
APVGAVPLWIGGGASESSTEL

SEQ ID NO: 635918 - protein, 17 aa, Mycobacterium
APVGLFVDTFGTATVDQ

SEQ ID NO: 635919 - protein, 17 aa, Mycobacterium
APVGLFVETFGSETVDP

SEQ ID NO: 635920 - protein, 18 aa, Mycobacterium
APVGPVLAETLGLPVSVA

SEQ ID NO: 635921 - protein, 23 aa, Mycobacterium
APVHSRLPPSMIARSSMMAGAVM

SEQ ID NO: 635922 - protein, 18 aa, Mycobacterium
APVHVRWSDIDMYQHINH

SEQ ID NO: 635923 - protein, 22 aa, Mycobacterium
APVIEISDVWKLHKLGDEVVKA

SEQ ID NO: 635924 - protein, 25 aa, Mycobacterium
APVIEVLASFGLEGEQAFYAALEFW

SEQ ID NO: 635925 - protein, 18 aa, Mycobacterium
APVILHFHGGGLVMGSVH

SEQ ID NO: 635926 - protein, 23 aa, Mycobacterium
APVIRPGKILIIGLNYPSHAKEA

SEQ ID NO: 635927 - protein, 26 aa, Mycobacterium
APVLAICAAVQVLGHWYETSSGERVD

SEQ ID NO: 635928 - protein, 26 aa, Mycobacterium
APVLAWLHAPGMDFGPALAADVQIAI

SEQ ID NO: 635929 - protein, 26 aa, Mycobacterium
APVLAWLHPPGFDFGPALLADVQIAV

SEQ ID NO: 635930 - protein, 19 aa, Mycobacterium
APVLDRLASYQARSVDIDG

SEQ ID NO: 635931 - protein, 24 aa, Mycobacterium
APVLDRLIAFTGRRPVHPTGLTSP

SEQ ID NO: 635932 - protein, 28 aa, Mycobacterium
APVLHLYRCREVCAAVDVARADILLVDE

SEQ ID NO: 635933 - protein, 25 aa, Mycobacterium
APVLNQRRAFIFSESLGGLTTSLGY

SEQ ID NO: 635934 - protein, 23 aa, Mycobacterium
APVLTVALPDGWPSTPGTGDVAL

SEQ ID NO: 635935 - protein, 21 aa, Mycobacterium
APVMARIDLRGVELTAARLRT

SEQ ID NO: 635936 - protein, 27 aa, Mycobacterium
APVNGYKGWRSPALPEFDPFWRDVEDA

SEQ ID NO: 635937 - protein, 23 aa, Mycobacterium
APVPELRAGGMGVRDVKRLAKNT

SEQ ID NO: 635938 - protein, 25 aa, Mycobacterium
APVPELRSGGLGIREVKRLTKATGI

SEQ ID NO: 635939 - protein, 20 aa, Mycobacterium
APVPGRRLGVLVDHLVAGSK

SEQ ID NO: 635940 - protein, 20 aa, Mycobacterium
APVPILGSAWGLVRDSAMYR

SEQ ID NO: 635941 - protein, 17 aa, Mycobacterium
APVPLILTHGWPDSFWR

SEQ ID NO: 635942 - protein, 20 aa, Mycobacterium
APVPNRLAVVRVDAGESLQD

SEQ ID NO: 635943 - protein, 24 aa, Mycobacterium
APVPREVLVPVLPRDAEGMTSWLT

SEQ ID NO: 635944 - protein, 25 aa, Mycobacterium
APVPTGWKVPQAWLDSGVVKQGHTW

SEQ ID NO: 635945 - protein, 28 aa, Mycobacterium
APVQELTGRPLIGNGLPGSAGSGVAGAP

SEQ ID NO: 635946 - protein, 19 aa, Mycobacterium
APVQLVRIGRLYLIGIPGE

SEQ ID NO: 635947 - protein, 25 aa, Mycobacterium
APVQVDTWGGWLFVNMDPDCEPLAD

SEQ ID NO: 635948 - protein, 25 aa, Mycobacterium
APVRAGDFVAMLGFTSVDYTAVDLA

SEQ ID NO: 635949 - protein, 17 aa, Mycobacterium
APVRAVLPAGAGVAEDF

SEQ ID NO: 635950 - protein, 25 aa, Mycobacterium
APVRCEVWEGFIFINFDDNAAPLTD

SEQ ID NO: 635951 - protein, 24 aa, Mycobacterium
APVRCEVWEGFIFINFDHDAAPLA

SEQ ID NO: 635952 - protein, 18 aa, Mycobacterium
APVRMTALGIWRAMQGAE

SEQ ID NO: 635953 - protein, 21 aa, Mycobacterium
APVRPGGAVPLALAAAPGASV

SEQ ID NO: 635954 - protein, 22 aa, Mycobacterium
APVRRYLPEFAVADPAVGAAVT

SEQ ID NO: 635955 - protein, 18 aa, Mycobacterium
APVSALFGGWNLFMTLGY

SEQ ID NO: 635956 - protein, 23 aa, Mycobacterium
APVSCPLPTFPQGPNPVETFIPV

SEQ ID NO: 635957 - protein, 27 aa, Mycobacterium
APVSLVDCPPYRPFWAITKHADVMEIE

SEQ ID NO: 635958 - protein, 24 aa, Mycobacterium
APVSRLAPILAEVEPRILTVSAEY

SEQ ID NO: 635959 - protein, 26 aa, Mycobacterium
APVSRVCSVEVPIPYAKHLEQAALPQ

SEQ ID NO: 635960 - protein, 27 aa, Mycobacterium
APVTDGRWSCVHWGDAVAPFPHQEAAS

SEQ ID NO: 635961 - protein, 19 aa, Mycobacterium
APVTEWQLADGDIIRLGHS

SEQ ID NO: 635962 - protein, 19 aa, Mycobacterium
APVTEYFVWFGDEYQVDET

SEQ ID NO: 635963 - protein, 17 aa, Mycobacterium
APVTMRLEHALVCDDYV

SEQ ID NO: 635964 - protein, 26 aa, Mycobacterium
APVTRPRIRLAYQLTPRRITGDARAA

SEQ ID NO: 635965 - protein, 18 aa, Mycobacterium
APVTVSYCEALPPETFDL

SEQ ID NO: 635966 - protein, 21 aa, Mycobacterium
APVVVSWPAGPYMATVLECQE

SEQ ID NO: 635967 - protein, 17 aa, Mycobacterium
APVWPLERMKQRVEASE

SEQ ID NO: 635968 - protein, 18 aa, Mycobacterium
APVYLYRFDYSTPLLKLL

SEQ ID NO: 635969 - protein, 18 aa, Mycobacterium
APVYLYRFDYSTPLLRLL

SEQ ID NO: 635970 - protein, 22 aa, Mycobacterium
APVYRGRLALRPPDRDVYFISR

SEQ ID NO: 635971 - protein, 19 aa, Mycobacterium
APVYYNAKWDFWALTRYDD

SEQ ID NO: 635972 - protein, 22 aa, Mycobacterium
APWKCGVTWTQRLVSLLVFDGP

SEQ ID NO: 635973 - protein, 17 aa, Mycobacterium
APWKDVEAQGWIAPAEC

SEQ ID NO: 635974 - protein, 23 aa, Mycobacterium
APWLGVYWLFGGFLRKRRNIRDM

SEQ ID NO: 635975 - protein, 18 aa, Mycobacterium
APWLPLERAVPLDSSADW

SEQ ID NO: 635976 - protein, 18 aa, Mycobacterium
APWNRRLAYPRLQFSPLH

SEQ ID NO: 635977 - protein, 18 aa, Mycobacterium
APYAAWLTTTSADYAATA

SEQ ID NO: 635978 - protein, 21 aa, Mycobacterium
APYAGWLGLAAARAGDVSAQA

SEQ ID NO: 635979 - protein, 19 aa, Mycobacterium
APYARGWAANLALSQVQAT

SEQ ID NO: 635980 - protein, 25 aa, Mycobacterium
APYEHSFPFTGRIHRIDASVSPRPA

SEQ ID NO: 635981 - protein, 18 aa, Mycobacterium
APYEPGYRVLDGIRAALG

SEQ ID NO: 635982 - protein, 18 aa, Mycobacterium
APYFGMLPAGTWRDEREA

SEQ ID NO: 635983 - protein, 25 aa, Mycobacterium
APYGLAGSANLVWVSETSTNTVIGY

SEQ ID NO: 635984 - protein, 27 aa, Mycobacterium
APYKYRVTTRYEIPCTVSGTVTVGDAT

SEQ ID NO: 635985 - protein, 19 aa, Mycobacterium
APYLRDGKAAIVRCADASR

SEQ ID NO: 635986 - protein, 18 aa, Mycobacterium
APYNLARRILSVDRATGG

SEQ ID NO: 635987 - protein, 23 aa, Mycobacterium
APYPDYRDLAGYERDARRASLLG

SEQ ID NO: 635988 - protein, 27 aa, Mycobacterium
APYTPAFFDEFARRFALATRGFDSYFY

SEQ ID NO: 635989 - protein, 17 aa, Mycobacterium
APYTPRWLARKMAALAL

SEQ ID NO: 635990 - protein, 17 aa, Mycobacterium
AQAAAAIHRADPHGPGL

SEQ ID NO: 635991 - protein, 27 aa, Mycobacterium
AQAAASEHRLRIIGVTWNDEAAAQAAL

SEQ ID NO: 635992 - protein, 25 aa, Mycobacterium
AQAADLFRWLGPYPDAAVGSAGTVA

SEQ ID NO: 635993 - protein, 26 aa, Mycobacterium
AQAAEALGAYVAPAWGMTECSILTSC

SEQ ID NO: 635994 - protein, 27 aa, Mycobacterium
AQAAEFHERFVRAMAAGAASYATAEAA

SEQ ID NO: 635995 - protein, 26 aa, Mycobacterium
AQAAERLGFRRGWLSERFDLKDSGAI

SEQ ID NO: 635996 - protein, 18 aa, Mycobacterium
AQAAGIRYIGFRHEGSAG

SEQ ID NO: 635997 - protein, 18 aa, Mycobacterium
AQAAGIRYIGFRQEASAG

SEQ ID NO: 635998 - protein, 17 aa, Mycobacterium
AQAAGQVNHEFGDELAA

SEQ ID NO: 635999 - protein, 18 aa, Mycobacterium
AQAAIFAWPERLDPVEGR

SEQ ID NO: 636000 - protein, 26 aa, Mycobacterium
AQAAIPDMLAAGWGRIVMISSSSAQR

SEQ ID NO: 636001 - protein, 26 aa, Mycobacterium
AQAALCGSIVSGLRMHPGNWAGAYAC

SEQ ID NO: 636002 - protein, 17 aa, Mycobacterium
AQAAPTRFARGWHCLGL

SEQ ID NO: 636003 - protein, 29 aa, Mycobacterium
AQAAPTRFARGWHCLGLIRDFADGKPHAI

SEQ ID NO: 636004 - protein, 22 aa, Mycobacterium
AQAAQFHSQFVQAMQAGAGSYA

SEQ ID NO: 636005 - protein, 19 aa, Mycobacterium
AQAAQYAFILNKLTHAADG

SEQ ID NO: 636006 - protein, 18 aa, Mycobacterium
AQAARAPEAVAITDGDRS

SEQ ID NO: 636007 - protein, 27 aa, Mycobacterium
AQAARRCARVLLDLHVVDGRLRRACLG

SEQ ID NO: 636008 - protein, 17 aa, Mycobacterium
AQAAWREALDGFEAPTL

SEQ ID NO: 636009 - protein, 17 aa, Mycobacterium
AQAAWREVLAGFDTPTL

SEQ ID NO: 636010 - protein, 18 aa, Mycobacterium
AQAAWREVLDGFDAPTLV

SEQ ID NO: 636011 - protein, 22 aa, Mycobacterium
AQACARAEVPSIGLLSGGVSGS

SEQ ID NO: 636012 - protein, 17 aa, Mycobacterium
AQACCSPLSGGILDSAS

SEQ ID NO: 636013 - protein, 18 aa, Mycobacterium
AQACDGFVLAATHMPGAF

SEQ ID NO: 636014 - protein, 30 aa, Mycobacterium
AQACGAGTDCGRCRRTVQAILRSSSPERTP

SEQ ID NO: 636015 - protein, 27 aa, Mycobacterium
AQACRDRGVGFSFGFPVDARVWDAVDT

SEQ ID NO: 636016 - protein, 25 aa, Mycobacterium
AQAEGMWKPGWIEFSGTALSVGALR

SEQ ID NO: 636017 - protein, 18 aa, Mycobacterium
AQAELGVAVPDGVVEDYE

SEQ ID NO: 636018 - protein, 18 aa, Mycobacterium
AQAELGVPVPDGVVDDYE

SEQ ID NO: 636019 - protein, 35 aa, Mycobacterium
AQAELGWRNRLGFRDAVAWTIDWERQVHGGADPLA

SEQ ID NO: 636020 - protein, 19 aa, Mycobacterium
AQAELKRIRAAGFSDRPFA

SEQ ID NO: 636021 - protein, 20 aa, Mycobacterium
AQAFINEWPCAALPDEIAAG

SEQ ID NO: 636022 - protein, 26 aa, Mycobacterium
AQAFPKSRFTGIDFSEPAIAAASQEA

SEQ ID NO: 636023 - protein, 19 aa, Mycobacterium
AQAGAELGLTVIAGINESA

SEQ ID NO: 636024 - protein, 18 aa, Mycobacterium
AQAGAFHDHFVRTLQAGM

SEQ ID NO: 636025 - protein, 19 aa, Mycobacterium
AQAGIGFAGGEFAESFTLA

SEQ ID NO: 636026 - protein, 19 aa, Mycobacterium
AQAGLKWPNDVLAGPPGSL

SEQ ID NO: 636027 - protein, 19 aa, Mycobacterium
AQAGRFGIHPALLDAALHA

SEQ ID NO: 636028 - protein, 25 aa, Mycobacterium
AQAGTSMLCCLPRPARLRESVIAHK

SEQ ID NO: 636029 - protein, 17 aa, Mycobacterium
AQAGVFRGSVMDWSKTP

SEQ ID NO: 636030 - protein, 22 aa, Mycobacterium
AQAGWPSARVHLERFTAPEQDP

SEQ ID NO: 636031 - protein, 18 aa, Mycobacterium
AQAIAGLLTKAGVDTKVS

SEQ ID NO: 636032 - protein, 19 aa, Mycobacterium
AQAIPTLFPFVECQSRLLA

SEQ ID NO: 636033 - protein, 17 aa, Mycobacterium
AQAIVHCGFGFGIVFVN

SEQ ID NO: 636034 - protein, 17 aa, Mycobacterium
AQAKARSSLVNWQFAPA

SEQ ID NO: 636035 - protein, 17 aa, Mycobacterium
AQAKERGFQIVRTASEL

SEQ ID NO: 636036 - protein, 24 aa, Mycobacterium
AQAKRKLLAEARCLVFPIQWEEPF

SEQ ID NO: 636037 - protein, 19 aa, Mycobacterium
AQAKRWLTDYAEAAHGMFA

SEQ ID NO: 636038 - protein, 26 aa, Mycobacterium
AQALADWADVGGYEFETQCDVHTTAA

SEQ ID NO: 636039 - protein, 17 aa, Mycobacterium
AQALALDPGLLIADEPT

SEQ ID NO: 636040 - protein, 18 aa, Mycobacterium
AQALDVRIEPGRVYVNDG

SEQ ID NO: 636041 - protein, 24 aa, Mycobacterium
AQALEPYLAWLRLTAQQCQQTAAS

SEQ ID NO: 636042 - protein, 18 aa, Mycobacterium
AQALLDFQEHDWSQTLEW

SEQ ID NO: 636043 - protein, 17 aa, Mycobacterium
AQALLGHPIIGTGGSGS

SEQ ID NO: 636044 - protein, 25 aa, Mycobacterium
AQALLGRPLFGNGINGAPGTGQDGG

SEQ ID NO: 636045 - protein, 25 aa, Mycobacterium
AQALLGRPLIGNGIDGTATNPNGGD

SEQ ID NO: 636046 - protein, 21 aa, Mycobacterium
AQALLPYFAPGFNQLRTAFLD

SEQ ID NO: 636047 - protein, 23 aa, Mycobacterium
AQALPGLRQALGLAEDGTDERAA

SEQ ID NO: 636048 - protein, 17 aa, Mycobacterium
AQALRAKVFPKLVNVLK

SEQ ID NO: 636049 - protein, 18 aa, Mycobacterium
AQALRFVTRRGLEAHVNA

SEQ ID NO: 636050 - protein, 18 aa, Mycobacterium
AQALRVLFDAHLVDENER

SEQ ID NO: 636051 - protein, 18 aa, Mycobacterium
AQALVKEGLRNVAAGANP

SEQ ID NO: 636052 - protein, 22 aa, Mycobacterium
AQAMAGPLLAMMSQMGGMAFGS

SEQ ID NO: 636053 - protein, 23 aa, Mycobacterium
AQANADLWLSFAQDYRDETGSKV

SEQ ID NO: 636054 - protein, 24 aa, Mycobacterium
AQAPAEPMLIWAKPRRCNIHTRLI

SEQ ID NO: 636055 - protein, 24 aa, Mycobacterium
AQAPEFLDSSGFGRNMLFADEPDH

SEQ ID NO: 636056 - protein, 25 aa, Mycobacterium
AQAPFGYPEVHYLTSPVRKASVAAG

SEQ ID NO: 636057 - protein, 22 aa, Mycobacterium
AQAPGGLSCFFLPRILPDGRRN

SEQ ID NO: 636058 - protein, 22 aa, Mycobacterium
AQAPGGLSCFFLPRVLPDGSRN

SEQ ID NO: 636059 - protein, 23 aa, Mycobacterium
AQAQLERAAACWAANDHAGTEQL

SEQ ID NO: 636060 - protein, 24 aa, Mycobacterium
AQAQRVVMGRGWVQLMRDDVEGAR

SEQ ID NO: 636061 - protein, 24 aa, Mycobacterium
AQARALRVGDGWLPYAGTSTPDDV

SEQ ID NO: 636062 - protein, 23 aa, Mycobacterium
AQARAVIEWGMRCTCPSIDSCTC

SEQ ID NO: 636063 - protein, 23 aa, Mycobacterium
AQARGKLTELCRELGVTEFMLLQ

SEQ ID NO: 636064 - protein, 18 aa, Mycobacterium
AQARLAAAHIVRESRAVI

SEQ ID NO: 636065 - protein, 17 aa, Mycobacterium
AQARLDAARPYAFQITA

SEQ ID NO: 636066 - protein, 22 aa, Mycobacterium
AQARLGWVRGRLLGARGDIASA

SEQ ID NO: 636067 - protein, 17 aa, Mycobacterium
AQARLLATIEVHGEARI

SEQ ID NO: 636068 - protein, 17 aa, Mycobacterium
AQARRLVVRGFFNEIIA

SEQ ID NO: 636069 - protein, 25 aa, Mycobacterium
AQARSRLNPGAGVMVSAVWATSTGE

SEQ ID NO: 636070 - protein, 24 aa, Mycobacterium
AQARTDFGGTLFFGVPTVWSRVGA

SEQ ID NO: 636071 - protein, 22 aa, Mycobacterium
AQASERRLLIIIGDGLISDEGY

SEQ ID NO: 636072 - protein, 24 aa, Mycobacterium
AQASWNFLEGCMETLGGLAAGSTT

SEQ ID NO: 636073 - protein, 18 aa, Mycobacterium
AQATRLGAVAGIHLEGPW

SEQ ID NO: 636074 - protein, 22 aa, Mycobacterium
AQATVLKANWQRAAKVLGSSRP

SEQ ID NO: 636075 - protein, 26 aa, Mycobacterium
AQAVASAFEAARMAMIHPLAVAANRN

SEQ ID NO: 636076 - protein, 18 aa, Mycobacterium
AQAVEAFGRLDIVVNNVG

SEQ ID NO: 636077 - protein, 18 aa, Mycobacterium
AQAWMRGAVIEWAQGSAQ

SEQ ID NO: 636078 - protein, 23 aa, Mycobacterium
AQAYPDRFVLGLGAGYPSQAELV

SEQ ID NO: 636079 - protein, 20 aa, Mycobacterium
AQCAKRFPGAQMLFDLPPRW

SEQ ID NO: 636080 - protein, 24 aa, Mycobacterium
AQCAKRFPGGQMFFDLPPTIVKKV

SEQ ID NO: 636081 - protein, 19 aa, Mycobacterium
AQCCFLAPRAFKLAGEEAL

SEQ ID NO: 636082 - protein, 26 aa, Mycobacterium
AQCRDGRYNICRELRVFGCQTPGALA

SEQ ID NO: 636083 - protein, 27 aa, Mycobacterium
AQDEVSAAIAALFSVHGQTYQQLSAQA

SEQ ID NO: 636084 - protein, 24 aa, Mycobacterium
AQDEVSQAIAAVFSTHAQAYQAAS

SEQ ID NO: 636085 - protein, 21 aa, Mycobacterium
AQDFYGTVFGWTFESAGPEYG

SEQ ID NO: 636086 - protein, 25 aa, Mycobacterium
AQDIARFKVFDWARSDHWQTDIPFA

SEQ ID NO: 636087 - protein, 28 aa, Mycobacterium
AQDIKMRPGAPWIPAQVVAAFAEKTFDA

SEQ ID NO: 636088 - protein, 17 aa, Mycobacterium
AQDKLRTVLWGWAGKPV

SEQ ID NO: 636089 - protein, 18 aa, Mycobacterium
AQDLLFERVVALSAPGSQ

SEQ ID NO: 636090 - protein, 33 aa, Mycobacterium
AQDPALRPPLTWEVDNPFPLPRLDTYTSDPRIA

SEQ ID NO: 636091 - protein, 19 aa, Mycobacterium
AQDTRLIWEERRMRREVRA

SEQ ID NO: 636092 - protein, 18 aa, Mycobacterium
AQDTRLTWEERRMRREVR

SEQ ID NO: 636093 - protein, 24 aa, Mycobacterium
AQDWEVLEAGLVQRSRLLDAVLAD

SEQ ID NO: 636094 - protein, 21 aa, Mycobacterium
AQDYDRWLGLLTEDIHYYMPV

SEQ ID NO: 636095 - protein, 21 aa, Mycobacterium
AQDYDRWLGVLTEDIHYYMPV

SEQ ID NO: 636096 - protein, 21 aa, Mycobacterium
AQEAAIRMALQRAGVEPNDVA

SEQ ID NO: 636097 - protein, 19 aa, Mycobacterium
AQEALDWGLLNRVVPREDL

SEQ ID NO: 636098 - protein, 18 aa, Mycobacterium
AQEALDWGMVSRVVPHDD

SEQ ID NO: 636099 - protein, 19 aa, Mycobacterium
AQEALNFFLESSSLFGRRR

SEQ ID NO: 636100 - protein, 33 aa, Mycobacterium
AQEATRVGMPYVNQRWLGGMLTNFQTVHKRLQR

SEQ ID NO: 636101 - protein, 21 aa, Mycobacterium
AQEAWRSLPVGTVKINAVFGG

SEQ ID NO: 636102 - protein, 21 aa, Mycobacterium
AQEAYRMGLVFDVVPAEELLD

SEQ ID NO: 636103 - protein, 21 aa, Mycobacterium
AQECRRLGAQVRTIALDLLDA

SEQ ID NO: 636104 - protein, 23 aa, Mycobacterium
AQEDWKFQYGWQATEAIVDTGRG

SEQ ID NO: 636105 - protein, 18 aa, Mycobacterium
AQEDWNFQYGWQATDAIV

SEQ ID NO: 636106 - protein, 23 aa, Mycobacterium
AQEFAARTAVAVEWTRAPAYAVV

SEQ ID NO: 636107 - protein, 17 aa, Mycobacterium
AQEGLSLDVCSSGELAT

SEQ ID NO: 636108 - protein, 21 aa, Mycobacterium
AQEHRIAVSFQEHLLDLNRGS

SEQ ID NO: 636109 - protein, 26 aa, Mycobacterium
AQEKTGEAWIDWQLYGGHTRGEFEYA

SEQ ID NO: 636110 - protein, 25 aa, Mycobacterium
AQELAARFARPLAFGTAGLRGPVRG

SEQ ID NO: 636111 - protein, 17 aa, Mycobacterium
AQELALHLAHCAADPDT

SEQ ID NO: 636112 - protein, 17 aa, Mycobacterium
AQELARQLGAPAVRLEE

SEQ ID NO: 636113 - protein, 19 aa, Mycobacterium
AQELKRRGGGIGVAALCGG

SEQ ID NO: 636114 - protein, 23 aa, Mycobacterium
AQELMSRYSLHHAIRDHQRSDAM

SEQ ID NO: 636115 - protein, 23 aa, Mycobacterium
AQELPEPVDFAAWRREHAGRATA

SEQ ID NO: 636116 - protein, 27 aa, Mycobacterium
AQELYFPACFELAVARGMPAHDADEVA

SEQ ID NO: 636117 - protein, 25 aa, Mycobacterium
AQELYFPVCYELAVTQGIPREADHL

SEQ ID NO: 636118 - protein, 18 aa, Mycobacterium
AQEPDWDASLAIGAVAVI

SEQ ID NO: 636119 - protein, 24 aa, Mycobacterium
AQEPPRRLIGWKKVALEPGESKAV

SEQ ID NO: 636120 - protein, 26 aa, Mycobacterium
AQERSRAGAILGPFEAWLGARSLATA

SEQ ID NO: 636121 - protein, 19 aa, Mycobacterium
AQETLRMFKDLGVLDEELA

SEQ ID NO: 636122 - protein, 18 aa, Mycobacterium
AQEYRHWLDLLTDDVHYF

SEQ ID NO: 636123 - protein, 18 aa, Mycobacterium
AQFADLVRPFAPGPGVYT

SEQ ID NO: 636124 - protein, 17 aa, Mycobacterium
AQFAEWDVRIVPRDRVQ

SEQ ID NO: 636125 - protein, 20 aa, Mycobacterium
AQFGLDWNKFGVMARTATVS

SEQ ID NO: 636126 - protein, 17 aa, Mycobacterium
AQFIKYENPKTWLNSGG

SEQ ID NO: 636127 - protein, 20 aa, Mycobacterium
AQFIRAGSIIQLLLGNIGRP

SEQ ID NO: 636128 - protein, 21 aa, Mycobacterium
AQFIRAGSIIQLLLGNIGRPG

SEQ ID NO: 636129 - protein, 23 aa, Mycobacterium
AQFKVETGIPVFFADPQSPRQRG

SEQ ID NO: 636130 - protein, 17 aa, Mycobacterium
AQFLLGMVVSTGVGGGL

SEQ ID NO: 636131 - protein, 28 aa, Mycobacterium
AQFLVFCAAVIRAVHKFAGLLRVSVASA

SEQ ID NO: 636132 - protein, 28 aa, Mycobacterium
AQFLVFCAAVIRAVHKYAGLLRVSVASA

SEQ ID NO: 636133 - protein, 24 aa, Mycobacterium
AQFPLGGVVPGFKKAIAGQRVGST

SEQ ID NO: 636134 - protein, 18 aa, Mycobacterium
AQFPPDVIDGAWAPVPHS

SEQ ID NO: 636135 - protein, 18 aa, Mycobacterium
AQFSWAHTVDALLASYSR

SEQ ID NO: 636136 - protein, 26 aa, Mycobacterium
AQFTHAVALTAVWRAHGVAPDMTVGH

SEQ ID NO: 636137 - protein, 30 aa, Mycobacterium
AQFTHAVSLAHEWRCHGVLPAMTVGHSLGE

SEQ ID NO: 636138 - protein, 26 aa, Mycobacterium
AQFVHGVALARVWRSHGVVPDITVGH

SEQ ID NO: 636139 - protein, 18 aa, Mycobacterium
AQFVPTMFVRMLKLPAKV

SEQ ID NO: 636140 - protein, 19 aa, Mycobacterium
AQFVPTMFVRMLRMPEEAR

SEQ ID NO: 636141 - protein, 17 aa, Mycobacterium
AQGALSLLLRLTSGAGL

SEQ ID NO: 636142 - protein, 20 aa, Mycobacterium
AQGALSWLALSGCTTTTDHH

SEQ ID NO: 636143 - protein, 26 aa, Mycobacterium
AQGAPAQFGSTGFAGGDGGAGGDGGT

SEQ ID NO: 636144 - protein, 17 aa, Mycobacterium
AQGAPGRAVSAGVFEGR

SEQ ID NO: 636145 - protein, 18 aa, Mycobacterium
AQGCTYWNGEAMQGTNFN

SEQ ID NO: 636146 - protein, 20 aa, Mycobacterium
AQGDWCDIAGPALTDAVAQA

SEQ ID NO: 636147 - protein, 18 aa, Mycobacterium
AQGEIRWDIVAQGLGCHG

SEQ ID NO: 636148 - protein, 25 aa, Mycobacterium
AQGFAWPWSICRWVTGENPKFGQLV

SEQ ID NO: 636149 - protein, 17 aa, Mycobacterium
AQGGGGFQGVSGLPMDA

SEQ ID NO: 636150 - protein, 19 aa, Mycobacterium
AQGGLLPWAVSEYEQQTGR

SEQ ID NO: 636151 - protein, 17 aa, Mycobacterium
AQGGRFAEIAKRDIWSH

SEQ ID NO: 636152 - protein, 21 aa, Mycobacterium
AQGIERFYVWFADFAAPQTIS

SEQ ID NO: 636153 - protein, 18 aa, Mycobacterium
AQGIPPQFLVDILTNLRT

SEQ ID NO: 636154 - protein, 24 aa, Mycobacterium
AQGISVNVTLIFSIERHRQAMDAY

SEQ ID NO: 636155 - protein, 17 aa, Mycobacterium
AQGLLRITGFGYNEDAT

SEQ ID NO: 636156 - protein, 26 aa, Mycobacterium
AQGLPAMPGSAIKPGGVAAGLEHLAA

SEQ ID NO: 636157 - protein, 26 aa, Mycobacterium
AQGLRLATKLTPWPAVDGERIAAVSA

SEQ ID NO: 636158 - protein, 25 aa, Mycobacterium
AQGLSAGRILVAWSDLTADEVLAGV

SEQ ID NO: 636159 - protein, 22 aa, Mycobacterium
AQGPEMGRAILALYRSAADTAA

SEQ ID NO: 636160 - protein, 24 aa, Mycobacterium
AQGPRLRLVHKFGAGVNTIDVAAA

SEQ ID NO: 636161 - protein, 19 aa, Mycobacterium
AQGQIGFDYTLTVPEIGLN

SEQ ID NO: 636162 - protein, 19 aa, Mycobacterium
AQGRLDLRAAAGVKVTAAR

SEQ ID NO: 636163 - protein, 26 aa, Mycobacterium
AQGRLSARLIGQITWRTRLVQDPQAL

SEQ ID NO: 636164 - protein, 18 aa, Mycobacterium
AQGSELWAAGSDTTDVAA

SEQ ID NO: 636165 - protein, 18 aa, Mycobacterium
AQGSPRLAGRSARNYPHQ

SEQ ID NO: 636166 - protein, 20 aa, Mycobacterium
AQGSVMLRMPMHPVAIELLR

SEQ ID NO: 636167 - protein, 17 aa, Mycobacterium
AQGTQLGPTEWLEITQE

SEQ ID NO: 636168 - protein, 24 aa, Mycobacterium
AQGVPNWRSAPPVVLAVKDQVRSS

SEQ ID NO: 636169 - protein, 19 aa, Mycobacterium
AQGWNCQRALSARNNVVID

SEQ ID NO: 636170 - protein, 18 aa, Mycobacterium
AQGYSRVRVDGVVHSLTD

SEQ ID NO: 636171 - protein, 18 aa, Mycobacterium
AQHALRWTKHSLNQWYRM

SEQ ID NO: 636172 - protein, 28 aa, Mycobacterium
AQHASRITAPRGWELVRYNGPLPSNPED

SEQ ID NO: 636173 - protein, 18 aa, Mycobacterium
AQHGRRAVTHVVDVRDEQ

SEQ ID NO: 636174 - protein, 24 aa, Mycobacterium
AQHGVKLSAGWLVERAGFDKGYPG

SEQ ID NO: 636175 - protein, 21 aa, Mycobacterium
AQHIRRAGTLLAEHLAASGTL

SEQ ID NO: 636176 - protein, 18 aa, Mycobacterium
AQHKGHTVFAVDFVPERL

SEQ ID NO: 636177 - protein, 21 aa, Mycobacterium
AQHLLDLSVDYAKNRLQFGRP

SEQ ID NO: 636178 - protein, 21 aa, Mycobacterium
AQHLLDLSVDYAKSRLQFGRP

SEQ ID NO: 636179 - protein, 22 aa, Mycobacterium
AQHLPVPIFLQRSPHFRPPRTS

SEQ ID NO: 636180 - protein, 28 aa, Mycobacterium
AQHPRLVCNPRWTLGQIIAEPALIRGDR

SEQ ID NO: 636181 - protein, 22 aa, Mycobacterium
AQHPYTRRLLDSVPRKDLSARK

SEQ ID NO: 636182 - protein, 21 aa, Mycobacterium
AQHRGLHGLTALVVEAALCDM

SEQ ID NO: 636183 - protein, 26 aa, Mycobacterium
AQHRVWDRVLFDAGLSVITWPKQYGG

SEQ ID NO: 636184 - protein, 21 aa, Mycobacterium
AQHSYMLGSYSEWEPVAEMGT

SEQ ID NO: 636185 - protein, 17 aa, Mycobacterium
AQHTFMMESMNELAGDG

SEQ ID NO: 636186 - protein, 18 aa, Mycobacterium
AQHWPIPQVFVVTPSDGA

SEQ ID NO: 636187 - protein, 20 aa, Mycobacterium
AQIAALCDRRRGLGADGVLR

SEQ ID NO: 636188 - protein, 25 aa, Mycobacterium
AQIAKLGLRGGVLLPGIAPGTGIPP

SEQ ID NO: 636189 - protein, 25 aa, Mycobacterium
AQIAKLGLRGGVLLPGIAPGTGLPP

SEQ ID NO: 636190 - protein, 21 aa, Mycobacterium
AQIAKLGLRGGVLLPGVAPGT

SEQ ID NO: 636191 - protein, 22 aa, Mycobacterium
AQIAKLGLRGGVLLPGVVPGTG

SEQ ID NO: 636192 - protein, 17 aa, Mycobacterium
AQIAMSYVRAHAKQLGV

SEQ ID NO: 636193 - protein, 24 aa, Mycobacterium
AQIAQRYAAEFGYDPAAVAKIAVD

SEQ ID NO: 636194 - protein, 23 aa, Mycobacterium
AQIAQRYAAEYGYDPAAVAKIAV

SEQ ID NO: 636195 - protein, 20 aa, Mycobacterium
AQIARFPKPYVALMDGIVMG

SEQ ID NO: 636196 - protein, 19 aa, Mycobacterium
AQIFPRPIGLVLGLELSGN

SEQ ID NO: 636197 - protein, 37 aa, Mycobacterium
AQIGDLRWFYVYSGVMWACVFMRTGARRVHFGETEKP

SEQ ID NO: 636198 - protein, 17 aa, Mycobacterium
AQIGGLSVPNAWASSMP

SEQ ID NO: 636199 - protein, 18 aa, Mycobacterium
AQIGKGMWAMTDLMADMV

SEQ ID NO: 636200 - protein, 18 aa, Mycobacterium
AQIGKGMWAMTELMADMV

SEQ ID NO: 636201 - protein, 19 aa, Mycobacterium
AQIGKGMWAMTELMADMVE

SEQ ID NO: 636202 - protein, 19 aa, Mycobacterium
AQIGNIWNAEIVSRVGNHY

SEQ ID NO: 636203 - protein, 17 aa, Mycobacterium
AQIHGWCVGGASDYALC

SEQ ID NO: 636204 - protein, 17 aa, Mycobacterium
AQILPRSFVPFKEIEGF

SEQ ID NO: 636205 - protein, 31 aa, Mycobacterium
AQINRPMRGCYRIALVSLKGGVGKTTITATL

SEQ ID NO: 636206 - protein, 22 aa, Mycobacterium
AQINSSWAVRVFRDELVEFQVD

SEQ ID NO: 636207 - protein, 26 aa, Mycobacterium
AQINSVVRWDLCAATIASAATADTVV

SEQ ID NO: 636208 - protein, 17 aa, Mycobacterium
AQIPRPAPVDDHVITRR

SEQ ID NO: 636209 - protein, 19 aa, Mycobacterium
AQIRAEFGVDLTVRTIFDA

SEQ ID NO: 636210 - protein, 18 aa, Mycobacterium
AQIRAIVGIELSIESVEG

SEQ ID NO: 636211 - protein, 20 aa, Mycobacterium
AQIRGEWQPLYTFTTEPRPR

SEQ ID NO: 636212 - protein, 21 aa, Mycobacterium
AQIRQSEWIAAYRDAWADPAS

SEQ ID NO: 636213 - protein, 19 aa, Mycobacterium
AQISNIWNAEIVSRVGNHY

SEQ ID NO: 636214 - protein, 19 aa, Mycobacterium
AQISYPLKLFRLATPEEAR

SEQ ID NO: 636215 - protein, 29 aa, Mycobacterium
AQITRLPEWYRYNAALLLADRTSVVPMAG

SEQ ID NO: 636216 - protein, 26 aa, Mycobacterium
AQIYAWRKGIKTLYYIRLRQLALEGT

SEQ ID NO: 636217 - protein, 27 aa, Mycobacterium
AQKAGLPVADFAATVARFNGFARSGVD

SEQ ID NO: 636218 - protein, 20 aa, Mycobacterium
AQKAGLPVNEFTATVERFNG

SEQ ID NO: 636219 - protein, 18 aa, Mycobacterium
AQKALLPAMEAVRAAADE

SEQ ID NO: 636220 - protein, 36 aa, Mycobacterium
AQKFKKMSGMTWKSMITDGLAMRHGKDLTWSQVVMA

SEQ ID NO: 636221 - protein, 18 aa, Mycobacterium
AQKITSQWILGKNADRSG

SEQ ID NO: 636222 - protein, 19 aa, Mycobacterium
AQKQGWSLVLLDLGVDLTT

SEQ ID NO: 636223 - protein, 22 aa, Mycobacterium
AQKQSRRWSRESVAEAMKVVAA

SEQ ID NO: 636224 - protein, 17 aa, Mycobacterium
AQKRFVPKVPDFDPTAL

SEQ ID NO: 636225 - protein, 18 aa, Mycobacterium
AQKRFVPRAEPATLDPEQ

SEQ ID NO: 636226 - protein, 26 aa, Mycobacterium
AQKVSCAGLVLGSWPAHPGLVESSNR

SEQ ID NO: 636227 - protein, 17 aa, Mycobacterium
AQLAAFISVAVRANSDN

SEQ ID NO: 636228 - protein, 23 aa, Mycobacterium
AQLAAIGGFGKWDHMVRRHLRDP

SEQ ID NO: 636229 - protein, 18 aa, Mycobacterium
AQLAALLARCPAVTRGRL

SEQ ID NO: 636230 - protein, 25 aa, Mycobacterium
AQLAANLWPLGVFPNADSIAGNGVW

SEQ ID NO: 636231 - protein, 18 aa, Mycobacterium
AQLAELSRELGFELVSTD

SEQ ID NO: 636232 - protein, 24 aa, Mycobacterium
AQLAHRSFLFASCIPAPGCSTFVS

SEQ ID NO: 636233 - protein, 18 aa, Mycobacterium
AQLAPVVFEGTSFGGALM

SEQ ID NO: 636234 - protein, 18 aa, Mycobacterium
AQLARLDLGSVLVPMPEG

SEQ ID NO: 636235 - protein, 17 aa, Mycobacterium
AQLARLTALLAARQLRM

SEQ ID NO: 636236 - protein, 17 aa, Mycobacterium
AQLARRNSDVFQRMQEA

SEQ ID NO: 636237 - protein, 25 aa, Mycobacterium
AQLARWDGGVALGFDGFARLSSSSA

SEQ ID NO: 636238 - protein, 21 aa, Mycobacterium
AQLASLFGVSAECVRKDLAQL

SEQ ID NO: 636239 - protein, 20 aa, Mycobacterium
AQLATAHAFASLGEDIGPGL

SEQ ID NO: 636240 - protein, 17 aa, Mycobacterium
AQLATFQASVNRVAAAQ

SEQ ID NO: 636241 - protein, 17 aa, Mycobacterium
AQLCVDWEAATLPAQYA

SEQ ID NO: 636242 - protein, 18 aa, Mycobacterium
AQLDDPYCLQGMNHWLAN

SEQ ID NO: 636243 - protein, 23 aa, Mycobacterium
AQLDPWLQSLHDLASRLAAALGL

SEQ ID NO: 636244 - protein, 20 aa, Mycobacterium
AQLDRFSVRLELKYLSEQDE

SEQ ID NO: 636245 - protein, 23 aa, Mycobacterium
AQLDRRLARWMRLYPDAHAEQAL

SEQ ID NO: 636246 - protein, 19 aa, Mycobacterium
AQLEASLASALRHNDRPEV

SEQ ID NO: 636247 - protein, 29 aa, Mycobacterium
AQLEKAIAWYSMIARVVVDAKLAVNDNLL

SEQ ID NO: 636248 - protein, 18 aa, Mycobacterium
AQLFAAGTVRPYIGARFP

SEQ ID NO: 636249 - protein, 19 aa, Mycobacterium
AQLFEAGYVGADWPTEWGG

SEQ ID NO: 636250 - protein, 17 aa, Mycobacterium
AQLFLAEGAIPGLLGTE

SEQ ID NO: 636251 - protein, 19 aa, Mycobacterium
AQLFPGRRFGGGALSVYID

SEQ ID NO: 636252 - protein, 21 aa, Mycobacterium
AQLFRSTGIPVCLWFFAMDKK

SEQ ID NO: 636253 - protein, 20 aa, Mycobacterium
AQLGEPWTAVHVGDEFTIGS

SEQ ID NO: 636254 - protein, 18 aa, Mycobacterium
AQLGGPWQAVHAGDNFTV

SEQ ID NO: 636255 - protein, 20 aa, Mycobacterium
AQLGHCLPDLVAEVRRVLGV

SEQ ID NO: 636256 - protein, 33 aa, Mycobacterium
AQLGQARAWAPVCNLQLPPDWAQHPQLVANPGR

SEQ ID NO: 636257 - protein, 23 aa, Mycobacterium
AQLHARSALFLLVQGQSADVRDA

SEQ ID NO: 636258 - protein, 18 aa, Mycobacterium
AQLHPLLSPSLVDSVVAV

SEQ ID NO: 636259 - protein, 24 aa, Mycobacterium
AQLIGADLAHRVRLARPRAESSIG

SEQ ID NO: 636260 - protein, 18 aa, Mycobacterium
AQLIKVCCSGGVMSLTGE

SEQ ID NO: 636261 - protein, 20 aa, Mycobacterium
AQLISNWRWSDALFTPSDID

SEQ ID NO: 636262 - protein, 24 aa, Mycobacterium
AQLISRPYLPWGDVEQFADRVLRA

SEQ ID NO: 636263 - protein, 18 aa, Mycobacterium
AQLKGYKMICVMPENTSI

SEQ ID NO: 636264 - protein, 23 aa, Mycobacterium
AQLKNGRGAEVWGIEYNEEAARR

SEQ ID NO: 636265 - protein, 26 aa, Mycobacterium
AQLLCAATHLGVRLGVDPSVLLSTLQ

SEQ ID NO: 636266 - protein, 20 aa, Mycobacterium
AQLLMIGWGSSYGPIGEACR

SEQ ID NO: 636267 - protein, 19 aa, Mycobacterium
AQLLPRPIGLIIGLQLSAN

SEQ ID NO: 636268 - protein, 20 aa, Mycobacterium
AQLLPRPIGLIIGLQLSANP

SEQ ID NO: 636269 - protein, 19 aa, Mycobacterium
AQLLPRPIGLIIGLQLTAN

SEQ ID NO: 636270 - protein, 25 aa, Mycobacterium
AQLLRACGRIEGLERIRFTSPHPAE

SEQ ID NO: 636271 - protein, 18 aa, Mycobacterium
AQLLRVYAHWARRTADPS

SEQ ID NO: 636272 - protein, 17 aa, Mycobacterium
AQLLVLIATNFFGQNTS

SEQ ID NO: 636273 - protein, 25 aa, Mycobacterium
AQLMIDPGLGFAKTGQHNWALLHAL

SEQ ID NO: 636274 - protein, 25 aa, Mycobacterium
AQLNVPWNREFNALVYVLSGRGTVG

SEQ ID NO: 636275 - protein, 25 aa, Mycobacterium
AQLPAILRKTLTWDRGKEMANHVAI

SEQ ID NO: 636276 - protein, 19 aa, Mycobacterium
AQLPDGFRMSVKAHRGLTH

SEQ ID NO: 636277 - protein, 19 aa, Mycobacterium
AQLPLRFISAAPIDAASYR

SEQ ID NO: 636278 - protein, 18 aa, Mycobacterium
AQLPLTARPIEWPDSPGR

SEQ ID NO: 636279 - protein, 18 aa, Mycobacterium
AQLPPVLPLPKTVQGLAF

SEQ ID NO: 636280 - protein, 33 aa, Mycobacterium
AQLPQKLAYALVRWKNALLGITFFNLSRRRPEL

SEQ ID NO: 636281 - protein, 25 aa, Mycobacterium
AQLPRIAGMGFDVVYLPPIHPIGKV

SEQ ID NO: 636282 - protein, 18 aa, Mycobacterium
AQLPVAVIGDILGVPEPD

SEQ ID NO: 636283 - protein, 31 aa, Mycobacterium
AQLQARCRRIASICTGAFLLAQAGMLDHRRA

SEQ ID NO: 636284 - protein, 17 aa, Mycobacterium
AQLQRLQLEFAELADAD

SEQ ID NO: 636285 - protein, 23 aa, Mycobacterium
AQLRAEGVEIVFAPTAAAMYPDG

SEQ ID NO: 636286 - protein, 18 aa, Mycobacterium
AQLRALGGVGEMFDTLLV

SEQ ID NO: 636287 - protein, 17 aa, Mycobacterium
AQLRAVLDLTNTEIQVA

SEQ ID NO: 636288 - protein, 24 aa, Mycobacterium
AQLRDDLPVAWKHRSERYTEKLAT

SEQ ID NO: 636289 - protein, 31 aa, Mycobacterium
AQLRDWAGQCLRSPYGLLYTRLTERGGVPME

SEQ ID NO: 636290 - protein, 24 aa, Mycobacterium
AQLREARPLSWHPPVEDALMPDAD

SEQ ID NO: 636291 - protein, 25 aa, Mycobacterium
AQLRGRGGTHLVAMAVTADSPFGRA

SEQ ID NO: 636292 - protein, 17 aa, Mycobacterium
AQLRLNYDAVVLAGGAT

SEQ ID NO: 636293 - protein, 17 aa, Mycobacterium
AQLRNWEFFGAPLAGVV

SEQ ID NO: 636294 - protein, 19 aa, Mycobacterium
AQLRPLLAPSLVDSVVSVG

SEQ ID NO: 636295 - protein, 17 aa, Mycobacterium
AQLRPPPTFAEVSFSTY

SEQ ID NO: 636296 - protein, 26 aa, Mycobacterium
AQLRREFSEWLGTHFTLDPVRASDIV

SEQ ID NO: 636297 - protein, 17 aa, Mycobacterium
AQLRSDVGMVFQSFNLF

SEQ ID NO: 636298 - protein, 21 aa, Mycobacterium
AQLRSPMWLVTRGAQHVTDTD

SEQ ID NO: 636299 - protein, 26 aa, Mycobacterium
AQLRSRSWWSGFDVVLLVDDWHMIVG

SEQ ID NO: 636300 - protein, 21 aa, Mycobacterium
AQLRVKPSLAHKSTAQTKLTS

SEQ ID NO: 636301 - protein, 18 aa, Mycobacterium
AQLRYEITVEQALAAPIV

SEQ ID NO: 636302 - protein, 19 aa, Mycobacterium
AQLSHLHWLSSVDPDDGSV

SEQ ID NO: 636303 - protein, 17 aa, Mycobacterium
AQLSILIVPVSPLKPED

SEQ ID NO: 636304 - protein, 17 aa, Mycobacterium
AQLSSWQGMVSGVLSGV

SEQ ID NO: 636305 - protein, 26 aa, Mycobacterium
AQLTKPVRWDLCTATLRDRFQNAESA

SEQ ID NO: 636306 - protein, 18 aa, Mycobacterium
AQLTPLVFEGSQFGGALM

SEQ ID NO: 636307 - protein, 25 aa, Mycobacterium
AQLVTRYLATYAFYRGAFSPAAARL

SEQ ID NO: 636308 - protein, 23 aa, Mycobacterium
AQLYRRLHVPAMPQLSSLTEDVR

SEQ ID NO: 636309 - protein, 24 aa, Mycobacterium
AQLYSVRSGQSWGVGDLTDLTDLA

SEQ ID NO: 636310 - protein, 23 aa, Mycobacterium
AQMAAGNIKACWIICTNPVASVA

SEQ ID NO: 636311 - protein, 24 aa, Mycobacterium
AQMAETLARVALRGSWLDRDATAL

SEQ ID NO: 636312 - protein, 19 aa, Mycobacterium
AQMALPPSVWSYVVGGAGD

SEQ ID NO: 636313 - protein, 27 aa, Mycobacterium
AQMGIGGGWYEHEWRAYGYGFPGAAER

SEQ ID NO: 636314 - protein, 28 aa, Mycobacterium
AQMMLRNRPDLVGALVLFAGLQPSPVGA

SEQ ID NO: 636315 - protein, 24 aa, Mycobacterium
AQMPDRRSYFWIARTTTAEPSRYL

SEQ ID NO: 636316 - protein, 21 aa, Mycobacterium
AQMRRFGGLLSVELADAAAVH

SEQ ID NO: 636317 - protein, 19 aa, Mycobacterium
AQMTLDFSTEWKAYHREGA

SEQ ID NO: 636318 - protein, 19 aa, Mycobacterium
AQMTLDFSTEWTAYHRDGA

SEQ ID NO: 636319 - protein, 20 aa, Mycobacterium
AQMTPFEFVADVVIRTRAWE

SEQ ID NO: 636320 - protein, 26 aa, Mycobacterium
AQMTRPVRWDLCTAAMKDLGVTALVE

SEQ ID NO: 636321 - protein, 19 aa, Mycobacterium
AQMVRLLVQYAAWHLDRDH

SEQ ID NO: 636322 - protein, 18 aa, Mycobacterium
AQMVRLLVRYAASELDRN

SEQ ID NO: 636323 - protein, 23 aa, Mycobacterium
AQMVRLLVYYAAWHLDRNHHMEV

SEQ ID NO: 636324 - protein, 18 aa, Mycobacterium
AQMYRRFGAEVTVVEKGP

SEQ ID NO: 636325 - protein, 19 aa, Mycobacterium
AQNAIRWTKHSLNYWYRMF

SEQ ID NO: 636326 - protein, 24 aa, Mycobacterium
AQNALPRRGLSALVRRPRRRPLDE

SEQ ID NO: 636327 - protein, 20 aa, Mycobacterium
AQNALRWIGADVELNTEPPV

SEQ ID NO: 636328 - protein, 17 aa, Mycobacterium
AQNGRFAEIAKRDIWTP

SEQ ID NO: 636329 - protein, 18 aa, Mycobacterium
AQNGRYGPYLKRGKDSRS

SEQ ID NO: 636330 - protein, 18 aa, Mycobacterium
AQNGRYGPYLKRGTDSRS

SEQ ID NO: 636331 - protein, 20 aa, Mycobacterium
AQNGRYGPYLKRGTDSRSLA

SEQ ID NO: 636332 - protein, 23 aa, Mycobacterium
AQNLDFLVAVARSCVGHAVSVVV

SEQ ID NO: 636333 - protein, 26 aa, Mycobacterium
AQNLLDLINAPALALFGRPWIGNGAD

SEQ ID NO: 636334 - protein, 18 aa, Mycobacterium
AQNMAAAFVNELTAAGIP

SEQ ID NO: 636335 - protein, 20 aa, Mycobacterium
AQNRCFYRTSANLLTPGGPT

SEQ ID NO: 636336 - protein, 21 aa, Mycobacterium
AQNRLRPGVVRGEHLNHPTTA

SEQ ID NO: 636337 - protein, 20 aa, Mycobacterium
AQNRLRPGVVRGEHTNHPTT

SEQ ID NO: 636338 - protein, 17 aa, Mycobacterium
AQNRVEMAWGDVLTDGI

SEQ ID NO: 636339 - protein, 19 aa, Mycobacterium
AQNVGAMFGYHVGVSEALS

SEQ ID NO: 636340 - protein, 31 aa, Mycobacterium
AQNYYPRNAVAFAPMIFLGREFWTEKLPVLP

SEQ ID NO: 636341 - protein, 19 aa, Mycobacterium
AQPACIALFSPWLNMAVDH

SEQ ID NO: 636342 - protein, 20 aa, Mycobacterium
AQPADIGWAAAFLASDLASY

SEQ ID NO: 636343 - protein, 25 aa, Mycobacterium
AQPAEMYSAICIAATLIVPGCDHAS

SEQ ID NO: 636344 - protein, 23 aa, Mycobacterium
AQPAEPLPWLLSGAKTLSYAINM

SEQ ID NO: 636345 - protein, 19 aa, Mycobacterium
AQPALFALEVGLWALLEHW

SEQ ID NO: 636346 - protein, 18 aa, Mycobacterium
AQPARAAGVPHYADCPMP

SEQ ID NO: 636347 - protein, 20 aa, Mycobacterium
AQPEFGGLVSSLPDAVQSLA

SEQ ID NO: 636348 - protein, 17 aa, Mycobacterium
AQPGAQIFVTFDADGQH

SEQ ID NO: 636349 - protein, 18 aa, Mycobacterium
AQPGKSLILRYGPGMGQA

SEQ ID NO: 636350 - protein, 22 aa, Mycobacterium
AQPGPDGWIRAVGYHESVAGPL

SEQ ID NO: 636351 - protein, 17 aa, Mycobacterium
AQPGSDHQLAFVNTLCS

SEQ ID NO: 636352 - protein, 22 aa, Mycobacterium
AQPGVRVRIRFHGRLVDAFLLE

SEQ ID NO: 636353 - protein, 34 aa, Mycobacterium
AQPIACPDCGPSLWFRSAAGWVRGSDAALAATQR

SEQ ID NO: 636354 - protein, 26 aa, Mycobacterium
AQPIACPDCGPSLWFRSSDGRVDGAD

SEQ ID NO: 636355 - protein, 27 aa, Mycobacterium
AQPIACPNCGPSLWFRSATEHVAGADA

SEQ ID NO: 636356 - protein, 25 aa, Mycobacterium
AQPICCPGCGPTLRYRDRAGRELAG

SEQ ID NO: 636357 - protein, 24 aa, Mycobacterium
AQPLQRLASAWQRLTAVTGTSEAQ

SEQ ID NO: 636358 - protein, 18 aa, Mycobacterium
AQPLYARYWLHNRGPAPL

SEQ ID NO: 636359 - protein, 22 aa, Mycobacterium
AQPRARFGLVLRYRAAPAHHRR

SEQ ID NO: 636360 - protein, 23 aa, Mycobacterium
AQPRIKELAAYGALRGAILDIGC

SEQ ID NO: 636361 - protein, 22 aa, Mycobacterium
AQPRLAGQLEHGGLRLRRRSTL

SEQ ID NO: 636362 - protein, 23 aa, Mycobacterium
AQPSLPFTDEWLSRWRACDPDPD

SEQ ID NO: 636363 - protein, 17 aa, Mycobacterium
AQPVLRSAYAVYALPSP

SEQ ID NO: 636364 - protein, 19 aa, Mycobacterium
AQPVPGWFCESADLAELGA

SEQ ID NO: 636365 - protein, 18 aa, Mycobacterium
AQPVPLPPGELVLASAPL

SEQ ID NO: 636366 - protein, 21 aa, Mycobacterium
AQPVRLCLDLDAGYWRAGGRV

SEQ ID NO: 636367 - protein, 25 aa, Mycobacterium
AQPWRWVGQELPELSVAPTYLRSGA

SEQ ID NO: 636368 - protein, 18 aa, Mycobacterium
AQQAIALLLGAFVEPGDR

SEQ ID NO: 636369 - protein, 26 aa, Mycobacterium
AQQALAFRLATSWMFGYVDAALNRAE

SEQ ID NO: 636370 - protein, 24 aa, Mycobacterium
AQQFIGRLLIPLGGISEVQPDLQL

SEQ ID NO: 636371 - protein, 25 aa, Mycobacterium
AQQFKDRLAPNVLYPQRLGNPEEFA

SEQ ID NO: 636372 - protein, 26 aa, Mycobacterium
AQQFNQRWVRLGCDIDLSGLFYEGER

SEQ ID NO: 636373 - protein, 18 aa, Mycobacterium
AQQHWRTALGFAAPSVLE

SEQ ID NO: 636374 - protein, 19 aa, Mycobacterium
AQQHWRTALGFAAPSVLES

SEQ ID NO: 636375 - protein, 17 aa, Mycobacterium
AQQMGLLRDELLKRVDD

SEQ ID NO: 636376 - protein, 21 aa, Mycobacterium
AQQMTEGWRAHGLDMDIAGLT

SEQ ID NO: 636377 - protein, 19 aa, Mycobacterium
AQQQALVAINSPVQDLTGR

SEQ ID NO: 636378 - protein, 25 aa, Mycobacterium
AQQVARWKAARGRRSEGANTANETE

SEQ ID NO: 636379 - protein, 20 aa, Mycobacterium
AQQVRCIYVAVGQKGSTVAA

SEQ ID NO: 636380 - protein, 25 aa, Mycobacterium
AQQVRLPGFRPGKAPAKLLEARVGR

SEQ ID NO: 636381 - protein, 19 aa, Mycobacterium
AQQVWDNRIVPFAHNLSTR

SEQ ID NO: 636382 - protein, 25 aa, Mycobacterium
AQQWADMCAIPISFIKETVKRAQAE

SEQ ID NO: 636383 - protein, 18 aa, Mycobacterium
AQQWFDLCAMVGHPEWID

SEQ ID NO: 636384 - protein, 25 aa, Mycobacterium
AQQWRWSPAHLVVTCGARGARYVGV

SEQ ID NO: 636385 - protein, 25 aa, Mycobacterium
AQRAEQRLAAIAARRRVADRELERE

SEQ ID NO: 636386 - protein, 18 aa, Mycobacterium
AQRAFPYIGRSVHVDEDA

SEQ ID NO: 636387 - protein, 20 aa, Mycobacterium
AQRAGGRPVKLALTRQQMFS

SEQ ID NO: 636388 - protein, 25 aa, Mycobacterium
AQRAIKEAFDPAGLLNPGVMLPEQS

SEQ ID NO: 636389 - protein, 22 aa, Mycobacterium
AQRAKEVGLVWRLVEPDRLQAE

SEQ ID NO: 636390 - protein, 26 aa, Mycobacterium
AQRALRFASSTGFGRRAIAYERLSLL

SEQ ID NO: 636391 - protein, 25 aa, Mycobacterium
AQRCEAAGMTLRIPRPRLCTDNGAM

SEQ ID NO: 636392 - protein, 23 aa, Mycobacterium
AQRCPAQGGSPLLSYGTPRSPAV

SEQ ID NO: 636393 - protein, 21 aa, Mycobacterium
AQRCPDRPGLVDELGTLTWRE

SEQ ID NO: 636394 - protein, 23 aa, Mycobacterium
AQRDRFLFKLNVDYPSPEEEREI

SEQ ID NO: 636395 - protein, 19 aa, Mycobacterium
AQREARRGTPERLGLVARH

SEQ ID NO: 636396 - protein, 24 aa, Mycobacterium
AQRFADAVTAIWHGRVEIDRFNEL

SEQ ID NO: 636397 - protein, 24 aa, Mycobacterium
AQRFADAVTAIWQGRIEIDRFNEL

SEQ ID NO: 636398 - protein, 24 aa, Mycobacterium
AQRFADAVTAIWQGRVEVDRFNEL

SEQ ID NO: 636399 - protein, 19 aa, Mycobacterium
AQRFGHAPTGIWAPECAYA

SEQ ID NO: 636400 - protein, 19 aa, Mycobacterium
AQRFPRLDVLVNNAGANFP

SEQ ID NO: 636401 - protein, 21 aa, Mycobacterium
AQRFPTIEFHAEQIGKTAAGY

SEQ ID NO: 636402 - protein, 22 aa, Mycobacterium
AQRFRAARVVIDIGVHCGLTAP

SEQ ID NO: 636403 - protein, 18 aa, Mycobacterium
AQRGHFNAAVVVGNDSTA

SEQ ID NO: 636404 - protein, 19 aa, Mycobacterium
AQRGLSAVMGMAVGSGSFA

SEQ ID NO: 636405 - protein, 37 aa, Mycobacterium
AQRHWIHRVFEGMGWRTAELLEAMWTCDDFYFDSIAQ

SEQ ID NO: 636406 - protein, 28 aa, Mycobacterium
AQRIKDLVIPPAWKNVWISPSPNGHIQA

SEQ ID NO: 636407 - protein, 19 aa, Mycobacterium
AQRIPGPSVLEWATTSDGP

SEQ ID NO: 636408 - protein, 21 aa, Mycobacterium
AQRISEKFPTSAIAVLRVSDR

SEQ ID NO: 636409 - protein, 24 aa, Mycobacterium
AQRLAEKLWKLRILDDERSASDVA

SEQ ID NO: 636410 - protein, 23 aa, Mycobacterium
AQRLAESCGLDITDLGKVVRHTD

SEQ ID NO: 636411 - protein, 25 aa, Mycobacterium
AQRLARAGWRIVILEAGPFWHPDED

SEQ ID NO: 636412 - protein, 20 aa, Mycobacterium
AQRLGGPVLIVLEDVDLWCR

SEQ ID NO: 636413 - protein, 18 aa, Mycobacterium
AQRLGLIDPDAWAFTWVV

SEQ ID NO: 636414 - protein, 17 aa, Mycobacterium
AQRLHWLGTELNGAPVD

SEQ ID NO: 636415 - protein, 18 aa, Mycobacterium
AQRLLGRARSELEFMRPG

SEQ ID NO: 636416 - protein, 23 aa, Mycobacterium
AQRLPGLLPPLSRGESLEVTAIH

SEQ ID NO: 636417 - protein, 18 aa, Mycobacterium
AQRLSVYIRHQLEAGQQF

SEQ ID NO: 636418 - protein, 20 aa, Mycobacterium
AQRLYGKGRWAAMLELGAHL

SEQ ID NO: 636419 - protein, 20 aa, Mycobacterium
AQRMCLARTLLAQPQVLLLD

SEQ ID NO: 636420 - protein, 19 aa, Mycobacterium
AQRPELWNIYNGRHRKGEH

SEQ ID NO: 636421 - protein, 20 aa, Mycobacterium
AQRPELWNLYNGRHHKGEHI

SEQ ID NO: 636422 - protein, 28 aa, Mycobacterium
AQRPGVELRLLQTMLALFDLVRKAQGPD

SEQ ID NO: 636423 - protein, 17 aa, Mycobacterium
AQRPRRILFVSGGSGIT

SEQ ID NO: 636424 - protein, 24 aa, Mycobacterium
AQRRFARHYVHAGMIGWDGHKMSK

SEQ ID NO: 636425 - protein, 18 aa, Mycobacterium
AQRRGAVVVGGLDMLLNQ

SEQ ID NO: 636426 - protein, 22 aa, Mycobacterium
AQRRLPSFGIPYWTGRGFGLGL

SEQ ID NO: 636427 - protein, 21 aa, Mycobacterium
AQRRRVVELAGRLDRLSPGAA

SEQ ID NO: 636428 - protein, 24 aa, Mycobacterium
AQRSMFEHRAVVFGAGREELLSGL

SEQ ID NO: 636429 - protein, 25 aa, Mycobacterium
AQRTRPDMWSVLEYGCHVRDVHRIF

SEQ ID NO: 636430 - protein, 23 aa, Mycobacterium
AQRVDEVLEMVGLTEVANRHAGT

SEQ ID NO: 636431 - protein, 18 aa, Mycobacterium
AQRVGLARALFRSPELLL

SEQ ID NO: 636432 - protein, 18 aa, Mycobacterium
AQRVWQRVLVPLAAEMGT

SEQ ID NO: 636433 - protein, 19 aa, Mycobacterium
AQRWPEVISSLGEELGSFE

SEQ ID NO: 636434 - protein, 22 aa, Mycobacterium
AQRYLEVIPDPDVVMLADDIAH

SEQ ID NO: 636435 - protein, 27 aa, Mycobacterium
AQSAAFHERLVQTLRSGASAYLGTELA

SEQ ID NO: 636436 - protein, 25 aa, Mycobacterium
AQSANARWGNNIAILAGDYLFATAS

SEQ ID NO: 636437 - protein, 19 aa, Mycobacterium
AQSDLRRTAAMLSAVTGDR

SEQ ID NO: 636438 - protein, 22 aa, Mycobacterium
AQSGRPGAVLVDIPKDILQAQT

SEQ ID NO: 636439 - protein, 19 aa, Mycobacterium
AQSHPQLRLIGGNFGDQAV

SEQ ID NO: 636440 - protein, 21 aa, Mycobacterium
AQSMAGPLLGMMTQMGGMAFG

SEQ ID NO: 636441 - protein, 18 aa, Mycobacterium
AQSNGFNAVRVFLHDLLW

SEQ ID NO: 636442 - protein, 27 aa, Mycobacterium
AQSPKESWLRLVLIDAGLPRPTTQIRV

SEQ ID NO: 636443 - protein, 27 aa, Mycobacterium
AQSPKESWLRLVLIQAGLPRPQTQIPV

SEQ ID NO: 636444 - protein, 28 aa, Mycobacterium
AQSPKETWLRLGALVLVTAGFPRPQTQI

SEQ ID NO: 636445 - protein, 26 aa, Mycobacterium
AQSPKETWLRLLIVRDGLPKPTTQIP

SEQ ID NO: 636446 - protein, 26 aa, Mycobacterium
AQSPKETWLRLLLIDAGFPRPQTQIA

SEQ ID NO: 636447 - protein, 25 aa, Mycobacterium
AQSPKETWLRLLLLDDGLPRPQTQI

SEQ ID NO: 636448 - protein, 25 aa, Mycobacterium
AQSPKETWLRLLLRDAGLPPVSTQI

SEQ ID NO: 636449 - protein, 27 aa, Mycobacterium
AQSPKETWLRLVLVQGGLPRPQTQIPV

SEQ ID NO: 636450 - protein, 19 aa, Mycobacterium
AQSRYRIFIIDEAHMVTTA

SEQ ID NO: 636451 - protein, 24 aa, Mycobacterium
AQSSSILFLGRHVGYPVALEGALK

SEQ ID NO: 636452 - protein, 19 aa, Mycobacterium
AQSSTVLFLGRHVGYPVAL

SEQ ID NO: 636453 - protein, 17 aa, Mycobacterium
AQSTFDALGAHALPGGY

SEQ ID NO: 636454 - protein, 25 aa, Mycobacterium
AQSVLKLLGSEAMQRACEDALGAKG

SEQ ID NO: 636455 - protein, 18 aa, Mycobacterium
AQSWDRLAAGRAGRVVLL

SEQ ID NO: 636456 - protein, 17 aa, Mycobacterium
AQTAGISDFLWLRIMNV

SEQ ID NO: 636457 - protein, 24 aa, Mycobacterium
AQTAPRVAEGVMRNAVIEGVSAIA

SEQ ID NO: 636458 - protein, 26 aa, Mycobacterium
AQTAWREVLDGFGAPSLVGPPGGLAL

SEQ ID NO: 636459 - protein, 18 aa, Mycobacterium
AQTDWEFRQLCLSDPAAA

SEQ ID NO: 636460 - protein, 24 aa, Mycobacterium
AQTDWLDPLIALSFAAAATNRIEL

SEQ ID NO: 636461 - protein, 19 aa, Mycobacterium
AQTGFRRIVIVNGHGGNDE

SEQ ID NO: 636462 - protein, 25 aa, Mycobacterium
AQTGRAALPYGVHVGRWDELDGLVD

SEQ ID NO: 636463 - protein, 21 aa, Mycobacterium
AQTGRRVHRLAVSHAFHSPLM

SEQ ID NO: 636464 - protein, 21 aa, Mycobacterium
AQTHPGLRYVVYDISTATPER

SEQ ID NO: 636465 - protein, 23 aa, Mycobacterium
AQTKRRVAVLGGNRIPFARSDGA

SEQ ID NO: 636466 - protein, 26 aa, Mycobacterium
AQTLALHEQFVKLMSGGAAQYAAAEA

SEQ ID NO: 636467 - protein, 23 aa, Mycobacterium
AQTLERFTALVLPASGDPTVVVP

SEQ ID NO: 636468 - protein, 21 aa, Mycobacterium
AQTLFGRPFIGNGADGTAASP

SEQ ID NO: 636469 - protein, 23 aa, Mycobacterium
AQTLLGRPLIGNGANGAPGTGAN

SEQ ID NO: 636470 - protein, 21 aa, Mycobacterium
AQTLQAFLHWAISDGNNSSFL

SEQ ID NO: 636471 - protein, 19 aa, Mycobacterium
AQTPAGCSLMEWENDDNGR

SEQ ID NO: 636472 - protein, 19 aa, Mycobacterium
AQTPAGCSLMEWENNNNGR

SEQ ID NO: 636473 - protein, 19 aa, Mycobacterium
AQTQLRYTLLRKLADDPGR

SEQ ID NO: 636474 - protein, 18 aa, Mycobacterium
AQTRADPHLARITCPALV

SEQ ID NO: 636475 - protein, 25 aa, Mycobacterium
AQTRAEPHLARIRCPALVINADADT

SEQ ID NO: 636476 - protein, 24 aa, Mycobacterium
AQTRAEPHLARITCPALVINADAD

SEQ ID NO: 636477 - protein, 24 aa, Mycobacterium
AQTRAEPHLARITCPALVINADQD

SEQ ID NO: 636478 - protein, 25 aa, Mycobacterium
AQTREMIKTGGFDAVCFTSSSTVRN

SEQ ID NO: 636479 - protein, 18 aa, Mycobacterium
AQTRFLLNVPLFQRESVH

SEQ ID NO: 636480 - protein, 17 aa, Mycobacterium
AQTRLGGGRIHHAMRTI

SEQ ID NO: 636481 - protein, 19 aa, Mycobacterium
AQTVWGVGIAPSITTASLR

SEQ ID NO: 636482 - protein, 17 aa, Mycobacterium
AQTWSRLDAPLPAPREV

SEQ ID NO: 636483 - protein, 18 aa, Mycobacterium
AQVADLLARIRAELPPLA

SEQ ID NO: 636484 - protein, 18 aa, Mycobacterium
AQVAKELPQHGAMPYRSI

SEQ ID NO: 636485 - protein, 25 aa, Mycobacterium
AQVCESFAIPWLVIRALSDLAGAGS

SEQ ID NO: 636486 - protein, 25 aa, Mycobacterium
AQVCESFGIPWLVIRALSDLAGSDS

SEQ ID NO: 636487 - protein, 23 aa, Mycobacterium
AQVCHRRGKPLIVDEAWGAHLPF

SEQ ID NO: 636488 - protein, 22 aa, Mycobacterium
AQVCRDQHRIGGYRRCPHGKQL

SEQ ID NO: 636489 - protein, 17 aa, Mycobacterium
AQVDAAINWNFQHLTAL

SEQ ID NO: 636490 - protein, 19 aa, Mycobacterium
AQVELRALVDVDIAVNGEQ

SEQ ID NO: 636491 - protein, 18 aa, Mycobacterium
AQVFGVRMLERFDVDWAE

SEQ ID NO: 636492 - protein, 32 aa, Mycobacterium
AQVGAVMPVVAESVASNYGYQSQWVNTGNPIH

SEQ ID NO: 636493 - protein, 26 aa, Mycobacterium
AQVGLPAMMMRAFCDLAERHTWTETR

SEQ ID NO: 636494 - protein, 26 aa, Mycobacterium
AQVGQAGAYLSAWANALGAMLAEMSG

SEQ ID NO: 636495 - protein, 21 aa, Mycobacterium
AQVHRACVPLMTPAPMPHSEP

SEQ ID NO: 636496 - protein, 18 aa, Mycobacterium
AQVKRRLKVGTHRRLSAT

SEQ ID NO: 636497 - protein, 19 aa, Mycobacterium
AQVLDVWRRKDLPAQPAPV

SEQ ID NO: 636498 - protein, 20 aa, Mycobacterium
AQVLDVWRRKNLPAHPAPVL

SEQ ID NO: 636499 - protein, 18 aa, Mycobacterium
AQVLGGSVFAVFPAGGSH

SEQ ID NO: 636500 - protein, 24 aa, Mycobacterium
AQVLKRRAPAGARVIVGRDARHGS

SEQ ID NO: 636501 - protein, 17 aa, Mycobacterium
AQVLSRRAAGGACSESA

SEQ ID NO: 636502 - protein, 30 aa, Mycobacterium
AQVMPVKMPSWLGVPARLVMASLIGNVRVP

SEQ ID NO: 636503 - protein, 24 aa, Mycobacterium
AQVMRKLWHGELIFNHDGPLGKYQ

SEQ ID NO: 636504 - protein, 20 aa, Mycobacterium
AQVMRRLWHGELIFNHDGPM

SEQ ID NO: 636505 - protein, 24 aa, Mycobacterium
AQVMRRLWHGELIFNHDGPMGKYP

SEQ ID NO: 636506 - protein, 23 aa, Mycobacterium
AQVPAVVAMRPEFITVYTHQAAQ

SEQ ID NO: 636507 - protein, 17 aa, Mycobacterium
AQVPDAGGMIIASDRTA

SEQ ID NO: 636508 - protein, 31 aa, Mycobacterium
AQVPEGVTLLGRWWGMNGQGFAIVETDDAKA

SEQ ID NO: 636509 - protein, 23 aa, Mycobacterium
AQVPELLARFPGARTAKVKVAEP

SEQ ID NO: 636510 - protein, 20 aa, Mycobacterium
AQVPGCRFTGLGGATEAAIH

SEQ ID NO: 636511 - protein, 23 aa, Mycobacterium
AQVQGISSAHSWAVTQHPTVAQL

SEQ ID NO: 636512 - protein, 18 aa, Mycobacterium
AQVRLGTPLLQINTSQVA

SEQ ID NO: 636513 - protein, 24 aa, Mycobacterium
AQVRLKRMYPAAGYRATTSTVQVP

SEQ ID NO: 636514 - protein, 21 aa, Mycobacterium
AQVRMEFADGMLRLSAGADDV

SEQ ID NO: 636515 - protein, 23 aa, Mycobacterium
AQVRPGVDVLFLDTGYHFAETIG

SEQ ID NO: 636516 - protein, 17 aa, Mycobacterium
AQVSPWSPREAELLAVT

SEQ ID NO: 636517 - protein, 23 aa, Mycobacterium
AQVTEFDGGVLVNWDVREDAFRP

SEQ ID NO: 636518 - protein, 23 aa, Mycobacterium
AQVTEFDGGVLVNWDVREGVFPA

SEQ ID NO: 636519 - protein, 25 aa, Mycobacterium
AQVTELRGGLLVNWDARESAFPPGL

SEQ ID NO: 636520 - protein, 26 aa, Mycobacterium
AQVTELRGGLLVNWDVRESAFPAGLV

SEQ ID NO: 636521 - protein, 25 aa, Mycobacterium
AQVTEVRGGLLLNWDVRESAFPHGM

SEQ ID NO: 636522 - protein, 19 aa, Mycobacterium
AQVVDGFATYHVMNSHDDG

SEQ ID NO: 636523 - protein, 24 aa, Mycobacterium
AQVVSGDLLAAINAPVLSLTGRPL

SEQ ID NO: 636524 - protein, 20 aa, Mycobacterium
AQVVSLRLVTAGGDILTLSE

SEQ ID NO: 636525 - protein, 19 aa, Mycobacterium
AQVWDVLEEVIAEHPVLLN

SEQ ID NO: 636526 - protein, 24 aa, Mycobacterium
AQVYGSGGSRCMLGSVKTNIGHSE

SEQ ID NO: 636527 - protein, 20 aa, Mycobacterium
AQWAEPAPYFVRDEKHFVPT

SEQ ID NO: 636528 - protein, 17 aa, Mycobacterium
AQWCLQTTLDYVRQRKQ

SEQ ID NO: 636529 - protein, 17 aa, Mycobacterium
AQWEEFHRIGLFLDEIT

SEQ ID NO: 636530 - protein, 17 aa, Mycobacterium
AQWKNQRIIVGAVPETL

SEQ ID NO: 636531 - protein, 17 aa, Mycobacterium
AQWKNQRVIVGAVPETL

SEQ ID NO: 636532 - protein, 19 aa, Mycobacterium
AQWKSSRGPVRQALTTLRA

SEQ ID NO: 636533 - protein, 23 aa, Mycobacterium
AQWLAEEVMQWAGLDLLILRVAA

SEQ ID NO: 636534 - protein, 20 aa, Mycobacterium
AQWLSRAVAVFAEDLDLSLR

SEQ ID NO: 636535 - protein, 18 aa, Mycobacterium
AQWLWAASSGERFEAPPA

SEQ ID NO: 636536 - protein, 22 aa, Mycobacterium
AQWQKYALIVSHTIPFENLGEA

SEQ ID NO: 636537 - protein, 21 aa, Mycobacterium
AQWRAAIGVNLDGAYHTAWAA

SEQ ID NO: 636538 - protein, 19 aa, Mycobacterium
AQWRRLVERFFTAARAGDV

SEQ ID NO: 636539 - protein, 37 aa, Mycobacterium
AQWSPEYREYFGLCLEFPTLCARAFTAHEAVERAQRL

SEQ ID NO: 636540 - protein, 23 aa, Mycobacterium
AQYAEMWTQDATAMYGYAAASSA

SEQ ID NO: 636541 - protein, 22 aa, Mycobacterium
AQYDAGLAWVHLPRGFGGLDLP

SEQ ID NO: 636542 - protein, 18 aa, Mycobacterium
AQYERAWGTIEELKEKDE

SEQ ID NO: 636543 - protein, 19 aa, Mycobacterium
AQYERAWGTIEELKEKDEA

SEQ ID NO: 636544 - protein, 18 aa, Mycobacterium
AQYFAMVRCCAAINRRLA

SEQ ID NO: 636545 - protein, 23 aa, Mycobacterium
AQYGAARLKYRLRTRANPVASAD

SEQ ID NO: 636546 - protein, 23 aa, Mycobacterium
AQYGDGWCPFPAPPQLAQTAGTA

SEQ ID NO: 636547 - protein, 25 aa, Mycobacterium
AQYGDGWCPFPAPPRLAQTAGTAVI

SEQ ID NO: 636548 - protein, 24 aa, Mycobacterium
AQYHFDRLRFIASVGEPLNPEAVW

SEQ ID NO: 636549 - protein, 17 aa, Mycobacterium
AQYLRGVIDTPRCADPL

SEQ ID NO: 636550 - protein, 20 aa, Mycobacterium
AQYMGRRFVSPYGHKFVTAE

SEQ ID NO: 636551 - protein, 18 aa, Mycobacterium
AQYPPGDMSVWDWSEPTG

SEQ ID NO: 636552 - protein, 19 aa, Mycobacterium
AQYRCGRQADALETYRRVR

SEQ ID NO: 636553 - protein, 19 aa, Mycobacterium
AQYRDPGLLLGQRIGASDF

SEQ ID NO: 636554 - protein, 19 aa, Mycobacterium
AQYSTLINCCAAINRRLAQ

SEQ ID NO: 636555 - protein, 21 aa, Mycobacterium
AQYYGHFWVTNALNRTYYGAT

SEQ ID NO: 636556 - protein, 17 aa, Mycobacterium
AQYYRRRFRHILVDEYQ

SEQ ID NO: 636557 - protein, 18 aa, Mycobacterium
AQYYRRRFRHILVDEYQD

SEQ ID NO: 636558 - protein, 19 aa, Mycobacterium
ARAAARYGADTCARGDEDA

SEQ ID NO: 636559 - protein, 29 aa, Mycobacterium
ARAAEAAGFASLWTYERLLFPADPVESYA

SEQ ID NO: 636560 - protein, 24 aa, Mycobacterium
ARAAEFYHAVFGWDVEAPPQAEFG

SEQ ID NO: 636561 - protein, 21 aa, Mycobacterium
ARAAFGAVLDALASVKDPMEQ

SEQ ID NO: 636562 - protein, 17 aa, Mycobacterium
ARAAFRRMQQARHVGKI

SEQ ID NO: 636563 - protein, 24 aa, Mycobacterium
ARAAGEMRARLRALGQQTGVPTGA

SEQ ID NO: 636564 - protein, 19 aa, Mycobacterium
ARAAGLAVSPRMIFENSTV

SEQ ID NO: 636565 - protein, 18 aa, Mycobacterium
ARAAGLICRTRDIFVEQT

SEQ ID NO: 636566 - protein, 18 aa, Mycobacterium
ARAAGLLRGRRRVLDSTP

SEQ ID NO: 636567 - protein, 18 aa, Mycobacterium
ARAAGLVCRPRDIFVEQT

SEQ ID NO: 636568 - protein, 18 aa, Mycobacterium
ARAAGVVCRPRDIFVEQT

SEQ ID NO: 636569 - protein, 18 aa, Mycobacterium
ARAAGVVCRPRDVFTEQT

SEQ ID NO: 636570 - protein, 18 aa, Mycobacterium
ARAAGVVCRPRDVFVEQT

SEQ ID NO: 636571 - protein, 19 aa, Mycobacterium
ARAAGWRLLLADELGVDRT

SEQ ID NO: 636572 - protein, 17 aa, Mycobacterium
ARAAGWRVLLADELGAQ

SEQ ID NO: 636573 - protein, 31 aa, Mycobacterium
ARAAHEALGLPYVWGGGGALGPTGGGFDCSG

SEQ ID NO: 636574 - protein, 19 aa, Mycobacterium
ARAAIPFTPLNYRLSAEGL

SEQ ID NO: 636575 - protein, 17 aa, Mycobacterium
ARAAKRLAKEVTAELSA

SEQ ID NO: 636576 - protein, 21 aa, Mycobacterium
ARAALCSGARIVNDVSGGRAD

SEQ ID NO: 636577 - protein, 21 aa, Mycobacterium
ARAALLDHVDIPPGQVHPMAA

SEQ ID NO: 636578 - protein, 27 aa, Mycobacterium
ARAALTNLGYRGFWMGYFAARSAPLGQ

SEQ ID NO: 636579 - protein, 21 aa, Mycobacterium
ARAALTVLRAEPWRPEAVLRH

SEQ ID NO: 636580 - protein, 18 aa, Mycobacterium
ARAAMISAVLEKHARLSL

SEQ ID NO: 636581 - protein, 19 aa, Mycobacterium
ARAAPGYAAYAAAKAGVIS

SEQ ID NO: 636582 - protein, 18 aa, Mycobacterium
ARAAQHTFMVEAMASELS

SEQ ID NO: 636583 - protein, 19 aa, Mycobacterium
ARAARACYVSQPALSEAIR

SEQ ID NO: 636584 - protein, 23 aa, Mycobacterium
ARAARARPPLTLPSGTATLWAWL

SEQ ID NO: 636585 - protein, 19 aa, Mycobacterium
ARAARELRDGDYVNLGIGL

SEQ ID NO: 636586 - protein, 28 aa, Mycobacterium
ARAARLAALPGWVWRESREDLWERLYAT

SEQ ID NO: 636587 - protein, 26 aa, Mycobacterium
ARAARLETLPGWAWNGNAGHEQWLEQ

SEQ ID NO: 636588 - protein, 28 aa, Mycobacterium
ARAARLETLPGWVWRDSRADRWERGFAA

SEQ ID NO: 636589 - protein, 17 aa, Mycobacterium
ARAARQLVRALLDETMS

SEQ ID NO: 636590 - protein, 20 aa, Mycobacterium
ARAARSRAVMRAMTVAALAA

SEQ ID NO: 636591 - protein, 18 aa, Mycobacterium
ARAARWADGITGFSVSGA

SEQ ID NO: 636592 - protein, 19 aa, Mycobacterium
ARAARWLPDTPVLPVDEVA

SEQ ID NO: 636593 - protein, 19 aa, Mycobacterium
ARAARYAALQAHRDGPVLL

SEQ ID NO: 636594 - protein, 20 aa, Mycobacterium
ARAATLAALSPRMDELFKSA

SEQ ID NO: 636595 - protein, 19 aa, Mycobacterium
ARAATLCFMLGGELENVGA

SEQ ID NO: 636596 - protein, 27 aa, Mycobacterium
ARAAVDPALRLPRVVKSRIVKRRGQLQ

SEQ ID NO: 636597 - protein, 19 aa, Mycobacterium
ARAAVKWVAPAVPVSVVAN

SEQ ID NO: 636598 - protein, 21 aa, Mycobacterium
ARAAWGEVFAGFDAPALVGRQ

SEQ ID NO: 636599 - protein, 17 aa, Mycobacterium
ARAAWQQVLDGFDTPTL

SEQ ID NO: 636600 - protein, 25 aa, Mycobacterium
ARACGVAIRAFELAVRYAQQRHTFG

SEQ ID NO: 636601 - protein, 25 aa, Mycobacterium
ARACGVGIRAFELAVKYAQQRSTFG

SEQ ID NO: 636602 - protein, 27 aa, Mycobacterium
ARACGVGIRAFELAVRYAQQRHTFGKP

SEQ ID NO: 636603 - protein, 23 aa, Mycobacterium
ARACPELRMRVHDGAVLTYPRWL

SEQ ID NO: 636604 - protein, 24 aa, Mycobacterium
ARADADPIRLVWTLYEVAICSGAL

SEQ ID NO: 636605 - protein, 20 aa, Mycobacterium
ARADLGWQIVDATQWSTEKL

SEQ ID NO: 636606 - protein, 26 aa, Mycobacterium
ARADVKFGIEPWFRYFQKIAAFPQMT

SEQ ID NO: 636607 - protein, 23 aa, Mycobacterium
ARADVKFGIEPWFRYFQKVAAFP

SEQ ID NO: 636608 - protein, 17 aa, Mycobacterium
ARAEADSGAALRDVDDR

SEQ ID NO: 636609 - protein, 22 aa, Mycobacterium
ARAEALATLRHWAQHTDRAHIW

SEQ ID NO: 636610 - protein, 24 aa, Mycobacterium
ARAEALDASAQWVPQVWRDMDTTL

SEQ ID NO: 636611 - protein, 19 aa, Mycobacterium
ARAEALLALHQPGNPVILP

SEQ ID NO: 636612 - protein, 17 aa, Mycobacterium
ARAEAQLGYALTGSHIG

SEQ ID NO: 636613 - protein, 19 aa, Mycobacterium
ARAEELLKRVNLEERMKHR

SEQ ID NO: 636614 - protein, 24 aa, Mycobacterium
ARAEPGDPFSWWSVNADGEEVVTR

SEQ ID NO: 636615 - protein, 25 aa, Mycobacterium
ARAERAELIDWLFGQGITAAEIRTT

SEQ ID NO: 636616 - protein, 23 aa, Mycobacterium
ARAESYGPVALRPDHRDQRRELG

SEQ ID NO: 636617 - protein, 21 aa, Mycobacterium
ARAEYRFGTRITEIDSSGATL

SEQ ID NO: 636618 - protein, 22 aa, Mycobacterium
ARAFKAHAMAAVGAHDTAHDTG

SEQ ID NO: 636619 - protein, 19 aa, Mycobacterium
ARAFSGVKIACVGESTADR

SEQ ID NO: 636620 - protein, 19 aa, Mycobacterium
ARAFSGVKIACVGQATAEK

SEQ ID NO: 636621 - protein, 20 aa, Mycobacterium
ARAFTPKKMRAIEDKIRAFC

SEQ ID NO: 636622 - protein, 20 aa, Mycobacterium
ARAFVDARIQTIYGGTNEIM

SEQ ID NO: 636623 - protein, 20 aa, Mycobacterium
ARAFVNRPLVLIADEPTGNL

SEQ ID NO: 636624 - protein, 21 aa, Mycobacterium
ARAGDLNWLFLPGGPGIGSES

SEQ ID NO: 636625 - protein, 20 aa, Mycobacterium
ARAGEMLDLVAAYAADPLDP

SEQ ID NO: 636626 - protein, 20 aa, Mycobacterium
ARAGEVVDRITTDGGTALAL

SEQ ID NO: 636627 - protein, 21 aa, Mycobacterium
ARAGGFALIVGIDRAERAEDL

SEQ ID NO: 636628 - protein, 21 aa, Mycobacterium
ARAGIDMAGTPSFMWLEVDDV

SEQ ID NO: 636629 - protein, 20 aa, Mycobacterium
ARAGILESLGRPGGERETQL

SEQ ID NO: 636630 - protein, 20 aa, Mycobacterium
ARAGIPFSLSTLGTCAIEDL

SEQ ID NO: 636631 - protein, 24 aa, Mycobacterium
ARAGKLPVTMFTAGGIATPADAAM

SEQ ID NO: 636632 - protein, 25 aa, Mycobacterium
ARAGMPCPVCGDVVREVSFADKSFQ

SEQ ID NO: 636633 - protein, 19 aa, Mycobacterium
ARAGPRIRIAQVAPSTIAR

SEQ ID NO: 636634 - protein, 23 aa, Mycobacterium
ARAGTHIMLEWGDVFGPWEAGPQ

SEQ ID NO: 636635 - protein, 21 aa, Mycobacterium
ARAGTVPAIADWYRTRGITPR

SEQ ID NO: 636636 - protein, 18 aa, Mycobacterium
ARAGTWLDAATFTLTEDA

SEQ ID NO: 636637 - protein, 21 aa, Mycobacterium
ARAGVAFTPINYRLSAEGIQA

SEQ ID NO: 636638 - protein, 19 aa, Mycobacterium
ARAGVVAAVHAGRVGAAGG

SEQ ID NO: 636639 - protein, 21 aa, Mycobacterium
ARAHGADLILLIVAALEQTAL

SEQ ID NO: 636640 - protein, 21 aa, Mycobacterium
ARAHGADLLLLIVAALEQPAL

SEQ ID NO: 636641 - protein, 21 aa, Mycobacterium
ARAHGADMLLLIVAALDQPVL

SEQ ID NO: 636642 - protein, 20 aa, Mycobacterium
ARAIATEIGHPVMVKAQVKI

SEQ ID NO: 636643 - protein, 18 aa, Mycobacterium
ARAIERFLRPVCYQNAPK

SEQ ID NO: 636644 - protein, 21 aa, Mycobacterium
ARAIKARAKLEAKLAARNETR

SEQ ID NO: 636645 - protein, 22 aa, Mycobacterium
ARAIPEMFRKAFKVAETERPAA

SEQ ID NO: 636646 - protein, 25 aa, Mycobacterium
ARAITIGAFANKVTLGFTSDIKNLV

SEQ ID NO: 636647 - protein, 20 aa, Mycobacterium
ARAKFLAITGAGGFLLYLQM

SEQ ID NO: 636648 - protein, 20 aa, Mycobacterium
ARAKGFRNRVTWTVTKWDPP

SEQ ID NO: 636649 - protein, 24 aa, Mycobacterium
ARAKGFRNRVTWTVTTWDPPHQVA

SEQ ID NO: 636650 - protein, 17 aa, Mycobacterium
ARAKLQIGRSGRHIAQE

SEQ ID NO: 636651 - protein, 19 aa, Mycobacterium
ARAKLQIGRSGRHIAQESI

SEQ ID NO: 636652 - protein, 19 aa, Mycobacterium
ARAKLQRKGCDLLVVNAVG

SEQ ID NO: 636653 - protein, 25 aa, Mycobacterium
ARAKNRPVWIKGFGEQVPFKTPTYA

SEQ ID NO: 636654 - protein, 19 aa, Mycobacterium
ARAKVALASRIYVEGRHDA

SEQ ID NO: 636655 - protein, 19 aa, Mycobacterium
ARAKVSRLAAVIPVHTHID

SEQ ID NO: 636656 - protein, 23 aa, Mycobacterium
ARALAASVGISWTSELLTVTGVD

SEQ ID NO: 636657 - protein, 19 aa, Mycobacterium
ARALAEFKAMFQMKFYAVA

SEQ ID NO: 636658 - protein, 20 aa, Mycobacterium
ARALAMAPQVMFFDEATSAL

SEQ ID NO: 636659 - protein, 17 aa, Mycobacterium
ARALAYFAALTIAADDP

SEQ ID NO: 636660 - protein, 25 aa, Mycobacterium
ARALCLRLLTVRARTRAELEAQLTK

SEQ ID NO: 636661 - protein, 17 aa, Mycobacterium
ARALDAFLRDVYSEQAI

SEQ ID NO: 636662 - protein, 19 aa, Mycobacterium
ARALDNCAAAGLTVTLVAA

SEQ ID NO: 636663 - protein, 28 aa, Mycobacterium
ARALGCTIKLLAICERLTSPKGKQKVSA

SEQ ID NO: 636664 - protein, 26 aa, Mycobacterium
ARALGCTIKLLSICERITGDDGQERV

SEQ ID NO: 636665 - protein, 27 aa, Mycobacterium
ARALGCTIKLLSICERLTTDEGQQRVS

SEQ ID NO: 636666 - protein, 25 aa, Mycobacterium
ARALGLRPLAAFRSWSYVSVDPADE

SEQ ID NO: 636667 - protein, 17 aa, Mycobacterium
ARALGLTKSDAMRYLTN

SEQ ID NO: 636668 - protein, 25 aa, Mycobacterium
ARALIAVRGLHRFAAAEGIAAIDVA

SEQ ID NO: 636669 - protein, 25 aa, Mycobacterium
ARALIAVRGLHRFAAAEGLAALDVA

SEQ ID NO: 636670 - protein, 22 aa, Mycobacterium
ARALIESGCRIVAEGANMPCTP

SEQ ID NO: 636671 - protein, 20 aa, Mycobacterium
ARALIRSRLVPPARPEPIAE

SEQ ID NO: 636672 - protein, 18 aa, Mycobacterium
ARALLAIDGVAGVNVSGL

SEQ ID NO: 636673 - protein, 17 aa, Mycobacterium
ARALLALEGGAGAQEEL

SEQ ID NO: 636674 - protein, 17 aa, Mycobacterium
ARALLELYEVIDAAVEI

SEQ ID NO: 636675 - protein, 24 aa, Mycobacterium
ARALLRRVAELGLQVVLATSAPDD

SEQ ID NO: 636676 - protein, 19 aa, Mycobacterium
ARALLSIDGVEGVNVSGLA

SEQ ID NO: 636677 - protein, 26 aa, Mycobacterium
ARALPEHTRWLPGDYRYCDVVATLAA

SEQ ID NO: 636678 - protein, 19 aa, Mycobacterium
ARALPRIFGAMARHHFMGN

SEQ ID NO: 636679 - protein, 17 aa, Mycobacterium
ARALRALGVRKGDRVGG

SEQ ID NO: 636680 - protein, 18 aa, Mycobacterium
ARALRDWLAALAEGVDLL

SEQ ID NO: 636681 - protein, 24 aa, Mycobacterium
ARALREITIELSVFGSEGRQGKLD

SEQ ID NO: 636682 - protein, 17 aa, Mycobacterium
ARALSPISSVAGRKGYL

SEQ ID NO: 636683 - protein, 22 aa, Mycobacterium
ARALTPPALIARVVAALKEGHS

SEQ ID NO: 636684 - protein, 22 aa, Mycobacterium
ARALTPPALVVRLVDMLRAGHA

SEQ ID NO: 636685 - protein, 22 aa, Mycobacterium
ARALTPPALVVRVVDALRSGHN

SEQ ID NO: 636686 - protein, 21 aa, Mycobacterium
ARALYEKNWIRLISDVDYTPA

SEQ ID NO: 636687 - protein, 18 aa, Mycobacterium
ARAMLGFMDTELRIDYRD

SEQ ID NO: 636688 - protein, 22 aa, Mycobacterium
ARANARGLVVVRMGSETKGSEG

SEQ ID NO: 636689 - protein, 28 aa, Mycobacterium
ARANGFRDIICPPLFLQYAVLGVTHLEA

SEQ ID NO: 636690 - protein, 19 aa, Mycobacterium
ARANKHFHGMLTFGFASLA

SEQ ID NO: 636691 - protein, 20 aa, Mycobacterium
ARANLKWTPQPAMPGQLRAV

SEQ ID NO: 636692 - protein, 20 aa, Mycobacterium
ARAPGGPAIRVEPEATVFTN

SEQ ID NO: 636693 - protein, 21 aa, Mycobacterium
ARAPGLSAREDHRRSRSSTQA

SEQ ID NO: 636694 - protein, 20 aa, Mycobacterium
ARAPHGFAHHLRRLGRSAAG

SEQ ID NO: 636695 - protein, 33 aa, Mycobacterium
ARAPHLFRHARAIPGRAAHGWRQNRGGVAVADN

SEQ ID NO: 636696 - protein, 21 aa, Mycobacterium
ARAPLEFPSIPALFDAHVAGT

SEQ ID NO: 636697 - protein, 18 aa, Mycobacterium
ARAPRVDIVAAYLGSDGV

SEQ ID NO: 636698 - protein, 30 aa, Mycobacterium
ARAPSVDVFAGWRITSHQGGWFARSGVGSD

SEQ ID NO: 636699 - protein, 18 aa, Mycobacterium
ARAPVLVVGHSFGGALAM

SEQ ID NO: 636700 - protein, 27 aa, Mycobacterium
ARAQAGGLPALFSGLARRPRRRQIDDT

SEQ ID NO: 636701 - protein, 18 aa, Mycobacterium
ARAQAQWAAKPPVERAGV

SEQ ID NO: 636702 - protein, 19 aa, Mycobacterium
ARAQFRWSDVPALCEGMGE

SEQ ID NO: 636703 - protein, 21 aa, Mycobacterium
ARAQLAFGEIMELAVGLGGTI

SEQ ID NO: 636704 - protein, 19 aa, Mycobacterium
ARAQLERAAARWADGDIAE

SEQ ID NO: 636705 - protein, 25 aa, Mycobacterium
ARAQLKPIVFEGTQFGGALMTTTEV

SEQ ID NO: 636706 - protein, 25 aa, Mycobacterium
ARAQLKPLVFEGTQFGGALMTTTEV

SEQ ID NO: 636707 - protein, 18 aa, Mycobacterium
ARAQRAYAELVHDTPGFV

SEQ ID NO: 636708 - protein, 21 aa, Mycobacterium
ARAQVAPAYADKGFTLLEQRP

SEQ ID NO: 636709 - protein, 23 aa, Mycobacterium
ARARAAFENGPWPRLARSERARL

SEQ ID NO: 636710 - protein, 18 aa, Mycobacterium
ARARADAAYRRRNYTPEA

SEQ ID NO: 636711 - protein, 20 aa, Mycobacterium
ARARAGNLLGLDPPEHQRLR

SEQ ID NO: 636712 - protein, 22 aa, Mycobacterium
ARARCADLSWRRSAAGVSAVLK

SEQ ID NO: 636713 - protein, 22 aa, Mycobacterium
ARARDDLGWQPRYDYRRILDCL

SEQ ID NO: 636714 - protein, 20 aa, Mycobacterium
ARARDKGVFGTKMRSVIKLP

SEQ ID NO: 636715 - protein, 22 aa, Mycobacterium
ARAREAGLIGGRCCPAPATTDS

SEQ ID NO: 636716 - protein, 18 aa, Mycobacterium
ARARERWEGLTALAQLVD

SEQ ID NO: 636717 - protein, 21 aa, Mycobacterium
ARARGIRACLLGRFLQDDVRV

SEQ ID NO: 636718 - protein, 24 aa, Mycobacterium
ARARLCGLETMRFTTELQPLLTGL

SEQ ID NO: 636719 - protein, 21 aa, Mycobacterium
ARARLSTKHALALTNRGQATT

SEQ ID NO: 636720 - protein, 23 aa, Mycobacterium
ARARMHLGWRPVWDLEKAIHHTA

SEQ ID NO: 636721 - protein, 21 aa, Mycobacterium
ARARRCPDLALRISDGVKLAY

SEQ ID NO: 636722 - protein, 19 aa, Mycobacterium
ARARRDGFVDVPRAAAISA

SEQ ID NO: 636723 - protein, 17 aa, Mycobacterium
ARARRLLDEVVPGEPFD

SEQ ID NO: 636724 - protein, 31 aa, Mycobacterium
ARARRLYASRGWLPWLGPTSVLAPTGPVRTP

SEQ ID NO: 636725 - protein, 30 aa, Mycobacterium
ARARSLRIMRELVPHGLPHAGFRTEHGGTG

SEQ ID NO: 636726 - protein, 22 aa, Mycobacterium
ARARVIELLKLVRLPDPERRYD

SEQ ID NO: 636727 - protein, 18 aa, Mycobacterium
ARARVVAMGDDLDDTLDY

SEQ ID NO: 636728 - protein, 19 aa, Mycobacterium
ARASARRWLEAVGAVELAD

SEQ ID NO: 636729 - protein, 21 aa, Mycobacterium
ARASDAVACAVRLQRAPLAPI

SEQ ID NO: 636730 - protein, 18 aa, Mycobacterium
ARASELLADRRARGPVKK

SEQ ID NO: 636731 - protein, 20 aa, Mycobacterium
ARASKATVYRRWPSKAELVL

SEQ ID NO: 636732 - protein, 23 aa, Mycobacterium
ARASQTWRYPPFFHALLDAGIYP

SEQ ID NO: 636733 - protein, 18 aa, Mycobacterium
ARASRGLAEGLLLTMDQP

SEQ ID NO: 636734 - protein, 18 aa, Mycobacterium
ARASRWNRISDYLVTADT

SEQ ID NO: 636735 - protein, 20 aa, Mycobacterium
ARASTLSALAARGATTLLVD

SEQ ID NO: 636736 - protein, 19 aa, Mycobacterium
ARATGLVAEDVWPLVDAHR

SEQ ID NO: 636737 - protein, 30 aa, Mycobacterium
ARATRLRAKIAFAESRVGAFGSVTVSEAAI

SEQ ID NO: 636738 - protein, 18 aa, Mycobacterium
ARAVAFLVSEDARFITGE

SEQ ID NO: 636739 - protein, 20 aa, Mycobacterium
ARAVARAFDAARAATVHPLM

SEQ ID NO: 636740 - protein, 20 aa, Mycobacterium
ARAVEAMLDLGARAGDISAL

SEQ ID NO: 636741 - protein, 25 aa, Mycobacterium
ARAVLPEWFLGSGLTAAAYRGAQLL

SEQ ID NO: 636742 - protein, 23 aa, Mycobacterium
ARAVLRYPDFYSVAVAVSGNHDN

SEQ ID NO: 636743 - protein, 19 aa, Mycobacterium
ARAVMIGRAYLWGLAAEGQ

SEQ ID NO: 636744 - protein, 19 aa, Mycobacterium
ARAVMIGRAYLWGLAANGQ

SEQ ID NO: 636745 - protein, 24 aa, Mycobacterium
ARAVVAVRGLHRFAAAEGLTENDV

SEQ ID NO: 636746 - protein, 22 aa, Mycobacterium
ARAVVRERLGVALGVVPVEGAR

SEQ ID NO: 636747 - protein, 19 aa, Mycobacterium
ARAVVRIGGAGHSAAIHSE

SEQ ID NO: 636748 - protein, 17 aa, Mycobacterium
ARAVYLDAMLAAMFAGR

SEQ ID NO: 636749 - protein, 22 aa, Mycobacterium
ARAWAAENLRGFYMCPVTPLTD

SEQ ID NO: 636750 - protein, 22 aa, Mycobacterium
ARAWPDVTVRVLPAMTAAQAVA

SEQ ID NO: 636751 - protein, 23 aa, Mycobacterium
ARAYAELIAEGWLTSQHGSHTTV

SEQ ID NO: 636752 - protein, 20 aa, Mycobacterium
ARAYDGPDRYGFVDRGSVSL

SEQ ID NO: 636753 - protein, 17 aa, Mycobacterium
ARAYLDARVQTIYGGTT

SEQ ID NO: 636754 - protein, 21 aa, Mycobacterium
ARAYRPRIVFVDADNKPVDLG

SEQ ID NO: 636755 - protein, 19 aa, Mycobacterium
ARAYTRKPAVVAFDHAYHG

SEQ ID NO: 636756 - protein, 17 aa, Mycobacterium
ARCAAAVAEVDEAVRRH

SEQ ID NO: 636757 - protein, 20 aa, Mycobacterium
ARCAALLVILCDPDRTEVHA

SEQ ID NO: 636758 - protein, 17 aa, Mycobacterium
ARCAQRHYPIRHAMLQD

SEQ ID NO: 636759 - protein, 18 aa, Mycobacterium
ARCARTGKPLTRSSAGGV

SEQ ID NO: 636760 - protein, 18 aa, Mycobacterium
ARCGADVVIASRNMDNCV

SEQ ID NO: 636761 - protein, 18 aa, Mycobacterium
ARCGELGVDWAVVASGAV

SEQ ID NO: 636762 - protein, 17 aa, Mycobacterium
ARCGSSAVRAVVVGARR

SEQ ID NO: 636763 - protein, 18 aa, Mycobacterium
ARCHAGWYHRLVVDAEEQ

SEQ ID NO: 636764 - protein, 20 aa, Mycobacterium
ARCMKLDGDRMVGMTAVMQH

SEQ ID NO: 636765 - protein, 19 aa, Mycobacterium
ARCRDLADEMGLQWDVRDA

SEQ ID NO: 636766 - protein, 17 aa, Mycobacterium
ARCRGAKAFLHCSSAAV

SEQ ID NO: 636767 - protein, 17 aa, Mycobacterium
ARCRYRDTDGVTRIVQR

SEQ ID NO: 636768 - protein, 19 aa, Mycobacterium
ARCTAFVVSFGAPIDTPAA

SEQ ID NO: 636769 - protein, 21 aa, Mycobacterium
ARCYGMPGVYSYLPGLTNVAA

SEQ ID NO: 636770 - protein, 19 aa, Mycobacterium
ARDAAAVSLIVRGADAVVS

SEQ ID NO: 636771 - protein, 17 aa, Mycobacterium
ARDAAGFARELGERIAP

SEQ ID NO: 636772 - protein, 20 aa, Mycobacterium
ARDAGAMAYLVKPFNINDLV

SEQ ID NO: 636773 - protein, 19 aa, Mycobacterium
ARDAGDFYTHLVDVIAEHR

SEQ ID NO: 636774 - protein, 17 aa, Mycobacterium
ARDAGFTGAMFPWQSGS

SEQ ID NO: 636775 - protein, 20 aa, Mycobacterium
ARDAGLPGIIAHGLCTMAFT

SEQ ID NO: 636776 - protein, 19 aa, Mycobacterium
ARDALMRRVTGRMFDDPVL

SEQ ID NO: 636777 - protein, 25 aa, Mycobacterium
ARDAMKRSAARFDNAGFEALYVAMH

SEQ ID NO: 636778 - protein, 20 aa, Mycobacterium
ARDAPPVICVHGVPASSFLY

SEQ ID NO: 636779 - protein, 20 aa, Mycobacterium
ARDARQLIITELIKTTPPGS

SEQ ID NO: 636780 - protein, 24 aa, Mycobacterium
ARDATQIFGGYGFMNEYSVARHYR

SEQ ID NO: 636781 - protein, 29 aa, Mycobacterium
ARDAYDRFVDLPVCDDLALADHVDAALPG

SEQ ID NO: 636782 - protein, 19 aa, Mycobacterium
ARDAYTLGVSDAGDPYGVH

SEQ ID NO: 636783 - protein, 18 aa, Mycobacterium
ARDCDELQFVLGEGPCLE

SEQ ID NO: 636784 - protein, 18 aa, Mycobacterium
ARDCGEVLLIRRSGGRTR

SEQ ID NO: 636785 - protein, 23 aa, Mycobacterium
ARDCGVERLLFLGSSCIYPKFAE

SEQ ID NO: 636786 - protein, 20 aa, Mycobacterium
ARDDLLLVAGMRVSARARLL

SEQ ID NO: 636787 - protein, 22 aa, Mycobacterium
ARDEALLDWLRRAHRTARWTTS

SEQ ID NO: 636788 - protein, 19 aa, Mycobacterium
ARDEFPARELPKARVADGV

SEQ ID NO: 636789 - protein, 18 aa, Mycobacterium
ARDETFRASIERRDGAPE

SEQ ID NO: 636790 - protein, 23 aa, Mycobacterium
ARDEVVLAWVRRAHETSTWTTSV

SEQ ID NO: 636791 - protein, 30 aa, Mycobacterium
ARDGKVYCCAILDCFSRMIVARTFSTTADT

SEQ ID NO: 636792 - protein, 19 aa, Mycobacterium
ARDGTGLIGPMVLPGITSC

SEQ ID NO: 636793 - protein, 20 aa, Mycobacterium
ARDGVPNFDFRVCGVEPGVP

SEQ ID NO: 636794 - protein, 19 aa, Mycobacterium
ARDGVSLNLDEAAVAMAAR

SEQ ID NO: 636795 - protein, 24 aa, Mycobacterium
ARDGWDFASVLARFANARHTRSLP

SEQ ID NO: 636796 - protein, 25 aa, Mycobacterium
ARDHAKPGYIGYAWTAMEPVNAIPA

SEQ ID NO: 636797 - protein, 23 aa, Mycobacterium
ARDHLRRLSARYGATAALSAVVD

SEQ ID NO: 636798 - protein, 23 aa, Mycobacterium
ARDIAQRIDYDWSKTTITAGRSP

SEQ ID NO: 636799 - protein, 18 aa, Mycobacterium
ARDIAYSIAFLASPRAAY

SEQ ID NO: 636800 - protein, 23 aa, Mycobacterium
ARDIPAHRLVHDRAEVQRLREQA

SEQ ID NO: 636801 - protein, 20 aa, Mycobacterium
ARDLARLMTPFAERYGVVAD

SEQ ID NO: 636802 - protein, 30 aa, Mycobacterium
ARDLELRWAGLRAHNRWLADFCSLSPERRA

SEQ ID NO: 636803 - protein, 17 aa, Mycobacterium
ARDLGINFFDTAQQYGF

SEQ ID NO: 636804 - protein, 21 aa, Mycobacterium
ARDLKHRPAIIEAAAQGAGAD

SEQ ID NO: 636805 - protein, 24 aa, Mycobacterium
ARDLPCHTGIRLLGGTSHALGRVN

SEQ ID NO: 636806 - protein, 23 aa, Mycobacterium
ARDLPCHTGVRLLGSTSHALGRV

SEQ ID NO: 636807 - protein, 24 aa, Mycobacterium
ARDLSRELIRVVTIAPGLFKTPLL

SEQ ID NO: 636808 - protein, 19 aa, Mycobacterium
ARDLVVSAWALLRKRAWFE

SEQ ID NO: 636809 - protein, 20 aa, Mycobacterium
ARDPMVVAWPGRITPDKRIR

SEQ ID NO: 636810 - protein, 24 aa, Mycobacterium
ARDPQCVPIADALGLVLASDVVAP

SEQ ID NO: 636811 - protein, 24 aa, Mycobacterium
ARDQLRYARFHLGDGRAPNGEQIL

SEQ ID NO: 636812 - protein, 17 aa, Mycobacterium
ARDRARRSLVVVLTDGR

SEQ ID NO: 636813 - protein, 20 aa, Mycobacterium
ARDRFARAWTHEDGENPIND

SEQ ID NO: 636814 - protein, 32 aa, Mycobacterium
ARDRGCTRPGCTVPGYWCQAHHASADWKDDGH

SEQ ID NO: 636815 - protein, 23 aa, Mycobacterium
ARDRGCTRPNCLEPGYHCEVHHC

SEQ ID NO: 636816 - protein, 24 aa, Mycobacterium
ARDRIGVEIHRRITSAMGPNADPT

SEQ ID NO: 636817 - protein, 21 aa, Mycobacterium
ARDRLGFKPVVSYHEGMARSK

SEQ ID NO: 636818 - protein, 20 aa, Mycobacterium
ARDRYHWVYRPGITAGVVPT

SEQ ID NO: 636819 - protein, 18 aa, Mycobacterium
ARDSAPSLVFLDEVDALA

SEQ ID NO: 636820 - protein, 20 aa, Mycobacterium
ARDSMPPLRLAIIDYLAKHP

SEQ ID NO: 636821 - protein, 23 aa, Mycobacterium
ARDSRWVPHEVIEQLQAVQEGVV

SEQ ID NO: 636822 - protein, 19 aa, Mycobacterium
ARDSYQIGVFGLKGGVGKT

SEQ ID NO: 636823 - protein, 25 aa, Mycobacterium
ARDVARLRAALGHWDITTNGPGVRR

SEQ ID NO: 636824 - protein, 22 aa, Mycobacterium
ARDVCRSCAVATRCLAYALEIE

SEQ ID NO: 636825 - protein, 25 aa, Mycobacterium
ARDVPSLGWRSYRLADGAGGGWSPV

SEQ ID NO: 636826 - protein, 20 aa, Mycobacterium
ARDVQPLVCLDANGNKFSNK

SEQ ID NO: 636827 - protein, 26 aa, Mycobacterium
ARDWLTERFGERVGWLAGAHVAAKRY

SEQ ID NO: 636828 - protein, 20 aa, Mycobacterium
AREAAALVHVEYQEKEHDAA

SEQ ID NO: 636829 - protein, 24 aa, Mycobacterium
AREAAREGGHPWWTLSQLSDESAV

SEQ ID NO: 636830 - protein, 19 aa, Mycobacterium
AREAAWRVLDQRPFDVQVM

SEQ ID NO: 636831 - protein, 19 aa, Mycobacterium
AREAAWRVLDQRPFEVQLM

SEQ ID NO: 636832 - protein, 23 aa, Mycobacterium
AREALRELAGWAQTHYPGATRTH

SEQ ID NO: 636833 - protein, 29 aa, Mycobacterium
AREALSVFGECWRGDLIPDDPRVSPLAAE

SEQ ID NO: 636834 - protein, 18 aa, Mycobacterium
AREAMMLASTQAGMAFSN

SEQ ID NO: 636835 - protein, 20 aa, Mycobacterium
AREAMPYAAALGRAFQLTNF

SEQ ID NO: 636836 - protein, 25 aa, Mycobacterium
AREAREYAARVAAAVSECGRQIAGK

SEQ ID NO: 636837 - protein, 24 aa, Mycobacterium
AREARSAIWRVLVRDFFQAWIRRS

SEQ ID NO: 636838 - protein, 24 aa, Mycobacterium
AREATSLLGRLSAFFAAAMDAESA

SEQ ID NO: 636839 - protein, 19 aa, Mycobacterium
AREDHRRSRSSTQAGTTVT

SEQ ID NO: 636840 - protein, 20 aa, Mycobacterium
AREDVTWCVVPSPAVSRVVK

SEQ ID NO: 636841 - protein, 23 aa, Mycobacterium
AREEGWPQFADRLLELARAAQPG

SEQ ID NO: 636842 - protein, 24 aa, Mycobacterium
AREELPAQLVVRAVGYRGLPTPGL

SEQ ID NO: 636843 - protein, 20 aa, Mycobacterium
AREEWLREHLADFTPDQRAV

SEQ ID NO: 636844 - protein, 19 aa, Mycobacterium
AREFLSFVAEHRMQVTTPE

SEQ ID NO: 636845 - protein, 22 aa, Mycobacterium
AREFSYFGSFWGNYNDLTEVLA

SEQ ID NO: 636846 - protein, 18 aa, Mycobacterium
AREGARLGVDSSVNGTRW

SEQ ID NO: 636847 - protein, 21 aa, Mycobacterium
AREGGCLLVSVDYRLAPEHPC

SEQ ID NO: 636848 - protein, 30 aa, Mycobacterium
AREGLDYPKVVLVTGACRFLGGYLTARLAQ

SEQ ID NO: 636849 - protein, 24 aa, Mycobacterium
AREGLRPLIFALWDMVAAYRAAQP

SEQ ID NO: 636850 - protein, 25 aa, Mycobacterium
AREGVCQDFARIAATALRTQGLAAR

SEQ ID NO: 636851 - protein, 32 aa, Mycobacterium
AREGVCQDFARLAIACLRANGLAACYVSGYLA

SEQ ID NO: 636852 - protein, 25 aa, Mycobacterium
AREHGGRLLLRLAGVTDRDSADALR

SEQ ID NO: 636853 - protein, 24 aa, Mycobacterium
AREHGGRLLVRLAGISDRDAADAL

SEQ ID NO: 636854 - protein, 20 aa, Mycobacterium
AREHGWPQFADKLLELARAA

SEQ ID NO: 636855 - protein, 23 aa, Mycobacterium
AREHKALVIKGGYMDGHPLTVAE

SEQ ID NO: 636856 - protein, 26 aa, Mycobacterium
AREICGGGFIGSRVAVLGAAFKPDSD

SEQ ID NO: 636857 - protein, 26 aa, Mycobacterium
AREKLFPLICRYALAYHVVFIPSVEV

SEQ ID NO: 636858 - protein, 18 aa, Mycobacterium
ARELARITFEHMPFGDPT

SEQ ID NO: 636859 - protein, 22 aa, Mycobacterium
ARELARVGAHVIMAVRNTEKGN

SEQ ID NO: 636860 - protein, 25 aa, Mycobacterium
ARELARWGIETTIIVPGAFTSGTNH

SEQ ID NO: 636861 - protein, 28 aa, Mycobacterium
ARELELRWAGLRAHNRWLSDFCSLSPER

SEQ ID NO: 636862 - protein, 22 aa, Mycobacterium
ARELGFRLVAVAARDPQRANIF

SEQ ID NO: 636863 - protein, 24 aa, Mycobacterium
ARELGRLPGAGVVFAVETEDTGPG

SEQ ID NO: 636864 - protein, 20 aa, Mycobacterium
ARELGVDVAWDCEPAKTPEG

SEQ ID NO: 636865 - protein, 20 aa, Mycobacterium
ARELHRLSGIRVPTDAFDLD

SEQ ID NO: 636866 - protein, 20 aa, Mycobacterium
ARELIARGALRTQTDSRGRT

SEQ ID NO: 636867 - protein, 24 aa, Mycobacterium
ARELLGVVCDLYALSVIEEDKAWY

SEQ ID NO: 636868 - protein, 18 aa, Mycobacterium
ARELRAAADIANDGVIES

SEQ ID NO: 636869 - protein, 24 aa, Mycobacterium
ARELRERPAWITGIEHRIETPVLG

SEQ ID NO: 636870 - protein, 20 aa, Mycobacterium
ARELSDFGFAHVDRNPSPES

SEQ ID NO: 636871 - protein, 20 aa, Mycobacterium
ARELSGSSNLLFRRNSVTGA

SEQ ID NO: 636872 - protein, 17 aa, Mycobacterium
ARELSPIAVGPHGPEVL

SEQ ID NO: 636873 - protein, 26 aa, Mycobacterium
AREMLRRGASQLKLMAGGGVTSAYDP

SEQ ID NO: 636874 - protein, 18 aa, Mycobacterium
AREMVPIYLRPGVGGNVD

SEQ ID NO: 636875 - protein, 18 aa, Mycobacterium
AREPDRFAGLTLMVPATA

SEQ ID NO: 636876 - protein, 19 aa, Mycobacterium
AREPEVWWNTPEGRGLPPV

SEQ ID NO: 636877 - protein, 21 aa, Mycobacterium
AREPHSWDLCVGHAGRITAPR

SEQ ID NO: 636878 - protein, 19 aa, Mycobacterium
AREPHSWDLCVSHAGRITA

SEQ ID NO: 636879 - protein, 18 aa, Mycobacterium
AREQTCYYAHVLDSDLEL

SEQ ID NO: 636880 - protein, 24 aa, Mycobacterium
AREQVRVFAPRVGGGFGAKQEMLT

SEQ ID NO: 636881 - protein, 18 aa, Mycobacterium
ARERACRALCDQYMQWTD

SEQ ID NO: 636882 - protein, 22 aa, Mycobacterium
AREREVAELLGIPDTVTQAALF

SEQ ID NO: 636883 - protein, 24 aa, Mycobacterium
AREREVAELLLLGLPYRDIGRQLF

SEQ ID NO: 636884 - protein, 20 aa, Mycobacterium
ARERGATMIFTRTKRTAQKV

SEQ ID NO: 636885 - protein, 20 aa, Mycobacterium
ARERGDLKPGAMIVESTSGT

SEQ ID NO: 636886 - protein, 27 aa, Mycobacterium
ARERLRRVGVTAAVLWVLDGNARARRF

SEQ ID NO: 636887 - protein, 19 aa, Mycobacterium
ARERYIFRDGKGAHGELPP

SEQ ID NO: 636888 - protein, 34 aa, Mycobacterium
ARETLEVIAPLAHRLGMATVKWELEDLAFAILHP

SEQ ID NO: 636889 - protein, 30 aa, Mycobacterium
ARETLEVIAPLAHRLGMATVKWELEDLSFA

SEQ ID NO: 636890 - protein, 32 aa, Mycobacterium
ARETLEVIAPLAHRLGMATVKWELEDLSFAIL

SEQ ID NO: 636891 - protein, 26 aa, Mycobacterium
AREVARFVQEAGRKCVLVPGDLSDPA

SEQ ID NO: 636892 - protein, 24 aa, Mycobacterium
AREVGSVRLVLGWLPAPIDGLDAD

SEQ ID NO: 636893 - protein, 20 aa, Mycobacterium
AREVHHVAALVGFGAAAVNP

SEQ ID NO: 636894 - protein, 23 aa, Mycobacterium
AREWADAAVRAWSSARGVDVSPP

SEQ ID NO: 636895 - protein, 24 aa, Mycobacterium
ARFACPNLLVGNTIVLKHAPQCPE

SEQ ID NO: 636896 - protein, 21 aa, Mycobacterium
ARFADEFNIPFVPLDELTTQY

SEQ ID NO: 636897 - protein, 28 aa, Mycobacterium
ARFADTHARVGLLPTWGLSVRLPQKVGV

SEQ ID NO: 636898 - protein, 18 aa, Mycobacterium
ARFAETLLPLIAEDVDTA

SEQ ID NO: 636899 - protein, 20 aa, Mycobacterium
ARFAGPIVVIEIDMKFGSLD

SEQ ID NO: 636900 - protein, 20 aa, Mycobacterium
ARFAGPVVVIELDMKFGSLD

SEQ ID NO: 636901 - protein, 20 aa, Mycobacterium
ARFAGPVVVIELDMRFGSLE

SEQ ID NO: 636902 - protein, 20 aa, Mycobacterium
ARFAGPVVVIELDMRFGSVE

SEQ ID NO: 636903 - protein, 20 aa, Mycobacterium
ARFAGPVVVVELDMRFGSVE

SEQ ID NO: 636904 - protein, 24 aa, Mycobacterium
ARFASRLRAGKVMALSGVLDQLIQ

SEQ ID NO: 636905 - protein, 22 aa, Mycobacterium
ARFCHGCGAPVAAAADAHAEYK

SEQ ID NO: 636906 - protein, 17 aa, Mycobacterium
ARFCVALFGLLRAGAIP

SEQ ID NO: 636907 - protein, 21 aa, Mycobacterium
ARFDLPGLFGNAGKPDDGAID

SEQ ID NO: 636908 - protein, 23 aa, Mycobacterium
ARFDRISYTWIPRDRNSYADRLA

SEQ ID NO: 636909 - protein, 21 aa, Mycobacterium
ARFDVDGVIHIAGYKYAGESV

SEQ ID NO: 636910 - protein, 21 aa, Mycobacterium
ARFENLVGYPFAPHYVDVAAT

SEQ ID NO: 636911 - protein, 20 aa, Mycobacterium
ARFEYAGGLPAEVRDRYHVV

SEQ ID NO: 636912 - protein, 18 aa, Mycobacterium
ARFGAELDDAATRAADIR

SEQ ID NO: 636913 - protein, 19 aa, Mycobacterium
ARFGLGRFLADWDRVIEEQ

SEQ ID NO: 636914 - protein, 21 aa, Mycobacterium
ARFGLSLPVGFGTDYAGVIDQ

SEQ ID NO: 636915 - protein, 20 aa, Mycobacterium
ARFGNPEPGLGILAAAGASY

SEQ ID NO: 636916 - protein, 21 aa, Mycobacterium
ARFGSVFIKAGFSSMDMGTSY

SEQ ID NO: 636917 - protein, 19 aa, Mycobacterium
ARFGVVAQPAFAFVGAAGH

SEQ ID NO: 636918 - protein, 25 aa, Mycobacterium
ARFHDLKGGLVLLSALSGIDWSTYG

SEQ ID NO: 636919 - protein, 19 aa, Mycobacterium
ARFIKFIVTEIFPGGRLPS

SEQ ID NO: 636920 - protein, 18 aa, Mycobacterium
ARFLIARILFHDWEHEMS

SEQ ID NO: 636921 - protein, 17 aa, Mycobacterium
ARFLLGIQQLFGLGQFH

SEQ ID NO: 636922 - protein, 19 aa, Mycobacterium
ARFLPGMVERRHGVVLNVA

SEQ ID NO: 636923 - protein, 21 aa, Mycobacterium
ARFLTLASLKWVIANRAYTPW

SEQ ID NO: 636924 - protein, 22 aa, Mycobacterium
ARFLTLASLKWVLKNRAFTPWY

SEQ ID NO: 636925 - protein, 20 aa, Mycobacterium
ARFPADRAVIGVGDLAADAS

SEQ ID NO: 636926 - protein, 23 aa, Mycobacterium
ARFPDALFPVWRYHPFFTDSDEP

SEQ ID NO: 636927 - protein, 17 aa, Mycobacterium
ARFPDVDPAAVIAANRK

SEQ ID NO: 636928 - protein, 27 aa, Mycobacterium
ARFRECAARALLLPRRTPGRRSPLWQQ

SEQ ID NO: 636929 - protein, 28 aa, Mycobacterium
ARFRVKRPIRVTGWPPKGTDRGKGDAVA

SEQ ID NO: 636930 - protein, 17 aa, Mycobacterium
ARFSPFQKLIILDVPDD

SEQ ID NO: 636931 - protein, 17 aa, Mycobacterium
ARFTEMLADADILIEST

SEQ ID NO: 636932 - protein, 28 aa, Mycobacterium
ARFTIHAGEAFGLPSIHEAIAFCGADRL

SEQ ID NO: 636933 - protein, 20 aa, Mycobacterium
ARFTPHLTLGYRDAVAVADS

SEQ ID NO: 636934 - protein, 21 aa, Mycobacterium
ARFTPRARGAVVAAQNAAHEA

SEQ ID NO: 636935 - protein, 22 aa, Mycobacterium
ARFTVDLLRPALMSPVQIRTSV

SEQ ID NO: 636936 - protein, 19 aa, Mycobacterium
ARFVEFLERVVVRKSIARH

SEQ ID NO: 636937 - protein, 17 aa, Mycobacterium
ARFVELLDAVWRVRGYG

SEQ ID NO: 636938 - protein, 27 aa, Mycobacterium
ARFVRLCDAFGIPLIVVVDVPGYLPGV

SEQ ID NO: 636939 - protein, 38 aa, Mycobacterium
ARFVRLCNAFGIPLIVLVDVPGYLPGVGQEWGGVVRRG

SEQ ID NO: 636940 - protein, 28 aa, Mycobacterium
ARFVVASREGLSWIPPGVYMPDGVTVAS

SEQ ID NO: 636941 - protein, 17 aa, Mycobacterium
ARFWAAMRTPRKNTPAG

SEQ ID NO: 636942 - protein, 18 aa, Mycobacterium
ARFYIFVNQIANFVPFAV

SEQ ID NO: 636943 - protein, 19 aa, Mycobacterium
ARGACRWLTAHGVNAPNPR

SEQ ID NO: 636944 - protein, 26 aa, Mycobacterium
ARGADGWRLDAAYAVPDRFWAQVLPR

SEQ ID NO: 636945 - protein, 25 aa, Mycobacterium
ARGAEIVSGLAIVSALCRAWGATPT

SEQ ID NO: 636946 - protein, 18 aa, Mycobacterium
ARGAFYLLTQPEYVGSAM

SEQ ID NO: 636947 - protein, 21 aa, Mycobacterium
ARGAHAVACDYAKIREQYGKQ

SEQ ID NO: 636948 - protein, 19 aa, Mycobacterium
ARGAHPFRASARNTLLRNL

SEQ ID NO: 636949 - protein, 19 aa, Mycobacterium
ARGAIHAPSFRERVRYRSV

SEQ ID NO: 636950 - protein, 18 aa, Mycobacterium
ARGAKTWIIMANLEANDH

SEQ ID NO: 636951 - protein, 21 aa, Mycobacterium
ARGALTTALPAPAVREVYLLQ

SEQ ID NO: 636952 - protein, 17 aa, Mycobacterium
ARGAPRCAALVEQAAAV

SEQ ID NO: 636953 - protein, 20 aa, Mycobacterium
ARGAQALARVAGYMGTAEAV

SEQ ID NO: 636954 - protein, 17 aa, Mycobacterium
ARGAQYSIYHAVSEDGV

SEQ ID NO: 636955 - protein, 22 aa, Mycobacterium
ARGARCAVAPVAPKPPAVPAGL

SEQ ID NO: 636956 - protein, 25 aa, Mycobacterium
ARGARLVSICSGAFALAAAGVLDGH

SEQ ID NO: 636957 - protein, 18 aa, Mycobacterium
ARGARRLVIAPWFLAPGL

SEQ ID NO: 636958 - protein, 24 aa, Mycobacterium
ARGASKVRFADWAPVYERHAGIPN

SEQ ID NO: 636959 - protein, 19 aa, Mycobacterium
ARGASYVRVEIHGKACHAG

SEQ ID NO: 636960 - protein, 21 aa, Mycobacterium
ARGATLRLVYVTKPSDRSAAE

SEQ ID NO: 636961 - protein, 18 aa, Mycobacterium
ARGAVEFDPANLYREPDL

SEQ ID NO: 636962 - protein, 22 aa, Mycobacterium
ARGAVEFEALFPGLLAELVAAG

SEQ ID NO: 636963 - protein, 19 aa, Mycobacterium
ARGAVHYVALGDKHSRTEV

SEQ ID NO: 636964 - protein, 18 aa, Mycobacterium
ARGAWDTRIESNLVDAVV

SEQ ID NO: 636965 - protein, 19 aa, Mycobacterium
ARGCRRVAEELSFEPAFRA

SEQ ID NO: 636966 - protein, 19 aa, Mycobacterium
ARGDLKPGAMIVESTSGTL

SEQ ID NO: 636967 - protein, 19 aa, Mycobacterium
ARGDLKTSVFALYNPPAPP

SEQ ID NO: 636968 - protein, 21 aa, Mycobacterium
ARGEAIPCVLTMIADEFGGDI

SEQ ID NO: 636969 - protein, 17 aa, Mycobacterium
ARGEAPLAFEGTAEPSA

SEQ ID NO: 636970 - protein, 23 aa, Mycobacterium
ARGEGAAKWRAATVDERADGLKR

SEQ ID NO: 636971 - protein, 23 aa, Mycobacterium
ARGEPVCVFAVTDVMAIGAIAAW

SEQ ID NO: 636972 - protein, 21 aa, Mycobacterium
ARGFAFYALDLHKCGRSRRDG

SEQ ID NO: 636973 - protein, 18 aa, Mycobacterium
ARGFARHEIEPDGRASVA

SEQ ID NO: 636974 - protein, 24 aa, Mycobacterium
ARGFEYGQAFRGCTALWRRDQELF

SEQ ID NO: 636975 - protein, 29 aa, Mycobacterium
ARGFPVTEFNVALPWTKMVVLNPGVQTES

SEQ ID NO: 636976 - protein, 18 aa, Mycobacterium
ARGFSLNISNFYTTDEEI

SEQ ID NO: 636977 - protein, 32 aa, Mycobacterium
ARGGAGAGPLQGRRCGACRIEIDRGEIARITA

SEQ ID NO: 636978 - protein, 24 aa, Mycobacterium
ARGGCCGSGPAGPAVAAVAAVAEG

SEQ ID NO: 636979 - protein, 24 aa, Mycobacterium
ARGGDIERLITLMAPDVIRTVDHT

SEQ ID NO: 636980 - protein, 19 aa, Mycobacterium
ARGGIKTNWVIALPPGQTG

SEQ ID NO: 636981 - protein, 21 aa, Mycobacterium
ARGGINTNWAIARPPGQTKAL

SEQ ID NO: 636982 - protein, 18 aa, Mycobacterium
ARGGLLLYGPPGCGKSYL

SEQ ID NO: 636983 - protein, 35 aa, Mycobacterium
ARGGMFAQLCADLPWAQQLSEVWRMRDPEERTASL

SEQ ID NO: 636984 - protein, 30 aa, Mycobacterium
ARGGMFAQLCADLPWTQRLSEVWRMTDPAE

SEQ ID NO: 636985 - protein, 18 aa, Mycobacterium
ARGGMFAQLCTDLPWTQT

SEQ ID NO: 636986 - protein, 35 aa, Mycobacterium
ARGGMFDQLCIELPWTQRLSQVWRMHDPAERDASL

SEQ ID NO: 636987 - protein, 29 aa, Mycobacterium
ARGGNGGSGGLLFGGGGIGGTGGTGAAGA

SEQ ID NO: 636988 - protein, 22 aa, Mycobacterium
ARGGPGAVRYQVVSALGAFGTG

SEQ ID NO: 636989 - protein, 33 aa, Mycobacterium
ARGGPGGAPGCWQRVTRDLWPAPELVMDTGNSL

SEQ ID NO: 636990 - protein, 22 aa, Mycobacterium
ARGGRHIHPRDASVIVAVANGL

SEQ ID NO: 636991 - protein, 17 aa, Mycobacterium
ARGGVMRGIGHFPVAEN

SEQ ID NO: 636992 - protein, 21 aa, Mycobacterium
ARGGVPVAWEIAAALGAPLDV

SEQ ID NO: 636993 - protein, 23 aa, Mycobacterium
ARGIAEPYLRPGQLEEHLIYPVT

SEQ ID NO: 636994 - protein, 24 aa, Mycobacterium
ARGIAEPYLRPGQLEEHLVYPVTT

SEQ ID NO: 636995 - protein, 25 aa, Mycobacterium
ARGIGETIAEVFARDGAAVVAIDMP

SEQ ID NO: 636996 - protein, 27 aa, Mycobacterium
ARGILTSRFGARWGTLHAGLDIANAVG

SEQ ID NO: 636997 - protein, 19 aa, Mycobacterium
ARGIRRAVAALSLMDGGAQ

SEQ ID NO: 636998 - protein, 34 aa, Mycobacterium
ARGIYPFGGATPRFPRVAGWGNAMRWMLTAEEFD

SEQ ID NO: 636999 - protein, 18 aa, Mycobacterium
ARGIYYGRLAEMTDTDFQ

SEQ ID NO: 637000 - protein, 18 aa, Mycobacterium
ARGIYYGRLTEMTTTDFQ

SEQ ID NO: 637001 - protein, 24 aa, Mycobacterium
ARGKKAMLDKVRRAPQLIKVESVV

SEQ ID NO: 637002 - protein, 30 aa, Mycobacterium
ARGKLCDALDDFTGCLLLVSHDRMLLDRMD

SEQ ID NO: 637003 - protein, 23 aa, Mycobacterium
ARGKLLHRLGEIIAREADQLAEL

SEQ ID NO: 637004 - protein, 21 aa, Mycobacterium
ARGKLTPRERIELLVDPDSPF

SEQ ID NO: 637005 - protein, 17 aa, Mycobacterium
ARGLARRGFPLLLVARR

SEQ ID NO: 637006 - protein, 19 aa, Mycobacterium
ARGLFPHHLDTIVNVPAPS

SEQ ID NO: 637007 - protein, 19 aa, Mycobacterium
ARGLGVLIDAVFNHLGPSG

SEQ ID NO: 637008 - protein, 18 aa, Mycobacterium
ARGLHHLANVLGLVDGGA

SEQ ID NO: 637009 - protein, 18 aa, Mycobacterium
ARGLLARTGAEVYVDAGA

SEQ ID NO: 637010 - protein, 21 aa, Mycobacterium
ARGLMAIGVERGDRVGIWAPN

SEQ ID NO: 637011 - protein, 20 aa, Mycobacterium
ARGLNALQLVAGSPNGLTVA

SEQ ID NO: 637012 - protein, 25 aa, Mycobacterium
ARGLQRLRAALPLVDPGAASPKETW

SEQ ID NO: 637013 - protein, 25 aa, Mycobacterium
ARGLRLFRDGWRICGVVPTRAAVAA

SEQ ID NO: 637014 - protein, 28 aa, Mycobacterium
ARGLVRKRCGAWWSRNYGSIVVTMTHGF

SEQ ID NO: 637015 - protein, 20 aa, Mycobacterium
ARGPAKRPAKKAARKSPAKK

SEQ ID NO: 637016 - protein, 17 aa, Mycobacterium
ARGPALLIIDRQRDVWR

SEQ ID NO: 637017 - protein, 23 aa, Mycobacterium
ARGPFRREVLQLAGGGGDDLGVE

SEQ ID NO: 637018 - protein, 31 aa, Mycobacterium
ARGPKGRAKVLARYALWLGEHRAEIERLLIA

SEQ ID NO: 637019 - protein, 30 aa, Mycobacterium
ARGPKGRAKVLARYAVWLGDHRDEIEKLLI

SEQ ID NO: 637020 - protein, 19 aa, Mycobacterium
ARGPVHLIALPRFPEPGST

SEQ ID NO: 637021 - protein, 17 aa, Mycobacterium
ARGQAVWTPVAKISDAL

SEQ ID NO: 637022 - protein, 21 aa, Mycobacterium
ARGQRAVLCASTGNTSASAAA

SEQ ID NO: 637023 - protein, 18 aa, Mycobacterium
ARGQYWIHPALPEVVENA

SEQ ID NO: 637024 - protein, 24 aa, Mycobacterium
ARGRALWPILLSIWEWERRWVPEQ

SEQ ID NO: 637025 - protein, 19 aa, Mycobacterium
ARGRDAVFWQSPRTRKQAR

SEQ ID NO: 637026 - protein, 18 aa, Mycobacterium
ARGRGIPPLDRLQYLGEV

SEQ ID NO: 637027 - protein, 24 aa, Mycobacterium
ARGRGRLAELLGYLNAGAHATPEG

SEQ ID NO: 637028 - protein, 18 aa, Mycobacterium
ARGRGVVTANLIRRDGVL

SEQ ID NO: 637029 - protein, 22 aa, Mycobacterium
ARGRKPWAWKCPTAAAPGDSHA

SEQ ID NO: 637030 - protein, 20 aa, Mycobacterium
ARGRLGNRMEIIYVIPDYYE

SEQ ID NO: 637031 - protein, 22 aa, Mycobacterium
ARGRPLGEIDLDYSPLQLEDTF

SEQ ID NO: 637032 - protein, 26 aa, Mycobacterium
ARGRYLRSLYRAMKPQGRLFLYGFSD

SEQ ID NO: 637033 - protein, 19 aa, Mycobacterium
ARGSRHLGFAKALVHEMPH

SEQ ID NO: 637034 - protein, 17 aa, Mycobacterium
ARGSRHLGFAKALVNEM

SEQ ID NO: 637035 - protein, 27 aa, Mycobacterium
ARGTERWLSQRLSHVLGRGSGQDGICA

SEQ ID NO: 637036 - protein, 17 aa, Mycobacterium
ARGTIFVSVANRDKRSL

SEQ ID NO: 637037 - protein, 25 aa, Mycobacterium
ARGTIQWSGTCARYTGARRDPLSGE

SEQ ID NO: 637038 - protein, 25 aa, Mycobacterium
ARGTMLMCKYAIPRLISAGGGAIVN

SEQ ID NO: 637039 - protein, 17 aa, Mycobacterium
ARGTTSLRRIREIAPPP

SEQ ID NO: 637040 - protein, 20 aa, Mycobacterium
ARGTVALMWGAEDLVATLGG

SEQ ID NO: 637041 - protein, 22 aa, Mycobacterium
ARGVAWLEGLVRPFTPESTQAQ

SEQ ID NO: 637042 - protein, 18 aa, Mycobacterium
ARGVDVLRFAPSGRDEAL

SEQ ID NO: 637043 - protein, 24 aa, Mycobacterium
ARGVERWLSQRLSHLLGHAPGGGD

SEQ ID NO: 637044 - protein, 24 aa, Mycobacterium
ARGVERWLSQRLSHVLGRARGGDG

SEQ ID NO: 637045 - protein, 24 aa, Mycobacterium
ARGVERWLSQRLSHVLGRARGGGV

SEQ ID NO: 637046 - protein, 21 aa, Mycobacterium
ARGVIWPTIPPDILGQSGTAW

SEQ ID NO: 637047 - protein, 20 aa, Mycobacterium
ARGVPIWATLIALLQDGVPV

SEQ ID NO: 637048 - protein, 26 aa, Mycobacterium
ARGVPMTAGCVVPRGDVLELIDDIKD

SEQ ID NO: 637049 - protein, 25 aa, Mycobacterium
ARGVPMTAGCVVPRGDVLELLDDIK

SEQ ID NO: 637050 - protein, 23 aa, Mycobacterium
ARGVTIDAVLEFRVPVEELVQRL

SEQ ID NO: 637051 - protein, 22 aa, Mycobacterium
ARGVVWPTIPADILGQAGTAWQ

SEQ ID NO: 637052 - protein, 28 aa, Mycobacterium
ARGWDAATAPAWARPLLDDHRNLLAEIA

SEQ ID NO: 637053 - protein, 20 aa, Mycobacterium
ARGWHCLGLADSFRDGAPHG

SEQ ID NO: 637054 - protein, 26 aa, Mycobacterium
ARGWTNATAPAWARPLITVNPVLTAE

SEQ ID NO: 637055 - protein, 18 aa, Mycobacterium
ARGYKCVLTMPDTMSIER

SEQ ID NO: 637056 - protein, 21 aa, Mycobacterium
ARGYRRLYLITGNRQPEAEAL

SEQ ID NO: 637057 - protein, 25 aa, Mycobacterium
ARHADLHAILTWSRFRNHDFLARLR

SEQ ID NO: 637058 - protein, 17 aa, Mycobacterium
ARHCARVALRELGVPPV

SEQ ID NO: 637059 - protein, 17 aa, Mycobacterium
ARHDIRPLFVLFDSCWD

SEQ ID NO: 637060 - protein, 19 aa, Mycobacterium
ARHDVLWPMIADMPALGTG

SEQ ID NO: 637061 - protein, 21 aa, Mycobacterium
ARHDYDLHRWLASNGMVLTWR

SEQ ID NO: 637062 - protein, 20 aa, Mycobacterium
ARHELRRATVIYGSKRQLDL

SEQ ID NO: 637063 - protein, 23 aa, Mycobacterium
ARHFDHLNVIAGFDELARKIDVV

SEQ ID NO: 637064 - protein, 20 aa, Mycobacterium
ARHFDHLNVIAGFDELPGKL

SEQ ID NO: 637065 - protein, 24 aa, Mycobacterium
ARHGDLRFDCILSAELAHAYKPAP

SEQ ID NO: 637066 - protein, 25 aa, Mycobacterium
ARHGDRFLLGIGVSHAPLIDAGQPG

SEQ ID NO: 637067 - protein, 26 aa, Mycobacterium
ARHGGEPRRSWAVLGEMAELGPDAIS

SEQ ID NO: 637068 - protein, 18 aa, Mycobacterium
ARHGKFATVAAVDRGQAV

SEQ ID NO: 637069 - protein, 19 aa, Mycobacterium
ARHGLGVAILPQSMARGGS

SEQ ID NO: 637070 - protein, 18 aa, Mycobacterium
ARHHPKWPSRPPEGEQVR

SEQ ID NO: 637071 - protein, 20 aa, Mycobacterium
ARHHRRSFVADRLATGTAAL

SEQ ID NO: 637072 - protein, 27 aa, Mycobacterium
ARHIIRPELRGGAGFDDPVDVPEDAGA

SEQ ID NO: 637073 - protein, 18 aa, Mycobacterium
ARHLARCVRAVKAAVPAL

SEQ ID NO: 637074 - protein, 19 aa, Mycobacterium
ARHLLDFVFAEVWQRPGLT

SEQ ID NO: 637075 - protein, 23 aa, Mycobacterium
ARHLLVAIIDRFPGVEIVFDTIS

SEQ ID NO: 637076 - protein, 26 aa, Mycobacterium
ARHMLKFLSSPLWRAYISTYVEGYQL

SEQ ID NO: 637077 - protein, 18 aa, Mycobacterium
ARHPGDEATRRWMERFID

SEQ ID NO: 637078 - protein, 30 aa, Mycobacterium
ARHPNLRAAFWDRDVPKPVQIVPARAELPW

SEQ ID NO: 637079 - protein, 20 aa, Mycobacterium
ARHRAMLETFTRWREDTRRQ

SEQ ID NO: 637080 - protein, 24 aa, Mycobacterium
ARHRAVELLELVGIAQPERRARAF

SEQ ID NO: 637081 - protein, 26 aa, Mycobacterium
ARHRDRYRWASWSGRLGIDGTAVEQV

SEQ ID NO: 637082 - protein, 28 aa, Mycobacterium
ARHREIENRFGFRLVVGYALSETPYGLI

SEQ ID NO: 637083 - protein, 18 aa, Mycobacterium
ARHRFVLTVHHIVMDGWS

SEQ ID NO: 637084 - protein, 26 aa, Mycobacterium
ARHRGVPRDCILELDLLEVPPESVHL

SEQ ID NO: 637085 - protein, 25 aa, Mycobacterium
ARHRIVAALGRRWGSAFTVNLPIIG

SEQ ID NO: 637086 - protein, 17 aa, Mycobacterium
ARHRPFRVHISDAPEPV

SEQ ID NO: 637087 - protein, 21 aa, Mycobacterium
ARHRVACGVVLRGIGGFGSGR

SEQ ID NO: 637088 - protein, 19 aa, Mycobacterium
ARHSSGLSVQTFLRGIHIV

SEQ ID NO: 637089 - protein, 25 aa, Mycobacterium
ARHVADRRALLLGRRQRGRPEQGDR

SEQ ID NO: 637090 - protein, 18 aa, Mycobacterium
ARHVDTFATFGITTHGVW

SEQ ID NO: 637091 - protein, 26 aa, Mycobacterium
ARHVKRTLDAWLRELTATISAAQADG

SEQ ID NO: 637092 - protein, 24 aa, Mycobacterium
ARHVSAVLGRRVGPSTGTNVWGAF

SEQ ID NO: 637093 - protein, 27 aa, Mycobacterium
ARIAAALPRRRLAELLDAAAEVMTDAL

SEQ ID NO: 637094 - protein, 18 aa, Mycobacterium
ARIAALVVANGFLPTAQQ

SEQ ID NO: 637095 - protein, 25 aa, Mycobacterium
ARIAELPWGGALVAHHYTRYLGDLS

SEQ ID NO: 637096 - protein, 17 aa, Mycobacterium
ARIAFLMLPGVGTKDDI

SEQ ID NO: 637097 - protein, 17 aa, Mycobacterium
ARIAGAFNPAAARAAVR

SEQ ID NO: 637098 - protein, 20 aa, Mycobacterium
ARIAGALTIVAVDPVEFKRE

SEQ ID NO: 637099 - protein, 19 aa, Mycobacterium
ARIAGRPAATLLHLGPGMA

SEQ ID NO: 637100 - protein, 24 aa, Mycobacterium
ARIAGRPAAVLLHLGPGLGNGLAN

SEQ ID NO: 637101 - protein, 30 aa, Mycobacterium
ARIAGRVGLRPDVRRLPLFGLGCVAGAAGV

SEQ ID NO: 637102 - protein, 30 aa, Mycobacterium
ARIAGRVGLRPDVRRVPIFGLGCVAGAAGV

SEQ ID NO: 637103 - protein, 30 aa, Mycobacterium
ARIAGRVGLRPDVRRVPLFGLGCVAGAAGV

SEQ ID NO: 637104 - protein, 21 aa, Mycobacterium
ARIAGWGHRTVGLGLQQKIDR

SEQ ID NO: 637105 - protein, 25 aa, Mycobacterium
ARIALGTALARLGMFAPALSYLEEP

SEQ ID NO: 637106 - protein, 19 aa, Mycobacterium
ARIALHVRTLYGRDPHHIT

SEQ ID NO: 637107 - protein, 17 aa, Mycobacterium
ARIALNPTQQWLDELDR

SEQ ID NO: 637108 - protein, 17 aa, Mycobacterium
ARIALQVFTYRPGRRTP

SEQ ID NO: 637109 - protein, 20 aa, Mycobacterium
ARIALRVPLYSPGRHAAKIT

SEQ ID NO: 637110 - protein, 17 aa, Mycobacterium
ARIAPSVALPSKEAIGQ

SEQ ID NO: 637111 - protein, 20 aa, Mycobacterium
ARIASLAGRLADWLQTPEAA

SEQ ID NO: 637112 - protein, 19 aa, Mycobacterium
ARIAVNLGAPLLLTVSGKG

SEQ ID NO: 637113 - protein, 21 aa, Mycobacterium
ARIAVSYHTPVIVLSDGAIAN

SEQ ID NO: 637114 - protein, 45 aa, Mycobacterium
ARIAYRLHPPVLRALGLKRKLVLGPWFRPVYRILVAARRLRGTRA

SEQ ID NO: 637115 - protein, 17 aa, Mycobacterium
ARIDALAIGLERKDGSA

SEQ ID NO: 637116 - protein, 18 aa, Mycobacterium
ARIDASVAELRAERDAVA

SEQ ID NO: 637117 - protein, 26 aa, Mycobacterium
ARIDEGWDTARLVPLLAGLNELAPWV

SEQ ID NO: 637118 - protein, 25 aa, Mycobacterium
ARIDISLDHGHTWRQAELHPAPGTW

SEQ ID NO: 637119 - protein, 20 aa, Mycobacterium
ARIDLAFFVGERWSEAGEPA

SEQ ID NO: 637120 - protein, 17 aa, Mycobacterium
ARIDSIVGSGTRRGDAA

SEQ ID NO: 637121 - protein, 19 aa, Mycobacterium
ARIDVPVLVGFGAVDVSPD

SEQ ID NO: 637122 - protein, 25 aa, Mycobacterium
ARIEDLAARIGLRVSAPRAAHEREG

SEQ ID NO: 637123 - protein, 26 aa, Mycobacterium
ARIEKMPWQWIGQELPQFSSAPTDHA

SEQ ID NO: 637124 - protein, 28 aa, Mycobacterium
ARIEPVVARELFIRHALVEGEWQTRHHF

SEQ ID NO: 637125 - protein, 17 aa, Mycobacterium
ARIESIVASGTHRGDAA

SEQ ID NO: 637126 - protein, 18 aa, Mycobacterium
ARIFDLFDELPFAGHPII

SEQ ID NO: 637127 - protein, 19 aa, Mycobacterium
ARIGDLAAVDHCSQPTMTT

SEQ ID NO: 637128 - protein, 19 aa, Mycobacterium
ARIGMGWPECKVGVEFDSA

SEQ ID NO: 637129 - protein, 21 aa, Mycobacterium
ARIGMPATRFLGPALGSLHMF

SEQ ID NO: 637130 - protein, 17 aa, Mycobacterium
ARIGSGLLVDVVGINDG

SEQ ID NO: 637131 - protein, 26 aa, Mycobacterium
ARIHQAGCMGCIGMGQAPATGRNSLR

SEQ ID NO: 637132 - protein, 23 aa, Mycobacterium
ARIIPRGTPGEMVELIDWEEFIH

SEQ ID NO: 637133 - protein, 17 aa, Mycobacterium
ARIKFPTPAACGRVPLV

SEQ ID NO: 637134 - protein, 17 aa, Mycobacterium
ARIKWLMADKSKDYDDI

SEQ ID NO: 637135 - protein, 19 aa, Mycobacterium
ARILAALIRDIPGGAAVDT

SEQ ID NO: 637136 - protein, 19 aa, Mycobacterium
ARILADRLLAADVAKAGVS

SEQ ID NO: 637137 - protein, 22 aa, Mycobacterium
ARILATAGRTWLRVLANHVDGE

SEQ ID NO: 637138 - protein, 18 aa, Mycobacterium
ARILGIFVDGARVPVASA

SEQ ID NO: 637139 - protein, 17 aa, Mycobacterium
ARILLAKNPAGWQEALS

SEQ ID NO: 637140 - protein, 18 aa, Mycobacterium
ARINDLRNEWLFGQSWGI

SEQ ID NO: 637141 - protein, 18 aa, Mycobacterium
ARIPGVPVPGVLRKVPES

SEQ ID NO: 637142 - protein, 19 aa, Mycobacterium
ARIPHAVGDDVEWVVLCSE

SEQ ID NO: 637143 - protein, 21 aa, Mycobacterium
ARIQDGPGWWTAREAIQQTAE

SEQ ID NO: 637144 - protein, 20 aa, Mycobacterium
ARIQLFAALVHDGNRSYWDE

SEQ ID NO: 637145 - protein, 19 aa, Mycobacterium
ARIQRRCLGSLSIDELSFS

SEQ ID NO: 637146 - protein, 19 aa, Mycobacterium
ARIREAFAAIVPPDADAST

SEQ ID NO: 637147 - protein, 20 aa, Mycobacterium
ARIREAGVITAVRVSPQNAQ

SEQ ID NO: 637148 - protein, 22 aa, Mycobacterium
ARIRNGLSWADIAKHLDAPLVW

SEQ ID NO: 637149 - protein, 18 aa, Mycobacterium
ARIRPGREPEVTRYFVPR

SEQ ID NO: 637150 - protein, 17 aa, Mycobacterium
ARIRQGMRDDRPLKRDG

SEQ ID NO: 637151 - protein, 28 aa, Mycobacterium
ARIRSIGLRLGVPWYAYDTITFTGEVTA

SEQ ID NO: 637152 - protein, 18 aa, Mycobacterium
ARIRVTEVYSKFCQAETY

SEQ ID NO: 637153 - protein, 22 aa, Mycobacterium
ARISKWQGWSRQRIVNAIDRQV

SEQ ID NO: 637154 - protein, 22 aa, Mycobacterium
ARISVRSVIHRHYLEVLRPLVR

SEQ ID NO: 637155 - protein, 27 aa, Mycobacterium
ARITLHVALELARRGSGYGVAALCGAG

SEQ ID NO: 637156 - protein, 27 aa, Mycobacterium
ARITLHVALELARRGSGYGVAALCGGG

SEQ ID NO: 637157 - protein, 21 aa, Mycobacterium
ARIVDRPEWVAAAAESMRVMM

SEQ ID NO: 637158 - protein, 26 aa, Mycobacterium
ARIVKALGGRGVFGVELMINGDEVYF

SEQ ID NO: 637159 - protein, 18 aa, Mycobacterium
ARKAAIESLVRATHSANA

SEQ ID NO: 637160 - protein, 23 aa, Mycobacterium
ARKAARMLCAAGVPVEVHVWPGQ

SEQ ID NO: 637161 - protein, 25 aa, Mycobacterium
ARKAAYEVLERVGLNPKVASRYPAQ

SEQ ID NO: 637162 - protein, 17 aa, Mycobacterium
ARKADALLFSLGALGPT

SEQ ID NO: 637163 - protein, 20 aa, Mycobacterium
ARKAGQWAFEGKWDGYRLLV

SEQ ID NO: 637164 - protein, 30 aa, Mycobacterium
ARKAGYDRAFEFPGFVPAYIRPQFCEGRGP

SEQ ID NO: 637165 - protein, 27 aa, Mycobacterium
ARKAGYEVLERVGLDVKLARRYPAQLS

SEQ ID NO: 637166 - protein, 26 aa, Mycobacterium
ARKAVILGTGGFEWDQRLVEAYLRGP

SEQ ID NO: 637167 - protein, 22 aa, Mycobacterium
ARKFFRAIDMAWKRTSYSGLLR

SEQ ID NO: 637168 - protein, 20 aa, Mycobacterium
ARKGIARGRSVIALAYADGV

SEQ ID NO: 637169 - protein, 19 aa, Mycobacterium
ARKGIARGRSVVALAYSEG

SEQ ID NO: 637170 - protein, 19 aa, Mycobacterium
ARKGIWSDHEMALIHRLHG

SEQ ID NO: 637171 - protein, 19 aa, Mycobacterium
ARKGVLLAAGGFGHNKEMR

SEQ ID NO: 637172 - protein, 21 aa, Mycobacterium
ARKHGLPVYAVAPFATRALVK

SEQ ID NO: 637173 - protein, 17 aa, Mycobacterium
ARKHKSLTMFLVPLDSP

SEQ ID NO: 637174 - protein, 25 aa, Mycobacterium
ARKHLAHVIFGYGSRYCVGAPLARM

SEQ ID NO: 637175 - protein, 21 aa, Mycobacterium
ARKIVGWKVATEMTQKLVTDA

SEQ ID NO: 637176 - protein, 18 aa, Mycobacterium
ARKKALVAVLDFALRAVG

SEQ ID NO: 637177 - protein, 21 aa, Mycobacterium
ARKLFAERGFHGTTLADITSA

SEQ ID NO: 637178 - protein, 18 aa, Mycobacterium
ARKLGLRPLARIHTTTVV

SEQ ID NO: 637179 - protein, 26 aa, Mycobacterium
ARKLLPRKPAHLVVRMYSALTEAVFF

SEQ ID NO: 637180 - protein, 19 aa, Mycobacterium
ARKLWGLRGYAEVGTPEIA

SEQ ID NO: 637181 - protein, 17 aa, Mycobacterium
ARKLWKAARRAGHDVGR

SEQ ID NO: 637182 - protein, 19 aa, Mycobacterium
ARKMEVLAMGTSDLPVGCS

SEQ ID NO: 637183 - protein, 27 aa, Mycobacterium
ARKMLEPGMLMYGWRRSSLRGNTFRGF

SEQ ID NO: 637184 - protein, 17 aa, Mycobacterium
ARKMTFRALYRLERRDE

SEQ ID NO: 637185 - protein, 19 aa, Mycobacterium
ARKNERLMRLPALSTRATP

SEQ ID NO: 637186 - protein, 20 aa, Mycobacterium
ARKPQRWVRLTGAMAAGELS

SEQ ID NO: 637187 - protein, 23 aa, Mycobacterium
ARKRAIELLERVGIASQKDKYPA

SEQ ID NO: 637188 - protein, 17 aa, Mycobacterium
ARKSLVVPVRYAGVHVY

SEQ ID NO: 637189 - protein, 25 aa, Mycobacterium
ARKTALEVLERVGLDPKLATRYPAQ

SEQ ID NO: 637190 - protein, 18 aa, Mycobacterium
ARKVAAWGADAMIVQGGE

SEQ ID NO: 637191 - protein, 18 aa, Mycobacterium
ARKVEGFGVRLRKGDIVL

SEQ ID NO: 637192 - protein, 21 aa, Mycobacterium
ARKYLPAAWADVSLALLTVLA

SEQ ID NO: 637193 - protein, 17 aa, Mycobacterium
ARLAAAHIVHESRAVIG

SEQ ID NO: 637194 - protein, 17 aa, Mycobacterium
ARLAAALVRASLDDDVR

SEQ ID NO: 637195 - protein, 19 aa, Mycobacterium
ARLAAEWLTETLLRHLTKR

SEQ ID NO: 637196 - protein, 17 aa, Mycobacterium
ARLAAVHTVHESRAVIA

SEQ ID NO: 637197 - protein, 17 aa, Mycobacterium
ARLACETYGPAALFENL

SEQ ID NO: 637198 - protein, 20 aa, Mycobacterium
ARLACVHAMGGFFTHSATMI

SEQ ID NO: 637199 - protein, 25 aa, Mycobacterium
ARLADGMPAYGSCAGMILLATEIAD

SEQ ID NO: 637200 - protein, 21 aa, Mycobacterium
ARLADLAARVRTGRLKPVVGR

SEQ ID NO: 637201 - protein, 21 aa, Mycobacterium
ARLADRLHAILAQLSADDDIT

SEQ ID NO: 637202 - protein, 17 aa, Mycobacterium
ARLAEDMLLGAEQLGGT

SEQ ID NO: 637203 - protein, 18 aa, Mycobacterium
ARLAELDLALPEVVAPLA

SEQ ID NO: 637204 - protein, 21 aa, Mycobacterium
ARLAELVALGLLARRPYREPG

SEQ ID NO: 637205 - protein, 17 aa, Mycobacterium
ARLAEQAWQHFQAIEAH

SEQ ID NO: 637206 - protein, 18 aa, Mycobacterium
ARLAEYVLATTGVDLDPS

SEQ ID NO: 637207 - protein, 17 aa, Mycobacterium
ARLAFLISGGTGAGKTT

SEQ ID NO: 637208 - protein, 28 aa, Mycobacterium
ARLAFQDRFALCGSDGAGVREVLDANRI

SEQ ID NO: 637209 - protein, 20 aa, Mycobacterium
ARLAGAAGFQAFRELIEGIV

SEQ ID NO: 637210 - protein, 25 aa, Mycobacterium
ARLAGLDVAVCKPIQTGTRDGDDDL

SEQ ID NO: 637211 - protein, 19 aa, Mycobacterium
ARLAGLRATTMHRLLGSRP

SEQ ID NO: 637212 - protein, 21 aa, Mycobacterium
ARLAGLRTRRRAPVGAPTGRR

SEQ ID NO: 637213 - protein, 19 aa, Mycobacterium
ARLAGLVVLGPDGESIGRV

SEQ ID NO: 637214 - protein, 17 aa, Mycobacterium
ARLAHYVLPAATQFEKV

SEQ ID NO: 637215 - protein, 17 aa, Mycobacterium
ARLALGIGVHDITAGYR

SEQ ID NO: 637216 - protein, 20 aa, Mycobacterium
ARLANRLVDQGCDGLVVSGT

SEQ ID NO: 637217 - protein, 21 aa, Mycobacterium
ARLARDAGFDGVEIHGANGYL

SEQ ID NO: 637218 - protein, 18 aa, Mycobacterium
ARLARWRSATALPEAPDA

SEQ ID NO: 637219 - protein, 21 aa, Mycobacterium
ARLASEAGLPDGVFNVVTGSG

SEQ ID NO: 637220 - protein, 18 aa, Mycobacterium
ARLASSRSGRRCTDRLET

SEQ ID NO: 637221 - protein, 25 aa, Mycobacterium
ARLATRVGLRPDVKRVPLFGLGCVA

SEQ ID NO: 637222 - protein, 26 aa, Mycobacterium
ARLAVEAMTALVARHIDLSAIVAAAA

SEQ ID NO: 637223 - protein, 18 aa, Mycobacterium
ARLAVTVPAVERHVTNIF

SEQ ID NO: 637224 - protein, 19 aa, Mycobacterium
ARLAWRLQGLKFTVTGVEN

SEQ ID NO: 637225 - protein, 21 aa, Mycobacterium
ARLAYLFEVDYVDHFVWVVTD

SEQ ID NO: 637226 - protein, 25 aa, Mycobacterium
ARLCRDISGEIGLPVIDGVTAAVNL

SEQ ID NO: 637227 - protein, 22 aa, Mycobacterium
ARLDFEGIAVLDLFAGSGALGL

SEQ ID NO: 637228 - protein, 22 aa, Mycobacterium
ARLDHLAHLGVDGIWLNPVTVS

SEQ ID NO: 637229 - protein, 17 aa, Mycobacterium
ARLDPRAGMLSLGANTN

SEQ ID NO: 637230 - protein, 24 aa, Mycobacterium
ARLDRLAATGGRVGREVMLSDGLA

SEQ ID NO: 637231 - protein, 23 aa, Mycobacterium
ARLDWMAATTLLTGRRTWVPWSV

SEQ ID NO: 637232 - protein, 18 aa, Mycobacterium
ARLDWQLRHYPPRTEDVR

SEQ ID NO: 637233 - protein, 23 aa, Mycobacterium
ARLEAGVALSAITARFPDARLAG

SEQ ID NO: 637234 - protein, 22 aa, Mycobacterium
ARLEAGVALSAVTARFPDARLV

SEQ ID NO: 637235 - protein, 22 aa, Mycobacterium
ARLEEVEPLLTAFVTTTPELAL

SEQ ID NO: 637236 - protein, 20 aa, Mycobacterium
ARLEGEIAHLLSAVHTVQNS

SEQ ID NO: 637237 - protein, 23 aa, Mycobacterium
ARLEHIPEIEACYSVAGEDNYML

SEQ ID NO: 637238 - protein, 20 aa, Mycobacterium
ARLEKVWLPGPDRLLDCVER

SEQ ID NO: 637239 - protein, 26 aa, Mycobacterium
ARLELSMMLERLLKRLPDMELVSQDP

SEQ ID NO: 637240 - protein, 22 aa, Mycobacterium
ARLEPADALGIPLGPGQPPAFL

SEQ ID NO: 637241 - protein, 22 aa, Mycobacterium
ARLEPFALGAFNDCSIRRPGAP

SEQ ID NO: 637242 - protein, 26 aa, Mycobacterium
ARLERHAVYTFKACWADRWRDGRVLV

SEQ ID NO: 637243 - protein, 25 aa, Mycobacterium
ARLEVAVLLAEWLRRVPEYAIRAEG

SEQ ID NO: 637244 - protein, 19 aa, Mycobacterium
ARLFAQHGAHVYICDVLEE

SEQ ID NO: 637245 - protein, 20 aa, Mycobacterium
ARLFGLPYFPVTPLFPAAGP

SEQ ID NO: 637246 - protein, 18 aa, Mycobacterium
ARLFGRRAPIPSAEPRRR

SEQ ID NO: 637247 - protein, 17 aa, Mycobacterium
ARLFPKGLATLIDRRDQ

SEQ ID NO: 637248 - protein, 18 aa, Mycobacterium
ARLFPKGLATLIDRRDQT

SEQ ID NO: 637249 - protein, 20 aa, Mycobacterium
ARLGEMKDLVAAIDQALEKA

SEQ ID NO: 637250 - protein, 26 aa, Mycobacterium
ARLGHFYRGVGLSIYEGYGLTETSAA

SEQ ID NO: 637251 - protein, 18 aa, Mycobacterium
ARLGHFYRGVGLTIHEGY

SEQ ID NO: 637252 - protein, 26 aa, Mycobacterium
ARLGHFYRGVGLTIYEGYGLTETTAA

SEQ ID NO: 637253 - protein, 20 aa, Mycobacterium
ARLGHMADMLAAAYASAGSD

SEQ ID NO: 637254 - protein, 20 aa, Mycobacterium
ARLGPARTAGICAISPALFS

SEQ ID NO: 637255 - protein, 20 aa, Mycobacterium
ARLGPARTAGICAISPALYT

SEQ ID NO: 637256 - protein, 20 aa, Mycobacterium
ARLGPSLRVVVTAVRSLLQP

SEQ ID NO: 637257 - protein, 21 aa, Mycobacterium
ARLGRIGDCEIALDDALTAAR

SEQ ID NO: 637258 - protein, 32 aa, Mycobacterium
ARLGRKLRIAHAWSLSFDASWQPMIGLLDGHA

SEQ ID NO: 637259 - protein, 33 aa, Mycobacterium; identical to SEQ ID NO: 94354

SEQ ID NO: 637260 - protein, 17 aa, Mycobacterium
ARLGVGVLPRAPVRHPG

SEQ ID NO: 637261 - protein, 18 aa, Mycobacterium
ARLIQRGIPALGIDRSAT

SEQ ID NO: 637262 - protein, 17 aa, Mycobacterium
ARLIWAHRDPYRATGSL

SEQ ID NO: 637263 - protein, 20 aa, Mycobacterium
ARLKGDLSLMPTAVEEMIRW

SEQ ID NO: 637264 - protein, 17 aa, Mycobacterium
ARLKRLLAEAELVKDAL

SEQ ID NO: 637265 - protein, 21 aa, Mycobacterium
ARLKSVPILLAPPWGLAVSDM

SEQ ID NO: 637266 - protein, 20 aa, Mycobacterium
ARLLAAALLECFPSNVTAGT

SEQ ID NO: 637267 - protein, 21 aa, Mycobacterium
ARLLAEAGVNLVLIARKPGPL

SEQ ID NO: 637268 - protein, 31 aa, Mycobacterium
ARLLAEVLRLRGWRVDFLGAQVPTPHLIAHL

SEQ ID NO: 637269 - protein, 26 aa, Mycobacterium
ARLLAMKLFSERAVDYFRTASADDRR

SEQ ID NO: 637270 - protein, 22 aa, Mycobacterium
ARLLEWRLGQLQEISRIAQPFG

SEQ ID NO: 637271 - protein, 19 aa, Mycobacterium
ARLLGLPAAVLGETVPAAP

SEQ ID NO: 637272 - protein, 18 aa, Mycobacterium
ARLLGLPADDLPTFRKRA

SEQ ID NO: 637273 - protein, 19 aa, Mycobacterium
ARLLLALCDAPRATGVQLA

SEQ ID NO: 637274 - protein, 19 aa, Mycobacterium
ARLLLTLAAAEPVGDPALL

SEQ ID NO: 637275 - protein, 25 aa, Mycobacterium
ARLLPEGVPSQWSIFFGAEDVDKTL

SEQ ID NO: 637276 - protein, 22 aa, Mycobacterium
ARLLQRAGFVFEGRLRRHSVYP

SEQ ID NO: 637277 - protein, 17 aa, Mycobacterium
ARLLRPGGRCAVEHDDS

SEQ ID NO: 637278 - protein, 26 aa, Mycobacterium
ARLLSKLRAGKVLSLSGIMDDLIQES

SEQ ID NO: 637279 - protein, 17 aa, Mycobacterium
ARLLSLYQKGKDKQWDA

SEQ ID NO: 637280 - protein, 32 aa, Mycobacterium
ARLLTSFFGVSGWGRILVPINFRLAPAEIEYI

SEQ ID NO: 637281 - protein, 24 aa, Mycobacterium
ARLLVEAVGLPHFVKVARGEIDFD

SEQ ID NO: 637282 - protein, 25 aa, Mycobacterium
ARLLVHAITDVWGLETFRMVTHDRG

SEQ ID NO: 637283 - protein, 19 aa, Mycobacterium
ARLLVPLRAVLKERVALAP

SEQ ID NO: 637284 - protein, 17 aa, Mycobacterium
ARLLWEMLQGDVVADGW

SEQ ID NO: 637285 - protein, 17 aa, Mycobacterium
ARLNCRVSQGYGMTELS

SEQ ID NO: 637286 - protein, 19 aa, Mycobacterium
ARLNHSFGARGWAPQGFYF

SEQ ID NO: 637287 - protein, 17 aa, Mycobacterium
ARLNILAANGSRMLATV

SEQ ID NO: 637288 - protein, 18 aa, Mycobacterium
ARLNLPPMCHHNPTHRVS

SEQ ID NO: 637289 - protein, 20 aa, Mycobacterium
ARLNMIAHLLSTIDYYDVEA

SEQ ID NO: 637290 - protein, 19 aa, Mycobacterium
ARLNRSFGARGWAPQGYYF

SEQ ID NO: 637291 - protein, 26 aa, Mycobacterium
ARLNVRARVALCGLISGYNSADPPPG

SEQ ID NO: 637292 - protein, 30 aa, Mycobacterium
ARLPADLRDTWAIREVPLHILLDGADLRDG

SEQ ID NO: 637293 - protein, 27 aa, Mycobacterium
ARLPAEAWPPTAWFEGWATGIDVFDVE

SEQ ID NO: 637294 - protein, 25 aa, Mycobacterium
ARLPDAVRYSVRFGKPVLLPASVGV

SEQ ID NO: 637295 - protein, 23 aa, Mycobacterium
ARLPEAVAHLLAERARYAPAARR

SEQ ID NO: 637296 - protein, 24 aa, Mycobacterium
ARLPGAQCTTAFCAVLSPDTGELV

SEQ ID NO: 637297 - protein, 24 aa, Mycobacterium
ARLPGARCTTAFCAVLDPRIGEVV

SEQ ID NO: 637298 - protein, 17 aa, Mycobacterium
ARLPLAHSLSWQGRGRD

SEQ ID NO: 637299 - protein, 24 aa, Mycobacterium
ARLPLDPRIGRMILQADAEGCVRE

SEQ ID NO: 637300 - protein, 20 aa, Mycobacterium
ARLPSIALRAARSALAAAAP

SEQ ID NO: 637301 - protein, 19 aa, Mycobacterium
ARLPSLMVLCGVNNAADAI

SEQ ID NO: 637302 - protein, 17 aa, Mycobacterium
ARLPYILSDGHLRELAL

SEQ ID NO: 637303 - protein, 17 aa, Mycobacterium
ARLQCLRRCPLAQQRRC

SEQ ID NO: 637304 - protein, 19 aa, Mycobacterium
ARLQECGWTVIPITVDDIR

SEQ ID NO: 637305 - protein, 21 aa, Mycobacterium
ARLQELKGFVHAKDWTRDRPG

SEQ ID NO: 637306 - protein, 18 aa, Mycobacterium
ARLQEVWIGRQIAEVKSK

SEQ ID NO: 637307 - protein, 22 aa, Mycobacterium
ARLQFPGYFLVVHDIARFCREN

SEQ ID NO: 637308 - protein, 23 aa, Mycobacterium
ARLQKRLGTTTVYVTHDQTEAMT

SEQ ID NO: 637309 - protein, 18 aa, Mycobacterium
ARLQPGSFYALPQSPQLF

SEQ ID NO: 637310 - protein, 19 aa, Mycobacterium
ARLQRDWAQRQADIELELV

SEQ ID NO: 637311 - protein, 21 aa, Mycobacterium
ARLRAALPRGGADIEAVLPKV

SEQ ID NO: 637312 - protein, 19 aa, Mycobacterium
ARLRAAVAGAILMGIASQR

SEQ ID NO: 637313 - protein, 19 aa, Mycobacterium
ARLRAELGEALAVNDGPTA

SEQ ID NO: 637314 - protein, 22 aa, Mycobacterium
ARLRAPELLLIHGGASGIGTHA

SEQ ID NO: 637315 - protein, 20 aa, Mycobacterium
ARLRARIWVAQVGRVPLLLL

SEQ ID NO: 637316 - protein, 19 aa, Mycobacterium
ARLRCMYPNAIIASSTDAY

SEQ ID NO: 637317 - protein, 19 aa, Mycobacterium
ARLRDYFGVHGHRLELDDA

SEQ ID NO: 637318 - protein, 17 aa, Mycobacterium
ARLRELAIMRIGWLTAC

SEQ ID NO: 637319 - protein, 20 aa, Mycobacterium
ARLRELIIMRIGWVTDSVYE

SEQ ID NO: 637320 - protein, 26 aa, Mycobacterium
ARLRFSGSCKSCPSSAATLELAISDA

SEQ ID NO: 637321 - protein, 24 aa, Mycobacterium
ARLRGAGLRALWVCRGEDQRDADE

SEQ ID NO: 637322 - protein, 22 aa, Mycobacterium
ARLRGPRLWAADREDTGRAFSG

SEQ ID NO: 637323 - protein, 25 aa, Mycobacterium
ARLRGRGGTHLVAMAVTADSPYGRV

SEQ ID NO: 637324 - protein, 30 aa, Mycobacterium
ARLRPGDAVGLPEARYVHLFVARGRVTLED

SEQ ID NO: 637325 - protein, 21 aa, Mycobacterium
ARLRPGLDVRVAFCEQNPPSL

SEQ ID NO: 637326 - protein, 17 aa, Mycobacterium
ARLRPGTTAADVSFPAF

SEQ ID NO: 637327 - protein, 22 aa, Mycobacterium
ARLRPRHLHWPVLRHSHGHSPA

SEQ ID NO: 637328 - protein, 23 aa, Mycobacterium
ARLRQGQTLIGFLAPRNAENSIG

SEQ ID NO: 637329 - protein, 21 aa, Mycobacterium
ARLRRPIGLQVRWPGADLAGA

SEQ ID NO: 637330 - protein, 30 aa, Mycobacterium
ARLRTGLLRIWSAMRDCVARGLATDGTLPG

SEQ ID NO: 637331 - protein, 17 aa, Mycobacterium
ARLRTRIGVMLQGGGGY

SEQ ID NO: 637332 - protein, 19 aa, Mycobacterium
ARLRTRPGPPVLYGQLPMS

SEQ ID NO: 637333 - protein, 23 aa, Mycobacterium
ARLRTSRDLELRLVAKVEPNGPT

SEQ ID NO: 637334 - protein, 23 aa, Mycobacterium
ARLRVILRRAGKGGAEPRSARLT

SEQ ID NO: 637335 - protein, 19 aa, Mycobacterium
ARLRVILRRSGGRVQEPRT

SEQ ID NO: 637336 - protein, 19 aa, Mycobacterium
ARLRVILRRSGMGSEPARK

SEQ ID NO: 637337 - protein, 30 aa, Mycobacterium
ARLRVLQDLYARWPFFRTVLSNMAQVLAKA

SEQ ID NO: 637338 - protein, 24 aa, Mycobacterium
ARLRWQRGAGLGEIYSWTVVHRPV

SEQ ID NO: 637339 - protein, 25 aa, Mycobacterium
ARLSALARNAAELGIAPDTAHLDLL

SEQ ID NO: 637340 - protein, 24 aa, Mycobacterium
ARLSALARNAAELGLIPDTAHLEL

SEQ ID NO: 637341 - protein, 17 aa, Mycobacterium
ARLSALVESADAQAAAA

SEQ ID NO: 637342 - protein, 21 aa, Mycobacterium
ARLSGEPEYKRNLTLRGMSTL

SEQ ID NO: 637343 - protein, 20 aa, Mycobacterium
ARLSIDLLQRHPAELSGGQR

SEQ ID NO: 637344 - protein, 23 aa, Mycobacterium
ARLSKIRVRRCADDSAEIFGTFE

SEQ ID NO: 637345 - protein, 27 aa, Mycobacterium
ARLSNLVGIGIDLLGCHGLDEASTTLV

SEQ ID NO: 637346 - protein, 17 aa, Mycobacterium
ARLSPKSVVREMWERGM

SEQ ID NO: 637347 - protein, 17 aa, Mycobacterium
ARLSRGGASLWERGWSH

SEQ ID NO: 637348 - protein, 19 aa, Mycobacterium
ARLSRLAWFDDVTPVILDA

SEQ ID NO: 637349 - protein, 19 aa, Mycobacterium
ARLSRYSYLVSLLPRRIVD

SEQ ID NO: 637350 - protein, 18 aa, Mycobacterium
ARLSSGMTERGLTLASPT

SEQ ID NO: 637351 - protein, 21 aa, Mycobacterium
ARLSTLWFQALAGICAHVRDG

SEQ ID NO: 637352 - protein, 17 aa, Mycobacterium
ARLSTSHAFLHPILGTR

SEQ ID NO: 637353 - protein, 17 aa, Mycobacterium
ARLTAFISVAVRANSEN

SEQ ID NO: 637354 - protein, 20 aa, Mycobacterium
ARLTERIECLARNRDAIAAY

SEQ ID NO: 637355 - protein, 20 aa, Mycobacterium
ARLTEVGLWDAVKDRLGDSP

SEQ ID NO: 637356 - protein, 19 aa, Mycobacterium
ARLTEWGNIAGYTLTPGSR

SEQ ID NO: 637357 - protein, 20 aa, Mycobacterium
ARLTILDVMAEAIDRPDEMS

SEQ ID NO: 637358 - protein, 20 aa, Mycobacterium
ARLTILEVMAEAIDAPDEMS

SEQ ID NO: 637359 - protein, 20 aa, Mycobacterium
ARLTILEVMAEAIDRPDEMS

SEQ ID NO: 637360 - protein, 19 aa, Mycobacterium
ARLTILEVMAEAIDTPDEM

SEQ ID NO: 637361 - protein, 17 aa, Mycobacterium
ARLTRVFLEAWERPESR

SEQ ID NO: 637362 - protein, 19 aa, Mycobacterium
ARLTSKYAHAYRALGADFG

SEQ ID NO: 637363 - protein, 25 aa, Mycobacterium
ARLVKAGKVSKDWNTDATKGIPFGS

SEQ ID NO: 637364 - protein, 17 aa, Mycobacterium
ARLVLFDGMGHDLPEPL

SEQ ID NO: 637365 - protein, 29 aa, Mycobacterium
ARLVLFPEATMCRFGVPLGPVAQPLDGPW

SEQ ID NO: 637366 - protein, 20 aa, Mycobacterium
ARLVLGPGMRIQAPPNLVSR

SEQ ID NO: 637367 - protein, 23 aa, Mycobacterium
ARLWEHWGKPDIVWYPGGHTGFF

SEQ ID NO: 637368 - protein, 18 aa, Mycobacterium
ARLWETLASRWARSTDPS

SEQ ID NO: 637369 - protein, 20 aa, Mycobacterium
ARLWRDSRVQRLYAGTTEIM

SEQ ID NO: 637370 - protein, 20 aa, Mycobacterium
ARLYGLARLGFTQSYTYFTW

SEQ ID NO: 637371 - protein, 30 aa, Mycobacterium; identical to SEQ ID NO: 94371

SEQ ID NO: 637372 - protein, 19 aa, Mycobacterium
ARLYIGRLGIFDRDNDFEP

SEQ ID NO: 637373 - protein, 19 aa, Mycobacterium
ARLYRTRLWLRSESNISVI

SEQ ID NO: 637374 - protein, 25 aa, Mycobacterium
ARLYSEVRRVLAAGGRIALWDIAIG

SEQ ID NO: 637375 - protein, 28 aa, Mycobacterium
ARLYWESMKSFRPGGRVEIPTGVASFPK

SEQ ID NO: 637376 - protein, 20 aa, Mycobacterium
ARMAAWAPDGALLVSVPSTG

SEQ ID NO: 637377 - protein, 24 aa, Mycobacterium
ARMADKPAAVLLHLGPGLGNGLAN

SEQ ID NO: 637378 - protein, 18 aa, Mycobacterium
ARMAFAFELLDDATSSSP

SEQ ID NO: 637379 - protein, 19 aa, Mycobacterium
ARMAGVVFPGETLRVSVWK

SEQ ID NO: 637380 - protein, 17 aa, Mycobacterium
ARMASGGTRLVHNREMK

SEQ ID NO: 637381 - protein, 18 aa, Mycobacterium
ARMASGGTRLVHSREMKV

SEQ ID NO: 637382 - protein, 23 aa, Mycobacterium
ARMDLTFSLADRWTEAGRHAGIG

SEQ ID NO: 637383 - protein, 23 aa, Mycobacterium
ARMDLTFSLAEHWGAGGEPAGIG

SEQ ID NO: 637384 - protein, 23 aa, Mycobacterium
ARMDLTFSLAERWTEGNEPGGIG

SEQ ID NO: 637385 - protein, 21 aa, Mycobacterium
ARMDLTISLAERFSDAGEPAG

SEQ ID NO: 637386 - protein, 19 aa, Mycobacterium
ARMDLVFSLAERWTEDGRP

SEQ ID NO: 637387 - protein, 19 aa, Mycobacterium
ARMELPFFRTVESAPGPTT

SEQ ID NO: 637388 - protein, 22 aa, Mycobacterium
ARMEMRIALPALLRRFPTLALA

SEQ ID NO: 637389 - protein, 20 aa, Mycobacterium
ARMFGLYPRKGVISPGADAD

SEQ ID NO: 637390 - protein, 21 aa, Mycobacterium
ARMFLAHGVGPTWNPELVDVV

SEQ ID NO: 637391 - protein, 28 aa, Mycobacterium
ARMGARLDFGCVWINTHIPLVAEMPHGG

SEQ ID NO: 637392 - protein, 18 aa, Mycobacterium
ARMGLRLVLDEDLATTTG

SEQ ID NO: 637393 - protein, 17 aa, Mycobacterium
ARMIRLRGAETVIVGLR

SEQ ID NO: 637394 - protein, 27 aa, Mycobacterium
ARMKPVYRPGLIHVYHGVTWGPLMREI

SEQ ID NO: 637395 - protein, 17 aa, Mycobacterium
ARMLIRGPGRYPFDPVV

SEQ ID NO: 637396 - protein, 18 aa, Mycobacterium
ARMLMTMFVTANSIIAES

SEQ ID NO: 637397 - protein, 19 aa, Mycobacterium
ARMLRPVAVMTRRMGPGDP

SEQ ID NO: 637398 - protein, 18 aa, Mycobacterium
ARMLRTAWTEEWDRPENP

SEQ ID NO: 637399 - protein, 19 aa, Mycobacterium
ARMLTAYGARVDMVTEPHP

SEQ ID NO: 637400 - protein, 20 aa, Mycobacterium
ARMNFLLSLTEQFTDSGEPA

SEQ ID NO: 637401 - protein, 18 aa, Mycobacterium
ARMNRLMTKLALARPRRT

SEQ ID NO: 637402 - protein, 23 aa, Mycobacterium
ARMPAFGVEGPWRDRVGFAPTME

SEQ ID NO: 637403 - protein, 20 aa, Mycobacterium
ARMPAGPARLAIDTGARLLP

SEQ ID NO: 637404 - protein, 19 aa, Mycobacterium
ARMPYTVGLLGSVPRLDAP

SEQ ID NO: 637405 - protein, 24 aa, Mycobacterium
ARMSEARAALDLLKGQVDDVVQGD

SEQ ID NO: 637406 - protein, 23 aa, Mycobacterium
ARMVNGGQVCVCPDYVMVPDDHL

SEQ ID NO: 637407 - protein, 17 aa, Mycobacterium
ARMVPGAVDGWLGEVKE

SEQ ID NO: 637408 - protein, 17 aa, Mycobacterium
ARMWLRDPTPLFRTNVE

SEQ ID NO: 637409 - protein, 18 aa, Mycobacterium
ARMYRTGDLVRWGADGQL

SEQ ID NO: 637410 - protein, 21 aa, Mycobacterium
ARMYRTGDLVRWGRDGQLEYL

SEQ ID NO: 637411 - protein, 20 aa, Mycobacterium
ARNAAALFVPCHRVFRIGGA

SEQ ID NO: 637412 - protein, 24 aa, Mycobacterium
ARNAKLASIPVGFAGRAALGFGKR

SEQ ID NO: 637413 - protein, 20 aa, Mycobacterium
ARNALTPAMYFGIRYAVGRV

SEQ ID NO: 637414 - protein, 17 aa, Mycobacterium
ARNALVLVRGKPTDQLP

SEQ ID NO: 637415 - protein, 20 aa, Mycobacterium
ARNARLATVLDRCSYLRDGI

SEQ ID NO: 637416 - protein, 20 aa, Mycobacterium
ARNAVRAALVVAGISIVSAC

SEQ ID NO: 637417 - protein, 20 aa, Mycobacterium
ARNDIIEMVTDLTLGHDPAA

SEQ ID NO: 637418 - protein, 26 aa, Mycobacterium
ARNEDPACPVGSYVGPNAIRNPDGSP

SEQ ID NO: 637419 - protein, 21 aa, Mycobacterium
ARNGLTLNTAVLFAWAVVLSR

SEQ ID NO: 637420 - protein, 19 aa, Mycobacterium
ARNGRIHAVTELVAGQEPS

SEQ ID NO: 637421 - protein, 20 aa, Mycobacterium
ARNIREWQTLGLVPPPEKRG

SEQ ID NO: 637422 - protein, 19 aa, Mycobacterium
ARNKDWFPDEPLVADEPEV

SEQ ID NO: 637423 - protein, 24 aa, Mycobacterium
ARNLPRPVERAFLAAAPVLFAQTA

SEQ ID NO: 637424 - protein, 21 aa, Mycobacterium
ARNPLAAGMPAGFPDLSQMPE

SEQ ID NO: 637425 - protein, 26 aa, Mycobacterium
ARNQVWSRMAAKYGVDNPVPPWQTSL

SEQ ID NO: 637426 - protein, 20 aa, Mycobacterium
ARNRCQFCATTHEAVAAATL

SEQ ID NO: 637427 - protein, 21 aa, Mycobacterium
ARNRGFRVLAGYIFGANHAKS

SEQ ID NO: 637428 - protein, 18 aa, Mycobacterium
ARNSPKQVRFMIADYRSG

SEQ ID NO: 637429 - protein, 17 aa, Mycobacterium
ARNSRFVLAPGSALTKR

SEQ ID NO: 637430 - protein, 18 aa, Mycobacterium
ARNVLAIKLDAQLVDELP

SEQ ID NO: 637431 - protein, 17 aa, Mycobacterium
ARNVLGWSPRWSSEAAL

SEQ ID NO: 637432 - protein, 25 aa, Mycobacterium
ARNVSRGAVDVALFAIQQVVEPTSE

SEQ ID NO: 637433 - protein, 23 aa, Mycobacterium
ARNWFGFGVAGNFAGHLEQAGEA

SEQ ID NO: 637434 - protein, 18 aa, Mycobacterium
ARNYAHLIARRYGYDLVD

SEQ ID NO: 637435 - protein, 17 aa, Mycobacterium
ARNYPHLVAEQQRLKLV

SEQ ID NO: 637436 - protein, 17 aa, Mycobacterium
ARNYPHLVAERLGLDLI

SEQ ID NO: 637437 - protein, 22 aa, Mycobacterium
ARPADTFVAAFVGSPKMNLLEG

SEQ ID NO: 637438 - protein, 25 aa, Mycobacterium
ARPAEIADAVAFLLSEHASFITGSE

SEQ ID NO: 637439 - protein, 19 aa, Mycobacterium
ARPAENILFVSGGSGITPV

SEQ ID NO: 637440 - protein, 23 aa, Mycobacterium
ARPAGLPPRLSLFGHTRMAVTDI

SEQ ID NO: 637441 - protein, 24 aa, Mycobacterium
ARPAGRIGALAAEFTLDLNPPEIT

SEQ ID NO: 637442 - protein, 17 aa, Mycobacterium
ARPALITGGGRGIGRAI

SEQ ID NO: 637443 - protein, 27 aa, Mycobacterium
ARPALLSVSFGDDWAWVRRAHDVGVTV

SEQ ID NO: 637444 - protein, 20 aa, Mycobacterium
ARPALVLGHSLGELAAAAIA

SEQ ID NO: 637445 - protein, 17 aa, Mycobacterium
ARPARRVLDPTDMVSLT

SEQ ID NO: 637446 - protein, 21 aa, Mycobacterium
ARPATPVSVPALFAAQAARTP

SEQ ID NO: 637447 - protein, 17 aa, Mycobacterium
ARPAVLFDVDGTLVDSN

SEQ ID NO: 637448 - protein, 21 aa, Mycobacterium
ARPAVTLPPGAHWANDLVEAP

SEQ ID NO: 637449 - protein, 18 aa, Mycobacterium
ARPDGVTLTERFGTLLDE

SEQ ID NO: 637450 - protein, 21 aa, Mycobacterium
ARPDLWPNTVEEILRLDSPVQ

SEQ ID NO: 637451 - protein, 25 aa, Mycobacterium
ARPDPFCALEAGWLSHIDHDHRDLV

SEQ ID NO: 637452 - protein, 17 aa, Mycobacterium
ARPDRWRRTSGIHRVRD

SEQ ID NO: 637453 - protein, 23 aa, Mycobacterium
ARPDWQLICDIATAMGFGDAFGY

SEQ ID NO: 637454 - protein, 17 aa, Mycobacterium
ARPEGGAGIDVVLVTGL

SEQ ID NO: 637455 - protein, 22 aa, Mycobacterium
ARPEHLELSPVWGDGMVPARVD

SEQ ID NO: 637456 - protein, 22 aa, Mycobacterium
ARPEPSKTAGGRWRREVAQRGA

SEQ ID NO: 637457 - protein, 20 aa, Mycobacterium
ARPERDPGLVLRVAAASATT

SEQ ID NO: 637458 - protein, 24 aa, Mycobacterium
ARPEVPQPYAFRLADPDTDADMIA

SEQ ID NO: 637459 - protein, 23 aa, Mycobacterium
ARPFCLEEVPLLAKRYPRARGLQ

SEQ ID NO: 637460 - protein, 21 aa, Mycobacterium
ARPFRLGGYLIDPGTRIVVHM

SEQ ID NO: 637461 - protein, 18 aa, Mycobacterium
ARPGDYALALSVAGASLP

SEQ ID NO: 637462 - protein, 19 aa, Mycobacterium
ARPGEDWTGSEEFSGDNPF

SEQ ID NO: 637463 - protein, 22 aa, Mycobacterium
ARPGGRRDLELLIACEDVEAAK

SEQ ID NO: 637464 - protein, 20 aa, Mycobacterium
ARPGLPGDWPTGFDDATRPY

SEQ ID NO: 637465 - protein, 20 aa, Mycobacterium
ARPGTWRAVVDYPFDEAGFT

SEQ ID NO: 637466 - protein, 19 aa, Mycobacterium
ARPGVCLTTSGPGFLNALP

SEQ ID NO: 637467 - protein, 21 aa, Mycobacterium
ARPHLTFSVGAHFCLGSALAR

SEQ ID NO: 637468 - protein, 21 aa, Mycobacterium
ARPHVWMRRQINPFDALAAAT

SEQ ID NO: 637469 - protein, 26 aa, Mycobacterium
ARPIAVEAYGLFIFRDCIEATGGSST

SEQ ID NO: 637470 - protein, 23 aa, Mycobacterium
ARPKGYVAPWWEMSEHTATILKE

SEQ ID NO: 637471 - protein, 19 aa, Mycobacterium
ARPKLGLNQPEAVLSGRTP

SEQ ID NO: 637472 - protein, 17 aa, Mycobacterium
ARPKMAVTIKADGRATI

SEQ ID NO: 637473 - protein, 21 aa, Mycobacterium
ARPLADIETIWAAKEPSGVRV

SEQ ID NO: 637474 - protein, 23 aa, Mycobacterium
ARPLERLAELVVRAGRSVSREFG

SEQ ID NO: 637475 - protein, 21 aa, Mycobacterium
ARPLFAANLALPWPDDPLAAL

SEQ ID NO: 637476 - protein, 26 aa, Mycobacterium
ARPLGEIGDGWSLLIVRDAFDGLRRF

SEQ ID NO: 637477 - protein, 22 aa, Mycobacterium
ARPLGIPVIVLAGQVVLDKSTI

SEQ ID NO: 637478 - protein, 17 aa, Mycobacterium
ARPLLDLPLDIEESPSG

SEQ ID NO: 637479 - protein, 19 aa, Mycobacterium
ARPLPTRINFVGDRPGAAL

SEQ ID NO: 637480 - protein, 19 aa, Mycobacterium
ARPLRNAIMAARDQGPLRV

SEQ ID NO: 637481 - protein, 17 aa, Mycobacterium
ARPPALITGGGMISPAQ

SEQ ID NO: 637482 - protein, 21 aa, Mycobacterium
ARPPHNWTPDVIWNAYAAIDG

SEQ ID NO: 637483 - protein, 22 aa, Mycobacterium
ARPPMVLQHGRLRGHAVAVPNL

SEQ ID NO: 637484 - protein, 17 aa, Mycobacterium
ARPPWSIGQPQPEILKL

SEQ ID NO: 637485 - protein, 18 aa, Mycobacterium
ARPQIPGNLGAELQLTKI

SEQ ID NO: 637486 - protein, 28 aa, Mycobacterium
ARPQLAVTFRNGWRWATVEGGAELAGPD

SEQ ID NO: 637487 - protein, 26 aa, Mycobacterium
ARPQPARDADRAWWARRLPELPDPPA

SEQ ID NO: 637488 - protein, 19 aa, Mycobacterium
ARPQPARDTARNWWAQRIP

SEQ ID NO: 637489 - protein, 19 aa, Mycobacterium
ARPRAEFHRTVRRMQGAIT

SEQ ID NO: 637490 - protein, 23 aa, Mycobacterium
ARPRAGILRAREFVMKDSYSFDI

SEQ ID NO: 637491 - protein, 23 aa, Mycobacterium
ARPRAGLIGCAFADLAEIMAGVF

SEQ ID NO: 637492 - protein, 24 aa, Mycobacterium
ARPRAGLIGCAFADLAEVMAGVFA

SEQ ID NO: 637493 - protein, 24 aa, Mycobacterium
ARPRAGLIGCAFADLAEVTAGVFA

SEQ ID NO: 637494 - protein, 19 aa, Mycobacterium
ARPRELAMVFVAGHQGAGM

SEQ ID NO: 637495 - protein, 20 aa, Mycobacterium
ARPRQKVVVEVGGRRLEVSL

SEQ ID NO: 637496 - protein, 20 aa, Mycobacterium
ARPRRGSPVIVDGDLDELPP

SEQ ID NO: 637497 - protein, 18 aa, Mycobacterium
ARPRRVLIVGSGFVGSEI

SEQ ID NO: 637498 - protein, 20 aa, Mycobacterium
ARPRVNLLNWDGGQVPAGMF

SEQ ID NO: 637499 - protein, 19 aa, Mycobacterium
ARPRYVRIAADLPSTATHK

SEQ ID NO: 637500 - protein, 17 aa, Mycobacterium
ARPSALVFDGATDSVGE

SEQ ID NO: 637501 - protein, 28 aa, Mycobacterium
ARPSPLNLLVRAAVSYARRPPRLLSAAR

SEQ ID NO: 637502 - protein, 21 aa, Mycobacterium
ARPSRVPTLFIWSDGDSAVTR

SEQ ID NO: 637503 - protein, 26 aa, Mycobacterium
ARPTAWLAEGVLIGFLPPEAETRLLD

SEQ ID NO: 637504 - protein, 19 aa, Mycobacterium
ARPTGSVRHVEVFQMDGVG

SEQ ID NO: 637505 - protein, 21 aa, Mycobacterium
ARPTKFYAMLLARLHDHRSMD

SEQ ID NO: 637506 - protein, 20 aa, Mycobacterium
ARPTSEFGARFAGVNLVDGI

SEQ ID NO: 637507 - protein, 17 aa, Mycobacterium
ARPTSWRVPDTDSLPAL

SEQ ID NO: 637508 - protein, 19 aa, Mycobacterium
ARPTYRYIGSTAKSRDGWD

SEQ ID NO: 637509 - protein, 30 aa, Mycobacterium
ARPVGGMGAIYGRIAAELGDAVHLSQPVRH

SEQ ID NO: 637510 - protein, 17 aa, Mycobacterium
ARPVKRILHGCERNGVR

SEQ ID NO: 637511 - protein, 25 aa, Mycobacterium
ARPVPPEDLAKVWAVPVDSPVTEAQ

SEQ ID NO: 637512 - protein, 18 aa, Mycobacterium
ARPVPVSSVAVVESTGDR

SEQ ID NO: 637513 - protein, 27 aa, Mycobacterium
ARPWWLDRLRLLTWVIVDPASPIMIRL

SEQ ID NO: 637514 - protein, 26 aa, Mycobacterium
ARPYASATFPWYLLGRQVHVRGRVTK

SEQ ID NO: 637515 - protein, 22 aa, Mycobacterium
ARPYPIPIICALLGAPPEDWEQ

SEQ ID NO: 637516 - protein, 22 aa, Mycobacterium
ARPYPIPIICALLGAPREDWRL

SEQ ID NO: 637517 - protein, 20 aa, Mycobacterium
ARPYRDYIVWLAKQDRSAAL

SEQ ID NO: 637518 - protein, 24 aa, Mycobacterium
ARPYRGVEAAERLATRRNRLLAAG

SEQ ID NO: 637519 - protein, 25 aa, Mycobacterium
ARPYRGVEAAQRLAARRRQLLDAGL

SEQ ID NO: 637520 - protein, 19 aa, Mycobacterium
ARQAAHFALIERLARLDGH

SEQ ID NO: 637521 - protein, 21 aa, Mycobacterium
ARQAALSKLVRRGNALASSIA

SEQ ID NO: 637522 - protein, 30 aa, Mycobacterium
ARQAEWRRGRLPPGQLGWRKVTEIRDQAAA

SEQ ID NO: 637523 - protein, 17 aa, Mycobacterium
ARQAGRADSDWVQETAG

SEQ ID NO: 637524 - protein, 26 aa, Mycobacterium
ARQAIWPHRMFSLLAGFVEAGESFEV

SEQ ID NO: 637525 - protein, 18 aa, Mycobacterium
ARQALRILGLGADAVIEV

SEQ ID NO: 637526 - protein, 25 aa, Mycobacterium
ARQALRLFDDLRLVHGRLDQPIPVG

SEQ ID NO: 637527 - protein, 24 aa, Mycobacterium
ARQARQGVLPAILSSLITTRRHAT

SEQ ID NO: 637528 - protein, 26 aa, Mycobacterium
ARQAVWPERMFSLLAGFVEAGESFEA

SEQ ID NO: 637529 - protein, 26 aa, Mycobacterium
ARQAVWPERMFSLLAGFVEAGESFEG

SEQ ID NO: 637530 - protein, 18 aa, Mycobacterium
ARQELGWNPRFDLNAVAA

SEQ ID NO: 637531 - protein, 17 aa, Mycobacterium
ARQGAKVTREYYFNDHG

SEQ ID NO: 637532 - protein, 18 aa, Mycobacterium
ARQGFTVALIPDGDDPRR

SEQ ID NO: 637533 - protein, 31 aa, Mycobacterium
ARQGLTVAGTRAWLNRQLRPIGKALDREGPD

SEQ ID NO: 637534 - protein, 25 aa, Mycobacterium
ARQGRRCLPVIFPRGRDTPAALHHV

SEQ ID NO: 637535 - protein, 20 aa, Mycobacterium
ARQGSLPAILSALTTTRRQA

SEQ ID NO: 637536 - protein, 24 aa, Mycobacterium
ARQHGRFLLTRGMLIGADPVHTVI

SEQ ID NO: 637537 - protein, 18 aa, Mycobacterium
ARQHGWSPMHVVGLTYPL

SEQ ID NO: 637538 - protein, 19 aa, Mycobacterium
ARQHLSFGRGIHSCPGAPL

SEQ ID NO: 637539 - protein, 22 aa, Mycobacterium
ARQIGTEWLRSYLALPNYANNL

SEQ ID NO: 637540 - protein, 19 aa, Mycobacterium
ARQKLPIDVVAYVPMAENM

SEQ ID NO: 637541 - protein, 17 aa, Mycobacterium
ARQKTPVAWHFVDALPT

SEQ ID NO: 637542 - protein, 18 aa, Mycobacterium
ARQLISIHHADPARVDVV

SEQ ID NO: 637543 - protein, 17 aa, Mycobacterium
ARQLPGQILVLGGGEAR

SEQ ID NO: 637544 - protein, 18 aa, Mycobacterium
ARQLPGRLVGVSVDADGS

SEQ ID NO: 637545 - protein, 18 aa, Mycobacterium
ARQLPGRLVGVSVDGDGN

SEQ ID NO: 637546 - protein, 18 aa, Mycobacterium
ARQLPGRLVGVSVDSDGN

SEQ ID NO: 637547 - protein, 18 aa, Mycobacterium
ARQMLDMALSGLYTSAGS

SEQ ID NO: 637548 - protein, 25 aa, Mycobacterium
ARQMRRFGGIVSFELADADAVHALV

SEQ ID NO: 637549 - protein, 36 aa, Mycobacterium
ARQPAGAFWSSWPGRQLWWSYYMRLLIYVTPRRALF

SEQ ID NO: 637550 - protein, 18 aa, Mycobacterium
ARQPAVSELLRFITTPRC

SEQ ID NO: 637551 - protein, 20 aa, Mycobacterium
ARQPELRLTQILQTLVEGYA

SEQ ID NO: 637552 - protein, 20 aa, Mycobacterium
ARQRHWVEPKHMAWAQIPTA

SEQ ID NO: 637553 - protein, 19 aa, Mycobacterium
ARQRIAVVRAVRSALERRG

SEQ ID NO: 637554 - protein, 22 aa, Mycobacterium
ARQRIYRQPGFVAAMRDIVALQ

SEQ ID NO: 637555 - protein, 17 aa, Mycobacterium
ARQRLAAGLAQTTADIV

SEQ ID NO: 637556 - protein, 19 aa, Mycobacterium
ARQRLAANASAVVTEDSIE

SEQ ID NO: 637557 - protein, 28 aa, Mycobacterium
ARQRLIFSIPELKAALYDEYYRTVNVMA

SEQ ID NO: 637558 - protein, 21 aa, Mycobacterium
ARQRPFLVRIVDGCEPVEFTT

SEQ ID NO: 637559 - protein, 23 aa, Mycobacterium
ARQRPQLLIDWLGGDPGDLDEDL

SEQ ID NO: 637560 - protein, 21 aa, Mycobacterium
ARQSLRLAVMTALQELPARQR

SEQ ID NO: 637561 - protein, 25 aa, Mycobacterium
ARQSLRLFDDLRLEHGRLDEPIPVG

SEQ ID NO: 637562 - protein, 20 aa, Mycobacterium
ARQVGYFFGHMFLNMTEGTA

SEQ ID NO: 637563 - protein, 27 aa, Mycobacterium
ARQVIRPEFRGGAGFADPVDVPEDAGA

SEQ ID NO: 637564 - protein, 36 aa, Mycobacterium
ARQYREWFSRLAPGLAEQVVEHWGPPPGELFVDTSA

SEQ ID NO: 637565 - protein, 22 aa, Mycobacterium
ARRAAMCVLGKLGIGTSEVDRL

SEQ ID NO: 637566 - protein, 25 aa, Mycobacterium
ARRAARFRLPLSLADHLPEIAAYYR

SEQ ID NO: 637567 - protein, 24 aa, Mycobacterium
ARRADALSALAGRRIHAKFRTGGL

SEQ ID NO: 637568 - protein, 23 aa, Mycobacterium
ARRADIPFGGTVAVIGLGAVGLC

SEQ ID NO: 637569 - protein, 19 aa, Mycobacterium
ARRAFYRYHASLMEPWDGP

SEQ ID NO: 637570 - protein, 27 aa, Mycobacterium
ARRAGKRGPRFAVPMGLLNAAIPVIEP

SEQ ID NO: 637571 - protein, 25 aa, Mycobacterium
ARRAGRIPKRFWAQASSPTLVTTQS

SEQ ID NO: 637572 - protein, 19 aa, Mycobacterium
ARRALDFLRGLRRQDTIAT

SEQ ID NO: 637573 - protein, 19 aa, Mycobacterium
ARRALDFLRGMRRQDTLAT

SEQ ID NO: 637574 - protein, 18 aa, Mycobacterium
ARRALDLTKAYALERTAF

SEQ ID NO: 637575 - protein, 26 aa, Mycobacterium
ARRALEVLRRLYARVGDKLVLISVGG

SEQ ID NO: 637576 - protein, 19 aa, Mycobacterium
ARRALGDRLGRVAAPHRIL

SEQ ID NO: 637577 - protein, 21 aa, Mycobacterium
ARRALSRVFDLPPPVCDFVVH

SEQ ID NO: 637578 - protein, 18 aa, Mycobacterium
ARRARMSLTTIYKRYPTR

SEQ ID NO: 637579 - protein, 23 aa, Mycobacterium
ARRARVASRVLALLPTVAKDQAL

SEQ ID NO: 637580 - protein, 22 aa, Mycobacterium
ARRARYRAAVDLALNQVDASHL

SEQ ID NO: 637581 - protein, 26 aa, Mycobacterium
ARRASCLTGLGYPAATQVLGARPVEV

SEQ ID NO: 637582 - protein, 25 aa, Mycobacterium
ARRAVRFRLPLSLADHLPDIAAYYR

SEQ ID NO: 637583 - protein, 17 aa, Mycobacterium
ARRCLQEGRSVILDGTW

SEQ ID NO: 637584 - protein, 22 aa, Mycobacterium
ARRDGKVPAVLYGHGTDPQHLE

SEQ ID NO: 637585 - protein, 28 aa, Mycobacterium
ARRDGVACYPARFQLVLAANLCPCAPAD

SEQ ID NO: 637586 - protein, 28 aa, Mycobacterium
ARRDGVACYPARFQLVLAANPCPCAPAD

SEQ ID NO: 637587 - protein, 17 aa, Mycobacterium
ARRDGVSVITLDRGLPA

SEQ ID NO: 637588 - protein, 17 aa, Mycobacterium
ARRDLPWRRPGVSAWQI

SEQ ID NO: 637589 - protein, 17 aa, Mycobacterium
ARRDPNFIVCARTDAAA

SEQ ID NO: 637590 - protein, 26 aa, Mycobacterium
ARRECTGFIFNRVWAAIKRESLAVVA

SEQ ID NO: 637591 - protein, 22 aa, Mycobacterium
ARRELAEALRILAARLPNPRIS

SEQ ID NO: 637592 - protein, 17 aa, Mycobacterium
ARRELAETLAALDVTML

SEQ ID NO: 637593 - protein, 24 aa, Mycobacterium
ARRELAPRLAFHAWVQQQCAEQLG

SEQ ID NO: 637594 - protein, 22 aa, Mycobacterium
ARREVAQQIAFYASVRTYQPLL

SEQ ID NO: 637595 - protein, 24 aa, Mycobacterium
ARREWPSPMLPALQALPADGPDIH

SEQ ID NO: 637596 - protein, 20 aa, Mycobacterium
ARRFARDDYDILLIGHEGHE

SEQ ID NO: 637597 - protein, 18 aa, Mycobacterium
ARRFCIPAVEAKGSLLLE

SEQ ID NO: 637598 - protein, 21 aa, Mycobacterium
ARRFLEHWEQGAVFEPFLTLW

SEQ ID NO: 637599 - protein, 20 aa, Mycobacterium
ARRFWVRYAAESAGWLTLDA

SEQ ID NO: 637600 - protein, 17 aa, Mycobacterium
ARRGAGITGPGHVTALV

SEQ ID NO: 637601 - protein, 24 aa, Mycobacterium
ARRGDGWIKLVGDWIDRGAGDLAP

SEQ ID NO: 637602 - protein, 24 aa, Mycobacterium
ARRGDGWIKLVGDWIDRQIGDLAP

SEQ ID NO: 637603 - protein, 25 aa, Mycobacterium
ARRGGRFAVALGMGGMGYSFGAGIG

SEQ ID NO: 637604 - protein, 20 aa, Mycobacterium
ARRGGVPAEAGREWRHESEP

SEQ ID NO: 637605 - protein, 19 aa, Mycobacterium
ARRGLAFQLVDGAARLGRV

SEQ ID NO: 637606 - protein, 17 aa, Mycobacterium
ARRGLALQLVEGAAKLG

SEQ ID NO: 637607 - protein, 18 aa, Mycobacterium
ARRGLTNAIVAYLENSGA

SEQ ID NO: 637608 - protein, 26 aa, Mycobacterium
ARRGMPVLGICNGFQVLCEAGLLPGA

SEQ ID NO: 637609 - protein, 20 aa, Mycobacterium
ARRGRARKVIEFKTARHLED

SEQ ID NO: 637610 - protein, 17 aa, Mycobacterium
ARRGRGALAALARAVPT

SEQ ID NO: 637611 - protein, 20 aa, Mycobacterium
ARRGVVLAMGSFAYNDAMVA

SEQ ID NO: 637612 - protein, 18 aa, Mycobacterium
ARRHGWTFPYLYDESQDV

SEQ ID NO: 637613 - protein, 28 aa, Mycobacterium
ARRHLGVAFDMFTRMGAAGFAERARREL

SEQ ID NO: 637614 - protein, 22 aa, Mycobacterium
ARRHWPEILARMTGDHGAAAYL

SEQ ID NO: 637615 - protein, 23 aa, Mycobacterium
ARRIADLGPRHVVVKGGVEFPGS

SEQ ID NO: 637616 - protein, 18 aa, Mycobacterium
ARRIALSVTNLFGQHTPA

SEQ ID NO: 637617 - protein, 28 aa, Mycobacterium
ARRIARFGSGWIPWGSAFADLPAAIKAM

SEQ ID NO: 637618 - protein, 20 aa, Mycobacterium
ARRIAWLPSEVGKRPPGHLW

SEQ ID NO: 637619 - protein, 27 aa, Mycobacterium
ARRICGPRPVLAVLGGFHLGFPTTPAD

SEQ ID NO: 637620 - protein, 25 aa, Mycobacterium
ARRIESLGYGAVWIGGSPDADLAWV

SEQ ID NO: 637621 - protein, 30 aa, Mycobacterium
ARRIHLLPMLRWKCVESPLGLNHPYWVEDP

SEQ ID NO: 637622 - protein, 18 aa, Mycobacterium
ARRIPVIMATDYRGLLDV

SEQ ID NO: 637623 - protein, 20 aa, Mycobacterium
ARRITGWVAALGSAVTEAEI

SEQ ID NO: 637624 - protein, 18 aa, Mycobacterium
ARRITGWVAALGSSEAEA

SEQ ID NO: 637625 - protein, 19 aa, Mycobacterium
ARRITGWVAALGTSDAGGY

SEQ ID NO: 637626 - protein, 17 aa, Mycobacterium
ARRKAALQEATRDSADE

SEQ ID NO: 637627 - protein, 22 aa, Mycobacterium
ARRKLRMICHGIGRTDGFAPAS

SEQ ID NO: 637628 - protein, 21 aa, Mycobacterium
ARRKLRMICHGIGRTEGFAPK

SEQ ID NO: 637629 - protein, 21 aa, Mycobacterium
ARRKLRMICHGIGYTEGFTPA

SEQ ID NO: 637630 - protein, 24 aa, Mycobacterium
ARRLAALVDRLVCSGVHAIAALGS

SEQ ID NO: 637631 - protein, 24 aa, Mycobacterium
ARRLADLLEHWGLKRPSMIANDIG

SEQ ID NO: 637632 - protein, 24 aa, Mycobacterium
ARRLAEKLWSLRILDDEKSASDIG

SEQ ID NO: 637633 - protein, 22 aa, Mycobacterium
ARRLAEKVWYLRILADERSAAD

SEQ ID NO: 637634 - protein, 20 aa, Mycobacterium
ARRLAGLFASYARQRPELLV

SEQ ID NO: 637635 - protein, 20 aa, Mycobacterium
ARRLAGLFASYARQRPQLLV

SEQ ID NO: 637636 - protein, 22 aa, Mycobacterium
ARRLAPGGAIVVGGRLDSAPLL

SEQ ID NO: 637637 - protein, 24 aa, Mycobacterium
ARRLCPDREVVLVFVGDGSVPPPA

SEQ ID NO: 637638 - protein, 26 aa, Mycobacterium
ARRLCPRAVVVPPRMSAYTRASEAVF

SEQ ID NO: 637639 - protein, 18 aa, Mycobacterium
ARRLDEYYPVLYTGDNGM

SEQ ID NO: 637640 - protein, 21 aa, Mycobacterium
ARRLFECWKAGETGYPLVDAG

SEQ ID NO: 637641 - protein, 21 aa, Mycobacterium
ARRLGLCGFGQYVDRSGEQER

SEQ ID NO: 637642 - protein, 33 aa, Mycobacterium
ARRLKASGIDTVFTLSGGHLFSIYDGCRDEGIR

SEQ ID NO: 637643 - protein, 27 aa, Mycobacterium
ARRLKASGVDTVFTLSGGHLFSVYDGC

SEQ ID NO: 637644 - protein, 24 aa, Mycobacterium
ARRLLAEPVGLIFAVRDHGAPALA

SEQ ID NO: 637645 - protein, 19 aa, Mycobacterium
ARRLLAFYGSTPAYRPVLE

SEQ ID NO: 637646 - protein, 26 aa, Mycobacterium
ARRLPDALARFPITRLVSSPQVRAIE

SEQ ID NO: 637647 - protein, 19 aa, Mycobacterium
ARRLPELPDPPALPTTGGR

SEQ ID NO: 637648 - protein, 18 aa, Mycobacterium
ARRLPLFLHPALEPPIGG

SEQ ID NO: 637649 - protein, 24 aa, Mycobacterium
ARRLSEALYSYSLLDIIDIAHAHS

SEQ ID NO: 637650 - protein, 24 aa, Mycobacterium
ARRLTEVRKNGVLDYLRPDGKTQV

SEQ ID NO: 637651 - protein, 17 aa, Mycobacterium
ARRLTVLSDRERIARGD

SEQ ID NO: 637652 - protein, 25 aa, Mycobacterium
ARRLYRLPLAIARLARSGRITQRLS

SEQ ID NO: 637653 - protein, 24 aa, Mycobacterium
ARRMGRGLVHLHLCDGSGLPADEH

SEQ ID NO: 637654 - protein, 25 aa, Mycobacterium
ARRMPFRVHIAYYRYFVRYPGAGKP

SEQ ID NO: 637655 - protein, 21 aa, Mycobacterium
ARRMRIAIEYPHRGVDCAQEV

SEQ ID NO: 637656 - protein, 24 aa, Mycobacterium
ARRMRISIEYSHRGVDCAREVADV

SEQ ID NO: 637657 - protein, 17 aa, Mycobacterium
ARRNARRLQRMVDSLLA

SEQ ID NO: 637658 - protein, 17 aa, Mycobacterium
ARRPDLILLDLNLPKYD

SEQ ID NO: 637659 - protein, 19 aa, Mycobacterium
ARRPHANVVRPEPARLGQG

SEQ ID NO: 637660 - protein, 23 aa, Mycobacterium
ARRPHPINPIGIIGVSRGGVDRR

SEQ ID NO: 637661 - protein, 25 aa, Mycobacterium
ARRPLSWRLVLTIGEPGDPTGDATK

SEQ ID NO: 637662 - protein, 23 aa, Mycobacterium
ARRPRFNCFGLHEWAMVYRTPTV

SEQ ID NO: 637663 - protein, 19 aa, Mycobacterium
ARRPTSRLACQVQVDNALG

SEQ ID NO: 637664 - protein, 21 aa, Mycobacterium
ARRPVIMAGTNVWWGHAEAAL

SEQ ID NO: 637665 - protein, 30 aa, Mycobacterium
ARRQLQYFWPRLVGDTGWELLDSKFSVVAQ

SEQ ID NO: 637666 - protein, 17 aa, Mycobacterium
ARRQSWDAPMFDETYSF

SEQ ID NO: 637667 - protein, 20 aa, Mycobacterium
ARRRAEIIAAVAQDAVVVED

SEQ ID NO: 637668 - protein, 17 aa, Mycobacterium
ARRRAHRSVRTAVVADG

SEQ ID NO: 637669 - protein, 24 aa, Mycobacterium
ARRRARERLTFDEAVGLQWALVAR

SEQ ID NO: 637670 - protein, 18 aa, Mycobacterium
ARRRELYEPLTASVRDLI

SEQ ID NO: 637671 - protein, 20 aa, Mycobacterium
ARRRGHRPVRTAVLADNVSE

SEQ ID NO: 637672 - protein, 18 aa, Mycobacterium
ARRRGITVLGDRPPMVSV

SEQ ID NO: 637673 - protein, 19 aa, Mycobacterium
ARRRGVAVFYTYCESHASD

SEQ ID NO: 637674 - protein, 23 aa, Mycobacterium
ARRRMWLPVGAIFGRLEPNANDY

SEQ ID NO: 637675 - protein, 18 aa, Mycobacterium
ARRRRRATLRGYGDEFMD

SEQ ID NO: 637676 - protein, 26 aa, Mycobacterium
ARRRSAFLASRARVFSVLRPVPDLVR

SEQ ID NO: 637677 - protein, 26 aa, Mycobacterium
ARRRSQELLEQFGLMHAAKRRVSTYS

SEQ ID NO: 637678 - protein, 21 aa, Mycobacterium
ARRRVGLVGLHAWSDIDVSEW

SEQ ID NO: 637679 - protein, 24 aa, Mycobacterium
ARRSDPLRGRHVIITGASSGIGRA

SEQ ID NO: 637680 - protein, 17 aa, Mycobacterium
ARRSGMIEQIWRAFFSS

SEQ ID NO: 637681 - protein, 21 aa, Mycobacterium
ARRSGVRRVVYLSGLHPEQSK

SEQ ID NO: 637682 - protein, 22 aa, Mycobacterium
ARRSLFPALRFDEHLIMGEDVL

SEQ ID NO: 637683 - protein, 19 aa, Mycobacterium
ARRTAKLVGNVGGRYLDGA

SEQ ID NO: 637684 - protein, 18 aa, Mycobacterium
ARRTDLMFEQGFVGEVEY

SEQ ID NO: 637685 - protein, 22 aa, Mycobacterium
ARRVADVLGIPFYVWDFAEKFQ

SEQ ID NO: 637686 - protein, 22 aa, Mycobacterium
ARRVADVLGIPFYVWDFAERFK

SEQ ID NO: 637687 - protein, 31 aa, Mycobacterium
ARRVDTIRTGDEWKLAARTVYFEQATLGVQN

SEQ ID NO: 637688 - protein, 21 aa, Mycobacterium
ARRVFTPKVAGSWRLHEATAD

SEQ ID NO: 637689 - protein, 20 aa, Mycobacterium
ARRVLKPGGHFIAMGPNIRF

SEQ ID NO: 637690 - protein, 22 aa, Mycobacterium
ARRVRYPMWLAAKMSTLANSRA

SEQ ID NO: 637691 - protein, 21 aa, Mycobacterium
ARRVVAMGATLARAAGWDAEP

SEQ ID NO: 637692 - protein, 32 aa, Mycobacterium
ARRWCDIWLHEGFACYAEWLWSEHSGGPSADE

SEQ ID NO: 637693 - protein, 21 aa, Mycobacterium
ARRWNEHLVRPSAFDAAAGVT

SEQ ID NO: 637694 - protein, 26 aa, Mycobacterium
ARRWQRLLFDNGWLIPGNPPEFGGRN

SEQ ID NO: 637695 - protein, 27 aa, Mycobacterium
ARRWQRLLFDNGWLLPGNPPEFGGRNA

SEQ ID NO: 637696 - protein, 27 aa, Mycobacterium
ARRWQRLLFDNGWLLPGQPPEFGGRNA

SEQ ID NO: 637697 - protein, 26 aa, Mycobacterium
ARRWQRLLFDNGWLLPSQPPEYGGRN

SEQ ID NO: 637698 - protein, 27 aa, Mycobacterium
ARRWQRLLFDSGWLLPGNPPEFGGRNA

SEQ ID NO: 637699 - protein, 23 aa, Mycobacterium
ARRWRGSPERFGMSAAILLGDLA

SEQ ID NO: 637700 - protein, 24 aa, Mycobacterium
ARRWSGERIRVYSMHPGWADTPGV

SEQ ID NO: 637701 - protein, 18 aa, Mycobacterium
ARRYFEFLERERANDAAG

SEQ ID NO: 637702 - protein, 20 aa, Mycobacterium
ARRYGVPVKIVRIFNTYGPG

SEQ ID NO: 637703 - protein, 21 aa, Mycobacterium
ARRYGWNCLIFEGPGQGAALR

SEQ ID NO: 637704 - protein, 23 aa, Mycobacterium
ARRYPAIVCQVHLGIVEGVLERF

SEQ ID NO: 637705 - protein, 25 aa, Mycobacterium
ARRYRHPLCLRVHFPAGTLLDDTGC

SEQ ID NO: 637706 - protein, 27 aa, Mycobacterium
ARRYVAKYTICPAIAHGLDHEVGSVEV

SEQ ID NO: 637707 - protein, 24 aa, Mycobacterium
ARSAADFRAPFAPSGRFEGLEIEH

SEQ ID NO: 637708 - protein, 22 aa, Mycobacterium
ARSACTHCNLCMPTIYSRTRCV

SEQ ID NO: 637709 - protein, 17 aa, Mycobacterium
ARSAEQLGRYGQPPHSA

SEQ ID NO: 637710 - protein, 23 aa, Mycobacterium
ARSAGRAPGWADLPVQYVDYTLW

SEQ ID NO: 637711 - protein, 24 aa, Mycobacterium
ARSAGSLPAFRIGSSVAVNVLAND

SEQ ID NO: 637712 - protein, 19 aa, Mycobacterium
ARSAGVAYDVVHLCNSPAA

SEQ ID NO: 637713 - protein, 18 aa, Mycobacterium
ARSAIEPMAARLLAENGT

SEQ ID NO: 637714 - protein, 21 aa, Mycobacterium
ARSAIQWCRRIVIVNGHGGNI

SEQ ID NO: 637715 - protein, 28 aa, Mycobacterium
ARSALDALGYRGFWAGYFAARSAPLGPV

SEQ ID NO: 637716 - protein, 17 aa, Mycobacterium
ARSALIVNIQNAAGQIF

SEQ ID NO: 637717 - protein, 19 aa, Mycobacterium
ARSALLRDGFDSICQELVR

SEQ ID NO: 637718 - protein, 20 aa, Mycobacterium
ARSAQYTVMLDGMREHGHDT

SEQ ID NO: 637719 - protein, 19 aa, Mycobacterium
ARSAVKRPIAWIHTRASLT

SEQ ID NO: 637720 - protein, 24 aa, Mycobacterium
ARSAVLLCLGARGLKHSTQGRIGS

SEQ ID NO: 637721 - protein, 23 aa, Mycobacterium
ARSDKLWRSKPVGLLRRVLNNPR

SEQ ID NO: 637722 - protein, 22 aa, Mycobacterium
ARSDLFTAFVPFAARWPVEVHI

SEQ ID NO: 637723 - protein, 21 aa, Mycobacterium
ARSDLPATPWLIPESTGLELL

SEQ ID NO: 637724 - protein, 19 aa, Mycobacterium
ARSELEFLQPGALLDSLET

SEQ ID NO: 637725 - protein, 20 aa, Mycobacterium
ARSELEFLQPGALLESLETR

SEQ ID NO: 637726 - protein, 26 aa, Mycobacterium
ARSERRRPFDLSRGPALRVVLLSAPG

SEQ ID NO: 637727 - protein, 30 aa, Mycobacterium
ARSERRRPFDLSRGPALRVVVLSVPGETKR

SEQ ID NO: 637728 - protein, 18 aa, Mycobacterium
ARSESWLQTATFTLTENR

SEQ ID NO: 637729 - protein, 20 aa, Mycobacterium
ARSEWDRVIATMAMAIDPKD

SEQ ID NO: 637730 - protein, 17 aa, Mycobacterium
ARSEYLASLTAALWEVE

SEQ ID NO: 637731 - protein, 22 aa, Mycobacterium
ARSFASALGLDFTRVQFTPDLL

SEQ ID NO: 637732 - protein, 28 aa, Mycobacterium
ARSFLRRWPRVQSWADIPLDEQLAANCS

SEQ ID NO: 637733 - protein, 18 aa, Mycobacterium
ARSFRAMIAVGDRMSTST

SEQ ID NO: 637734 - protein, 18 aa, Mycobacterium
ARSGADVVRLVAGDPLSV

SEQ ID NO: 637735 - protein, 25 aa, Mycobacterium
ARSGEAIAMRVCIVIVVGDDGLITR

SEQ ID NO: 637736 - protein, 20 aa, Mycobacterium
ARSGIDIASRAMGDSANATQ

SEQ ID NO: 637737 - protein, 22 aa, Mycobacterium
ARSGRPGAVLVDIPKDILQGQC

SEQ ID NO: 637738 - protein, 21 aa, Mycobacterium
ARSHGVSKFYDVGRHGIVHQV

SEQ ID NO: 637739 - protein, 25 aa, Mycobacterium
ARSIAEPYLRPGQIEEHLVYPVTTE

SEQ ID NO: 637740 - protein, 26 aa, Mycobacterium
ARSIAPWDCPSWADVLDVFAETLATS

SEQ ID NO: 637741 - protein, 18 aa, Mycobacterium
ARSIVECIRRLRPDLDAR

SEQ ID NO: 637742 - protein, 20 aa, Mycobacterium
ARSIVEWGMQCTCPSIDECT

SEQ ID NO: 637743 - protein, 17 aa, Mycobacterium
ARSIYYGRLTELTDTDF

SEQ ID NO: 637744 - protein, 19 aa, Mycobacterium
ARSKLEFVQPGVLLESLDS

SEQ ID NO: 637745 - protein, 22 aa, Mycobacterium
ARSKLGFLPNMYRNMANVPGLL

SEQ ID NO: 637746 - protein, 24 aa, Mycobacterium
ARSKPTISVGAWLQYLLDNFGTVA

SEQ ID NO: 637747 - protein, 34 aa, Mycobacterium
ARSLAEVGIGFCFAPLFHPSYRHTSAVRRELGVP

SEQ ID NO: 637748 - protein, 22 aa, Mycobacterium
ARSLATAGLRFERQCQNALAVA

SEQ ID NO: 637749 - protein, 18 aa, Mycobacterium
ARSLGKSMRIFKSELREM

SEQ ID NO: 637750 - protein, 23 aa, Mycobacterium
ARSLKPGGRFFALVFATEAFPPN

SEQ ID NO: 637751 - protein, 18 aa, Mycobacterium
ARSLLCAGYAVDPQKVII

SEQ ID NO: 637752 - protein, 21 aa, Mycobacterium
ARSLLGFDFCGVLLPDEQSRH

SEQ ID NO: 637753 - protein, 18 aa, Mycobacterium
ARSLLPEEHRAFVDDILA

SEQ ID NO: 637754 - protein, 20 aa, Mycobacterium
ARSLPAQWIAIGVGDGQYHA

SEQ ID NO: 637755 - protein, 18 aa, Mycobacterium
ARSLRILGVRALDLQERF

SEQ ID NO: 637756 - protein, 23 aa, Mycobacterium
ARSLRPDTVRTWYATSDADTAVP

SEQ ID NO: 637757 - protein, 18 aa, Mycobacterium
ARSLSIATDVGFRMPSVW

SEQ ID NO: 637758 - protein, 17 aa, Mycobacterium
ARSLSMSAFANKVTIGY

SEQ ID NO: 637759 - protein, 18 aa, Mycobacterium
ARSLSMSAFANKVTIGYT

SEQ ID NO: 637760 - protein, 21 aa, Mycobacterium
ARSMAYFSLGYLLKRSEPVRA

SEQ ID NO: 637761 - protein, 19 aa, Mycobacterium
ARSMFDYPAIQAVADALPF

SEQ ID NO: 637762 - protein, 24 aa, Mycobacterium
ARSPEALAELALRYETALAAGAPL

SEQ ID NO: 637763 - protein, 23 aa, Mycobacterium
ARSPEALVALAQRYETWLTAHPE

SEQ ID NO: 637764 - protein, 22 aa, Mycobacterium
ARSPRFVIVAVDISEPGNAGTL

SEQ ID NO: 637765 - protein, 18 aa, Mycobacterium
ARSPRPTLGVEWEFALVD

SEQ ID NO: 637766 - protein, 21 aa, Mycobacterium
ARSPSCPRLADSIRHAVAEGC

SEQ ID NO: 637767 - protein, 30 aa, Mycobacterium
ARSPYVASFRAGWAYLSLITVHIYYGTATP

SEQ ID NO: 637768 - protein, 29 aa, Mycobacterium
ARSQIVALAESFARAGIELDPRLTNLDPE

SEQ ID NO: 637769 - protein, 23 aa, Mycobacterium
ARSRANFGYYARRALARHPDALS

SEQ ID NO: 637770 - protein, 20 aa, Mycobacterium
ARSRATWQRHHVFAEAQRLV

SEQ ID NO: 637771 - protein, 25 aa, Mycobacterium
ARSRAWRREWAYSRAATIYGGTSEI

SEQ ID NO: 637772 - protein, 18 aa, Mycobacterium
ARSRFLSHLYRYAEDPEP

SEQ ID NO: 637773 - protein, 25 aa, Mycobacterium
ARSRIKEIPLFTGPGTLGLPILTIL

SEQ ID NO: 637774 - protein, 21 aa, Mycobacterium
ARSRLAMAMGAIRARQSLDSA

SEQ ID NO: 637775 - protein, 20 aa, Mycobacterium
ARSRPGQAFAAKNADLIFVT

SEQ ID NO: 637776 - protein, 25 aa, Mycobacterium
ARSRPRFVGATLKRADHVILLSEEA

SEQ ID NO: 637777 - protein, 18 aa, Mycobacterium
ARSSFVMTPPTGIWYPMQ

SEQ ID NO: 637778 - protein, 21 aa, Mycobacterium
ARSTFPVWMMNAIGDITFHHA

SEQ ID NO: 637779 - protein, 18 aa, Mycobacterium
ARSTHRYDLTYSPGAAGH

SEQ ID NO: 637780 - protein, 36 aa, Mycobacterium
ARSTKRVCRDCGFFLPLAGALGAMFGVCGNELSADG

SEQ ID NO: 637781 - protein, 36 aa, Mycobacterium
ARSTKRVCRDCGFYLPLGGALGRMFGVCANELSADG

SEQ ID NO: 637782 - protein, 20 aa, Mycobacterium
ARSTLRHRIALRPDAELEGA

SEQ ID NO: 637783 - protein, 22 aa, Mycobacterium
ARSVAALVVWKLGSSSANAHTI

SEQ ID NO: 637784 - protein, 17 aa, Mycobacterium
ARSVARWTSGQVVPQRL

SEQ ID NO: 637785 - protein, 17 aa, Mycobacterium
ARSVAVDVLKPVLDELG

SEQ ID NO: 637786 - protein, 23 aa, Mycobacterium
ARSVCARSGIAAHQVTYVEAHGT

SEQ ID NO: 637787 - protein, 18 aa, Mycobacterium
ARSVLLWGKGGKQRLVPV

SEQ ID NO: 637788 - protein, 25 aa, Mycobacterium
ARSVLPVELRLGVPDRLPTSIESGA

SEQ ID NO: 637789 - protein, 20 aa, Mycobacterium
ARSVSPGWRQAYVSAASLPG

SEQ ID NO: 637790 - protein, 19 aa, Mycobacterium
ARSVTAIAPAGGWTKYSPL

SEQ ID NO: 637791 - protein, 25 aa, Mycobacterium
ARSVVARARQRGCTLLVTDGDWQGA

SEQ ID NO: 637792 - protein, 27 aa, Mycobacterium
ARSWRLLCTRQAHFSARQALRILGLGA

SEQ ID NO: 637793 - protein, 17 aa, Mycobacterium
ARSWTRRWPTVFGIRHG

SEQ ID NO: 637794 - protein, 26 aa, Mycobacterium
ARSWYRPPPRTDWQLLVSDLSGLPAT

SEQ ID NO: 637795 - protein, 25 aa, Mycobacterium
ARSWYRRLAADWRRCEGKTAVIVRA

SEQ ID NO: 637796 - protein, 18 aa, Mycobacterium
ARSYLSMPAPEYAEGDTR

SEQ ID NO: 637797 - protein, 24 aa, Mycobacterium
ARTAACAFENAFAATVAPSVIAAN

SEQ ID NO: 637798 - protein, 18 aa, Mycobacterium
ARTAADLLRGGVRPAQST

SEQ ID NO: 637799 - protein, 19 aa, Mycobacterium
ARTACPLAGVGRSRDARRR

SEQ ID NO: 637800 - protein, 23 aa, Mycobacterium
ARTAFDLGRRLPFVDGVQRIDAL

SEQ ID NO: 637801 - protein, 24 aa, Mycobacterium
ARTAGHPPTWVPLPVHYADYTLWH

SEQ ID NO: 637802 - protein, 21 aa, Mycobacterium
ARTAGHPVVALVVGEALSGGF

SEQ ID NO: 637803 - protein, 19 aa, Mycobacterium
ARTAGICAISPALFSSFTG

SEQ ID NO: 637804 - protein, 19 aa, Mycobacterium
ARTAGICAISPALYTSFTG

SEQ ID NO: 637805 - protein, 17 aa, Mycobacterium
ARTAGISSFGISGTNAH

SEQ ID NO: 637806 - protein, 19 aa, Mycobacterium
ARTAGISSFGISGTNAHLI

SEQ ID NO: 637807 - protein, 17 aa, Mycobacterium
ARTAIGLARKAAEAFAE

SEQ ID NO: 637808 - protein, 19 aa, Mycobacterium
ARTARDVWWVDVLLTQLES

SEQ ID NO: 637809 - protein, 22 aa, Mycobacterium
ARTARPGFTLTQRNAAAVARIC

SEQ ID NO: 637810 - protein, 18 aa, Mycobacterium
ARTARYGALDAHRDGPVL

SEQ ID NO: 637811 - protein, 17 aa, Mycobacterium
ARTAVDLACRYPLDTAV

SEQ ID NO: 637812 - protein, 28 aa, Mycobacterium
ARTAWGKVLEGFDTPTLVAPPAPPGARG

SEQ ID NO: 637813 - protein, 18 aa, Mycobacterium
ARTAWNFRMHNMGQACNS

SEQ ID NO: 637814 - protein, 25 aa, Mycobacterium
ARTCGEFGLRIADAGFWTYPEWAPR

SEQ ID NO: 637815 - protein, 17 aa, Mycobacterium
ARTCSAGVFKRHKQIDR

SEQ ID NO: 637816 - protein, 19 aa, Mycobacterium
ARTCSAGVFKRHRQIDRPC

SEQ ID NO: 637817 - protein, 21 aa, Mycobacterium
ARTDALFSLAERWTETGEPAG

SEQ ID NO: 637818 - protein, 24 aa, Mycobacterium
ARTDARAPLGLDVAIERANRFAAA

SEQ ID NO: 637819 - protein, 23 aa, Mycobacterium
ARTDARGPLGLDEAIRRANRYAA

SEQ ID NO: 637820 - protein, 22 aa, Mycobacterium
ARTDPRPAVLISASSVGYYGYD

SEQ ID NO: 637821 - protein, 25 aa, Mycobacterium
ARTECPAGTVGEIWVQGDNVAMGYW

SEQ ID NO: 637822 - protein, 21 aa, Mycobacterium
ARTEWSNLIYGAGQTVSQPKL

SEQ ID NO: 637823 - protein, 17 aa, Mycobacterium
ARTFPITVAEAVMMGRW

SEQ ID NO: 637824 - protein, 17 aa, Mycobacterium
ARTGAIVVGATFPNTSP

SEQ ID NO: 637825 - protein, 18 aa, Mycobacterium
ARTGEFRQRPLVLMRSID

SEQ ID NO: 637826 - protein, 18 aa, Mycobacterium
ARTGEFRQRPLVLVRGMD

SEQ ID NO: 637827 - protein, 25 aa, Mycobacterium
ARTGLEPGTQWLSVRGYRQADGASV

SEQ ID NO: 637828 - protein, 25 aa, Mycobacterium
ARTGRSTAEIAAWLISRFAQELGLP

SEQ ID NO: 637829 - protein, 18 aa, Mycobacterium
ARTGVIGAVHAGRVGAQH

SEQ ID NO: 637830 - protein, 19 aa, Mycobacterium
ARTHGFRAANFIELAAYPL

SEQ ID NO: 637831 - protein, 18 aa, Mycobacterium
ARTHTVHDAVRWKPYSIG

SEQ ID NO: 637832 - protein, 20 aa, Mycobacterium
ARTIPFVKPAVFLHSQTTRC

SEQ ID NO: 637833 - protein, 18 aa, Mycobacterium
ARTKAMFDRGLIEEVISL

SEQ ID NO: 637834 - protein, 26 aa, Mycobacterium
ARTKIIPVSFGFPFGLSVVLPLNVPL

SEQ ID NO: 637835 - protein, 27 aa, Mycobacterium
ARTKNMFALGLLSWMYHRPLEGTEQFL

SEQ ID NO: 637836 - protein, 19 aa, Mycobacterium
ARTLAEWSERFATLAGPWA

SEQ ID NO: 637837 - protein, 21 aa, Mycobacterium
ARTLGSLALMGIRVEELLINQ

SEQ ID NO: 637838 - protein, 19 aa, Mycobacterium
ARTLGSLALMGVEVAELLV

SEQ ID NO: 637839 - protein, 18 aa, Mycobacterium
ARTLIKLGAIDAHADPAR

SEQ ID NO: 637840 - protein, 19 aa, Mycobacterium
ARTLLGAAHPVPWESFAAD

SEQ ID NO: 637841 - protein, 17 aa, Mycobacterium
ARTLLGPDHPVPWETFA

SEQ ID NO: 637842 - protein, 33 aa, Mycobacterium
ARTLRRCGAPLLSLRTDRDWIADVMRFVANRRR

SEQ ID NO: 637843 - protein, 23 aa, Mycobacterium
ARTLSTLTWRAATNVTKLPGLGG

SEQ ID NO: 637844 - protein, 25 aa, Mycobacterium
ARTLTAIAPAGGWPHHSLSKYETVL

SEQ ID NO: 637845 - protein, 24 aa, Mycobacterium
ARTLTGIAPAGGWTRFTPAKYEIV

SEQ ID NO: 637846 - protein, 19 aa, Mycobacterium
ARTMRKAFMGNPILCDLIL

SEQ ID NO: 637847 - protein, 20 aa, Mycobacterium
ARTMVWRAAAAVTEGDPRAA

SEQ ID NO: 637848 - protein, 18 aa, Mycobacterium
ARTNGYRRDLLFGSDDEP

SEQ ID NO: 637849 - protein, 20 aa, Mycobacterium
ARTPAGLGDRVQWRGWSAGP

SEQ ID NO: 637850 - protein, 32 aa, Mycobacterium
ARTPDYRGCSSWVRLPVDPRWGEPVHSEAELD

SEQ ID NO: 637851 - protein, 17 aa, Mycobacterium
ARTPEYPTATSIQKCIR

SEQ ID NO: 637852 - protein, 24 aa, Mycobacterium
ARTPIAVEVPFEMPVGDTVVRGRI

SEQ ID NO: 637853 - protein, 20 aa, Mycobacterium
ARTPLPDWWADLDADAVTAQ

SEQ ID NO: 637854 - protein, 18 aa, Mycobacterium
ARTPMFLLNRVSYDQDDV

SEQ ID NO: 637855 - protein, 28 aa, Mycobacterium
ARTPQCPMCPLSSCAWHEAGQPPLDAPA

SEQ ID NO: 637856 - protein, 18 aa, Mycobacterium
ARTPRLLVASDFDGTLAP

SEQ ID NO: 637857 - protein, 17 aa, Mycobacterium
ARTQLRIAHEMLDAMGM

SEQ ID NO: 637858 - protein, 25 aa, Mycobacterium
ARTQRLRIGHLVLCDAFRHPAVLAK

SEQ ID NO: 637859 - protein, 26 aa, Mycobacterium
ARTRAGELLEAVGLPPQRLDAYPHQL

SEQ ID NO: 637860 - protein, 31 aa, Mycobacterium
ARTRCGSPAWNLPVVFGPIAITYNVRGVSSL

SEQ ID NO: 637861 - protein, 20 aa, Mycobacterium
ARTRESVVLAMLMDTLTAAG

SEQ ID NO: 637862 - protein, 21 aa, Mycobacterium
ARTRESVVLAMLMDTLTAAGR

SEQ ID NO: 637863 - protein, 17 aa, Mycobacterium
ARTRFLLIGVPGPPPPR

SEQ ID NO: 637864 - protein, 19 aa, Mycobacterium
ARTRFVLVGCPGPPPKRTG

SEQ ID NO: 637865 - protein, 22 aa, Mycobacterium
ARTRHNLGFMVADLLAARLGAK

SEQ ID NO: 637866 - protein, 20 aa, Mycobacterium
ARTRPALRSVAVWTQDGPLQ

SEQ ID NO: 637867 - protein, 33 aa, Mycobacterium
ARTRPDSIALRRCDGRDAMSYGELIGAVEDLAA

SEQ ID NO: 637868 - protein, 17 aa, Mycobacterium
ARTRPPVGWIEQTDGRI

SEQ ID NO: 637869 - protein, 19 aa, Mycobacterium
ARTRPVFGQLGNHQRPQRD

SEQ ID NO: 637870 - protein, 24 aa, Mycobacterium
ARTRPVRIAPRIALMAKALNTLGP

SEQ ID NO: 637871 - protein, 21 aa, Mycobacterium
ARTRRAMALLAIRNLDSYLDT

SEQ ID NO: 637872 - protein, 21 aa, Mycobacterium
ARTRSCPKLSDSIEHAVAEGY

SEQ ID NO: 637873 - protein, 20 aa, Mycobacterium
ARTRTGASIVAIVRDDEVLA

SEQ ID NO: 637874 - protein, 21 aa, Mycobacterium
ARTRTGASIVAIVRGQEVVAS

SEQ ID NO: 637875 - protein, 20 aa, Mycobacterium
ARTRTGASIVAIVRNEEVLA

SEQ ID NO: 637876 - protein, 24 aa, Mycobacterium
ARTRVEFGAWLNRYFSPCADRFSD

SEQ ID NO: 637877 - protein, 18 aa, Mycobacterium
ARTRYDLSSLRRVVHAAA

SEQ ID NO: 637878 - protein, 18 aa, Mycobacterium
ARTSRIELGTGVVPIYTR

SEQ ID NO: 637879 - protein, 17 aa, Mycobacterium
ARTSSVRGWARMPVLAR

SEQ ID NO: 637880 - protein, 17 aa, Mycobacterium
ARTTAWRRASASPAAAT

SEQ ID NO: 637881 - protein, 19 aa, Mycobacterium
ARTTFPVWMMNAVADHVAH

SEQ ID NO: 637882 - protein, 18 aa, Mycobacterium
ARTTFTYLAVATMGSDAQ

SEQ ID NO: 637883 - protein, 18 aa, Mycobacterium
ARTTFTYLAVATRGTEAQ

SEQ ID NO: 637884 - protein, 18 aa, Mycobacterium
ARTTLLISSHVMDEAEHC

SEQ ID NO: 637885 - protein, 22 aa, Mycobacterium
ARTTLRLLFEMIKGEDRLAELQ

SEQ ID NO: 637886 - protein, 19 aa, Mycobacterium
ARTTQLCRLFAAMTRHHHL

SEQ ID NO: 637887 - protein, 18 aa, Mycobacterium
ARTVARRGLALTVHGDLA

SEQ ID NO: 637888 - protein, 26 aa, Mycobacterium
ARTVDLHWRRVEALRAAIGPLTPDGV

SEQ ID NO: 637889 - protein, 23 aa, Mycobacterium
ARTVEAMLALGARAEDISALMGP

SEQ ID NO: 637890 - protein, 20 aa, Mycobacterium
ARTVFKSMLTAVLDRMPDYV

SEQ ID NO: 637891 - protein, 17 aa, Mycobacterium
ARTVGGLSPNAAGTSRA

SEQ ID NO: 637892 - protein, 20 aa, Mycobacterium
ARTVGRVNPTAWVFNPTDGE

SEQ ID NO: 637893 - protein, 17 aa, Mycobacterium
ARTVIDFAARHIYSDVY

SEQ ID NO: 637894 - protein, 17 aa, Mycobacterium
ARTVIDFAARHVYAPQY

SEQ ID NO: 637895 - protein, 26 aa, Mycobacterium
ARTVLPPLLVPRAFVPVAALPVTPAG

SEQ ID NO: 637896 - protein, 17 aa, Mycobacterium
ARTWADRLIGAAAVGSV

SEQ ID NO: 637897 - protein, 20 aa, Mycobacterium
ARTWPKLRWQQTTDPQPHEA

SEQ ID NO: 637898 - protein, 17 aa, Mycobacterium
ARTWTDRLIAAAAEGSV

SEQ ID NO: 637899 - protein, 21 aa, Mycobacterium
ARTYRGRPLIQLSARNLSDDH

SEQ ID NO: 637900 - protein, 18 aa, Mycobacterium
ARVAAPYRVIQFAVNPFK

SEQ ID NO: 637901 - protein, 18 aa, Mycobacterium
ARVAARDLARLTADAKNS

SEQ ID NO: 637902 - protein, 17 aa, Mycobacterium
ARVAAVFADDAIFQGLR

SEQ ID NO: 637903 - protein, 25 aa, Mycobacterium
ARVAEAPGAVALTCGGLSVTYRELD

SEQ ID NO: 637904 - protein, 23 aa, Mycobacterium
ARVAEGKPLGGIENVGGPDKISF

SEQ ID NO: 637905 - protein, 20 aa, Mycobacterium
ARVAEIIARSGVPVQVGYQR

SEQ ID NO: 637906 - protein, 23 aa, Mycobacterium
ARVAELLDIVGLRRSDASRYPAE

SEQ ID NO: 637907 - protein, 20 aa, Mycobacterium
ARVAELLEFVGLGDKAKSYP

SEQ ID NO: 637908 - protein, 24 aa, Mycobacterium
ARVAELLEIVGLRRADATRYPAEF

SEQ ID NO: 637909 - protein, 20 aa, Mycobacterium
ARVAFLIRFGAGVLPEPKSV

SEQ ID NO: 637910 - protein, 21 aa, Mycobacterium
ARVAFLLRFGTGVLPEPKTVL

SEQ ID NO: 637911 - protein, 18 aa, Mycobacterium
ARVAGLGDRGRIAAGYKA

SEQ ID NO: 637912 - protein, 19 aa, Mycobacterium
ARVAGLGDRGRIAVGYKAD

SEQ ID NO: 637913 - protein, 20 aa, Mycobacterium
ARVAGLGDRGRIAVGYKADL

SEQ ID NO: 637914 - protein, 18 aa, Mycobacterium
ARVALELTEESALALADA

SEQ ID NO: 637915 - protein, 21 aa, Mycobacterium
ARVALEVVEQGRSYRAMADPI

SEQ ID NO: 637916 - protein, 17 aa, Mycobacterium
ARVAPFNVNYRYVADEL

SEQ ID NO: 637917 - protein, 19 aa, Mycobacterium
ARVAPVAAFLTHRDCPVSG

SEQ ID NO: 637918 - protein, 25 aa, Mycobacterium
ARVARHIEAEIVRRGWTVGASLGSE

SEQ ID NO: 637919 - protein, 19 aa, Mycobacterium
ARVATSWLRQPADLVINNA

SEQ ID NO: 637920 - protein, 21 aa, Mycobacterium
ARVAVGWWLVGSARAMLALAR

SEQ ID NO: 637921 - protein, 17 aa, Mycobacterium
ARVAWSGAGIDLRTGTP

SEQ ID NO: 637922 - protein, 22 aa, Mycobacterium
ARVCASSSLIPAVNKLGTMGLI

SEQ ID NO: 637923 - protein, 31 aa, Mycobacterium
ARVCGYEITPHWGMPAPGFGRISGVRLQVSG

SEQ ID NO: 637924 - protein, 19 aa, Mycobacterium
ARVDALCNELAQLLSTTQV

SEQ ID NO: 637925 - protein, 29 aa, Mycobacterium
ARVDCGLAGTVLRFVPPLAALSAAVVTFD

SEQ ID NO: 637926 - protein, 18 aa, Mycobacterium
ARVDEMIDVIKLVLGGGM

SEQ ID NO: 637927 - protein, 18 aa, Mycobacterium
ARVDEVFLIPASDDTAQI

SEQ ID NO: 637928 - protein, 23 aa, Mycobacterium
ARVDPSMVLYLFGSKAALFRESL

SEQ ID NO: 637929 - protein, 24 aa, Mycobacterium
ARVDQLPEIWKRLVDGGMESGHAY

SEQ ID NO: 637930 - protein, 32 aa, Mycobacterium
ARVEGMPLDALRAGLDWGWASFGDWLDRLEGR

SEQ ID NO: 637931 - protein, 21 aa, Mycobacterium
ARVEHIAPLAAWDVEGSRRSM

SEQ ID NO: 637932 - protein, 19 aa, Mycobacterium
ARVFAEFTLPDIFDRQSEA

SEQ ID NO: 637933 - protein, 19 aa, Mycobacterium
ARVFAEFTLPEIFDRHSEA

SEQ ID NO: 637934 - protein, 18 aa, Mycobacterium
ARVFFCNSGTEANEAAFK

SEQ ID NO: 637935 - protein, 24 aa, Mycobacterium
ARVFPDLFATHRVRAVDDYSSHLL

SEQ ID NO: 637936 - protein, 24 aa, Mycobacterium
ARVFPNLFATHRVRSVDDYASHLL

SEQ ID NO: 637937 - protein, 23 aa, Mycobacterium
ARVFWPRTRIVVTRDDVSLFGAE

SEQ ID NO: 637938 - protein, 20 aa, Mycobacterium
ARVGAAVADRASWRRWWPDL

SEQ ID NO: 637939 - protein, 26 aa, Mycobacterium
ARVGAAVADRSCWRRWWPDLRLQVVE

SEQ ID NO: 637940 - protein, 20 aa, Mycobacterium
ARVGFSLAVGEHLEYGPALI

SEQ ID NO: 637941 - protein, 21 aa, Mycobacterium
ARVGFSVAVGEHLAAGPTAVR

SEQ ID NO: 637942 - protein, 21 aa, Mycobacterium
ARVGFSVAVGEHLSCGPELIR

SEQ ID NO: 637943 - protein, 20 aa, Mycobacterium
ARVGKAAIYRRWPSKAEVVA

SEQ ID NO: 637944 - protein, 19 aa, Mycobacterium
ARVGNVLYRDFRPVAVLDW

SEQ ID NO: 637945 - protein, 18 aa, Mycobacterium
ARVGRLLFSTQLADPVVV

SEQ ID NO: 637946 - protein, 20 aa, Mycobacterium
ARVGRRAAGWIGFDQLPDDV

SEQ ID NO: 637947 - protein, 18 aa, Mycobacterium
ARVGWPVQDTEIISLVNA

SEQ ID NO: 637948 - protein, 18 aa, Mycobacterium
ARVHAHWVDEPVGAITDI

SEQ ID NO: 637949 - protein, 21 aa, Mycobacterium
ARVHELCAPHLVPGPMPNSLP

SEQ ID NO: 637950 - protein, 25 aa, Mycobacterium
ARVICRRSKLMCRISGAGAMASVEL

SEQ ID NO: 637951 - protein, 24 aa, Mycobacterium
ARVICRRSRLMSRIAGAGATASVE

SEQ ID NO: 637952 - protein, 20 aa, Mycobacterium
ARVIDSWTPIPGRFPSYLVE

SEQ ID NO: 637953 - protein, 21 aa, Mycobacterium
ARVISRLRAGKLMGLSGILDD

SEQ ID NO: 637954 - protein, 23 aa, Mycobacterium
ARVKEMAEELAVLRANQRRELAV

SEQ ID NO: 637955 - protein, 29 aa, Mycobacterium
ARVKRGMAEMLKGGVIMDVVTAEQARIAE

SEQ ID NO: 637956 - protein, 28 aa, Mycobacterium
ARVKRGMAEMLKGGVIMDVVTPEQAKIA

SEQ ID NO: 637957 - protein, 28 aa, Mycobacterium
ARVKSISLRLGVPWYAYDTTVFTGEVAA

SEQ ID NO: 637958 - protein, 20 aa, Mycobacterium
ARVLDGRVAVVGLDDPVAAG

SEQ ID NO: 637959 - protein, 20 aa, Mycobacterium
ARVLERWSTVPARPAVTVVQ

SEQ ID NO: 637960 - protein, 28 aa, Mycobacterium
ARVLGAIAKCLSRIGISIPETVTVFVRP

SEQ ID NO: 637961 - protein, 17 aa, Mycobacterium
ARVLIDAGVPVFAAVDD

SEQ ID NO: 637962 - protein, 18 aa, Mycobacterium
ARVLIGSTADWVLHSSPV

SEQ ID NO: 637963 - protein, 27 aa, Mycobacterium
ARVLLRECVEFFAPYLSAARLTGEVRK

SEQ ID NO: 637964 - protein, 18 aa, Mycobacterium
ARVLNFYAPGGFDDHLPF

SEQ ID NO: 637965 - protein, 25 aa, Mycobacterium
ARVLPLPVAMRLILMGKHEKLNAQR

SEQ ID NO: 637966 - protein, 24 aa, Mycobacterium
ARVLPRPRALATLDAALHSGLCTA

SEQ ID NO: 637967 - protein, 26 aa, Mycobacterium
ARVLPRSVALRMALVGKHERMDARRA

SEQ ID NO: 637968 - protein, 23 aa, Mycobacterium
ARVLQPQGLFVFDDLVTPQRPVS

SEQ ID NO: 637969 - protein, 25 aa, Mycobacterium
ARVLREISIELSVMGSEGRQGKLDA

SEQ ID NO: 637970 - protein, 28 aa, Mycobacterium
ARVLRPGGRLGLVWNTRDERLGWVRELG

SEQ ID NO: 637971 - protein, 30 aa, Mycobacterium
ARVLRPGGRLGLVWNVRDERLGWVSDLGHI

SEQ ID NO: 637972 - protein, 25 aa, Mycobacterium
ARVLRPGGSLGLVWNNRDERLGWVK

SEQ ID NO: 637973 - protein, 18 aa, Mycobacterium
ARVLRPGGSLLISTPNRI

SEQ ID NO: 637974 - protein, 22 aa, Mycobacterium
ARVLRPGGYFLYTDARPRYDIP

SEQ ID NO: 637975 - protein, 18 aa, Mycobacterium
ARVLRPHGRYAIHELALT

SEQ ID NO: 637976 - protein, 18 aa, Mycobacterium
ARVLRPSGLLLVSTPNRI

SEQ ID NO: 637977 - protein, 17 aa, Mycobacterium
ARVLRRMSSTAVMEHMG

SEQ ID NO: 637978 - protein, 24 aa, Mycobacterium
ARVLSRYVEAIVWRTFGQDRLEAM

SEQ ID NO: 637979 - protein, 17 aa, Mycobacterium
ARVLVATDIAARGVHVD

SEQ ID NO: 637980 - protein, 18 aa, Mycobacterium
ARVLYDFVNNEALPGTDL

SEQ ID NO: 637981 - protein, 18 aa, Mycobacterium
ARVNFAYGQTLRRAGKRR

SEQ ID NO: 637982 - protein, 25 aa, Mycobacterium
ARVPDRPPPRVPPCPGPTGERADWW

SEQ ID NO: 637983 - protein, 19 aa, Mycobacterium
ARVPFDILVVATGADARPA

SEQ ID NO: 637984 - protein, 17 aa, Mycobacterium
ARVPGPHLDDLRDELAG

SEQ ID NO: 637985 - protein, 24 aa, Mycobacterium
ARVPGRRGGTHFPFLENPQTFNDV

SEQ ID NO: 637986 - protein, 23 aa, Mycobacterium
ARVPIVPLIVWGAHRVWTKDHPR

SEQ ID NO: 637987 - protein, 19 aa, Mycobacterium
ARVPKARMAAWAPDGALLV

SEQ ID NO: 637988 - protein, 18 aa, Mycobacterium
ARVPMVVIVGDHATYHKK

SEQ ID NO: 637989 - protein, 19 aa, Mycobacterium
ARVPVLQILEARLRELQSG

SEQ ID NO: 637990 - protein, 17 aa, Mycobacterium
ARVQHGAGIRIHRRPGE

SEQ ID NO: 637991 - protein, 35 aa, Mycobacterium
ARVQKLPAARFVDWWLEASLLDFQSQLAVLFDAVH

SEQ ID NO: 637992 - protein, 21 aa, Mycobacterium
ARVQRPLWASTGVKNPDYDDT

SEQ ID NO: 637993 - protein, 20 aa, Mycobacterium
ARVQRPLWASTGVKNPDYSD

SEQ ID NO: 637994 - protein, 17 aa, Mycobacterium
ARVREIMHQLPPNAQAA

SEQ ID NO: 637995 - protein, 18 aa, Mycobacterium
ARVRELLDDVGLSSEQLD

SEQ ID NO: 637996 - protein, 23 aa, Mycobacterium
ARVRELYMAMGLDLYTNLVEIRE

SEQ ID NO: 637997 - protein, 24 aa, Mycobacterium
ARVRGISGQAEFKGTGSHPPPEPD

SEQ ID NO: 637998 - protein, 19 aa, Mycobacterium
ARVRPGCALQGNLDPVVLL

SEQ ID NO: 637999 - protein, 18 aa, Mycobacterium
ARVRQARVLRRMSSTAVM

SEQ ID NO: 638000 - protein, 21 aa, Mycobacterium
ARVRTGGLLLRTRVPGNRLAD

SEQ ID NO: 638001 - protein, 17 aa, Mycobacterium
ARVSAVVVDARYREALH

SEQ ID NO: 638002 - protein, 26 aa, Mycobacterium
ARVSESPWALMHFMVRLPEDVATGSI

SEQ ID NO: 638003 - protein, 24 aa, Mycobacterium
ARVSESPWALMHFMVRLPEKDDGV

SEQ ID NO: 638004 - protein, 25 aa, Mycobacterium
ARVSESPWALMHFMVRLPQKEDAAA

SEQ ID NO: 638005 - protein, 25 aa, Mycobacterium
ARVSESPWALMHFMVRLPSDDPGAT

SEQ ID NO: 638006 - protein, 24 aa, Mycobacterium
ARVSESPWALVHFTVRLPENSPHN

SEQ ID NO: 638007 - protein, 26 aa, Mycobacterium
ARVSGPAPWRPLLGMSGPTRLPLEFG

SEQ ID NO: 638008 - protein, 23 aa, Mycobacterium
ARVSRARCGTVAVGSVVDSILDL

SEQ ID NO: 638009 - protein, 19 aa, Mycobacterium
ARVSRKSVYNHSNLLDQIH

SEQ ID NO: 638010 - protein, 23 aa, Mycobacterium
ARVSRLLVRNGRVEGAVLDNGDE

SEQ ID NO: 638011 - protein, 19 aa, Mycobacterium
ARVSTPLHWDEVPDCHPDV

SEQ ID NO: 638012 - protein, 20 aa, Mycobacterium
ARVSTPLRWDEVAGCRPESF

SEQ ID NO: 638013 - protein, 19 aa, Mycobacterium
ARVSTPLRWDEVPTCRPEE

SEQ ID NO: 638014 - protein, 19 aa, Mycobacterium
ARVSTPLRWDEVTERRPEE

SEQ ID NO: 638015 - protein, 20 aa, Mycobacterium
ARVSVRAVVHRHYLQVLRPL

SEQ ID NO: 638016 - protein, 18 aa, Mycobacterium
ARVTAGAIIGVFMAASDD

SEQ ID NO: 638017 - protein, 20 aa, Mycobacterium
ARVTDAWVVRVSRSSHTDSG

SEQ ID NO: 638018 - protein, 19 aa, Mycobacterium
ARVTGIMGMDPFRCDLLAS

SEQ ID NO: 638019 - protein, 20 aa, Mycobacterium
ARVTHHLSRPADFVTDSLVS

SEQ ID NO: 638020 - protein, 17 aa, Mycobacterium
ARVTLRGDRMWEFLDRL

SEQ ID NO: 638021 - protein, 18 aa, Mycobacterium
ARVTLRGDRMWEFLDRLV

SEQ ID NO: 638022 - protein, 27 aa, Mycobacterium
ARVTLVIRGSCLLRHCDDTICERFTRI

SEQ ID NO: 638023 - protein, 25 aa, Mycobacterium
ARVTRRLVAMLARRGYSQTVACEVV

SEQ ID NO: 638024 - protein, 24 aa, Mycobacterium
ARVTRRLVGMLARRGYSQNLACEV

SEQ ID NO: 638025 - protein, 24 aa, Mycobacterium
ARVVAKIYCGLGLLKKETVREVHR

SEQ ID NO: 638026 - protein, 27 aa, Mycobacterium
ARVVAKIYCGLGLLKRENIREVHRADL

SEQ ID NO: 638027 - protein, 27 aa, Mycobacterium
ARVVAKIYCGLGLLKRENVREVHRADL

SEQ ID NO: 638028 - protein, 25 aa, Mycobacterium
ARVVALRSRLLVKLAGSGGMVSVSC

SEQ ID NO: 638029 - protein, 19 aa, Mycobacterium
ARVVDRCLQLFGGYGYMME

SEQ ID NO: 638030 - protein, 26 aa, Mycobacterium
ARVVKALGGRGVFGVELMVNGDEVYF

SEQ ID NO: 638031 - protein, 24 aa, Mycobacterium
ARVVKAQVPLSEMFGYVGDLRSKT

SEQ ID NO: 638032 - protein, 29 aa, Mycobacterium
ARVVNPRWINAMRRHGYKGAFEMAATVDY

SEQ ID NO: 638033 - protein, 23 aa, Mycobacterium
ARVVPNVQRWYEHGDLPVRKLAL

SEQ ID NO: 638034 - protein, 24 aa, Mycobacterium
ARVVRADEALPFAAIAVDASLVRA

SEQ ID NO: 638035 - protein, 22 aa, Mycobacterium
ARVVSMPCVEWFESQPEEYRDS

SEQ ID NO: 638036 - protein, 19 aa, Mycobacterium
ARVWPGVSIPDGGIRYSSD

SEQ ID NO: 638037 - protein, 18 aa, Mycobacterium
ARWAGPSTRRIGYLTISS

SEQ ID NO: 638038 - protein, 20 aa, Mycobacterium
ARWFSLCKVDGVTVTTADGR

SEQ ID NO: 638039 - protein, 17 aa, Mycobacterium
ARWLARLREGKPEMAAG

SEQ ID NO: 638040 - protein, 24 aa, Mycobacterium
ARWLRGRSMACDWLVAAASAPETS

SEQ ID NO: 638041 - protein, 30 aa, Mycobacterium
ARWPGADLLAAPILRPGSWIGGDRDGNPNV

SEQ ID NO: 638042 - protein, 21 aa, Mycobacterium
ARWPQGRLSKAYAAYDRPFWR

SEQ ID NO: 638043 - protein, 20 aa, Mycobacterium
ARWRAHLDGLDGPTLLAPAL

SEQ ID NO: 638044 - protein, 17 aa, Mycobacterium
ARWRPWRSYATQYLWTT

SEQ ID NO: 638045 - protein, 19 aa, Mycobacterium
ARWRRGREIAPELDGYWVG

SEQ ID NO: 638046 - protein, 24 aa, Mycobacterium
ARWSRGNTLAGLTCHSDAGSQFTS

SEQ ID NO: 638047 - protein, 18 aa, Mycobacterium
ARWSRGNTLPGLTCHSDA

SEQ ID NO: 638048 - protein, 17 aa, Mycobacterium
ARWTRLYPDVRAEPVIV

SEQ ID NO: 638049 - protein, 20 aa, Mycobacterium
ARWTSAMLASGPRLDFSDLR

SEQ ID NO: 638050 - protein, 17 aa, Mycobacterium
ARWVDVAAGVVRAPAVV

SEQ ID NO: 638051 - protein, 20 aa, Mycobacterium
ARWWKEERHGVFVDFNQNAK

SEQ ID NO: 638052 - protein, 17 aa, Mycobacterium
ARYALIERVRHLGEQTR

SEQ ID NO: 638053 - protein, 19 aa, Mycobacterium
ARYDYLVNMCDELGVVTPE

SEQ ID NO: 638054 - protein, 24 aa, Mycobacterium
ARYFEAISGVWARRSSEVAQTVVI

SEQ ID NO: 638055 - protein, 18 aa, Mycobacterium
ARYFPSLLPEVSDEDPVA

SEQ ID NO: 638056 - protein, 18 aa, Mycobacterium
ARYGALEVHDRDKRVLQF

SEQ ID NO: 638057 - protein, 20 aa, Mycobacterium
ARYGERLRDLLGATMRATSH

SEQ ID NO: 638058 - protein, 20 aa, Mycobacterium
ARYGKCLGSAVNPVLRQGNS

SEQ ID NO: 638059 - protein, 21 aa, Mycobacterium
ARYHARAVALVALERQASEPG

SEQ ID NO: 638060 - protein, 22 aa, Mycobacterium
ARYILELEPFKSLPVEQIAETI

SEQ ID NO: 638061 - protein, 20 aa, Mycobacterium
ARYIPLLAGVGRPVRKPRPI

SEQ ID NO: 638062 - protein, 21 aa, Mycobacterium
ARYKLPKRLIFTATLPRNPAG

SEQ ID NO: 638063 - protein, 20 aa, Mycobacterium
ARYLASRGGIAAVISSPLSR

SEQ ID NO: 638064 - protein, 18 aa, Mycobacterium
ARYLFVFLDHHGMLSVFG

SEQ ID NO: 638065 - protein, 25 aa, Mycobacterium
ARYLPDRHRITCRTLQLDIVGEPLV

SEQ ID NO: 638066 - protein, 19 aa, Mycobacterium
ARYNAGLSVSRFVKPLTYQ

SEQ ID NO: 638067 - protein, 17 aa, Mycobacterium
ARYNALVTNPLFASMEF

SEQ ID NO: 638068 - protein, 18 aa, Mycobacterium
ARYPDALFPVWRYHPFFT

SEQ ID NO: 638069 - protein, 27 aa, Mycobacterium
ARYPDARSALLPLLHLVQAQDGYLTPA

SEQ ID NO: 638070 - protein, 25 aa, Mycobacterium
ARYPQELYDLWTLWHIASTNPWLSV

SEQ ID NO: 638071 - protein, 19 aa, Mycobacterium
ARYRELLIESGLIDRNGEL

SEQ ID NO: 638072 - protein, 21 aa, Mycobacterium
ARYRIGVSVVVPGAVRTPLVD

SEQ ID NO: 638073 - protein, 21 aa, Mycobacterium
ARYRLGPPGGGFGMMMETVLP

SEQ ID NO: 638074 - protein, 17 aa, Mycobacterium
ARYRPSREGALLCGDFY

SEQ ID NO: 638075 - protein, 30 aa, Mycobacterium
ARYRREWDDLPFVICVFGNGDLNQVTWELR

SEQ ID NO: 638076 - protein, 23 aa, Mycobacterium
ARYRRMADEFGMLAHEQGICGCH

SEQ ID NO: 638077 - protein, 24 aa, Mycobacterium
ARYRRPNSAIARFAGPTAGSLPLQ

SEQ ID NO: 638078 - protein, 27 aa, Mycobacterium
ARYTWPRFVCGLPREFFAAVRAELADR

SEQ ID NO: 638079 - protein, 20 aa, Mycobacterium
ARYVPERVVEHLPQRIITAA

SEQ ID NO: 638080 - protein, 19 aa, Mycobacterium
ARYVPFEGSYGFGRDRVTT

SEQ ID NO: 638081 - protein, 22 aa, Mycobacterium
ARYWPDGTLEFVGRADHRVKLS

SEQ ID NO: 638082 - protein, 18 aa, Mycobacterium
ARYYARQAVKLLAPKRVQ

SEQ ID NO: 638083 - protein, 19 aa, Mycobacterium
ASAAARWIEIIGRGHGLSW

SEQ ID NO: 638084 - protein, 25 aa, Mycobacterium
ASAAKRAVVIGAGFIGCEVAASLRG

SEQ ID NO: 638085 - protein, 19 aa, Mycobacterium
ASAALFLACDDSSFVNGQL

SEQ ID NO: 638086 - protein, 26 aa, Mycobacterium
ASAALIWQRPRWSRRLQPEPISDLLA

SEQ ID NO: 638087 - protein, 22 aa, Mycobacterium
ASAALLRQLWAAGLLLSDGRPN

SEQ ID NO: 638088 - protein, 28 aa, Mycobacterium
ASAARARARLAVGSALFGLLRADDPVPA

SEQ ID NO: 638089 - protein, 23 aa, Mycobacterium
ASAARLAANFPQVGEELRGRYRV

SEQ ID NO: 638090 - protein, 18 aa, Mycobacterium
ASAARPPARMPVARPTSW

SEQ ID NO: 638091 - protein, 17 aa, Mycobacterium
ASAARRAGHLAGTLGDQ

SEQ ID NO: 638092 - protein, 27 aa, Mycobacterium
ASAARSRPALRPRILVTADMDDDGLAA

SEQ ID NO: 638093 - protein, 27 aa, Mycobacterium
ASAAYLRATFDWHIDGCTPIGDECPQR

SEQ ID NO: 638094 - protein, 24 aa, Mycobacterium
ASADALRYPARYLFVFLDHHGMLS

SEQ ID NO: 638095 - protein, 19 aa, Mycobacterium
ASADAVVWSAGSAVAEHPA

SEQ ID NO: 638096 - protein, 25 aa, Mycobacterium
ASADEAWEAPGPPALPEAQRAVREA

SEQ ID NO: 638097 - protein, 21 aa, Mycobacterium
ASADGGALVRIIAGEIDGHRG

SEQ ID NO: 638098 - protein, 20 aa, Mycobacterium
ASADLPVAVRWKPVVTTSEA

SEQ ID NO: 638099 - protein, 26 aa, Mycobacterium
ASADVASDVVVSWLPLFHDMGMMGLL

SEQ ID NO: 638100 - protein, 24 aa, Mycobacterium
ASADWRLRRGRIVLLDGDSPAGLR

SEQ ID NO: 638101 - protein, 25 aa, Mycobacterium
ASADWRLRRGRIVLLPGDSPAGLRL

SEQ ID NO: 638102 - protein, 17 aa, Mycobacterium
ASAEGKNALARALLSTG

SEQ ID NO: 638103 - protein, 25 aa, Mycobacterium
ASAETGRLLLGRRVAGLVAALQSLD

SEQ ID NO: 638104 - protein, 23 aa, Mycobacterium
ASAETIARFGLPQAAWTMFAGIV

SEQ ID NO: 638105 - protein, 21 aa, Mycobacterium
ASAEVSGLMDIFSTLFDRGIQ

SEQ ID NO: 638106 - protein, 17 aa, Mycobacterium
ASAFRSSFGEDFGVTIA

SEQ ID NO: 638107 - protein, 17 aa, Mycobacterium
ASAGFPGFSGRVPFENG

SEQ ID NO: 638108 - protein, 22 aa, Mycobacterium
ASAGGLLLPVGVRRLRTYCSTR

SEQ ID NO: 638109 - protein, 29 aa, Mycobacterium
ASAGGRVGWRISIPAMLCYWSELTRPAVI

SEQ ID NO: 638110 - protein, 22 aa, Mycobacterium
ASAGHIYAVIGLKDTTTGDTLC

SEQ ID NO: 638111 - protein, 22 aa, Mycobacterium
ASAGHIYAVIGLKDTTTGDTLS

SEQ ID NO: 638112 - protein, 27 aa, Mycobacterium
ASAGMGRAGLVGGLSVPQGWAMSAPAV

SEQ ID NO: 638113 - protein, 26 aa, Mycobacterium
ASAGRLSADLAGGIARITEGSQAVAA

SEQ ID NO: 638114 - protein, 35 aa, Mycobacterium
ASAGVPGQCQQVWCPVCALAALISGEQHPLLTVVA

SEQ ID NO: 638115 - protein, 21 aa, Mycobacterium
ASAHSERGPWLGIGASVAVLE

SEQ ID NO: 638116 - protein, 19 aa, Mycobacterium
ASAIDRAALPYVVGTIAGD

SEQ ID NO: 638117 - protein, 24 aa, Mycobacterium
ASAIDRAALPYVVGTIAGDDTVFV

SEQ ID NO: 638118 - protein, 24 aa, Mycobacterium
ASAIGYAGAGTVEFLADDDGEFYF

SEQ ID NO: 638119 - protein, 20 aa, Mycobacterium
ASAIHEMFVNTLGISSGSYA

SEQ ID NO: 638120 - protein, 31 aa, Mycobacterium
ASAIRASANLDRHWRNLRTLFSHNPTVYKAR

SEQ ID NO: 638121 - protein, 21 aa, Mycobacterium
ASAIRWCLRDAGVAPEEVDAV

SEQ ID NO: 638122 - protein, 27 aa, Mycobacterium
ASAKATETWRFPAFFHALLDAGIYPPP

SEQ ID NO: 638123 - protein, 17 aa, Mycobacterium
ASAKLGKSVAIIERGRM

SEQ ID NO: 638124 - protein, 24 aa, Mycobacterium
ASAKNARLWRGLLRCTATADAGRV

SEQ ID NO: 638125 - protein, 18 aa, Mycobacterium
ASALAARLFGRRAPIPSA

SEQ ID NO: 638126 - protein, 28 aa, Mycobacterium
ASALAARLKNVWAPGGLVQRSQGKWYPG

SEQ ID NO: 638127 - protein, 21 aa, Mycobacterium
ASALFVRRGPQPDGHIWSPPV

SEQ ID NO: 638128 - protein, 17 aa, Mycobacterium
ASALLAQALDPFSTITG

SEQ ID NO: 638129 - protein, 17 aa, Mycobacterium
ASALLRCVVRDPDPANV

SEQ ID NO: 638130 - protein, 17 aa, Mycobacterium
ASALLRCVVRDPDPDVV

SEQ ID NO: 638131 - protein, 17 aa, Mycobacterium
ASALLYKAVDAIENKDP

SEQ ID NO: 638132 - protein, 22 aa, Mycobacterium
ASALRAGTVVVCVDDDAGRAMA

SEQ ID NO: 638133 - protein, 27 aa, Mycobacterium
ASALTARLKKVWAPQGLVQRSQGKWYP

SEQ ID NO: 638134 - protein, 18 aa, Mycobacterium
ASAPAIQFERRWVTWGQI

SEQ ID NO: 638135 - protein, 22 aa, Mycobacterium
ASAPDWLPRASVTHRSGTTTYP

SEQ ID NO: 638136 - protein, 33 aa, Mycobacterium
ASAPIGSPVPRAALFVLDRWLRPAPEGVVGELY

SEQ ID NO: 638137 - protein, 17 aa, Mycobacterium
ASAPYVAWLRASAIRAE

SEQ ID NO: 638138 - protein, 27 aa, Mycobacterium
ASAQAAAFGSRFVQALTSGAGAYTSAE

SEQ ID NO: 638139 - protein, 17 aa, Mycobacterium
ASAQHPVVLPVAEDIPA

SEQ ID NO: 638140 - protein, 24 aa, Mycobacterium
ASAQRGLSEAVVRDISAKKNEPDW

SEQ ID NO: 638141 - protein, 24 aa, Mycobacterium
ASAQRGLSEAVVRDISAKKSEPEW

SEQ ID NO: 638142 - protein, 23 aa, Mycobacterium
ASAQRGLSEAVVRDISEKKSEPE

SEQ ID NO: 638143 - protein, 24 aa, Mycobacterium
ASAQRGLSEAVVRDISGKKNEPEW

SEQ ID NO: 638144 - protein, 18 aa, Mycobacterium
ASAQWGRRGARINSISPG

SEQ ID NO: 638145 - protein, 21 aa, Mycobacterium
ASARCLAAYVYAAAGEGESTT

SEQ ID NO: 638146 - protein, 22 aa, Mycobacterium
ASAREFHIDWDLAAAEKGGYEY

SEQ ID NO: 638147 - protein, 25 aa, Mycobacterium
ASARELAVFWTARTIGCSWCVDFGA

SEQ ID NO: 638148 - protein, 23 aa, Mycobacterium
ASARELFARNGIRNTSIRAVAAS

SEQ ID NO: 638149 - protein, 17 aa, Mycobacterium
ASARFGLYYTPGSELYH

SEQ ID NO: 638150 - protein, 17 aa, Mycobacterium
ASARLFLHYGDLTDGTR

SEQ ID NO: 638151 - protein, 27 aa, Mycobacterium
ASARLPADLLQKWAIRVVPLHILLDGA

SEQ ID NO: 638152 - protein, 25 aa, Mycobacterium
ASARPEILRTALIRGAFDYQGQKCS

SEQ ID NO: 638153 - protein, 17 aa, Mycobacterium
ASARPRAEFHRTVRRMQ

SEQ ID NO: 638154 - protein, 19 aa, Mycobacterium
ASARSGSVLIKRFVSEKHH

SEQ ID NO: 638155 - protein, 18 aa, Mycobacterium
ASARVAGALPDWPTGTPP

SEQ ID NO: 638156 - protein, 30 aa, Mycobacterium
ASASEIDWPARWSAWKARRYGDTRLEMASV

SEQ ID NO: 638157 - protein, 17 aa, Mycobacterium
ASATFPWYQLGRQVHVR

SEQ ID NO: 638158 - protein, 23 aa, Mycobacterium
ASATIDAARDWLLGTPADDWVSM

SEQ ID NO: 638159 - protein, 19 aa, Mycobacterium
ASATLDWLDAHGHEDLVRN

SEQ ID NO: 638160 - protein, 19 aa, Mycobacterium
ASATLDWLDAHGHQEMVRN

SEQ ID NO: 638161 - protein, 20 aa, Mycobacterium
ASATLDWLDAHGYEELVRGS

SEQ ID NO: 638162 - protein, 19 aa, Mycobacterium
ASATLDWLEAHGYEELVRN

SEQ ID NO: 638163 - protein, 23 aa, Mycobacterium
ASATVDAARDWLLGSPDGDWVSM

SEQ ID NO: 638164 - protein, 27 aa, Mycobacterium
ASATVDAARSWLLGSPEGDWVSMAVYS

SEQ ID NO: 638165 - protein, 18 aa, Mycobacterium
ASATWYLQDRVIAPDFNF

SEQ ID NO: 638166 - protein, 21 aa, Mycobacterium
ASAVGIGRPYAWGAALGGSKG

SEQ ID NO: 638167 - protein, 21 aa, Mycobacterium
ASAVGMVWRAAAAIELGICDV

SEQ ID NO: 638168 - protein, 24 aa, Mycobacterium
ASAVGRLSVPQSWAATNPTIATVA

SEQ ID NO: 638169 - protein, 17 aa, Mycobacterium
ASAVHYGLACLELEAAD

SEQ ID NO: 638170 - protein, 22 aa, Mycobacterium
ASAVKPMLSSAVGGQVSGSLGK

SEQ ID NO: 638171 - protein, 23 aa, Mycobacterium
ASAVKRAGFEVVEAAAMNARAHR

SEQ ID NO: 638172 - protein, 23 aa, Mycobacterium
ASAVNAKSAFLFLKEAGKHVNDN

SEQ ID NO: 638173 - protein, 18 aa, Mycobacterium
ASAVPWLAAMPNWEYEFE

SEQ ID NO: 638174 - protein, 30 aa, Mycobacterium
ASAVRKFLFDRFASVELVMFDEQVFPEAEA

SEQ ID NO: 638175 - protein, 19 aa, Mycobacterium
ASAVSRLAGAYGDDAANEI

SEQ ID NO: 638176 - protein, 23 aa, Mycobacterium
ASAVSRLARRGGYLDVRPEAERR

SEQ ID NO: 638177 - protein, 21 aa, Mycobacterium
ASAVSRLEVGLARPFAESTYD

SEQ ID NO: 638178 - protein, 18 aa, Mycobacterium
ASAWAGIGTPDFVDVPMD

SEQ ID NO: 638179 - protein, 18 aa, Mycobacterium
ASAWAGVGTPDFVDVPID

SEQ ID NO: 638180 - protein, 17 aa, Mycobacterium
ASAWAHANNTPFQWGKQ

SEQ ID NO: 638181 - protein, 26 aa, Mycobacterium
ASAWDSLWVYDHFHTVPLPSDEATHE

SEQ ID NO: 638182 - protein, 23 aa, Mycobacterium
ASAYRCGEAWSALVHHRASGRRL

SEQ ID NO: 638183 - protein, 24 aa, Mycobacterium
ASCAVPGAWPPVAIAGRRYMDGGV

SEQ ID NO: 638184 - protein, 23 aa, Mycobacterium
ASCDAEHAASFVHRVLGPLAADD

SEQ ID NO: 638185 - protein, 19 aa, Mycobacterium
ASCDLSWTPPAGGQVAIYR

SEQ ID NO: 638186 - protein, 22 aa, Mycobacterium
ASCGDLSLAYQVFGDGPVELVW

SEQ ID NO: 638187 - protein, 17 aa, Mycobacterium
ASCPIVASFGRRDPLGI

SEQ ID NO: 638188 - protein, 20 aa, Mycobacterium
ASCRAAGIDPVRQPIPVVPG

SEQ ID NO: 638189 - protein, 23 aa, Mycobacterium
ASDAAGFKWLAPYTGSAIGQHWM

SEQ ID NO: 638190 - protein, 23 aa, Mycobacterium
ASDAAGWREIWVAAESDIAGSGP

SEQ ID NO: 638191 - protein, 18 aa, Mycobacterium
ASDALRHGAMYGANPAGG

SEQ ID NO: 638192 - protein, 17 aa, Mycobacterium
ASDAWRALVKAADVPYR

SEQ ID NO: 638193 - protein, 18 aa, Mycobacterium
ASDEAFGRAAEPWEVAAT

SEQ ID NO: 638194 - protein, 26 aa, Mycobacterium
ASDEGRPRTGVVFQDALLMPWLTVAE

SEQ ID NO: 638195 - protein, 25 aa, Mycobacterium
ASDEWKIAVLRAYWDLPAMMLQFLR

SEQ ID NO: 638196 - protein, 18 aa, Mycobacterium
ASDGIRLRSEMEPHEAAL

SEQ ID NO: 638197 - protein, 17 aa, Mycobacterium
ASDGLGVGEVGYLITGV

SEQ ID NO: 638198 - protein, 25 aa, Mycobacterium
ASDIFCLPNGPVLLDCLEFDDRLRH

SEQ ID NO: 638199 - protein, 18 aa, Mycobacterium
ASDITLKAVEMAGTTGYS

SEQ ID NO: 638200 - protein, 26 aa, Mycobacterium
ASDKLGIPVIDHWWQTETGWAIAANP

SEQ ID NO: 638201 - protein, 25 aa, Mycobacterium
ASDLAARLKARWAPEGLVQRSQGRW

SEQ ID NO: 638202 - protein, 22 aa, Mycobacterium
ASDLALAVIRFARQLRSQRSDS

SEQ ID NO: 638203 - protein, 18 aa, Mycobacterium
ASDLKAWLDAHVVETKPA

SEQ ID NO: 638204 - protein, 20 aa, Mycobacterium
ASDLLLSFVPGVPEHGEHLR

SEQ ID NO: 638205 - protein, 20 aa, Mycobacterium
ASDLPGFVLHVEICEDMFVP

SEQ ID NO: 638206 - protein, 18 aa, Mycobacterium
ASDLSLVVIRLARHLRFR

SEQ ID NO: 638207 - protein, 18 aa, Mycobacterium
ASDLSRFDEWMTIFAGWR

SEQ ID NO: 638208 - protein, 18 aa, Mycobacterium
ASDLVGILLYLASDESKF

SEQ ID NO: 638209 - protein, 20 aa, Mycobacterium
ASDNDPVWFWMYVIAALQKI

SEQ ID NO: 638210 - protein, 18 aa, Mycobacterium
ASDPGGRRLAVTWRADPH

SEQ ID NO: 638211 - protein, 21 aa, Mycobacterium
ASDPPMTGTFEWVADNVAHWV

SEQ ID NO: 638212 - protein, 22 aa, Mycobacterium
ASDPRPAVLSDHDWLINERGVA

SEQ ID NO: 638213 - protein, 24 aa, Mycobacterium
ASDPWTGCRGWEARFGTQEISQFR

SEQ ID NO: 638214 - protein, 23 aa, Mycobacterium
ASDQAFFLLAFTKIGLMPDGGAS

SEQ ID NO: 638215 - protein, 23 aa, Mycobacterium
ASDQRLRVIGVTWNDDAAAQAAL

SEQ ID NO: 638216 - protein, 22 aa, Mycobacterium
ASDRGAGPLGFAGTASAGAADA

SEQ ID NO: 638217 - protein, 21 aa, Mycobacterium
ASDRPLPWATMHKLTAPTLLT

SEQ ID NO: 638218 - protein, 24 aa, Mycobacterium
ASDSRRCAPASYFAVAGSSCAAPG

SEQ ID NO: 638219 - protein, 18 aa, Mycobacterium
ASDTVLVFMHPIGGGAYL

SEQ ID NO: 638220 - protein, 26 aa, Mycobacterium
ASEAEFRLTYPFSPVLVSTLRNLSSV

SEQ ID NO: 638221 - protein, 29 aa, Mycobacterium
ASEALALGMGRLRGNAIVAAFDAERATSV

SEQ ID NO: 638222 - protein, 33 aa, Mycobacterium
ASEALKSVGAFRLALPRVMLRFAGGREITLGDL

SEQ ID NO: 638223 - protein, 24 aa, Mycobacterium
ASEALRLGLDIMLIGVWNAFQVAI

SEQ ID NO: 638224 - protein, 18 aa, Mycobacterium
ASEALSIGLLSRVVADDE

SEQ ID NO: 638225 - protein, 20 aa, Mycobacterium
ASEAPAPYKKRRHLDGGMRH

SEQ ID NO: 638226 - protein, 21 aa, Mycobacterium
ASEAPPWIGALDVLIVAGDDP

SEQ ID NO: 638227 - protein, 24 aa, Mycobacterium
ASECVPYLAAFRYKESGMRKRAAW

SEQ ID NO: 638228 - protein, 19 aa, Mycobacterium
ASEFGVYWPTLIPASEVAH

SEQ ID NO: 638229 - protein, 20 aa, Mycobacterium
ASEFNIPFVPLDTLKTQFER

SEQ ID NO: 638230 - protein, 19 aa, Mycobacterium
ASEFPWCAQAARVLDTEFG

SEQ ID NO: 638231 - protein, 19 aa, Mycobacterium
ASEFYSRSGSISMAAMANS

SEQ ID NO: 638232 - protein, 18 aa, Mycobacterium
ASEGRAVVLIAPTRVYSN

SEQ ID NO: 638233 - protein, 23 aa, Mycobacterium
ASEHIKAGAGLHPPSTATTVRVR

SEQ ID NO: 638234 - protein, 27 aa, Mycobacterium
ASEIEMMRGWLALWGVGPAAAQQHHPN

SEQ ID NO: 638235 - protein, 21 aa, Mycobacterium
ASEKELLAWALDDLATVFGLA

SEQ ID NO: 638236 - protein, 18 aa, Mycobacterium
ASEKRLTVETTRYSLDDA

SEQ ID NO: 638237 - protein, 17 aa, Mycobacterium
ASELARRAADEGAAVIV

SEQ ID NO: 638238 - protein, 22 aa, Mycobacterium
ASELMINLFWRGLKGSPSAASD

SEQ ID NO: 638239 - protein, 20 aa, Mycobacterium
ASELRRLRRSIVAAAGADDP

SEQ ID NO: 638240 - protein, 20 aa, Mycobacterium
ASELRRLRRSIVAAAGADHP

SEQ ID NO: 638241 - protein, 19 aa, Mycobacterium
ASELSGGNNLLFRRNSVSG

SEQ ID NO: 638242 - protein, 18 aa, Mycobacterium
ASELSRRDIQLVPYSLSG

SEQ ID NO: 638243 - protein, 17 aa, Mycobacterium
ASEPGMIAAAWQRRTTR

SEQ ID NO: 638244 - protein, 22 aa, Mycobacterium
ASEPRRASGTGFGFGPELLDEM

SEQ ID NO: 638245 - protein, 25 aa, Mycobacterium
ASEQERLRRIFAIVDVADRTRIGLT

SEQ ID NO: 638246 - protein, 18 aa, Mycobacterium
ASERPRGVFSRQLVLGEN

SEQ ID NO: 638247 - protein, 19 aa, Mycobacterium
ASERPRGVFSRQLVLGENL

SEQ ID NO: 638248 - protein, 17 aa, Mycobacterium
ASERRIAEETAKAEGKP

SEQ ID NO: 638249 - protein, 17 aa, Mycobacterium
ASERWCVRAGQRVAVEV

SEQ ID NO: 638250 - protein, 23 aa, Mycobacterium
ASESAYFLLAFTKIGLMPDGGAS

SEQ ID NO: 638251 - protein, 25 aa, Mycobacterium
ASESEPYCPVGISPLFETIEDLHNG

SEQ ID NO: 638252 - protein, 27 aa, Mycobacterium
ASESGKCPPPAGFYGTVASVSGNTITV

SEQ ID NO: 638253 - protein, 24 aa, Mycobacterium
ASESMAAKAAPYVWWLHSTAEQTQ

SEQ ID NO: 638254 - protein, 25 aa, Mycobacterium
ASETGRTAFPYSVHVGHWDELDGLV

SEQ ID NO: 638255 - protein, 19 aa, Mycobacterium
ASETYAPLNAWHVLGQPTI

SEQ ID NO: 638256 - protein, 18 aa, Mycobacterium
ASEVRVGVPFPVAALEVM

SEQ ID NO: 638257 - protein, 20 aa, Mycobacterium
ASEVWAEIWDDIGPRIERVL

SEQ ID NO: 638258 - protein, 23 aa, Mycobacterium
ASFAESFVQLGLVPGDGGTWFLQ

SEQ ID NO: 638259 - protein, 27 aa, Mycobacterium
ASFAMPDVHWGYGFPIGGVAATDIDDG

SEQ ID NO: 638260 - protein, 20 aa, Mycobacterium
ASFAQQRMWFLSRLEPGSHY

SEQ ID NO: 638261 - protein, 24 aa, Mycobacterium
ASFCRDRLAPFEVPTDFQQAAELP

SEQ ID NO: 638262 - protein, 21 aa, Mycobacterium
ASFDALTARHFIWTLLEPEKA

SEQ ID NO: 638263 - protein, 20 aa, Mycobacterium
ASFDLKMRFEQALLFRSARE

SEQ ID NO: 638264 - protein, 24 aa, Mycobacterium
ASFELPADLPLGYHRLHVRVDGAR

SEQ ID NO: 638265 - protein, 17 aa, Mycobacterium
ASFGGRDPLGLGAADRL

SEQ ID NO: 638266 - protein, 20 aa, Mycobacterium
ASFHQQFVQLMSGGATEYAA

SEQ ID NO: 638267 - protein, 23 aa, Mycobacterium
ASFKDRWLLRNRPHLVLDGLRLA

SEQ ID NO: 638268 - protein, 23 aa, Mycobacterium
ASFKEINCLPFAPMRDNPYSGAG

SEQ ID NO: 638269 - protein, 18 aa, Mycobacterium
ASFKRSYRDIDILLVDDI

SEQ ID NO: 638270 - protein, 20 aa, Mycobacterium
ASFQPSVSVPVDLDGARKVL

SEQ ID NO: 638271 - protein, 32 aa, Mycobacterium
ASFSEKQPIAALARLYPNYTQVIARTDAGINS

SEQ ID NO: 638272 - protein, 27 aa, Mycobacterium
ASFSRTEPAVFVWLGVIFYLTPDAAGS

SEQ ID NO: 638273 - protein, 17 aa, Mycobacterium
ASFTGEFVRFDSVRVNP

SEQ ID NO: 638274 - protein, 17 aa, Mycobacterium
ASFTMAYTKVGLSPDGS

SEQ ID NO: 638275 - protein, 24 aa, Mycobacterium
ASFTRWPAIRLRQPKSFLESFSPP

SEQ ID NO: 638276 - protein, 24 aa, Mycobacterium
ASFVDDFVLYWGFLALAQVRGGRH

SEQ ID NO: 638277 - protein, 21 aa, Mycobacterium
ASFVREIRAGDNLHREAAPEM

SEQ ID NO: 638278 - protein, 17 aa, Mycobacterium
ASFYIYFEDKGHLLRRL

SEQ ID NO: 638279 - protein, 22 aa, Mycobacterium
ASGAAAIAHAWREIILGDADIA

SEQ ID NO: 638280 - protein, 19 aa, Mycobacterium
ASGAALLLGARGRRVDPRQ

SEQ ID NO: 638281 - protein, 25 aa, Mycobacterium
ASGADFLLALAVAYEVQCRFSTQVP

SEQ ID NO: 638282 - protein, 25 aa, Mycobacterium
ASGAGCVPCSSMGRLFDAVASLLGV

SEQ ID NO: 638283 - protein, 26 aa, Mycobacterium
ASGAGHRLRMIGVTWGDEASAQAALL

SEQ ID NO: 638284 - protein, 18 aa, Mycobacterium
ASGAGLACIGLLSGGIAR

SEQ ID NO: 638285 - protein, 23 aa, Mycobacterium
ASGAPIDHIVCIDGAPEGTISVA

SEQ ID NO: 638286 - protein, 18 aa, Mycobacterium
ASGAPIEHIVCIDGAPEG

SEQ ID NO: 638287 - protein, 19 aa, Mycobacterium
ASGAPIEHIVCIDGSPPGT

SEQ ID NO: 638288 - protein, 28 aa, Mycobacterium
ASGARLDWPAVFLGWGGRRVSLPTYAFM

SEQ ID NO: 638289 - protein, 17 aa, Mycobacterium
ASGASWAPRLPSYGGND

SEQ ID NO: 638290 - protein, 27 aa, Mycobacterium
ASGATILKPAERVFWGGYSGYFADPDG

SEQ ID NO: 638291 - protein, 32 aa, Mycobacterium
ASGAVRFIGVDGYRWMIRCVINGPHETMEALE

SEQ ID NO: 638292 - protein, 23 aa, Mycobacterium
ASGCGKSTLLRLIAGFETPTEGE

SEQ ID NO: 638293 - protein, 23 aa, Mycobacterium
ASGCGKSTLLRLLAGFESPSEGA

SEQ ID NO: 638294 - protein, 23 aa, Mycobacterium
ASGCGKSTLLRLLAGFESPTDGS

SEQ ID NO: 638295 - protein, 24 aa, Mycobacterium
ASGCGKTTLLRLVAGFENPDAGTV

SEQ ID NO: 638296 - protein, 17 aa, Mycobacterium
ASGEASLRARFEDAHAT

SEQ ID NO: 638297 - protein, 24 aa, Mycobacterium
ASGEASLRISLRTAAIPHHPGGLQ

SEQ ID NO: 638298 - protein, 19 aa, Mycobacterium
ASGELGCHNGLPVSIVVTT

SEQ ID NO: 638299 - protein, 17 aa, Mycobacterium
ASGELIATVAAPPLVSR

SEQ ID NO: 638300 - protein, 23 aa, Mycobacterium
ASGELPRAASLLREAAATLAPTG

SEQ ID NO: 638301 - protein, 25 aa, Mycobacterium
ASGEMGDPVIPSVVGKEGIGRTADG

SEQ ID NO: 638302 - protein, 26 aa, Mycobacterium
ASGFLPDIRRYGATYMNYVGKPLAYI

SEQ ID NO: 638303 - protein, 19 aa, Mycobacterium
ASGFNKWGLTNGVAAALLL

SEQ ID NO: 638304 - protein, 18 aa, Mycobacterium
ASGFRDSFGDDFGIKIVD

SEQ ID NO: 638305 - protein, 18 aa, Mycobacterium
ASGFVIKDIKGMDLTHAI

SEQ ID NO: 638306 - protein, 24 aa, Mycobacterium
ASGGAAFLLCRRASRLTSHAAQWA

SEQ ID NO: 638307 - protein, 23 aa, Mycobacterium
ASGGFNMAGAFGASVASVNTAGS

SEQ ID NO: 638308 - protein, 20 aa, Mycobacterium
ASGGLGGIFGLSSNTANIGN

SEQ ID NO: 638309 - protein, 17 aa, Mycobacterium
ASGGLSLETAAAYAKTG

SEQ ID NO: 638310 - protein, 24 aa, Mycobacterium
ASGGPGPGGVRWVGVSAGGDDESV

SEQ ID NO: 638311 - protein, 19 aa, Mycobacterium
ASGGRSLCQGKIFTQSGQM

SEQ ID NO: 638312 - protein, 24 aa, Mycobacterium
ASGGRYSYRASKIVDGQCQQIAGT

SEQ ID NO: 638313 - protein, 17 aa, Mycobacterium
ASGGWSVGAVALVAGWV

SEQ ID NO: 638314 - protein, 17 aa, Mycobacterium
ASGGYLRATEHRVQVSA

SEQ ID NO: 638315 - protein, 19 aa, Mycobacterium
ASGHPRFAIGESTVPETIM

SEQ ID NO: 638316 - protein, 22 aa, Mycobacterium
ASGHWPLIRYNPVLRATGKPPF

SEQ ID NO: 638317 - protein, 22 aa, Mycobacterium
ASGHWPLIRYNPVLRSTGRPPF

SEQ ID NO: 638318 - protein, 24 aa, Mycobacterium
ASGIGLATGRRLRAEGATVVVGDI

SEQ ID NO: 638319 - protein, 20 aa, Mycobacterium
ASGIPGDWALYDVDGKNGEH

SEQ ID NO: 638320 - protein, 20 aa, Mycobacterium
ASGIQGRIAIGCVGSATYSL

SEQ ID NO: 638321 - protein, 19 aa, Mycobacterium
ASGITLLLIDSRAPHRHAT

SEQ ID NO: 638322 - protein, 23 aa, Mycobacterium
ASGKPPIYFGFGSMPVQSPADAV

SEQ ID NO: 638323 - protein, 21 aa, Mycobacterium
ASGLAAAWWLGVTKYAPEIVE

SEQ ID NO: 638324 - protein, 28 aa, Mycobacterium
ASGLDSRAWRLPWPDGTVVYELDQPRVL

SEQ ID NO: 638325 - protein, 17 aa, Mycobacterium
ASGLEDRDDFVVGSLAG

SEQ ID NO: 638326 - protein, 17 aa, Mycobacterium
ASGLGIKDMVAGAVALA

SEQ ID NO: 638327 - protein, 24 aa, Mycobacterium
ASGLPSWQQALSGLPGIGQAAAAP

SEQ ID NO: 638328 - protein, 25 aa, Mycobacterium
ASGLPVPEWFPMLGGHEGSGVVEAV

SEQ ID NO: 638329 - protein, 25 aa, Mycobacterium
ASGLRAARRLGADWPAATRREVVVP

SEQ ID NO: 638330 - protein, 25 aa, Mycobacterium
ASGLRKSELIAAIRAHRGESNGRTA

SEQ ID NO: 638331 - protein, 17 aa, Mycobacterium
ASGLSFGAPTPAESELA

SEQ ID NO: 638332 - protein, 26 aa, Mycobacterium
ASGMLQRWSQGWVEPVTPPPHPRHIA

SEQ ID NO: 638333 - protein, 17 aa, Mycobacterium
ASGMPVAPPPLGPPPTP

SEQ ID NO: 638334 - protein, 23 aa, Mycobacterium
ASGMRKGELIAAIRERRGEANGS

SEQ ID NO: 638335 - protein, 19 aa, Mycobacterium
ASGMSMLIEAARQVMGKAA

SEQ ID NO: 638336 - protein, 22 aa, Mycobacterium
ASGNVLPLLAIPANLAQGSATL

SEQ ID NO: 638337 - protein, 29 aa, Mycobacterium
ASGPFGTTIAHGFMTLALLPRLQHQIYTV

SEQ ID NO: 638338 - protein, 17 aa, Mycobacterium
ASGPGAALWVEVTEVPE

SEQ ID NO: 638339 - protein, 25 aa, Mycobacterium
ASGPLYGTFFLRMAPALGTDDTVSA

SEQ ID NO: 638340 - protein, 22 aa, Mycobacterium
ASGPPAPRRGGGLVDAMTAQLP

SEQ ID NO: 638341 - protein, 18 aa, Mycobacterium
ASGPRAAVELLRRDLDYL

SEQ ID NO: 638342 - protein, 22 aa, Mycobacterium
ASGPTPGFGMWVKIRAADGTVT

SEQ ID NO: 638343 - protein, 25 aa, Mycobacterium
ASGRGEIPLSIELTGDPQRVLTLVA

SEQ ID NO: 638344 - protein, 21 aa, Mycobacterium
ASGRLSAAFTNSWVATSDEDA

SEQ ID NO: 638345 - protein, 17 aa, Mycobacterium
ASGRPAPHLATRQLERL

SEQ ID NO: 638346 - protein, 17 aa, Mycobacterium
ASGRSPAAWTPEYFGGN

SEQ ID NO: 638347 - protein, 21 aa, Mycobacterium
ASGRSPAGWTPEYFGGEAVPL

SEQ ID NO: 638348 - protein, 17 aa, Mycobacterium
ASGRVAYALGLQGPAIT

SEQ ID NO: 638349 - protein, 17 aa, Mycobacterium
ASGRVSYALGLEGPAVS

SEQ ID NO: 638350 - protein, 18 aa, Mycobacterium
ASGRWPGPVATEVTPAGV

SEQ ID NO: 638351 - protein, 18 aa, Mycobacterium
ASGSRLAAEVALLGSDSE

SEQ ID NO: 638352 - protein, 17 aa, Mycobacterium
ASGSRLAVESVPSQQSA

SEQ ID NO: 638353 - protein, 26 aa, Mycobacterium
ASGSRMRPDIVIKFMDRFGDVIYNNY

SEQ ID NO: 638354 - protein, 23 aa, Mycobacterium
ASGSRTRLVRFFPTAMKGTHVEL

SEQ ID NO: 638355 - protein, 19 aa, Mycobacterium
ASGSRVLTFMKHHVPISAR

SEQ ID NO: 638356 - protein, 18 aa, Mycobacterium
ASGTELMRHITFGPEALT

SEQ ID NO: 638357 - protein, 18 aa, Mycobacterium
ASGTFEWAATAVALSPKT

SEQ ID NO: 638358 - protein, 21 aa, Mycobacterium
ASGTQPLCFIDHSSHDMRIGY

SEQ ID NO: 638359 - protein, 21 aa, Mycobacterium
ASGTRHFCAGAGLAPQPAGAG

SEQ ID NO: 638360 - protein, 25 aa, Mycobacterium
ASGVPRVPFKPPVSAGGRGLAGLTP

SEQ ID NO: 638361 - protein, 18 aa, Mycobacterium
ASGVRMLIVPGSMRVRAQ

SEQ ID NO: 638362 - protein, 17 aa, Mycobacterium
ASGVRMLLDAAKQVSGA

SEQ ID NO: 638363 - protein, 17 aa, Mycobacterium
ASGVRMLLDAAKQVSGG

SEQ ID NO: 638364 - protein, 17 aa, Mycobacterium
ASGVRMLLDAARQVSDT

SEQ ID NO: 638365 - protein, 17 aa, Mycobacterium
ASGVRMLLDATKQVSAS

SEQ ID NO: 638366 - protein, 18 aa, Mycobacterium
ASGVRRVYGLPGDSLNGF

SEQ ID NO: 638367 - protein, 26 aa, Mycobacterium
ASGVYLTFFGSFVFGTPGFPLADVPL

SEQ ID NO: 638368 - protein, 17 aa, Mycobacterium
ASGWAHANNTPFQWGKQ

SEQ ID NO: 638369 - protein, 17 aa, Mycobacterium
ASGYRRFTAYDCARLRF

SEQ ID NO: 638370 - protein, 17 aa, Mycobacterium
ASHARFVEAAAKVNALL

SEQ ID NO: 638371 - protein, 17 aa, Mycobacterium
ASHARVMAGHGAKVVCG

SEQ ID NO: 638372 - protein, 22 aa, Mycobacterium
ASHDRFRFYLNVEIGKHLTHAD

SEQ ID NO: 638373 - protein, 22 aa, Mycobacterium
ASHEHPSRIIVVMRGDPYAEKP

SEQ ID NO: 638374 - protein, 26 aa, Mycobacterium
ASHFRCPYHGWSYRNDGRIVGLPFHQ

SEQ ID NO: 638375 - protein, 18 aa, Mycobacterium
ASHGGFKLDSCTSNTNDT

SEQ ID NO: 638376 - protein, 25 aa, Mycobacterium
ASHHLRWLASANCLLEIGEDVTEVP

SEQ ID NO: 638377 - protein, 25 aa, Mycobacterium
ASHHLRWLASANCLLELDEDTAEVA

SEQ ID NO: 638378 - protein, 23 aa, Mycobacterium
ASHHLRWLAVSNCLLDIPEDVTQ

SEQ ID NO: 638379 - protein, 24 aa, Mycobacterium
ASHIKPRLLGHWGTTPGLNIIYAH

SEQ ID NO: 638380 - protein, 18 aa, Mycobacterium
ASHLAKYRMRTHGDIDMP

SEQ ID NO: 638381 - protein, 19 aa, Mycobacterium
ASHNGMWDLSILGIIPGIR

SEQ ID NO: 638382 - protein, 18 aa, Mycobacterium
ASHNGMWDLSILGIVPGM

SEQ ID NO: 638383 - protein, 19 aa, Mycobacterium
ASHNGMWDLSILNVVPGMR

SEQ ID NO: 638384 - protein, 19 aa, Mycobacterium
ASHNGMWDLSMLGIVPGMR

SEQ ID NO: 638385 - protein, 20 aa, Mycobacterium
ASHPGEGWAVVDVETSGFRP

SEQ ID NO: 638386 - protein, 21 aa, Mycobacterium
ASHPLLLSTLVKFTSDREIAL

SEQ ID NO: 638387 - protein, 17 aa, Mycobacterium
ASHPRDARLGSVGKLLP

SEQ ID NO: 638388 - protein, 22 aa, Mycobacterium
ASHPSEGWAVIDVETSGFRPGQ

SEQ ID NO: 638389 - protein, 20 aa, Mycobacterium
ASHRCWKLSGNRIAILGDLN

SEQ ID NO: 638390 - protein, 23 aa, Mycobacterium
ASHRIKLAWFLLNAARYMPAQVF

SEQ ID NO: 638391 - protein, 25 aa, Mycobacterium
ASHVLAVTVSDGWSGEFPDANELCR

SEQ ID NO: 638392 - protein, 17 aa, Mycobacterium
ASHVLRTALPHLTDSAT

SEQ ID NO: 638393 - protein, 18 aa, Mycobacterium
ASHYGGAGARGFSPVPTL

SEQ ID NO: 638394 - protein, 19 aa, Mycobacterium
ASIAAAVHRGELMPADADH

SEQ ID NO: 638395 - protein, 18 aa, Mycobacterium
ASIAALFLTTEAVVADKP

SEQ ID NO: 638396 - protein, 37 aa, Mycobacterium
ASIADLRAIPWVLAWSQSRVMLPGWYGTGSAFEQWLA

SEQ ID NO: 638397 - protein, 31 aa, Mycobacterium
ASIAEARNALKLSWRYIEAFEAEAAALYAAP

SEQ ID NO: 638398 - protein, 17 aa, Mycobacterium
ASIAGLFLTTEAVVADK

SEQ ID NO: 638399 - protein, 25 aa, Mycobacterium
ASIAYWRLTGAAAAARNLLAVQGAG

SEQ ID NO: 638400 - protein, 17 aa, Mycobacterium
ASICARRGPTLQWVRSE

SEQ ID NO: 638401 - protein, 18 aa, Mycobacterium
ASIFAYWVADPAAYGVVE

SEQ ID NO: 638402 - protein, 17 aa, Mycobacterium
ASIFPACRAVVHHGGSG

SEQ ID NO: 638403 - protein, 29 aa, Mycobacterium
ASIGCPGCSASICRRCLSEDHVASTAICV

SEQ ID NO: 638404 - protein, 26 aa, Mycobacterium
ASIGPGGWPAVLARQLFMSWYTLFHQ

SEQ ID NO: 638405 - protein, 21 aa, Mycobacterium
ASIGQVHRAVWSDGRVVAVKV

SEQ ID NO: 638406 - protein, 24 aa, Mycobacterium
ASIHPPRFLVGLSQRNHTFRTARD

SEQ ID NO: 638407 - protein, 17 aa, Mycobacterium
ASIHTAELARIMVDADI

SEQ ID NO: 638408 - protein, 20 aa, Mycobacterium
ASIIAVDICAQIPSVEYPMA

SEQ ID NO: 638409 - protein, 24 aa, Mycobacterium
ASILVDADDGWSYAVAEGTAELTA

SEQ ID NO: 638410 - protein, 24 aa, Mycobacterium
ASINVKAAAEWSFRIAASLLVTPG

SEQ ID NO: 638411 - protein, 19 aa, Mycobacterium
ASIPFKLRYYRQAVERGRR

SEQ ID NO: 638412 - protein, 17 aa, Mycobacterium
ASIPNIRYLPALGKVVF

SEQ ID NO: 638413 - protein, 25 aa, Mycobacterium
ASIPNIRYLPALGKVVFRRDFPQED

SEQ ID NO: 638414 - protein, 27 aa, Mycobacterium
ASIPVKRLRQAGVLELLLALANETGGN

SEQ ID NO: 638415 - protein, 20 aa, Mycobacterium
ASIRGLVGMIPPGRPFAEVA

SEQ ID NO: 638416 - protein, 17 aa, Mycobacterium
ASIRRTGRCVVLHEGPR

SEQ ID NO: 638417 - protein, 23 aa, Mycobacterium
ASITAYDRVVWVAGGLLKGASVD

SEQ ID NO: 638418 - protein, 25 aa, Mycobacterium
ASIVERLVPDFLWISTEHTARVSLD

SEQ ID NO: 638419 - protein, 26 aa, Mycobacterium
ASIVRAAERFGFTGALIPTGAWCEDA

SEQ ID NO: 638420 - protein, 27 aa, Mycobacterium
ASIVRQAYLLDRHWRNIRTLASHNPSS

SEQ ID NO: 638421 - protein, 20 aa, Mycobacterium
ASKAALWSLTNSLRVELAAQ

SEQ ID NO: 638422 - protein, 24 aa, Mycobacterium
ASKALRTGYVAAFSVPANQLPKEV

SEQ ID NO: 638423 - protein, 22 aa, Mycobacterium
ASKATEILAFINGMETLWLLDP

SEQ ID NO: 638424 - protein, 17 aa, Mycobacterium
ASKCGLTPQYTALEQLA

SEQ ID NO: 638425 - protein, 27 aa, Mycobacterium
ASKFLFPRVEVEVGFILAADLPGEDCT

SEQ ID NO: 638426 - protein, 35 aa, Mycobacterium
ASKGDSADGVWSRLKFEGGVHRVQRVPVTESQGRV

SEQ ID NO: 638427 - protein, 17 aa, Mycobacterium
ASKGGDPKHPSWYFNVK

SEQ ID NO: 638428 - protein, 19 aa, Mycobacterium
ASKGGQSVRDWLTELRAAG

SEQ ID NO: 638429 - protein, 22 aa, Mycobacterium
ASKHAELMFLSAYTPETIAQQI

SEQ ID NO: 638430 - protein, 26 aa, Mycobacterium
ASKHRRVWFCVDGVYSMYGDLAPTRL

SEQ ID NO: 638431 - protein, 24 aa, Mycobacterium
ASKIMPVAPFPAVVKQRERASARR

SEQ ID NO: 638432 - protein, 22 aa, Mycobacterium
ASKMAAAGCGRIVLTARSQPNP

SEQ ID NO: 638433 - protein, 21 aa, Mycobacterium
ASKNAIPWGDFDAHLAELQHL

SEQ ID NO: 638434 - protein, 21 aa, Mycobacterium
ASKNAIPWGDFDTHLAQLQDL

SEQ ID NO: 638435 - protein, 24 aa, Mycobacterium
ASKNPKDHFDFFPLTVDVEERMYA

SEQ ID NO: 638436 - protein, 18 aa, Mycobacterium
ASKPRKPVLVSAPDPTAL

SEQ ID NO: 638437 - protein, 26 aa, Mycobacterium
ASKQPKEHFDFFPLTIDVEERMYAAG

SEQ ID NO: 638438 - protein, 19 aa, Mycobacterium
ASKRARADHERWNAEDLAD

SEQ ID NO: 638439 - protein, 23 aa, Mycobacterium
ASKRELLCAALVSAVPPLPAPNA

SEQ ID NO: 638440 - protein, 22 aa, Mycobacterium
ASKRIAPIVILTAFSQRELVER

SEQ ID NO: 638441 - protein, 23 aa, Mycobacterium
ASKSRPGEGILTFAHTGRNQHGD

SEQ ID NO: 638442 - protein, 23 aa, Mycobacterium
ASKVARTTLYRHFHSSSHLLAAT

SEQ ID NO: 638443 - protein, 19 aa, Mycobacterium
ASKVLVVSCRLTWEQSSVR

SEQ ID NO: 638444 - protein, 22 aa, Mycobacterium
ASKWIPFGPVMTARARWLESVG

SEQ ID NO: 638445 - protein, 20 aa, Mycobacterium
ASKYRCFTQELSFPIESAGE

SEQ ID NO: 638446 - protein, 30 aa, Mycobacterium
ASLAAAHGRGEFRPRVSFLSPGKKILHDDR

SEQ ID NO: 638447 - protein, 24 aa, Mycobacterium
ASLAAELQAAAGYYQSVVSGLTSG

SEQ ID NO: 638448 - protein, 24 aa, Mycobacterium
ASLAAELWGGGAHWDLDDGDHPHE

SEQ ID NO: 638449 - protein, 19 aa, Mycobacterium
ASLAALRGALGIPSAAPAV

SEQ ID NO: 638450 - protein, 19 aa, Mycobacterium
ASLAFYRDALGFEVRKDVG

SEQ ID NO: 638451 - protein, 18 aa, Mycobacterium
ASLAGAWTALVGGFGGLR

SEQ ID NO: 638452 - protein, 18 aa, Mycobacterium
ASLAMEYADAGIRVVATA

SEQ ID NO: 638453 - protein, 25 aa, Mycobacterium
ASLARPDGTFVWTGRKFFTRPGELE

SEQ ID NO: 638454 - protein, 26 aa, Mycobacterium
ASLAVGFPGLSHVGLTLATGIANVPA

SEQ ID NO: 638455 - protein, 17 aa, Mycobacterium
ASLAWKRITKSRRPIGA

SEQ ID NO: 638456 - protein, 25 aa, Mycobacterium
ASLCASQLVGLGIMRYGIRSEPLHS

SEQ ID NO: 638457 - protein, 23 aa, Mycobacterium
ASLDAVRVTGRFAPGADPATVAA

SEQ ID NO: 638458 - protein, 21 aa, Mycobacterium
ASLDGALVVLDWAPHRPNGPL

SEQ ID NO: 638459 - protein, 24 aa, Mycobacterium
ASLDPRLPISDLLAEPLQANGFNK

SEQ ID NO: 638460 - protein, 20 aa, Mycobacterium
ASLEDAVRIAVAALGAGGNG

SEQ ID NO: 638461 - protein, 24 aa, Mycobacterium
ASLERLCGFLLDAGVDGLFVCGSS

SEQ ID NO: 638462 - protein, 17 aa, Mycobacterium
ASLERLGLDYVDLYLIH

SEQ ID NO: 638463 - protein, 18 aa, Mycobacterium
ASLFPLVVIVHADAEQRV

SEQ ID NO: 638464 - protein, 20 aa, Mycobacterium
ASLFRLALEQAPPGSVLHAV

SEQ ID NO: 638465 - protein, 25 aa, Mycobacterium
ASLFSLPNPLAVSYYLGKGAVQGVQ

SEQ ID NO: 638466 - protein, 25 aa, Mycobacterium
ASLGASWEGGWRCGEVVLSMVAENA

SEQ ID NO: 638467 - protein, 17 aa, Mycobacterium
ASLGGLIILATHLLASP

SEQ ID NO: 638468 - protein, 28 aa, Mycobacterium
ASLGTFFIGQCLYRFANVYNKALRAEIN

SEQ ID NO: 638469 - protein, 27 aa, Mycobacterium
ASLHAAKGLEWDAVFLVGLADGTLPIS

SEQ ID NO: 638470 - protein, 26 aa, Mycobacterium
ASLHAFNLWLDEDWGFDRPDHRIIAA

SEQ ID NO: 638471 - protein, 23 aa, Mycobacterium
ASLHAGHLVPLLTLRRFQRAGHR

SEQ ID NO: 638472 - protein, 21 aa, Mycobacterium
ASLHGLAGWVDVKPAVVSTAV

SEQ ID NO: 638473 - protein, 21 aa, Mycobacterium
ASLIAHWMLVGFVHGVMNTDN

SEQ ID NO: 638474 - protein, 20 aa, Mycobacterium
ASLIGELVRKCRLVMRGEQL

SEQ ID NO: 638475 - protein, 25 aa, Mycobacterium
ASLIHLALAAARDFPWTERRQGVLG

SEQ ID NO: 638476 - protein, 22 aa, Mycobacterium
ASLIHLALAAAREFPWEERRQG

SEQ ID NO: 638477 - protein, 24 aa, Mycobacterium
ASLKDRWLLRNRPHLILDGLRLAA

SEQ ID NO: 638478 - protein, 22 aa, Mycobacterium
ASLKGLVRALAFEHPDMRATLV

SEQ ID NO: 638479 - protein, 20 aa, Mycobacterium
ASLKKLYAASEWLHRETTRI

SEQ ID NO: 638480 - protein, 17 aa, Mycobacterium
ASLLAAVVGVHAFQGTK

SEQ ID NO: 638481 - protein, 20 aa, Mycobacterium
ASLLAQWMLVGFIHGVMNTD

SEQ ID NO: 638482 - protein, 26 aa, Mycobacterium
ASLLGELVRRCRMVMAGEPLPHPDPV

SEQ ID NO: 638483 - protein, 17 aa, Mycobacterium
ASLLMYGRELNWVQQWW

SEQ ID NO: 638484 - protein, 17 aa, Mycobacterium
ASLLPAGLSAPAATTTA

SEQ ID NO: 638485 - protein, 22 aa, Mycobacterium
ASLLPDPLDTVFLVNSGSEASD

SEQ ID NO: 638486 - protein, 18 aa, Mycobacterium
ASLLPEAVPSNWVTFFGA

SEQ ID NO: 638487 - protein, 18 aa, Mycobacterium
ASLLRAVTLPAYGGTTAW

SEQ ID NO: 638488 - protein, 18 aa, Mycobacterium
ASLLRAVTLPSYGGTTAW

SEQ ID NO: 638489 - protein, 39 aa, Mycobacterium
ASLLRPEVSAVLGPLGLTLPEFVCLRMLSMFPGMSSAEL

SEQ ID NO: 638490 - protein, 25 aa, Mycobacterium
ASLLSARLQSFGQWMNEGATSAGAQ

SEQ ID NO: 638491 - protein, 19 aa, Mycobacterium
ASLLTRFMYRVTKRRYGQV

SEQ ID NO: 638492 - protein, 31 aa, Mycobacterium
ASLNARRVARVCGCIAALLMAILGCTSVTEG

SEQ ID NO: 638493 - protein, 17 aa, Mycobacterium
ASLNFPSLIAGFAGTVF

SEQ ID NO: 638494 - protein, 24 aa, Mycobacterium
ASLNKPEGVYSFLLSALAVTVASW

SEQ ID NO: 638495 - protein, 19 aa, Mycobacterium
ASLPKLPTFTLTSQSVTDG

SEQ ID NO: 638496 - protein, 22 aa, Mycobacterium
ASLPPGQSGEVWVRSNQNMTGY

SEQ ID NO: 638497 - protein, 17 aa, Mycobacterium
ASLPPLDVLTDWHRAFE

SEQ ID NO: 638498 - protein, 24 aa, Mycobacterium
ASLPRYIPSIPELWASRHGQSVVL

SEQ ID NO: 638499 - protein, 23 aa, Mycobacterium
ASLPSKFMPAPGYSAYVAPDKYA

SEQ ID NO: 638500 - protein, 25 aa, Mycobacterium
ASLPYFRQFLGREVMRHAPAVAPQA

SEQ ID NO: 638501 - protein, 23 aa, Mycobacterium
ASLQPGDVAFTFIDYDTDPEGVA

SEQ ID NO: 638502 - protein, 20 aa, Mycobacterium
ASLRALAAHPGWSHTNLQGN

SEQ ID NO: 638503 - protein, 17 aa, Mycobacterium
ASLRARIDALSVGLDRK

SEQ ID NO: 638504 - protein, 19 aa, Mycobacterium
ASLRAWRRVRDYRPHVVIA

SEQ ID NO: 638505 - protein, 18 aa, Mycobacterium
ASLREFLVGAAPVAEEIG

SEQ ID NO: 638506 - protein, 25 aa, Mycobacterium
ASLREHAWKRSSFNGTEIFGKTVGV

SEQ ID NO: 638507 - protein, 21 aa, Mycobacterium
ASLREYFGRVSGYAEQTGARR

SEQ ID NO: 638508 - protein, 17 aa, Mycobacterium
ASLRLDSAWTAARTETA

SEQ ID NO: 638509 - protein, 20 aa, Mycobacterium
ASLRLLAPGGRFIEMGKTDI

SEQ ID NO: 638510 - protein, 20 aa, Mycobacterium
ASLRLLAPGGRFIEMGKTDL

SEQ ID NO: 638511 - protein, 21 aa, Mycobacterium
ASLRLLAPGGRFIEMGKTDVR

SEQ ID NO: 638512 - protein, 17 aa, Mycobacterium
ASLRLLSPGGRFIEMGK

SEQ ID NO: 638513 - protein, 19 aa, Mycobacterium
ASLRNDAKLSFLGRKMVQV

SEQ ID NO: 638514 - protein, 17 aa, Mycobacterium
ASLRNPVLRELAGEADA

SEQ ID NO: 638515 - protein, 30 aa, Mycobacterium
ASLRRAVSLGDGWMPFGLRTSGIRALLDAT

SEQ ID NO: 638516 - protein, 19 aa, Mycobacterium
ASLRRLPAVVATVADRLRA

SEQ ID NO: 638517 - protein, 19 aa, Mycobacterium
ASLRVNYLRQFFGGAHARY

SEQ ID NO: 638518 - protein, 28 aa, Mycobacterium
ASLSMASAFWPYVTWTSMVATQAGEAAS

SEQ ID NO: 638519 - protein, 25 aa, Mycobacterium
ASLVERLVPDFLWISTEHTAQVSLD

SEQ ID NO: 638520 - protein, 22 aa, Mycobacterium
ASLVRSCGIGFRGVSEPRESSD

SEQ ID NO: 638521 - protein, 18 aa, Mycobacterium
ASLVSCGVSTGWGSATIS

SEQ ID NO: 638522 - protein, 20 aa, Mycobacterium
ASLVSCGVSTGWGSATVSAG

SEQ ID NO: 638523 - protein, 23 aa, Mycobacterium
ASLVVADGMPLVWAARAGGDRLP

SEQ ID NO: 638524 - protein, 24 aa, Mycobacterium
ASLVYGCAKFPCLTDATRVKALQH

SEQ ID NO: 638525 - protein, 19 aa, Mycobacterium
ASMAGHMPYELTAEQEQEL

SEQ ID NO: 638526 - protein, 24 aa, Mycobacterium
ASMAQAVAPYVAWMRTTAAQAEQT

SEQ ID NO: 638527 - protein, 17 aa, Mycobacterium
ASMARSIPAGALGTPED

SEQ ID NO: 638528 - protein, 18 aa, Mycobacterium
ASMASFLIVMAMTDPEAP

SEQ ID NO: 638529 - protein, 24 aa, Mycobacterium
ASMDALKVVRAWETGGAETVEEGE

SEQ ID NO: 638530 - protein, 26 aa, Mycobacterium
ASMDIAKGGLLGGVYAYLDNNNQLVM

SEQ ID NO: 638531 - protein, 25 aa, Mycobacterium
ASMFRFGCVCGGASLYAPQAHNNVV

SEQ ID NO: 638532 - protein, 19 aa, Mycobacterium
ASMGGMIAQIFAARFAERT

SEQ ID NO: 638533 - protein, 18 aa, Mycobacterium
ASMGGMIAQIFAARFRER

SEQ ID NO: 638534 - protein, 19 aa, Mycobacterium
ASMGGMIAQIFAARFRERT

SEQ ID NO: 638535 - protein, 22 aa, Mycobacterium
ASMGRPEYPTPLGTYSVLGKER

SEQ ID NO: 638536 - protein, 18 aa, Mycobacterium
ASMHPSRYLTLIEGVTAV

SEQ ID NO: 638537 - protein, 19 aa, Mycobacterium
ASMLDEVTQLFGPELPQVH

SEQ ID NO: 638538 - protein, 24 aa, Mycobacterium
ASMPAMIRAGGKMYGADGKLKDTK

SEQ ID NO: 638539 - protein, 25 aa, Mycobacterium
ASMPKSVVISPYFDWGNDRPPDRHY

SEQ ID NO: 638540 - protein, 19 aa, Mycobacterium
ASMRGEALPSGGATSTPAT

SEQ ID NO: 638541 - protein, 30 aa, Mycobacterium
ASMRPGRGPKRYVCGGVMLSFDEMIGALEA

SEQ ID NO: 638542 - protein, 22 aa, Mycobacterium
ASMRTLVWRRWPTTGLAAPVQS

SEQ ID NO: 638543 - protein, 19 aa, Mycobacterium
ASMRVMTRMGAAALEKLGD

SEQ ID NO: 638544 - protein, 17 aa, Mycobacterium
ASMVRKVGGFTFQELNL

SEQ ID NO: 638545 - protein, 25 aa, Mycobacterium
ASMVYKLVEVDGMPVAKRSSSKESH

SEQ ID NO: 638546 - protein, 27 aa, Mycobacterium
ASNASIKGWPGWSVYAGSKAALHAFAR

SEQ ID NO: 638547 - protein, 28 aa, Mycobacterium
ASNELLDAWTLRRRLPRVAEVFASGAIS

SEQ ID NO: 638548 - protein, 26 aa, Mycobacterium
ASNFRCPYHGWSYRNDGRLIGLPFHK

SEQ ID NO: 638549 - protein, 17 aa, Mycobacterium
ASNGMNVEFLKALHEKV

SEQ ID NO: 638550 - protein, 28 aa, Mycobacterium
ASNIKCLCRFHHLIKTFWAGFVDTQLPD

SEQ ID NO: 638551 - protein, 19 aa, Mycobacterium
ASNLGRPGLAIVESDEDVL

SEQ ID NO: 638552 - protein, 24 aa, Mycobacterium
ASNPDWFAALGSFSYQTSGVAMPN

SEQ ID NO: 638553 - protein, 21 aa, Mycobacterium
ASNRLAVNFIPSRLTLDFAGA

SEQ ID NO: 638554 - protein, 20 aa, Mycobacterium
ASNSWSPVVVKLPVDLADPA

SEQ ID NO: 638555 - protein, 19 aa, Mycobacterium
ASNTHRWFGAYGVSKSAVD

SEQ ID NO: 638556 - protein, 19 aa, Mycobacterium
ASNTLGFGRPEDGERFTDG

SEQ ID NO: 638557 - protein, 24 aa, Mycobacterium
ASPAAVCPHVEWALSSTLGAKANL

SEQ ID NO: 638558 - protein, 24 aa, Mycobacterium
ASPAAVCPHVEWALSSTLGSKANL

SEQ ID NO: 638559 - protein, 24 aa, Mycobacterium
ASPAAVCPHVEWALSSTLHAKANL

SEQ ID NO: 638560 - protein, 23 aa, Mycobacterium
ASPAAVCPHVEWALSSTLNARAN

SEQ ID NO: 638561 - protein, 24 aa, Mycobacterium
ASPAAVCPHVEWALSSTLQAKANL

SEQ ID NO: 638562 - protein, 23 aa, Mycobacterium
ASPAAVCPHVEWALSSTLSARAN

SEQ ID NO: 638563 - protein, 23 aa, Mycobacterium
ASPAAVCPHVEWALTSTLTSTPS

SEQ ID NO: 638564 - protein, 22 aa, Mycobacterium
ASPAGPKVGAFFDLDGTLVAGF

SEQ ID NO: 638565 - protein, 22 aa, Mycobacterium
ASPAYLGFNLFQHAIARAVIHG

SEQ ID NO: 638566 - protein, 19 aa, Mycobacterium
ASPDRARAGAEALDSFESG

SEQ ID NO: 638567 - protein, 25 aa, Mycobacterium
ASPELLVARHGRHVLCRPFAGSAPR

SEQ ID NO: 638568 - protein, 21 aa, Mycobacterium
ASPELRPWLAEELAPGAHITD

SEQ ID NO: 638569 - protein, 18 aa, Mycobacterium
ASPFKVAYVTAKHALEGL

SEQ ID NO: 638570 - protein, 27 aa, Mycobacterium
ASPGYPCYRNILSALGCEVVEIPCGPE

SEQ ID NO: 638571 - protein, 27 aa, Mycobacterium
ASPGYPCYRNILSALGCEVVEIPCGPQ

SEQ ID NO: 638572 - protein, 27 aa, Mycobacterium
ASPGYPCYRNILSALGCEVVELPCGPD

SEQ ID NO: 638573 - protein, 23 aa, Mycobacterium
ASPHPRAEFAMLRASSGPPVEAG

SEQ ID NO: 638574 - protein, 20 aa, Mycobacterium
ASPLGRCIAGARPGEQRIYA

SEQ ID NO: 638575 - protein, 23 aa, Mycobacterium
ASPLGRGPACWYFDEGELDVWEV

SEQ ID NO: 638576 - protein, 29 aa, Mycobacterium
ASPLLGVLCSAYWQRPRVSVEVGAEPATV

SEQ ID NO: 638577 - protein, 21 aa, Mycobacterium
ASPLPHPLLLRVPVDEDVLSV

SEQ ID NO: 638578 - protein, 26 aa, Mycobacterium
ASPLQTLEQNVLAAINAPSQALTARP

SEQ ID NO: 638579 - protein, 19 aa, Mycobacterium
ASPMLPLAPLVSFVPKPAL

SEQ ID NO: 638580 - protein, 24 aa, Mycobacterium
ASPMPLPLLRQALEAWPNTDFMQA

SEQ ID NO: 638581 - protein, 21 aa, Mycobacterium
ASPNGGWAALAHVPALRALPE

SEQ ID NO: 638582 - protein, 30 aa, Mycobacterium
ASPPDMKLPIALALGWPARVAGAAAACDFS

SEQ ID NO: 638583 - protein, 28 aa, Mycobacterium
ASPPDMKLPIALALGWPDRIAGAAAACD

SEQ ID NO: 638584 - protein, 29 aa, Mycobacterium
ASPPDMKLPIALALGWPDRVPAAASACDF

SEQ ID NO: 638585 - protein, 30 aa, Mycobacterium
ASPPDMRLPIALALGWPRRVPGAAASCDFS

SEQ ID NO: 638586 - protein, 17 aa, Mycobacterium
ASPPGGARVNSWQAPFG

SEQ ID NO: 638587 - protein, 23 aa, Mycobacterium
ASPPRLLRCIEAVLECREALAMN

SEQ ID NO: 638588 - protein, 25 aa, Mycobacterium
ASPQFESWQAVMAQVYIDSHSYSGQ

SEQ ID NO: 638589 - protein, 23 aa, Mycobacterium
ASPRAELDLVQMSRARALLLGRD

SEQ ID NO: 638590 - protein, 23 aa, Mycobacterium
ASPRATIALCTAARALAVLSGRD

SEQ ID NO: 638591 - protein, 25 aa, Mycobacterium
ASPRSFCAGVHRAIEAVERVLDRAT

SEQ ID NO: 638592 - protein, 17 aa, Mycobacterium
ASPSAAVVTRWTRTTAV

SEQ ID NO: 638593 - protein, 30 aa, Mycobacterium
ASPSQLALAWLLKRSPVMLPIPGTSKVAHL

SEQ ID NO: 638594 - protein, 18 aa, Mycobacterium
ASPTMAWMYSPRGVFVDD

SEQ ID NO: 638595 - protein, 18 aa, Mycobacterium
ASPTQLALEMLAAYVQPN

SEQ ID NO: 638596 - protein, 17 aa, Mycobacterium
ASPVAAWGYAESTTAPA

SEQ ID NO: 638597 - protein, 25 aa, Mycobacterium
ASPVLHAINYLLGWLDEKYLTTLRD

SEQ ID NO: 638598 - protein, 29 aa, Mycobacterium
ASPVLQRLGLEWLHRLALEPRRLARRYLR

SEQ ID NO: 638599 - protein, 19 aa, Mycobacterium
ASPYAGWLSAAAARAAGAA

SEQ ID NO: 638600 - protein, 30 aa, Mycobacterium
ASQALDELVEWALRAVHSFMSNPSDPPRDA

SEQ ID NO: 638601 - protein, 25 aa, Mycobacterium
ASQAYERIFMWFAARDWDAMAEVVA

SEQ ID NO: 638602 - protein, 18 aa, Mycobacterium
ASQEWLLTQLGKLDPDQR

SEQ ID NO: 638603 - protein, 25 aa, Mycobacterium
ASQGARRFLAHPVMLDVAVQALGAT

SEQ ID NO: 638604 - protein, 20 aa, Mycobacterium
ASQGRRRVAVLGGNRIPFAR

SEQ ID NO: 638605 - protein, 24 aa, Mycobacterium
ASQHLSRALTQWRGPVLDDLRDFQ

SEQ ID NO: 638606 - protein, 25 aa, Mycobacterium
ASQIYPVLCGSAFKNKGVQPMLDAV

SEQ ID NO: 638607 - protein, 22 aa, Mycobacterium
ASQLRMGISVSDAVLPHQCYRL

SEQ ID NO: 638608 - protein, 17 aa, Mycobacterium
ASQMARLLAALQEKKPA

SEQ ID NO: 638609 - protein, 25 aa, Mycobacterium
ASQPRKASGSGFGFGPELLDEMTTM

SEQ ID NO: 638610 - protein, 21 aa, Mycobacterium
ASQRFILRMPDLVDADIDDIL

SEQ ID NO: 638611 - protein, 23 aa, Mycobacterium
ASQRPPLRVGLVQHRWRPDAGEL

SEQ ID NO: 638612 - protein, 19 aa, Mycobacterium
ASQRWMWRQIPGAQFARVP

SEQ ID NO: 638613 - protein, 19 aa, Mycobacterium
ASQSWDLVRDGVFVGYQLD

SEQ ID NO: 638614 - protein, 28 aa, Mycobacterium
ASQTSWRGLDPWLRHTFEDARHQLPLTA

SEQ ID NO: 638615 - protein, 25 aa, Mycobacterium
ASQWRELSTRFSVLASPTPGRPCQP

SEQ ID NO: 638616 - protein, 26 aa, Mycobacterium
ASQYKDVILGLVFLKFVSDARDGRKP

SEQ ID NO: 638617 - protein, 17 aa, Mycobacterium
ASRAEQGLSFAREAALA

SEQ ID NO: 638618 - protein, 26 aa, Mycobacterium
ASRAGRLRLGVGVTEAIRRHPVLIAQ

SEQ ID NO: 638619 - protein, 26 aa, Mycobacterium
ASRAMIWQRPRWAVRLQPATVSDLFA

SEQ ID NO: 638620 - protein, 18 aa, Mycobacterium
ASRAPGPLRAFYQRIKAR

SEQ ID NO: 638621 - protein, 25 aa, Mycobacterium
ASRAWSVLPCTVWPTRAAAPPHRMA

SEQ ID NO: 638622 - protein, 26 aa, Mycobacterium
ASRAYTLDRAHVFHSWSAQSQIKPMT

SEQ ID NO: 638623 - protein, 17 aa, Mycobacterium
ASRDGRRASTMPLIEIA

SEQ ID NO: 638624 - protein, 24 aa, Mycobacterium
ASRELLGDGALWFESWLDHPDTDD

SEQ ID NO: 638625 - protein, 21 aa, Mycobacterium
ASREWLKDPWAITDESGTYSG

SEQ ID NO: 638626 - protein, 18 aa, Mycobacterium
ASRFGRVELLTADAASDP

SEQ ID NO: 638627 - protein, 22 aa, Mycobacterium
ASRFTGKFWKLLGAATDKNQSQ

SEQ ID NO: 638628 - protein, 26 aa, Mycobacterium
ASRFVACPFGAFGSRMYRTGDLVRWG

SEQ ID NO: 638629 - protein, 18 aa, Mycobacterium
ASRGELLADLALTDQDVA

SEQ ID NO: 638630 - protein, 18 aa, Mycobacterium
ASRGELLADLGLTDQDVA

SEQ ID NO: 638631 - protein, 24 aa, Mycobacterium
ASRGIPLRLVHAVPERAASTNDEA

SEQ ID NO: 638632 - protein, 25 aa, Mycobacterium
ASRGKWDILRRMGFDDDHIGDSRTV

SEQ ID NO: 638633 - protein, 23 aa, Mycobacterium
ASRGKWDTLRAMGFDDDHIGDSR

SEQ ID NO: 638634 - protein, 23 aa, Mycobacterium
ASRGKWDTLRAMGFDDDHISDSR

SEQ ID NO: 638635 - protein, 29 aa, Mycobacterium
ASRGVRGPYRLGPEIARMASTVRLSVVAD

SEQ ID NO: 638636 - protein, 19 aa, Mycobacterium
ASRHAESVFGIFPTPKSMR

SEQ ID NO: 638637 - protein, 23 aa, Mycobacterium
ASRKVVRLRQKVVMPTLPTAAPR

SEQ ID NO: 638638 - protein, 18 aa, Mycobacterium
ASRLLADVACRDRSFDAV

SEQ ID NO: 638639 - protein, 19 aa, Mycobacterium
ASRLLPWARSGHLAAPRAG

SEQ ID NO: 638640 - protein, 19 aa, Mycobacterium
ASRLLPWARSGHLTLPRGG

SEQ ID NO: 638641 - protein, 18 aa, Mycobacterium
ASRLLPWARSGHLTVPRG

SEQ ID NO: 638642 - protein, 18 aa, Mycobacterium
ASRLLPWSRSGHLTVPRG

SEQ ID NO: 638643 - protein, 19 aa, Mycobacterium
ASRLLPWSRTGHLTVPRGS

SEQ ID NO: 638644 - protein, 18 aa, Mycobacterium
ASRLLPYAHNLRMRQRAP

SEQ ID NO: 638645 - protein, 24 aa, Mycobacterium
ASRLPCRYANPGPFVAGRPLVQGM

SEQ ID NO: 638646 - protein, 20 aa, Mycobacterium
ASRLPQYFPTPLRERFTPEI

SEQ ID NO: 638647 - protein, 28 aa, Mycobacterium
ASRLPSYFPKPLRERFAPEIRSHQLRRE

SEQ ID NO: 638648 - protein, 21 aa, Mycobacterium
ASRLRAVLVGAAGVGKTSMAR

SEQ ID NO: 638649 - protein, 24 aa, Mycobacterium
ASRLRGGGELIDLSMLETSVLGLT

SEQ ID NO: 638650 - protein, 18 aa, Mycobacterium
ASRLRVSEMTVRRDLDAM

SEQ ID NO: 638651 - protein, 24 aa, Mycobacterium
ASRMPCPYLNPGHYVRGRPLVQGM

SEQ ID NO: 638652 - protein, 24 aa, Mycobacterium
ASRMPCPYLNPGPYVGGRPLVQGM

SEQ ID NO: 638653 - protein, 24 aa, Mycobacterium
ASRMSCPYLNPGRYVSGRPLVQGM

SEQ ID NO: 638654 - protein, 18 aa, Mycobacterium
ASRNWKPPHNALKDLLHQ

SEQ ID NO: 638655 - protein, 19 aa, Mycobacterium
ASRQARRDGKVPAVLYGHG

SEQ ID NO: 638656 - protein, 24 aa, Mycobacterium
ASRQRVYRQPGFVAAMSDIMALQD

SEQ ID NO: 638657 - protein, 19 aa, Mycobacterium
ASRRARRDGRIPAVLYGHG

SEQ ID NO: 638658 - protein, 17 aa, Mycobacterium
ASRRLALTGTPFRSDDS

SEQ ID NO: 638659 - protein, 24 aa, Mycobacterium
ASRRRAAVIPAHYPGHGGATVVAR

SEQ ID NO: 638660 - protein, 24 aa, Mycobacterium
ASRRRVGLVAVHVWSDVGVFPILG

SEQ ID NO: 638661 - protein, 24 aa, Mycobacterium
ASRRVRARLARRMTAQRSTLNPVL

SEQ ID NO: 638662 - protein, 24 aa, Mycobacterium
ASRRVRARLARRMTARSGAINPVL

SEQ ID NO: 638663 - protein, 23 aa, Mycobacterium
ASRRWVLHLDMDAFFASVEQLTR

SEQ ID NO: 638664 - protein, 24 aa, Mycobacterium
ASRSEFRATPAFDGEAASLMWRHY

SEQ ID NO: 638665 - protein, 21 aa, Mycobacterium
ASRTLRAAYLGQVMTAGPESA

SEQ ID NO: 638666 - protein, 22 aa, Mycobacterium
ASRVERARRTLIEIQESGEKDL

SEQ ID NO: 638667 - protein, 20 aa, Mycobacterium
ASRVERARRTLLEIQENGDK

SEQ ID NO: 638668 - protein, 24 aa, Mycobacterium
ASRWPRAGALGPLVRDPDGSVYPS

SEQ ID NO: 638669 - protein, 27 aa, Mycobacterium
ASRYLWPRVEVEVGFLLNADLPGAECT

SEQ ID NO: 638670 - protein, 24 aa, Mycobacterium
ASSAEFVRLLLAASIRGLVGMIPP

SEQ ID NO: 638671 - protein, 19 aa, Mycobacterium
ASSAIPFVFEPVRVAGATW

SEQ ID NO: 638672 - protein, 23 aa, Mycobacterium
ASSAKLTLTRTVDVAGELAPAPR

SEQ ID NO: 638673 - protein, 24 aa, Mycobacterium
ASSAPDWLPRASVVHRSGTTTYPI

SEQ ID NO: 638674 - protein, 20 aa, Mycobacterium
ASSAPPWLVDRALRHLLTDI

SEQ ID NO: 638675 - protein, 19 aa, Mycobacterium
ASSAPSWLERGSITHKSGT

SEQ ID NO: 638676 - protein, 18 aa, Mycobacterium
ASSAREWWAPLRANHRVF

SEQ ID NO: 638677 - protein, 19 aa, Mycobacterium
ASSARTCGAGSGATGAGGA

SEQ ID NO: 638678 - protein, 23 aa, Mycobacterium
ASSARVGLGYEVVVTRLDDEANI

SEQ ID NO: 638679 - protein, 27 aa, Mycobacterium
ASSAWTLGFYALHNWLLSLFDLRVQQE

SEQ ID NO: 638680 - protein, 28 aa, Mycobacterium
ASSAWTLGFYALHNWMLSLFDPRAQEEV

SEQ ID NO: 638681 - protein, 26 aa, Mycobacterium
ASSAWTLGFYTLHNWMLALFSEEAQQ

SEQ ID NO: 638682 - protein, 24 aa, Mycobacterium
ASSEADWDAVIAVHLKGTFAVTRH

SEQ ID NO: 638683 - protein, 26 aa, Mycobacterium
ASSELKGFTAIREWAKKFYPDGLGGS

SEQ ID NO: 638684 - protein, 18 aa, Mycobacterium
ASSFLYRKVVAAMAQRGL

SEQ ID NO: 638685 - protein, 20 aa, Mycobacterium
ASSGFSCQKGIAFADVHNDP

SEQ ID NO: 638686 - protein, 17 aa, Mycobacterium
ASSGLYGATKFAVEAIT

SEQ ID NO: 638687 - protein, 22 aa, Mycobacterium
ASSGRPGAVLVDIPKDVLQGQC

SEQ ID NO: 638688 - protein, 18 aa, Mycobacterium
ASSHIYYLAARDGHTLVG

SEQ ID NO: 638689 - protein, 22 aa, Mycobacterium
ASSLAYKVADRLVFTTIRERFG

SEQ ID NO: 638690 - protein, 30 aa, Mycobacterium
ASSLDQGGPCARTVLDTALLHAVIAGHDAR

SEQ ID NO: 638691 - protein, 31 aa, Mycobacterium
ASSLDQGGPCARTVLDTALLHQVIAGHDPLD

SEQ ID NO: 638692 - protein, 30 aa, Mycobacterium
ASSLKIDRLFAYWELRAMISQLLGSGGDGL

SEQ ID NO: 638693 - protein, 23 aa, Mycobacterium
ASSLLRLGVRKGDRVAILLVNSV

SEQ ID NO: 638694 - protein, 22 aa, Mycobacterium
ASSLPNHWVGIGVGPEDQVAGP

SEQ ID NO: 638695 - protein, 19 aa, Mycobacterium
ASSLRLVVVRELLQMRRPL

SEQ ID NO: 638696 - protein, 24 aa, Mycobacterium
ASSLRTRFGREITHHEIVGDELRI

SEQ ID NO: 638697 - protein, 18 aa, Mycobacterium
ASSMPVNRYRSFDDEVEP

SEQ ID NO: 638698 - protein, 24 aa, Mycobacterium
ASSMSAGDFVRWCRQVLDLADQVR

SEQ ID NO: 638699 - protein, 17 aa, Mycobacterium
ASSMVEMKAFYDAITPR

SEQ ID NO: 638700 - protein, 20 aa, Mycobacterium
ASSNIHRWFGAYGVSKAALD

SEQ ID NO: 638701 - protein, 17 aa, Mycobacterium
ASSPVWSSVALHRPAEF

SEQ ID NO: 638702 - protein, 20 aa, Mycobacterium
ASSRALGELDAWYTERGLPT

SEQ ID NO: 638703 - protein, 20 aa, Mycobacterium
ASSRARDALVVTWSGKRSEL

SEQ ID NO: 638704 - protein, 17 aa, Mycobacterium
ASSRDARGWKTVGDIGY

SEQ ID NO: 638705 - protein, 20 aa, Mycobacterium
ASSRILNWGKGVRMSMLVSA

SEQ ID NO: 638706 - protein, 19 aa, Mycobacterium
ASSRLMAELVPRYLDRDAI

SEQ ID NO: 638707 - protein, 17 aa, Mycobacterium
ASSRRLAIPELPDELFI

SEQ ID NO: 638708 - protein, 21 aa, Mycobacterium
ASSRVLAIWCMDWPAVAAAAA

SEQ ID NO: 638709 - protein, 23 aa, Mycobacterium
ASSSRAGLGYEVIVSRLDDEANI

SEQ ID NO: 638710 - protein, 24 aa, Mycobacterium
ASSSRAGLGYEVIVSRLDEEANIA

SEQ ID NO: 638711 - protein, 25 aa, Mycobacterium
ASSTRRGRPTAHMHFAALHRDRNWL

SEQ ID NO: 638712 - protein, 24 aa, Mycobacterium
ASSTWEGRAVIGGRVSKSAANVLL

SEQ ID NO: 638713 - protein, 24 aa, Mycobacterium
ASSVGRLSVPASWSTAAPAVTADI

SEQ ID NO: 638714 - protein, 19 aa, Mycobacterium
ASSWGSGKDWHVWNGEKVA

SEQ ID NO: 638715 - protein, 29 aa, Mycobacterium
ASTDWRLERRDVLRAFSMLRNQYSVVLVD

SEQ ID NO: 638716 - protein, 29 aa, Mycobacterium
ASTERPEYPPGWARRVFWALMQAGYEAAK

SEQ ID NO: 638717 - protein, 18 aa, Mycobacterium
ASTEWILPELLQYEAALA

SEQ ID NO: 638718 - protein, 18 aa, Mycobacterium
ASTEWKNAVTAARRALAT

SEQ ID NO: 638719 - protein, 23 aa, Mycobacterium
ASTFKRATLRKLGVKHVYDSRTT

SEQ ID NO: 638720 - protein, 23 aa, Mycobacterium
ASTGVDELVAWLGPTVQRYLTDE

SEQ ID NO: 638721 - protein, 25 aa, Mycobacterium
ASTKPDVVKAWDLIVKKQAEFEELR

SEQ ID NO: 638722 - protein, 34 aa, Mycobacterium
ASTLHDCFDWLLRFRWRARAAAWEEGQPMSDTVS

SEQ ID NO: 638723 - protein, 18 aa, Mycobacterium
ASTLLVGRSTVYRALNRQ

SEQ ID NO: 638724 - protein, 18 aa, Mycobacterium
ASTLPALAQGAATAQRAD

SEQ ID NO: 638725 - protein, 17 aa, Mycobacterium
ASTLRLDGLTVVVDCAH

SEQ ID NO: 638726 - protein, 24 aa, Mycobacterium
ASTPLFFAQAIGRFVRSRRAGETA

SEQ ID NO: 638727 - protein, 24 aa, Mycobacterium
ASTPLFFAQAIGRFVRSRRPGETA

SEQ ID NO: 638728 - protein, 23 aa, Mycobacterium
ASTPLFFAQAIGRYVRSRTPGET

SEQ ID NO: 638729 - protein, 24 aa, Mycobacterium
ASTPLFFAQAVGRFVRSRRPGETA

SEQ ID NO: 638730 - protein, 20 aa, Mycobacterium
ASTPRLWLLGSSMYSARLAA

SEQ ID NO: 638731 - protein, 22 aa, Mycobacterium
ASTPRSSLDLGVPAGARDLSTG

SEQ ID NO: 638732 - protein, 21 aa, Mycobacterium
ASTQPPRRWYLVSYLADDGEG

SEQ ID NO: 638733 - protein, 18 aa, Mycobacterium
ASTRRFFVVLADNAVAQL

SEQ ID NO: 638734 - protein, 27 aa, Mycobacterium
ASTSGWNFAECLSLLTSLTSPASAAAS

SEQ ID NO: 638735 - protein, 18 aa, Mycobacterium
ASTVELFDGFRFEIAGSV

SEQ ID NO: 638736 - protein, 32 aa, Mycobacterium
ASTWLEPLIWRGFENLNIPLLDVHMSGDYAHM

SEQ ID NO: 638737 - protein, 18 aa, Mycobacterium
ASTYEWVVEHGDWSYDQP

SEQ ID NO: 638738 - protein, 18 aa, Mycobacterium
ASTYRAESFRDLIDPRGA

SEQ ID NO: 638739 - protein, 19 aa, Mycobacterium
ASVAARRGVAVALPSAGGG

SEQ ID NO: 638740 - protein, 20 aa, Mycobacterium
ASVAARRGVAVALPSAGGSG

SEQ ID NO: 638741 - protein, 26 aa, Mycobacterium
ASVACQEFITQLGRNFQVIYEQANAH

SEQ ID NO: 638742 - protein, 24 aa, Mycobacterium
ASVACRRFWDDADAIVSSRLLYVE

SEQ ID NO: 638743 - protein, 18 aa, Mycobacterium
ASVAFCARTPAAVEQAQA

SEQ ID NO: 638744 - protein, 31 aa, Mycobacterium
ASVAFQAAHARFVEAAARVNTLLDIAQANLG

SEQ ID NO: 638745 - protein, 24 aa, Mycobacterium
ASVAGRIRAAGAIFVGPYAPVSLG

SEQ ID NO: 638746 - protein, 18 aa, Mycobacterium
ASVAKELPELVEVLQRPL

SEQ ID NO: 638747 - protein, 19 aa, Mycobacterium
ASVALAWVRAQRAVSSVII

SEQ ID NO: 638748 - protein, 21 aa, Mycobacterium
ASVATSYVRWLGSAASGAVQT

SEQ ID NO: 638749 - protein, 24 aa, Mycobacterium
ASVCVGGPIFRFSEDDLRGKFARM

SEQ ID NO: 638750 - protein, 20 aa, Mycobacterium
ASVDALKVVDAWQRAERTGH

SEQ ID NO: 638751 - protein, 27 aa, Mycobacterium
ASVDARVRLRLRAEADAVTVFARNLKD

SEQ ID NO: 638752 - protein, 25 aa, Mycobacterium
ASVDFKRFARDGVVAMSSEEALGLL

SEQ ID NO: 638753 - protein, 25 aa, Mycobacterium
ASVDKFESGSGWPSFTRPIDSGNVV

SEQ ID NO: 638754 - protein, 17 aa, Mycobacterium
ASVDLKAALAMHLGSDV

SEQ ID NO: 638755 - protein, 22 aa, Mycobacterium
ASVDLKAALAMHLGSDVAPEHI

SEQ ID NO: 638756 - protein, 24 aa, Mycobacterium
ASVDLRLSNQFIVFEQTSNASFNA

SEQ ID NO: 638757 - protein, 17 aa, Mycobacterium
ASVDLVSVLGRMISRGF

SEQ ID NO: 638758 - protein, 17 aa, Mycobacterium
ASVDYWGEIASRHGLAL

SEQ ID NO: 638759 - protein, 19 aa, Mycobacterium
ASVEAAAPDDRWQGSGANA

SEQ ID NO: 638760 - protein, 18 aa, Mycobacterium
ASVEALAAATSWQQALGA

SEQ ID NO: 638761 - protein, 24 aa, Mycobacterium
ASVEVPVPFAGTIVELHGDPGAAM

SEQ ID NO: 638762 - protein, 18 aa, Mycobacterium
ASVFRLVAEEALKLTSAD

SEQ ID NO: 638763 - protein, 18 aa, Mycobacterium
ASVGECLAVAGQIRGTGA

SEQ ID NO: 638764 - protein, 17 aa, Mycobacterium
ASVGGLSVPASWANTVG

SEQ ID NO: 638765 - protein, 25 aa, Mycobacterium
ASVGKLSVPQSWSASPGIRLAATAL

SEQ ID NO: 638766 - protein, 26 aa, Mycobacterium
ASVGRLTLAGAHLWNSRPYGAAGELL

SEQ ID NO: 638767 - protein, 26 aa, Mycobacterium
ASVHAFNLWLDEDWGFNRPDGRILSA

SEQ ID NO: 638768 - protein, 19 aa, Mycobacterium
ASVIMEFANEFGLNMPIAR

SEQ ID NO: 638769 - protein, 19 aa, Mycobacterium
ASVIMEFANEFGLPMPIAR

SEQ ID NO: 638770 - protein, 19 aa, Mycobacterium
ASVIMEFANEFGLTMPIAR

SEQ ID NO: 638771 - protein, 18 aa, Mycobacterium
ASVIRFMDGLGISSAAVV

SEQ ID NO: 638772 - protein, 25 aa, Mycobacterium
ASVISELTHALWVGPASASMLSAVM

SEQ ID NO: 638773 - protein, 23 aa, Mycobacterium
ASVKDRWLLRNRPHLVLDGLRLA

SEQ ID NO: 638774 - protein, 24 aa, Mycobacterium
ASVKGTGVGGRIRKQDVLAAAEKS

SEQ ID NO: 638775 - protein, 24 aa, Mycobacterium
ASVLARCSYLRDGVAVRDMGVVLD

SEQ ID NO: 638776 - protein, 23 aa, Mycobacterium
ASVLIRPGYEWPGHKPGQYVRLG

SEQ ID NO: 638777 - protein, 23 aa, Mycobacterium
ASVLIRPGYEWPGHQPGQYVRLG

SEQ ID NO: 638778 - protein, 19 aa, Mycobacterium
ASVLRPTVNNMLRVGARQF

SEQ ID NO: 638779 - protein, 24 aa, Mycobacterium
ASVLWRAAACCRFNSAIHAHVSSE

SEQ ID NO: 638780 - protein, 17 aa, Mycobacterium
ASVMAAVFAENGATEVF

SEQ ID NO: 638781 - protein, 17 aa, Mycobacterium
ASVMGFVVRGGRIRAID

SEQ ID NO: 638782 - protein, 27 aa, Mycobacterium
ASVNGRTVWGVGIAPSITTASLRAVVS

SEQ ID NO: 638783 - protein, 17 aa, Mycobacterium
ASVPADWQDLPDRRVDA

SEQ ID NO: 638784 - protein, 23 aa, Mycobacterium
ASVPEILVRGVLDRLAEHGFDTV

SEQ ID NO: 638785 - protein, 23 aa, Mycobacterium
ASVPEILVRGVLERLAEHGYDTV

SEQ ID NO: 638786 - protein, 18 aa, Mycobacterium
ASVPGALIGVWKPGEAPY

SEQ ID NO: 638787 - protein, 23 aa, Mycobacterium
ASVPGAPVLPCRNPQAVPPGEDV

SEQ ID NO: 638788 - protein, 19 aa, Mycobacterium
ASVPPPLVAANRAETQQLI

SEQ ID NO: 638789 - protein, 17 aa, Mycobacterium
ASVPPSLIRRASTCFEK

SEQ ID NO: 638790 - protein, 17 aa, Mycobacterium
ASVPVLVHPAPRSVLGG

SEQ ID NO: 638791 - protein, 24 aa, Mycobacterium
ASVQAGTAATVFEDALAAIVHPAV

SEQ ID NO: 638792 - protein, 29 aa, Mycobacterium
ASVQRIAKRAGLSYGALFRHFPTVGDFMA

SEQ ID NO: 638793 - protein, 18 aa, Mycobacterium
ASVQWTLQMLLDLFEVEP

SEQ ID NO: 638794 - protein, 20 aa, Mycobacterium
ASVRARLRHLLQRTGHTELA

SEQ ID NO: 638795 - protein, 20 aa, Mycobacterium
ASVREIERWAGHPFMAQILI

SEQ ID NO: 638796 - protein, 21 aa, Mycobacterium
ASVRELRECVGRRLATEAEQL

SEQ ID NO: 638797 - protein, 19 aa, Mycobacterium
ASVRLARLAKSAGVRRFLY

SEQ ID NO: 638798 - protein, 17 aa, Mycobacterium
ASVRPIVRYLFDRPMLP

SEQ ID NO: 638799 - protein, 24 aa, Mycobacterium
ASVRRWPRRGVRCRIEVAVGAPVE

SEQ ID NO: 638800 - protein, 23 aa, Mycobacterium
ASVSARAAFEMADLSPSDVQVAE

SEQ ID NO: 638801 - protein, 29 aa, Mycobacterium
ASVSCAIQNLWLAARAEGLGMGWVSLFDP

SEQ ID NO: 638802 - protein, 31 aa, Mycobacterium
ASVSCAIQNLWLAARAEGLGMGWVSLFDPHR

SEQ ID NO: 638803 - protein, 24 aa, Mycobacterium
ASVSCAIQNLWLAARSEGLGMGWV

SEQ ID NO: 638804 - protein, 25 aa, Mycobacterium
ASVSCAIQNLWLAARSEGLGMGWVS

SEQ ID NO: 638805 - protein, 25 aa, Mycobacterium
ASVSCAIQNMWLAARAEGLGMGWVS

SEQ ID NO: 638806 - protein, 20 aa, Mycobacterium
ASVSDEIFCEVFLDDVEVPF

SEQ ID NO: 638807 - protein, 17 aa, Mycobacterium
ASVSLPVALVVDGANVT

SEQ ID NO: 638808 - protein, 17 aa, Mycobacterium
ASVSPSLIRRAAGYFDR

SEQ ID NO: 638809 - protein, 25 aa, Mycobacterium
ASVSRFLPLLAERFARQRLRALARV

SEQ ID NO: 638810 - protein, 17 aa, Mycobacterium
ASVTFPWYQLGRQVHIR

SEQ ID NO: 638811 - protein, 17 aa, Mycobacterium
ASVTGLSVPTSWMNSVG

SEQ ID NO: 638812 - protein, 24 aa, Mycobacterium
ASVTRFAMELGFRGYPEMRAELGN

SEQ ID NO: 638813 - protein, 19 aa, Mycobacterium
ASVTSGLAGQAWQGPAAAA

SEQ ID NO: 638814 - protein, 18 aa, Mycobacterium
ASVTSGLVGGAWQGASSV

SEQ ID NO: 638815 - protein, 18 aa, Mycobacterium
ASVWEVPCDIAIPCATQN

SEQ ID NO: 638816 - protein, 19 aa, Mycobacterium
ASVYPFVWNILLSARNEGF

SEQ ID NO: 638817 - protein, 25 aa, Mycobacterium
ASWAVFQFVGRRGESRFIARRELLS

SEQ ID NO: 638818 - protein, 25 aa, Mycobacterium
ASWDRPSDLEGWSLRDLVGHVTGSA

SEQ ID NO: 638819 - protein, 20 aa, Mycobacterium
ASWERYDRFFKMCYNVLPDD

SEQ ID NO: 638820 - protein, 17 aa, Mycobacterium
ASWGDGWYGFNLDGVAA

SEQ ID NO: 638821 - protein, 20 aa, Mycobacterium
ASWGDLAMMLSVPYQGLGNA

SEQ ID NO: 638822 - protein, 25 aa, Mycobacterium
ASWTIKAGHVAGVFASWQGIYQGRT

SEQ ID NO: 638823 - protein, 21 aa, Mycobacterium
ASWTTCRDADGGLLPYTYRVS

SEQ ID NO: 638824 - protein, 21 aa, Mycobacterium
ASWTTCRNGDGGLLPYTYRVS

SEQ ID NO: 638825 - protein, 20 aa, Mycobacterium
ASYDASLRVSWRQLQPTDPA

SEQ ID NO: 638826 - protein, 24 aa, Mycobacterium
ASYDASLRVSWRQLQPVDPRTLPP

SEQ ID NO: 638827 - protein, 23 aa, Mycobacterium
ASYFDSATSFAMIRGGHVDVAVL

SEQ ID NO: 638828 - protein, 20 aa, Mycobacterium
ASYGTLWIKSPANMLGYWGS

SEQ ID NO: 638829 - protein, 19 aa, Mycobacterium
ASYGVRPGAVIGHSMGEVA

SEQ ID NO: 638830 - protein, 23 aa, Mycobacterium
ASYNDIAAWSWTAVPSALGVTDH

SEQ ID NO: 638831 - protein, 25 aa, Mycobacterium
ASYPADRLLFLPADLSTLGFTAWGT

SEQ ID NO: 638832 - protein, 17 aa, Mycobacterium
ASYPLGHGHGPVSPLFR

SEQ ID NO: 638833 - protein, 19 aa, Mycobacterium
ASYRLADLVGKSVAKQVIL

SEQ ID NO: 638834 - protein, 22 aa, Mycobacterium
ASYSTYFLAHWARDRKSGRFTV

SEQ ID NO: 638835 - protein, 17 aa, Mycobacterium
ATAAAWLVSAPPSVVVG

SEQ ID NO: 638836 - protein, 18 aa, Mycobacterium
ATAACKRPTEPVAEGIDV

SEQ ID NO: 638837 - protein, 19 aa, Mycobacterium
ATAAFFAKNMLPRLVSLRK

SEQ ID NO: 638838 - protein, 21 aa, Mycobacterium
ATAALEIGGQYSIEDGAGGSG

SEQ ID NO: 638839 - protein, 25 aa, Mycobacterium
ATAAPAYRPVALALPASAAGLATNV

SEQ ID NO: 638840 - protein, 24 aa, Mycobacterium
ATAAPGMGGHGGAGGTSYQLGGAA

SEQ ID NO: 638841 - protein, 20 aa, Mycobacterium
ATAARLVLERTILDAQAAGD

SEQ ID NO: 638842 - protein, 18 aa, Mycobacterium
ATAASAFDEAFAMTVPPS

SEQ ID NO: 638843 - protein, 24 aa, Mycobacterium
ATAATRLQVWLTRSSADTFTLYAS

SEQ ID NO: 638844 - protein, 27 aa, Mycobacterium
ATAAVCLPHDWLGWRLTGSNDLADLRT

SEQ ID NO: 638845 - protein, 18 aa, Mycobacterium
ATADALKVVGAWTQTDTQ

SEQ ID NO: 638846 - protein, 24 aa, Mycobacterium
ATADFPILVAHGMSCVLHCNGARF

SEQ ID NO: 638847 - protein, 19 aa, Mycobacterium
ATADLRPKIGRARPLAERS

SEQ ID NO: 638848 - protein, 26 aa, Mycobacterium
ATADLYPRYVCDYGTPAHASSAADYY

SEQ ID NO: 638849 - protein, 22 aa, Mycobacterium
ATADPGCRWADAVPNADQPPLR

SEQ ID NO: 638850 - protein, 25 aa, Mycobacterium
ATADPRYAPPPLLRQMVAAGRLGNK

SEQ ID NO: 638851 - protein, 26 aa, Mycobacterium
ATADSWSYRAAHAGHTYILAAAIGDQ

SEQ ID NO: 638852 - protein, 25 aa, Mycobacterium
ATADTRAGAAISHVATTFGVPAEHA

SEQ ID NO: 638853 - protein, 23 aa, Mycobacterium
ATAEAFAGGWFHSGDLVRMDEDG

SEQ ID NO: 638854 - protein, 22 aa, Mycobacterium
ATAEALAAVVLRGLDCGAFSAD

SEQ ID NO: 638855 - protein, 17 aa, Mycobacterium
ATAEALATVVLRGLDCG

SEQ ID NO: 638856 - protein, 25 aa, Mycobacterium
ATAEALKPWYGYFCKRPCFHDEYLQ

SEQ ID NO: 638857 - protein, 22 aa, Mycobacterium
ATAEAVIDCRVLPGRLADFERE

SEQ ID NO: 638858 - protein, 21 aa, Mycobacterium
ATAEAVIDCRVLPGRLEAFER

SEQ ID NO: 638859 - protein, 22 aa, Mycobacterium
ATAEAVVDCRVLPGRQAAFEAE

SEQ ID NO: 638860 - protein, 23 aa, Mycobacterium
ATAEFAWGLLIATVRNLAEEHRQ

SEQ ID NO: 638861 - protein, 21 aa, Mycobacterium
ATAEICPLPLAAYQVSGEYSM

SEQ ID NO: 638862 - protein, 17 aa, Mycobacterium
ATAEIVFKGRNVEIPDH

SEQ ID NO: 638863 - protein, 19 aa, Mycobacterium
ATAELGWEHNIVALAARYR

SEQ ID NO: 638864 - protein, 22 aa, Mycobacterium
ATAELLAERGAHVAVLDRENSD

SEQ ID NO: 638865 - protein, 19 aa, Mycobacterium
ATAEPVAALILGELRTAVA

SEQ ID NO: 638866 - protein, 19 aa, Mycobacterium
ATAEVLEWEILRDICDADA

SEQ ID NO: 638867 - protein, 20 aa, Mycobacterium
ATAFIYIGEICRYLLNQPAK

SEQ ID NO: 638868 - protein, 20 aa, Mycobacterium
ATAFIYIGEICRYLLNQPRK

SEQ ID NO: 638869 - protein, 25 aa, Mycobacterium
ATAFIYIGEVCRYLLNQPAKPTDRA

SEQ ID NO: 638870 - protein, 24 aa, Mycobacterium
ATAFIYIGEVCRYLLNQPTKPTDR

SEQ ID NO: 638871 - protein, 17 aa, Mycobacterium
ATAGLAIIETGAGSDDD

SEQ ID NO: 638872 - protein, 19 aa, Mycobacterium
ATAGLKGVERLDAALRFIV

SEQ ID NO: 638873 - protein, 17 aa, Mycobacterium
ATAGLRPRPEISLTTNG

SEQ ID NO: 638874 - protein, 26 aa, Mycobacterium
ATAGVPLVRIVSCSPLEITAAQVPPP

SEQ ID NO: 638875 - protein, 22 aa, Mycobacterium
ATAGWKGYGDFQHTAEEAARMN

SEQ ID NO: 638876 - protein, 23 aa, Mycobacterium
ATAHAAWRGAPAVEEQDVRVAAE

SEQ ID NO: 638877 - protein, 25 aa, Mycobacterium
ATAHAKFTGEIGCCLATSGGGAIHL

SEQ ID NO: 638878 - protein, 18 aa, Mycobacterium
ATAHELYHPMPLRGKNLD

SEQ ID NO: 638879 - protein, 18 aa, Mycobacterium
ATAHELYHPQPLRGKKLD

SEQ ID NO: 638880 - protein, 25 aa, Mycobacterium
ATAHTEFDTGLSLEAVCDLEPYWEA

SEQ ID NO: 638881 - protein, 17 aa, Mycobacterium
ATAIAFDEASWRGAELV

SEQ ID NO: 638882 - protein, 18 aa, Mycobacterium
ATAIMGFVVRDGLVVSIN

SEQ ID NO: 638883 - protein, 23 aa, Mycobacterium
ATAKTGAEYPVFPEYGDDVYYAV

SEQ ID NO: 638884 - protein, 18 aa, Mycobacterium
ATAKVWGLYMAGSRLGFE

SEQ ID NO: 638885 - protein, 26 aa, Mycobacterium
ATALAPVRFFNPLSMRFARKATADDI

SEQ ID NO: 638886 - protein, 22 aa, Mycobacterium
ATALARYMSRSDFSALRSLVAE

SEQ ID NO: 638887 - protein, 25 aa, Mycobacterium
ATALFDRPAFRTCVSHGIVLGNDGQ

SEQ ID NO: 638888 - protein, 27 aa, Mycobacterium
ATALGMFAGLEVGVWEMTEGVMTDTEA

SEQ ID NO: 638889 - protein, 17 aa, Mycobacterium
ATALLGVGVGGAGSIGG

SEQ ID NO: 638890 - protein, 31 aa, Mycobacterium
ATALLYHAAFAPRVAEILPDLPQLRVLIQIA

SEQ ID NO: 638891 - protein, 22 aa, Mycobacterium
ATALRQMADWLGLDDVVVAERG

SEQ ID NO: 638892 - protein, 18 aa, Mycobacterium
ATALSWGLVNEVLSDDEL

SEQ ID NO: 638893 - protein, 24 aa, Mycobacterium
ATALYRRWESLWDRLIAACQPDAG

SEQ ID NO: 638894 - protein, 19 aa, Mycobacterium
ATAPIWGAVARRFVDAHYG

SEQ ID NO: 638895 - protein, 18 aa, Mycobacterium
ATAPIWGAVARRYVNAQL

SEQ ID NO: 638896 - protein, 29 aa, Mycobacterium
ATAPRLLLEVICARLLLPSASDAESALLQ

SEQ ID NO: 638897 - protein, 29 aa, Mycobacterium
ATAPRLLLEVVCARLLLPSASDAESALLQ

SEQ ID NO: 638898 - protein, 23 aa, Mycobacterium
ATAPVRIGIAIADAGLGIAGETL

SEQ ID NO: 638899 - protein, 27 aa, Mycobacterium
ATAQAYRAIAEFVPRIGNLIDVVHRHH

SEQ ID NO: 638900 - protein, 32 aa, Mycobacterium
ATAQAYRAVAEFVPRIGTLIDIVHRHHLTSAR

SEQ ID NO: 638901 - protein, 28 aa, Mycobacterium
ATAQAYRAVAEFVPRISALIDVVHRHHL

SEQ ID NO: 638902 - protein, 23 aa, Mycobacterium
ATARAGVVLVPVNFMLTAEEICY

SEQ ID NO: 638903 - protein, 25 aa, Mycobacterium
ATARALAGVIHRGSVCGALTVDEIE

SEQ ID NO: 638904 - protein, 30 aa, Mycobacterium
ATARASSPWRSYVSMHLWRKGIAALPRQLT

SEQ ID NO: 638905 - protein, 24 aa, Mycobacterium
ATARFLLAAWAGVLTMEAGSGDQA

SEQ ID NO: 638906 - protein, 22 aa, Mycobacterium
ATARITAVLDWEMATVGDPLAD

SEQ ID NO: 638907 - protein, 26 aa, Mycobacterium
ATARLCREEIFGPVAVVAPFDTEADG

SEQ ID NO: 638908 - protein, 20 aa, Mycobacterium
ATARLYLCTDARRERGDLAE

SEQ ID NO: 638909 - protein, 26 aa, Mycobacterium
ATARQVRLPRRWSIATGLPSGAEKRL

SEQ ID NO: 638910 - protein, 17 aa, Mycobacterium
ATARREIDRVLSEVREQ

SEQ ID NO: 638911 - protein, 23 aa, Mycobacterium
ATARRFEALSALSAGVKDVRAVI

SEQ ID NO: 638912 - protein, 22 aa, Mycobacterium
ATARRLAQIGARVSDDGDTLTV

SEQ ID NO: 638913 - protein, 24 aa, Mycobacterium
ATARRLASSYGHWVYSIRAGGGAA

SEQ ID NO: 638914 - protein, 24 aa, Mycobacterium
ATARRLGALLVERGIIADSEDVFH

SEQ ID NO: 638915 - protein, 23 aa, Mycobacterium
ATARRRAHILLNHLAQALTDSPV

SEQ ID NO: 638916 - protein, 18 aa, Mycobacterium
ATARWTRYLGTVSGPLML

SEQ ID NO: 638917 - protein, 20 aa, Mycobacterium
ATASGGFDWSLRRATADNGE

SEQ ID NO: 638918 - protein, 18 aa, Mycobacterium
ATASMLEPIWQVMPASRA

SEQ ID NO: 638919 - protein, 19 aa, Mycobacterium
ATASMLEPIWQVMPPSKAE

SEQ ID NO: 638920 - protein, 21 aa, Mycobacterium
ATASMLEPIWQVMPPSKAEGV

SEQ ID NO: 638921 - protein, 18 aa, Mycobacterium
ATASMLEPIWQVMPQSRA

SEQ ID NO: 638922 - protein, 18 aa, Mycobacterium
ATASRTVDLHWQRVQVLR

SEQ ID NO: 638923 - protein, 26 aa, Mycobacterium
ATASTFKRATLRKLGVKYVYDSRTTD

SEQ ID NO: 638924 - protein, 27 aa, Mycobacterium
ATATECVLCECCAELFDGTAPGIDEDF

SEQ ID NO: 638925 - protein, 24 aa, Mycobacterium
ATAVACAALGRPVNGVTEIAGPEV

SEQ ID NO: 638926 - protein, 21 aa, Mycobacterium
ATAVGRLSVPQTWATTNPAAV

SEQ ID NO: 638927 - protein, 17 aa, Mycobacterium
ATAVLGNGGDVDMPIAY

SEQ ID NO: 638928 - protein, 17 aa, Mycobacterium
ATAVLSMPMHRFRNPCT

SEQ ID NO: 638929 - protein, 19 aa, Mycobacterium
ATAVPRYFHSSSFRQEWVD

SEQ ID NO: 638930 - protein, 20 aa, Mycobacterium
ATAVSGHTAGAGGTGGTGGT

SEQ ID NO: 638931 - protein, 24 aa, Mycobacterium
ATAVWSLEWHTVAPALAVCGGAVR

SEQ ID NO: 638932 - protein, 22 aa, Mycobacterium
ATAWDGIVMVCPPRSVDESLPD

SEQ ID NO: 638933 - protein, 25 aa, Mycobacterium
ATAYAANAAEGWAMATASVRDLFAE

SEQ ID NO: 638934 - protein, 20 aa, Mycobacterium
ATAYCASKFGVVGFTRALAA

SEQ ID NO: 638935 - protein, 19 aa, Mycobacterium
ATAYLATRANLAIPNDAAS

SEQ ID NO: 638936 - protein, 26 aa, Mycobacterium
ATAYLECAQACGLALLGGPPTPETAM

SEQ ID NO: 638937 - protein, 17 aa, Mycobacterium
ATCDVFLTSYLPTRRKK

SEQ ID NO: 638938 - protein, 26 aa, Mycobacterium
ATCEYHGLHAFRWVAADGSARFVRYH

SEQ ID NO: 638939 - protein, 18 aa, Mycobacterium
ATCFPSYALRRHAKVTGG

SEQ ID NO: 638940 - protein, 32 aa, Mycobacterium
ATCGGKWFRRFGGVNPRWLAPQGQKRPRLSAD

SEQ ID NO: 638941 - protein, 23 aa, Mycobacterium
ATCGGVRVWSLYVPNGRALGDPH

SEQ ID NO: 638942 - protein, 23 aa, Mycobacterium
ATCGIPMQAEMGGKNAAVVLDDA

SEQ ID NO: 638943 - protein, 17 aa, Mycobacterium
ATCGLRRADMATAAHDV

SEQ ID NO: 638944 - protein, 21 aa, Mycobacterium
ATCNIEHGCVVAEADHLHGAE

SEQ ID NO: 638945 - protein, 19 aa, Mycobacterium
ATCPSRFQAVGDAYRDFHQ

SEQ ID NO: 638946 - protein, 19 aa, Mycobacterium
ATCQTGGKVLADRRMSRLL

SEQ ID NO: 638947 - protein, 20 aa, Mycobacterium
ATCRTIRLALLEADVALPVV

SEQ ID NO: 638948 - protein, 18 aa, Mycobacterium
ATCYRPRNGRTWPPTAWS

SEQ ID NO: 638949 - protein, 22 aa, Mycobacterium
ATDAEYDRFVWVAGGDQPWMTG

SEQ ID NO: 638950 - protein, 17 aa, Mycobacterium
ATDAGYLRRFYPPGDDE

SEQ ID NO: 638951 - protein, 27 aa, Mycobacterium
ATDALHPGLALRSGPAYTTITATTAGS

SEQ ID NO: 638952 - protein, 18 aa, Mycobacterium
ATDALTLSEVVRFKSPAE

SEQ ID NO: 638953 - protein, 20 aa, Mycobacterium
ATDAVFWEPFLDRGFSPDSG

SEQ ID NO: 638954 - protein, 27 aa, Mycobacterium
ATDDLDFLRLAVLDALLVLRADAEPVP

SEQ ID NO: 638955 - protein, 24 aa, Mycobacterium
ATDDPRPVMLWAYDPLAFNGEGKA

SEQ ID NO: 638956 - protein, 26 aa, Mycobacterium
ATDELDFLRLAVLDALLVLQADSMPV

SEQ ID NO: 638957 - protein, 31 aa, Mycobacterium
ATDEQKKWAEFVAERGWGATMVLTEPDAGSD

SEQ ID NO: 638958 - protein, 28 aa, Mycobacterium
ATDEVSTRIAALFGAHGLEYQAVVAEAA

SEQ ID NO: 638959 - protein, 26 aa, Mycobacterium
ATDFECCLRLGGAEVRDDEVFETLLA

SEQ ID NO: 638960 - protein, 24 aa, Mycobacterium
ATDFSRPLARVVLAAAPALSLGEL

SEQ ID NO: 638961 - protein, 24 aa, Mycobacterium
ATDFSRPLARVVLSSAPATVLSET

SEQ ID NO: 638962 - protein, 19 aa, Mycobacterium
ATDGGKEITARYCVMAVGG

SEQ ID NO: 638963 - protein, 21 aa, Mycobacterium
ATDGLCAMGLRFSEDKLSPGE

SEQ ID NO: 638964 - protein, 26 aa, Mycobacterium
ATDGLDFLRLAVLDALLVLHADTAAV

SEQ ID NO: 638965 - protein, 19 aa, Mycobacterium
ATDGLRGSLDLMPGSLEKM

SEQ ID NO: 638966 - protein, 22 aa, Mycobacterium
ATDGRIGHRIPLPGVAPSLLLH

SEQ ID NO: 638967 - protein, 23 aa, Mycobacterium
ATDGRTAAAFALACDQAGVPLQR

SEQ ID NO: 638968 - protein, 24 aa, Mycobacterium
ATDGRTAAAFALACRQAGVPLQRY

SEQ ID NO: 638969 - protein, 26 aa, Mycobacterium
ATDHRPEILLSFGFVPKVEARVGLIN

SEQ ID NO: 638970 - protein, 27 aa, Mycobacterium
ATDIAEWLVRQGVPFRIAHEAAGAAVK

SEQ ID NO: 638971 - protein, 26 aa, Mycobacterium
ATDIAEWLVRQGVPFRSAHEAAGAAV

SEQ ID NO: 638972 - protein, 26 aa, Mycobacterium
ATDIAEWLVRRGVPFRSAHEAAGAAV

SEQ ID NO: 638973 - protein, 18 aa, Mycobacterium
ATDLADWSPVRGRATLTV

SEQ ID NO: 638974 - protein, 27 aa, Mycobacterium
ATDLAEWMVRQGIPFRVAHEAAGEAVR

SEQ ID NO: 638975 - protein, 20 aa, Mycobacterium
ATDLAIFYGRNNLLINGDAG

SEQ ID NO: 638976 - protein, 19 aa, Mycobacterium
ATDLCEFMEFPSGTLQVCG

SEQ ID NO: 638977 - protein, 19 aa, Mycobacterium
ATDLCEFMEFPSRVLQVCG

SEQ ID NO: 638978 - protein, 18 aa, Mycobacterium
ATDLLAMTSLGPLRLRNV

SEQ ID NO: 638979 - protein, 21 aa, Mycobacterium
ATDLLRWADEHFGGINGPRGW

SEQ ID NO: 638980 - protein, 18 aa, Mycobacterium
ATDLPRWRQFAFGVLGFA

SEQ ID NO: 638981 - protein, 21 aa, Mycobacterium
ATDLRAVVSAIRIAADAQRMG

SEQ ID NO: 638982 - protein, 24 aa, Mycobacterium
ATDNLRLVGLHSHIGSQIFDVAGF

SEQ ID NO: 638983 - protein, 28 aa, Mycobacterium
ATDRAMVAACPLTFPWNVLGWPSINVPA

SEQ ID NO: 638984 - protein, 17 aa, Mycobacterium
ATDRAQQALAFRLATSW

SEQ ID NO: 638985 - protein, 21 aa, Mycobacterium
ATDRKGFCVGCGYYHAVHNTH

SEQ ID NO: 638986 - protein, 27 aa, Mycobacterium
ATDRLDAFGSCRLCLVEIDGRRGTPAS

SEQ ID NO: 638987 - protein, 22 aa, Mycobacterium
ATDRPGLHHLAFLVDDIDAVRA

SEQ ID NO: 638988 - protein, 20 aa, Mycobacterium
ATDRRYLTTLGIGPYTPTGV

SEQ ID NO: 638989 - protein, 23 aa, Mycobacterium
ATDSRFDEVLARVCADDPMTTRL

SEQ ID NO: 638990 - protein, 17 aa, Mycobacterium
ATDTCAGVVVLLRHDSS

SEQ ID NO: 638991 - protein, 26 aa, Mycobacterium
ATDVGFRMPSVWLAEGHAHAAPVYLY

SEQ ID NO: 638992 - protein, 26 aa, Mycobacterium
ATDVGFRMPSVWLAEGHSAVAPVYLY

SEQ ID NO: 638993 - protein, 26 aa, Mycobacterium
ATDVGFRMPSVWLAEGHSRVAPVYLY

SEQ ID NO: 638994 - protein, 21 aa, Mycobacterium
ATDVRCLRMTVYIACAPSFHE

SEQ ID NO: 638995 - protein, 25 aa, Mycobacterium
ATDWPERDRAIILTALLAGLRAAEL

SEQ ID NO: 638996 - protein, 23 aa, Mycobacterium
ATDYPRLPVMGSEDAIGCVNAES

SEQ ID NO: 638997 - protein, 18 aa, Mycobacterium
ATEAEYAQMWAQDAAAMY

SEQ ID NO: 638998 - protein, 18 aa, Mycobacterium
ATEAFTLGLVNRVVSAAD

SEQ ID NO: 638999 - protein, 18 aa, Mycobacterium
ATEAHYAEMWAQDAAAMY

SEQ ID NO: 639000 - protein, 17 aa, Mycobacterium
ATEAHYATMWAQDAAAM

SEQ ID NO: 639001 - protein, 26 aa, Mycobacterium
ATEAIAHGIGVIGLLNVQYALKDDVL

SEQ ID NO: 639002 - protein, 23 aa, Mycobacterium
ATEALKAVAAFRLALPRTMLRFA

SEQ ID NO: 639003 - protein, 24 aa, Mycobacterium
ATEALKWLLANAGRLRNERITPLA

SEQ ID NO: 639004 - protein, 21 aa, Mycobacterium
ATEALNLVSYVLGDKRFDRAV

SEQ ID NO: 639005 - protein, 20 aa, Mycobacterium
ATEALNLVSYVLGDNRFERA

SEQ ID NO: 639006 - protein, 25 aa, Mycobacterium
ATEALRWAMMRGEPLVVLADALAEA

SEQ ID NO: 639007 - protein, 18 aa, Mycobacterium
ATEAQYGEMWAQDAATMY

SEQ ID NO: 639008 - protein, 25 aa, Mycobacterium
ATEARRVALPNIVRLLPVARAAGVR

SEQ ID NO: 639009 - protein, 21 aa, Mycobacterium
ATEARWTEDQPAWSYAGLALR

SEQ ID NO: 639010 - protein, 22 aa, Mycobacterium
ATEATRIVAWFRHGAAPRVTAN

SEQ ID NO: 639011 - protein, 18 aa, Mycobacterium
ATEAVLIRAAEAGLDPIV

SEQ ID NO: 639012 - protein, 18 aa, Mycobacterium
ATEAVRWADDLTVGVLAR

SEQ ID NO: 639013 - protein, 21 aa, Mycobacterium
ATECPAGVVGEIWVHGDNVAA

SEQ ID NO: 639014 - protein, 20 aa, Mycobacterium
ATEDAWRRVFAFFGEHLAAG

SEQ ID NO: 639015 - protein, 19 aa, Mycobacterium
ATEDAWRRVFAFFGEHLGS

SEQ ID NO: 639016 - protein, 19 aa, Mycobacterium
ATEEFLRFFTPAPGDGRTF

SEQ ID NO: 639017 - protein, 21 aa, Mycobacterium
ATEEMIRWVTPVKAFMRTAAT

SEQ ID NO: 639018 - protein, 24 aa, Mycobacterium
ATEFKSNGNGAVFDEAVQSGVSLD

SEQ ID NO: 639019 - protein, 17 aa, Mycobacterium
ATEFMVYHAALAVVLHK

SEQ ID NO: 639020 - protein, 23 aa, Mycobacterium
ATEGRTAAAFALACQQAGVNLQR

SEQ ID NO: 639021 - protein, 17 aa, Mycobacterium
ATEKVLGLFGLDAAEAH

SEQ ID NO: 639022 - protein, 18 aa, Mycobacterium
ATELAGIGSALGQATAGA

SEQ ID NO: 639023 - protein, 23 aa, Mycobacterium
ATELEYAEMWAQDAAAMYGYAAS

SEQ ID NO: 639024 - protein, 21 aa, Mycobacterium
ATELFPLLLSVMSTGVTFVRS

SEQ ID NO: 639025 - protein, 19 aa, Mycobacterium
ATELLAVFDVYRTRLGRLL

SEQ ID NO: 639026 - protein, 17 aa, Mycobacterium
ATELLGWAGWDHAQQAL

SEQ ID NO: 639027 - protein, 25 aa, Mycobacterium
ATENYGGAVGLNWYSTDPTLQFTMA

SEQ ID NO: 639028 - protein, 20 aa, Mycobacterium
ATENYLRWISEADRTEPRPD

SEQ ID NO: 639029 - protein, 24 aa, Mycobacterium
ATEPALDVLAGWLASRIDGPVRRA

SEQ ID NO: 639030 - protein, 25 aa, Mycobacterium
ATEPALDVTAGWLASRIDGPVTRVV

SEQ ID NO: 639031 - protein, 32 aa, Mycobacterium
ATEPELRSALAWLCNAVSRFGRNPSAPHVREV

SEQ ID NO: 639032 - protein, 17 aa, Mycobacterium
ATEPERYAKRLASTMAE

SEQ ID NO: 639033 - protein, 23 aa, Mycobacterium
ATEPLAVPIVMRAVPAVLFLMGK

SEQ ID NO: 639034 - protein, 17 aa, Mycobacterium
ATEPLPVMVFIHGGGYI

SEQ ID NO: 639035 - protein, 26 aa, Mycobacterium
ATEQLDFLRLAVLDALLVLLADTEPV

SEQ ID NO: 639036 - protein, 30 aa, Mycobacterium
ATERARCLVVALAACAAAGTVRRGAEAAVD

SEQ ID NO: 639037 - protein, 19 aa, Mycobacterium
ATERPRGVFSRQLVLGENL

SEQ ID NO: 639038 - protein, 22 aa, Mycobacterium
ATERPWLVHFADTWNHQDREVT

SEQ ID NO: 639039 - protein, 19 aa, Mycobacterium
ATESIAHGIGVVGLLNVQY

SEQ ID NO: 639040 - protein, 19 aa, Mycobacterium
ATESLNLVSYVLGDSRFDR

SEQ ID NO: 639041 - protein, 25 aa, Mycobacterium
ATETEFGWRPTTTLSDGLRRTLACA

SEQ ID NO: 639042 - protein, 17 aa, Mycobacterium
ATEVRFFASARSAGKKL

SEQ ID NO: 639043 - protein, 19 aa, Mycobacterium
ATEVRPRMCDGGIGKKTLV

SEQ ID NO: 639044 - protein, 23 aa, Mycobacterium
ATFADLQIHPSVMRAIADVGYES

SEQ ID NO: 639045 - protein, 17 aa, Mycobacterium
ATFAEFFSDASLNPDAS

SEQ ID NO: 639046 - protein, 18 aa, Mycobacterium
ATFAHEFGAALSVADQVV

SEQ ID NO: 639047 - protein, 34 aa, Mycobacterium
ATFAPRVAEVLPELPRLRVLIQIADDSGNGLLDG

SEQ ID NO: 639048 - protein, 17 aa, Mycobacterium
ATFDGEWTEPTVLPAQW

SEQ ID NO: 639049 - protein, 24 aa, Mycobacterium
ATFDLYSCFPVPVFNICDGLGIAT

SEQ ID NO: 639050 - protein, 18 aa, Mycobacterium
ATFDRRALGPSAFDTIIE

SEQ ID NO: 639051 - protein, 19 aa, Mycobacterium
ATFERPVLLFSGGKDSVVM

SEQ ID NO: 639052 - protein, 29 aa, Mycobacterium
ATFILATGRPPRWVRPVVEELGFTPMAVC

SEQ ID NO: 639053 - protein, 24 aa, Mycobacterium
ATFLEEFLETLTAGARAYASAEAA

SEQ ID NO: 639054 - protein, 17 aa, Mycobacterium
ATFLKWAPMLYSLAYQA

SEQ ID NO: 639055 - protein, 17 aa, Mycobacterium
ATFMAKVDDHWAGSSSH

SEQ ID NO: 639056 - protein, 19 aa, Mycobacterium
ATFMPKPFGQHAGSAMHTH

SEQ ID NO: 639057 - protein, 19 aa, Mycobacterium
ATFQHLWREVGANIDRYHT

SEQ ID NO: 639058 - protein, 25 aa, Mycobacterium
ATFRRMASALARRHGIAVDIVDGAG

SEQ ID NO: 639059 - protein, 20 aa, Mycobacterium
ATFTSSVVVSALFQGAFATV

SEQ ID NO: 639060 - protein, 23 aa, Mycobacterium
ATFVAQKLQADWAAEEATDEEST

SEQ ID NO: 639061 - protein, 17 aa, Mycobacterium
ATFYFYFASKFSVVSGL

SEQ ID NO: 639062 - protein, 29 aa, Mycobacterium
ATGAALTWPAGWSVWPERVYGDTRLELAD

SEQ ID NO: 639063 - protein, 24 aa, Mycobacterium
ATGADGPIVFCRGAVRPVSPAPVG

SEQ ID NO: 639064 - protein, 23 aa, Mycobacterium
ATGAGLRAGAFATEAGPAAQPLV

SEQ ID NO: 639065 - protein, 20 aa, Mycobacterium
ATGAGRLIFGSGADACTGAG

SEQ ID NO: 639066 - protein, 24 aa, Mycobacterium
ATGAKFVREIFTGVYASDFGLWDT

SEQ ID NO: 639067 - protein, 19 aa, Mycobacterium
ATGAPPVRNGYGLSEVGML

SEQ ID NO: 639068 - protein, 19 aa, Mycobacterium
ATGAQWVREIFTGVYASDF

SEQ ID NO: 639069 - protein, 25 aa, Mycobacterium
ATGARIANIIREFRVAAEASSLPTA

SEQ ID NO: 639070 - protein, 17 aa, Mycobacterium
ATGARMLVTLVHELRRR

SEQ ID NO: 639071 - protein, 26 aa, Mycobacterium
ATGARSIAALVAWKLGTSAGNAERIV

SEQ ID NO: 639072 - protein, 22 aa, Mycobacterium
ATGATARAACQVARAQGADRVV

SEQ ID NO: 639073 - protein, 17 aa, Mycobacterium
ATGCARVNLGTAALENP

SEQ ID NO: 639074 - protein, 24 aa, Mycobacterium
ATGDELRATLLALLGSPHLCSRAF

SEQ ID NO: 639075 - protein, 17 aa, Mycobacterium
ATGEALPGLTARESVWP

SEQ ID NO: 639076 - protein, 24 aa, Mycobacterium
ATGEELRATLLALLGSPHLCSRAF

SEQ ID NO: 639077 - protein, 24 aa, Mycobacterium
ATGEELRATLLAMVGSPHLCSRAF

SEQ ID NO: 639078 - protein, 23 aa, Mycobacterium
ATGEFPILVAHDLACVLQCNGAR

SEQ ID NO: 639079 - protein, 23 aa, Mycobacterium
ATGEIPISAPIGLDPALGSYPIL

SEQ ID NO: 639080 - protein, 18 aa, Mycobacterium
ATGEPFLRRFRVKFAGNI

SEQ ID NO: 639081 - protein, 27 aa, Mycobacterium
ATGESIPEMVLRCALVDEAVLARVLSP

SEQ ID NO: 639082 - protein, 24 aa, Mycobacterium
ATGFHIGYALSHFSYFADLAESYA

SEQ ID NO: 639083 - protein, 28 aa, Mycobacterium
ATGFLGRYLALDWLERMDLVDGKVIALV

SEQ ID NO: 639084 - protein, 25 aa, Mycobacterium
ATGFLGRYLALDWLERMDMVDGKVI

SEQ ID NO: 639085 - protein, 29 aa, Mycobacterium
ATGFLGRYLALEWLERMDLVDGKLICLVR

SEQ ID NO: 639086 - protein, 29 aa, Mycobacterium
ATGFLGRYLALEWLERMDLVDGKVICLVR

SEQ ID NO: 639087 - protein, 39 aa, Mycobacterium
ATGFLGRYLALEWLERMDLVDGRVIALVRAKSDDEARAR

SEQ ID NO: 639088 - protein, 24 aa, Mycobacterium
ATGFLGRYLALEWLERMSEVGGTV

SEQ ID NO: 639089 - protein, 22 aa, Mycobacterium
ATGFLGRYLVLQWLERLELADG

SEQ ID NO: 639090 - protein, 24 aa, Mycobacterium
ATGGRFRLGLGTQVRRHVVHRYGT

SEQ ID NO: 639091 - protein, 24 aa, Mycobacterium
ATGHLRQAINIGLQGRYAEFAGSV

SEQ ID NO: 639092 - protein, 19 aa, Mycobacterium
ATGIPQLFESAGRLLQSQD

SEQ ID NO: 639093 - protein, 21 aa, Mycobacterium
ATGKIAFPIARALVAAGNEVW

SEQ ID NO: 639094 - protein, 21 aa, Mycobacterium
ATGKIAFPIARLLAPHNDVWG

SEQ ID NO: 639095 - protein, 17 aa, Mycobacterium
ATGLAVVPVMFDRIMEL

SEQ ID NO: 639096 - protein, 18 aa, Mycobacterium
ATGLCVVPVMFDRIMELP

SEQ ID NO: 639097 - protein, 22 aa, Mycobacterium
ATGLESTVRFILSAKSTYVDGQ

SEQ ID NO: 639098 - protein, 23 aa, Mycobacterium
ATGLKRRLALWAIDTGVRAASQM

SEQ ID NO: 639099 - protein, 18 aa, Mycobacterium
ATGLLKPGGTIVEPTSGN

SEQ ID NO: 639100 - protein, 24 aa, Mycobacterium
ATGLLQCAWVYNRGLDFDGLRRFH

SEQ ID NO: 639101 - protein, 18 aa, Mycobacterium
ATGLNWYLTDPTLQFSMA

SEQ ID NO: 639102 - protein, 22 aa, Mycobacterium
ATGLVCALLLTARGTALTLGQL

SEQ ID NO: 639103 - protein, 22 aa, Mycobacterium
ATGLYVYARETVGYALSIGGRV

SEQ ID NO: 639104 - protein, 23 aa, Mycobacterium
ATGMAGFRRTHMDAAAAQRLLAR

SEQ ID NO: 639105 - protein, 26 aa, Mycobacterium
ATGMGMATGAWRVGIYLLGDGDSHPR

SEQ ID NO: 639106 - protein, 25 aa, Mycobacterium
ATGNAPQWLAQHGFVPTDKPVAGAF

SEQ ID NO: 639107 - protein, 17 aa, Mycobacterium
ATGNPFMVVGGLIDAPA

SEQ ID NO: 639108 - protein, 19 aa, Mycobacterium
ATGPARTAGSTGHDSGAPS

SEQ ID NO: 639109 - protein, 19 aa, Mycobacterium
ATGPCWFDADGVRVGDRRL

SEQ ID NO: 639110 - protein, 19 aa, Mycobacterium
ATGPDRFDCSGLVQWAYAQ

SEQ ID NO: 639111 - protein, 20 aa, Mycobacterium
ATGPLQGVFDLGNAPVQALT

SEQ ID NO: 639112 - protein, 21 aa, Mycobacterium
ATGPRSSWRATDPVLYAMCGA

SEQ ID NO: 639113 - protein, 19 aa, Mycobacterium
ATGPVGEWGVGQFERIAKD

SEQ ID NO: 639114 - protein, 17 aa, Mycobacterium
ATGQAHFNEVFLDDVFV

SEQ ID NO: 639115 - protein, 17 aa, Mycobacterium
ATGQAHFNEVFLNDVFI

SEQ ID NO: 639116 - protein, 19 aa, Mycobacterium
ATGQFLWQNIFGVWPVSGE

SEQ ID NO: 639117 - protein, 19 aa, Mycobacterium
ATGQFLWQNIFGVWPVSGQ

SEQ ID NO: 639118 - protein, 21 aa, Mycobacterium
ATGQVLLPGFVDLHTHLREPG

SEQ ID NO: 639119 - protein, 18 aa, Mycobacterium
ATGRAVGILADLQGPKIR

SEQ ID NO: 639120 - protein, 28 aa, Mycobacterium
ATGREVAHLRAFRAYAEHCQEIALHQAY

SEQ ID NO: 639121 - protein, 25 aa, Mycobacterium
ATGREVAHLRAFRAYAGHCQEIALH

SEQ ID NO: 639122 - protein, 26 aa, Mycobacterium
ATGRFDEALAWYGCIFGREPDLRPVA

SEQ ID NO: 639123 - protein, 25 aa, Mycobacterium
ATGRGGGQVSNLIHDVMKLRQQGYR

SEQ ID NO: 639124 - protein, 17 aa, Mycobacterium
ATGRGGTGAAVIDEVDM

SEQ ID NO: 639125 - protein, 22 aa, Mycobacterium
ATGRLRLVLLLSPPRTGSTALA

SEQ ID NO: 639126 - protein, 17 aa, Mycobacterium
ATGRPAFGDRFHTGNQE

SEQ ID NO: 639127 - protein, 17 aa, Mycobacterium
ATGRQLWDASLITAETL

SEQ ID NO: 639128 - protein, 17 aa, Mycobacterium
ATGRRALAVATDITDEA

SEQ ID NO: 639129 - protein, 24 aa, Mycobacterium
ATGRRFEALSALAAGVKEVRAVID

SEQ ID NO: 639130 - protein, 24 aa, Mycobacterium
ATGRRFEALSALTAGVKEVRAVID

SEQ ID NO: 639131 - protein, 24 aa, Mycobacterium
ATGRRPRGWMGPGLTETHHTPELL

SEQ ID NO: 639132 - protein, 26 aa, Mycobacterium
ATGRTSARLLPRFDTISYRDLWANVG

SEQ ID NO: 639133 - protein, 21 aa, Mycobacterium
ATGSGHPWWTLSQLSGEAVLE

SEQ ID NO: 639134 - protein, 18 aa, Mycobacterium
ATGTGVCAMCYGRSMATG

SEQ ID NO: 639135 - protein, 24 aa, Mycobacterium
ATGTLPPLLPFVSAPINGVMSVGL

SEQ ID NO: 639136 - protein, 24 aa, Mycobacterium
ATGTRAHSARSWLGDNAIHKLGAV

SEQ ID NO: 639137 - protein, 24 aa, Mycobacterium
ATGTRAHSARSWLGDNAIHKLSAV

SEQ ID NO: 639138 - protein, 18 aa, Mycobacterium
ATGTWYLQDRVIAPDFNF

SEQ ID NO: 639139 - protein, 17 aa, Mycobacterium
ATGVFAGLIVQGYGMLA

SEQ ID NO: 639140 - protein, 32 aa, Mycobacterium
ATGVVRFIGVDGYRWMIRCVINGAHETMEALE

SEQ ID NO: 639141 - protein, 24 aa, Mycobacterium
ATGYRPLDVRAFLGALASCYEFDE

SEQ ID NO: 639142 - protein, 19 aa, Mycobacterium
ATGYRRRMLIIVISDEPDA

SEQ ID NO: 639143 - protein, 22 aa, Mycobacterium
ATHADLPRLGLVNRIVTETLRL

SEQ ID NO: 639144 - protein, 18 aa, Mycobacterium
ATHALRFLNRAQFADGTF

SEQ ID NO: 639145 - protein, 25 aa, Mycobacterium
ATHASGASVATCPTGTTGTTVGTHH

SEQ ID NO: 639146 - protein, 24 aa, Mycobacterium
ATHATELFAVFDIYRTRFGALLTA

SEQ ID NO: 639147 - protein, 19 aa, Mycobacterium
ATHFKSGKPHGWIHNELRR

SEQ ID NO: 639148 - protein, 27 aa, Mycobacterium
ATHGHVWKLQNEFRIPASQFTQEQIDH

SEQ ID NO: 639149 - protein, 18 aa, Mycobacterium
ATHHWPLLLDKIQQRYLE

SEQ ID NO: 639150 - protein, 18 aa, Mycobacterium
ATHIGGLWWILNGLMHGA

SEQ ID NO: 639151 - protein, 26 aa, Mycobacterium
ATHLSRLVPQHMMRRLFFTATTVDAA

SEQ ID NO: 639152 - protein, 17 aa, Mycobacterium
ATHQMAGVTIVDPATTW

SEQ ID NO: 639153 - protein, 17 aa, Mycobacterium
ATHRAKAGAAVARMQGR

SEQ ID NO: 639154 - protein, 18 aa, Mycobacterium
ATHRIRVGAGAVQIASTT

SEQ ID NO: 639155 - protein, 18 aa, Mycobacterium
ATHSRTAMHNTLSALAIT

SEQ ID NO: 639156 - protein, 18 aa, Mycobacterium
ATHVPWASTAERVVLVWR

SEQ ID NO: 639157 - protein, 22 aa, Mycobacterium
ATIAAERGWGATMVLTEPDAGS

SEQ ID NO: 639158 - protein, 18 aa, Mycobacterium
ATIAFTVWTSSLADITRL

SEQ ID NO: 639159 - protein, 18 aa, Mycobacterium
ATIALGILHRLTATVAKV

SEQ ID NO: 639160 - protein, 24 aa, Mycobacterium
ATIAPGSSVTVGFQAAQTGSYAPP

SEQ ID NO: 639161 - protein, 17 aa, Mycobacterium
ATIARGRVIAMDTNLAR

SEQ ID NO: 639162 - protein, 22 aa, Mycobacterium
ATIARGRVVAMDVAAARALDGV

SEQ ID NO: 639163 - protein, 24 aa, Mycobacterium
ATIASICTGAFVLADTGLLDGRRA

SEQ ID NO: 639164 - protein, 17 aa, Mycobacterium
ATIATAFVCPFDGDTPV

SEQ ID NO: 639165 - protein, 22 aa, Mycobacterium
ATIDADGAWMLAEEASKASVGD

SEQ ID NO: 639166 - protein, 18 aa, Mycobacterium
ATIDAWRLWSKVHQSYDG

SEQ ID NO: 639167 - protein, 17 aa, Mycobacterium
ATIDPVVRITRWAALCC

SEQ ID NO: 639168 - protein, 19 aa, Mycobacterium
ATIDRIVMLGFEVRVELTS

SEQ ID NO: 639169 - protein, 20 aa, Mycobacterium
ATIEMCLTGPLAFEDGEATY

SEQ ID NO: 639170 - protein, 25 aa, Mycobacterium
ATIGRRVCETEWDLLNLLAPADDGR

SEQ ID NO: 639171 - protein, 18 aa, Mycobacterium
ATIGRYIRYRRYPTQLCV

SEQ ID NO: 639172 - protein, 19 aa, Mycobacterium
ATIGSAVVERGWVAQDDLV

SEQ ID NO: 639173 - protein, 32 aa, Mycobacterium
ATIGYHGLHAFRWVADDGSARFVRYHMVPAAT

SEQ ID NO: 639174 - protein, 17 aa, Mycobacterium
ATIIPVRVFVLENVLEL

SEQ ID NO: 639175 - protein, 19 aa, Mycobacterium
ATIKHLICLEYSTVAIQNK

SEQ ID NO: 639176 - protein, 23 aa, Mycobacterium
ATILNVTSGLAFMPSALTPTYCA

SEQ ID NO: 639177 - protein, 26 aa, Mycobacterium
ATILRAAAQHWIAWMTQKQELAQSLR

SEQ ID NO: 639178 - protein, 17 aa, Mycobacterium
ATILRYCSHHRIAVVPF

SEQ ID NO: 639179 - protein, 18 aa, Mycobacterium
ATINRVAPAVGHNFAVVR

SEQ ID NO: 639180 - protein, 17 aa, Mycobacterium
ATIPNARLEVIAGARTF

SEQ ID NO: 639181 - protein, 18 aa, Mycobacterium
ATIRAAFDATRRGGAVTL

SEQ ID NO: 639182 - protein, 25 aa, Mycobacterium
ATIRAEADLARFPADVARVVVRLIH

SEQ ID NO: 639183 - protein, 25 aa, Mycobacterium
ATIRAEADLSRFPADIARVVVRLIH

SEQ ID NO: 639184 - protein, 18 aa, Mycobacterium
ATIRAEADLTRFPDDVAR

SEQ ID NO: 639185 - protein, 31 aa, Mycobacterium
ATIRAEADLTRFPPDVARVVVRLIHTCGQVD

SEQ ID NO: 639186 - protein, 20 aa, Mycobacterium
ATIRPYRPSLSAALPPSALW

SEQ ID NO: 639187 - protein, 20 aa, Mycobacterium
ATIRRELRRAGVQFDSENDT

SEQ ID NO: 639188 - protein, 18 aa, Mycobacterium
ATISGYGQDGPWRDRKAY

SEQ ID NO: 639189 - protein, 18 aa, Mycobacterium
ATIVSWLPFYHDMGLVLG

SEQ ID NO: 639190 - protein, 18 aa, Mycobacterium
ATIYRYAGGKAKIRDVVI

SEQ ID NO: 639191 - protein, 24 aa, Mycobacterium
ATKFGCGFAPSGWETLTKHLLRKG

SEQ ID NO: 639192 - protein, 28 aa, Mycobacterium
ATKGTFRLAFGIGDFRRDTGFGDDPATL

SEQ ID NO: 639193 - protein, 28 aa, Mycobacterium
ATKGTFRLAFGIGDFRRDTGFGENPATL

SEQ ID NO: 639194 - protein, 20 aa, Mycobacterium
ATKIAFDCVIRGGDGAPYLR

SEQ ID NO: 639195 - protein, 24 aa, Mycobacterium
ATKILELARAYGIEALDIDEEERD

SEQ ID NO: 639196 - protein, 17 aa, Mycobacterium
ATKLQEMAEDLTARDSG

SEQ ID NO: 639197 - protein, 20 aa, Mycobacterium
ATKLRGSPVAGRATVLIFPD

SEQ ID NO: 639198 - protein, 32 aa, Mycobacterium
ATKLTRWPAVDGRRLAAVSAFGMSGANAHAIV

SEQ ID NO: 639199 - protein, 20 aa, Mycobacterium
ATKPSPWRITERRALEIQAY

SEQ ID NO: 639200 - protein, 19 aa, Mycobacterium
ATKQCAHKAQLLASGVSMP

SEQ ID NO: 639201 - protein, 22 aa, Mycobacterium
ATKRALADWAALQGLIDDELRL

SEQ ID NO: 639202 - protein, 20 aa, Mycobacterium
ATKRFGLTVTLAERERQLAI

SEQ ID NO: 639203 - protein, 22 aa, Mycobacterium
ATKRIAPIVILTAFSQRDLVEK

SEQ ID NO: 639204 - protein, 17 aa, Mycobacterium
ATKRLELYHGRELGRLD

SEQ ID NO: 639205 - protein, 17 aa, Mycobacterium
ATKRLGMTVTLAERERV

SEQ ID NO: 639206 - protein, 21 aa, Mycobacterium
ATKRLSLTVTLAERERQLSIA

SEQ ID NO: 639207 - protein, 18 aa, Mycobacterium
ATKRLVWSGLGSSVEERL

SEQ ID NO: 639208 - protein, 17 aa, Mycobacterium
ATKSCITAAGWAGLLVT

SEQ ID NO: 639209 - protein, 19 aa, Mycobacterium
ATLAALVARHGVELIAVGN

SEQ ID NO: 639210 - protein, 17 aa, Mycobacterium
ATLAALVARHSVELIAV

SEQ ID NO: 639211 - protein, 17 aa, Mycobacterium
ATLAARWARLRREGLAW

SEQ ID NO: 639212 - protein, 17 aa, Mycobacterium
ATLAFKALGVRHVVVVD

SEQ ID NO: 639213 - protein, 20 aa, Mycobacterium
ATLAGLGCRGRIRQLPDSTH

SEQ ID NO: 639214 - protein, 22 aa, Mycobacterium
ATLAGQSWLGRAATAMAAGAAP

SEQ ID NO: 639215 - protein, 24 aa, Mycobacterium
ATLAKRLAAHITEFSGVEVPAGFL

SEQ ID NO: 639216 - protein, 24 aa, Mycobacterium
ATLARVVELRFSLGAKSFPRTPPS

SEQ ID NO: 639217 - protein, 22 aa, Mycobacterium
ATLAVAPQAGWRVQVDGAAVTV

SEQ ID NO: 639218 - protein, 17 aa, Mycobacterium
ATLDAVLAKLAAPGMCN

SEQ ID NO: 639219 - protein, 23 aa, Mycobacterium
ATLDLLAADGFEFRIRRGDNGQL

SEQ ID NO: 639220 - protein, 18 aa, Mycobacterium
ATLDRITFDVTFTAATAD

SEQ ID NO: 639221 - protein, 24 aa, Mycobacterium
ATLDRPAIGYGIRYEYGIFDQEIR

SEQ ID NO: 639222 - protein, 18 aa, Mycobacterium
ATLDRYNTYAARGEDPDF

SEQ ID NO: 639223 - protein, 19 aa, Mycobacterium
ATLDYCWLRSDIADPSARL

SEQ ID NO: 639224 - protein, 17 aa, Mycobacterium
ATLELVGCYAFSPEKAG

SEQ ID NO: 639225 - protein, 20 aa, Mycobacterium
ATLFGHCLGAGLELPLGCTF

SEQ ID NO: 639226 - protein, 18 aa, Mycobacterium
ATLFLLAPSWRYRPAADK

SEQ ID NO: 639227 - protein, 23 aa, Mycobacterium
ATLFPGGEGRLLLTDPSDMLTTG

SEQ ID NO: 639228 - protein, 24 aa, Mycobacterium
ATLFRAGERLRLVIAGRWLCPRNP

SEQ ID NO: 639229 - protein, 20 aa, Mycobacterium
ATLFRLWLRDAVRRVADGVL

SEQ ID NO: 639230 - protein, 19 aa, Mycobacterium
ATLGARLTIEKAVGAPGPV

SEQ ID NO: 639231 - protein, 25 aa, Mycobacterium
ATLHHRAGALIGRLVRELTADWDYA

SEQ ID NO: 639232 - protein, 26 aa, Mycobacterium
ATLHHRASALIGRLMRELTADWDYAL

SEQ ID NO: 639233 - protein, 19 aa, Mycobacterium
ATLHPEIRSALDGVADQLS

SEQ ID NO: 639234 - protein, 20 aa, Mycobacterium
ATLIPDEWLEPAATGSARQC

SEQ ID NO: 639235 - protein, 19 aa, Mycobacterium
ATLIPDEWLEPSATGSAQQ

SEQ ID NO: 639236 - protein, 24 aa, Mycobacterium
ATLKQRLGDAFAVIEIDSSPGNAD

SEQ ID NO: 639237 - protein, 25 aa, Mycobacterium
ATLKRFADRFARFNLQEKVLRPSYG

SEQ ID NO: 639238 - protein, 18 aa, Mycobacterium
ATLKVIAGDVYWTTIGNQ

SEQ ID NO: 639239 - protein, 17 aa, Mycobacterium
ATLLARFTGIRTCTKRL

SEQ ID NO: 639240 - protein, 18 aa, Mycobacterium
ATLLGGITNLGWQYDNEI

SEQ ID NO: 639241 - protein, 26 aa, Mycobacterium
ATLLTATCPVLFAPAMHTEMWLHPAT

SEQ ID NO: 639242 - protein, 19 aa, Mycobacterium
ATLPALMAAVAPEATDGGF

SEQ ID NO: 639243 - protein, 25 aa, Mycobacterium
ATLPCSGLTAWFALVERGRVRAGET

SEQ ID NO: 639244 - protein, 19 aa, Mycobacterium
ATLPGASWQRCRTHYTTNL

SEQ ID NO: 639245 - protein, 27 aa, Mycobacterium
ATLPRLRPRVFYDLVVEVALIRPGPIQ

SEQ ID NO: 639246 - protein, 25 aa, Mycobacterium
ATLPRPAVRLLEQWLAHSALLRSFV

SEQ ID NO: 639247 - protein, 17 aa, Mycobacterium
ATLPRSAFEATLDLLSG

SEQ ID NO: 639248 - protein, 18 aa, Mycobacterium
ATLPRWMRELGQFDQPGI

SEQ ID NO: 639249 - protein, 18 aa, Mycobacterium
ATLPVFGSWCEEYRVVPE

SEQ ID NO: 639250 - protein, 20 aa, Mycobacterium
ATLPVLGMTGSVFFQQATDL

SEQ ID NO: 639251 - protein, 17 aa, Mycobacterium
ATLPVPVRSVLGFLTVW

SEQ ID NO: 639252 - protein, 18 aa, Mycobacterium
ATLPWRTVRDNVAFALEV

SEQ ID NO: 639253 - protein, 24 aa, Mycobacterium
ATLPYPMLMAARLKSLGLPMNSKA

SEQ ID NO: 639254 - protein, 20 aa, Mycobacterium
ATLQPGWQRRRITNFQVLTA

SEQ ID NO: 639255 - protein, 25 aa, Mycobacterium
ATLQRFVDRFAHFNFRDSMMRPSYG

SEQ ID NO: 639256 - protein, 25 aa, Mycobacterium
ATLQRPAVGYGIRYEFGIFDQEIRD

SEQ ID NO: 639257 - protein, 23 aa, Mycobacterium
ATLREFTVFYAPNINSYKRFADG

SEQ ID NO: 639258 - protein, 23 aa, Mycobacterium
ATLREIPTVIAIATGPEKIAATR

SEQ ID NO: 639259 - protein, 25 aa, Mycobacterium
ATLRERSWKRSSFSGTEIFGKTVGV

SEQ ID NO: 639260 - protein, 27 aa, Mycobacterium
ATLRFELLCLARACGYVHPALVPLDTI

SEQ ID NO: 639261 - protein, 25 aa, Mycobacterium
ATLRFWPRRVTPAIVSFLVETFGID

SEQ ID NO: 639262 - protein, 21 aa, Mycobacterium
ATLRGFIVLDHFGRAPEAMTE

SEQ ID NO: 639263 - protein, 17 aa, Mycobacterium
ATLRIASFTVRPVTMFS

SEQ ID NO: 639264 - protein, 25 aa, Mycobacterium
ATLRISSQLLANWLRHGVITSEDVR

SEQ ID NO: 639265 - protein, 22 aa, Mycobacterium
ATLRLLDELGLFEKFDALPHSR

SEQ ID NO: 639266 - protein, 17 aa, Mycobacterium
ATLRPAIDMGTPIVEQL

SEQ ID NO: 639267 - protein, 24 aa, Mycobacterium
ATLRRELHQSLGFEWLPVDPATGM

SEQ ID NO: 639268 - protein, 23 aa, Mycobacterium
ATLRRELHRSLGVEWAAVDPRTG

SEQ ID NO: 639269 - protein, 17 aa, Mycobacterium
ATLRRLADSAAELPTPW

SEQ ID NO: 639270 - protein, 23 aa, Mycobacterium
ATLRRPAVAAVRADYEKVLRQRT

SEQ ID NO: 639271 - protein, 22 aa, Mycobacterium
ATLRRPTIAGVRADYDKVLRQR

SEQ ID NO: 639272 - protein, 24 aa, Mycobacterium
ATLRRRLGDRLTEHPLRREIVATA

SEQ ID NO: 639273 - protein, 28 aa, Mycobacterium
ATLRTRVPFVHFFDGFRTSHELNTIELL

SEQ ID NO: 639274 - protein, 28 aa, Mycobacterium
ATLRTRVPFVHFFDGFRTSHELNTIEVL

SEQ ID NO: 639275 - protein, 19 aa, Mycobacterium
ATLRVARGAGFDQLIVTLG

SEQ ID NO: 639276 - protein, 24 aa, Mycobacterium
ATLRYRLKEDLGYNKLLATNVGQA

SEQ ID NO: 639277 - protein, 17 aa, Mycobacterium
ATLSLLASEPMMVSVSL

SEQ ID NO: 639278 - protein, 20 aa, Mycobacterium
ATLSRLATCTPELPTPWPRE

SEQ ID NO: 639279 - protein, 17 aa, Mycobacterium
ATLSRTGKPAALVPLAR

SEQ ID NO: 639280 - protein, 19 aa, Mycobacterium
ATLTLALPKIGMRNAPQVG

SEQ ID NO: 639281 - protein, 19 aa, Mycobacterium
ATLTPIGLTLPFGEVMLTP

SEQ ID NO: 639282 - protein, 18 aa, Mycobacterium
ATLTSIGLTLPFGEVTLA

SEQ ID NO: 639283 - protein, 24 aa, Mycobacterium
ATLVARAWLDPDFAELARTEPMTA

SEQ ID NO: 639284 - protein, 17 aa, Mycobacterium
ATLVDHLIPPMARAETY

SEQ ID NO: 639285 - protein, 17 aa, Mycobacterium
ATLVIKPGWGFNFDYQP

SEQ ID NO: 639286 - protein, 22 aa, Mycobacterium
ATLWPVRHRRVRAGVHPRAPDG

SEQ ID NO: 639287 - protein, 25 aa, Mycobacterium
ATLWRAAGAGRRWLVAPHVPPEEDR

SEQ ID NO: 639288 - protein, 23 aa, Mycobacterium
ATLYGSIFPPVWNFQLALHTRGY

SEQ ID NO: 639289 - protein, 17 aa, Mycobacterium
ATLYNWRRTYGGMDTDA

SEQ ID NO: 639290 - protein, 18 aa, Mycobacterium
ATLYRRFPTKAALVDAVV

SEQ ID NO: 639291 - protein, 28 aa, Mycobacterium
ATMAGWRTDFLNQMGLVIADSVKPFGTD

SEQ ID NO: 639292 - protein, 19 aa, Mycobacterium
ATMAQWCFLLARTSKGEKK

SEQ ID NO: 639293 - protein, 22 aa, Mycobacterium
ATMAQWCFLLARTSRLGEGATQ

SEQ ID NO: 639294 - protein, 18 aa, Mycobacterium
ATMARWCAERGVELAPHG

SEQ ID NO: 639295 - protein, 18 aa, Mycobacterium
ATMASLGKQCEQLAATLD

SEQ ID NO: 639296 - protein, 17 aa, Mycobacterium
ATMAVHIQGGLGVSAEA

SEQ ID NO: 639297 - protein, 19 aa, Mycobacterium
ATMCGWIDGAIRSGERAAS

SEQ ID NO: 639298 - protein, 17 aa, Mycobacterium
ATMDAVWDDVVDRMRWL

SEQ ID NO: 639299 - protein, 17 aa, Mycobacterium
ATMHPSRYHALIEGVSE

SEQ ID NO: 639300 - protein, 18 aa, Mycobacterium
ATMHPSRYLTLIDGVSAV

SEQ ID NO: 639301 - protein, 20 aa, Mycobacterium
ATMHPSRYLTLIEGVRAVFV

SEQ ID NO: 639302 - protein, 19 aa, Mycobacterium
ATMHPSRYLTLIEGVSQVF

SEQ ID NO: 639303 - protein, 17 aa, Mycobacterium
ATMLLFMQGRRGAAPEV

SEQ ID NO: 639304 - protein, 17 aa, Mycobacterium
ATMLRVLLYPDQMLDEA

SEQ ID NO: 639305 - protein, 19 aa, Mycobacterium
ATMPDPIITLARTFMIQPT

SEQ ID NO: 639306 - protein, 19 aa, Mycobacterium
ATMPDPIITLARTFMTQPT

SEQ ID NO: 639307 - protein, 18 aa, Mycobacterium
ATMPDPIITLARTFMVQP

SEQ ID NO: 639308 - protein, 19 aa, Mycobacterium
ATMQGFNALDEWGRFDEAF

SEQ ID NO: 639309 - protein, 23 aa, Mycobacterium
ATMRALTGRSWRAGLRQRATVRV

SEQ ID NO: 639310 - protein, 17 aa, Mycobacterium
ATMRCVAEVGYSQATIR

SEQ ID NO: 639311 - protein, 23 aa, Mycobacterium
ATMREVIETLAPIERGAGDPGEQ

SEQ ID NO: 639312 - protein, 20 aa, Mycobacterium
ATMSAIRLARGFTGRAKIVK

SEQ ID NO: 639313 - protein, 24 aa, Mycobacterium
ATMSWDRFVATYGRTGGPVRLGHW

SEQ ID NO: 639314 - protein, 20 aa, Mycobacterium
ATMSWPEHTDHAGAAERLRN

SEQ ID NO: 639315 - protein, 19 aa, Mycobacterium
ATMTAWRAGVEYRTGGPLP

SEQ ID NO: 639316 - protein, 25 aa, Mycobacterium
ATMVGKLSVPPSWAGPATPVVGTSA

SEQ ID NO: 639317 - protein, 25 aa, Mycobacterium
ATMVGRLSVPPSWAGTTEVTDHVAT

SEQ ID NO: 639318 - protein, 17 aa, Mycobacterium
ATMYVCGITPYDATHLG

SEQ ID NO: 639319 - protein, 24 aa, Mycobacterium
ATNASPLQPLLDLINAPTQAILGR

SEQ ID NO: 639320 - protein, 17 aa, Mycobacterium
ATNDIEALLALKPDCVV

SEQ ID NO: 639321 - protein, 17 aa, Mycobacterium
ATNESYLRHVIEVGHLS

SEQ ID NO: 639322 - protein, 18 aa, Mycobacterium
ATNLLLMRGMIGKPGAGV

SEQ ID NO: 639323 - protein, 22 aa, Mycobacterium
ATNLRGTFLATRAVGRHLVAQR

SEQ ID NO: 639324 - protein, 19 aa, Mycobacterium
ATNVTKLPGLGGWRRPQEE

SEQ ID NO: 639325 - protein, 19 aa, Mycobacterium
ATNVTKLPGLGSWRRPQAE

SEQ ID NO: 639326 - protein, 21 aa, Mycobacterium
ATNWRSDSALVDRLQVVLRGA

SEQ ID NO: 639327 - protein, 20 aa, Mycobacterium
ATPAAAPWMKVSEAVDYLRA

SEQ ID NO: 639328 - protein, 19 aa, Mycobacterium
ATPADWRPGDPVIVPPAGS

SEQ ID NO: 639329 - protein, 24 aa, Mycobacterium
ATPAEQRDAFAWHIDLAKRSGKPL

SEQ ID NO: 639330 - protein, 18 aa, Mycobacterium
ATPAFTHWTENVLPAGSD

SEQ ID NO: 639331 - protein, 17 aa, Mycobacterium
ATPAGAPLLRLAAQTAL

SEQ ID NO: 639332 - protein, 17 aa, Mycobacterium
ATPAGVPLLRLAAQTAL

SEQ ID NO: 639333 - protein, 19 aa, Mycobacterium
ATPARRWATATSVGDQAQF

SEQ ID NO: 639334 - protein, 20 aa, Mycobacterium
ATPAWARTAIELARKAAQMF

SEQ ID NO: 639335 - protein, 19 aa, Mycobacterium
ATPCSEWTVSDLIEHVIGG

SEQ ID NO: 639336 - protein, 24 aa, Mycobacterium
ATPDAANLVTAWRLLQSADPRLRT

SEQ ID NO: 639337 - protein, 23 aa, Mycobacterium
ATPDEFRGQIDITKEVLQALGIT

SEQ ID NO: 639338 - protein, 22 aa, Mycobacterium
ATPDLPAAVEIRLNNGPIAAMA

SEQ ID NO: 639339 - protein, 26 aa, Mycobacterium
ATPDPFHWECFSFGIIQNEDHFTFYA

SEQ ID NO: 639340 - protein, 18 aa, Mycobacterium
ATPEALVESALWEAGLFE

SEQ ID NO: 639341 - protein, 19 aa, Mycobacterium
ATPEAYPFTQLEAPASTDD

SEQ ID NO: 639342 - protein, 21 aa, Mycobacterium
ATPEDVNRLWELQQDGLNALT

SEQ ID NO: 639343 - protein, 23 aa, Mycobacterium
ATPEFAWGLLIATVRNLAEEHRR

SEQ ID NO: 639344 - protein, 24 aa, Mycobacterium
ATPEGFGRIAATTARQVFQQGVRD

SEQ ID NO: 639345 - protein, 24 aa, Mycobacterium
ATPEVARAWSSYAPTAVRLPDGRV

SEQ ID NO: 639346 - protein, 24 aa, Mycobacterium
ATPEVARAWSSYAPTVVRLSDGRI

SEQ ID NO: 639347 - protein, 19 aa, Mycobacterium
ATPGDLLFHIRAESMDVCF

SEQ ID NO: 639348 - protein, 25 aa, Mycobacterium
ATPGKGRRILVEFDGRPSASTALQT

SEQ ID NO: 639349 - protein, 29 aa, Mycobacterium
ATPGKRIRAGLGLACFRLQPSAATVSPAE

SEQ ID NO: 639350 - protein, 17 aa, Mycobacterium
ATPGRIVLLTSGTTGTP

SEQ ID NO: 639351 - protein, 19 aa, Mycobacterium
ATPGYCYQDSLGPGPDNLA

SEQ ID NO: 639352 - protein, 23 aa, Mycobacterium
ATPIPRTVALTIYGDLETSTLRE

SEQ ID NO: 639353 - protein, 23 aa, Mycobacterium
ATPIPRTVALTVFGDLETSTLRE

SEQ ID NO: 639354 - protein, 21 aa, Mycobacterium
ATPKGWMKALRAYNQSDPYAR

SEQ ID NO: 639355 - protein, 21 aa, Mycobacterium
ATPKGWMTALWAYNQSDPYAR

SEQ ID NO: 639356 - protein, 21 aa, Mycobacterium
ATPKHPIVFECVGVPGIIDDI

SEQ ID NO: 639357 - protein, 19 aa, Mycobacterium
ATPKRDWEATLSVNLWGVI

SEQ ID NO: 639358 - protein, 23 aa, Mycobacterium
ATPLIEFTCVLPVEEAGARIRAR

SEQ ID NO: 639359 - protein, 19 aa, Mycobacterium
ATPLIIDFAHIWRNLPKVV

SEQ ID NO: 639360 - protein, 25 aa, Mycobacterium
ATPLRPGRWRAYADHRMAMAGAIVG

SEQ ID NO: 639361 - protein, 27 aa, Mycobacterium
ATPPQRYAMFMSYSLAGGAGRTELQIL

SEQ ID NO: 639362 - protein, 25 aa, Mycobacterium
ATPPTRPRVSPARLHNSRSTTTSAA

SEQ ID NO: 639363 - protein, 20 aa, Mycobacterium
ATPQWARTAIGLARKAAEAF

SEQ ID NO: 639364 - protein, 20 aa, Mycobacterium
ATPQWARTAIGLARKAAEGL

SEQ ID NO: 639365 - protein, 17 aa, Mycobacterium
ATPRFHSKIVELNLLAP

SEQ ID NO: 639366 - protein, 30 aa, Mycobacterium
ATPRFKRRLTAMIVKLAARFLALREQGKAG

SEQ ID NO: 639367 - protein, 23 aa, Mycobacterium
ATPRLRVNRSVAWVELRKRVEAA

SEQ ID NO: 639368 - protein, 18 aa, Mycobacterium
ATPRRNLSRVVEWPEQLL

SEQ ID NO: 639369 - protein, 22 aa, Mycobacterium
ATPRVLPWQECPGAVASAARIT

SEQ ID NO: 639370 - protein, 23 aa, Mycobacterium
ATPSDGAFFWSGRNVDGTGIGPI

SEQ ID NO: 639371 - protein, 17 aa, Mycobacterium
ATPSFKRYAHLHSEQHA

SEQ ID NO: 639372 - protein, 30 aa, Mycobacterium; identical to SEQ ID NO: 78315

SEQ ID NO: 639373 - protein, 31 aa, Mycobacterium
ATPSQLALAWLLKRSPVMLPIPGTSRVAHLQ

SEQ ID NO: 639374 - protein, 22 aa, Mycobacterium
ATPSRGPVWFRHLVSERPIGDG

SEQ ID NO: 639375 - protein, 20 aa, Mycobacterium
ATPSRLKLISPYDVIGDVRQ

SEQ ID NO: 639376 - protein, 20 aa, Mycobacterium
ATPSRLKLISPYDVLGEPRQ

SEQ ID NO: 639377 - protein, 17 aa, Mycobacterium
ATPSRVLSIRWWDMKSA

SEQ ID NO: 639378 - protein, 17 aa, Mycobacterium
ATPTWKKSFGLHPLLAF

SEQ ID NO: 639379 - protein, 19 aa, Mycobacterium
ATPTWKKSFGLHPLLAFLD

SEQ ID NO: 639380 - protein, 20 aa, Mycobacterium
ATPVDVRESLAITRQTAHLT

SEQ ID NO: 639381 - protein, 20 aa, Mycobacterium
ATPVDVRESLAITRQTAHVT

SEQ ID NO: 639382 - protein, 25 aa, Mycobacterium
ATPWWKERIVSALSSYWVYQHLGNL

SEQ ID NO: 639383 - protein, 20 aa, Mycobacterium
ATPYKSQFITAAPGSTAVNI

SEQ ID NO: 639384 - protein, 18 aa, Mycobacterium
ATPYLQWLISAAGQAEIA

SEQ ID NO: 639385 - protein, 18 aa, Mycobacterium
ATQAALWAIDEAVSRDIP

SEQ ID NO: 639386 - protein, 19 aa, Mycobacterium
ATQAGRIAVVFDLEDSRPL

SEQ ID NO: 639387 - protein, 17 aa, Mycobacterium
ATQARAAAFAYETAFAE

SEQ ID NO: 639388 - protein, 24 aa, Mycobacterium
ATQEMQRLMALPVGMRPDPSDLSF

SEQ ID NO: 639389 - protein, 18 aa, Mycobacterium
ATQLRARAARRAAAQPGL

SEQ ID NO: 639390 - protein, 17 aa, Mycobacterium
ATQPDWLATATPAAMDL

SEQ ID NO: 639391 - protein, 25 aa, Mycobacterium
ATQPLLDRELLGIAEAIRSSGLAAG

SEQ ID NO: 639392 - protein, 19 aa, Mycobacterium
ATQPLSVFFFDILHRDGDD

SEQ ID NO: 639393 - protein, 26 aa, Mycobacterium
ATQPRYVYRHEWRLGDLLMWDNTGTM

SEQ ID NO: 639394 - protein, 26 aa, Mycobacterium
ATQRAYSAWLWTGRRGVIAGLAASAV

SEQ ID NO: 639395 - protein, 24 aa, Mycobacterium
ATQRCIAVLYAAMYGDTTLRATGM

SEQ ID NO: 639396 - protein, 25 aa, Mycobacterium
ATQRTRLPLPYAQARLLSTIEDQGE

SEQ ID NO: 639397 - protein, 26 aa, Mycobacterium
ATQRWSSDIAAGWWQAALDAYDRVPV

SEQ ID NO: 639398 - protein, 27 aa, Mycobacterium
ATRAEAGNLWFEWSRSLDNPAEYVLVE

SEQ ID NO: 639399 - protein, 26 aa, Mycobacterium
ATRAEGVECYRLFISGLLDVTDNVDK

SEQ ID NO: 639400 - protein, 21 aa, Mycobacterium
ATRAKMPTLRIPDFAMSSVSQ

SEQ ID NO: 639401 - protein, 20 aa, Mycobacterium
ATRALPAVRQLGGGLVEIPR

SEQ ID NO: 639402 - protein, 18 aa, Mycobacterium
ATRCGYCDFNTYTPAELG

SEQ ID NO: 639403 - protein, 26 aa, Mycobacterium
ATRCPFGTECFAELARLEAGQSDVVV

SEQ ID NO: 639404 - protein, 24 aa, Mycobacterium
ATRCWELRHDSHWVALPQEGQTVR

SEQ ID NO: 639405 - protein, 19 aa, Mycobacterium
ATRDPVMCHNGFQIFGGGV

SEQ ID NO: 639406 - protein, 20 aa, Mycobacterium
ATRDPVMCHSGFQIFGGGVL

SEQ ID NO: 639407 - protein, 25 aa, Mycobacterium
ATREEGVACYRLFIAGLLDITDNVD

SEQ ID NO: 639408 - protein, 26 aa, Mycobacterium
ATREELPELYALIKREVGDVASFEVL

SEQ ID NO: 639409 - protein, 24 aa, Mycobacterium
ATREELRIAIVTWIERTYHRRRRQ

SEQ ID NO: 639410 - protein, 27 aa, Mycobacterium
ATREHLDRITALLARVPKTARVECGGR

SEQ ID NO: 639411 - protein, 25 aa, Mycobacterium
ATREILDREILGIAEAIRGSGLSAG

SEQ ID NO: 639412 - protein, 24 aa, Mycobacterium
ATRELLDRELLGISEALRASGLAA

SEQ ID NO: 639413 - protein, 21 aa, Mycobacterium
ATREYLDYHPCATVVALAEGL

SEQ ID NO: 639414 - protein, 23 aa, Mycobacterium
ATRFGRDGAWGTWVGQWTAEEGR

SEQ ID NO: 639415 - protein, 25 aa, Mycobacterium
ATRGKRLSLARVRSFNPDSRREGFA

SEQ ID NO: 639416 - protein, 23 aa, Mycobacterium
ATRGRSTATLSTRISTAVENDID

SEQ ID NO: 639417 - protein, 17 aa, Mycobacterium
ATRHFYGALGWTPLLDV

SEQ ID NO: 639418 - protein, 28 aa, Mycobacterium
ATRIEFWAFDLLYLDGRSLLRAKYQDRR

SEQ ID NO: 639419 - protein, 19 aa, Mycobacterium
ATRIGAALGPGWPRAVKST

SEQ ID NO: 639420 - protein, 20 aa, Mycobacterium
ATRILTSFVPPIPDRVDVVW

SEQ ID NO: 639421 - protein, 18 aa, Mycobacterium
ATRLCAEFIAGEEAVTQD

SEQ ID NO: 639422 - protein, 24 aa, Mycobacterium
ATRLDGGPVRFDFRVQIAGPTDST

SEQ ID NO: 639423 - protein, 18 aa, Mycobacterium
ATRLGRCVRDLAPAGDAV

SEQ ID NO: 639424 - protein, 25 aa, Mycobacterium
ATRLLGFDCAIAYHNRRRIDGSPYR

SEQ ID NO: 639425 - protein, 25 aa, Mycobacterium
ATRLLGFDCAVAYHNRRRIDGSPFR

SEQ ID NO: 639426 - protein, 17 aa, Mycobacterium
ATRLPPERAEQFGELTA

SEQ ID NO: 639427 - protein, 19 aa, Mycobacterium
ATRLSGLFRTRRFRVYTTD

SEQ ID NO: 639428 - protein, 23 aa, Mycobacterium
ATRNQLSFLFGGVIYDLGGTLLG

SEQ ID NO: 639429 - protein, 33 aa, Mycobacterium
ATRPGPPPTVWSVRWKQRWEPPVPVAITSGTDT

SEQ ID NO: 639430 - protein, 22 aa, Mycobacterium
ATRPPAVLHRMRQTLPIQPVAI

SEQ ID NO: 639431 - protein, 34 aa, Mycobacterium
ATRPSKPEQLAWDELKAMWRADARGLDLDRDAHF

SEQ ID NO: 639432 - protein, 24 aa, Mycobacterium
ATRPSKPEQLAWDELKTMWRADAR

SEQ ID NO: 639433 - protein, 25 aa, Mycobacterium
ATRRALADVRGWRVLEALDEPSAIT

SEQ ID NO: 639434 - protein, 36 aa, Mycobacterium
ATRRFEWNKPWAQRICGHLPLPRLVWPADVVGTVTP

SEQ ID NO: 639435 - protein, 17 aa, Mycobacterium
ATRRLALTGTPFRSDDS

SEQ ID NO: 639436 - protein, 18 aa, Mycobacterium
ATRRLALTGTPFRSDDSA

SEQ ID NO: 639437 - protein, 19 aa, Mycobacterium
ATRRLSLTGTPFRSDDSPI

SEQ ID NO: 639438 - protein, 27 aa, Mycobacterium
ATRRMRWLRWPTAWASRVGCSTRSTTT

SEQ ID NO: 639439 - protein, 29 aa, Mycobacterium
ATRRPVALPRLAALAQWLEAHLPGITPAE

SEQ ID NO: 639440 - protein, 21 aa, Mycobacterium
ATRRRGVCLFERGKAYPPGSF

SEQ ID NO: 639441 - protein, 18 aa, Mycobacterium
ATRRRGWVTTFGEIEPNT

SEQ ID NO: 639442 - protein, 21 aa, Mycobacterium
ATRRRVLALGIRLLDHGHFRS

SEQ ID NO: 639443 - protein, 22 aa, Mycobacterium
ATRRTAVAAGFLRTSTEVVALI

SEQ ID NO: 639444 - protein, 27 aa, Mycobacterium
ATRRVCRSCGFYLPLAGSLGVAFGVCA

SEQ ID NO: 639445 - protein, 29 aa, Mycobacterium
ATRRWAVAHPACWALLYGSPVPGYHAPPE

SEQ ID NO: 639446 - protein, 19 aa, Mycobacterium
ATRSYRYIDYWGTAVTAFD

SEQ ID NO: 639447 - protein, 19 aa, Mycobacterium
ATRSYRYVDYWGTAVTAFD

SEQ ID NO: 639448 - protein, 24 aa, Mycobacterium
ATRSYRYVDYWGTAVTTFDLHAPH

SEQ ID NO: 639449 - protein, 18 aa, Mycobacterium
ATRTEFGLDPEVKVEALW

SEQ ID NO: 639450 - protein, 18 aa, Mycobacterium
ATRTHSWAAQDYATISEL

SEQ ID NO: 639451 - protein, 23 aa, Mycobacterium
ATRVVEVLQHIASLVADEPAFAG

SEQ ID NO: 639452 - protein, 21 aa, Mycobacterium
ATRYEWPIIDFAILSIGAVTV

SEQ ID NO: 639453 - protein, 22 aa, Mycobacterium
ATRYEWPILDFAILSIGAVTVP

SEQ ID NO: 639454 - protein, 18 aa, Mycobacterium
ATSAGRYATAEAAAASPL

SEQ ID NO: 639455 - protein, 18 aa, Mycobacterium
ATSCAWETSRESIVVNSF

SEQ ID NO: 639456 - protein, 19 aa, Mycobacterium
ATSFEARFTALDQKLNVSR

SEQ ID NO: 639457 - protein, 19 aa, Mycobacterium
ATSGRCFSAAPNFAFELAV

SEQ ID NO: 639458 - protein, 25 aa, Mycobacterium
ATSHPWPPWADPDVVQAFHDQGIRS

SEQ ID NO: 639459 - protein, 17 aa, Mycobacterium
ATSIDWSGHAAGALRAA

SEQ ID NO: 639460 - protein, 25 aa, Mycobacterium
ATSIFDVPDGFALTSDDRGVLIVPA

SEQ ID NO: 639461 - protein, 19 aa, Mycobacterium
ATSIIAIDLHESRRKLAID

SEQ ID NO: 639462 - protein, 19 aa, Mycobacterium
ATSKLRFYTNVLKLGSRNP

SEQ ID NO: 639463 - protein, 24 aa, Mycobacterium
ATSKTRFVIVDAIGVTEHEFVEPP

SEQ ID NO: 639464 - protein, 19 aa, Mycobacterium
ATSLGGLGFSMKWNMGWMH

SEQ ID NO: 639465 - protein, 28 aa, Mycobacterium
ATSLVAKWRFVGTDIDWDNTYFGVKSLI

SEQ ID NO: 639466 - protein, 23 aa, Mycobacterium
ATSNHPLLCLVDVAGVPTLLWKL

SEQ ID NO: 639467 - protein, 19 aa, Mycobacterium
ATSNMRWKDITVGHTRLWA

SEQ ID NO: 639468 - protein, 19 aa, Mycobacterium
ATSPEYLWRNPAFPTAVEL

SEQ ID NO: 639469 - protein, 17 aa, Mycobacterium
ATSPWPTADAFRRQVFE

SEQ ID NO: 639470 - protein, 22 aa, Mycobacterium
ATSRAECLRMVGDYAAANPGRP

SEQ ID NO: 639471 - protein, 17 aa, Mycobacterium
ATSRFGGIVSPPVMLQT

SEQ ID NO: 639472 - protein, 18 aa, Mycobacterium
ATSRLRLGTLVTGVHYRH

SEQ ID NO: 639473 - protein, 28 aa, Mycobacterium
ATSRPIKLMGIDSVFPLYLTLDSALSSL

SEQ ID NO: 639474 - protein, 17 aa, Mycobacterium
ATSRPLKLVGIADVVDL

SEQ ID NO: 639475 - protein, 17 aa, Mycobacterium
ATSRPPTFVLFTSGFLE

SEQ ID NO: 639476 - protein, 26 aa, Mycobacterium
ATSSGARPARSWCWVEYAGNMLTPEL

SEQ ID NO: 639477 - protein, 17 aa, Mycobacterium
ATSVFLAPPSWETLESR

SEQ ID NO: 639478 - protein, 18 aa, Mycobacterium
ATSVGLSYPAQFWPLTSG

SEQ ID NO: 639479 - protein, 20 aa, Mycobacterium
ATSVMLRGAAGFGPSRQIRT

SEQ ID NO: 639480 - protein, 26 aa, Mycobacterium
ATSVRTGLNLDRHWRNARTLASHNPD

SEQ ID NO: 639481 - protein, 19 aa, Mycobacterium
ATSYAEWLEATAIQTGQTA

SEQ ID NO: 639482 - protein, 25 aa, Mycobacterium
ATSYRCAAAAWASRTIKHTAAPKTR

SEQ ID NO: 639483 - protein, 25 aa, Mycobacterium
ATTAKRDGADWVLRGTKYYISGVDE

SEQ ID NO: 639484 - protein, 19 aa, Mycobacterium
ATTAVARRADSTRSAGTAV

SEQ ID NO: 639485 - protein, 17 aa, Mycobacterium
ATTDLVYVRMHGPDRDA

SEQ ID NO: 639486 - protein, 25 aa, Mycobacterium
ATTDRIRLGTSILLAALRRPAVLAK

SEQ ID NO: 639487 - protein, 25 aa, Mycobacterium
ATTEYHGLHAFRWIAADGSARFVRY

SEQ ID NO: 639488 - protein, 17 aa, Mycobacterium
ATTFEYLAELGLLDRIY

SEQ ID NO: 639489 - protein, 26 aa, Mycobacterium
ATTFSFGIANPGFWNVGSANIGSYNL

SEQ ID NO: 639490 - protein, 18 aa, Mycobacterium
ATTGPEIWADTDGKVTHF

SEQ ID NO: 639491 - protein, 24 aa, Mycobacterium
ATTGYRLAAQLGVRLPPRRLFGRR

SEQ ID NO: 639492 - protein, 27 aa, Mycobacterium
ATTHSRLRPPWVTDIDVVFGTSLAETI

SEQ ID NO: 639493 - protein, 31 aa, Mycobacterium
ATTHWRSAGDFRRLFPHIELDPNVLFTDCDD

SEQ ID NO: 639494 - protein, 24 aa, Mycobacterium
ATTKLRLGTAVVLPLERELFTFAK

SEQ ID NO: 639495 - protein, 24 aa, Mycobacterium
ATTKLRNGFRIERQNTRIGQDVAE

SEQ ID NO: 639496 - protein, 17 aa, Mycobacterium
ATTKMRALQTWYEGHAH

SEQ ID NO: 639497 - protein, 29 aa, Mycobacterium
ATTLFGALLPRYLATRVYAALLEAAASES

SEQ ID NO: 639498 - protein, 19 aa, Mycobacterium
ATTLFLLAPSWRYRSAADK

SEQ ID NO: 639499 - protein, 24 aa, Mycobacterium
ATTLKAAACLQAFGETSVDRERFA

SEQ ID NO: 639500 - protein, 19 aa, Mycobacterium
ATTLLALARLAGQPAVVLG

SEQ ID NO: 639501 - protein, 24 aa, Mycobacterium
ATTLRNWLGMWSLRHAQTRAEPHL

SEQ ID NO: 639502 - protein, 18 aa, Mycobacterium
ATTLVACGDYFCVRDRAL

SEQ ID NO: 639503 - protein, 18 aa, Mycobacterium
ATTMGAAERAFWQFHASL

SEQ ID NO: 639504 - protein, 18 aa, Mycobacterium
ATTPPRCEGGCRTPYPAT

SEQ ID NO: 639505 - protein, 17 aa, Mycobacterium
ATTRAHHAYRAAVTVPG

SEQ ID NO: 639506 - protein, 18 aa, Mycobacterium
ATTRRAAVAPAIIPPDVY

SEQ ID NO: 639507 - protein, 17 aa, Mycobacterium
ATTSLAEWVTGPDSPNK

SEQ ID NO: 639508 - protein, 27 aa, Mycobacterium
ATTSMNVWSNLRLVRQMLSRKPRIEGK

SEQ ID NO: 639509 - protein, 24 aa, Mycobacterium
ATTTAHWASMAYRLLNPSAGQITG

SEQ ID NO: 639510 - protein, 27 aa, Mycobacterium
ATTTLGLRVRLPWHTTRTPVTAAADAL

SEQ ID NO: 639511 - protein, 27 aa, Mycobacterium
ATTVLDTDCRVFRVAGLRVVDASAMPT

SEQ ID NO: 639512 - protein, 17 aa, Mycobacterium
ATVADVLLGVVNAPTQA

SEQ ID NO: 639513 - protein, 24 aa, Mycobacterium
ATVAEWPEGLAAVLTAAVDQARAA

SEQ ID NO: 639514 - protein, 26 aa, Mycobacterium
ATVAGSLRASREWDLPHEVLDAPQIA

SEQ ID NO: 639515 - protein, 17 aa, Mycobacterium
ATVARQFLKQALGVDVL

SEQ ID NO: 639516 - protein, 21 aa, Mycobacterium
ATVARSFLRQALGVEVLSHVI

SEQ ID NO: 639517 - protein, 22 aa, Mycobacterium
ATVARSFLRQALGVEVLSHVIA

SEQ ID NO: 639518 - protein, 17 aa, Mycobacterium
ATVASWLSELGVQTPLV

SEQ ID NO: 639519 - protein, 17 aa, Mycobacterium
ATVCGYVPVGTEPGSIT

SEQ ID NO: 639520 - protein, 21 aa, Mycobacterium
ATVDAARSWLLGTPADDWVSM

SEQ ID NO: 639521 - protein, 18 aa, Mycobacterium
ATVDALKVVAAWNDETHT

SEQ ID NO: 639522 - protein, 18 aa, Mycobacterium
ATVDEIARRAGVSHMTVY

SEQ ID NO: 639523 - protein, 22 aa, Mycobacterium
ATVDIPDGFDIVLPAGPLDPRE

SEQ ID NO: 639524 - protein, 18 aa, Mycobacterium
ATVDMRCLLIVGSSQTQW

SEQ ID NO: 639525 - protein, 19 aa, Mycobacterium
ATVDPEWDRPGDSVTSDHD

SEQ ID NO: 639526 - protein, 17 aa, Mycobacterium
ATVEGLILGSYRFTAFR

SEQ ID NO: 639527 - protein, 29 aa, Mycobacterium
ATVENGARLNIPWRRDFNALVYVLSGSGY

SEQ ID NO: 639528 - protein, 20 aa, Mycobacterium
ATVERLEGGLDHLEGTLSSL

SEQ ID NO: 639529 - protein, 17 aa, Mycobacterium
ATVFEPEALVGNSAVLA

SEQ ID NO: 639530 - protein, 18 aa, Mycobacterium
ATVFRLVAEEALKLTAAD

SEQ ID NO: 639531 - protein, 20 aa, Mycobacterium
ATVGDAWAADVVVKVAPPTT

SEQ ID NO: 639532 - protein, 19 aa, Mycobacterium
ATVGKLSVPQAWADSPAVR

SEQ ID NO: 639533 - protein, 27 aa, Mycobacterium
ATVGTARRLRVAGAGLIRAWRARTSDA

SEQ ID NO: 639534 - protein, 18 aa, Mycobacterium
ATVHPVAVLANRTQLVSL

SEQ ID NO: 639535 - protein, 27 aa, Mycobacterium
ATVKQIANRWGFIHIGRFAIYYRETYG

SEQ ID NO: 639536 - protein, 23 aa, Mycobacterium
ATVKSAHETVVWVALDGTVHPER

SEQ ID NO: 639537 - protein, 17 aa, Mycobacterium
ATVLARFAAPPAPTASG

SEQ ID NO: 639538 - protein, 24 aa, Mycobacterium
ATVLSRNTFHWVLAFADGELLTPS

SEQ ID NO: 639539 - protein, 24 aa, Mycobacterium
ATVLSRNTFHWVLAFADSELLTPA

SEQ ID NO: 639540 - protein, 24 aa, Mycobacterium
ATVLSRNTFHWVLAFARSGLSTPA

SEQ ID NO: 639541 - protein, 24 aa, Mycobacterium
ATVLSRNTFHWVLTFAHSGLSTPA

SEQ ID NO: 639542 - protein, 24 aa, Mycobacterium
ATVLTRNTFHWVLAFSPGGLSTAK

SEQ ID NO: 639543 - protein, 19 aa, Mycobacterium
ATVPFAMQRVTEMVSHSAD

SEQ ID NO: 639544 - protein, 36 aa, Mycobacterium
ATVPIGAGCKICDRPACSQRAFPYLGRPVHIDPDSS

SEQ ID NO: 639545 - protein, 20 aa, Mycobacterium
ATVPVVRIPIASAISSANTA

SEQ ID NO: 639546 - protein, 25 aa, Mycobacterium
ATVQEVRNALGLRTRWYVSAMETAG

SEQ ID NO: 639547 - protein, 23 aa, Mycobacterium
ATVRRPAVAGVRADYDKVLRQRT

SEQ ID NO: 639548 - protein, 17 aa, Mycobacterium
ATVSFLFTTPGVGEPAG

SEQ ID NO: 639549 - protein, 20 aa, Mycobacterium
ATVSGPAFELARIAESLVTS

SEQ ID NO: 639550 - protein, 17 aa, Mycobacterium
ATVSGRVAPVFDLGVGM

SEQ ID NO: 639551 - protein, 25 aa, Mycobacterium
ATVSMPLSWDELRNADPDDYTMNTV

SEQ ID NO: 639552 - protein, 30 aa, Mycobacterium
ATVSRLSPRRVAAYLAKYVTKSLHDFGITA

SEQ ID NO: 639553 - protein, 25 aa, Mycobacterium
ATVSTDHCPFCFKGQKEMGLGDFSK

SEQ ID NO: 639554 - protein, 17 aa, Mycobacterium
ATVSVQWPAELQQRVRE

SEQ ID NO: 639555 - protein, 17 aa, Mycobacterium
ATVSVWMGILLTAKLRG

SEQ ID NO: 639556 - protein, 25 aa, Mycobacterium
ATVTAWCARIDVLATDMRVEQRSLE

SEQ ID NO: 639557 - protein, 18 aa, Mycobacterium
ATVVDVVGILPVAGITPA

SEQ ID NO: 639558 - protein, 24 aa, Mycobacterium
ATVVGRLSGRYGMAVLSMGADRAE

SEQ ID NO: 639559 - protein, 20 aa, Mycobacterium
ATVVGRLTGRYAMAVLGAGL

SEQ ID NO: 639560 - protein, 20 aa, Mycobacterium
ATVVKRLVPYTAAVMNRHGW

SEQ ID NO: 639561 - protein, 19 aa, Mycobacterium
ATVVPVLEPDGIRSGTAVT

SEQ ID NO: 639562 - protein, 17 aa, Mycobacterium
ATVWRLVDPAPRQLPAP

SEQ ID NO: 639563 - protein, 19 aa, Mycobacterium
ATVYLPRATVRGLKQAALD

SEQ ID NO: 639564 - protein, 17 aa, Mycobacterium
ATVYRRFRHKRNLVRLT

SEQ ID NO: 639565 - protein, 18 aa, Mycobacterium
ATWAPAQIALAWAPDRLS

SEQ ID NO: 639566 - protein, 20 aa, Mycobacterium
ATWARKALAQVHFPVGLQAK

SEQ ID NO: 639567 - protein, 17 aa, Mycobacterium
ATWDCFGGLVEMPAMTR

SEQ ID NO: 639568 - protein, 24 aa, Mycobacterium
ATWEEMATRIGVPAANLVETARRF

SEQ ID NO: 639569 - protein, 17 aa, Mycobacterium
ATWGIAAAMTRGDITVT

SEQ ID NO: 639570 - protein, 17 aa, Mycobacterium
ATWGWLSLATGLAVVDT

SEQ ID NO: 639571 - protein, 17 aa, Mycobacterium
ATWLYDNGKPCGREANT

SEQ ID NO: 639572 - protein, 17 aa, Mycobacterium
ATWRERRKLISVLRKRG

SEQ ID NO: 639573 - protein, 24 aa, Mycobacterium
ATWRRLELGVPLVVDPVCVSMHGN

SEQ ID NO: 639574 - protein, 29 aa, Mycobacterium
ATWSHSLKSLRPGGCIVIAGATTGMNPPA

SEQ ID NO: 639575 - protein, 24 aa, Mycobacterium
ATWWDRAVRAWPDYAEYQKNTDRQ

SEQ ID NO: 639576 - protein, 19 aa, Mycobacterium
ATYAECMRAAIADAGLSPS

SEQ ID NO: 639577 - protein, 17 aa, Mycobacterium
ATYEFDIDWQLAGTAEV

SEQ ID NO: 639578 - protein, 19 aa, Mycobacterium
ATYFGPAYMIDWIHNDLGP

SEQ ID NO: 639579 - protein, 19 aa, Mycobacterium
ATYFGPAYMINWLHNDLAP

SEQ ID NO: 639580 - protein, 18 aa, Mycobacterium
ATYFRDALVLSFGAAGQG

SEQ ID NO: 639581 - protein, 17 aa, Mycobacterium
ATYGEYPTPVTFCEIFP

SEQ ID NO: 639582 - protein, 27 aa, Mycobacterium
ATYGIDFIEACRWIKENLPGVHISGGI

SEQ ID NO: 639583 - protein, 23 aa, Mycobacterium
ATYKLPYDIPLIGAQCDEANDFW

SEQ ID NO: 639584 - protein, 20 aa, Mycobacterium
ATYLIPRADFEFWNPENRPS

SEQ ID NO: 639585 - protein, 25 aa, Mycobacterium
ATYPALAAWVCHRLAGTSYSFTVHA

SEQ ID NO: 639586 - protein, 18 aa, Mycobacterium
ATYPLGRVADAFAELERR

SEQ ID NO: 639587 - protein, 26 aa, Mycobacterium
ATYRKLAAHFFLTFPQLDDVRFTHRW

SEQ ID NO: 639588 - protein, 24 aa, Mycobacterium
ATYRWPMVPALALLAAMPALGSAE

SEQ ID NO: 639589 - protein, 18 aa, Mycobacterium
ATYSPRVLREYALLADGE

SEQ ID NO: 639590 - protein, 23 aa, Mycobacterium
ATYSRMRISPCTHTNAHRWIRIW

SEQ ID NO: 639591 - protein, 23 aa, Mycobacterium
ATYSRRLPIRLVEARGTRVRDSS

SEQ ID NO: 639592 - protein, 18 aa, Mycobacterium
ATYVFPLPARAGVTDFVA

SEQ ID NO: 639593 - protein, 17 aa, Mycobacterium
ATYYAAMAVAAEADDAE

SEQ ID NO: 639594 - protein, 22 aa, Mycobacterium
AVAAALRPGDQLVLGASNPVRD

SEQ ID NO: 639595 - protein, 18 aa, Mycobacterium
AVAAARAAFPAWAGATPA

SEQ ID NO: 639596 - protein, 19 aa, Mycobacterium
AVAAARLGAHTALVTELGD

SEQ ID NO: 639597 - protein, 19 aa, Mycobacterium
AVAACAPHGVPVIADGGLQ

SEQ ID NO: 639598 - protein, 18 aa, Mycobacterium
AVAACKPYGVPVIADGGL

SEQ ID NO: 639599 - protein, 19 aa, Mycobacterium
AVAADWGIDLVPIPTGSMV

SEQ ID NO: 639600 - protein, 18 aa, Mycobacterium
AVAAELIPSLGPELVRAC

SEQ ID NO: 639601 - protein, 17 aa, Mycobacterium
AVAAGLRSIEYVVAADD

SEQ ID NO: 639602 - protein, 23 aa, Mycobacterium
AVAAHLPLSLTIALDPDDVSVEF

SEQ ID NO: 639603 - protein, 18 aa, Mycobacterium
AVAAHRAVATSTAAATVT

SEQ ID NO: 639604 - protein, 23 aa, Mycobacterium
AVAAILLIDGRVGAVIAPGGHPF

SEQ ID NO: 639605 - protein, 23 aa, Mycobacterium
AVAAKAGATWMLAFGLPRYPRAL

SEQ ID NO: 639606 - protein, 21 aa, Mycobacterium
AVAALCDRRRGLGADGLLRVT

SEQ ID NO: 639607 - protein, 19 aa, Mycobacterium
AVAALCDRRRGLGADGVLR

SEQ ID NO: 639608 - protein, 17 aa, Mycobacterium
AVAALLEPMHEALLAAN

SEQ ID NO: 639609 - protein, 29 aa, Mycobacterium
AVAANRNAFVRLVLSNVFGQNAPAIALAE

SEQ ID NO: 639610 - protein, 25 aa, Mycobacterium
AVAAPIRLSPPIGLSSARYTQSTFT

SEQ ID NO: 639611 - protein, 24 aa, Mycobacterium
AVAAPPERLLVGWTGAPAATTAQI

SEQ ID NO: 639612 - protein, 22 aa, Mycobacterium
AVAAPYASWLSAAAAQAAGTAG

SEQ ID NO: 639613 - protein, 18 aa, Mycobacterium
AVAAQLGTAFLLADEAGS

SEQ ID NO: 639614 - protein, 20 aa, Mycobacterium
AVAARGATVFALARNAEALD

SEQ ID NO: 639615 - protein, 20 aa, Mycobacterium
AVAARGAWLTLIRDGTPIEA

SEQ ID NO: 639616 - protein, 23 aa, Mycobacterium
AVAARIAVEMARRSDPDLDGILR

SEQ ID NO: 639617 - protein, 33 aa, Mycobacterium
AVAARPELTLGRARYAVHAAFALAVDIGRLVYP

SEQ ID NO: 639618 - protein, 26 aa, Mycobacterium
AVAASDLERLGSTISAANVAAAGSTT

SEQ ID NO: 639619 - protein, 30 aa, Mycobacterium
AVAASPRWADPVDRLGCLRGISALTGLALS

SEQ ID NO: 639620 - protein, 19 aa, Mycobacterium
AVAAWLWSHRRGVLAGLTA

SEQ ID NO: 639621 - protein, 21 aa, Mycobacterium
AVAAWLWSRRTATLAGLSAAA

SEQ ID NO: 639622 - protein, 18 aa, Mycobacterium
AVAAWPALCSGLRAEARQ

SEQ ID NO: 639623 - protein, 18 aa, Mycobacterium
AVAAYLPHRRRPRNPEGL

SEQ ID NO: 639624 - protein, 20 aa, Mycobacterium
AVACELVRRGEFDDVDIGVL

SEQ ID NO: 639625 - protein, 19 aa, Mycobacterium
AVACFAYRRRVPVVDTNVR

SEQ ID NO: 639626 - protein, 24 aa, Mycobacterium
AVADFWRIIEHYRITTFSTVPTVY

SEQ ID NO: 639627 - protein, 19 aa, Mycobacterium
AVADGRYAWVSQHIGDMDD

SEQ ID NO: 639628 - protein, 18 aa, Mycobacterium
AVADLLLFDADNPRSLLY

SEQ ID NO: 639629 - protein, 20 aa, Mycobacterium
AVADMLAAVFWGLGFHARML

SEQ ID NO: 639630 - protein, 28 aa, Mycobacterium
AVADSFYLPLVVRRRITFLAKAEYFTGT

SEQ ID NO: 639631 - protein, 17 aa, Mycobacterium
AVADTIKSIDVHGDVIG

SEQ ID NO: 639632 - protein, 25 aa, Mycobacterium
AVADTVAGGGFCWGYHSELDLVGHL

SEQ ID NO: 639633 - protein, 24 aa, Mycobacterium
AVADWPPERVGAVTGIGEDRIRRL

SEQ ID NO: 639634 - protein, 23 aa, Mycobacterium
AVADYPAPFPFVGGTIDRVIVDV

SEQ ID NO: 639635 - protein, 22 aa, Mycobacterium
AVAEAFRSQGYFFSSTGGSPLS

SEQ ID NO: 639636 - protein, 17 aa, Mycobacterium
AVAEARALLAIDGVAGV

SEQ ID NO: 639637 - protein, 23 aa, Mycobacterium
AVAEFAFGCGDKVSLDAVGQKAP

SEQ ID NO: 639638 - protein, 17 aa, Mycobacterium
AVAEFKTMVKAFHDAGI

SEQ ID NO: 639639 - protein, 23 aa, Mycobacterium
AVAEFNGQVILGVFNSDRQVAAR

SEQ ID NO: 639640 - protein, 28 aa, Mycobacterium
AVAEGGRFACGGGRPADRDTGFFIEPTV

SEQ ID NO: 639641 - protein, 24 aa, Mycobacterium
AVAEITALLAGLGYAGHFDFGGAR

SEQ ID NO: 639642 - protein, 26 aa, Mycobacterium
AVAELQIEAAWVWPEQHQWLKQFGET

SEQ ID NO: 639643 - protein, 17 aa, Mycobacterium
AVAERAPVCVAMTSGTA

SEQ ID NO: 639644 - protein, 28 aa, Mycobacterium
AVAERAYCVPKAVLLTAACRAAGIPARL

SEQ ID NO: 639645 - protein, 19 aa, Mycobacterium
AVAERGAQAALEFCESFDG

SEQ ID NO: 639646 - protein, 17 aa, Mycobacterium
AVAERGLSFDMWVYGHQ

SEQ ID NO: 639647 - protein, 19 aa, Mycobacterium
AVAERIRDWWGLPSTVISP

SEQ ID NO: 639648 - protein, 17 aa, Mycobacterium
AVAEVLEFGESEEDEPR

SEQ ID NO: 639649 - protein, 18 aa, Mycobacterium
AVAEYASQRWDWHDLEVG

SEQ ID NO: 639650 - protein, 20 aa, Mycobacterium
AVAFCAAGPASVPAQPVRVV

SEQ ID NO: 639651 - protein, 19 aa, Mycobacterium
AVAFELGVLASGYTSVISE

SEQ ID NO: 639652 - protein, 30 aa, Mycobacterium
AVAFGKRWVTECLRAAYPLGAGHGPVSPLF

SEQ ID NO: 639653 - protein, 20 aa, Mycobacterium
AVAFPGLELAAVITSSQDKV

SEQ ID NO: 639654 - protein, 23 aa, Mycobacterium
AVAFQVGEAFGRREGAKLGLRGL

SEQ ID NO: 639655 - protein, 18 aa, Mycobacterium
AVAGCLIAGVPFVPVPAD

SEQ ID NO: 639656 - protein, 33 aa, Mycobacterium
AVAGEELVEVFLRLAHGVGRRQVLLAHAAERQV

SEQ ID NO: 639657 - protein, 26 aa, Mycobacterium
AVAGEQPLGHLWRWELQPAGEGRTLV

SEQ ID NO: 639658 - protein, 18 aa, Mycobacterium
AVAGGGGRGMRRVGDIAA

SEQ ID NO: 639659 - protein, 17 aa, Mycobacterium
AVAGGGGRGMRRVNDIS

SEQ ID NO: 639660 - protein, 31 aa, Mycobacterium
AVAGGLARHVLCFRTLWEATFNELMKQGRVA

SEQ ID NO: 639661 - protein, 30 aa, Mycobacterium
AVAGGLARHVLCFRTLWEATYNELMKRGKI

SEQ ID NO: 639662 - protein, 17 aa, Mycobacterium
AVAGGRLALGVGPSHHW

SEQ ID NO: 639663 - protein, 18 aa, Mycobacterium
AVAGGRLALGVGPSHHWI

SEQ ID NO: 639664 - protein, 30 aa, Mycobacterium
AVAGHWLLARLGKRVLRPGGVELTRTLLSR

SEQ ID NO: 639665 - protein, 27 aa, Mycobacterium
AVAGLSLRPGYVLSDGFRVPGLPVPSL

SEQ ID NO: 639666 - protein, 19 aa, Mycobacterium
AVAGQWERSGLRAWPGDLP

SEQ ID NO: 639667 - protein, 17 aa, Mycobacterium
AVAGRPKEEYGLEPQGL

SEQ ID NO: 639668 - protein, 19 aa, Mycobacterium
AVAGRRGGVTVATNMAGRG

SEQ ID NO: 639669 - protein, 20 aa, Mycobacterium
AVAHAAWRGAGTVSEEDVRV

SEQ ID NO: 639670 - protein, 20 aa, Mycobacterium
AVAHAAWRGAPTVEEQDIRV

SEQ ID NO: 639671 - protein, 22 aa, Mycobacterium
AVAHGALAYLLKPFTFAAFRDR

SEQ ID NO: 639672 - protein, 18 aa, Mycobacterium
AVAHPRLSGRPEEQRIQR

SEQ ID NO: 639673 - protein, 17 aa, Mycobacterium
AVAIRLAAEGHLVVGGA

SEQ ID NO: 639674 - protein, 18 aa, Mycobacterium
AVAIRLGVGVLAVRKAGK

SEQ ID NO: 639675 - protein, 31 aa, Mycobacterium
AVAKARFVRVSPRKARRVIDLVRGRSVADAL

SEQ ID NO: 639676 - protein, 19 aa, Mycobacterium
AVAKARFVRVSPTKARRVI

SEQ ID NO: 639677 - protein, 34 aa, Mycobacterium
AVAKARYVPVPADLRDDWPAALVEAGFDPAQPTA

SEQ ID NO: 639678 - protein, 28 aa, Mycobacterium
AVAKLGRHRFPLVLTEAVTQFLGAVAEE

SEQ ID NO: 639679 - protein, 23 aa, Mycobacterium
AVAKLRVNREIELRLVAKVEPNG

SEQ ID NO: 639680 - protein, 18 aa, Mycobacterium
AVAKRFPDKSVRSAHAVF

SEQ ID NO: 639681 - protein, 23 aa, Mycobacterium
AVAKRIAPMEVEYVGEAAGPTTQ

SEQ ID NO: 639682 - protein, 24 aa, Mycobacterium
AVAKSSEVAIVFAVQHESEGTDLP

SEQ ID NO: 639683 - protein, 30 aa, Mycobacterium
AVAKTEALDGFRFWSVQGLQRSLPVLREDL

SEQ ID NO: 639684 - protein, 17 aa, Mycobacterium
AVALALDSEDAWVAALR

SEQ ID NO: 639685 - protein, 23 aa, Mycobacterium
AVALARPGGRVVIAGTRGGGGAP

SEQ ID NO: 639686 - protein, 22 aa, Mycobacterium
AVALARPGGRVVVAGTRGGGGA

SEQ ID NO: 639687 - protein, 24 aa, Mycobacterium
AVALGDRLVLIVGDVVGHGVEAAA

SEQ ID NO: 639688 - protein, 20 aa, Mycobacterium
AVALGYDFLPGTTVNRYCSS

SEQ ID NO: 639689 - protein, 23 aa, Mycobacterium
AVALKVSRALDVDVGRLFSDETA

SEQ ID NO: 639690 - protein, 18 aa, Mycobacterium
AVALLEWLQTTHPAPKVS

SEQ ID NO: 639691 - protein, 18 aa, Mycobacterium
AVALLRARGMHRILCEGG

SEQ ID NO: 639692 - protein, 25 aa, Mycobacterium
AVALNGGDAPLVFVSTATMSYDSVD

SEQ ID NO: 639693 - protein, 18 aa, Mycobacterium
AVALPDRVQLTIIDTGSW

SEQ ID NO: 639694 - protein, 20 aa, Mycobacterium
AVAMAGAVLQFARDEPEDAR

SEQ ID NO: 639695 - protein, 27 aa, Mycobacterium
AVAMLPGWARKPLWLPYFPPLEATAVR

SEQ ID NO: 639696 - protein, 20 aa, Mycobacterium
AVAMLSRLASGLLDTVDTGD

SEQ ID NO: 639697 - protein, 30 aa, Mycobacterium
AVANAIALRLGWRLFEPMLRSATGLDELAD

SEQ ID NO: 639698 - protein, 25 aa, Mycobacterium
AVANGLPAPTTVHWHGIALRNDMDG

SEQ ID NO: 639699 - protein, 21 aa, Mycobacterium
AVANLRRADIGPGLVATGDQV

SEQ ID NO: 639700 - protein, 24 aa, Mycobacterium
AVAPEINHTLMIAGDLGASLVEAA

SEQ ID NO: 639701 - protein, 18 aa, Mycobacterium
AVAPHLKAQGWGRIINIS

SEQ ID NO: 639702 - protein, 20 aa, Mycobacterium
AVAPQKPWFMYFCPGCGHAP

SEQ ID NO: 639703 - protein, 17 aa, Mycobacterium
AVAPWGWDQATQDDPQF

SEQ ID NO: 639704 - protein, 26 aa, Mycobacterium
AVAPYAPRLAGTPVLLDAIYDPWPTP

SEQ ID NO: 639705 - protein, 20 aa, Mycobacterium
AVAPYLRWLTGTAAQAEQIA

SEQ ID NO: 639706 - protein, 21 aa, Mycobacterium
AVAPYTSWLSAAAAQAVGAAG

SEQ ID NO: 639707 - protein, 19 aa, Mycobacterium
AVAQCLRSRLRLTTEEERR

SEQ ID NO: 639708 - protein, 27 aa, Mycobacterium
AVAQRHLKRLWGLPGTQLGVVAWPPTR

SEQ ID NO: 639709 - protein, 24 aa, Mycobacterium
AVAQRVPYQQVWNLTGQPVAAVPW

SEQ ID NO: 639710 - protein, 20 aa, Mycobacterium
AVAQSWYKLVGDTGEIVSIE

SEQ ID NO: 639711 - protein, 27 aa, Mycobacterium
AVARARRAGVSSFGFGGTNAHVVLEQA

SEQ ID NO: 639712 - protein, 25 aa, Mycobacterium
AVAREVLRAGPGIPELRAAGEKMLD

SEQ ID NO: 639713 - protein, 24 aa, Mycobacterium
AVARFGDALPFLVKVLAADEPLSL

SEQ ID NO: 639714 - protein, 25 aa, Mycobacterium
AVARGDASAGWCVSIAITSALLVAY

SEQ ID NO: 639715 - protein, 18 aa, Mycobacterium
AVARLGRHQFPLVCTDTV

SEQ ID NO: 639716 - protein, 19 aa, Mycobacterium
AVARLGRHQFPLVITDTVA

SEQ ID NO: 639717 - protein, 19 aa, Mycobacterium
AVARLGRHQFPLVLTDTVA

SEQ ID NO: 639718 - protein, 25 aa, Mycobacterium
AVARLRTVRDLELRLVAKVEPNGPT

SEQ ID NO: 639719 - protein, 25 aa, Mycobacterium
AVARLTSRHDVMWAMVTDMPAAGVK

SEQ ID NO: 639720 - protein, 20 aa, Mycobacterium
AVARLVSGLVRLGGEGARVE

SEQ ID NO: 639721 - protein, 23 aa, Mycobacterium
AVARRADGRLVLGSADGAVYTLA

SEQ ID NO: 639722 - protein, 27 aa, Mycobacterium
AVARRLARFGAGWIPWGPDARDVAAGI

SEQ ID NO: 639723 - protein, 19 aa, Mycobacterium
AVARRPADIGFVLADGLSP

SEQ ID NO: 639724 - protein, 18 aa, Mycobacterium
AVARRQARVRAMLHTLPK

SEQ ID NO: 639725 - protein, 19 aa, Mycobacterium
AVARTLAPSVAWPVVADAY

SEQ ID NO: 639726 - protein, 23 aa, Mycobacterium
AVARYVAELLVWDRAVRADVDDS

SEQ ID NO: 639727 - protein, 19 aa, Mycobacterium
AVASEFRVLRTAGVESDME

SEQ ID NO: 639728 - protein, 18 aa, Mycobacterium
AVASFPFEHARIRLAYGM

SEQ ID NO: 639729 - protein, 26 aa, Mycobacterium
AVASGRWPAVRFAVRHTVVQGPNAVP

SEQ ID NO: 639730 - protein, 22 aa, Mycobacterium
AVASLLAPLGIEYVVQYRRGVP

SEQ ID NO: 639731 - protein, 24 aa, Mycobacterium
AVATARRVGMEWVGETTKYYGLSL

SEQ ID NO: 639732 - protein, 25 aa, Mycobacterium
AVATGEFLAAIGFTQVQALTQVEVA

SEQ ID NO: 639733 - protein, 22 aa, Mycobacterium
AVATGEVHVCFGVTEPGAGLDT

SEQ ID NO: 639734 - protein, 31 aa, Mycobacterium
AVATGMARHVLCFRTLWEATFNQLMKEGKAS

SEQ ID NO: 639735 - protein, 18 aa, Mycobacterium
AVATLFAGFGQEYQVLST

SEQ ID NO: 639736 - protein, 19 aa, Mycobacterium
AVATMGPRLVRGHATLDGA

SEQ ID NO: 639737 - protein, 21 aa, Mycobacterium
AVAVADGRAYVGIAAAGHDAV

SEQ ID NO: 639738 - protein, 18 aa, Mycobacterium
AVAVARCGHRLEHVEMVT

SEQ ID NO: 639739 - protein, 27 aa, Mycobacterium
AVAVKQGWFCCWNRANQLHVSTGIIGP

SEQ ID NO: 639740 - protein, 19 aa, Mycobacterium
AVAVLCGTDARYGTEASAA

SEQ ID NO: 639741 - protein, 18 aa, Mycobacterium
AVAVRLGPTVLRTSTAAA

SEQ ID NO: 639742 - protein, 18 aa, Mycobacterium
AVAWLARKVEAFGVRLKA

SEQ ID NO: 639743 - protein, 18 aa, Mycobacterium
AVAWLARKVEGFGVRLRK

SEQ ID NO: 639744 - protein, 23 aa, Mycobacterium
AVCALEPYWEAVRKVYAPFESGL

SEQ ID NO: 639745 - protein, 18 aa, Mycobacterium
AVCDDCVRELFDPRDRRF

SEQ ID NO: 639746 - protein, 17 aa, Mycobacterium
AVCELIHLATLYHDDVM

SEQ ID NO: 639747 - protein, 19 aa, Mycobacterium
AVCELLRQHGFAGATVLLG

SEQ ID NO: 639748 - protein, 23 aa, Mycobacterium
AVCEPGQGWAPLAPAVTATETDA

SEQ ID NO: 639749 - protein, 20 aa, Mycobacterium
AVCFSELPSRLDLPSIHSGY

SEQ ID NO: 639750 - protein, 18 aa, Mycobacterium
AVCGGAEVAARYAAEPGY

SEQ ID NO: 639751 - protein, 18 aa, Mycobacterium
AVCKCPPGHVLVVDAGGQ

SEQ ID NO: 639752 - protein, 19 aa, Mycobacterium
AVCRGEFGALTGRGEELDA

SEQ ID NO: 639753 - protein, 24 aa, Mycobacterium
AVCRRAEVERLFALAAEPEDLTSG

SEQ ID NO: 639754 - protein, 24 aa, Mycobacterium
AVCSARTAAQFGVEPRVAMLSYST

SEQ ID NO: 639755 - protein, 17 aa, Mycobacterium
AVCTAMLDLYQHEGIIA

SEQ ID NO: 639756 - protein, 17 aa, Mycobacterium
AVCTAMLGLYQNEGIIA

SEQ ID NO: 639757 - protein, 17 aa, Mycobacterium
AVCTTMLDLYQNEGIIA

SEQ ID NO: 639758 - protein, 19 aa, Mycobacterium
AVCTVGRKAAALQWHAVDV

SEQ ID NO: 639759 - protein, 23 aa, Mycobacterium
AVCVVCAPQGIAALEAVAPDMRL

SEQ ID NO: 639760 - protein, 19 aa, Mycobacterium
AVDAATAWHGRLHGVVHSA

SEQ ID NO: 639761 - protein, 17 aa, Mycobacterium
AVDAGLIHISTDYVFGA

SEQ ID NO: 639762 - protein, 36 aa, Mycobacterium
AVDAGVRFVLATGRPPRWVGPVVDQLGFAPMAVCAN

SEQ ID NO: 639763 - protein, 19 aa, Mycobacterium
AVDARRLGLPLAQQLSAYL

SEQ ID NO: 639764 - protein, 25 aa, Mycobacterium
AVDARRLGVPLAQALSAYLRGLDAG

SEQ ID NO: 639765 - protein, 24 aa, Mycobacterium
AVDARRLGVPLAQELSAHLRTLEP

SEQ ID NO: 639766 - protein, 25 aa, Mycobacterium
AVDARRLGVPLAQELSAYLRGLEPA

SEQ ID NO: 639767 - protein, 25 aa, Mycobacterium
AVDAWLCGWDEKFTTALAARGWLGM

SEQ ID NO: 639768 - protein, 18 aa, Mycobacterium
AVDCAQALLDLHIVDGRL

SEQ ID NO: 639769 - protein, 25 aa, Mycobacterium
AVDDGVAALGRLDIIVANAGVAAPQ

SEQ ID NO: 639770 - protein, 30 aa, Mycobacterium
AVDDPARWARWAAPCPIGDAEIRRAKERKH

SEQ ID NO: 639771 - protein, 23 aa, Mycobacterium
AVDEAMAGFATRVDVKIHADGSV

SEQ ID NO: 639772 - protein, 19 aa, Mycobacterium
AVDEARALLSIDGVEGVNV

SEQ ID NO: 639773 - protein, 20 aa, Mycobacterium
AVDEGAVCTTMLDLYQNEGI

SEQ ID NO: 639774 - protein, 25 aa, Mycobacterium
AVDEIRPGPDFPPFAVIWGDSNLGL

SEQ ID NO: 639775 - protein, 19 aa, Mycobacterium
AVDELRTAGSWEAAQTHVS

SEQ ID NO: 639776 - protein, 20 aa, Mycobacterium
AVDEVVRVGGRFEVVSPHAP

SEQ ID NO: 639777 - protein, 18 aa, Mycobacterium
AVDFRASMRTRQLNAAQL

SEQ ID NO: 639778 - protein, 18 aa, Mycobacterium
AVDGARKCVEEAAKYPGT

SEQ ID NO: 639779 - protein, 19 aa, Mycobacterium
AVDGFPRLLRLNSVRFTVV

SEQ ID NO: 639780 - protein, 26 aa, Mycobacterium
AVDGGYRLSGSWSFGSGTGHAQYIAA

SEQ ID NO: 639781 - protein, 26 aa, Mycobacterium
AVDGGYRLTGAWSFGSGTGHAEYVAA

SEQ ID NO: 639782 - protein, 25 aa, Mycobacterium
AVDGLNRFSATLAHDRDNLGRALDT

SEQ ID NO: 639783 - protein, 29 aa, Mycobacterium
AVDGLVRSFGCEWGRYGITVNGLAPTVFR

SEQ ID NO: 639784 - protein, 18 aa, Mycobacterium
AVDGRLLADGGILDPLPM

SEQ ID NO: 639785 - protein, 18 aa, Mycobacterium
AVDHCKRLITATGAVQRI

SEQ ID NO: 639786 - protein, 19 aa, Mycobacterium
AVDHVECAHALEAGVRELR

SEQ ID NO: 639787 - protein, 17 aa, Mycobacterium
AVDICRDYDTVGYRMAT

SEQ ID NO: 639788 - protein, 17 aa, Mycobacterium
AVDIPLLANMTEFGKSE

SEQ ID NO: 639789 - protein, 17 aa, Mycobacterium
AVDIRYASADAKFSVRE

SEQ ID NO: 639790 - protein, 18 aa, Mycobacterium
AVDIRYASSDAKFSVREV

SEQ ID NO: 639791 - protein, 24 aa, Mycobacterium
AVDLCAQIASVPYPLATPDDLATT

SEQ ID NO: 639792 - protein, 17 aa, Mycobacterium
AVDLCQDIDSIGYSLAT

SEQ ID NO: 639793 - protein, 20 aa, Mycobacterium
AVDLCWEVIDATTWTPGQLR

SEQ ID NO: 639794 - protein, 19 aa, Mycobacterium
AVDLRDDWIAALRTAGFDA

SEQ ID NO: 639795 - protein, 25 aa, Mycobacterium
AVDLRDDWPSALRQAGFRADRPTAW

SEQ ID NO: 639796 - protein, 18 aa, Mycobacterium
AVDLYRPMVEMYVSVIKL

SEQ ID NO: 639797 - protein, 30 aa, Mycobacterium
AVDPAHPFPFVSGLSLNLAVMVRQPEDGGQ

SEQ ID NO: 639798 - protein, 28 aa, Mycobacterium
AVDPAHPFPFVSGLSLNLAVTVRQPEDG

SEQ ID NO: 639799 - protein, 22 aa, Mycobacterium
AVDPRPEYTAVIGNPPYIRYQD

SEQ ID NO: 639800 - protein, 22 aa, Mycobacterium
AVDPRSGNLMVIEKTSANSSRV

SEQ ID NO: 639801 - protein, 22 aa, Mycobacterium
AVDPSVVVLLNLSRDQLDRVGE

SEQ ID NO: 639802 - protein, 24 aa, Mycobacterium
AVDPVSLQTAMGFSAQGQEHSAMA

SEQ ID NO: 639803 - protein, 22 aa, Mycobacterium
AVDPYAIGVPGVYLCSQSTPPG

SEQ ID NO: 639804 - protein, 21 aa, Mycobacterium
AVDPYEWKREQALKFGATAAF

SEQ ID NO: 639805 - protein, 24 aa, Mycobacterium
AVDRAILRVAVWELLHAQDVPEVV

SEQ ID NO: 639806 - protein, 24 aa, Mycobacterium
AVDRAILRVSVWELLHADDVPEPV

SEQ ID NO: 639807 - protein, 18 aa, Mycobacterium
AVDRARLAGLRATTMHRL

SEQ ID NO: 639808 - protein, 22 aa, Mycobacterium
AVDRDGVVVGYVLGSTYSVLTD

SEQ ID NO: 639809 - protein, 17 aa, Mycobacterium
AVDRGRWGCVLGGDPLR

SEQ ID NO: 639810 - protein, 22 aa, Mycobacterium
AVDRHWRVYIDPVLLGTDEGWS

SEQ ID NO: 639811 - protein, 17 aa, Mycobacterium
AVDRIKALTGRIDLVHC

SEQ ID NO: 639812 - protein, 28 aa, Mycobacterium
AVDRLDPEQGWMLSAVWLHPDNEPGVLI

SEQ ID NO: 639813 - protein, 30 aa, Mycobacterium
AVDSGLEWVSLRPTMFVSNLVGMWSTQLQA

SEQ ID NO: 639814 - protein, 17 aa, Mycobacterium
AVDSSWVRDALVHLDGD

SEQ ID NO: 639815 - protein, 18 aa, Mycobacterium
AVDVALGGAHAFLGEFDE

SEQ ID NO: 639816 - protein, 17 aa, Mycobacterium
AVDVLIFPNAIRVVEES

SEQ ID NO: 639817 - protein, 19 aa, Mycobacterium
AVDYAARRAALKALEHPKI

SEQ ID NO: 639818 - protein, 25 aa, Mycobacterium
AVDYLTFRLTGRWVGSQMNAVCKYN

SEQ ID NO: 639819 - protein, 22 aa, Mycobacterium
AVEACAISGQFPGSEVIVDSVC

SEQ ID NO: 639820 - protein, 17 aa, Mycobacterium
AVEAELPAFAPAMVRAR

SEQ ID NO: 639821 - protein, 17 aa, Mycobacterium
AVEAGLPADLFQVLPGR

SEQ ID NO: 639822 - protein, 24 aa, Mycobacterium
AVEAGPFLNVALEYGGNLDFATIE

SEQ ID NO: 639823 - protein, 17 aa, Mycobacterium
AVEDAWAATLWVAEQGA

SEQ ID NO: 639824 - protein, 19 aa, Mycobacterium
AVEDAWAATLWVAGHAAEL

SEQ ID NO: 639825 - protein, 18 aa, Mycobacterium
AVEDLGYRGFWRGYFATR

SEQ ID NO: 639826 - protein, 19 aa, Mycobacterium
AVEDVFPLPRELVGEGTLF

SEQ ID NO: 639827 - protein, 19 aa, Mycobacterium
AVEDVFPLPRELVGQGTLF

SEQ ID NO: 639828 - protein, 23 aa, Mycobacterium
AVEEARALLSIDGIEGVNISGSA

SEQ ID NO: 639829 - protein, 23 aa, Mycobacterium
AVEEFIRWATPVMTFRRTAATDF

SEQ ID NO: 639830 - protein, 23 aa, Mycobacterium
AVEEFIRWATPVMTFRRTAATDI

SEQ ID NO: 639831 - protein, 26 aa, Mycobacterium
AVEEIIRWTAPVKEFMRTATADTEVR

SEQ ID NO: 639832 - protein, 21 aa, Mycobacterium
AVEEIVRWASPVVYMRRTLSQ

SEQ ID NO: 639833 - protein, 27 aa, Mycobacterium
AVEELLRWATPVMHFRRTVVRDVEIRG

SEQ ID NO: 639834 - protein, 17 aa, Mycobacterium
AVEELLRYLSIIQNGQR

SEQ ID NO: 639835 - protein, 28 aa, Mycobacterium
AVEEMIRWSTPVKEFMRTAAEDTTVRGV

SEQ ID NO: 639836 - protein, 22 aa, Mycobacterium
AVEEMIRWVVPVKEFMRTAQAD

SEQ ID NO: 639837 - protein, 19 aa, Mycobacterium
AVEEVTWDRFGVRLEAIGA

SEQ ID NO: 639838 - protein, 21 aa, Mycobacterium
AVEFSTWTPHWFGVVDGPVEA

SEQ ID NO: 639839 - protein, 27 aa, Mycobacterium
AVEGVKGKAKEVIGVVTGRDDLQREGE

SEQ ID NO: 639840 - protein, 24 aa, Mycobacterium
AVEHHAVLDAVQWLADHEGAAVTW

SEQ ID NO: 639841 - protein, 24 aa, Mycobacterium
AVEICSLSWPTTRITTADLVVTGL

SEQ ID NO: 639842 - protein, 28 aa, Mycobacterium
AVEITKPRVAIPIHYNDFSVFLSGLDDF

SEQ ID NO: 639843 - protein, 18 aa, Mycobacterium
AVEKALAYMDLRPGTPMR

SEQ ID NO: 639844 - protein, 26 aa, Mycobacterium
AVEKARKTLKKWINFLEDCKPYAKAL

SEQ ID NO: 639845 - protein, 19 aa, Mycobacterium
AVEKFDYTKGYKFSTYATW

SEQ ID NO: 639846 - protein, 19 aa, Mycobacterium
AVEKIKVFDAFPLTHHTEC

SEQ ID NO: 639847 - protein, 24 aa, Mycobacterium
AVEKLKAGELVGVYPEATISRSFE

SEQ ID NO: 639848 - protein, 26 aa, Mycobacterium
AVEKLSALKSEIGFSQVLYDDHIGKV

SEQ ID NO: 639849 - protein, 18 aa, Mycobacterium
AVELALAGYPGFHVTTPP

SEQ ID NO: 639850 - protein, 18 aa, Mycobacterium
AVELARGRHREFFQRHNV

SEQ ID NO: 639851 - protein, 20 aa, Mycobacterium
AVELCREIGNAAPLSAHAKR

SEQ ID NO: 639852 - protein, 32 aa, Mycobacterium
AVELELRYRGLRSPHKLKMGVSGCARECAEAR

SEQ ID NO: 639853 - protein, 20 aa, Mycobacterium
AVELFKPLAKKATRPEVRGD

SEQ ID NO: 639854 - protein, 27 aa, Mycobacterium
AVELLRYCLQHGYQLRIIEQMPLDASH

SEQ ID NO: 639855 - protein, 24 aa, Mycobacterium
AVELRNRLKAATGLSLTPTLVFDY

SEQ ID NO: 639856 - protein, 26 aa, Mycobacterium
AVELRRRGCEVGRLIVLDAAGEVDSA

SEQ ID NO: 639857 - protein, 18 aa, Mycobacterium
AVELRYYLGSAHYRSMLE

SEQ ID NO: 639858 - protein, 23 aa, Mycobacterium
AVEMLLFQRARLIGSASGKVPAL

SEQ ID NO: 639859 - protein, 21 aa, Mycobacterium
AVEMMARRAKSRFTQGSSLAD

SEQ ID NO: 639860 - protein, 23 aa, Mycobacterium
AVEMRARHTAVRFGDPSQATPLE

SEQ ID NO: 639861 - protein, 26 aa, Mycobacterium
AVEMRNRLKAATGLALSPTLIFDYPN

SEQ ID NO: 639862 - protein, 25 aa, Mycobacterium
AVENALKVAFDWKSRFNEARGLDPA

SEQ ID NO: 639863 - protein, 24 aa, Mycobacterium
AVENALKVAFDWKSRHNEAHGIDP

SEQ ID NO: 639864 - protein, 25 aa, Mycobacterium
AVENALKVAFDWKSRHNQALGIDAG

SEQ ID NO: 639865 - protein, 24 aa, Mycobacterium
AVENALKVAFDWKSRHNQARGIDP

SEQ ID NO: 639866 - protein, 24 aa, Mycobacterium
AVENALKVAFDWKSRLNEAQGRSP

SEQ ID NO: 639867 - protein, 27 aa, Mycobacterium
AVENALKVAFDWKSRWNEAHGIDASLG

SEQ ID NO: 639868 - protein, 19 aa, Mycobacterium
AVENMIPAQVCLTNRTTQA

SEQ ID NO: 639869 - protein, 22 aa, Mycobacterium
AVEPAILRPSFRNWDHPYRRQI

SEQ ID NO: 639870 - protein, 20 aa, Mycobacterium
AVEPAVLVLLNLSRDQLDRV

SEQ ID NO: 639871 - protein, 18 aa, Mycobacterium
AVEPERRLAVLAEQAAAG

SEQ ID NO: 639872 - protein, 37 aa, Mycobacterium
AVEPGDFVILNWRAVCGQCRACKRGRPHLCFDTFNAA

SEQ ID NO: 639873 - protein, 22 aa, Mycobacterium
AVEPGILRPSFRNWDHPYRRQI

SEQ ID NO: 639874 - protein, 18 aa, Mycobacterium
AVEPGRFGLLEAELGQQA

SEQ ID NO: 639875 - protein, 20 aa, Mycobacterium
AVEPLPGGWLVRPAGGEDGE

SEQ ID NO: 639876 - protein, 19 aa, Mycobacterium
AVEQARWWERHIVEILSGR

SEQ ID NO: 639877 - protein, 17 aa, Mycobacterium
AVEQLAFEAYRDVSHLL

SEQ ID NO: 639878 - protein, 19 aa, Mycobacterium
AVEQLGLAVEVVRGRAEDP

SEQ ID NO: 639879 - protein, 21 aa, Mycobacterium
AVERGSTVLRFSKGPTDKLDV

SEQ ID NO: 639880 - protein, 21 aa, Mycobacterium
AVERIELFADALIKGGRPADT

SEQ ID NO: 639881 - protein, 19 aa, Mycobacterium
AVERIELFAEALLAGGRPA

SEQ ID NO: 639882 - protein, 24 aa, Mycobacterium
AVERMVASVAEFVPGYRLKQKVQF

SEQ ID NO: 639883 - protein, 23 aa, Mycobacterium
AVERPPEDWLFKARTGDTVVDVL

SEQ ID NO: 639884 - protein, 18 aa, Mycobacterium
AVERVMVVRDRVRTEPPH

SEQ ID NO: 639885 - protein, 24 aa, Mycobacterium
AVESGIKVARKWGTDVKGVAAGQS

SEQ ID NO: 639886 - protein, 23 aa, Mycobacterium
AVESGIKVARKWGTDVKGVPVDQ

SEQ ID NO: 639887 - protein, 24 aa, Mycobacterium
AVESGIKVARKWGTDVKGVSDSTI

SEQ ID NO: 639888 - protein, 24 aa, Mycobacterium
AVESGLKVARKWGADVKGVPDGRA

SEQ ID NO: 639889 - protein, 24 aa, Mycobacterium
AVESGLKVARKWGADVKGVPEGQA

SEQ ID NO: 639890 - protein, 25 aa, Mycobacterium
AVESPEPPAFLLLGSDALSAYRRVA

SEQ ID NO: 639891 - protein, 27 aa, Mycobacterium
AVEVALFRLLESWGIHPDFVMGHSIGE

SEQ ID NO: 639892 - protein, 27 aa, Mycobacterium
AVEVALFRLLESWGIHPDLVLGHSIGE

SEQ ID NO: 639893 - protein, 28 aa, Mycobacterium
AVEVALRSARGFGGPVIVHVVTRKGMGY

SEQ ID NO: 639894 - protein, 19 aa, Mycobacterium
AVEVLDSFAARSLQTIARM

SEQ ID NO: 639895 - protein, 20 aa, Mycobacterium
AVEVLRPDFEKFYADESLTA

SEQ ID NO: 639896 - protein, 17 aa, Mycobacterium
AVEYARRDGLLAEDELF

SEQ ID NO: 639897 - protein, 19 aa, Mycobacterium
AVEYLRILVDGGLSVPDAL

SEQ ID NO: 639898 - protein, 23 aa, Mycobacterium
AVFAAQHHMHWVSLGLGPGWNHS

SEQ ID NO: 639899 - protein, 21 aa, Mycobacterium
AVFADPRWRAHHDRMSELGFE

SEQ ID NO: 639900 - protein, 22 aa, Mycobacterium
AVFADPRWRAHHDRMSELGFEV

SEQ ID NO: 639901 - protein, 19 aa, Mycobacterium
AVFAEAYLGTARHLEVQVV

SEQ ID NO: 639902 - protein, 17 aa, Mycobacterium
AVFAGEIVDRFVVGASG

SEQ ID NO: 639903 - protein, 18 aa, Mycobacterium
AVFASLRALGGRPPYTVV

SEQ ID NO: 639904 - protein, 17 aa, Mycobacterium
AVFAYWVANPSAYGVVE

SEQ ID NO: 639905 - protein, 18 aa, Mycobacterium
AVFCAAGLAVLTFDYRGF

SEQ ID NO: 639906 - protein, 19 aa, Mycobacterium
AVFEAMRACDIRYAEPPAS

SEQ ID NO: 639907 - protein, 26 aa, Mycobacterium
AVFEMLKILWPGYSISWAYGATAELV

SEQ ID NO: 639908 - protein, 18 aa, Mycobacterium
AVFETNYFGALRVAKAFA

SEQ ID NO: 639909 - protein, 23 aa, Mycobacterium
AVFFHQRAAAFVSQIDEVEGMRA

SEQ ID NO: 639910 - protein, 34 aa, Mycobacterium
AVFGEGCFWGAERGFWKLPGVYSTAVGYAGGYTP

SEQ ID NO: 639911 - protein, 24 aa, Mycobacterium
AVFGRPSEHLRVIGVTGTSGKTTT

SEQ ID NO: 639912 - protein, 17 aa, Mycobacterium
AVFGSFDNGRLVGVASM

SEQ ID NO: 639913 - protein, 19 aa, Mycobacterium
AVFIRAPWVERVGDGVEVL

SEQ ID NO: 639914 - protein, 17 aa, Mycobacterium
AVFKRELIDTGLSEQQA

SEQ ID NO: 639915 - protein, 17 aa, Mycobacterium
AVFLRLLGVPVIVVAQP

SEQ ID NO: 639916 - protein, 19 aa, Mycobacterium
AVFPLVIRAGGGSPRDTLS

SEQ ID NO: 639917 - protein, 18 aa, Mycobacterium
AVFQQFQGGAIIAKNNQA

SEQ ID NO: 639918 - protein, 19 aa, Mycobacterium
AVFRDPALDAVRRDHGLVV

SEQ ID NO: 639919 - protein, 19 aa, Mycobacterium
AVFREHFGAERVVESPSPL

SEQ ID NO: 639920 - protein, 33 aa, Mycobacterium
AVFSRRCGTPGAPALVLVHGFPTSSIDYFALAG

SEQ ID NO: 639921 - protein, 20 aa, Mycobacterium
AVFTAEAWGSDAYTPLAWLG

SEQ ID NO: 639922 - protein, 25 aa, Mycobacterium
AVFTRVRPRLFGVAYRMTGTVAEAE

SEQ ID NO: 639923 - protein, 19 aa, Mycobacterium
AVFWTARQIGCSWCVDFGS

SEQ ID NO: 639924 - protein, 18 aa, Mycobacterium
AVGAAAACLDRGVRVGCF

SEQ ID NO: 639925 - protein, 24 aa, Mycobacterium
AVGAACGTVGFALTEQAKQLGSDV

SEQ ID NO: 639926 - protein, 17 aa, Mycobacterium
AVGACPECHGLGRIHRV

SEQ ID NO: 639927 - protein, 18 aa, Mycobacterium
AVGACRLPTIAAVNGAAV

SEQ ID NO: 639928 - protein, 17 aa, Mycobacterium
AVGAGGFGVVLNSLAGE

SEQ ID NO: 639929 - protein, 25 aa, Mycobacterium
AVGAKAAVIPAHYPGCGGATIRAVE

SEQ ID NO: 639930 - protein, 17 aa, Mycobacterium
AVGALLSVFARLSGGKA

SEQ ID NO: 639931 - protein, 18 aa, Mycobacterium
AVGAPGACQDRFSIPANT

SEQ ID NO: 639932 - protein, 29 aa, Mycobacterium
AVGARRPRIGIPMAVVYGFAYLADAIGSV

SEQ ID NO: 639933 - protein, 23 aa, Mycobacterium
AVGCPTMRAARVTRLDGPDAIEV

SEQ ID NO: 639934 - protein, 17 aa, Mycobacterium
AVGCSSLGTFSTRFAEL

SEQ ID NO: 639935 - protein, 19 aa, Mycobacterium
AVGDFLRRLLGSSPGSPGS

SEQ ID NO: 639936 - protein, 27 aa, Mycobacterium
AVGDIFFPRVFLRRGQFLPAGTVTLTI

SEQ ID NO: 639937 - protein, 25 aa, Mycobacterium
AVGDIPWNLIWALLKEVAEAYLAFN

SEQ ID NO: 639938 - protein, 24 aa, Mycobacterium
AVGDPGLIVAVWDRRLHTGARAAG

SEQ ID NO: 639939 - protein, 23 aa, Mycobacterium
AVGDRVAIGWFGGHCGTCVPCRK

SEQ ID NO: 639940 - protein, 34 aa, Mycobacterium
AVGDRVGIAWLRHTCGVCKYCRRGDENLCPKSLY

SEQ ID NO: 639941 - protein, 26 aa, Mycobacterium
AVGEAADAFSTWRTTPAPVRGTLVAR

SEQ ID NO: 639942 - protein, 19 aa, Mycobacterium
AVGEFEFRAAAVIVTSGGI

SEQ ID NO: 639943 - protein, 24 aa, Mycobacterium
AVGEFPADRGWNLAELFDPDPDAV

SEQ ID NO: 639944 - protein, 25 aa, Mycobacterium
AVGEFSEPFIQLWDPSYTYVGSNIA

SEQ ID NO: 639945 - protein, 25 aa, Mycobacterium
AVGEGLRTSDEFNAAVVLVAALNDP

SEQ ID NO: 639946 - protein, 23 aa, Mycobacterium
AVGEGRRPVQWCVDLLNKERRSS

SEQ ID NO: 639947 - protein, 19 aa, Mycobacterium
AVGELDWAQVMAGDRSLGV

SEQ ID NO: 639948 - protein, 21 aa, Mycobacterium
AVGERPPLRQVLGGPSDDPFG

SEQ ID NO: 639949 - protein, 17 aa, Mycobacterium
AVGEVLRMKYFDQEMVA

SEQ ID NO: 639950 - protein, 31 aa, Mycobacterium
AVGFGKRWVTECLRASYPLGHGHGPVSPLFR

SEQ ID NO: 639951 - protein, 23 aa, Mycobacterium
AVGFPGGYGIQIGIGRGKPTWSM

SEQ ID NO: 639952 - protein, 19 aa, Mycobacterium
AVGFVPKFALSVPAIQNLL

SEQ ID NO: 639953 - protein, 23 aa, Mycobacterium
AVGGELKNTFCLTDGTRAYLSGH

SEQ ID NO: 639954 - protein, 18 aa, Mycobacterium
AVGGELPDLSGLVQAGAV

SEQ ID NO: 639955 - protein, 17 aa, Mycobacterium
AVGGGWIGYLGYPDRAA

SEQ ID NO: 639956 - protein, 19 aa, Mycobacterium
AVGGLRVDTVLNRILHSGL

SEQ ID NO: 639957 - protein, 23 aa, Mycobacterium
AVGGSWLAPRIAQYGSVDVKLAL

SEQ ID NO: 639958 - protein, 20 aa, Mycobacterium
AVGHGRIPRNLNFRQLTPHA

SEQ ID NO: 639959 - protein, 25 aa, Mycobacterium
AVGHLRSGMTIGIAGWGSRRKPMAF

SEQ ID NO: 639960 - protein, 19 aa, Mycobacterium
AVGHPDPPRRAVGQRGITT

SEQ ID NO: 639961 - protein, 24 aa, Mycobacterium
AVGILCRNGHGFIEATFATALVGA

SEQ ID NO: 639962 - protein, 17 aa, Mycobacterium
AVGKLYVQRHFPPGAKA

SEQ ID NO: 639963 - protein, 36 aa, Mycobacterium
AVGLAAWRLGAGRSRPGDRVQFGAGIRLHRRPGEPV

SEQ ID NO: 639964 - protein, 20 aa, Mycobacterium
AVGLARLGRHVDFLTHIADD

SEQ ID NO: 639965 - protein, 24 aa, Mycobacterium
AVGLARRGSLRAGFDANLVVLDRD

SEQ ID NO: 639966 - protein, 24 aa, Mycobacterium
AVGLAVWRLGAGRSVPGEQVQFGA

SEQ ID NO: 639967 - protein, 20 aa, Mycobacterium
AVGLCALRSALAQGAATVFA

SEQ ID NO: 639968 - protein, 19 aa, Mycobacterium
AVGLDGRWMREIADEMYTS

SEQ ID NO: 639969 - protein, 20 aa, Mycobacterium
AVGLGCNLALAADFTVADAD

SEQ ID NO: 639970 - protein, 26 aa, Mycobacterium
AVGLGYEPTRIASLLPGAAMPGPSAA

SEQ ID NO: 639971 - protein, 19 aa, Mycobacterium
AVGLPAIYVPLPIGNGEQR

SEQ ID NO: 639972 - protein, 20 aa, Mycobacterium
AVGLPAVYVPLPIGNGEQRL

SEQ ID NO: 639973 - protein, 18 aa, Mycobacterium
AVGLQWALVARRHGELSE

SEQ ID NO: 639974 - protein, 17 aa, Mycobacterium
AVGLQWALVARRHSELS

SEQ ID NO: 639975 - protein, 20 aa, Mycobacterium
AVGLRPVRRYDDDPVAVVQG

SEQ ID NO: 639976 - protein, 18 aa, Mycobacterium
AVGLSRQLYGLTIASERP

SEQ ID NO: 639977 - protein, 26 aa, Mycobacterium
AVGMEFRPGIPVPPVFTSRPQVHPTY

SEQ ID NO: 639978 - protein, 20 aa, Mycobacterium
AVGMVRRLAVIQFERAAVAR

SEQ ID NO: 639979 - protein, 24 aa, Mycobacterium
AVGPELAGLGGLYLEDCRVGEPAP

SEQ ID NO: 639980 - protein, 26 aa, Mycobacterium
AVGPGRPRLAVVMSKFDVLRALNEVE

SEQ ID NO: 639981 - protein, 23 aa, Mycobacterium
AVGPKLPELWGGSADLAGSNNTT

SEQ ID NO: 639982 - protein, 17 aa, Mycobacterium
AVGPRMTRVAARDADGL

SEQ ID NO: 639983 - protein, 30 aa, Mycobacterium
AVGQCALRSALALGAARVFAVDPVVARRER

SEQ ID NO: 639984 - protein, 25 aa, Mycobacterium
AVGQRVVLVFLPRCEHCAACATEGM

SEQ ID NO: 639985 - protein, 25 aa, Mycobacterium
AVGQRVVLVFLPRCGHCAACATEGL

SEQ ID NO: 639986 - protein, 25 aa, Mycobacterium
AVGQRVVLVFLPRCGHCVACATQGL

SEQ ID NO: 639987 - protein, 18 aa, Mycobacterium
AVGRGDRGPVWVFSGQGS

SEQ ID NO: 639988 - protein, 17 aa, Mycobacterium
AVGRKFIDFYLGLSNYV

SEQ ID NO: 639989 - protein, 30 aa, Mycobacterium
AVGRLDPERGALVAAVWLRPPAGPSVLLLA

SEQ ID NO: 639990 - protein, 22 aa, Mycobacterium
AVGRPQFSAVVECASAARELGG

SEQ ID NO: 639991 - protein, 18 aa, Mycobacterium
AVGRSGRTFRDWLSQEWA

SEQ ID NO: 639992 - protein, 23 aa, Mycobacterium
AVGRSGRTFRDWLSQEWANIVGH

SEQ ID NO: 639993 - protein, 22 aa, Mycobacterium
AVGRSRCVMVVHKLDHLRRSGR

SEQ ID NO: 639994 - protein, 20 aa, Mycobacterium
AVGSGHSFTDCACTDGVMVD

SEQ ID NO: 639995 - protein, 18 aa, Mycobacterium
AVGSRLAADYGTINGSSA

SEQ ID NO: 639996 - protein, 24 aa, Mycobacterium
AVGTHLGQVFALYLGAFGAGVESD

SEQ ID NO: 639997 - protein, 20 aa, Mycobacterium
AVGVAARGAWAHGDYAHARS

SEQ ID NO: 639998 - protein, 20 aa, Mycobacterium
AVGVARWALQTAVEYAKVRE

SEQ ID NO: 639999 - protein, 18 aa, Mycobacterium
AVGVGRDRIVALAKESEG

SEQ ID NO: 640000 - protein, 20 aa, Mycobacterium
AVGVHRLLCWGIVGTPLTLV

SEQ ID NO: 640001 - protein, 26 aa, Mycobacterium
AVGVPHEWFLAGHIVVGWPRGHHGPV

SEQ ID NO: 640002 - protein, 18 aa, Mycobacterium
AVGVTPEGGWVLTDGDPA

SEQ ID NO: 640003 - protein, 17 aa, Mycobacterium
AVGWFGGNCNRCIPCRR

SEQ ID NO: 640004 - protein, 20 aa, Mycobacterium
AVGYPGRLIADYVRGTPDQV

SEQ ID NO: 640005 - protein, 24 aa, Mycobacterium
AVGYRFDLATEIPVRAELLRVSSA

SEQ ID NO: 640006 - protein, 17 aa, Mycobacterium
AVGYVGAGTVEFVYDAA

SEQ ID NO: 640007 - protein, 24 aa, Mycobacterium
AVHAAMALVIDVGRLVHYAASDEA

SEQ ID NO: 640008 - protein, 28 aa, Mycobacterium
AVHDLPMPAGRGFLFEKVFPAFWQFKPT

SEQ ID NO: 640009 - protein, 18 aa, Mycobacterium
AVHDRCPGNRTLRNLAAD

SEQ ID NO: 640010 - protein, 17 aa, Mycobacterium
AVHFKSVAKQAGVTVGS

SEQ ID NO: 640011 - protein, 18 aa, Mycobacterium
AVHFKSVAKQAGVTVGSV

SEQ ID NO: 640012 - protein, 29 aa, Mycobacterium
AVHGGMIPLCYDWLCGMVVSTAGIPPTRT

SEQ ID NO: 640013 - protein, 17 aa, Mycobacterium
AVHGIRPWIEPMPLHEA

SEQ ID NO: 640014 - protein, 17 aa, Mycobacterium
AVHLALEAGRKCFYTTP

SEQ ID NO: 640015 - protein, 20 aa, Mycobacterium
AVHLLDGMAVGLERTRRIID

SEQ ID NO: 640016 - protein, 18 aa, Mycobacterium
AVHPRWLAAPDVAVRAIA

SEQ ID NO: 640017 - protein, 18 aa, Mycobacterium
AVHRAVLAVCEVRRPAEL

SEQ ID NO: 640018 - protein, 18 aa, Mycobacterium
AVHRLGVTSVRFTGGEPL

SEQ ID NO: 640019 - protein, 26 aa, Mycobacterium
AVHRPDLVVSAGFMKILGPQFLSQFL

SEQ ID NO: 640020 - protein, 24 aa, Mycobacterium
AVHRRARGLPAISLGWGLWNQASA

SEQ ID NO: 640021 - protein, 18 aa, Mycobacterium
AVIAESLAEVGLPADLAD

SEQ ID NO: 640022 - protein, 20 aa, Mycobacterium
AVIAGALGNWLMSRGETVAP

SEQ ID NO: 640023 - protein, 20 aa, Mycobacterium
AVIAGALGNWLMSRGETVSQ

SEQ ID NO: 640024 - protein, 32 aa, Mycobacterium
AVIAHVVRLAGRWLRPGGLLAVEHDDTTSGLT

SEQ ID NO: 640025 - protein, 26 aa, Mycobacterium
AVIARELDRYLPFLATTKVLIAAVRA

SEQ ID NO: 640026 - protein, 26 aa, Mycobacterium
AVIARELDRYLPFLATTKVLMAAVRA

SEQ ID NO: 640027 - protein, 27 aa, Mycobacterium
AVIARELDRYLPFLATTRVLIAAVRAG

SEQ ID NO: 640028 - protein, 19 aa, Mycobacterium
AVIARLVNRHHWRIGVVAQ

SEQ ID NO: 640029 - protein, 22 aa, Mycobacterium
AVICARAGLRVQVIEAQQTFGG

SEQ ID NO: 640030 - protein, 21 aa, Mycobacterium
AVIDAKPGFLTPLDLPLIAGR

SEQ ID NO: 640031 - protein, 19 aa, Mycobacterium
AVIDARRGKMFARLIKNIE

SEQ ID NO: 640032 - protein, 23 aa, Mycobacterium
AVIDEVRPALVLVEAGLEVGHVE

SEQ ID NO: 640033 - protein, 31 aa, Mycobacterium
AVIDGLRRDYRWAEADRHLWIADERGTWHLR

SEQ ID NO: 640034 - protein, 19 aa, Mycobacterium
AVIDRAWRAIGDGVEVLSA

SEQ ID NO: 640035 - protein, 26 aa, Mycobacterium
AVIDRELRRYLPFLATTKVLMAAVRA

SEQ ID NO: 640036 - protein, 21 aa, Mycobacterium
AVIEAGWDKAGLDEELGGMPM

SEQ ID NO: 640037 - protein, 19 aa, Mycobacterium
AVIERIVMLGFEVRVELLN

SEQ ID NO: 640038 - protein, 29 aa, Mycobacterium
AVIFDLPVGAWGARPTAQFGYEAAASAGT

SEQ ID NO: 640039 - protein, 27 aa, Mycobacterium
AVIGHDRLRLALVLCAVRPDIGGVLIR

SEQ ID NO: 640040 - protein, 24 aa, Mycobacterium
AVIGRRLLEVNPCFDRLARDRGFY

SEQ ID NO: 640041 - protein, 26 aa, Mycobacterium
AVIGSNLRPGNVWQTVELPRLMDNPH

SEQ ID NO: 640042 - protein, 24 aa, Mycobacterium
AVIICPLGFVADHIEVVWDLDHEL

SEQ ID NO: 640043 - protein, 20 aa, Mycobacterium
AVIIGTGFSGLGMAIALQKQ

SEQ ID NO: 640044 - protein, 26 aa, Mycobacterium
AVIISDFLGPINWMRPLRAIAARHEV

SEQ ID NO: 640045 - protein, 26 aa, Mycobacterium
AVIISDFLGPINWMRPLRAISARHEV

SEQ ID NO: 640046 - protein, 25 aa, Mycobacterium
AVIISDFLGPINWMRPLRAVAARHE

SEQ ID NO: 640047 - protein, 17 aa, Mycobacterium
AVIKGEPSFELQLDVAF

SEQ ID NO: 640048 - protein, 23 aa, Mycobacterium
AVIMARIQMRAMAFGQAQMPDDP

SEQ ID NO: 640049 - protein, 17 aa, Mycobacterium
AVIPAVAVADTIKSIDV

SEQ ID NO: 640050 - protein, 17 aa, Mycobacterium
AVIPGGVNSPVRAFTAV

SEQ ID NO: 640051 - protein, 17 aa, Mycobacterium
AVIPKSTAVVVWQPRQQ

SEQ ID NO: 640052 - protein, 24 aa, Mycobacterium
AVIPRAHGSALFERGETQILGVTT

SEQ ID NO: 640053 - protein, 19 aa, Mycobacterium
AVIPRSHWDTALTDGAKVE

SEQ ID NO: 640054 - protein, 27 aa, Mycobacterium
AVIQRELDRYLPFLATTRILIAAVRAG

SEQ ID NO: 640055 - protein, 26 aa, Mycobacterium
AVIQRELDRYLPFLATTRILMAAVRA

SEQ ID NO: 640056 - protein, 19 aa, Mycobacterium
AVIQSEILFTFTGLEPRVL

SEQ ID NO: 640057 - protein, 24 aa, Mycobacterium
AVIREYLLLGLRFDRIEEGYVDSF

SEQ ID NO: 640058 - protein, 26 aa, Mycobacterium
AVIRKFCHQLPGWVSAAAREFAEAQL

SEQ ID NO: 640059 - protein, 29 aa, Mycobacterium
AVIRPIVALAARWLRDGGKCAVEHDDTTS

SEQ ID NO: 640060 - protein, 17 aa, Mycobacterium
AVIRRHPNLAARFVEQF

SEQ ID NO: 640061 - protein, 23 aa, Mycobacterium
AVISELTGEGWLGPASASMAAAV

SEQ ID NO: 640062 - protein, 29 aa, Mycobacterium
AVISMLACARLGIMHSVVFAGFTAKALRA

SEQ ID NO: 640063 - protein, 23 aa, Mycobacterium
AVIVCPIGFVSDHIEVVWDLDSE

SEQ ID NO: 640064 - protein, 26 aa, Mycobacterium
AVIYFLRKVIWFLPDFTVECYHDQLR

SEQ ID NO: 640065 - protein, 23 aa, Mycobacterium
AVKDGRFTISRMQAMGFPADSII

SEQ ID NO: 640066 - protein, 26 aa, Mycobacterium
AVKEAVLPFHRFRRADGAAIDSLLGP

SEQ ID NO: 640067 - protein, 26 aa, Mycobacterium
AVKEAVLPFHRFRRIDGAAIDSLLGP

SEQ ID NO: 640068 - protein, 23 aa, Mycobacterium
AVKHSVRFAKPVVLPAKAALYVE

SEQ ID NO: 640069 - protein, 27 aa, Mycobacterium
AVKKHARTPFRQEVWDRLAEGFRFVQG

SEQ ID NO: 640070 - protein, 24 aa, Mycobacterium
AVKLDEWLRLSLDEPELLKTLGAT

SEQ ID NO: 640071 - protein, 18 aa, Mycobacterium
AVKQCLRSSLRLTTNEER

SEQ ID NO: 640072 - protein, 20 aa, Mycobacterium
AVKQCLRSSLRLTTREERAR

SEQ ID NO: 640073 - protein, 22 aa, Mycobacterium
AVKQHGVWRFSRWVLGIDQSNT

SEQ ID NO: 640074 - protein, 17 aa, Mycobacterium
AVKQISVSFVFGYDPAE

SEQ ID NO: 640075 - protein, 33 aa, Mycobacterium
AVKRMPLARALQTVHRYDYLDAYVADLPNVVNL

SEQ ID NO: 640076 - protein, 21 aa, Mycobacterium
AVKRWKPFIDDVTRACLDEKI

SEQ ID NO: 640077 - protein, 20 aa, Mycobacterium
AVKRWVPFVDDITRACLDER

SEQ ID NO: 640078 - protein, 18 aa, Mycobacterium
AVKYQFGDIDGFWAAVLH

SEQ ID NO: 640079 - protein, 23 aa, Mycobacterium
AVKYREEYGVWAGVKLPGGQYRK

SEQ ID NO: 640080 - protein, 20 aa, Mycobacterium
AVKYSVKFGKPLVLPGTAGL

SEQ ID NO: 640081 - protein, 18 aa, Mycobacterium
AVLAAGWPEHIPGTTVNR

SEQ ID NO: 640082 - protein, 18 aa, Mycobacterium
AVLAARPVGVPAIVVRPD

SEQ ID NO: 640083 - protein, 26 aa, Mycobacterium
AVLAGRAGPPTVVWPVTAVSAVTVVS

SEQ ID NO: 640084 - protein, 22 aa, Mycobacterium
AVLAGWRMLLDAGRLQDGEPHL

SEQ ID NO: 640085 - protein, 20 aa, Mycobacterium
AVLANGFLNGGVTLPLLLPI

SEQ ID NO: 640086 - protein, 25 aa, Mycobacterium
AVLANRIRLLALIATNFFGQNTPAI

SEQ ID NO: 640087 - protein, 30 aa, Mycobacterium
AVLAPRLPIPDEFGLCRYLAAGLAVVHAVE

SEQ ID NO: 640088 - protein, 18 aa, Mycobacterium
AVLAPRLSVPDEFGLCRY

SEQ ID NO: 640089 - protein, 17 aa, Mycobacterium
AVLARELEICYAAIALV

SEQ ID NO: 640090 - protein, 26 aa, Mycobacterium
AVLARLLPALVLPGFLLAQSRHDNPS

SEQ ID NO: 640091 - protein, 22 aa, Mycobacterium
AVLASWRMLLDAGRLQDGEPHL

SEQ ID NO: 640092 - protein, 26 aa, Mycobacterium
AVLAVRAGLPPGVFNVVTGIGAEAGA

SEQ ID NO: 640093 - protein, 18 aa, Mycobacterium
AVLAVYRPLLAPLGITHP

SEQ ID NO: 640094 - protein, 17 aa, Mycobacterium
AVLAVYRPLLEPLGLTH

SEQ ID NO: 640095 - protein, 19 aa, Mycobacterium
AVLCRRGVGLLEQYCAEHA

SEQ ID NO: 640096 - protein, 23 aa, Mycobacterium
AVLDAALTLAARVIVNAPLSVQA

SEQ ID NO: 640097 - protein, 17 aa, Mycobacterium
AVLDAGLIWIGPSPQSI

SEQ ID NO: 640098 - protein, 21 aa, Mycobacterium
AVLDCARGRDVVAASLTAGLA

SEQ ID NO: 640099 - protein, 18 aa, Mycobacterium
AVLDFPLCDQEVLLRHLH

SEQ ID NO: 640100 - protein, 18 aa, Mycobacterium
AVLDLSWTSPPAGRVLIF

SEQ ID NO: 640101 - protein, 23 aa, Mycobacterium
AVLDPLTALGCMPLAIHPAMTFA

SEQ ID NO: 640102 - protein, 18 aa, Mycobacterium
AVLDRLARYPARSVDIDG

SEQ ID NO: 640103 - protein, 27 aa, Mycobacterium
AVLDRLRAEMLHRIGMHDLLQPARLFQ

SEQ ID NO: 640104 - protein, 21 aa, Mycobacterium
AVLDRNGLRPSRIWVTEDGLV

SEQ ID NO: 640105 - protein, 23 aa, Mycobacterium
AVLDRNGLRPSRVWVTNDGLVVM

SEQ ID NO: 640106 - protein, 18 aa, Mycobacterium
AVLDRTGYRAELEASSDP

SEQ ID NO: 640107 - protein, 19 aa, Mycobacterium
AVLDVAGWARPWDTSDVRE

SEQ ID NO: 640108 - protein, 25 aa, Mycobacterium
AVLDVRQIARWAGCVGGRSTIVAIP

SEQ ID NO: 640109 - protein, 24 aa, Mycobacterium
AVLDVTHIARWAGCIGNRSTIIPV

SEQ ID NO: 640110 - protein, 17 aa, Mycobacterium
AVLDWPTIRDQAAAFIT

SEQ ID NO: 640111 - protein, 31 aa, Mycobacterium
AVLEAARWAATWGQRQPVRFIVGRRGGQTGA

SEQ ID NO: 640112 - protein, 26 aa, Mycobacterium
AVLEAARWAPTWGGRQPVRFVVGVRG

SEQ ID NO: 640113 - protein, 19 aa, Mycobacterium
AVLEALKAAAIVCGVAQAL

SEQ ID NO: 640114 - protein, 17 aa, Mycobacterium
AVLEARGGTSRRLLVVL

SEQ ID NO: 640115 - protein, 17 aa, Mycobacterium
AVLECREALAMNVKPKF

SEQ ID NO: 640116 - protein, 22 aa, Mycobacterium
AVLEKLSLPRLFATADQGAAPL

SEQ ID NO: 640117 - protein, 19 aa, Mycobacterium
AVLELDLPTLAICRGLQVL

SEQ ID NO: 640118 - protein, 24 aa, Mycobacterium
AVLEPLAILTDRGFEVTLVPPTRG

SEQ ID NO: 640119 - protein, 21 aa, Mycobacterium
AVLEPRADGFRNYVRVGEKAP

SEQ ID NO: 640120 - protein, 21 aa, Mycobacterium
AVLEPRTDGFRNFFRPGDKNP

SEQ ID NO: 640121 - protein, 23 aa, Mycobacterium
AVLERHGRLPLGNNDIYMATVGG

SEQ ID NO: 640122 - protein, 20 aa, Mycobacterium
AVLFASRRRSSGAVKFPAER

SEQ ID NO: 640123 - protein, 18 aa, Mycobacterium
AVLGALVWNKEVWLATIA

SEQ ID NO: 640124 - protein, 18 aa, Mycobacterium
AVLGDAGLAHLVTHDDAG

SEQ ID NO: 640125 - protein, 20 aa, Mycobacterium
AVLGLRRRKGMVLDESDRDT

SEQ ID NO: 640126 - protein, 22 aa, Mycobacterium
AVLGPVWPGNRWTKAYRQEHLE

SEQ ID NO: 640127 - protein, 17 aa, Mycobacterium
AVLGRIRSALAAVPPQP

SEQ ID NO: 640128 - protein, 27 aa, Mycobacterium
AVLGRLAHKARVVLCGVISSYLTGEHP

SEQ ID NO: 640129 - protein, 28 aa, Mycobacterium
AVLGRLAHKARVVLCGVISSYLTGEHPG

SEQ ID NO: 640130 - protein, 18 aa, Mycobacterium
AVLHHRLAVEPKRSGYDP

SEQ ID NO: 640131 - protein, 19 aa, Mycobacterium
AVLHKERRRSASTVRSGSR

SEQ ID NO: 640132 - protein, 25 aa, Mycobacterium
AVLHLLYARFWHKVLYDLGHVSSRE

SEQ ID NO: 640133 - protein, 21 aa, Mycobacterium
AVLKAGAAYLPIDPAYPDERI

SEQ ID NO: 640134 - protein, 21 aa, Mycobacterium
AVLKAGAAYLPIDPAYPQDRI

SEQ ID NO: 640135 - protein, 26 aa, Mycobacterium
AVLKDHQLRCGVVVLGPPGSVSKTTS

SEQ ID NO: 640136 - protein, 25 aa, Mycobacterium
AVLKIPARDRFQIITAHDAGDIIAE

SEQ ID NO: 640137 - protein, 23 aa, Mycobacterium
AVLKTCRTKLPATMVPAAVMVLD

SEQ ID NO: 640138 - protein, 24 aa, Mycobacterium
AVLLKEVYGDLGLESELQTLYSDG

SEQ ID NO: 640139 - protein, 17 aa, Mycobacterium
AVLLKLVTRMIRARVFG

SEQ ID NO: 640140 - protein, 19 aa, Mycobacterium
AVLLLKAVGLAAQRYGEFN

SEQ ID NO: 640141 - protein, 20 aa, Mycobacterium
AVLLQLRWLGLEGRHDPVDG

SEQ ID NO: 640142 - protein, 19 aa, Mycobacterium
AVLMSPVAFVQRPARWIRL

SEQ ID NO: 640143 - protein, 18 aa, Mycobacterium
AVLPAGWTSGIEVIQANG

SEQ ID NO: 640144 - protein, 24 aa, Mycobacterium
AVLPALLRLFPRASREFIGDPRYL

SEQ ID NO: 640145 - protein, 23 aa, Mycobacterium
AVLPAMRARGSGHIINISSMTGL

SEQ ID NO: 640146 - protein, 18 aa, Mycobacterium
AVLPEKPELILLDNFPVW

SEQ ID NO: 640147 - protein, 17 aa, Mycobacterium
AVLPGAVVSNIFESARG

SEQ ID NO: 640148 - protein, 23 aa, Mycobacterium
AVLPGMRARGSGHIINMSSMTGL

SEQ ID NO: 640149 - protein, 17 aa, Mycobacterium
AVLPMAGVSFVAVAPTH

SEQ ID NO: 640150 - protein, 23 aa, Mycobacterium
AVLPRLEGHFTLVFAHADDPGTI

SEQ ID NO: 640151 - protein, 23 aa, Mycobacterium
AVLPRSDWTTTLFDGARLEVVTA

SEQ ID NO: 640152 - protein, 26 aa, Mycobacterium
AVLPRSRWATELSELPGAPVRLEVVT

SEQ ID NO: 640153 - protein, 17 aa, Mycobacterium
AVLPVHLYGAFADIHAL

SEQ ID NO: 640154 - protein, 17 aa, Mycobacterium
AVLPWIFVGYPIVQESA

SEQ ID NO: 640155 - protein, 23 aa, Mycobacterium
AVLQAMCPKVTYVGTEFNGSKIK

SEQ ID NO: 640156 - protein, 17 aa, Mycobacterium
AVLQEMTTDFELTVYDI

SEQ ID NO: 640157 - protein, 22 aa, Mycobacterium
AVLRAERPVSWHPPVEDSLMPD

SEQ ID NO: 640158 - protein, 24 aa, Mycobacterium
AVLRCLRLPNDLPMLEDRSIHWYT

SEQ ID NO: 640159 - protein, 24 aa, Mycobacterium
AVLRETTRWGSFLDDLPGFDAEFF

SEQ ID NO: 640160 - protein, 23 aa, Mycobacterium
AVLRFHYQLARFPLQLIEDRVVT

SEQ ID NO: 640161 - protein, 19 aa, Mycobacterium
AVLRFIVEYQHSYSGVRMV

SEQ ID NO: 640162 - protein, 21 aa, Mycobacterium
AVLRHARILAEVCDVPDVPQS

SEQ ID NO: 640163 - protein, 28 aa, Mycobacterium
AVLRLAPYRLRVMPGAVMMRGEGAPLMW

SEQ ID NO: 640164 - protein, 24 aa, Mycobacterium
AVLRLHYQLARFPLQLIEDRVVTR

SEQ ID NO: 640165 - protein, 22 aa, Mycobacterium
AVLRLQYRIARTPLQLFESSVI

SEQ ID NO: 640166 - protein, 17 aa, Mycobacterium
AVLRPALQPETRLAAPL

SEQ ID NO: 640167 - protein, 24 aa, Mycobacterium
AVLRRAGLVTARREGLSVLYTLTS

SEQ ID NO: 640168 - protein, 22 aa, Mycobacterium
AVLRRAIELGVDHIDTAQFYGP

SEQ ID NO: 640169 - protein, 26 aa, Mycobacterium
AVLRRARLALAGGHTVILDGTWRSPR

SEQ ID NO: 640170 - protein, 24 aa, Mycobacterium
AVLRRNILENPAWYTAYTPYQPEI

SEQ ID NO: 640171 - protein, 18 aa, Mycobacterium
AVLSIEFLVHAWDYAAAT

SEQ ID NO: 640172 - protein, 18 aa, Mycobacterium
AVLSNRSRMLFDYFQQLF

SEQ ID NO: 640173 - protein, 20 aa, Mycobacterium
AVLSPRAWMAASRGMKGQSW

SEQ ID NO: 640174 - protein, 18 aa, Mycobacterium
AVLSRPAPDPVSITDMFA

SEQ ID NO: 640175 - protein, 19 aa, Mycobacterium
AVLSRRPRMLYDYFHQLFA

SEQ ID NO: 640176 - protein, 24 aa, Mycobacterium
AVLTADCVPVLFADAAAGVVAGAH

SEQ ID NO: 640177 - protein, 23 aa, Mycobacterium
AVLTARHIDCWTLGTIKKSGKDS

SEQ ID NO: 640178 - protein, 28 aa, Mycobacterium
AVLTELFSRPGVHFISGFYGPLERALRD

SEQ ID NO: 640179 - protein, 17 aa, Mycobacterium
AVLTERLDYIQAPDGSK

SEQ ID NO: 640180 - protein, 33 aa, Mycobacterium
AVLTMARGEARFYLRAGALLTEAASLAGADGTA

SEQ ID NO: 640181 - protein, 24 aa, Mycobacterium
AVLTRPDAAAGRRGKPRPSPVAQL

SEQ ID NO: 640182 - protein, 26 aa, Mycobacterium
AVLTRPDAAAGRRGRPSPSPVAELAA

SEQ ID NO: 640183 - protein, 23 aa, Mycobacterium
AVLTRRIAYLLAEREVGVGQVLA

SEQ ID NO: 640184 - protein, 21 aa, Mycobacterium
AVLVAPRVVNWAQTLVTPAVL

SEQ ID NO: 640185 - protein, 20 aa, Mycobacterium
AVLVGCGVPTGWGTSVYAGG

SEQ ID NO: 640186 - protein, 19 aa, Mycobacterium
AVLVGWAVALACQGSMALR

SEQ ID NO: 640187 - protein, 33 aa, Mycobacterium
AVLVHHCHRELWPVAGPVMGRIGWFVESWLSPR

SEQ ID NO: 640188 - protein, 34 aa, Mycobacterium
AVLVRPAPVPGYRGPRSFALPEFDPFWHRCVEHD

SEQ ID NO: 640189 - protein, 39 aa, Mycobacterium
AVLVRPAPVPGYRGPRSFALPEFDPFWQRCVEHDVLVAM

SEQ ID NO: 640190 - protein, 25 aa, Mycobacterium
AVLVRPDGVVAWACNDRPHLEQAAH

SEQ ID NO: 640191 - protein, 18 aa, Mycobacterium
AVLWKHVVCDGSAEVRRM

SEQ ID NO: 640192 - protein, 19 aa, Mycobacterium
AVLWTARQIGCSWCVDFGS

SEQ ID NO: 640193 - protein, 19 aa, Mycobacterium
AVLWTARSIGCSWCVDFGS

SEQ ID NO: 640194 - protein, 17 aa, Mycobacterium
AVLYHFPDIQTLLIEAN

SEQ ID NO: 640195 - protein, 19 aa, Mycobacterium
AVLYREISAHAAAIHDQLV

SEQ ID NO: 640196 - protein, 25 aa, Mycobacterium
AVMAARWNRILGAWPITTSFPGGND

SEQ ID NO: 640197 - protein, 29 aa, Mycobacterium
AVMCGEPTWWRCHRRMIADLAVRDGHRVQ

SEQ ID NO: 640198 - protein, 21 aa, Mycobacterium
AVMCGWVDGAIRSGERAAAEV

SEQ ID NO: 640199 - protein, 20 aa, Mycobacterium
AVMDGGWDKAGIEEALGGMP

SEQ ID NO: 640200 - protein, 18 aa, Mycobacterium
AVMEGSWGSADKGAVNVA

SEQ ID NO: 640201 - protein, 23 aa, Mycobacterium
AVMEHYTRIKSVWVDMQDDLPNW

SEQ ID NO: 640202 - protein, 22 aa, Mycobacterium
AVMEPWTMLGHLAARNRVARLR

SEQ ID NO: 640203 - protein, 25 aa, Mycobacterium
AVMEVLSPRGYREIPAAEFFTGLWE

SEQ ID NO: 640204 - protein, 17 aa, Mycobacterium
AVMGGSFGGYMANWIAG

SEQ ID NO: 640205 - protein, 25 aa, Mycobacterium
AVMILPVSYWKLNEHEIFQHYRSVG

SEQ ID NO: 640206 - protein, 18 aa, Mycobacterium
AVMILPVSYWKLTEREIA

SEQ ID NO: 640207 - protein, 24 aa, Mycobacterium
AVMKPKSGMHEWDIVCRIATAMGY

SEQ ID NO: 640208 - protein, 18 aa, Mycobacterium
AVMKRVWAGEQISESVRP

SEQ ID NO: 640209 - protein, 17 aa, Mycobacterium
AVMLCVGAIGISGADTR

SEQ ID NO: 640210 - protein, 23 aa, Mycobacterium
AVMLDQFLRHFAGYVDKPHGSST

SEQ ID NO: 640211 - protein, 18 aa, Mycobacterium
AVMLVCPDPAPLLDTVLN

SEQ ID NO: 640212 - protein, 22 aa, Mycobacterium
AVMLVCPEPAPLLRAALDLAAA

SEQ ID NO: 640213 - protein, 17 aa, Mycobacterium
AVMLWGLELDRRLRAAA

SEQ ID NO: 640214 - protein, 19 aa, Mycobacterium
AVMLYPFLTVDAVRTVVER

SEQ ID NO: 640215 - protein, 24 aa, Mycobacterium
AVMPGHGTVCVWSPPLDDDGNSAG

SEQ ID NO: 640216 - protein, 24 aa, Mycobacterium
AVMQSRPPLAIGHAPGHMLITDLR

SEQ ID NO: 640217 - protein, 19 aa, Mycobacterium
AVMRALSALRLPGAGFDVK

SEQ ID NO: 640218 - protein, 18 aa, Mycobacterium
AVMREWNFGAADHERTNV

SEQ ID NO: 640219 - protein, 20 aa, Mycobacterium
AVMRRIYPFIGRLFAEQTAE

SEQ ID NO: 640220 - protein, 28 aa, Mycobacterium
AVMSQLRTALRLQIAAGRSIGEALEALD

SEQ ID NO: 640221 - protein, 26 aa, Mycobacterium
AVMSQLRTALRMQIVAGYPVAEALAA

SEQ ID NO: 640222 - protein, 27 aa, Mycobacterium
AVMVSMAALWRSCGVQPDMVIGHSQGE

SEQ ID NO: 640223 - protein, 24 aa, Mycobacterium
AVNAARWAGALAEKLGAPLHILHA

SEQ ID NO: 640224 - protein, 17 aa, Mycobacterium
AVNACRKSGAVIQQGAS

SEQ ID NO: 640225 - protein, 24 aa, Mycobacterium
AVNDVLAAPGYRAAARRAAASIAD

SEQ ID NO: 640226 - protein, 18 aa, Mycobacterium
AVNFPDVLFIAGKYQVKI

SEQ ID NO: 640227 - protein, 21 aa, Mycobacterium
AVNFPLYVILSLLGLPEEDFG

SEQ ID NO: 640228 - protein, 24 aa, Mycobacterium
AVNGLYVHWVVAGIAPGSGSTADG

SEQ ID NO: 640229 - protein, 25 aa, Mycobacterium
AVNGPAIGGGLCLALAADIRVAATG

SEQ ID NO: 640230 - protein, 25 aa, Mycobacterium
AVNGPAIGGGLCLALAADIRVASTT

SEQ ID NO: 640231 - protein, 25 aa, Mycobacterium
AVNNERIRLGIAIPQEVAVRLRATR

SEQ ID NO: 640232 - protein, 17 aa, Mycobacterium
AVNNSFGFGGHNVAIAL

SEQ ID NO: 640233 - protein, 32 aa, Mycobacterium
AVNPAEWREELPLIEEWFEFVGDKLPTGVRDE

SEQ ID NO: 640234 - protein, 20 aa, Mycobacterium
AVNPAVIVLLNLSRDQLDRV

SEQ ID NO: 640235 - protein, 22 aa, Mycobacterium
AVNPRLNAIIRRIDALAEGRAA

SEQ ID NO: 640236 - protein, 19 aa, Mycobacterium
AVNQGRTADDLMGRYWRGE

SEQ ID NO: 640237 - protein, 26 aa, Mycobacterium
AVNRARASGMTVVFWLDTERPHEVEL

SEQ ID NO: 640238 - protein, 25 aa, Mycobacterium
AVNRARRAIAEFRIRGVSTNIPFLQ

SEQ ID NO: 640239 - protein, 25 aa, Mycobacterium
AVNRARRAMAEFRIRGVSTNIPFLQ

SEQ ID NO: 640240 - protein, 25 aa, Mycobacterium
AVNRLRPSELQWALNHDAVHGIAYA

SEQ ID NO: 640241 - protein, 18 aa, Mycobacterium
AVNRRLMAPFGVDRFERL

SEQ ID NO: 640242 - protein, 25 aa, Mycobacterium
AVNRTVEVWGRLDVAFNNGATIQPP

SEQ ID NO: 640243 - protein, 19 aa, Mycobacterium
AVNRWQRDRMRRWRDGDLT

SEQ ID NO: 640244 - protein, 27 aa, Mycobacterium
AVNSARWATEFSRGTGLDYRGVVATGT

SEQ ID NO: 640245 - protein, 18 aa, Mycobacterium
AVNSCPVLTPSSPMIGNR

SEQ ID NO: 640246 - protein, 20 aa, Mycobacterium
AVNTAAWFVMAAIPNSVFLG

SEQ ID NO: 640247 - protein, 24 aa, Mycobacterium
AVNVDTWGGWIWINMDPAAQPLRQ

SEQ ID NO: 640248 - protein, 18 aa, Mycobacterium
AVNVDWGLDDILLPGTGP

SEQ ID NO: 640249 - protein, 18 aa, Mycobacterium
AVNVLGERCIEGITANTD

SEQ ID NO: 640250 - protein, 20 aa, Mycobacterium
AVNYPLYVILSLLGLPESDF

SEQ ID NO: 640251 - protein, 23 aa, Mycobacterium
AVNYPLYVIMSLLGLPEADFGRM

SEQ ID NO: 640252 - protein, 22 aa, Mycobacterium
AVNYPLYVIMSLLGLPEADFPR

SEQ ID NO: 640253 - protein, 24 aa, Mycobacterium
AVNYRLTLRNGVLVYRKASADAST

SEQ ID NO: 640254 - protein, 24 aa, Mycobacterium
AVNYRLTLRNGVLVYRKSAPQPAT

SEQ ID NO: 640255 - protein, 26 aa, Mycobacterium
AVPAAIRLLGAIGYRVVLLETVGVGQ

SEQ ID NO: 640256 - protein, 22 aa, Mycobacterium
AVPAALLRWGVAQFDADARPTQ

SEQ ID NO: 640257 - protein, 18 aa, Mycobacterium
AVPAAMGAKMGRPEAEVW

SEQ ID NO: 640258 - protein, 27 aa, Mycobacterium
AVPAEFRAEPAAARRASTRAYRDSHTD

SEQ ID NO: 640259 - protein, 24 aa, Mycobacterium
AVPAEVLQPMLAAALHLVQILGPH

SEQ ID NO: 640260 - protein, 21 aa, Mycobacterium
AVPALLWPNWAIPMQPNNIEY

SEQ ID NO: 640261 - protein, 23 aa, Mycobacterium
AVPAPLLRWGISHFDPDVRSPTV

SEQ ID NO: 640262 - protein, 25 aa, Mycobacterium
AVPAPRLPALLAELAPHSADIARRI

SEQ ID NO: 640263 - protein, 21 aa, Mycobacterium
AVPAVRARLVALQREMAAGPG

SEQ ID NO: 640264 - protein, 27 aa, Mycobacterium
AVPDAIDVAPGWELDRLTAPSRLFGAN

SEQ ID NO: 640265 - protein, 20 aa, Mycobacterium
AVPDDIAWCRLEDFRCYATL

SEQ ID NO: 640266 - protein, 25 aa, Mycobacterium
AVPDDRSGSAWAMRELVILHELAHH

SEQ ID NO: 640267 - protein, 18 aa, Mycobacterium
AVPDFPAKDLIDIQITVE

SEQ ID NO: 640268 - protein, 19 aa, Mycobacterium
AVPDGPDGQGWRITGQKVW

SEQ ID NO: 640269 - protein, 18 aa, Mycobacterium
AVPEGLTYGLLRYQNHEV

SEQ ID NO: 640270 - protein, 23 aa, Mycobacterium
AVPELKKKGGSVVFIGSQSAFHP

SEQ ID NO: 640271 - protein, 18 aa, Mycobacterium
AVPELVVERGGTPLRSRV

SEQ ID NO: 640272 - protein, 19 aa, Mycobacterium
AVPEMAVRWRAEAPADLRL

SEQ ID NO: 640273 - protein, 20 aa, Mycobacterium
AVPERGRDGAALRAAQKELG

SEQ ID NO: 640274 - protein, 22 aa, Mycobacterium
AVPEVADLVAMLRLIADPTAGS

SEQ ID NO: 640275 - protein, 24 aa, Mycobacterium
AVPEVARAWSSYAPTLVRLPDGRV

SEQ ID NO: 640276 - protein, 23 aa, Mycobacterium
AVPEVARAWTSFAPTVVSLPDGS

SEQ ID NO: 640277 - protein, 19 aa, Mycobacterium
AVPFLAAYRYKPSGLDKRA

SEQ ID NO: 640278 - protein, 30 aa, Mycobacterium
AVPGAHVFGIGGGYSAEWAAWANGVAVREL

SEQ ID NO: 640279 - protein, 17 aa, Mycobacterium
AVPGCYPTAALLALWPA

SEQ ID NO: 640280 - protein, 19 aa, Mycobacterium
AVPGGKVWSKRVGGGSGLP

SEQ ID NO: 640281 - protein, 34 aa, Mycobacterium
AVPGGNVWFKRVGGGPGLPLLVVHGGPGLPHYYL

SEQ ID NO: 640282 - protein, 23 aa, Mycobacterium
AVPHMRGQGAGWIVNIGSVTGVA

SEQ ID NO: 640283 - protein, 17 aa, Mycobacterium
AVPHMRNQGAGWIVNIG

SEQ ID NO: 640284 - protein, 21 aa, Mycobacterium
AVPHPKWWFDLLTTEPLAFAS

SEQ ID NO: 640285 - protein, 23 aa, Mycobacterium
AVPHYGIGYGLLRYLYAPTARLL

SEQ ID NO: 640286 - protein, 28 aa, Mycobacterium
AVPLAKACARIMLGASIAELREEGVLAR

SEQ ID NO: 640287 - protein, 30 aa, Mycobacterium
AVPLAKACARIMLGASISQLRAEGMLVASG

SEQ ID NO: 640288 - protein, 26 aa, Mycobacterium
AVPLAKACARIMLGATIAGLREEGLL

SEQ ID NO: 640289 - protein, 25 aa, Mycobacterium
AVPLAKACARVMLGATITQLRDEGL

SEQ ID NO: 640290 - protein, 22 aa, Mycobacterium
AVPLCFGFHPYLQLPGVPRTEW

SEQ ID NO: 640291 - protein, 22 aa, Mycobacterium
AVPLPCTVFLQLLGLPLEDLDK

SEQ ID NO: 640292 - protein, 22 aa, Mycobacterium
AVPLPCTVFLQLLGLPLEDLDR

SEQ ID NO: 640293 - protein, 18 aa, Mycobacterium
AVPLPMMVLCELLGVPYA

SEQ ID NO: 640294 - protein, 25 aa, Mycobacterium
AVPLPRISIFLSLFDAHVQRAPLAG

SEQ ID NO: 640295 - protein, 29 aa, Mycobacterium
AVPMRLSTRPEHRIPIYLAALSPAMLRLT

SEQ ID NO: 640296 - protein, 17 aa, Mycobacterium
AVPNICLQMLLRGRNTV

SEQ ID NO: 640297 - protein, 17 aa, Mycobacterium
AVPPAPPYYPVRTAAAQ

SEQ ID NO: 640298 - protein, 32 aa, Mycobacterium
AVPPEAWTAYGPWLRKPIDGIHWAGTETADVW

SEQ ID NO: 640299 - protein, 20 aa, Mycobacterium
AVPPETLAAVSLPRAKGAWC

SEQ ID NO: 640300 - protein, 18 aa, Mycobacterium
AVPPGFELPEGITGPMPA

SEQ ID NO: 640301 - protein, 22 aa, Mycobacterium
AVPPRPVLSLPLNHPGLAVRIA

SEQ ID NO: 640302 - protein, 29 aa, Mycobacterium
AVPQPGGGWRLYGKKTWGTLCEAASIITT

SEQ ID NO: 640303 - protein, 29 aa, Mycobacterium
AVPQRAGWFRFYFEGHRWVWSDQVQRMHG

SEQ ID NO: 640304 - protein, 21 aa, Mycobacterium
AVPRAARAVEEIVAALQGPAT

SEQ ID NO: 640305 - protein, 23 aa, Mycobacterium
AVPRAAVEPLVLMLAPLAPHMAE

SEQ ID NO: 640306 - protein, 18 aa, Mycobacterium
AVPRAHRFPSGPVSADAI

SEQ ID NO: 640307 - protein, 17 aa, Mycobacterium
AVPRPTTVINRWLRLLP

SEQ ID NO: 640308 - protein, 27 aa, Mycobacterium
AVPRSRVAPTQAWRKTFGENFFYILYF

SEQ ID NO: 640309 - protein, 19 aa, Mycobacterium
AVPSEILAGIAAHQLSRPD

SEQ ID NO: 640310 - protein, 31 aa, Mycobacterium
AVPSFLQVPVSWLGAGVYQLVNIPAQIWIRL

SEQ ID NO: 640311 - protein, 18 aa, Mycobacterium
AVPSRYGQALAESEIQPL

SEQ ID NO: 640312 - protein, 17 aa, Mycobacterium
AVPTGFMGADFCDIAGG

SEQ ID NO: 640313 - protein, 17 aa, Mycobacterium
AVPTVAAPRTWEELDDP

SEQ ID NO: 640314 - protein, 23 aa, Mycobacterium
AVPYRPAAEFEELTGAKILQFYG

SEQ ID NO: 640315 - protein, 22 aa, Mycobacterium
AVQAALLARWMLIGFVHGVMNT

SEQ ID NO: 640316 - protein, 25 aa, Mycobacterium
AVQAFARQRIDAILTEVTAADSAAD

SEQ ID NO: 640317 - protein, 24 aa, Mycobacterium
AVQARGSFFAAIAIPFGAERFRAP

SEQ ID NO: 640318 - protein, 25 aa, Mycobacterium
AVQAWTRSAAKAWAADKITVNALAP

SEQ ID NO: 640319 - protein, 25 aa, Mycobacterium
AVQAWTRSAAKAWAADNVTVNALAP

SEQ ID NO: 640320 - protein, 17 aa, Mycobacterium
AVQCIPGPRHTRGTPPN

SEQ ID NO: 640321 - protein, 18 aa, Mycobacterium
AVQDEWAATPARTRGEIL

SEQ ID NO: 640322 - protein, 33 aa, Mycobacterium
AVQGRCISGGLLLCWPCDLILASDDALFSDPVA

SEQ ID NO: 640323 - protein, 33 aa, Mycobacterium
AVQGRCISGGLLLCWPCDLIVAADDAQFSDPVV

SEQ ID NO: 640324 - protein, 20 aa, Mycobacterium
AVQHARSLRAMLGSLATAGE

SEQ ID NO: 640325 - protein, 32 aa, Mycobacterium
AVQIAVGSEGLWKRFCDGFHLDAHAPGMATNP

SEQ ID NO: 640326 - protein, 18 aa, Mycobacterium
AVQLAVLVDRGHRELPIR

SEQ ID NO: 640327 - protein, 18 aa, Mycobacterium
AVQLAVLVDRGHRELPLR

SEQ ID NO: 640328 - protein, 20 aa, Mycobacterium
AVQLGYDFLPGTTVNRYCSS

SEQ ID NO: 640329 - protein, 20 aa, Mycobacterium
AVQPAVIVLLNLSRDQLDRV

SEQ ID NO: 640330 - protein, 22 aa, Mycobacterium
AVQPDGRYLLRTDAGDEFTADQ

SEQ ID NO: 640331 - protein, 24 aa, Mycobacterium
AVQQCARAGDGLAPAVIAAGDAAV

SEQ ID NO: 640332 - protein, 18 aa, Mycobacterium
AVQQCLRSPLQLTTQEER

SEQ ID NO: 640333 - protein, 19 aa, Mycobacterium
AVQRLIDAGAIILGKTNLD

SEQ ID NO: 640334 - protein, 19 aa, Mycobacterium
AVQRRIFELEIGRAHTPWF

SEQ ID NO: 640335 - protein, 17 aa, Mycobacterium
AVQRSAGAVAIGPVLQG

SEQ ID NO: 640336 - protein, 24 aa, Mycobacterium
AVQRSREVWLMVSGSAKADAVAAA

SEQ ID NO: 640337 - protein, 18 aa, Mycobacterium
AVQRSVVISDGWDIMDFV

SEQ ID NO: 640338 - protein, 28 aa, Mycobacterium
AVQRSVVLSEGWDIMDFVEQLQKLAAGN

SEQ ID NO: 640339 - protein, 27 aa, Mycobacterium
AVQSAMVRPALVAANRSDLVSLVLSNL

SEQ ID NO: 640340 - protein, 24 aa, Mycobacterium
AVQSLRLYERHGLVTPARSDGGTR

SEQ ID NO: 640341 - protein, 24 aa, Mycobacterium
AVQTCRKFAEQAVERRAGKKKLFG

SEQ ID NO: 640342 - protein, 24 aa, Mycobacterium
AVQYRELLSGYALDEIDAAEWKHR

SEQ ID NO: 640343 - protein, 22 aa, Mycobacterium
AVQYRLPMTFVLFNNNAHAMCV

SEQ ID NO: 640344 - protein, 25 aa, Mycobacterium
AVRAFARRRIDAILAGVPAADSADD

SEQ ID NO: 640345 - protein, 19 aa, Mycobacterium
AVRAFKAIDCQGLARVDFF

SEQ ID NO: 640346 - protein, 22 aa, Mycobacterium
AVRAGALGARLTGGGFGGCVIA

SEQ ID NO: 640347 - protein, 24 aa, Mycobacterium
AVRAHLIDAARPFIFDTGLAPAAV

SEQ ID NO: 640348 - protein, 20 aa, Mycobacterium
AVRAKFKPEFINRLDDVLIF

SEQ ID NO: 640349 - protein, 20 aa, Mycobacterium
AVRALVPRRDVNAIMDEIAA

SEQ ID NO: 640350 - protein, 24 aa, Mycobacterium
AVRAPAVVKLHRWLQEAYEYVNRS

SEQ ID NO: 640351 - protein, 20 aa, Mycobacterium
AVRARKSLDDAAGWLDPVGG

SEQ ID NO: 640352 - protein, 24 aa, Mycobacterium
AVRARWERRLAEVGVGELHAELAR

SEQ ID NO: 640353 - protein, 23 aa, Mycobacterium
AVRASGLSAGIIDAGLSRGLAGV

SEQ ID NO: 640354 - protein, 18 aa, Mycobacterium
AVRCGPAAVTIRAVGDAV

SEQ ID NO: 640355 - protein, 27 aa, Mycobacterium
AVRDCGVLVCFAGRVLEPLGLRKAATD

SEQ ID NO: 640356 - protein, 33 aa, Mycobacterium
AVRDEWRRVTPRARAGLFGEAYRLLRSRAEAFA

SEQ ID NO: 640357 - protein, 18 aa, Mycobacterium
AVRDGRPTVLQSLTEDPA

SEQ ID NO: 640358 - protein, 20 aa, Mycobacterium
AVRDWCRFNSAGSLFIDPGS

SEQ ID NO: 640359 - protein, 24 aa, Mycobacterium
AVRDWIDMFTMWPQKPTPGIRTHL

SEQ ID NO: 640360 - protein, 25 aa, Mycobacterium
AVREFGFGALQIWQAFTEKVSKQPA

SEQ ID NO: 640361 - protein, 19 aa, Mycobacterium
AVREGHRPRSLVVLTGSSV

SEQ ID NO: 640362 - protein, 17 aa, Mycobacterium
AVRELALRARLVAEPSG

SEQ ID NO: 640363 - protein, 17 aa, Mycobacterium
AVRELIDGIGLTLFPLT

SEQ ID NO: 640364 - protein, 23 aa, Mycobacterium
AVRESLRRSLSFNGYSVDLAEDG

SEQ ID NO: 640365 - protein, 26 aa, Mycobacterium
AVRGARAMLLWDFFSKAVRDVWSAAG

SEQ ID NO: 640366 - protein, 28 aa, Mycobacterium
AVRGFCWSRGDGLCNVFIPHATAGVAII

SEQ ID NO: 640367 - protein, 27 aa, Mycobacterium
AVRGFCWSRGDGLCNVFVPHATAGVAI

SEQ ID NO: 640368 - protein, 19 aa, Mycobacterium
AVRGTRLAILKGLDVPLHE

SEQ ID NO: 640369 - protein, 19 aa, Mycobacterium
AVRGTRLAILKGLNVPLHE

SEQ ID NO: 640370 - protein, 22 aa, Mycobacterium
AVRHDPDWSVLRSFKRLLNEAG

SEQ ID NO: 640371 - protein, 22 aa, Mycobacterium
AVRHDPGWSVLRSFKRLLNDAG

SEQ ID NO: 640372 - protein, 25 aa, Mycobacterium
AVRHESVAVCQRAVGMINDQTRLVL

SEQ ID NO: 640373 - protein, 26 aa, Mycobacterium
AVRHPERLGALVLTSCDAFEHFPPPI

SEQ ID NO: 640374 - protein, 22 aa, Mycobacterium
AVRIANCSGFYGDRLSAMREML

SEQ ID NO: 640375 - protein, 21 aa, Mycobacterium
AVRLALRLRRDELIDDAEALR

SEQ ID NO: 640376 - protein, 20 aa, Mycobacterium
AVRLAREGANIIGIDICADI

SEQ ID NO: 640377 - protein, 17 aa, Mycobacterium
AVRLIRAYLPAMIGAGW

SEQ ID NO: 640378 - protein, 19 aa, Mycobacterium
AVRLLGRLDGIAVTMGTAG

SEQ ID NO: 640379 - protein, 23 aa, Mycobacterium
AVRLPFRRHRPILLLSRPEHAEH

SEQ ID NO: 640380 - protein, 20 aa, Mycobacterium
AVRLPFVLSGVTLHATAATR

SEQ ID NO: 640381 - protein, 17 aa, Mycobacterium
AVRLRRGADYVVAMFAV

SEQ ID NO: 640382 - protein, 20 aa, Mycobacterium
AVRPDIGGVLIRGEKGTAKS

SEQ ID NO: 640383 - protein, 19 aa, Mycobacterium
AVRPDWTPGEARFAVHAAM

SEQ ID NO: 640384 - protein, 21 aa, Mycobacterium
AVRPEILASRIISSIDHQHAF

SEQ ID NO: 640385 - protein, 25 aa, Mycobacterium
AVRRAVSRAQGWAPFNTFGYAAASR

SEQ ID NO: 640386 - protein, 29 aa, Mycobacterium
AVRRLRLTYEALRRWNERIVCVAITGYGL

SEQ ID NO: 640387 - protein, 25 aa, Mycobacterium
AVRRPAPRLTAWVPVAVNPGAAAHA

SEQ ID NO: 640388 - protein, 22 aa, Mycobacterium
AVRRQLPHVLLQWEDFASTHAQ

SEQ ID NO: 640389 - protein, 22 aa, Mycobacterium
AVRRRCLLVGGPGRGKTASAVL

SEQ ID NO: 640390 - protein, 24 aa, Mycobacterium
AVRRRPYTVILFDEIEKAHPDVFD

SEQ ID NO: 640391 - protein, 22 aa, Mycobacterium
AVRRRPYTVVLFDEVEKAHPDV

SEQ ID NO: 640392 - protein, 32 aa, Mycobacterium
AVRRRVGTASGRRLRGKLVRVLRDRDLGTASN

SEQ ID NO: 640393 - protein, 29 aa, Mycobacterium
AVRRSQIKAVWRAVAAVDQIFARSGGNAL

SEQ ID NO: 640394 - protein, 23 aa, Mycobacterium
AVRRVKGGWIATGEPWSYDEQRY

SEQ ID NO: 640395 - protein, 22 aa, Mycobacterium
AVRRYKNRLIYVSTCEVYGDGH

SEQ ID NO: 640396 - protein, 28 aa, Mycobacterium
AVRSPRRLGRRTGVQVTDWSHIQGLTPS

SEQ ID NO: 640397 - protein, 22 aa, Mycobacterium
AVRSQHGLAWISAMATNLYGPG

SEQ ID NO: 640398 - protein, 26 aa, Mycobacterium
AVRSQLRSEGWRFMRSMNRELSVPVL

SEQ ID NO: 640399 - protein, 27 aa, Mycobacterium
AVRSTRAALPLLRRSDSAAIVNVSSLT

SEQ ID NO: 640400 - protein, 22 aa, Mycobacterium
AVRTAEVLERFGLAGHADQPAH

SEQ ID NO: 640401 - protein, 25 aa, Mycobacterium
AVRTFARRRIDAILADVAPADGHDD

SEQ ID NO: 640402 - protein, 25 aa, Mycobacterium
AVRTFARRRIDTILSGVTAGSGDVA

SEQ ID NO: 640403 - protein, 18 aa, Mycobacterium
AVRTGRFDSIVEVGHPNR

SEQ ID NO: 640404 - protein, 24 aa, Mycobacterium
AVRTYRDVLLWNRDPNSSAWSPFS

SEQ ID NO: 640405 - protein, 26 aa, Mycobacterium
AVRVIRTLRRLGIRSVAVYSDADARA

SEQ ID NO: 640406 - protein, 20 aa, Mycobacterium
AVRYEMQRQAAILVGGGQII

SEQ ID NO: 640407 - protein, 17 aa, Mycobacterium
AVSAAARSHVCSMRTIA

SEQ ID NO: 640408 - protein, 17 aa, Mycobacterium
AVSAALEMGCRLIDTAS

SEQ ID NO: 640409 - protein, 17 aa, Mycobacterium
AVSAALEVGCRLIDTAA

SEQ ID NO: 640410 - protein, 19 aa, Mycobacterium
AVSAAREAQREWITLGVDQ

SEQ ID NO: 640411 - protein, 17 aa, Mycobacterium
AVSAAWAGAGIRLNALA

SEQ ID NO: 640412 - protein, 19 aa, Mycobacterium
AVSADWGLDEILLPSTGPA

SEQ ID NO: 640413 - protein, 22 aa, Mycobacterium
AVSAGAGRLVWLPASLPAPYRE

SEQ ID NO: 640414 - protein, 25 aa, Mycobacterium
AVSAGLPSLMVLSGVSTATDAVFAA

SEQ ID NO: 640415 - protein, 18 aa, Mycobacterium
AVSALHRAAEDPRVAGLI

SEQ ID NO: 640416 - protein, 32 aa, Mycobacterium
AVSALRANHPVFRRRRFFSGKPVGRRGEDGLP

SEQ ID NO: 640417 - protein, 18 aa, Mycobacterium
AVSARAAFVAATRGGWRA

SEQ ID NO: 640418 - protein, 25 aa, Mycobacterium
AVSARAEWAPTFSIYDVATLDELAA

SEQ ID NO: 640419 - protein, 18 aa, Mycobacterium
AVSARLTTRTLFFARSLP

SEQ ID NO: 640420 - protein, 17 aa, Mycobacterium
AVSAVLRAWAPPGATVV

SEQ ID NO: 640421 - protein, 24 aa, Mycobacterium
AVSDDIRRMLGYSIHPPFVGAVDG

SEQ ID NO: 640422 - protein, 22 aa, Mycobacterium
AVSDLANIGSVLTTANAAAALP

SEQ ID NO: 640423 - protein, 25 aa, Mycobacterium
AVSDWTAGLANHFGIRGITINAVAV

SEQ ID NO: 640424 - protein, 19 aa, Mycobacterium
AVSEPGRGWAPLNPAVTAT

SEQ ID NO: 640425 - protein, 23 aa, Mycobacterium
AVSEVLRLGVAVAAGLESAHRLG

SEQ ID NO: 640426 - protein, 17 aa, Mycobacterium
AVSFIHSLGFTFGAKLT

SEQ ID NO: 640427 - protein, 20 aa, Mycobacterium
AVSFRTGRDAAIGVAVPGVA

SEQ ID NO: 640428 - protein, 19 aa, Mycobacterium
AVSFWRAVQTGVWRGHPDP

SEQ ID NO: 640429 - protein, 24 aa, Mycobacterium
AVSGGRLIPGFGIGWSPEEYQAAG

SEQ ID NO: 640430 - protein, 18 aa, Mycobacterium
AVSGRLNPQVNLVDTLNN

SEQ ID NO: 640431 - protein, 25 aa, Mycobacterium
AVSHGDFNAVFGVGGGSAIANGATA

SEQ ID NO: 640432 - protein, 24 aa, Mycobacterium
AVSHLLRQRERVMARLGEMKDLVA

SEQ ID NO: 640433 - protein, 26 aa, Mycobacterium
AVSHPGLMAVYWDRYILPRRAQARRL

SEQ ID NO: 640434 - protein, 19 aa, Mycobacterium
AVSIARRLQDPLAELVKID

SEQ ID NO: 640435 - protein, 24 aa, Mycobacterium
AVSIELADGLGLPVLSVASMVARP

SEQ ID NO: 640436 - protein, 24 aa, Mycobacterium
AVSIELADGLGLPVLSVGSMVARP

SEQ ID NO: 640437 - protein, 26 aa, Mycobacterium
AVSIELADGLGLPVLSVRAMVARSVS

SEQ ID NO: 640438 - protein, 24 aa, Mycobacterium
AVSIELSDGLGLPVLSVASMLARP

SEQ ID NO: 640439 - protein, 26 aa, Mycobacterium
AVSIFPVAALAPVFGPIGAHYLGAFA

SEQ ID NO: 640440 - protein, 29 aa, Mycobacterium
AVSILLSSRFSMWMAWGPELTFFCNSAYR

SEQ ID NO: 640441 - protein, 20 aa, Mycobacterium
AVSIPELFAAQATVRDPEAV

SEQ ID NO: 640442 - protein, 23 aa, Mycobacterium
AVSIPVLRKDFIVRPYQIHEARA

SEQ ID NO: 640443 - protein, 18 aa, Mycobacterium
AVSIRRLLVELGVSSFVV

SEQ ID NO: 640444 - protein, 19 aa, Mycobacterium
AVSLGDWPIPLPRELAGSG

SEQ ID NO: 640445 - protein, 19 aa, Mycobacterium
AVSLGDWPVAVPREIAGAA

SEQ ID NO: 640446 - protein, 30 aa, Mycobacterium
AVSLPRAKGAWCSDSRPGPSTSTHVVDAAY

SEQ ID NO: 640447 - protein, 18 aa, Mycobacterium
AVSMELRKGDGIRKGAVF

SEQ ID NO: 640448 - protein, 21 aa, Mycobacterium
AVSNRPSIYVATYFGDPGAAL

SEQ ID NO: 640449 - protein, 18 aa, Mycobacterium
AVSQHWESWHNTFWDNLA

SEQ ID NO: 640450 - protein, 24 aa, Mycobacterium
AVSQMWGRFIYHDEIAAGVVNVAG

SEQ ID NO: 640451 - protein, 19 aa, Mycobacterium
AVSQVRWDAVVLSDHTVLT

SEQ ID NO: 640452 - protein, 17 aa, Mycobacterium
AVSRAHRGVLFLDECAE

SEQ ID NO: 640453 - protein, 18 aa, Mycobacterium
AVSRAWGDLLARSGQDRY

SEQ ID NO: 640454 - protein, 17 aa, Mycobacterium
AVSRCGQHRCFPVLAGP

SEQ ID NO: 640455 - protein, 17 aa, Mycobacterium
AVSRRHALPVADIRLVQ

SEQ ID NO: 640456 - protein, 18 aa, Mycobacterium
AVSSFGLGGTNAHVIIEQ

SEQ ID NO: 640457 - protein, 17 aa, Mycobacterium
AVSSFGLSGTNAHVVLE

SEQ ID NO: 640458 - protein, 18 aa, Mycobacterium
AVSSFGLSGTNAHVVLEQ

SEQ ID NO: 640459 - protein, 26 aa, Mycobacterium
AVSSQAALFHDQFVQALTTGASSYAS

SEQ ID NO: 640460 - protein, 25 aa, Mycobacterium
AVSSRYKAPFAFTGGSIARVTIDLS

SEQ ID NO: 640461 - protein, 29 aa, Mycobacterium
AVSTQAAEFHDRFVAALTAGADAYSSAEA

SEQ ID NO: 640462 - protein, 20 aa, Mycobacterium
AVSTRFPFTGFRATLHPEIR

SEQ ID NO: 640463 - protein, 18 aa, Mycobacterium
AVSTRVVETLTWRTQLVT

SEQ ID NO: 640464 - protein, 18 aa, Mycobacterium
AVSTRVVETLTWRTRLID

SEQ ID NO: 640465 - protein, 25 aa, Mycobacterium
AVSVARLKAAGAIVLAKTNLPEFSY

SEQ ID NO: 640466 - protein, 18 aa, Mycobacterium
AVSVEFGMTGKICLSPEQ

SEQ ID NO: 640467 - protein, 18 aa, Mycobacterium
AVSWDELTDLLATELRRV

SEQ ID NO: 640468 - protein, 26 aa, Mycobacterium
AVSYEAGDALGVWPRNDSRLVDEWLT

SEQ ID NO: 640469 - protein, 21 aa, Mycobacterium
AVSYSEFANVLAIGQKNPDYL

SEQ ID NO: 640470 - protein, 21 aa, Mycobacterium
AVTALERRGILAGTYADELCT

SEQ ID NO: 640471 - protein, 17 aa, Mycobacterium
AVTALPVPVIGAVRGLA

SEQ ID NO: 640472 - protein, 18 aa, Mycobacterium
AVTARALARMDMAKMNHR

SEQ ID NO: 640473 - protein, 28 aa, Mycobacterium
AVTARRPGWFNARWVAVAMQNRAQRWAD

SEQ ID NO: 640474 - protein, 21 aa, Mycobacterium
AVTASGWSWRHAGRPRWALRD

SEQ ID NO: 640475 - protein, 23 aa, Mycobacterium
AVTDAGLEWKDIQAATGGSWTVA

SEQ ID NO: 640476 - protein, 17 aa, Mycobacterium
AVTDCLNFGSPEDPGVM

SEQ ID NO: 640477 - protein, 19 aa, Mycobacterium
AVTDGRIVAVGNRSDVNEL

SEQ ID NO: 640478 - protein, 23 aa, Mycobacterium
AVTDIRPSLLVHTGLATAQFILR

SEQ ID NO: 640479 - protein, 23 aa, Mycobacterium
AVTDRPSFIALRTIIGYPAPKLM

SEQ ID NO: 640480 - protein, 18 aa, Mycobacterium
AVTEHWGPPPGELFVDRS

SEQ ID NO: 640481 - protein, 17 aa, Mycobacterium
AVTEMWHIVGSAIIGVA

SEQ ID NO: 640482 - protein, 19 aa, Mycobacterium
AVTENWLGISAVRVAENQR

SEQ ID NO: 640483 - protein, 29 aa, Mycobacterium
AVTESYRLLKHGGFNRILFLVDRNNLADQ

SEQ ID NO: 640484 - protein, 20 aa, Mycobacterium
AVTFAGRIDAAIARLAGLEI

SEQ ID NO: 640485 - protein, 23 aa, Mycobacterium
AVTFAPRYDNFIGGEWVAPADGQ

SEQ ID NO: 640486 - protein, 48 aa, Mycobacterium
AVTFLRPLDGFPERRARLMIEMHVLGPLHLCQLAIPAMRERGRGWILN

SEQ ID NO: 640487 - protein, 36 aa, Mycobacterium
AVTFLRPLDGFPERRARLMLEMHVLGPLQLSQLAIP

SEQ ID NO: 640488 - protein, 19 aa, Mycobacterium
AVTGCLIAGVPVVPVPADV

SEQ ID NO: 640489 - protein, 22 aa, Mycobacterium
AVTGLDLVEWQLRVAAGEKLGF

SEQ ID NO: 640490 - protein, 23 aa, Mycobacterium
AVTGLPDLQAWFAQELAEAVPAG

SEQ ID NO: 640491 - protein, 29 aa, Mycobacterium
AVTGNLRWTLTGVVYAEWLLSPRPNGHER

SEQ ID NO: 640492 - protein, 22 aa, Mycobacterium
AVTGRGSAVSWLDLGEAGSVTR

SEQ ID NO: 640493 - protein, 17 aa, Mycobacterium
AVTHHWGPPPGDLFVDR

SEQ ID NO: 640494 - protein, 21 aa, Mycobacterium
AVTHPAHWAVLLVEDTAWCDV

SEQ ID NO: 640495 - protein, 21 aa, Mycobacterium
AVTIPVFDAGFLGIPIDAGPV

SEQ ID NO: 640496 - protein, 27 aa, Mycobacterium
AVTIRPGEIPVFWACGVTPQAAVMQSR

SEQ ID NO: 640497 - protein, 17 aa, Mycobacterium
AVTKAPVGWIPQRDGRV

SEQ ID NO: 640498 - protein, 26 aa, Mycobacterium
AVTKHAAVGFAEWLAITYGDDGVGVS

SEQ ID NO: 640499 - protein, 25 aa, Mycobacterium
AVTLDRVVAVPAMLPQNTRRRQKVT

SEQ ID NO: 640500 - protein, 20 aa, Mycobacterium
AVTLLEHLVRSWRGKTARKE

SEQ ID NO: 640501 - protein, 17 aa, Mycobacterium
AVTLLPAERSRLHVDLD

SEQ ID NO: 640502 - protein, 20 aa, Mycobacterium
AVTLPAYGGTTAWASTEAAY

SEQ ID NO: 640503 - protein, 20 aa, Mycobacterium
AVTLPRYGGTTLWTNTAAAY

SEQ ID NO: 640504 - protein, 20 aa, Mycobacterium
AVTLPSYGGSTLWASTVAAY

SEQ ID NO: 640505 - protein, 24 aa, Mycobacterium
AVTLPSYGGTTAWASTEAAYQQLP

SEQ ID NO: 640506 - protein, 25 aa, Mycobacterium
AVTLWEHWDHCALHWFPGSHIMHVS

SEQ ID NO: 640507 - protein, 25 aa, Mycobacterium
AVTMAAAVAPYVAWMRATAAAAEQA

SEQ ID NO: 640508 - protein, 32 aa, Mycobacterium
AVTNWFGDQPFAVWPWAAPKLGGARPVVLNLD

SEQ ID NO: 640509 - protein, 20 aa, Mycobacterium
AVTPYVSWVTAAGVQAEETA

SEQ ID NO: 640510 - protein, 36 aa, Mycobacterium
AVTQCWMSLFSPRVITYRASRGFTAAPAMAVVVQQM

SEQ ID NO: 640511 - protein, 25 aa, Mycobacterium
AVTQRHLRRLWAMPGTQLGVVAWPA

SEQ ID NO: 640512 - protein, 24 aa, Mycobacterium
AVTRDPRPLLGLPPLTTDDRDDLL

SEQ ID NO: 640513 - protein, 21 aa, Mycobacterium
AVTRLRIRDGVQLPRGSTAEL

SEQ ID NO: 640514 - protein, 20 aa, Mycobacterium
AVTRMWTFLAPAYDLPFLQQ

SEQ ID NO: 640515 - protein, 24 aa, Mycobacterium
AVTRRLADLGIFVFRSYGSTEHPS

SEQ ID NO: 640516 - protein, 17 aa, Mycobacterium
AVTRSAVDLVVLSDNLV

SEQ ID NO: 640517 - protein, 20 aa, Mycobacterium
AVTRYAVRLSQPAIVSAAEG

SEQ ID NO: 640518 - protein, 18 aa, Mycobacterium
AVTSARRADELCALLRRR

SEQ ID NO: 640519 - protein, 25 aa, Mycobacterium
AVTSGVGIVEGWRGAVLHRVEVDGA

SEQ ID NO: 640520 - protein, 31 aa, Mycobacterium
AVTSWLYRIVVNACLDRMRRNKAHIPIELEE

SEQ ID NO: 640521 - protein, 18 aa, Mycobacterium
AVTSWPSICSGLRAEARH

SEQ ID NO: 640522 - protein, 17 aa, Mycobacterium
AVTSYVWEAGIGAVFTR

SEQ ID NO: 640523 - protein, 18 aa, Mycobacterium
AVTTAITKHHRVLQLPPV

SEQ ID NO: 640524 - protein, 24 aa, Mycobacterium
AVTVAKGMARRGAMTEITAIRRVD

SEQ ID NO: 640525 - protein, 29 aa, Mycobacterium
AVTVARVAMKWGFGHLGRFSAEYRRKFGV

SEQ ID NO: 640526 - protein, 19 aa, Mycobacterium
AVTVNLRRLSVDWRDYSRS

SEQ ID NO: 640527 - protein, 27 aa, Mycobacterium
AVTVNWPKALMLCRRMIGAGTTVADCL

SEQ ID NO: 640528 - protein, 19 aa, Mycobacterium
AVTVPELGTFVAERPPVAV

SEQ ID NO: 640529 - protein, 19 aa, Mycobacterium
AVTVPELGTFVAERPPVVV

SEQ ID NO: 640530 - protein, 24 aa, Mycobacterium
AVTVPRGAAAVVFPADVSSAPTTA

SEQ ID NO: 640531 - protein, 26 aa, Mycobacterium
AVTVPRTGREPSPWKPVDDATVLRAL

SEQ ID NO: 640532 - protein, 26 aa, Mycobacterium
AVVAACLRAGFPQQRLSCDVLTRFAS

SEQ ID NO: 640533 - protein, 27 aa, Mycobacterium
AVVAADWPLLAAAYRTRGSLRIVDDLL

SEQ ID NO: 640534 - protein, 23 aa, Mycobacterium
AVVAALARRLAPGGLLVAGFQLG

SEQ ID NO: 640535 - protein, 27 aa, Mycobacterium
AVVAARAAAVQCVRAGSAGSAGAASPA

SEQ ID NO: 640536 - protein, 18 aa, Mycobacterium
AVVAARRALPQWAGVTPA

SEQ ID NO: 640537 - protein, 21 aa, Mycobacterium
AVVAARWALAEAHAGDGEDQV

SEQ ID NO: 640538 - protein, 20 aa, Mycobacterium
AVVADRRLDVEFSVAAGEVL

SEQ ID NO: 640539 - protein, 25 aa, Mycobacterium
AVVALPEHCDFVGRRTGEGWTLTGS

SEQ ID NO: 640540 - protein, 17 aa, Mycobacterium
AVVALRDDLDLVLVDVS

SEQ ID NO: 640541 - protein, 37 aa, Mycobacterium
AVVAMNADWSRARQVGFGGLVPKMFGELGTADTVGGQ

SEQ ID NO: 640542 - protein, 17 aa, Mycobacterium
AVVAREYGLPCVVNTLV

SEQ ID NO: 640543 - protein, 17 aa, Mycobacterium
AVVARYFPEQPGLYAAR

SEQ ID NO: 640544 - protein, 33 aa, Mycobacterium
AVVAVKCANPVICVLIHRRSETNLKTATVVGAA

SEQ ID NO: 640545 - protein, 18 aa, Mycobacterium
AVVCAYVALYAQRRPTDV

SEQ ID NO: 640546 - protein, 19 aa, Mycobacterium
AVVDCRILPGRKAAFEAEV

SEQ ID NO: 640547 - protein, 32 aa, Mycobacterium
AVVDELKHAIADAIHGLKCVVDVLADELSRIP

SEQ ID NO: 640548 - protein, 19 aa, Mycobacterium
AVVDGEIWLETKAKSQKAV

SEQ ID NO: 640549 - protein, 19 aa, Mycobacterium
AVVDLGARRRTLLFMRADP

SEQ ID NO: 640550 - protein, 19 aa, Mycobacterium
AVVDLMGRIYRDFEYRSGS

SEQ ID NO: 640551 - protein, 26 aa, Mycobacterium
AVVEGRPKHYWSIYQKMIVKGRDFDD

SEQ ID NO: 640552 - protein, 20 aa, Mycobacterium
AVVEPAFWMGQPRTCAGSFI

SEQ ID NO: 640553 - protein, 24 aa, Mycobacterium
AVVESWLSATGFHGAEAVIVDGRQ

SEQ ID NO: 640554 - protein, 26 aa, Mycobacterium
AVVETRGRFGTFISRFDPTDAAMAAA

SEQ ID NO: 640555 - protein, 18 aa, Mycobacterium
AVVFCHGGGFVLCDIESH

SEQ ID NO: 640556 - protein, 19 aa, Mycobacterium
AVVFPRLKVIESILQAAAR

SEQ ID NO: 640557 - protein, 21 aa, Mycobacterium
AVVGIYGRYDWEDRSTAERAR

SEQ ID NO: 640558 - protein, 17 aa, Mycobacterium
AVVGQRCDPLFVMAAPG

SEQ ID NO: 640559 - protein, 25 aa, Mycobacterium
AVVGVAAGREVCWATDLNAGGAAML

SEQ ID NO: 640560 - protein, 21 aa, Mycobacterium
AVVGVAWKHFTETGAIKAKAV

SEQ ID NO: 640561 - protein, 25 aa, Mycobacterium
AVVHEGRKPRSRFADMLIAATAHAN

SEQ ID NO: 640562 - protein, 20 aa, Mycobacterium
AVVHYGRIKALHSVSLTVHE

SEQ ID NO: 640563 - protein, 22 aa, Mycobacterium
AVVIRAPRSVPLGVFYSMIEII

SEQ ID NO: 640564 - protein, 19 aa, Mycobacterium
AVVKLRLAIEALVQLASHV

SEQ ID NO: 640565 - protein, 18 aa, Mycobacterium
AVVLEHGKPLGLVTEAAC

SEQ ID NO: 640566 - protein, 25 aa, Mycobacterium
AVVLFGMPNVRAMNFLGQPPVVIGP

SEQ ID NO: 640567 - protein, 24 aa, Mycobacterium
AVVLGRPGGPAFRPSEVARLGYLA

SEQ ID NO: 640568 - protein, 18 aa, Mycobacterium
AVVLKFFVRELLRRNPQL

SEQ ID NO: 640569 - protein, 17 aa, Mycobacterium
AVVLWEAQFGDFVNGAQ

SEQ ID NO: 640570 - protein, 27 aa, Mycobacterium
AVVMSFSAAAVWRIRRAAPMLPTVLLG

SEQ ID NO: 640571 - protein, 28 aa, Mycobacterium
AVVMSFSAAAVWRIRRVAPLLPTVLLGR

SEQ ID NO: 640572 - protein, 28 aa, Mycobacterium
AVVMSFSAAAVWRVRRAAPLLPTVLLGK

SEQ ID NO: 640573 - protein, 18 aa, Mycobacterium
AVVNRLATEQVMRIASDP

SEQ ID NO: 640574 - protein, 21 aa, Mycobacterium
AVVPALRFNPELAKIYEPLLT

SEQ ID NO: 640575 - protein, 18 aa, Mycobacterium
AVVPLLLAHRHRLPASLR

SEQ ID NO: 640576 - protein, 18 aa, Mycobacterium
AVVPRAHGSALFQRGETQ

SEQ ID NO: 640577 - protein, 20 aa, Mycobacterium
AVVQGLSMTTGWPELAEAAL

SEQ ID NO: 640578 - protein, 25 aa, Mycobacterium
AVVRAHCRHLATIVTIRGEIDAVNV

SEQ ID NO: 640579 - protein, 23 aa, Mycobacterium
AVVRDPHAWSGYLTEAIDAFADR

SEQ ID NO: 640580 - protein, 18 aa, Mycobacterium
AVVRILGGYRAWQDGIDA

SEQ ID NO: 640581 - protein, 18 aa, Mycobacterium
AVVRQRRSLLPAGITAVS

SEQ ID NO: 640582 - protein, 24 aa, Mycobacterium
AVVRQWLDYGLTFRDSYLTCWQGN

SEQ ID NO: 640583 - protein, 19 aa, Mycobacterium
AVVRRINEKPPWVIAKELA

SEQ ID NO: 640584 - protein, 20 aa, Mycobacterium
AVVRVRLVPGTGKFHLDGRS

SEQ ID NO: 640585 - protein, 20 aa, Mycobacterium
AVVRVRLVPGTGQFHLDGRS

SEQ ID NO: 640586 - protein, 19 aa, Mycobacterium
AVVSIFIADFVPRVRAGLE

SEQ ID NO: 640587 - protein, 18 aa, Mycobacterium
AVVSKVFGGYGLSAQAVL

SEQ ID NO: 640588 - protein, 26 aa, Mycobacterium
AVVSLMPVWRNFFLGNELRKKNILRS

SEQ ID NO: 640589 - protein, 17 aa, Mycobacterium
AVVSNIFESARGVDDSD

SEQ ID NO: 640590 - protein, 23 aa, Mycobacterium
AVVSRAGSQLAQYTHTCFLNVPY

SEQ ID NO: 640591 - protein, 23 aa, Mycobacterium
AVVSRVITDLGVFDVTGDGFRVV

SEQ ID NO: 640592 - protein, 25 aa, Mycobacterium
AVVSVLTEGPWRGSVSASMAAAAAP

SEQ ID NO: 640593 - protein, 24 aa, Mycobacterium
AVVVDGAGAPVGWIDAEGRERHRA

SEQ ID NO: 640594 - protein, 26 aa, Mycobacterium
AVVVEARAAGRLMFYGQGAGGAPTAS

SEQ ID NO: 640595 - protein, 18 aa, Mycobacterium
AVVVECLGHQLAPGPFLT

SEQ ID NO: 640596 - protein, 19 aa, Mycobacterium
AVVVGAGFIGCEVAASLRG

SEQ ID NO: 640597 - protein, 19 aa, Mycobacterium
AVVVLAHGLGEYARRYDHV

SEQ ID NO: 640598 - protein, 23 aa, Mycobacterium
AVVVRVDPQWVWVKFSTDPGRLA

SEQ ID NO: 640599 - protein, 35 aa, Mycobacterium
AVWATIGYDLPLPLPRISYEEAMRRFGSDKPDLRF

SEQ ID NO: 640600 - protein, 17 aa, Mycobacterium
AVWEKFAEFGLDARAFS

SEQ ID NO: 640601 - protein, 22 aa, Mycobacterium
AVWPLSEPALTYFPDVRFATSD

SEQ ID NO: 640602 - protein, 17 aa, Mycobacterium
AVWQHPDLLPAVDDLDD

SEQ ID NO: 640603 - protein, 24 aa, Mycobacterium
AVWTRPAWQLDNWVRDFFGPADDW

SEQ ID NO: 640604 - protein, 23 aa, Mycobacterium
AVWWERAVEAWPDYAEYQQKTDR

SEQ ID NO: 640605 - protein, 28 aa, Mycobacterium
AVYATHIALAWSMLRRQDQFRSALASRD

SEQ ID NO: 640606 - protein, 23 aa, Mycobacterium
AVYDFLNTRCLTIAGGTEQILLT

SEQ ID NO: 640607 - protein, 22 aa, Mycobacterium
AVYGSGPLVIGVCAEYDALPGI

SEQ ID NO: 640608 - protein, 33 aa, Mycobacterium
AVYHEGWMACCFHGRLPWIRAQRNIPFGDAERW

SEQ ID NO: 640609 - protein, 23 aa, Mycobacterium
AVYLADCRKLGITVLPPDVNESG

SEQ ID NO: 640610 - protein, 18 aa, Mycobacterium
AVYLGLPVCAALTAELDR

SEQ ID NO: 640611 - protein, 18 aa, Mycobacterium
AVYLSDWGTEEFTRGAYG

SEQ ID NO: 640612 - protein, 22 aa, Mycobacterium
AVYNRSRLPLGVRELARMAVAF

SEQ ID NO: 640613 - protein, 19 aa, Mycobacterium
AVYPRDEFEKLARRASQAS

SEQ ID NO: 640614 - protein, 20 aa, Mycobacterium
AVYQDGWIAACFHGRLPWVR

SEQ ID NO: 640615 - protein, 18 aa, Mycobacterium
AVYRAASIERVCKLAYDV

SEQ ID NO: 640616 - protein, 21 aa, Mycobacterium
AVYRLAWAALSGMPESSVRTA

SEQ ID NO: 640617 - protein, 17 aa, Mycobacterium
AVYRLTGELADWYHLDA

SEQ ID NO: 640618 - protein, 17 aa, Mycobacterium
AVYRPSVLRANRAATAT

SEQ ID NO: 640619 - protein, 19 aa, Mycobacterium
AVYRRAWASLREIDPARVR

SEQ ID NO: 640620 - protein, 25 aa, Mycobacterium
AVYRVSPEQAFRVLQWRSQETNTKV

SEQ ID NO: 640621 - protein, 32 aa, Mycobacterium
AVYSGYRFVRRAAALAIPIAIVNRGPTRGDGL

SEQ ID NO: 640622 - protein, 17 aa, Mycobacterium
AVYTAWGGFAYGRDLDG

SEQ ID NO: 640623 - protein, 24 aa, Mycobacterium
AVYTKGRLPMRVRELARMVIALDN

SEQ ID NO: 640624 - protein, 26 aa, Mycobacterium
AVYTPEEFFPLGGLTFDDSVAEGLAN

SEQ ID NO: 640625 - protein, 21 aa, Mycobacterium
AVYVCGPPPMLEAVRAARAEY

SEQ ID NO: 640626 - protein, 19 aa, Mycobacterium
AWAALPFDERAAVFLRAAD

SEQ ID NO: 640627 - protein, 21 aa, Mycobacterium
AWACASSGWELLTAERLHGAL

SEQ ID NO: 640628 - protein, 30 aa, Mycobacterium
AWADEVRRLLKLRGATLLAHNYQLPEIQDV

SEQ ID NO: 640629 - protein, 22 aa, Mycobacterium
AWADRYPIAMWWGVGCRGSVLA

SEQ ID NO: 640630 - protein, 28 aa, Mycobacterium
AWAERGWLAIRFDMPFRRNRPSGPPSAS

SEQ ID NO: 640631 - protein, 22 aa, Mycobacterium
AWAESLLQMHLMDGYGSTEAGM

SEQ ID NO: 640632 - protein, 35 aa, Mycobacterium
AWAETYPGTMSYYLASAFREIWMQPAGSVGLIGFA

SEQ ID NO: 640633 - protein, 26 aa, Mycobacterium
AWAGPPPLWWAQRFGIQPDLAEALVC

SEQ ID NO: 640634 - protein, 19 aa, Mycobacterium
AWAGTLIVVSHDRYLLERI

SEQ ID NO: 640635 - protein, 20 aa, Mycobacterium
AWAHDEVRVGDRVCILGFNS

SEQ ID NO: 640636 - protein, 19 aa, Mycobacterium
AWALDLLDVAALESLQLET

SEQ ID NO: 640637 - protein, 20 aa, Mycobacterium
AWAPELLSQLGIPITVQRQV

SEQ ID NO: 640638 - protein, 18 aa, Mycobacterium
AWAPEVGGGIPWRKQDLF

SEQ ID NO: 640639 - protein, 18 aa, Mycobacterium
AWAPGALRGIGDSLYTPF

SEQ ID NO: 640640 - protein, 27 aa, Mycobacterium
AWAPTRAEALGALSAALAGARIHGLTT

SEQ ID NO: 640641 - protein, 17 aa, Mycobacterium
AWARHGVEHPMGADFTG

SEQ ID NO: 640642 - protein, 17 aa, Mycobacterium
AWASKGYAGSVFEGAGW

SEQ ID NO: 640643 - protein, 22 aa, Mycobacterium
AWASSMPGLGRVATVPLSSVAA

SEQ ID NO: 640644 - protein, 21 aa, Mycobacterium
AWAVERLRRSPSFVAQLVDEI

SEQ ID NO: 640645 - protein, 27 aa, Mycobacterium
AWCELDLRIAFYPGITADEAWSEITAE

SEQ ID NO: 640646 - protein, 18 aa, Mycobacterium
AWCTALRTDVAPLLLDTG

SEQ ID NO: 640647 - protein, 18 aa, Mycobacterium
AWDARVATLLPEVSDTSP

SEQ ID NO: 640648 - protein, 23 aa, Mycobacterium
AWDEALDSIEWIEGEVLAIGTSP

SEQ ID NO: 640649 - protein, 22 aa, Mycobacterium
AWDEIAAEVGVAANGYNSVVTE

SEQ ID NO: 640650 - protein, 24 aa, Mycobacterium
AWDELKTMWRADARGLDLDRDAHF

SEQ ID NO: 640651 - protein, 18 aa, Mycobacterium
AWDELPAAIELARRHDPK

SEQ ID NO: 640652 - protein, 21 aa, Mycobacterium
AWDLPLTRKIRERAAKQARDV

SEQ ID NO: 640653 - protein, 20 aa, Mycobacterium
AWDPPVVKVNYALREPVPWR

SEQ ID NO: 640654 - protein, 24 aa, Mycobacterium
AWDSLWVYDHFHTVPVPTGEATHE

SEQ ID NO: 640655 - protein, 21 aa, Mycobacterium
AWDVSCGLYAALSVVAALRRR

SEQ ID NO: 640656 - protein, 19 aa, Mycobacterium
AWDVTCGIYTALSVVTALR

SEQ ID NO: 640657 - protein, 18 aa, Mycobacterium
AWEGLTFAEAAERDPELH

SEQ ID NO: 640658 - protein, 18 aa, Mycobacterium
AWEGLTFGEAAERDPELH

SEQ ID NO: 640659 - protein, 17 aa, Mycobacterium
AWEGLTFSEASQRDPEL

SEQ ID NO: 640660 - protein, 29 aa, Mycobacterium
AWELAATRLGRFAGLVAIDRGHPAIADSE

SEQ ID NO: 640661 - protein, 23 aa, Mycobacterium
AWEPKTGAVGSLWDVVRDRRLTH

SEQ ID NO: 640662 - protein, 23 aa, Mycobacterium
AWEPKTGAVGSLWDVVRDRRQAH

SEQ ID NO: 640663 - protein, 18 aa, Mycobacterium
AWEPLILARRIRDYSPQM

SEQ ID NO: 640664 - protein, 20 aa, Mycobacterium
AWETLMLRLGYERYGAQGGD

SEQ ID NO: 640665 - protein, 19 aa, Mycobacterium
AWEVAGLRGGDRVVKVQAP

SEQ ID NO: 640666 - protein, 27 aa, Mycobacterium
AWEVQGRGELALAILVEQMRREGFELT

SEQ ID NO: 640667 - protein, 20 aa, Mycobacterium
AWFPLTKRWLGFEDAHITFE

SEQ ID NO: 640668 - protein, 18 aa, Mycobacterium
AWGDGGPWGDRRGFDSLV

SEQ ID NO: 640669 - protein, 17 aa, Mycobacterium
AWGEVLAGFDTPSLVGP

SEQ ID NO: 640670 - protein, 17 aa, Mycobacterium
AWGEVLAGFDTPTLVGP

SEQ ID NO: 640671 - protein, 20 aa, Mycobacterium
AWGGGPGRCRGRRRPGRGGD

SEQ ID NO: 640672 - protein, 18 aa, Mycobacterium
AWGGGVFNGGAWLHIDGR

SEQ ID NO: 640673 - protein, 26 aa, Mycobacterium
AWGGKHLRPGDEIVITHLEHHANIVP

SEQ ID NO: 640674 - protein, 24 aa, Mycobacterium
AWGGPPIGALVFRDPSLISAFGSV

SEQ ID NO: 640675 - protein, 18 aa, Mycobacterium
AWGKLGYPRRAKRLHECA

SEQ ID NO: 640676 - protein, 27 aa, Mycobacterium
AWGKVFEGFETPTLVGPPGRMVLGRRG

SEQ ID NO: 640677 - protein, 20 aa, Mycobacterium
AWGLPYAALMAGAGLVMPDR

SEQ ID NO: 640678 - protein, 18 aa, Mycobacterium
AWGRKMFVTPGVVVDGKL

SEQ ID NO: 640679 - protein, 38 aa, Mycobacterium
AWHAAWCWDDHFLDFFAGRGYRALALSFRGHGRSATDK

SEQ ID NO: 640680 - protein, 24 aa, Mycobacterium
AWHKICVDRGILPGMQELVHRIGD

SEQ ID NO: 640681 - protein, 19 aa, Mycobacterium
AWHRICVDRGILPGMQELV

SEQ ID NO: 640682 - protein, 21 aa, Mycobacterium
AWHRPEHFDALVAQLSEFDVH

SEQ ID NO: 640683 - protein, 20 aa, Mycobacterium
AWHRSGLQRRWLSAAERGGP

SEQ ID NO: 640684 - protein, 20 aa, Mycobacterium
AWIAEGLLDYLPPDAQDQLF

SEQ ID NO: 640685 - protein, 20 aa, Mycobacterium
AWIEQMKRIGIYGLAIGEAY

SEQ ID NO: 640686 - protein, 23 aa, Mycobacterium
AWILCAAIAHNLLRAAGVLAGTA

SEQ ID NO: 640687 - protein, 18 aa, Mycobacterium
AWINLLGPEKVWELYGGT

SEQ ID NO: 640688 - protein, 26 aa, Mycobacterium
AWIRNMELAILKGEEKALLKKYTDYQ

SEQ ID NO: 640689 - protein, 21 aa, Mycobacterium
AWKACRDAMRDADRGRVVKPS

SEQ ID NO: 640690 - protein, 22 aa, Mycobacterium
AWKTLKPQRVYAFTAHASVTYT

SEQ ID NO: 640691 - protein, 33 aa, Mycobacterium
AWKVESLRVEWWQSCRLPVNWKLATAAFMEGYH

SEQ ID NO: 640692 - protein, 20 aa, Mycobacterium
AWLAAPPPIVPRSTVGAGDS

SEQ ID NO: 640693 - protein, 17 aa, Mycobacterium
AWLACGPAIVALTLGDQ

SEQ ID NO: 640694 - protein, 17 aa, Mycobacterium
AWLADELTRSWAGQWPA

SEQ ID NO: 640695 - protein, 18 aa, Mycobacterium
AWLAEGLLMYLPADAQDQ

SEQ ID NO: 640696 - protein, 24 aa, Mycobacterium
AWLAENRSGAGIFGSIAQLVKVRP

SEQ ID NO: 640697 - protein, 23 aa, Mycobacterium
AWLAEVLPAFPAYAHMLGNFDVR

SEQ ID NO: 640698 - protein, 17 aa, Mycobacterium
AWLARKVDSFGVRLRQG

SEQ ID NO: 640699 - protein, 20 aa, Mycobacterium
AWLDELRRVGLLGPDPSPDT

SEQ ID NO: 640700 - protein, 23 aa, Mycobacterium
AWLGHADPAFTMRTYVHAQNDAL

SEQ ID NO: 640701 - protein, 24 aa, Mycobacterium
AWLGRDEIRIELGSPWVGAGDVAD

SEQ ID NO: 640702 - protein, 20 aa, Mycobacterium
AWLHEGRPALATADSGPALL

SEQ ID NO: 640703 - protein, 19 aa, Mycobacterium
AWLNLVRPLTIVEGFALLS

SEQ ID NO: 640704 - protein, 24 aa, Mycobacterium
AWLPELSNMRVLREPRGPLDQTVP

SEQ ID NO: 640705 - protein, 18 aa, Mycobacterium
AWLPKLGLPQGFGARPMV

SEQ ID NO: 640706 - protein, 23 aa, Mycobacterium
AWLPSLACGAVRGTTALWNARDA

SEQ ID NO: 640707 - protein, 17 aa, Mycobacterium
AWLQVFAQMEIPRRILQ

SEQ ID NO: 640708 - protein, 17 aa, Mycobacterium
AWLRCMHTAVASIDSET

SEQ ID NO: 640709 - protein, 18 aa, Mycobacterium
AWLRELTDLPLIVKGICH

SEQ ID NO: 640710 - protein, 20 aa, Mycobacterium
AWLRELWGGPFMLKGVMRVD

SEQ ID NO: 640711 - protein, 21 aa, Mycobacterium
AWLRLAEAVGLTRAEVEDARH

SEQ ID NO: 640712 - protein, 23 aa, Mycobacterium
AWLRQLWGGPFMLKGVMRVDDAK

SEQ ID NO: 640713 - protein, 18 aa, Mycobacterium
AWLSWGQLGAATRRVAAL

SEQ ID NO: 640714 - protein, 18 aa, Mycobacterium
AWLVEGLLIYLPADAQER

SEQ ID NO: 640715 - protein, 20 aa, Mycobacterium
AWLYSGFYGLAKVGINGLTQ

SEQ ID NO: 640716 - protein, 17 aa, Mycobacterium
AWMDAFRTFTTTLFSRF

SEQ ID NO: 640717 - protein, 24 aa, Mycobacterium
AWMPQYGGGIPWRKQDRFFNAPAN

SEQ ID NO: 640718 - protein, 21 aa, Mycobacterium
AWMRELFPFDRVIRLSMENVK

SEQ ID NO: 640719 - protein, 20 aa, Mycobacterium
AWNHWARTWAPGFDFHRDAQ

SEQ ID NO: 640720 - protein, 21 aa, Mycobacterium
AWNLCGIKAAVAIAGAEAGTD

SEQ ID NO: 640721 - protein, 18 aa, Mycobacterium
AWPAAGRFFTVRAGSLVA

SEQ ID NO: 640722 - protein, 21 aa, Mycobacterium
AWPALCSGLRAEARQGRMLPY

SEQ ID NO: 640723 - protein, 22 aa, Mycobacterium
AWPATLERLLAIGGPDAIYVPG

SEQ ID NO: 640724 - protein, 20 aa, Mycobacterium
AWPAVCSGLRSEARKGRMLP

SEQ ID NO: 640725 - protein, 18 aa, Mycobacterium
AWPDDVDPSWTYGAATPV

SEQ ID NO: 640726 - protein, 21 aa, Mycobacterium
AWPELKIALEYEGQHHTDPVT

SEQ ID NO: 640727 - protein, 20 aa, Mycobacterium
AWPGLTPRLLRAEQGTETLA

SEQ ID NO: 640728 - protein, 19 aa, Mycobacterium
AWPPSRIAEVCASARLAAV

SEQ ID NO: 640729 - protein, 24 aa, Mycobacterium
AWPPTRRDAMFGTWHYWWQAHLLD

SEQ ID NO: 640730 - protein, 24 aa, Mycobacterium
AWPQISELVAALFAPQTMKELVAA

SEQ ID NO: 640731 - protein, 19 aa, Mycobacterium
AWPQISVLVAALFAGQTMK

SEQ ID NO: 640732 - protein, 27 aa, Mycobacterium
AWPRSRSWPSISRARIRGHDGAAGVAP

SEQ ID NO: 640733 - protein, 18 aa, Mycobacterium
AWPSFGLTLPEILPDHFT

SEQ ID NO: 640734 - protein, 17 aa, Mycobacterium
AWPSVPRHIEWKHGVCQ

SEQ ID NO: 640735 - protein, 20 aa, Mycobacterium
AWQADRERAYEFGALATAAQ

SEQ ID NO: 640736 - protein, 18 aa, Mycobacterium
AWQARWNQALDDLVRSYQ

SEQ ID NO: 640737 - protein, 19 aa, Mycobacterium
AWQDRRLPMRYDPRPSAVN

SEQ ID NO: 640738 - protein, 21 aa, Mycobacterium
AWQESRELLVLGGQVKSSDLS

SEQ ID NO: 640739 - protein, 23 aa, Mycobacterium
AWQETAFQYAWLLAAADRHRDRG

SEQ ID NO: 640740 - protein, 24 aa, Mycobacterium
AWQGDTGLTYQGWQAQWNQSMQEL

SEQ ID NO: 640741 - protein, 26 aa, Mycobacterium
AWQGDTGMTYQVWQAQWNQAMESLVR

SEQ ID NO: 640742 - protein, 18 aa, Mycobacterium
AWQHLPFAAQWHSDNELA

SEQ ID NO: 640743 - protein, 19 aa, Mycobacterium
AWQIFPNFQIGQGLTTALC

SEQ ID NO: 640744 - protein, 20 aa, Mycobacterium
AWQSTLGDRAWVVSRDEAIA

SEQ ID NO: 640745 - protein, 19 aa, Mycobacterium
AWQVFPNFQIGQGLTSALC

SEQ ID NO: 640746 - protein, 19 aa, Mycobacterium
AWRAAERGFYALATVAGVN

SEQ ID NO: 640747 - protein, 26 aa, Mycobacterium
AWRAALDPKGEWMPAVIAAADKRLQG

SEQ ID NO: 640748 - protein, 21 aa, Mycobacterium
AWRAGPDGCRLSAVLIGTPPP

SEQ ID NO: 640749 - protein, 25 aa, Mycobacterium
AWRARAASLAGVFERARERGELRAG

SEQ ID NO: 640750 - protein, 28 aa, Mycobacterium
AWRCGQWYTARLSPMPLRPEERKTTVVE

SEQ ID NO: 640751 - protein, 19 aa, Mycobacterium
AWRDGDRILVPHLVVTHGA

SEQ ID NO: 640752 - protein, 26 aa, Mycobacterium
AWRDGQWYAARLCPSPLRAAERRTAV

SEQ ID NO: 640753 - protein, 25 aa, Mycobacterium
AWRDLRVWWQLRNPFTPSWGEPYTQ

SEQ ID NO: 640754 - protein, 19 aa, Mycobacterium
AWRELLSAFAEFDNQFLDG

SEQ ID NO: 640755 - protein, 21 aa, Mycobacterium
AWREVLDGFDAPTLVGPAGRM

SEQ ID NO: 640756 - protein, 21 aa, Mycobacterium
AWRGGEWYVARLFPGPLSADE

SEQ ID NO: 640757 - protein, 24 aa, Mycobacterium
AWRIRRFDSGMAWAEDPPSRTRHL

SEQ ID NO: 640758 - protein, 26 aa, Mycobacterium
AWRQGQWLTARLCPAPLRSEERETTV

SEQ ID NO: 640759 - protein, 17 aa, Mycobacterium
AWRRIRSTVRDWNDLEP

SEQ ID NO: 640760 - protein, 26 aa, Mycobacterium
AWRYIRASVPAVWAYTRREPMLTLEL

SEQ ID NO: 640761 - protein, 25 aa, Mycobacterium
AWSAEPWTTLPARYGVPLPGRPAPL

SEQ ID NO: 640762 - protein, 20 aa, Mycobacterium
AWSAHPWTTRFGFPVPGRPA

SEQ ID NO: 640763 - protein, 35 aa, Mycobacterium
AWSARPWTTRPAIPWPWRPAPLHPNEDGMTAVADL

SEQ ID NO: 640764 - protein, 19 aa, Mycobacterium
AWSGSRFAQRPMLPEDIHR

SEQ ID NO: 640765 - protein, 21 aa, Mycobacterium
AWSLAPFTGLLPRRPKIEERT

SEQ ID NO: 640766 - protein, 17 aa, Mycobacterium
AWSPFSRQPVMGPAVSN

SEQ ID NO: 640767 - protein, 17 aa, Mycobacterium
AWSQRSTRLREWAKDNL

SEQ ID NO: 640768 - protein, 21 aa, Mycobacterium
AWSSWNRYAGEFADHAGARVV

SEQ ID NO: 640769 - protein, 19 aa, Mycobacterium
AWSTDRWLRDFFGPAAASD

SEQ ID NO: 640770 - protein, 24 aa, Mycobacterium
AWSVCMRMTLSGFYSHPWAWNEIG

SEQ ID NO: 640771 - protein, 19 aa, Mycobacterium
AWTELGVPAIRVIGPQDGA

SEQ ID NO: 640772 - protein, 19 aa, Mycobacterium
AWTHPDVLAAFVTVRQAAD

SEQ ID NO: 640773 - protein, 26 aa, Mycobacterium
AWTKNHWDWFDPFYAHRVLWPNRAYK

SEQ ID NO: 640774 - protein, 29 aa, Mycobacterium
AWTLAMGHAMIRAGLSLKRHGTDRPWRPD

SEQ ID NO: 640775 - protein, 26 aa, Mycobacterium
AWTLAMGHAMIRTGLKVRDSAGNPWV

SEQ ID NO: 640776 - protein, 29 aa, Mycobacterium
AWTLAMGHSMIRAGLSLKKRGSNRPWRPD

SEQ ID NO: 640777 - protein, 20 aa, Mycobacterium
AWTPTAFPVEFLSLGAGGVG

SEQ ID NO: 640778 - protein, 18 aa, Mycobacterium
AWVAVRYAECVQILQDWE

SEQ ID NO: 640779 - protein, 23 aa, Mycobacterium
AWVCARSTVLRGVRIGANSVVGA

SEQ ID NO: 640780 - protein, 28 aa, Mycobacterium
AWVGPRRFSGELARQWVAAGARIVGGCC

SEQ ID NO: 640781 - protein, 24 aa, Mycobacterium
AWVHLPRGFGGLDLPRKAQELVDA

SEQ ID NO: 640782 - protein, 22 aa, Mycobacterium
AWVHLPRGFGGLDLPRTAQERV

SEQ ID NO: 640783 - protein, 24 aa, Mycobacterium
AWVKAKPGASVLIAPNFAIGAVLS

SEQ ID NO: 640784 - protein, 17 aa, Mycobacterium
AWVKPQLGLYIGGMGAK

SEQ ID NO: 640785 - protein, 17 aa, Mycobacterium
AWVPFGGGAKRCLGAAF

SEQ ID NO: 640786 - protein, 25 aa, Mycobacterium
AWVPLEEVPEVWAAVTSVFRDYGYR

SEQ ID NO: 640787 - protein, 19 aa, Mycobacterium
AWVSLRPSVFASNFAGMWS

SEQ ID NO: 640788 - protein, 20 aa, Mycobacterium
AWWFYAHSIVRGGIDKVHVG

SEQ ID NO: 640789 - protein, 19 aa, Mycobacterium
AWWFYPHSIVRGGIDKVHI

SEQ ID NO: 640790 - protein, 32 aa, Mycobacterium
AWYAAIEGFTRWRALRYARRIGRDFDLYPTEC

SEQ ID NO: 640791 - protein, 17 aa, Mycobacterium
AYAAALVDKGEYDKANE

SEQ ID NO: 640792 - protein, 19 aa, Mycobacterium
AYAAFRWAYDHAGELGAAA

SEQ ID NO: 640793 - protein, 19 aa, Mycobacterium
AYAAFTWAYEHAGELGAAP

SEQ ID NO: 640794 - protein, 17 aa, Mycobacterium
AYAAMMRQGYGRFVFVS

SEQ ID NO: 640795 - protein, 18 aa, Mycobacterium
AYAAPLRVGNPSVVGRLE

SEQ ID NO: 640796 - protein, 18 aa, Mycobacterium
AYAARAGITCAVLIPQGK

SEQ ID NO: 640797 - protein, 20 aa, Mycobacterium
AYAARAGITCAVLIPQGKIA

SEQ ID NO: 640798 - protein, 19 aa, Mycobacterium
AYADHGFELPEEMAELSGD

SEQ ID NO: 640799 - protein, 17 aa, Mycobacterium
AYADIKVPSLVIGFTDD

SEQ ID NO: 640800 - protein, 21 aa, Mycobacterium
AYADMPLFLFHLLEYMDVEYE

SEQ ID NO: 640801 - protein, 19 aa, Mycobacterium
AYADPRVGEEIWAQDVDTW

SEQ ID NO: 640802 - protein, 17 aa, Mycobacterium
AYAEAGVTWITIEPASR

SEQ ID NO: 640803 - protein, 23 aa, Mycobacterium
AYAEGLRALYLFTATHQNAEMAK

SEQ ID NO: 640804 - protein, 23 aa, Mycobacterium
AYAEGLRALYLFTSTYQDASVAE

SEQ ID NO: 640805 - protein, 23 aa, Mycobacterium
AYAEGLRALYLYAAAHQDDAVAQ

SEQ ID NO: 640806 - protein, 23 aa, Mycobacterium
AYAEGLRALYLYAAAHQDNAVAQ

SEQ ID NO: 640807 - protein, 22 aa, Mycobacterium
AYAEGLRALYLYTAAHQDTTVA

SEQ ID NO: 640808 - protein, 22 aa, Mycobacterium
AYAEGLRALYLYTATYQDAAVA

SEQ ID NO: 640809 - protein, 23 aa, Mycobacterium
AYAELKPDPWLVDTCREEMRRLG

SEQ ID NO: 640810 - protein, 18 aa, Mycobacterium
AYAEYCVAPADFVAYVPD

SEQ ID NO: 640811 - protein, 24 aa, Mycobacterium
AYAGGLKPVLCLTKSDLAAPEAFA

SEQ ID NO: 640812 - protein, 19 aa, Mycobacterium
AYAGHPEFVVPRVVASAPK

SEQ ID NO: 640813 - protein, 25 aa, Mycobacterium
AYAGHPRFLVPHIVASAPKVVIQEW

SEQ ID NO: 640814 - protein, 26 aa, Mycobacterium
AYAGVPCWSGGPARWAHVTVAVAYDL

SEQ ID NO: 640815 - protein, 18 aa, Mycobacterium
AYAHSYGATGHRLDDPAK

SEQ ID NO: 640816 - protein, 19 aa, Mycobacterium
AYAKARPSWEHSESAVEGF

SEQ ID NO: 640817 - protein, 29 aa, Mycobacterium
AYAKKFRFPTFVGAFKYYTSYTLKTFDGK

SEQ ID NO: 640818 - protein, 18 aa, Mycobacterium
AYAPLPWLPDSVTTQIVD

SEQ ID NO: 640819 - protein, 23 aa, Mycobacterium
AYARGRKLVGFFCQQGVFDRGRA

SEQ ID NO: 640820 - protein, 19 aa, Mycobacterium
AYARSRFTIAAKAAGLPSA

SEQ ID NO: 640821 - protein, 19 aa, Mycobacterium
AYARSRFTIAAKAAHLPSA

SEQ ID NO: 640822 - protein, 18 aa, Mycobacterium
AYARSRFTIAAKAANLPS

SEQ ID NO: 640823 - protein, 19 aa, Mycobacterium
AYARSRFTIAAKAASLPSA

SEQ ID NO: 640824 - protein, 23 aa, Mycobacterium
AYASLRPGLDRIDANLVKQIDQQ

SEQ ID NO: 640825 - protein, 25 aa, Mycobacterium
AYASRSAGCAPDWAPLPVQYVDYTL

SEQ ID NO: 640826 - protein, 18 aa, Mycobacterium
AYAVLAQESVRCRRRGVN

SEQ ID NO: 640827 - protein, 24 aa, Mycobacterium
AYCAMFPDTIGLYAGNPVTQMGYQ

SEQ ID NO: 640828 - protein, 19 aa, Mycobacterium
AYDAIAVGFHGTVCIHPTQ

SEQ ID NO: 640829 - protein, 24 aa, Mycobacterium
AYDDLRPGLRMNIIGNPGVDKSEF

SEQ ID NO: 640830 - protein, 17 aa, Mycobacterium
AYDESWDDLLLRRLKTA

SEQ ID NO: 640831 - protein, 18 aa, Mycobacterium
AYDIPALLAEHSRTEDGE

SEQ ID NO: 640832 - protein, 20 aa, Mycobacterium
AYDLLDDWDTLVLVDAVPSR

SEQ ID NO: 640833 - protein, 21 aa, Mycobacterium
AYDLLEGWDTLVLVDAVPSRG

SEQ ID NO: 640834 - protein, 18 aa, Mycobacterium
AYDLSSIRRFWHVASACP

SEQ ID NO: 640835 - protein, 19 aa, Mycobacterium
AYDPARWNALCDALGAPDL

SEQ ID NO: 640836 - protein, 22 aa, Mycobacterium
AYDPEAFNGWGKAAIAIGNPDY

SEQ ID NO: 640837 - protein, 18 aa, Mycobacterium
AYDPLTGRFVLVLEDLAA

SEQ ID NO: 640838 - protein, 24 aa, Mycobacterium
AYDRLKAELDQLIANRPVIAAEIN

SEQ ID NO: 640839 - protein, 23 aa, Mycobacterium
AYEARTSLTNALRKAFEHHFQHN

SEQ ID NO: 640840 - protein, 18 aa, Mycobacterium
AYEPVWAIGTGRVAGAAD

SEQ ID NO: 640841 - protein, 18 aa, Mycobacterium
AYERISGLWFGDWIGPSA

SEQ ID NO: 640842 - protein, 17 aa, Mycobacterium
AYERIYWDQASLLVQVG

SEQ ID NO: 640843 - protein, 24 aa, Mycobacterium
AYERRRCAPCALKRRTAAALSGPD

SEQ ID NO: 640844 - protein, 24 aa, Mycobacterium
AYERVTLYGLPLVARRRVGYARVE

SEQ ID NO: 640845 - protein, 23 aa, Mycobacterium
AYEVNEAFAPVPLAWLRDIGADE

SEQ ID NO: 640846 - protein, 17 aa, Mycobacterium
AYEVVKDAFGREGDQGV

SEQ ID NO: 640847 - protein, 19 aa, Mycobacterium
AYEVWPMGHNRAGRRRWKR

SEQ ID NO: 640848 - protein, 21 aa, Mycobacterium
AYEWIRDAILSGEFAEGEFID

SEQ ID NO: 640849 - protein, 17 aa, Mycobacterium
AYFAQLLGLPFIAVMTA

SEQ ID NO: 640850 - protein, 19 aa, Mycobacterium
AYFDLAWAHAGGLPRPPMV

SEQ ID NO: 640851 - protein, 17 aa, Mycobacterium
AYFEGFAALADMTDDER

SEQ ID NO: 640852 - protein, 18 aa, Mycobacterium
AYFNGWDPLLQTGLPEPT

SEQ ID NO: 640853 - protein, 28 aa, Mycobacterium
AYFRFLQSRLKTGGLLLNHCITRPDNRT

SEQ ID NO: 640854 - protein, 21 aa, Mycobacterium
AYFRSEVHGLGSFPPGGALVV

SEQ ID NO: 640855 - protein, 17 aa, Mycobacterium
AYGAEPADNVWASGAAT

SEQ ID NO: 640856 - protein, 21 aa, Mycobacterium
AYGAGAMVALSCDYRVMRSDR

SEQ ID NO: 640857 - protein, 19 aa, Mycobacterium
AYGAPDCRWDTYRISAFAE

SEQ ID NO: 640858 - protein, 23 aa, Mycobacterium
AYGASPRASLGIIAASRALALVR

SEQ ID NO: 640859 - protein, 17 aa, Mycobacterium
AYGDMGLSLPILAPGGV

SEQ ID NO: 640860 - protein, 24 aa, Mycobacterium
AYGDSGLDLPLWVITQGGAQVNPD

SEQ ID NO: 640861 - protein, 18 aa, Mycobacterium
AYGGAYDVMGSKHMGADV

SEQ ID NO: 640862 - protein, 18 aa, Mycobacterium
AYGGGMLKIEPREADVLP

SEQ ID NO: 640863 - protein, 17 aa, Mycobacterium
AYGGTFLQFSDYMRPAV

SEQ ID NO: 640864 - protein, 24 aa, Mycobacterium
AYGIKVNALLPVGFTRMVENMPEP

SEQ ID NO: 640865 - protein, 31 aa, Mycobacterium
AYGLAAADGVMRWLEEHQRGVAMGAGVVPIV

SEQ ID NO: 640866 - protein, 19 aa, Mycobacterium
AYGPAGFLQYQFVIPTEAV

SEQ ID NO: 640867 - protein, 19 aa, Mycobacterium
AYGPAGFLQYQFVVPTEAV

SEQ ID NO: 640868 - protein, 20 aa, Mycobacterium
AYGPLRPTMRHLPTAEPTPW

SEQ ID NO: 640869 - protein, 19 aa, Mycobacterium
AYGQIIFDGQCRNMGNHKG

SEQ ID NO: 640870 - protein, 18 aa, Mycobacterium
AYGRYMIRVKEMWESIKI

SEQ ID NO: 640871 - protein, 19 aa, Mycobacterium
AYGRYMIRVNEMWESIKII

SEQ ID NO: 640872 - protein, 19 aa, Mycobacterium
AYGSAGFAVLERTIAALRA

SEQ ID NO: 640873 - protein, 24 aa, Mycobacterium
AYGSFATMAGCRWEDLDGDPVDIR

SEQ ID NO: 640874 - protein, 25 aa, Mycobacterium
AYGSSGKVYGGMGVVGPTRMDYPGT

SEQ ID NO: 640875 - protein, 19 aa, Mycobacterium
AYGTLRPMLGRELPADPAS

SEQ ID NO: 640876 - protein, 23 aa, Mycobacterium
AYGWSSLRSRPALRDQAAGAITG

SEQ ID NO: 640877 - protein, 23 aa, Mycobacterium
AYGWSSLRSRPALRDQAAGALHG

SEQ ID NO: 640878 - protein, 25 aa, Mycobacterium
AYGWSSLRSRPALRDQVAAAIAGAR

SEQ ID NO: 640879 - protein, 25 aa, Mycobacterium
AYGWSSLRSRPALRDQVAGALHGAR

SEQ ID NO: 640880 - protein, 21 aa, Mycobacterium
AYHALRPGGIVVVRQLNSTLD

SEQ ID NO: 640881 - protein, 17 aa, Mycobacterium
AYHAVALVMIDHDAEVS

SEQ ID NO: 640882 - protein, 17 aa, Mycobacterium
AYHGWTYATDAVSTSTA

SEQ ID NO: 640883 - protein, 20 aa, Mycobacterium
AYHGYPWLIHRLTYRRTNHP

SEQ ID NO: 640884 - protein, 30 aa, Mycobacterium
AYHKVILSRCVEVPFRLDFPSTYRRGRERN

SEQ ID NO: 640885 - protein, 23 aa, Mycobacterium
AYHLAKGWLAPAVRRSDGIDANG

SEQ ID NO: 640886 - protein, 18 aa, Mycobacterium
AYHLMKPAGGRGIVMGGV

SEQ ID NO: 640887 - protein, 18 aa, Mycobacterium
AYHPRAWQRIRGRLTGLG

SEQ ID NO: 640888 - protein, 18 aa, Mycobacterium
AYHRARTAGHPVVALVVG

SEQ ID NO: 640889 - protein, 21 aa, Mycobacterium
AYHSELAWWTTPFATEDGIPQ

SEQ ID NO: 640890 - protein, 24 aa, Mycobacterium
AYHTRLDPSTGYLWTLPMFHCNGW

SEQ ID NO: 640891 - protein, 24 aa, Mycobacterium
AYIGCQALRGGVIVRLDPDDSATV

SEQ ID NO: 640892 - protein, 23 aa, Mycobacterium
AYIGCQSFSGGVIIRLDTDNSAQ

SEQ ID NO: 640893 - protein, 21 aa, Mycobacterium
AYIGLAPRTSGGPVYKDGQRI

SEQ ID NO: 640894 - protein, 33 aa, Mycobacterium
AYIMKADHGLVLPRRLQIEFSQVIQQITDGEGG

SEQ ID NO: 640895 - protein, 22 aa, Mycobacterium
AYIVEPWVRATLVGPLTLRHGH

SEQ ID NO: 640896 - protein, 17 aa, Mycobacterium
AYKACTVVRQLAEAGHS

SEQ ID NO: 640897 - protein, 22 aa, Mycobacterium
AYKALDYPLKIALESELLETAR

SEQ ID NO: 640898 - protein, 17 aa, Mycobacterium
AYKRIGRAHAIAGVCDD

SEQ ID NO: 640899 - protein, 21 aa, Mycobacterium
AYLAARGGYFAVDLSTGHTAQ

SEQ ID NO: 640900 - protein, 18 aa, Mycobacterium
AYLAGFAWGLNREYTVLV

SEQ ID NO: 640901 - protein, 25 aa, Mycobacterium
AYLAGFAWGLSRDYSVLVEMDADGS

SEQ ID NO: 640902 - protein, 26 aa, Mycobacterium
AYLAGFDWGLRRGYSVLVEMDADGSH

SEQ ID NO: 640903 - protein, 24 aa, Mycobacterium
AYLAGHLPGAVFVDLDVDLADHSV

SEQ ID NO: 640904 - protein, 27 aa, Mycobacterium
AYLAHLHCPPALPSLAAEVLISAFNQS

SEQ ID NO: 640905 - protein, 17 aa, Mycobacterium
AYLAKLVTRQSLNALRA

SEQ ID NO: 640906 - protein, 22 aa, Mycobacterium
AYLARAGLRVVVLEASPTSGGM

SEQ ID NO: 640907 - protein, 18 aa, Mycobacterium
AYLATGLVPVGKTQMSEF

SEQ ID NO: 640908 - protein, 27 aa, Mycobacterium
AYLDGLDRLAKLGVTWVSVHLPGDSMT

SEQ ID NO: 640909 - protein, 21 aa, Mycobacterium
AYLDMGWEEWMVAVEYDGDQH

SEQ ID NO: 640910 - protein, 17 aa, Mycobacterium
AYLDRLLDLLLIGVLRI

SEQ ID NO: 640911 - protein, 21 aa, Mycobacterium
AYLDVCGRALFPSSVPARSAG

SEQ ID NO: 640912 - protein, 23 aa, Mycobacterium
AYLECAGDLLLMLTEGTFPNVAD

SEQ ID NO: 640913 - protein, 25 aa, Mycobacterium
AYLEGFAWGLSREYSVLVEMDADGS

SEQ ID NO: 640914 - protein, 25 aa, Mycobacterium
AYLEGFAWGLSRGYSVLVEMDADGS

SEQ ID NO: 640915 - protein, 25 aa, Mycobacterium
AYLERATDVVIRWNGTINEILGDGL

SEQ ID NO: 640916 - protein, 27 aa, Mycobacterium
AYLGALGMTGLTAWIGIRDIGKPQPGE

SEQ ID NO: 640917 - protein, 27 aa, Mycobacterium
AYLGALGMTGLTAWIGMREIAKPRPGE

SEQ ID NO: 640918 - protein, 20 aa, Mycobacterium
AYLGLLRFLLGLDLIDRVVF

SEQ ID NO: 640919 - protein, 18 aa, Mycobacterium
AYLGVAVSGFPNFFMLYG

SEQ ID NO: 640920 - protein, 18 aa, Mycobacterium
AYLKKVLQALTFLRGPQT

SEQ ID NO: 640921 - protein, 28 aa, Mycobacterium
AYLKRVLQALTFLRGPRTWVLKSPQHCE

SEQ ID NO: 640922 - protein, 18 aa, Mycobacterium
AYLLEILPALTYLHSIGL

SEQ ID NO: 640923 - protein, 31 aa, Mycobacterium
AYLPIDPALPAARMEFMLGDATPIAAVTTAS

SEQ ID NO: 640924 - protein, 29 aa, Mycobacterium
AYLPIDPALPAARMEFMLTDAAPIAAVTT

SEQ ID NO: 640925 - protein, 17 aa, Mycobacterium
AYLPIDPAVPVARLEFM

SEQ ID NO: 640926 - protein, 20 aa, Mycobacterium
AYLPKLNVLPIYGGSSYAVQ

SEQ ID NO: 640927 - protein, 18 aa, Mycobacterium
AYLPLFKVLRTLAAEGRE

SEQ ID NO: 640928 - protein, 23 aa, Mycobacterium
AYLPRYRLAGADIGLRRGDRVVG

SEQ ID NO: 640929 - protein, 32 aa, Mycobacterium
AYLPTAFAPAAFRWLGLRDMPNKLMNVAVSSV

SEQ ID NO: 640930 - protein, 27 aa, Mycobacterium
AYLQRMSTVIGRRVWENAGSPEVDTNR

SEQ ID NO: 640931 - protein, 29 aa, Mycobacterium
AYLQTRLARYEIPTALILTDAIPRTPSGK

SEQ ID NO: 640932 - protein, 24 aa, Mycobacterium
AYLRALPADGWLRVMCTATQIGED

SEQ ID NO: 640933 - protein, 20 aa, Mycobacterium
AYLRDFRFSGDIDGYAEGEL

SEQ ID NO: 640934 - protein, 27 aa, Mycobacterium
AYLRGLPADGWLRVMCTTVQIGEDWFD

SEQ ID NO: 640935 - protein, 23 aa, Mycobacterium
AYLRSHLPGAVYVSLEDELSDHT

SEQ ID NO: 640936 - protein, 21 aa, Mycobacterium
AYLSLRFAPAAVRVAAPPDSA

SEQ ID NO: 640937 - protein, 18 aa, Mycobacterium
AYLTAWHGLCEVGRLSAG

SEQ ID NO: 640938 - protein, 17 aa, Mycobacterium
AYLTEAFQNLGPEIFET

SEQ ID NO: 640939 - protein, 20 aa, Mycobacterium
AYLTQIVAAFGIARDQVLAH

SEQ ID NO: 640940 - protein, 24 aa, Mycobacterium
AYLVEYLDLIGLLPEVLAVYNPMT

SEQ ID NO: 640941 - protein, 17 aa, Mycobacterium
AYLVRRIRSHGLVAASV

SEQ ID NO: 640942 - protein, 23 aa, Mycobacterium
AYMDWPAFPALIPDPRGWTLPAD

SEQ ID NO: 640943 - protein, 19 aa, Mycobacterium
AYMGPCPPAGTGTHHYRFT

SEQ ID NO: 640944 - protein, 21 aa, Mycobacterium
AYMLEIFAFRYKIICGAHATK

SEQ ID NO: 640945 - protein, 18 aa, Mycobacterium
AYMRGRTLNSAFIVLDEA

SEQ ID NO: 640946 - protein, 19 aa, Mycobacterium
AYMRLPFGHGSDAWLAELA

SEQ ID NO: 640947 - protein, 19 aa, Mycobacterium
AYMRLPFGKGSDTWLAELA

SEQ ID NO: 640948 - protein, 24 aa, Mycobacterium
AYNEAREGAVWSIVTKAGVRRLFQ

SEQ ID NO: 640949 - protein, 18 aa, Mycobacterium
AYNKMMFERQGRLDDAKA

SEQ ID NO: 640950 - protein, 25 aa, Mycobacterium
AYNPCFPEYRFTEFDAEKATGGVEF

SEQ ID NO: 640951 - protein, 25 aa, Mycobacterium
AYPAFPRRRALVAFGSDVMFGAPTW

SEQ ID NO: 640952 - protein, 25 aa, Mycobacterium
AYPAQQRPLLHPSLEDEDAHYERFN

SEQ ID NO: 640953 - protein, 24 aa, Mycobacterium
AYPARFVPMAIPVIWDAEACAAEV

SEQ ID NO: 640954 - protein, 18 aa, Mycobacterium
AYPAYYAHMGVINTEGPD

SEQ ID NO: 640955 - protein, 17 aa, Mycobacterium
AYPDGRRLIDAGVTVAL

SEQ ID NO: 640956 - protein, 18 aa, Mycobacterium
AYPDHVISADTWRSEVAK

SEQ ID NO: 640957 - protein, 24 aa, Mycobacterium
AYPLPVAVICRLLGVPLADEPEFS

SEQ ID NO: 640958 - protein, 23 aa, Mycobacterium
AYPLPVAVICRLLGVPLDDEPQF

SEQ ID NO: 640959 - protein, 24 aa, Mycobacterium
AYPLPVAVICRLLGVPLEDEPQFS

SEQ ID NO: 640960 - protein, 17 aa, Mycobacterium
AYPLVSLEDPLYENDWD

SEQ ID NO: 640961 - protein, 20 aa, Mycobacterium
AYPNTRPMCSANCDGAAAAI

SEQ ID NO: 640962 - protein, 28 aa, Mycobacterium
AYPQWNPEIKGCWILARYNDGRPSQLRL

SEQ ID NO: 640963 - protein, 18 aa, Mycobacterium
AYPRGHDPGARMFTNSRA

SEQ ID NO: 640964 - protein, 19 aa, Mycobacterium
AYPVLYEPATVFTIGGSHT

SEQ ID NO: 640965 - protein, 24 aa, Mycobacterium
AYQDVCGFCKSVMLAEIRAANYAL

SEQ ID NO: 640966 - protein, 21 aa, Mycobacterium
AYQEELHWWTAPFEATEGVPY

SEQ ID NO: 640967 - protein, 25 aa, Mycobacterium
AYQLLSARAATFHEQFLQALSGGGA

SEQ ID NO: 640968 - protein, 18 aa, Mycobacterium
AYQRACLHAIDYLTKFGY

SEQ ID NO: 640969 - protein, 28 aa, Mycobacterium
AYQRIFDRLKVRYVIVSAVSGAMGGSAS

SEQ ID NO: 640970 - protein, 26 aa, Mycobacterium
AYQRIFGRLGLDYVIVAATSGAMGGS

SEQ ID NO: 640971 - protein, 28 aa, Mycobacterium
AYQRYFGCPPFFCEPVGGFTLRATDMQK

SEQ ID NO: 640972 - protein, 20 aa, Mycobacterium
AYQTELDWWTAPFTLEDGVP

SEQ ID NO: 640973 - protein, 35 aa, Mycobacterium
AYQVLARQGIYGDFFSFYLCDIVLKLNGKGGQPVY

SEQ ID NO: 640974 - protein, 20 aa, Mycobacterium
AYRARGCRVAVLAVDPSSPF

SEQ ID NO: 640975 - protein, 22 aa, Mycobacterium
AYRDRLLVLAALDLAATVENEP

SEQ ID NO: 640976 - protein, 19 aa, Mycobacterium
AYREFADALLRHWKSGRKM

SEQ ID NO: 640977 - protein, 19 aa, Mycobacterium
AYRFTRPGQDVTLFSRTMT

SEQ ID NO: 640978 - protein, 19 aa, Mycobacterium
AYRGCLQPETVTPYGMALN

SEQ ID NO: 640979 - protein, 19 aa, Mycobacterium
AYRGFGLAASMLGWLADSL

SEQ ID NO: 640980 - protein, 24 aa, Mycobacterium
AYRGRRLAWSDSWLTSPGGGNLYA

SEQ ID NO: 640981 - protein, 20 aa, Mycobacterium
AYRKGWLKKINVISSSMVFE

SEQ ID NO: 640982 - protein, 19 aa, Mycobacterium
AYRLAIKHRVKVAFGTDIL

SEQ ID NO: 640983 - protein, 23 aa, Mycobacterium
AYRLKGPHRMFSFAGEPSQKTPY

SEQ ID NO: 640984 - protein, 24 aa, Mycobacterium
AYRLKSVAAKDVWVRTATRVTAEA

SEQ ID NO: 640985 - protein, 24 aa, Mycobacterium
AYRLRRELGDDARISLYDPAGQLG

SEQ ID NO: 640986 - protein, 27 aa, Mycobacterium
AYRPDEEKLAWARRVLVAARTERGVFA

SEQ ID NO: 640987 - protein, 25 aa, Mycobacterium
AYRRAHGLPAIGINWGPWAQVGRAQ

SEQ ID NO: 640988 - protein, 18 aa, Mycobacterium
AYRRLCDIAGGASVRLEV

SEQ ID NO: 640989 - protein, 20 aa, Mycobacterium
AYRRPRLMRVAGRDACVKLL

SEQ ID NO: 640990 - protein, 17 aa, Mycobacterium
AYRRVRKAAKLAKAAAK

SEQ ID NO: 640991 - protein, 29 aa, Mycobacterium
AYRRYAIERPHMYRLMFGSTSAHGINAPA

SEQ ID NO: 640992 - protein, 29 aa, Mycobacterium
AYRRYAIERPHMYRLMFGSTSAHGINAPT

SEQ ID NO: 640993 - protein, 23 aa, Mycobacterium
AYRSRVCATMVARAWSEATTAAR

SEQ ID NO: 640994 - protein, 18 aa, Mycobacterium
AYRTAYHTLRSVARVSEG

SEQ ID NO: 640995 - protein, 22 aa, Mycobacterium
AYSAESAKFFGLEETRYEGPTG

SEQ ID NO: 640996 - protein, 18 aa, Mycobacterium
AYSAGGARVTYHRDAFNE

SEQ ID NO: 640997 - protein, 17 aa, Mycobacterium
AYSARLWLPLLRAERGA

SEQ ID NO: 640998 - protein, 17 aa, Mycobacterium
AYSAYLWAREHAAELGA

SEQ ID NO: 640999 - protein, 19 aa, Mycobacterium
AYSDWFGPQQIEWLSRLTA

SEQ ID NO: 641000 - protein, 23 aa, Mycobacterium
AYSESFARGTFVHYMLPAHAYHR

SEQ ID NO: 641001 - protein, 24 aa, Mycobacterium
AYSESFGGGTFVHYMLKPNSYHRY

SEQ ID NO: 641002 - protein, 20 aa, Mycobacterium
AYSGELLFLYNGVRPRHVMP

SEQ ID NO: 641003 - protein, 32 aa, Mycobacterium
AYSIDLYTLLPVGELWVAAARLRTLDVMTHHL

SEQ ID NO: 641004 - protein, 33 aa, Mycobacterium
AYSKEWMSGAIGREIHDPYALYAAIAAQSDLTT

SEQ ID NO: 641005 - protein, 26 aa, Mycobacterium
AYSMREINATFPLCHHGRYHVSPWVI

SEQ ID NO: 641006 - protein, 30 aa, Mycobacterium
AYSPRLRPGTPVSFPVAWDALDRIHPSDFT

SEQ ID NO: 641007 - protein, 17 aa, Mycobacterium
AYSRGRFILGLGTQIQP

SEQ ID NO: 641008 - protein, 19 aa, Mycobacterium
AYSRLAFVVERLQQHLAGA

SEQ ID NO: 641009 - protein, 18 aa, Mycobacterium
AYSSEMLHTGAAPNGIDF

SEQ ID NO: 641010 - protein, 18 aa, Mycobacterium
AYTLAMLLADALGPEAFR

SEQ ID NO: 641011 - protein, 17 aa, Mycobacterium
AYTLSLFASLAMSDVLP

SEQ ID NO: 641012 - protein, 20 aa, Mycobacterium
AYTPWYLVRYWRLLKFKLAN

SEQ ID NO: 641013 - protein, 24 aa, Mycobacterium
AYVALSDAVTWLAAAGRLSDPRPL

SEQ ID NO: 641014 - protein, 17 aa, Mycobacterium
AYVDAGLPWFDYYDADA

SEQ ID NO: 641015 - protein, 17 aa, Mycobacterium
AYVDVFDAFVDRLAPGG

SEQ ID NO: 641016 - protein, 19 aa, Mycobacterium
AYVEAGLPWFDYYDADARD

SEQ ID NO: 641017 - protein, 18 aa, Mycobacterium
AYVGGPWGAVASLSPELF

SEQ ID NO: 641018 - protein, 23 aa, Mycobacterium
AYVGPEELVCWASQQFTLHPGDI

SEQ ID NO: 641019 - protein, 20 aa, Mycobacterium
AYVPKHWQQLCHLIGRPDLL

SEQ ID NO: 641020 - protein, 24 aa, Mycobacterium
AYVQRHVFDPLGLQDTHYLPPAAA

SEQ ID NO: 641021 - protein, 18 aa, Mycobacterium
AYVSAKFAVRGFTEALHQ

SEQ ID NO: 641022 - protein, 20 aa, Mycobacterium
AYVYDPRAALPKNLNPEMVE

SEQ ID NO: 641023 - protein, 24 aa, Mycobacterium
AYWDEMLDRFVPHKTVLYGTGYIR

SEQ ID NO: 641024 - protein, 18 aa, Mycobacterium
AYWDEMLERFVPHKTVLY

SEQ ID NO: 641025 - protein, 17 aa, Mycobacterium
AYWEVLCEPDMRGMSPQ

SEQ ID NO: 641026 - protein, 17 aa, Mycobacterium
AYWPEFRRVDFLRALRD

SEQ ID NO: 641027 - protein, 18 aa, Mycobacterium
AYWRKNLPPEGGHDYQLP

SEQ ID NO: 641028 - protein, 32 aa, Mycobacterium
AYYLMGFDIPCFTPIFVMSRITGWTAHIMEQA

SEQ ID NO: 641029 - protein, 25 aa, Mycobacterium
CAAAGLRPRIAFEATSPAELAELAR

SEQ ID NO: 641030 - protein, 19 aa, Mycobacterium
CAAAGRPAPVDGVTTALDD

SEQ ID NO: 641031 - protein, 19 aa, Mycobacterium
CAADLPWKALLRSNIHAIS

SEQ ID NO: 641032 - protein, 18 aa, Mycobacterium
CAAEAFDLFTTLIDAQIG

SEQ ID NO: 641033 - protein, 19 aa, Mycobacterium
CAAEGIAWVPYFPLGSSFP

SEQ ID NO: 641034 - protein, 18 aa, Mycobacterium
CAAEPGWASAQLDDEQRL

SEQ ID NO: 641035 - protein, 27 aa, Mycobacterium
CAAERFPRPRVVVEPGRAISARAGVTL

SEQ ID NO: 641036 - protein, 22 aa, Mycobacterium
CAAGFRAEMGVDLNAEIFNGTA

SEQ ID NO: 641037 - protein, 20 aa, Mycobacterium
CAAGYACLVFDYRNFGDSEG

SEQ ID NO: 641038 - protein, 22 aa, Mycobacterium
CAAGYRVVRHPGTLMLPAPAVD

SEQ ID NO: 641039 - protein, 18 aa, Mycobacterium
CAALDRLAAGGGVDVPVH

SEQ ID NO: 641040 - protein, 19 aa, Mycobacterium
CAAMDRAGGLTFAGMMAIP

SEQ ID NO: 641041 - protein, 18 aa, Mycobacterium
CAANAAAAARTTGLLAAA

SEQ ID NO: 641042 - protein, 17 aa, Mycobacterium
CAAPDPYGRLVGKRLTI

SEQ ID NO: 641043 - protein, 18 aa, Mycobacterium
CAAQSWDIDRVETVKNAA

SEQ ID NO: 641044 - protein, 25 aa, Mycobacterium
CAARAKAAGVALAIENASSLYADIH

SEQ ID NO: 641045 - protein, 22 aa, Mycobacterium
CAARGLPRRSRVLLISADAPGA

SEQ ID NO: 641046 - protein, 22 aa, Mycobacterium
CAARVLSDFFGRVTVFERDELP

SEQ ID NO: 641047 - protein, 18 aa, Mycobacterium
CAASSSPSGAGDCSAGRA

SEQ ID NO: 641048 - protein, 19 aa, Mycobacterium
CAATHSVALVGAAVETSGG

SEQ ID NO: 641049 - protein, 18 aa, Mycobacterium
CAAVDQRPGFTLRGGTNE

SEQ ID NO: 641050 - protein, 20 aa, Mycobacterium
CACASRILVHEAVYEAFTER

SEQ ID NO: 641051 - protein, 20 aa, Mycobacterium
CACGNRLPAITVEGRAADLL

SEQ ID NO: 641052 - protein, 21 aa, Mycobacterium
CADDIAALWLLKQIAVTIERF

SEQ ID NO: 641053 - protein, 24 aa, Mycobacterium
CADGLRLAVCRRLLGQWWAQHSPS

SEQ ID NO: 641054 - protein, 23 aa, Mycobacterium
CADIDAGALRRALTLFRDMDPAV

SEQ ID NO: 641055 - protein, 24 aa, Mycobacterium
CADIRVSVAPGWQLGDLLRQPTAL

SEQ ID NO: 641056 - protein, 28 aa, Mycobacterium
CADLLDWPAKLRLLEGFRNRENLGWNAP

SEQ ID NO: 641057 - protein, 28 aa, Mycobacterium
CADLLDWPAKLRLLEGFRQRENLSWSAP

SEQ ID NO: 641058 - protein, 21 aa, Mycobacterium
CADLPAAAAFYDKVLGVLGFT

SEQ ID NO: 641059 - protein, 24 aa, Mycobacterium
CADMPTLAGVTWVGRWEMNLKREG

SEQ ID NO: 641060 - protein, 18 aa, Mycobacterium
CADPRPLGYDDSTAFCAA

SEQ ID NO: 641061 - protein, 18 aa, Mycobacterium
CADPRPLGYHDSAAFCAA

SEQ ID NO: 641062 - protein, 24 aa, Mycobacterium
CADTWLPMPREWAALTVEKQRADP

SEQ ID NO: 641063 - protein, 17 aa, Mycobacterium
CAEALALQRAYPDELSG

SEQ ID NO: 641064 - protein, 17 aa, Mycobacterium
CAEARLNDRYFYESFRS

SEQ ID NO: 641065 - protein, 22 aa, Mycobacterium
CAEGGPALLDCLEFDDRLRYVD

SEQ ID NO: 641066 - protein, 18 aa, Mycobacterium
CAEGGVLGIICASIASVM

SEQ ID NO: 641067 - protein, 18 aa, Mycobacterium
CAEGGVLGILCASIASVM

SEQ ID NO: 641068 - protein, 18 aa, Mycobacterium
CAEGGVLGILCSSIASIM

SEQ ID NO: 641069 - protein, 18 aa, Mycobacterium
CAELGERALIGAGWSDFG

SEQ ID NO: 641070 - protein, 22 aa, Mycobacterium
CAELGLGRYLLRCRTGERIRVA

SEQ ID NO: 641071 - protein, 20 aa, Mycobacterium
CAELTWQLRGAADKRQVEGV

SEQ ID NO: 641072 - protein, 20 aa, Mycobacterium
CAEPARPGVLVQVTRRLDVR

SEQ ID NO: 641073 - protein, 23 aa, Mycobacterium
CAERAGVRRVVLLSSDSVEMDDA

SEQ ID NO: 641074 - protein, 20 aa, Mycobacterium
CAESCALLLDAEGNRLPGLD

SEQ ID NO: 641075 - protein, 17 aa, Mycobacterium
CAESVAVYRCANKRIDA

SEQ ID NO: 641076 - protein, 25 aa, Mycobacterium
CAEVALKRDMFAGIRVGRGGRAVGP

SEQ ID NO: 641077 - protein, 19 aa, Mycobacterium
CAEVSAALRISRSRANWQV

SEQ ID NO: 641078 - protein, 17 aa, Mycobacterium
CAEWAHLAAGTTSIREG

SEQ ID NO: 641079 - protein, 18 aa, Mycobacterium
CAFLCASAPAALDVGTQL

SEQ ID NO: 641080 - protein, 17 aa, Mycobacterium
CAFLCTSAGAAVDIGTD

SEQ ID NO: 641081 - protein, 20 aa, Mycobacterium
CAFLEERACYGPGDLKGKTL

SEQ ID NO: 641082 - protein, 17 aa, Mycobacterium
CAFMEAFDPATVFSSID

SEQ ID NO: 641083 - protein, 17 aa, Mycobacterium
CAFRETSRILAGLPDER

SEQ ID NO: 641084 - protein, 19 aa, Mycobacterium
CAFRETSRILAGLPDQRPD

SEQ ID NO: 641085 - protein, 19 aa, Mycobacterium
CAFRRKPIPEDDILNSAML

SEQ ID NO: 641086 - protein, 20 aa, Mycobacterium
CAFSHCRDVVAAVTNAGGFG

SEQ ID NO: 641087 - protein, 20 aa, Mycobacterium
CAGAFRVRPVVGVVTFISRG

SEQ ID NO: 641088 - protein, 22 aa, Mycobacterium
CAGATHALGHGFRMIRRGETDA

SEQ ID NO: 641089 - protein, 18 aa, Mycobacterium
CAGCAPRATATCAHCGAQ

SEQ ID NO: 641090 - protein, 18 aa, Mycobacterium
CAGDDEWCVISIGSDEEW

SEQ ID NO: 641091 - protein, 18 aa, Mycobacterium
CAGDDEWCVISIRTDDEW

SEQ ID NO: 641092 - protein, 21 aa, Mycobacterium
CAGEAPGWAELPVQYVDYTLW

SEQ ID NO: 641093 - protein, 20 aa, Mycobacterium
CAGFRFTASIGRRSAGGDGR

SEQ ID NO: 641094 - protein, 27 aa, Mycobacterium
CAGGFLCDRARAGWNVRVLVDGPGERR

SEQ ID NO: 641095 - protein, 21 aa, Mycobacterium
CAGGLDGIKLRSPVADTTVSV

SEQ ID NO: 641096 - protein, 18 aa, Mycobacterium
CAGHPPPIMVTADRTTEL

SEQ ID NO: 641097 - protein, 19 aa, Mycobacterium
CAGHPRWYEPAEWLGGERA

SEQ ID NO: 641098 - protein, 23 aa, Mycobacterium
CAGHPYPLLVFPDHRAVFLTSGR

SEQ ID NO: 641099 - protein, 19 aa, Mycobacterium
CAGMAEMCRAISAEVGVPV

SEQ ID NO: 641100 - protein, 23 aa, Mycobacterium
CAGMGDGLCNIAYAAVDRHAGGS

SEQ ID NO: 641101 - protein, 17 aa, Mycobacterium
CAGMLTGVMVLNTWIRQ

SEQ ID NO: 641102 - protein, 27 aa, Mycobacterium
CAGRLDELIRFFGWLGQREITSLTAID

SEQ ID NO: 641103 - protein, 17 aa, Mycobacterium
CAGSVAHFDWLVGCGVP

SEQ ID NO: 641104 - protein, 25 aa, Mycobacterium
CAGTSCGSCIPMLKQILAAQGVEQS

SEQ ID NO: 641105 - protein, 22 aa, Mycobacterium
CAGVGLRGLATVEFLVSAEEFV

SEQ ID NO: 641106 - protein, 26 aa, Mycobacterium
CAHLLLWRADAPWERLNVADTVKVPW

SEQ ID NO: 641107 - protein, 17 aa, Mycobacterium
CAHLPTPPQVVVVRGEP

SEQ ID NO: 641108 - protein, 20 aa, Mycobacterium
CAHPAIAANCRTPLMLQTVL

SEQ ID NO: 641109 - protein, 23 aa, Mycobacterium
CAHRRGPFGVAHWNRQIERWLAE

SEQ ID NO: 641110 - protein, 20 aa, Mycobacterium
CAHRRGPYGIAHWNHQVQRW

SEQ ID NO: 641111 - protein, 19 aa, Mycobacterium
CAIAGRRMSATLAIVGAGA

SEQ ID NO: 641112 - protein, 17 aa, Mycobacterium
CAIDAMSSRCFPSYALR

SEQ ID NO: 641113 - protein, 18 aa, Mycobacterium
CAIEDDWGRGALAELFYG

SEQ ID NO: 641114 - protein, 18 aa, Mycobacterium
CAIEGFEAVRARLRRHGA

SEQ ID NO: 641115 - protein, 17 aa, Mycobacterium
CAIIPNPTVEELADIAV

SEQ ID NO: 641116 - protein, 24 aa, Mycobacterium
CAIPQELSYLLGLMSGPERHQIAK

SEQ ID NO: 641117 - protein, 19 aa, Mycobacterium
CAIRMPVLTPTLVIAEKLS

SEQ ID NO: 641118 - protein, 20 aa, Mycobacterium
CAKTQALVAERGFEITRAAA

SEQ ID NO: 641119 - protein, 20 aa, Mycobacterium
CALAHGFTVPDAVAFGKRWV

SEQ ID NO: 641120 - protein, 20 aa, Mycobacterium
CALAHLGGHPVAVVANQPQV

SEQ ID NO: 641121 - protein, 19 aa, Mycobacterium
CALEPIGLMRRVGLGETLR

SEQ ID NO: 641122 - protein, 19 aa, Mycobacterium
CALHLAHATLNFGPNKGRA

SEQ ID NO: 641123 - protein, 20 aa, Mycobacterium
CALIAGWMDEGWSPKLISQV

SEQ ID NO: 641124 - protein, 26 aa, Mycobacterium
CALIAGWMDEGWSPKLISQVLAETYA

SEQ ID NO: 641125 - protein, 22 aa, Mycobacterium
CALLGLECVIYMGAVDTERQAL

SEQ ID NO: 641126 - protein, 25 aa, Mycobacterium
CALPHWAGVVPLRVTAGAPVPAAGL

SEQ ID NO: 641127 - protein, 21 aa, Mycobacterium
CALPLHRRFGLAATARASFAV

SEQ ID NO: 641128 - protein, 18 aa, Mycobacterium
CALRAMLSPGDHVVIPDD

SEQ ID NO: 641129 - protein, 19 aa, Mycobacterium
CAMACAYCYVPRRKGYANP

SEQ ID NO: 641130 - protein, 20 aa, Mycobacterium
CAMAKRIATDVGFTVANEAL

SEQ ID NO: 641131 - protein, 34 aa, Mycobacterium
CAMDPRQRLALELTWELFENAFIVPDTLRTEPVS

SEQ ID NO: 641132 - protein, 20 aa, Mycobacterium
CAMGGLTPMPVRSALTHFPD

SEQ ID NO: 641133 - protein, 21 aa, Mycobacterium
CAMPLHRRFGLAATARASFAV

SEQ ID NO: 641134 - protein, 21 aa, Mycobacterium
CAMPLHRRFGVAATARASFAV

SEQ ID NO: 641135 - protein, 19 aa, Mycobacterium
CAMVACPIIGIQDSGGARI

SEQ ID NO: 641136 - protein, 20 aa, Mycobacterium
CANCTGLPSARQIDLSGPEV

SEQ ID NO: 641137 - protein, 30 aa, Mycobacterium
CANEEARELLGILCDLYALSVIEDDKAWYI

SEQ ID NO: 641138 - protein, 25 aa, Mycobacterium
CANFNKIGFRMCGGIELYEKTIRER

SEQ ID NO: 641139 - protein, 21 aa, Mycobacterium
CANLHLAECNWLVEKGPIAKL

SEQ ID NO: 641140 - protein, 20 aa, Mycobacterium
CANYSRAYIRHLFKAKEMLS

SEQ ID NO: 641141 - protein, 20 aa, Mycobacterium
CANYTRAYLHHLFKAKELLA

SEQ ID NO: 641142 - protein, 28 aa, Mycobacterium
CAPAAKWVDVFCERGAFDLDQSRAILQA

SEQ ID NO: 641143 - protein, 18 aa, Mycobacterium
CAPANRWSVRTVGDLELL

SEQ ID NO: 641144 - protein, 20 aa, Mycobacterium
CAPATEWFGAHGWTALGTPL

SEQ ID NO: 641145 - protein, 19 aa, Mycobacterium
CAPATEWFGNRGWTAVGTP

SEQ ID NO: 641146 - protein, 19 aa, Mycobacterium
CAPCTARPLAGADPRSGRW

SEQ ID NO: 641147 - protein, 26 aa, Mycobacterium
CAPDHPWAKEHPEWFTVLPDGTIAYA

SEQ ID NO: 641148 - protein, 26 aa, Mycobacterium
CAPDHPWARDHPEWFTVLPDGTIAYA

SEQ ID NO: 641149 - protein, 20 aa, Mycobacterium
CAPDHPWAREHREWFTELPD

SEQ ID NO: 641150 - protein, 20 aa, Mycobacterium
CAPDHPWAREHRNWFTELPD

SEQ ID NO: 641151 - protein, 21 aa, Mycobacterium
CAPDHPWAREHRNWFTQLPDG

SEQ ID NO: 641152 - protein, 20 aa, Mycobacterium
CAPDHPWARNHRNWFTELPD

SEQ ID NO: 641153 - protein, 22 aa, Mycobacterium
CAPDRIEAFRSWMDAAAVPSSE

SEQ ID NO: 641154 - protein, 17 aa, Mycobacterium
CAPELLRKYGVEDRVRV

SEQ ID NO: 641155 - protein, 18 aa, Mycobacterium
CAPERRHDMLHDQVAMLA

SEQ ID NO: 641156 - protein, 18 aa, Mycobacterium
CAPHHRLLGHGWTTRKRK

SEQ ID NO: 641157 - protein, 18 aa, Mycobacterium
CAPPTGCAGLFGPPPRSC

SEQ ID NO: 641158 - protein, 18 aa, Mycobacterium
CAPQNKWSVRSVGDLDLL

SEQ ID NO: 641159 - protein, 19 aa, Mycobacterium
CAPRALATSAVFQRVMLSR

SEQ ID NO: 641160 - protein, 19 aa, Mycobacterium
CAPRSGLLGRPGPHRRYAA

SEQ ID NO: 641161 - protein, 19 aa, Mycobacterium
CAPVEIGVDPTESWVEYAL

SEQ ID NO: 641162 - protein, 21 aa, Mycobacterium
CAPVYVCGEVTATLGAEDTVW

SEQ ID NO: 641163 - protein, 19 aa, Mycobacterium
CAQAARLIFDALPRAYDDP

SEQ ID NO: 641164 - protein, 19 aa, Mycobacterium
CAQAARLIFDALPRAYEHP

SEQ ID NO: 641165 - protein, 17 aa, Mycobacterium
CAQATMIHESFVKMLHL

SEQ ID NO: 641166 - protein, 20 aa, Mycobacterium
CAQDLLWGPAMRNYPDLRFA

SEQ ID NO: 641167 - protein, 19 aa, Mycobacterium
CAQERISLHAALRAITIDA

SEQ ID NO: 641168 - protein, 25 aa, Mycobacterium
CAQILPWNYPLASAISKLAPALAMG

SEQ ID NO: 641169 - protein, 19 aa, Mycobacterium
CAQILVQHCDIDLRSHLYG

SEQ ID NO: 641170 - protein, 24 aa, Mycobacterium
CAQPVVQREAFAWHIDLAKRTGKP

SEQ ID NO: 641171 - protein, 23 aa, Mycobacterium
CAREVADVVAPVLGWSAADVERE

SEQ ID NO: 641172 - protein, 23 aa, Mycobacterium
CAREVADVVAPVLGWTVEDIERE

SEQ ID NO: 641173 - protein, 24 aa, Mycobacterium
CARGRARLARLLGYLDADINAVDM

SEQ ID NO: 641174 - protein, 22 aa, Mycobacterium
CARGRARLARLLGYLDTEANAF

SEQ ID NO: 641175 - protein, 20 aa, Mycobacterium
CARMGISIQPVRLGEGRDKG

SEQ ID NO: 641176 - protein, 19 aa, Mycobacterium
CARSRILVQRSVYDRFMEL

SEQ ID NO: 641177 - protein, 19 aa, Mycobacterium
CARSRILVQRSVYDRFMEM

SEQ ID NO: 641178 - protein, 21 aa, Mycobacterium
CARTLGLPALPAEVVVAEPQS

SEQ ID NO: 641179 - protein, 19 aa, Mycobacterium
CARVLRPGGVLLMSTPNRI

SEQ ID NO: 641180 - protein, 24 aa, Mycobacterium
CARVLRPSGLLMMSTPNRITFSPG

SEQ ID NO: 641181 - protein, 18 aa, Mycobacterium
CASDRWAYLPALEQVAAW

SEQ ID NO: 641182 - protein, 17 aa, Mycobacterium
CASGKSLNVGGSDNTLT

SEQ ID NO: 641183 - protein, 23 aa, Mycobacterium
CASGRSAEELLAILTERLENDPE

SEQ ID NO: 641184 - protein, 20 aa, Mycobacterium
CASHGDGLCNVFVPHATAGV

SEQ ID NO: 641185 - protein, 23 aa, Mycobacterium
CASPSGIPLRMSCQAAGPMGIQA

SEQ ID NO: 641186 - protein, 17 aa, Mycobacterium
CASRILVQASVYTAFVE

SEQ ID NO: 641187 - protein, 18 aa, Mycobacterium
CASSELRPVRKLRQRGEE

SEQ ID NO: 641188 - protein, 18 aa, Mycobacterium
CATAMLYRHPNLRARFIY

SEQ ID NO: 641189 - protein, 22 aa, Mycobacterium
CATLMAYLRRRIRTHGLVAGSI

SEQ ID NO: 641190 - protein, 25 aa, Mycobacterium
CATPGLRLAAVMAYDGQIAGVGDIV

SEQ ID NO: 641191 - protein, 18 aa, Mycobacterium
CATRGGLLPSGPRRRYAA

SEQ ID NO: 641192 - protein, 21 aa, Mycobacterium
CATVHGALPPARRPTVLGLVR

SEQ ID NO: 641193 - protein, 20 aa, Mycobacterium
CAVAGRIKPAGAVKDGVDDA

SEQ ID NO: 641194 - protein, 20 aa, Mycobacterium
CAVAPWRRPRTVECHAGATL

SEQ ID NO: 641195 - protein, 17 aa, Mycobacterium
CAVCGNVSDGERCRICA

SEQ ID NO: 641196 - protein, 29 aa, Mycobacterium
CAVLPHALAAVGRRPDLLVVHLNGPDTAS

SEQ ID NO: 641197 - protein, 37 aa, Mycobacterium
CAVLRRADHRPTFDVLFDLWFPPALGARFVEVGEEGI

SEQ ID NO: 641198 - protein, 17 aa, Mycobacterium
CAVNGIATMFGFVDVEI

SEQ ID NO: 641199 - protein, 26 aa, Mycobacterium
CAVPPGRLGWGWAKFAFNSWKALSWL

SEQ ID NO: 641200 - protein, 17 aa, Mycobacterium
CAVPVVAAVNGFCVGGG

SEQ ID NO: 641201 - protein, 17 aa, Mycobacterium
CAVRGAGCQDCVVSVLL

SEQ ID NO: 641202 - protein, 19 aa, Mycobacterium
CAVRGPACRDCVVSVLLGV

SEQ ID NO: 641203 - protein, 20 aa, Mycobacterium
CAVRGPGCRDCVVSVILGVP

SEQ ID NO: 641204 - protein, 19 aa, Mycobacterium
CAVRGPGCRDCVVSVLLGV

SEQ ID NO: 641205 - protein, 30 aa, Mycobacterium
CAVRLQRAPLAPIRLRIGVHTGEVRLRSQT

SEQ ID NO: 641206 - protein, 17 aa, Mycobacterium
CAVRNRAGSQCRPSSTP

SEQ ID NO: 641207 - protein, 19 aa, Mycobacterium
CAVTSPRPGTGLLVDDITD

SEQ ID NO: 641208 - protein, 20 aa, Mycobacterium
CAVVLLKRLRDALRDGDRIL

SEQ ID NO: 641209 - protein, 27 aa, Mycobacterium
CAWVARLAVDFRQAFKKDVVIDMLCYR

SEQ ID NO: 641210 - protein, 30 aa, Mycobacterium
CAWYGDPAFDLAFCLNHLLLKRIWKPQHRA

SEQ ID NO: 641211 - protein, 21 aa, Mycobacterium
CAYGFRPGRRAQDAIAEIHHL

SEQ ID NO: 641212 - protein, 18 aa, Mycobacterium
CAYIEARPGQLHCYPDTD

SEQ ID NO: 641213 - protein, 19 aa, Mycobacterium
CAYVLARAAWYRGDIHEAA

SEQ ID NO: 641214 - protein, 21 aa, Mycobacterium
CCARSRILVQRSVFDRFMELL

SEQ ID NO: 641215 - protein, 21 aa, Mycobacterium
CCDACGHIAADVAVGSRAEIG

SEQ ID NO: 641216 - protein, 29 aa, Mycobacterium
CCDAGDWSARVTLSFSGQSEQEWSYVDFG

SEQ ID NO: 641217 - protein, 19 aa, Mycobacterium
CCGRSRFANAALRGPLLMA

SEQ ID NO: 641218 - protein, 22 aa, Mycobacterium
CCKAALRHMVPAQKGSIVNTAS

SEQ ID NO: 641219 - protein, 19 aa, Mycobacterium
CCLEARQLAESHLAAIHAK

SEQ ID NO: 641220 - protein, 27 aa, Mycobacterium
CCQYQHWAGRRWKYRRSLFDSYETLPK

SEQ ID NO: 641221 - protein, 19 aa, Mycobacterium
CCRGCGCQLAGVYDGPEGG

SEQ ID NO: 641222 - protein, 25 aa, Mycobacterium
CCSVPDIGTIWVRRATREELPELYA

SEQ ID NO: 641223 - protein, 22 aa, Mycobacterium
CCTSLNEIICHGIPDSTVIEDG

SEQ ID NO: 641224 - protein, 23 aa, Mycobacterium
CCTSLNEIICHGIPDSTVIEDGD

SEQ ID NO: 641225 - protein, 18 aa, Mycobacterium
CCVREVGFEPFLRRARPF

SEQ ID NO: 641226 - protein, 19 aa, Mycobacterium
CCVVPGCSATRGLHAHHLV

SEQ ID NO: 641227 - protein, 19 aa, Mycobacterium
CDADVPFGPDLLFAASDIP

SEQ ID NO: 641228 - protein, 25 aa, Mycobacterium
CDAFENFPPPILKPVILAAKSKPLF

SEQ ID NO: 641229 - protein, 24 aa, Mycobacterium
CDAFETFPPFPFPAVFTLLRGPRS

SEQ ID NO: 641230 - protein, 25 aa, Mycobacterium
CDAGDCGACSVLIDDVAVHSCVYPA

SEQ ID NO: 641231 - protein, 20 aa, Mycobacterium
CDAGDCGACTVLVDGASQHS

SEQ ID NO: 641232 - protein, 28 aa, Mycobacterium
CDAHRIAWSHLWERLSIEFSNHTEELRV

SEQ ID NO: 641233 - protein, 19 aa, Mycobacterium
CDAIREMLLHPAGVLGLSD

SEQ ID NO: 641234 - protein, 19 aa, Mycobacterium
CDAIREMMLHPAGVLGLSD

SEQ ID NO: 641235 - protein, 17 aa, Mycobacterium
CDAKRELSRQLEHQKST

SEQ ID NO: 641236 - protein, 19 aa, Mycobacterium
CDAMARLGGVTLSKAGLRL

SEQ ID NO: 641237 - protein, 19 aa, Mycobacterium
CDAMIRLGAVADVNVGIVT

SEQ ID NO: 641238 - protein, 20 aa, Mycobacterium
CDAMISIRAEIDRVGSGQWP

SEQ ID NO: 641239 - protein, 21 aa, Mycobacterium
CDARPVFATRARFPTADDVVV

SEQ ID NO: 641240 - protein, 24 aa, Mycobacterium
CDCGPQLDAAMEMVAKEGRGIVLY

SEQ ID NO: 641241 - protein, 19 aa, Mycobacterium
CDCKSCSQLGNLSLKFVTH

SEQ ID NO: 641242 - protein, 25 aa, Mycobacterium
CDCYNIPIVLLVDVPGFLPGTDQEY

SEQ ID NO: 641243 - protein, 17 aa, Mycobacterium
CDDHPAAKASFRVQIAT

SEQ ID NO: 641244 - protein, 19 aa, Mycobacterium
CDDTVCKRFTRIAAAKWEL

SEQ ID NO: 641245 - protein, 23 aa, Mycobacterium
CDEFLDVVRRLWAGETVTHRGKY

SEQ ID NO: 641246 - protein, 26 aa, Mycobacterium
CDEIGRRCAWLLLDASGPLTLTLACD

SEQ ID NO: 641247 - protein, 19 aa, Mycobacterium
CDEKLALLRRLLAGETVIE

SEQ ID NO: 641248 - protein, 19 aa, Mycobacterium
CDERARIHSPVGLDIGAKT

SEQ ID NO: 641249 - protein, 21 aa, Mycobacterium
CDESVRIFLATGLSDVDRPEA

SEQ ID NO: 641250 - protein, 19 aa, Mycobacterium
CDFGPVLSIARAIREQVDW

SEQ ID NO: 641251 - protein, 17 aa, Mycobacterium
CDFVSSFATLLPLRIID

SEQ ID NO: 641252 - protein, 19 aa, Mycobacterium
CDGHAPGWEPLPIQYIDYA

SEQ ID NO: 641253 - protein, 19 aa, Mycobacterium
CDGIGYPVELVIGAETVVL

SEQ ID NO: 641254 - protein, 18 aa, Mycobacterium
CDGIGYPVELVLGPETVI

SEQ ID NO: 641255 - protein, 22 aa, Mycobacterium
CDGIPGSAWIYPGAIPLAPVYR

SEQ ID NO: 641256 - protein, 25 aa, Mycobacterium
CDGPRFRWVQGLKVSCEKGFPPSTL

SEQ ID NO: 641257 - protein, 25 aa, Mycobacterium
CDGPRFRWVQGLQVACERGFPVATL

SEQ ID NO: 641258 - protein, 28 aa, Mycobacterium
CDGPRFRWVQGLQVCCENGFPPATLDDL

SEQ ID NO: 641259 - protein, 17 aa, Mycobacterium
CDGPVIGAAALWDPPNQ

SEQ ID NO: 641260 - protein, 21 aa, Mycobacterium
CDGRIGMSYIPPGTPWNNGHI

SEQ ID NO: 641261 - protein, 18 aa, Mycobacterium
CDGSRKAERLIAHELAHQ

SEQ ID NO: 641262 - protein, 17 aa, Mycobacterium
CDGVPFYIEQVVTGLRT

SEQ ID NO: 641263 - protein, 32 aa, Mycobacterium
CDGVVIGRGCLGRPWLFAELSAAFTGNPGPTP

SEQ ID NO: 641264 - protein, 33 aa, Mycobacterium
CDGVVIGRGCLGRPWLFAELSAVFNGQTIPAPP

SEQ ID NO: 641265 - protein, 22 aa, Mycobacterium
CDHAHPGMRIHVLAPSGTFVPK

SEQ ID NO: 641266 - protein, 24 aa, Mycobacterium
CDHGACGACTVLVDGRRINSCLTL

SEQ ID NO: 641267 - protein, 19 aa, Mycobacterium
CDHPDQWVLLAQHPDLAAN

SEQ ID NO: 641268 - protein, 17 aa, Mycobacterium
CDIKPTVAMFMTSDMAN

SEQ ID NO: 641269 - protein, 24 aa, Mycobacterium
CDIPSLLYSYSFEPNPGWTHTYSG

SEQ ID NO: 641270 - protein, 24 aa, Mycobacterium
CDIPSLLYSYSFEPNPGWTRAYSG

SEQ ID NO: 641271 - protein, 22 aa, Mycobacterium
CDKGNACLGCGHFATDTTHLDE

SEQ ID NO: 641272 - protein, 20 aa, Mycobacterium
CDLAAGPAFRAALIRTGEAR

SEQ ID NO: 641273 - protein, 24 aa, Mycobacterium
CDLADRPTLRAALIRTEGNQHRFV

SEQ ID NO: 641274 - protein, 24 aa, Mycobacterium
CDLAERPPFRAALIRTADNRHRFV

SEQ ID NO: 641275 - protein, 25 aa, Mycobacterium
CDLAGRPPFRAALIRAADDLYRFVL

SEQ ID NO: 641276 - protein, 20 aa, Mycobacterium
CDLALWDARVLELGGSSNSL

SEQ ID NO: 641277 - protein, 17 aa, Mycobacterium
CDLERDALREALLAAGF

SEQ ID NO: 641278 - protein, 19 aa, Mycobacterium
CDLHLWDGQIHDFPLAADI

SEQ ID NO: 641279 - protein, 17 aa, Mycobacterium
CDLILGRVMAYISAVPH

SEQ ID NO: 641280 - protein, 17 aa, Mycobacterium
CDLQRPAAVNQLQVVGQ

SEQ ID NO: 641281 - protein, 17 aa, Mycobacterium
CDLQRPGAVNQLQVVGE

SEQ ID NO: 641282 - protein, 23 aa, Mycobacterium
CDLVARSAFLVYRNRLEREENIF

SEQ ID NO: 641283 - protein, 19 aa, Mycobacterium
CDLYLGCDLLVAADEKYLN

SEQ ID NO: 641284 - protein, 17 aa, Mycobacterium
CDPMEACDIYTRQCSTL

SEQ ID NO: 641285 - protein, 21 aa, Mycobacterium
CDPPREFAWAVGEPDYPAAVW

SEQ ID NO: 641286 - protein, 17 aa, Mycobacterium
CDPRFNKLLGPIPFPHH

SEQ ID NO: 641287 - protein, 24 aa, Mycobacterium
CDQCGPCRAGNYNVCQQIGFHGLM

SEQ ID NO: 641288 - protein, 20 aa, Mycobacterium
CDQGACGACTIHLNGERVVA

SEQ ID NO: 641289 - protein, 19 aa, Mycobacterium
CDQPARWLIDGSRHAQLVV

SEQ ID NO: 641290 - protein, 20 aa, Mycobacterium
CDRHLLGLFIEALREGKDVA

SEQ ID NO: 641291 - protein, 18 aa, Mycobacterium
CDRIAFVVDGTIAAMDRP

SEQ ID NO: 641292 - protein, 23 aa, Mycobacterium
CDRICVLDRGQVVAVGAPREVLT

SEQ ID NO: 641293 - protein, 25 aa, Mycobacterium
CDRPIADVCPVEWARMADRSVLQWD

SEQ ID NO: 641294 - protein, 25 aa, Mycobacterium
CDRPIADVCPVEWARMANRSVLQWD

SEQ ID NO: 641295 - protein, 17 aa, Mycobacterium
CDRRRGLGADGVLRVTR

SEQ ID NO: 641296 - protein, 17 aa, Mycobacterium
CDRRRGLGADGVLRVTT

SEQ ID NO: 641297 - protein, 17 aa, Mycobacterium
CDSALLAAVIFERGLDA

SEQ ID NO: 641298 - protein, 22 aa, Mycobacterium
CDSGEVLVPFVGAIVTSVSLDD

SEQ ID NO: 641299 - protein, 22 aa, Mycobacterium
CDSPGFTVPYYWWTFNMPTDHG

SEQ ID NO: 641300 - protein, 20 aa, Mycobacterium
CDTHWPWRHEDVVAPGALNF

SEQ ID NO: 641301 - protein, 29 aa, Mycobacterium
CDTPSGLGRRVAGVLGYDHTRIQMDYVGL

SEQ ID NO: 641302 - protein, 19 aa, Mycobacterium
CDTPVKWARLDSAPFTDRL

SEQ ID NO: 641303 - protein, 19 aa, Mycobacterium
CDVAGALDCPLLLKEVGHG

SEQ ID NO: 641304 - protein, 24 aa, Mycobacterium
CDVALAGGVNVMFQPETFITMCKG

SEQ ID NO: 641305 - protein, 19 aa, Mycobacterium
CDVDGRPLLTATLDEPGTL

SEQ ID NO: 641306 - protein, 19 aa, Mycobacterium
CDVEARTGTDLTTDLGVLR

SEQ ID NO: 641307 - protein, 32 aa, Mycobacterium
CDVEGWKGDYFPFVFNIRDWNVIMSDSLHLPP

SEQ ID NO: 641308 - protein, 18 aa, Mycobacterium
CDVHGWRYNVETGISPVN

SEQ ID NO: 641309 - protein, 26 aa, Mycobacterium
CDVLRPQWEASGGWDGRVSIEVDPRL

SEQ ID NO: 641310 - protein, 19 aa, Mycobacterium
CDVPACAATGALAPVLAGV

SEQ ID NO: 641311 - protein, 17 aa, Mycobacterium
CDVPIDGCVAVLVSTAE

SEQ ID NO: 641312 - protein, 18 aa, Mycobacterium
CDVPYLYRFELMGTAEDV

SEQ ID NO: 641313 - protein, 18 aa, Mycobacterium
CDVRAAATASGAWAGAEH

SEQ ID NO: 641314 - protein, 17 aa, Mycobacterium
CDVRPAGRWIIDPDGAV

SEQ ID NO: 641315 - protein, 17 aa, Mycobacterium
CDWEMCTIGDPLLDLGW

SEQ ID NO: 641316 - protein, 19 aa, Mycobacterium
CDYAPVVMVNWEFFDNQTP

SEQ ID NO: 641317 - protein, 19 aa, Mycobacterium
CDYAPVVMVNWEFYDNQTP

SEQ ID NO: 641318 - protein, 32 aa, Mycobacterium
CDYPGDPWVVPKFYWTILGLSAFLAGRQALTP

SEQ ID NO: 641319 - protein, 18 aa, Mycobacterium
CDYWNIRWIHVDDPACRI

SEQ ID NO: 641320 - protein, 26 aa, Mycobacterium
CEACGNPFAGFGGWLMRRVGKSPSRK

SEQ ID NO: 641321 - protein, 25 aa, Mycobacterium
CEAFDRWGLMPRMFVGAAERDLTVE

SEQ ID NO: 641322 - protein, 18 aa, Mycobacterium
CEAFLPAMIESGRGGHVV

SEQ ID NO: 641323 - protein, 18 aa, Mycobacterium
CEAFVAALCESGAAGLCF

SEQ ID NO: 641324 - protein, 21 aa, Mycobacterium
CEAGTRLLIPASRRDEIVDKL

SEQ ID NO: 641325 - protein, 20 aa, Mycobacterium
CEALPPETFDLVIVDEAHRS

SEQ ID NO: 641326 - protein, 28 aa, Mycobacterium
CEALYHFAWDEFCDWYLELAKVQLGQED

SEQ ID NO: 641327 - protein, 27 aa, Mycobacterium
CEALYHFAWDEFCDWYVELAKTQLADG

SEQ ID NO: 641328 - protein, 19 aa, Mycobacterium
CEAMISIRAEIDRVGAGQW

SEQ ID NO: 641329 - protein, 35 aa, Mycobacterium
CEASLDQQREWILHMAKLSAALAKQAQYIAQLQVW

SEQ ID NO: 641330 - protein, 28 aa, Mycobacterium
CEDIGVDIAFNWDHFFPLFGDPDGAHFE

SEQ ID NO: 641331 - protein, 28 aa, Mycobacterium
CEDIGVDIAFNWDHFFPLYGDPDGAHYE

SEQ ID NO: 641332 - protein, 26 aa, Mycobacterium
CEDIGVDVVFNWDHFFPLYGDPDGAH

SEQ ID NO: 641333 - protein, 26 aa, Mycobacterium
CEDPRFSIARLSLLDRGMVFVVAHVR

SEQ ID NO: 641334 - protein, 23 aa, Mycobacterium
CEDVCYLAMPLFHSNAVYAGWSV

SEQ ID NO: 641335 - protein, 19 aa, Mycobacterium
CEEMARAWHTVKLDESVHA

SEQ ID NO: 641336 - protein, 17 aa, Mycobacterium
CEGDHRGLLAIHSLSKS

SEQ ID NO: 641337 - protein, 43 aa, Mycobacterium
CEGETWPLLRNARWLPLVIAHGLLDEFVPFFAVAQQLLKLHRL

SEQ ID NO: 641338 - protein, 18 aa, Mycobacterium
CEGLRGAANILLTEGHVE

SEQ ID NO: 641339 - protein, 24 aa, Mycobacterium
CEGMGRGLCNIAYAAVDRHSTGPD

SEQ ID NO: 641340 - protein, 17 aa, Mycobacterium
CEGQERLTPVLTTKHAI

SEQ ID NO: 641341 - protein, 20 aa, Mycobacterium
CEGSEVEAWLGLTAKGGTCV

SEQ ID NO: 641342 - protein, 19 aa, Mycobacterium
CEHEDLGLYSWCLIELIEA

SEQ ID NO: 641343 - protein, 21 aa, Mycobacterium
CEHPDCIRLADDVDHVVPLAE

SEQ ID NO: 641344 - protein, 18 aa, Mycobacterium
CEHPGRFAHIDVDDSPAS

SEQ ID NO: 641345 - protein, 24 aa, Mycobacterium
CEIFPPDDFPLYFYRKPSAPDLQI

SEQ ID NO: 641346 - protein, 24 aa, Mycobacterium
CEIFPPDNFPLYFYRKPSAPDLQI

SEQ ID NO: 641347 - protein, 19 aa, Mycobacterium
CEIGSCGTCMGRLTQGSAR

SEQ ID NO: 641348 - protein, 17 aa, Mycobacterium
CEIRRGNGVFGPLPGPF

SEQ ID NO: 641349 - protein, 19 aa, Mycobacterium
CEIRTRRYGAYEVHATSAA

SEQ ID NO: 641350 - protein, 17 aa, Mycobacterium
CEITLSLALANSGDLQV

SEQ ID NO: 641351 - protein, 19 aa, Mycobacterium
CELALACDIVIAGESGQFG

SEQ ID NO: 641352 - protein, 17 aa, Mycobacterium
CELAMLCDLVIAADTAR

SEQ ID NO: 641353 - protein, 17 aa, Mycobacterium
CELAMMCDLLIAADTAK

SEQ ID NO: 641354 - protein, 17 aa, Mycobacterium
CELHLVEPLGFDLSEPQ

SEQ ID NO: 641355 - protein, 19 aa, Mycobacterium
CELHPEAPVRCDGFDASGN

SEQ ID NO: 641356 - protein, 17 aa, Mycobacterium
CELILRIVMSAYVFPTR

SEQ ID NO: 641357 - protein, 19 aa, Mycobacterium
CELKIDGVALSLVYRDGRL

SEQ ID NO: 641358 - protein, 26 aa, Mycobacterium
CELLTARGYLLVSFEDVLGRPLAQAP

SEQ ID NO: 641359 - protein, 20 aa, Mycobacterium
CELNARRRAIWELTGMPSPL

SEQ ID NO: 641360 - protein, 18 aa, Mycobacterium
CEMENFLFEEAELLNDGR

SEQ ID NO: 641361 - protein, 17 aa, Mycobacterium
CEPFLVRAGMVARTPRG

SEQ ID NO: 641362 - protein, 17 aa, Mycobacterium
CEPPDRVVFTWDIGPTW

SEQ ID NO: 641363 - protein, 19 aa, Mycobacterium
CEPQVRYALDPQPAAVEAV

SEQ ID NO: 641364 - protein, 17 aa, Mycobacterium
CEPVCPVDAIYYEDDLP

SEQ ID NO: 641365 - protein, 17 aa, Mycobacterium
CEPVCPVEAIYYEDDLP

SEQ ID NO: 641366 - protein, 18 aa, Mycobacterium
CEPVCPVEAIYYEDDVPE

SEQ ID NO: 641367 - protein, 17 aa, Mycobacterium
CEPYPKLLNSIIAVDMA

SEQ ID NO: 641368 - protein, 18 aa, Mycobacterium
CEQCNYVKENAGWRVSTS

SEQ ID NO: 641369 - protein, 18 aa, Mycobacterium
CEQFEVCIQRRQGFEQAL

SEQ ID NO: 641370 - protein, 17 aa, Mycobacterium
CEQGDWWGLVTYPVAYG

SEQ ID NO: 641371 - protein, 18 aa, Mycobacterium
CEQGDWWGLVTYPVAYGS

SEQ ID NO: 641372 - protein, 26 aa, Mycobacterium
CEQIDFWRFNVAFAQQILAQQPISGP

SEQ ID NO: 641373 - protein, 18 aa, Mycobacterium
CERACGSPPVGDVLVATE

SEQ ID NO: 641374 - protein, 25 aa, Mycobacterium
CERADAVLVLTEWSEFVDLDPAALD

SEQ ID NO: 641375 - protein, 17 aa, Mycobacterium
CERFPVFGKAFDAAAEA

SEQ ID NO: 641376 - protein, 23 aa, Mycobacterium
CERGRSFGFAVLWPNGKTVNTWR

SEQ ID NO: 641377 - protein, 20 aa, Mycobacterium
CERLLRRRLASLRPDDAILG

SEQ ID NO: 641378 - protein, 29 aa, Mycobacterium
CERNWGAGFPRRWWWGQAHDFGDADVSVA

SEQ ID NO: 641379 - protein, 25 aa, Mycobacterium
CERRGEWRIELDLRPSGRFVRTLTE

SEQ ID NO: 641380 - protein, 17 aa, Mycobacterium
CERVRRLVYTSSVAAYG

SEQ ID NO: 641381 - protein, 17 aa, Mycobacterium
CERVWEVLAQGWTYTQW

SEQ ID NO: 641382 - protein, 24 aa, Mycobacterium
CESGTRLLLHASIHDEFVRRLVAR

SEQ ID NO: 641383 - protein, 19 aa, Mycobacterium
CETGSCATCMARLTQGSAR

SEQ ID NO: 641384 - protein, 17 aa, Mycobacterium
CETHRKVADQAGKLVAQ

SEQ ID NO: 641385 - protein, 19 aa, Mycobacterium
CETLARYDVTLALAAGLQP

SEQ ID NO: 641386 - protein, 22 aa, Mycobacterium
CEVKDACLEYALANDERFGIWG

SEQ ID NO: 641387 - protein, 24 aa, Mycobacterium
CEVRDACLEYALAHDERFGIWGGL

SEQ ID NO: 641388 - protein, 18 aa, Mycobacterium
CEVWFELRGRVIGTGRAT

SEQ ID NO: 641389 - protein, 19 aa, Mycobacterium
CEWIVPPMVAMQGTKFTYL

SEQ ID NO: 641390 - protein, 19 aa, Mycobacterium
CEYDGVVGIWYGKAPGLDR

SEQ ID NO: 641391 - protein, 23 aa, Mycobacterium
CEYLKAGELVGVYPEATISRSFE

SEQ ID NO: 641392 - protein, 22 aa, Mycobacterium
CFAQLLRPGLCTERHRHTSSAV

SEQ ID NO: 641393 - protein, 20 aa, Mycobacterium
CFASGRISYALRLHGPAVTV

SEQ ID NO: 641394 - protein, 26 aa, Mycobacterium
CFEKPWDARSLWTWMSPDDGARLLEA

SEQ ID NO: 641395 - protein, 18 aa, Mycobacterium
CFELATKLVEAMSGAITI

SEQ ID NO: 641396 - protein, 17 aa, Mycobacterium
CFEVEFSDGTVLVADAE

SEQ ID NO: 641397 - protein, 18 aa, Mycobacterium
CFLLPRILPDGSRNRMFL

SEQ ID NO: 641398 - protein, 18 aa, Mycobacterium
CFMLPRVLPDGSRNRMFL

SEQ ID NO: 641399 - protein, 22 aa, Mycobacterium
CFPDRYSNWMPKLKEMIPSLGI

SEQ ID NO: 641400 - protein, 18 aa, Mycobacterium
CFQLPALLAPEARATVVV

SEQ ID NO: 641401 - protein, 19 aa, Mycobacterium
CFRPGEPRVSLIDRKTSSP

SEQ ID NO: 641402 - protein, 20 aa, Mycobacterium
CFSTERFSYVQEWTKLSFDY

SEQ ID NO: 641403 - protein, 26 aa, Mycobacterium
CFSVGGRPALDWADLVRAAGVGGALE

SEQ ID NO: 641404 - protein, 23 aa, Mycobacterium
CFTTEADPGLAGRSIHYARGRVI

SEQ ID NO: 641405 - protein, 23 aa, Mycobacterium
CFVRSPFARARINGIDASAALEL

SEQ ID NO: 641406 - protein, 18 aa, Mycobacterium
CGAADMKSGDAVFLHLAA

SEQ ID NO: 641407 - protein, 19 aa, Mycobacterium
CGAALSAVLLECTLAGLAT

SEQ ID NO: 641408 - protein, 20 aa, Mycobacterium
CGACPSCQAGLRNLCDLGAM

SEQ ID NO: 641409 - protein, 19 aa, Mycobacterium
CGADAIYPGYGFLSENPDL

SEQ ID NO: 641410 - protein, 17 aa, Mycobacterium
CGAELGIRDVFEFPTVG

SEQ ID NO: 641411 - protein, 17 aa, Mycobacterium
CGAELGIRDVFELVTVG

SEQ ID NO: 641412 - protein, 17 aa, Mycobacterium
CGAFYPAMFQAAIDAGR

SEQ ID NO: 641413 - protein, 17 aa, Mycobacterium
CGAGLFQKATRGVLSTI

SEQ ID NO: 641414 - protein, 28 aa, Mycobacterium
CGAKTLQSALGWLKYTIDTELRMNEIGE

SEQ ID NO: 641415 - protein, 27 aa, Mycobacterium
CGALCPRHHRGCYGCFGPSAAPQTATL

SEQ ID NO: 641416 - protein, 25 aa, Mycobacterium
CGALSEWRATILVRETAYLAVEDRQ

SEQ ID NO: 641417 - protein, 25 aa, Mycobacterium
CGALSEWRATLIARESACLSPELRR

SEQ ID NO: 641418 - protein, 26 aa, Mycobacterium
CGALSEWRATLIVRESACLSVEDRRR

SEQ ID NO: 641419 - protein, 21 aa, Mycobacterium
CGALSRSGPTIGTPVLPPDGI

SEQ ID NO: 641420 - protein, 19 aa, Mycobacterium
CGALSRSGPTTGTPVLPPD

SEQ ID NO: 641421 - protein, 25 aa, Mycobacterium
CGAPSTRWCAACATELAVAATHPHV

SEQ ID NO: 641422 - protein, 28 aa, Mycobacterium
CGAPVLTLRTDRDWLADIVRFVASRRRG

SEQ ID NO: 641423 - protein, 17 aa, Mycobacterium
CGAQRVIDTRTEAFDEA

SEQ ID NO: 641424 - protein, 20 aa, Mycobacterium
CGARGAGTVRMFETGPDATG

SEQ ID NO: 641425 - protein, 18 aa, Mycobacterium
CGASVIGTDGLREYITTG

SEQ ID NO: 641426 - protein, 21 aa, Mycobacterium
CGATARANGWRNADLIPGTRI

SEQ ID NO: 641427 - protein, 17 aa, Mycobacterium
CGAVMRAAPVGFAGADP

SEQ ID NO: 641428 - protein, 20 aa, Mycobacterium
CGAVTGLPAPLAHPGLVCDV

SEQ ID NO: 641429 - protein, 26 aa, Mycobacterium
CGAYNASIFRRAEELFSLLREQGKTP

SEQ ID NO: 641430 - protein, 20 aa, Mycobacterium
CGAYNSSIFRRSEELFSLLR

SEQ ID NO: 641431 - protein, 19 aa, Mycobacterium
CGCDHAAASRGEWRTEVGD

SEQ ID NO: 641432 - protein, 20 aa, Mycobacterium
CGDCADCCDCGDCCDCGDCC

SEQ ID NO: 641433 - protein, 20 aa, Mycobacterium
CGDCGVKSNCLSVQPVETEL

SEQ ID NO: 641434 - protein, 19 aa, Mycobacterium
CGDGAILRELARLGGRPRG

SEQ ID NO: 641435 - protein, 21 aa, Mycobacterium
CGDKTPPRLAVIAMGKCGARE

SEQ ID NO: 641436 - protein, 19 aa, Mycobacterium
CGDLLLMREGRLVAHTTPS

SEQ ID NO: 641437 - protein, 20 aa, Mycobacterium
CGDLSLAYQLFGDGPIPLVF

SEQ ID NO: 641438 - protein, 23 aa, Mycobacterium
CGDLTYYLDMGWEDCKVAAEYDG

SEQ ID NO: 641439 - protein, 23 aa, Mycobacterium
CGDPEALGAWHAMIDEPIGRAIT

SEQ ID NO: 641440 - protein, 19 aa, Mycobacterium
CGDRFKLARRTILADESVL

SEQ ID NO: 641441 - protein, 23 aa, Mycobacterium
CGDSRYLLELIHNIWDRIQPYMA

SEQ ID NO: 641442 - protein, 21 aa, Mycobacterium
CGDWPNPPLLYAGWYCAKASE

SEQ ID NO: 641443 - protein, 20 aa, Mycobacterium
CGEAMISAWLYRPAGADPAR

SEQ ID NO: 641444 - protein, 18 aa, Mycobacterium
CGEAVFLHEIGRRGDGGR

SEQ ID NO: 641445 - protein, 26 aa, Mycobacterium
CGECHECRKGWMAVCQNQTSMGYQYD

SEQ ID NO: 641446 - protein, 18 aa, Mycobacterium
CGECRACTTTMAGTHADV

SEQ ID NO: 641447 - protein, 27 aa, Mycobacterium
CGEGADALWLAERGWRVVAVDVSATAL

SEQ ID NO: 641448 - protein, 23 aa, Mycobacterium
CGERELYTWTQLRDRAARLGSTL

SEQ ID NO: 641449 - protein, 29 aa, Mycobacterium
CGERVTMSCGWFFCASGYYRYDAGYTPEF

SEQ ID NO: 641450 - protein, 17 aa, Mycobacterium
CGESVSVYRCANKRIDA

SEQ ID NO: 641451 - protein, 17 aa, Mycobacterium
CGEVLLIRRSGGRTRLM

SEQ ID NO: 641452 - protein, 21 aa, Mycobacterium
CGFDTPYPPARLEKVWLPGPD

SEQ ID NO: 641453 - protein, 31 aa, Mycobacterium
CGFDTPYPPARLEKWWLPGPDRLLDCVERAL

SEQ ID NO: 641454 - protein, 29 aa, Mycobacterium
CGFDTPYPPARLERLWLPGPDRLLDCVER

SEQ ID NO: 641455 - protein, 19 aa, Mycobacterium
CGFIEAMLGALLVDYRLGR

SEQ ID NO: 641456 - protein, 24 aa, Mycobacterium
CGFQIPRWQRLVPVDFEAGACWRE

SEQ ID NO: 641457 - protein, 19 aa, Mycobacterium
CGFSDLLPVYPTVASALRP

SEQ ID NO: 641458 - protein, 22 aa, Mycobacterium
CGFTWPASRLTLALSPATLPKM

SEQ ID NO: 641459 - protein, 18 aa, Mycobacterium
CGFWPGGGEEGAFYAYAY

SEQ ID NO: 641460 - protein, 18 aa, Mycobacterium
CGFWPGGGEEGAFYSYAY

SEQ ID NO: 641461 - protein, 28 aa, Mycobacterium
CGGAAPCPLIAACRLRRALAEAKEAFYR

SEQ ID NO: 641462 - protein, 19 aa, Mycobacterium
CGGAIDFLAGKTIRAPGWM

SEQ ID NO: 641463 - protein, 20 aa, Mycobacterium
CGGCGAPSSRWCEACATELA

SEQ ID NO: 641464 - protein, 18 aa, Mycobacterium
CGGDELYLAAESDLHTVL

SEQ ID NO: 641465 - protein, 17 aa, Mycobacterium
CGGFFSWHVINDVKDAP

SEQ ID NO: 641466 - protein, 20 aa, Mycobacterium
CGGGRPADRDVGFFIEPTVI

SEQ ID NO: 641467 - protein, 18 aa, Mycobacterium
CGGGRPAGRDVGYFIEPT

SEQ ID NO: 641468 - protein, 19 aa, Mycobacterium
CGGHTRIWRHTSSRRDENT

SEQ ID NO: 641469 - protein, 20 aa, Mycobacterium
CGGITDWLRAAAVAAANNVD

SEQ ID NO: 641470 - protein, 26 aa, Mycobacterium
CGGNPAWDLPLVFGPIALAYNLPGNP

SEQ ID NO: 641471 - protein, 27 aa, Mycobacterium
CGGNPAWDLPLVFGPIALVYNLPGVKT

SEQ ID NO: 641472 - protein, 19 aa, Mycobacterium
CGGRLSLVHNGIIENATQL

SEQ ID NO: 641473 - protein, 19 aa, Mycobacterium
CGGVETWIEAVPVGAFSQL

SEQ ID NO: 641474 - protein, 17 aa, Mycobacterium
CGGVFLDRGELEQLSEA

SEQ ID NO: 641475 - protein, 17 aa, Mycobacterium
CGGVLLPSLPQGYDNSG

SEQ ID NO: 641476 - protein, 17 aa, Mycobacterium
CGHGVLVCAPTGAGKTV

SEQ ID NO: 641477 - protein, 18 aa, Mycobacterium
CGHMGPPADPECALDALS

SEQ ID NO: 641478 - protein, 21 aa, Mycobacterium
CGHVVLVPAISPLAEHRELAR

SEQ ID NO: 641479 - protein, 17 aa, Mycobacterium
CGIDDVYSACAPLVDKT

SEQ ID NO: 641480 - protein, 17 aa, Mycobacterium
CGIGLKTELIRSVLAEA

SEQ ID NO: 641481 - protein, 17 aa, Mycobacterium
CGILVLKRLSDAQRSGD

SEQ ID NO: 641482 - protein, 17 aa, Mycobacterium
CGILVLKRLSDAVRDGD

SEQ ID NO: 641483 - protein, 18 aa, Mycobacterium
CGIVELVELFGADEALPA

SEQ ID NO: 641484 - protein, 19 aa, Mycobacterium
CGIVPDTDALLLLSLLQVM

SEQ ID NO: 641485 - protein, 19 aa, Mycobacterium
CGKCDHHLSGMWTTQKTST

SEQ ID NO: 641486 - protein, 19 aa, Mycobacterium
CGKGDPPAGHFVNQYAIDL

SEQ ID NO: 641487 - protein, 27 aa, Mycobacterium
CGKSKKIAALPWFWSDQYDLKLQIAGL

SEQ ID NO: 641488 - protein, 25 aa, Mycobacterium
CGKSKKVAALPWFWSDQYDVKLQIA

SEQ ID NO: 641489 - protein, 24 aa, Mycobacterium
CGKSNLVRAIRMAFDPKYPFDPAV

SEQ ID NO: 641490 - protein, 17 aa, Mycobacterium
CGKTRFVEHMGSLLQRP

SEQ ID NO: 641491 - protein, 18 aa, Mycobacterium
CGKTRFVQAMAHELGREL

SEQ ID NO: 641492 - protein, 26 aa, Mycobacterium
CGKTRLVEHMGLLLGRPVVTISCHDD

SEQ ID NO: 641493 - protein, 17 aa, Mycobacterium
CGLDEPTGIVATDDVDA

SEQ ID NO: 641494 - protein, 25 aa, Mycobacterium
CGLDFARWYPWYRRTAAGLHFMRTH

SEQ ID NO: 641495 - protein, 25 aa, Mycobacterium
CGLEPNMRWRTFCAELLAIIEKLNV

SEQ ID NO: 641496 - protein, 26 aa, Mycobacterium
CGLLSEWRATLIVRESACLDIEHRRE

SEQ ID NO: 641497 - protein, 18 aa, Mycobacterium
CGLPASSIYWHFKDKDDL

SEQ ID NO: 641498 - protein, 21 aa, Mycobacterium
CGLPEELAELSVFRVALHQPR

SEQ ID NO: 641499 - protein, 24 aa, Mycobacterium
CGLPHALKFLLMLRGGARQTKSQG

SEQ ID NO: 641500 - protein, 19 aa, Mycobacterium
CGLPVQYTAIRIVGPDGED

SEQ ID NO: 641501 - protein, 20 aa, Mycobacterium
CGLQALPAGFAGTVVVTSGD

SEQ ID NO: 641502 - protein, 17 aa, Mycobacterium
CGLRCDPRNPAVPKIGT

SEQ ID NO: 641503 - protein, 19 aa, Mycobacterium
CGMDASLLRELNLLTTKPF

SEQ ID NO: 641504 - protein, 21 aa, Mycobacterium
CGNCTMVCPTCFCTSVEDVTD

SEQ ID NO: 641505 - protein, 21 aa, Mycobacterium
CGNDWPMARLTLALSPATLPK

SEQ ID NO: 641506 - protein, 19 aa, Mycobacterium
CGNEAAFQFRLTVTSGDSK

SEQ ID NO: 641507 - protein, 18 aa, Mycobacterium
CGNGVRVFAHYLRSVGLE

SEQ ID NO: 641508 - protein, 18 aa, Mycobacterium
CGNIDGLERVRFTSPHPA

SEQ ID NO: 641509 - protein, 21 aa, Mycobacterium
CGPCSEIYYDRGPDYGIDGGP

SEQ ID NO: 641510 - protein, 22 aa, Mycobacterium
CGPCSEIYYDRGPEYGIEGGPE

SEQ ID NO: 641511 - protein, 20 aa, Mycobacterium
CGPDDVLVRMRACGICGSDA

SEQ ID NO: 641512 - protein, 19 aa, Mycobacterium
CGPDFRWDPAADELHSRDR

SEQ ID NO: 641513 - protein, 17 aa, Mycobacterium
CGPDMPTVAVVDVDVPL

SEQ ID NO: 641514 - protein, 19 aa, Mycobacterium
CGPDTRFQPTLQMLTELDP

SEQ ID NO: 641515 - protein, 17 aa, Mycobacterium
CGPEGMLDDAQRTWADA

SEQ ID NO: 641516 - protein, 17 aa, Mycobacterium
CGPEPMLRFGAEALLTK

SEQ ID NO: 641517 - protein, 23 aa, Mycobacterium
CGPETRYQPTVAMLEALAQADGR

SEQ ID NO: 641518 - protein, 17 aa, Mycobacterium
CGPHHRLLQQGWTTRKR

SEQ ID NO: 641519 - protein, 19 aa, Mycobacterium
CGPHHRLLTPDGWTTRKNT

SEQ ID NO: 641520 - protein, 19 aa, Mycobacterium
CGQCPTCQAGMRNLCDLGA

SEQ ID NO: 641521 - protein, 17 aa, Mycobacterium
CGQRLAFENSACLSCGS

SEQ ID NO: 641522 - protein, 19 aa, Mycobacterium
CGQRLAFENSLCLSCGSAL

SEQ ID NO: 641523 - protein, 19 aa, Mycobacterium
CGQRLSFENSVCLNCKSAL

SEQ ID NO: 641524 - protein, 19 aa, Mycobacterium
CGQSACPTGTTPAPRPVVI

SEQ ID NO: 641525 - protein, 26 aa, Mycobacterium
CGRAYDPRFLFAWPSAKSAVMGGAQL

SEQ ID NO: 641526 - protein, 26 aa, Mycobacterium
CGRAYDPRFLFAWPTSKSAVMGGAQL

SEQ ID NO: 641527 - protein, 32 aa, Mycobacterium
CGRAYSPRFLWMWPNARISVMGGEQAASVLAT

SEQ ID NO: 641528 - protein, 33 aa, Mycobacterium
CGRAYSPRFMWMWPNARISVMGGEQAASVLATV

SEQ ID NO: 641529 - protein, 23 aa, Mycobacterium
CGRCEPCSRGMSNLCVLGAAIIA

SEQ ID NO: 641530 - protein, 21 aa, Mycobacterium
CGRGEVIGSFAREGGVASALW

SEQ ID NO: 641531 - protein, 24 aa, Mycobacterium
CGRRSEITSAWSIWCPECDSPDVE

SEQ ID NO: 641532 - protein, 24 aa, Mycobacterium
CGRRSEITSAWSIWCPHCDSPDVE

SEQ ID NO: 641533 - protein, 19 aa, Mycobacterium
CGRSAHTRRAYLGDLRLLF

SEQ ID NO: 641534 - protein, 20 aa, Mycobacterium
CGRSAHTRRAYLGDLRSLLD

SEQ ID NO: 641535 - protein, 20 aa, Mycobacterium
CGRSAHTRRAYLGDLRSLLT

SEQ ID NO: 641536 - protein, 27 aa, Mycobacterium
CGRSYSPRFLFTWPNSRSAVMGPAQLA

SEQ ID NO: 641537 - protein, 20 aa, Mycobacterium
CGRYEWLFAALRHELADWQY

SEQ ID NO: 641538 - protein, 17 aa, Mycobacterium
CGSACREVTPSARPPAE

SEQ ID NO: 641539 - protein, 20 aa, Mycobacterium
CGSAPAPIWLWHNVEDRLGI

SEQ ID NO: 641540 - protein, 22 aa, Mycobacterium
CGSCDFDLCAACGDDAVFADCP

SEQ ID NO: 641541 - protein, 19 aa, Mycobacterium
CGSCGATTFPVQQWCPRCS

SEQ ID NO: 641542 - protein, 20 aa, Mycobacterium
CGSCKELVGQVVEWAAGGAV

SEQ ID NO: 641543 - protein, 21 aa, Mycobacterium
CGSCPSCQAGLRNLCDLGAGL

SEQ ID NO: 641544 - protein, 20 aa, Mycobacterium
CGSDLPAFRGARGHLPGDDG

SEQ ID NO: 641545 - protein, 20 aa, Mycobacterium
CGSDLPAFRGARGRLPGDDG

SEQ ID NO: 641546 - protein, 26 aa, Mycobacterium
CGSILTGLTDLSWRGPASESMAASAA

SEQ ID NO: 641547 - protein, 21 aa, Mycobacterium
CGSTTRLFLHESLHDQVVSGL

SEQ ID NO: 641548 - protein, 19 aa, Mycobacterium
CGTCKALCETGSYDGGTYI

SEQ ID NO: 641549 - protein, 17 aa, Mycobacterium
CGTCRECRRGMTGSCNS

SEQ ID NO: 641550 - protein, 21 aa, Mycobacterium
CGTDVHCWEGSLAIPVGLPLI

SEQ ID NO: 641551 - protein, 19 aa, Mycobacterium
CGTERDLASAMNVLTYQSL

SEQ ID NO: 641552 - protein, 20 aa, Mycobacterium
CGTLTAGGLTIDLADGYPKV

SEQ ID NO: 641553 - protein, 20 aa, Mycobacterium
CGTSDMKAGDAVFLHLAATI

SEQ ID NO: 641554 - protein, 30 aa, Mycobacterium
CGTVSPTVFWPIPRVYSGLVRIDRYATSPW

SEQ ID NO: 641555 - protein, 18 aa, Mycobacterium
CGVAELSLSLAAQGYTVV

SEQ ID NO: 641556 - protein, 20 aa, Mycobacterium
CGVDVYPLQIGVGLEEVESF

SEQ ID NO: 641557 - protein, 20 aa, Mycobacterium
CGVEAMALYRHVHGRQDLLG

SEQ ID NO: 641558 - protein, 28 aa, Mycobacterium
CGVFMGGGLMTWAQLSAIYEPYNHTRRI

SEQ ID NO: 641559 - protein, 17 aa, Mycobacterium
CGVGCGISVETRTDPAS

SEQ ID NO: 641560 - protein, 25 aa, Mycobacterium
CGVHAGSPPACWRRAVGEPVGGSVA

SEQ ID NO: 641561 - protein, 19 aa, Mycobacterium
CGVNWPRVRVNGPLVRVAM

SEQ ID NO: 641562 - protein, 23 aa, Mycobacterium
CGVPAEQFLQIARKWTENSNRER

SEQ ID NO: 641563 - protein, 17 aa, Mycobacterium
CGVPGQRSGVTWSNLLK

SEQ ID NO: 641564 - protein, 17 aa, Mycobacterium
CGVPSLLEATAVYPDTL

SEQ ID NO: 641565 - protein, 18 aa, Mycobacterium
CGVPTGWGTSVYAGGVRP

SEQ ID NO: 641566 - protein, 17 aa, Mycobacterium
CGVPVVAGRSGGAPETV

SEQ ID NO: 641567 - protein, 19 aa, Mycobacterium
CGVQTRIGMEDTLRLPDGT

SEQ ID NO: 641568 - protein, 18 aa, Mycobacterium
CGVSTGWGSATISAGTEP

SEQ ID NO: 641569 - protein, 18 aa, Mycobacterium
CGVSTGWGSATVSAGTEP

SEQ ID NO: 641570 - protein, 22 aa, Mycobacterium
CGWAAIRPGPDFEMYRDYHDRE

SEQ ID NO: 641571 - protein, 25 aa, Mycobacterium
CGYDIPLDIIWHGGEPTLLPRTYFE

SEQ ID NO: 641572 - protein, 36 aa, Mycobacterium
CGYWKRSGLTASRFVACPFGAPGSRMYRTGDLVCWG

SEQ ID NO: 641573 - protein, 20 aa, Mycobacterium
CHAIGSSIRWRTRADQITSS

SEQ ID NO: 641574 - protein, 18 aa, Mycobacterium
CHAPSLHNSQPWRWIAVG

SEQ ID NO: 641575 - protein, 21 aa, Mycobacterium
CHARGKPLIVDEAWGAHLPFH

SEQ ID NO: 641576 - protein, 19 aa, Mycobacterium
CHDAFKLGLETAVASGRLG

SEQ ID NO: 641577 - protein, 21 aa, Mycobacterium
CHDAYRWLRLGGYDPEQIVLA

SEQ ID NO: 641578 - protein, 20 aa, Mycobacterium
CHDGYRWLRLLGYDPEQIVL

SEQ ID NO: 641579 - protein, 26 aa, Mycobacterium
CHEAFRAEWLLSFLAADVRRDGPHDL

SEQ ID NO: 641580 - protein, 24 aa, Mycobacterium
CHELGRRGLKVAVLDVNEHAAQRV

SEQ ID NO: 641581 - protein, 19 aa, Mycobacterium
CHELMALDFKSHIFQSFAE

SEQ ID NO: 641582 - protein, 18 aa, Mycobacterium
CHELMALNFASHLFQSFA

SEQ ID NO: 641583 - protein, 18 aa, Mycobacterium
CHFPRPGWKLPRRETASQ

SEQ ID NO: 641584 - protein, 21 aa, Mycobacterium
CHGDLCLPNIVIAPGDFSVAG

SEQ ID NO: 641585 - protein, 25 aa, Mycobacterium
CHGLQCGFCTPGMMITARALLDRNP

SEQ ID NO: 641586 - protein, 25 aa, Mycobacterium
CHGLQCGFCTPGMMITARALLRQNP

SEQ ID NO: 641587 - protein, 19 aa, Mycobacterium
CHGVDRFTRVCDVAITDFV

SEQ ID NO: 641588 - protein, 17 aa, Mycobacterium
CHGYCGLLNTKLSDGSL

SEQ ID NO: 641589 - protein, 23 aa, Mycobacterium
CHHYAGPHLPPFGTRAAAEFLGS

SEQ ID NO: 641590 - protein, 17 aa, Mycobacterium
CHLGPELGGPGYGQLKL

SEQ ID NO: 641591 - protein, 23 aa, Mycobacterium
CHLSSRILVPAKRYAEFVSAIAE

SEQ ID NO: 641592 - protein, 20 aa, Mycobacterium
CHLYVRRARSGLQLFGDSGL

SEQ ID NO: 641593 - protein, 25 aa, Mycobacterium
CHPAIRPGGFAAFAVVDGNSETLAV

SEQ ID NO: 641594 - protein, 25 aa, Mycobacterium
CHPAIRPGGIAAFAVDAGDVGDVEG

SEQ ID NO: 641595 - protein, 20 aa, Mycobacterium
CHQVNLEYLSRVVFTRQGPE

SEQ ID NO: 641596 - protein, 21 aa, Mycobacterium
CHRYGTTKETLGWIALNQRAN

SEQ ID NO: 641597 - protein, 17 aa, Mycobacterium
CHTCTRRKTSGTVRNLV

SEQ ID NO: 641598 - protein, 17 aa, Mycobacterium
CHVCVTGVVAGRATYRQ

SEQ ID NO: 641599 - protein, 19 aa, Mycobacterium
CIAAGVFGAMEFWMLGDDR

SEQ ID NO: 641600 - protein, 25 aa, Mycobacterium
CIAAKRFIAHADIYDAFVDKFVEQM

SEQ ID NO: 641601 - protein, 25 aa, Mycobacterium
CIAAKRFIAHADIYDAFVDKFVERM

SEQ ID NO: 641602 - protein, 19 aa, Mycobacterium
CIAAKRFIAHRDIYDDFLS

SEQ ID NO: 641603 - protein, 21 aa, Mycobacterium
CIAAKRFIVHTDIYDAFVDKF

SEQ ID NO: 641604 - protein, 24 aa, Mycobacterium
CIAAKRFIVHTDIYDAFVDKFTER

SEQ ID NO: 641605 - protein, 18 aa, Mycobacterium
CIACDVCITVCPTDVFDR

SEQ ID NO: 641606 - protein, 21 aa, Mycobacterium
CIAGGRLTVGLGVGNRTDDYA

SEQ ID NO: 641607 - protein, 28 aa, Mycobacterium
CIAKELDIRFSLYYTLEEFAQTFAHLAA

SEQ ID NO: 641608 - protein, 19 aa, Mycobacterium
CIDEFSWARIAEQTLQIYR

SEQ ID NO: 641609 - protein, 20 aa, Mycobacterium
CIEACPTRALTMINDYEMAD

SEQ ID NO: 641610 - protein, 17 aa, Mycobacterium
CIECFLCQDVCHVIRDH

SEQ ID NO: 641611 - protein, 23 aa, Mycobacterium
CIECGSCMTGCRYGAKNTLLKNY

SEQ ID NO: 641612 - protein, 23 aa, Mycobacterium
CIECGSCMTGCRYGAKNTLVKNY

SEQ ID NO: 641613 - protein, 18 aa, Mycobacterium
CIEEFSWAQVAGQTLDVY

SEQ ID NO: 641614 - protein, 21 aa, Mycobacterium
CIEVRLTPLGLHRVSGLAMDA

SEQ ID NO: 641615 - protein, 25 aa, Mycobacterium
CIFDTRAGLIVSMRLYGDTRATASA

SEQ ID NO: 641616 - protein, 18 aa, Mycobacterium
CIHTATFFPEPGAADYVR

SEQ ID NO: 641617 - protein, 25 aa, Mycobacterium
CILCAACTTSCPVFWHEGSYYGPAA

SEQ ID NO: 641618 - protein, 21 aa, Mycobacterium
CILCACCTTSCPVYWSEGSYF

SEQ ID NO: 641619 - protein, 20 aa, Mycobacterium
CILGYHDIDHAVELANDTDY

SEQ ID NO: 641620 - protein, 19 aa, Mycobacterium
CILHSRLLLPDSLHDDVVD

SEQ ID NO: 641621 - protein, 20 aa, Mycobacterium
CILHSRLLLPDSLHDDVVDR

SEQ ID NO: 641622 - protein, 20 aa, Mycobacterium
CILHSRLLLPEAMHDEIVDR

SEQ ID NO: 641623 - protein, 24 aa, Mycobacterium
CILSKRQWHGMFALMGSPEEFADP

SEQ ID NO: 641624 - protein, 18 aa, Mycobacterium
CINLSPTNAKWFFDNFGS

SEQ ID NO: 641625 - protein, 17 aa, Mycobacterium
CINPFFHNFGYKAGILA

SEQ ID NO: 641626 - protein, 19 aa, Mycobacterium
CIRCSACLNVCPVYERAGG

SEQ ID NO: 641627 - protein, 20 aa, Mycobacterium
CIRCSACLNVCPVYERTGGH

SEQ ID NO: 641628 - protein, 17 aa, Mycobacterium
CIRTIHHLDQFKTPVLA

SEQ ID NO: 641629 - protein, 18 aa, Mycobacterium
CIRVRHSSDLAVLAHTAA

SEQ ID NO: 641630 - protein, 19 aa, Mycobacterium
CITILPLQHPIVLAKALAT

SEQ ID NO: 641631 - protein, 18 aa, Mycobacterium
CITLDYDKMRGMDSDEYR

SEQ ID NO: 641632 - protein, 20 aa, Mycobacterium
CITVLPLQHPIVLAKALATA

SEQ ID NO: 641633 - protein, 23 aa, Mycobacterium
CIVPRAAVDDVEFGGHTFPAGTL

SEQ ID NO: 641634 - protein, 30 aa, Mycobacterium
CIWHAVCWGIIIPSGWWRTRDTALYRYLWR

SEQ ID NO: 641635 - protein, 24 aa, Mycobacterium
CIYLPDGSLGFGFERPHVSTNDVV

SEQ ID NO: 641636 - protein, 18 aa, Mycobacterium
CKAARVRVIVKLVSSEGI

SEQ ID NO: 641637 - protein, 22 aa, Mycobacterium
CKAKQWGIDSFLFFPNFMLLIW

SEQ ID NO: 641638 - protein, 19 aa, Mycobacterium
CKAMARGGIYDQLSGGFAR

SEQ ID NO: 641639 - protein, 20 aa, Mycobacterium
CKAMSRLGGVTMAKAGLRLQ

SEQ ID NO: 641640 - protein, 27 aa, Mycobacterium
CKASLERLGLDYVDLYLIHWPAPAVGK

SEQ ID NO: 641641 - protein, 18 aa, Mycobacterium
CKCYCRLHHLIKTFWPGF

SEQ ID NO: 641642 - protein, 22 aa, Mycobacterium
CKFEPRHAAFERFLSFGDVCTH

SEQ ID NO: 641643 - protein, 17 aa, Mycobacterium
CKGGFLAVDGRSKPFSA

SEQ ID NO: 641644 - protein, 26 aa, Mycobacterium
CKGIDSFCPIGPWIVTADEIPNPHDL

SEQ ID NO: 641645 - protein, 24 aa, Mycobacterium
CKGVKEPVLSRVFEYWRNVDPDLG

SEQ ID NO: 641646 - protein, 20 aa, Mycobacterium
CKLLAAEGLLALAWPKEHGG

SEQ ID NO: 641647 - protein, 19 aa, Mycobacterium
CKLSFAETRVRAQSLVPEL

SEQ ID NO: 641648 - protein, 17 aa, Mycobacterium
CKNVIALACGMAVGVGL

SEQ ID NO: 641649 - protein, 17 aa, Mycobacterium
CKPDCVVYAASGPERDG

SEQ ID NO: 641650 - protein, 20 aa, Mycobacterium
CKPDHKLAGNGWQTTKLPNG

SEQ ID NO: 641651 - protein, 21 aa, Mycobacterium
CKPKPSDKVLIFGAGPIGLGA

SEQ ID NO: 641652 - protein, 17 aa, Mycobacterium
CKRVEVWSWQDGPENAL

SEQ ID NO: 641653 - protein, 18 aa, Mycobacterium
CKSAPLDAGSGFPPIGSP

SEQ ID NO: 641654 - protein, 17 aa, Mycobacterium
CKSNVLYKGALQGDPGS

SEQ ID NO: 641655 - protein, 18 aa, Mycobacterium
CKSVFAAAPAIVPETLVV

SEQ ID NO: 641656 - protein, 17 aa, Mycobacterium
CKTGIRSAEVLAIVKKA

SEQ ID NO: 641657 - protein, 18 aa, Mycobacterium
CKVLLEIGPQPVLTAAAL

SEQ ID NO: 641658 - protein, 17 aa, Mycobacterium
CLAELAMKPPSLYDTEL

SEQ ID NO: 641659 - protein, 20 aa, Mycobacterium
CLAHIGGLLSRQRSGVRVMH

SEQ ID NO: 641660 - protein, 17 aa, Mycobacterium
CLALIGAGVDDWGGVSP

SEQ ID NO: 641661 - protein, 24 aa, Mycobacterium
CLASPPEVWDCVEAESLSADLGAA

SEQ ID NO: 641662 - protein, 18 aa, Mycobacterium
CLASRFAFVEGERAQVES

SEQ ID NO: 641663 - protein, 25 aa, Mycobacterium
CLDAAAWCAAGWYYRALGRPAAPRG

SEQ ID NO: 641664 - protein, 19 aa, Mycobacterium
CLDAGVKVGCFRPPTVPAG

SEQ ID NO: 641665 - protein, 25 aa, Mycobacterium
CLDAPDVRAAHAFWSTVFSAKVSDW

SEQ ID NO: 641666 - protein, 20 aa, Mycobacterium
CLDGDCPSFVTVEVTPGRAR

SEQ ID NO: 641667 - protein, 19 aa, Mycobacterium
CLDGNCPSFVTVEMPATKG

SEQ ID NO: 641668 - protein, 26 aa, Mycobacterium
CLDITVQWCRDRETFGRPLISRQAVQ

SEQ ID NO: 641669 - protein, 26 aa, Mycobacterium
CLDITVQWCRDRETFGRPLISRQSVQ

SEQ ID NO: 641670 - protein, 22 aa, Mycobacterium
CLDKYTRLFASLRTWERHTDIA

SEQ ID NO: 641671 - protein, 21 aa, Mycobacterium
CLDRYARLFAALTTWERHTDI

SEQ ID NO: 641672 - protein, 18 aa, Mycobacterium
CLDVDWVVGGCMSVDPAH

SEQ ID NO: 641673 - protein, 19 aa, Mycobacterium
CLEPSDLAGFAIDEAEVVY

SEQ ID NO: 641674 - protein, 21 aa, Mycobacterium
CLETPVPYFAVGQGYRNFTQT

SEQ ID NO: 641675 - protein, 19 aa, Mycobacterium
CLGATFAMVEMRVVLREIL

SEQ ID NO: 641676 - protein, 20 aa, Mycobacterium
CLGDPDWRTGLDRATPLVRD

SEQ ID NO: 641677 - protein, 24 aa, Mycobacterium
CLGSNLARLEFRVGVEQTLQRIPD

SEQ ID NO: 641678 - protein, 23 aa, Mycobacterium
CLHHYAWTRDRLVVVTLADVASR

SEQ ID NO: 641679 - protein, 18 aa, Mycobacterium
CLHKASPIVGLPSIAAAS

SEQ ID NO: 641680 - protein, 23 aa, Mycobacterium
CLHKTRHGRFAPRHHARRGLAAH

SEQ ID NO: 641681 - protein, 17 aa, Mycobacterium
CLHQHKIDHVAHLGPSV

SEQ ID NO: 641682 - protein, 19 aa, Mycobacterium
CLIAKDCPSFGLGPTEAPL

SEQ ID NO: 641683 - protein, 19 aa, Mycobacterium
CLIESGLAYGVLPLSACGR

SEQ ID NO: 641684 - protein, 21 aa, Mycobacterium
CLIGAAGRFGGMFSGADGEQV

SEQ ID NO: 641685 - protein, 19 aa, Mycobacterium
CLIGVALPKPGVTTNVITA

SEQ ID NO: 641686 - protein, 20 aa, Mycobacterium
CLLPAADLETLFAPPTPVDA

SEQ ID NO: 641687 - protein, 19 aa, Mycobacterium
CLLTPPPWYPILRGTTQQA

SEQ ID NO: 641688 - protein, 19 aa, Mycobacterium
CLNVGCIPSKALLRNAELA

SEQ ID NO: 641689 - protein, 25 aa, Mycobacterium
CLNVGCIPTKMFVYAAEVAHSVRTS

SEQ ID NO: 641690 - protein, 25 aa, Mycobacterium
CLNVGCIPTKMFVYAAEVAQSIREA

SEQ ID NO: 641691 - protein, 19 aa, Mycobacterium
CLPDLPAEIRAERNIMARN

SEQ ID NO: 641692 - protein, 23 aa, Mycobacterium
CLPDWRVRFRLDRNVALADAIEH

SEQ ID NO: 641693 - protein, 22 aa, Mycobacterium
CLPGHRAAELSHFIEVADAVGL

SEQ ID NO: 641694 - protein, 20 aa, Mycobacterium
CLPSQWMRRLTSQRLNTLGA

SEQ ID NO: 641695 - protein, 24 aa, Mycobacterium
CLQEGRSVILDGTWRDPQSRARAH

SEQ ID NO: 641696 - protein, 25 aa, Mycobacterium
CLQGEFGPNLAIMARHGFEVRTLPL

SEQ ID NO: 641697 - protein, 17 aa, Mycobacterium
CLQRAGCDPGELDLVVN

SEQ ID NO: 641698 - protein, 18 aa, Mycobacterium
CLRDMGLMLGEYWDLTAL

SEQ ID NO: 641699 - protein, 20 aa, Mycobacterium
CLRSRLRLTTEEERREIIAI

SEQ ID NO: 641700 - protein, 22 aa, Mycobacterium
CLSCKGCLSDCPVNVDMATYKA

SEQ ID NO: 641701 - protein, 19 aa, Mycobacterium
CLSMTKCALFNPADILADD

SEQ ID NO: 641702 - protein, 19 aa, Mycobacterium
CLTAGLTLMRIRSRHHGCG

SEQ ID NO: 641703 - protein, 24 aa, Mycobacterium
CLTCGNCTMVCPTCFCTSTEDVSD

SEQ ID NO: 641704 - protein, 24 aa, Mycobacterium
CLTCGNCTMVCPTCYCTSTEDVTD

SEQ ID NO: 641705 - protein, 27 aa, Mycobacterium
CLTDLIRFGSLFLRDGTSLTGQQVVPA

SEQ ID NO: 641706 - protein, 19 aa, Mycobacterium
CLTFGAKQLHDWHNPTAGE

SEQ ID NO: 641707 - protein, 18 aa, Mycobacterium
CLTLDYDKMRGMDNDEYR

SEQ ID NO: 641708 - protein, 18 aa, Mycobacterium
CLTLDYDKMRGMDSDEFR

SEQ ID NO: 641709 - protein, 26 aa, Mycobacterium
CLTMARDLGSLGIRALAIAPSLFATG

SEQ ID NO: 641710 - protein, 25 aa, Mycobacterium
CLTMARDLGSVGIRVLGIAPSLFAT

SEQ ID NO: 641711 - protein, 19 aa, Mycobacterium
CLTPSFSASRFLSDIRYFG

SEQ ID NO: 641712 - protein, 28 aa, Mycobacterium
CLTVAGSLRASREWGLPHDLLDGKEVRA

SEQ ID NO: 641713 - protein, 19 aa, Mycobacterium
CLVARVGVRVIQARQVPAA

SEQ ID NO: 641714 - protein, 19 aa, Mycobacterium
CLVIEAVGALAAVESRIDT

SEQ ID NO: 641715 - protein, 18 aa, Mycobacterium
CLVNSVAHALRFRPFASV

SEQ ID NO: 641716 - protein, 23 aa, Mycobacterium
CLVPGCGFGQHRYRLCYTHSHAW

SEQ ID NO: 641717 - protein, 19 aa, Mycobacterium
CLYKGGVDVLRMFVGEMDD

SEQ ID NO: 641718 - protein, 22 aa, Mycobacterium
CMDARLDVYRLLGLNEGEAHVI

SEQ ID NO: 641719 - protein, 20 aa, Mycobacterium
CMDNGMPILVFNLLTDGNIA

SEQ ID NO: 641720 - protein, 20 aa, Mycobacterium
CMDNGMPILVFNLLTSGNIA

SEQ ID NO: 641721 - protein, 17 aa, Mycobacterium
CMEELRRRDDLLLVAGM

SEQ ID NO: 641722 - protein, 22 aa, Mycobacterium
CMEGICGTCEVAVLEGSPDHRD

SEQ ID NO: 641723 - protein, 26 aa, Mycobacterium
CMETEVGFDPAVWRRAADELGLQGLA

SEQ ID NO: 641724 - protein, 18 aa, Mycobacterium
CMGAERLRGLRGVEALLP

SEQ ID NO: 641725 - protein, 18 aa, Mycobacterium
CMGGRISVLLAGRQPDRV

SEQ ID NO: 641726 - protein, 24 aa, Mycobacterium
CMGYEIAGGIGVRMAAPDRDVFVM

SEQ ID NO: 641727 - protein, 24 aa, Mycobacterium
CMGYEIAGGIGVRMASPDRDVFVM

SEQ ID NO: 641728 - protein, 18 aa, Mycobacterium
CMHIFGGAGYLIDETPLG

SEQ ID NO: 641729 - protein, 21 aa, Mycobacterium
CMLDADFLIDVGFVVVGPHPY

SEQ ID NO: 641730 - protein, 26 aa, Mycobacterium
CMLFCAPPPPPAEPFNPFAPQPPAEP

SEQ ID NO: 641731 - protein, 24 aa, Mycobacterium
CMRLGAIFVPLNFRLARPELEFLC

SEQ ID NO: 641732 - protein, 24 aa, Mycobacterium
CMRLGALFVPLNWRLHTTEIQEIC

SEQ ID NO: 641733 - protein, 24 aa, Mycobacterium
CMSRRPNALDSYGQVIGMVSGRQP

SEQ ID NO: 641734 - protein, 30 aa, Mycobacterium
CMSTGFCVWANRMAIEYLLTAATEYSMAAV

SEQ ID NO: 641735 - protein, 20 aa, Mycobacterium
CNAAKRFIVNESIYDDFLAK

SEQ ID NO: 641736 - protein, 19 aa, Mycobacterium
CNAAKRFIVVDELYDAFVE

SEQ ID NO: 641737 - protein, 25 aa, Mycobacterium
CNAGCPAGENIQAWLAHARVGENER

SEQ ID NO: 641738 - protein, 20 aa, Mycobacterium
CNALPRRGISALRRRPKRRP

SEQ ID NO: 641739 - protein, 20 aa, Mycobacterium
CNAMSRLGGVTMSKAGLRLQ

SEQ ID NO: 641740 - protein, 20 aa, Mycobacterium
CNECPVRAHCAAHAIRTDEP

SEQ ID NO: 641741 - protein, 23 aa, Mycobacterium
CNELAQACGFGVLLDEQRLPVAP

SEQ ID NO: 641742 - protein, 23 aa, Mycobacterium
CNELAQACGLGVLLEEQRLPVAP

SEQ ID NO: 641743 - protein, 22 aa, Mycobacterium
CNEVYRRVCAALAEALSQHNVV

SEQ ID NO: 641744 - protein, 20 aa, Mycobacterium
CNGATIRLATGFHIGYALSH

SEQ ID NO: 641745 - protein, 21 aa, Mycobacterium
CNGVRVWSLYVPNGRTLEDPH

SEQ ID NO: 641746 - protein, 18 aa, Mycobacterium
CNHLEIRGGIAALGSQRT

SEQ ID NO: 641747 - protein, 19 aa, Mycobacterium
CNLAGELSDGFVCHPTNSH

SEQ ID NO: 641748 - protein, 20 aa, Mycobacterium
CNLFDMCAIAIPAGTTSDGA

SEQ ID NO: 641749 - protein, 17 aa, Mycobacterium
CNLKWTTLAGIGMVESH

SEQ ID NO: 641750 - protein, 17 aa, Mycobacterium
CNLRCNYCMPAEGLDWL

SEQ ID NO: 641751 - protein, 18 aa, Mycobacterium
CNLSTFPVVPVKNTGLRF

SEQ ID NO: 641752 - protein, 30 aa, Mycobacterium
CNNPFGGPVGRIFAAAGFRRSRKNPNLCER

SEQ ID NO: 641753 - protein, 17 aa, Mycobacterium
CNPRATSGILLFDPQTG

SEQ ID NO: 641754 - protein, 21 aa, Mycobacterium
CNPYLTFAVLLAAGLRGVEKG

SEQ ID NO: 641755 - protein, 22 aa, Mycobacterium
CNQEFGSLASWLVDVINILTGH

SEQ ID NO: 641756 - protein, 22 aa, Mycobacterium
CNQEFGSLASWLVDVVNILTGH

SEQ ID NO: 641757 - protein, 25 aa, Mycobacterium
CNQKIKFSALSARAVALGFDTVATG

SEQ ID NO: 641758 - protein, 23 aa, Mycobacterium
CNRCPVTAECLSWALESGQDAGV

SEQ ID NO: 641759 - protein, 24 aa, Mycobacterium
CNRCPVTTECLGWALNTGQDSGVW

SEQ ID NO: 641760 - protein, 21 aa, Mycobacterium
CNRCPVTTECLSWALESGQDA

SEQ ID NO: 641761 - protein, 24 aa, Mycobacterium
CNRCPVTTECLSWALNTGQDSGVW

SEQ ID NO: 641762 - protein, 25 aa, Mycobacterium
CNRSKLSEMPALWAYARDLFQTPGF

SEQ ID NO: 641763 - protein, 29 aa, Mycobacterium
CNSPAALTRPDLAFDMVRPGIAVYGQTPI

SEQ ID NO: 641764 - protein, 17 aa, Mycobacterium
CNTLTLWSARAIQSLAL

SEQ ID NO: 641765 - protein, 22 aa, Mycobacterium
CNYAKEAPGWSVIITETSDGEH

SEQ ID NO: 641766 - protein, 22 aa, Mycobacterium
CNYPPGMLRQFDAVLGTGSLLG

SEQ ID NO: 641767 - protein, 21 aa, Mycobacterium
CPAAHELARGLSLPGTNVRRH

SEQ ID NO: 641768 - protein, 18 aa, Mycobacterium
CPACGSPYSFLPQLNPGD

SEQ ID NO: 641769 - protein, 24 aa, Mycobacterium
CPAFDRYDLTSLRKGYYGASAMPR

SEQ ID NO: 641770 - protein, 20 aa, Mycobacterium
CPAGAMLVFDSTLWHAAGQN

SEQ ID NO: 641771 - protein, 18 aa, Mycobacterium
CPAHVPGFGVLAAESARA

SEQ ID NO: 641772 - protein, 23 aa, Mycobacterium
CPAPCEASCVLGINQDPVTIKQV

SEQ ID NO: 641773 - protein, 23 aa, Mycobacterium
CPAPCEGSCVLGINQDPVTIKQV

SEQ ID NO: 641774 - protein, 23 aa, Mycobacterium
CPAPPPRELDMLLTAGERMSNAL

SEQ ID NO: 641775 - protein, 20 aa, Mycobacterium
CPCRWLCAREAVESPGAEGL

SEQ ID NO: 641776 - protein, 27 aa, Mycobacterium
CPDEFRRPDLRLALMDRQGVYGAVMFP

SEQ ID NO: 641777 - protein, 23 aa, Mycobacterium
CPDGSSGMVRWMVRQLAEKGDKI

SEQ ID NO: 641778 - protein, 21 aa, Mycobacterium
CPDHRPIGIDLREDWPSALRQ

SEQ ID NO: 641779 - protein, 18 aa, Mycobacterium
CPDLDTCMYTLGGGVDPE

SEQ ID NO: 641780 - protein, 17 aa, Mycobacterium
CPDQFLGAHVKRVTGRQ

SEQ ID NO: 641781 - protein, 19 aa, Mycobacterium
CPDQFLGAHVRRVTGRQNL

SEQ ID NO: 641782 - protein, 18 aa, Mycobacterium
CPDRRLTYAQLRDEVRRA

SEQ ID NO: 641783 - protein, 28 aa, Mycobacterium
CPDSWACYSHPVCEALLLTVAPVVRQVS

SEQ ID NO: 641784 - protein, 20 aa, Mycobacterium
CPDVRPHPRVLTVADTEYGR

SEQ ID NO: 641785 - protein, 19 aa, Mycobacterium
CPEALAPLQAGQVRVAVAA

SEQ ID NO: 641786 - protein, 21 aa, Mycobacterium
CPELEVSPCPAARNLTAQRYA

SEQ ID NO: 641787 - protein, 23 aa, Mycobacterium
CPELTPPHARLLARAAIGLITDI

SEQ ID NO: 641788 - protein, 22 aa, Mycobacterium
CPEMAPDGWNLYVGTSVPENPT

SEQ ID NO: 641789 - protein, 18 aa, Mycobacterium
CPEPAPLSPELIREMMDW

SEQ ID NO: 641790 - protein, 18 aa, Mycobacterium
CPEPQPLSIDLIREMMDW

SEQ ID NO: 641791 - protein, 21 aa, Mycobacterium
CPEREVSPCPAVRDADAQTYA

SEQ ID NO: 641792 - protein, 24 aa, Mycobacterium
CPEVIDAGGKWVLPGFVDIHTHYD

SEQ ID NO: 641793 - protein, 22 aa, Mycobacterium
CPFCEATCGLTLTIDDGRVVGA

SEQ ID NO: 641794 - protein, 17 aa, Mycobacterium
CPFGFGASINRSIGSTT

SEQ ID NO: 641795 - protein, 20 aa, Mycobacterium
CPFRGRCGYNAVATGATHGI

SEQ ID NO: 641796 - protein, 24 aa, Mycobacterium
CPGARTRLSTGLEYERHIEDLHRR

SEQ ID NO: 641797 - protein, 20 aa, Mycobacterium
CPGWTLKQLLRHVGRGERWA

SEQ ID NO: 641798 - protein, 21 aa, Mycobacterium
CPGWVGITRWLKPVLSTRLGE

SEQ ID NO: 641799 - protein, 29 aa, Mycobacterium
CPHAAASCDCRKPGAGMLVRAAREHGFAL

SEQ ID NO: 641800 - protein, 19 aa, Mycobacterium
CPHAANSCDCRKPGTGMLV

SEQ ID NO: 641801 - protein, 17 aa, Mycobacterium
CPHCRSLDWDTVESSGR

SEQ ID NO: 641802 - protein, 30 aa, Mycobacterium
CPHEETRELLGILCDLYALSVIEDDKAWYI

SEQ ID NO: 641803 - protein, 19 aa, Mycobacterium
CPHQGGPLCSGRARGRTIV

SEQ ID NO: 641804 - protein, 19 aa, Mycobacterium
CPHRGGPLADGLADDCVIV

SEQ ID NO: 641805 - protein, 25 aa, Mycobacterium
CPICRKEQLTLVSWVFGDHLGPVSG

SEQ ID NO: 641806 - protein, 19 aa, Mycobacterium
CPIQRIADYGDWLQRFETA

SEQ ID NO: 641807 - protein, 19 aa, Mycobacterium
CPISMTYAVVPALRYNPEL

SEQ ID NO: 641808 - protein, 17 aa, Mycobacterium
CPKCQQEAPIVAKAAAA

SEQ ID NO: 641809 - protein, 20 aa, Mycobacterium
CPKSFWRIDVAPLSRIALHY

SEQ ID NO: 641810 - protein, 19 aa, Mycobacterium
CPKSIAFEAQLPRTDTGKL

SEQ ID NO: 641811 - protein, 23 aa, Mycobacterium
CPLHGSCFDSGGSVLWGPATEPL

SEQ ID NO: 641812 - protein, 20 aa, Mycobacterium
CPLLDLPIVSPYLGRRYTEC

SEQ ID NO: 641813 - protein, 19 aa, Mycobacterium
CPLLGTWQSIVLVDLNRDN

SEQ ID NO: 641814 - protein, 17 aa, Mycobacterium
CPLLYRLRAIDRLPEPP

SEQ ID NO: 641815 - protein, 20 aa, Mycobacterium
CPLQDLHIVSPYLGREYTEC

SEQ ID NO: 641816 - protein, 18 aa, Mycobacterium
CPNCERAYCPAPQFCSRC

SEQ ID NO: 641817 - protein, 17 aa, Mycobacterium
CPPAAGVGRMAVRDIDV

SEQ ID NO: 641818 - protein, 19 aa, Mycobacterium
CPPDGASNRSPIRYLNDGV

SEQ ID NO: 641819 - protein, 20 aa, Mycobacterium
CPPEDLAPLAGRLQPLRAAA

SEQ ID NO: 641820 - protein, 24 aa, Mycobacterium
CPPESVRAAFHYVRSGQTVIPETL

SEQ ID NO: 641821 - protein, 21 aa, Mycobacterium
CPPRDVTRLAAAIRTVLDDPR

SEQ ID NO: 641822 - protein, 18 aa, Mycobacterium
CPQYLYLSLEDNLGAPGF

SEQ ID NO: 641823 - protein, 18 aa, Mycobacterium
CPQYLYLSLEEQLAAPGF

SEQ ID NO: 641824 - protein, 24 aa, Mycobacterium
CPRAGPPPPPAIRLASTALPATSA

SEQ ID NO: 641825 - protein, 18 aa, Mycobacterium
CPRCVAVADYVFIEPAEP

SEQ ID NO: 641826 - protein, 19 aa, Mycobacterium
CPRSISFELQLPRTDTGKL

SEQ ID NO: 641827 - protein, 17 aa, Mycobacterium
CPRSVEFDAELPRDPNG

SEQ ID NO: 641828 - protein, 28 aa, Mycobacterium
CPSGAFTLFSMTRILTWGKYQSPEHVRG

SEQ ID NO: 641829 - protein, 22 aa, Mycobacterium
CPSGLDFLAGFFGCVYAGAAAV

SEQ ID NO: 641830 - protein, 18 aa, Mycobacterium
CPSIAGFCFLKRHRGDVL

SEQ ID NO: 641831 - protein, 18 aa, Mycobacterium
CPTCGSCSGMFTANSMNC

SEQ ID NO: 641832 - protein, 19 aa, Mycobacterium
CPTDITVFLIEAENVDFGA

SEQ ID NO: 641833 - protein, 19 aa, Mycobacterium
CPVCGGSGLRAEALAVTFA

SEQ ID NO: 641834 - protein, 17 aa, Mycobacterium
CPVERVWQTVTTQEGIN

SEQ ID NO: 641835 - protein, 18 aa, Mycobacterium
CPVHAIAEVGERTSPSAH

SEQ ID NO: 641836 - protein, 18 aa, Mycobacterium
CPVHAILNIGERRPDQTP

SEQ ID NO: 641837 - protein, 19 aa, Mycobacterium
CPVLHELTLMAPLAISESG

SEQ ID NO: 641838 - protein, 20 aa, Mycobacterium
CPVRRQCLAAALERAEPWGV

SEQ ID NO: 641839 - protein, 20 aa, Mycobacterium
CPVVSPGKLFDEWFPASRLV

SEQ ID NO: 641840 - protein, 20 aa, Mycobacterium
CPVVTPATLFDEWFPANKLV

SEQ ID NO: 641841 - protein, 25 aa, Mycobacterium
CPVWREPAHGVVMVSGYDEALAVQR

SEQ ID NO: 641842 - protein, 17 aa, Mycobacterium
CPWHSDAEWIRIKQDER

SEQ ID NO: 641843 - protein, 19 aa, Mycobacterium
CPYFPGKRYENWELADPAG

SEQ ID NO: 641844 - protein, 19 aa, Mycobacterium
CPYHGWTYDNGGRLVGLPG

SEQ ID NO: 641845 - protein, 17 aa, Mycobacterium
CPYPVTWDEADAKLRDV

SEQ ID NO: 641846 - protein, 24 aa, Mycobacterium
CQAIWRLDGGYCAASDPRRDGQAA

SEQ ID NO: 641847 - protein, 17 aa, Mycobacterium
CQALRLNECDLALAGGA

SEQ ID NO: 641848 - protein, 30 aa, Mycobacterium
CQALVFKHGIQLFGAMGFTWENDLQFALKR

SEQ ID NO: 641849 - protein, 24 aa, Mycobacterium
CQAPAEVWETLQLGNCGPPIETGE

SEQ ID NO: 641850 - protein, 33 aa, Mycobacterium
CQDFAHLSLIVLRGMGIPARYVSGYLHPKRNAV

SEQ ID NO: 641851 - protein, 34 aa, Mycobacterium
CQDFAHLTLMVLRGMGIPSRYVSGYLHPKKNAKV

SEQ ID NO: 641852 - protein, 20 aa, Mycobacterium
CQDFARLAIACLRANGLAAC

SEQ ID NO: 641853 - protein, 22 aa, Mycobacterium
CQDSALSWMDWELATANADLLQ

SEQ ID NO: 641854 - protein, 18 aa, Mycobacterium
CQEFITQLGRNFQVIHEQ

SEQ ID NO: 641855 - protein, 23 aa, Mycobacterium
CQELLDYRCDLALAGGVSLNPHP

SEQ ID NO: 641856 - protein, 17 aa, Mycobacterium
CQFAVGLSRQLYGRTIA

SEQ ID NO: 641857 - protein, 21 aa, Mycobacterium
CQGFYCGAHTEALLEALLETG

SEQ ID NO: 641858 - protein, 18 aa, Mycobacterium
CQGHTLCSMIAPEAFRLD

SEQ ID NO: 641859 - protein, 23 aa, Mycobacterium
CQGLARVDFFLAEDGPLINEINT

SEQ ID NO: 641860 - protein, 24 aa, Mycobacterium
CQGLCPDCGVALEDAEPGHHHEKI

SEQ ID NO: 641861 - protein, 25 aa, Mycobacterium
CQGPCGATATLLQHRFWSAESGLEL

SEQ ID NO: 641862 - protein, 22 aa, Mycobacterium
CQKRFEWQLGDLPKGYDHKYIY

SEQ ID NO: 641863 - protein, 20 aa, Mycobacterium
CQKRHHLPGLDFVRGDAENL

SEQ ID NO: 641864 - protein, 22 aa, Mycobacterium
CQLLDRRVRPVVEVAMIDAEID

SEQ ID NO: 641865 - protein, 23 aa, Mycobacterium
CQMRYILGCIDMIIASGAAAAEP

SEQ ID NO: 641866 - protein, 25 aa, Mycobacterium
CQPARARVSKIPPGNRFTTTGRRLG

SEQ ID NO: 641867 - protein, 33 aa, Mycobacterium
CQPDALPMATVWAVFPTCCALAGAGRFSEVPRL

SEQ ID NO: 641868 - protein, 20 aa, Mycobacterium
CQPLTSGVWDGEWADAGSRS

SEQ ID NO: 641869 - protein, 23 aa, Mycobacterium
CQPWLRPLEAFTLSVSTDIAKVV

SEQ ID NO: 641870 - protein, 17 aa, Mycobacterium
CQPWLRPMEAFTLSIAR

SEQ ID NO: 641871 - protein, 21 aa, Mycobacterium
CQQGFCGTCRVRALPRDGDGA

SEQ ID NO: 641872 - protein, 19 aa, Mycobacterium
CQQRHHLPGLDFVQGDAED

SEQ ID NO: 641873 - protein, 19 aa, Mycobacterium
CQRAIGITLARMMTRRQFG

SEQ ID NO: 641874 - protein, 24 aa, Mycobacterium
CQRLAEAARGWWLDLDAIVYRSRT

SEQ ID NO: 641875 - protein, 18 aa, Mycobacterium
CQRRGFAGVQRDPAVATR

SEQ ID NO: 641876 - protein, 18 aa, Mycobacterium
CQSILGYVVRWIDQGVGC

SEQ ID NO: 641877 - protein, 30 aa, Mycobacterium; identical to SEQ ID NO: 94850

SEQ ID NO: 641878 - protein, 31 aa, Mycobacterium; identical to SEQ ID NO: 87265

SEQ ID NO: 641879 - protein, 18 aa, Mycobacterium
CQSKDYEKSLAFYPQVIG

SEQ ID NO: 641880 - protein, 21 aa, Mycobacterium
CQSLRWRETDMALVGGTNLLL

SEQ ID NO: 641881 - protein, 21 aa, Mycobacterium
CQTFGLPCPDTATAEDVASSW

SEQ ID NO: 641882 - protein, 20 aa, Mycobacterium
CQTFVKWLGVPGLIKTFTAA

SEQ ID NO: 641883 - protein, 19 aa, Mycobacterium
CQTNRWLNRLVGLDERISV

SEQ ID NO: 641884 - protein, 22 aa, Mycobacterium
CQWLALRPGTDVAVMLGLAYVL

SEQ ID NO: 641885 - protein, 20 aa, Mycobacterium
CQYGASGIRCNAVAPGVTVT

SEQ ID NO: 641886 - protein, 17 aa, Mycobacterium
CRAALFGSDVPTFLATE

SEQ ID NO: 641887 - protein, 19 aa, Mycobacterium
CRAALRHMVPAGKGSIINT

SEQ ID NO: 641888 - protein, 18 aa, Mycobacterium
CRAFDAAADGFVRGEGAG

SEQ ID NO: 641889 - protein, 20 aa, Mycobacterium
CRAFSSGMAAADCALRAMLS

SEQ ID NO: 641890 - protein, 17 aa, Mycobacterium
CRAGSPCRSLPVQPMLA

SEQ ID NO: 641891 - protein, 27 aa, Mycobacterium
CRALARRVPLGLARTGTTGSHFSGDIF

SEQ ID NO: 641892 - protein, 21 aa, Mycobacterium
CRALLSSRGRHIMVAGDEPSS

SEQ ID NO: 641893 - protein, 19 aa, Mycobacterium
CRAMKRVREQMGLTNVVLM

SEQ ID NO: 641894 - protein, 17 aa, Mycobacterium
CRAPSLHNSQPWRWVDH

SEQ ID NO: 641895 - protein, 17 aa, Mycobacterium
CRAPSLHNSQPWRWVVG

SEQ ID NO: 641896 - protein, 17 aa, Mycobacterium
CRARIQRRCLGSLSIDE

SEQ ID NO: 641897 - protein, 17 aa, Mycobacterium
CRAVRLVPFDPHLEEGA

SEQ ID NO: 641898 - protein, 17 aa, Mycobacterium
CRCFAQFGYGPATNNQI

SEQ ID NO: 641899 - protein, 22 aa, Mycobacterium
CRCGGELNGALSAMSAQGSGVV

SEQ ID NO: 641900 - protein, 17 aa, Mycobacterium
CRDDELFVVGRLKDLVI

SEQ ID NO: 641901 - protein, 23 aa, Mycobacterium
CRDDGRAALIGYLPTGYPDVTTS

SEQ ID NO: 641902 - protein, 25 aa, Mycobacterium
CRDEISWRYFPGFEPLPYDADSLGQ

SEQ ID NO: 641903 - protein, 19 aa, Mycobacterium
CRDERGGCVAVEIKRRGEI

SEQ ID NO: 641904 - protein, 19 aa, Mycobacterium
CRDERGGSVAVEIKRRGEI

SEQ ID NO: 641905 - protein, 20 aa, Mycobacterium
CRDGGTALVSYGFPSSPMVR

SEQ ID NO: 641906 - protein, 20 aa, Mycobacterium
CRDLCVLSDTLIVSVDYRHA

SEQ ID NO: 641907 - protein, 18 aa, Mycobacterium
CRDPRPTSILHIHGTADR

SEQ ID NO: 641908 - protein, 18 aa, Mycobacterium
CRDRETFGRPLISRQSVQ

SEQ ID NO: 641909 - protein, 20 aa, Mycobacterium
CRDTLAWLAQRGILVAPGEF

SEQ ID NO: 641910 - protein, 25 aa, Mycobacterium
CRDTLRLEAGMALYGHELSLETSPY

SEQ ID NO: 641911 - protein, 17 aa, Mycobacterium
CREALAFPGDPHRAVVL

SEQ ID NO: 641912 - protein, 17 aa, Mycobacterium
CREALAFPGDPHTAVVL

SEQ ID NO: 641913 - protein, 17 aa, Mycobacterium
CRECGGSLVAREVSGRG

SEQ ID NO: 641914 - protein, 20 aa, Mycobacterium
CREDAAVLYWAFVNAGKPVP

SEQ ID NO: 641915 - protein, 26 aa, Mycobacterium
CREGFKRIHNCGGFLTGAATFDPAFF

SEQ ID NO: 641916 - protein, 25 aa, Mycobacterium
CREGHCGACACTLKTGKVSMEVNDV

SEQ ID NO: 641917 - protein, 26 aa, Mycobacterium
CREGHCGACACTLRGGKVSMEVNDVL

SEQ ID NO: 641918 - protein, 26 aa, Mycobacterium
CREGHCGACACTLRSGKVNMEVNDVL

SEQ ID NO: 641919 - protein, 26 aa, Mycobacterium
CREGHCGACAVLKKSGDIEMEVNDVL

SEQ ID NO: 641920 - protein, 21 aa, Mycobacterium
CREGHCGACAVLKKSGEVHME

SEQ ID NO: 641921 - protein, 26 aa, Mycobacterium
CREGHCMTCACVLKDGKVRMLVNDAL

SEQ ID NO: 641922 - protein, 27 aa, Mycobacterium
CREHHLLKTFWPGWSNVQFPDGTIVWR

SEQ ID NO: 641923 - protein, 28 aa, Mycobacterium
CRELRKYGDYRLPVILLTALGEEDDRIA

SEQ ID NO: 641924 - protein, 23 aa, Mycobacterium
CREQRPPGANARRLAVICAATVL

SEQ ID NO: 641925 - protein, 18 aa, Mycobacterium
CRERLAGFKTPKRVFFVD

SEQ ID NO: 641926 - protein, 20 aa, Mycobacterium
CRERVSAFWAAHPELVAGRM

SEQ ID NO: 641927 - protein, 26 aa, Mycobacterium
CRESACATCICSVKGGQTRMLMNESL

SEQ ID NO: 641928 - protein, 25 aa, Mycobacterium
CRFPGCSRPADFCDVDHTTPWPTGV

SEQ ID NO: 641929 - protein, 27 aa, Mycobacterium
CRFPGCSRPAMICDIDHTIPFNHQDPR

SEQ ID NO: 641930 - protein, 18 aa, Mycobacterium
CRGACRNAIACKQSSILM

SEQ ID NO: 641931 - protein, 17 aa, Mycobacterium
CRGGALRTQCTTSIDGR

SEQ ID NO: 641932 - protein, 19 aa, Mycobacterium
CRGIGHAIADALAREGAIT

SEQ ID NO: 641933 - protein, 24 aa, Mycobacterium
CRGRLWWWRPGCVAVRPTPRRGRG

SEQ ID NO: 641934 - protein, 17 aa, Mycobacterium
CRGRSRCGIGNDGIVAR

SEQ ID NO: 641935 - protein, 26 aa, Mycobacterium
CRIGERSSHTWFVLTHLLGKPGVRNY

SEQ ID NO: 641936 - protein, 17 aa, Mycobacterium
CRIGERSSHTWFVLTYL

SEQ ID NO: 641937 - protein, 18 aa, Mycobacterium
CRIHHGVTIGEGRAGEYP

SEQ ID NO: 641938 - protein, 18 aa, Mycobacterium
CRIIDALLMALHRRTGRT

SEQ ID NO: 641939 - protein, 25 aa, Mycobacterium
CRINHPARCLRYGDAQYGLPVNGLW

SEQ ID NO: 641940 - protein, 30 aa, Mycobacterium
CRKAPGFAKWFLRRRITKLLPAGYPVDVHF

SEQ ID NO: 641941 - protein, 22 aa, Mycobacterium
CRKGHVRQALRQGGPDAAERAL

SEQ ID NO: 641942 - protein, 20 aa, Mycobacterium
CRKRELAVELLRVVAESTGN

SEQ ID NO: 641943 - protein, 17 aa, Mycobacterium
CRLLCLLFDDGDGCAGH

SEQ ID NO: 641944 - protein, 20 aa, Mycobacterium
CRLLPNLVTVLGWEHCDHSG

SEQ ID NO: 641945 - protein, 17 aa, Mycobacterium
CRLMFTCTPQHTFLGLE

SEQ ID NO: 641946 - protein, 17 aa, Mycobacterium
CRLNPKPGDEFHVQASL

SEQ ID NO: 641947 - protein, 21 aa, Mycobacterium
CRLRDFRCYATLTVEVEANWK

SEQ ID NO: 641948 - protein, 17 aa, Mycobacterium
CRMEIATALYYCALERE

SEQ ID NO: 641949 - protein, 17 aa, Mycobacterium
CRMGICQSCVVDLVQGH

SEQ ID NO: 641950 - protein, 21 aa, Mycobacterium
CRMGICQSCVVGLVEGHVRDL

SEQ ID NO: 641951 - protein, 19 aa, Mycobacterium
CRMGICQSCVVNLMEGHVR

SEQ ID NO: 641952 - protein, 19 aa, Mycobacterium
CRMGICQTCVVSLVQGHAR

SEQ ID NO: 641953 - protein, 18 aa, Mycobacterium
CRNGIEIVIALTAIVKIR

SEQ ID NO: 641954 - protein, 17 aa, Mycobacterium
CRNSGYLVERLTPAGQR

SEQ ID NO: 641955 - protein, 18 aa, Mycobacterium
CRPALGRSAPRSRSCGPT

SEQ ID NO: 641956 - protein, 21 aa, Mycobacterium
CRPAPRPTCAPRCRSQAEQQT

SEQ ID NO: 641957 - protein, 25 aa, Mycobacterium
CRPGDRRPVMVWVHGGAYVLGSASQ

SEQ ID NO: 641958 - protein, 22 aa, Mycobacterium
CRPGQMRLCATDRYMIARREIE

SEQ ID NO: 641959 - protein, 19 aa, Mycobacterium
CRPKRAHVMSEGYVGQGMR

SEQ ID NO: 641960 - protein, 24 aa, Mycobacterium
CRPTKRRLRVAVGDTVLVDTDDTI

SEQ ID NO: 641961 - protein, 21 aa, Mycobacterium
CRPYEQVMLFDGNDPRGIDVG

SEQ ID NO: 641962 - protein, 19 aa, Mycobacterium
CRQAFEALELMVVIDVAMT

SEQ ID NO: 641963 - protein, 26 aa, Mycobacterium
CRQFTCKYHAWRYALNGDLTFIQQED

SEQ ID NO: 641964 - protein, 27 aa, Mycobacterium
CRQFTCKYHAWRYGLDGELTFIQQEDE

SEQ ID NO: 641965 - protein, 19 aa, Mycobacterium
CRQFTCKYHAWRYNLDGDL

SEQ ID NO: 641966 - protein, 20 aa, Mycobacterium
CRQFTCKYHAWRYNLDGDLT

SEQ ID NO: 641967 - protein, 26 aa, Mycobacterium
CRQFTCKYHAWRYSLDGELTFIQQED

SEQ ID NO: 641968 - protein, 19 aa, Mycobacterium
CRQFTCKYHGWRYDLEGAL

SEQ ID NO: 641969 - protein, 19 aa, Mycobacterium
CRQFTCKYHGWRYDLQGAL

SEQ ID NO: 641970 - protein, 27 aa, Mycobacterium
CRQFTCKYHGWRYGLDGELTFVQQPGE

SEQ ID NO: 641971 - protein, 20 aa, Mycobacterium
CRQGFCGTCRTRVLSGEVDH

SEQ ID NO: 641972 - protein, 18 aa, Mycobacterium
CRQGFPRRDLDAAEVDAV

SEQ ID NO: 641973 - protein, 24 aa, Mycobacterium
CRQHHRLKTFGGWRDKQLADGTVV

SEQ ID NO: 641974 - protein, 25 aa, Mycobacterium
CRQIEFDLPVARRSIRRVRDRIAPD

SEQ ID NO: 641975 - protein, 18 aa, Mycobacterium
CRQIKLPWPVLDNDELGK

SEQ ID NO: 641976 - protein, 18 aa, Mycobacterium
CRQIMLYHLDRGWADHLA

SEQ ID NO: 641977 - protein, 19 aa, Mycobacterium
CRQIMLYHLDRGWADHLAY

SEQ ID NO: 641978 - protein, 19 aa, Mycobacterium
CRQQRLHVFEGGVWSGGAA

SEQ ID NO: 641979 - protein, 17 aa, Mycobacterium
CRQTCRDAGVSVLSVDY

SEQ ID NO: 641980 - protein, 23 aa, Mycobacterium
CRRHGYAPRSARIAGAFNPAAAR

SEQ ID NO: 641981 - protein, 17 aa, Mycobacterium
CRRLRLGSHRPFSQDPA

SEQ ID NO: 641982 - protein, 18 aa, Mycobacterium
CRRSFRADRAHWCRTGVG

SEQ ID NO: 641983 - protein, 21 aa, Mycobacterium
CRRSVPHLQRLLAHLESSLKD

SEQ ID NO: 641984 - protein, 20 aa, Mycobacterium
CRRSVPHLQRLLGHLETSLK

SEQ ID NO: 641985 - protein, 21 aa, Mycobacterium
CRRSVPHLQRLLLHLESSLKD

SEQ ID NO: 641986 - protein, 17 aa, Mycobacterium
CRRVGSLDSAVEPDSMV

SEQ ID NO: 641987 - protein, 17 aa, Mycobacterium
CRSALAAAADALGGIDN

SEQ ID NO: 641988 - protein, 18 aa, Mycobacterium
CRSAPWRAATRRLVLPWA

SEQ ID NO: 641989 - protein, 20 aa, Mycobacterium
CRSLFRAGRRFDLVATRANG

SEQ ID NO: 641990 - protein, 22 aa, Mycobacterium
CRSSPRSSRRSLWRTRLSRLTP

SEQ ID NO: 641991 - protein, 18 aa, Mycobacterium
CRTAGVGFSCGFPVDWRV

SEQ ID NO: 641992 - protein, 17 aa, Mycobacterium
CRTDFQLIDGYFDRGQD

SEQ ID NO: 641993 - protein, 17 aa, Mycobacterium
CRTEYYISRSFAAVGRL

SEQ ID NO: 641994 - protein, 26 aa, Mycobacterium
CRTFEIPACGGLFVGERTDEHSELLN

SEQ ID NO: 641995 - protein, 26 aa, Mycobacterium
CRTHHLIKSFCGWAEKQLADGTLILT

SEQ ID NO: 641996 - protein, 17 aa, Mycobacterium
CRTMKTHGRVYVPAKTP

SEQ ID NO: 641997 - protein, 22 aa, Mycobacterium
CRTVVLRLRFGDYTRATRSRTV

SEQ ID NO: 641998 - protein, 23 aa, Mycobacterium
CRVHALGVMRYVPVASRDYVARH

SEQ ID NO: 641999 - protein, 19 aa, Mycobacterium
CRVIRRHGRVMVICQDPRH

SEQ ID NO: 642000 - protein, 19 aa, Mycobacterium
CRVLLEIGPRPVLTATALA

SEQ ID NO: 642001 - protein, 17 aa, Mycobacterium
CRVPAAAILGDEPGRGF

SEQ ID NO: 642002 - protein, 17 aa, Mycobacterium
CRWLLTSRLELIEDRNR

SEQ ID NO: 642003 - protein, 25 aa, Mycobacterium
CRWPGCDCPALACDIDHTIPYSAGG

SEQ ID NO: 642004 - protein, 17 aa, Mycobacterium
CRWWPASPGFAGFATTT

SEQ ID NO: 642005 - protein, 17 aa, Mycobacterium
CRYIAADACDVSWFEQV

SEQ ID NO: 642006 - protein, 18 aa, Mycobacterium
CRYMKMITPAAMLRCLVE

SEQ ID NO: 642007 - protein, 17 aa, Mycobacterium
CRYSTTGSTTWENAQPV

SEQ ID NO: 642008 - protein, 17 aa, Mycobacterium
CRYSTTGSVTWENAQPV

SEQ ID NO: 642009 - protein, 24 aa, Mycobacterium
CSAAADLLWSRVIKQFPDVRFALS

SEQ ID NO: 642010 - protein, 25 aa, Mycobacterium
CSAALPPDCHNFRRLFYQAIERGGE

SEQ ID NO: 642011 - protein, 24 aa, Mycobacterium
CSADNCLTVKGFSYSQLQLPGGET

SEQ ID NO: 642012 - protein, 18 aa, Mycobacterium
CSAEDDLLLVSAHGQSIR

SEQ ID NO: 642013 - protein, 20 aa, Mycobacterium
CSAESALWETHFIVLLQHFA

SEQ ID NO: 642014 - protein, 19 aa, Mycobacterium
CSAGTRLIIEESIADEFVA

SEQ ID NO: 642015 - protein, 31 aa, Mycobacterium
CSAHPLVKAQICSRLAVTELYRRLRDFELDA

SEQ ID NO: 642016 - protein, 20 aa, Mycobacterium
CSALKRHYRDILRTGWSDVF

SEQ ID NO: 642017 - protein, 25 aa, Mycobacterium
CSALLDLRPLAPVVGVVAGEVGSFG

SEQ ID NO: 642018 - protein, 19 aa, Mycobacterium
CSALTRAFITDGFGESDAA

SEQ ID NO: 642019 - protein, 24 aa, Mycobacterium
CSAMARTYLGPSFDIHCGGMDLVF

SEQ ID NO: 642020 - protein, 26 aa, Mycobacterium
CSAPGCDVPGYRCEVHHVREWASTHR

SEQ ID NO: 642021 - protein, 22 aa, Mycobacterium
CSAQAAPWSGLADHLVADPELL

SEQ ID NO: 642022 - protein, 30 aa, Mycobacterium
CSASSFYWPFGFALLGGRFWVADTGNRRVL

SEQ ID NO: 642023 - protein, 19 aa, Mycobacterium
CSATFKALDKQGIGYEKVD

SEQ ID NO: 642024 - protein, 20 aa, Mycobacterium
CSAVFASLWDTYTVRPRTSE

SEQ ID NO: 642025 - protein, 18 aa, Mycobacterium
CSAVHPLALASPFFSAYD

SEQ ID NO: 642026 - protein, 18 aa, Mycobacterium
CSCCERGIEQYCKRGATF

SEQ ID NO: 642027 - protein, 21 aa, Mycobacterium
CSCTSRIYVQRGIYDDVVQRL

SEQ ID NO: 642028 - protein, 20 aa, Mycobacterium
CSDAVAFARHIGYSCAGTVE

SEQ ID NO: 642029 - protein, 22 aa, Mycobacterium
CSDLFYSIWWPRIPGDDSPVPE

SEQ ID NO: 642030 - protein, 21 aa, Mycobacterium
CSDLFYSIWWPRLPGDDSDVP

SEQ ID NO: 642031 - protein, 22 aa, Mycobacterium
CSECLGDACPRACKADGNNRAL

SEQ ID NO: 642032 - protein, 20 aa, Mycobacterium
CSECQHTTAKWVGRCPDCGT

SEQ ID NO: 642033 - protein, 19 aa, Mycobacterium
CSEEARFITGQVLGVNGGA

SEQ ID NO: 642034 - protein, 19 aa, Mycobacterium
CSEEARYITGQVLGVNGGS

SEQ ID NO: 642035 - protein, 24 aa, Mycobacterium
CSEGVVIPMECAFFSLRGLALLTD

SEQ ID NO: 642036 - protein, 19 aa, Mycobacterium
CSEPAGYLTGSWIEVDGGL

SEQ ID NO: 642037 - protein, 17 aa, Mycobacterium
CSEPPEIAYFDEQVKPL

SEQ ID NO: 642038 - protein, 25 aa, Mycobacterium
CSERPAIHRFPGSMAGRIQALAQII

SEQ ID NO: 642039 - protein, 28 aa, Mycobacterium
CSERPAIHRFPGSMAKRVQVLAQEIVDE

SEQ ID NO: 642040 - protein, 22 aa, Mycobacterium
CSETLELLLRPTGYSDDITLLA

SEQ ID NO: 642041 - protein, 20 aa, Mycobacterium
CSETLELLLRSTGYSDDVTL

SEQ ID NO: 642042 - protein, 20 aa, Mycobacterium
CSFHPPALRCALDTIGPSRL

SEQ ID NO: 642043 - protein, 18 aa, Mycobacterium
CSFINVLIELGPDSPAGR

SEQ ID NO: 642044 - protein, 20 aa, Mycobacterium
CSGHRALYELGHTGIPIYNV

SEQ ID NO: 642045 - protein, 21 aa, Mycobacterium
CSGLVIDICDAVRNGTAMAWT

SEQ ID NO: 642046 - protein, 19 aa, Mycobacterium
CSGNAGGGLDMMWNNAGVG

SEQ ID NO: 642047 - protein, 20 aa, Mycobacterium
CSGPDAWLLHADAWGATLTR

SEQ ID NO: 642048 - protein, 18 aa, Mycobacterium
CSGRVGIAGFCMGGGFAL

SEQ ID NO: 642049 - protein, 23 aa, Mycobacterium
CSGSSDYLAGRAFSFISAIDSIG

SEQ ID NO: 642050 - protein, 22 aa, Mycobacterium
CSHPHCCSVGYLVRDDSDRWRS

SEQ ID NO: 642051 - protein, 22 aa, Mycobacterium
CSILYLESRCVSLARALGSQGV

SEQ ID NO: 642052 - protein, 19 aa, Mycobacterium
CSIPQPAQVTSLFGHPGGT

SEQ ID NO: 642053 - protein, 17 aa, Mycobacterium
CSIQRRYQKIIEEAPST

SEQ ID NO: 642054 - protein, 18 aa, Mycobacterium
CSIQRRYQKLVEIAPAQQ

SEQ ID NO: 642055 - protein, 17 aa, Mycobacterium
CSLCGTDVHCWEGSLAI

SEQ ID NO: 642056 - protein, 17 aa, Mycobacterium
CSLGILIERAAKLQLAA

SEQ ID NO: 642057 - protein, 17 aa, Mycobacterium
CSLLRAVGPGGRVVSYE

SEQ ID NO: 642058 - protein, 17 aa, Mycobacterium
CSLQRRYQKLVEEAPAP

SEQ ID NO: 642059 - protein, 18 aa, Mycobacterium
CSLQRRYQKLVEEAPAPF

SEQ ID NO: 642060 - protein, 20 aa, Mycobacterium
CSLRRGEHRPQALVAGHHVG

SEQ ID NO: 642061 - protein, 19 aa, Mycobacterium
CSLSTLALLAKGFDVPVTS

SEQ ID NO: 642062 - protein, 22 aa, Mycobacterium
CSLTFPGYKPSAAGLVGSALFA

SEQ ID NO: 642063 - protein, 19 aa, Mycobacterium
CSPASMAVIKRQLYGDATD

SEQ ID NO: 642064 - protein, 34 aa, Mycobacterium
CSPSRFCWGVWLRGICRGSVVGLTRCDLSPQITG

SEQ ID NO: 642065 - protein, 24 aa, Mycobacterium
CSPYYRLGQWVLPQGYSVHLHIEQ

SEQ ID NO: 642066 - protein, 24 aa, Mycobacterium
CSQGKVIPDLIEWWCERDGVRPDK

SEQ ID NO: 642067 - protein, 18 aa, Mycobacterium
CSQNQLWSVFGKKRGKNG

SEQ ID NO: 642068 - protein, 21 aa, Mycobacterium
CSRALNRLEIETMKLGFAPGM

SEQ ID NO: 642069 - protein, 18 aa, Mycobacterium
CSRCFLVQHRSRLRSSAG

SEQ ID NO: 642070 - protein, 24 aa, Mycobacterium
CSRDEMRRMLALQSGRRGVVNIRE

SEQ ID NO: 642071 - protein, 29 aa, Mycobacterium
CSSCRVGELCPACSRLGPATDDELSCLPV

SEQ ID NO: 642072 - protein, 23 aa, Mycobacterium
CSSESFRALRCIVSAGEALDMGL

SEQ ID NO: 642073 - protein, 25 aa, Mycobacterium
CSSGNNFFAHFAYPWNGMVNEAATF

SEQ ID NO: 642074 - protein, 19 aa, Mycobacterium
CSSIAAGLTSGWRGPAAVP

SEQ ID NO: 642075 - protein, 19 aa, Mycobacterium
CSSPDAMAGLIRRMSDNPG

SEQ ID NO: 642076 - protein, 17 aa, Mycobacterium
CSSRFPYYLETYGFHSI

SEQ ID NO: 642077 - protein, 20 aa, Mycobacterium
CSSSLVAVHLACQSILNGEC

SEQ ID NO: 642078 - protein, 23 aa, Mycobacterium
CSSWPAHCRAGSRGADFHPDLDT

SEQ ID NO: 642079 - protein, 19 aa, Mycobacterium
CSSYAIAAGESFGVWGATT

SEQ ID NO: 642080 - protein, 24 aa, Mycobacterium
CSTPPLVFLDGHFSGPGTAEGEVM

SEQ ID NO: 642081 - protein, 19 aa, Mycobacterium
CSVARSLAVLGERWTILIL

SEQ ID NO: 642082 - protein, 22 aa, Mycobacterium
CSWAAIRPGPDFEMYRDYHDQE

SEQ ID NO: 642083 - protein, 19 aa, Mycobacterium
CSWVLFLWSLGRLWVTMLS

SEQ ID NO: 642084 - protein, 25 aa, Mycobacterium
CSYLNKLLWVLTGNFAKRGGQHLHS

SEQ ID NO: 642085 - protein, 23 aa, Mycobacterium
CSYLNKMLWILTGNFAKQGGQHL

SEQ ID NO: 642086 - protein, 19 aa, Mycobacterium
CTAAELAPAQAWTDRAAAV

SEQ ID NO: 642087 - protein, 18 aa, Mycobacterium
CTAANRFYVHASVHDEFV

SEQ ID NO: 642088 - protein, 17 aa, Mycobacterium
CTAANRIYVQRGIADAF

SEQ ID NO: 642089 - protein, 26 aa, Mycobacterium
CTAAPNLRPQPCIDLYDAVRAGDLDR

SEQ ID NO: 642090 - protein, 20 aa, Mycobacterium
CTAARALAVLSGRDHVIPSD

SEQ ID NO: 642091 - protein, 21 aa, Mycobacterium
CTAGAGWCRTEEGAFDVGVGD

SEQ ID NO: 642092 - protein, 19 aa, Mycobacterium
CTAGHPPPLLVGGEGSRYL

SEQ ID NO: 642093 - protein, 18 aa, Mycobacterium
CTAGHPPPLLVTADAKSR

SEQ ID NO: 642094 - protein, 18 aa, Mycobacterium
CTAGHPPPLLVTSEATSR

SEQ ID NO: 642095 - protein, 17 aa, Mycobacterium
CTAGLLAARLTDRAGSS

SEQ ID NO: 642096 - protein, 23 aa, Mycobacterium
CTALWRRDQELFAEVALPEQVSA

SEQ ID NO: 642097 - protein, 24 aa, Mycobacterium
CTAMSTRLSAWVDGAAAPGPAAIV

SEQ ID NO: 642098 - protein, 24 aa, Mycobacterium
CTAPMEIVGRFLALLELYRSRAVA

SEQ ID NO: 642099 - protein, 20 aa, Mycobacterium
CTAQVLLAVLAAMYASYHGP

SEQ ID NO: 642100 - protein, 17 aa, Mycobacterium
CTAVELFDGKPPFTART

SEQ ID NO: 642101 - protein, 23 aa, Mycobacterium
CTCAPRAAVLTADFGDTSPSRYP

SEQ ID NO: 642102 - protein, 20 aa, Mycobacterium
CTDLPWTQTLSEVWRMQDPA

SEQ ID NO: 642103 - protein, 18 aa, Mycobacterium
CTDPVWPIVRGARTNTTA

SEQ ID NO: 642104 - protein, 17 aa, Mycobacterium
CTDRDRFHSELTAALIS

SEQ ID NO: 642105 - protein, 26 aa, Mycobacterium
CTDSYGGGQLLEWLERCIFPAEARLA

SEQ ID NO: 642106 - protein, 26 aa, Mycobacterium
CTDTPWWAHDIWDLRADPRIPQRPHE

SEQ ID NO: 642107 - protein, 18 aa, Mycobacterium
CTDVQPAFSKRPAFFGGV

SEQ ID NO: 642108 - protein, 20 aa, Mycobacterium
CTECGAGVGEVCRFTNGVKK

SEQ ID NO: 642109 - protein, 17 aa, Mycobacterium
CTEEVQTILRWAGANRV

SEQ ID NO: 642110 - protein, 25 aa, Mycobacterium
CTEGDPATCFYVMIDGELVMSKRSG

SEQ ID NO: 642111 - protein, 18 aa, Mycobacterium
CTEILLRRGHTVVAVDVR

SEQ ID NO: 642112 - protein, 18 aa, Mycobacterium
CTEMQARVVDRCLQLFGG

SEQ ID NO: 642113 - protein, 25 aa, Mycobacterium
CTEPEFPHFDLAPGTVFKTQKVSGM

SEQ ID NO: 642114 - protein, 21 aa, Mycobacterium
CTEPGGLCFCASMGTGPAVGP

SEQ ID NO: 642115 - protein, 21 aa, Mycobacterium
CTEPGGLCFCASMGTGPHLGP

SEQ ID NO: 642116 - protein, 17 aa, Mycobacterium
CTFRETARTLAGLTDPN

SEQ ID NO: 642117 - protein, 20 aa, Mycobacterium
CTGAAIGTPDGWLARAATVR

SEQ ID NO: 642118 - protein, 22 aa, Mycobacterium
CTGCGRKLVVHYHVSRRAGAFL

SEQ ID NO: 642119 - protein, 22 aa, Mycobacterium
CTGERIVAVAIVERQWPQNADP

SEQ ID NO: 642120 - protein, 21 aa, Mycobacterium
CTGGKPLPGMEARIVDLDTRE

SEQ ID NO: 642121 - protein, 26 aa, Mycobacterium
CTGMGPQWWQMCRGLLDVFPVFTDSI

SEQ ID NO: 642122 - protein, 33 aa, Mycobacterium
CTGSGSGLRELKCGYHGWTWDLAGALKRVPNRK

SEQ ID NO: 642123 - protein, 17 aa, Mycobacterium
CTGSPGCARSVADVRAD

SEQ ID NO: 642124 - protein, 19 aa, Mycobacterium
CTGTLPATVVACSGLDVLS

SEQ ID NO: 642125 - protein, 18 aa, Mycobacterium
CTGYDRFERYLLGADDGI

SEQ ID NO: 642126 - protein, 21 aa, Mycobacterium
CTHCNKCMPTIYTHTHCVLTG

SEQ ID NO: 642127 - protein, 17 aa, Mycobacterium
CTHIGPDGAGHFVKMVH

SEQ ID NO: 642128 - protein, 18 aa, Mycobacterium
CTHLGPKFHDPNTLVGNT

SEQ ID NO: 642129 - protein, 23 aa, Mycobacterium
CTHVRAIIAPMCRAVFDCGTPPH

SEQ ID NO: 642130 - protein, 22 aa, Mycobacterium
CTIAPGLFKTPLLGSLPEEAQA

SEQ ID NO: 642131 - protein, 18 aa, Mycobacterium
CTIEESLRSGATTAVKRP

SEQ ID NO: 642132 - protein, 29 aa, Mycobacterium
CTIGDPLLDLGWLLATWRQSDGASVFGHA

SEQ ID NO: 642133 - protein, 28 aa, Mycobacterium
CTLFEHFGLRLRRQLPLGPTGAGTYLYE

SEQ ID NO: 642134 - protein, 20 aa, Mycobacterium
CTLPLTGVGCVNRIVTELAV

SEQ ID NO: 642135 - protein, 20 aa, Mycobacterium
CTMCAGALVMARVARVVFGA

SEQ ID NO: 642136 - protein, 19 aa, Mycobacterium
CTMLMPALARETRHIGFLY

SEQ ID NO: 642137 - protein, 18 aa, Mycobacterium
CTMRVDLVGSDGGRIETE

SEQ ID NO: 642138 - protein, 26 aa, Mycobacterium
CTNAERIARWFLPITGDLRAGGHYSL

SEQ ID NO: 642139 - protein, 20 aa, Mycobacterium
CTNCGPRFTLIASLPYDRAS

SEQ ID NO: 642140 - protein, 23 aa, Mycobacterium
CTNCGPRLTVIRTLPYDRPGTTM

SEQ ID NO: 642141 - protein, 24 aa, Mycobacterium
CTNLPAQRLLAGFLTGGHLADHLV

SEQ ID NO: 642142 - protein, 17 aa, Mycobacterium
CTNTLQFFVRDSRLHLM

SEQ ID NO: 642143 - protein, 21 aa, Mycobacterium
CTPAPWWSYDTWDLRIDPRIP

SEQ ID NO: 642144 - protein, 21 aa, Mycobacterium
CTPEALRALGIREEAEAENAL

SEQ ID NO: 642145 - protein, 20 aa, Mycobacterium
CTPTRSALMTGRYPIRSGNH

SEQ ID NO: 642146 - protein, 25 aa, Mycobacterium
CTQGKVIPDLIEWWAQRDGVRPDKS

SEQ ID NO: 642147 - protein, 24 aa, Mycobacterium
CTQGRVIPDLIAWWCERDGVRPDK

SEQ ID NO: 642148 - protein, 22 aa, Mycobacterium
CTQHRCFPVLAGPPGSHDLLLI

SEQ ID NO: 642149 - protein, 24 aa, Mycobacterium
CTQHRCFPVLAGPPGTQDLLLISP

SEQ ID NO: 642150 - protein, 25 aa, Mycobacterium
CTQKFLTRPKLPLMEQLRVAVPAVQ

SEQ ID NO: 642151 - protein, 17 aa, Mycobacterium
CTQRVARDMVAAEMPGS

SEQ ID NO: 642152 - protein, 25 aa, Mycobacterium
CTRAASGFCRSWPCGGAPRRGLGRS

SEQ ID NO: 642153 - protein, 20 aa, Mycobacterium
CTRAVYKHIAQRGGGAIVNQ

SEQ ID NO: 642154 - protein, 26 aa, Mycobacterium
CTREFGRGMVDRGWGRVVNIASQNAI

SEQ ID NO: 642155 - protein, 21 aa, Mycobacterium
CTRGTAGLVPFSSRLAAEEWR

SEQ ID NO: 642156 - protein, 21 aa, Mycobacterium
CTRIWRDGRVEQLGWPQVTIR

SEQ ID NO: 642157 - protein, 21 aa, Mycobacterium
CTRIWRDGRVEQLGWPRVKIH

SEQ ID NO: 642158 - protein, 25 aa, Mycobacterium
CTRVWKDGRVEQLGWPRVKIQYRSG

SEQ ID NO: 642159 - protein, 22 aa, Mycobacterium
CTRVWRDGRVEQLGWPRVKIHY

SEQ ID NO: 642160 - protein, 20 aa, Mycobacterium
CTRVWRFDRMATVCDPGSGR

SEQ ID NO: 642161 - protein, 21 aa, Mycobacterium
CTSLNEVICHGIPDSTVIEDG

SEQ ID NO: 642162 - protein, 18 aa, Mycobacterium
CTSMVRLGKPLYARDVPG

SEQ ID NO: 642163 - protein, 30 aa, Mycobacterium
CTSVTAVLRGHGDGVVLLRADMDALPVQEH

SEQ ID NO: 642164 - protein, 18 aa, Mycobacterium
CTTEACGFRDHFDELRAA

SEQ ID NO: 642165 - protein, 19 aa, Mycobacterium
CTTFDKWRLIPVLDADDRV

SEQ ID NO: 642166 - protein, 18 aa, Mycobacterium
CTTLRRLIVHSSIADELV

SEQ ID NO: 642167 - protein, 17 aa, Mycobacterium
CTTLRRLIVHSSVADEV

SEQ ID NO: 642168 - protein, 18 aa, Mycobacterium
CTTMAAMPVLKPLHDEAG

SEQ ID NO: 642169 - protein, 23 aa, Mycobacterium
CTTRGIAFVPFFPLGAAFMRPNP

SEQ ID NO: 642170 - protein, 23 aa, Mycobacterium
CTVFDSFGPHHRLIFPLNTILEL

SEQ ID NO: 642171 - protein, 29 aa, Mycobacterium
CTVGDPLLDLGWLLVCWPDGPNPIDAGSA

SEQ ID NO: 642172 - protein, 26 aa, Mycobacterium
CTVLLDGAAVRSCLLFAVQADGMEVT

SEQ ID NO: 642173 - protein, 17 aa, Mycobacterium
CTVRRTIFVPADEISPI

SEQ ID NO: 642174 - protein, 20 aa, Mycobacterium
CVAADFSVGMLAAGHERKVC

SEQ ID NO: 642175 - protein, 17 aa, Mycobacterium
CVAALARAADAIGETPE

SEQ ID NO: 642176 - protein, 19 aa, Mycobacterium
CVAANRIIVHRAVAEEFTK

SEQ ID NO: 642177 - protein, 18 aa, Mycobacterium
CVAFGGASSFGIFFQNNG

SEQ ID NO: 642178 - protein, 19 aa, Mycobacterium
CVAGDLGVPDAVKFDPDGR

SEQ ID NO: 642179 - protein, 19 aa, Mycobacterium
CVAHARAAGPALAIENASS

SEQ ID NO: 642180 - protein, 29 aa, Mycobacterium
CVAIVPWNFPLLLGIWKIGPALAAGNSVV

SEQ ID NO: 642181 - protein, 17 aa, Mycobacterium
CVALFTATCPEWVYFWL

SEQ ID NO: 642182 - protein, 17 aa, Mycobacterium
CVAQCRPNTAPTVLQTD

SEQ ID NO: 642183 - protein, 25 aa, Mycobacterium
CVAQTRILAPRSRYDEIVDAVSNFV

SEQ ID NO: 642184 - protein, 25 aa, Mycobacterium
CVAQTRILAPRSRYDEIVDAVSTFV

SEQ ID NO: 642185 - protein, 25 aa, Mycobacterium
CVATVGRLSVPQSWTAAISQPSVGD

SEQ ID NO: 642186 - protein, 18 aa, Mycobacterium
CVAYRLAGLVDEDRLHTA

SEQ ID NO: 642187 - protein, 18 aa, Mycobacterium
CVCDMAWVVGLPQGLVSH

SEQ ID NO: 642188 - protein, 21 aa, Mycobacterium
CVCGSRIFAQRGVYDRVVEGI

SEQ ID NO: 642189 - protein, 18 aa, Mycobacterium
CVCRACYLLFTDSAAELR

SEQ ID NO: 642190 - protein, 20 aa, Mycobacterium
CVDAAMALLTVHHWGDLSAG

SEQ ID NO: 642191 - protein, 20 aa, Mycobacterium
CVDDALAMVSMSAYADRYPR

SEQ ID NO: 642192 - protein, 20 aa, Mycobacterium
CVDLALERFGSVDILINNAG

SEQ ID NO: 642193 - protein, 25 aa, Mycobacterium
CVDMLEMLPTPWGLVRSGVAPDHPK

SEQ ID NO: 642194 - protein, 23 aa, Mycobacterium
CVDPDMLASWWAGVAGGEVNAVA

SEQ ID NO: 642195 - protein, 17 aa, Mycobacterium
CVDSLHLATLVDVAMPN

SEQ ID NO: 642196 - protein, 20 aa, Mycobacterium
CVDYARGRFDAAVPEEVQRE

SEQ ID NO: 642197 - protein, 19 aa, Mycobacterium
CVEFSAARPGMLGLQTALS

SEQ ID NO: 642198 - protein, 18 aa, Mycobacterium
CVELARDGGCLVVSVDYR

SEQ ID NO: 642199 - protein, 19 aa, Mycobacterium
CVEQTYLKQYCALIHGQVV

SEQ ID NO: 642200 - protein, 18 aa, Mycobacterium
CVFWRKGYEGASYSDLTQ

SEQ ID NO: 642201 - protein, 22 aa, Mycobacterium
CVGALRKEDLHLAFASGTGNKI

SEQ ID NO: 642202 - protein, 24 aa, Mycobacterium
CVGCDHFRTNIAFLPDLQAYLDDL

SEQ ID NO: 642203 - protein, 27 aa, Mycobacterium
CVGNACNGRDGGLIWGNGGAGANGGHG

SEQ ID NO: 642204 - protein, 17 aa, Mycobacterium
CVGQCHLEVPAPAVEAV

SEQ ID NO: 642205 - protein, 26 aa, Mycobacterium
CVGQTRILAPRSRYDEVIEKLGEAVR

SEQ ID NO: 642206 - protein, 25 aa, Mycobacterium
CVGQTRILAPRSRYDEVVEKVAAGV

SEQ ID NO: 642207 - protein, 25 aa, Mycobacterium
CVGQTRILAPRSRYEEIVEAVSAFV

SEQ ID NO: 642208 - protein, 22 aa, Mycobacterium
CVGRLRYLGLVLYDVDRVLEAA

SEQ ID NO: 642209 - protein, 17 aa, Mycobacterium
CVGSDWCRYGQQDSVQM

SEQ ID NO: 642210 - protein, 17 aa, Mycobacterium
CVGTCHLDGPAVEAHAR

SEQ ID NO: 642211 - protein, 23 aa, Mycobacterium
CVGVDRFARVRDIAALDFVSAPV

SEQ ID NO: 642212 - protein, 18 aa, Mycobacterium
CVHAGMDLYKWAFKLGPL

SEQ ID NO: 642213 - protein, 17 aa, Mycobacterium
CVHCCQLNEVMPIDRLG

SEQ ID NO: 642214 - protein, 21 aa, Mycobacterium
CVHFEPRIHRVLGLRDHSALT

SEQ ID NO: 642215 - protein, 23 aa, Mycobacterium
CVIGSCRDAIGWFGHGSVDTRYI

SEQ ID NO: 642216 - protein, 22 aa, Mycobacterium
CVIPLRARIAERLDQSGPTVSQ

SEQ ID NO: 642217 - protein, 24 aa, Mycobacterium
CVITADDGRLVWDNDSYRFLDSEQ

SEQ ID NO: 642218 - protein, 20 aa, Mycobacterium
CVLADPRWDHIQDIGDVSDF

SEQ ID NO: 642219 - protein, 21 aa, Mycobacterium
CVLAKDCPSFGLGPTEPLLAA

SEQ ID NO: 642220 - protein, 22 aa, Mycobacterium
CVLAKDCPSYGLGPTEPLLAAP

SEQ ID NO: 642221 - protein, 20 aa, Mycobacterium
CVLELGCGEGVFGAIVKQST

SEQ ID NO: 642222 - protein, 17 aa, Mycobacterium
CVLGAFQVSERGDLANW

SEQ ID NO: 642223 - protein, 20 aa, Mycobacterium
CVLNACFYKPALLARDVTAL

SEQ ID NO: 642224 - protein, 20 aa, Mycobacterium
CVLPTRLLVPRSRYDEAREL

SEQ ID NO: 642225 - protein, 26 aa, Mycobacterium
CVLRALLRPGDHLIIPNDAYGGTFRL

SEQ ID NO: 642226 - protein, 22 aa, Mycobacterium
CVLRAVLRPGDHIVIPDDAYGG

SEQ ID NO: 642227 - protein, 20 aa, Mycobacterium
CVLSKAQILDRVWSYDFGGR

SEQ ID NO: 642228 - protein, 20 aa, Mycobacterium
CVNSIPAVCAAEPGIATYLD

SEQ ID NO: 642229 - protein, 17 aa, Mycobacterium
CVPFHVRPTDLEAFLDG

SEQ ID NO: 642230 - protein, 19 aa, Mycobacterium
CVPGAKLGVDLWVEEVNPP

SEQ ID NO: 642231 - protein, 18 aa, Mycobacterium
CVPHLQKSANPHVLTISP

SEQ ID NO: 642232 - protein, 20 aa, Mycobacterium
CVPTSSMGRLFDAVSALIGL

SEQ ID NO: 642233 - protein, 19 aa, Mycobacterium
CVPVLMAALGRITGTDTDG

SEQ ID NO: 642234 - protein, 18 aa, Mycobacterium
CVQAGDREGWLALMADDV

SEQ ID NO: 642235 - protein, 25 aa, Mycobacterium
CVQAGIPAVTFWAAVPHYVSQPPNP

SEQ ID NO: 642236 - protein, 41 aa, Mycobacterium
CVRDGDFDEACWLVFLATHFGFHRHNRWALSGNFYRRLDAG

SEQ ID NO: 642237 - protein, 18 aa, Mycobacterium
CVREFGRIDILINCAGTA

SEQ ID NO: 642238 - protein, 18 aa, Mycobacterium
CVRELFDPRDRRFRHPFV

SEQ ID NO: 642239 - protein, 18 aa, Mycobacterium
CVRFPELKLCMIHGADPW

SEQ ID NO: 642240 - protein, 18 aa, Mycobacterium
CVRRACQITEEAVAEIQK

SEQ ID NO: 642241 - protein, 18 aa, Mycobacterium
CVRRRHLATRADEHSKGG

SEQ ID NO: 642242 - protein, 18 aa, Mycobacterium
CVRVPVFTGHSLSINAEF

SEQ ID NO: 642243 - protein, 21 aa, Mycobacterium
CVSACPVGAIAPDSRLDSKQL

SEQ ID NO: 642244 - protein, 19 aa, Mycobacterium
CVSAGSILRNLDPQRFEVI

SEQ ID NO: 642245 - protein, 17 aa, Mycobacterium
CVSAIQSWVLRSGGATI

SEQ ID NO: 642246 - protein, 24 aa, Mycobacterium
CVSAPEALTMFLGRPDRPGQARSV

SEQ ID NO: 642247 - protein, 22 aa, Mycobacterium
CVSDPSGLFLDQRPKAVSGTAV

SEQ ID NO: 642248 - protein, 20 aa, Mycobacterium
CVSHQLPVWTLRLHLTGQRL

SEQ ID NO: 642249 - protein, 20 aa, Mycobacterium
CVSHQLPVWTLRLHLTGRRL

SEQ ID NO: 642250 - protein, 20 aa, Mycobacterium
CVSMVADLFHAEGLRDDDPG

SEQ ID NO: 642251 - protein, 18 aa, Mycobacterium
CVSRRELSGAELLATARA

SEQ ID NO: 642252 - protein, 18 aa, Mycobacterium
CVSVERIFVVGAVEAMVE

SEQ ID NO: 642253 - protein, 20 aa, Mycobacterium
CVSVQWGQWTVHFDLDASSM

SEQ ID NO: 642254 - protein, 18 aa, Mycobacterium
CVTGAPAPVSIDGTRVPQ

SEQ ID NO: 642255 - protein, 23 aa, Mycobacterium
CVTKPLSSLLFPNWNTTTTPTPP

SEQ ID NO: 642256 - protein, 17 aa, Mycobacterium
CVTLDYDQMRGMDSDEY

SEQ ID NO: 642257 - protein, 19 aa, Mycobacterium
CVTVLRYVAVDDFGRVINE

SEQ ID NO: 642258 - protein, 26 aa, Mycobacterium
CVVRAVLRWTEFYAHESCGKCTPCRE

SEQ ID NO: 642259 - protein, 21 aa, Mycobacterium
CVVRDPGLYRMWYCARGAQYS

SEQ ID NO: 642260 - protein, 21 aa, Mycobacterium
CVVVAEGIPCLGPVTHAGCGA

SEQ ID NO: 642261 - protein, 18 aa, Mycobacterium
CWAALQWVHEHAAEIGGD

SEQ ID NO: 642262 - protein, 22 aa, Mycobacterium
CWADRWRDGRVLVAGDAAHLMP

SEQ ID NO: 642263 - protein, 26 aa, Mycobacterium
CWAPRRPWESCRCPRAGPPPPPAIRL

SEQ ID NO: 642264 - protein, 17 aa, Mycobacterium
CWATPLVDLVVGEQMTP

SEQ ID NO: 642265 - protein, 32 aa, Mycobacterium
CWATRPVRAVQRWAACQGKTLRAVIATEQQFA

SEQ ID NO: 642266 - protein, 19 aa, Mycobacterium
CWDPSAPEFDEYVGDFHHW

SEQ ID NO: 642267 - protein, 18 aa, Mycobacterium
CWERTAAALRALGHDVTA

SEQ ID NO: 642268 - protein, 17 aa, Mycobacterium
CWGAMSVAETLGRPWVV

SEQ ID NO: 642269 - protein, 17 aa, Mycobacterium
CWITNGGKSDWYTVMAV

SEQ ID NO: 642270 - protein, 20 aa, Mycobacterium
CWRNFLTCNANLAVTLPPGL

SEQ ID NO: 642271 - protein, 22 aa, Mycobacterium
CWRRWWPDLRLQVVEDRGDKGI

SEQ ID NO: 642272 - protein, 24 aa, Mycobacterium
CWSTWNTLCAFLYTDELIPSNPMP

SEQ ID NO: 642273 - protein, 17 aa, Mycobacterium
CWVAEAWGSDAPSALGY

SEQ ID NO: 642274 - protein, 17 aa, Mycobacterium
CWVAEAWGTDGPSALGY

SEQ ID NO: 642275 - protein, 18 aa, Mycobacterium
CWYAPELDVVFSGDTLFC

SEQ ID NO: 642276 - protein, 19 aa, Mycobacterium
CYAALLWLRQQQWVDPSRI

SEQ ID NO: 642277 - protein, 20 aa, Mycobacterium
CYADDVVYWMPAWTDDDKLV

SEQ ID NO: 642278 - protein, 19 aa, Mycobacterium
CYADDVVYWMPSWADDDRL

SEQ ID NO: 642279 - protein, 21 aa, Mycobacterium
CYAGASFLRPVECAQRHRIGV

SEQ ID NO: 642280 - protein, 17 aa, Mycobacterium
CYCRTHHLIKSFCGWAE

SEQ ID NO: 642281 - protein, 19 aa, Mycobacterium
CYDAYKWLRETGYEPEQIV

SEQ ID NO: 642282 - protein, 26 aa, Mycobacterium
CYDIRFPELYVELARRGAQLITVHAS

SEQ ID NO: 642283 - protein, 24 aa, Mycobacterium
CYDVEFPENVRALAMARADVVVVP

SEQ ID NO: 642284 - protein, 25 aa, Mycobacterium
CYEFVGRLRLLWRGFDGGQQAREFI

SEQ ID NO: 642285 - protein, 17 aa, Mycobacterium
CYEHFNALARYALIADD

SEQ ID NO: 642286 - protein, 18 aa, Mycobacterium
CYFGIGMSEPDSGSDLAS

SEQ ID NO: 642287 - protein, 20 aa, Mycobacterium
CYHAYPAHAAFGGYKQSGIG

SEQ ID NO: 642288 - protein, 17 aa, Mycobacterium
CYLLEPVSVWAPECSEE

SEQ ID NO: 642289 - protein, 19 aa, Mycobacterium
CYNPLWPSIDELVRLLESG

SEQ ID NO: 642290 - protein, 17 aa, Mycobacterium
CYPEFMAHLERWETVTE

SEQ ID NO: 642291 - protein, 24 aa, Mycobacterium
CYPSVPRFLAEVARVLRPGGHLLY

SEQ ID NO: 642292 - protein, 20 aa, Mycobacterium
CYQFGDAKPVYALEGSIAVT

SEQ ID NO: 642293 - protein, 19 aa, Mycobacterium
CYQFGDSKPVYALEGSIAV

SEQ ID NO: 642294 - protein, 17 aa, Mycobacterium
CYQIEFSDGTTIVADAE

SEQ ID NO: 642295 - protein, 18 aa, Mycobacterium
CYSALRWLAALPAVDPGR

SEQ ID NO: 642296 - protein, 26 aa, Mycobacterium
CYSSAFDLSVWDIWGALLRGRRLLVV

SEQ ID NO: 642297 - protein, 21 aa, Mycobacterium
CYTSADFEAVIALMADGVYDT

SEQ ID NO: 642298 - protein, 21 aa, Mycobacterium
CYTVTAGVCRRGVDIDAAAID

SEQ ID NO: 642299 - protein, 18 aa, Mycobacterium
CYVDPYLEIESFRQRDEA

SEQ ID NO: 642300 - protein, 18 aa, Mycobacterium
CYVSGRYAGPFGEDDLEV

SEQ ID NO: 642301 - protein, 17 aa, Mycobacterium
CYVSMPLFHSNAVVAGW

SEQ ID NO: 642302 - protein, 18 aa, Mycobacterium
CYVVAGFPGADWVENVRA

SEQ ID NO: 642303 - protein, 20 aa, Mycobacterium
DAAAALAEFDVPAEVRVVSA

SEQ ID NO: 642304 - protein, 20 aa, Mycobacterium
DAAADPMAAAGASGGHGGPG

SEQ ID NO: 642305 - protein, 22 aa, Mycobacterium
DAAADRPLLCLVDDEQWLDRSS

SEQ ID NO: 642306 - protein, 25 aa, Mycobacterium
DAAAELRLAPGQRVWFSVKAHEVAL

SEQ ID NO: 642307 - protein, 25 aa, Mycobacterium
DAAAEPVEFAQRLSIAIATEVAALR

SEQ ID NO: 642308 - protein, 19 aa, Mycobacterium
DAAAFLGRAVQAFESMDQN

SEQ ID NO: 642309 - protein, 17 aa, Mycobacterium
DAAAFVGEYGWRLVEQA

SEQ ID NO: 642310 - protein, 19 aa, Mycobacterium
DAAAGFILDGFPRTVDQAD

SEQ ID NO: 642311 - protein, 19 aa, Mycobacterium
DAAALAMLVLTSFEGAIVV

SEQ ID NO: 642312 - protein, 17 aa, Mycobacterium
DAAALDIGCRRTREATP

SEQ ID NO: 642313 - protein, 22 aa, Mycobacterium
DAAALRPFLLVASFVNPHDIVL

SEQ ID NO: 642314 - protein, 20 aa, Mycobacterium
DAAAPPPVLAIVGRPNVGKS

SEQ ID NO: 642315 - protein, 20 aa, Mycobacterium
DAAAQMWSRTALKPADLEVA

SEQ ID NO: 642316 - protein, 19 aa, Mycobacterium
DAAAQMWSRTDLKPSDLQV

SEQ ID NO: 642317 - protein, 23 aa, Mycobacterium
DAAAQWIGVVSFLMSPGTARRLS

SEQ ID NO: 642318 - protein, 17 aa, Mycobacterium
DAAARAGLEKAGVRCQS

SEQ ID NO: 642319 - protein, 23 aa, Mycobacterium
DAAARAGVKRFVMVSYFGAGPDH

SEQ ID NO: 642320 - protein, 18 aa, Mycobacterium
DAAARRVLTEAGMGEAFV

SEQ ID NO: 642321 - protein, 24 aa, Mycobacterium
DAAARTVIYYVLGFTVDEQSRLQW

SEQ ID NO: 642322 - protein, 25 aa, Mycobacterium
DAAAVQIMTVWVSKGLQYPVVYLPF

SEQ ID NO: 642323 - protein, 22 aa, Mycobacterium
DAAAYLAHRGWHTTIRTTSELY

SEQ ID NO: 642324 - protein, 22 aa, Mycobacterium
DAACAGYDCLLITDASATTSPS

SEQ ID NO: 642325 - protein, 18 aa, Mycobacterium
DAACGAGAVVVWDQGTYA

SEQ ID NO: 642326 - protein, 23 aa, Mycobacterium
DAACGSEIFGNVAVSFDEPHIWR

SEQ ID NO: 642327 - protein, 19 aa, Mycobacterium
DAADICGIPGATGVVATSD

SEQ ID NO: 642328 - protein, 17 aa, Mycobacterium
DAADLDAALARFAELTC

SEQ ID NO: 642329 - protein, 25 aa, Mycobacterium
DAADPRAPFGFAIADFEPGQRLSLR

SEQ ID NO: 642330 - protein, 19 aa, Mycobacterium
DAADPYFRMEILTAGGRVP

SEQ ID NO: 642331 - protein, 24 aa, Mycobacterium
DAADSIVFRLMFNTLRATYEPALP

SEQ ID NO: 642332 - protein, 24 aa, Mycobacterium
DAADVLYRLAFRKIDMPDPRAELA

SEQ ID NO: 642333 - protein, 19 aa, Mycobacterium
DAADWRRIAGVVAGLSDRD

SEQ ID NO: 642334 - protein, 23 aa, Mycobacterium
DAAEAWRAVVEQATDPGVRAFGV

SEQ ID NO: 642335 - protein, 26 aa, Mycobacterium
DAAELRARLRLAITRRRHALEGTLEF

SEQ ID NO: 642336 - protein, 25 aa, Mycobacterium
DAAERILPVLMRLFQIKSGSPEAAL

SEQ ID NO: 642337 - protein, 17 aa, Mycobacterium
DAAERVRLLAETAPILW

SEQ ID NO: 642338 - protein, 25 aa, Mycobacterium
DAAETDRSFAFLTIFNKNRPGGTIV

SEQ ID NO: 642339 - protein, 25 aa, Mycobacterium
DAAFLSRYRDLTARRAARVPLQHLT

SEQ ID NO: 642340 - protein, 28 aa, Mycobacterium
DAAFPKRMGRPIEYAKLVAAIVENPMLN

SEQ ID NO: 642341 - protein, 19 aa, Mycobacterium
DAAFSAAHEGWRNWRGTTP

SEQ ID NO: 642342 - protein, 19 aa, Mycobacterium
DAAGCRPLISEAVRGEGAV

SEQ ID NO: 642343 - protein, 19 aa, Mycobacterium
DAAGIRLSLITGFDEHSTC

SEQ ID NO: 642344 - protein, 18 aa, Mycobacterium
DAAGKWVVPGFIDVHTHY

SEQ ID NO: 642345 - protein, 23 aa, Mycobacterium
DAAGLARDFFRLMAGQVAVRTRF

SEQ ID NO: 642346 - protein, 21 aa, Mycobacterium
DAAGLKIVATVAIPQVEADKS

SEQ ID NO: 642347 - protein, 22 aa, Mycobacterium
DAAGQLIRWSDDYAVSDSLRLR

SEQ ID NO: 642348 - protein, 25 aa, Mycobacterium
DAAGRLRIAAAVGINGDVAAKAGAL

SEQ ID NO: 642349 - protein, 18 aa, Mycobacterium
DAAGRRPDAAYALHVFST

SEQ ID NO: 642350 - protein, 21 aa, Mycobacterium
DAAGVTARFNRNVLAVVNREL

SEQ ID NO: 642351 - protein, 20 aa, Mycobacterium
DAAHLWHPYSGIGIPAAAQR

SEQ ID NO: 642352 - protein, 17 aa, Mycobacterium
DAAHPWSKFASDTPEGQ

SEQ ID NO: 642353 - protein, 18 aa, Mycobacterium
DAAIARAYARFQDYRHNT

SEQ ID NO: 642354 - protein, 27 aa, Mycobacterium
DAAIIRITPRRIISFGIDDQETPPHQL

SEQ ID NO: 642355 - protein, 32 aa, Mycobacterium
DAAIPRGVGTKGVWRLPDRRALEQVLTGGARF

SEQ ID NO: 642356 - protein, 17 aa, Mycobacterium
DAAIRLLADEGIKGLTH

SEQ ID NO: 642357 - protein, 18 aa, Mycobacterium
DAAITSVRHPLRWHHLAL

SEQ ID NO: 642358 - protein, 22 aa, Mycobacterium
DAAKDMLRRGLVEGTAGNISAR

SEQ ID NO: 642359 - protein, 17 aa, Mycobacterium
DAAKHKGISCLIVDMTL

SEQ ID NO: 642360 - protein, 22 aa, Mycobacterium
DAAKNQCRWQWGVLGPEGAESA

SEQ ID NO: 642361 - protein, 18 aa, Mycobacterium
DAAKRCDRGATRVVVLTG

SEQ ID NO: 642362 - protein, 24 aa, Mycobacterium
DAAKRFYGGNAIVAGGLPLAVGIA

SEQ ID NO: 642363 - protein, 17 aa, Mycobacterium
DAAKVTCPILFCVCEAD

SEQ ID NO: 642364 - protein, 18 aa, Mycobacterium
DAALALWMQLHDSAFPAG

SEQ ID NO: 642365 - protein, 24 aa, Mycobacterium
DAALARDFLTIWFAQLHSQVAEIR

SEQ ID NO: 642366 - protein, 27 aa, Mycobacterium
DAALARDFLTIWFAQLYRHVADIKARI

SEQ ID NO: 642367 - protein, 29 aa, Mycobacterium
DAALAREFLLSWFVYTAWELEEAKRISGA

SEQ ID NO: 642368 - protein, 23 aa, Mycobacterium
DAALCVAAALFGRLHSGHGESID

SEQ ID NO: 642369 - protein, 25 aa, Mycobacterium
DAALDRFASEPAWVVKDDGLAAGKG

SEQ ID NO: 642370 - protein, 25 aa, Mycobacterium
DAALGRDFLTIWFAQLHHQVADIKR

SEQ ID NO: 642371 - protein, 18 aa, Mycobacterium
DAALPEAVSPVWKAMGSG

SEQ ID NO: 642372 - protein, 26 aa, Mycobacterium
DAALPELPWFATDGAQEFGGAPVADT

SEQ ID NO: 642373 - protein, 19 aa, Mycobacterium
DAALPLPARLAATARAKAF

SEQ ID NO: 642374 - protein, 21 aa, Mycobacterium
DAALPRVSIFLSLLDAHVQRA

SEQ ID NO: 642375 - protein, 20 aa, Mycobacterium
DAALRFIVDYQYSYSGVRMV

SEQ ID NO: 642376 - protein, 25 aa, Mycobacterium
DAALRRAARCDGWMHGGGTEDLDEL

SEQ ID NO: 642377 - protein, 18 aa, Mycobacterium
DAALRVIVEYQLSYPGMR

SEQ ID NO: 642378 - protein, 30 aa, Mycobacterium
DAALSAAGYLCWRGKDLATARGWITALRAY

SEQ ID NO: 642379 - protein, 21 aa, Mycobacterium
DAALTDLGWRDMLEEMPDAAI

SEQ ID NO: 642380 - protein, 20 aa, Mycobacterium
DAALYPGSWSEWSSDPQRPV

SEQ ID NO: 642381 - protein, 19 aa, Mycobacterium
DAAMAAELWALSEQLTKTQ

SEQ ID NO: 642382 - protein, 17 aa, Mycobacterium
DAAMFAGLAEPTGVTAT

SEQ ID NO: 642383 - protein, 27 aa, Mycobacterium
DAAMKHHFAELLGFRYGRSDQQQAVVE

SEQ ID NO: 642384 - protein, 17 aa, Mycobacterium
DAAMRLAIEQSKQVKGT

SEQ ID NO: 642385 - protein, 21 aa, Mycobacterium
DAANALAEFEIPFEVGVVSAH

SEQ ID NO: 642386 - protein, 18 aa, Mycobacterium
DAANGFILDGFPRSLQQA

SEQ ID NO: 642387 - protein, 21 aa, Mycobacterium
DAANPKGLWRRTTLESYRAEN

SEQ ID NO: 642388 - protein, 25 aa, Mycobacterium
DAANRLAVRPGRCVVVAVDPAGATA

SEQ ID NO: 642389 - protein, 18 aa, Mycobacterium
DAAPGMTSQRGWVFLATG

SEQ ID NO: 642390 - protein, 24 aa, Mycobacterium
DAAPGRITAVLGLHDLLGGGHAGQ

SEQ ID NO: 642391 - protein, 21 aa, Mycobacterium
DAAPPWLRPLLDNVGHVPNAY

SEQ ID NO: 642392 - protein, 23 aa, Mycobacterium
DAAPRYAEAGIRAIDLTPAAIGP

SEQ ID NO: 642393 - protein, 22 aa, Mycobacterium
DAAPRYEEAGIRAIDLTPAAVG

SEQ ID NO: 642394 - protein, 19 aa, Mycobacterium
DAAPTLGAGLDWKTSLQEL

SEQ ID NO: 642395 - protein, 25 aa, Mycobacterium
DAAPTLGAGLDWKTSLQELTAARGM

SEQ ID NO: 642396 - protein, 18 aa, Mycobacterium
DAAQACNLVHVYPDTVVH

SEQ ID NO: 642397 - protein, 18 aa, Mycobacterium
DAAQAFGKIIEPLRNSRI

SEQ ID NO: 642398 - protein, 18 aa, Mycobacterium
DAAQDWLYLLEAFDQPHR

SEQ ID NO: 642399 - protein, 17 aa, Mycobacterium
DAARALLEFWWQQDGDG

SEQ ID NO: 642400 - protein, 27 aa, Mycobacterium
DAARETARVPLRFLMGMRSYVNSALRQ

SEQ ID NO: 642401 - protein, 17 aa, Mycobacterium
DAARFAGDLAFPRFSIE

SEQ ID NO: 642402 - protein, 22 aa, Mycobacterium
DAARFRAAGFWSDTTLSDAVRR

SEQ ID NO: 642403 - protein, 17 aa, Mycobacterium
DAARGCLHDCVVFSLPA

SEQ ID NO: 642404 - protein, 17 aa, Mycobacterium
DAARLCGLDEPTGIVAT

SEQ ID NO: 642405 - protein, 22 aa, Mycobacterium
DAARLSWQRARHVADQLPHDAE

SEQ ID NO: 642406 - protein, 22 aa, Mycobacterium
DAARPIEQWVLGSPVTVDLGGA

SEQ ID NO: 642407 - protein, 18 aa, Mycobacterium
DAARRGDTYLSFTRDSEL

SEQ ID NO: 642408 - protein, 27 aa, Mycobacterium
DAARVGIPHTFRIAVSATRPPFVLHRM

SEQ ID NO: 642409 - protein, 18 aa, Mycobacterium
DAASGRRGKPEPSPVARA

SEQ ID NO: 642410 - protein, 18 aa, Mycobacterium
DAASHSFRGPGVRNSVMF

SEQ ID NO: 642411 - protein, 24 aa, Mycobacterium
DAASLRCFREMVLDALHGQSNDLD

SEQ ID NO: 642412 - protein, 18 aa, Mycobacterium
DAASMPVNAASSLSGLGS

SEQ ID NO: 642413 - protein, 20 aa, Mycobacterium
DAASPRVIWGLAPGASGSKA

SEQ ID NO: 642414 - protein, 24 aa, Mycobacterium
DAASRMIFIPGEFGQHDYAAMLQR

SEQ ID NO: 642415 - protein, 26 aa, Mycobacterium
DAASVLHAWRTWCVTLPESVNTSISL

SEQ ID NO: 642416 - protein, 18 aa, Mycobacterium
DAASVPFVAGHRADSAVR

SEQ ID NO: 642417 - protein, 17 aa, Mycobacterium
DAATFLKSIRFPEAARH

SEQ ID NO: 642418 - protein, 35 aa, Mycobacterium
DAATRARLLDRFGMFGIRISIAVLKAGVTDAAGLA

SEQ ID NO: 642419 - protein, 23 aa, Mycobacterium
DAATRKALLEALLRHVPTGDLDI

SEQ ID NO: 642420 - protein, 22 aa, Mycobacterium
DAATRKALLESLLKNVPAGGLD

SEQ ID NO: 642421 - protein, 18 aa, Mycobacterium
DAAVAHERAAEVHERAAA

SEQ ID NO: 642422 - protein, 17 aa, Mycobacterium
DAAVAIHAVERFLGDTA

SEQ ID NO: 642423 - protein, 17 aa, Mycobacterium
DAAVAWGGANGAFELNV

SEQ ID NO: 642424 - protein, 19 aa, Mycobacterium
DAAVAWRAVLEQATTSEDR

SEQ ID NO: 642425 - protein, 18 aa, Mycobacterium
DAAVEANETFTLTLSNPA

SEQ ID NO: 642426 - protein, 19 aa, Mycobacterium
DAAVEAWKLLRTDEGAQFD

SEQ ID NO: 642427 - protein, 28 aa, Mycobacterium
DAAVFPSHYEPFGLVALEAAAAGTPLVT

SEQ ID NO: 642428 - protein, 21 aa, Mycobacterium
DAAVGVCRAAVNGEESQWDAA

SEQ ID NO: 642429 - protein, 18 aa, Mycobacterium
DAAVILKLGRSYPAVRQA

SEQ ID NO: 642430 - protein, 17 aa, Mycobacterium
DAAVLRSRDRVVLVNGP

SEQ ID NO: 642431 - protein, 20 aa, Mycobacterium
DAAVLWSLGLGEPMPISAMH

SEQ ID NO: 642432 - protein, 17 aa, Mycobacterium
DAAVMAAVFADNGATEV

SEQ ID NO: 642433 - protein, 24 aa, Mycobacterium
DAAVRVYLDLIARLARFGEHAGVR

SEQ ID NO: 642434 - protein, 21 aa, Mycobacterium
DAAVTRWGKVDFLINNAGVGS

SEQ ID NO: 642435 - protein, 23 aa, Mycobacterium
DAAWCPCSAVGGDAHAGHTETSV

SEQ ID NO: 642436 - protein, 24 aa, Mycobacterium
DAAWQQRSGLALMFLFDDVLTDAG

SEQ ID NO: 642437 - protein, 17 aa, Mycobacterium
DAAYHCPHAANSCDCRK

SEQ ID NO: 642438 - protein, 17 aa, Mycobacterium
DAAYPPALAESWDSVGL

SEQ ID NO: 642439 - protein, 25 aa, Mycobacterium
DACGRDAYRLLSRAFLGTEADLDES

SEQ ID NO: 642440 - protein, 17 aa, Mycobacterium
DACKRRYGPTFTLRVAG

SEQ ID NO: 642441 - protein, 30 aa, Mycobacterium
DACLDKYARLYAWLGLWERRTDLAVIPADG

SEQ ID NO: 642442 - protein, 22 aa, Mycobacterium
DACPVFPGLRYEEWKLEDPHGQ

SEQ ID NO: 642443 - protein, 23 aa, Mycobacterium
DACRAHGVTELFASGGGTRNPVL

SEQ ID NO: 642444 - protein, 24 aa, Mycobacterium
DACRGGCMAAKFFTGLPLDGPDPE

SEQ ID NO: 642445 - protein, 25 aa, Mycobacterium
DACRGGCMAAKFFTGLPMDGPDPEC

SEQ ID NO: 642446 - protein, 26 aa, Mycobacterium
DACRGGCMAAKFFTGLPMDGPDPECV

SEQ ID NO: 642447 - protein, 22 aa, Mycobacterium
DACVQLHGGYGYMKEYRVARAW

SEQ ID NO: 642448 - protein, 17 aa, Mycobacterium
DADAAELGTFFLTGLFA

SEQ ID NO: 642449 - protein, 17 aa, Mycobacterium
DADAAPERPTWRAKVRN

SEQ ID NO: 642450 - protein, 25 aa, Mycobacterium
DADAAWRAAFDHEQTCVAIIKHANP

SEQ ID NO: 642451 - protein, 20 aa, Mycobacterium
DADAAYAHFGRRFEDLETEV

SEQ ID NO: 642452 - protein, 27 aa, Mycobacterium
DADAGARLHATWTWALSALSHNQVDRI

SEQ ID NO: 642453 - protein, 18 aa, Mycobacterium
DADATWVRTGDLGAYHDG

SEQ ID NO: 642454 - protein, 20 aa, Mycobacterium
DADAVFFMFDPLRVKGVRDQ

SEQ ID NO: 642455 - protein, 26 aa, Mycobacterium
DADCGWQISDARGWSTTRLGNAVETL

SEQ ID NO: 642456 - protein, 18 aa, Mycobacterium
DADCVFYAPLWSDPDEVC

SEQ ID NO: 642457 - protein, 26 aa, Mycobacterium
DADDWLIARWGCLRAANLAWGCGDAE

SEQ ID NO: 642458 - protein, 27 aa, Mycobacterium
DADEHRRRIGVALARLRDPADPLDKVV

SEQ ID NO: 642459 - protein, 25 aa, Mycobacterium
DADERGMRTVMCILNGQLRPVVVRD

SEQ ID NO: 642460 - protein, 18 aa, Mycobacterium
DADEWRQRSAVLLNDTRS

SEQ ID NO: 642461 - protein, 26 aa, Mycobacterium
DADFGRLRWAQLRDRVFGRTDAIAAD

SEQ ID NO: 642462 - protein, 25 aa, Mycobacterium
DADFSIAQGEFFSMLGPSGCGKTTT

SEQ ID NO: 642463 - protein, 24 aa, Mycobacterium
DADFSIASGEFFSMLGPSGCGKTT

SEQ ID NO: 642464 - protein, 19 aa, Mycobacterium
DADGAVVGVRWKHFTETGD

SEQ ID NO: 642465 - protein, 19 aa, Mycobacterium
DADGGAALVEFAGRACYQS

SEQ ID NO: 642466 - protein, 17 aa, Mycobacterium
DADGGLLPYTYRVSLVG

SEQ ID NO: 642467 - protein, 19 aa, Mycobacterium
DADGGPALVEFAGRACYQS

SEQ ID NO: 642468 - protein, 21 aa, Mycobacterium
DADGGSALVEFAGRACYQSWS

SEQ ID NO: 642469 - protein, 20 aa, Mycobacterium
DADGKYLICEGAKPAETFKL

SEQ ID NO: 642470 - protein, 20 aa, Mycobacterium
DADGLRALFTTWITAPQPDL

SEQ ID NO: 642471 - protein, 21 aa, Mycobacterium
DADGLRALFTTWITLPQPSLD

SEQ ID NO: 642472 - protein, 22 aa, Mycobacterium
DADGRRPRVLVAKMGQDGHDRG

SEQ ID NO: 642473 - protein, 21 aa, Mycobacterium
DADHISWARDVLRDLSDTMNA

SEQ ID NO: 642474 - protein, 23 aa, Mycobacterium
DADKYRRLHVIIGDANLAETSTF

SEQ ID NO: 642475 - protein, 23 aa, Mycobacterium
DADLAADILRWGPQSAKKTEAAI

SEQ ID NO: 642476 - protein, 24 aa, Mycobacterium
DADLAVLGYYEWREGLQRGLAAHH

SEQ ID NO: 642477 - protein, 21 aa, Mycobacterium
DADLIEMIEWAAALDESSHDD

SEQ ID NO: 642478 - protein, 24 aa, Mycobacterium
DADLKILASPVRRYAAYTAAIRAE

SEQ ID NO: 642479 - protein, 18 aa, Mycobacterium
DADLPLRPANFVSGLEKM

SEQ ID NO: 642480 - protein, 23 aa, Mycobacterium
DADLRLTLIEVVLALSGLDSSFI

SEQ ID NO: 642481 - protein, 18 aa, Mycobacterium
DADLRWQPELYRALVDRV

SEQ ID NO: 642482 - protein, 23 aa, Mycobacterium
DADPADLKWVPGIANYPDRVPLI

SEQ ID NO: 642483 - protein, 24 aa, Mycobacterium
DADPEHRERILSAYPGYPDRDVCV

SEQ ID NO: 642484 - protein, 25 aa, Mycobacterium
DADPLLGVATAWLFGPESHGLSAEI

SEQ ID NO: 642485 - protein, 20 aa, Mycobacterium
DADPLRPAQVEAINGVEKSL

SEQ ID NO: 642486 - protein, 29 aa, Mycobacterium
DADPPIWRRIDLRSDLTLDVVHQVLQVAF

SEQ ID NO: 642487 - protein, 20 aa, Mycobacterium
DADPSWAWARIAKSRRPIGA

SEQ ID NO: 642488 - protein, 21 aa, Mycobacterium
DADPSWAWARIMKSRRPIGAL

SEQ ID NO: 642489 - protein, 18 aa, Mycobacterium
DADPVFALAEFQKEPLVF

SEQ ID NO: 642490 - protein, 18 aa, Mycobacterium
DADQKWWAERIPDLPDPP

SEQ ID NO: 642491 - protein, 21 aa, Mycobacterium
DADRAKRCHEFLAKLQGANTG

SEQ ID NO: 642492 - protein, 23 aa, Mycobacterium
DADRARAWVIVRMMHNAMWELTE

SEQ ID NO: 642493 - protein, 23 aa, Mycobacterium
DADRAVRVARRIRTGQIAVNGFG

SEQ ID NO: 642494 - protein, 17 aa, Mycobacterium
DADRFITLDAPYRPDPA

SEQ ID NO: 642495 - protein, 24 aa, Mycobacterium
DADRIRNGWYWTGDLGYLDAAGFI

SEQ ID NO: 642496 - protein, 24 aa, Mycobacterium
DADRLRPLLPDNLAYVIYTSGSTG

SEQ ID NO: 642497 - protein, 18 aa, Mycobacterium
DADRLRVLLAAPITDDAE

SEQ ID NO: 642498 - protein, 30 aa, Mycobacterium
DADRQFPGAVWSFSIGWGCDKLITAADLAP

SEQ ID NO: 642499 - protein, 22 aa, Mycobacterium
DADRRFARSFFRGEPGDQADDD

SEQ ID NO: 642500 - protein, 22 aa, Mycobacterium
DADRYRRLHVIIGDANLSETST

SEQ ID NO: 642501 - protein, 19 aa, Mycobacterium
DADSIAALVARLQRVLTAM

SEQ ID NO: 642502 - protein, 29 aa, Mycobacterium
DADTLADLVFAWKVGRAVKSNAIVIASGG

SEQ ID NO: 642503 - protein, 17 aa, Mycobacterium
DADTRFYFVHSYAAQQW

SEQ ID NO: 642504 - protein, 31 aa, Mycobacterium
DADVALLLRRLEHVPIATAVRLPSPDPAPIG

SEQ ID NO: 642505 - protein, 24 aa, Mycobacterium
DADVIRYLRWFTFLSADELGELEQ

SEQ ID NO: 642506 - protein, 24 aa, Mycobacterium
DADVIRYLRWFTFLSAEELAELEQ

SEQ ID NO: 642507 - protein, 24 aa, Mycobacterium
DADVIRYLRWFTFLTADELGELEQ

SEQ ID NO: 642508 - protein, 26 aa, Mycobacterium
DADVIRYLRWFTFLVAEELTELEQAT

SEQ ID NO: 642509 - protein, 18 aa, Mycobacterium
DADVKIFLTASAEERARR

SEQ ID NO: 642510 - protein, 20 aa, Mycobacterium
DADVPYTRIHEFRHFHPERA

SEQ ID NO: 642511 - protein, 18 aa, Mycobacterium
DADVRRLAGRPVSHIVLT

SEQ ID NO: 642512 - protein, 17 aa, Mycobacterium
DADVVAFHSARHGRSIA

SEQ ID NO: 642513 - protein, 24 aa, Mycobacterium
DADVVPYLRWFTFLTAEELAELEL

SEQ ID NO: 642514 - protein, 19 aa, Mycobacterium
DADVWDWAGELAELPTLLA

SEQ ID NO: 642515 - protein, 26 aa, Mycobacterium
DADVYRWPLIPALAMVAAMPALGAAE

SEQ ID NO: 642516 - protein, 24 aa, Mycobacterium
DADWLGDGWVSLLRKWIDDAERSG

SEQ ID NO: 642517 - protein, 18 aa, Mycobacterium
DADYIWLACRTDPEAAKH

SEQ ID NO: 642518 - protein, 18 aa, Mycobacterium
DADYIWLACRTDPEAPKH

SEQ ID NO: 642519 - protein, 18 aa, Mycobacterium
DADYIWLACRTDPEAVKH

SEQ ID NO: 642520 - protein, 22 aa, Mycobacterium
DAEAAGLLDLFGPRDRWNTTQH

SEQ ID NO: 642521 - protein, 28 aa, Mycobacterium
DAEAARHFGCGFAPSGWDSLTKHLVRKG

SEQ ID NO: 642522 - protein, 18 aa, Mycobacterium
DAEAAWRGAFLAHGSLTE

SEQ ID NO: 642523 - protein, 27 aa, Mycobacterium
DAEAQLELKWRAIKEDLERAHADAAVI

SEQ ID NO: 642524 - protein, 24 aa, Mycobacterium
DAEARAGIVRLHLRDRPVAGIDPR

SEQ ID NO: 642525 - protein, 22 aa, Mycobacterium
DAEARPGPDLVDLFPTGKARPG

SEQ ID NO: 642526 - protein, 18 aa, Mycobacterium
DAECTASMVTRAGGVIAG

SEQ ID NO: 642527 - protein, 21 aa, Mycobacterium
DAEDIWECPLHGSCFDSGGSV

SEQ ID NO: 642528 - protein, 22 aa, Mycobacterium
DAEDRRQFAWARIDHLDDDPGH

SEQ ID NO: 642529 - protein, 19 aa, Mycobacterium
DAEEGPAWWDGTVIEHLRV

SEQ ID NO: 642530 - protein, 23 aa, Mycobacterium
DAEFDKRCAAMGFDDFATGNLRT

SEQ ID NO: 642531 - protein, 23 aa, Mycobacterium
DAEFRVGTMGLGWDSEAQTIVVE

SEQ ID NO: 642532 - protein, 22 aa, Mycobacterium
DAEFRVGTMGLGWDSEAQTVVV

SEQ ID NO: 642533 - protein, 23 aa, Mycobacterium
DAEGCVEEILVLAAALSIPDPRE

SEQ ID NO: 642534 - protein, 25 aa, Mycobacterium
DAEGELRAAVLEFMDSVRRAEDTIA

SEQ ID NO: 642535 - protein, 17 aa, Mycobacterium
DAEGFVWIVGRADQAII

SEQ ID NO: 642536 - protein, 24 aa, Mycobacterium
DAEGLLPAITFVFSRAGCDAAVQQ

SEQ ID NO: 642537 - protein, 28 aa, Mycobacterium
DAEGLRAFCDICVAAFAGFAIVKPQVAF

SEQ ID NO: 642538 - protein, 23 aa, Mycobacterium
DAEGRLAIQTAAKVARGESVPEF

SEQ ID NO: 642539 - protein, 22 aa, Mycobacterium
DAEGVMWTWTVDLRTGAVSESQ

SEQ ID NO: 642540 - protein, 26 aa, Mycobacterium
DAEIAILHRHAHGFDPRDLSAIKPVA

SEQ ID NO: 642541 - protein, 23 aa, Mycobacterium
DAEIARVVPFIEWVRGAHPDLLI

SEQ ID NO: 642542 - protein, 18 aa, Mycobacterium
DAEIKRFIAMHVAGEIDS

SEQ ID NO: 642543 - protein, 19 aa, Mycobacterium
DAEIRRLTTIDVLIIDDFA

SEQ ID NO: 642544 - protein, 27 aa, Mycobacterium
DAEKLWWAEVCQIASKLMAQMPSGGVL

SEQ ID NO: 642545 - protein, 23 aa, Mycobacterium
DAEKYRRLHVIVGDSNMAETTTM

SEQ ID NO: 642546 - protein, 23 aa, Mycobacterium
DAEKYRRLHVIVGDSNMCEATTM

SEQ ID NO: 642547 - protein, 23 aa, Mycobacterium
DAEKYRRLHVIVGDSNMSESTTM

SEQ ID NO: 642548 - protein, 23 aa, Mycobacterium
DAELCAPAGLFLVAALHEEPVGC

SEQ ID NO: 642549 - protein, 19 aa, Mycobacterium
DAELGRLAPGYLADIIAVP

SEQ ID NO: 642550 - protein, 22 aa, Mycobacterium
DAELGRLCSPIGLDLGARTPEE

SEQ ID NO: 642551 - protein, 17 aa, Mycobacterium
DAELGWIATAFDPDVLT

SEQ ID NO: 642552 - protein, 24 aa, Mycobacterium
DAELIPKLMSAGVIEVAPLAYMRG

SEQ ID NO: 642553 - protein, 21 aa, Mycobacterium
DAELLRQAWLTATNARNALVL

SEQ ID NO: 642554 - protein, 26 aa, Mycobacterium
DAELNRTRFTAVPGQGLFYRSGDLAH

SEQ ID NO: 642555 - protein, 21 aa, Mycobacterium
DAELPSAIADFVRDEDNRDGT

SEQ ID NO: 642556 - protein, 18 aa, Mycobacterium
DAELRPAYSNADAAQQVA

SEQ ID NO: 642557 - protein, 18 aa, Mycobacterium
DAELRPAYSNADAARQVA

SEQ ID NO: 642558 - protein, 24 aa, Mycobacterium
DAELRRRLGAAASERARSEFSATA

SEQ ID NO: 642559 - protein, 26 aa, Mycobacterium
DAEMICVGCVGIGRYARSIVGSTATE

SEQ ID NO: 642560 - protein, 25 aa, Mycobacterium
DAENCLRAAVLDFSDNVRRAERAIV

SEQ ID NO: 642561 - protein, 22 aa, Mycobacterium
DAEPGRARGCGPLRQVVSRRVA

SEQ ID NO: 642562 - protein, 22 aa, Mycobacterium
DAEPPGDVLVFLSGEREIRDTA

SEQ ID NO: 642563 - protein, 22 aa, Mycobacterium
DAEPVFPLVQAMPIPYVEPEDI

SEQ ID NO: 642564 - protein, 18 aa, Mycobacterium
DAEPVFYVQQAMKVPWVE

SEQ ID NO: 642565 - protein, 20 aa, Mycobacterium
DAEQALDCIQRRGVTHAQFV

SEQ ID NO: 642566 - protein, 23 aa, Mycobacterium
DAERAAALRRIRFAGDQHAIDAL

SEQ ID NO: 642567 - protein, 27 aa, Mycobacterium
DAERARLAYLRACNRLWALADPDGARS

SEQ ID NO: 642568 - protein, 23 aa, Mycobacterium
DAERAVGVARRIRTGQIAVNGFG

SEQ ID NO: 642569 - protein, 18 aa, Mycobacterium
DAERAVWIGHDWGAAVVW

SEQ ID NO: 642570 - protein, 24 aa, Mycobacterium
DAERCARVAGLAVRHAQLRHVAPP

SEQ ID NO: 642571 - protein, 23 aa, Mycobacterium
DAERIRRVAERIVETKKAGNDVV

SEQ ID NO: 642572 - protein, 24 aa, Mycobacterium
DAERRLRDAVSLRAAADVRGQATT

SEQ ID NO: 642573 - protein, 25 aa, Mycobacterium
DAESLRLLLRRIFESAGGTHDDWDT

SEQ ID NO: 642574 - protein, 20 aa, Mycobacterium
DAESTWKLLLDRQSGIRKLE

SEQ ID NO: 642575 - protein, 21 aa, Mycobacterium
DAETLRAAPGLPKVTTEPRTV

SEQ ID NO: 642576 - protein, 25 aa, Mycobacterium
DAEVAGFCGPVFGDLPIPAATAPVE

SEQ ID NO: 642577 - protein, 22 aa, Mycobacterium
DAEVDRIWFAPNVWPREVPELA

SEQ ID NO: 642578 - protein, 23 aa, Mycobacterium
DAEVPGTPSREWTGLTRTSWSTL

SEQ ID NO: 642579 - protein, 20 aa, Mycobacterium
DAEYAAFGVLLGIPGEKVPR

SEQ ID NO: 642580 - protein, 19 aa, Mycobacterium
DAFAIVWDGRQLHGLNASG

SEQ ID NO: 642581 - protein, 24 aa, Mycobacterium
DAFALEWRSRYLPSMSEICSGRRE

SEQ ID NO: 642582 - protein, 19 aa, Mycobacterium
DAFALYQRRTCGIAAHSVA

SEQ ID NO: 642583 - protein, 18 aa, Mycobacterium
DAFCRHMGGDLSQGEVKG

SEQ ID NO: 642584 - protein, 24 aa, Mycobacterium
DAFDADFFAAWGKLAAVRTPTIAA

SEQ ID NO: 642585 - protein, 19 aa, Mycobacterium
DAFDAMFGYPGPTVAAING

SEQ ID NO: 642586 - protein, 18 aa, Mycobacterium
DAFDYRVVVETGATRLAA

SEQ ID NO: 642587 - protein, 20 aa, Mycobacterium
DAFEAVRVIGRAAGVEFTFR

SEQ ID NO: 642588 - protein, 24 aa, Mycobacterium
DAFGRPAPDLPIGVTDYATAVRVH

SEQ ID NO: 642589 - protein, 24 aa, Mycobacterium
DAFGRPVPDLPLGLTDYATAVRVH

SEQ ID NO: 642590 - protein, 23 aa, Mycobacterium
DAFLDFAQRWIAPGGAGPRTGDS

SEQ ID NO: 642591 - protein, 27 aa, Mycobacterium
DAFLDKALEGFTMFALNQGEVCTCPSR

SEQ ID NO: 642592 - protein, 24 aa, Mycobacterium
DAFLEPWTTLGHLAGRHRFNRMRL

SEQ ID NO: 642593 - protein, 24 aa, Mycobacterium
DAFMAGLLDALWELGLLGADRRAA

SEQ ID NO: 642594 - protein, 22 aa, Mycobacterium
DAFMAGLLDTLWEQGLLGADRR

SEQ ID NO: 642595 - protein, 18 aa, Mycobacterium
DAFMTGLIDALWSADLLG

SEQ ID NO: 642596 - protein, 17 aa, Mycobacterium
DAFNAYIDAARAVANAI

SEQ ID NO: 642597 - protein, 17 aa, Mycobacterium
DAFPEVYKQAVTPADAI

SEQ ID NO: 642598 - protein, 29 aa, Mycobacterium
DAFQCGYCTPGQICSAVGMLDEVKAGAPS

SEQ ID NO: 642599 - protein, 29 aa, Mycobacterium
DAFQCGYCTPGQICSAVGMLDEVKSGAPS

SEQ ID NO: 642600 - protein, 18 aa, Mycobacterium
DAFQEFYHAPVLHANQSP

SEQ ID NO: 642601 - protein, 25 aa, Mycobacterium
DAFQEWARTAALPAPSARVGTIGSP

SEQ ID NO: 642602 - protein, 18 aa, Mycobacterium
DAFQEYYHVPSLHPQQVP

SEQ ID NO: 642603 - protein, 18 aa, Mycobacterium
DAFQEYYHVPSLHSQQVP

SEQ ID NO: 642604 - protein, 18 aa, Mycobacterium
DAFQEYYHVPSLHTQQVP

SEQ ID NO: 642605 - protein, 23 aa, Mycobacterium
DAFRPGVADAMFAHHIAELERLA

SEQ ID NO: 642606 - protein, 19 aa, Mycobacterium
DAFRRFDARSSRPYQVMIS

SEQ ID NO: 642607 - protein, 21 aa, Mycobacterium
DAFRYRPGQFLTLKIPSEQTG

SEQ ID NO: 642608 - protein, 19 aa, Mycobacterium
DAFTDGWFKTGDLGALDED

SEQ ID NO: 642609 - protein, 19 aa, Mycobacterium
DAFTDGWFKTGDLGVLDDD

SEQ ID NO: 642610 - protein, 22 aa, Mycobacterium
DAFTIERLRAGGAVLIGLTNMP

SEQ ID NO: 642611 - protein, 25 aa, Mycobacterium
DAFTRTGFTGGLNWYRNFDRNWELT

SEQ ID NO: 642612 - protein, 20 aa, Mycobacterium
DAFVDRLAPGGALVVCVDDP

SEQ ID NO: 642613 - protein, 23 aa, Mycobacterium
DAFVSEVYDWVIAEIAASTQAAV

SEQ ID NO: 642614 - protein, 17 aa, Mycobacterium
DAFVYPETMPAWFTDAD

SEQ ID NO: 642615 - protein, 22 aa, Mycobacterium
DAFYAHVRRVGGAVLASPKRHT

SEQ ID NO: 642616 - protein, 21 aa, Mycobacterium
DAGALLWWLRATGSADFEQTA

SEQ ID NO: 642617 - protein, 21 aa, Mycobacterium
DAGAMAVRLGPTVLRTSTAAA

SEQ ID NO: 642618 - protein, 32 aa, Mycobacterium
DAGANGFAGFGGLGGEGGWVGNITLGPIGVDG

SEQ ID NO: 642619 - protein, 27 aa, Mycobacterium
DAGARMRWARCVSAPLLAGAFAVAKEW

SEQ ID NO: 642620 - protein, 17 aa, Mycobacterium
DAGARWILDLGPGDILT

SEQ ID NO: 642621 - protein, 21 aa, Mycobacterium
DAGATRLGLSGSRAVLDGFGS

SEQ ID NO: 642622 - protein, 19 aa, Mycobacterium
DAGCCGLAGNFGFEKGHYD

SEQ ID NO: 642623 - protein, 23 aa, Mycobacterium
DAGCGEAALALALAGRGHPVVGL

SEQ ID NO: 642624 - protein, 23 aa, Mycobacterium
DAGCGEAATALYLAAQGFTTVGL

SEQ ID NO: 642625 - protein, 25 aa, Mycobacterium
DAGCGEGGDAIWLAQHGWQVTGMDF

SEQ ID NO: 642626 - protein, 22 aa, Mycobacterium
DAGCGPGRLGRHLAAAGHRVVG

SEQ ID NO: 642627 - protein, 21 aa, Mycobacterium
DAGCYAVHMVRTFGGSTPEVV

SEQ ID NO: 642628 - protein, 20 aa, Mycobacterium
DAGDCGACSVLVDGAAVHSC

SEQ ID NO: 642629 - protein, 17 aa, Mycobacterium
DAGDEWEAFLGKDEDLF

SEQ ID NO: 642630 - protein, 24 aa, Mycobacterium
DAGDEWRQVIRRAAAATAGPQFVA

SEQ ID NO: 642631 - protein, 17 aa, Mycobacterium
DAGDFGALGDFGGPGGL

SEQ ID NO: 642632 - protein, 20 aa, Mycobacterium
DAGEALRLANGVRYALASSV

SEQ ID NO: 642633 - protein, 22 aa, Mycobacterium
DAGEIPWSLFSPFTPYLRSRGV

SEQ ID NO: 642634 - protein, 24 aa, Mycobacterium
DAGELTAGYALYGTTGWDDVTVYD

SEQ ID NO: 642635 - protein, 19 aa, Mycobacterium
DAGFCEKGKGMEFVAGHDL

SEQ ID NO: 642636 - protein, 18 aa, Mycobacterium
DAGFCEKGKGMEFVANHD

SEQ ID NO: 642637 - protein, 18 aa, Mycobacterium
DAGFKQSVRMIADHMGFR

SEQ ID NO: 642638 - protein, 26 aa, Mycobacterium
DAGGHVPGGWFWRYDLAPNGHRTDVT

SEQ ID NO: 642639 - protein, 18 aa, Mycobacterium
DAGGKWVVPGFIDVHTHY

SEQ ID NO: 642640 - protein, 22 aa, Mycobacterium
DAGGPPGALFGYLAAGKKSVAN

SEQ ID NO: 642641 - protein, 26 aa, Mycobacterium
DAGGWPYFHMEMMLAGIPIPVPPGGP

SEQ ID NO: 642642 - protein, 17 aa, Mycobacterium
DAGGYKADAMWGPSSDP

SEQ ID NO: 642643 - protein, 26 aa, Mycobacterium
DAGHCGFGRFVFHHHPEYGAALETYL

SEQ ID NO: 642644 - protein, 17 aa, Mycobacterium
DAGHDVVVWDLSDADVI

SEQ ID NO: 642645 - protein, 24 aa, Mycobacterium
DAGHIPGAIKLDWRSDLQDPVKRD

SEQ ID NO: 642646 - protein, 23 aa, Mycobacterium
DAGHLRWHSAEDMAARLNQAGVG

SEQ ID NO: 642647 - protein, 18 aa, Mycobacterium
DAGHRAALEFLDRPDRPS

SEQ ID NO: 642648 - protein, 25 aa, Mycobacterium
DAGIALRFQLLWYPSTTFDTSLPSF

SEQ ID NO: 642649 - protein, 20 aa, Mycobacterium
DAGIDCIEHGFLIDDGAIAS

SEQ ID NO: 642650 - protein, 24 aa, Mycobacterium
DAGIRNPKVVWVHNDSGDSARIFA

SEQ ID NO: 642651 - protein, 21 aa, Mycobacterium
DAGLEIARRFAHLTYRGEAEL

SEQ ID NO: 642652 - protein, 24 aa, Mycobacterium
DAGLFCLRPLPSLKPLERDALDQA

SEQ ID NO: 642653 - protein, 22 aa, Mycobacterium
DAGLIMKIVGDFEAYPQWNEEI

SEQ ID NO: 642654 - protein, 18 aa, Mycobacterium
DAGLKSRTLLQVHDELLF

SEQ ID NO: 642655 - protein, 25 aa, Mycobacterium
DAGLLAGALTMVWQRGEVLQVNEIG

SEQ ID NO: 642656 - protein, 25 aa, Mycobacterium
DAGLLAGAVTLVWHAGEVRQVNELG

SEQ ID NO: 642657 - protein, 25 aa, Mycobacterium
DAGLLAGAVTLVWQAGKVLQVNTLG

SEQ ID NO: 642658 - protein, 25 aa, Mycobacterium
DAGLLAGAVTVVWQRGELLQVNEIG

SEQ ID NO: 642659 - protein, 20 aa, Mycobacterium
DAGLLFSAGGAGGFGGFGSG

SEQ ID NO: 642660 - protein, 20 aa, Mycobacterium
DAGLLPSERSNFPLSSITTQ

SEQ ID NO: 642661 - protein, 19 aa, Mycobacterium
DAGLLSGAVTVVWQHGEVL

SEQ ID NO: 642662 - protein, 24 aa, Mycobacterium
DAGLLSGAVTVVWQRGEVLQVNEI

SEQ ID NO: 642663 - protein, 23 aa, Mycobacterium
DAGLPFEVVDGIVASHLAESEIF

SEQ ID NO: 642664 - protein, 30 aa, Mycobacterium
DAGLPKPGVWPLCHSLAFDVSVWEIWGALL

SEQ ID NO: 642665 - protein, 18 aa, Mycobacterium
DAGLPMQRDTLFRIASMT

SEQ ID NO: 642666 - protein, 22 aa, Mycobacterium
DAGLQRRPLAASECVTQNLAVV

SEQ ID NO: 642667 - protein, 23 aa, Mycobacterium
DAGLRPADIDGMVTFSVDDNEEI

SEQ ID NO: 642668 - protein, 24 aa, Mycobacterium
DAGLSAKIAFFFTRRKLAQMTGLQ

SEQ ID NO: 642669 - protein, 28 aa, Mycobacterium
DAGLTRWPFADVRGSHNLIYSRDKAEGN

SEQ ID NO: 642670 - protein, 26 aa, Mycobacterium
DAGLVCGGVKTANATVYMIDTVLMPP

SEQ ID NO: 642671 - protein, 18 aa, Mycobacterium
DAGMEVCCGGILGMGETL

SEQ ID NO: 642672 - protein, 18 aa, Mycobacterium
DAGMEVCCGGILGMGETV

SEQ ID NO: 642673 - protein, 20 aa, Mycobacterium
DAGMFGFGGAGGDGGIGDDT

SEQ ID NO: 642674 - protein, 25 aa, Mycobacterium
DAGNHSPGGWFWRYDLQPDGDATAV

SEQ ID NO: 642675 - protein, 19 aa, Mycobacterium
DAGPGFCHINFQVETLDDV

SEQ ID NO: 642676 - protein, 17 aa, Mycobacterium
DAGPGGFGGHGGDALLF

SEQ ID NO: 642677 - protein, 29 aa, Mycobacterium
DAGPQLHAEWTWASSVFDRGALVKLAGLW

SEQ ID NO: 642678 - protein, 23 aa, Mycobacterium
DAGPVKGFGAATHFHKAMSEAFF

SEQ ID NO: 642679 - protein, 25 aa, Mycobacterium
DAGRDCPKRMTFGPCGGVHPDGQCE

SEQ ID NO: 642680 - protein, 17 aa, Mycobacterium
DAGRFLSAFDAMLTSAG

SEQ ID NO: 642681 - protein, 17 aa, Mycobacterium
DAGRFLTTIKRRLEEGA

SEQ ID NO: 642682 - protein, 25 aa, Mycobacterium
DAGRILRYGLRIHVISRDTSAQAWA

SEQ ID NO: 642683 - protein, 17 aa, Mycobacterium
DAGRPAPRIVAGIPVCL

SEQ ID NO: 642684 - protein, 29 aa, Mycobacterium
DAGRPPPRIVAGIPVCLCAPSQVEEAKER

SEQ ID NO: 642685 - protein, 25 aa, Mycobacterium
DAGRQIRDAFVVGAGYSELMTADYS

SEQ ID NO: 642686 - protein, 23 aa, Mycobacterium
DAGRQIRDAFVVGDGYSELMTAD

SEQ ID NO: 642687 - protein, 25 aa, Mycobacterium
DAGRRAALAMVRRHRLMETFLVNEL

SEQ ID NO: 642688 - protein, 24 aa, Mycobacterium
DAGRRAALAMVRRHRLMETFLVQE

SEQ ID NO: 642689 - protein, 25 aa, Mycobacterium
DAGRYGTKNGKGWTGDFDDETKAAV

SEQ ID NO: 642690 - protein, 21 aa, Mycobacterium
DAGSVWVCHAEGTLGADSAQP

SEQ ID NO: 642691 - protein, 21 aa, Mycobacterium
DAGTDEWAQFIGRVSVSGEAS

SEQ ID NO: 642692 - protein, 25 aa, Mycobacterium
DAGTEIARLLPFVEWLRDAYPHQLI

SEQ ID NO: 642693 - protein, 26 aa, Mycobacterium
DAGTESFDDFSWIKTVVVRTAAEPVD

SEQ ID NO: 642694 - protein, 26 aa, Mycobacterium
DAGTLPTRYARGWHCLGVAKDFMDGE

SEQ ID NO: 642695 - protein, 23 aa, Mycobacterium
DAGTRKALLESLLKSVPAGALDL

SEQ ID NO: 642696 - protein, 28 aa, Mycobacterium
DAGVAGRYFRFYGHAIDSYYGQTIPLTT

SEQ ID NO: 642697 - protein, 18 aa, Mycobacterium
DAGVCAIIAHAEAFGIAG

SEQ ID NO: 642698 - protein, 18 aa, Mycobacterium
DAGVDLFLCDSTNAEHPG

SEQ ID NO: 642699 - protein, 22 aa, Mycobacterium
DAGVDWKDIQFGFGGSYEVSNP

SEQ ID NO: 642700 - protein, 20 aa, Mycobacterium
DAGVLAALLLNRIMLAPGEA

SEQ ID NO: 642701 - protein, 20 aa, Mycobacterium
DAGVLAALLLNRISLAPGEA

SEQ ID NO: 642702 - protein, 20 aa, Mycobacterium
DAGVLAALLLNRISLSPGEA

SEQ ID NO: 642703 - protein, 19 aa, Mycobacterium
DAGVLAALLLNRVSLGPGE

SEQ ID NO: 642704 - protein, 19 aa, Mycobacterium
DAGVLASLLLNRLSLAPGE

SEQ ID NO: 642705 - protein, 19 aa, Mycobacterium
DAGVLRLDAYRAAGSEVLT

SEQ ID NO: 642706 - protein, 25 aa, Mycobacterium
DAGVLRPLPVTAFDVRRAPAALRYL

SEQ ID NO: 642707 - protein, 17 aa, Mycobacterium
DAGVLVCVLAQLTGDAG

SEQ ID NO: 642708 - protein, 17 aa, Mycobacterium
DAGVRRGECVAFLDKNH

SEQ ID NO: 642709 - protein, 23 aa, Mycobacterium
DAGVRRIVYLGGFVPADEALSEH

SEQ ID NO: 642710 - protein, 19 aa, Mycobacterium
DAGVSVAGFGVHPVMLDAA

SEQ ID NO: 642711 - protein, 28 aa, Mycobacterium
DAGVSVCRACPRLVEWREEAASVKRKSY

SEQ ID NO: 642712 - protein, 20 aa, Mycobacterium
DAGVYRWTVTPGHTAVGAVV

SEQ ID NO: 642713 - protein, 19 aa, Mycobacterium
DAGWCPCEAAGGDAHAGHT

SEQ ID NO: 642714 - protein, 24 aa, Mycobacterium
DAGWGAKIAFFFTRRKLTQMTGLE

SEQ ID NO: 642715 - protein, 24 aa, Mycobacterium
DAGWLRGPDGLRFLVGDLVPDTAV

SEQ ID NO: 642716 - protein, 32 aa, Mycobacterium
DAGWSRTDHYGWISGLLLELGITSLDALTAVL

SEQ ID NO: 642717 - protein, 18 aa, Mycobacterium
DAGYEIAVHFAPGRTDAS

SEQ ID NO: 642718 - protein, 25 aa, Mycobacterium
DAGYRGEIKVSLINLDPQTPVVISR

SEQ ID NO: 642719 - protein, 23 aa, Mycobacterium
DAGYRSLGLTGFRLEISSLGDAS

SEQ ID NO: 642720 - protein, 21 aa, Mycobacterium
DAHAFGARWAGFARSSVFSAL

SEQ ID NO: 642721 - protein, 30 aa, Mycobacterium
DAHALIAWCRERMAGFKVPRYVEFLDELPL

SEQ ID NO: 642722 - protein, 23 aa, Mycobacterium
DAHARLLVWELINALRRDGVTVL

SEQ ID NO: 642723 - protein, 22 aa, Mycobacterium
DAHARLVVWELIDALRRDGVTV

SEQ ID NO: 642724 - protein, 21 aa, Mycobacterium
DAHARLVVWELIDCLRRDGVS

SEQ ID NO: 642725 - protein, 21 aa, Mycobacterium
DAHGFEVRFLPTLDDGRLALD

SEQ ID NO: 642726 - protein, 25 aa, Mycobacterium
DAHGRLRIATAVGINGDVAAKARDL

SEQ ID NO: 642727 - protein, 24 aa, Mycobacterium
DAHGRLRVGAAVGINGDVGAKARS

SEQ ID NO: 642728 - protein, 19 aa, Mycobacterium
DAHIGLKLFRTPQELVSEP

SEQ ID NO: 642729 - protein, 19 aa, Mycobacterium
DAHIGRFVGQLAGVEIVSS

SEQ ID NO: 642730 - protein, 22 aa, Mycobacterium
DAHIYYRRALGLTAALGRSGGA

SEQ ID NO: 642731 - protein, 19 aa, Mycobacterium
DAHLYLRRAHSIGRFLGGA

SEQ ID NO: 642732 - protein, 23 aa, Mycobacterium
DAHLYVRHAWQAAAMLGDSRALY

SEQ ID NO: 642733 - protein, 20 aa, Mycobacterium
DAHPDLVGRLVLTNCDAFET

SEQ ID NO: 642734 - protein, 21 aa, Mycobacterium
DAHSGGVGQLIAAARAAGAGR

SEQ ID NO: 642735 - protein, 26 aa, Mycobacterium
DAHTEIARLIPFIEWLREAYPDQLIS

SEQ ID NO: 642736 - protein, 23 aa, Mycobacterium
DAHVRWVMRKGLKDLAAQRRFPV

SEQ ID NO: 642737 - protein, 23 aa, Mycobacterium
DAHVYLCGNNGFVQAVRGQLTDR

SEQ ID NO: 642738 - protein, 24 aa, Mycobacterium
DAIAEAGPGWARVEDRRRGLFVAQ

SEQ ID NO: 642739 - protein, 27 aa, Mycobacterium
DAIAEFGRGGALFTITGTWMQQPLQDA

SEQ ID NO: 642740 - protein, 18 aa, Mycobacterium
DAIAGWWNTGAPNEADGS

SEQ ID NO: 642741 - protein, 25 aa, Mycobacterium
DAIARAIANGCDRVLNLAAGLDTRP

SEQ ID NO: 642742 - protein, 29 aa, Mycobacterium
DAIAREVRRGGLPLQRLVNGEGMASLARE

SEQ ID NO: 642743 - protein, 27 aa, Mycobacterium
DAIARFKRLDGFDVRFLTGTDVHGLKM

SEQ ID NO: 642744 - protein, 24 aa, Mycobacterium
DAICAGIDAILRLGGAQPGDKTMV

SEQ ID NO: 642745 - protein, 22 aa, Mycobacterium
DAIDAVEWARAFGATLGVDTSR

SEQ ID NO: 642746 - protein, 22 aa, Mycobacterium
DAIDQWAFCALTSSPGARTFYD

SEQ ID NO: 642747 - protein, 17 aa, Mycobacterium
DAIDWQAYFHLRNRLVV

SEQ ID NO: 642748 - protein, 18 aa, Mycobacterium
DAIELSALGALRLIQAFT

SEQ ID NO: 642749 - protein, 19 aa, Mycobacterium
DAIELTVFGALRLIQGFTP

SEQ ID NO: 642750 - protein, 17 aa, Mycobacterium
DAIGAEIDGAVAGQDSL

SEQ ID NO: 642751 - protein, 19 aa, Mycobacterium
DAIGAHFVLAPGAEVTTEA

SEQ ID NO: 642752 - protein, 18 aa, Mycobacterium
DAIGMLVGMPVEIAPAIQ

SEQ ID NO: 642753 - protein, 26 aa, Mycobacterium
DAIGRFAVRLDVSRLLVVGSGRAMNA

SEQ ID NO: 642754 - protein, 17 aa, Mycobacterium
DAIGSGLEVIWTHTPTK

SEQ ID NO: 642755 - protein, 18 aa, Mycobacterium
DAIHAYKERGGRLMYMGG

SEQ ID NO: 642756 - protein, 17 aa, Mycobacterium
DAIICLGNSFTHLHDEH

SEQ ID NO: 642757 - protein, 22 aa, Mycobacterium
DAIKELFSMSATRYYQVLNALV

SEQ ID NO: 642758 - protein, 23 aa, Mycobacterium
DAIKELFSMSATRYYQVLNALVD

SEQ ID NO: 642759 - protein, 23 aa, Mycobacterium
DAIKERFPQINWSITPGNSSPLS

SEQ ID NO: 642760 - protein, 24 aa, Mycobacterium
DAILARLAGELGVRPGGTTEDGKV

SEQ ID NO: 642761 - protein, 25 aa, Mycobacterium
DAILEPWTMLGHLAARHRGRLRFGV

SEQ ID NO: 642762 - protein, 24 aa, Mycobacterium
DAILRAGVPMLLIRGQMSDLVSQD

SEQ ID NO: 642763 - protein, 21 aa, Mycobacterium
DAIPTDLWIGGKQVPSSTGTR

SEQ ID NO: 642764 - protein, 24 aa, Mycobacterium
DAIRAAGGIPREFNTIAVDDGIAM

SEQ ID NO: 642765 - protein, 17 aa, Mycobacterium
DAIRIGRRIMARLNWRK

SEQ ID NO: 642766 - protein, 27 aa, Mycobacterium
DAIRLEFATHFWGTLSMTRAFAPILAR

SEQ ID NO: 642767 - protein, 17 aa, Mycobacterium
DAIRSGLPSGIAVAGSY

SEQ ID NO: 642768 - protein, 17 aa, Mycobacterium
DAISGWWNTGAANEADG

SEQ ID NO: 642769 - protein, 17 aa, Mycobacterium
DAISRPVIPIFVNAIGV

SEQ ID NO: 642770 - protein, 24 aa, Mycobacterium
DAITEFPADRGWDIEGTFDPDPDA

SEQ ID NO: 642771 - protein, 18 aa, Mycobacterium
DAITFPRGMTGPGDDPYA

SEQ ID NO: 642772 - protein, 26 aa, Mycobacterium
DAITGVNLRGFFELTRAALGALPAGG

SEQ ID NO: 642773 - protein, 28 aa, Mycobacterium
DAIVRPLLRFFFKSWFRVEVSGVENIPS

SEQ ID NO: 642774 - protein, 28 aa, Mycobacterium
DAIVRPLLRFFFRSWFRVEVSGIENLPS

SEQ ID NO: 642775 - protein, 26 aa, Mycobacterium
DAKAFARLGIRCFGFSPLRLPPDLDF

SEQ ID NO: 642776 - protein, 26 aa, Mycobacterium
DAKAFARLGIRCFGFSPLRLPPELDF

SEQ ID NO: 642777 - protein, 23 aa, Mycobacterium
DAKALARICALNAVAAVDALVGI

SEQ ID NO: 642778 - protein, 23 aa, Mycobacterium
DAKESRGIHALRARGAQINIGHD

SEQ ID NO: 642779 - protein, 25 aa, Mycobacterium
DAKESRGLHALRARGALIRIGHDAA

SEQ ID NO: 642780 - protein, 19 aa, Mycobacterium
DAKEWRQLVAAMEGTLRLH

SEQ ID NO: 642781 - protein, 30 aa, Mycobacterium
DAKIGYPPMRVWGVPAAGLWAHRLGDQRAK

SEQ ID NO: 642782 - protein, 32 aa, Mycobacterium
DAKIGYPPTRVWGVPAAGLWAHRLGDARAKRL

SEQ ID NO: 642783 - protein, 21 aa, Mycobacterium
DAKITVPALFLAGAADPVLGF

SEQ ID NO: 642784 - protein, 19 aa, Mycobacterium
DAKKRYALRQTPVFVEEFI

SEQ ID NO: 642785 - protein, 22 aa, Mycobacterium
DAKLRVQMRAEISRLQDRLGTT

SEQ ID NO: 642786 - protein, 25 aa, Mycobacterium
DAKLVLREPVTGLARYPAAAPTELV

SEQ ID NO: 642787 - protein, 17 aa, Mycobacterium
DAKLWVDMAHFAGLVAA

SEQ ID NO: 642788 - protein, 23 aa, Mycobacterium
DAKNSARYLVHFTQSGIGLPDES

SEQ ID NO: 642789 - protein, 23 aa, Mycobacterium
DAKNSARYLVHFTQSGLGLPDES

SEQ ID NO: 642790 - protein, 20 aa, Mycobacterium
DAKPCGHGRMLRKEDPRFIR

SEQ ID NO: 642791 - protein, 19 aa, Mycobacterium
DAKPPVCKIMDYGKFKYET

SEQ ID NO: 642792 - protein, 20 aa, Mycobacterium
DAKPTFGFADRYRVESTIRK

SEQ ID NO: 642793 - protein, 20 aa, Mycobacterium
DAKQFIAMPWHIYGDDPRWR

SEQ ID NO: 642794 - protein, 23 aa, Mycobacterium
DAKRFDMLVLRRQLAQLEGDAVA

SEQ ID NO: 642795 - protein, 21 aa, Mycobacterium
DAKRMFACFDQPDLKAAFDVT

SEQ ID NO: 642796 - protein, 21 aa, Mycobacterium
DAKRMFACFDQPDLKATFDLR

SEQ ID NO: 642797 - protein, 21 aa, Mycobacterium
DAKRMFACFDQPDLKATFDVR

SEQ ID NO: 642798 - protein, 21 aa, Mycobacterium
DAKRMFACFDQPDLKATFEIR

SEQ ID NO: 642799 - protein, 26 aa, Mycobacterium
DAKVGGALTRRFWHDEYLLNSYIGRY

SEQ ID NO: 642800 - protein, 23 aa, Mycobacterium
DAKWTDSAVRRYVTDAGPLLSRL

SEQ ID NO: 642801 - protein, 19 aa, Mycobacterium
DALAARCPVAVVSGRALAD

SEQ ID NO: 642802 - protein, 17 aa, Mycobacterium
DALACADAGCQDRGSAH

SEQ ID NO: 642803 - protein, 19 aa, Mycobacterium
DALAEGILAAVKRLYLLGK

SEQ ID NO: 642804 - protein, 26 aa, Mycobacterium
DALAELRTLVGIYFDVICDLQPVNRA

SEQ ID NO: 642805 - protein, 20 aa, Mycobacterium
DALAGRAVEEFGGIDVVCAN

SEQ ID NO: 642806 - protein, 18 aa, Mycobacterium
DALALALDQERTVTEQIS

SEQ ID NO: 642807 - protein, 18 aa, Mycobacterium
DALALPYPGVLPEGPPPS

SEQ ID NO: 642808 - protein, 18 aa, Mycobacterium
DALAPGVALSTVDAAARQ

SEQ ID NO: 642809 - protein, 20 aa, Mycobacterium
DALARAGFHTLKLQTYLTAG

SEQ ID NO: 642810 - protein, 18 aa, Mycobacterium
DALARAGIPAVYTGDTDV

SEQ ID NO: 642811 - protein, 24 aa, Mycobacterium
DALARLAPMRAVLSAGAAQLSVAD

SEQ ID NO: 642812 - protein, 19 aa, Mycobacterium
DALARPLPRQIIGEMFGFP

SEQ ID NO: 642813 - protein, 25 aa, Mycobacterium
DALARTVSGWTRRTLDCGDIAVDAV

SEQ ID NO: 642814 - protein, 18 aa, Mycobacterium
DALAYARHALGLPATTVN

SEQ ID NO: 642815 - protein, 19 aa, Mycobacterium
DALCAHLATMHPSRYLTLI

SEQ ID NO: 642816 - protein, 17 aa, Mycobacterium
DALDLGDRVTLVLHDWG

SEQ ID NO: 642817 - protein, 18 aa, Mycobacterium
DALDLLPLRDRLDLVGKI

SEQ ID NO: 642818 - protein, 19 aa, Mycobacterium
DALDRATCRADIPDFKQRR

SEQ ID NO: 642819 - protein, 23 aa, Mycobacterium
DALDRNKMRVVPGLTSKAMSVAS

SEQ ID NO: 642820 - protein, 21 aa, Mycobacterium
DALDTSAWCGLAAASATFDRP

SEQ ID NO: 642821 - protein, 17 aa, Mycobacterium
DALERNKMRVVPGLTSK

SEQ ID NO: 642822 - protein, 26 aa, Mycobacterium
DALFERRHLLLLGWTKMRDGQLASAG

SEQ ID NO: 642823 - protein, 20 aa, Mycobacterium
DALFSGVGMYWTLRDSAIYY

SEQ ID NO: 642824 - protein, 17 aa, Mycobacterium
DALFSPDGPMLAAIREV

SEQ ID NO: 642825 - protein, 18 aa, Mycobacterium
DALGAGLGALGFGRGTLY

SEQ ID NO: 642826 - protein, 20 aa, Mycobacterium
DALGAYLLNRLRIVDQSTSE

SEQ ID NO: 642827 - protein, 18 aa, Mycobacterium
DALGFEVRLDVGHGTMRW

SEQ ID NO: 642828 - protein, 19 aa, Mycobacterium
DALGIGWAVVVGDRAGGEL

SEQ ID NO: 642829 - protein, 24 aa, Mycobacterium
DALGPRFWAEDAIAVMDAAGCQEA

SEQ ID NO: 642830 - protein, 19 aa, Mycobacterium
DALGRQVCAVPGPITSASS

SEQ ID NO: 642831 - protein, 18 aa, Mycobacterium
DALGRWLLSRTADLSTEY

SEQ ID NO: 642832 - protein, 18 aa, Mycobacterium
DALGRWLLSRTAEISAQR

SEQ ID NO: 642833 - protein, 20 aa, Mycobacterium
DALGVAWRVRCEVGGPEPVA

SEQ ID NO: 642834 - protein, 17 aa, Mycobacterium
DALHAEWSALENLEGRL

SEQ ID NO: 642835 - protein, 27 aa, Mycobacterium
DALHRLRGMFAFAIWDTVERELFCARD

SEQ ID NO: 642836 - protein, 17 aa, Mycobacterium
DALIALRPDALVHYGPT

SEQ ID NO: 642837 - protein, 19 aa, Mycobacterium
DALIGYARKRRDIVAITAA

SEQ ID NO: 642838 - protein, 18 aa, Mycobacterium
DALIHAARAADGWRRAGV

SEQ ID NO: 642839 - protein, 22 aa, Mycobacterium
DALKFLPITRPWAASLAEDAAR

SEQ ID NO: 642840 - protein, 42 aa, Mycobacterium
DALKKLLPRYRLVPFEVRRESVGFIFNRIWAAIKREALMVVQ

SEQ ID NO: 642841 - protein, 17 aa, Mycobacterium
DALKLWNVVSGMAELPH

SEQ ID NO: 642842 - protein, 24 aa, Mycobacterium
DALKSADAGAVFAELIRAGLQALI

SEQ ID NO: 642843 - protein, 24 aa, Mycobacterium
DALKSADASAVFAELIRAGLQQLI

SEQ ID NO: 642844 - protein, 22 aa, Mycobacterium
DALKSRGHVVIALPEVETYESG

SEQ ID NO: 642845 - protein, 19 aa, Mycobacterium
DALKTVDAFTEMVSSRGTV

SEQ ID NO: 642846 - protein, 24 aa, Mycobacterium
DALKVTHPAAIVWAAQMATVTLHP

SEQ ID NO: 642847 - protein, 24 aa, Mycobacterium
DALKVTHPAAIVWAAQMGTITLHP

SEQ ID NO: 642848 - protein, 24 aa, Mycobacterium
DALLAAGHPCELVIISTEGDRNQG

SEQ ID NO: 642849 - protein, 17 aa, Mycobacterium
DALLAAKVEDGRTVEQA

SEQ ID NO: 642850 - protein, 17 aa, Mycobacterium
DALLALGADACCYNPLW

SEQ ID NO: 642851 - protein, 19 aa, Mycobacterium
DALLARFPAAGVSLHTERL

SEQ ID NO: 642852 - protein, 26 aa, Mycobacterium
DALLGCAREALLAAEQCVSRPLRSPG

SEQ ID NO: 642853 - protein, 17 aa, Mycobacterium
DALLGSLLRGLSARQAA

SEQ ID NO: 642854 - protein, 24 aa, Mycobacterium
DALLGVPVPADFTGSLLASGSADA

SEQ ID NO: 642855 - protein, 18 aa, Mycobacterium
DALLMFGAIGYTWEHDMH

SEQ ID NO: 642856 - protein, 23 aa, Mycobacterium
DALLPLLVCGDVNVTDAARMPHP

SEQ ID NO: 642857 - protein, 30 aa, Mycobacterium
DALLPNFLRVWGPRGAFLPLLRAAASNRDA

SEQ ID NO: 642858 - protein, 29 aa, Mycobacterium
DALLQHWDWLSSMAELSIKIAKQASDLAQ

SEQ ID NO: 642859 - protein, 25 aa, Mycobacterium
DALLRARAAGVVFGLTEQTPAAPAD

SEQ ID NO: 642860 - protein, 26 aa, Mycobacterium
DALLRFPVMLMLLPRRSRPPRDRAPR

SEQ ID NO: 642861 - protein, 25 aa, Mycobacterium
DALLRRARRVLLPVARTGADNAAQP

SEQ ID NO: 642862 - protein, 20 aa, Mycobacterium
DALMKITHVLRGEDLLPSTP

SEQ ID NO: 642863 - protein, 20 aa, Mycobacterium
DALMRGVRCAENVESRGAHR

SEQ ID NO: 642864 - protein, 18 aa, Mycobacterium
DALNATWRSATCRVLVAA

SEQ ID NO: 642865 - protein, 26 aa, Mycobacterium
DALNWMPGVLSARWSGRHGDDAANTA

SEQ ID NO: 642866 - protein, 22 aa, Mycobacterium
DALPDRYRLILESRFLRGNSIK

SEQ ID NO: 642867 - protein, 22 aa, Mycobacterium
DALPHPHWWFDLLTTEPLAFAS

SEQ ID NO: 642868 - protein, 19 aa, Mycobacterium
DALPPETFDLVIVDEAHRS

SEQ ID NO: 642869 - protein, 21 aa, Mycobacterium
DALPPRMPIRLLVAAISAAVA

SEQ ID NO: 642870 - protein, 26 aa, Mycobacterium
DALPPRPEVRLLWKLIETAAAAEGAL

SEQ ID NO: 642871 - protein, 23 aa, Mycobacterium
DALPRLVERFADVQLLIVGRGDE

SEQ ID NO: 642872 - protein, 17 aa, Mycobacterium
DALPRQAVHLDLTDANV

SEQ ID NO: 642873 - protein, 22 aa, Mycobacterium
DALPRRHGVAVLSGSRVLSGDR

SEQ ID NO: 642874 - protein, 28 aa, Mycobacterium
DALPRRLADGLPIVFGTKVDSIVHKDDS

SEQ ID NO: 642875 - protein, 26 aa, Mycobacterium
DALPRVPRWLRPFARFQARDHLWDAP

SEQ ID NO: 642876 - protein, 23 aa, Mycobacterium
DALPSRYGQALAESEIQPLGRPD

SEQ ID NO: 642877 - protein, 19 aa, Mycobacterium
DALPVRVIDEPVPWQTNGR

SEQ ID NO: 642878 - protein, 19 aa, Mycobacterium
DALQLILLTILARGHVLIE

SEQ ID NO: 642879 - protein, 20 aa, Mycobacterium
DALQPPARWAQMQHAVRNLG

SEQ ID NO: 642880 - protein, 18 aa, Mycobacterium
DALQRALAGMVSRHEILR

SEQ ID NO: 642881 - protein, 20 aa, Mycobacterium
DALQSRGLYQYKPEMPYTPG

SEQ ID NO: 642882 - protein, 20 aa, Mycobacterium
DALRAAGIVCFGPSKDAARI

SEQ ID NO: 642883 - protein, 17 aa, Mycobacterium
DALRAAGYTLPPSQANF

SEQ ID NO: 642884 - protein, 25 aa, Mycobacterium
DALRAHILPVIFEWQVGHEVNGIGA

SEQ ID NO: 642885 - protein, 19 aa, Mycobacterium
DALRERLRRVIQEAYGAAK

SEQ ID NO: 642886 - protein, 17 aa, Mycobacterium
DALRFGTDVLAHFLTHC

SEQ ID NO: 642887 - protein, 17 aa, Mycobacterium
DALRFGTEVLTHFLTHC

SEQ ID NO: 642888 - protein, 25 aa, Mycobacterium
DALRKRAAAVVTDIIGIEPPNITVT

SEQ ID NO: 642889 - protein, 25 aa, Mycobacterium
DALRLDWSRPMWMSYLIDGLDGGRF

SEQ ID NO: 642890 - protein, 24 aa, Mycobacterium
DALRLREILEVGAARMAAGRTLSA

SEQ ID NO: 642891 - protein, 17 aa, Mycobacterium
DALRLRGPINVVESPVT

SEQ ID NO: 642892 - protein, 18 aa, Mycobacterium
DALRLRHYVLTAAADAAA

SEQ ID NO: 642893 - protein, 17 aa, Mycobacterium
DALRLRRDCVVADAEGA

SEQ ID NO: 642894 - protein, 23 aa, Mycobacterium
DALRLRVVRRATLGRRGIQNLPI

SEQ ID NO: 642895 - protein, 24 aa, Mycobacterium
DALRMSRSVLPHHSLTSVDQRLAD

SEQ ID NO: 642896 - protein, 23 aa, Mycobacterium
DALRPHWDNLLLLVTSDHDQETI

SEQ ID NO: 642897 - protein, 24 aa, Mycobacterium
DALRPKWLFGATVHEGCDRAGYYE

SEQ ID NO: 642898 - protein, 23 aa, Mycobacterium
DALRPKWLFGNTVHEGCDRAGYY

SEQ ID NO: 642899 - protein, 22 aa, Mycobacterium
DALRPLTAVVRSARIAAVSAIL

SEQ ID NO: 642900 - protein, 22 aa, Mycobacterium
DALRPLTAVVRSARMAAVTAIL

SEQ ID NO: 642901 - protein, 22 aa, Mycobacterium
DALRPMMRLVVTNGTAKEIAGC

SEQ ID NO: 642902 - protein, 21 aa, Mycobacterium
DALRPTWLFGQTVHEGCDRAG

SEQ ID NO: 642903 - protein, 18 aa, Mycobacterium
DALRRARSSVGFPTPTRH

SEQ ID NO: 642904 - protein, 17 aa, Mycobacterium
DALRRGGYRCAAPGEPV

SEQ ID NO: 642905 - protein, 20 aa, Mycobacterium
DALRRGGYRSARPGEPAVTQ

SEQ ID NO: 642906 - protein, 23 aa, Mycobacterium
DALRRIEIALGRAGAALTDVVRT

SEQ ID NO: 642907 - protein, 20 aa, Mycobacterium
DALRRKGCPLAWVAGKTIAA

SEQ ID NO: 642908 - protein, 17 aa, Mycobacterium
DALRVPYVINPRMVRGL

SEQ ID NO: 642909 - protein, 17 aa, Mycobacterium
DALRVSGSFQIIAESPL

SEQ ID NO: 642910 - protein, 27 aa, Mycobacterium
DALSDTELLDFTALAKVFGYPTTTEAQ

SEQ ID NO: 642911 - protein, 17 aa, Mycobacterium
DALSIGFCGPTHDERSW

SEQ ID NO: 642912 - protein, 25 aa, Mycobacterium
DALSTARFEFRWNDQFALSLDPDSA

SEQ ID NO: 642913 - protein, 17 aa, Mycobacterium
DALSVLVRLLASLHDDE

SEQ ID NO: 642914 - protein, 22 aa, Mycobacterium
DALTERAFRLPVTPTERRMCAI

SEQ ID NO: 642915 - protein, 25 aa, Mycobacterium
DALTKPRLGFPHNMLELAPGIINGG

SEQ ID NO: 642916 - protein, 21 aa, Mycobacterium
DALTQLAAVWSRAPLQALARL

SEQ ID NO: 642917 - protein, 42 aa, Mycobacterium
DALTTCPKCSGRLRKLFGSVGVVFKGSGFYRTDNRSDSGKSS

SEQ ID NO: 642918 - protein, 19 aa, Mycobacterium
DALVADGIPFTAFGVDDVH

SEQ ID NO: 642919 - protein, 18 aa, Mycobacterium
DALVALGADCVVYTSQGE

SEQ ID NO: 642920 - protein, 21 aa, Mycobacterium
DALVDCLRGGFGTPEDEPFRF

SEQ ID NO: 642921 - protein, 18 aa, Mycobacterium
DALVDFHLDFAFDESDLI

SEQ ID NO: 642922 - protein, 25 aa, Mycobacterium
DALVDVRSGRRWSYAQLLTDVRQLA

SEQ ID NO: 642923 - protein, 25 aa, Mycobacterium
DALVGQCWPAVFAAIGSAVTDSGVP

SEQ ID NO: 642924 - protein, 24 aa, Mycobacterium
DALVKRLGPRGVIVVVEAEHLCMA

SEQ ID NO: 642925 - protein, 24 aa, Mycobacterium
DALVLRGEVRAVPAAAQASLLVLP

SEQ ID NO: 642926 - protein, 20 aa, Mycobacterium
DALVNVSAWALWDTATGEPA

SEQ ID NO: 642927 - protein, 19 aa, Mycobacterium
DALVYWKPALLIDDIPDTG

SEQ ID NO: 642928 - protein, 17 aa, Mycobacterium
DALWAAALHIAIARRTG

SEQ ID NO: 642929 - protein, 19 aa, Mycobacterium
DALWPAVVFTLVALLDDPT

SEQ ID NO: 642930 - protein, 26 aa, Mycobacterium
DALYPGRIDLGLGRTGHRIRDRLAGN

SEQ ID NO: 642931 - protein, 23 aa, Mycobacterium
DAMADIRPALLVHTSLATVQFVL

SEQ ID NO: 642932 - protein, 21 aa, Mycobacterium
DAMAGAELLLGLRRFAARSLT

SEQ ID NO: 642933 - protein, 18 aa, Mycobacterium
DAMDTWSRGLERFNTARA

SEQ ID NO: 642934 - protein, 21 aa, Mycobacterium
DAMGSFISRNALDVFVVIDVA

SEQ ID NO: 642935 - protein, 25 aa, Mycobacterium
DAMIEWRWFELEAFIYGDALTPMAG

SEQ ID NO: 642936 - protein, 17 aa, Mycobacterium
DAMKLCGSYGLQEEARL

SEQ ID NO: 642937 - protein, 17 aa, Mycobacterium
DAMLEWQTQRFLELADG

SEQ ID NO: 642938 - protein, 18 aa, Mycobacterium
DAMLGEIAGELGGPKAPI

SEQ ID NO: 642939 - protein, 20 aa, Mycobacterium
DAMMRRAPLTLGVGGRPFEY

SEQ ID NO: 642940 - protein, 21 aa, Mycobacterium
DAMNLGWKLAATIGGEAPEHL

SEQ ID NO: 642941 - protein, 19 aa, Mycobacterium
DAMNLSWKLDAVLRGRADA

SEQ ID NO: 642942 - protein, 26 aa, Mycobacterium
DAMPPRAPVRLLWKAIDMAAAAEAAV

SEQ ID NO: 642943 - protein, 17 aa, Mycobacterium
DAMPVQRYDIRRPDGDF

SEQ ID NO: 642944 - protein, 19 aa, Mycobacterium
DAMRLAIDQSYLVKGSTYP

SEQ ID NO: 642945 - protein, 18 aa, Mycobacterium
DAMRRWLRERPREAARPP

SEQ ID NO: 642946 - protein, 20 aa, Mycobacterium
DANAVLGFVYLHSGYYQEID

SEQ ID NO: 642947 - protein, 17 aa, Mycobacterium
DANEMYAAICVAATLAI

SEQ ID NO: 642948 - protein, 20 aa, Mycobacterium
DANFGWSARDACYCYGSFVL

SEQ ID NO: 642949 - protein, 26 aa, Mycobacterium
DANGVRRWLALDGQPLHRVTVAASEL

SEQ ID NO: 642950 - protein, 20 aa, Mycobacterium
DANIGSIMGIGFPPWTGGSA

SEQ ID NO: 642951 - protein, 24 aa, Mycobacterium
DANLPRHRIAYVIRDAQLQVVLAE

SEQ ID NO: 642952 - protein, 17 aa, Mycobacterium
DANVVDLLGAVVVAAAH

SEQ ID NO: 642953 - protein, 19 aa, Mycobacterium
DANWGRVLAAVGIAPVTLD

SEQ ID NO: 642954 - protein, 23 aa, Mycobacterium
DANWLGQAVLQWLASSPTSWQID

SEQ ID NO: 642955 - protein, 22 aa, Mycobacterium
DANYAKSLRMFAVLPTIVASDM

SEQ ID NO: 642956 - protein, 26 aa, Mycobacterium
DAPAAWRHYLDAGVLIRDVGIPGYLR

SEQ ID NO: 642957 - protein, 20 aa, Mycobacterium
DAPAGVWAKQLRQVRELGFD

SEQ ID NO: 642958 - protein, 29 aa, Mycobacterium
DAPAHPVPWRLDGLPLLLDPADWNVLEVG

SEQ ID NO: 642959 - protein, 25 aa, Mycobacterium
DAPAKRKKPVLKRITESFKATPGKH

SEQ ID NO: 642960 - protein, 17 aa, Mycobacterium
DAPDCLHDMVAETARRT

SEQ ID NO: 642961 - protein, 25 aa, Mycobacterium
DAPDGYRLTVDYAVRITGRGLYVHS

SEQ ID NO: 642962 - protein, 21 aa, Mycobacterium
DAPDIDFVWAKSMSDAERTLA

SEQ ID NO: 642963 - protein, 18 aa, Mycobacterium
DAPDIPPVASTVVVDADH

SEQ ID NO: 642964 - protein, 21 aa, Mycobacterium
DAPDTPRCAFLTMYDAAAKMI

SEQ ID NO: 642965 - protein, 21 aa, Mycobacterium
DAPEGWRHLLHPDEPYASLSA

SEQ ID NO: 642966 - protein, 23 aa, Mycobacterium
DAPELIIPFMVPDGAHSYPDERR

SEQ ID NO: 642967 - protein, 17 aa, Mycobacterium
DAPELTGAVTLDDALAA

SEQ ID NO: 642968 - protein, 23 aa, Mycobacterium
DAPELVIPFLVPDGAHSYPDDAR

SEQ ID NO: 642969 - protein, 21 aa, Mycobacterium
DAPESLPLLVFPHAGAGASAY

SEQ ID NO: 642970 - protein, 24 aa, Mycobacterium
DAPEVAGLLALFLLHDARRPARTR

SEQ ID NO: 642971 - protein, 20 aa, Mycobacterium
DAPGGIAERIVGPLARAALE

SEQ ID NO: 642972 - protein, 19 aa, Mycobacterium
DAPGIAGIVEELFPQEAIT

SEQ ID NO: 642973 - protein, 24 aa, Mycobacterium
DAPGLEWSFVGARHLRGIHGEVRL

SEQ ID NO: 642974 - protein, 24 aa, Mycobacterium
DAPGMMSALVGFWMTPDSVYLSPA

SEQ ID NO: 642975 - protein, 24 aa, Mycobacterium
DAPIADLRLDFEDGYGRRSDDVED

SEQ ID NO: 642976 - protein, 20 aa, Mycobacterium
DAPIALEFLLQMLVPLDVAT

SEQ ID NO: 642977 - protein, 17 aa, Mycobacterium
DAPKRLGSFMDSRLWRL

SEQ ID NO: 642978 - protein, 17 aa, Mycobacterium
DAPKRLGSFMDSRLWRM

SEQ ID NO: 642979 - protein, 18 aa, Mycobacterium
DAPLAAGVFGQWISFPDR

SEQ ID NO: 642980 - protein, 25 aa, Mycobacterium
DAPLLTLRTDRDWIADVVRFVASRR

SEQ ID NO: 642981 - protein, 24 aa, Mycobacterium
DAPLPRVSIFLSVFDAHVQRAPVS

SEQ ID NO: 642982 - protein, 24 aa, Mycobacterium
DAPLPVWTRRRMLLRPDRAGRHSC

SEQ ID NO: 642983 - protein, 24 aa, Mycobacterium
DAPLRAMIFDSVYDIYRGVVTYVR

SEQ ID NO: 642984 - protein, 19 aa, Mycobacterium
DAPLTLVFVHGFCLQMGAF

SEQ ID NO: 642985 - protein, 21 aa, Mycobacterium
DAPLVFDWIDWQGVRRTDQPT

SEQ ID NO: 642986 - protein, 18 aa, Mycobacterium
DAPMSEEILRFERTLAKA

SEQ ID NO: 642987 - protein, 20 aa, Mycobacterium
DAPPDLPIVDAYRHAVATVF

SEQ ID NO: 642988 - protein, 21 aa, Mycobacterium
DAPPEFAYWQFGGIGVCQLIA

SEQ ID NO: 642989 - protein, 22 aa, Mycobacterium
DAPPIVLLHGFPTSSFMFRDLI

SEQ ID NO: 642990 - protein, 19 aa, Mycobacterium
DAPPLDRLVAFGRERIRFV

SEQ ID NO: 642991 - protein, 19 aa, Mycobacterium
DAPPPAGCGRRQPPRRTRP

SEQ ID NO: 642992 - protein, 21 aa, Mycobacterium
DAPPRRLIFRTDLPRPPRCLP

SEQ ID NO: 642993 - protein, 23 aa, Mycobacterium
DAPPRSFWRIDIAPVSRTVLHHR

SEQ ID NO: 642994 - protein, 20 aa, Mycobacterium
DAPQPPLWRKAIRGSALEDL

SEQ ID NO: 642995 - protein, 22 aa, Mycobacterium
DAPRAGYIIAGMEVPHLHVHVF

SEQ ID NO: 642996 - protein, 23 aa, Mycobacterium
DAPRAIQFRYFWLEILGSEQAAP

SEQ ID NO: 642997 - protein, 18 aa, Mycobacterium
DAPRLCSRALNRLEIETM

SEQ ID NO: 642998 - protein, 25 aa, Mycobacterium
DAPRNRMGLAYVERLSEVVDDIAAD

SEQ ID NO: 642999 - protein, 23 aa, Mycobacterium
DAPRPYRDYIGWLAARDQDHARS

SEQ ID NO: 643000 - protein, 17 aa, Mycobacterium
DAPRYAELIKRTQWWGR

SEQ ID NO: 643001 - protein, 23 aa, Mycobacterium
DAPRYAEPVPEGAIEDNLTDEDL

SEQ ID NO: 643002 - protein, 18 aa, Mycobacterium
DAPSARVAARLQVLADGY

SEQ ID NO: 643003 - protein, 18 aa, Mycobacterium
DAPSLFAAAGRYILDRAI

SEQ ID NO: 643004 - protein, 18 aa, Mycobacterium
DAPSLRHAIEIENRTQVL

SEQ ID NO: 643005 - protein, 19 aa, Mycobacterium
DAPSLTLWTGLTCTEIVTT

SEQ ID NO: 643006 - protein, 20 aa, Mycobacterium
DAPSTWTCFFGADDVDKTIE

SEQ ID NO: 643007 - protein, 20 aa, Mycobacterium
DAPTPAAGWAVRDQISHLAF

SEQ ID NO: 643008 - protein, 25 aa, Mycobacterium
DAPTYRWPMVPALALVASMPVLGAA

SEQ ID NO: 643009 - protein, 27 aa, Mycobacterium
DAPVADYWPEFGVKGKSAITVSDLLRH

SEQ ID NO: 643010 - protein, 27 aa, Mycobacterium
DAPVARVCSAEVPIPYAKHLEEAALPQ

SEQ ID NO: 643011 - protein, 27 aa, Mycobacterium
DAPVGRVCSAEVPIPYAKHLEEAALPQ

SEQ ID NO: 643012 - protein, 23 aa, Mycobacterium
DAPVRERLALGFGSSSFRYAAPA

SEQ ID NO: 643013 - protein, 20 aa, Mycobacterium
DAPVRERLALGFGSSTFRYA

SEQ ID NO: 643014 - protein, 19 aa, Mycobacterium
DAPVSMAGMARWVGSAQHR

SEQ ID NO: 643015 - protein, 29 aa, Mycobacterium
DAPWFPKDVPAWSVRWVILHVINELARHA

SEQ ID NO: 643016 - protein, 19 aa, Mycobacterium
DAPWKDIEAQGWIAPAECI

SEQ ID NO: 643017 - protein, 19 aa, Mycobacterium
DAPWKDIEAQGWIAPAECV

SEQ ID NO: 643018 - protein, 22 aa, Mycobacterium
DAPYAHGWATWFPPDGPPRTGR

SEQ ID NO: 643019 - protein, 28 aa, Mycobacterium
DAQAARRFGCGFAPSGWDSLTKHLQRKG

SEQ ID NO: 643020 - protein, 21 aa, Mycobacterium
DAQAGLCAQAGLGAEPEPETG

SEQ ID NO: 643021 - protein, 17 aa, Mycobacterium
DAQARRVLFDGIRAVGV

SEQ ID NO: 643022 - protein, 21 aa, Mycobacterium
DAQARYAMRMIRRPVHDPSRY

SEQ ID NO: 643023 - protein, 19 aa, Mycobacterium
DAQAVKWSTSVAEQVRAQL

SEQ ID NO: 643024 - protein, 25 aa, Mycobacterium
DAQAWPRWASVITKVTWTSPEPRGV

SEQ ID NO: 643025 - protein, 21 aa, Mycobacterium
DAQFHIARVISDVWTSNMIAW

SEQ ID NO: 643026 - protein, 18 aa, Mycobacterium
DAQGFFRSGDLVRITDDG

SEQ ID NO: 643027 - protein, 18 aa, Mycobacterium
DAQPGWAALTAVQRGAIL

SEQ ID NO: 643028 - protein, 24 aa, Mycobacterium
DAQPRIIVYDGVWADVALEVATKA

SEQ ID NO: 643029 - protein, 20 aa, Mycobacterium
DAQQAEWRRGTLPPGQLGWR

SEQ ID NO: 643030 - protein, 23 aa, Mycobacterium
DAQRAGGGLGEYYAEHDTRTPVW

SEQ ID NO: 643031 - protein, 22 aa, Mycobacterium
DAQRLDWCRTLGTFPVGDKDSA

SEQ ID NO: 643032 - protein, 18 aa, Mycobacterium
DAQRMTARLARYRSIGLP

SEQ ID NO: 643033 - protein, 26 aa, Mycobacterium
DAQRWSAERHLVFACGRYEGIDQRVA

SEQ ID NO: 643034 - protein, 25 aa, Mycobacterium
DAQSGSIGLGFAIPVDQAKRIADEL

SEQ ID NO: 643035 - protein, 17 aa, Mycobacterium
DAQVIDAIWRLRRSNKL

SEQ ID NO: 643036 - protein, 18 aa, Mycobacterium
DAQVKIRGHRVEPGEIAA

SEQ ID NO: 643037 - protein, 23 aa, Mycobacterium
DAQVRERLALGFGSSSFRYAGPA

SEQ ID NO: 643038 - protein, 23 aa, Mycobacterium
DAQWPMELVFMVEAALALSHREA

SEQ ID NO: 643039 - protein, 19 aa, Mycobacterium
DARAAEWIGRPPHEELQRK

SEQ ID NO: 643040 - protein, 19 aa, Mycobacterium
DARAAEWIGRPSHEELQRK

SEQ ID NO: 643041 - protein, 21 aa, Mycobacterium
DARACLDIDLDPAFEHGVLCD

SEQ ID NO: 643042 - protein, 20 aa, Mycobacterium
DARACLRVAESLSDAELVAA

SEQ ID NO: 643043 - protein, 20 aa, Mycobacterium
DARAPILVISQFTLYADTAK

SEQ ID NO: 643044 - protein, 23 aa, Mycobacterium
DARAVPLLIGLGVDALSVTPPAI

SEQ ID NO: 643045 - protein, 17 aa, Mycobacterium
DARCAPAAYRFVSQARQ

SEQ ID NO: 643046 - protein, 25 aa, Mycobacterium
DARDRAEAVDAWLAERQQALAQQAA

SEQ ID NO: 643047 - protein, 19 aa, Mycobacterium
DARDRYFFRDGRGPDGSLP

SEQ ID NO: 643048 - protein, 23 aa, Mycobacterium
DARFGEVPVAFVVFDHPGQVTAE

SEQ ID NO: 643049 - protein, 23 aa, Mycobacterium
DARFGWPKRNGFVQPLVDAELLA

SEQ ID NO: 643050 - protein, 24 aa, Mycobacterium
DARFGWPKRNGFVQPMVDAELFGG

SEQ ID NO: 643051 - protein, 20 aa, Mycobacterium
DARFPLHGMPDDAKRLMHLM

SEQ ID NO: 643052 - protein, 19 aa, Mycobacterium
DARGARRALALSGGSVSAV

SEQ ID NO: 643053 - protein, 24 aa, Mycobacterium
DARGDGVVCGRDLAVPALVIGNLA

SEQ ID NO: 643054 - protein, 22 aa, Mycobacterium
DARGRRPLWTYAHVPSGSPVDM

SEQ ID NO: 643055 - protein, 30 aa, Mycobacterium
DARGRVLWRSGSPRVLKLADRLGFIEGASW

SEQ ID NO: 643056 - protein, 30 aa, Mycobacterium
DARHPFLVMELIEGGTLRELLGERGPMPPY

SEQ ID NO: 643057 - protein, 25 aa, Mycobacterium
DARHVIALPASLSWIDAAALPVGLA

SEQ ID NO: 643058 - protein, 22 aa, Mycobacterium
DARIAPEAEIRWTGGGNTRGVE

SEQ ID NO: 643059 - protein, 19 aa, Mycobacterium
DARIDVYRVLGINEGEAHV

SEQ ID NO: 643060 - protein, 25 aa, Mycobacterium
DARITLDPNGGWLLRDAIVTCRQLT

SEQ ID NO: 643061 - protein, 20 aa, Mycobacterium
DARKRVLAMRRTFRKHRKQL

SEQ ID NO: 643062 - protein, 18 aa, Mycobacterium
DARLDAAGVGLTMGGEPT

SEQ ID NO: 643063 - protein, 18 aa, Mycobacterium
DARLERNERVGAAERKAA

SEQ ID NO: 643064 - protein, 21 aa, Mycobacterium
DARLGEVGKAYIVLKPGATLN

SEQ ID NO: 643065 - protein, 20 aa, Mycobacterium
DARLIWAHRDPYKATGSLGN

SEQ ID NO: 643066 - protein, 18 aa, Mycobacterium
DARLNWRGLIHRVTGIDL

SEQ ID NO: 643067 - protein, 25 aa, Mycobacterium
DARLPARTDQVWGLSWRVPDADAAR

SEQ ID NO: 643068 - protein, 21 aa, Mycobacterium
DARLPGNAHFTFHGCEGDSLL

SEQ ID NO: 643069 - protein, 25 aa, Mycobacterium
DARLPRVAQSWTYAHIRPEFADRAQ

SEQ ID NO: 643070 - protein, 22 aa, Mycobacterium
DARLRELIIMRIGWVTGSVYEW

SEQ ID NO: 643071 - protein, 23 aa, Mycobacterium
DARLRELIIMRIGWVTGSVYEWT

SEQ ID NO: 643072 - protein, 18 aa, Mycobacterium
DARLRRIAAELADGRRRF

SEQ ID NO: 643073 - protein, 20 aa, Mycobacterium
DARLRRRLERVAEHWEARRG

SEQ ID NO: 643074 - protein, 19 aa, Mycobacterium
DARMVGNALTARWHGHEAE

SEQ ID NO: 643075 - protein, 21 aa, Mycobacterium
DARNALSPAMYFGIRYAVGRL

SEQ ID NO: 643076 - protein, 20 aa, Mycobacterium
DARPGLPGEDPFYLPPAGYH

SEQ ID NO: 643077 - protein, 17 aa, Mycobacterium
DARPHIEAMCERENRVV

SEQ ID NO: 643078 - protein, 22 aa, Mycobacterium
DARPPVVVCGVGPLTISSTDTP

SEQ ID NO: 643079 - protein, 22 aa, Mycobacterium
DARQWLAFGAAQWLRRSAEART

SEQ ID NO: 643080 - protein, 20 aa, Mycobacterium
DARRAFKPSPAVYRYVCDEL

SEQ ID NO: 643081 - protein, 17 aa, Mycobacterium
DARRAVAEITDFIKVLP

SEQ ID NO: 643082 - protein, 25 aa, Mycobacterium
DARRFRRFLTHTVWPSIRDTGSYTT

SEQ ID NO: 643083 - protein, 17 aa, Mycobacterium
DARRPIAEFDVALHQNP

SEQ ID NO: 643084 - protein, 18 aa, Mycobacterium
DARRSCIRIEKNWPDIRP

SEQ ID NO: 643085 - protein, 22 aa, Mycobacterium
DARSELWFFYHLGRKLREKLAG

SEQ ID NO: 643086 - protein, 22 aa, Mycobacterium
DARSELWFFYHLGRKLREKLSG

SEQ ID NO: 643087 - protein, 23 aa, Mycobacterium
DARSELWFFYHLGRRLRDKLGGS

SEQ ID NO: 643088 - protein, 25 aa, Mycobacterium
DARSGQWFLGPEIYVLGAASAPRYN

SEQ ID NO: 643089 - protein, 20 aa, Mycobacterium
DARSGVGWLEWNRNLGEQSG

SEQ ID NO: 643090 - protein, 26 aa, Mycobacterium
DARSRARAAWLWSGRTATLAGYSAAA

SEQ ID NO: 643091 - protein, 23 aa, Mycobacterium
DARTDIRPALLVHTSLATVKFVF

SEQ ID NO: 643092 - protein, 19 aa, Mycobacterium
DARTDVSLVVRMHHDADFV

SEQ ID NO: 643093 - protein, 19 aa, Mycobacterium
DARTLRDIAEMGGGFTTST

SEQ ID NO: 643094 - protein, 20 aa, Mycobacterium
DARTVIVVMDMHDLDKAREF

SEQ ID NO: 643095 - protein, 20 aa, Mycobacterium
DARVALPTREDQALIYRLSG

SEQ ID NO: 643096 - protein, 24 aa, Mycobacterium
DARVARDLLPSFGPLGNRPTLNSA

SEQ ID NO: 643097 - protein, 20 aa, Mycobacterium
DARVGRLLFNAHLDNPVVVR

SEQ ID NO: 643098 - protein, 19 aa, Mycobacterium
DARVGRLLFSSQLANTVIA

SEQ ID NO: 643099 - protein, 19 aa, Mycobacterium
DARVLLMCAEMLKHLDLAG

SEQ ID NO: 643100 - protein, 23 aa, Mycobacterium
DARVRELLDMVGLSAHAADKYPQ

SEQ ID NO: 643101 - protein, 25 aa, Mycobacterium
DARVTLKLRRCFDITAANSAQSRKK

SEQ ID NO: 643102 - protein, 18 aa, Mycobacterium
DARYDMVRPGIAVYGINP

SEQ ID NO: 643103 - protein, 20 aa, Mycobacterium
DARYEIRWDAIASAAASTGA

SEQ ID NO: 643104 - protein, 20 aa, Mycobacterium
DARYRWFGVSLDVGEGVTWS

SEQ ID NO: 643105 - protein, 20 aa, Mycobacterium
DASAAAAPWPTGVLDDVVIT

SEQ ID NO: 643106 - protein, 18 aa, Mycobacterium
DASALRDWAHIVVSDLIT

SEQ ID NO: 643107 - protein, 20 aa, Mycobacterium
DASAPRLGAMLRDCPGLRLL

SEQ ID NO: 643108 - protein, 26 aa, Mycobacterium
DASARQRVRRELKVLQREFGYTTIVV

SEQ ID NO: 643109 - protein, 26 aa, Mycobacterium
DASASVVCGIGFADLSSFTVLTQTLT

SEQ ID NO: 643110 - protein, 20 aa, Mycobacterium
DASAVMAAWSLQADGQEYAR

SEQ ID NO: 643111 - protein, 19 aa, Mycobacterium
DASAWAGVGTPNFVNVPTD

SEQ ID NO: 643112 - protein, 17 aa, Mycobacterium
DASCLQRAVERLDDRGA

SEQ ID NO: 643113 - protein, 26 aa, Mycobacterium
DASDVRLAIVASTWHTKICDALLAGA

SEQ ID NO: 643114 - protein, 35 aa, Mycobacterium
DASEVAKLWPWADLEPFAAFGWEARGGYGDAYQTA

SEQ ID NO: 643115 - protein, 20 aa, Mycobacterium
DASFNVSRAALLIVALTERP

SEQ ID NO: 643116 - protein, 23 aa, Mycobacterium
DASFRSAGHLGFDDLIHPQETRD

SEQ ID NO: 643117 - protein, 19 aa, Mycobacterium
DASGFARLVSVLDEPDPGF

SEQ ID NO: 643118 - protein, 17 aa, Mycobacterium
DASGKWVLPGLVDIHTH

SEQ ID NO: 643119 - protein, 26 aa, Mycobacterium
DASGLRLALVASTWHSEICDALLAGA

SEQ ID NO: 643120 - protein, 20 aa, Mycobacterium
DASGLSWLTGFSDRTPFEPY

SEQ ID NO: 643121 - protein, 29 aa, Mycobacterium
DASGPEAVWPDGWELMSRKYGGTRLELGS

SEQ ID NO: 643122 - protein, 26 aa, Mycobacterium
DASGPEPYCPVGISPLFETIDDLHNG

SEQ ID NO: 643123 - protein, 26 aa, Mycobacterium
DASGPQPYCPVAISPLFETIDDLHNG

SEQ ID NO: 643124 - protein, 26 aa, Mycobacterium
DASGPQPYCPVGISPLFETIDDLRNG

SEQ ID NO: 643125 - protein, 18 aa, Mycobacterium
DASGRYGRPKRWVVVTGT

SEQ ID NO: 643126 - protein, 29 aa, Mycobacterium
DASGTQVLLCLHRRFGRWVQLGGHCEEAD

SEQ ID NO: 643127 - protein, 20 aa, Mycobacterium
DASLLLAVLNRFLPSDDPRI

SEQ ID NO: 643128 - protein, 23 aa, Mycobacterium
DASLRLVAPGGAFLEMGKTDMRE

SEQ ID NO: 643129 - protein, 24 aa, Mycobacterium
DASLRLVAPGGMFLEMGKTDIRDP

SEQ ID NO: 643130 - protein, 24 aa, Mycobacterium
DASLRLVAPGGVFLEMGKTDIRDP

SEQ ID NO: 643131 - protein, 24 aa, Mycobacterium
DASLRLVAPGGVFLEMGKTDIREA

SEQ ID NO: 643132 - protein, 18 aa, Mycobacterium
DASLRSWLAFGAEKVAEV

SEQ ID NO: 643133 - protein, 23 aa, Mycobacterium
DASMLMYPFSMAMSPLMNLMSSS

SEQ ID NO: 643134 - protein, 23 aa, Mycobacterium
DASPAFLGFNLFQHAIARAVIHG

SEQ ID NO: 643135 - protein, 23 aa, Mycobacterium
DASPAFLGFNLFQHAIARAVIYG

SEQ ID NO: 643136 - protein, 26 aa, Mycobacterium
DASPRPGQCLRTFLREHGHVEVKKGC

SEQ ID NO: 643137 - protein, 17 aa, Mycobacterium
DASRWQGFSTRAIHGGF

SEQ ID NO: 643138 - protein, 29 aa, Mycobacterium
DASSWKGRWPLGRGFERFYGFLGGETNQW

SEQ ID NO: 643139 - protein, 17 aa, Mycobacterium
DASTLTPFVTWGTNPGQ

SEQ ID NO: 643140 - protein, 24 aa, Mycobacterium
DASTPFDAFIRLISPTRLFTTAFK

SEQ ID NO: 643141 - protein, 26 aa, Mycobacterium
DASVGLPMRCVFALTAMGFLPQSPDA

SEQ ID NO: 643142 - protein, 18 aa, Mycobacterium
DASVPAVVAARWALAEAH

SEQ ID NO: 643143 - protein, 24 aa, Mycobacterium
DASYEFAEFGAVLSPGAGKVEVIS

SEQ ID NO: 643144 - protein, 20 aa, Mycobacterium
DATAALVYTGTGWRDGLDEP

SEQ ID NO: 643145 - protein, 18 aa, Mycobacterium
DATAGWLFDVPQWEPALA

SEQ ID NO: 643146 - protein, 18 aa, Mycobacterium
DATARNKLLADWISGLPE

SEQ ID NO: 643147 - protein, 24 aa, Mycobacterium
DATARRSLLEMLLRGVPSEDLDLG

SEQ ID NO: 643148 - protein, 25 aa, Mycobacterium
DATAVAGYGARFAGVAFPGETLTVN

SEQ ID NO: 643149 - protein, 18 aa, Mycobacterium
DATCAAAAAAGRAVSDHP

SEQ ID NO: 643150 - protein, 24 aa, Mycobacterium
DATDCVGVTAGAPFASGATSASDH

SEQ ID NO: 643151 - protein, 23 aa, Mycobacterium
DATDFNPSWGWAAGAMVSTLDDM

SEQ ID NO: 643152 - protein, 24 aa, Mycobacterium
DATDPRGGPLLMFSNADCQVLLSR

SEQ ID NO: 643153 - protein, 26 aa, Mycobacterium
DATEALALPGVRAVFTAADINPEVKE

SEQ ID NO: 643154 - protein, 18 aa, Mycobacterium
DATFARLLIMEILMGYKA

SEQ ID NO: 643155 - protein, 26 aa, Mycobacterium
DATFDAVCCFGALYLMPEPFRVAREM

SEQ ID NO: 643156 - protein, 28 aa, Mycobacterium
DATFLGLMLIEIHLMYAALVSGGAPITL

SEQ ID NO: 643157 - protein, 18 aa, Mycobacterium
DATFVWIRKRYEVAEGHT

SEQ ID NO: 643158 - protein, 25 aa, Mycobacterium
DATGKATGWERLVAGDIDWPDPEAG

SEQ ID NO: 643159 - protein, 24 aa, Mycobacterium
DATGLRAGTPLVVGGADHVLSAYA

SEQ ID NO: 643160 - protein, 18 aa, Mycobacterium
DATGRCVERAEAQRISTP

SEQ ID NO: 643161 - protein, 29 aa, Mycobacterium
DATGRLGLVPLRWALACLLIDLGSVTLST

SEQ ID NO: 643162 - protein, 20 aa, Mycobacterium
DATIPYARIIGDWVPGFRED

SEQ ID NO: 643163 - protein, 18 aa, Mycobacterium
DATIRFYTRVLGMEQETF

SEQ ID NO: 643164 - protein, 25 aa, Mycobacterium
DATLAATHRAMWALGDYALMAEEVM

SEQ ID NO: 643165 - protein, 24 aa, Mycobacterium
DATLAGLPVRVCRTGYTGEHGYEL

SEQ ID NO: 643166 - protein, 24 aa, Mycobacterium
DATLRPWAALRAQLLLAETLRAAG

SEQ ID NO: 643167 - protein, 26 aa, Mycobacterium
DATLRVRTWKRSSFSGTEIFGKTVGV

SEQ ID NO: 643168 - protein, 28 aa, Mycobacterium
DATMARACIDEGWLLSLSGTVSFKNARD

SEQ ID NO: 643169 - protein, 23 aa, Mycobacterium
DATMKRLLPDFFRPQTDHPAGSG

SEQ ID NO: 643170 - protein, 24 aa, Mycobacterium
DATMRALTARSWRAGLRQRAAVRV

SEQ ID NO: 643171 - protein, 25 aa, Mycobacterium
DATPEFGEELLAWLRDRLAHYKCPR

SEQ ID NO: 643172 - protein, 25 aa, Mycobacterium
DATPEWFYIVKFMMADLWHGYTGPS

SEQ ID NO: 643173 - protein, 20 aa, Mycobacterium
DATRAVATLGGFKAVHFKSV

SEQ ID NO: 643174 - protein, 24 aa, Mycobacterium
DATRAVATLGGFKAVHFKSVAKQA

SEQ ID NO: 643175 - protein, 23 aa, Mycobacterium
DATRLEGFDGRFDTVVDSAFYHV

SEQ ID NO: 643176 - protein, 17 aa, Mycobacterium
DATRLKLRRIVESSLIG

SEQ ID NO: 643177 - protein, 22 aa, Mycobacterium
DATRTGDIWVFRGRSGPDRLIQ

SEQ ID NO: 643178 - protein, 22 aa, Mycobacterium
DATRVQVLWSLADREMSVNELA

SEQ ID NO: 643179 - protein, 17 aa, Mycobacterium
DATSLSPFVTWGTNPGQ

SEQ ID NO: 643180 - protein, 26 aa, Mycobacterium
DATTMPKPWVKWSYEPARAEDVPAAF

SEQ ID NO: 643181 - protein, 20 aa, Mycobacterium
DATVAPILVCRKAHVTTFYM

SEQ ID NO: 643182 - protein, 25 aa, Mycobacterium
DATVEVAIRLGVDPRKADQMVRGTV

SEQ ID NO: 643183 - protein, 24 aa, Mycobacterium
DATVRRIIRHGAGWIANPLPIDHL

SEQ ID NO: 643184 - protein, 18 aa, Mycobacterium
DATYLLTVVQSMRSAPFS

SEQ ID NO: 643185 - protein, 18 aa, Mycobacterium
DAVAAGFTTRGKDRDDAL

SEQ ID NO: 643186 - protein, 20 aa, Mycobacterium
DAVAEHYMHFGGVSPINGIN

SEQ ID NO: 643187 - protein, 19 aa, Mycobacterium
DAVAELRAARVYRNDNTTA

SEQ ID NO: 643188 - protein, 24 aa, Mycobacterium
DAVAEMTVALLLAATRHVLPADAD

SEQ ID NO: 643189 - protein, 23 aa, Mycobacterium
DAVAEMTVALLLASTRHLLTADA

SEQ ID NO: 643190 - protein, 24 aa, Mycobacterium
DAVAEMTVALLLTVTRHVLTADAE

SEQ ID NO: 643191 - protein, 23 aa, Mycobacterium
DAVAEMTVALLLVTTRQLLPADA

SEQ ID NO: 643192 - protein, 17 aa, Mycobacterium
DAVAETWATPTADLGRQ

SEQ ID NO: 643193 - protein, 17 aa, Mycobacterium
DAVAFARQIGYSCAGTV

SEQ ID NO: 643194 - protein, 20 aa, Mycobacterium
DAVAIMGIVADIERYPEWNE

SEQ ID NO: 643195 - protein, 25 aa, Mycobacterium
DAVAINCGDRSWTYGQFDVAANRLA

SEQ ID NO: 643196 - protein, 19 aa, Mycobacterium
DAVALRVLDDGVFVGSSAA

SEQ ID NO: 643197 - protein, 24 aa, Mycobacterium
DAVALSCGDRSWTYRELDEASNRM

SEQ ID NO: 643198 - protein, 27 aa, Mycobacterium
DAVARFKRLDGFDVRYLTGTDEHGLKV

SEQ ID NO: 643199 - protein, 26 aa, Mycobacterium
DAVARVIAETGILRGRRKRCVDSTVF

SEQ ID NO: 643200 - protein, 18 aa, Mycobacterium
DAVCDPGPAAAYSPTGYA

SEQ ID NO: 643201 - protein, 27 aa, Mycobacterium
DAVCERGECDFVWDLAAPLPMAVIGDM

SEQ ID NO: 643202 - protein, 24 aa, Mycobacterium
DAVDRIKALTGRIDLVHCNDSRDA

SEQ ID NO: 643203 - protein, 23 aa, Mycobacterium
DAVDRIRALTGRIDLVHCNDSRD

SEQ ID NO: 643204 - protein, 34 aa, Mycobacterium
DAVEARTAAGGALRRVSVELSEKLRAAATNYDNT

SEQ ID NO: 643205 - protein, 19 aa, Mycobacterium
DAVELHGAHGYLLDEFLWD

SEQ ID NO: 643206 - protein, 18 aa, Mycobacterium
DAVELVWNPEFLREGFAV

SEQ ID NO: 643207 - protein, 17 aa, Mycobacterium
DAVEQLRPADSEDDAGL

SEQ ID NO: 643208 - protein, 22 aa, Mycobacterium
DAVFRRMWLNVGRVNRLPRTGS

SEQ ID NO: 643209 - protein, 20 aa, Mycobacterium
DAVFTAEAWGSDAYTPLAWW

SEQ ID NO: 643210 - protein, 31 aa, Mycobacterium
DAVGDRFGARLCRLSLGWALLMRGELIQAVA

SEQ ID NO: 643211 - protein, 27 aa, Mycobacterium
DAVGDRLPLGAGFSFEAAQLLTAATPT

SEQ ID NO: 643212 - protein, 17 aa, Mycobacterium
DAVGFSFHETTIDADSV

SEQ ID NO: 643213 - protein, 27 aa, Mycobacterium
DAVGIPEGWMVAGHIVVGWPKGKHGPL

SEQ ID NO: 643214 - protein, 17 aa, Mycobacterium
DAVGKAFIEVAGPDDEI

SEQ ID NO: 643215 - protein, 18 aa, Mycobacterium
DAVGKLYVQRHFPPGAKA

SEQ ID NO: 643216 - protein, 17 aa, Mycobacterium
DAVGLWRPAADDAATGG

SEQ ID NO: 643217 - protein, 29 aa, Mycobacterium
DAVGLWTFRVDGWGDPIATWRHAVEAKLE

SEQ ID NO: 643218 - protein, 27 aa, Mycobacterium
DAVGRGDFRAPLVIGDRLDTDIEGANA

SEQ ID NO: 643219 - protein, 22 aa, Mycobacterium
DAVGVPAEWFLAGHVVIGRPRG

SEQ ID NO: 643220 - protein, 24 aa, Mycobacterium
DAVHPLEVGVEWVSAAPRAALRTV

SEQ ID NO: 643221 - protein, 19 aa, Mycobacterium
DAVHSGARVIARCRAERVL

SEQ ID NO: 643222 - protein, 23 aa, Mycobacterium
DAVIAHALARGASIILIGDDGQL

SEQ ID NO: 643223 - protein, 19 aa, Mycobacterium
DAVITQMCRRASSPGFGSW

SEQ ID NO: 643224 - protein, 22 aa, Mycobacterium
DAVIYHARFGPTLAETLEKAGG

SEQ ID NO: 643225 - protein, 23 aa, Mycobacterium
DAVKAGVGGLMLFGVPQEKDKDA

SEQ ID NO: 643226 - protein, 30 aa, Mycobacterium
DAVLARDFLLTWFVTLAWEVAEAKRLTGAG

SEQ ID NO: 643227 - protein, 18 aa, Mycobacterium
DAVLEHFKTLDPATIDFS

SEQ ID NO: 643228 - protein, 17 aa, Mycobacterium
DAVLFMFDPLRVQVIRD

SEQ ID NO: 643229 - protein, 18 aa, Mycobacterium
DAVLGEWVAPLLAQQGIR

SEQ ID NO: 643230 - protein, 17 aa, Mycobacterium
DAVLGFAEDVHRQLGPA

SEQ ID NO: 643231 - protein, 25 aa, Mycobacterium
DAVLPLRWTDGGMNRVRVLRGAPSG

SEQ ID NO: 643232 - protein, 22 aa, Mycobacterium
DAVLRKAPWVDVVFGTHNIGSL

SEQ ID NO: 643233 - protein, 25 aa, Mycobacterium
DAVLRVLAPLGLVFDERSPWLNASS

SEQ ID NO: 643234 - protein, 26 aa, Mycobacterium
DAVLTAQHRLRFAAGNFYINDKPTGA

SEQ ID NO: 643235 - protein, 20 aa, Mycobacterium
DAVLYTRAGPEIGVAATKTF

SEQ ID NO: 643236 - protein, 20 aa, Mycobacterium
DAVMFVCPDPVPLLDTVLKL

SEQ ID NO: 643237 - protein, 26 aa, Mycobacterium
DAVMFVCPEPLPMLDVVVKLVDAVDT

SEQ ID NO: 643238 - protein, 20 aa, Mycobacterium
DAVMFVCPEPQPLLDVVLKL

SEQ ID NO: 643239 - protein, 25 aa, Mycobacterium
DAVMILPVSYWKLSEREIVAHYRSV

SEQ ID NO: 643240 - protein, 19 aa, Mycobacterium
DAVMILPVSYWKLTEREIF

SEQ ID NO: 643241 - protein, 23 aa, Mycobacterium
DAVMYHARFGPTLAEALERYDRR

SEQ ID NO: 643242 - protein, 24 aa, Mycobacterium
DAVNGMAGLMAWSQAPTRALGRFE

SEQ ID NO: 643243 - protein, 24 aa, Mycobacterium
DAVNGMAGLMAWSQGPTRALGRFE

SEQ ID NO: 643244 - protein, 19 aa, Mycobacterium
DAVPGRLDGLFHAAGVAGG

SEQ ID NO: 643245 - protein, 22 aa, Mycobacterium
DAVPHPKWWFDLLTTEPLAFAS

SEQ ID NO: 643246 - protein, 25 aa, Mycobacterium
DAVPRALMRRCLLSGTPDEVLDQLA

SEQ ID NO: 643247 - protein, 24 aa, Mycobacterium
DAVPVTNWVPFADWADGRAVLGGR

SEQ ID NO: 643248 - protein, 18 aa, Mycobacterium
DAVQGPGLTAGWVPLHKL

SEQ ID NO: 643249 - protein, 21 aa, Mycobacterium
DAVQLQLFWDYQFNLDGYPAY

SEQ ID NO: 643250 - protein, 20 aa, Mycobacterium
DAVREGRTGPGPVNGVVAGF

SEQ ID NO: 643251 - protein, 21 aa, Mycobacterium
DAVSFAGRIDGAIARLTGLEI

SEQ ID NO: 643252 - protein, 18 aa, Mycobacterium
DAVSHVLTAMGLTERAAR

SEQ ID NO: 643253 - protein, 22 aa, Mycobacterium
DAVSIPERFAARVAEAPDAAAL

SEQ ID NO: 643254 - protein, 29 aa, Mycobacterium
DAVSMAGLQARFGLDAGKWTAEQMAQVAL

SEQ ID NO: 643255 - protein, 20 aa, Mycobacterium
DAVSPRYAGQRVPRVEDSRL

SEQ ID NO: 643256 - protein, 18 aa, Mycobacterium
DAVSRCTQHRCFPVLAGP

SEQ ID NO: 643257 - protein, 17 aa, Mycobacterium
DAVSTPFGAVVRTAKVG

SEQ ID NO: 643258 - protein, 17 aa, Mycobacterium
DAVSTPFGAVVRTGKVA

SEQ ID NO: 643259 - protein, 21 aa, Mycobacterium
DAVTAVHLKGHFATMRHAAAY

SEQ ID NO: 643260 - protein, 18 aa, Mycobacterium
DAVTRLVGLTGIPFTDVF

SEQ ID NO: 643261 - protein, 20 aa, Mycobacterium
DAVVAVHLKGHFATMKHAAA

SEQ ID NO: 643262 - protein, 20 aa, Mycobacterium
DAVVAVHLKGHFATMRHAAS

SEQ ID NO: 643263 - protein, 23 aa, Mycobacterium
DAVVAVHLKGHFATMRHAASYWR

SEQ ID NO: 643264 - protein, 21 aa, Mycobacterium
DAVVLRFGLFYGPGASNSDLI

SEQ ID NO: 643265 - protein, 24 aa, Mycobacterium
DAVVPRGAMPKFLSAARELATGAG

SEQ ID NO: 643266 - protein, 22 aa, Mycobacterium
DAVVRPRLQIVESILQAAVDDG

SEQ ID NO: 643267 - protein, 26 aa, Mycobacterium
DAVVSRTAFPAAIDTEFVTLVAEPGR

SEQ ID NO: 643268 - protein, 18 aa, Mycobacterium
DAVYAPRLVRRTGEPSDT

SEQ ID NO: 643269 - protein, 22 aa, Mycobacterium
DAWAMIKVTPMIGVNDDPSEVF

SEQ ID NO: 643270 - protein, 32 aa, Mycobacterium
DAWASYRWCAFYGFMLSIPMAVQLERSDRGDA

SEQ ID NO: 643271 - protein, 28 aa, Mycobacterium
DAWERWGRRCAGLTAAQWRARTRCEGWD

SEQ ID NO: 643272 - protein, 18 aa, Mycobacterium
DAWFYLDELEAIIREWIA

SEQ ID NO: 643273 - protein, 19 aa, Mycobacterium
DAWLRCMHTAVASIDSATL

SEQ ID NO: 643274 - protein, 24 aa, Mycobacterium
DAWPVAAEPFAMWVLEDDFSHGRP

SEQ ID NO: 643275 - protein, 24 aa, Mycobacterium
DAWREVVSTPALLPAVRPEEDTYQ

SEQ ID NO: 643276 - protein, 28 aa, Mycobacterium
DAWTKKETPSVCDWMIFGKGHCIVIDAT

SEQ ID NO: 643277 - protein, 17 aa, Mycobacterium
DAWTRMTQFALQAGAAA

SEQ ID NO: 643278 - protein, 18 aa, Mycobacterium
DAYACGRGTDDLEQRLVA

SEQ ID NO: 643279 - protein, 22 aa, Mycobacterium
DAYAELTAEGWLTAQQGSGTRV

SEQ ID NO: 643280 - protein, 23 aa, Mycobacterium
DAYAEWAAALGLDPVFTQHVNEG

SEQ ID NO: 643281 - protein, 25 aa, Mycobacterium
DAYARARLAGQLGFPLDGLADDEPI

SEQ ID NO: 643282 - protein, 28 aa, Mycobacterium
DAYDLTSIRRFWHVGAPCPPAVKQAWID

SEQ ID NO: 643283 - protein, 19 aa, Mycobacterium
DAYFARFGGVRDYLMNIVD

SEQ ID NO: 643284 - protein, 17 aa, Mycobacterium
DAYFPAFPHRPADYKQR

SEQ ID NO: 643285 - protein, 25 aa, Mycobacterium
DAYFQYPPLQGFGMPSGECSIEPWV

SEQ ID NO: 643286 - protein, 26 aa, Mycobacterium
DAYGLKPLVRLVSWGVAGVAPNVMGI

SEQ ID NO: 643287 - protein, 20 aa, Mycobacterium
DAYGRYMIRVKEMWESVKIV

SEQ ID NO: 643288 - protein, 20 aa, Mycobacterium
DAYGRYMIRVNEMWESIKIV

SEQ ID NO: 643289 - protein, 24 aa, Mycobacterium
DAYGVSRLPAREALQALKTEGFLE

SEQ ID NO: 643290 - protein, 22 aa, Mycobacterium
DAYIDYRALGGIDGRYPEVKKW

SEQ ID NO: 643291 - protein, 19 aa, Mycobacterium
DAYKAIWDFHGQQCTSRHV

SEQ ID NO: 643292 - protein, 18 aa, Mycobacterium
DAYKHYGDFVALDHVDFV

SEQ ID NO: 643293 - protein, 25 aa, Mycobacterium
DAYKTGRGSIRMRGVVEIEEDSRGR

SEQ ID NO: 643294 - protein, 25 aa, Mycobacterium
DAYKTGRGSIRMRGVVEVEEDSRGR

SEQ ID NO: 643295 - protein, 18 aa, Mycobacterium
DAYLHAGGQWEWDSAAPA

SEQ ID NO: 643296 - protein, 17 aa, Mycobacterium
DAYLRLVRRGLAAEPEG

SEQ ID NO: 643297 - protein, 19 aa, Mycobacterium
DAYPAWSQTTPREKARLFR

SEQ ID NO: 643298 - protein, 19 aa, Mycobacterium
DAYPDGGLIELTRDRVRGI

SEQ ID NO: 643299 - protein, 26 aa, Mycobacterium
DAYPSLHLKAAALLHSLARNHALVDG

SEQ ID NO: 643300 - protein, 17 aa, Mycobacterium
DAYRFLPTLGEIDLHLF

SEQ ID NO: 643301 - protein, 23 aa, Mycobacterium
DAYRRLAELLTRLVSAVHPVTAD

SEQ ID NO: 643302 - protein, 17 aa, Mycobacterium
DAYRRRLIAEFKASLMT

SEQ ID NO: 643303 - protein, 23 aa, Mycobacterium
DAYTEAKEAMFFYTDTDSAPWTV

SEQ ID NO: 643304 - protein, 29 aa, Mycobacterium
DAYTNPGQPIWWLARALEFFQDGEEFWRL

SEQ ID NO: 643305 - protein, 19 aa, Mycobacterium
DAYVTWDYCRGYADASMTE

SEQ ID NO: 643306 - protein, 19 aa, Mycobacterium
DCACFGGIPAMEPNPSGST

SEQ ID NO: 643307 - protein, 20 aa, Mycobacterium
DCACQLARAALPHMAADGDA

SEQ ID NO: 643308 - protein, 26 aa, Mycobacterium
DCAEVLDWPAKLRLLEGFRQRENLNW

SEQ ID NO: 643309 - protein, 21 aa, Mycobacterium
DCAFLPDWPGVPVGNEEGEII

SEQ ID NO: 643310 - protein, 21 aa, Mycobacterium
DCAFLPEWPGVPVGNEEGEII

SEQ ID NO: 643311 - protein, 19 aa, Mycobacterium
DCAFPTLAGVETGSDPNKI

SEQ ID NO: 643312 - protein, 24 aa, Mycobacterium
DCAKGERPLDIFVFEGTVIEAPNG

SEQ ID NO: 643313 - protein, 18 aa, Mycobacterium
DCALAFLDVDGLKRVNDG

SEQ ID NO: 643314 - protein, 24 aa, Mycobacterium
DCALLPRSDWATMLSEGDRLEVVT

SEQ ID NO: 643315 - protein, 23 aa, Mycobacterium
DCAREVAEVVAPILGWSPEDVDR

SEQ ID NO: 643316 - protein, 18 aa, Mycobacterium
DCAVDAHMKVIMTGGVVR

SEQ ID NO: 643317 - protein, 22 aa, Mycobacterium
DCCADPDWTPVREWAGRHRQST

SEQ ID NO: 643318 - protein, 27 aa, Mycobacterium
DCDGIGGACVLWDCVPSKSFIAATGVR

SEQ ID NO: 643319 - protein, 27 aa, Mycobacterium
DCDQLMPPYLRFVKGVVDAQDMSLNVS

SEQ ID NO: 643320 - protein, 17 aa, Mycobacterium
DCDVPIDGSIAVVVSSA

SEQ ID NO: 643321 - protein, 18 aa, Mycobacterium
DCDYPRWRDARSEDFRAR

SEQ ID NO: 643322 - protein, 19 aa, Mycobacterium
DCENTVMSYCCDRSRSVTW

SEQ ID NO: 643323 - protein, 29 aa, Mycobacterium
DCFDIAVEAVRIAINYHTPVMILSDGAIA

SEQ ID NO: 643324 - protein, 21 aa, Mycobacterium
DCFYNARFLQMAKSYWNARYA

SEQ ID NO: 643325 - protein, 26 aa, Mycobacterium
DCGADFRLTDAAAWERFYGSAHAGSW

SEQ ID NO: 643326 - protein, 26 aa, Mycobacterium
DCGADFRLTDAAAWERFYGSAHSGSW

SEQ ID NO: 643327 - protein, 26 aa, Mycobacterium
DCGADFRLTDAAAWERFYGTPHAGSW

SEQ ID NO: 643328 - protein, 26 aa, Mycobacterium
DCGADFRLTDAAAWERYYGSKHAGSW

SEQ ID NO: 643329 - protein, 26 aa, Mycobacterium
DCGADFRLTDAGDWQRFYGSEHAGSW

SEQ ID NO: 643330 - protein, 26 aa, Mycobacterium
DCGADFRLTDPAAWERFYGSPHAGSW

SEQ ID NO: 643331 - protein, 17 aa, Mycobacterium
DCGAGLFDPVTLGVLDT

SEQ ID NO: 643332 - protein, 18 aa, Mycobacterium
DCGAGLFQPGARGVLSTV

SEQ ID NO: 643333 - protein, 21 aa, Mycobacterium
DCGGITYVYRLFEDAGTGSVD

SEQ ID NO: 643334 - protein, 18 aa, Mycobacterium
DCGIDCIEHGFLMDDEAI

SEQ ID NO: 643335 - protein, 19 aa, Mycobacterium
DCGIDCIEHGFLMDDEAIQ

SEQ ID NO: 643336 - protein, 21 aa, Mycobacterium
DCGIHARVGRVPSVQPQPILA

SEQ ID NO: 643337 - protein, 18 aa, Mycobacterium
DCGVLFPGHDEPGVDLIL

SEQ ID NO: 643338 - protein, 26 aa, Mycobacterium
DCHDAYRWLRLRGYQPDQIVLAGDSA

SEQ ID NO: 643339 - protein, 23 aa, Mycobacterium
DCHHRGRIGIMTKVHHAAVDGVT

SEQ ID NO: 643340 - protein, 18 aa, Mycobacterium
DCLAAAGAMSLGWNHPAV

SEQ ID NO: 643341 - protein, 21 aa, Mycobacterium
DCLEATLDYVGTREVFDKTLA

SEQ ID NO: 643342 - protein, 22 aa, Mycobacterium
DCLETALAYACSREQFDRPIGG

SEQ ID NO: 643343 - protein, 23 aa, Mycobacterium
DCLGRARAAALVRVNRLGRSSGA

SEQ ID NO: 643344 - protein, 20 aa, Mycobacterium
DCLIGVALPKPGVTTNAVTR

SEQ ID NO: 643345 - protein, 20 aa, Mycobacterium
DCLIGVALPKPGVTTNVIVD

SEQ ID NO: 643346 - protein, 25 aa, Mycobacterium
DCPALDRCRRWFGALPLARRPRGVV

SEQ ID NO: 643347 - protein, 21 aa, Mycobacterium
DCPCGRTGQTVKFRRRRQGAE

SEQ ID NO: 643348 - protein, 20 aa, Mycobacterium
DCPGCARTLEIHGHFASALG

SEQ ID NO: 643349 - protein, 26 aa, Mycobacterium
DCPGLCPECGVPLAAEPGHQHDRIDP

SEQ ID NO: 643350 - protein, 26 aa, Mycobacterium
DCPGLCPECGVSLAAEPGHHHDRIDP

SEQ ID NO: 643351 - protein, 25 aa, Mycobacterium
DCPHFDYSLPAYYLILPSEVSSNLA

SEQ ID NO: 643352 - protein, 25 aa, Mycobacterium
DCPIPDPLDLLAFLAGHTTSLGLAT

SEQ ID NO: 643353 - protein, 25 aa, Mycobacterium
DCPIPDPLDLLAFLAGRTTTLGLAT

SEQ ID NO: 643354 - protein, 26 aa, Mycobacterium
DCPIPDPLDLLGFLAGRTTRLGLATG

SEQ ID NO: 643355 - protein, 17 aa, Mycobacterium
DCPPGLLMSLGFAPQWV

SEQ ID NO: 643356 - protein, 22 aa, Mycobacterium
DCPPGLLMSLGFAPQWVPGYLA

SEQ ID NO: 643357 - protein, 19 aa, Mycobacterium
DCPQVPVDLDHRGEASEDG

SEQ ID NO: 643358 - protein, 18 aa, Mycobacterium
DCQTCFMCEAYCPTDALY

SEQ ID NO: 643359 - protein, 17 aa, Mycobacterium
DCQTCFMCEAYCPVDAL

SEQ ID NO: 643360 - protein, 25 aa, Mycobacterium
DCQVPIEIVGRFLALLELYRARAVT

SEQ ID NO: 643361 - protein, 21 aa, Mycobacterium
DCRDAIALGRWWSEVLEWPHT

SEQ ID NO: 643362 - protein, 17 aa, Mycobacterium
DCRKLAEDRGWPVGAEY

SEQ ID NO: 643363 - protein, 21 aa, Mycobacterium
DCRKPVIAAIQGWCIGGGVDL

SEQ ID NO: 643364 - protein, 18 aa, Mycobacterium
DCRPPRSAYGFSKLTGEI

SEQ ID NO: 643365 - protein, 29 aa, Mycobacterium
DCRTPTIAAVHGWCIGGGVDLISAVDIRY

SEQ ID NO: 643366 - protein, 29 aa, Mycobacterium
DCRTPTIASVHGWCIGGGVDLISAVDMRY

SEQ ID NO: 643367 - protein, 20 aa, Mycobacterium
DCSEGGVLIPGGVDVTAGSS

SEQ ID NO: 643368 - protein, 25 aa, Mycobacterium
DCSHRFRYKAGQFLTVRVSVDGRDL

SEQ ID NO: 643369 - protein, 19 aa, Mycobacterium
DCSLDDFRAAVARTTDAAD

SEQ ID NO: 643370 - protein, 23 aa, Mycobacterium
DCTGLLPLASVAAMQGRIAMYHA

SEQ ID NO: 643371 - protein, 23 aa, Mycobacterium
DCTRRLLRHYVMLALTAMPEAPV

SEQ ID NO: 643372 - protein, 18 aa, Mycobacterium
DCVHLGRTQVGVVTSATR

SEQ ID NO: 643373 - protein, 18 aa, Mycobacterium
DCVLLDLHLPDASGMDAL

SEQ ID NO: 643374 - protein, 20 aa, Mycobacterium
DCVQAHLAALDLVYTGVIED

SEQ ID NO: 643375 - protein, 37 aa, Mycobacterium
DCYDYIGHVLFTWNMPELWRRFTITLRRTLRRELRAL

SEQ ID NO: 643376 - protein, 23 aa, Mycobacterium
DCYMGEGVPKVWAPARSWAFYTP

SEQ ID NO: 643377 - protein, 18 aa, Mycobacterium
DDAAEWILRTILSLLSVR

SEQ ID NO: 643378 - protein, 23 aa, Mycobacterium
DDAARMWARLRIHLAETGQRVRI

SEQ ID NO: 643379 - protein, 18 aa, Mycobacterium
DDAARRLGVDDVDRRELS

SEQ ID NO: 643380 - protein, 17 aa, Mycobacterium
DDADFASAAAFGVTYRT

SEQ ID NO: 643381 - protein, 19 aa, Mycobacterium
DDADLDWAIDASIFGSFFH

SEQ ID NO: 643382 - protein, 23 aa, Mycobacterium
DDAELRGAATVRFMHPHSTAWGP

SEQ ID NO: 643383 - protein, 26 aa, Mycobacterium
DDAEPRWSWFPSDQTVGFTRRMQTYE

SEQ ID NO: 643384 - protein, 25 aa, Mycobacterium
DDAFPLVITHGWPGSIVEFHKVIEP

SEQ ID NO: 643385 - protein, 17 aa, Mycobacterium
DDAFRSWWDLAGNRAAS

SEQ ID NO: 643386 - protein, 25 aa, Mycobacterium
DDAGKIIEFKVMIRPLQAINAIHEK

SEQ ID NO: 643387 - protein, 18 aa, Mycobacterium
DDAGYAWVREHLTVERLR

SEQ ID NO: 643388 - protein, 25 aa, Mycobacterium
DDAHGTLYLATRGGYFVVDVATGHT

SEQ ID NO: 643389 - protein, 25 aa, Mycobacterium
DDAIWRPQARWVYELIRALVDSGAD

SEQ ID NO: 643390 - protein, 24 aa, Mycobacterium
DDAKAICRSCPRRWLCAREAYESP

SEQ ID NO: 643391 - protein, 17 aa, Mycobacterium
DDALEWVRAHNDPTLEA

SEQ ID NO: 643392 - protein, 25 aa, Mycobacterium
DDALFVRPFLKYQIIAVAAPNSPVA

SEQ ID NO: 643393 - protein, 21 aa, Mycobacterium
DDALGGLGLDRAHLFGVSVGG

SEQ ID NO: 643394 - protein, 18 aa, Mycobacterium
DDALLDWLRRAHRTARWT

SEQ ID NO: 643395 - protein, 22 aa, Mycobacterium
DDALMKITHVLRGEDILPSTPR

SEQ ID NO: 643396 - protein, 17 aa, Mycobacterium
DDALRAWLDKSPTVPLR

SEQ ID NO: 643397 - protein, 25 aa, Mycobacterium
DDALRPKWLFGQSVHEGCDRAGYYE

SEQ ID NO: 643398 - protein, 24 aa, Mycobacterium
DDALRPVPVGAIGEIYIGGGHVAR

SEQ ID NO: 643399 - protein, 18 aa, Mycobacterium
DDALWKRYSTARETFNRR

SEQ ID NO: 643400 - protein, 23 aa, Mycobacterium
DDAMCRAFEVCCGPTRFIDGPGY

SEQ ID NO: 643401 - protein, 23 aa, Mycobacterium
DDAPAVAVGLLIGSQVPAPGALT

SEQ ID NO: 643402 - protein, 22 aa, Mycobacterium
DDAPGFRYRLLAALEDSIADTG

SEQ ID NO: 643403 - protein, 19 aa, Mycobacterium
DDAPKALVTLEFQSIEYRR

SEQ ID NO: 643404 - protein, 18 aa, Mycobacterium
DDAPRYAGLDVDAETYAD

SEQ ID NO: 643405 - protein, 17 aa, Mycobacterium
DDARAAALLDTAAAPVR

SEQ ID NO: 643406 - protein, 23 aa, Mycobacterium
DDARADARWVLAAVRNRKASHIA

SEQ ID NO: 643407 - protein, 23 aa, Mycobacterium
DDARAHAAKLFGYTMARTYLTGA

SEQ ID NO: 643408 - protein, 30 aa, Mycobacterium
DDARAKAAFAEFIESLGLRPLDVGGLHMAH

SEQ ID NO: 643409 - protein, 23 aa, Mycobacterium
DDAREIIELTIARRPDGLVSNYL

SEQ ID NO: 643410 - protein, 23 aa, Mycobacterium
DDARFGLPEVERGALGAATHLSR

SEQ ID NO: 643411 - protein, 24 aa, Mycobacterium
DDARFSDVVAVRMGMPGVEYYAHP

SEQ ID NO: 643412 - protein, 23 aa, Mycobacterium
DDARKAELAAMVAPADAVFLDAK

SEQ ID NO: 643413 - protein, 17 aa, Mycobacterium
DDARLGPSLRVVVTAVR

SEQ ID NO: 643414 - protein, 31 aa, Mycobacterium
DDARLLVHAIRRVWKLTEFRMLTHDRGSSVG

SEQ ID NO: 643415 - protein, 29 aa, Mycobacterium
DDARLLVHAIRRVWQLTEFRMLTHDRGSS

SEQ ID NO: 643416 - protein, 28 aa, Mycobacterium
DDARLRDLLCTVLTPLDCDIVQAGSGEE

SEQ ID NO: 643417 - protein, 19 aa, Mycobacterium
DDARWAVDFTLEVPGDLPS

SEQ ID NO: 643418 - protein, 18 aa, Mycobacterium
DDASEWILRAILSLLTVE

SEQ ID NO: 643419 - protein, 26 aa, Mycobacterium
DDASRRLPVFEVRVINGNVEIGMLRS

SEQ ID NO: 643420 - protein, 18 aa, Mycobacterium
DDATPVWVSAAVTAPGTA

SEQ ID NO: 643421 - protein, 17 aa, Mycobacterium
DDAWCARMVQDVSAELL

SEQ ID NO: 643422 - protein, 17 aa, Mycobacterium
DDCGVSWDHLGERAKFP

SEQ ID NO: 643423 - protein, 17 aa, Mycobacterium
DDCHDGYRWLRLLGYDP

SEQ ID NO: 643424 - protein, 22 aa, Mycobacterium
DDCHDGYRWLRLLGYDPEQIVL

SEQ ID NO: 643425 - protein, 25 aa, Mycobacterium
DDCIECPFHGWRWGPDGSNTYIPYQ

SEQ ID NO: 643426 - protein, 21 aa, Mycobacterium
DDCPVRPAGRWIVDPDGAVVR

SEQ ID NO: 643427 - protein, 22 aa, Mycobacterium
DDDCPGWLDGYGPVPAGFCRAL

SEQ ID NO: 643428 - protein, 25 aa, Mycobacterium
DDDEIRVPWELKPRRRSNPGHRSSP

SEQ ID NO: 643429 - protein, 23 aa, Mycobacterium
DDDEVRVPWSMAPRKRGGRRSPS

SEQ ID NO: 643430 - protein, 18 aa, Mycobacterium
DDDGLHFVGRVGTGFTDK

SEQ ID NO: 643431 - protein, 17 aa, Mycobacterium
DDDGRGALIGFGVTDVA

SEQ ID NO: 643432 - protein, 17 aa, Mycobacterium
DDDIANVFLDWSATETE

SEQ ID NO: 643433 - protein, 18 aa, Mycobacterium
DDDIASAIAEFVSEEAGR

SEQ ID NO: 643434 - protein, 39 aa, Mycobacterium
DDDLASSAHFVWVRETLRLGGKFPLKAGLVTSLGFGHVS

SEQ ID NO: 643435 - protein, 29 aa, Mycobacterium
DDDLAVLGYYEWREGLLRGLAAHHAGMLP

SEQ ID NO: 643436 - protein, 21 aa, Mycobacterium
DDDLDGWYRYPECVADQPETP

SEQ ID NO: 643437 - protein, 20 aa, Mycobacterium
DDDLEGWARYPECVADQPDT

SEQ ID NO: 643438 - protein, 18 aa, Mycobacterium
DDDLGCRVVRAYLGIWEQ

SEQ ID NO: 643439 - protein, 23 aa, Mycobacterium
DDDLQHRLGRMVASTTAFGANEN

SEQ ID NO: 643440 - protein, 18 aa, Mycobacterium
DDDLQWARLDLDGTTDFD

SEQ ID NO: 643441 - protein, 26 aa, Mycobacterium
DDDLRPLRPAILYGIDTRASEEIEAL

SEQ ID NO: 643442 - protein, 24 aa, Mycobacterium
DDDLRVAVVNAEFEALLVGADSKL

SEQ ID NO: 643443 - protein, 20 aa, Mycobacterium
DDDPRWPLLQAERSALITLN

SEQ ID NO: 643444 - protein, 20 aa, Mycobacterium
DDDRCVAILENSRRKALPES

SEQ ID NO: 643445 - protein, 17 aa, Mycobacterium
DDDRLHGMITDRDIVTK

SEQ ID NO: 643446 - protein, 17 aa, Mycobacterium
DDDRLHSALSYLRANDP

SEQ ID NO: 643447 - protein, 24 aa, Mycobacterium
DDDRLRRIAVFDVLINNADRKGGH

SEQ ID NO: 643448 - protein, 24 aa, Mycobacterium
DDDRLRRPGAVILVGERLATSPGA

SEQ ID NO: 643449 - protein, 19 aa, Mycobacterium
DDDRTLLTFTYGTKAPADS

SEQ ID NO: 643450 - protein, 19 aa, Mycobacterium
DDDTAIAFARQVQTGQLDI

SEQ ID NO: 643451 - protein, 18 aa, Mycobacterium
DDDVAGWIQRSPDIGTAM

SEQ ID NO: 643452 - protein, 18 aa, Mycobacterium
DDDWKGATAVVSRYYNLV

SEQ ID NO: 643453 - protein, 18 aa, Mycobacterium
DDDWRAATEIVSRYYNLV

SEQ ID NO: 643454 - protein, 21 aa, Mycobacterium
DDDWSKLWWVRADGVASIHHS

SEQ ID NO: 643455 - protein, 20 aa, Mycobacterium
DDDWYPISMRTMLRNNLTLK

SEQ ID NO: 643456 - protein, 21 aa, Mycobacterium
DDEAHWLIYEIWETVEHDEAY

SEQ ID NO: 643457 - protein, 21 aa, Mycobacterium
DDEAHWLIYELWDTVEHDEAY

SEQ ID NO: 643458 - protein, 24 aa, Mycobacterium
DDEALRPIIRFDGTDYPIGIHPLV

SEQ ID NO: 643459 - protein, 25 aa, Mycobacterium
DDEAVLRMPWRPELATTADMVHGGA

SEQ ID NO: 643460 - protein, 22 aa, Mycobacterium
DDECPGAGMIAGIGRVSGRECM

SEQ ID NO: 643461 - protein, 18 aa, Mycobacterium
DDEFGFFVMLLAVAGNET

SEQ ID NO: 643462 - protein, 21 aa, Mycobacterium
DDEFPLALHFTMIAGGPIRAR

SEQ ID NO: 643463 - protein, 24 aa, Mycobacterium
DDEGRFWLRTVVPRYYPIPDDGPV

SEQ ID NO: 643464 - protein, 21 aa, Mycobacterium
DDEIVSFFILLTIAGNDTTRQ

SEQ ID NO: 643465 - protein, 21 aa, Mycobacterium
DDEIYRVIARLGIADEFAAIS

SEQ ID NO: 643466 - protein, 23 aa, Mycobacterium
DDEKAQWPQWVPVGRMGVPLDQA

SEQ ID NO: 643467 - protein, 25 aa, Mycobacterium
DDEKFPLAARIGAAAGQAFGSAYDA

SEQ ID NO: 643468 - protein, 28 aa, Mycobacterium
DDEKKLFCRMAEVFAGFLSYTDAQIGRI

SEQ ID NO: 643469 - protein, 27 aa, Mycobacterium
DDEKRLFSRMAEVFAGFLSYTDAQIGR

SEQ ID NO: 643470 - protein, 43 aa, Mycobacterium
DDELAGAAHFVWVRDALRLGGKFPLKAGMLTSLGFGHVSGLVA

SEQ ID NO: 643471 - protein, 25 aa, Mycobacterium
DDELASSAHFVWVRETLRLGEKFPL

SEQ ID NO: 643472 - protein, 38 aa, Mycobacterium
DDELATAGHFVWVREALDLRGKFPLKAGLVTSLGFGHV

SEQ ID NO: 643473 - protein, 25 aa, Mycobacterium
DDELATSGHFVWVREPLDLRGKFPL

SEQ ID NO: 643474 - protein, 20 aa, Mycobacterium
DDELERLWTAPVETPAYRRG

SEQ ID NO: 643475 - protein, 18 aa, Mycobacterium
DDELLAWADEDLATLFGI

SEQ ID NO: 643476 - protein, 20 aa, Mycobacterium
DDELRPVVITRGFTENPAGS

SEQ ID NO: 643477 - protein, 23 aa, Mycobacterium
DDELRRRLARVGLGPKLLRARPD

SEQ ID NO: 643478 - protein, 20 aa, Mycobacterium
DDELRRWADRIAAWQGEGRD

SEQ ID NO: 643479 - protein, 22 aa, Mycobacterium
DDELRWMWLTSQAALHLWDDAH

SEQ ID NO: 643480 - protein, 26 aa, Mycobacterium
DDELRYRIGASLPRAVDTSMPREAQQ

SEQ ID NO: 643481 - protein, 24 aa, Mycobacterium
DDEPLRLIWCGRLSPEKRVLEAVK

SEQ ID NO: 643482 - protein, 24 aa, Mycobacterium
DDEPLRLVWCGRLSSEKRALEAIE

SEQ ID NO: 643483 - protein, 18 aa, Mycobacterium
DDEPVCVHLVYSTPAYAR

SEQ ID NO: 643484 - protein, 17 aa, Mycobacterium
DDERGWHDARVIPYGPI

SEQ ID NO: 643485 - protein, 24 aa, Mycobacterium
DDERLQRLLTFVARQEPRLNWAVG

SEQ ID NO: 643486 - protein, 31 aa, Mycobacterium
DDESGRPLWPMIIMRTPKGWTGPATVDGKKV

SEQ ID NO: 643487 - protein, 20 aa, Mycobacterium
DDETAPFCRTEYFINRSFAA

SEQ ID NO: 643488 - protein, 24 aa, Mycobacterium
DDEVLRPLPVTTFDVRRAPAALRY

SEQ ID NO: 643489 - protein, 18 aa, Mycobacterium
DDEVMSWIASGPPPICFA

SEQ ID NO: 643490 - protein, 18 aa, Mycobacterium
DDEVPEFVANIAANTGEF

SEQ ID NO: 643491 - protein, 22 aa, Mycobacterium
DDEWPVLAFAAFGGSAARAKPY

SEQ ID NO: 643492 - protein, 23 aa, Mycobacterium
DDEYRAVLRFGGLDEAGLHRIGL

SEQ ID NO: 643493 - protein, 23 aa, Mycobacterium
DDFAEAFAKVLAKHRVWERQTDS

SEQ ID NO: 643494 - protein, 28 aa, Mycobacterium
DDFAQYWAEICSIPISFIAESVRRAQAE

SEQ ID NO: 643495 - protein, 23 aa, Mycobacterium
DDFDRSAGFGIYGTVKAALNRLT

SEQ ID NO: 643496 - protein, 18 aa, Mycobacterium
DDFEIAGFATLLGGAGAE

SEQ ID NO: 643497 - protein, 22 aa, Mycobacterium
DDFETLCQVWATFATVNRQQHM

SEQ ID NO: 643498 - protein, 19 aa, Mycobacterium
DDFFRLFLDPTMTYSCAYF

SEQ ID NO: 643499 - protein, 24 aa, Mycobacterium
DDFGEWLRRFEAALRELPERQRKH

SEQ ID NO: 643500 - protein, 24 aa, Mycobacterium
DDFGEWLRRFEAALRELPERQRQH

SEQ ID NO: 643501 - protein, 23 aa, Mycobacterium
DDFGMGLLLKGRQVKKVIASYVG

SEQ ID NO: 643502 - protein, 19 aa, Mycobacterium
DDFGVPFTLTRRGALTAEL

SEQ ID NO: 643503 - protein, 19 aa, Mycobacterium
DDFLSWFFKADRGELEPFV

SEQ ID NO: 643504 - protein, 19 aa, Mycobacterium
DDFMIPFATLRPAPYRQAT

SEQ ID NO: 643505 - protein, 20 aa, Mycobacterium
DDFMRRAPLLLAVGGEPFEY

SEQ ID NO: 643506 - protein, 27 aa, Mycobacterium
DDFQRRACAALECGHGVLVCAPTGAGK

SEQ ID NO: 643507 - protein, 24 aa, Mycobacterium
DDFQRRACAALEGGHGVLVCAPTG

SEQ ID NO: 643508 - protein, 30 aa, Mycobacterium
DDFTDIFDVFPWADGEPVQFGSLTVTPTRV

SEQ ID NO: 643509 - protein, 25 aa, Mycobacterium
DDFTFLDGVMAWYATVSSINNISSL

SEQ ID NO: 643510 - protein, 21 aa, Mycobacterium
DDGAGGWSLWVPEAGTVDAGG

SEQ ID NO: 643511 - protein, 22 aa, Mycobacterium
DDGAHYWGRFGSAGLLLRAPLP

SEQ ID NO: 643512 - protein, 17 aa, Mycobacterium
DDGALPRLYAYPERDGT

SEQ ID NO: 643513 - protein, 23 aa, Mycobacterium
DDGASWRRLLGPLVTNFAAVVDF

SEQ ID NO: 643514 - protein, 25 aa, Mycobacterium
DDGCGISPDVSRRSGLANMRSRAEK

SEQ ID NO: 643515 - protein, 19 aa, Mycobacterium
DDGDHLVCTGSKIWTTHAQ

SEQ ID NO: 643516 - protein, 22 aa, Mycobacterium
DDGEVKIADFGLVRAVAAAGIT

SEQ ID NO: 643517 - protein, 25 aa, Mycobacterium
DDGFLNRLDLAFSRDQRQRIYVQHK

SEQ ID NO: 643518 - protein, 26 aa, Mycobacterium
DDGFLWLDGRVSDMINRGGLKVFPGT

SEQ ID NO: 643519 - protein, 24 aa, Mycobacterium
DDGFPRALLQELLSAYGPCGQEAA

SEQ ID NO: 643520 - protein, 23 aa, Mycobacterium
DDGFVNVIYRWARTGDLAAALAA

SEQ ID NO: 643521 - protein, 23 aa, Mycobacterium
DDGFVNVIYRWARTGDLGAALAA

SEQ ID NO: 643522 - protein, 24 aa, Mycobacterium
DDGFVNVVYRWARTGDLSAALAAA

SEQ ID NO: 643523 - protein, 19 aa, Mycobacterium
DDGGKGIGSLFSWTQNPGG

SEQ ID NO: 643524 - protein, 19 aa, Mycobacterium
DDGIACWLAPLLQDGAKLP

SEQ ID NO: 643525 - protein, 25 aa, Mycobacterium
DDGIGIDEYVDWLIEAGHPIERIDD

SEQ ID NO: 643526 - protein, 23 aa, Mycobacterium
DDGIGLDEFVDWLDEAGYPIERI

SEQ ID NO: 643527 - protein, 24 aa, Mycobacterium
DDGIGLDEFVDWLNESGCPIQRIA

SEQ ID NO: 643528 - protein, 26 aa, Mycobacterium
DDGIGLDEYVDWLIDAGHRIQRIADY

SEQ ID NO: 643529 - protein, 24 aa, Mycobacterium
DDGIGLDEYVDWLIEAGYPIERVG

SEQ ID NO: 643530 - protein, 24 aa, Mycobacterium
DDGIGLDEYVDWLIEAGYPVHRVD

SEQ ID NO: 643531 - protein, 24 aa, Mycobacterium
DDGIGLDEYVDWVIEAGYPIERID

SEQ ID NO: 643532 - protein, 24 aa, Mycobacterium
DDGIGLDEYVDWVIEAGYPIERVD

SEQ ID NO: 643533 - protein, 30 aa, Mycobacterium
DDGIGMDRFVDWLVDAGCAIHRIDDYGDWL

SEQ ID NO: 643534 - protein, 20 aa, Mycobacterium
DDGIIQWLIHRLPGLSETFV

SEQ ID NO: 643535 - protein, 21 aa, Mycobacterium
DDGIRCTWLDTSHAFHSELLE

SEQ ID NO: 643536 - protein, 19 aa, Mycobacterium
DDGKFRFVITSYKHVKDAV

SEQ ID NO: 643537 - protein, 36 aa, Mycobacterium
DDGLGTWRFHVERSGSISWFGLDGMEHPGGTADIDG

SEQ ID NO: 643538 - protein, 19 aa, Mycobacterium
DDGLPGWRTLPDLLSESDI

SEQ ID NO: 643539 - protein, 17 aa, Mycobacterium
DDGLTCAILGVPAVDVV

SEQ ID NO: 643540 - protein, 23 aa, Mycobacterium
DDGMLEWRLAGLPVHEGEAVRTP

SEQ ID NO: 643541 - protein, 22 aa, Mycobacterium
DDGPIALALVKRGLPAETELMT

SEQ ID NO: 643542 - protein, 21 aa, Mycobacterium
DDGPMKPVRLWSRIGRRPIFA

SEQ ID NO: 643543 - protein, 24 aa, Mycobacterium
DDGPRGWATVWARAADVRLARGDH

SEQ ID NO: 643544 - protein, 21 aa, Mycobacterium
DDGQVLLRFMAAGVCGSDLPA

SEQ ID NO: 643545 - protein, 18 aa, Mycobacterium
DDGRLSSYDGVYRVNPPL

SEQ ID NO: 643546 - protein, 17 aa, Mycobacterium
DDGRMAQAFERMGPGWR

SEQ ID NO: 643547 - protein, 23 aa, Mycobacterium
DDGRPPVIQMWARPRGVAPDALF

SEQ ID NO: 643548 - protein, 24 aa, Mycobacterium
DDGRPRFSPPEAALGLPAQDATPA

SEQ ID NO: 643549 - protein, 21 aa, Mycobacterium
DDGRSPLVVKRRYRAAHNIGH

SEQ ID NO: 643550 - protein, 22 aa, Mycobacterium
DDGRTVIHLNPFAAQGDNSYFP

SEQ ID NO: 643551 - protein, 33 aa, Mycobacterium
DDGRVIINAGLVFEGYLRKKAFADIAGPTRTIV

SEQ ID NO: 643552 - protein, 27 aa, Mycobacterium
DDGRVKAWKGIRYAAAPVGDLRFRAPQ

SEQ ID NO: 643553 - protein, 22 aa, Mycobacterium
DDGSPPFVVRWLSDGHEATVYP

SEQ ID NO: 643554 - protein, 25 aa, Mycobacterium
DDGTLKFGGWSWRYDLESLAPARTR

SEQ ID NO: 643555 - protein, 26 aa, Mycobacterium
DDGTMSGRTRLEVISPTAAQQLSAVG

SEQ ID NO: 643556 - protein, 26 aa, Mycobacterium
DDGVKVICRRSRLMGRVAGSGAMASV

SEQ ID NO: 643557 - protein, 18 aa, Mycobacterium
DDGWAYAVAEGDAILTPP

SEQ ID NO: 643558 - protein, 18 aa, Mycobacterium
DDGWRLHGPIEEWISTAA

SEQ ID NO: 643559 - protein, 21 aa, Mycobacterium
DDGWWFAVGDGHQWAVVARGG

SEQ ID NO: 643560 - protein, 32 aa, Mycobacterium
DDGYCTIIGRLKDMVIRGGENIYPREIEEFLL

SEQ ID NO: 643561 - protein, 21 aa, Mycobacterium
DDGYDAYVWLYTEEICRWEHI

SEQ ID NO: 643562 - protein, 20 aa, Mycobacterium
DDGYLAILDIRPFSRGHTLV

SEQ ID NO: 643563 - protein, 26 aa, Mycobacterium
DDGYLRAAVRPEWPQLVDAIAEVRQA

SEQ ID NO: 643564 - protein, 22 aa, Mycobacterium
DDHAHWLIYELWDTVEHDEAYR

SEQ ID NO: 643565 - protein, 17 aa, Mycobacterium
DDHDWSGDIVVVSHGAA

SEQ ID NO: 643566 - protein, 18 aa, Mycobacterium
DDHFWFSFFHEAGHIVLH

SEQ ID NO: 643567 - protein, 17 aa, Mycobacterium
DDHHTFDEIVGRVRRHG

SEQ ID NO: 643568 - protein, 18 aa, Mycobacterium
DDHKEFRVMLGAERPGSR

SEQ ID NO: 643569 - protein, 18 aa, Mycobacterium
DDHLDLEALMAWITDSHG

SEQ ID NO: 643570 - protein, 31 aa, Mycobacterium
DDHLRRIGELWARFNAVAVDNPHAWIRTPSS

SEQ ID NO: 643571 - protein, 24 aa, Mycobacterium
DDHLRRVAVESAPWNFAAHTVARG

SEQ ID NO: 643572 - protein, 30 aa, Mycobacterium
DDHPGLRVGWFEGGIAWVPWALQDAEHLVA

SEQ ID NO: 643573 - protein, 31 aa, Mycobacterium
DDHRKRIGELWARFNAVAVDNPHAWIRKPVT

SEQ ID NO: 643574 - protein, 18 aa, Mycobacterium
DDHRLRLEHVGAITPEQL

SEQ ID NO: 643575 - protein, 24 aa, Mycobacterium
DDIARLSVLLAGWPETVPGMTLNR

SEQ ID NO: 643576 - protein, 17 aa, Mycobacterium
DDIELQFGFFQTSLDDP

SEQ ID NO: 643577 - protein, 26 aa, Mycobacterium
DDIERFARRFGCVVQDGFGSTEGGVA

SEQ ID NO: 643578 - protein, 28 aa, Mycobacterium
DDIEVFHTGWLFDHFYPIASPSQRDHNS

SEQ ID NO: 643579 - protein, 18 aa, Mycobacterium
DDIFCMPDGPAMLDCLEF

SEQ ID NO: 643580 - protein, 17 aa, Mycobacterium
DDIFGPAALRIHRRISM

SEQ ID NO: 643581 - protein, 17 aa, Mycobacterium
DDIHAPQRIWGHTGKSD

SEQ ID NO: 643582 - protein, 17 aa, Mycobacterium
DDIKHAKLLSGKGIHML

SEQ ID NO: 643583 - protein, 20 aa, Mycobacterium
DDILPVARLLVLPESGWTTA

SEQ ID NO: 643584 - protein, 23 aa, Mycobacterium
DDINASAWPAEWNGELIDLLSVL

SEQ ID NO: 643585 - protein, 17 aa, Mycobacterium
DDIPRKKGIGLLQADLL

SEQ ID NO: 643586 - protein, 34 aa, Mycobacterium
DDIQSWRAVQRVGWKWWLAACFQVTDDKEQLCEL

SEQ ID NO: 643587 - protein, 21 aa, Mycobacterium
DDIQTAILYDHFTPYTLLQLE

SEQ ID NO: 643588 - protein, 17 aa, Mycobacterium
DDIRARNAIGFAGAGAM

SEQ ID NO: 643589 - protein, 20 aa, Mycobacterium
DDIRCAARLLGTAERLLSTV

SEQ ID NO: 643590 - protein, 26 aa, Mycobacterium
DDIRGRIAVEVSRRITASLGPGAATE

SEQ ID NO: 643591 - protein, 26 aa, Mycobacterium
DDISRPGMLHACFVRSPFARARINGI

SEQ ID NO: 643592 - protein, 24 aa, Mycobacterium
DDITPTGSLWCYATPETREWWGGM

SEQ ID NO: 643593 - protein, 25 aa, Mycobacterium
DDIVRPGMLHACFVRSPFAHAKING

SEQ ID NO: 643594 - protein, 18 aa, Mycobacterium
DDIYPGWDGLAWAVEHIR

SEQ ID NO: 643595 - protein, 20 aa, Mycobacterium
DDKARLGAQRVWIIDPLDGT

SEQ ID NO: 643596 - protein, 24 aa, Mycobacterium
DDKGVAPLGCLRPVNPPVGVGRQF

SEQ ID NO: 643597 - protein, 26 aa, Mycobacterium
DDKLAIAQGFLLPRQRERAALTSDEV

SEQ ID NO: 643598 - protein, 24 aa, Mycobacterium
DDKLPRYIGGVLARLQEVWMGRQI

SEQ ID NO: 643599 - protein, 22 aa, Mycobacterium
DDKNIRIAPTFPSLPDLRNAVD

SEQ ID NO: 643600 - protein, 22 aa, Mycobacterium
DDLAARLALRRRLVPTRDVRNR

SEQ ID NO: 643601 - protein, 23 aa, Mycobacterium
DDLAHEAQQWWGVAGRRNPGDVH

SEQ ID NO: 643602 - protein, 26 aa, Mycobacterium
DDLAPDWPREIGYAVTFEGTPNMTFQ

SEQ ID NO: 643603 - protein, 22 aa, Mycobacterium
DDLAPRLAPFANKNPDNGLGVH

SEQ ID NO: 643604 - protein, 22 aa, Mycobacterium
DDLATVFGLRVDPVDARVQRWI

SEQ ID NO: 643605 - protein, 20 aa, Mycobacterium
DDLCSEILPLLASARGVAAW

SEQ ID NO: 643606 - protein, 21 aa, Mycobacterium
DDLDASILFYSKLFGVDPAKR

SEQ ID NO: 643607 - protein, 23 aa, Mycobacterium
DDLDFHWLDVGWHVLLRRWMSDA

SEQ ID NO: 643608 - protein, 18 aa, Mycobacterium
DDLDVLDWPEQVKTMQRN

SEQ ID NO: 643609 - protein, 17 aa, Mycobacterium
DDLECVNLASTLNDALD

SEQ ID NO: 643610 - protein, 26 aa, Mycobacterium
DDLEFALRLGVDLVALSFVRSPADVE

SEQ ID NO: 643611 - protein, 19 aa, Mycobacterium
DDLGLIAFRLSDLAHDVTT

SEQ ID NO: 643612 - protein, 21 aa, Mycobacterium
DDLGPRFTFVPADVTDEAAIA

SEQ ID NO: 643613 - protein, 26 aa, Mycobacterium
DDLHSIMARGWLRPGAIVVADNVRVP

SEQ ID NO: 643614 - protein, 19 aa, Mycobacterium
DDLIMAPKYGEWIRDQIPH

SEQ ID NO: 643615 - protein, 27 aa, Mycobacterium
DDLIREFVEATGIPFLPMSMAKGLLPD

SEQ ID NO: 643616 - protein, 23 aa, Mycobacterium
DDLKPGVPDRSWSQVSVSARECL

SEQ ID NO: 643617 - protein, 26 aa, Mycobacterium
DDLLIQRRPRMAGVRADYDKVLRQRT

SEQ ID NO: 643618 - protein, 18 aa, Mycobacterium
DDLMAPIPSLLAVAAVHH

SEQ ID NO: 643619 - protein, 25 aa, Mycobacterium
DDLPCANGITVDRGRLFVGECRDGG

SEQ ID NO: 643620 - protein, 20 aa, Mycobacterium
DDLPDGGAWLYAETVRAIKE

SEQ ID NO: 643621 - protein, 21 aa, Mycobacterium
DDLPDGGAWLYAETVRAIKEL

SEQ ID NO: 643622 - protein, 21 aa, Mycobacterium
DDLPDGGAWLYAETVRQIKAL

SEQ ID NO: 643623 - protein, 21 aa, Mycobacterium
DDLPEITHFVAGLGTAGTLMG

SEQ ID NO: 643624 - protein, 17 aa, Mycobacterium
DDLPFACKGGVCGTCRA

SEQ ID NO: 643625 - protein, 17 aa, Mycobacterium
DDLPIDPNVLFDGMSAF

SEQ ID NO: 643626 - protein, 17 aa, Mycobacterium
DDLPRLAARMERPAEPL

SEQ ID NO: 643627 - protein, 18 aa, Mycobacterium
DDLPYVWPASDRPRRVPV

SEQ ID NO: 643628 - protein, 21 aa, Mycobacterium
DDLRAALSPARAAAPEVVDIA

SEQ ID NO: 643629 - protein, 17 aa, Mycobacterium
DDLRAIATLADRGVEGA

SEQ ID NO: 643630 - protein, 17 aa, Mycobacterium
DDLRALVPQRLILAHRD

SEQ ID NO: 643631 - protein, 23 aa, Mycobacterium
DDLRARFVVMASGPFHRPKLPGI

SEQ ID NO: 643632 - protein, 21 aa, Mycobacterium
DDLRESGRLTVLGGVEVTGIR

SEQ ID NO: 643633 - protein, 17 aa, Mycobacterium
DDLRKVLLGLRRAKSNV

SEQ ID NO: 643634 - protein, 17 aa, Mycobacterium
DDLRRARSSVGFPTPTR

SEQ ID NO: 643635 - protein, 17 aa, Mycobacterium
DDLRRWAERLTAWDGEG

SEQ ID NO: 643636 - protein, 25 aa, Mycobacterium
DDLRSVPAAVRFLSCEPLLGTLKGI

SEQ ID NO: 643637 - protein, 17 aa, Mycobacterium
DDLRVAATILDGKKVKS

SEQ ID NO: 643638 - protein, 21 aa, Mycobacterium
DDLRVAIEGGFLSVTEETVTV

SEQ ID NO: 643639 - protein, 26 aa, Mycobacterium
DDLRVPMRFGEELAMLIPQSRFVALP

SEQ ID NO: 643640 - protein, 23 aa, Mycobacterium
DDLRWHDLRHSGAVLAAATGASL

SEQ ID NO: 643641 - protein, 20 aa, Mycobacterium
DDLRYLAAWSAARTGVEAYV

SEQ ID NO: 643642 - protein, 17 aa, Mycobacterium
DDLSLRLGWAERTVELP

SEQ ID NO: 643643 - protein, 17 aa, Mycobacterium
DDLSVGQVFDWAPAITL

SEQ ID NO: 643644 - protein, 18 aa, Mycobacterium
DDLTEAWVRPGLSDPAIA

SEQ ID NO: 643645 - protein, 19 aa, Mycobacterium
DDLTSFLLQFEFDGHRLTD

SEQ ID NO: 643646 - protein, 22 aa, Mycobacterium
DDLVAFLIGCSFSFEAALLDSG

SEQ ID NO: 643647 - protein, 25 aa, Mycobacterium
DDLVEAIGVDAARYSLIRSSVDTPI

SEQ ID NO: 643648 - protein, 17 aa, Mycobacterium
DDLVRRMMKANPIPQPW

SEQ ID NO: 643649 - protein, 17 aa, Mycobacterium
DDLVRRMMKGNPIPLPW

SEQ ID NO: 643650 - protein, 21 aa, Mycobacterium
DDLWLNESFATFASVLCQAEA

SEQ ID NO: 643651 - protein, 21 aa, Mycobacterium
DDLWLNESFATFASVLCQSEA

SEQ ID NO: 643652 - protein, 20 aa, Mycobacterium
DDLWQSRLPKALAELTPHAE

SEQ ID NO: 643653 - protein, 29 aa, Mycobacterium
DDMAPICQLFHTLPIPWVEAEDISNAVLF

SEQ ID NO: 643654 - protein, 25 aa, Mycobacterium
DDMAPICQMFHTLPIPWVEAEDISN

SEQ ID NO: 643655 - protein, 26 aa, Mycobacterium
DDMAPICQMFHTLPIPWVEPIDISNA

SEQ ID NO: 643656 - protein, 24 aa, Mycobacterium
DDMASRFPMRMAELGGSLRRTLAL

SEQ ID NO: 643657 - protein, 18 aa, Mycobacterium
DDMIAFLLARARGGVALA

SEQ ID NO: 643658 - protein, 25 aa, Mycobacterium
DDMLWRDIHPDKEFRAVEDGLVLKA

SEQ ID NO: 643659 - protein, 25 aa, Mycobacterium
DDMPDELKPVLARQMEIYAGFLEQT

SEQ ID NO: 643660 - protein, 17 aa, Mycobacterium
DDMPEPDDWVLVHVGFA

SEQ ID NO: 643661 - protein, 23 aa, Mycobacterium
DDMQLELILPVSGTSIYTEFLER

SEQ ID NO: 643662 - protein, 20 aa, Mycobacterium
DDMRARYGVPGSSRDTMGPW

SEQ ID NO: 643663 - protein, 20 aa, Mycobacterium
DDNFVFPDGMLLVFEPVVWE

SEQ ID NO: 643664 - protein, 24 aa, Mycobacterium
DDNISVKLFDDWSNLGSVSDLSAS

SEQ ID NO: 643665 - protein, 24 aa, Mycobacterium
DDNLRQTFDYCVTSAFIMSQLAVP

SEQ ID NO: 643666 - protein, 17 aa, Mycobacterium
DDNMPWVKLGRQLVDSA

SEQ ID NO: 643667 - protein, 25 aa, Mycobacterium
DDPALRFELCLGVSGVHYPDDTGRE

SEQ ID NO: 643668 - protein, 26 aa, Mycobacterium
DDPASDWARYALRAPVMLVHTPEAVP

SEQ ID NO: 643669 - protein, 17 aa, Mycobacterium
DDPAVLGDAVFYLMDPV

SEQ ID NO: 643670 - protein, 29 aa, Mycobacterium
DDPDAPAGLYVHWVVIGIAPGPGSTAEGQ

SEQ ID NO: 643671 - protein, 18 aa, Mycobacterium
DDPDFRAGRVTTSFIDER

SEQ ID NO: 643672 - protein, 25 aa, Mycobacterium
DDPDGYRLPVDYAVRITSRGLYVHS

SEQ ID NO: 643673 - protein, 23 aa, Mycobacterium
DDPDLADYVILDFDSFEWREEDE

SEQ ID NO: 643674 - protein, 25 aa, Mycobacterium
DDPDWLRWNYATVVWGLATAHELYH

SEQ ID NO: 643675 - protein, 22 aa, Mycobacterium
DDPEFGYRFLVEEARDAGHPMA

SEQ ID NO: 643676 - protein, 23 aa, Mycobacterium
DDPELKGYFGNFIVDISREHNRE

SEQ ID NO: 643677 - protein, 22 aa, Mycobacterium
DDPEMRDSVSFWTVDDRGRIGL

SEQ ID NO: 643678 - protein, 19 aa, Mycobacterium
DDPESWTLATYRRHDGYRA

SEQ ID NO: 643679 - protein, 24 aa, Mycobacterium
DDPEWLRWNYATVVWGIATAHELY

SEQ ID NO: 643680 - protein, 25 aa, Mycobacterium
DDPEWLRWNYATVVWGLATAHELYH

SEQ ID NO: 643681 - protein, 20 aa, Mycobacterium
DDPEYRRIVLYALTQTSWSS

SEQ ID NO: 643682 - protein, 23 aa, Mycobacterium
DDPGSGFTTVWNAVVSELNGEPT

SEQ ID NO: 643683 - protein, 20 aa, Mycobacterium
DDPGTDWGRYALKAPVMLVH

SEQ ID NO: 643684 - protein, 17 aa, Mycobacterium
DDPGTWTEPGVRQLAAD

SEQ ID NO: 643685 - protein, 17 aa, Mycobacterium
DDPGVLGDAVFYLMEPV

SEQ ID NO: 643686 - protein, 24 aa, Mycobacterium
DDPHIPSLFGIYPTTDWHERETYD

SEQ ID NO: 643687 - protein, 21 aa, Mycobacterium
DDPIELWAWVGAYDHVALCQL

SEQ ID NO: 643688 - protein, 21 aa, Mycobacterium
DDPKHRVLRAIGADWFRPKAM

SEQ ID NO: 643689 - protein, 17 aa, Mycobacterium
DDPKIRGEECLTVTVWS

SEQ ID NO: 643690 - protein, 22 aa, Mycobacterium
DDPKVAAILAFAVAVNEQRGRI

SEQ ID NO: 643691 - protein, 27 aa, Mycobacterium
DDPLAMYLFDLCTLPLNLAGHCGMSVP

SEQ ID NO: 643692 - protein, 20 aa, Mycobacterium
DDPLRIVLVAPPYFDIPPKG

SEQ ID NO: 643693 - protein, 18 aa, Mycobacterium
DDPLSFRAGQYAEFTLDS

SEQ ID NO: 643694 - protein, 32 aa, Mycobacterium
DDPPFEGMWWLYIPMAFDDFGIVIIIQEDPLG

SEQ ID NO: 643695 - protein, 26 aa, Mycobacterium
DDPPHTRWQPLPTWFERLTRAGVEAR

SEQ ID NO: 643696 - protein, 18 aa, Mycobacterium
DDPPHWFEHVPGKPQIRA

SEQ ID NO: 643697 - protein, 24 aa, Mycobacterium
DDPPLRLLLGRDVLKAMRDKIAAL

SEQ ID NO: 643698 - protein, 24 aa, Mycobacterium
DDPQILALRARQMRNIFATLVLSQ

SEQ ID NO: 643699 - protein, 24 aa, Mycobacterium
DDPRADEILVRIEAAGVCHTDLVN

SEQ ID NO: 643700 - protein, 20 aa, Mycobacterium
DDPRLARILFVESATEPLLR

SEQ ID NO: 643701 - protein, 23 aa, Mycobacterium
DDPRRRLAAAMAKASAGECQSLV

SEQ ID NO: 643702 - protein, 17 aa, Mycobacterium
DDPRWLVKHLPEHAREA

SEQ ID NO: 643703 - protein, 17 aa, Mycobacterium
DDPRWSLELAGGALMDL

SEQ ID NO: 643704 - protein, 17 aa, Mycobacterium
DDPRYDPALLRDGDSRN

SEQ ID NO: 643705 - protein, 23 aa, Mycobacterium
DDPRYLGCSIMPGDYPNCAITTA

SEQ ID NO: 643706 - protein, 23 aa, Mycobacterium
DDPSERVVDRWTRLTRVIDPIGR

SEQ ID NO: 643707 - protein, 22 aa, Mycobacterium
DDPSLRGILIGSRDTVLGALAH

SEQ ID NO: 643708 - protein, 17 aa, Mycobacterium
DDPSLRQNICFLYHVLG

SEQ ID NO: 643709 - protein, 24 aa, Mycobacterium
DDPSQRVVDRWTRLTHVIDPLGRT

SEQ ID NO: 643710 - protein, 17 aa, Mycobacterium
DDPVLHFRTLAYSASVK

SEQ ID NO: 643711 - protein, 18 aa, Mycobacterium
DDPVLHFRTLAYSASVKL

SEQ ID NO: 643712 - protein, 24 aa, Mycobacterium
DDPVRLCSERVWIVDPLDGTREFS

SEQ ID NO: 643713 - protein, 19 aa, Mycobacterium
DDPVRLSAQRVWIVDPLDG

SEQ ID NO: 643714 - protein, 22 aa, Mycobacterium
DDPVVRMLFTLHGIIRPDTTTL

SEQ ID NO: 643715 - protein, 20 aa, Mycobacterium
DDPWGRPFLDRRRTETRSYC

SEQ ID NO: 643716 - protein, 22 aa, Mycobacterium
DDPWYRMRVARSIFTHVMAIIR

SEQ ID NO: 643717 - protein, 26 aa, Mycobacterium
DDPYFTAALHRYFPATLRRRLGDRLT

SEQ ID NO: 643718 - protein, 25 aa, Mycobacterium
DDQGAGLERIRWRLDVWNASAQVSN

SEQ ID NO: 643719 - protein, 20 aa, Mycobacterium
DDQLAILDIRPFTRGHTLVI

SEQ ID NO: 643720 - protein, 23 aa, Mycobacterium
DDQRHVVCWIGWDPALSRDAELR

SEQ ID NO: 643721 - protein, 23 aa, Mycobacterium
DDQRLDLWLADNGEKLDLRAQMD

SEQ ID NO: 643722 - protein, 35 aa, Mycobacterium
DDQRLRRLLMFVARQEPRLNWAIGQRPEGTVLVTD

SEQ ID NO: 643723 - protein, 17 aa, Mycobacterium
DDQRRGAILESFAAYFG

SEQ ID NO: 643724 - protein, 21 aa, Mycobacterium
DDQVRFVPGWFKDTLQDAPID

SEQ ID NO: 643725 - protein, 23 aa, Mycobacterium
DDRANLVGINWAPPFEGAFAGDP

SEQ ID NO: 643726 - protein, 22 aa, Mycobacterium
DDRARPLIESMIAAHRVIGVLA

SEQ ID NO: 643727 - protein, 25 aa, Mycobacterium
DDREFAYGVLRAWLHTLRDRLPVEA

SEQ ID NO: 643728 - protein, 23 aa, Mycobacterium
DDRGRRFLIDAAKIAYVEIGVAD

SEQ ID NO: 643729 - protein, 23 aa, Mycobacterium
DDRGRVSLMVAVHPLCPLSARQI

SEQ ID NO: 643730 - protein, 17 aa, Mycobacterium
DDRGWVLSVAHVDVVRP

SEQ ID NO: 643731 - protein, 29 aa, Mycobacterium
DDRICIPAPFYHCFGMVLGNLAATSHGAA

SEQ ID NO: 643732 - protein, 22 aa, Mycobacterium
DDRIDPRFPVFSAASLAEALPG

SEQ ID NO: 643733 - protein, 23 aa, Mycobacterium
DDRIDPRFPVFSATGLTEALPGP

SEQ ID NO: 643734 - protein, 28 aa, Mycobacterium
DDRIGVAVEEMVRWASPVMTFRRTAAVD

SEQ ID NO: 643735 - protein, 25 aa, Mycobacterium
DDRILAGAVTLVWQGGQLRHLGATG

SEQ ID NO: 643736 - protein, 19 aa, Mycobacterium
DDRLAMFFVDYPRKQRLKV

SEQ ID NO: 643737 - protein, 22 aa, Mycobacterium
DDRLCKLIPGPDWGSGASVVGT

SEQ ID NO: 643738 - protein, 19 aa, Mycobacterium
DDRLEELLALAHEVRMRWC

SEQ ID NO: 643739 - protein, 21 aa, Mycobacterium
DDRLGEVGKAFVVTLPGAELD

SEQ ID NO: 643740 - protein, 22 aa, Mycobacterium
DDRLRYSVRGCYGDIPAQPDLL

SEQ ID NO: 643741 - protein, 21 aa, Mycobacterium
DDRLVAFLLGVGYPADRPLAP

SEQ ID NO: 643742 - protein, 28 aa, Mycobacterium
DDRPFFMWYDWMAGGWGGRSTKDGSTAT

SEQ ID NO: 643743 - protein, 18 aa, Mycobacterium
DDRPIYGLQAWNFYHTAE

SEQ ID NO: 643744 - protein, 24 aa, Mycobacterium
DDRPVEYWPTAAIRAALETDDLTV

SEQ ID NO: 643745 - protein, 19 aa, Mycobacterium
DDRRFGFGIVTSSDVYYQG

SEQ ID NO: 643746 - protein, 18 aa, Mycobacterium
DDRRRVVNVGFWDGRDAV

SEQ ID NO: 643747 - protein, 23 aa, Mycobacterium
DDRRVAFKRSYRDIDVLLVDDIQ

SEQ ID NO: 643748 - protein, 23 aa, Mycobacterium
DDRSDRGPGRFFTMRLALSDIGI

SEQ ID NO: 643749 - protein, 25 aa, Mycobacterium
DDRSVVPVRVFWLPPPDRGRIAKLA

SEQ ID NO: 643750 - protein, 27 aa, Mycobacterium
DDRTGLRARWDALQASFVDNPKQCVQE

SEQ ID NO: 643751 - protein, 24 aa, Mycobacterium
DDRTRLRIFFEFTRGADESGPAAL

SEQ ID NO: 643752 - protein, 18 aa, Mycobacterium
DDRVEAIFTTGKRAYIAD

SEQ ID NO: 643753 - protein, 27 aa, Mycobacterium
DDRVVAKCFLLWAAVVGAISLEVFGQY

SEQ ID NO: 643754 - protein, 27 aa, Mycobacterium
DDRVVAKCFLLWAGVLGAISLEVFGQY

SEQ ID NO: 643755 - protein, 24 aa, Mycobacterium
DDRVYKRGALALHSLRGRLGDAKF

SEQ ID NO: 643756 - protein, 24 aa, Mycobacterium
DDRVYKRGALTLHALRLRLGDTKF

SEQ ID NO: 643757 - protein, 25 aa, Mycobacterium
DDRVYKRGALTLHVLRERIGDKNFF

SEQ ID NO: 643758 - protein, 25 aa, Mycobacterium
DDRVYKRGALTLHVLRQRIGDANFF

SEQ ID NO: 643759 - protein, 23 aa, Mycobacterium
DDRYPWLDKVGEWLAAHRDGGVV

SEQ ID NO: 643760 - protein, 26 aa, Mycobacterium
DDRYPWLEAIGKWLAEHPAGGVMSCS

SEQ ID NO: 643761 - protein, 25 aa, Mycobacterium
DDSAEWKVFLGLLRSRFETDKGKWT

SEQ ID NO: 643762 - protein, 25 aa, Mycobacterium
DDSAPDRWRVSPGPIGARDWVIEPD

SEQ ID NO: 643763 - protein, 18 aa, Mycobacterium
DDSLRLARREVLLDHSTL

SEQ ID NO: 643764 - protein, 17 aa, Mycobacterium
DDSRLASYDGRNRVNPP

SEQ ID NO: 643765 - protein, 21 aa, Mycobacterium
DDSRLRWLRAGEVPTLGNWFR

SEQ ID NO: 643766 - protein, 25 aa, Mycobacterium
DDSRLRWLRRGEVPTLGNWFRAAGY

SEQ ID NO: 643767 - protein, 22 aa, Mycobacterium
DDSTPWLIHGYEAIRALFTDSR

SEQ ID NO: 643768 - protein, 18 aa, Mycobacterium
DDSVDHFLATGETVRGAT

SEQ ID NO: 643769 - protein, 27 aa, Mycobacterium
DDSVKYRLGRDVARMEAALSAPGMFGR

SEQ ID NO: 643770 - protein, 17 aa, Mycobacterium
DDSYCAGPRAMPGLVPT

SEQ ID NO: 643771 - protein, 22 aa, Mycobacterium
DDSYPYPVLSIRVSDGSYQDRN

SEQ ID NO: 643772 - protein, 18 aa, Mycobacterium
DDTERAWFQAHIDQTLAS

SEQ ID NO: 643773 - protein, 25 aa, Mycobacterium
DDTEWQRLCGVLGAAALAGDPRYAT

SEQ ID NO: 643774 - protein, 26 aa, Mycobacterium
DDTGYRAPAAFGYRPFEGGLALKRLA

SEQ ID NO: 643775 - protein, 17 aa, Mycobacterium
DDTHLRAIAALNYANAR

SEQ ID NO: 643776 - protein, 24 aa, Mycobacterium
DDTIREFVESTGIPYVPMSMAKGL

SEQ ID NO: 643777 - protein, 18 aa, Mycobacterium
DDTIRLGQFLKLANLIDS

SEQ ID NO: 643778 - protein, 21 aa, Mycobacterium
DDTKLAWAREFGATHTVNARE

SEQ ID NO: 643779 - protein, 25 aa, Mycobacterium
DDTLPMLTGIRVEIAGHTVVLAATD

SEQ ID NO: 643780 - protein, 20 aa, Mycobacterium
DDTLPMLTGIRVEISGDTVV

SEQ ID NO: 643781 - protein, 20 aa, Mycobacterium
DDTLPMLTGIRVEISGEKVV

SEQ ID NO: 643782 - protein, 24 aa, Mycobacterium
DDTLPMLTGIRVEISGEKVVLAAT

SEQ ID NO: 643783 - protein, 24 aa, Mycobacterium
DDTLPMLTGIRVEISGESVVLAAT

SEQ ID NO: 643784 - protein, 23 aa, Mycobacterium
DDTLPMLTGIRVEISGNTVVLAA

SEQ ID NO: 643785 - protein, 24 aa, Mycobacterium
DDTLSPWPTWPLVLRTSPAHAEGG

SEQ ID NO: 643786 - protein, 23 aa, Mycobacterium
DDTQAVAVIVSWLSGELPQRQIG

SEQ ID NO: 643787 - protein, 25 aa, Mycobacterium
DDTRKSFGIAGARVSDAIKLSVPFL

SEQ ID NO: 643788 - protein, 22 aa, Mycobacterium
DDTRRPVLVFLHGGGQAQGHGS

SEQ ID NO: 643789 - protein, 24 aa, Mycobacterium
DDTRSPWPTWPIMLRTKLSPAHAE

SEQ ID NO: 643790 - protein, 23 aa, Mycobacterium
DDTRWHPVNSLPPMAFDHGPMVA

SEQ ID NO: 643791 - protein, 20 aa, Mycobacterium
DDTVACPFHDWRWGGDGRCT

SEQ ID NO: 643792 - protein, 18 aa, Mycobacterium
DDTVDGWGSLDYSVELAQ

SEQ ID NO: 643793 - protein, 20 aa, Mycobacterium
DDTVRRWIDSGALPASKDDA

SEQ ID NO: 643794 - protein, 19 aa, Mycobacterium
DDTVRRWINQGSLTVGHDA

SEQ ID NO: 643795 - protein, 17 aa, Mycobacterium
DDTWKGPGRPLSSGYAE

SEQ ID NO: 643796 - protein, 22 aa, Mycobacterium
DDVADCVRFLVGNGHAPAGKVA

SEQ ID NO: 643797 - protein, 22 aa, Mycobacterium
DDVAVHWGRLCGRLRPNQVCAL

SEQ ID NO: 643798 - protein, 24 aa, Mycobacterium
DDVDLRRSYPFYGQLHQGGIATPP

SEQ ID NO: 643799 - protein, 33 aa, Mycobacterium
DDVDRIVVHLAPWLEPEPICLAIKHVRVRVAPG

SEQ ID NO: 643800 - protein, 17 aa, Mycobacterium
DDVDTWMASPYAPQGVA

SEQ ID NO: 643801 - protein, 20 aa, Mycobacterium
DDVEAGFYYAIRNCAELNVD

SEQ ID NO: 643802 - protein, 19 aa, Mycobacterium
DDVEFGKRLRAFIVTEPGA

SEQ ID NO: 643803 - protein, 17 aa, Mycobacterium
DDVELVDIYSCFPSAVQ

SEQ ID NO: 643804 - protein, 17 aa, Mycobacterium
DDVEVGWRREDLTRLPE

SEQ ID NO: 643805 - protein, 18 aa, Mycobacterium
DDVFARWGGEEFIVALPG

SEQ ID NO: 643806 - protein, 23 aa, Mycobacterium
DDVGGVWYWNRYPGLTCDVPSQA

SEQ ID NO: 643807 - protein, 19 aa, Mycobacterium
DDVGRRIPTGLGREPGETL

SEQ ID NO: 643808 - protein, 23 aa, Mycobacterium
DDVGTDCRDLWLVTTAAEQLTGD

SEQ ID NO: 643809 - protein, 26 aa, Mycobacterium
DDVHIPELLALDGIVAARRLRPVDGQ

SEQ ID NO: 643810 - protein, 23 aa, Mycobacterium
DDVIFCSFGDMLRVPGSHQDLFS

SEQ ID NO: 643811 - protein, 24 aa, Mycobacterium
DDVIWKREWLIDALQIFEGAQVWM

SEQ ID NO: 643812 - protein, 17 aa, Mycobacterium
DDVKIALMTAVLDAIAK

SEQ ID NO: 643813 - protein, 24 aa, Mycobacterium
DDVKRQALQWAMSVAGRRAAALLA

SEQ ID NO: 643814 - protein, 19 aa, Mycobacterium
DDVLARFVPAGEFERSRLA

SEQ ID NO: 643815 - protein, 17 aa, Mycobacterium
DDVLLGLMLARIDTALG

SEQ ID NO: 643816 - protein, 21 aa, Mycobacterium
DDVLWRMTHPDKDFRAVEDDM

SEQ ID NO: 643817 - protein, 24 aa, Mycobacterium
DDVPAEVLGALVVKPMTDVAEIVA

SEQ ID NO: 643818 - protein, 17 aa, Mycobacterium
DDVPEFYDSYSGAEVLR

SEQ ID NO: 643819 - protein, 40 aa, Mycobacterium
DDVPRGMSFLLNRNRLNVAISRAKFQAVIVRSPALTEYLP

SEQ ID NO: 643820 - protein, 28 aa, Mycobacterium
DDVPRGMSFLLNRNRLNVAISRAQYAAV

SEQ ID NO: 643821 - protein, 21 aa, Mycobacterium
DDVQAAFELACRPVPDRVKIV

SEQ ID NO: 643822 - protein, 20 aa, Mycobacterium
DDVQGAFELACRPDPERVKI

SEQ ID NO: 643823 - protein, 17 aa, Mycobacterium
DDVRAWYAATLTDKPTM

SEQ ID NO: 643824 - protein, 18 aa, Mycobacterium
DDVRLDVFTAHHVERARA

SEQ ID NO: 643825 - protein, 23 aa, Mycobacterium
DDVRLPADLILGGREKFEARIAR

SEQ ID NO: 643826 - protein, 21 aa, Mycobacterium
DDVRRACGWFAEQGRADLPVT

SEQ ID NO: 643827 - protein, 23 aa, Mycobacterium
DDVRTALEVAIERTRIVHADQRR

SEQ ID NO: 643828 - protein, 17 aa, Mycobacterium
DDVRVACDVLRPQWEAS

SEQ ID NO: 643829 - protein, 23 aa, Mycobacterium
DDVRWELGRFGKLNVRHGKGSRR

SEQ ID NO: 643830 - protein, 17 aa, Mycobacterium
DDVRYRIIGDHSRTAAI

SEQ ID NO: 643831 - protein, 25 aa, Mycobacterium
DDVSLWGLLIPLRRAFNQYVNLRPV

SEQ ID NO: 643832 - protein, 17 aa, Mycobacterium
DDVVDMVGLSAVAGSRA

SEQ ID NO: 643833 - protein, 24 aa, Mycobacterium
DDVVGDFALAVAMRRQSAEHTRDD

SEQ ID NO: 643834 - protein, 20 aa, Mycobacterium
DDVVPFISIRTWQPINEHET

SEQ ID NO: 643835 - protein, 27 aa, Mycobacterium
DDVWHYLLRWALMFGVTEDLLPRTGID

SEQ ID NO: 643836 - protein, 19 aa, Mycobacterium
DDVWTFLMQEANPWGYSNK

SEQ ID NO: 643837 - protein, 26 aa, Mycobacterium
DDVYDAAAGWARRFLDGPRHALAAAK

SEQ ID NO: 643838 - protein, 26 aa, Mycobacterium
DDVYDAAARWARRFLDGPRHALAAAK

SEQ ID NO: 643839 - protein, 20 aa, Mycobacterium
DDWDSTAVLERWSKELFDQD

SEQ ID NO: 643840 - protein, 20 aa, Mycobacterium
DDWFEISLIPTTRELTTLGT

SEQ ID NO: 643841 - protein, 21 aa, Mycobacterium
DDWFEQLRGFDAIFFGAVGWP

SEQ ID NO: 643842 - protein, 19 aa, Mycobacterium
DDWFWIKVPVGYLYTIANP

SEQ ID NO: 643843 - protein, 17 aa, Mycobacterium
DDWGLAISKRLEWHNNP

SEQ ID NO: 643844 - protein, 22 aa, Mycobacterium
DDWGQAGAMVRDVLDDAARDRL

SEQ ID NO: 643845 - protein, 21 aa, Mycobacterium
DDWHAAFELGTLSAVRSVRAA

SEQ ID NO: 643846 - protein, 17 aa, Mycobacterium
DDWLKVMGIPMPSSSIV

SEQ ID NO: 643847 - protein, 17 aa, Mycobacterium
DDWPAALRHNGFDTTQP

SEQ ID NO: 643848 - protein, 20 aa, Mycobacterium
DDWRAGYVPAMDRVRRGELP

SEQ ID NO: 643849 - protein, 24 aa, Mycobacterium
DDWSKDRPGLGLGENLFDVGTSFL

SEQ ID NO: 643850 - protein, 18 aa, Mycobacterium
DDWTQLWWVRADGVATTH

SEQ ID NO: 643851 - protein, 19 aa, Mycobacterium
DDWVLIHVGFAMAKIDETE

SEQ ID NO: 643852 - protein, 19 aa, Mycobacterium
DDYDEWLGRFGTALRALPD

SEQ ID NO: 643853 - protein, 18 aa, Mycobacterium
DDYFRRAAGAGVRQVVIL

SEQ ID NO: 643854 - protein, 24 aa, Mycobacterium
DDYIWPRRSAAAARAYCRDLDLEL

SEQ ID NO: 643855 - protein, 17 aa, Mycobacterium
DDYKTLHGMTSRGFPNQ

SEQ ID NO: 643856 - protein, 17 aa, Mycobacterium
DDYLAILDIRPFTRGHT

SEQ ID NO: 643857 - protein, 18 aa, Mycobacterium
DDYLRFVRMLLGDGTIDG

SEQ ID NO: 643858 - protein, 17 aa, Mycobacterium
DDYLRFVRMLLGEGTVD

SEQ ID NO: 643859 - protein, 19 aa, Mycobacterium
DDYPAMLRAECARLNRAGL

SEQ ID NO: 643860 - protein, 23 aa, Mycobacterium
DDYPELMRLTGYGSKWSVEQGDS

SEQ ID NO: 643861 - protein, 24 aa, Mycobacterium
DDYQVRIGCMWVMSFHSALVGDAD

SEQ ID NO: 643862 - protein, 17 aa, Mycobacterium
DDYRAAVRYVRGRDDID

SEQ ID NO: 643863 - protein, 19 aa, Mycobacterium
DDYRISASLRLRPAPGHTP

SEQ ID NO: 643864 - protein, 20 aa, Mycobacterium
DDYRPFWAVTKHDDIMAVER

SEQ ID NO: 643865 - protein, 19 aa, Mycobacterium
DEAAAKWVADNGFDKPITG

SEQ ID NO: 643866 - protein, 18 aa, Mycobacterium
DEAAALIRNGCKVVAEGA

SEQ ID NO: 643867 - protein, 28 aa, Mycobacterium
DEAAARLVLDWSGSWGIRRSASRCSGLR

SEQ ID NO: 643868 - protein, 29 aa, Mycobacterium
DEAAGSRVHWRSREYFPAGTKVHVKAPLY

SEQ ID NO: 643869 - protein, 22 aa, Mycobacterium
DEAALRPFLLVASFINPHDVVL

SEQ ID NO: 643870 - protein, 17 aa, Mycobacterium
DEACRRLAAGEFVGVYP

SEQ ID NO: 643871 - protein, 26 aa, Mycobacterium
DEADLRPRLRWEMLRLAADHADAGWI

SEQ ID NO: 643872 - protein, 24 aa, Mycobacterium
DEADLRRAISFFAEDAHVFATTVR

SEQ ID NO: 643873 - protein, 25 aa, Mycobacterium
DEAEGLPHIPVRLHARSWHRYPEPP

SEQ ID NO: 643874 - protein, 24 aa, Mycobacterium
DEAEVWYLPAEGVDDISTYMPTNP

SEQ ID NO: 643875 - protein, 18 aa, Mycobacterium
DEAFARLAAERDRVQKAY

SEQ ID NO: 643876 - protein, 22 aa, Mycobacterium
DEAFGLVKINAIAAWTDEDMQK

SEQ ID NO: 643877 - protein, 22 aa, Mycobacterium
DEAFKLVKINPLAAWSDDEVQD

SEQ ID NO: 643878 - protein, 20 aa, Mycobacterium
DEAFLREHVHGADAVRAVLR

SEQ ID NO: 643879 - protein, 21 aa, Mycobacterium
DEAFPRLSVVRAPRHDRVVGP

SEQ ID NO: 643880 - protein, 17 aa, Mycobacterium
DEAFQAWAKGPAIEAHA

SEQ ID NO: 643881 - protein, 25 aa, Mycobacterium
DEAFRDEVFNLIDIGFAQRRKTSRN

SEQ ID NO: 643882 - protein, 29 aa, Mycobacterium
DEAFWAFATIEVLRLTGIRCEELLELSHH

SEQ ID NO: 643883 - protein, 20 aa, Mycobacterium
DEAGEGFEYVHLVDDDVSHL

SEQ ID NO: 643884 - protein, 24 aa, Mycobacterium
DEAGVEVGMIFSVIGATGTAVRDP

SEQ ID NO: 643885 - protein, 18 aa, Mycobacterium
DEAHSVGVFGARRTGIAE

SEQ ID NO: 643886 - protein, 19 aa, Mycobacterium
DEAHWIIYERWESVEHDEA

SEQ ID NO: 643887 - protein, 23 aa, Mycobacterium
DEAILREGFRGCDAAFVNIDGFN

SEQ ID NO: 643888 - protein, 20 aa, Mycobacterium
DEALALWRGPFLDDLRDEQW

SEQ ID NO: 643889 - protein, 26 aa, Mycobacterium
DEALGRLRFTTSLADMADRQLVIEAV

SEQ ID NO: 643890 - protein, 20 aa, Mycobacterium
DEALIRLDLAEMLREEGYEI

SEQ ID NO: 643891 - protein, 19 aa, Mycobacterium
DEALIRMDLAEMLREEGYD

SEQ ID NO: 643892 - protein, 19 aa, Mycobacterium
DEALIRMDLAEMLREEGYE

SEQ ID NO: 643893 - protein, 24 aa, Mycobacterium
DEALKTAIGLGDFVKIGFEQDVQI

SEQ ID NO: 643894 - protein, 30 aa, Mycobacterium
DEALRLRELLKFEFLFSARAQFEKELADEV

SEQ ID NO: 643895 - protein, 30 aa, Mycobacterium
DEALRLRELLKFEFLFSARAQFEKELTDEV

SEQ ID NO: 643896 - protein, 20 aa, Mycobacterium
DEALRSGGVVVVFPGGDYDV

SEQ ID NO: 643897 - protein, 19 aa, Mycobacterium
DEALVGWSRLEVPAKTGQG

SEQ ID NO: 643898 - protein, 20 aa, Mycobacterium
DEALVPLVLAGTSHREAPSS

SEQ ID NO: 643899 - protein, 20 aa, Mycobacterium
DEALVPLVLAGTSHRETPRV

SEQ ID NO: 643900 - protein, 17 aa, Mycobacterium
DEAMELFDTALIVDEPF

SEQ ID NO: 643901 - protein, 22 aa, Mycobacterium
DEANFEYGLNCILDHAGRLIEE

SEQ ID NO: 643902 - protein, 18 aa, Mycobacterium
DEAPEGDAVEQLRPADSE

SEQ ID NO: 643903 - protein, 17 aa, Mycobacterium
DEAQPWFAASDEHRLDR

SEQ ID NO: 643904 - protein, 20 aa, Mycobacterium
DEAQPWVDGHLLAPGPGGQL

SEQ ID NO: 643905 - protein, 25 aa, Mycobacterium
DEARAPARFALRGRHPFAVYRWVFE

SEQ ID NO: 643906 - protein, 20 aa, Mycobacterium
DEAREALADTVIRRGDTPLP

SEQ ID NO: 643907 - protein, 21 aa, Mycobacterium
DEARELALLALRLGRAPGAYR

SEQ ID NO: 643908 - protein, 21 aa, Mycobacterium
DEARILRFLAAHGAQPVVDVR

SEQ ID NO: 643909 - protein, 20 aa, Mycobacterium
DEARIRATVWGYGAHAAASG

SEQ ID NO: 643910 - protein, 30 aa, Mycobacterium
DEARKAGRRFARLAPIVATYRKLVAAREDL

SEQ ID NO: 643911 - protein, 31 aa, Mycobacterium; identical to SEQ ID NO: 78645

SEQ ID NO: 643912 - protein, 17 aa, Mycobacterium
DEARMAPNLRGRINMAS

SEQ ID NO: 643913 - protein, 30 aa, Mycobacterium
DEARPRAGILRGREFVMKDSYSFDTSDDGL

SEQ ID NO: 643914 - protein, 30 aa, Mycobacterium
DEARPRAGILRGREFVMKDSYSFDVDDDGL

SEQ ID NO: 643915 - protein, 28 aa, Mycobacterium
DEARPRAGILRVREFLMKDSYSFDIDDA

SEQ ID NO: 643916 - protein, 30 aa, Mycobacterium
DEARPRAGILRVREFLMKDSYSFDVDDAGL

SEQ ID NO: 643917 - protein, 29 aa, Mycobacterium
DEARPRAGILRVREFVMKDSYSFDIDSAG

SEQ ID NO: 643918 - protein, 23 aa, Mycobacterium
DEARSGALTAVIERQAARRRAAH

SEQ ID NO: 643919 - protein, 23 aa, Mycobacterium
DEARVIAATMAYLTVRQRPDDLP

SEQ ID NO: 643920 - protein, 17 aa, Mycobacterium
DEASCRSAIAAAADALG

SEQ ID NO: 643921 - protein, 22 aa, Mycobacterium
DEASDALGGLGYLDTADGLAST

SEQ ID NO: 643922 - protein, 17 aa, Mycobacterium
DEASRWGLVTEVVADDE

SEQ ID NO: 643923 - protein, 19 aa, Mycobacterium
DEASRYLAGRDFGLYSEAF

SEQ ID NO: 643924 - protein, 20 aa, Mycobacterium
DEATARRCIDVLLDDHTEVA

SEQ ID NO: 643925 - protein, 23 aa, Mycobacterium
DEAVKLGDKVAVFGPGGVLQQYD

SEQ ID NO: 643926 - protein, 27 aa, Mycobacterium
DEAVRAGRIAKVYCARAARTVCETAIQ

SEQ ID NO: 643927 - protein, 17 aa, Mycobacterium
DEAWRWAANAAAAPART

SEQ ID NO: 643928 - protein, 23 aa, Mycobacterium
DEAYPIPDTRGWLREYSADNVSQ

SEQ ID NO: 643929 - protein, 20 aa, Mycobacterium
DEAYRLGMVSKVFGREELED

SEQ ID NO: 643930 - protein, 21 aa, Mycobacterium
DEAYRLGMVSKVFPAAELEEK

SEQ ID NO: 643931 - protein, 18 aa, Mycobacterium
DECIHAWRRLTRAGTDLE

SEQ ID NO: 643932 - protein, 18 aa, Mycobacterium
DECLPGWLASSAEEHAVW

SEQ ID NO: 643933 - protein, 20 aa, Mycobacterium
DECPGAGMIAGIGRVSGREC

SEQ ID NO: 643934 - protein, 24 aa, Mycobacterium
DECRLEEPELLPVGADHRAACIRT

SEQ ID NO: 643935 - protein, 19 aa, Mycobacterium
DECRMFLSMLGIGPSKTEV

SEQ ID NO: 643936 - protein, 24 aa, Mycobacterium
DECVTARAALTMFLGRPDQPGRVR

SEQ ID NO: 643937 - protein, 21 aa, Mycobacterium
DEDAARRCVDLTLDRFGSVDI

SEQ ID NO: 643938 - protein, 23 aa, Mycobacterium
DEDAGRAVNRWQRAQLRRWRDGD

SEQ ID NO: 643939 - protein, 33 aa, Mycobacterium
DEDAVAAILRYCTEHRIAIVPFGGGTSVVGGLD

SEQ ID NO: 643940 - protein, 19 aa, Mycobacterium
DEDCLRLNIWAPANTAPGA

SEQ ID NO: 643941 - protein, 17 aa, Mycobacterium
DEDCSFADLGIDSLALA

SEQ ID NO: 643942 - protein, 19 aa, Mycobacterium
DEDDGWLLVPVIDGVENIA

SEQ ID NO: 643943 - protein, 23 aa, Mycobacterium
DEDELRAAVSTYWEIDEIRPSFI

SEQ ID NO: 643944 - protein, 27 aa, Mycobacterium
DEDFTCWRIKLPHLDAAKFDAALASHR

SEQ ID NO: 643945 - protein, 23 aa, Mycobacterium
DEDFWATKWARAYVEFAAGEKRS

SEQ ID NO: 643946 - protein, 17 aa, Mycobacterium
DEDGCVIEGLYATGNIT

SEQ ID NO: 643947 - protein, 19 aa, Mycobacterium
DEDGFLWILGRADQAIIRG

SEQ ID NO: 643948 - protein, 20 aa, Mycobacterium
DEDGFYFIVDRVKDMIVTGG

SEQ ID NO: 643949 - protein, 24 aa, Mycobacterium
DEDGRAGARLVARAFDAMAEALAD

SEQ ID NO: 643950 - protein, 27 aa, Mycobacterium
DEDGYAYFAGRLGDWMRVDGENIGTAP

SEQ ID NO: 643951 - protein, 18 aa, Mycobacterium
DEDLPEFYGYPAKLSGTW

SEQ ID NO: 643952 - protein, 28 aa, Mycobacterium
DEDLRFWRSAMTDLPEPLELPGPHGSAV

SEQ ID NO: 643953 - protein, 23 aa, Mycobacterium
DEDRELLESFDLSYGEDTGDEAD

SEQ ID NO: 643954 - protein, 23 aa, Mycobacterium
DEDRELLESFDLTYGEDAGDEED

SEQ ID NO: 643955 - protein, 23 aa, Mycobacterium
DEDRELLESFDLTYGEDEGTEED

SEQ ID NO: 643956 - protein, 23 aa, Mycobacterium
DEDRELLESFDLTYGEDSGDESE

SEQ ID NO: 643957 - protein, 20 aa, Mycobacterium
DEDRELLQSFDLSYGEDEGG

SEQ ID NO: 643958 - protein, 17 aa, Mycobacterium
DEDRFADSLKEQGSSRE

SEQ ID NO: 643959 - protein, 25 aa, Mycobacterium
DEDRLAFYRNLYRESARFGAKLWVV

SEQ ID NO: 643960 - protein, 22 aa, Mycobacterium
DEDRPGDHWQRVGVIDTSAQRD

SEQ ID NO: 643961 - protein, 22 aa, Mycobacterium
DEDWGVGFAKSIAVFLNGQGIA

SEQ ID NO: 643962 - protein, 20 aa, Mycobacterium
DEEAARRCVDLALERFGSVD

SEQ ID NO: 643963 - protein, 25 aa, Mycobacterium
DEEDFPELCALSWTVYSLPGAPVLD

SEQ ID NO: 643964 - protein, 19 aa, Mycobacterium
DEEFIRFGATADWQARARA

SEQ ID NO: 643965 - protein, 19 aa, Mycobacterium
DEEGFRMGLLGAGALSNHP

SEQ ID NO: 643966 - protein, 20 aa, Mycobacterium
DEEIGAFLILLASAGNDTTK

SEQ ID NO: 643967 - protein, 18 aa, Mycobacterium
DEEIKRWRIGTNRGDDIR

SEQ ID NO: 643968 - protein, 21 aa, Mycobacterium
DEEILGFMFLMVIAGNETTTK

SEQ ID NO: 643969 - protein, 26 aa, Mycobacterium
DEEIQWSAGDSFVVPNWMWHAHMNRS

SEQ ID NO: 643970 - protein, 19 aa, Mycobacterium
DEEKERYAALRVVHSLEAS

SEQ ID NO: 643971 - protein, 24 aa, Mycobacterium
DEEKGRAFAAMYAYIEELVERKAR

SEQ ID NO: 643972 - protein, 25 aa, Mycobacterium
DEEKMPRYIAGVLARLQEVWMGRQI

SEQ ID NO: 643973 - protein, 21 aa, Mycobacterium
DEEKQRFGTLRVVHSLEASQR

SEQ ID NO: 643974 - protein, 18 aa, Mycobacterium
DEEKRVADAITRLNELKS

SEQ ID NO: 643975 - protein, 23 aa, Mycobacterium
DEELTHAGFLRVHRRHIVNLNRI

SEQ ID NO: 643976 - protein, 25 aa, Mycobacterium
DEELWRRRVGIIGTFAFIRRGDAVP

SEQ ID NO: 643977 - protein, 29 aa, Mycobacterium
DEEMKQFPVELGKMGFVFNFITYGGHQID

SEQ ID NO: 643978 - protein, 25 aa, Mycobacterium
DEERFDGCWPAIVDRVKHEKVVALL

SEQ ID NO: 643979 - protein, 24 aa, Mycobacterium
DEERPRTAAALGERGDEFLALKVE

SEQ ID NO: 643980 - protein, 24 aa, Mycobacterium
DEERSEGVLGWLHSVARSHVEVAL

SEQ ID NO: 643981 - protein, 17 aa, Mycobacterium
DEESARRTLAEFAHLGV

SEQ ID NO: 643982 - protein, 23 aa, Mycobacterium
DEESLCYEMPLILNTPTFTICCA

SEQ ID NO: 643983 - protein, 21 aa, Mycobacterium
DEEVLAFLFLMVIAGNETTTK

SEQ ID NO: 643984 - protein, 19 aa, Mycobacterium
DEFAAALTKDAAFPKRLGR

SEQ ID NO: 643985 - protein, 24 aa, Mycobacterium
DEFADTFARAWFKLTHIDMGPIQR

SEQ ID NO: 643986 - protein, 20 aa, Mycobacterium
DEFAMPVAPWMFGAAGREHM

SEQ ID NO: 643987 - protein, 23 aa, Mycobacterium
DEFARAAVELALVDPGKVTGRTI

SEQ ID NO: 643988 - protein, 23 aa, Mycobacterium
DEFARAAVELALVDPTEVTGRTI

SEQ ID NO: 643989 - protein, 21 aa, Mycobacterium
DEFARRLPLMAAGRDFTDPVG

SEQ ID NO: 643990 - protein, 27 aa, Mycobacterium
DEFASQLPAFTWSHCVSDPSSTSANKV

SEQ ID NO: 643991 - protein, 19 aa, Mycobacterium
DEFAYRLTGSADLYEHTAR

SEQ ID NO: 643992 - protein, 17 aa, Mycobacterium
DEFCARLVTAGYRVIRF

SEQ ID NO: 643993 - protein, 19 aa, Mycobacterium
DEFCRAVGHPGVFAVGDVV

SEQ ID NO: 643994 - protein, 21 aa, Mycobacterium
DEFGFPLNAAVTIRAESEATG

SEQ ID NO: 643995 - protein, 19 aa, Mycobacterium
DEFGLCRYLAAGLAVLRTV

SEQ ID NO: 643996 - protein, 18 aa, Mycobacterium
DEFGRLDSWVAIAVATDE

SEQ ID NO: 643997 - protein, 19 aa, Mycobacterium
DEFGRRLAERMAEMPVGRG

SEQ ID NO: 643998 - protein, 22 aa, Mycobacterium
DEFHPELQFDKPYLLAMANAGP

SEQ ID NO: 643999 - protein, 22 aa, Mycobacterium
DEFHPLFGSPMWDAADDARRAE

SEQ ID NO: 644000 - protein, 21 aa, Mycobacterium
DEFIARYGIDLSVAEEAMALD

SEQ ID NO: 644001 - protein, 26 aa, Mycobacterium
DEFKRFGDLRLRLSVNGQERQNALVE

SEQ ID NO: 644002 - protein, 26 aa, Mycobacterium
DEFMTAWWRLVRRLTLGERARDDHAI

SEQ ID NO: 644003 - protein, 18 aa, Mycobacterium
DEFPAWWSERNNKQAARL

SEQ ID NO: 644004 - protein, 20 aa, Mycobacterium
DEFQVELNFMYDRADLTADR

SEQ ID NO: 644005 - protein, 18 aa, Mycobacterium
DEFTCLLETVFTDVEAQR

SEQ ID NO: 644006 - protein, 23 aa, Mycobacterium
DEFTVKDLRTWHGTVLAATAFAD

SEQ ID NO: 644007 - protein, 23 aa, Mycobacterium
DEFTYPLKWGWLDVDDVVEVLLA

SEQ ID NO: 644008 - protein, 22 aa, Mycobacterium
DEFTYPLKWGWVDPDEVVEVLR

SEQ ID NO: 644009 - protein, 22 aa, Mycobacterium
DEFTYPLKWGWVDVDDVVSTLT

SEQ ID NO: 644010 - protein, 22 aa, Mycobacterium
DEFTYPLKWGWVDVDEVVDVLS

SEQ ID NO: 644011 - protein, 22 aa, Mycobacterium
DEFTYPLKWGWVDVGEVVDVLL

SEQ ID NO: 644012 - protein, 22 aa, Mycobacterium
DEFTYPLKWGWVDVHEVVEVLA

SEQ ID NO: 644013 - protein, 25 aa, Mycobacterium
DEFVEKFGLPVWIGGHLKEPIDNHM

SEQ ID NO: 644014 - protein, 22 aa, Mycobacterium
DEFVSCVFDWVVAELAATTQAA

SEQ ID NO: 644015 - protein, 18 aa, Mycobacterium
DEFWPAHSTISLSVGGVK

SEQ ID NO: 644016 - protein, 22 aa, Mycobacterium
DEGAAAVVMCRADIAHRYTDKP

SEQ ID NO: 644017 - protein, 22 aa, Mycobacterium
DEGAAAVVMCRADIAHRYTGTP

SEQ ID NO: 644018 - protein, 22 aa, Mycobacterium
DEGDFRWAATLLDHAIFTDENH

SEQ ID NO: 644019 - protein, 23 aa, Mycobacterium
DEGDLCYEYNLFILSRTKIRTTE

SEQ ID NO: 644020 - protein, 17 aa, Mycobacterium
DEGEARTAIAMASNAQR

SEQ ID NO: 644021 - protein, 19 aa, Mycobacterium
DEGFALLRDDFTFWTLYTR

SEQ ID NO: 644022 - protein, 24 aa, Mycobacterium
DEGFARPGARRSRADFEICATAQI

SEQ ID NO: 644023 - protein, 23 aa, Mycobacterium
DEGFARPGARRSREDFEICATAN

SEQ ID NO: 644024 - protein, 24 aa, Mycobacterium
DEGFARPGARRSREDFEICATANI

SEQ ID NO: 644025 - protein, 18 aa, Mycobacterium
DEGFARPGARRTRETFEI

SEQ ID NO: 644026 - protein, 19 aa, Mycobacterium
DEGFFGRILSMRGEFGYWV

SEQ ID NO: 644027 - protein, 24 aa, Mycobacterium
DEGFHAATVRRIRPGEEVVLGDGE

SEQ ID NO: 644028 - protein, 25 aa, Mycobacterium
DEGFHAATVRRIRPGEQLVLGDGAG

SEQ ID NO: 644029 - protein, 23 aa, Mycobacterium
DEGFSRPGARRSREDFEIAATAQ

SEQ ID NO: 644030 - protein, 23 aa, Mycobacterium
DEGGKRVGARIVVVTHLATDAAL

SEQ ID NO: 644031 - protein, 22 aa, Mycobacterium
DEGGRRVGARIVVVTHRATDAA

SEQ ID NO: 644032 - protein, 17 aa, Mycobacterium
DEGHWPLYEIGARLTRL

SEQ ID NO: 644033 - protein, 18 aa, Mycobacterium
DEGIFCCAHCARKDTNAD

SEQ ID NO: 644034 - protein, 25 aa, Mycobacterium
DEGIRCTWLATSHAFHSELLDPVLD

SEQ ID NO: 644035 - protein, 22 aa, Mycobacterium
DEGIRCTWLQTSHAFHSELLDP

SEQ ID NO: 644036 - protein, 18 aa, Mycobacterium
DEGLILACQAHPTSDSVE

SEQ ID NO: 644037 - protein, 22 aa, Mycobacterium
DEGLKLLGQFGRYVEIGNINIG

SEQ ID NO: 644038 - protein, 19 aa, Mycobacterium
DEGMLRCGLQAAAQRLPFL

SEQ ID NO: 644039 - protein, 23 aa, Mycobacterium
DEGPDLVLRWAALLHDIGKPATR

SEQ ID NO: 644040 - protein, 22 aa, Mycobacterium
DEGPWPRMGLAERGAILHRLAD

SEQ ID NO: 644041 - protein, 21 aa, Mycobacterium
DEGQRVFDRFGAPPVPLVPLI

SEQ ID NO: 644042 - protein, 17 aa, Mycobacterium
DEGRALYDAALRYLDGG

SEQ ID NO: 644043 - protein, 20 aa, Mycobacterium
DEGRALYDAAVRYLGGGVGV

SEQ ID NO: 644044 - protein, 17 aa, Mycobacterium
DEGRARLLSLYQKGKDK

SEQ ID NO: 644045 - protein, 17 aa, Mycobacterium
DEGRPAVDHTRRYLRAC

SEQ ID NO: 644046 - protein, 22 aa, Mycobacterium
DEGRPGGLFDLLGRGGTVRAHD

SEQ ID NO: 644047 - protein, 20 aa, Mycobacterium
DEGRPVMVWADIGELPYLRV

SEQ ID NO: 644048 - protein, 20 aa, Mycobacterium
DEGRRIFAEMVDACAARVVR

SEQ ID NO: 644049 - protein, 23 aa, Mycobacterium
DEGRRLSVVPIYGGRPYEAQIEA

SEQ ID NO: 644050 - protein, 17 aa, Mycobacterium
DEGRVIVNSGLVFEGPL

SEQ ID NO: 644051 - protein, 22 aa, Mycobacterium
DEGRVSHQVLLWVIRLQHETKV

SEQ ID NO: 644052 - protein, 19 aa, Mycobacterium
DEGTAEFDLVRDLWSLSAD

SEQ ID NO: 644053 - protein, 29 aa, Mycobacterium
DEGTRRGGAVWARRGEVFAVHAAGNGPGV

SEQ ID NO: 644054 - protein, 22 aa, Mycobacterium
DEGVIALALVKRGLPVDTALTT

SEQ ID NO: 644055 - protein, 20 aa, Mycobacterium
DEGWLAATWTHLRSHPVPFG

SEQ ID NO: 644056 - protein, 24 aa, Mycobacterium
DEGWPGEEIPPALLEPFKGPWGTD

SEQ ID NO: 644057 - protein, 24 aa, Mycobacterium
DEGYKMAGNAPIYAILREANDRAK

SEQ ID NO: 644058 - protein, 26 aa, Mycobacterium
DEHAAWAFDKRPTLGFDTKAAEIRTH

SEQ ID NO: 644059 - protein, 20 aa, Mycobacterium
DEHAPLLALELAREFDAAGL

SEQ ID NO: 644060 - protein, 17 aa, Mycobacterium
DEHARFGGVVPEIASRA

SEQ ID NO: 644061 - protein, 22 aa, Mycobacterium
DEHCTRLGLISVNLGSAARTFL

SEQ ID NO: 644062 - protein, 18 aa, Mycobacterium
DEHGLRFDIKLQGDGETV

SEQ ID NO: 644063 - protein, 19 aa, Mycobacterium
DEHGLTFDIRLQGDRETVF

SEQ ID NO: 644064 - protein, 19 aa, Mycobacterium
DEHLPCGWSGPGALAVQDR

SEQ ID NO: 644065 - protein, 23 aa, Mycobacterium
DEHLRLPLRRVLWGTDAAVLQNT

SEQ ID NO: 644066 - protein, 17 aa, Mycobacterium
DEHPELINMYGITETTV

SEQ ID NO: 644067 - protein, 25 aa, Mycobacterium
DEHQGIYRWLWPVRTVTWSRATFSK

SEQ ID NO: 644068 - protein, 25 aa, Mycobacterium
DEHQRLHHTYSFLGVETYRQVSTEP

SEQ ID NO: 644069 - protein, 24 aa, Mycobacterium
DEHQTPEFLINWDNGNELFGDLPK

SEQ ID NO: 644070 - protein, 26 aa, Mycobacterium
DEHRLRALVHRYCRAVDRGDVEALRT

SEQ ID NO: 644071 - protein, 24 aa, Mycobacterium
DEHYAADTAVCWDDHGVRACFRCE

SEQ ID NO: 644072 - protein, 18 aa, Mycobacterium
DEIAAGCYPDGTRLPTES

SEQ ID NO: 644073 - protein, 21 aa, Mycobacterium
DEIACPFHDWRWGGDGRCKLV

SEQ ID NO: 644074 - protein, 25 aa, Mycobacterium
DEIADRAGVSKPVLYQHFSSKVELY

SEQ ID NO: 644075 - protein, 17 aa, Mycobacterium
DEIAEFISGVTHHDAGP

SEQ ID NO: 644076 - protein, 25 aa, Mycobacterium
DEIAERAGVSKPVLYQHFSSKLELY

SEQ ID NO: 644077 - protein, 19 aa, Mycobacterium
DEIAFRAAVDVVTARHPIL

SEQ ID NO: 644078 - protein, 23 aa, Mycobacterium
DEIARIAHDIAMVVDNFSAEVDA

SEQ ID NO: 644079 - protein, 22 aa, Mycobacterium
DEIARRAGVGAGTVYRHFPAKE

SEQ ID NO: 644080 - protein, 22 aa, Mycobacterium
DEIARRAGVGAGTVYRHFPSKE

SEQ ID NO: 644081 - protein, 23 aa, Mycobacterium
DEIARRAGVGAGTVYRHFPTKEA

SEQ ID NO: 644082 - protein, 17 aa, Mycobacterium
DEIDALLTAAGDAIKMV

SEQ ID NO: 644083 - protein, 25 aa, Mycobacterium
DEIDARLAEWFARQTLEPTVERLAG

SEQ ID NO: 644084 - protein, 17 aa, Mycobacterium
DEIDGWVSMPLRVTTTP

SEQ ID NO: 644085 - protein, 24 aa, Mycobacterium
DEIDWSKVHIYWGDERFVPADDDE

SEQ ID NO: 644086 - protein, 23 aa, Mycobacterium
DEIDYFCCGPCWPTPTKPGRTAS

SEQ ID NO: 644087 - protein, 19 aa, Mycobacterium
DEIEAAVGLAERDQGIKVI

SEQ ID NO: 644088 - protein, 20 aa, Mycobacterium
DEIEAAVGLAERDRDIKVIV

SEQ ID NO: 644089 - protein, 26 aa, Mycobacterium
DEIEALWPMVIARAAVLLVSDLQQIA

SEQ ID NO: 644090 - protein, 18 aa, Mycobacterium
DEIFGPAGAEAFADDLPD

SEQ ID NO: 644091 - protein, 23 aa, Mycobacterium
DEIFGPAGAEAFAGDLPSAEIRL

SEQ ID NO: 644092 - protein, 22 aa, Mycobacterium
DEIFGPVAPVVAWEDEDELLRW

SEQ ID NO: 644093 - protein, 24 aa, Mycobacterium
DEIFRELGIPYLPVRWRSDNPDSI

SEQ ID NO: 644094 - protein, 21 aa, Mycobacterium
DEIGSGLAVFHPKGGIVRREL

SEQ ID NO: 644095 - protein, 21 aa, Mycobacterium
DEIGSGLAVFHPKGGVVRREL

SEQ ID NO: 644096 - protein, 21 aa, Mycobacterium
DEIGTPFCVTVDFDSLEDDAV

SEQ ID NO: 644097 - protein, 21 aa, Mycobacterium
DEIGTPFCVTVDFDSLEDDSV

SEQ ID NO: 644098 - protein, 21 aa, Mycobacterium
DEIGTPFCVTVDFDSLEDNAV

SEQ ID NO: 644099 - protein, 20 aa, Mycobacterium
DEIHAPLVFSGARFTPYLTV

SEQ ID NO: 644100 - protein, 20 aa, Mycobacterium
DEIIGFMFLMVIAGNETTTK

SEQ ID NO: 644101 - protein, 21 aa, Mycobacterium
DEIIQMVDLMIGRVGNQLKAK

SEQ ID NO: 644102 - protein, 21 aa, Mycobacterium
DEIIQMVDLMIGRVSNQLKTK

SEQ ID NO: 644103 - protein, 18 aa, Mycobacterium
DEIIRAADLAMVYGGQPV

SEQ ID NO: 644104 - protein, 18 aa, Mycobacterium
DEIIRVRVLPTWLRLDAR

SEQ ID NO: 644105 - protein, 17 aa, Mycobacterium
DEIKEVLLQSAIYCGVP

SEQ ID NO: 644106 - protein, 26 aa, Mycobacterium
DEIKSVLSEARWNIQYFGRTTYLGSR

SEQ ID NO: 644107 - protein, 19 aa, Mycobacterium
DEILARFTAVPSQELILPY

SEQ ID NO: 644108 - protein, 24 aa, Mycobacterium
DEILGSAGAFAFDPTHVTIDVVGL

SEQ ID NO: 644109 - protein, 19 aa, Mycobacterium
DEILLDRLRQFGGDVEFNC

SEQ ID NO: 644110 - protein, 25 aa, Mycobacterium
DEILNRWPEWDIDYDTAQLASTSTV

SEQ ID NO: 644111 - protein, 26 aa, Mycobacterium
DEILNRWPEWDIDYPTARLAPTSTVR

SEQ ID NO: 644112 - protein, 28 aa, Mycobacterium
DEILPYLVPHHRVIRMDWRGHGLDRTPV

SEQ ID NO: 644113 - protein, 25 aa, Mycobacterium
DEILRCARTLIIIGGYNGFSYADIA

SEQ ID NO: 644114 - protein, 20 aa, Mycobacterium
DEINVPFDLPEVVDEISYQR

SEQ ID NO: 644115 - protein, 17 aa, Mycobacterium
DEIPARFTSIDAGILHL

SEQ ID NO: 644116 - protein, 17 aa, Mycobacterium
DEIPGFLDPSVPFTAHT

SEQ ID NO: 644117 - protein, 22 aa, Mycobacterium
DEIRKAVRYQIKHGAALIKVCV

SEQ ID NO: 644118 - protein, 21 aa, Mycobacterium
DEIRKAVRYQIKHGAELIKVC

SEQ ID NO: 644119 - protein, 21 aa, Mycobacterium
DEIRWDIRPSPHLGTIEIRVC

SEQ ID NO: 644120 - protein, 22 aa, Mycobacterium
DEISLRDGQRFVHRLVAAPTVG

SEQ ID NO: 644121 - protein, 21 aa, Mycobacterium
DEISTSMGFVVGKLAKAPEGS

SEQ ID NO: 644122 - protein, 17 aa, Mycobacterium
DEITARILAAIAEQAEL

SEQ ID NO: 644123 - protein, 20 aa, Mycobacterium
DEITELFGPGLAETTVIRNG

SEQ ID NO: 644124 - protein, 22 aa, Mycobacterium
DEITGIGAGVTWAADNATVYYV

SEQ ID NO: 644125 - protein, 21 aa, Mycobacterium
DEITRALTLLDELWKRYQKVQ

SEQ ID NO: 644126 - protein, 18 aa, Mycobacterium
DEIVDRFCVLGPAEDHVR

SEQ ID NO: 644127 - protein, 18 aa, Mycobacterium
DEIYAWVRSRPVDEIREL

SEQ ID NO: 644128 - protein, 20 aa, Mycobacterium
DEIYHGLSYGDQKTSSAWEF

SEQ ID NO: 644129 - protein, 26 aa, Mycobacterium
DEKALFCRMAEVFAGFLSYTDAQIGR

SEQ ID NO: 644130 - protein, 24 aa, Mycobacterium
DEKDRAALWYGRLHAPDSVVQSGK

SEQ ID NO: 644131 - protein, 23 aa, Mycobacterium
DEKGRRFLVQSTRIAYVEIGAAD

SEQ ID NO: 644132 - protein, 24 aa, Mycobacterium
DEKLPRYIAGVLARLQEVWMGRQI

SEQ ID NO: 644133 - protein, 29 aa, Mycobacterium
DEKLWSALRRIPVRELRRTGLLDKLLLLA

SEQ ID NO: 644134 - protein, 24 aa, Mycobacterium
DEKRRLSRNHWGYLDETAGDVDNH

SEQ ID NO: 644135 - protein, 26 aa, Mycobacterium
DEKVRYGFEIAPELVRTVLRDREPDW

SEQ ID NO: 644136 - protein, 21 aa, Mycobacterium
DEKWDFKRFQGLPASGIDIRI

SEQ ID NO: 644137 - protein, 17 aa, Mycobacterium
DEKYSFGGLPTGRGGKF

SEQ ID NO: 644138 - protein, 19 aa, Mycobacterium
DELAELLSIEHGKTVADSK

SEQ ID NO: 644139 - protein, 20 aa, Mycobacterium
DELAELLSLEHGKTLADAAG

SEQ ID NO: 644140 - protein, 28 aa, Mycobacterium
DELAEPLLSAGYPRIERIVGDVAKSDAR

SEQ ID NO: 644141 - protein, 19 aa, Mycobacterium
DELAFALRRSAGRTVRPIG

SEQ ID NO: 644142 - protein, 23 aa, Mycobacterium
DELAKLPRWRLDLDDESIRFDTT

SEQ ID NO: 644143 - protein, 21 aa, Mycobacterium
DELALHFAAYYGWPKGSYLNQ

SEQ ID NO: 644144 - protein, 26 aa, Mycobacterium
DELARGISLIGPRGFVAERLAAFAEA

SEQ ID NO: 644145 - protein, 23 aa, Mycobacterium
DELARSGLYQSLRARGVHIRLAR

SEQ ID NO: 644146 - protein, 22 aa, Mycobacterium
DELARSWRVQWPQLPDAMEEAA

SEQ ID NO: 644147 - protein, 22 aa, Mycobacterium
DELARSWRVQWPQLPDAMEQAA

SEQ ID NO: 644148 - protein, 20 aa, Mycobacterium
DELCDRVAFVVDGRIVALDR

SEQ ID NO: 644149 - protein, 23 aa, Mycobacterium
DELCQRYPIADVLPLTPLQQGLL

SEQ ID NO: 644150 - protein, 24 aa, Mycobacterium
DELDAIRIGRRIVARLNWTKQGPK

SEQ ID NO: 644151 - protein, 24 aa, Mycobacterium
DELDAIRVGRRIVARLNWVKRGPA

SEQ ID NO: 644152 - protein, 21 aa, Mycobacterium
DELDLPAGVGLQIRVGLNSGQ

SEQ ID NO: 644153 - protein, 26 aa, Mycobacterium
DELDVCPPILVLTGRPDDAWLARWSR

SEQ ID NO: 644154 - protein, 17 aa, Mycobacterium
DELERRGARRALITLCV

SEQ ID NO: 644155 - protein, 24 aa, Mycobacterium
DELESLLRGYGYRPITVAGDDPPR

SEQ ID NO: 644156 - protein, 23 aa, Mycobacterium
DELFAGPTAIAFITGEPVDAAKA

SEQ ID NO: 644157 - protein, 20 aa, Mycobacterium
DELFAGPTAIAFVKGEAVDA

SEQ ID NO: 644158 - protein, 23 aa, Mycobacterium
DELFAGPTAIAFVKGEPVDAAKA

SEQ ID NO: 644159 - protein, 23 aa, Mycobacterium
DELFAGPTAIAFVTGEPVDAAKA

SEQ ID NO: 644160 - protein, 21 aa, Mycobacterium
DELFAQCLLDGFDEILALAGE

SEQ ID NO: 644161 - protein, 19 aa, Mycobacterium
DELFFPGLAAEWEKCGVRR

SEQ ID NO: 644162 - protein, 17 aa, Mycobacterium
DELFSVPIASPLPHPLL

SEQ ID NO: 644163 - protein, 17 aa, Mycobacterium
DELGFYLLAGAGGEGPA

SEQ ID NO: 644164 - protein, 26 aa, Mycobacterium
DELGGFRAAVRRAKVLAGLDEDSDVR

SEQ ID NO: 644165 - protein, 17 aa, Mycobacterium
DELGLWERFAELPFSEV

SEQ ID NO: 644166 - protein, 22 aa, Mycobacterium
DELGRPLALISELRYPATDSIE

SEQ ID NO: 644167 - protein, 26 aa, Mycobacterium
DELGTGWSRFSVDLIPSLGRAIFSRG

SEQ ID NO: 644168 - protein, 21 aa, Mycobacterium
DELHAASWCRVVGGSGQHHLI

SEQ ID NO: 644169 - protein, 17 aa, Mycobacterium
DELHALLIAEKVTVLCQ

SEQ ID NO: 644170 - protein, 25 aa, Mycobacterium
DELHRQLADFGFRVVEDLSGNELIG

SEQ ID NO: 644171 - protein, 17 aa, Mycobacterium
DELHSFSRTVARREDGK

SEQ ID NO: 644172 - protein, 20 aa, Mycobacterium
DELIGPDVSREWISELASYE

SEQ ID NO: 644173 - protein, 19 aa, Mycobacterium
DELIGPDVTREWIRDLPSY

SEQ ID NO: 644174 - protein, 31 aa, Mycobacterium
DELIRGGVRDVVLCPGSRNAPLAFALADADS

SEQ ID NO: 644175 - protein, 31 aa, Mycobacterium
DELIRGGVRDVVLCPGSRNAPLAFALHDADK

SEQ ID NO: 644176 - protein, 31 aa, Mycobacterium; identical to SEQ ID NO: 197701

SEQ ID NO: 644177 - protein, 32 aa, Mycobacterium
DELIRGGVRDVVLCPGSRNAPLAFALQDADRT

SEQ ID NO: 644178 - protein, 31 aa, Mycobacterium
DELIRGGVRDVVLCPGSRNAPLAFALSDADR

SEQ ID NO: 644179 - protein, 18 aa, Mycobacterium
DELISGGNIAKFVMVDPY

SEQ ID NO: 644180 - protein, 27 aa, Mycobacterium
DELISWCRERMAGFKVPRSVQFVEALP

SEQ ID NO: 644181 - protein, 21 aa, Mycobacterium
DELKALAAETGCEWHTCDLSH

SEQ ID NO: 644182 - protein, 20 aa, Mycobacterium
DELKGLVGQHVGRYAAPRVV

SEQ ID NO: 644183 - protein, 23 aa, Mycobacterium
DELKKSWLRPLASTEHIWCQLFS

SEQ ID NO: 644184 - protein, 17 aa, Mycobacterium
DELKTVDAIGTMDEVFA

SEQ ID NO: 644185 - protein, 17 aa, Mycobacterium
DELLALKPDCVVYNPMW

SEQ ID NO: 644186 - protein, 18 aa, Mycobacterium
DELLARARDKGVFGTKMR

SEQ ID NO: 644187 - protein, 25 aa, Mycobacterium
DELLARASSKYALVIYAAKRARQIN

SEQ ID NO: 644188 - protein, 20 aa, Mycobacterium
DELLDNVMLYWVTASAASSA

SEQ ID NO: 644189 - protein, 22 aa, Mycobacterium
DELLERSGLIALRDVIDQQFAQ

SEQ ID NO: 644190 - protein, 17 aa, Mycobacterium
DELLGALVEGARTAAFA

SEQ ID NO: 644191 - protein, 21 aa, Mycobacterium
DELLIKIQACDAGNIDAVREF

SEQ ID NO: 644192 - protein, 18 aa, Mycobacterium
DELLPLGDVDNIFFESGI

SEQ ID NO: 644193 - protein, 28 aa, Mycobacterium
DELLQRMLFESCLLHAGQACILHSRLLL

SEQ ID NO: 644194 - protein, 26 aa, Mycobacterium
DELLREFLDWLFARYLEIVDGEPNPL

SEQ ID NO: 644195 - protein, 22 aa, Mycobacterium
DELLRRLPWPLNLTTSVNKCAA

SEQ ID NO: 644196 - protein, 23 aa, Mycobacterium
DELLRSFLDWLFARYREIVDSEA

SEQ ID NO: 644197 - protein, 20 aa, Mycobacterium
DELLRSGTLVDLYPLVRKSI

SEQ ID NO: 644198 - protein, 17 aa, Mycobacterium
DELLSFFNIPRAMLPAV

SEQ ID NO: 644199 - protein, 25 aa, Mycobacterium
DELLVDLMVRLAVAVWERKDAAAVD

SEQ ID NO: 644200 - protein, 22 aa, Mycobacterium
DELMAMCFLLITAGYETTVNLI

SEQ ID NO: 644201 - protein, 19 aa, Mycobacterium
DELMRNGIRVFPITYPAVS

SEQ ID NO: 644202 - protein, 29 aa, Mycobacterium
DELMSAAAGMRFPLFVKAVAGGGGRGMRR

SEQ ID NO: 644203 - protein, 35 aa, Mycobacterium
DELPDVPLLCAEEVDRACAPWGLLAEDHQAALLAG

SEQ ID NO: 644204 - protein, 25 aa, Mycobacterium
DELPGFVAGLGDEWVGLSVTMPGKF

SEQ ID NO: 644205 - protein, 17 aa, Mycobacterium
DELPGLVAAVSERLGPI

SEQ ID NO: 644206 - protein, 24 aa, Mycobacterium
DELPLPRPKFEIFVYSPRVEGVHL

SEQ ID NO: 644207 - protein, 20 aa, Mycobacterium
DELPPGLADFDLSKLKFPGN

SEQ ID NO: 644208 - protein, 19 aa, Mycobacterium
DELPPRERLLALTRTLVSP

SEQ ID NO: 644209 - protein, 22 aa, Mycobacterium
DELPQRGALGIRAKQAVDDGLA

SEQ ID NO: 644210 - protein, 21 aa, Mycobacterium
DELPTRVLLVSAHDESAIVYS

SEQ ID NO: 644211 - protein, 28 aa, Mycobacterium
DELQMRFKEGPCLDAALDQTVVRTDDFR

SEQ ID NO: 644212 - protein, 18 aa, Mycobacterium
DELQQEWTWTEKYATQAE

SEQ ID NO: 644213 - protein, 17 aa, Mycobacterium
DELQQEWTWTERYATQA

SEQ ID NO: 644214 - protein, 27 aa, Mycobacterium
DELQQRFPFDLVIFALDCGGEFINHEV

SEQ ID NO: 644215 - protein, 28 aa, Mycobacterium
DELQTRLAAGPVRFYFRVQIAGPGDSIV

SEQ ID NO: 644216 - protein, 20 aa, Mycobacterium
DELRAAGAQQVWGLSSQDTD

SEQ ID NO: 644217 - protein, 21 aa, Mycobacterium
DELRAAVGKYWEIDEIRPAFI

SEQ ID NO: 644218 - protein, 22 aa, Mycobacterium
DELRAAVGKYWEVDEIRPAFIL

SEQ ID NO: 644219 - protein, 19 aa, Mycobacterium
DELRAAWVDIPEVVGAATV

SEQ ID NO: 644220 - protein, 17 aa, Mycobacterium
DELRALLTVADVVIEGS

SEQ ID NO: 644221 - protein, 22 aa, Mycobacterium
DELRARLGRECRAEVHGRVLGS

SEQ ID NO: 644222 - protein, 17 aa, Mycobacterium
DELRATSFANLTMRAVA

SEQ ID NO: 644223 - protein, 21 aa, Mycobacterium
DELRDAVAVGVGRLVLDSSLG

SEQ ID NO: 644224 - protein, 24 aa, Mycobacterium
DELREAVEMAVEMCPTRALTITEK

SEQ ID NO: 644225 - protein, 20 aa, Mycobacterium
DELRHGRAPERVTGPDPVPG

SEQ ID NO: 644226 - protein, 17 aa, Mycobacterium
DELRIVVAGARADLGQF

SEQ ID NO: 644227 - protein, 25 aa, Mycobacterium
DELRMKMLECLLVLHTLPDEADLNF

SEQ ID NO: 644228 - protein, 27 aa, Mycobacterium
DELRRFGELRLRLSVNGDERQNSLVEG

SEQ ID NO: 644229 - protein, 20 aa, Mycobacterium
DELRRIAARLDEPIRVAIAG

SEQ ID NO: 644230 - protein, 28 aa, Mycobacterium
DELRRIIPPWVTLGSRLAVLPTPHRTYG

SEQ ID NO: 644231 - protein, 23 aa, Mycobacterium
DELRRLIPPWVTLGSRMATMPKP

SEQ ID NO: 644232 - protein, 25 aa, Mycobacterium
DELRRRWGGLLSYRYIGRRYAQMDL

SEQ ID NO: 644233 - protein, 17 aa, Mycobacterium
DELRRSYAEDVRYLTRS

SEQ ID NO: 644234 - protein, 18 aa, Mycobacterium
DELRSCRIIAGAVTEEPV

SEQ ID NO: 644235 - protein, 29 aa, Mycobacterium
DELRSGRKRTHWIWFVFPQLRGLGRSPTA

SEQ ID NO: 644236 - protein, 17 aa, Mycobacterium
DELRTGLSPPLTGDDAA

SEQ ID NO: 644237 - protein, 17 aa, Mycobacterium
DELRVAPSKSLRSALTD

SEQ ID NO: 644238 - protein, 24 aa, Mycobacterium
DELRVVEISDRIAGSYCSKLLVDA

SEQ ID NO: 644239 - protein, 35 aa, Mycobacterium
DELRVVIPAAVEFGSKIALLPSVVRKDLGAWSPGG

SEQ ID NO: 644240 - protein, 21 aa, Mycobacterium
DELRWNVPTLYGHVIDGLTRA

SEQ ID NO: 644241 - protein, 18 aa, Mycobacterium
DELSAAFGEFERTVARAA

SEQ ID NO: 644242 - protein, 26 aa, Mycobacterium
DELSAGRPPGWWDALVGNGFHAVHLP

SEQ ID NO: 644243 - protein, 20 aa, Mycobacterium
DELSGLLYSLADPGVSALAK

SEQ ID NO: 644244 - protein, 21 aa, Mycobacterium
DELSREAGAFAEPQQEPEDVG

SEQ ID NO: 644245 - protein, 23 aa, Mycobacterium
DELSRIPVLPSLTEMATMTGISG

SEQ ID NO: 644246 - protein, 23 aa, Mycobacterium
DELSRLLNGYLFSRLTMPGADDP

SEQ ID NO: 644247 - protein, 24 aa, Mycobacterium
DELSRRAGVVAGRSVCGVVGSGDN

SEQ ID NO: 644248 - protein, 25 aa, Mycobacterium
DELSSRLQLDAALFAGEALQPHRLT

SEQ ID NO: 644249 - protein, 26 aa, Mycobacterium
DELSTCPPILVLTGRPDDSWLASWSR

SEQ ID NO: 644250 - protein, 17 aa, Mycobacterium
DELSTSQHFVWLRESLP

SEQ ID NO: 644251 - protein, 19 aa, Mycobacterium
DELSWAWVQTEMLRLHVRR

SEQ ID NO: 644252 - protein, 26 aa, Mycobacterium
DELSYRLRMGAVGLPLQHHLGARLRR

SEQ ID NO: 644253 - protein, 25 aa, Mycobacterium
DELTARLGRRCRAHVHGQVLGSGLE

SEQ ID NO: 644254 - protein, 26 aa, Mycobacterium
DELTDLLWRMGIRTVGQFAALSRTDV

SEQ ID NO: 644255 - protein, 23 aa, Mycobacterium
DELTLAWRRLRAWPDAVPGLTRL

SEQ ID NO: 644256 - protein, 21 aa, Mycobacterium
DELTMPIILLGGITNRETMDR

SEQ ID NO: 644257 - protein, 17 aa, Mycobacterium
DELTRLLEFVLSLLKDY

SEQ ID NO: 644258 - protein, 26 aa, Mycobacterium
DELTTCPPILVLTGRPDDAWLASWSR

SEQ ID NO: 644259 - protein, 21 aa, Mycobacterium
DELTVHPRLRVVIASTGSELV

SEQ ID NO: 644260 - protein, 24 aa, Mycobacterium
DELVARSRLNWVRAAVVEIGRTGE

SEQ ID NO: 644261 - protein, 23 aa, Mycobacterium
DELVDRWAPGRVMVNAYGPTETT

SEQ ID NO: 644262 - protein, 21 aa, Mycobacterium
DELVEAFAVFEGTVDRAAQTR

SEQ ID NO: 644263 - protein, 24 aa, Mycobacterium
DELVELDGLLLLPGGGPELDDDAV

SEQ ID NO: 644264 - protein, 18 aa, Mycobacterium
DELVGFFVNTLVLRVDLA

SEQ ID NO: 644265 - protein, 22 aa, Mycobacterium
DELVRRSGLQWAQVAARGVHPV

SEQ ID NO: 644266 - protein, 19 aa, Mycobacterium
DELWAAATDIGFFQVVEHG

SEQ ID NO: 644267 - protein, 23 aa, Mycobacterium
DELYAAGAAAIFPPGTVIADAAI

SEQ ID NO: 644268 - protein, 22 aa, Mycobacterium
DELYRINLHHVFLLTRAFLPAM

SEQ ID NO: 644269 - protein, 22 aa, Mycobacterium
DEMALRMDTLIAVGGFVEVITA

SEQ ID NO: 644270 - protein, 20 aa, Mycobacterium
DEMDGVIGLPTGFYDDGGLV

SEQ ID NO: 644271 - protein, 18 aa, Mycobacterium
DEMHGAWVRFATTGDPGW

SEQ ID NO: 644272 - protein, 31 aa, Mycobacterium
DEMIRVRILPTWLRIDARFGSVYRRRGDPPL

SEQ ID NO: 644273 - protein, 17 aa, Mycobacterium
DEMKRFPEELGKMGFVF

SEQ ID NO: 644274 - protein, 24 aa, Mycobacterium
DEMKRQALQWAMSVAARRAEAVLA

SEQ ID NO: 644275 - protein, 29 aa, Mycobacterium
DEMLALMRELWKPGWTEFGGRFYRTPRLE

SEQ ID NO: 644276 - protein, 19 aa, Mycobacterium
DEMLERFVPHKTVLYGTGY

SEQ ID NO: 644277 - protein, 19 aa, Mycobacterium
DEMLLGGPTDGWSLAIATM

SEQ ID NO: 644278 - protein, 32 aa, Mycobacterium
DEMLRQMLFDCCSLHAGQACILHSRLLLPDSL

SEQ ID NO: 644279 - protein, 22 aa, Mycobacterium
DEMPRAYFDPVARIPDMDEDHV

SEQ ID NO: 644280 - protein, 20 aa, Mycobacterium
DEMRLPWDATKQRRFDRLIA

SEQ ID NO: 644281 - protein, 22 aa, Mycobacterium
DEMVAAFDYCLHGRGGAAPSID

SEQ ID NO: 644282 - protein, 23 aa, Mycobacterium
DENGTPLLEWLRQRGIDDVDVAG

SEQ ID NO: 644283 - protein, 17 aa, Mycobacterium
DENIAWLESMSINGQIG

SEQ ID NO: 644284 - protein, 24 aa, Mycobacterium
DENLCPKSRYTGWDADGGYAEFAT

SEQ ID NO: 644285 - protein, 29 aa, Mycobacterium
DENLPVSAWRIHRCIGMDGTTLVRTLSGD

SEQ ID NO: 644286 - protein, 22 aa, Mycobacterium
DENRFSPDWLETVDGLLDDVLT

SEQ ID NO: 644287 - protein, 22 aa, Mycobacterium
DENRFTPQFLDEVDALLDAVLE

SEQ ID NO: 644288 - protein, 20 aa, Mycobacterium
DENVEFVDVRFCDLPGIMQH

SEQ ID NO: 644289 - protein, 18 aa, Mycobacterium
DENVEYVDIRFCDLPGVV

SEQ ID NO: 644290 - protein, 17 aa, Mycobacterium
DENWVWAGAGVIEPEYT

SEQ ID NO: 644291 - protein, 19 aa, Mycobacterium
DEPAGHAYDAARIAADTRA

SEQ ID NO: 644292 - protein, 20 aa, Mycobacterium
DEPDAALLVFFHGGGHVIGS

SEQ ID NO: 644293 - protein, 26 aa, Mycobacterium
DEPDCVRELAAMAFAFAYETARDATR

SEQ ID NO: 644294 - protein, 20 aa, Mycobacterium
DEPDGLFVKNLENVQGDERD

SEQ ID NO: 644295 - protein, 24 aa, Mycobacterium
DEPEDARLLLSIRRADLLDGGPDA

SEQ ID NO: 644296 - protein, 24 aa, Mycobacterium
DEPEFGRASALLGQGLDPVYALTG

SEQ ID NO: 644297 - protein, 33 aa, Mycobacterium
DEPEIVIKYFGPRAAERFCVPHVLVPVEIPSPD

SEQ ID NO: 644298 - protein, 23 aa, Mycobacterium
DEPEVLGLAALLCLSESRRAARR

SEQ ID NO: 644299 - protein, 28 aa, Mycobacterium
DEPFDGWTLRAAWVNTVFDIKRRNDFAK

SEQ ID NO: 644300 - protein, 21 aa, Mycobacterium
DEPFFRCVRLVELANGDFAQS

SEQ ID NO: 644301 - protein, 21 aa, Mycobacterium
DEPFGSLLLDADGVTRVEDRN

SEQ ID NO: 644302 - protein, 22 aa, Mycobacterium
DEPFPRLSAVRDPRHRKAIGPF

SEQ ID NO: 644303 - protein, 20 aa, Mycobacterium
DEPFWKQTFSEFSTLLKTED

SEQ ID NO: 644304 - protein, 19 aa, Mycobacterium
DEPFWRADGLSGQSAAPGS

SEQ ID NO: 644305 - protein, 27 aa, Mycobacterium
DEPGEWGHVELAWWRQVLAGLPGDISI

SEQ ID NO: 644306 - protein, 18 aa, Mycobacterium
DEPHSFSFLDGFADEDFN

SEQ ID NO: 644307 - protein, 22 aa, Mycobacterium
DEPIADIGVGVFTAALREAIAD

SEQ ID NO: 644308 - protein, 17 aa, Mycobacterium
DEPIPDFPATPAGGAEG

SEQ ID NO: 644309 - protein, 17 aa, Mycobacterium
DEPLKRKVASTLLESFL

SEQ ID NO: 644310 - protein, 17 aa, Mycobacterium
DEPLNWVREHNAITTSE

SEQ ID NO: 644311 - protein, 25 aa, Mycobacterium
DEPLPGFADEWFARWERGEDVTRWY

SEQ ID NO: 644312 - protein, 25 aa, Mycobacterium
DEPPAALVQACLDRDLPLLTLPPDV

SEQ ID NO: 644313 - protein, 21 aa, Mycobacterium
DEPPVTYLVSYYALRGVILEC

SEQ ID NO: 644314 - protein, 17 aa, Mycobacterium
DEPRAAFIGSHLRALAC

SEQ ID NO: 644315 - protein, 20 aa, Mycobacterium
DEPRFMKLNGASAPEAPAAI

SEQ ID NO: 644316 - protein, 21 aa, Mycobacterium
DEPRISALVRKGLSANGFSVT

SEQ ID NO: 644317 - protein, 25 aa, Mycobacterium
DEPRMSAGQHRMWFVQSVDPDSALL

SEQ ID NO: 644318 - protein, 20 aa, Mycobacterium
DEPRRPLVWRSGADPTVAEL

SEQ ID NO: 644319 - protein, 22 aa, Mycobacterium
DEPRRWRQPRVVFVNSMSDLFH

SEQ ID NO: 644320 - protein, 21 aa, Mycobacterium
DEPRYGSVHPREFDRAERGGP

SEQ ID NO: 644321 - protein, 27 aa, Mycobacterium
DEPRYRPSRALQRFVHARDITCRFPGC

SEQ ID NO: 644322 - protein, 18 aa, Mycobacterium
DEPSIWAVGPPRADIHVM

SEQ ID NO: 644323 - protein, 19 aa, Mycobacterium
DEPTIRFALADMATGLETS

SEQ ID NO: 644324 - protein, 30 aa, Mycobacterium
DEPTRRVRLMRWGLVPPWAKAGADGAPETK

SEQ ID NO: 644325 - protein, 30 aa, Mycobacterium
DEPTRRVRLMRWGLVPPWAKAGEDGAPETK

SEQ ID NO: 644326 - protein, 25 aa, Mycobacterium
DEPVAVVGMACRFPGGVDSAAALWD

SEQ ID NO: 644327 - protein, 19 aa, Mycobacterium
DEPYRRALRVIHARLTSTA

SEQ ID NO: 644328 - protein, 19 aa, Mycobacterium
DEPYRRALRVVHARLTATA

SEQ ID NO: 644329 - protein, 22 aa, Mycobacterium
DEQARFAMRMIRRPVHDPSRYA

SEQ ID NO: 644330 - protein, 20 aa, Mycobacterium
DEQFSCWRITLPHPDAAKFD

SEQ ID NO: 644331 - protein, 26 aa, Mycobacterium
DEQGCVLLAVRGLRLGTGTSESGERD

SEQ ID NO: 644332 - protein, 23 aa, Mycobacterium
DEQGESPFVWGVIGALSEATSLP

SEQ ID NO: 644333 - protein, 17 aa, Mycobacterium
DEQIKIRGYRIELGEIQ

SEQ ID NO: 644334 - protein, 33 aa, Mycobacterium
DEQKARWFPGFCSGELISAIAMTEPGTGSDLQG

SEQ ID NO: 644335 - protein, 26 aa, Mycobacterium
DEQKHRWAVPVLRGERTASLGMSEPS

SEQ ID NO: 644336 - protein, 19 aa, Mycobacterium
DEQKKWATIAAERGWGATM

SEQ ID NO: 644337 - protein, 26 aa, Mycobacterium
DEQKQRWLPGIADGSLTMAFAITEPD

SEQ ID NO: 644338 - protein, 24 aa, Mycobacterium
DEQKQRWLPGIADGTLTMAFAITE

SEQ ID NO: 644339 - protein, 25 aa, Mycobacterium
DEQLIAAAAYLWARQWSAAGGDLWR

SEQ ID NO: 644340 - protein, 24 aa, Mycobacterium
DEQQRLRTLRGFGVRAFTALIYPH

SEQ ID NO: 644341 - protein, 24 aa, Mycobacterium
DEQRAIFRRTWLNVGRIERLPRTG

SEQ ID NO: 644342 - protein, 24 aa, Mycobacterium
DEQRAIFRRTWLNVGRVERLPRAG

SEQ ID NO: 644343 - protein, 22 aa, Mycobacterium
DEQRARLAGNIVGHVLDGVSEP

SEQ ID NO: 644344 - protein, 24 aa, Mycobacterium
DEQRLPVAPMVNGACELLGIDPLY

SEQ ID NO: 644345 - protein, 21 aa, Mycobacterium
DEQRLPVAPQVLGACDMLGID

SEQ ID NO: 644346 - protein, 25 aa, Mycobacterium
DEQRQRWLPDMLGGSTIGAYSLSEP

SEQ ID NO: 644347 - protein, 25 aa, Mycobacterium
DEQRRLHHTYSFLGIETYRQVSTEP

SEQ ID NO: 644348 - protein, 17 aa, Mycobacterium
DEQVKIRGFRIELGEVS

SEQ ID NO: 644349 - protein, 30 aa, Mycobacterium
DEQVKIRGYRIECGEVAAALAALDGVQQAV

SEQ ID NO: 644350 - protein, 31 aa, Mycobacterium
DEQVKIRGYRIECGEVTAALAALDGVQQAVV

SEQ ID NO: 644351 - protein, 29 aa, Mycobacterium
DEQVKIRGYRIECGEVTTALTTLDGVQQA

SEQ ID NO: 644352 - protein, 31 aa, Mycobacterium
DEQVRRVCLDGGLLPDMPSGSALVVHTTVSP

SEQ ID NO: 644353 - protein, 22 aa, Mycobacterium
DEQVWRVGRLAVWAVTRLFDIE

SEQ ID NO: 644354 - protein, 25 aa, Mycobacterium
DEQYEIADVLPLTPLQQGLLFHSNL

SEQ ID NO: 644355 - protein, 22 aa, Mycobacterium
DERARLMFMLGTLTPDRVTRDA

SEQ ID NO: 644356 - protein, 19 aa, Mycobacterium
DERARLQADPGLIPAAIDE

SEQ ID NO: 644357 - protein, 19 aa, Mycobacterium
DERAWLRARELQKRLYDGG

SEQ ID NO: 644358 - protein, 20 aa, Mycobacterium
DERCARIIVTPGDVDKIVTV

SEQ ID NO: 644359 - protein, 24 aa, Mycobacterium
DERDAGATVCAGPPVPADTTVTDQ

SEQ ID NO: 644360 - protein, 22 aa, Mycobacterium
DERDFPATSVRFFASARSQGRK

SEQ ID NO: 644361 - protein, 24 aa, Mycobacterium
DERDRPLLDLAWDYATEDAEGDEP

SEQ ID NO: 644362 - protein, 23 aa, Mycobacterium
DERDRPLLQLAWDYATEGDEPSG

SEQ ID NO: 644363 - protein, 19 aa, Mycobacterium
DERELGILVSRLHSHALDL

SEQ ID NO: 644364 - protein, 18 aa, Mycobacterium
DEREPARLLLAARPAQLV

SEQ ID NO: 644365 - protein, 27 aa, Mycobacterium
DERFGQRLVAFVVARPGSDIDVPELRE

SEQ ID NO: 644366 - protein, 17 aa, Mycobacterium
DERFRRINVEMTPHQRL

SEQ ID NO: 644367 - protein, 23 aa, Mycobacterium
DERGCGLSDWSARDFTFEDWVED

SEQ ID NO: 644368 - protein, 24 aa, Mycobacterium
DERGHHVFIEMNPRIQVEHTVTEE

SEQ ID NO: 644369 - protein, 28 aa, Mycobacterium
DERGKFPGQWWGPASWRRKPHRSRGKGT

SEQ ID NO: 644370 - protein, 23 aa, Mycobacterium
DERGRGRLSLMVVPTDAAGLQKT

SEQ ID NO: 644371 - protein, 18 aa, Mycobacterium
DERGRIVAILDMGWERHL

SEQ ID NO: 644372 - protein, 22 aa, Mycobacterium
DERGRRFLVAAAKIAYVEIGVA

SEQ ID NO: 644373 - protein, 22 aa, Mycobacterium
DERIAMEFAHRFATDHTALRDD

SEQ ID NO: 644374 - protein, 24 aa, Mycobacterium
DERITYDLILRVAVEAMNDSQLAS

SEQ ID NO: 644375 - protein, 26 aa, Mycobacterium
DERLEKICRLIMLYHLDRGWADHLAY

SEQ ID NO: 644376 - protein, 21 aa, Mycobacterium
DERLFLERYVRIRAELMPAER

SEQ ID NO: 644377 - protein, 23 aa, Mycobacterium
DERLKRQLLRAVNDGILVSADEL

SEQ ID NO: 644378 - protein, 23 aa, Mycobacterium
DERLPAVLADLGLDTEMVRPDST

SEQ ID NO: 644379 - protein, 24 aa, Mycobacterium
DERLPRYIGSVLAKLQEVWVGRQV

SEQ ID NO: 644380 - protein, 19 aa, Mycobacterium
DERLRQVLAAYRVLRDPQL

SEQ ID NO: 644381 - protein, 24 aa, Mycobacterium
DERLRSGAPLAEVLDYLGIPQSAR

SEQ ID NO: 644382 - protein, 24 aa, Mycobacterium
DERLRSGAPLAEVVDYLGIPQSAR

SEQ ID NO: 644383 - protein, 19 aa, Mycobacterium
DERLRYGPLKAGYHGGAAP

SEQ ID NO: 644384 - protein, 23 aa, Mycobacterium
DERMATQLLRHFANVLEAVLADP

SEQ ID NO: 644385 - protein, 20 aa, Mycobacterium
DERMPAVLADLGLDSDAVRP

SEQ ID NO: 644386 - protein, 30 aa, Mycobacterium
DERNRIGELIFRFYIGSLFQDNDFCGDPHP

SEQ ID NO: 644387 - protein, 29 aa, Mycobacterium
DERPDLAILDVRMPPTFTDEGIRAAALLR

SEQ ID NO: 644388 - protein, 23 aa, Mycobacterium
DERRFANRRVDVMQNGELLTTVM

SEQ ID NO: 644389 - protein, 21 aa, Mycobacterium
DERRLHAALTHLRAHAPVSWV

SEQ ID NO: 644390 - protein, 23 aa, Mycobacterium
DERRRVAACLGGLTDAQRECIEM

SEQ ID NO: 644391 - protein, 18 aa, Mycobacterium
DERRRVAAELRKRGVSTE

SEQ ID NO: 644392 - protein, 27 aa, Mycobacterium
DERSLHFAMGLARGHSLAVVEGSTPLA

SEQ ID NO: 644393 - protein, 28 aa, Mycobacterium
DERSLHFAMGLARGYSLAVVEGSTSLAE

SEQ ID NO: 644394 - protein, 23 aa, Mycobacterium
DERTAAELVRFGQAIRRLETGGL

SEQ ID NO: 644395 - protein, 25 aa, Mycobacterium
DERTRAKARLVWGDHTLVGVGLARL

SEQ ID NO: 644396 - protein, 25 aa, Mycobacterium
DERTRAKARLVWGDQTLVGIGLARL

SEQ ID NO: 644397 - protein, 22 aa, Mycobacterium
DERVFDWPDEYLIGREIGSRLL

SEQ ID NO: 644398 - protein, 17 aa, Mycobacterium
DERVGVLSFPLGKQQRP

SEQ ID NO: 644399 - protein, 26 aa, Mycobacterium
DERVLREWFAQLVMYSMSATLADSYV

SEQ ID NO: 644400 - protein, 26 aa, Mycobacterium
DERVWQLGAELGWAGLLIAEQYDGLG

SEQ ID NO: 644401 - protein, 25 aa, Mycobacterium
DESACDAWVGRIRCGDVDRVTLFRA

SEQ ID NO: 644402 - protein, 19 aa, Mycobacterium
DESALRVARDIAAKDTRVI

SEQ ID NO: 644403 - protein, 18 aa, Mycobacterium
DESAQWLANERFFGSYRR

SEQ ID NO: 644404 - protein, 18 aa, Mycobacterium
DESAWSFPLSGADRNILI

SEQ ID NO: 644405 - protein, 24 aa, Mycobacterium
DESELRAVAGLVLVAGFETTVNLL

SEQ ID NO: 644406 - protein, 21 aa, Mycobacterium
DESFGLPGLAAYCREAIHANA

SEQ ID NO: 644407 - protein, 24 aa, Mycobacterium
DESGRAVGVLADLQGPKIRLGRFA

SEQ ID NO: 644408 - protein, 18 aa, Mycobacterium
DESHLRAIADLNFTNARA

SEQ ID NO: 644409 - protein, 18 aa, Mycobacterium
DESITFYRKLFGVEPAKV

SEQ ID NO: 644410 - protein, 24 aa, Mycobacterium
DESKVKGLVYAAAVMPAAGEAASE

SEQ ID NO: 644411 - protein, 22 aa, Mycobacterium
DESLRLSTLVSEVAGRAGSPEE

SEQ ID NO: 644412 - protein, 23 aa, Mycobacterium
DESLRSLWAAWLYSTEVPALDAG

SEQ ID NO: 644413 - protein, 28 aa, Mycobacterium
DESLRYARSRPAFGSAIIDYQSVSFKIA

SEQ ID NO: 644414 - protein, 24 aa, Mycobacterium
DESPSARLAVQWAAHDAELRNIPL

SEQ ID NO: 644415 - protein, 17 aa, Mycobacterium
DESRAVLHDEALRRIFD

SEQ ID NO: 644416 - protein, 22 aa, Mycobacterium
DESRFMDWVGWVHTTVHDRAHD

SEQ ID NO: 644417 - protein, 29 aa, Mycobacterium
DESRLTFLAVRRWYGWSAGRIINIDIGGG

SEQ ID NO: 644418 - protein, 29 aa, Mycobacterium
DESRLTFLAVRRWYGWSAGRIVNIDIGGG

SEQ ID NO: 644419 - protein, 29 aa, Mycobacterium
DESRLTFLAVRRWYGWSAGRIVNLDIGGG

SEQ ID NO: 644420 - protein, 23 aa, Mycobacterium
DESRMAPDLASKIAIASMAASQM

SEQ ID NO: 644421 - protein, 21 aa, Mycobacterium
DESRRVWLCDSFAGVPAPDAA

SEQ ID NO: 644422 - protein, 24 aa, Mycobacterium
DESTRPLVICDLGMPRDVDPAVAG

SEQ ID NO: 644423 - protein, 21 aa, Mycobacterium
DESVAKLGYYSQFRDQNITAE

SEQ ID NO: 644424 - protein, 24 aa, Mycobacterium
DESVELAIALAVRALRGGSVCVDL

SEQ ID NO: 644425 - protein, 20 aa, Mycobacterium
DESVKYAKERQAFGAAIGTY

SEQ ID NO: 644426 - protein, 18 aa, Mycobacterium
DESVRIYLATGLTEVGRP

SEQ ID NO: 644427 - protein, 17 aa, Mycobacterium
DESWIAYVIAKTAAEED

SEQ ID NO: 644428 - protein, 24 aa, Mycobacterium
DESYEIFRLNAVPGTEKLPYSLKV

SEQ ID NO: 644429 - protein, 20 aa, Mycobacterium
DESYRRLARIIGEVVVAEQP

SEQ ID NO: 644430 - protein, 17 aa, Mycobacterium
DETAAVMTLEMGKTLTS

SEQ ID NO: 644431 - protein, 24 aa, Mycobacterium
DETARPWHSSSFVFDGNVIATKLK

SEQ ID NO: 644432 - protein, 33 aa, Mycobacterium
DETLKALEFDYVDLFLIHWPLPTLYDGDFVSTW

SEQ ID NO: 644433 - protein, 21 aa, Mycobacterium
DETLRAVSYYTVGGVGHTLAA

SEQ ID NO: 644434 - protein, 24 aa, Mycobacterium
DETPRTAVELAVLAVRAGLPPGVF

SEQ ID NO: 644435 - protein, 27 aa, Mycobacterium
DETRKSFGIAGPRVVDGLELSIPTKTL

SEQ ID NO: 644436 - protein, 22 aa, Mycobacterium
DETRLHAALTRLRAQAPVALVD

SEQ ID NO: 644437 - protein, 29 aa, Mycobacterium
DETRRIDGFPLLRAGICAGAVVKRRGDVF

SEQ ID NO: 644438 - protein, 30 aa, Mycobacterium
DETRRIDGFPLLRAGICAGAVVKRRGDVFG

SEQ ID NO: 644439 - protein, 17 aa, Mycobacterium
DETRRLFAGGGFGRGRY

SEQ ID NO: 644440 - protein, 24 aa, Mycobacterium
DETRRLFAGGGFGRRFGDNGFGGG

SEQ ID NO: 644441 - protein, 21 aa, Mycobacterium
DETRSVTGFFWVDDPRWLLYV

SEQ ID NO: 644442 - protein, 19 aa, Mycobacterium
DETSMLRRRLERGSAEPTV

SEQ ID NO: 644443 - protein, 24 aa, Mycobacterium
DETSVFWCPLPLFHTAGLATLTAC

SEQ ID NO: 644444 - protein, 20 aa, Mycobacterium
DETTLRWRVETDTGEVLTAR

SEQ ID NO: 644445 - protein, 19 aa, Mycobacterium
DETTLRWTVTTDAGQTISA

SEQ ID NO: 644446 - protein, 27 aa, Mycobacterium
DEVAAAWEYAMAGGRVSHTRIIVEGFV

SEQ ID NO: 644447 - protein, 21 aa, Mycobacterium
DEVAAGLGFARMVDTFAARAL

SEQ ID NO: 644448 - protein, 23 aa, Mycobacterium
DEVAARLRVEIMTGALRPESFIR

SEQ ID NO: 644449 - protein, 20 aa, Mycobacterium
DEVACPFHDWRWGGDGKCKL

SEQ ID NO: 644450 - protein, 20 aa, Mycobacterium
DEVACPFHDWRWGGDGRCKL

SEQ ID NO: 644451 - protein, 22 aa, Mycobacterium
DEVAELRRMFGIPDYFIRVQTA

SEQ ID NO: 644452 - protein, 18 aa, Mycobacterium
DEVAERIAALGASPQGTP

SEQ ID NO: 644453 - protein, 25 aa, Mycobacterium
DEVAEVKKILGFDPDKTFEVSEDVI

SEQ ID NO: 644454 - protein, 22 aa, Mycobacterium
DEVAGGPLREWLHKQRTGSPHV

SEQ ID NO: 644455 - protein, 23 aa, Mycobacterium
DEVAKAQAALRIEQLEQQVLEQF

SEQ ID NO: 644456 - protein, 18 aa, Mycobacterium
DEVANAQAALRIEQLEQM

SEQ ID NO: 644457 - protein, 22 aa, Mycobacterium
DEVAPRTCAAVWDALPLSAQVF

SEQ ID NO: 644458 - protein, 18 aa, Mycobacterium
DEVAQMFRGLRSPQGEEM

SEQ ID NO: 644459 - protein, 24 aa, Mycobacterium
DEVARGPLREWLHKQRTGLPHLTW

SEQ ID NO: 644460 - protein, 18 aa, Mycobacterium
DEVARRAAALDADQTDVR

SEQ ID NO: 644461 - protein, 20 aa, Mycobacterium
DEVASAIAFLASDDASFITG

SEQ ID NO: 644462 - protein, 19 aa, Mycobacterium
DEVDVLRLADKCGATARPL

SEQ ID NO: 644463 - protein, 19 aa, Mycobacterium
DEVEALYYLHPLTGDVIRQ

SEQ ID NO: 644464 - protein, 19 aa, Mycobacterium
DEVEALYYLHPLTGDVVRQ

SEQ ID NO: 644465 - protein, 24 aa, Mycobacterium
DEVEARALLAFSLAIGTHVIAADH

SEQ ID NO: 644466 - protein, 21 aa, Mycobacterium
DEVEECWQLLRQSLHSVSYET

SEQ ID NO: 644467 - protein, 19 aa, Mycobacterium
DEVEGALWVALRSLQEKAR

SEQ ID NO: 644468 - protein, 17 aa, Mycobacterium
DEVFARQVLATGRPGDV

SEQ ID NO: 644469 - protein, 20 aa, Mycobacterium
DEVFDAATSLAVFQLIPDPV

SEQ ID NO: 644470 - protein, 28 aa, Mycobacterium
DEVFLAWEPFSRMAFRFNAASTRSISAF

SEQ ID NO: 644471 - protein, 17 aa, Mycobacterium
DEVGATWEPVDVQHDTI

SEQ ID NO: 644472 - protein, 27 aa, Mycobacterium
DEVICAFGRIGSMFACDDFGYVPDMIT

SEQ ID NO: 644473 - protein, 28 aa, Mycobacterium
DEVICAFGRIGSMFACEDFGYQPDIVTC

SEQ ID NO: 644474 - protein, 27 aa, Mycobacterium
DEVICAFGRIGSMFACNDFGYVPDIIT

SEQ ID NO: 644475 - protein, 27 aa, Mycobacterium
DEVICAFGRIGSMFACSSDLGDFGYVP

SEQ ID NO: 644476 - protein, 27 aa, Mycobacterium
DEVICAYGRIGSMFACEDFGYVPDIIT

SEQ ID NO: 644477 - protein, 25 aa, Mycobacterium
DEVIFGWRSFELYPPQVAVAGATAV

SEQ ID NO: 644478 - protein, 21 aa, Mycobacterium
DEVIFGWRSFELYPPQVQVAG

SEQ ID NO: 644479 - protein, 29 aa, Mycobacterium
DEVILRNGSRWALVVGRTLPQRLETMAQA

SEQ ID NO: 644480 - protein, 38 aa, Mycobacterium
DEVKARLAVANALALQFGWRLFAPVLRSATGIEELTDA

SEQ ID NO: 644481 - protein, 19 aa, Mycobacterium
DEVKVVFSVASLTFEGDMP

SEQ ID NO: 644482 - protein, 17 aa, Mycobacterium
DEVLACFVLDPRLEASS

SEQ ID NO: 644483 - protein, 25 aa, Mycobacterium
DEVLFAWRSFEIYPLQVRTAGATPV

SEQ ID NO: 644484 - protein, 25 aa, Mycobacterium
DEVLFGWRSFEIYPLQVRTAGATPV

SEQ ID NO: 644485 - protein, 31 aa, Mycobacterium
DEVLGRALVVRRLDMLPVECVARGYLTGSGL

SEQ ID NO: 644486 - protein, 30 aa, Mycobacterium; identical to SEQ ID NO: 197721

SEQ ID NO: 644487 - protein, 20 aa, Mycobacterium
DEVLLRLFGKLVELVFLAVP

SEQ ID NO: 644488 - protein, 20 aa, Mycobacterium
DEVLPALADDAGLVVVDEAH

SEQ ID NO: 644489 - protein, 24 aa, Mycobacterium
DEVLPEKPELILLDNFPVWQTQTA

SEQ ID NO: 644490 - protein, 17 aa, Mycobacterium
DEVLPMLEAMISVDLWL

SEQ ID NO: 644491 - protein, 18 aa, Mycobacterium
DEVLWRIFDNARFAPSGG

SEQ ID NO: 644492 - protein, 29 aa, Mycobacterium
DEVMAGFGRSGKWFSINHFDVVPDLMTFA

SEQ ID NO: 644493 - protein, 28 aa, Mycobacterium
DEVMAGFGRTGEWFAINHFNVVPDLLTF

SEQ ID NO: 644494 - protein, 27 aa, Mycobacterium
DEVMAGFGRTGTWFAIDNFGVVPDLIT

SEQ ID NO: 644495 - protein, 25 aa, Mycobacterium
DEVMIGWRSFECYLPIIQVSGATTV

SEQ ID NO: 644496 - protein, 25 aa, Mycobacterium
DEVMMGWRSFECYLPIVQVSGATAV

SEQ ID NO: 644497 - protein, 25 aa, Mycobacterium
DEVMRAGPGAAVWIPKSTRHAFRVV

SEQ ID NO: 644498 - protein, 30 aa, Mycobacterium
DEVMVGFGRFGEWFAINAFDVTPDLITFAK

SEQ ID NO: 644499 - protein, 22 aa, Mycobacterium
DEVPDAGLLLAHHPLLLRGVDT

SEQ ID NO: 644500 - protein, 38 aa, Mycobacterium
DEVPDGEVWVHCASGYRSSIAASMIDRGDRTVVLVDDA

SEQ ID NO: 644501 - protein, 24 aa, Mycobacterium
DEVPDVWEGVVGIFRDYGYRRLRS

SEQ ID NO: 644502 - protein, 19 aa, Mycobacterium
DEVPDVWEGVVSIFRDYGY

SEQ ID NO: 644503 - protein, 19 aa, Mycobacterium
DEVPDVWEGVVSVFRDYGY

SEQ ID NO: 644504 - protein, 22 aa, Mycobacterium
DEVPEGGLLLAHHPLLLRGVDT

SEQ ID NO: 644505 - protein, 22 aa, Mycobacterium
DEVPELLRDALIAEGVAPDAIS

SEQ ID NO: 644506 - protein, 23 aa, Mycobacterium
DEVPLEWCFQPGVKLDFRHLDDG

SEQ ID NO: 644507 - protein, 20 aa, Mycobacterium
DEVPPELPVGSGPGVAEAFM

SEQ ID NO: 644508 - protein, 22 aa, Mycobacterium
DEVPPWLGDADFHLSHRSALLR

SEQ ID NO: 644509 - protein, 22 aa, Mycobacterium
DEVPVPPHWGGYLIAAEVVEFW

SEQ ID NO: 644510 - protein, 25 aa, Mycobacterium
DEVRGHFGPKVLGSVIPRSVKVSEA

SEQ ID NO: 644511 - protein, 19 aa, Mycobacterium
DEVRIAVTACGICGTDRAF

SEQ ID NO: 644512 - protein, 25 aa, Mycobacterium
DEVRRFARERSRWLFSNPDMIHLSI

SEQ ID NO: 644513 - protein, 27 aa, Mycobacterium
DEVRRYIIGAALRWMREFHADGLRLDA

SEQ ID NO: 644514 - protein, 19 aa, Mycobacterium
DEVRWDIRPSPHLGTIEVR

SEQ ID NO: 644515 - protein, 17 aa, Mycobacterium
DEVSAAIATLFNTYAEE

SEQ ID NO: 644516 - protein, 21 aa, Mycobacterium
DEVSAAIATLFSAHGQAYQAL

SEQ ID NO: 644517 - protein, 30 aa, Mycobacterium
DEVSAAVAELFGDHAQAYQVVSAQAAAFHQ

SEQ ID NO: 644518 - protein, 24 aa, Mycobacterium
DEVSAAVASLFAGYGQAYQSISLQ

SEQ ID NO: 644519 - protein, 23 aa, Mycobacterium
DEVSAAVASLFGSHGQSFQAVSL

SEQ ID NO: 644520 - protein, 28 aa, Mycobacterium
DEVSAGIAALFGAFGREYQIVSSQAQAF

SEQ ID NO: 644521 - protein, 22 aa, Mycobacterium
DEVSALIAAQFAAHAVLYREIS

SEQ ID NO: 644522 - protein, 27 aa, Mycobacterium
DEVSALTALQFAAHAQMYQAVSAQAAA

SEQ ID NO: 644523 - protein, 22 aa, Mycobacterium
DEVSAVIAGFFGAHAQEYQAIS

SEQ ID NO: 644524 - protein, 21 aa, Mycobacterium
DEVSDRLAVESVRTVVYSAAP

SEQ ID NO: 644525 - protein, 21 aa, Mycobacterium
DEVSEAIAAIFSAHGEGYLAL

SEQ ID NO: 644526 - protein, 22 aa, Mycobacterium
DEVSFAISALFDAHAQAYQALS

SEQ ID NO: 644527 - protein, 20 aa, Mycobacterium
DEVSQWCVGWLRYGLAVDVD

SEQ ID NO: 644528 - protein, 21 aa, Mycobacterium
DEVSRELKLLVDRREDLVGQR

SEQ ID NO: 644529 - protein, 22 aa, Mycobacterium
DEVSRELKLLVDRREDLVGQRT

SEQ ID NO: 644530 - protein, 30 aa, Mycobacterium
DEVSTVVASLFSRYAQAYQVLGADMAAIHD

SEQ ID NO: 644531 - protein, 17 aa, Mycobacterium
DEVSVLIAAQFATHAQM

SEQ ID NO: 644532 - protein, 17 aa, Mycobacterium
DEVSVLVPDDFVGAVMG

SEQ ID NO: 644533 - protein, 25 aa, Mycobacterium
DEVTRRVIVPLGLRDTYWPAPDDTG

SEQ ID NO: 644534 - protein, 18 aa, Mycobacterium
DEVVCLETPVPYFAVGQG

SEQ ID NO: 644535 - protein, 25 aa, Mycobacterium
DEVVDAWLARKERIRQIHELLTKAE

SEQ ID NO: 644536 - protein, 24 aa, Mycobacterium
DEVVEISAGLVLTSIGYRGTPIRG

SEQ ID NO: 644537 - protein, 28 aa, Mycobacterium
DEVVPLLQRAGCFRTGYRDGETLRERLG

SEQ ID NO: 644538 - protein, 18 aa, Mycobacterium
DEVVRVFLATGLSHPGRG

SEQ ID NO: 644539 - protein, 20 aa, Mycobacterium
DEVVVDWPHRYLAAQAEAGA

SEQ ID NO: 644540 - protein, 21 aa, Mycobacterium
DEVVVEWPHRYLAAQAEAGAV

SEQ ID NO: 644541 - protein, 22 aa, Mycobacterium
DEVYELRGAELIRIDAPTDASV

SEQ ID NO: 644542 - protein, 20 aa, Mycobacterium
DEWARFCGYVTDWEREMYWS

SEQ ID NO: 644543 - protein, 20 aa, Mycobacterium
DEWASPSGRRMDLPMRGNIL

SEQ ID NO: 644544 - protein, 32 aa, Mycobacterium
DEWCVISIRSDDEWRCAALVFDKPELAEDLRF

SEQ ID NO: 644545 - protein, 32 aa, Mycobacterium
DEWCVISIRTDDEWRRAASVFDHPEWADDPRF

SEQ ID NO: 644546 - protein, 17 aa, Mycobacterium
DEWGNRAVLTAPVRAAA

SEQ ID NO: 644547 - protein, 19 aa, Mycobacterium
DEWLIPRVLNDCFKVHMSE

SEQ ID NO: 644548 - protein, 25 aa, Mycobacterium
DEWNACLQAGLPVRWETTADTPFPY

SEQ ID NO: 644549 - protein, 17 aa, Mycobacterium
DEWPVPTAAAAVIGPSG

SEQ ID NO: 644550 - protein, 21 aa, Mycobacterium
DEWQRLFLFSRADTIYGGSNE

SEQ ID NO: 644551 - protein, 20 aa, Mycobacterium
DEWSSPSGRRMDLPNRGNIL

SEQ ID NO: 644552 - protein, 17 aa, Mycobacterium
DEWTVSSELALEIVPEA

SEQ ID NO: 644553 - protein, 24 aa, Mycobacterium
DEYARRLAGWTGWSDESQVLSRVR

SEQ ID NO: 644554 - protein, 20 aa, Mycobacterium
DEYARTALFHAFAVQMNLIS

SEQ ID NO: 644555 - protein, 21 aa, Mycobacterium
DEYDRRYGLDDAHLRAIAQLN

SEQ ID NO: 644556 - protein, 40 aa, Mycobacterium
DEYDWDIKPGDMARIWRGGCIIRAKFLNRITDAFDNDPGL

SEQ ID NO: 644557 - protein, 21 aa, Mycobacterium
DEYGIPFLGIRGITDGPGDPL

SEQ ID NO: 644558 - protein, 26 aa, Mycobacterium
DEYGLRPLVRLVSWGLAGVAPDVMGI

SEQ ID NO: 644559 - protein, 19 aa, Mycobacterium
DEYLALQCGRSAHTRRAYL

SEQ ID NO: 644560 - protein, 22 aa, Mycobacterium
DEYLRPVPPGVVGELYVAGGGL

SEQ ID NO: 644561 - protein, 21 aa, Mycobacterium
DEYLTRLGARFERRSTDDPDL

SEQ ID NO: 644562 - protein, 24 aa, Mycobacterium
DEYPNWRLPLPLTLEELQADPRVA

SEQ ID NO: 644563 - protein, 18 aa, Mycobacterium
DEYQRIRDILGRRPTDAE

SEQ ID NO: 644564 - protein, 18 aa, Mycobacterium
DEYQRIRDILGRRPTDTE

SEQ ID NO: 644565 - protein, 22 aa, Mycobacterium
DEYRAFLDRVVTGWIEIIRYHA

SEQ ID NO: 644566 - protein, 21 aa, Mycobacterium
DEYRGFLDRIVTDWIETIRQH

SEQ ID NO: 644567 - protein, 24 aa, Mycobacterium
DEYRKLDEEFVWYGRIPRAKLADY

SEQ ID NO: 644568 - protein, 26 aa, Mycobacterium
DEYSVAFDRWLACGAADLEDRVPAVL

SEQ ID NO: 644569 - protein, 34 aa, Mycobacterium
DEYVKGLADLGCFGMKIPTEYGGLGMSQVAYNRA

SEQ ID NO: 644570 - protein, 22 aa, Mycobacterium
DFAAEAAFVLAMIGVDLSRLAE

SEQ ID NO: 644571 - protein, 17 aa, Mycobacterium
DFACALPAEISVVPGAL

SEQ ID NO: 644572 - protein, 17 aa, Mycobacterium
DFACPLPAEISAVPAAL

SEQ ID NO: 644573 - protein, 27 aa, Mycobacterium
DFAELFLPTPLRWLVGATRFAPVRRLM

SEQ ID NO: 644574 - protein, 20 aa, Mycobacterium
DFAEPAWRDHGEIVVVDDVE

SEQ ID NO: 644575 - protein, 18 aa, Mycobacterium
DFAGDVVPIGRPLPSTAA

SEQ ID NO: 644576 - protein, 18 aa, Mycobacterium
DFAGGCYVHVQKYLHDMA

SEQ ID NO: 644577 - protein, 24 aa, Mycobacterium
DFALAGSYALWAYGAPEPVHDVDF

SEQ ID NO: 644578 - protein, 19 aa, Mycobacterium
DFAPFMMVISLAGEISVRR

SEQ ID NO: 644579 - protein, 28 aa, Mycobacterium
DFAPICRTFHILPIPWVTAADITNAVLF

SEQ ID NO: 644580 - protein, 30 aa, Mycobacterium
DFAQDIAVHFPLYVIMSLLGIPESDFDRML

SEQ ID NO: 644581 - protein, 24 aa, Mycobacterium
DFARAQLDAGMGLRTLIHMDDPRH

SEQ ID NO: 644582 - protein, 18 aa, Mycobacterium
DFARIWRDMPKVVFSRTL

SEQ ID NO: 644583 - protein, 17 aa, Mycobacterium
DFARLRAEFGLHVDDAT

SEQ ID NO: 644584 - protein, 22 aa, Mycobacterium
DFASAYWHWFFLIQPAPLPETL

SEQ ID NO: 644585 - protein, 17 aa, Mycobacterium
DFASVNWHEPGSPELAE

SEQ ID NO: 644586 - protein, 25 aa, Mycobacterium
DFCDPEVVEALRFHLRDLAVTFRFG

SEQ ID NO: 644587 - protein, 18 aa, Mycobacterium
DFCHERGWLASQGVDVRG

SEQ ID NO: 644588 - protein, 21 aa, Mycobacterium
DFCKEHDLIDPITLLIATGLR

SEQ ID NO: 644589 - protein, 19 aa, Mycobacterium
DFDAIRWRLDVWNASAQVA

SEQ ID NO: 644590 - protein, 26 aa, Mycobacterium
DFDDCGMGWYFYDFGTAVSFFEDHPS

SEQ ID NO: 644591 - protein, 20 aa, Mycobacterium
DFDEWHQHAQWWDQEGPRVR

SEQ ID NO: 644592 - protein, 25 aa, Mycobacterium
DFDKLPDRSLIAFLPVNVRPKGDEG

SEQ ID NO: 644593 - protein, 21 aa, Mycobacterium
DFDPICCWPKPVTKPHPPLYI

SEQ ID NO: 644594 - protein, 25 aa, Mycobacterium
DFDPSKCIACSRCVRACGEIQGTFA

SEQ ID NO: 644595 - protein, 28 aa, Mycobacterium
DFDRARPMWKLTLIEGLSDGRAAVLCCL

SEQ ID NO: 644596 - protein, 20 aa, Mycobacterium
DFDTLLVMSVEPGFGGQSFI

SEQ ID NO: 644597 - protein, 18 aa, Mycobacterium
DFDVIRWVTGQNVVEVYA

SEQ ID NO: 644598 - protein, 25 aa, Mycobacterium
DFDYALVCADGDWRRAGLPATSAQF

SEQ ID NO: 644599 - protein, 26 aa, Mycobacterium
DFEAGACWREQLEIAGFDSGRPAVVA

SEQ ID NO: 644600 - protein, 22 aa, Mycobacterium
DFEEYTWLYAESWSDPQVRWLL

SEQ ID NO: 644601 - protein, 27 aa, Mycobacterium
DFEGWARWVSPGGALIIHDVFPNPADG

SEQ ID NO: 644602 - protein, 20 aa, Mycobacterium
DFEIAVGPVAKGTQAVLQFE

SEQ ID NO: 644603 - protein, 24 aa, Mycobacterium
DFEPTRAAALAFLAGELLPHAAAE

SEQ ID NO: 644604 - protein, 20 aa, Mycobacterium
DFESAVGYSRAVRIGPHVAV

SEQ ID NO: 644605 - protein, 19 aa, Mycobacterium
DFETSWLDPFTEFRFPRIG

SEQ ID NO: 644606 - protein, 18 aa, Mycobacterium
DFFAELTIYTSSACLIGK

SEQ ID NO: 644607 - protein, 19 aa, Mycobacterium
DFFEARKLPFLIAVNDFDG

SEQ ID NO: 644608 - protein, 20 aa, Mycobacterium
DFFRPPVRAAAKISPDGTRI

SEQ ID NO: 644609 - protein, 17 aa, Mycobacterium
DFFSLGVDSIVAISLVN

SEQ ID NO: 644610 - protein, 18 aa, Mycobacterium
DFGAEAYQGWGMTETSPL

SEQ ID NO: 644611 - protein, 18 aa, Mycobacterium
DFGAFLQMFWRAFPDAFF

SEQ ID NO: 644612 - protein, 21 aa, Mycobacterium
DFGALPPEINSLRMYTGAGAA

SEQ ID NO: 644613 - protein, 19 aa, Mycobacterium
DFGCKRPAVSSSYLQTFTR

SEQ ID NO: 644614 - protein, 17 aa, Mycobacterium
DFGGGPLTVGVCAEYDA

SEQ ID NO: 644615 - protein, 23 aa, Mycobacterium
DFGHGPLVAGICAEYDALPEIGH

SEQ ID NO: 644616 - protein, 24 aa, Mycobacterium
DFGHIAVDVIMKWAEDHRHDTMIA

SEQ ID NO: 644617 - protein, 19 aa, Mycobacterium
DFGIEWPEVPELILSDRDA

SEQ ID NO: 644618 - protein, 18 aa, Mycobacterium
DFGIGRARLEELYQRGYA

SEQ ID NO: 644619 - protein, 25 aa, Mycobacterium
DFGKNTWHGLLLLRHVADLVKTGWP

SEQ ID NO: 644620 - protein, 19 aa, Mycobacterium
DFGSLISFGPMDVARALGD

SEQ ID NO: 644621 - protein, 19 aa, Mycobacterium
DFGVLRFTSLVYPHKPQMA

SEQ ID NO: 644622 - protein, 22 aa, Mycobacterium
DFGVSSIDAGSWRESLRAHAHR

SEQ ID NO: 644623 - protein, 22 aa, Mycobacterium
DFGYLCGALKHYVGGYPTTTDK

SEQ ID NO: 644624 - protein, 19 aa, Mycobacterium
DFHAAALAYVEFALANPGH

SEQ ID NO: 644625 - protein, 17 aa, Mycobacterium
DFHAGKTFTHFYPYHQA

SEQ ID NO: 644626 - protein, 24 aa, Mycobacterium
DFHDNRIAVRFQYECHDAGGQWYR

SEQ ID NO: 644627 - protein, 21 aa, Mycobacterium
DFHDNRIAVRFQYECRDHTGQ

SEQ ID NO: 644628 - protein, 19 aa, Mycobacterium
DFHDNRIAVRFQYECRDRS

SEQ ID NO: 644629 - protein, 17 aa, Mycobacterium
DFHPDMQDYFATKARLF

SEQ ID NO: 644630 - protein, 24 aa, Mycobacterium
DFIADGAIEIGGRLPINTHGGQLG

SEQ ID NO: 644631 - protein, 21 aa, Mycobacterium
DFIADGAIELGGRLPINTHGG

SEQ ID NO: 644632 - protein, 19 aa, Mycobacterium
DFIAPDTKLCFAGPGDVID

SEQ ID NO: 644633 - protein, 24 aa, Mycobacterium
DFIEVRRAGIALAREVERRAPKQV

SEQ ID NO: 644634 - protein, 21 aa, Mycobacterium
DFKGLSWDAFMATPRYAEWLL

SEQ ID NO: 644635 - protein, 22 aa, Mycobacterium
DFKPHFFHHATFRQFLASIGSD

SEQ ID NO: 644636 - protein, 23 aa, Mycobacterium
DFKQCPLLYRFRAIDRLPEKPST

SEQ ID NO: 644637 - protein, 23 aa, Mycobacterium
DFKQCPLLYRFRAIDRLPEPRST

SEQ ID NO: 644638 - protein, 23 aa, Mycobacterium
DFKQCPLLYRFRAIDRLPEPSST

SEQ ID NO: 644639 - protein, 23 aa, Mycobacterium
DFKRGESAYDRYYGDPTNKPNPN

SEQ ID NO: 644640 - protein, 25 aa, Mycobacterium
DFKVRVVPCASALAVRDALRSRKDG

SEQ ID NO: 644641 - protein, 17 aa, Mycobacterium
DFLAAAISLGFLDSIAI

SEQ ID NO: 644642 - protein, 25 aa, Mycobacterium
DFLAPRVSYKLNLRGPSISLGTGCS

SEQ ID NO: 644643 - protein, 18 aa, Mycobacterium
DFLAWFFRAERGELDPFV

SEQ ID NO: 644644 - protein, 22 aa, Mycobacterium
DFLDRRASAVQARHTAYRSRHH

SEQ ID NO: 644645 - protein, 24 aa, Mycobacterium
DFLGEFKFYLDFYTKQSSHGLEVR

SEQ ID NO: 644646 - protein, 21 aa, Mycobacterium
DFLHEGWLVLRRGKRHIAGVR

SEQ ID NO: 644647 - protein, 21 aa, Mycobacterium
DFLKKLDTFTARLNEQRDDIT

SEQ ID NO: 644648 - protein, 19 aa, Mycobacterium
DFLLHPVMMDIALQTLGAT

SEQ ID NO: 644649 - protein, 17 aa, Mycobacterium
DFLREIHTLASIFTTIR

SEQ ID NO: 644650 - protein, 22 aa, Mycobacterium
DFLRLLPASLLASADMAHATHP

SEQ ID NO: 644651 - protein, 18 aa, Mycobacterium
DFLRPGHVAPLLAEPHGV

SEQ ID NO: 644652 - protein, 22 aa, Mycobacterium
DFLRRQAPDLLPASLGGGAHGD

SEQ ID NO: 644653 - protein, 19 aa, Mycobacterium
DFLTSWLDPFTEFRFPRIG

SEQ ID NO: 644654 - protein, 19 aa, Mycobacterium
DFLVAWSALLRLAGEDDMA

SEQ ID NO: 644655 - protein, 17 aa, Mycobacterium
DFLYQRGVYEGAPRPDL

SEQ ID NO: 644656 - protein, 19 aa, Mycobacterium
DFMGCCAYTVLAEEADRCR

SEQ ID NO: 644657 - protein, 26 aa, Mycobacterium
DFMPVVWAMFEWGRHHLPGRHRLRLT

SEQ ID NO: 644658 - protein, 20 aa, Mycobacterium
DFMSYLNLWRYLGEQRRALS

SEQ ID NO: 644659 - protein, 26 aa, Mycobacterium
DFNDDFIYRECIGSFVWTKPKTSAGT

SEQ ID NO: 644660 - protein, 26 aa, Mycobacterium
DFNMKTRAAVLWGLEQKWEVEEVDLD

SEQ ID NO: 644661 - protein, 19 aa, Mycobacterium
DFNTIRLAYSSEMLHTGAA

SEQ ID NO: 644662 - protein, 19 aa, Mycobacterium
DFPAGGLCWTGVGNVAANL

SEQ ID NO: 644663 - protein, 23 aa, Mycobacterium
DFPGASFPAAAWAPDFDPAGKRI

SEQ ID NO: 644664 - protein, 19 aa, Mycobacterium
DFPGIEGFTGTVVHPQHWP

SEQ ID NO: 644665 - protein, 29 aa, Mycobacterium
DFPIESFTPLFVMSRITGWTAHIMEQAAS

SEQ ID NO: 644666 - protein, 26 aa, Mycobacterium
DFPLSWEWTDAAGFGETVMAAGPAVN

SEQ ID NO: 644667 - protein, 23 aa, Mycobacterium
DFPPRPGGIQSYLGEFVGRLVEA

SEQ ID NO: 644668 - protein, 20 aa, Mycobacterium
DFPPRPGGIQSYLQEMVSRL

SEQ ID NO: 644669 - protein, 23 aa, Mycobacterium
DFPPRPGGIQSYLSDFVGRLVDA

SEQ ID NO: 644670 - protein, 18 aa, Mycobacterium
DFPRMLKLTQELFGSDDS

SEQ ID NO: 644671 - protein, 18 aa, Mycobacterium
DFPRMLKLTQEMFGGDDS

SEQ ID NO: 644672 - protein, 18 aa, Mycobacterium
DFPRMLRLTQELFGGDDE

SEQ ID NO: 644673 - protein, 20 aa, Mycobacterium
DFPSQKAWLLADFDTRIGTA

SEQ ID NO: 644674 - protein, 17 aa, Mycobacterium
DFPSWTLHVQIMPFEDA

SEQ ID NO: 644675 - protein, 20 aa, Mycobacterium
DFPTGPAYHLMGFDIGCFTP

SEQ ID NO: 644676 - protein, 20 aa, Mycobacterium
DFPTGPAYYLMGFDIPCFTP

SEQ ID NO: 644677 - protein, 19 aa, Mycobacterium
DFQFVDAFATALVEDKILA

SEQ ID NO: 644678 - protein, 26 aa, Mycobacterium
DFQIGFRGGHQWKGRDGLQVYLNQRD

SEQ ID NO: 644679 - protein, 18 aa, Mycobacterium
DFQWSAPSDPVFDTHVER

SEQ ID NO: 644680 - protein, 20 aa, Mycobacterium
DFRASVWGTGSFAVNDFLGW

SEQ ID NO: 644681 - protein, 18 aa, Mycobacterium
DFRDAMRIPINDAQLEED

SEQ ID NO: 644682 - protein, 17 aa, Mycobacterium
DFRDLLIREKVTVLFQT

SEQ ID NO: 644683 - protein, 23 aa, Mycobacterium
DFRFSERAKRLFARVPQTQRVLR

SEQ ID NO: 644684 - protein, 19 aa, Mycobacterium
DFRHTKFSAGRLVVEMDAR

SEQ ID NO: 644685 - protein, 20 aa, Mycobacterium
DFRISLVSPVTVRGGCGYEF

SEQ ID NO: 644686 - protein, 24 aa, Mycobacterium
DFRKRPGQPLAVMGNLTWIVDDEV

SEQ ID NO: 644687 - protein, 21 aa, Mycobacterium
DFRLERDGVLVSWAVPKNLPL

SEQ ID NO: 644688 - protein, 22 aa, Mycobacterium
DFRPGPDCRLGVLVDHLVAGSK

SEQ ID NO: 644689 - protein, 28 aa, Mycobacterium
DFRPSPSRLCNWCAHQAHCPSFGGTPPP

SEQ ID NO: 644690 - protein, 18 aa, Mycobacterium
DFRQEFNKDVVIDMICYR

SEQ ID NO: 644691 - protein, 23 aa, Mycobacterium
DFSCLPTDFSYVFHTAVDPGADD

SEQ ID NO: 644692 - protein, 23 aa, Mycobacterium
DFSGGRWNVPMVLRAGVGGWYAD

SEQ ID NO: 644693 - protein, 20 aa, Mycobacterium
DFSQLCVRRLQAVRSSDTEA

SEQ ID NO: 644694 - protein, 24 aa, Mycobacterium
DFSRAGVPGDGWPAYRHDERAVYV

SEQ ID NO: 644695 - protein, 19 aa, Mycobacterium
DFSSLIVSGDEAWNTINSY

SEQ ID NO: 644696 - protein, 24 aa, Mycobacterium
DFSVWEIFGALLGGGRLLVVPDEV

SEQ ID NO: 644697 - protein, 25 aa, Mycobacterium
DFSVWEIFGSLLYGGRLVIVPDNVV

SEQ ID NO: 644698 - protein, 25 aa, Mycobacterium
DFTAVKGDGRWRFSRWVVGIDQTQP

SEQ ID NO: 644699 - protein, 18 aa, Mycobacterium
DFTFFPRTVIHRLSPGSA

SEQ ID NO: 644700 - protein, 23 aa, Mycobacterium
DFTGVPCIVDLATMREAVGELGG

SEQ ID NO: 644701 - protein, 24 aa, Mycobacterium
DFTGVPCVVDLVAMRDAIADLGGD

SEQ ID NO: 644702 - protein, 23 aa, Mycobacterium
DFTLPAPRPRRILFVSGGSGITP

SEQ ID NO: 644703 - protein, 18 aa, Mycobacterium
DFVCGLLGCMAAGVIAVP

SEQ ID NO: 644704 - protein, 25 aa, Mycobacterium
DFVDAAQGLGGWFRLGRIANQQKAW

SEQ ID NO: 644705 - protein, 24 aa, Mycobacterium
DFVDAEPGWTMFMVSHFHYDPVWW

SEQ ID NO: 644706 - protein, 17 aa, Mycobacterium
DFVGWYNAHPHFREMAP

SEQ ID NO: 644707 - protein, 17 aa, Mycobacterium
DFVKPHLALYIGGMGAK

SEQ ID NO: 644708 - protein, 20 aa, Mycobacterium
DFVLDEGRRTYYFVWHAQRR

SEQ ID NO: 644709 - protein, 24 aa, Mycobacterium
DFVLKGGVLLAAYGVRRPTKDADA

SEQ ID NO: 644710 - protein, 28 aa, Mycobacterium
DFVPLDMPGVFDTGGWLQPNGIAVNLSN

SEQ ID NO: 644711 - protein, 18 aa, Mycobacterium
DFVSAITVLVEIGAGVEK

SEQ ID NO: 644712 - protein, 24 aa, Mycobacterium
DFVSHLFGMFAFAIVERDSGRVLL

SEQ ID NO: 644713 - protein, 29 aa, Mycobacterium
DFVVLLGGCALDFEIPELIADALAPYGIV

SEQ ID NO: 644714 - protein, 26 aa, Mycobacterium
DFWASYCRPCHAFAPTYERSAQAHPD

SEQ ID NO: 644715 - protein, 18 aa, Mycobacterium
DFWDEIFRELGIPYLPVR

SEQ ID NO: 644716 - protein, 21 aa, Mycobacterium
DFWSKVGIDPVQIMTGAGTFY

SEQ ID NO: 644717 - protein, 27 aa, Mycobacterium
DFWSRFLRNFWRNFWRIRDLKELLRED

SEQ ID NO: 644718 - protein, 17 aa, Mycobacterium
DFYHTGIIVPDLGAAMS

SEQ ID NO: 644719 - protein, 20 aa, Mycobacterium
DFYRCGMLPAGPDFDADNAP

SEQ ID NO: 644720 - protein, 22 aa, Mycobacterium
DGAAARRCAARGLPRRSRVLLI

SEQ ID NO: 644721 - protein, 17 aa, Mycobacterium
DGAACLMSPDGRALTGP

SEQ ID NO: 644722 - protein, 18 aa, Mycobacterium
DGAAELFAAEGACVLRPG

SEQ ID NO: 644723 - protein, 17 aa, Mycobacterium
DGAAELFAGEGACVLRP

SEQ ID NO: 644724 - protein, 17 aa, Mycobacterium
DGAAELFGGEGACVLRR

SEQ ID NO: 644725 - protein, 20 aa, Mycobacterium
DGAAFPWRTIRGEECSAYWP

SEQ ID NO: 644726 - protein, 17 aa, Mycobacterium
DGAAIIRPVLPQPDLED

SEQ ID NO: 644727 - protein, 17 aa, Mycobacterium
DGAAPQGTWLIGGFDEL

SEQ ID NO: 644728 - protein, 43 aa, Mycobacterium
DGAAPSGECGRGFGKGSVHGFDLTFCAPKSVSLLRAVRGDDVV

SEQ ID NO: 644729 - protein, 19 aa, Mycobacterium
DGAAVICKFHHALTDGVGG

SEQ ID NO: 644730 - protein, 24 aa, Mycobacterium
DGAAVLWRASFRFIGRDTEVEIDG

SEQ ID NO: 644731 - protein, 18 aa, Mycobacterium
DGAAWVALECGFVLRMPN

SEQ ID NO: 644732 - protein, 18 aa, Mycobacterium
DGACACADAVFTSSAELV

SEQ ID NO: 644733 - protein, 18 aa, Mycobacterium
DGACPIVASFGGRDPLGL

SEQ ID NO: 644734 - protein, 18 aa, Mycobacterium
DGACPIVASLGGRDPLGR

SEQ ID NO: 644735 - protein, 24 aa, Mycobacterium
DGADERACLVLADRGYPTAHRAAV

SEQ ID NO: 644736 - protein, 24 aa, Mycobacterium
DGADIGARCELLRGLRVWPGITIP

SEQ ID NO: 644737 - protein, 26 aa, Mycobacterium
DGADIRGYFVWSLLDNFEWAYGYAKR

SEQ ID NO: 644738 - protein, 17 aa, Mycobacterium
DGAEAQPAWAYSVIALR

SEQ ID NO: 644739 - protein, 17 aa, Mycobacterium
DGAEARDVWPLEDPHAL

SEQ ID NO: 644740 - protein, 24 aa, Mycobacterium
DGAEFARAAGFRELVASLVAFHTG

SEQ ID NO: 644741 - protein, 32 aa, Mycobacterium
DGAEGAGGNGGRGEVGGLPGNGGDGGNGALGG

SEQ ID NO: 644742 - protein, 18 aa, Mycobacterium
DGAEIDRLLMEFASGTTD

SEQ ID NO: 644743 - protein, 19 aa, Mycobacterium
DGAEVGFAVLDRLRAEMLH

SEQ ID NO: 644744 - protein, 17 aa, Mycobacterium
DGAFDLQTGPVFRLTLL

SEQ ID NO: 644745 - protein, 21 aa, Mycobacterium
DGAGCCDLAFATPDASRRIKG

SEQ ID NO: 644746 - protein, 20 aa, Mycobacterium
DGAGDLRGLLGRLDYLQWLG

SEQ ID NO: 644747 - protein, 20 aa, Mycobacterium
DGAGGLARCEVEHAGRDGLR

SEQ ID NO: 644748 - protein, 17 aa, Mycobacterium
DGAGGWALRVPETGVVD

SEQ ID NO: 644749 - protein, 25 aa, Mycobacterium
DGAHFECWTMLAAWAEQTSRIQIGA

SEQ ID NO: 644750 - protein, 25 aa, Mycobacterium
DGAHFECWTMLGAWAEQTSRIQIGA

SEQ ID NO: 644751 - protein, 26 aa, Mycobacterium
DGAHFECWTMLGAWAEQTSRIQIGAL

SEQ ID NO: 644752 - protein, 26 aa, Mycobacterium
DGAHFECWTMLGAWAEQTSRVEIGAL

SEQ ID NO: 644753 - protein, 18 aa, Mycobacterium
DGAHIAGIDFARALPVPS

SEQ ID NO: 644754 - protein, 18 aa, Mycobacterium
DGAHWYSTGCEFKRPTPA

SEQ ID NO: 644755 - protein, 26 aa, Mycobacterium
DGAHYECWTMLGAWAEQTSRIEIGAL

SEQ ID NO: 644756 - protein, 21 aa, Mycobacterium
DGAIPLQFLFSGTVFAKSERG

SEQ ID NO: 644757 - protein, 23 aa, Mycobacterium
DGALARIRLPGGMLSSAQLAALA

SEQ ID NO: 644758 - protein, 18 aa, Mycobacterium
DGALARRNLVLDTMIQNI

SEQ ID NO: 644759 - protein, 17 aa, Mycobacterium
DGALKIGFSQATQQSPF

SEQ ID NO: 644760 - protein, 38 aa, Mycobacterium
DGALLTRICDEWAARGWLAIRYNLPYRRRRPKGPPSGS

SEQ ID NO: 644761 - protein, 18 aa, Mycobacterium
DGALMRRAAYGLAAVIAD

SEQ ID NO: 644762 - protein, 20 aa, Mycobacterium
DGALRPGDIITVDVTGAAPH

SEQ ID NO: 644763 - protein, 19 aa, Mycobacterium
DGALVCTRAVYKHIAQRGG

SEQ ID NO: 644764 - protein, 18 aa, Mycobacterium
DGAMRLVLDVGGRQRSLA

SEQ ID NO: 644765 - protein, 23 aa, Mycobacterium
DGANRWPAIHTLDAAHLYRLALE

SEQ ID NO: 644766 - protein, 25 aa, Mycobacterium
DGAPALKPGRLFRSGELSGLDDDGR

SEQ ID NO: 644767 - protein, 24 aa, Mycobacterium
DGAPETKGPMLINARADKVTSSPA

SEQ ID NO: 644768 - protein, 24 aa, Mycobacterium
DGAPGLRLALALPPIEVAVTARLT

SEQ ID NO: 644769 - protein, 17 aa, Mycobacterium
DGAPLPFGVDDAVTNMA

SEQ ID NO: 644770 - protein, 19 aa, Mycobacterium
DGAPQRPAIPVFDGDHLTL

SEQ ID NO: 644771 - protein, 29 aa, Mycobacterium
DGAPRYPAAEVRQALTLPAHIPVINIDAR

SEQ ID NO: 644772 - protein, 23 aa, Mycobacterium
DGAPWASLVTYGLLGGAPVLCVS

SEQ ID NO: 644773 - protein, 25 aa, Mycobacterium
DGAQIDLRVCIVIKVGADGLITRVD

SEQ ID NO: 644774 - protein, 24 aa, Mycobacterium
DGAQLLVRKACWAMDSAKEDAGAL

SEQ ID NO: 644775 - protein, 17 aa, Mycobacterium
DGAQLWFVLDPRSPGSG

SEQ ID NO: 644776 - protein, 23 aa, Mycobacterium
DGAQSYRVTGRFVGPKPPQYLIF

SEQ ID NO: 644777 - protein, 20 aa, Mycobacterium
DGARAITLVVRFLQLQHRRA

SEQ ID NO: 644778 - protein, 26 aa, Mycobacterium
DGARDWNWSTGRYWKIANPSRRNELG

SEQ ID NO: 644779 - protein, 25 aa, Mycobacterium
DGARLARRGGIVVVTMNFRLGVLGS

SEQ ID NO: 644780 - protein, 22 aa, Mycobacterium
DGARLMAERGRLFGSLPEGGRM

SEQ ID NO: 644781 - protein, 23 aa, Mycobacterium
DGARRLRAYMFADGHLNTDVVGR

SEQ ID NO: 644782 - protein, 23 aa, Mycobacterium
DGARSALATLDWLDHHGYSHLVR

SEQ ID NO: 644783 - protein, 25 aa, Mycobacterium
DGARSGPRLNVRALLFGGEALSPQR

SEQ ID NO: 644784 - protein, 24 aa, Mycobacterium
DGARVGMAAPWWAAPYLTVCATAL

SEQ ID NO: 644785 - protein, 21 aa, Mycobacterium
DGARWIGLSAIRGDDRAATAL

SEQ ID NO: 644786 - protein, 17 aa, Mycobacterium
DGARWRVIVDQIASYTE

SEQ ID NO: 644787 - protein, 20 aa, Mycobacterium
DGASFPWRTIRGEECSAYWP

SEQ ID NO: 644788 - protein, 21 aa, Mycobacterium
DGASHHGMWDLALLTNVPGLR

SEQ ID NO: 644789 - protein, 27 aa, Mycobacterium
DGASRFRLGRGIACTEAAMSTPDMYGR

SEQ ID NO: 644790 - protein, 17 aa, Mycobacterium
DGATAWLVGEEGRGVPT

SEQ ID NO: 644791 - protein, 17 aa, Mycobacterium
DGATAWLVGEQGRGVPT

SEQ ID NO: 644792 - protein, 20 aa, Mycobacterium
DGATAWRAVVEHAETADDRA

SEQ ID NO: 644793 - protein, 24 aa, Mycobacterium
DGATAWRAVVEYADTAGDRAFAST

SEQ ID NO: 644794 - protein, 21 aa, Mycobacterium
DGATGVVEFMGGSATAGSAGN

SEQ ID NO: 644795 - protein, 26 aa, Mycobacterium
DGATGWFAGRVIRRFDVGDHVAHLLE

SEQ ID NO: 644796 - protein, 21 aa, Mycobacterium
DGAVHRIGFRPSLIPRSPVAG

SEQ ID NO: 644797 - protein, 20 aa, Mycobacterium
DGAVRFRLLSTMREYGNSRI

SEQ ID NO: 644798 - protein, 18 aa, Mycobacterium
DGAWLAEQAWFDVPLSQG

SEQ ID NO: 644799 - protein, 27 aa, Mycobacterium
DGAWRDPRVWWQLRNPFTPSWGEPYLE

SEQ ID NO: 644800 - protein, 20 aa, Mycobacterium
DGAWWPRSGQIASELPELIE

SEQ ID NO: 644801 - protein, 24 aa, Mycobacterium
DGAYSATIDPIWTIGPKVHSGCMM

SEQ ID NO: 644802 - protein, 20 aa, Mycobacterium
DGAYSPPTHLLVNGQPVGGD

SEQ ID NO: 644803 - protein, 18 aa, Mycobacterium
DGCMKLHRAGKVTNTHKG

SEQ ID NO: 644804 - protein, 19 aa, Mycobacterium
DGCPRGCGHMGPPADPGCA

SEQ ID NO: 644805 - protein, 20 aa, Mycobacterium
DGCVMPGFVEAHGHPLMEAV

SEQ ID NO: 644806 - protein, 19 aa, Mycobacterium
DGDAAARFLAAPAGEAVTR

SEQ ID NO: 644807 - protein, 21 aa, Mycobacterium
DGDAAEAHWRTHLDTARALML

SEQ ID NO: 644808 - protein, 17 aa, Mycobacterium
DGDAAWADEVRRLLKLR

SEQ ID NO: 644809 - protein, 18 aa, Mycobacterium
DGDAQWAAEIRRLAKLRG

SEQ ID NO: 644810 - protein, 23 aa, Mycobacterium
DGDDARLLFVVFGVEDVVWKASL

SEQ ID NO: 644811 - protein, 26 aa, Mycobacterium
DGDDPASEWARYALRAPVMLVNSPDA

SEQ ID NO: 644812 - protein, 19 aa, Mycobacterium
DGDELKSRISDSLQDAARA

SEQ ID NO: 644813 - protein, 18 aa, Mycobacterium
DGDEQWAAEVRRLVELRG

SEQ ID NO: 644814 - protein, 25 aa, Mycobacterium
DGDFRPELPAAWLTEALYGLIGGTA

SEQ ID NO: 644815 - protein, 24 aa, Mycobacterium
DGDGLWRLGPALTELAGHVNDSLL

SEQ ID NO: 644816 - protein, 18 aa, Mycobacterium
DGDGQIFLDFTKSNDVIG

SEQ ID NO: 644817 - protein, 23 aa, Mycobacterium
DGDGRLDAFGLDFDGDGLHDDAF

SEQ ID NO: 644818 - protein, 21 aa, Mycobacterium
DGDGVFRWLTVGPPGQDDVSI

SEQ ID NO: 644819 - protein, 22 aa, Mycobacterium
DGDHIMVVLALAMHEAGELSSR

SEQ ID NO: 644820 - protein, 33 aa, Mycobacterium
DGDHVPGLAAFIRKHAGGSWADRDWLNRHNLDR

SEQ ID NO: 644821 - protein, 20 aa, Mycobacterium
DGDILGWSWLVPPYHWRFDA

SEQ ID NO: 644822 - protein, 25 aa, Mycobacterium
DGDIVVDPPDRWIEPEEHQTLDEQL

SEQ ID NO: 644823 - protein, 20 aa, Mycobacterium
DGDLDGWLRYPEAVADLPDT

SEQ ID NO: 644824 - protein, 25 aa, Mycobacterium
DGDLFRPTPCPEYDVSGLTGHLLNS

SEQ ID NO: 644825 - protein, 20 aa, Mycobacterium
DGDLLCFVHRGSGMAETEFG

SEQ ID NO: 644826 - protein, 23 aa, Mycobacterium
DGDLPPRYPIVGGHEGSGVIEEV

SEQ ID NO: 644827 - protein, 25 aa, Mycobacterium
DGDLRNDIAFSFVFSEPVDGRQLVD

SEQ ID NO: 644828 - protein, 24 aa, Mycobacterium
DGDPVGFDGSDRLIAVELEALRHI

SEQ ID NO: 644829 - protein, 25 aa, Mycobacterium
DGDPVPGFSRRRLLTTGAVSAALGA

SEQ ID NO: 644830 - protein, 23 aa, Mycobacterium
DGDREPVEGWGLYEHGALGRHDP

SEQ ID NO: 644831 - protein, 35 aa, Mycobacterium
DGDRFLRSREPWVWGPRMLVGLDISASATLGILGY

SEQ ID NO: 644832 - protein, 32 aa, Mycobacterium
DGDRIFRWQLAAAVRPTLFVFTSIGRLGHDRD

SEQ ID NO: 644833 - protein, 28 aa, Mycobacterium
DGDRSACIKAMIEKVVERMYAEIDDNRF

SEQ ID NO: 644834 - protein, 24 aa, Mycobacterium
DGDRVRVPAAWRVLGVQTTGAGDM

SEQ ID NO: 644835 - protein, 18 aa, Mycobacterium
DGDSCALGAVKTNIGHLE

SEQ ID NO: 644836 - protein, 19 aa, Mycobacterium
DGDTDPVEGWGLYEHGALG

SEQ ID NO: 644837 - protein, 19 aa, Mycobacterium
DGDTFAIKEWAPFERVTTH

SEQ ID NO: 644838 - protein, 17 aa, Mycobacterium
DGDVTGLVRSHLKATLK

SEQ ID NO: 644839 - protein, 19 aa, Mycobacterium
DGDVVAWVRDLEYGRLKLP

SEQ ID NO: 644840 - protein, 29 aa, Mycobacterium
DGDWPSFPLPLGDTWASCKGDLLTVEVLD

SEQ ID NO: 644841 - protein, 22 aa, Mycobacterium
DGDYLTGGWLVLRRGKRNIAGV

SEQ ID NO: 644842 - protein, 23 aa, Mycobacterium
DGEAGCTDSVFTIKVPEDEWEDK

SEQ ID NO: 644843 - protein, 19 aa, Mycobacterium
DGEAGGFIHPISPSLPVMV

SEQ ID NO: 644844 - protein, 17 aa, Mycobacterium
DGEAVFAVSPLRYPDTT

SEQ ID NO: 644845 - protein, 23 aa, Mycobacterium
DGEAWQLTADRFFAPAFDLAQPR

SEQ ID NO: 644846 - protein, 29 aa, Mycobacterium
DGEAYRRPWRACDPIVLFSALSQVTEHIG

SEQ ID NO: 644847 - protein, 21 aa, Mycobacterium
DGEFDEWQRLFLFSRADTIYG

SEQ ID NO: 644848 - protein, 20 aa, Mycobacterium
DGEFDEWQRLFLFTRADTIY

SEQ ID NO: 644849 - protein, 21 aa, Mycobacterium
DGEFDEWQRLFLFTRADTIYG

SEQ ID NO: 644850 - protein, 25 aa, Mycobacterium
DGEFVKFGPSWAWPKPVQPHIPILV

SEQ ID NO: 644851 - protein, 23 aa, Mycobacterium
DGEFWMLTNMGAFWNSMDYLYRP

SEQ ID NO: 644852 - protein, 20 aa, Mycobacterium
DGEGAAELFAGEGACVLQRD

SEQ ID NO: 644853 - protein, 18 aa, Mycobacterium
DGEGCSRFVVTDVTKDGT

SEQ ID NO: 644854 - protein, 24 aa, Mycobacterium
DGEGFKFMEVCGGHTHTIYRHGIE

SEQ ID NO: 644855 - protein, 17 aa, Mycobacterium
DGEGIGLTTVYRTLQSM

SEQ ID NO: 644856 - protein, 25 aa, Mycobacterium
DGEHVLPFISIRVWQPISENETEVL

SEQ ID NO: 644857 - protein, 17 aa, Mycobacterium
DGEICVIDFATPPAELS

SEQ ID NO: 644858 - protein, 27 aa, Mycobacterium
DGEITFCGAIEMGGFIDLRVDVIPGGM

SEQ ID NO: 644859 - protein, 20 aa, Mycobacterium
DGEKPCPNRDFGCQIEGVAR

SEQ ID NO: 644860 - protein, 25 aa, Mycobacterium
DGELLAIGSQPGWRVDVADTTVTVS

SEQ ID NO: 644861 - protein, 18 aa, Mycobacterium
DGELLWWSAMLVNKTLAK

SEQ ID NO: 644862 - protein, 21 aa, Mycobacterium
DGELSLAGWTKRLTGLPAVAV

SEQ ID NO: 644863 - protein, 24 aa, Mycobacterium
DGELWPVNGTAFAVTPALREAYSA

SEQ ID NO: 644864 - protein, 30 aa, Mycobacterium
DGELWRVDFAWPDLRLAAEYDSIDWHAGRV

SEQ ID NO: 644865 - protein, 26 aa, Mycobacterium
DGELWRVDFAWPEMRLAAEYESVEWH

SEQ ID NO: 644866 - protein, 24 aa, Mycobacterium
DGEPFWFPNWTRLVYAGNGLFSSE

SEQ ID NO: 644867 - protein, 21 aa, Mycobacterium
DGEPLLAAPFYPVTPHQWDRR

SEQ ID NO: 644868 - protein, 18 aa, Mycobacterium
DGEPYGVFTPGYVPAEKV

SEQ ID NO: 644869 - protein, 25 aa, Mycobacterium
DGERHKFFAGCLGIFGHGNVAGIGQ

SEQ ID NO: 644870 - protein, 25 aa, Mycobacterium
DGERRPGWVGLPLAGVQTRLLDDAG

SEQ ID NO: 644871 - protein, 25 aa, Mycobacterium
DGERRPGWVGLPLAGVQTRVLDDDG

SEQ ID NO: 644872 - protein, 18 aa, Mycobacterium
DGERWCVALSGGPDSLAL

SEQ ID NO: 644873 - protein, 30 aa, Mycobacterium
DGESALMLASRLQPLWLVRGRISEGRSWFD

SEQ ID NO: 644874 - protein, 21 aa, Mycobacterium
DGESCKGVVGLLTRTYYDYSG

SEQ ID NO: 644875 - protein, 18 aa, Mycobacterium
DGESLWWALVGRNKRDIS

SEQ ID NO: 644876 - protein, 25 aa, Mycobacterium
DGEVAYRLGRSVARLEAALSTPEMF

SEQ ID NO: 644877 - protein, 22 aa, Mycobacterium
DGEVRQQFSLLFTTTVLGGTLA

SEQ ID NO: 644878 - protein, 26 aa, Mycobacterium
DGEVTRWCVTYGVTLPDTYEVTTGRG

SEQ ID NO: 644879 - protein, 23 aa, Mycobacterium
DGEWEAAVGYSRAVRVGAHIAVA

SEQ ID NO: 644880 - protein, 21 aa, Mycobacterium
DGFAKLLAMRDLRYVVRLRRL

SEQ ID NO: 644881 - protein, 18 aa, Mycobacterium
DGFAMPFAEVAGVIGASE

SEQ ID NO: 644882 - protein, 25 aa, Mycobacterium
DGFARSDFYLGAAFEGPPGHVHGGV

SEQ ID NO: 644883 - protein, 22 aa, Mycobacterium
DGFASAPGHGRCEVICFSGNHT

SEQ ID NO: 644884 - protein, 20 aa, Mycobacterium
DGFCSASLLVDHPACRRAVS

SEQ ID NO: 644885 - protein, 20 aa, Mycobacterium
DGFCSASLLVDHPSCRRAVT

SEQ ID NO: 644886 - protein, 19 aa, Mycobacterium
DGFCSASLMVDHPACRRAV

SEQ ID NO: 644887 - protein, 24 aa, Mycobacterium
DGFFSRPGLLRVATRRPLASSDSR

SEQ ID NO: 644888 - protein, 17 aa, Mycobacterium
DGFGLTFSVAGGIDPTV

SEQ ID NO: 644889 - protein, 17 aa, Mycobacterium
DGFLDRLAAHLVGVTDP

SEQ ID NO: 644890 - protein, 19 aa, Mycobacterium
DGFLYLDCLIGRYARSAKR

SEQ ID NO: 644891 - protein, 23 aa, Mycobacterium
DGFMTRDEVVDWLAGWLDTFDPP

SEQ ID NO: 644892 - protein, 22 aa, Mycobacterium
DGFPEAMPFLIWGYGATRDGSP

SEQ ID NO: 644893 - protein, 21 aa, Mycobacterium
DGFQRRACEALAQGHGVLVCA

SEQ ID NO: 644894 - protein, 17 aa, Mycobacterium
DGFRCDRGFQVLNPAYP

SEQ ID NO: 644895 - protein, 19 aa, Mycobacterium
DGFSSLWYASGVAGDPLTA

SEQ ID NO: 644896 - protein, 24 aa, Mycobacterium
DGFVFGEAGAMMIIETEEHAKARG

SEQ ID NO: 644897 - protein, 20 aa, Mycobacterium
DGFVFGEAGAMMLIETEEHA

SEQ ID NO: 644898 - protein, 20 aa, Mycobacterium
DGFVSAPGDGRCEVICFSSD

SEQ ID NO: 644899 - protein, 20 aa, Mycobacterium
DGGAALWPLLTPIMRSREFL

SEQ ID NO: 644900 - protein, 20 aa, Mycobacterium
DGGAEGFSGTGIVITGSVVT

SEQ ID NO: 644901 - protein, 33 aa, Mycobacterium
DGGAELRAAFADRILPALHAFSPELIIVSAGFD

SEQ ID NO: 644902 - protein, 26 aa, Mycobacterium
DGGAGGRAGLVIGNGGAGGAGGESFG

SEQ ID NO: 644903 - protein, 27 aa, Mycobacterium
DGGAGGRGGLLFGVGGAGGAGGDGLDG

SEQ ID NO: 644904 - protein, 20 aa, Mycobacterium
DGGAGLSVGAHGATGNVVAN

SEQ ID NO: 644905 - protein, 22 aa, Mycobacterium
DGGAHYGMICDASFPTYMLTHW

SEQ ID NO: 644906 - protein, 24 aa, Mycobacterium
DGGALSDEAIDWVIDAYTRGEVAE

SEQ ID NO: 644907 - protein, 22 aa, Mycobacterium
DGGASWPLYPLKAHHTYVNIGF

SEQ ID NO: 644908 - protein, 25 aa, Mycobacterium
DGGDGASGVGLGKAGGTGATGGNGG

SEQ ID NO: 644909 - protein, 20 aa, Mycobacterium
DGGEALVEFAGRACYQSWSK

SEQ ID NO: 644910 - protein, 21 aa, Mycobacterium
DGGELLEWAEIHGGLHRSGTL

SEQ ID NO: 644911 - protein, 24 aa, Mycobacterium
DGGFGGHGPGVWDHSVADTHTVED

SEQ ID NO: 644912 - protein, 18 aa, Mycobacterium
DGGFKYNPPHGGPADTAV

SEQ ID NO: 644913 - protein, 18 aa, Mycobacterium
DGGFKYNPPHGGPADTDA

SEQ ID NO: 644914 - protein, 18 aa, Mycobacterium
DGGFKYNPPNGGPADTDA

SEQ ID NO: 644915 - protein, 17 aa, Mycobacterium
DGGFLFSAQELETATRL

SEQ ID NO: 644916 - protein, 17 aa, Mycobacterium
DGGGAIFYSVVARDSLD

SEQ ID NO: 644917 - protein, 19 aa, Mycobacterium
DGGGAMLIGNGGNGGNGAA

SEQ ID NO: 644918 - protein, 22 aa, Mycobacterium
DGGGDMARWVHQLEYERFGLPH

SEQ ID NO: 644919 - protein, 19 aa, Mycobacterium
DGGGFCPAGVRCERAELRG

SEQ ID NO: 644920 - protein, 28 aa, Mycobacterium
DGGGGGKSGWLGLAGALGGGGTGGSGGA

SEQ ID NO: 644921 - protein, 28 aa, Mycobacterium
DGGGPTFIECVTFRFRGHYFGDRTPYIP

SEQ ID NO: 644922 - protein, 17 aa, Mycobacterium
DGGGVLLIIDVDALLPA

SEQ ID NO: 644923 - protein, 25 aa, Mycobacterium
DGGIPWRLPEDLAHFKRLTMGHTVV

SEQ ID NO: 644924 - protein, 24 aa, Mycobacterium
DGGKIRRLTIVFADLVDSTVLSTR

SEQ ID NO: 644925 - protein, 19 aa, Mycobacterium
DGGLACWTTALLHPRLVRA

SEQ ID NO: 644926 - protein, 19 aa, Mycobacterium
DGGLACWTTALLHSRLVRS

SEQ ID NO: 644927 - protein, 18 aa, Mycobacterium
DGGLFAGVTARYLALVAT

SEQ ID NO: 644928 - protein, 22 aa, Mycobacterium
DGGLFNGILARYLALVATALPG

SEQ ID NO: 644929 - protein, 22 aa, Mycobacterium
DGGLFNGILARYLALVATTLPG

SEQ ID NO: 644930 - protein, 22 aa, Mycobacterium
DGGLFNGILARYLALVVTLLPQ

SEQ ID NO: 644931 - protein, 20 aa, Mycobacterium
DGGLGAWRRAGGHLQTGAVH

SEQ ID NO: 644932 - protein, 18 aa, Mycobacterium
DGGLLCGNGGAGYTSTIA

SEQ ID NO: 644933 - protein, 22 aa, Mycobacterium
DGGLQPRPAPRFSRTAPETPRP

SEQ ID NO: 644934 - protein, 18 aa, Mycobacterium
DGGLWRRSAVTLRAARAG

SEQ ID NO: 644935 - protein, 23 aa, Mycobacterium
DGGNAGALFGIGAGGHGGNAGSG

SEQ ID NO: 644936 - protein, 20 aa, Mycobacterium
DGGNAGFAIGGSDGTATGQQ

SEQ ID NO: 644937 - protein, 18 aa, Mycobacterium
DGGNARIIGNGGNGGNGG

SEQ ID NO: 644938 - protein, 24 aa, Mycobacterium
DGGNATDLMFANGGNGGNGGTGGE

SEQ ID NO: 644939 - protein, 22 aa, Mycobacterium
DGGNGGGLFNIGRGGDGGNGGN

SEQ ID NO: 644940 - protein, 25 aa, Mycobacterium
DGGNGGRAGLFGGAGGAGGMGATGG

SEQ ID NO: 644941 - protein, 31 aa, Mycobacterium
DGGNPYQLSWWINRFTEIFQTIARDLEEFPE

SEQ ID NO: 644942 - protein, 26 aa, Mycobacterium
DGGPAALRRAVGWYRRHDRLHIGDQV

SEQ ID NO: 644943 - protein, 25 aa, Mycobacterium
DGGPAPVRRAVAWYRAQDRLHAGDP

SEQ ID NO: 644944 - protein, 17 aa, Mycobacterium
DGGPVVFVAPYWVGDPD

SEQ ID NO: 644945 - protein, 19 aa, Mycobacterium
DGGPWRFARTWLANLRHPA

SEQ ID NO: 644946 - protein, 17 aa, Mycobacterium
DGGPYMCDPPPTTRQLV

SEQ ID NO: 644947 - protein, 18 aa, Mycobacterium
DGGRFALQISGGRARCTT

SEQ ID NO: 644948 - protein, 20 aa, Mycobacterium
DGGRFDPMFAAAGLSTDLVP

SEQ ID NO: 644949 - protein, 21 aa, Mycobacterium
DGGRIPLGRYIRPRVEVELAF

SEQ ID NO: 644950 - protein, 18 aa, Mycobacterium
DGGRLAGQIEQTFLRRVQ

SEQ ID NO: 644951 - protein, 17 aa, Mycobacterium
DGGRLGLRLYRGGSGST

SEQ ID NO: 644952 - protein, 25 aa, Mycobacterium
DGGRLSDAAIAWVIDAYTHGRVAEE

SEQ ID NO: 644953 - protein, 24 aa, Mycobacterium
DGGRLSDAAIDWVIDAYTEGRVAP

SEQ ID NO: 644954 - protein, 24 aa, Mycobacterium
DGGRVPFRRVHLTTGDHLDLYDTS

SEQ ID NO: 644955 - protein, 18 aa, Mycobacterium
DGGSALLIGDGGNGGNGG

SEQ ID NO: 644956 - protein, 20 aa, Mycobacterium
DGGSARLLGRDPWAEAVQLH

SEQ ID NO: 644957 - protein, 30 aa, Mycobacterium
DGGSAVIMPGISGADGRLGDAGADGVAGLS

SEQ ID NO: 644958 - protein, 19 aa, Mycobacterium
DGGTFDWTQGRFPGFTTPD

SEQ ID NO: 644959 - protein, 17 aa, Mycobacterium
DGGTFVISWEFDLANGR

SEQ ID NO: 644960 - protein, 24 aa, Mycobacterium
DGGTGGRGGWLCGDGGSGGSGGHG

SEQ ID NO: 644961 - protein, 20 aa, Mycobacterium
DGGTIAAQFARDENIKRVAV

SEQ ID NO: 644962 - protein, 23 aa, Mycobacterium
DGGTRARIIAVSPLIREMMIYGL

SEQ ID NO: 644963 - protein, 21 aa, Mycobacterium
DGGTWFLQRAIGYERAAEMTF

SEQ ID NO: 644964 - protein, 21 aa, Mycobacterium
DGGTWFLQRAIGYERAAEMTL

SEQ ID NO: 644965 - protein, 20 aa, Mycobacterium
DGGVDAELKIFARVDSLVTQ

SEQ ID NO: 644966 - protein, 18 aa, Mycobacterium
DGGWKINGQKVWTSGAQY

SEQ ID NO: 644967 - protein, 21 aa, Mycobacterium
DGGYLASSWAVYRAELALVEV

SEQ ID NO: 644968 - protein, 33 aa, Mycobacterium
DGGYLASSWAVYRAELALVEVARKTGIRLRLFH

SEQ ID NO: 644969 - protein, 33 aa, Mycobacterium
DGGYLVSGAWQWSSGCDHATWAFLGGPVIKDGK

SEQ ID NO: 644970 - protein, 17 aa, Mycobacterium
DGGYRITGSKAWITHGG

SEQ ID NO: 644971 - protein, 27 aa, Mycobacterium
DGGYRTNEILRWLFTPDESLTITRDGS

SEQ ID NO: 644972 - protein, 25 aa, Mycobacterium
DGHCYGVGLINWWDPRGARRTLTEL

SEQ ID NO: 644973 - protein, 23 aa, Mycobacterium
DGHDRVRWVPGRVLKGVAYDTPI

SEQ ID NO: 644974 - protein, 18 aa, Mycobacterium
DGHFPGLYLLITGTPAFF

SEQ ID NO: 644975 - protein, 22 aa, Mycobacterium
DGHGRITLYHGWESGMDNSPRW

SEQ ID NO: 644976 - protein, 24 aa, Mycobacterium
DGHIAGAIKLDWRTDLQDPIKRDF

SEQ ID NO: 644977 - protein, 23 aa, Mycobacterium
DGHIPGAIKLDWRTDLQDPVKRD

SEQ ID NO: 644978 - protein, 20 aa, Mycobacterium
DGHPLMFAAQAWNYMFPLTD

SEQ ID NO: 644979 - protein, 18 aa, Mycobacterium
DGHPRGAVVLTHGAGGSC

SEQ ID NO: 644980 - protein, 17 aa, Mycobacterium
DGHPSVFDREWPLRVGD

SEQ ID NO: 644981 - protein, 22 aa, Mycobacterium
DGHPWRRRRRIALTDLAGVPLI

SEQ ID NO: 644982 - protein, 24 aa, Mycobacterium
DGHPYLVMPYCRRGSVQTEISRLG

SEQ ID NO: 644983 - protein, 29 aa, Mycobacterium
DGHRNGGVVLLMWAGILAYLDRYGYDYVT

SEQ ID NO: 644984 - protein, 17 aa, Mycobacterium
DGHRVRVAECEVVQDGR

SEQ ID NO: 644985 - protein, 25 aa, Mycobacterium
DGHSPLIIRRTYRAAHNIGHFRFVE

SEQ ID NO: 644986 - protein, 21 aa, Mycobacterium
DGHSYLRTGDLGFLHDGELYV

SEQ ID NO: 644987 - protein, 18 aa, Mycobacterium
DGHTGMWMAPLQVTRTWA

SEQ ID NO: 644988 - protein, 26 aa, Mycobacterium
DGHVRSRIVPWFGPGAVITTPRHHVD

SEQ ID NO: 644989 - protein, 24 aa, Mycobacterium
DGHWYTARLRPGPLRAAERRTTVV

SEQ ID NO: 644990 - protein, 17 aa, Mycobacterium
DGIAALELMDSRLGVPS

SEQ ID NO: 644991 - protein, 19 aa, Mycobacterium
DGIAFAGVAKYPARVKCAL

SEQ ID NO: 644992 - protein, 18 aa, Mycobacterium
DGIAFAGVSKYPARVKCA

SEQ ID NO: 644993 - protein, 19 aa, Mycobacterium
DGIAFAGVSRYPARVKCAL

SEQ ID NO: 644994 - protein, 17 aa, Mycobacterium
DGICVHDPLIMRRALEY

SEQ ID NO: 644995 - protein, 26 aa, Mycobacterium
DGIDLKTCGVVAVGHRVVHGGNAFYE

SEQ ID NO: 644996 - protein, 17 aa, Mycobacterium
DGIDRFWAQVLADNEAV

SEQ ID NO: 644997 - protein, 18 aa, Mycobacterium
DGIFDWNQSLFGYPFGDP

SEQ ID NO: 644998 - protein, 26 aa, Mycobacterium
DGIGAAAARRLCRTGDQIVVVGRTPT

SEQ ID NO: 644999 - protein, 19 aa, Mycobacterium
DGIGCMFRASPNMTPTSRQ

SEQ ID NO: 645000 - protein, 22 aa, Mycobacterium
DGIGCSCHGSAFDLETGEPICP

SEQ ID NO: 645001 - protein, 24 aa, Mycobacterium
DGIGGACVLFDCVPSKTFIASTGV

SEQ ID NO: 645002 - protein, 24 aa, Mycobacterium
DGIGLDEYIDWLIEAGYSIERIAD

SEQ ID NO: 645003 - protein, 17 aa, Mycobacterium
DGIGYPVELVIGPETVV

SEQ ID NO: 645004 - protein, 19 aa, Mycobacterium
DGIIECREALAFPGDPDRV

SEQ ID NO: 645005 - protein, 20 aa, Mycobacterium
DGILKFGDLRLHPASFTASL

SEQ ID NO: 645006 - protein, 20 aa, Mycobacterium
DGILTVSGWYGKQFDDVDHV

SEQ ID NO: 645007 - protein, 30 aa, Mycobacterium
DGIPFKWWEKLGIIPPGWVARDAVRTVRNR

SEQ ID NO: 645008 - protein, 19 aa, Mycobacterium
DGIPNLAPFSFFTVVSSQP

SEQ ID NO: 645009 - protein, 22 aa, Mycobacterium
DGIPRARLDQVAAIALRAWPQR

SEQ ID NO: 645010 - protein, 26 aa, Mycobacterium
DGIPRIGCTLPEVFDNARAGDRIFFD

SEQ ID NO: 645011 - protein, 17 aa, Mycobacterium
DGIPVLLVDEARDVDDD

SEQ ID NO: 645012 - protein, 20 aa, Mycobacterium
DGIRLGDYDIGIAVGLDKHP

SEQ ID NO: 645013 - protein, 17 aa, Mycobacterium
DGIRLGQWVNAQRHTHR

SEQ ID NO: 645014 - protein, 20 aa, Mycobacterium
DGISEFLERIATQAGRDDAD

SEQ ID NO: 645015 - protein, 23 aa, Mycobacterium
DGISLDVFVDWLIADGHDVTRID

SEQ ID NO: 645016 - protein, 29 aa, Mycobacterium
DGISLDVFVDWLIRAGHPIDRVDDYDDWV

SEQ ID NO: 645017 - protein, 18 aa, Mycobacterium
DGITFFPFRRVFVVAQIR

SEQ ID NO: 645018 - protein, 17 aa, Mycobacterium
DGITLEFACWVKEFTES

SEQ ID NO: 645019 - protein, 21 aa, Mycobacterium
DGIWFPEHHGTPYGMTPNPIQ

SEQ ID NO: 645020 - protein, 33 aa, Mycobacterium
DGKCVHDPLVMRRALEYAKGLGVLIAQHAEEPR

SEQ ID NO: 645021 - protein, 25 aa, Mycobacterium
DGKDAGDLCGMPATGVIATRDIGAA

SEQ ID NO: 645022 - protein, 25 aa, Mycobacterium
DGKLHKHWGFGGGPHRCLGSHLARM

SEQ ID NO: 645023 - protein, 25 aa, Mycobacterium
DGKLYLCAIKDAFSNRIVGYSIDSR

SEQ ID NO: 645024 - protein, 23 aa, Mycobacterium
DGKNLIHWRGWTHAYRGTIPKLS

SEQ ID NO: 645025 - protein, 20 aa, Mycobacterium
DGKPGPATRIVFDLDPGEGV

SEQ ID NO: 645026 - protein, 19 aa, Mycobacterium
DGKPGVAILLTYGPDRDWL

SEQ ID NO: 645027 - protein, 25 aa, Mycobacterium
DGKPKLRVVDTIDIGSAVRDVAVSP

SEQ ID NO: 645028 - protein, 19 aa, Mycobacterium
DGKPMVIPMAYARDGEFLL

SEQ ID NO: 645029 - protein, 25 aa, Mycobacterium
DGKPWGSRFPRISIRDQVEADIAAL

SEQ ID NO: 645030 - protein, 24 aa, Mycobacterium
DGKRFMFDYIPPVFKGQYAETEQE

SEQ ID NO: 645031 - protein, 18 aa, Mycobacterium
DGKRRWEAFTDWPDPWVM

SEQ ID NO: 645032 - protein, 22 aa, Mycobacterium
DGKRSYAAAVHRATRPGATLLI

SEQ ID NO: 645033 - protein, 24 aa, Mycobacterium
DGKRTELWPGLRETFKTRNGADPA

SEQ ID NO: 645034 - protein, 22 aa, Mycobacterium
DGKRYLDCLAAYSAVNFGHGNP

SEQ ID NO: 645035 - protein, 27 aa, Mycobacterium
DGKVSLCVLDERWPFAYLQVYADAAVE

SEQ ID NO: 645036 - protein, 27 aa, Mycobacterium
DGKVSLCVLDERWPFTYLQVYADAMLD

SEQ ID NO: 645037 - protein, 25 aa, Mycobacterium
DGLAAELFAAASAFGAVTSGLAGGS

SEQ ID NO: 645038 - protein, 17 aa, Mycobacterium
DGLAAFVDHVVPVLQER

SEQ ID NO: 645039 - protein, 24 aa, Mycobacterium
DGLAALPARTAVRWRHTHDFEDLG

SEQ ID NO: 645040 - protein, 28 aa, Mycobacterium
DGLAAVLPCYWIYAEVGAALAERGSADP

SEQ ID NO: 645041 - protein, 27 aa, Mycobacterium
DGLACVVLRVARFFAEFDDMPDDYDGR

SEQ ID NO: 645042 - protein, 18 aa, Mycobacterium
DGLACVWVGIPAARFEAS

SEQ ID NO: 645043 - protein, 20 aa, Mycobacterium
DGLADMRWAPGSAVHVVLDG

SEQ ID NO: 645044 - protein, 18 aa, Mycobacterium
DGLAMRHGKELTWSQVVM

SEQ ID NO: 645045 - protein, 26 aa, Mycobacterium
DGLATLPARMALRWRHTHEFVDIGDD

SEQ ID NO: 645046 - protein, 20 aa, Mycobacterium
DGLDALPRVVERTVGGRAVR

SEQ ID NO: 645047 - protein, 24 aa, Mycobacterium
DGLDGWKSAGGRVYTGTNVRSKTL

SEQ ID NO: 645048 - protein, 19 aa, Mycobacterium
DGLDQYVFFLADSEHPNYR

SEQ ID NO: 645049 - protein, 24 aa, Mycobacterium
DGLDRFRQGGVRKIWVYRALDDGH

SEQ ID NO: 645050 - protein, 23 aa, Mycobacterium
DGLDRNKMRVVPGVTSKAMSAAS

SEQ ID NO: 645051 - protein, 25 aa, Mycobacterium
DGLDRVRPFRAFQVNEDLLALADSE

SEQ ID NO: 645052 - protein, 29 aa, Mycobacterium
DGLEKCIGCELCAWACPADAIFVESADNT

SEQ ID NO: 645053 - protein, 28 aa, Mycobacterium
DGLEKCIGCELCAWACPADAIYVEGADN

SEQ ID NO: 645054 - protein, 19 aa, Mycobacterium
DGLELNSWLYWPHTEPIGA

SEQ ID NO: 645055 - protein, 19 aa, Mycobacterium
DGLERLMGWVPGVSGTRTE

SEQ ID NO: 645056 - protein, 17 aa, Mycobacterium
DGLEVLSQAGVRAVVHP

SEQ ID NO: 645057 - protein, 18 aa, Mycobacterium
DGLFKRSTSWDVIVENTD

SEQ ID NO: 645058 - protein, 20 aa, Mycobacterium
DGLFPRLGVVDGDDALARRP

SEQ ID NO: 645059 - protein, 17 aa, Mycobacterium
DGLFVGRPMWLPLDDAG

SEQ ID NO: 645060 - protein, 17 aa, Mycobacterium
DGLGCAILGVPAVDLVE

SEQ ID NO: 645061 - protein, 18 aa, Mycobacterium
DGLGDGYSADALRTVLDV

SEQ ID NO: 645062 - protein, 20 aa, Mycobacterium
DGLGGACVLYDCVPSKTFIA

SEQ ID NO: 645063 - protein, 20 aa, Mycobacterium
DGLGGSSCCYGFGAHTDLQW

SEQ ID NO: 645064 - protein, 19 aa, Mycobacterium
DGLGLPADRVRPAYEDPLT

SEQ ID NO: 645065 - protein, 18 aa, Mycobacterium
DGLHALVITGGYDIDPAA

SEQ ID NO: 645066 - protein, 28 aa, Mycobacterium
DGLIDFVFAEVWTRPGLSRRDRRFVTLA

SEQ ID NO: 645067 - protein, 17 aa, Mycobacterium
DGLKAALGESLRHAGRL

SEQ ID NO: 645068 - protein, 31 aa, Mycobacterium
DGLKGVHRVPLARAMRSVHRHDYLNAYVDDL

SEQ ID NO: 645069 - protein, 17 aa, Mycobacterium
DGLKRVNDGIGHDAGDS

SEQ ID NO: 645070 - protein, 17 aa, Mycobacterium
DGLLARMQSSECHIELL

SEQ ID NO: 645071 - protein, 17 aa, Mycobacterium
DGLLHDWAREMLSTTQA

SEQ ID NO: 645072 - protein, 24 aa, Mycobacterium
DGLLNRLDLAFSRDQKARVYVQHK

SEQ ID NO: 645073 - protein, 24 aa, Mycobacterium
DGLLPRFGNSYVRDTVARLCADSS

SEQ ID NO: 645074 - protein, 20 aa, Mycobacterium
DGLLREIRLVRALSGTDVPH

SEQ ID NO: 645075 - protein, 23 aa, Mycobacterium
DGLLRKRPAGYFPAPGVDPHPAV

SEQ ID NO: 645076 - protein, 25 aa, Mycobacterium
DGLLRKRPGGYFAAPGLNPYAAVDI

SEQ ID NO: 645077 - protein, 24 aa, Mycobacterium
DGLLRRRPSGFFPAPGLDPHPAVD

SEQ ID NO: 645078 - protein, 18 aa, Mycobacterium
DGLLVMPFGSKRFLHEVT

SEQ ID NO: 645079 - protein, 21 aa, Mycobacterium
DGLPAYGACAGMILLASEILD

SEQ ID NO: 645080 - protein, 19 aa, Mycobacterium
DGLPCRTEAAGRPRPPSAP

SEQ ID NO: 645081 - protein, 30 aa, Mycobacterium
DGLPEPEWQAASPLPGWDVKALVAHMIGTE

SEQ ID NO: 645082 - protein, 21 aa, Mycobacterium
DGLPHRPGIYLFRGPSGEVLY

SEQ ID NO: 645083 - protein, 19 aa, Mycobacterium
DGLPIGVMFSGRRGSERTL

SEQ ID NO: 645084 - protein, 17 aa, Mycobacterium
DGLPLDPAVAMRETLTA

SEQ ID NO: 645085 - protein, 21 aa, Mycobacterium
DGLPNRPGVYLFRGPSDEVLY

SEQ ID NO: 645086 - protein, 25 aa, Mycobacterium
DGLPNYQRLFSLRVGQTVREQFEAD

SEQ ID NO: 645087 - protein, 30 aa, Mycobacterium
DGLPVAHLTYLSWRGLVQMEPPRRPEPDRP

SEQ ID NO: 645088 - protein, 17 aa, Mycobacterium
DGLPVLFDSGIRGGADI

SEQ ID NO: 645089 - protein, 17 aa, Mycobacterium
DGLPWTWETFPDYLNAL

SEQ ID NO: 645090 - protein, 17 aa, Mycobacterium
DGLPWTWETFPEFMDAL

SEQ ID NO: 645091 - protein, 23 aa, Mycobacterium
DGLPYKESYGMASKRAVAARTAG

SEQ ID NO: 645092 - protein, 21 aa, Mycobacterium
DGLQGFGGWNSGSGNIGLFNS

SEQ ID NO: 645093 - protein, 22 aa, Mycobacterium
DGLQGFGGWNSGSGNIGVFNSG

SEQ ID NO: 645094 - protein, 19 aa, Mycobacterium
DGLQIEAPIPLSAKLELLA

SEQ ID NO: 645095 - protein, 17 aa, Mycobacterium
DGLQRVHMQNVAGYSHV

SEQ ID NO: 645096 - protein, 21 aa, Mycobacterium
DGLRCAGCVDTVTNALTALQR

SEQ ID NO: 645097 - protein, 17 aa, Mycobacterium
DGLRGAAALWGLAQKAA

SEQ ID NO: 645098 - protein, 18 aa, Mycobacterium
DGLRGAAALWGLAQKTAM

SEQ ID NO: 645099 - protein, 33 aa, Mycobacterium
DGLRKNLRHKGGRWYWHWDPRFIDGTAPHPPME

SEQ ID NO: 645100 - protein, 24 aa, Mycobacterium
DGLRLPAVVLEVEFALDASGRSAP

SEQ ID NO: 645101 - protein, 20 aa, Mycobacterium
DGLRPLRLTLSQLRLRELLV

SEQ ID NO: 645102 - protein, 24 aa, Mycobacterium
DGLRQTAKRLADWVDAQGPELATS

SEQ ID NO: 645103 - protein, 25 aa, Mycobacterium
DGLRQTARELAEWVGSRADSADSTE

SEQ ID NO: 645104 - protein, 21 aa, Mycobacterium
DGLRQWEWRKDGESLWWALVG

SEQ ID NO: 645105 - protein, 24 aa, Mycobacterium
DGLRRSGRAFGEFTVIAQAMVAVG

SEQ ID NO: 645106 - protein, 23 aa, Mycobacterium
DGLSISGPIRWASNVFPDALMVV

SEQ ID NO: 645107 - protein, 19 aa, Mycobacterium
DGLSVAKAAVQLGYLDRYS

SEQ ID NO: 645108 - protein, 17 aa, Mycobacterium
DGLTALAAYVCDVPMAL

SEQ ID NO: 645109 - protein, 17 aa, Mycobacterium
DGLTARVLQRWSVAPVR

SEQ ID NO: 645110 - protein, 25 aa, Mycobacterium
DGLTAWLLLSCEALHAGAREALQIA

SEQ ID NO: 645111 - protein, 22 aa, Mycobacterium
DGLTFTGLMAIPPLGADADEAF

SEQ ID NO: 645112 - protein, 23 aa, Mycobacterium
DGLVAGALRLTADYVANRKQFGK

SEQ ID NO: 645113 - protein, 19 aa, Mycobacterium
DGLVNIAGIAQRFALFTDL

SEQ ID NO: 645114 - protein, 25 aa, Mycobacterium
DGLVPELQRRGAFRDGYDTTTLRGL

SEQ ID NO: 645115 - protein, 22 aa, Mycobacterium
DGLVSGALRLTADHVSNRVQFG

SEQ ID NO: 645116 - protein, 19 aa, Mycobacterium
DGLVSLTLGFDGRLLEVRI

SEQ ID NO: 645117 - protein, 21 aa, Mycobacterium
DGLVWSEFVLGAAYEGPPDTV

SEQ ID NO: 645118 - protein, 20 aa, Mycobacterium
DGMAARTRFFDDFFTDACAA

SEQ ID NO: 645119 - protein, 19 aa, Mycobacterium
DGMCFPGLATEWGGFSSNR

SEQ ID NO: 645120 - protein, 17 aa, Mycobacterium
DGMFPPMHIDAELNEDG

SEQ ID NO: 645121 - protein, 27 aa, Mycobacterium
DGMGKLRRLDFAWPECRVAVEYDGDDW

SEQ ID NO: 645122 - protein, 18 aa, Mycobacterium
DGMLDRFVPHKTVLYGTG

SEQ ID NO: 645123 - protein, 24 aa, Mycobacterium
DGMLPVAEIMIMDFIGIAADQLIN

SEQ ID NO: 645124 - protein, 20 aa, Mycobacterium
DGMPIAWRGQLLTGKPWPRV

SEQ ID NO: 645125 - protein, 23 aa, Mycobacterium
DGMPRRRLAELSGEPRRDPIAEL

SEQ ID NO: 645126 - protein, 17 aa, Mycobacterium
DGMRADLVVARTAMAHA

SEQ ID NO: 645127 - protein, 18 aa, Mycobacterium
DGMSCGHCEAAVRDEVGR

SEQ ID NO: 645128 - protein, 19 aa, Mycobacterium
DGMTYVGLVPFVMDSTKVG

SEQ ID NO: 645129 - protein, 17 aa, Mycobacterium
DGMYGMETIERFLHSSY

SEQ ID NO: 645130 - protein, 26 aa, Mycobacterium
DGNALFFGHGLNIHFGLIKAPENVTV

SEQ ID NO: 645131 - protein, 26 aa, Mycobacterium
DGNALFFGHGLNIHFGLIKPPANVTI

SEQ ID NO: 645132 - protein, 21 aa, Mycobacterium
DGNALKLARRTICVDESVLRM

SEQ ID NO: 645133 - protein, 18 aa, Mycobacterium
DGNDWVRIRLAGPGRVRL

SEQ ID NO: 645134 - protein, 21 aa, Mycobacterium
DGNGGWHFAVVRYGQLAGAGT

SEQ ID NO: 645135 - protein, 20 aa, Mycobacterium
DGNIGIGLNGDGLRGFEALN

SEQ ID NO: 645136 - protein, 22 aa, Mycobacterium
DGNKFTPGVILSPGGRKSSSAN

SEQ ID NO: 645137 - protein, 28 aa, Mycobacterium
DGNLLRWQNWSLRVGFNHREGMTLHTVR

SEQ ID NO: 645138 - protein, 26 aa, Mycobacterium
DGNMPVRWSGPPAVRHGYLQPAAKCT

SEQ ID NO: 645139 - protein, 20 aa, Mycobacterium
DGNPVLGFVTYGKVKLANLR

SEQ ID NO: 645140 - protein, 24 aa, Mycobacterium
DGNVGDYYVSGGTGGMGGDGGDAG

SEQ ID NO: 645141 - protein, 23 aa, Mycobacterium
DGPAGKGKAGFVARAKELAAKYG

SEQ ID NO: 645142 - protein, 18 aa, Mycobacterium
DGPALLIHSGMTGRPYYA

SEQ ID NO: 645143 - protein, 17 aa, Mycobacterium
DGPARYVATPGGQAVGL

SEQ ID NO: 645144 - protein, 24 aa, Mycobacterium
DGPAVSCPLLVWVKTRDPKAYAGP

SEQ ID NO: 645145 - protein, 20 aa, Mycobacterium
DGPCLEGWTTLTALAQATKR

SEQ ID NO: 645146 - protein, 21 aa, Mycobacterium
DGPDAGAAWHYGDPLGEQRAA

SEQ ID NO: 645147 - protein, 23 aa, Mycobacterium
DGPDGKWGRPAILMSPVAFLQKP

SEQ ID NO: 645148 - protein, 19 aa, Mycobacterium
DGPDIVLLVDDWHMITAAG

SEQ ID NO: 645149 - protein, 22 aa, Mycobacterium
DGPDLVLRWAALLHDIGKPTTR

SEQ ID NO: 645150 - protein, 21 aa, Mycobacterium
DGPDRPVVLVAHGGLIAALSA

SEQ ID NO: 645151 - protein, 22 aa, Mycobacterium
DGPDVVCWLCARHWEMGSTDAP

SEQ ID NO: 645152 - protein, 25 aa, Mycobacterium
DGPENGGRIAGAFGYWRESGRFILF

SEQ ID NO: 645153 - protein, 20 aa, Mycobacterium
DGPEPIVLLHGWPQTGQCWR

SEQ ID NO: 645154 - protein, 21 aa, Mycobacterium
DGPFGSYGRYYVAREVYRAIT

SEQ ID NO: 645155 - protein, 17 aa, Mycobacterium
DGPFPLDGFTKVIQVNL

SEQ ID NO: 645156 - protein, 24 aa, Mycobacterium
DGPGESWIRPEVDLVGGEAMTPLQ

SEQ ID NO: 645157 - protein, 21 aa, Mycobacterium
DGPGGGIGIRIYWPPSDSAQG

SEQ ID NO: 645158 - protein, 21 aa, Mycobacterium
DGPGGLPERVLAPLVRAAVTN

SEQ ID NO: 645159 - protein, 23 aa, Mycobacterium
DGPGGLPPRLSLFGHTRLASTDV

SEQ ID NO: 645160 - protein, 26 aa, Mycobacterium
DGPGIKRIRRGRGFSYEKPDGQAVTD

SEQ ID NO: 645161 - protein, 24 aa, Mycobacterium
DGPGLKPAYCITGDLVPEEQGLDL

SEQ ID NO: 645162 - protein, 26 aa, Mycobacterium
DGPGPEMIAGILLEFNDRLMERHTLG

SEQ ID NO: 645163 - protein, 23 aa, Mycobacterium
DGPGRGAVRCGIWHVPRLVAAGR

SEQ ID NO: 645164 - protein, 22 aa, Mycobacterium
DGPHVVTGPVFVEGAEPGDVLK

SEQ ID NO: 645165 - protein, 19 aa, Mycobacterium
DGPHVVTGPVFVEGAQPGD

SEQ ID NO: 645166 - protein, 18 aa, Mycobacterium
DGPITIFAGEQVARDDAR

SEQ ID NO: 645167 - protein, 23 aa, Mycobacterium
DGPKADKGLRRWSAVARSAARQS

SEQ ID NO: 645168 - protein, 20 aa, Mycobacterium
DGPLAAGYFIAPTIMELGMG

SEQ ID NO: 645169 - protein, 18 aa, Mycobacterium
DGPLDWPDATVVSGDAVD

SEQ ID NO: 645170 - protein, 22 aa, Mycobacterium
DGPLPERMRVLALTLAGERTVV

SEQ ID NO: 645171 - protein, 43 aa, Mycobacterium
DGPLWPRLMLGVRGMLRATWLVLRKRADVLHVHLAHGGSVIRK

SEQ ID NO: 645172 - protein, 26 aa, Mycobacterium
DGPMSDGGLRYCINSASLRFIHRDDL

SEQ ID NO: 645173 - protein, 27 aa, Mycobacterium
DGPNRMGFWVCDWCGHGSPRLSNPQKP

SEQ ID NO: 645174 - protein, 24 aa, Mycobacterium
DGPPEQWGPGPLPNAGPPWGPAPQ

SEQ ID NO: 645175 - protein, 21 aa, Mycobacterium
DGPPLTALRGRWSVERGLVLT

SEQ ID NO: 645176 - protein, 29 aa, Mycobacterium
DGPPRIHLIGHSFGARLVSYALAGLPATG

SEQ ID NO: 645177 - protein, 25 aa, Mycobacterium
DGPPTLPPFMLADGVASLNAAYAVM

SEQ ID NO: 645178 - protein, 20 aa, Mycobacterium
DGPQLAAIVDWEMSTIGDPL

SEQ ID NO: 645179 - protein, 25 aa, Mycobacterium
DGPQRAIRCAMAIRDAVPALGIEVR

SEQ ID NO: 645180 - protein, 20 aa, Mycobacterium
DGPRAAFAAAQRWRRRADHP

SEQ ID NO: 645181 - protein, 19 aa, Mycobacterium
DGPREAGGLRYCINSAALR

SEQ ID NO: 645182 - protein, 21 aa, Mycobacterium
DGPRGISAFVVEKGSAGLSFG

SEQ ID NO: 645183 - protein, 21 aa, Mycobacterium
DGPRGPMCMRDSQFDQQVYIA

SEQ ID NO: 645184 - protein, 23 aa, Mycobacterium
DGPRPEQMRVLALTLAAERTVVG

SEQ ID NO: 645185 - protein, 22 aa, Mycobacterium
DGPRSGEIASLIADLDDQTLTA

SEQ ID NO: 645186 - protein, 19 aa, Mycobacterium
DGPSALAEFERSGADIVLL

SEQ ID NO: 645187 - protein, 20 aa, Mycobacterium
DGPSLGGFVCPVTVVSADRW

SEQ ID NO: 645188 - protein, 19 aa, Mycobacterium
DGPSSLWGITYVVDDIDAT

SEQ ID NO: 645189 - protein, 20 aa, Mycobacterium
DGPVCKLALPERISSGTHST

SEQ ID NO: 645190 - protein, 20 aa, Mycobacterium
DGPVCKLELPERISSGTHST

SEQ ID NO: 645191 - protein, 21 aa, Mycobacterium
DGPVCKLPLPERISSGTHSTW

SEQ ID NO: 645192 - protein, 18 aa, Mycobacterium
DGPVDFVLLDGWKDLYLP

SEQ ID NO: 645193 - protein, 20 aa, Mycobacterium
DGPVGFVLLDGWKELYLPVI

SEQ ID NO: 645194 - protein, 19 aa, Mycobacterium
DGPVGRLLAATKRHPYRPA

SEQ ID NO: 645195 - protein, 19 aa, Mycobacterium
DGPVVLFFYPAAMTPGCTK

SEQ ID NO: 645196 - protein, 18 aa, Mycobacterium
DGPVVLFFYPAANTPGCT

SEQ ID NO: 645197 - protein, 24 aa, Mycobacterium
DGPWLRTGDLGFIHSGELFIVGRM

SEQ ID NO: 645198 - protein, 18 aa, Mycobacterium
DGPWPDPAAHSFRGPTKR

SEQ ID NO: 645199 - protein, 26 aa, Mycobacterium
DGPYPTARFDGFWIIDVPSKDEAKKW

SEQ ID NO: 645200 - protein, 18 aa, Mycobacterium
DGQAFYIHNRVRTIDSAA

SEQ ID NO: 645201 - protein, 25 aa, Mycobacterium
DGQARAVLYGSYRQSAPIGDRAAAA

SEQ ID NO: 645202 - protein, 20 aa, Mycobacterium
DGQAVGGAFVRLLDSSDEFT

SEQ ID NO: 645203 - protein, 18 aa, Mycobacterium
DGQCWLRRAQEFERAAGR

SEQ ID NO: 645204 - protein, 36 aa, Mycobacterium
DGQEGLDFLYRRGAHELAPRPDLVLLDLNLPKYDGR

SEQ ID NO: 645205 - protein, 21 aa, Mycobacterium
DGQFPALPLFELGYEVAHVGF

SEQ ID NO: 645206 - protein, 22 aa, Mycobacterium
DGQFPTLPFFELGYEVAHVGFN

SEQ ID NO: 645207 - protein, 23 aa, Mycobacterium
DGQIGTACTVSFGTAFERTSRHA

SEQ ID NO: 645208 - protein, 20 aa, Mycobacterium
DGQIKAMITIAGNPVLSAPD

SEQ ID NO: 645209 - protein, 22 aa, Mycobacterium
DGQKETIAYCRIGERSSHTWFV

SEQ ID NO: 645210 - protein, 17 aa, Mycobacterium
DGQKRLKNAKVLVIGAG

SEQ ID NO: 645211 - protein, 25 aa, Mycobacterium
DGQLARDFLLTWFVHAAYEVDYTKR

SEQ ID NO: 645212 - protein, 24 aa, Mycobacterium
DGQLGTACAVAFGAAFELTSRRAG

SEQ ID NO: 645213 - protein, 23 aa, Mycobacterium
DGQLKALITVAGNPVLSTPGGDK

SEQ ID NO: 645214 - protein, 17 aa, Mycobacterium
DGQLLDWHRHRRAQFLY

SEQ ID NO: 645215 - protein, 21 aa, Mycobacterium
DGQLLRQVLVLGGGETRDLHL

SEQ ID NO: 645216 - protein, 19 aa, Mycobacterium
DGQLPVWWPDLVENGFHVV

SEQ ID NO: 645217 - protein, 19 aa, Mycobacterium
DGQLRARIIFDLDDIDAAF

SEQ ID NO: 645218 - protein, 23 aa, Mycobacterium
DGQLSLPRHQAWRDDGLDLREPI

SEQ ID NO: 645219 - protein, 24 aa, Mycobacterium
DGQNCRRCGAVIRREKFMNRSSFY

SEQ ID NO: 645220 - protein, 17 aa, Mycobacterium
DGQPDICDSCFRGHEAL

SEQ ID NO: 645221 - protein, 19 aa, Mycobacterium
DGQPELWASMIEHRKVLAA

SEQ ID NO: 645222 - protein, 21 aa, Mycobacterium
DGQPTRIGYRVDEETGKKVRI

SEQ ID NO: 645223 - protein, 24 aa, Mycobacterium
DGQQATWDRLWPQLGRQARDGDEP

SEQ ID NO: 645224 - protein, 17 aa, Mycobacterium
DGQRAGSAMKRAMETAG

SEQ ID NO: 645225 - protein, 17 aa, Mycobacterium
DGQRVALMFQEPALFPW

SEQ ID NO: 645226 - protein, 23 aa, Mycobacterium
DGQRWVWSDTIARIHGYQPGQVQ

SEQ ID NO: 645227 - protein, 24 aa, Mycobacterium
DGQTLFEICARLLTNHGLSSTRQA

SEQ ID NO: 645228 - protein, 24 aa, Mycobacterium
DGQTYDFSIRWGAALAGRLRRLVH

SEQ ID NO: 645229 - protein, 18 aa, Mycobacterium
DGQVCRPGWVQTAGPTIS

SEQ ID NO: 645230 - protein, 30 aa, Mycobacterium
DGQVKALICIGGNPMAAWPDQRKTKRALES

SEQ ID NO: 645231 - protein, 30 aa, Mycobacterium
DGQVYTAASAIRWAVDLGLIPSADQIDSAA

SEQ ID NO: 645232 - protein, 26 aa, Mycobacterium
DGQWRFARRRCRFITSGGLSDNPEGA

SEQ ID NO: 645233 - protein, 18 aa, Mycobacterium
DGQWTRAKGHDTFCPLGP

SEQ ID NO: 645234 - protein, 20 aa, Mycobacterium
DGRAATILHLSHAVSDAVGG

SEQ ID NO: 645235 - protein, 24 aa, Mycobacterium
DGRADPGEIVWTWVAFEDDPTRGK

SEQ ID NO: 645236 - protein, 26 aa, Mycobacterium
DGRADPGEIVWTWVVYEDDPSRGKDR

SEQ ID NO: 645237 - protein, 24 aa, Mycobacterium
DGRAEWYRNRWVRGPAAARALGES

SEQ ID NO: 645238 - protein, 26 aa, Mycobacterium
DGRAGPGEIVWTWVVYEDDPTRGKDR

SEQ ID NO: 645239 - protein, 19 aa, Mycobacterium
DGRARAMLYGAYRTGAPFG

SEQ ID NO: 645240 - protein, 22 aa, Mycobacterium
DGRARLGKSISTVRTGSITDVQ

SEQ ID NO: 645241 - protein, 18 aa, Mycobacterium
DGRARLILRRETVEDLVS

SEQ ID NO: 645242 - protein, 23 aa, Mycobacterium
DGRARPLLPGLVGEPADRGDPVA

SEQ ID NO: 645243 - protein, 19 aa, Mycobacterium
DGRARSAVLTGRHADILVL

SEQ ID NO: 645244 - protein, 18 aa, Mycobacterium
DGRARVAAIHEIIGGTPR

SEQ ID NO: 645245 - protein, 17 aa, Mycobacterium
DGRCHLIELEMASQTLD

SEQ ID NO: 645246 - protein, 21 aa, Mycobacterium
DGRCRAEFVLGAAYEGPPGLV

SEQ ID NO: 645247 - protein, 20 aa, Mycobacterium
DGRDGDVVLCVNNLSRFPQP

SEQ ID NO: 645248 - protein, 19 aa, Mycobacterium
DGREILYFDSIPTERAAVD

SEQ ID NO: 645249 - protein, 17 aa, Mycobacterium
DGRFELMDEAGVDLQIL

SEQ ID NO: 645250 - protein, 27 aa, Mycobacterium
DGRFRAGEIGVRFVVGAAQHLDAALRD

SEQ ID NO: 645251 - protein, 22 aa, Mycobacterium
DGRFRTLGGAECRVTVRRRIVD

SEQ ID NO: 645252 - protein, 26 aa, Mycobacterium
DGRFWLHLDRGWRFFAPENLITRLVA

SEQ ID NO: 645253 - protein, 24 aa, Mycobacterium
DGRGAPLMPCGRCRQLLFEHGGPE

SEQ ID NO: 645254 - protein, 24 aa, Mycobacterium
DGRGRRPVGLLARGLARRVSPDIA

SEQ ID NO: 645255 - protein, 20 aa, Mycobacterium
DGRGVRMARDLADARDIARD

SEQ ID NO: 645256 - protein, 23 aa, Mycobacterium
DGRHELLAYLVLAANLTFDAYHR

SEQ ID NO: 645257 - protein, 19 aa, Mycobacterium
DGRIAGLVRQVCARTLGLP

SEQ ID NO: 645258 - protein, 23 aa, Mycobacterium
DGRIFRTSLKIPAGHTPENRDIE

SEQ ID NO: 645259 - protein, 19 aa, Mycobacterium
DGRIHGVHVWTGPANEEPP

SEQ ID NO: 645260 - protein, 21 aa, Mycobacterium
DGRIRVPIEATYGLDDYADAY

SEQ ID NO: 645261 - protein, 26 aa, Mycobacterium
DGRISLDAGCDWTEARSQLLALPGVG

SEQ ID NO: 645262 - protein, 20 aa, Mycobacterium
DGRKLCGILAEVATPHQAIV

SEQ ID NO: 645263 - protein, 19 aa, Mycobacterium
DGRLAGAGLDVFTDEPNVP

SEQ ID NO: 645264 - protein, 25 aa, Mycobacterium
DGRLLKLTLHPGVMTGYSHGELADR

SEQ ID NO: 645265 - protein, 21 aa, Mycobacterium
DGRLPELIGQLTGSASGGVEV

SEQ ID NO: 645266 - protein, 21 aa, Mycobacterium
DGRLRQASWRGLRDDKVPEDV

SEQ ID NO: 645267 - protein, 17 aa, Mycobacterium
DGRLRRASLGGVVGDSA

SEQ ID NO: 645268 - protein, 22 aa, Mycobacterium
DGRLRRLDCSQLTDGGAGLVLV

SEQ ID NO: 645269 - protein, 23 aa, Mycobacterium
DGRLRSADHGWSDLLQRRESDLA

SEQ ID NO: 645270 - protein, 24 aa, Mycobacterium
DGRLVRLAAAIAKHAAVSGRGELH

SEQ ID NO: 645271 - protein, 19 aa, Mycobacterium
DGRLWKMLLGSSRGLGRIV

SEQ ID NO: 645272 - protein, 25 aa, Mycobacterium
DGRMVPTFCRQALRNEPLTVSGTGL

SEQ ID NO: 645273 - protein, 18 aa, Mycobacterium
DGRPCLVESHLQRLTQSA

SEQ ID NO: 645274 - protein, 26 aa, Mycobacterium
DGRPKPTPIWGVPEGDKLLVITDDGS

SEQ ID NO: 645275 - protein, 24 aa, Mycobacterium
DGRPKPTPVWGVPHGDKLLISTDD

SEQ ID NO: 645276 - protein, 21 aa, Mycobacterium
DGRPMLRHRMELGAGSLADDV

SEQ ID NO: 645277 - protein, 23 aa, Mycobacterium
DGRPTICVYCASGGDNPADLSLA

SEQ ID NO: 645278 - protein, 18 aa, Mycobacterium
DGRPVIFLCRSGNRSIGA

SEQ ID NO: 645279 - protein, 22 aa, Mycobacterium
DGRRAAACITFDHLGEAAEIQI

SEQ ID NO: 645280 - protein, 17 aa, Mycobacterium
DGRRAVAGVSSFGLGGT

SEQ ID NO: 645281 - protein, 26 aa, Mycobacterium
DGRRYRLTVDLPRDFALNQPLSTFAL

SEQ ID NO: 645282 - protein, 19 aa, Mycobacterium
DGRSDLDPLALISSPAIPL

SEQ ID NO: 645283 - protein, 23 aa, Mycobacterium
DGRSEFSYGSFVRTVALPAGADE

SEQ ID NO: 645284 - protein, 23 aa, Mycobacterium
DGRSEFSYGSFVRTVALPSGANE

SEQ ID NO: 645285 - protein, 24 aa, Mycobacterium
DGRSLRAGYLVGCDGGRSVVRKGA

SEQ ID NO: 645286 - protein, 28 aa, Mycobacterium
DGRSPWPAWRAHPLLFPFLHGRPGGLLR

SEQ ID NO: 645287 - protein, 17 aa, Mycobacterium
DGRSRAYLGGRSVPAKS

SEQ ID NO: 645288 - protein, 22 aa, Mycobacterium
DGRTMLWRALCRVTTVVDRKVP

SEQ ID NO: 645289 - protein, 23 aa, Mycobacterium
DGRTTLRLLPRFDTTTYGELWSR

SEQ ID NO: 645290 - protein, 22 aa, Mycobacterium
DGRTVYSSLVWKRAEQAGWRVA

SEQ ID NO: 645291 - protein, 35 aa, Mycobacterium
DGRVAAVDWVFNGWGARDWARWDNDAHIGRFVGQL

SEQ ID NO: 645292 - protein, 20 aa, Mycobacterium
DGRVTLPFWMIYDSAGDRDG

SEQ ID NO: 645293 - protein, 20 aa, Mycobacterium
DGRVYVCTYPTMMNLINDTD

SEQ ID NO: 645294 - protein, 19 aa, Mycobacterium
DGRYARLLGADAWAPDARA

SEQ ID NO: 645295 - protein, 25 aa, Mycobacterium
DGSAAFRFLLSPIRIVCANTQSAAI

SEQ ID NO: 645296 - protein, 24 aa, Mycobacterium
DGSAALLCKFDHALTDGVGAVALA

SEQ ID NO: 645297 - protein, 31 aa, Mycobacterium
DGSAVLMEMMWSFRANGMWSDERGTNMLDTG

SEQ ID NO: 645298 - protein, 17 aa, Mycobacterium
DGSCALTVTAAWTNLDT

SEQ ID NO: 645299 - protein, 35 aa, Mycobacterium
DGSCGKLIAAAGWHAWRPAHLHVKVSAPGHELLTA

SEQ ID NO: 645300 - protein, 24 aa, Mycobacterium
DGSCNGGPSAGHFVSQYAIDLAQN

SEQ ID NO: 645301 - protein, 38 aa, Mycobacterium
DGSCSPRWLHADPWNFWVLRPWSFSVTHADHFVNSIKP

SEQ ID NO: 645302 - protein, 26 aa, Mycobacterium
DGSDLIVSGPIRWATNVFPDALMVLP

SEQ ID NO: 645303 - protein, 30 aa, Mycobacterium
DGSDRACSWLPIYHDMGLAFLLTAVLSGMP

SEQ ID NO: 645304 - protein, 21 aa, Mycobacterium
DGSDVWKFRDSVIPNPALNAV

SEQ ID NO: 645305 - protein, 18 aa, Mycobacterium
DGSDWILKGQKVYISGID

SEQ ID NO: 645306 - protein, 18 aa, Mycobacterium
DGSDWILNGSKMWITNGS

SEQ ID NO: 645307 - protein, 17 aa, Mycobacterium
DGSDWILNGTKMWITNG

SEQ ID NO: 645308 - protein, 18 aa, Mycobacterium
DGSDWILSGQKVYISGVD

SEQ ID NO: 645309 - protein, 18 aa, Mycobacterium
DGSDWVLDGRKMWITNGS

SEQ ID NO: 645310 - protein, 17 aa, Mycobacterium
DGSDWVLNGRKMWITNG

SEQ ID NO: 645311 - protein, 17 aa, Mycobacterium
DGSDWVLNGTKMWITNG

SEQ ID NO: 645312 - protein, 17 aa, Mycobacterium
DGSEYRGRYGLSVRALT

SEQ ID NO: 645313 - protein, 21 aa, Mycobacterium
DGSFRFHRKGVDFGAMCMLGT

SEQ ID NO: 645314 - protein, 17 aa, Mycobacterium
DGSFWHQWMRTYMTGPQ

SEQ ID NO: 645315 - protein, 23 aa, Mycobacterium
DGSGADPLWFLSLLSQDAVDLLE

SEQ ID NO: 645316 - protein, 25 aa, Mycobacterium
DGSGSPARVRACRFYGADTVVHVTL

SEQ ID NO: 645317 - protein, 23 aa, Mycobacterium
DGSIPYQRFRGGEIAGRTAGLVG

SEQ ID NO: 645318 - protein, 31 aa, Mycobacterium
DGSIPYQRFRGWEVAGLTAGLVGLGAVGRAT

SEQ ID NO: 645319 - protein, 20 aa, Mycobacterium
DGSLALPYWMIYDDREGEVP

SEQ ID NO: 645320 - protein, 22 aa, Mycobacterium
DGSLDRPALAAIAFSDDEKRTT

SEQ ID NO: 645321 - protein, 25 aa, Mycobacterium
DGSLFVRPFLKYQIITVVAPNSPLA

SEQ ID NO: 645322 - protein, 18 aa, Mycobacterium
DGSLKLRPSRGTHLVFDA

SEQ ID NO: 645323 - protein, 21 aa, Mycobacterium
DGSLPLLAPMSEVAGRLSAQV

SEQ ID NO: 645324 - protein, 20 aa, Mycobacterium
DGSLRLSFDDVVERIRCAAG

SEQ ID NO: 645325 - protein, 23 aa, Mycobacterium
DGSLRPVSGTAFALTPKLREAYA

SEQ ID NO: 645326 - protein, 19 aa, Mycobacterium
DGSLWPVNGTVFAVTPTLR

SEQ ID NO: 645327 - protein, 25 aa, Mycobacterium
DGSPASNAAVCWAARDAALRHVPLT

SEQ ID NO: 645328 - protein, 24 aa, Mycobacterium
DGSPASNAAVCWAARDAAMRNLPL

SEQ ID NO: 645329 - protein, 24 aa, Mycobacterium
DGSPASNAAVCWAARDAAMRNVQL

SEQ ID NO: 645330 - protein, 18 aa, Mycobacterium
DGSPGVFVSDGFGVVHRK

SEQ ID NO: 645331 - protein, 21 aa, Mycobacterium
DGSPHVRLWAKLEDRNPTGSI

SEQ ID NO: 645332 - protein, 27 aa, Mycobacterium
DGSPLRELAGWPALLRGKLSVTLDLHD

SEQ ID NO: 645333 - protein, 34 aa, Mycobacterium
DGSPPIRYRDFGSRSRFSCRHRHRQHYHSRSEKR

SEQ ID NO: 645334 - protein, 17 aa, Mycobacterium
DGSPVVAMKARPPFTKL

SEQ ID NO: 645335 - protein, 24 aa, Mycobacterium
DGSPWRAKLVPAERLIVVESTLRE

SEQ ID NO: 645336 - protein, 24 aa, Mycobacterium
DGSRAAVNAVRWAAAEALAREVCL

SEQ ID NO: 645337 - protein, 17 aa, Mycobacterium
DGSRASTHAAVWAVDEA

SEQ ID NO: 645338 - protein, 20 aa, Mycobacterium
DGSRIAAGLIAKGVRKGDRV

SEQ ID NO: 645339 - protein, 18 aa, Mycobacterium
DGSSPLVIRRTYRAAHNI

SEQ ID NO: 645340 - protein, 26 aa, Mycobacterium
DGSSWSRAAVRWAMAEATLRGVDLTI

SEQ ID NO: 645341 - protein, 22 aa, Mycobacterium
DGSTPWLIHGYDAIRALFTDSR

SEQ ID NO: 645342 - protein, 20 aa, Mycobacterium
DGSVDICLSSNVAEHVAQPW

SEQ ID NO: 645343 - protein, 19 aa, Mycobacterium
DGSVMACVFNFAGTEHGGY

SEQ ID NO: 645344 - protein, 17 aa, Mycobacterium
DGSVMVRFGGPAGEPNH

SEQ ID NO: 645345 - protein, 19 aa, Mycobacterium
DGSVRICGEAEIDRAQFGL

SEQ ID NO: 645346 - protein, 17 aa, Mycobacterium
DGSWHIDGVKRFITSGD

SEQ ID NO: 645347 - protein, 18 aa, Mycobacterium
DGSWRISHISYYRLYEAM

SEQ ID NO: 645348 - protein, 20 aa, Mycobacterium
DGSYEEIDWDTAIVEIAEGF

SEQ ID NO: 645349 - protein, 23 aa, Mycobacterium
DGTAARAAYAWMRANQPVFRDRN

SEQ ID NO: 645350 - protein, 26 aa, Mycobacterium
DGTAFWTRSGIGYALTPEELGGALGQ

SEQ ID NO: 645351 - protein, 26 aa, Mycobacterium
DGTAFWTRSGVGYALTPEELGGALGQ

SEQ ID NO: 645352 - protein, 19 aa, Mycobacterium
DGTAGWPLYLHRYAGLFGV

SEQ ID NO: 645353 - protein, 26 aa, Mycobacterium
DGTAHRRCSFEVFARRLPEGRRYGVT

SEQ ID NO: 645354 - protein, 22 aa, Mycobacterium
DGTAKPGTWLYGRDVLDLIRLG

SEQ ID NO: 645355 - protein, 18 aa, Mycobacterium
DGTAMDRFRRLVAAQGGD

SEQ ID NO: 645356 - protein, 25 aa, Mycobacterium
DGTARFGTELSRFGFDPGALSPSYG

SEQ ID NO: 645357 - protein, 25 aa, Mycobacterium
DGTARLALPGGLTWVARHVAESYDP

SEQ ID NO: 645358 - protein, 18 aa, Mycobacterium
DGTATMWTAPPAIDTDGD

SEQ ID NO: 645359 - protein, 22 aa, Mycobacterium
DGTCAAEWGIIHGACASDELPS

SEQ ID NO: 645360 - protein, 29 aa, Mycobacterium
DGTCDELGRRCCWVLLDADGPVSLTLACD

SEQ ID NO: 645361 - protein, 22 aa, Mycobacterium
DGTDGRWRIARRVAPDRMISTV

SEQ ID NO: 645362 - protein, 18 aa, Mycobacterium
DGTEITVEINATVVSHSG

SEQ ID NO: 645363 - protein, 22 aa, Mycobacterium
DGTELPADLVVVGIGSHPATGW

SEQ ID NO: 645364 - protein, 17 aa, Mycobacterium
DGTELTPALGIGAFADK

SEQ ID NO: 645365 - protein, 22 aa, Mycobacterium
DGTELVKALLFSLFEGGLRHGL

SEQ ID NO: 645366 - protein, 17 aa, Mycobacterium
DGTETFEGIDLLDPTKI

SEQ ID NO: 645367 - protein, 18 aa, Mycobacterium
DGTFDVARGLRIARQLLL

SEQ ID NO: 645368 - protein, 17 aa, Mycobacterium
DGTFDVGDRVAALMGGL

SEQ ID NO: 645369 - protein, 19 aa, Mycobacterium
DGTFPAFPLPLGDQSGPYA

SEQ ID NO: 645370 - protein, 17 aa, Mycobacterium
DGTGLSGVVPIVAGAPH

SEQ ID NO: 645371 - protein, 18 aa, Mycobacterium
DGTHIMSLFTQWVPAEWA

SEQ ID NO: 645372 - protein, 26 aa, Mycobacterium
DGTIPIPSWCNFVDVVAVGGAGGGQM

SEQ ID NO: 645373 - protein, 31 aa, Mycobacterium
DGTIPYQRFRGWEIAGLTAGLVGLGAVGRAL

SEQ ID NO: 645374 - protein, 25 aa, Mycobacterium
DGTIPYQRFRGWEIAGRTAGLVGLG

SEQ ID NO: 645375 - protein, 20 aa, Mycobacterium
DGTIRLYGRDSLVINTGGEK

SEQ ID NO: 645376 - protein, 19 aa, Mycobacterium
DGTKLVALIDPITPAEDDI

SEQ ID NO: 645377 - protein, 19 aa, Mycobacterium
DGTLAWSSTTLVLAEVSAG

SEQ ID NO: 645378 - protein, 27 aa, Mycobacterium
DGTLFEWLTTLYPLWSHLDADLEYVAA

SEQ ID NO: 645379 - protein, 25 aa, Mycobacterium
DGTLLPDTVKLVLLTGRHTIRRHHG

SEQ ID NO: 645380 - protein, 17 aa, Mycobacterium
DGTLLWVEGDRQACRKA

SEQ ID NO: 645381 - protein, 19 aa, Mycobacterium
DGTLPWSSTTMVLAEVTAG

SEQ ID NO: 645382 - protein, 17 aa, Mycobacterium
DGTLPYLAGPRTLSEFI

SEQ ID NO: 645383 - protein, 31 aa, Mycobacterium
DGTLRWLREAAGWGDLIWKFVRVADARVVKN

SEQ ID NO: 645384 - protein, 22 aa, Mycobacterium
DGTLRYLLWAAALLTPRPPQLL

SEQ ID NO: 645385 - protein, 23 aa, Mycobacterium
DGTLRYLLWSAALLSPRPPQLLV

SEQ ID NO: 645386 - protein, 18 aa, Mycobacterium
DGTLSFGELKAAAAGNDL

SEQ ID NO: 645387 - protein, 23 aa, Mycobacterium
DGTLWSIPIVFDLSAADIDSYGL

SEQ ID NO: 645388 - protein, 18 aa, Mycobacterium
DGTPRVGVRIGDHVIDLA

SEQ ID NO: 645389 - protein, 24 aa, Mycobacterium
DGTPSAFLSWRVWVPRGPEHFELF

SEQ ID NO: 645390 - protein, 18 aa, Mycobacterium
DGTPWRPLVHARDIAAAF

SEQ ID NO: 645391 - protein, 17 aa, Mycobacterium
DGTRLPSAVTVWTTGFG

SEQ ID NO: 645392 - protein, 19 aa, Mycobacterium
DGTRLRRRRLDAGDQAGFP

SEQ ID NO: 645393 - protein, 19 aa, Mycobacterium
DGTSIPYFLVRPTGSDGPG

SEQ ID NO: 645394 - protein, 17 aa, Mycobacterium
DGTSIYWTGLNKGKRSA

SEQ ID NO: 645395 - protein, 22 aa, Mycobacterium
DGTTIFPFRRLFIVAEVGGARR

SEQ ID NO: 645396 - protein, 26 aa, Mycobacterium
DGTTMFPFRRLFIVAEVGGARRSADV

SEQ ID NO: 645397 - protein, 20 aa, Mycobacterium
DGTTRWKRSPGGLVTALEPL

SEQ ID NO: 645398 - protein, 24 aa, Mycobacterium
DGTVAARFGVKRGLLGKLMPVKRT

SEQ ID NO: 645399 - protein, 21 aa, Mycobacterium
DGTVIDLAWTPPRFGHVLVFR

SEQ ID NO: 645400 - protein, 29 aa, Mycobacterium
DGTVLKLGGPRLKDVAGLSLTKLFVGSEG

SEQ ID NO: 645401 - protein, 19 aa, Mycobacterium
DGTVRFRNRYVRTKHYEKS

SEQ ID NO: 645402 - protein, 17 aa, Mycobacterium
DGTWTWRYDSFRKGDGF

SEQ ID NO: 645403 - protein, 17 aa, Mycobacterium
DGTWTWRYDSIRKGEGF

SEQ ID NO: 645404 - protein, 25 aa, Mycobacterium
DGTYFYRVGPDGALETVGMLFSPGY

SEQ ID NO: 645405 - protein, 25 aa, Mycobacterium
DGTYFYRVGPDGSLDTVGMLFSPGY

SEQ ID NO: 645406 - protein, 17 aa, Mycobacterium
DGVAAFVESGRAVMLGV

SEQ ID NO: 645407 - protein, 19 aa, Mycobacterium
DGVAFAGVAKYPARVKCAL

SEQ ID NO: 645408 - protein, 21 aa, Mycobacterium
DGVAHGVPWASEADRIVVVWR

SEQ ID NO: 645409 - protein, 23 aa, Mycobacterium
DGVARPAGPLAPRLPELVDKAIA

SEQ ID NO: 645410 - protein, 22 aa, Mycobacterium
DGVCAAAIEGLILGSYRFSAFR

SEQ ID NO: 645411 - protein, 20 aa, Mycobacterium
DGVCALCNGAVKKILRDDKV

SEQ ID NO: 645412 - protein, 26 aa, Mycobacterium
DGVDARTAAAFGVAYRTAYHTLRSVA

SEQ ID NO: 645413 - protein, 34 aa, Mycobacterium
DGVDRIVVHLAPWLEPEPICWAINHVRVRVGPGY

SEQ ID NO: 645414 - protein, 24 aa, Mycobacterium
DGVEARRFWRAEYLMNGQIGRFSK

SEQ ID NO: 645415 - protein, 17 aa, Mycobacterium
DGVEIHGANGYLLDAFL

SEQ ID NO: 645416 - protein, 24 aa, Mycobacterium
DGVEYPLDCLIFATGFEVGTDYSQ

SEQ ID NO: 645417 - protein, 18 aa, Mycobacterium
DGVFGGSLIRRAAEVLRR

SEQ ID NO: 645418 - protein, 18 aa, Mycobacterium
DGVGFSFHETTIDAGTVH

SEQ ID NO: 645419 - protein, 17 aa, Mycobacterium
DGVGFSFHETTIHPGTE

SEQ ID NO: 645420 - protein, 22 aa, Mycobacterium
DGVGGAGGRGGDPGLGGAGGAG

SEQ ID NO: 645421 - protein, 18 aa, Mycobacterium
DGVGIAFADVVTGDGTPF

SEQ ID NO: 645422 - protein, 23 aa, Mycobacterium
DGVGIDQFVDWLVEAGHPIERVG

SEQ ID NO: 645423 - protein, 25 aa, Mycobacterium
DGVIPELQRRGLYRGGYESQSLRAR

SEQ ID NO: 645424 - protein, 25 aa, Mycobacterium
DGVKVICRRTRLMTRIAGSGAMAMV

SEQ ID NO: 645425 - protein, 23 aa, Mycobacterium
DGVLEIRGLEPLRGRSAIASFLG

SEQ ID NO: 645426 - protein, 26 aa, Mycobacterium
DGVLGRLWLARGGTYVLANIRGGGEY

SEQ ID NO: 645427 - protein, 24 aa, Mycobacterium
DGVLKDPRCIELFESIDYPYESKF

SEQ ID NO: 645428 - protein, 22 aa, Mycobacterium
DGVLLWPRDRLDEAQRLLRDTQ

SEQ ID NO: 645429 - protein, 22 aa, Mycobacterium
DGVLRLTIPVAEKAKPRRIEIN

SEQ ID NO: 645430 - protein, 25 aa, Mycobacterium
DGVLRPAAGGSWCEWKGRASYFDLV

SEQ ID NO: 645431 - protein, 25 aa, Mycobacterium
DGVLRPHLEALVERWGLRERVRFRG

SEQ ID NO: 645432 - protein, 29 aa, Mycobacterium
DGVLVQAHGRWRLRGNLRPSPDLYELIAS

SEQ ID NO: 645433 - protein, 23 aa, Mycobacterium
DGVNLLNCCGAHAWQTEFHFHLH

SEQ ID NO: 645434 - protein, 20 aa, Mycobacterium
DGVNRVFGGTGGAGGTGGTA

SEQ ID NO: 645435 - protein, 21 aa, Mycobacterium
DGVPDSHSWIPFGGGTRRCLG

SEQ ID NO: 645436 - protein, 23 aa, Mycobacterium
DGVPRVETHLEWQMTPHTDPSWD

SEQ ID NO: 645437 - protein, 17 aa, Mycobacterium
DGVPVMIEERVAMRREL

SEQ ID NO: 645438 - protein, 24 aa, Mycobacterium
DGVQRQCRSRFVFFASGYYNYDQG

SEQ ID NO: 645439 - protein, 28 aa, Mycobacterium
DGVQSALCFPSFPGFGGGTFQRAEDKDL

SEQ ID NO: 645440 - protein, 31 aa, Mycobacterium
DGVRARGAFVLRMMMDPPWSLRIQDDAPLAI

SEQ ID NO: 645441 - protein, 17 aa, Mycobacterium
DGVRFCAVCGNVSDDER

SEQ ID NO: 645442 - protein, 18 aa, Mycobacterium
DGVRFCAVCGNVSDGERC

SEQ ID NO: 645443 - protein, 17 aa, Mycobacterium
DGVRFCAVCGNVSDNER

SEQ ID NO: 645444 - protein, 17 aa, Mycobacterium
DGVRIAVYEEGAADGPT

SEQ ID NO: 645445 - protein, 17 aa, Mycobacterium
DGVRLCGDPAVGVDVAA

SEQ ID NO: 645446 - protein, 19 aa, Mycobacterium
DGVRRWLLRATPVITDELW

SEQ ID NO: 645447 - protein, 26 aa, Mycobacterium
DGVRVICRRSRLMARIAGSGAMASVE

SEQ ID NO: 645448 - protein, 21 aa, Mycobacterium
DGVRWPDIVSRVFGRIDPLAG

SEQ ID NO: 645449 - protein, 25 aa, Mycobacterium
DGVSLDVFVDWLIAAGHDIRRIEDY

SEQ ID NO: 645450 - protein, 23 aa, Mycobacterium
DGVSMDTFVDWLIDAGYKIARID

SEQ ID NO: 645451 - protein, 24 aa, Mycobacterium
DGVSRISGAFGYWRESGRFILFEA

SEQ ID NO: 645452 - protein, 17 aa, Mycobacterium
DGVTFCSVCGNVSDEER

SEQ ID NO: 645453 - protein, 24 aa, Mycobacterium
DGVTKRWPECIVFERGDDGRIRHV

SEQ ID NO: 645454 - protein, 22 aa, Mycobacterium
DGVTVAGTFFGHVLQFASGPLS

SEQ ID NO: 645455 - protein, 21 aa, Mycobacterium
DGVVCVPALAGLAAPWWDSAA

SEQ ID NO: 645456 - protein, 20 aa, Mycobacterium
DGVVDWKRVHEQQIGLDRSH

SEQ ID NO: 645457 - protein, 18 aa, Mycobacterium
DGVVFEFVERPLKYFSPA

SEQ ID NO: 645458 - protein, 28 aa, Mycobacterium
DGVWKIALRRCTIEWMISGDSSILGKGA

SEQ ID NO: 645459 - protein, 28 aa, Mycobacterium
DGVWKIALRRCTLEWMMSGDSSVIASGA

SEQ ID NO: 645460 - protein, 17 aa, Mycobacterium
DGVWKIAVRRCTVEWMM

SEQ ID NO: 645461 - protein, 24 aa, Mycobacterium
DGVYIRRWVPELADPATVPDVHRI

SEQ ID NO: 645462 - protein, 24 aa, Mycobacterium
DGVYRPADVLIWATGFDVNHQLGP

SEQ ID NO: 645463 - protein, 22 aa, Mycobacterium
DGWALRDYQEMAADSFWAGGSG

SEQ ID NO: 645464 - protein, 25 aa, Mycobacterium
DGWARWVQKGGALVIHDVFPNPDDG

SEQ ID NO: 645465 - protein, 24 aa, Mycobacterium
DGWDQRAPVGWNMKDPTPVAKTVC

SEQ ID NO: 645466 - protein, 20 aa, Mycobacterium
DGWFRSGDRGHLRPDGRIVV

SEQ ID NO: 645467 - protein, 20 aa, Mycobacterium
DGWGAECARRAEATLFTKAE

SEQ ID NO: 645468 - protein, 21 aa, Mycobacterium
DGWIRFTGRLGDLIKTGGGTN

SEQ ID NO: 645469 - protein, 24 aa, Mycobacterium
DGWNVKWQKWSLRIGFNPREGITL

SEQ ID NO: 645470 - protein, 19 aa, Mycobacterium
DGWPDLALPVLKVLEPHLR

SEQ ID NO: 645471 - protein, 19 aa, Mycobacterium
DGWQGPLPYLRYVPSPQGL

SEQ ID NO: 645472 - protein, 19 aa, Mycobacterium
DGWRRPILRDPGATAAVSK

SEQ ID NO: 645473 - protein, 22 aa, Mycobacterium
DGWRVAMGTLTFERGVSTLGQQ

SEQ ID NO: 645474 - protein, 18 aa, Mycobacterium
DGWRVMREALAFERVGIA

SEQ ID NO: 645475 - protein, 23 aa, Mycobacterium
DGWSMSILLGEVFTRYGNGSLAT

SEQ ID NO: 645476 - protein, 19 aa, Mycobacterium
DGWVKRGSTVVCTVTGNGL

SEQ ID NO: 645477 - protein, 18 aa, Mycobacterium
DGYACEWKGVLEDPDKLS

SEQ ID NO: 645478 - protein, 25 aa, Mycobacterium
DGYADLKVRALTIEWADNGNSFENF

SEQ ID NO: 645479 - protein, 19 aa, Mycobacterium
DGYAEDWDLESLWTALKTL

SEQ ID NO: 645480 - protein, 18 aa, Mycobacterium
DGYARIAGRPAATLLHLG

SEQ ID NO: 645481 - protein, 17 aa, Mycobacterium
DGYARIAGRPAAVLLHL

SEQ ID NO: 645482 - protein, 18 aa, Mycobacterium
DGYARIRALTFSVRADIV

SEQ ID NO: 645483 - protein, 23 aa, Mycobacterium
DGYEFSRACEALYHFAWDEFCDW

SEQ ID NO: 645484 - protein, 24 aa, Mycobacterium
DGYFLNRQDMDWFAGHYLDGADVT

SEQ ID NO: 645485 - protein, 19 aa, Mycobacterium
DGYGILFCDIEHFKSINDR

SEQ ID NO: 645486 - protein, 20 aa, Mycobacterium
DGYGRLRGMSALVTTFGVGE

SEQ ID NO: 645487 - protein, 21 aa, Mycobacterium
DGYGWLQPRLSPIARPALPPH

SEQ ID NO: 645488 - protein, 20 aa, Mycobacterium
DGYGWLQPRLSPVARPALPP

SEQ ID NO: 645489 - protein, 20 aa, Mycobacterium
DGYGWLQPRLSPVARSALPP

SEQ ID NO: 645490 - protein, 19 aa, Mycobacterium
DGYLLISAYVPKHWQQLCH

SEQ ID NO: 645491 - protein, 30 aa, Mycobacterium
DGYLVISAYVPKHWAKLCQLIGRPDLLTDE

SEQ ID NO: 645492 - protein, 65 aa, Mycobacterium
DGYLVNGSWNWSSGCDHATWAFLGGPVIKDGRPVDFGSFLIPRTEYRIDDVWNVVGLRGTGSNTV

SEQ ID NO: 645493 - protein, 17 aa, Mycobacterium
DGYLYLDCLIGRHARSA

SEQ ID NO: 645494 - protein, 17 aa, Mycobacterium
DGYPIVFAHGITCAIEV

SEQ ID NO: 645495 - protein, 21 aa, Mycobacterium
DGYPQRFGIPDGLSGEAVAVK

SEQ ID NO: 645496 - protein, 22 aa, Mycobacterium
DGYRARVSVISMIGLPSDDQRQ

SEQ ID NO: 645497 - protein, 25 aa, Mycobacterium
DGYRRDGCRIRLRYRPEAAARAREL

SEQ ID NO: 645498 - protein, 23 aa, Mycobacterium
DGYRVPNELPIHVETMLADARHR

SEQ ID NO: 645499 - protein, 19 aa, Mycobacterium
DGYSAADCVALLRESAMTA

SEQ ID NO: 645500 - protein, 23 aa, Mycobacterium
DGYTIHRMFGFRSTTTLDDVRSG

SEQ ID NO: 645501 - protein, 20 aa, Mycobacterium
DGYVKLTLQALVAYPTAKDA

SEQ ID NO: 645502 - protein, 19 aa, Mycobacterium
DGYVRLCVMAPRQWRGLRR

SEQ ID NO: 645503 - protein, 24 aa, Mycobacterium
DGYYRTGDVFAEIAPDRLVYVDRR

SEQ ID NO: 645504 - protein, 22 aa, Mycobacterium
DHAAATIDVLWRGQRLRALSTI

SEQ ID NO: 645505 - protein, 25 aa, Mycobacterium
DHAAFKAALDLLWPVLTPETVLAEL

SEQ ID NO: 645506 - protein, 18 aa, Mycobacterium
DHAARLLAELPKEPAEFT

SEQ ID NO: 645507 - protein, 21 aa, Mycobacterium
DHAGAMARLNLARFPFPSTAE

SEQ ID NO: 645508 - protein, 18 aa, Mycobacterium
DHAPNRMTPFVLPEPKLP

SEQ ID NO: 645509 - protein, 27 aa, Mycobacterium
DHAPWHIVPCNRKWYSRLAITELLIEA

SEQ ID NO: 645510 - protein, 18 aa, Mycobacterium
DHARELVAHASLDVMRSR

SEQ ID NO: 645511 - protein, 22 aa, Mycobacterium
DHAREWRTWPGYSEQERLAAEF

SEQ ID NO: 645512 - protein, 22 aa, Mycobacterium
DHARMSAGVGVVLLTGNGPSPK

SEQ ID NO: 645513 - protein, 21 aa, Mycobacterium
DHARMSPDIGVVLLTGNGPSP

SEQ ID NO: 645514 - protein, 32 aa, Mycobacterium
DHARRWQRPSGFSRFAWDWEHSLGGTPRWGRW

SEQ ID NO: 645515 - protein, 25 aa, Mycobacterium
DHCGDLLLMREGRLLAHTTPARLRE

SEQ ID NO: 645516 - protein, 27 aa, Mycobacterium
DHCGNGFLRRMVGSLGASVQRMRQNVH

SEQ ID NO: 645517 - protein, 17 aa, Mycobacterium
DHCYTRLYAELEWLNQF

SEQ ID NO: 645518 - protein, 22 aa, Mycobacterium
DHDAAEGWSVIVKGRAQVLRTD

SEQ ID NO: 645519 - protein, 26 aa, Mycobacterium
DHDADPRLAPLLAWRQQLVDSGAVAP

SEQ ID NO: 645520 - protein, 24 aa, Mycobacterium
DHDGADALVAWLGGQPHVAAAVKR

SEQ ID NO: 645521 - protein, 18 aa, Mycobacterium
DHDLTFRGDFPLNTAGGQ

SEQ ID NO: 645522 - protein, 18 aa, Mycobacterium
DHDMAWRRQYLPILEKDW

SEQ ID NO: 645523 - protein, 26 aa, Mycobacterium
DHEGKWRVVFFWPKDFTFVCPTEIAA

SEQ ID NO: 645524 - protein, 25 aa, Mycobacterium
DHELDLWSLTDLVAFSTTAQGGSSI

SEQ ID NO: 645525 - protein, 20 aa, Mycobacterium
DHELDVWSLTDLVAYSKNAQ

SEQ ID NO: 645526 - protein, 24 aa, Mycobacterium
DHERRLVLIELRLDGGMDPNEVRA

SEQ ID NO: 645527 - protein, 18 aa, Mycobacterium
DHEVAALLGRMRADDAAD

SEQ ID NO: 645528 - protein, 18 aa, Mycobacterium
DHFAARGFAFYALDLHKC

SEQ ID NO: 645529 - protein, 23 aa, Mycobacterium
DHFARAWAHVAEYFRTNTAVFGY

SEQ ID NO: 645530 - protein, 18 aa, Mycobacterium
DHFCGKLLGLPMGVDVCY

SEQ ID NO: 645531 - protein, 25 aa, Mycobacterium
DHFGEIALLSGWRRAATVRASQPSV

SEQ ID NO: 645532 - protein, 25 aa, Mycobacterium
DHFPYGELQFDAFNKFGIKTQWSNA

SEQ ID NO: 645533 - protein, 23 aa, Mycobacterium
DHGDIPLGLFCRRSLADHMDAER

SEQ ID NO: 645534 - protein, 21 aa, Mycobacterium
DHGEWGFAGYVHHYIDKPTIA

SEQ ID NO: 645535 - protein, 19 aa, Mycobacterium
DHGFEFAVLPWPDYYGSVP

SEQ ID NO: 645536 - protein, 18 aa, Mycobacterium
DHGGCGRLTVVAAPVEEL

SEQ ID NO: 645537 - protein, 26 aa, Mycobacterium
DHGGPALKFQLLWYPSTMWDATLPSF

SEQ ID NO: 645538 - protein, 22 aa, Mycobacterium
DHGKAPVRRACYAADRTGHMIL

SEQ ID NO: 645539 - protein, 17 aa, Mycobacterium
DHGPAYRYHRMFLQHLQ

SEQ ID NO: 645540 - protein, 24 aa, Mycobacterium
DHGQCGSCTVLLDGRRVTTCLTFA

SEQ ID NO: 645541 - protein, 22 aa, Mycobacterium
DHGQCVIAAPSVFSMTDDGVLE

SEQ ID NO: 645542 - protein, 21 aa, Mycobacterium
DHGRGGPHILGRHTISDAGLF

SEQ ID NO: 645543 - protein, 17 aa, Mycobacterium
DHGRIINVSTRFTHGGR

SEQ ID NO: 645544 - protein, 26 aa, Mycobacterium
DHGRKAAVLMVRRHRLLETYLVNELG

SEQ ID NO: 645545 - protein, 18 aa, Mycobacterium
DHGRLRRLVAAPFTPRAI

SEQ ID NO: 645546 - protein, 24 aa, Mycobacterium
DHGSFPMAFGVHVAMATPSLHKHG

SEQ ID NO: 645547 - protein, 23 aa, Mycobacterium
DHGVWLRPFRNLIYVMPPYICTP

SEQ ID NO: 645548 - protein, 18 aa, Mycobacterium
DHHAGAWRPPDRGPTVPG

SEQ ID NO: 645549 - protein, 24 aa, Mycobacterium
DHHLHLRAAAAALRSLRVGPDEVR

SEQ ID NO: 645550 - protein, 18 aa, Mycobacterium
DHHLRVVDEIGPKGDWAK

SEQ ID NO: 645551 - protein, 18 aa, Mycobacterium
DHIANPGAFLASRLRRLS

SEQ ID NO: 645552 - protein, 18 aa, Mycobacterium
DHIAPFFTRTHRVIAPDV

SEQ ID NO: 645553 - protein, 20 aa, Mycobacterium
DHICDGRLILGIGSGWKQKD

SEQ ID NO: 645554 - protein, 28 aa, Mycobacterium
DHIDPILLDLLRLGAYQILRTRVDDHAA

SEQ ID NO: 645555 - protein, 17 aa, Mycobacterium
DHIEAIANWDPKAEPSI

SEQ ID NO: 645556 - protein, 24 aa, Mycobacterium
DHIGAILRPAADRVGRPLRIAHAW

SEQ ID NO: 645557 - protein, 22 aa, Mycobacterium
DHIRPDVVIGIGIPIRNPLPAP

SEQ ID NO: 645558 - protein, 21 aa, Mycobacterium
DHKEFRTVLGADRPGARVGAL

SEQ ID NO: 645559 - protein, 26 aa, Mycobacterium
DHKSLRYFFESALSPNTFWVELKNLD

SEQ ID NO: 645560 - protein, 19 aa, Mycobacterium
DHLAGLGVHTGHIRRDRGF

SEQ ID NO: 645561 - protein, 24 aa, Mycobacterium
DHLASLPWPFADDVTSFRYTVNVD

SEQ ID NO: 645562 - protein, 22 aa, Mycobacterium
DHLATVGFSRLDFVTDAHRRRA

SEQ ID NO: 645563 - protein, 21 aa, Mycobacterium
DHLATVIAWHRYVADLIGQAK

SEQ ID NO: 645564 - protein, 20 aa, Mycobacterium
DHLCRLHLRPDVARIAVLLS

SEQ ID NO: 645565 - protein, 23 aa, Mycobacterium
DHLELGESLGLIDMARGAKVAGS

SEQ ID NO: 645566 - protein, 22 aa, Mycobacterium
DHLERELGHWAAEMNRVKRDRL

SEQ ID NO: 645567 - protein, 20 aa, Mycobacterium
DHLERLWTPYRMNYLAEAPM

SEQ ID NO: 645568 - protein, 23 aa, Mycobacterium
DHLERRTLDLSRVDYLVLDEADE

SEQ ID NO: 645569 - protein, 28 aa, Mycobacterium
DHLNEFCLHMLPGAFATVIAARVDLASG

SEQ ID NO: 645570 - protein, 17 aa, Mycobacterium
DHLPVVLEFAATVDPVA

SEQ ID NO: 645571 - protein, 23 aa, Mycobacterium
DHLRRHGVGYVEWLTDDVEAAVR

SEQ ID NO: 645572 - protein, 20 aa, Mycobacterium
DHLRSGGSIIGVVAENPPAG

SEQ ID NO: 645573 - protein, 17 aa, Mycobacterium
DHLRSGGSIISVVAENP

SEQ ID NO: 645574 - protein, 17 aa, Mycobacterium
DHLRSGGSIISVVPDNP

SEQ ID NO: 645575 - protein, 17 aa, Mycobacterium
DHLRSGGSIISVVPENP

SEQ ID NO: 645576 - protein, 21 aa, Mycobacterium
DHLRSGGSIVNVLPESAKEGS

SEQ ID NO: 645577 - protein, 29 aa, Mycobacterium
DHLRTRLARYEIPTEIAIVDAIPRTPSGK

SEQ ID NO: 645578 - protein, 20 aa, Mycobacterium
DHLSDAMLLAGRLSDHADAL

SEQ ID NO: 645579 - protein, 24 aa, Mycobacterium
DHLSRGRVAWNIVTTMHPQAAANF

SEQ ID NO: 645580 - protein, 24 aa, Mycobacterium
DHLTEGRVAWNIVTSYLDSAARNL

SEQ ID NO: 645581 - protein, 19 aa, Mycobacterium
DHLTWRAALDELREREKAA

SEQ ID NO: 645582 - protein, 19 aa, Mycobacterium
DHLVAFLLGVGYPADRPLR

SEQ ID NO: 645583 - protein, 26 aa, Mycobacterium
DHLVKHLLELARRVGVDHVTMRGLAA

SEQ ID NO: 645584 - protein, 18 aa, Mycobacterium
DHLYRSGYLDAVDLQELR

SEQ ID NO: 645585 - protein, 25 aa, Mycobacterium
DHMADLGFLPGVKRLLDRTPKHCQR

SEQ ID NO: 645586 - protein, 24 aa, Mycobacterium
DHMADLGFLPGVTRILAATPNGGQ

SEQ ID NO: 645587 - protein, 26 aa, Mycobacterium
DHMADLGFLPGVTRILAATPRGGQRL

SEQ ID NO: 645588 - protein, 22 aa, Mycobacterium
DHNDPRLGRHVHHDSRSLDHEF

SEQ ID NO: 645589 - protein, 22 aa, Mycobacterium
DHPAILCNYANMLIDAQRPDTA

SEQ ID NO: 645590 - protein, 31 aa, Mycobacterium
DHPDARRVAAVWRPRIQGLRADAYGLADEAK

SEQ ID NO: 645591 - protein, 20 aa, Mycobacterium
DHPDEACGVIAGPEGSDRPE

SEQ ID NO: 645592 - protein, 21 aa, Mycobacterium
DHPDEACGVLAGPEGSDRAER

SEQ ID NO: 645593 - protein, 21 aa, Mycobacterium
DHPDEACGVLAGPEGSDRPER

SEQ ID NO: 645594 - protein, 25 aa, Mycobacterium
DHPECPRQATDFAAFACGLAMPVAG

SEQ ID NO: 645595 - protein, 31 aa, Mycobacterium
DHPEELADAFAKAWYKLLHRDMGPISRYLGP

SEQ ID NO: 645596 - protein, 24 aa, Mycobacterium
DHPEQRAWLTASFDDRIGGAVEEF

SEQ ID NO: 645597 - protein, 23 aa, Mycobacterium
DHPESLVNWDALAAMSGTIVLLM

SEQ ID NO: 645598 - protein, 23 aa, Mycobacterium
DHPESLVNWNALAAMSGTIVLLM

SEQ ID NO: 645599 - protein, 26 aa, Mycobacterium
DHPGKWRVIFFWPKDFTFVCPTEIAA

SEQ ID NO: 645600 - protein, 26 aa, Mycobacterium
DHPGKWRVVFFWPKDFTFVCPTEIAA

SEQ ID NO: 645601 - protein, 24 aa, Mycobacterium
DHPGRPRAGLAVPRAGWHRHRRDR

SEQ ID NO: 645602 - protein, 17 aa, Mycobacterium
DHPHKWVGFDEATIVTL

SEQ ID NO: 645603 - protein, 17 aa, Mycobacterium
DHPIVAAALDYTKRHLD

SEQ ID NO: 645604 - protein, 25 aa, Mycobacterium
DHPKKLWRPKVPIVVVVGEPIEPTL

SEQ ID NO: 645605 - protein, 18 aa, Mycobacterium
DHPKKVLRNKVPITVVAG

SEQ ID NO: 645606 - protein, 18 aa, Mycobacterium
DHPKKVWRNKVPVTVAAG

SEQ ID NO: 645607 - protein, 20 aa, Mycobacterium
DHPLGGLGFANWAYEVQRQE

SEQ ID NO: 645608 - protein, 18 aa, Mycobacterium
DHPLRLDPNAAWTPQTSV

SEQ ID NO: 645609 - protein, 23 aa, Mycobacterium
DHPLWEMWVIEGLAGTPASAGGR

SEQ ID NO: 645610 - protein, 21 aa, Mycobacterium
DHPLWQCWVADGLPANRWAIL

SEQ ID NO: 645611 - protein, 26 aa, Mycobacterium
DHPPARRRLMALGRAFSVAVRGVDGE

SEQ ID NO: 645612 - protein, 23 aa, Mycobacterium
DHPRARVAFLLDDTKPVAVLTLR

SEQ ID NO: 645613 - protein, 17 aa, Mycobacterium
DHPRVAGDVGMAGVAID

SEQ ID NO: 645614 - protein, 20 aa, Mycobacterium
DHPTSVHWHGIAVRNDMDGA

SEQ ID NO: 645615 - protein, 24 aa, Mycobacterium
DHQDLPFGVLLDRFDGARSSSHAV

SEQ ID NO: 645616 - protein, 29 aa, Mycobacterium
DHQEVAALLRWLGNGNFLLLGYQPCEVDD

SEQ ID NO: 645617 - protein, 25 aa, Mycobacterium
DHQIWQCPVVLLADVRSVGVQGDGR

SEQ ID NO: 645618 - protein, 22 aa, Mycobacterium
DHQRLGWRQAPVGPALADALGL

SEQ ID NO: 645619 - protein, 17 aa, Mycobacterium
DHQVKIRGYRVELGEVE

SEQ ID NO: 645620 - protein, 19 aa, Mycobacterium
DHRARLQVLGDRWFGHGIG

SEQ ID NO: 645621 - protein, 21 aa, Mycobacterium
DHRCRVHGIENLWVIDGSVLP

SEQ ID NO: 645622 - protein, 18 aa, Mycobacterium
DHRGLLDAVQFGEGGADF

SEQ ID NO: 645623 - protein, 18 aa, Mycobacterium
DHRGRPFFELLARIGART

SEQ ID NO: 645624 - protein, 17 aa, Mycobacterium
DHRGSYLQMHFALDEAP

SEQ ID NO: 645625 - protein, 19 aa, Mycobacterium
DHRHSLGGVQVRIPGLPPV

SEQ ID NO: 645626 - protein, 17 aa, Mycobacterium
DHRKGVIDYVDIRGRTK

SEQ ID NO: 645627 - protein, 26 aa, Mycobacterium
DHRMVVPIPAGWSFAAAASIPVAFLT

SEQ ID NO: 645628 - protein, 20 aa, Mycobacterium
DHRNGAVLMMMWSAILDYAD

SEQ ID NO: 645629 - protein, 29 aa, Mycobacterium
DHRNGAVVLLMWAGILAYLDRCDYTYVTG

SEQ ID NO: 645630 - protein, 18 aa, Mycobacterium
DHRPTVMLLGGGALSREL

SEQ ID NO: 645631 - protein, 24 aa, Mycobacterium
DHRRARLDVMAQRIVITGAGGMVG

SEQ ID NO: 645632 - protein, 24 aa, Mycobacterium
DHRRAVKVIDWFVRATVDRRYEIT

SEQ ID NO: 645633 - protein, 20 aa, Mycobacterium
DHRRIEGLIAPGTFNVDPSA

SEQ ID NO: 645634 - protein, 30 aa, Mycobacterium
DHRRRVGQLWARFNAVAVANPYAWIRTPMT

SEQ ID NO: 645635 - protein, 19 aa, Mycobacterium
DHRSHVVLMGRSWGELASS

SEQ ID NO: 645636 - protein, 19 aa, Mycobacterium
DHRVKLSGYRIELGEVEAA

SEQ ID NO: 645637 - protein, 18 aa, Mycobacterium
DHSITWPAATAVADVHGY

SEQ ID NO: 645638 - protein, 18 aa, Mycobacterium
DHSPRLRVANGLSADRLR

SEQ ID NO: 645639 - protein, 20 aa, Mycobacterium
DHSRMCVCARLMAAERTRAV

SEQ ID NO: 645640 - protein, 27 aa, Mycobacterium
DHSRRLWTLLIFMLWHAIFVERSVVPQ

SEQ ID NO: 645641 - protein, 26 aa, Mycobacterium
DHSRRLWTVLIFMLWHAIFVEHSVVP

SEQ ID NO: 645642 - protein, 26 aa, Mycobacterium
DHSRRLWTVLIFMLWHSIFVEKTVHP

SEQ ID NO: 645643 - protein, 30 aa, Mycobacterium
DHSYPHCWRCRNPLIYRAVSSWFIKVTEFR

SEQ ID NO: 645644 - protein, 18 aa, Mycobacterium
DHTALRLHKPVIRYDLPA

SEQ ID NO: 645645 - protein, 17 aa, Mycobacterium
DHTDSYVKLVFVADDVD

SEQ ID NO: 645646 - protein, 19 aa, Mycobacterium
DHTGCLGVQGCLVGTDDSE

SEQ ID NO: 645647 - protein, 26 aa, Mycobacterium
DHTIRASVLVAEWPVRPGIPDPDPLA

SEQ ID NO: 645648 - protein, 18 aa, Mycobacterium
DHTRLRRLVSKAFVPKVV

SEQ ID NO: 645649 - protein, 24 aa, Mycobacterium
DHTRPEDVLGMLAAQGIVTEVGGA

SEQ ID NO: 645650 - protein, 19 aa, Mycobacterium
DHTRRKGVHMEPNQHVEAE

SEQ ID NO: 645651 - protein, 18 aa, Mycobacterium
DHTSCLAADLIIDATVNN

SEQ ID NO: 645652 - protein, 19 aa, Mycobacterium
DHVAFLRLRATGVDTVGQV

SEQ ID NO: 645653 - protein, 17 aa, Mycobacterium
DHVCAARLLARLGTEDA

SEQ ID NO: 645654 - protein, 25 aa, Mycobacterium
DHVCATRLLARLGMLDAETAALANG

SEQ ID NO: 645655 - protein, 19 aa, Mycobacterium
DHVCVACGMSYPDTRIDDA

SEQ ID NO: 645656 - protein, 17 aa, Mycobacterium
DHVECAMALTAAGLLEQ

SEQ ID NO: 645657 - protein, 23 aa, Mycobacterium
DHVELGESLGLFDMERGAKVSGA

SEQ ID NO: 645658 - protein, 18 aa, Mycobacterium
DHVFNRLAIPSWMARTGF

SEQ ID NO: 645659 - protein, 18 aa, Mycobacterium
DHVGGLSANGCWATFLTC

SEQ ID NO: 645660 - protein, 23 aa, Mycobacterium
DHVHEWRTWPGYSDQERLAAEFA

SEQ ID NO: 645661 - protein, 20 aa, Mycobacterium
DHVLRLGLHRLPIDQFGHLR

SEQ ID NO: 645662 - protein, 20 aa, Mycobacterium
DHVMRLGLHRLPIGEFPHVR

SEQ ID NO: 645663 - protein, 27 aa, Mycobacterium
DHVPAEALAVVNLMSMFGLHRRLRGCA

SEQ ID NO: 645664 - protein, 20 aa, Mycobacterium
DHVPAPFAGVVTLNVVSGQE

SEQ ID NO: 645665 - protein, 19 aa, Mycobacterium
DHVPQRGLLVLGRDVDAHE

SEQ ID NO: 645666 - protein, 19 aa, Mycobacterium
DHVRARWAQIISDSGGVMP

SEQ ID NO: 645667 - protein, 18 aa, Mycobacterium
DHVREVVCEDSLGLAEEF

SEQ ID NO: 645668 - protein, 19 aa, Mycobacterium
DHVVPWPYGPTHPSNLNCK

SEQ ID NO: 645669 - protein, 23 aa, Mycobacterium
DHWPNYRVAQGLAGRRQFRLFLL

SEQ ID NO: 645670 - protein, 20 aa, Mycobacterium
DHWQIARWGSLFTDECASAE

SEQ ID NO: 645671 - protein, 17 aa, Mycobacterium
DHWRHWLPENARKLRAA

SEQ ID NO: 645672 - protein, 26 aa, Mycobacterium
DHYHKIHLYDAFGFAESRTVAPGHEP

SEQ ID NO: 645673 - protein, 25 aa, Mycobacterium
DHYRRTAFDIGEWGIGFMTTSLELG

SEQ ID NO: 645674 - protein, 25 aa, Mycobacterium
DHYRRTAFDIGEWGLGFMTTSLDLG

SEQ ID NO: 645675 - protein, 24 aa, Mycobacterium
DHYRRTAFDIGEWGLGFMTTSLEK

SEQ ID NO: 645676 - protein, 25 aa, Mycobacterium
DHYRRTAFDIGEWGLGFMTTSLELG

SEQ ID NO: 645677 - protein, 32 aa, Mycobacterium
DIAAEEMFGRHGLRLGGLDAQLARLLGDNLGT

SEQ ID NO: 645678 - protein, 24 aa, Mycobacterium
DIAASLGLGALVSRKPKDLSGGQQ

SEQ ID NO: 645679 - protein, 18 aa, Mycobacterium
DIACGTGILASRIRAELH

SEQ ID NO: 645680 - protein, 19 aa, Mycobacterium
DIADGEFLVLVGPSGCGKS

SEQ ID NO: 645681 - protein, 32 aa, Mycobacterium
DIAECDPLWLRRRVGMCFQRPTPFAGTVADNL

SEQ ID NO: 645682 - protein, 29 aa, Mycobacterium
DIAEILGRGALPIVVGGSMLYVQSLLDDW

SEQ ID NO: 645683 - protein, 28 aa, Mycobacterium
DIAERRGEPWFDPAGFFLAFDEDTGALL

SEQ ID NO: 645684 - protein, 19 aa, Mycobacterium
DIAEVYEWMALAHRGLGDD

SEQ ID NO: 645685 - protein, 21 aa, Mycobacterium
DIAGLAWRMPPETPDMLWDVL

SEQ ID NO: 645686 - protein, 24 aa, Mycobacterium
DIAGLPAYPAYALLVEFMAYTGLR

SEQ ID NO: 645687 - protein, 30 aa, Mycobacterium
DIAKHAWQPTWLKWSVSIIGKGALTRAGIA

SEQ ID NO: 645688 - protein, 17 aa, Mycobacterium
DIAKHLDAPLVWCVAAL

SEQ ID NO: 645689 - protein, 18 aa, Mycobacterium
DIALGGFYNYFSSKEELL

SEQ ID NO: 645690 - protein, 28 aa, Mycobacterium
DIALRIWRPRWAVWAAHVARSGGLVRDG

SEQ ID NO: 645691 - protein, 24 aa, Mycobacterium
DIALRRPSLDEVFLALTGDHPKAR

SEQ ID NO: 645692 - protein, 17 aa, Mycobacterium
DIAMLTRLVENIDLASY

SEQ ID NO: 645693 - protein, 28 aa, Mycobacterium
DIAPEEARSGLAYALSKSFVKWYSQSQA

SEQ ID NO: 645694 - protein, 17 aa, Mycobacterium
DIARADCQLVLADSKSS

SEQ ID NO: 645695 - protein, 25 aa, Mycobacterium
DIARAQSALARWPYPNPRQRSAVAE

SEQ ID NO: 645696 - protein, 20 aa, Mycobacterium
DIARLRWQFERLARGVPISA

SEQ ID NO: 645697 - protein, 23 aa, Mycobacterium
DIARMSVLLAGWPETVPGMTLSR

SEQ ID NO: 645698 - protein, 23 aa, Mycobacterium
DIARRLAERSVILLDAGSALPLD

SEQ ID NO: 645699 - protein, 30 aa, Mycobacterium
DIATFDLYSCFPFPVFVACEALGLAGDDPR

SEQ ID NO: 645700 - protein, 18 aa, Mycobacterium
DIATRLSGVLHRHGPGAV

SEQ ID NO: 645701 - protein, 17 aa, Mycobacterium
DIAVCGGVEGGIEALPI

SEQ ID NO: 645702 - protein, 27 aa, Mycobacterium
DIAVEAARIAINYHTPVIILSDGAVAN

SEQ ID NO: 645703 - protein, 18 aa, Mycobacterium
DIAYRPGDVLMFGPEPTG

SEQ ID NO: 645704 - protein, 17 aa, Mycobacterium
DICADIPANGYAMAGRD

SEQ ID NO: 645705 - protein, 23 aa, Mycobacterium
DICALGLESKELFLLAEIDEHPY

SEQ ID NO: 645706 - protein, 21 aa, Mycobacterium
DICALPDFALPSYRDVSAEQI

SEQ ID NO: 645707 - protein, 20 aa, Mycobacterium
DICAVDGLAGIYVGPADLAI

SEQ ID NO: 645708 - protein, 20 aa, Mycobacterium
DICGLGRDLGLTATDDVDAL

SEQ ID NO: 645709 - protein, 24 aa, Mycobacterium
DICRVTPDLVRFVAQRGGSAAKVL

SEQ ID NO: 645710 - protein, 19 aa, Mycobacterium
DICTCRPYLTHAIEECIRG

SEQ ID NO: 645711 - protein, 18 aa, Mycobacterium
DICVEAFADVAIVKPQVA

SEQ ID NO: 645712 - protein, 20 aa, Mycobacterium
DICVEAFSGFAVVKPQVAFF

SEQ ID NO: 645713 - protein, 18 aa, Mycobacterium
DICVRGMEIRTFMSDYPD

SEQ ID NO: 645714 - protein, 18 aa, Mycobacterium
DICVRGMEIRTFMTDHPD

SEQ ID NO: 645715 - protein, 26 aa, Mycobacterium
DIDEAFKLGDVVAVFAPGGRLQQCDE

SEQ ID NO: 645716 - protein, 25 aa, Mycobacterium
DIDEAIKLGDKVAVFGRGGVLQQYD

SEQ ID NO: 645717 - protein, 25 aa, Mycobacterium
DIDEAIKLGDRVAVFGRGGVLEQYD

SEQ ID NO: 645718 - protein, 26 aa, Mycobacterium
DIDEALKLADQVAVFRAGSLQQYDEP

SEQ ID NO: 645719 - protein, 25 aa, Mycobacterium
DIDEALRLGERVAVFKGGSLQQYDE

SEQ ID NO: 645720 - protein, 18 aa, Mycobacterium
DIDFGRIRLKAGGGVAGH

SEQ ID NO: 645721 - protein, 19 aa, Mycobacterium
DIDGAWWPRADRITNELPG

SEQ ID NO: 645722 - protein, 18 aa, Mycobacterium
DIDGFSWQLEKALPVPVF

SEQ ID NO: 645723 - protein, 27 aa, Mycobacterium
DIDGFSWRLENALPVPVFVQAMAQVTI

SEQ ID NO: 645724 - protein, 28 aa, Mycobacterium
DIDGGAPLTECLKDVVERFVPYFTEVIV

SEQ ID NO: 645725 - protein, 25 aa, Mycobacterium
DIDGNEIMKILGIPPGPQVGQAWNH

SEQ ID NO: 645726 - protein, 18 aa, Mycobacterium
DIDIRWRTVTFALVTHAA

SEQ ID NO: 645727 - protein, 17 aa, Mycobacterium
DIDIRWRTVTFALVTHS

SEQ ID NO: 645728 - protein, 17 aa, Mycobacterium
DIDIRWRTVTFGLVTHS

SEQ ID NO: 645729 - protein, 18 aa, Mycobacterium
DIDIRWRTVTFVLSTHSE

SEQ ID NO: 645730 - protein, 31 aa, Mycobacterium; identical to SEQ ID NO: 78763

SEQ ID NO: 645731 - protein, 30 aa, Mycobacterium; identical to SEQ ID NO: 87449

SEQ ID NO: 645732 - protein, 26 aa, Mycobacterium
DIDKVFVVACGTAFHSGLLAKYAIEH

SEQ ID NO: 645733 - protein, 18 aa, Mycobacterium
DIDPALRNLECRIAPTQT

SEQ ID NO: 645734 - protein, 18 aa, Mycobacterium
DIDPAWLDGVTTIGVTSG

SEQ ID NO: 645735 - protein, 26 aa, Mycobacterium
DIDPKWREAGIFPILSEGALRATLGI

SEQ ID NO: 645736 - protein, 22 aa, Mycobacterium
DIDRLKVTTVLGRGTAQALKAR

SEQ ID NO: 645737 - protein, 38 aa, Mycobacterium
DIDRLRAFLLDKVAKWWIPERWSFVSEIPRTSVGKYDK

SEQ ID NO: 645738 - protein, 22 aa, Mycobacterium
DIDRPDAWEVQGRGELALAVLV

SEQ ID NO: 645739 - protein, 18 aa, Mycobacterium
DIDRPFWDAIVVVRYPSR

SEQ ID NO: 645740 - protein, 18 aa, Mycobacterium
DIDRRLAAADAHLAARYP

SEQ ID NO: 645741 - protein, 25 aa, Mycobacterium
DIDRYTALHDLGWTIIRVSNKLLRY

SEQ ID NO: 645742 - protein, 18 aa, Mycobacterium
DIDSFGYDDCAGHPRWYE

SEQ ID NO: 645743 - protein, 25 aa, Mycobacterium
DIDSFGYDDCRGHPAWFEPTEWLGG

SEQ ID NO: 645744 - protein, 20 aa, Mycobacterium
DIDVSFPLGVLTSVTGVSGS

SEQ ID NO: 645745 - protein, 20 aa, Mycobacterium
DIEADIVRRGWAVGESLGSE

SEQ ID NO: 645746 - protein, 19 aa, Mycobacterium
DIEALGYGAIWAGGSPPAE

SEQ ID NO: 645747 - protein, 23 aa, Mycobacterium
DIEALGYGAVWVGGSPPAELSWV

SEQ ID NO: 645748 - protein, 17 aa, Mycobacterium
DIEEFARRFAVQVEDGF

SEQ ID NO: 645749 - protein, 23 aa, Mycobacterium
DIEEFARRFGVQVEDGFGSTENA

SEQ ID NO: 645750 - protein, 24 aa, Mycobacterium
DIEEFARRFGVQVEDGFGSTENAV

SEQ ID NO: 645751 - protein, 24 aa, Mycobacterium
DIEEFSRRFAVQVEDGFGSTENAV

SEQ ID NO: 645752 - protein, 33 aa, Mycobacterium
DIEGISWLAGHLKGRWARNTGGLLLVTHDRWFL

SEQ ID NO: 645753 - protein, 18 aa, Mycobacterium
DIEKVLPESAARVRANID

SEQ ID NO: 645754 - protein, 23 aa, Mycobacterium
DIELAVRLRLVIADATGEWADLV

SEQ ID NO: 645755 - protein, 25 aa, Mycobacterium
DIELHDRMALEWSIVVLGPDTAAAL

SEQ ID NO: 645756 - protein, 18 aa, Mycobacterium
DIEPRQPRICLISNVSGD

SEQ ID NO: 645757 - protein, 24 aa, Mycobacterium
DIEPRQVLILVEWESRDAFDGYCN

SEQ ID NO: 645758 - protein, 19 aa, Mycobacterium
DIERPARVLADYDDQGPVY

SEQ ID NO: 645759 - protein, 19 aa, Mycobacterium
DIERTDLLVIMGANPAASQ

SEQ ID NO: 645760 - protein, 19 aa, Mycobacterium
DIEVAHLRRPWAARAARTA

SEQ ID NO: 645761 - protein, 23 aa, Mycobacterium
DIEVGLRVRVRFHDVGPGVTLPY

SEQ ID NO: 645762 - protein, 31 aa, Mycobacterium
DIEVPAPPFWGSRIVKGLAVADYTGMLDERA

SEQ ID NO: 645763 - protein, 27 aa, Mycobacterium
DIEYVRLRAALAMGLGDVTGRVLPKVM

SEQ ID NO: 645764 - protein, 20 aa, Mycobacterium
DIFAFPVTITLSYRASSVPA

SEQ ID NO: 645765 - protein, 17 aa, Mycobacterium
DIFCTPEGPAILDCLEF

SEQ ID NO: 645766 - protein, 23 aa, Mycobacterium
DIFDEFLELAAIRTKAVRQGDPL

SEQ ID NO: 645767 - protein, 24 aa, Mycobacterium
DIFRERKPHIGFGHGAHVCLGMHL

SEQ ID NO: 645768 - protein, 19 aa, Mycobacterium
DIFRFAQAAGFSVEKVQLL

SEQ ID NO: 645769 - protein, 21 aa, Mycobacterium
DIGDTIARYVPPPAAYAPLPE

SEQ ID NO: 645770 - protein, 28 aa, Mycobacterium
DIGFEVLKLSPWVLTARVADQFQAGPCF

SEQ ID NO: 645771 - protein, 18 aa, Mycobacterium
DIGFVFQHYAAFKHLTVW

SEQ ID NO: 645772 - protein, 21 aa, Mycobacterium
DIGGGFGNKVPIYPGYVCAIV

SEQ ID NO: 645773 - protein, 24 aa, Mycobacterium
DIGGWIRLGLMPNEGHAWVNGLLC

SEQ ID NO: 645774 - protein, 24 aa, Mycobacterium
DIGHIPGAVKIDWHTDLNDPRVRD

SEQ ID NO: 645775 - protein, 22 aa, Mycobacterium
DIGKRIERGLALTALLRATLTT

SEQ ID NO: 645776 - protein, 22 aa, Mycobacterium
DIGKRIERGLGLTALLRSTLTT

SEQ ID NO: 645777 - protein, 23 aa, Mycobacterium
DIGLERCQQMFADLNRYAVRPAK

SEQ ID NO: 645778 - protein, 19 aa, Mycobacterium
DIGLWGGKVQRAFRDMGVL

SEQ ID NO: 645779 - protein, 29 aa, Mycobacterium
DIGMFTDRHALALGDGNAFLDGQMQQVSS

SEQ ID NO: 645780 - protein, 19 aa, Mycobacterium
DIGQFLAIVREAAERTIDE

SEQ ID NO: 645781 - protein, 30 aa, Mycobacterium
DIGRAISSPADWRRWWPDLQLNVVEERGEK

SEQ ID NO: 645782 - protein, 17 aa, Mycobacterium
DIGSCTIGLVGYGNIAK

SEQ ID NO: 645783 - protein, 23 aa, Mycobacterium
DIGSLQRFSEKLAQMDDQQVREL

SEQ ID NO: 645784 - protein, 25 aa, Mycobacterium
DIGSRIDPVLARSWLLVNGAHGERF

SEQ ID NO: 645785 - protein, 26 aa, Mycobacterium
DIGSSVSRFLALDFPEQVVAVHRMDA

SEQ ID NO: 645786 - protein, 18 aa, Mycobacterium
DIGSTMAAYAQAWLGDSP

SEQ ID NO: 645787 - protein, 22 aa, Mycobacterium
DIGTAVAGGLVFETASGNTSIG

SEQ ID NO: 645788 - protein, 21 aa, Mycobacterium
DIGVNVWSAMNFLLGYTPWGA

SEQ ID NO: 645789 - protein, 17 aa, Mycobacterium
DIHIPFTPGMAALIQAK

SEQ ID NO: 645790 - protein, 17 aa, Mycobacterium
DIHIPFTPGMASLIQAK

SEQ ID NO: 645791 - protein, 21 aa, Mycobacterium
DIHLTREWILRNSPVPVGTVP

SEQ ID NO: 645792 - protein, 18 aa, Mycobacterium
DIHRAIPVIRAFSHFALL

SEQ ID NO: 645793 - protein, 18 aa, Mycobacterium
DIHSMMSFHLYSHPKTHG

SEQ ID NO: 645794 - protein, 20 aa, Mycobacterium
DIIAAPAWDALRKNHDQIGE

SEQ ID NO: 645795 - protein, 17 aa, Mycobacterium
DIIAIDVCAPVDDTITY

SEQ ID NO: 645796 - protein, 20 aa, Mycobacterium
DIIKASAEDLHWIDPTQPPE

SEQ ID NO: 645797 - protein, 20 aa, Mycobacterium
DIIKGAFELAEKVSIDNLSM

SEQ ID NO: 645798 - protein, 17 aa, Mycobacterium
DIIKLKPDCVVYAAMSD

SEQ ID NO: 645799 - protein, 20 aa, Mycobacterium
DIILAGGMQNMSWVPISSAM

SEQ ID NO: 645800 - protein, 18 aa, Mycobacterium
DIKAAADAGRFRVGDPEL

SEQ ID NO: 645801 - protein, 18 aa, Mycobacterium
DILAETFGLIVYQEQIMF

SEQ ID NO: 645802 - protein, 24 aa, Mycobacterium
DILAHCRAHLAGFKTPKRVFLVDS

SEQ ID NO: 645803 - protein, 26 aa, Mycobacterium
DILATEILDPLGFRWTNFGVAKQDLP

SEQ ID NO: 645804 - protein, 17 aa, Mycobacterium
DILEAEGIRVELGADAI

SEQ ID NO: 645805 - protein, 21 aa, Mycobacterium
DILECLGALAADQGRDREAAR

SEQ ID NO: 645806 - protein, 19 aa, Mycobacterium
DILEGHGFVSVRVKNYGTV

SEQ ID NO: 645807 - protein, 23 aa, Mycobacterium
DILEKRIDAALVISNDSDLKFPV

SEQ ID NO: 645808 - protein, 17 aa, Mycobacterium
DILGFEVRLDVGKGEMR

SEQ ID NO: 645809 - protein, 17 aa, Mycobacterium
DILGFPIVHSVCAVGWG

SEQ ID NO: 645810 - protein, 25 aa, Mycobacterium
DILGKGVACQARFDPQAKGLGEWLR

SEQ ID NO: 645811 - protein, 24 aa, Mycobacterium
DILGKGVAYQARFDPQAKGIGEWL

SEQ ID NO: 645812 - protein, 25 aa, Mycobacterium
DILIANAGVLSWGRLWEMSDQQWED

SEQ ID NO: 645813 - protein, 17 aa, Mycobacterium
DILIARTTDPSWVSLMF

SEQ ID NO: 645814 - protein, 17 aa, Mycobacterium
DILLQGVSICFDQLHEI

SEQ ID NO: 645815 - protein, 24 aa, Mycobacterium
DILPRPDTYYGFSKAALEALGSLF

SEQ ID NO: 645816 - protein, 17 aa, Mycobacterium
DILRAVALGASLVGVAR

SEQ ID NO: 645817 - protein, 19 aa, Mycobacterium
DILRKWEVPCAPVMSMKEL

SEQ ID NO: 645818 - protein, 29 aa, Mycobacterium
DILRRRLPDLKVRVVNVVDIMRLQPESEH

SEQ ID NO: 645819 - protein, 23 aa, Mycobacterium
DILRSGPVMAHLAAWGAGSALGD

SEQ ID NO: 645820 - protein, 23 aa, Mycobacterium
DILSMRIPKPWFVLMPTPVWDQM

SEQ ID NO: 645821 - protein, 20 aa, Mycobacterium
DINGLLRVAMLYNDFWLAET

SEQ ID NO: 645822 - protein, 18 aa, Mycobacterium
DINIMPQVWAMRYTLERA

SEQ ID NO: 645823 - protein, 19 aa, Mycobacterium
DINIMPQVWAMRYTLERAM

SEQ ID NO: 645824 - protein, 28 aa, Mycobacterium
DINVFGRRAGIAAARYARGHDFVDMPAE

SEQ ID NO: 645825 - protein, 18 aa, Mycobacterium
DINVPRAGVVRLIGGTTP

SEQ ID NO: 645826 - protein, 24 aa, Mycobacterium
DINVRGHKVFKHLSPQVYAPGIVP

SEQ ID NO: 645827 - protein, 19 aa, Mycobacterium
DIPCGPVRTCVGCRKRELA

SEQ ID NO: 645828 - protein, 23 aa, Mycobacterium
DIPDERRGAAFVSACALVTPEGE

SEQ ID NO: 645829 - protein, 26 aa, Mycobacterium
DIPDNEFRVVLARRGQHWVSAVRVGG

SEQ ID NO: 645830 - protein, 26 aa, Mycobacterium
DIPDNEFRVVLARRGQHWVSAVRVGN

SEQ ID NO: 645831 - protein, 26 aa, Mycobacterium
DIPDNEFRVVLARRGQHWVSAVRVGS

SEQ ID NO: 645832 - protein, 19 aa, Mycobacterium
DIPDWAVFYLLPVDRQRCQ

SEQ ID NO: 645833 - protein, 17 aa, Mycobacterium
DIPEELDRFLVAVTFRI

SEQ ID NO: 645834 - protein, 22 aa, Mycobacterium
DIPEVKDWVWPAARESGFGTAG

SEQ ID NO: 645835 - protein, 21 aa, Mycobacterium
DIPGARLARDGVPVYERSVLI

SEQ ID NO: 645836 - protein, 25 aa, Mycobacterium
DIPGVFPRALPRVGLDSLPDEGAWL

SEQ ID NO: 645837 - protein, 25 aa, Mycobacterium
DIPIDETRQILGLAAAEVYNFDLDA

SEQ ID NO: 645838 - protein, 30 aa, Mycobacterium
DIPKSRILSDLGWRRCPRRKPGAGEVELRM

SEQ ID NO: 645839 - protein, 26 aa, Mycobacterium
DIPLAIDHFRYFAGAIRAQEGSLSQI

SEQ ID NO: 645840 - protein, 27 aa, Mycobacterium
DIPLAIDHFRYFAGVLRAQEGSISEID

SEQ ID NO: 645841 - protein, 28 aa, Mycobacterium
DIPLAIDHFRYFAGVLRAQEGSLSQIDE

SEQ ID NO: 645842 - protein, 18 aa, Mycobacterium
DIPLAIDHFRYFASAIRA

SEQ ID NO: 645843 - protein, 21 aa, Mycobacterium
DIPLDAARVATVYAAYEALKV

SEQ ID NO: 645844 - protein, 23 aa, Mycobacterium
DIPNDRPALLIGEGLTMYLNEPD

SEQ ID NO: 645845 - protein, 23 aa, Mycobacterium
DIPNLVRSGAKWAGSAGVTDPLA

SEQ ID NO: 645846 - protein, 19 aa, Mycobacterium
DIPQFLAIAREAADRATGL

SEQ ID NO: 645847 - protein, 24 aa, Mycobacterium
DIPRHEVTIGLAFRALTREPGLLP

SEQ ID NO: 645848 - protein, 19 aa, Mycobacterium
DIPSVIYQYSFFRNPHWSR

SEQ ID NO: 645849 - protein, 22 aa, Mycobacterium
DIPTTRLDDVLTRSPRLIATAV

SEQ ID NO: 645850 - protein, 26 aa, Mycobacterium
DIPVKGRGGAGVAFHPFVKGEDALLA

SEQ ID NO: 645851 - protein, 24 aa, Mycobacterium
DIPVKGRGGAGVGFHPFGKGEDAL

SEQ ID NO: 645852 - protein, 20 aa, Mycobacterium
DIPVKILWGRDDLIMAPKYG

SEQ ID NO: 645853 - protein, 22 aa, Mycobacterium
DIQAAPLRRVRAVIGAAREATA

SEQ ID NO: 645854 - protein, 27 aa, Mycobacterium
DIQAPLRWFREAYPGLDIDQATLLGFA

SEQ ID NO: 645855 - protein, 24 aa, Mycobacterium
DIQLALYVCYELHYRGFDGVDPDW

SEQ ID NO: 645856 - protein, 23 aa, Mycobacterium
DIQLRPALERALAAACATEPMYA

SEQ ID NO: 645857 - protein, 26 aa, Mycobacterium
DIQSFDWRTLPLVHRAEPSIPLVALY

SEQ ID NO: 645858 - protein, 18 aa, Mycobacterium
DIRAHAAAVLPDYMVPGA

SEQ ID NO: 645859 - protein, 21 aa, Mycobacterium
DIRARGRLIVGLDIGSNLFSF

SEQ ID NO: 645860 - protein, 22 aa, Mycobacterium
DIRARGYGAWRFDDTHQSLHHR

SEQ ID NO: 645861 - protein, 17 aa, Mycobacterium
DIREYLVGIGFDPALIH

SEQ ID NO: 645862 - protein, 19 aa, Mycobacterium
DIRFLKFLRESIFPGGELP

SEQ ID NO: 645863 - protein, 20 aa, Mycobacterium
DIRGTCVLVDGSIKTLSGSG

SEQ ID NO: 645864 - protein, 19 aa, Mycobacterium
DIRHADCRLIVTDSVGAQR

SEQ ID NO: 645865 - protein, 26 aa, Mycobacterium
DIRHYWDKHMCASFMVDPLGLRLIDD

SEQ ID NO: 645866 - protein, 23 aa, Mycobacterium
DIRKAVPNWLVWTHGCPGGETSA

SEQ ID NO: 645867 - protein, 18 aa, Mycobacterium
DIRLRPAVEQAFAAACVT

SEQ ID NO: 645868 - protein, 17 aa, Mycobacterium
DIRLRREYQRAAFEAGW

SEQ ID NO: 645869 - protein, 17 aa, Mycobacterium
DIRPELVSFTFGAPPPD

SEQ ID NO: 645870 - protein, 24 aa, Mycobacterium
DIRPGELVALLGPSGCGKTTTLRM

SEQ ID NO: 645871 - protein, 26 aa, Mycobacterium
DIRRKEILERLGWTVIRVLAGDRPTD

SEQ ID NO: 645872 - protein, 21 aa, Mycobacterium
DIRSAFCMTEPDVASSDATNM

SEQ ID NO: 645873 - protein, 20 aa, Mycobacterium
DIRSSERCGIAIIHQELALV

SEQ ID NO: 645874 - protein, 24 aa, Mycobacterium
DIRTDVSLVLRMHHGGDFVIEPLP

SEQ ID NO: 645875 - protein, 19 aa, Mycobacterium
DISAAIAYLVSDAAEYVTG

SEQ ID NO: 645876 - protein, 26 aa, Mycobacterium
DISAGCSGFGHALGIAADMIRGGSAA

SEQ ID NO: 645877 - protein, 24 aa, Mycobacterium
DISAKADLIGAIRLPSKAFTRVAG

SEQ ID NO: 645878 - protein, 39 aa, Mycobacterium
DISDDGRVALGWRLKLLVAAYPVLAMKWGMRRLALQTAI

SEQ ID NO: 645879 - protein, 19 aa, Mycobacterium
DISEAILLSQQVWVMSYRP

SEQ ID NO: 645880 - protein, 18 aa, Mycobacterium
DISITYAGYCSDFGRTWV

SEQ ID NO: 645881 - protein, 21 aa, Mycobacterium
DISLLGKARKVVITKDETTIV

SEQ ID NO: 645882 - protein, 24 aa, Mycobacterium
DISNEFYELFLGPTMGYTCGYFER

SEQ ID NO: 645883 - protein, 23 aa, Mycobacterium
DISPLQARCGWAIGWKRRRSSAA

SEQ ID NO: 645884 - protein, 18 aa, Mycobacterium
DISRLRAGNFYVATEGES

SEQ ID NO: 645885 - protein, 24 aa, Mycobacterium
DISRPGMLHACFVRSPFAHARING

SEQ ID NO: 645886 - protein, 25 aa, Mycobacterium
DISRPGMLHACFVRSPFARARINSI

SEQ ID NO: 645887 - protein, 22 aa, Mycobacterium
DISRPLWTATLIEGVQDGRAAL

SEQ ID NO: 645888 - protein, 26 aa, Mycobacterium
DISRVRRFAHPVLLERARAAELATAA

SEQ ID NO: 645889 - protein, 29 aa, Mycobacterium
DISSLRLVACGGSAVPLSLMQAFQERHDV

SEQ ID NO: 645890 - protein, 19 aa, Mycobacterium
DISSLRWIVSQLLEALDSG

SEQ ID NO: 645891 - protein, 23 aa, Mycobacterium
DISWKELLGRTAAFADALVSLGV

SEQ ID NO: 645892 - protein, 22 aa, Mycobacterium
DITAQLSPLIAVVPNALQGMAT

SEQ ID NO: 645893 - protein, 20 aa, Mycobacterium
DITATPAWDALRRHHEQIGA

SEQ ID NO: 645894 - protein, 20 aa, Mycobacterium
DITATPAWDALRRHHERIGA

SEQ ID NO: 645895 - protein, 20 aa, Mycobacterium
DITATPAWEALRKHHDQIGE

SEQ ID NO: 645896 - protein, 18 aa, Mycobacterium
DITEFGGWLRAQSALSAR

SEQ ID NO: 645897 - protein, 19 aa, Mycobacterium
DITIALGFTEPECGSDVAA

SEQ ID NO: 645898 - protein, 24 aa, Mycobacterium
DITKEVLAALGITVLAEPGFEADD

SEQ ID NO: 645899 - protein, 24 aa, Mycobacterium
DITKEVLGALGITVLAEPGFEADD

SEQ ID NO: 645900 - protein, 25 aa, Mycobacterium
DITKEVLNALGITVLAAPGFEADDI

SEQ ID NO: 645901 - protein, 24 aa, Mycobacterium
DITKEVLNALGITVLAEPGFEADD

SEQ ID NO: 645902 - protein, 18 aa, Mycobacterium
DITMALTVDGIRAAIQPA

SEQ ID NO: 645903 - protein, 18 aa, Mycobacterium
DITPGDVVAVWGAGPVGL

SEQ ID NO: 645904 - protein, 19 aa, Mycobacterium
DITVEFQKGGAPAVYLLDG

SEQ ID NO: 645905 - protein, 26 aa, Mycobacterium
DIVALRYRQMRNFWATLMVSQGTPMI

SEQ ID NO: 645906 - protein, 33 aa, Mycobacterium
DIVAPKKELEWMRRLGAEIDRPVSFALIQVDAD

SEQ ID NO: 645907 - protein, 20 aa, Mycobacterium
DIVCRIATAMGYPMHYDHPS

SEQ ID NO: 645908 - protein, 19 aa, Mycobacterium
DIVDKSCVQECPADCIYEG

SEQ ID NO: 645909 - protein, 19 aa, Mycobacterium
DIVENMFLGREIKVRGMLD

SEQ ID NO: 645910 - protein, 33 aa, Mycobacterium
DIVGPRKELEWMRRLAGEIDRPVSFALIQVDAD

SEQ ID NO: 645911 - protein, 25 aa, Mycobacterium
DIVHSYMGYRTCYYRTLNVAGATRA

SEQ ID NO: 645912 - protein, 18 aa, Mycobacterium
DIVIRGGENVSPREIEEF

SEQ ID NO: 645913 - protein, 31 aa, Mycobacterium
DIVIRQIRSITWCRRRTIQVGRIATRVPQEW

SEQ ID NO: 645914 - protein, 17 aa, Mycobacterium
DIVIRYITFAPYHMQTM

SEQ ID NO: 645915 - protein, 18 aa, Mycobacterium
DIVKDWLADLEYLVAAIL

SEQ ID NO: 645916 - protein, 24 aa, Mycobacterium
DIVLIRTGWWARFLMTGNKTERYS

SEQ ID NO: 645917 - protein, 21 aa, Mycobacterium
DIVLIRTGWWTRFAQTGDKTE

SEQ ID NO: 645918 - protein, 23 aa, Mycobacterium
DIVLIRTGWWTRFLMTANKTEPY

SEQ ID NO: 645919 - protein, 21 aa, Mycobacterium
DIVLIRTGWWTRFLQTGNKTE

SEQ ID NO: 645920 - protein, 19 aa, Mycobacterium
DIVPRGMRALRAPTIVAAL

SEQ ID NO: 645921 - protein, 28 aa, Mycobacterium
DIVPRYRTMRGFKVERRFGWDTHGLPAE

SEQ ID NO: 645922 - protein, 19 aa, Mycobacterium
DIVRLLRLYDAGQLKLDEL

SEQ ID NO: 645923 - protein, 18 aa, Mycobacterium
DIVRRVRTSGAPTDTIPN

SEQ ID NO: 645924 - protein, 38 aa, Mycobacterium
DIVSGWAGLETWPGLASVPPTPFPAAITNLGGSAISAG

SEQ ID NO: 645925 - protein, 18 aa, Mycobacterium
DIVSGWAGVQSFPGTGAV

SEQ ID NO: 645926 - protein, 20 aa, Mycobacterium
DIVSGWNGEQSWPGSGPAPV

SEQ ID NO: 645927 - protein, 25 aa, Mycobacterium
DIVVLRAGPLGGVRRALRRAERLGL

SEQ ID NO: 645928 - protein, 17 aa, Mycobacterium
DIVVRGGENISPREIEE

SEQ ID NO: 645929 - protein, 23 aa, Mycobacterium
DIWDKGKAAVIWSETRVTTPDGE

SEQ ID NO: 645930 - protein, 18 aa, Mycobacterium
DIWDKGKAAVIWSETTVS

SEQ ID NO: 645931 - protein, 22 aa, Mycobacterium
DIWDKGKAAVIWSETTVTAPDG

SEQ ID NO: 645932 - protein, 23 aa, Mycobacterium
DIWGRRRLAYEIAKHAEGIYAII

SEQ ID NO: 645933 - protein, 23 aa, Mycobacterium
DIWGRRRLAYEIAKHAEGIYAVI

SEQ ID NO: 645934 - protein, 24 aa, Mycobacterium
DIWGRRRLAYEIAKHAEGIYAVID

SEQ ID NO: 645935 - protein, 24 aa, Mycobacterium
DIWGRRRLAYEIAKHSEGIYVVVD

SEQ ID NO: 645936 - protein, 18 aa, Mycobacterium
DIYAAFLQGFRDLFTELS

SEQ ID NO: 645937 - protein, 27 aa, Mycobacterium
DIYADTRLGLFPFRRNLSFYAVDLALM

SEQ ID NO: 645938 - protein, 27 aa, Mycobacterium
DIYGDSRLGLFPFRRNLSLFAVDLALL

SEQ ID NO: 645939 - protein, 27 aa, Mycobacterium
DIYGDTRLGLFPFRRNLSFHAVDLVLV

SEQ ID NO: 645940 - protein, 27 aa, Mycobacterium
DIYGDTRLGLFPFRRNLTFYALDLGLM

SEQ ID NO: 645941 - protein, 26 aa, Mycobacterium
DIYLREVQDVWTWVRPYFDDRATGTA

SEQ ID NO: 645942 - protein, 30 aa, Mycobacterium
DIYNPLRFLRAGLKWCRKAAELGTIDEAAA

SEQ ID NO: 645943 - protein, 17 aa, Mycobacterium
DIYRPTAAMATPTPDAA

SEQ ID NO: 645944 - protein, 19 aa, Mycobacterium
DIYWCTADPGWVTGTSYGI

SEQ ID NO: 645945 - protein, 22 aa, Mycobacterium
DKAAIRTGRFDSIVEVGYPNST

SEQ ID NO: 645946 - protein, 21 aa, Mycobacterium
DKAAIRTGRFDSIVEVGYPSR

SEQ ID NO: 645947 - protein, 19 aa, Mycobacterium
DKAASFIRFCDAYNLPLVF

SEQ ID NO: 645948 - protein, 18 aa, Mycobacterium
DKAASFIRFCDSYNLPLV

SEQ ID NO: 645949 - protein, 23 aa, Mycobacterium
DKAFGLVKINPLAAWSDDDMQDY

SEQ ID NO: 645950 - protein, 22 aa, Mycobacterium
DKAGEWCVATLPPAARQPAVSE

SEQ ID NO: 645951 - protein, 19 aa, Mycobacterium
DKAGLWPYLEKLGFYLVGY

SEQ ID NO: 645952 - protein, 17 aa, Mycobacterium
DKAGRLFIIGRQDDLII

SEQ ID NO: 645953 - protein, 21 aa, Mycobacterium
DKAGRLRLHVRIDERTAGFLA

SEQ ID NO: 645954 - protein, 26 aa, Mycobacterium
DKAIADGDFRWAATLLDHAVFTDSNH

SEQ ID NO: 645955 - protein, 24 aa, Mycobacterium
DKAKALGLRPRARIVSQALVGAEP

SEQ ID NO: 645956 - protein, 25 aa, Mycobacterium
DKALDWPDVYVFTGLTSDELTQAGV

SEQ ID NO: 645957 - protein, 24 aa, Mycobacterium
DKALDWPDVYVFTGRTPDELRDAG

SEQ ID NO: 645958 - protein, 19 aa, Mycobacterium
DKALNEKLKEAATAENKGE

SEQ ID NO: 645959 - protein, 22 aa, Mycobacterium
DKAPVFVNGCLRSWRDVGQREC

SEQ ID NO: 645960 - protein, 22 aa, Mycobacterium
DKARALRVIDWFLSATTERRYE

SEQ ID NO: 645961 - protein, 22 aa, Mycobacterium
DKARALRVIDWFVSATAERRYE

SEQ ID NO: 645962 - protein, 22 aa, Mycobacterium
DKARIRVANLLTHTSGIPGRQP

SEQ ID NO: 645963 - protein, 21 aa, Mycobacterium
DKARTSIANFKTRSTTIGPAA

SEQ ID NO: 645964 - protein, 19 aa, Mycobacterium
DKCRVPIPWSGDAPPFGFS

SEQ ID NO: 645965 - protein, 23 aa, Mycobacterium
DKDEFTRRLPLMAEKRDFSEPVA

SEQ ID NO: 645966 - protein, 24 aa, Mycobacterium
DKDIPHVGAPIIVKYVSDLRLLGL

SEQ ID NO: 645967 - protein, 18 aa, Mycobacterium
DKDLALLCVKAWNDFYID

SEQ ID NO: 645968 - protein, 18 aa, Mycobacterium
DKDRPSLIGLAAVEAALA

SEQ ID NO: 645969 - protein, 24 aa, Mycobacterium
DKDSRGGSSFAEFAANAKALSGNK

SEQ ID NO: 645970 - protein, 22 aa, Mycobacterium
DKDYRRYGGVEFYSAIADSSPE

SEQ ID NO: 645971 - protein, 20 aa, Mycobacterium
DKEARRIVGHYIAAGMFTKP

SEQ ID NO: 645972 - protein, 24 aa, Mycobacterium
DKEFYDRLEAAGFELDWGADGSGL

SEQ ID NO: 645973 - protein, 18 aa, Mycobacterium
DKELATWCAPRSGDEIVE

SEQ ID NO: 645974 - protein, 23 aa, Mycobacterium
DKELRAKLTPQYEFGCKRPTYSN

SEQ ID NO: 645975 - protein, 22 aa, Mycobacterium
DKFARCPWRAGPFGMPILDDAV

SEQ ID NO: 645976 - protein, 24 aa, Mycobacterium
DKFERCSWRAGPYGMPILDDAAAW

SEQ ID NO: 645977 - protein, 26 aa, Mycobacterium
DKFERPRLRALSAIKQRAEERDMSQP

SEQ ID NO: 645978 - protein, 28 aa, Mycobacterium
DKFFSRNCRTWLGIALMMQGHLAEAKEV

SEQ ID NO: 645979 - protein, 18 aa, Mycobacterium
DKFGFWGLSRFADVEAAL

SEQ ID NO: 645980 - protein, 17 aa, Mycobacterium
DKFPRMVDYVMPSGVRI

SEQ ID NO: 645981 - protein, 23 aa, Mycobacterium
DKFYPEAMRAIGLPELVEDERFA

SEQ ID NO: 645982 - protein, 18 aa, Mycobacterium
DKGARWDPAELGPVVGDL

SEQ ID NO: 645983 - protein, 18 aa, Mycobacterium
DKGARWDPAELGRVVADL

SEQ ID NO: 645984 - protein, 26 aa, Mycobacterium
DKGGNANIGLWARDDAGYAWVREHLT

SEQ ID NO: 645985 - protein, 23 aa, Mycobacterium
DKGGSAYVGVWVRSDASYRWLVH

SEQ ID NO: 645986 - protein, 23 aa, Mycobacterium
DKGHRRLAASGWLIIGTPASTPD

SEQ ID NO: 645987 - protein, 21 aa, Mycobacterium
DKGIRERVFRIYNEHIAALQE

SEQ ID NO: 645988 - protein, 19 aa, Mycobacterium
DKGKAAVIWSETTVSAPDG

SEQ ID NO: 645989 - protein, 19 aa, Mycobacterium
DKGKAAVIWSETTVTTLDG

SEQ ID NO: 645990 - protein, 20 aa, Mycobacterium
DKGKTLRWVIDHLPDQRAAP

SEQ ID NO: 645991 - protein, 17 aa, Mycobacterium
DKGLGWKAEVEAALERL

SEQ ID NO: 645992 - protein, 18 aa, Mycobacterium
DKGLWLSIIDKLGLPFTD

SEQ ID NO: 645993 - protein, 21 aa, Mycobacterium
DKGNACLSCGHFATDATHLAD

SEQ ID NO: 645994 - protein, 23 aa, Mycobacterium
DKGNACLSCGHFATDRTHLEELV

SEQ ID NO: 645995 - protein, 24 aa, Mycobacterium
DKGNACLTCSVFVTDHTHHDVLHR

SEQ ID NO: 645996 - protein, 21 aa, Mycobacterium
DKGRALAVAVMRKHRLAERLL

SEQ ID NO: 645997 - protein, 32 aa, Mycobacterium
DKGRILTAMSVFFFDHLLRTAGVPNHLAGPPD

SEQ ID NO: 645998 - protein, 17 aa, Mycobacterium
DKGRILTAMSVFFFGLL

SEQ ID NO: 645999 - protein, 23 aa, Mycobacterium
DKHLRSADFFDVDRFPEIGVVVT

SEQ ID NO: 646000 - protein, 22 aa, Mycobacterium
DKHLRSADFFDVERFAEISVVV

SEQ ID NO: 646001 - protein, 23 aa, Mycobacterium
DKHLRSADFFDVERFPQIRVVVT

SEQ ID NO: 646002 - protein, 21 aa, Mycobacterium
DKHMARGRVHTVVADLLDRTI

SEQ ID NO: 646003 - protein, 23 aa, Mycobacterium
DKIDQRLTVLGIDNTITYKAGEP

SEQ ID NO: 646004 - protein, 25 aa, Mycobacterium
DKIEGLRLPLLILHSPTDNTVGIEN

SEQ ID NO: 646005 - protein, 17 aa, Mycobacterium
DKIILFYSSANWDTTVF

SEQ ID NO: 646006 - protein, 25 aa, Mycobacterium
DKIKNLRLPLLILHSPTDNTVGIEN

SEQ ID NO: 646007 - protein, 25 aa, Mycobacterium
DKIKSLRLPLLILHSPTDNTVGIGN

SEQ ID NO: 646008 - protein, 24 aa, Mycobacterium
DKIKTGARVHVHWADETVGAITDI

SEQ ID NO: 646009 - protein, 23 aa, Mycobacterium
DKIPLVMLLEGAGFRPGGGHYGR

SEQ ID NO: 646010 - protein, 23 aa, Mycobacterium
DKIPLVMLLEGAGFRPTGTHYGR

SEQ ID NO: 646011 - protein, 20 aa, Mycobacterium
DKITPGMLMAALRLNIPAVF

SEQ ID NO: 646012 - protein, 20 aa, Mycobacterium
DKITPGMLMAALRLNVPTVF

SEQ ID NO: 646013 - protein, 23 aa, Mycobacterium
DKKERLAELTARWQNEKSSIDAV

SEQ ID NO: 646014 - protein, 20 aa, Mycobacterium
DKKFRRRGVQMVTDGRHTQV

SEQ ID NO: 646015 - protein, 18 aa, Mycobacterium
DKKIRLAPQYLLDDLPRL

SEQ ID NO: 646016 - protein, 23 aa, Mycobacterium
DKKIRLAPQYLLDDLPRLAARME

SEQ ID NO: 646017 - protein, 19 aa, Mycobacterium
DKKVAFAHRLVDAGFTQLE

SEQ ID NO: 646018 - protein, 17 aa, Mycobacterium
DKLADLWTGTNHRGVQL

SEQ ID NO: 646019 - protein, 27 aa, Mycobacterium
DKLAKWSSPLLRPGGRMLAIKGERAAE

SEQ ID NO: 646020 - protein, 19 aa, Mycobacterium
DKLAYRFVDFSTERDGEYR

SEQ ID NO: 646021 - protein, 24 aa, Mycobacterium
DKLDLKPGMTLLDIGCGWGTTMRR

SEQ ID NO: 646022 - protein, 23 aa, Mycobacterium
DKLGAPLRAVRSMSLHVPAETGV

SEQ ID NO: 646023 - protein, 17 aa, Mycobacterium
DKLICAWAATRSVTEAV

SEQ ID NO: 646024 - protein, 23 aa, Mycobacterium
DKLIGDEVMAFFVRGISGPSYRR

SEQ ID NO: 646025 - protein, 20 aa, Mycobacterium
DKLIWAEGFSLPLTQSPGDV

SEQ ID NO: 646026 - protein, 22 aa, Mycobacterium
DKLKDAGFYWATRSGVTVSMAD

SEQ ID NO: 646027 - protein, 17 aa, Mycobacterium
DKLKLLLEFADELPDLP

SEQ ID NO: 646028 - protein, 19 aa, Mycobacterium
DKLLPSGWAAQIAKQIDGA

SEQ ID NO: 646029 - protein, 25 aa, Mycobacterium
DKLPAAQRRDMQWICRDGDRAKNHL

SEQ ID NO: 646030 - protein, 19 aa, Mycobacterium
DKLPAHLRVTFAVESADGS

SEQ ID NO: 646031 - protein, 17 aa, Mycobacterium
DKLPWLSMLPAYFVGVG

SEQ ID NO: 646032 - protein, 22 aa, Mycobacterium
DKLRAMAGIGKRAARFAYDVGR

SEQ ID NO: 646033 - protein, 21 aa, Mycobacterium
DKLRPKVSCITRLAHPVDGRR

SEQ ID NO: 646034 - protein, 21 aa, Mycobacterium
DKLRPKVSCITRLAHPVNGRR

SEQ ID NO: 646035 - protein, 26 aa, Mycobacterium
DKLRSDAKAVAFVHDFVNSGRPVAVI

SEQ ID NO: 646036 - protein, 20 aa, Mycobacterium
DKLRTVLWGWAGKPIDDDTL

SEQ ID NO: 646037 - protein, 19 aa, Mycobacterium
DKLRTVLWGWAGKPVDDES

SEQ ID NO: 646038 - protein, 17 aa, Mycobacterium
DKLRYDTVMVFNGDVLS

SEQ ID NO: 646039 - protein, 20 aa, Mycobacterium
DKLVMRRRLADLGAPIPQFA

SEQ ID NO: 646040 - protein, 23 aa, Mycobacterium
DKLVMRRRLEALGVPVPRYAEIR

SEQ ID NO: 646041 - protein, 22 aa, Mycobacterium
DKLVMRRRLQALDVPVPRYLGI

SEQ ID NO: 646042 - protein, 18 aa, Mycobacterium
DKLVPWAGVSRDFVAKAC

SEQ ID NO: 646043 - protein, 21 aa, Mycobacterium
DKLWAYCNVLRDDGVGVIEYT

SEQ ID NO: 646044 - protein, 31 aa, Mycobacterium
DKLWGTTVFQCPFCHAWELRDQRLATLAAGA

SEQ ID NO: 646045 - protein, 18 aa, Mycobacterium
DKMAYRFIDFSTERDGVE

SEQ ID NO: 646046 - protein, 19 aa, Mycobacterium
DKMFEEFKEPLYGPPPLLL

SEQ ID NO: 646047 - protein, 20 aa, Mycobacterium
DKMLAYNLSPSFNWDTTGMT

SEQ ID NO: 646048 - protein, 24 aa, Mycobacterium
DKNHPACLEVLFAAASIGAVTTIV

SEQ ID NO: 646049 - protein, 26 aa, Mycobacterium
DKNHSWLRTRCAAINLRTLVGNGLTR

SEQ ID NO: 646050 - protein, 26 aa, Mycobacterium
DKNIGWRIVPIIPDEARTFGMDSWFP

SEQ ID NO: 646051 - protein, 23 aa, Mycobacterium
DKPAFKTCVSHGIVLGNDGQKMS

SEQ ID NO: 646052 - protein, 25 aa, Mycobacterium
DKPDATRIVAWHSGERAGPTVEKLI

SEQ ID NO: 646053 - protein, 25 aa, Mycobacterium
DKPDLRFGLELVECAEFFKDTTFRV

SEQ ID NO: 646054 - protein, 24 aa, Mycobacterium
DKPDLRFGLELVECTDYFSETSFR

SEQ ID NO: 646055 - protein, 24 aa, Mycobacterium
DKPDLRFGLELVECTEYFADTPFR

SEQ ID NO: 646056 - protein, 17 aa, Mycobacterium
DKPFFGSLLEFITSGPL

SEQ ID NO: 646057 - protein, 17 aa, Mycobacterium
DKPFFLYHNHSLMHFPM

SEQ ID NO: 646058 - protein, 20 aa, Mycobacterium
DKPGSVVLWTNCHHPFYDEN

SEQ ID NO: 646059 - protein, 22 aa, Mycobacterium
DKPLIRRKLAEMIVDVEAALAL

SEQ ID NO: 646060 - protein, 24 aa, Mycobacterium
DKPLKYPHMFAAADLVLINKSDLL

SEQ ID NO: 646061 - protein, 25 aa, Mycobacterium
DKPLKYPHMFAAAGLVILNKIDLLP

SEQ ID NO: 646062 - protein, 22 aa, Mycobacterium
DKPLKYPVMFRSVDVLLLNKID

SEQ ID NO: 646063 - protein, 22 aa, Mycobacterium
DKPLKYPVMFRSVDVVLLNKID

SEQ ID NO: 646064 - protein, 22 aa, Mycobacterium
DKPLMRRKLAEMIVDVEAAQAL

SEQ ID NO: 646065 - protein, 28 aa, Mycobacterium
DKPMKGMLTGPVTILAWSFVRDDQPLAD

SEQ ID NO: 646066 - protein, 20 aa, Mycobacterium
DKPNRYVWHTTVGELAPKAP

SEQ ID NO: 646067 - protein, 21 aa, Mycobacterium
DKPNVRFVVHASIPESVDTYY

SEQ ID NO: 646068 - protein, 24 aa, Mycobacterium
DKPPGVAETIDWVAALVALRVGDL

SEQ ID NO: 646069 - protein, 23 aa, Mycobacterium
DKPPGVAETIDWVAALVSLGVAD

SEQ ID NO: 646070 - protein, 22 aa, Mycobacterium
DKPRDALALALDQERAVTDQVS

SEQ ID NO: 646071 - protein, 23 aa, Mycobacterium
DKPVGTVCFCAKTAAGEKAELRV

SEQ ID NO: 646072 - protein, 18 aa, Mycobacterium
DKPVHFVQMWVIPDRAGL

SEQ ID NO: 646073 - protein, 18 aa, Mycobacterium
DKPVIFAYHGYPWLIHRL

SEQ ID NO: 646074 - protein, 17 aa, Mycobacterium
DKPWFAIGGIDAPRLPE

SEQ ID NO: 646075 - protein, 23 aa, Mycobacterium
DKQALRLLGSVALARAARGEDDT

SEQ ID NO: 646076 - protein, 23 aa, Mycobacterium
DKQALRLLGSVALARAARGEDDV

SEQ ID NO: 646077 - protein, 23 aa, Mycobacterium
DKQALRLLGSVALARASRGEDDT

SEQ ID NO: 646078 - protein, 23 aa, Mycobacterium
DKQARAALLDHVDIPSSQVHPMP

SEQ ID NO: 646079 - protein, 33 aa, Mycobacterium
DKQERRYQRFAAFWRSRPVNWVWDRLPMTVRYS

SEQ ID NO: 646080 - protein, 21 aa, Mycobacterium
DKQIAATGWRSLRSDGASGVE

SEQ ID NO: 646081 - protein, 18 aa, Mycobacterium
DKRCDVGALARIIDCQNL

SEQ ID NO: 646082 - protein, 22 aa, Mycobacterium
DKRELLDVFVVWERQYYERAIA

SEQ ID NO: 646083 - protein, 18 aa, Mycobacterium
DKRFAFLGTDGTLAVTLW

SEQ ID NO: 646084 - protein, 23 aa, Mycobacterium
DKRFMFDYIPPVFKGQYAETEQE

SEQ ID NO: 646085 - protein, 20 aa, Mycobacterium
DKRFRRRGVQMFSDGRHTQA

SEQ ID NO: 646086 - protein, 18 aa, Mycobacterium
DKRGKRAAGGDADNNQKA

SEQ ID NO: 646087 - protein, 19 aa, Mycobacterium
DKRGLAAVRELWLTRDQIA

SEQ ID NO: 646088 - protein, 20 aa, Mycobacterium
DKRIDNHPGLALVLEGRMKR

SEQ ID NO: 646089 - protein, 21 aa, Mycobacterium
DKRIPLELCPSSNVQTGAVAS

SEQ ID NO: 646090 - protein, 18 aa, Mycobacterium
DKRLLPPAPAYGGIHAEL

SEQ ID NO: 646091 - protein, 26 aa, Mycobacterium
DKRLPRIAGSCGMVIFGVTGDLARKK

SEQ ID NO: 646092 - protein, 19 aa, Mycobacterium
DKRLRLCRDHHGTGGYRRC

SEQ ID NO: 646093 - protein, 26 aa, Mycobacterium
DKRMAELQAMPGFRLNMDLAALGRAG

SEQ ID NO: 646094 - protein, 23 aa, Mycobacterium
DKRQPAEAIAITAGKCADARGTK

SEQ ID NO: 646095 - protein, 17 aa, Mycobacterium
DKRRDGRCHLIELEMAS

SEQ ID NO: 646096 - protein, 24 aa, Mycobacterium
DKSRGMGRNGPWIGGKLTERPSAI

SEQ ID NO: 646097 - protein, 17 aa, Mycobacterium
DKSRTQLMWEINAHATE

SEQ ID NO: 646098 - protein, 21 aa, Mycobacterium
DKSSFAAPGMRGQREVIAAAH

SEQ ID NO: 646099 - protein, 21 aa, Mycobacterium
DKTGHPFLQHLLAHRDATRLK

SEQ ID NO: 646100 - protein, 22 aa, Mycobacterium
DKTGHPFLQHLLAHRDATRLKV

SEQ ID NO: 646101 - protein, 21 aa, Mycobacterium
DKTGHPFLQHLLAHRDVTRLK

SEQ ID NO: 646102 - protein, 19 aa, Mycobacterium
DKTGHPFLQHLLTHRDVTR

SEQ ID NO: 646103 - protein, 25 aa, Mycobacterium
DKTILQAIELWKIVDRPNLLIKIPA

SEQ ID NO: 646104 - protein, 35 aa, Mycobacterium
DKTILQAIELWKIVDRPNLLIKIPATKAGLPAITA

SEQ ID NO: 646105 - protein, 18 aa, Mycobacterium
DKTLVHFGQCTKVDPAAD

SEQ ID NO: 646106 - protein, 24 aa, Mycobacterium
DKTPAQVVLRWHIQRGDIVFPKSV

SEQ ID NO: 646107 - protein, 24 aa, Mycobacterium
DKTVFPAVFPKLLPGVGPGGTRPH

SEQ ID NO: 646108 - protein, 26 aa, Mycobacterium
DKVARFLLGLMERYGPQMTQAINPAL

SEQ ID NO: 646109 - protein, 24 aa, Mycobacterium
DKVARFMFGLARRYGPAFFTANQL

SEQ ID NO: 646110 - protein, 25 aa, Mycobacterium
DKVARIGIRVADVLDEESLRQKVHA

SEQ ID NO: 646111 - protein, 26 aa, Mycobacterium
DKVEFLRKRHEALVGNPLFAKMEFID

SEQ ID NO: 646112 - protein, 18 aa, Mycobacterium
DKVELCAMAKRYVTDTCF

SEQ ID NO: 646113 - protein, 17 aa, Mycobacterium
DKVESYVRLGISEGAQL

SEQ ID NO: 646114 - protein, 19 aa, Mycobacterium
DKVFTRWNVEYTPVALSDL

SEQ ID NO: 646115 - protein, 29 aa, Mycobacterium
DKVIGWALEHRRVPLAASVLLVSGRASFE

SEQ ID NO: 646116 - protein, 24 aa, Mycobacterium
DKVITALSGEEWLGPASASMAQAV

SEQ ID NO: 646117 - protein, 25 aa, Mycobacterium
DKVLAAKADAAWHLHQLTADADLDA

SEQ ID NO: 646118 - protein, 18 aa, Mycobacterium
DKVLEHWLASARRDDEAR

SEQ ID NO: 646119 - protein, 21 aa, Mycobacterium
DKVLPELKRFNLVICDESHNL

SEQ ID NO: 646120 - protein, 26 aa, Mycobacterium
DKVLVHPRPRLSVMCVGGELVDVSRT

SEQ ID NO: 646121 - protein, 18 aa, Mycobacterium
DKVPEPPGGLLSIEDAIT

SEQ ID NO: 646122 - protein, 18 aa, Mycobacterium
DKVPLPGRHWDWGNPDLQ

SEQ ID NO: 646123 - protein, 24 aa, Mycobacterium
DKVRCVDLALLPGVEADMGPGDEW

SEQ ID NO: 646124 - protein, 24 aa, Mycobacterium
DKVRQRIGMVFQHFNLFPHMTVID

SEQ ID NO: 646125 - protein, 24 aa, Mycobacterium
DKVSRLVLCGAYARGRAVRALSDD

SEQ ID NO: 646126 - protein, 24 aa, Mycobacterium
DKVTLCAMAKRYVTDTCFDVADSA

SEQ ID NO: 646127 - protein, 17 aa, Mycobacterium
DKVTLWYGSANRDETKF

SEQ ID NO: 646128 - protein, 19 aa, Mycobacterium
DKVVLGFLGCRDTLPHLQR

SEQ ID NO: 646129 - protein, 31 aa, Mycobacterium
DKVVPDFLWINGEYTARVSLNALERNKMRVV

SEQ ID NO: 646130 - protein, 23 aa, Mycobacterium
DKWADRFKKVGHFIERNAKGDRL

SEQ ID NO: 646131 - protein, 23 aa, Mycobacterium
DKWLRPAPEGVVGELYVAGNGVA

SEQ ID NO: 646132 - protein, 20 aa, Mycobacterium
DKWLRPVPTGVVGELYVAGA

SEQ ID NO: 646133 - protein, 21 aa, Mycobacterium
DKWSVPVEIEYNGEKHTVFVR

SEQ ID NO: 646134 - protein, 21 aa, Mycobacterium
DKYNLRGAFNKGIFESTKGLF

SEQ ID NO: 646135 - protein, 19 aa, Mycobacterium
DKYSLSQRVARLGTEHAWA

SEQ ID NO: 646136 - protein, 24 aa, Mycobacterium
DLAAELRKYWNIDFDDAGAIGRRY

SEQ ID NO: 646137 - protein, 24 aa, Mycobacterium
DLAAELRQSWNVEFDDAGAIGRRY

SEQ ID NO: 646138 - protein, 20 aa, Mycobacterium
DLAAFWTRYLLAARDTGEIH

SEQ ID NO: 646139 - protein, 18 aa, Mycobacterium
DLAAIATLDRVLGRGQFP

SEQ ID NO: 646140 - protein, 26 aa, Mycobacterium
DLAALEFCDSAGLSGLLLVHRRSHQA

SEQ ID NO: 646141 - protein, 33 aa, Mycobacterium
DLAALPESYAVAWTCLFRNLRLTAGQTLLLRGA

SEQ ID NO: 646142 - protein, 23 aa, Mycobacterium
DLAAPRPPLRILYGTQTGNAEIV

SEQ ID NO: 646143 - protein, 24 aa, Mycobacterium
DLAAPRRRPVWVVLPQLRGQVGAL

SEQ ID NO: 646144 - protein, 24 aa, Mycobacterium
DLAARVGAPLVLRGVGVRRVAADR

SEQ ID NO: 646145 - protein, 25 aa, Mycobacterium
DLAARVGAPLVLRGVGVRRVAPDRG

SEQ ID NO: 646146 - protein, 17 aa, Mycobacterium
DLAATAFTLAKRFAAGA

SEQ ID NO: 646147 - protein, 27 aa, Mycobacterium
DLAATRLDRFIGLVVIDRGHPRVADLT

SEQ ID NO: 646148 - protein, 24 aa, Mycobacterium
DLAAWPATLDRLLAVGGPGATYVP

SEQ ID NO: 646149 - protein, 24 aa, Mycobacterium
DLACGRPEPVLVPALLDTNALRAQ

SEQ ID NO: 646150 - protein, 23 aa, Mycobacterium
DLACNGAEALQCYRTRPPDVTLV

SEQ ID NO: 646151 - protein, 24 aa, Mycobacterium
DLACTRFSGRPAPKHPGGAPNCGD

SEQ ID NO: 646152 - protein, 24 aa, Mycobacterium
DLADARKAFGITVSDVLLAPTLRE

SEQ ID NO: 646153 - protein, 26 aa, Mycobacterium
DLAECRTGQIIWGWPHCVQDTGLTQV

SEQ ID NO: 646154 - protein, 17 aa, Mycobacterium
DLAEFYSGADLPELGYT

SEQ ID NO: 646155 - protein, 25 aa, Mycobacterium
DLAELFLPRPLRWLVSATRPTTLRR

SEQ ID NO: 646156 - protein, 25 aa, Mycobacterium
DLAELFLPTPLRWLVAATRAAPLRR

SEQ ID NO: 646157 - protein, 22 aa, Mycobacterium
DLAELNRLFAAWVETVYHRTVH

SEQ ID NO: 646158 - protein, 26 aa, Mycobacterium
DLAERRGEPWFDPAGLFLALEGSEGA

SEQ ID NO: 646159 - protein, 25 aa, Mycobacterium
DLAESVAKPVQWYDIAQVLPELGVQ

SEQ ID NO: 646160 - protein, 34 aa, Mycobacterium
DLAEVAWRQPGIVFFKYLLGMPVDDVPLCVELTD

SEQ ID NO: 646161 - protein, 18 aa, Mycobacterium
DLAGAAWQGPSAAAMASV

SEQ ID NO: 646162 - protein, 21 aa, Mycobacterium
DLAGACSMAAFTASMHAGQGC

SEQ ID NO: 646163 - protein, 19 aa, Mycobacterium
DLAGALCERLGYAQLADVE

SEQ ID NO: 646164 - protein, 19 aa, Mycobacterium
DLAGCKMLVTAGGTREPVD

SEQ ID NO: 646165 - protein, 19 aa, Mycobacterium
DLAGCKVLVTAGGTREPID

SEQ ID NO: 646166 - protein, 19 aa, Mycobacterium
DLAGCREIVIVGAHPDDET

SEQ ID NO: 646167 - protein, 24 aa, Mycobacterium
DLAGECSRCLEPITGHADATITEL

SEQ ID NO: 646168 - protein, 22 aa, Mycobacterium
DLAGERDRIEWLSAQRIPGPSV

SEQ ID NO: 646169 - protein, 23 aa, Mycobacterium
DLAGGWMPPHVRLPAHVTLLEPA

SEQ ID NO: 646170 - protein, 18 aa, Mycobacterium
DLAGPGVTVAEALAAVDF

SEQ ID NO: 646171 - protein, 27 aa, Mycobacterium
DLAGWRHAIDLATQRWVAGTGDEGAMR

SEQ ID NO: 646172 - protein, 23 aa, Mycobacterium
DLAGWYRNGPDATTFSFGIANPG

SEQ ID NO: 646173 - protein, 17 aa, Mycobacterium
DLAHAWAAFRDDAGAWV

SEQ ID NO: 646174 - protein, 17 aa, Mycobacterium
DLAHAWAAFRDDANAWV

SEQ ID NO: 646175 - protein, 29 aa, Mycobacterium
DLAHTVCLAGAFMVPDPIFGRCVTDELPS

SEQ ID NO: 646176 - protein, 30 aa, Mycobacterium
DLAIEYEVMDRLKPAIVLCRDKQDSTTATL

SEQ ID NO: 646177 - protein, 19 aa, Mycobacterium
DLAIKRPLLAAVDDLADQD

SEQ ID NO: 646178 - protein, 23 aa, Mycobacterium
DLAIPFDIVVAGVRRQPYAALPS

SEQ ID NO: 646179 - protein, 22 aa, Mycobacterium
DLAKRFARWRLSIGRSPNQTYI

SEQ ID NO: 646180 - protein, 23 aa, Mycobacterium
DLALELRLACEVFDIDEASVRGV

SEQ ID NO: 646181 - protein, 18 aa, Mycobacterium
DLALKLGLGYKSGPLELL

SEQ ID NO: 646182 - protein, 18 aa, Mycobacterium
DLALQCAPDHPWAKEHPE

SEQ ID NO: 646183 - protein, 18 aa, Mycobacterium
DLALQCAPDHPWAREHRE

SEQ ID NO: 646184 - protein, 18 aa, Mycobacterium
DLALQCAPDHPWARNHRN

SEQ ID NO: 646185 - protein, 21 aa, Mycobacterium
DLALRCVRLLEDRHAVDAGSS

SEQ ID NO: 646186 - protein, 17 aa, Mycobacterium
DLANDVVAEWLIRWLRE

SEQ ID NO: 646187 - protein, 19 aa, Mycobacterium
DLANMMWRRMIDNTEGYME

SEQ ID NO: 646188 - protein, 26 aa, Mycobacterium
DLAPEPRLVVGMSLGGLTALRIAATE

SEQ ID NO: 646189 - protein, 19 aa, Mycobacterium
DLAPLLAEHVLPILSGNRP

SEQ ID NO: 646190 - protein, 17 aa, Mycobacterium
DLAPMLRSYCDFYEVDP

SEQ ID NO: 646191 - protein, 20 aa, Mycobacterium
DLAQRCRRELDGTLRKLAKA

SEQ ID NO: 646192 - protein, 21 aa, Mycobacterium
DLAQRLGIDAFEFRRRNVVVP

SEQ ID NO: 646193 - protein, 18 aa, Mycobacterium
DLARAHVAIDFELISAAM

SEQ ID NO: 646194 - protein, 21 aa, Mycobacterium
DLARARFTLHAGQDSVPVQLA

SEQ ID NO: 646195 - protein, 25 aa, Mycobacterium
DLARAVPTCPGWTVADLLGHLWSIE

SEQ ID NO: 646196 - protein, 23 aa, Mycobacterium
DLARELTEYVLAQGFTHVELLPV

SEQ ID NO: 646197 - protein, 17 aa, Mycobacterium
DLARFPGLNKWTTEDLN

SEQ ID NO: 646198 - protein, 30 aa, Mycobacterium
DLARKLMSAFALGLRLPADYFVDTIDRDIS

SEQ ID NO: 646199 - protein, 25 aa, Mycobacterium
DLARPRREHAWGFIDSVPATGLDAA

SEQ ID NO: 646200 - protein, 19 aa, Mycobacterium
DLARRGRGTPAIFLNVRGG

SEQ ID NO: 646201 - protein, 22 aa, Mycobacterium
DLASACLYLLEHFDGPKPVNVG

SEQ ID NO: 646202 - protein, 21 aa, Mycobacterium
DLASACLYLLEHFDGPNHVNI

SEQ ID NO: 646203 - protein, 17 aa, Mycobacterium
DLASAFGDWESIREHVR

SEQ ID NO: 646204 - protein, 28 aa, Mycobacterium
DLASDVASCLYGFSLLDIIDIADIADRD

SEQ ID NO: 646205 - protein, 17 aa, Mycobacterium
DLASLKVVVSGAGAAGV

SEQ ID NO: 646206 - protein, 24 aa, Mycobacterium
DLATAITWHKYVAGLVVQAKLAID

SEQ ID NO: 646207 - protein, 18 aa, Mycobacterium
DLATLKCRIALNGLASEA

SEQ ID NO: 646208 - protein, 25 aa, Mycobacterium
DLATLRSFLRRRISTTGLVTASVAA

SEQ ID NO: 646209 - protein, 28 aa, Mycobacterium
DLAVRWNCKAGKCGSCSAEINGRPRLLC

SEQ ID NO: 646210 - protein, 18 aa, Mycobacterium
DLAVTFRFGEEVTTVEVN

SEQ ID NO: 646211 - protein, 19 aa, Mycobacterium
DLAYFRVLIHGTRNRALGL

SEQ ID NO: 646212 - protein, 20 aa, Mycobacterium
DLAYGYARNQMTAYVELQER

SEQ ID NO: 646213 - protein, 23 aa, Mycobacterium
DLCEAGAPFGLRPQAILPAYGMA

SEQ ID NO: 646214 - protein, 25 aa, Mycobacterium
DLCELPVAVFRSDMILAHSRYAGQL

SEQ ID NO: 646215 - protein, 24 aa, Mycobacterium
DLCGLPVTVFRCDMILADTSYAGQ

SEQ ID NO: 646216 - protein, 18 aa, Mycobacterium
DLCGVPVAVFRSDMILAH

SEQ ID NO: 646217 - protein, 22 aa, Mycobacterium
DLCLSCKGCASDCPTGVDMAAY

SEQ ID NO: 646218 - protein, 24 aa, Mycobacterium
DLCNLRCTYCMPAEGLDWMPRDQK

SEQ ID NO: 646219 - protein, 17 aa, Mycobacterium
DLCPEMAPDGWNLYVGT

SEQ ID NO: 646220 - protein, 22 aa, Mycobacterium
DLCQAGAPFGLRPQAILPAYGM

SEQ ID NO: 646221 - protein, 20 aa, Mycobacterium
DLCREICRAGRIHVLSVDYR

SEQ ID NO: 646222 - protein, 20 aa, Mycobacterium
DLCRYLHATGLARQKTPVAW

SEQ ID NO: 646223 - protein, 21 aa, Mycobacterium
DLDAAAALIVKGAFGLSGQAC

SEQ ID NO: 646224 - protein, 19 aa, Mycobacterium
DLDAAITFYSKLFNAEPAK

SEQ ID NO: 646225 - protein, 20 aa, Mycobacterium
DLDAAVLKKWARAIDDGPFS

SEQ ID NO: 646226 - protein, 24 aa, Mycobacterium
DLDADEFLKVMLRWLNAFVSKPGQ

SEQ ID NO: 646227 - protein, 18 aa, Mycobacterium
DLDAGYWRAGGRVKIGPK

SEQ ID NO: 646228 - protein, 20 aa, Mycobacterium
DLDALIVVSSPWWDGASAAG

SEQ ID NO: 646229 - protein, 21 aa, Mycobacterium
DLDAPLWAGLRTLAAHPGAAA

SEQ ID NO: 646230 - protein, 24 aa, Mycobacterium
DLDARRGTAFHSWVQRHYGSVRLI

SEQ ID NO: 646231 - protein, 24 aa, Mycobacterium
DLDDALRSWLAFGREKVAEVVTLA

SEQ ID NO: 646232 - protein, 17 aa, Mycobacterium
DLDDGRMAQAFERMGPG

SEQ ID NO: 646233 - protein, 17 aa, Mycobacterium
DLDDLLISTYGELRKYS

SEQ ID NO: 646234 - protein, 17 aa, Mycobacterium
DLDDLLLATYSELRSRS

SEQ ID NO: 646235 - protein, 17 aa, Mycobacterium
DLDDLLLTTYSELRSRS

SEQ ID NO: 646236 - protein, 23 aa, Mycobacterium
DLDEAREAVDIGADVIVAQGTEG

SEQ ID NO: 646237 - protein, 26 aa, Mycobacterium
DLDEAWLADGWLALFRTWLADAQRAG

SEQ ID NO: 646238 - protein, 19 aa, Mycobacterium
DLDEGFALLSDDFTYWSIA

SEQ ID NO: 646239 - protein, 19 aa, Mycobacterium
DLDEGFALLSDDFTYWSLV

SEQ ID NO: 646240 - protein, 24 aa, Mycobacterium
DLDELVRYVPWEVELVSTGRRSAI

SEQ ID NO: 646241 - protein, 24 aa, Mycobacterium
DLDERLRVNLVWSAPGQIEHEAIA

SEQ ID NO: 646242 - protein, 25 aa, Mycobacterium
DLDERLRYVLVGGIRSTGLTSGMAV

SEQ ID NO: 646243 - protein, 18 aa, Mycobacterium
DLDEVRRRHLLTLDEGRE

SEQ ID NO: 646244 - protein, 29 aa, Mycobacterium
DLDGAPMCGVLRGSAKFTERLTLGYRDAV

SEQ ID NO: 646245 - protein, 29 aa, Mycobacterium
DLDGFKKTIEFYLTAVFNVMRLTAAAIAR

SEQ ID NO: 646246 - protein, 19 aa, Mycobacterium
DLDGHGWLRRAQELEAAAG

SEQ ID NO: 646247 - protein, 25 aa, Mycobacterium
DLDGLRRFQRNLGHGLLGRRIERSP

SEQ ID NO: 646248 - protein, 24 aa, Mycobacterium
DLDGNEIMQILGIPPGPQVGEAWK

SEQ ID NO: 646249 - protein, 17 aa, Mycobacterium
DLDGPVPASAFPDSTET

SEQ ID NO: 646250 - protein, 18 aa, Mycobacterium
DLDGRVCLRIDDQVLTAP

SEQ ID NO: 646251 - protein, 19 aa, Mycobacterium
DLDHGCWRGNSLGDIDPGE

SEQ ID NO: 646252 - protein, 24 aa, Mycobacterium
DLDKPKLVFFFDEAHLLFTDASKA

SEQ ID NO: 646253 - protein, 30 aa, Mycobacterium
DLDKSKCFYEALGFTEVRRLAVPDPVAGGL

SEQ ID NO: 646254 - protein, 33 aa, Mycobacterium
DLDKSRYGLVPVHCEVWEGFIFVNFAPEPEQSL

SEQ ID NO: 646255 - protein, 25 aa, Mycobacterium
DLDKSRYGLVPVHCQVWEGFIFVNF

SEQ ID NO: 646256 - protein, 19 aa, Mycobacterium
DLDLAPGRQVYFVVKAQEV

SEQ ID NO: 646257 - protein, 23 aa, Mycobacterium
DLDLRLVGYFVVVAEHRHFGRAA

SEQ ID NO: 646258 - protein, 24 aa, Mycobacterium
DLDMASYVLEWHARVPDWRDYYLG

SEQ ID NO: 646259 - protein, 26 aa, Mycobacterium
DLDMQTDCWVFPRGMRRDGGVGAGSI

SEQ ID NO: 646260 - protein, 18 aa, Mycobacterium
DLDMSARGLIEVESHEVD

SEQ ID NO: 646261 - protein, 25 aa, Mycobacterium
DLDNCAREPIHIPGSVQPRGVLVVV

SEQ ID NO: 646262 - protein, 18 aa, Mycobacterium
DLDPGCPPVRPAPPTAPP

SEQ ID NO: 646263 - protein, 20 aa, Mycobacterium
DLDPQFGLAFDLLSSQFEKV

SEQ ID NO: 646264 - protein, 26 aa, Mycobacterium
DLDQLWMCGLPGYSPGDLIDFDFVGD

SEQ ID NO: 646265 - protein, 20 aa, Mycobacterium
DLDRCLPETVVDTFEAIRLF

SEQ ID NO: 646266 - protein, 23 aa, Mycobacterium
DLDRDIETEFGRYRDNGGRVVVI

SEQ ID NO: 646267 - protein, 24 aa, Mycobacterium
DLDRLFKVDGCFGGSPYMKLRDVL

SEQ ID NO: 646268 - protein, 24 aa, Mycobacterium
DLDRRRGRARSMGGPERLDRHHGQ

SEQ ID NO: 646269 - protein, 27 aa, Mycobacterium
DLDSMDWLNFLLGIHKRMHVDIPESDY

SEQ ID NO: 646270 - protein, 22 aa, Mycobacterium
DLDSWRAAARPNTKAFFAETIS

SEQ ID NO: 646271 - protein, 17 aa, Mycobacterium
DLDVEWPASELVDATII

SEQ ID NO: 646272 - protein, 19 aa, Mycobacterium
DLDVEWPAVELIDTTIIDT

SEQ ID NO: 646273 - protein, 24 aa, Mycobacterium
DLDVLSHGLTLWDLDREFKVSGFK

SEQ ID NO: 646274 - protein, 21 aa, Mycobacterium
DLDVPVFGICYGFQAMAQALG

SEQ ID NO: 646275 - protein, 17 aa, Mycobacterium
DLDWLRLTHSDLRNFQR

SEQ ID NO: 646276 - protein, 17 aa, Mycobacterium
DLEAVLRSLGWQPEGGI

SEQ ID NO: 646277 - protein, 17 aa, Mycobacterium
DLEDLVRIESVWADPGR

SEQ ID NO: 646278 - protein, 17 aa, Mycobacterium
DLEDLVRIQSVWADPGR

SEQ ID NO: 646279 - protein, 23 aa, Mycobacterium
DLEERTRTSAFYRGIPSSEVVRA

SEQ ID NO: 646280 - protein, 18 aa, Mycobacterium
DLEFHIVRLRDERRFANR

SEQ ID NO: 646281 - protein, 19 aa, Mycobacterium
DLEGARKVLKLVDALEDSD

SEQ ID NO: 646282 - protein, 23 aa, Mycobacterium
DLEIATAAPLRAVIEAGVAQGVF

SEQ ID NO: 646283 - protein, 19 aa, Mycobacterium
DLEIMPRAYIFGGKAAPGY

SEQ ID NO: 646284 - protein, 19 aa, Mycobacterium
DLEKFLAWEDMILHQSGVG

SEQ ID NO: 646285 - protein, 24 aa, Mycobacterium
DLEKHGLQWLWPEVDCAHPLDDGS

SEQ ID NO: 646286 - protein, 23 aa, Mycobacterium
DLEKLVRIESVWADPGRRAEVHR

SEQ ID NO: 646287 - protein, 26 aa, Mycobacterium
DLEKTLRFWLDRGVDGFRIDVAHGMA

SEQ ID NO: 646288 - protein, 25 aa, Mycobacterium
DLELALRLGASVDRVAEASGVDPWF

SEQ ID NO: 646289 - protein, 22 aa, Mycobacterium
DLELGFAAARKFSGDSQAVAAI

SEQ ID NO: 646290 - protein, 17 aa, Mycobacterium
DLELLDWPEPVKAMQRN

SEQ ID NO: 646291 - protein, 17 aa, Mycobacterium
DLELLDWPEPVKTMQRN

SEQ ID NO: 646292 - protein, 17 aa, Mycobacterium
DLELPLARHAISSVGAL

SEQ ID NO: 646293 - protein, 26 aa, Mycobacterium
DLELRNRLKIISGLALPPTLIVDHPT

SEQ ID NO: 646294 - protein, 23 aa, Mycobacterium
DLEMVGHWQRFLTDPRAYLRHLF

SEQ ID NO: 646295 - protein, 22 aa, Mycobacterium
DLEPGVIVDLPMSNMALNPAGR

SEQ ID NO: 646296 - protein, 20 aa, Mycobacterium
DLEPLLARWREHGFDLDLGD

SEQ ID NO: 646297 - protein, 18 aa, Mycobacterium
DLERIRHALDLGAGAVMA

SEQ ID NO: 646298 - protein, 28 aa, Mycobacterium
DLERIYWAFCTHLGYLVSNNSFGHRMVR

SEQ ID NO: 646299 - protein, 20 aa, Mycobacterium
DLERRRISLSLKQANEDYSE

SEQ ID NO: 646300 - protein, 17 aa, Mycobacterium
DLESREVLLAKLAGAMK

SEQ ID NO: 646301 - protein, 21 aa, Mycobacterium
DLESWRAASRPNTKAFFAETI

SEQ ID NO: 646302 - protein, 19 aa, Mycobacterium
DLESWRAAVRPNTKAFFAE

SEQ ID NO: 646303 - protein, 19 aa, Mycobacterium
DLEVLRFGATVRLFDDGSF

SEQ ID NO: 646304 - protein, 23 aa, Mycobacterium
DLEVRTAQGPRCVFTLLREGRGV

SEQ ID NO: 646305 - protein, 17 aa, Mycobacterium
DLEWRGLIAQSTDREAL

SEQ ID NO: 646306 - protein, 26 aa, Mycobacterium
DLEYELEGLLGRPAVRPLNITHSMDL

SEQ ID NO: 646307 - protein, 17 aa, Mycobacterium
DLFARKAGWDIAGLGLP

SEQ ID NO: 646308 - protein, 18 aa, Mycobacterium
DLFAYGFGMGESYGMVVP

SEQ ID NO: 646309 - protein, 21 aa, Mycobacterium
DLFCREPAPTTVRRAAQILGL

SEQ ID NO: 646310 - protein, 19 aa, Mycobacterium
DLFCRFPGCDVSADRCDID

SEQ ID NO: 646311 - protein, 25 aa, Mycobacterium
DLFDEWKLPVPALFGQMVLPPAAST

SEQ ID NO: 646312 - protein, 17 aa, Mycobacterium
DLFDYTSEWKIRSLVKK

SEQ ID NO: 646313 - protein, 25 aa, Mycobacterium
DLFEVNEAFAPVVLAWAADTGADLS

SEQ ID NO: 646314 - protein, 24 aa, Mycobacterium
DLFEVNEAFAPVVLAWAQDTGADL

SEQ ID NO: 646315 - protein, 26 aa, Mycobacterium
DLFEVNEAFAPVVLSWAADVGGGDGA

SEQ ID NO: 646316 - protein, 39 aa, Mycobacterium
DLFGSLRFAVAFCYARFLRRGRKAPGFFVKSADNRYLLQ

SEQ ID NO: 646317 - protein, 17 aa, Mycobacterium
DLFNRFIHDAFWRDPER

SEQ ID NO: 646318 - protein, 22 aa, Mycobacterium
DLFPHAVKWRGNVYLEDGLHRA

SEQ ID NO: 646319 - protein, 23 aa, Mycobacterium
DLFPHAVRWKGVVYLEDGLHRAV

SEQ ID NO: 646320 - protein, 23 aa, Mycobacterium
DLFPHAVRWRGVIYLEDGLHRAV

SEQ ID NO: 646321 - protein, 26 aa, Mycobacterium
DLFPSLRFALTFSYARFLRRGRKAPG

SEQ ID NO: 646322 - protein, 21 aa, Mycobacterium
DLFRYPGIRADTDMYTLGFRF

SEQ ID NO: 646323 - protein, 21 aa, Mycobacterium
DLFRYPGIRSDSDIFTLSYPY

SEQ ID NO: 646324 - protein, 20 aa, Mycobacterium
DLFRYPGIRSDSDIYTLSFG

SEQ ID NO: 646325 - protein, 19 aa, Mycobacterium
DLFRYPGIRSDSDLHTFAY

SEQ ID NO: 646326 - protein, 22 aa, Mycobacterium
DLFRYPGIRSDSDMFTLGFRFK

SEQ ID NO: 646327 - protein, 21 aa, Mycobacterium
DLFRYPGIRSDSDMFTLGYRF

SEQ ID NO: 646328 - protein, 21 aa, Mycobacterium
DLFRYPGIRSDSDMHTLGFRF

SEQ ID NO: 646329 - protein, 19 aa, Mycobacterium
DLFSAAGLPELGKAAEQVP

SEQ ID NO: 646330 - protein, 21 aa, Mycobacterium
DLFTAGWFARYISSYAGTIAG

SEQ ID NO: 646331 - protein, 22 aa, Mycobacterium
DLFTEFVCWTAEILVARAVPAE

SEQ ID NO: 646332 - protein, 25 aa, Mycobacterium
DLGAEMPMRVIGMLIGIPEELQRSV

SEQ ID NO: 646333 - protein, 26 aa, Mycobacterium
DLGAEMPMRVIGMLVGMPDSLQRSVR

SEQ ID NO: 646334 - protein, 19 aa, Mycobacterium
DLGAGAYFIHFRWDSGDPD

SEQ ID NO: 646335 - protein, 25 aa, Mycobacterium
DLGAVWRVEGAYTFHALETHQIKDA

SEQ ID NO: 646336 - protein, 24 aa, Mycobacterium
DLGCGEGADALWLADRGWQVVAVD

SEQ ID NO: 646337 - protein, 18 aa, Mycobacterium
DLGCGEGGDTLWLAEHGW

SEQ ID NO: 646338 - protein, 26 aa, Mycobacterium
DLGDEFDEGFVLRPGMVLVLEPVVWE

SEQ ID NO: 646339 - protein, 18 aa, Mycobacterium
DLGDGHPLLGRRMPDLDL

SEQ ID NO: 646340 - protein, 22 aa, Mycobacterium
DLGDLREFVNWTASEHGAGAVL

SEQ ID NO: 646341 - protein, 19 aa, Mycobacterium
DLGDQILLPGLMDMEVNLL

SEQ ID NO: 646342 - protein, 17 aa, Mycobacterium
DLGDWLVMHEGWRSELP

SEQ ID NO: 646343 - protein, 17 aa, Mycobacterium
DLGEGFGAWQLGDDDAM

SEQ ID NO: 646344 - protein, 17 aa, Mycobacterium
DLGEGFGAWRLGDDDAM

SEQ ID NO: 646345 - protein, 21 aa, Mycobacterium
DLGEGFGIWQLGDDDAMLGIV

SEQ ID NO: 646346 - protein, 22 aa, Mycobacterium
DLGEGFGVWALGDDDAMLDIVT

SEQ ID NO: 646347 - protein, 23 aa, Mycobacterium
DLGEGFGVWRLGDDDAMLDIVTS

SEQ ID NO: 646348 - protein, 23 aa, Mycobacterium
DLGEGFGVWRLGDDDAMLRIVTS

SEQ ID NO: 646349 - protein, 18 aa, Mycobacterium
DLGERMWRCEDFVLEDII

SEQ ID NO: 646350 - protein, 20 aa, Mycobacterium
DLGESFGVYTYGADAEMMPL

SEQ ID NO: 646351 - protein, 18 aa, Mycobacterium
DLGGASAVGMVWRAAAAI

SEQ ID NO: 646352 - protein, 18 aa, Mycobacterium
DLGGDCAITSSPGGGTRV

SEQ ID NO: 646353 - protein, 17 aa, Mycobacterium
DLGGHSLVATKLVAAIR

SEQ ID NO: 646354 - protein, 19 aa, Mycobacterium
DLGGLGYVVEEFFVSGTAH

SEQ ID NO: 646355 - protein, 26 aa, Mycobacterium
DLGGPKLRTGPIRPGPRVVKMKPRRD

SEQ ID NO: 646356 - protein, 17 aa, Mycobacterium
DLGGQAWQGAASASMTT

SEQ ID NO: 646357 - protein, 17 aa, Mycobacterium
DLGGSILEAARQGAKDA

SEQ ID NO: 646358 - protein, 19 aa, Mycobacterium
DLGGTMRLGAYPAVLEPDS

SEQ ID NO: 646359 - protein, 20 aa, Mycobacterium
DLGGTMRLGAYPAVLQKNSL

SEQ ID NO: 646360 - protein, 19 aa, Mycobacterium
DLGGTMRLGAYPAVLTPNS

SEQ ID NO: 646361 - protein, 25 aa, Mycobacterium
DLGHKGLLAPLTFISVFGYKAQSAF

SEQ ID NO: 646362 - protein, 21 aa, Mycobacterium
DLGKHPPQSLLTWKLSGPTTV

SEQ ID NO: 646363 - protein, 21 aa, Mycobacterium
DLGLDSVRFVLLMKRLGVDRE

SEQ ID NO: 646364 - protein, 18 aa, Mycobacterium
DLGLPLVAGNVVSAEGTR

SEQ ID NO: 646365 - protein, 25 aa, Mycobacterium
DLGLYSWCLIELIEAAVRCGEHDTA

SEQ ID NO: 646366 - protein, 23 aa, Mycobacterium
DLGMLACAGHAWLVSNATAEARQ

SEQ ID NO: 646367 - protein, 17 aa, Mycobacterium
DLGMRRLSVNAVASRLG

SEQ ID NO: 646368 - protein, 23 aa, Mycobacterium
DLGNLRPLIPLQIDPPEHAKYRR

SEQ ID NO: 646369 - protein, 23 aa, Mycobacterium
DLGPAISPFNAFLIAQGLETLSL

SEQ ID NO: 646370 - protein, 24 aa, Mycobacterium
DLGPALTAEAAWRHEVARLPSGPA

SEQ ID NO: 646371 - protein, 25 aa, Mycobacterium
DLGPEHEPRIALRADMDALPMAERT

SEQ ID NO: 646372 - protein, 30 aa, Mycobacterium
DLGPESLLWRWAGDMRIAFEGGTAGLMQTM

SEQ ID NO: 646373 - protein, 21 aa, Mycobacterium
DLGPIPSWRDDLAAGRVDADV

SEQ ID NO: 646374 - protein, 24 aa, Mycobacterium
DLGRFDEWLTIFGGWRSAVPDIIE

SEQ ID NO: 646375 - protein, 17 aa, Mycobacterium
DLGRFGSFGRGVTPQQA

SEQ ID NO: 646376 - protein, 22 aa, Mycobacterium
DLGRIEMSFVVASTEMLEAAVS

SEQ ID NO: 646377 - protein, 17 aa, Mycobacterium
DLGRITIEMGKLLETIN

SEQ ID NO: 646378 - protein, 17 aa, Mycobacterium
DLGRVCIPGTVRVEDYS

SEQ ID NO: 646379 - protein, 19 aa, Mycobacterium
DLGSAWRKGAWGSPEKYRR

SEQ ID NO: 646380 - protein, 19 aa, Mycobacterium
DLGSMRFYRETALAVGFEV

SEQ ID NO: 646381 - protein, 20 aa, Mycobacterium
DLGVAYARRCAGEPPGWAPL

SEQ ID NO: 646382 - protein, 17 aa, Mycobacterium
DLGVEFTDRGNVARGDD

SEQ ID NO: 646383 - protein, 19 aa, Mycobacterium
DLGVPFAMHNFGSFFRFSL

SEQ ID NO: 646384 - protein, 18 aa, Mycobacterium
DLGVPLAGAPEYLKVEAY

SEQ ID NO: 646385 - protein, 27 aa, Mycobacterium
DLGYHCFPAPGLLGGFGHMGAGGSTGW

SEQ ID NO: 646386 - protein, 25 aa, Mycobacterium
DLHAARLALCLATRQVIANGLDILG

SEQ ID NO: 646387 - protein, 17 aa, Mycobacterium
DLHALLIAENVSVLSQT

SEQ ID NO: 646388 - protein, 21 aa, Mycobacterium
DLHAVCRRHGALLLVDEAHGL

SEQ ID NO: 646389 - protein, 20 aa, Mycobacterium
DLHCGSGWEAEFPRDVWELH

SEQ ID NO: 646390 - protein, 25 aa, Mycobacterium
DLHCLINACAHRGAMICRRKTDNRT

SEQ ID NO: 646391 - protein, 21 aa, Mycobacterium
DLHDATVFYTVMGRTLDDEPD

SEQ ID NO: 646392 - protein, 24 aa, Mycobacterium
DLHIPEPLAALITALVRDGRPYTG

SEQ ID NO: 646393 - protein, 19 aa, Mycobacterium
DLHLRPALYDDELVRADGQ

SEQ ID NO: 646394 - protein, 23 aa, Mycobacterium
DLHLRRHKWTRLGAYAQSKLAVM

SEQ ID NO: 646395 - protein, 25 aa, Mycobacterium
DLHLRRHKWTRLGAYAQSKLAVMLW

SEQ ID NO: 646396 - protein, 24 aa, Mycobacterium
DLHLTLKHVHWNVVGPNFIGVHEM

SEQ ID NO: 646397 - protein, 18 aa, Mycobacterium
DLHLYLRRVTLYRSMFGT

SEQ ID NO: 646398 - protein, 23 aa, Mycobacterium
DLHMLGGPVLVPGVGAQGGRPEA

SEQ ID NO: 646399 - protein, 18 aa, Mycobacterium
DLHPKVLISTALHLSAAT

SEQ ID NO: 646400 - protein, 22 aa, Mycobacterium
DLHQRFTQRLGRMLELIHRHYL

SEQ ID NO: 646401 - protein, 20 aa, Mycobacterium
DLHRAGCDIVTITQYLRPSP

SEQ ID NO: 646402 - protein, 25 aa, Mycobacterium
DLHRAISSFARMDAVLITAVNGTAA

SEQ ID NO: 646403 - protein, 17 aa, Mycobacterium
DLHRHGESILDAVKISR

SEQ ID NO: 646404 - protein, 24 aa, Mycobacterium
DLHRRARAAVRIVQRVTGRPYTFA

SEQ ID NO: 646405 - protein, 22 aa, Mycobacterium
DLHRRLGMTAGNIFHGGLSWPF

SEQ ID NO: 646406 - protein, 24 aa, Mycobacterium
DLHTMLRLPTGIFYAQGVKANVLF

SEQ ID NO: 646407 - protein, 24 aa, Mycobacterium
DLHVGNILPRLGLTTAERLEMLLR

SEQ ID NO: 646408 - protein, 17 aa, Mycobacterium
DLIAKLKEAGVVVIPSV

SEQ ID NO: 646409 - protein, 21 aa, Mycobacterium
DLIARRGYEGFTIEALAARVH

SEQ ID NO: 646410 - protein, 24 aa, Mycobacterium
DLIDPALLRPGRLERLVFVEPPDA

SEQ ID NO: 646411 - protein, 25 aa, Mycobacterium
DLIEALPMQRIRDICDYHSSVEQAA

SEQ ID NO: 646412 - protein, 27 aa, Mycobacterium
DLIEPDLRYLVNWGYGDPAYGWSTSPP

SEQ ID NO: 646413 - protein, 17 aa, Mycobacterium
DLIFPHHEFTAAHAECV

SEQ ID NO: 646414 - protein, 18 aa, Mycobacterium
DLIGRNVLYGRWTFQVVE

SEQ ID NO: 646415 - protein, 19 aa, Mycobacterium
DLIHTPGIYVDRIIEGTGY

SEQ ID NO: 646416 - protein, 18 aa, Mycobacterium
DLIIEHRDELALADTTDM

SEQ ID NO: 646417 - protein, 20 aa, Mycobacterium
DLIITPAYSWHDHHNESDKR

SEQ ID NO: 646418 - protein, 28 aa, Mycobacterium
DLIKQLLPILTPIVLAFVAKKLTGGGAA

SEQ ID NO: 646419 - protein, 26 aa, Mycobacterium
DLILKEALRLLAPVPLVMRKTVRDVA

SEQ ID NO: 646420 - protein, 20 aa, Mycobacterium
DLINQPVLTLTGRPLIGNGA

SEQ ID NO: 646421 - protein, 20 aa, Mycobacterium
DLINSPAVALTGRPLIGNGA

SEQ ID NO: 646422 - protein, 17 aa, Mycobacterium
DLIPGFITLDPPEHGRL

SEQ ID NO: 646423 - protein, 26 aa, Mycobacterium
DLIPNMVSEIIRWQTPLAYMRRVAKK

SEQ ID NO: 646424 - protein, 17 aa, Mycobacterium
DLIRGALNAQRWNAPLD

SEQ ID NO: 646425 - protein, 17 aa, Mycobacterium
DLIRGVFYQAWNPNSVP

SEQ ID NO: 646426 - protein, 23 aa, Mycobacterium
DLIRRYAPKVSLIVTSHQHFDHW

SEQ ID NO: 646427 - protein, 17 aa, Mycobacterium
DLISEWPSDRGWYGEPY

SEQ ID NO: 646428 - protein, 23 aa, Mycobacterium
DLISNDEVAAWVAAHPDRFAGLA

SEQ ID NO: 646429 - protein, 27 aa, Mycobacterium
DLISRRGVTVLHLVPSMLSTLLLLPQV

SEQ ID NO: 646430 - protein, 28 aa, Mycobacterium
DLITRYAWGEIWTRPGLDRRSRSMITLT

SEQ ID NO: 646431 - protein, 22 aa, Mycobacterium
DLIVAALRWWMDTHRYAAVAAH

SEQ ID NO: 646432 - protein, 27 aa, Mycobacterium
DLKARRAGLPLAKLIGAQRDSCRVYNT

SEQ ID NO: 646433 - protein, 21 aa, Mycobacterium
DLKERREGDVLGRNQSGKAIT

SEQ ID NO: 646434 - protein, 22 aa, Mycobacterium
DLKERREGDVLGRNQSGRAVNL

SEQ ID NO: 646435 - protein, 25 aa, Mycobacterium
DLKGKLLDLPVCRVLGMAHDAVPIY

SEQ ID NO: 646436 - protein, 19 aa, Mycobacterium
DLKILGWQPPERFRTTASD

SEQ ID NO: 646437 - protein, 22 aa, Mycobacterium
DLKNTWAEVIVRFVMGSFRHAN

SEQ ID NO: 646438 - protein, 32 aa, Mycobacterium
DLKPIGAPERLKSGWLNGIKHWQVDYTGAGKA

SEQ ID NO: 646439 - protein, 32 aa, Mycobacterium
DLKPISAPERLRSGWLNGIKHWQVDYTGKCPV

SEQ ID NO: 646440 - protein, 17 aa, Mycobacterium
DLKRRSFRFSPRGMHWP

SEQ ID NO: 646441 - protein, 22 aa, Mycobacterium
DLKRYSHRFGVPAAKPDAPLSA

SEQ ID NO: 646442 - protein, 20 aa, Mycobacterium
DLKSLAALLRKSLDDALYTV

SEQ ID NO: 646443 - protein, 26 aa, Mycobacterium
DLKVGDKVGNAWLWSACGSCEQCRTG

SEQ ID NO: 646444 - protein, 19 aa, Mycobacterium
DLLACWLLDAHDMGADAAV

SEQ ID NO: 646445 - protein, 19 aa, Mycobacterium
DLLACWLLEASGMPTDDAV

SEQ ID NO: 646446 - protein, 18 aa, Mycobacterium
DLLACWLLQANRMPVDGA

SEQ ID NO: 646447 - protein, 25 aa, Mycobacterium
DLLADPRRAAAMGVAGRHWALDNWQ

SEQ ID NO: 646448 - protein, 18 aa, Mycobacterium
DLLAELTVALLTRAKMRD

SEQ ID NO: 646449 - protein, 20 aa, Mycobacterium
DLLAFTAFPKQIWRQIWSNN

SEQ ID NO: 646450 - protein, 19 aa, Mycobacterium
DLLALAWPKEHGGGGGSIW

SEQ ID NO: 646451 - protein, 19 aa, Mycobacterium
DLLALFAHALGLPANPFVA

SEQ ID NO: 646452 - protein, 19 aa, Mycobacterium
DLLALGALLHDIGKGRGVD

SEQ ID NO: 646453 - protein, 19 aa, Mycobacterium
DLLAPVPVWTRAEFTALRD

SEQ ID NO: 646454 - protein, 22 aa, Mycobacterium
DLLAQRFRLIIPDMPGYGRSSK

SEQ ID NO: 646455 - protein, 23 aa, Mycobacterium
DLLARLRLPIPEVTTPQMFTYQL

SEQ ID NO: 646456 - protein, 19 aa, Mycobacterium
DLLARMRGGIDQDRRAELI

SEQ ID NO: 646457 - protein, 18 aa, Mycobacterium
DLLASADFARDWTRNPDG

SEQ ID NO: 646458 - protein, 28 aa, Mycobacterium
DLLASTATELARIDAALNTANAAAVLPT

SEQ ID NO: 646459 - protein, 21 aa, Mycobacterium
DLLATATMDLDRIGNAINAGS

SEQ ID NO: 646460 - protein, 25 aa, Mycobacterium
DLLDGFPRAAAIVVDPGMTVVVANR

SEQ ID NO: 646461 - protein, 17 aa, Mycobacterium
DLLDLPTEERFGALDAL

SEQ ID NO: 646462 - protein, 23 aa, Mycobacterium
DLLDQAWWSPGMTHPDGRSAFAL

SEQ ID NO: 646463 - protein, 17 aa, Mycobacterium
DLLDRLLAGGVVIAGDL

SEQ ID NO: 646464 - protein, 24 aa, Mycobacterium
DLLDSWPGTLIVVSHDRYLLERVT

SEQ ID NO: 646465 - protein, 28 aa, Mycobacterium
DLLDVSVCFDGRPVLRDIEWRIGPGERT

SEQ ID NO: 646466 - protein, 24 aa, Mycobacterium
DLLEEYRGALGLPKAEMPSPDEVW

SEQ ID NO: 646467 - protein, 25 aa, Mycobacterium
DLLEFVRPRHRMVLTTFRSGGSPQS

SEQ ID NO: 646468 - protein, 18 aa, Mycobacterium
DLLEGLQYLAGCIAACTH

SEQ ID NO: 646469 - protein, 19 aa, Mycobacterium
DLLEGLQYLAGCIAACTHV

SEQ ID NO: 646470 - protein, 18 aa, Mycobacterium
DLLEGLQYLAGCVASCMH

SEQ ID NO: 646471 - protein, 24 aa, Mycobacterium
DLLERRLGLTTADIERLAKAKTIA

SEQ ID NO: 646472 - protein, 25 aa, Mycobacterium
DLLEVEEVYLPLARLIHLQVAARQA

SEQ ID NO: 646473 - protein, 29 aa, Mycobacterium
DLLFIGCTPIVWNGPIANWIAACDAMIAL

SEQ ID NO: 646474 - protein, 20 aa, Mycobacterium
DLLGEAFLGALFGDHPIGRS

SEQ ID NO: 646475 - protein, 17 aa, Mycobacterium
DLLGGRYIFAMTGSAPM

SEQ ID NO: 646476 - protein, 18 aa, Mycobacterium
DLLGLCRALIDSVPEQLL

SEQ ID NO: 646477 - protein, 25 aa, Mycobacterium
DLLGMPRPICIETEYSLAERSADRE

SEQ ID NO: 646478 - protein, 17 aa, Mycobacterium
DLLGREMLDQRFAGMKE

SEQ ID NO: 646479 - protein, 18 aa, Mycobacterium
DLLGRLAALDVFMGRHAV

SEQ ID NO: 646480 - protein, 24 aa, Mycobacterium
DLLGTRYLPPFPYFMESPKAFRVL

SEQ ID NO: 646481 - protein, 23 aa, Mycobacterium
DLLGTRYLPPFPYFVDTPNAFRV

SEQ ID NO: 646482 - protein, 20 aa, Mycobacterium
DLLGVRDWRNYAGFGPAERA

SEQ ID NO: 646483 - protein, 20 aa, Mycobacterium
DLLHEGRSGIVRVPSQRWDA

SEQ ID NO: 646484 - protein, 20 aa, Mycobacterium
DLLHRFRLWGSADLRRWLPL

SEQ ID NO: 646485 - protein, 20 aa, Mycobacterium
DLLIGWRLLVQAGVAHAALA

SEQ ID NO: 646486 - protein, 18 aa, Mycobacterium
DLLKGRLFSRDVCTGDVH

SEQ ID NO: 646487 - protein, 24 aa, Mycobacterium
DLLKPEYKGKVSISNPVTSGTGQA

SEQ ID NO: 646488 - protein, 18 aa, Mycobacterium
DLLLPALVEPASLDYFRE

SEQ ID NO: 646489 - protein, 18 aa, Mycobacterium
DLLPEQRLLSAEVRSVVV

SEQ ID NO: 646490 - protein, 23 aa, Mycobacterium
DLLPGNELHFTWSGVEATGEDQI

SEQ ID NO: 646491 - protein, 20 aa, Mycobacterium
DLLPLLQPLLLFVPRPILSA

SEQ ID NO: 646492 - protein, 19 aa, Mycobacterium
DLLPRTGIDAMRNLDYLLA

SEQ ID NO: 646493 - protein, 23 aa, Mycobacterium
DLLQLKAAVLGSRRAMKQAGRHI

SEQ ID NO: 646494 - protein, 20 aa, Mycobacterium
DLLQRLSHAAAIVVSATNEV

SEQ ID NO: 646495 - protein, 24 aa, Mycobacterium
DLLRAVRVLAEMTGAEGIAGIHLE

SEQ ID NO: 646496 - protein, 25 aa, Mycobacterium
DLLRAYARIAGIWRAPVAVYGIDTS

SEQ ID NO: 646497 - protein, 18 aa, Mycobacterium
DLLRDVAATEAMFTDHAL

SEQ ID NO: 646498 - protein, 25 aa, Mycobacterium
DLLRGLRLQHLVAMGESQSAMFLTT

SEQ ID NO: 646499 - protein, 18 aa, Mycobacterium
DLLRLGSLAFPIAAGTGT

SEQ ID NO: 646500 - protein, 23 aa, Mycobacterium
DLLRLIDDIRLRFDIPTQSCVLA

SEQ ID NO: 646501 - protein, 22 aa, Mycobacterium
DLLRLLDKWFPGEQVHGVGPSM

SEQ ID NO: 646502 - protein, 23 aa, Mycobacterium
DLLRLPAPLLAPAYLFAAAVGWV

SEQ ID NO: 646503 - protein, 19 aa, Mycobacterium
DLLRNTIVAFMRYIDANRA

SEQ ID NO: 646504 - protein, 23 aa, Mycobacterium
DLLRPVIDKVAAVAPRGYGAGNH

SEQ ID NO: 646505 - protein, 23 aa, Mycobacterium
DLLRPVIDLVAARAPRGYDAGRH

SEQ ID NO: 646506 - protein, 24 aa, Mycobacterium
DLLRQARPALQNTIHQADRVSGIV

SEQ ID NO: 646507 - protein, 24 aa, Mycobacterium
DLLRSLHQLTGWLSGPAAPAVAAV

SEQ ID NO: 646508 - protein, 24 aa, Mycobacterium
DLLRSRFGAALPVRVCTIRTDPWN

SEQ ID NO: 646509 - protein, 26 aa, Mycobacterium
DLLRSRFGAELAVRVSAIRTDPWNVE

SEQ ID NO: 646510 - protein, 23 aa, Mycobacterium
DLLSDGRLEIGLGTGYVREEFEA

SEQ ID NO: 646511 - protein, 24 aa, Mycobacterium
DLLTGWRDAWEIGRTVRDNSLQLL

SEQ ID NO: 646512 - protein, 24 aa, Mycobacterium
DLLTGWRDAWELGRTARDNALASI

SEQ ID NO: 646513 - protein, 23 aa, Mycobacterium
DLLTPFIWRMDCFGRPHLEQTPW

SEQ ID NO: 646514 - protein, 22 aa, Mycobacterium
DLLTPFMWRMDCFGRPHLEQTP

SEQ ID NO: 646515 - protein, 18 aa, Mycobacterium
DLLTRPDLVAALDELEEL

SEQ ID NO: 646516 - protein, 24 aa, Mycobacterium
DLLVEALTTWSLEAIPIPETGSIE

SEQ ID NO: 646517 - protein, 19 aa, Mycobacterium
DLLVLGALVHDIGKGRGGD

SEQ ID NO: 646518 - protein, 22 aa, Mycobacterium
DLLVRGPGWRRVPALRATGATI

SEQ ID NO: 646519 - protein, 19 aa, Mycobacterium
DLLVVRKGEKVTVEVTVHI

SEQ ID NO: 646520 - protein, 18 aa, Mycobacterium
DLLVVRRGEKVVVEVAVV

SEQ ID NO: 646521 - protein, 17 aa, Mycobacterium
DLLWRNRRGELDMSVVM

SEQ ID NO: 646522 - protein, 19 aa, Mycobacterium
DLLWSRPIKEFPDLKIALS

SEQ ID NO: 646523 - protein, 30 aa, Mycobacterium
DLLYREGITSMHFVPSLLGLFLSLPGVNQW

SEQ ID NO: 646524 - protein, 23 aa, Mycobacterium
DLMADWIGWLFAFDDVFDESIDG

SEQ ID NO: 646525 - protein, 24 aa, Mycobacterium
DLMDEAWWLPSVFIADGGDAARAL

SEQ ID NO: 646526 - protein, 20 aa, Mycobacterium
DLMIRALRSLGFDIIGDGTD

SEQ ID NO: 646527 - protein, 17 aa, Mycobacterium
DLMNFIAGVPLAVDGVV

SEQ ID NO: 646528 - protein, 22 aa, Mycobacterium
DLMPAALRLARSIAENNAYGVW

SEQ ID NO: 646529 - protein, 19 aa, Mycobacterium
DLMRLALPVIKADYRAFDA

SEQ ID NO: 646530 - protein, 22 aa, Mycobacterium
DLMRRIKAGFDPAGILNPDVVF

SEQ ID NO: 646531 - protein, 23 aa, Mycobacterium
DLMTTRLYAAVGTMRAARGRADD

SEQ ID NO: 646532 - protein, 19 aa, Mycobacterium
DLNAGFPLITTKKVHTKSI

SEQ ID NO: 646533 - protein, 25 aa, Mycobacterium
DLNALRRLGVRIVGRLAGIRDGVAQ

SEQ ID NO: 646534 - protein, 26 aa, Mycobacterium
DLNAPGPCRAAGTSDLTFASGWIEFR

SEQ ID NO: 646535 - protein, 29 aa, Mycobacterium
DLNDPPPCAVGFLPPPLMRTPADVSLREL

SEQ ID NO: 646536 - protein, 26 aa, Mycobacterium
DLNFLWLPLAHAFGKVMLALPLQIGF

SEQ ID NO: 646537 - protein, 26 aa, Mycobacterium
DLNFLWLPLAHAFGKVMLALPLSIGF

SEQ ID NO: 646538 - protein, 19 aa, Mycobacterium
DLNPATGVELLIPDFNAIP

SEQ ID NO: 646539 - protein, 29 aa, Mycobacterium
DLNQLWMCGLPGYFPGDLIDFEFSGDTIE

SEQ ID NO: 646540 - protein, 28 aa, Mycobacterium
DLNQLWMCGLPGYFPGDLIDFQFSGDTI

SEQ ID NO: 646541 - protein, 25 aa, Mycobacterium
DLNQLWMCGLPGYGPGDLIDFEFSG

SEQ ID NO: 646542 - protein, 28 aa, Mycobacterium
DLNQLWMCGLPGYYPGDLIDFQFAGDTI

SEQ ID NO: 646543 - protein, 19 aa, Mycobacterium
DLNRAGAFAQAFGFAVSAR

SEQ ID NO: 646544 - protein, 24 aa, Mycobacterium
DLNWKARPYSAWLAYGQSKLANLM

SEQ ID NO: 646545 - protein, 20 aa, Mycobacterium
DLNWRSRPYSAWLAYSQSKL

SEQ ID NO: 646546 - protein, 25 aa, Mycobacterium
DLPADWEPLGAIAIGYAAEPAGPRD

SEQ ID NO: 646547 - protein, 24 aa, Mycobacterium
DLPADWEPLGAVAIGYPEEPPGPR

SEQ ID NO: 646548 - protein, 19 aa, Mycobacterium
DLPALIQDMFDTMDAANGV

SEQ ID NO: 646549 - protein, 29 aa, Mycobacterium
DLPARPGEVWSQWHSLVFDVSVWEIWGAL

SEQ ID NO: 646550 - protein, 26 aa, Mycobacterium
DLPDFRDYAVPVARPACETHEATRVL

SEQ ID NO: 646551 - protein, 19 aa, Mycobacterium
DLPDGGAWLYAETVRAIKE

SEQ ID NO: 646552 - protein, 20 aa, Mycobacterium
DLPDGGAWLYAETVRYIKDL

SEQ ID NO: 646553 - protein, 20 aa, Mycobacterium
DLPDGGAWLYAETVRYIKRL

SEQ ID NO: 646554 - protein, 20 aa, Mycobacterium
DLPDGGAWLYAQTVRAIKEL

SEQ ID NO: 646555 - protein, 17 aa, Mycobacterium
DLPDLRDTIIVAAFEGW

SEQ ID NO: 646556 - protein, 26 aa, Mycobacterium
DLPEPRASAAFTRTLRAVVDWRGQVV

SEQ ID NO: 646557 - protein, 21 aa, Mycobacterium
DLPEWPLADWPTRRDRELFLQ

SEQ ID NO: 646558 - protein, 35 aa, Mycobacterium
DLPEYKYFWSTEGMLGWKRSFQVGSYIATVLPSIG

SEQ ID NO: 646559 - protein, 23 aa, Mycobacterium
DLPEYRDPQLLRLALGEKNRALL

SEQ ID NO: 646560 - protein, 23 aa, Mycobacterium
DLPFAVGPVPEWLHDNDVVSAAR

SEQ ID NO: 646561 - protein, 22 aa, Mycobacterium
DLPFGSGDPWAAMRAAVHRRTP

SEQ ID NO: 646562 - protein, 22 aa, Mycobacterium
DLPFLASLDDLVAFVGTHDLGE

SEQ ID NO: 646563 - protein, 23 aa, Mycobacterium
DLPFPPARGKFMRTVVWGVQRLP

SEQ ID NO: 646564 - protein, 27 aa, Mycobacterium
DLPGDTFVGPRFGQWGPTGSVGRSPLA

SEQ ID NO: 646565 - protein, 22 aa, Mycobacterium
DLPGHGHSAWRQDGDYSPQHNA

SEQ ID NO: 646566 - protein, 23 aa, Mycobacterium
DLPGHGHSGWREDGDYSPQINAD

SEQ ID NO: 646567 - protein, 22 aa, Mycobacterium
DLPGLQPFMPPYVPGGGTKPHY

SEQ ID NO: 646568 - protein, 24 aa, Mycobacterium
DLPGRLRAAGFTDIDTDVKRGRQR

SEQ ID NO: 646569 - protein, 22 aa, Mycobacterium
DLPGYAGALFDHLIKHPEHLRL

SEQ ID NO: 646570 - protein, 19 aa, Mycobacterium
DLPHIDAVVLGDALQRGVE

SEQ ID NO: 646571 - protein, 17 aa, Mycobacterium
DLPHPAELLSRIGHKHA

SEQ ID NO: 646572 - protein, 19 aa, Mycobacterium
DLPHVRRRPSDYVREHVRF

SEQ ID NO: 646573 - protein, 24 aa, Mycobacterium
DLPHVRRSPSEYVREHVRFTTQPL

SEQ ID NO: 646574 - protein, 24 aa, Mycobacterium
DLPHVRTGHGLREMLGGRADSGAP

SEQ ID NO: 646575 - protein, 28 aa, Mycobacterium
DLPKLADRLNLPSGWSYQPNRLTDELRI

SEQ ID NO: 646576 - protein, 27 aa, Mycobacterium
DLPLDRPGGVAVFREFMVAAAHLVAGY

SEQ ID NO: 646577 - protein, 23 aa, Mycobacterium
DLPLGYHRVHLRSGDSETSTALI

SEQ ID NO: 646578 - protein, 18 aa, Mycobacterium
DLPLGYHRVHLRSGGDET

SEQ ID NO: 646579 - protein, 22 aa, Mycobacterium
DLPLHPGFAASWQRLRTAPALL

SEQ ID NO: 646580 - protein, 26 aa, Mycobacterium
DLPLLRPGDEVYVSWAPDASLVLPGA

SEQ ID NO: 646581 - protein, 25 aa, Mycobacterium
DLPLRSWLFTVARNIVIDGSRSARV

SEQ ID NO: 646582 - protein, 21 aa, Mycobacterium
DLPLVEVIRRLLEGYGDRPAL

SEQ ID NO: 646583 - protein, 19 aa, Mycobacterium
DLPMLRWAGHGVAMGNAHP

SEQ ID NO: 646584 - protein, 19 aa, Mycobacterium
DLPPGGRLGLYGFGGSAHI

SEQ ID NO: 646585 - protein, 24 aa, Mycobacterium
DLPQCKKLAPGIPNNWPKPYVRPD

SEQ ID NO: 646586 - protein, 22 aa, Mycobacterium
DLPRLNRARIILERARMLGLIT

SEQ ID NO: 646587 - protein, 23 aa, Mycobacterium
DLPRLPWARACFDEGQRLQGAPI

SEQ ID NO: 646588 - protein, 21 aa, Mycobacterium
DLPRPSAAVAEPTHHEPDAGG

SEQ ID NO: 646589 - protein, 22 aa, Mycobacterium
DLPRTSAAIAERTSHDPDSGGH

SEQ ID NO: 646590 - protein, 22 aa, Mycobacterium
DLPRTSSAIAERTSHDPDSGGH

SEQ ID NO: 646591 - protein, 18 aa, Mycobacterium
DLPSLKVLIQIADDSGNE

SEQ ID NO: 646592 - protein, 19 aa, Mycobacterium
DLPTCVVKFVPLHTPAVTM

SEQ ID NO: 646593 - protein, 20 aa, Mycobacterium
DLPVLGVCRGMQLINVHAGG

SEQ ID NO: 646594 - protein, 22 aa, Mycobacterium
DLPWFRKRAVELISYTINHKRA

SEQ ID NO: 646595 - protein, 26 aa, Mycobacterium
DLPWGGEWHGYEGFKGWSVEMSRHFD

SEQ ID NO: 646596 - protein, 23 aa, Mycobacterium
DLPWLRSLTDLPLILKGLCHPDD

SEQ ID NO: 646597 - protein, 24 aa, Mycobacterium
DLPWLRSLTKLPLIVKGVCHPDDA

SEQ ID NO: 646598 - protein, 18 aa, Mycobacterium
DLPYAGELLDVFDEHAQW

SEQ ID NO: 646599 - protein, 22 aa, Mycobacterium
DLQAWLREHADFLARPSNAALV

SEQ ID NO: 646600 - protein, 25 aa, Mycobacterium
DLQCLPDGVLVDWHRVATFRAPPGA

SEQ ID NO: 646601 - protein, 19 aa, Mycobacterium
DLQEEFGLSYLFVAHDLGV

SEQ ID NO: 646602 - protein, 17 aa, Mycobacterium
DLQERYGLSYLFVSHDL

SEQ ID NO: 646603 - protein, 27 aa, Mycobacterium
DLQGFVRRIRPAFLLLQTAFCSGVSVA

SEQ ID NO: 646604 - protein, 25 aa, Mycobacterium
DLQGLRFFGTDGLVALDRVRRHCKV

SEQ ID NO: 646605 - protein, 24 aa, Mycobacterium
DLQICVAELPLSSAENAAVYGLPE

SEQ ID NO: 646606 - protein, 24 aa, Mycobacterium
DLQLALYMCYELHYRGFSGVDPTW

SEQ ID NO: 646607 - protein, 24 aa, Mycobacterium
DLQLALYVCYELHYRGFSGVDPRW

SEQ ID NO: 646608 - protein, 21 aa, Mycobacterium
DLQLSIGELFTLVVYGGLILE

SEQ ID NO: 646609 - protein, 18 aa, Mycobacterium
DLQMWVAACLFVGLEDTY

SEQ ID NO: 646610 - protein, 24 aa, Mycobacterium
DLQRAHADFANYRKRVERDRQAVI

SEQ ID NO: 646611 - protein, 27 aa, Mycobacterium
DLQSVEGIGAMWARHIREGLSRLAEST

SEQ ID NO: 646612 - protein, 22 aa, Mycobacterium
DLQVCALSAYWELPAMIGQFAR

SEQ ID NO: 646613 - protein, 18 aa, Mycobacterium
DLQWTWREYLAEAAARAA

SEQ ID NO: 646614 - protein, 24 aa, Mycobacterium
DLQYEVVQGNWFFFRGADRKIPAI

SEQ ID NO: 646615 - protein, 22 aa, Mycobacterium
DLRADLQLVIAFRDDEDGFVVP

SEQ ID NO: 646616 - protein, 20 aa, Mycobacterium
DLRALIDRRYGAALVAHAPA

SEQ ID NO: 646617 - protein, 22 aa, Mycobacterium
DLRALVLKVMDGVAEMETVRLE

SEQ ID NO: 646618 - protein, 21 aa, Mycobacterium
DLRAPLLAALGAADLALATVN

SEQ ID NO: 646619 - protein, 18 aa, Mycobacterium
DLRDDWPQALRDSGFDAE

SEQ ID NO: 646620 - protein, 19 aa, Mycobacterium
DLRDKFSIAVEVLPLDLSD

SEQ ID NO: 646621 - protein, 25 aa, Mycobacterium
DLRDNLMFRAPRFRHHVAPDETATD

SEQ ID NO: 646622 - protein, 18 aa, Mycobacterium
DLRDRAAAIVYAYDHGIV

SEQ ID NO: 646623 - protein, 22 aa, Mycobacterium
DLRDRLGLDSGYVTRILTRLEN

SEQ ID NO: 646624 - protein, 30 aa, Mycobacterium
DLRDWRQWWDWAPGASWRHPFGPDSDIADK

SEQ ID NO: 646625 - protein, 22 aa, Mycobacterium
DLRDWVGALVRPLTDHLQALGT

SEQ ID NO: 646626 - protein, 18 aa, Mycobacterium
DLREDWPQALRDSGFDPA

SEQ ID NO: 646627 - protein, 19 aa, Mycobacterium
DLRFDAVVIGIGITPNTAV

SEQ ID NO: 646628 - protein, 19 aa, Mycobacterium
DLRFLHFLGKEIFPGGQMC

SEQ ID NO: 646629 - protein, 20 aa, Mycobacterium
DLRGAFVGLDLSHTRADMYR

SEQ ID NO: 646630 - protein, 21 aa, Mycobacterium
DLRGFPGPRLLTGDLNMTPKT

SEQ ID NO: 646631 - protein, 26 aa, Mycobacterium
DLRGFQAADVLARWPVPGPDDDKYTQ

SEQ ID NO: 646632 - protein, 18 aa, Mycobacterium
DLRGKRILLTGASSGIGE

SEQ ID NO: 646633 - protein, 21 aa, Mycobacterium
DLRGLASLGLDGVRLDDTPDR

SEQ ID NO: 646634 - protein, 21 aa, Mycobacterium
DLRGLLGAFMFSGPQLDQLAG

SEQ ID NO: 646635 - protein, 21 aa, Mycobacterium
DLRGLLGAFMFSGPQLDQPAG

SEQ ID NO: 646636 - protein, 21 aa, Mycobacterium
DLRGLLGAFMFTGPQLDQPAG

SEQ ID NO: 646637 - protein, 21 aa, Mycobacterium
DLRGLLGAFMFTGPQLEQPAG

SEQ ID NO: 646638 - protein, 21 aa, Mycobacterium
DLRGRFRWMGLYTQREQGYDG

SEQ ID NO: 646639 - protein, 22 aa, Mycobacterium
DLRGRFRWWGLYTQREQGYDGT

SEQ ID NO: 646640 - protein, 31 aa, Mycobacterium
DLRHPEVHYPLRVLVCHRCWLVQTEDYARPE

SEQ ID NO: 646641 - protein, 19 aa, Mycobacterium
DLRIEAWAPTRDGCIRQAV

SEQ ID NO: 646642 - protein, 33 aa, Mycobacterium
DLRKNSEGWRMYTRARFAPYVEKLLLDGARSKL

SEQ ID NO: 646643 - protein, 18 aa, Mycobacterium
DLRKRPGTGDVITVIDPA

SEQ ID NO: 646644 - protein, 18 aa, Mycobacterium
DLRLERDGVLVSFAVPKN

SEQ ID NO: 646645 - protein, 19 aa, Mycobacterium
DLRLFPNLVNELRDTPVQD

SEQ ID NO: 646646 - protein, 19 aa, Mycobacterium
DLRLFPNLVNELRGVPVED

SEQ ID NO: 646647 - protein, 21 aa, Mycobacterium
DLRLIVIDYLQLMTSGKKVES

SEQ ID NO: 646648 - protein, 30 aa, Mycobacterium
DLRLPHPLAHLRPFVMIPWLDVDPAAEVPL

SEQ ID NO: 646649 - protein, 19 aa, Mycobacterium
DLRNGVIIRKARAHGLATP

SEQ ID NO: 646650 - protein, 19 aa, Mycobacterium
DLRPAFDGVGTVDEFVLSF

SEQ ID NO: 646651 - protein, 25 aa, Mycobacterium
DLRPARKIGAIGIRVSRATTLHGFA

SEQ ID NO: 646652 - protein, 18 aa, Mycobacterium
DLRPGAAHCRTCHRLFEL

SEQ ID NO: 646653 - protein, 21 aa, Mycobacterium
DLRPGHPDLSSFPRTEWSRAV

SEQ ID NO: 646654 - protein, 27 aa, Mycobacterium
DLRPLPLDAPMVVLRTHRLQLPSEEEQ

SEQ ID NO: 646655 - protein, 18 aa, Mycobacterium
DLRPLRVAVDAGNGMAGH

SEQ ID NO: 646656 - protein, 19 aa, Mycobacterium
DLRPPVVAPPSMPSAPAGP

SEQ ID NO: 646657 - protein, 19 aa, Mycobacterium
DLRPRIELVDEGEQPLVLA

SEQ ID NO: 646658 - protein, 17 aa, Mycobacterium
DLRPWREDSGFLVAVLR

SEQ ID NO: 646659 - protein, 19 aa, Mycobacterium
DLRRKFRAIWVGGRTPPAG

SEQ ID NO: 646660 - protein, 28 aa, Mycobacterium
DLRRRARQYAVEMTRRLEIDEALRQQQR

SEQ ID NO: 646661 - protein, 24 aa, Mycobacterium
DLRRRSAQALRNWVQREQRGLDQV

SEQ ID NO: 646662 - protein, 23 aa, Mycobacterium
DLRRRSAQALRNWVSREQRALTQ

SEQ ID NO: 646663 - protein, 24 aa, Mycobacterium
DLRRRSARALRNWVNRETHVVTQL

SEQ ID NO: 646664 - protein, 21 aa, Mycobacterium
DLRRVHLVPAPPYGQGPAAAR

SEQ ID NO: 646665 - protein, 23 aa, Mycobacterium
DLRRVNPKTARAVLKTAAALAAG

SEQ ID NO: 646666 - protein, 23 aa, Mycobacterium
DLRTRPPVVTVMGHVDHGKTRLL

SEQ ID NO: 646667 - protein, 18 aa, Mycobacterium
DLRVLRPLDDDTILDSVR

SEQ ID NO: 646668 - protein, 18 aa, Mycobacterium
DLRVLRPLDTDTILESVR

SEQ ID NO: 646669 - protein, 18 aa, Mycobacterium
DLRVRIELAGAFERADAD

SEQ ID NO: 646670 - protein, 28 aa, Mycobacterium
DLRVVFVEGGFTWAMPVMSRMDRIWEAR

SEQ ID NO: 646671 - protein, 26 aa, Mycobacterium
DLRWWPLDKLPEGVDFGLTQLAAAAA

SEQ ID NO: 646672 - protein, 17 aa, Mycobacterium
DLSAAAYAALAEPDRDR

SEQ ID NO: 646673 - protein, 17 aa, Mycobacterium
DLSAAGPADGWAVVVDG

SEQ ID NO: 646674 - protein, 24 aa, Mycobacterium
DLSALRPGSLQALLPPEQRARPGA

SEQ ID NO: 646675 - protein, 26 aa, Mycobacterium
DLSAVGDWMLMAAIDALIDGHEYLAN

SEQ ID NO: 646676 - protein, 17 aa, Mycobacterium
DLSAWPPIGATPVDVGD

SEQ ID NO: 646677 - protein, 20 aa, Mycobacterium
DLSDLRMDPAVLAHQAVIAE

SEQ ID NO: 646678 - protein, 20 aa, Mycobacterium
DLSDPEWLPAASVYCSHECS

SEQ ID NO: 646679 - protein, 21 aa, Mycobacterium
DLSDSPGFRRAGLNGLSRQMA

SEQ ID NO: 646680 - protein, 20 aa, Mycobacterium
DLSDVVPMIVVYSTSAVMSA

SEQ ID NO: 646681 - protein, 19 aa, Mycobacterium
DLSELLKGGGSVKCCTLEL

SEQ ID NO: 646682 - protein, 21 aa, Mycobacterium
DLSFAEVFEADFFELWSKFAA

SEQ ID NO: 646683 - protein, 24 aa, Mycobacterium
DLSFRRNSCCLYYRLPGAGKCGDC

SEQ ID NO: 646684 - protein, 22 aa, Mycobacterium
DLSFSLGPGRTGLVAPNGAGKS

SEQ ID NO: 646685 - protein, 17 aa, Mycobacterium
DLSGAEERLRMFLEQYW

SEQ ID NO: 646686 - protein, 18 aa, Mycobacterium
DLSGRRGRLLGTDTVGNE

SEQ ID NO: 646687 - protein, 19 aa, Mycobacterium
DLSGRRGRVLGTDKHDADR

SEQ ID NO: 646688 - protein, 18 aa, Mycobacterium
DLSGRRGRVLGTETAANE

SEQ ID NO: 646689 - protein, 24 aa, Mycobacterium
DLSISRTSFDWGVKVPGHPDHVVY

SEQ ID NO: 646690 - protein, 24 aa, Mycobacterium
DLSISRTSFDWGVQVPEHPDHVMY

SEQ ID NO: 646691 - protein, 25 aa, Mycobacterium
DLSISRTTFDWGVPVPDHPDHVMYV

SEQ ID NO: 646692 - protein, 25 aa, Mycobacterium
DLSISRTTFDWGVPVPDNPEHVMYV

SEQ ID NO: 646693 - protein, 24 aa, Mycobacterium
DLSISRTTFDWGVPVPGHPDHVMY

SEQ ID NO: 646694 - protein, 22 aa, Mycobacterium
DLSIYEPLFWILGAQTSAYDQL

SEQ ID NO: 646695 - protein, 25 aa, Mycobacterium
DLSKLARPTSTWTYMIHDDPRKNDS

SEQ ID NO: 646696 - protein, 25 aa, Mycobacterium
DLSKLARPTSTWTYMVHDNPLADDT

SEQ ID NO: 646697 - protein, 25 aa, Mycobacterium
DLSKLARPTSTWTYMVNDNPLSDDT

SEQ ID NO: 646698 - protein, 28 aa, Mycobacterium
DLSLMVKAGVQWGLFGGAIENLGTATHH

SEQ ID NO: 646699 - protein, 22 aa, Mycobacterium
DLSMPVRQCLRDEIISTKLSLL

SEQ ID NO: 646700 - protein, 22 aa, Mycobacterium
DLSPRAGLALIRAAQLAHEHGA

SEQ ID NO: 646701 - protein, 24 aa, Mycobacterium
DLSPRESRHVLGLLFEQISRPEYS

SEQ ID NO: 646702 - protein, 22 aa, Mycobacterium
DLSRAVAVGERLDFGMVGINRG

SEQ ID NO: 646703 - protein, 23 aa, Mycobacterium
DLSRDVFMGHEFCAEVIEAGPDT

SEQ ID NO: 646704 - protein, 25 aa, Mycobacterium
DLSRELAIALGRLGARVIAVDERGD

SEQ ID NO: 646705 - protein, 18 aa, Mycobacterium
DLSRFPADVSRVVVRLIH

SEQ ID NO: 646706 - protein, 19 aa, Mycobacterium
DLSRTVGWFTAKYPVSLRV

SEQ ID NO: 646707 - protein, 19 aa, Mycobacterium
DLSRTVGWFTTKYPVALSV

SEQ ID NO: 646708 - protein, 18 aa, Mycobacterium
DLSRTVGWFTTKYPVAVT

SEQ ID NO: 646709 - protein, 21 aa, Mycobacterium
DLSRVPLWVEETLRYDTSSQI

SEQ ID NO: 646710 - protein, 21 aa, Mycobacterium
DLSSLRFALNGAEGIDVATLE

SEQ ID NO: 646711 - protein, 24 aa, Mycobacterium
DLSSLRFALSGAEPVEPADVEDLC

SEQ ID NO: 646712 - protein, 23 aa, Mycobacterium
DLSSLRFALSGAEPVEPSDVEDL

SEQ ID NO: 646713 - protein, 29 aa, Mycobacterium
DLSSLRRFWHLGAPCPPAIKQAWIDLLGP

SEQ ID NO: 646714 - protein, 30 aa, Mycobacterium
DLSSLRRFWHMGAPCPPAIKEAWINLLGPE

SEQ ID NO: 646715 - protein, 21 aa, Mycobacterium
DLSSLRWALSGAEQVDPDDVE

SEQ ID NO: 646716 - protein, 21 aa, Mycobacterium
DLSTLRAYLVRRIRSHGLVAA

SEQ ID NO: 646717 - protein, 19 aa, Mycobacterium
DLSVPTRRGDWWYYGRSFQ

SEQ ID NO: 646718 - protein, 22 aa, Mycobacterium
DLSVPWPDPWCFVVDHYVPTSH

SEQ ID NO: 646719 - protein, 20 aa, Mycobacterium
DLSVQLAGWMLMEAAHSVDS

SEQ ID NO: 646720 - protein, 25 aa, Mycobacterium
DLSVSRTSFNWGVPVPGHPDHVMYV

SEQ ID NO: 646721 - protein, 26 aa, Mycobacterium
DLSWQPELWCALVAVVGADPPHLRHE

SEQ ID NO: 646722 - protein, 20 aa, Mycobacterium
DLSWREWELELSGGPDIALF

SEQ ID NO: 646723 - protein, 20 aa, Mycobacterium
DLTAALRRVRKRQKEYRLKL

SEQ ID NO: 646724 - protein, 18 aa, Mycobacterium
DLTAFGLSEGSRVDLVSE

SEQ ID NO: 646725 - protein, 22 aa, Mycobacterium
DLTAPPDWMGVDLFGTPGANVP

SEQ ID NO: 646726 - protein, 19 aa, Mycobacterium
DLTDAQVWNLKRGGHDYRK

SEQ ID NO: 646727 - protein, 24 aa, Mycobacterium
DLTDGRFYYARVAAVTDAGIRPVY

SEQ ID NO: 646728 - protein, 23 aa, Mycobacterium
DLTDGRFYYARVASVTDAGVQPV

SEQ ID NO: 646729 - protein, 20 aa, Mycobacterium
DLTDRIVIFQAAFGEQLAKL

SEQ ID NO: 646730 - protein, 22 aa, Mycobacterium
DLTELEMQWGRTIGQLPSPYTA

SEQ ID NO: 646731 - protein, 17 aa, Mycobacterium
DLTGEWLTAALGAGRVT

SEQ ID NO: 646732 - protein, 24 aa, Mycobacterium
DLTGIGEALRAATAAAAPSTTSLV

SEQ ID NO: 646733 - protein, 19 aa, Mycobacterium
DLTGRRAASTGAHRVAVVR

SEQ ID NO: 646734 - protein, 17 aa, Mycobacterium
DLTGRVVLITGGSRGLG

SEQ ID NO: 646735 - protein, 29 aa, Mycobacterium
DLTIPRLKRSLMLGTRWEQEGAQLVPAPG

SEQ ID NO: 646736 - protein, 18 aa, Mycobacterium
DLTKARFAGPVVVIELDM

SEQ ID NO: 646737 - protein, 19 aa, Mycobacterium
DLTKARFAGPVVVIELDMR

SEQ ID NO: 646738 - protein, 18 aa, Mycobacterium
DLTKARFAGPVVVVELDM

SEQ ID NO: 646739 - protein, 17 aa, Mycobacterium
DLTLDWVKKRETFGRPL

SEQ ID NO: 646740 - protein, 18 aa, Mycobacterium
DLTLHFVQIWRSIAPPGA

SEQ ID NO: 646741 - protein, 20 aa, Mycobacterium
DLTMALLLDVTRRVSEGDRL

SEQ ID NO: 646742 - protein, 18 aa, Mycobacterium
DLTPRPPSIPIISTTYED

SEQ ID NO: 646743 - protein, 18 aa, Mycobacterium
DLTPSMKLRRKVVLDKSA

SEQ ID NO: 646744 - protein, 19 aa, Mycobacterium
DLTPSMKLRRKVVVDKSAD

SEQ ID NO: 646745 - protein, 19 aa, Mycobacterium
DLTRPRTQIMINLGNPDLA

SEQ ID NO: 646746 - protein, 17 aa, Mycobacterium
DLTRYVTAIARRLERLP

SEQ ID NO: 646747 - protein, 18 aa, Mycobacterium
DLTSFLIQFEFDGQRLSD

SEQ ID NO: 646748 - protein, 23 aa, Mycobacterium
DLTSRPGQISDWYDSEEGLDLYA

SEQ ID NO: 646749 - protein, 25 aa, Mycobacterium
DLTSRTGTKYTVQWQDYDTGAPITA

SEQ ID NO: 646750 - protein, 25 aa, Mycobacterium
DLTTAIARCRRLLDLDADPEAVDDA

SEQ ID NO: 646751 - protein, 25 aa, Mycobacterium
DLTTAIARCRRLLDLDADPEAVDEA

SEQ ID NO: 646752 - protein, 29 aa, Mycobacterium
DLTTLRAKAWRQIRGGSVGLIPQDPTISL

SEQ ID NO: 646753 - protein, 18 aa, Mycobacterium
DLTTTRFVACPFGAPGSR

SEQ ID NO: 646754 - protein, 25 aa, Mycobacterium
DLTWLLSRWTCVFGTPACHGTVAGR

SEQ ID NO: 646755 - protein, 25 aa, Mycobacterium
DLTWLLSRWTCVFGTPACQGTVEGR

SEQ ID NO: 646756 - protein, 25 aa, Mycobacterium
DLVAALPHRAAQRVWQLHGGARNSS

SEQ ID NO: 646757 - protein, 26 aa, Mycobacterium
DLVAEMPKFSWPTVVVSGGRDLITPP

SEQ ID NO: 646758 - protein, 18 aa, Mycobacterium
DLVAEVRRVLGLDCDVRA

SEQ ID NO: 646759 - protein, 18 aa, Mycobacterium
DLVALRREICARFIREPG

SEQ ID NO: 646760 - protein, 19 aa, Mycobacterium
DLVALRREICARFIREPGY

SEQ ID NO: 646761 - protein, 18 aa, Mycobacterium
DLVAPAVGWLAHETCSVT

SEQ ID NO: 646762 - protein, 20 aa, Mycobacterium
DLVARAGVLGKTLSHGIEEL

SEQ ID NO: 646763 - protein, 23 aa, Mycobacterium
DLVARAHCPVAIIRTDPDGSPTG

SEQ ID NO: 646764 - protein, 23 aa, Mycobacterium
DLVAVPLDPALPVGEQRARSEAV

SEQ ID NO: 646765 - protein, 18 aa, Mycobacterium
DLVAWRRHIHRYPELGRQ

SEQ ID NO: 646766 - protein, 23 aa, Mycobacterium
DLVDAERALAMGLINRVVAADRL

SEQ ID NO: 646767 - protein, 24 aa, Mycobacterium
DLVDAIGVDAARYALIRSSVDTSI

SEQ ID NO: 646768 - protein, 24 aa, Mycobacterium
DLVDLLWRMGIRTIGAFAELARAD

SEQ ID NO: 646769 - protein, 24 aa, Mycobacterium
DLVDPDAWAFVWVVDPPLFEPADE

SEQ ID NO: 646770 - protein, 25 aa, Mycobacterium
DLVEAIGVDAARYALIRSSVDTPID

SEQ ID NO: 646771 - protein, 24 aa, Mycobacterium
DLVEALGVDAARYSLIRSSVDTAI

SEQ ID NO: 646772 - protein, 25 aa, Mycobacterium
DLVEFLLRVLLSFFVAPNVPSRSDD

SEQ ID NO: 646773 - protein, 25 aa, Mycobacterium
DLVETLKIALTLPFSADAIPKVVHG

SEQ ID NO: 646774 - protein, 24 aa, Mycobacterium
DLVFNDFLIAVARMRALDPVTSEL

SEQ ID NO: 646775 - protein, 25 aa, Mycobacterium
DLVGHSQGGLLIKNFVAQDKSDSVA

SEQ ID NO: 646776 - protein, 17 aa, Mycobacterium
DLVGLGVDGCRWGAVAL

SEQ ID NO: 646777 - protein, 21 aa, Mycobacterium
DLVGRLPAGRLHTWYERAHVE

SEQ ID NO: 646778 - protein, 18 aa, Mycobacterium
DLVGWRRHIHRYPELGRQ

SEQ ID NO: 646779 - protein, 17 aa, Mycobacterium
DLVIGAVLRPGAKAPSL

SEQ ID NO: 646780 - protein, 19 aa, Mycobacterium
DLVKIWLMDEDDIDADWAR

SEQ ID NO: 646781 - protein, 17 aa, Mycobacterium
DLVKSVIEFFKDPAGYL

SEQ ID NO: 646782 - protein, 18 aa, Mycobacterium
DLVLAGGVNLVLEPRRYV

SEQ ID NO: 646783 - protein, 18 aa, Mycobacterium
DLVLDLNSIFAIQDPGAY

SEQ ID NO: 646784 - protein, 24 aa, Mycobacterium
DLVLELNSIYGLRDPGAYPIMLAS

SEQ ID NO: 646785 - protein, 17 aa, Mycobacterium
DLVLEWRTVEFDPAGDP

SEQ ID NO: 646786 - protein, 24 aa, Mycobacterium
DLVLKSSRLLTALQKEWKADDVRK

SEQ ID NO: 646787 - protein, 17 aa, Mycobacterium
DLVLPKIPAGGAIAVVA

SEQ ID NO: 646788 - protein, 24 aa, Mycobacterium
DLVLRRLTEALGRDRTRHQVSEVT

SEQ ID NO: 646789 - protein, 19 aa, Mycobacterium
DLVLRWAALLHDIGKPATR

SEQ ID NO: 646790 - protein, 18 aa, Mycobacterium
DLVLTRWHGLGPMGGTDL

SEQ ID NO: 646791 - protein, 23 aa, Mycobacterium
DLVNRGGDAWGISAELTDRDAVT

SEQ ID NO: 646792 - protein, 19 aa, Mycobacterium
DLVPGLRSALIVEGAGHFV

SEQ ID NO: 646793 - protein, 38 aa, Mycobacterium
DLVPIGAPVPGAGVFVLDRWLRPVPPGTVGELYVAGAG

SEQ ID NO: 646794 - protein, 38 aa, Mycobacterium
DLVPIGAPVPGAGVFVLDSWLRPVPPGTVGELYVAGTG

SEQ ID NO: 646795 - protein, 20 aa, Mycobacterium
DLVPLLAERGVVLSREQVFR

SEQ ID NO: 646796 - protein, 19 aa, Mycobacterium
DLVPLLAERGVVLSREQVY

SEQ ID NO: 646797 - protein, 23 aa, Mycobacterium
DLVPTLLGLLGIDAPADVDGVSH

SEQ ID NO: 646798 - protein, 25 aa, Mycobacterium
DLVRAARRARQEWLAERLATLDSGK

SEQ ID NO: 646799 - protein, 18 aa, Mycobacterium
DLVRAGGDVAVYLSSAVT

SEQ ID NO: 646800 - protein, 18 aa, Mycobacterium
DLVRDFADHAAIALTLAT

SEQ ID NO: 646801 - protein, 18 aa, Mycobacterium
DLVRFVFALVPSRFRKHP

SEQ ID NO: 646802 - protein, 19 aa, Mycobacterium
DLVRLPGLVAVAYQHETSR

SEQ ID NO: 646803 - protein, 24 aa, Mycobacterium
DLVRRADVVVSNFRHGVIERMGFG

SEQ ID NO: 646804 - protein, 25 aa, Mycobacterium
DLVRSGGMKALFGGVYAPSTIGTLL

SEQ ID NO: 646805 - protein, 18 aa, Mycobacterium
DLVRWGRDGQLEYLGRAD

SEQ ID NO: 646806 - protein, 19 aa, Mycobacterium
DLVSALPQRVARRVSQLHA

SEQ ID NO: 646807 - protein, 19 aa, Mycobacterium
DLVSEFICRVLNYMDDNGF

SEQ ID NO: 646808 - protein, 17 aa, Mycobacterium
DLVSLIYFYEANHDALV

SEQ ID NO: 646809 - protein, 24 aa, Mycobacterium
DLVSLTQVVAWDLPLTKKVSDQVA

SEQ ID NO: 646810 - protein, 24 aa, Mycobacterium
DLVSMFAPITRWAAGIPTPRAIPE

SEQ ID NO: 646811 - protein, 18 aa, Mycobacterium
DLVSMFAPITRWAAGVPT

SEQ ID NO: 646812 - protein, 20 aa, Mycobacterium
DLVSMFAPITRWAAGVPTAR

SEQ ID NO: 646813 - protein, 28 aa, Mycobacterium
DLVSQGRFRFGVGVGWLREEIANHGVDP

SEQ ID NO: 646814 - protein, 26 aa, Mycobacterium
DLVVALERLGRWCVPGPVAESIAVAP

SEQ ID NO: 646815 - protein, 26 aa, Mycobacterium
DLVVFKELRILGALGVDATAYRAALA

SEQ ID NO: 646816 - protein, 20 aa, Mycobacterium
DLVVIGAGYTGLWTALHAAE

SEQ ID NO: 646817 - protein, 25 aa, Mycobacterium
DLVVLWRRATGFGRGGAPAVGPDVG

SEQ ID NO: 646818 - protein, 25 aa, Mycobacterium
DLVVMGLAWRNEIDGEFSYTPIDPA

SEQ ID NO: 646819 - protein, 29 aa, Mycobacterium
DLVYTGLGALCWIPSISRWADVVASLLRP

SEQ ID NO: 646820 - protein, 17 aa, Mycobacterium
DLVYYQVLGGWKLATLL

SEQ ID NO: 646821 - protein, 19 aa, Mycobacterium
DLWAGWERLRAKGLAAAET

SEQ ID NO: 646822 - protein, 17 aa, Mycobacterium
DLWGRYRLRGSGRPPFP

SEQ ID NO: 646823 - protein, 26 aa, Mycobacterium
DLWIGCTSLRLGIPILTANVADFRRI

SEQ ID NO: 646824 - protein, 20 aa, Mycobacterium
DLWLNESFATFASVLCQAEA

SEQ ID NO: 646825 - protein, 17 aa, Mycobacterium
DLWTGDALHGIAIAARK

SEQ ID NO: 646826 - protein, 19 aa, Mycobacterium
DLWWKNAVVYCADIETFYD

SEQ ID NO: 646827 - protein, 24 aa, Mycobacterium
DLYAARSRVRYAVTDAQAAGFQVE

SEQ ID NO: 646828 - protein, 27 aa, Mycobacterium
DLYGLPVAVFRCGMILADTSYAGQLNM

SEQ ID NO: 646829 - protein, 19 aa, Mycobacterium
DLYGNFRRGYAVNHDRELA

SEQ ID NO: 646830 - protein, 25 aa, Mycobacterium
DLYGPRWAMVRAFNAANDLDRIEVD

SEQ ID NO: 646831 - protein, 23 aa, Mycobacterium
DLYKWAYKLGPLVASDLVADALE

SEQ ID NO: 646832 - protein, 27 aa, Mycobacterium
DLYLWSERARFGSTWGGGADVAAGWLE

SEQ ID NO: 646833 - protein, 20 aa, Mycobacterium
DLYPMARRVLLTAYADTNAA

SEQ ID NO: 646834 - protein, 22 aa, Mycobacterium
DLYPRLVVAVVRAVGDAAAEAY

SEQ ID NO: 646835 - protein, 24 aa, Mycobacterium
DLYRENIRYFPSLLPEVSEEDPVA

SEQ ID NO: 646836 - protein, 25 aa, Mycobacterium
DLYRRKGSDYDRWIAGMRRYQRSLR

SEQ ID NO: 646837 - protein, 20 aa, Mycobacterium
DLYRRVEVFDEPDLDAALAR

SEQ ID NO: 646838 - protein, 17 aa, Mycobacterium
DLYSCFPSAVQVAAAEL

SEQ ID NO: 646839 - protein, 28 aa, Mycobacterium
DLYSLLPLGELWVAAARMRRIDRLEHPL

SEQ ID NO: 646840 - protein, 18 aa, Mycobacterium
DLYVRGFELATGYSELID

SEQ ID NO: 646841 - protein, 18 aa, Mycobacterium
DLYVRKFELATGYSELID

SEQ ID NO: 646842 - protein, 19 aa, Mycobacterium
DLYVRKFELATGYSELIDP

SEQ ID NO: 646843 - protein, 22 aa, Mycobacterium
DLYWPGRLDGCARPDTQRDAFA

SEQ ID NO: 646844 - protein, 19 aa, Mycobacterium
DMAAGLALVSSRPELRAVT

SEQ ID NO: 646845 - protein, 26 aa, Mycobacterium
DMAARMGEGLAHLHLCDGSGASYDEH

SEQ ID NO: 646846 - protein, 20 aa, Mycobacterium
DMADPWLGRLTVDYDEDQRW

SEQ ID NO: 646847 - protein, 19 aa, Mycobacterium
DMAERVSALAAHASPPRLL

SEQ ID NO: 646848 - protein, 22 aa, Mycobacterium
DMAGLLRPPAAATLVSALRSRF

SEQ ID NO: 646849 - protein, 22 aa, Mycobacterium
DMAGLLRPPAAATLVTALRSRF

SEQ ID NO: 646850 - protein, 21 aa, Mycobacterium
DMAILALHVDVLWKTVDDFTI

SEQ ID NO: 646851 - protein, 19 aa, Mycobacterium
DMAKTLGFEGHSDWAEAMP

SEQ ID NO: 646852 - protein, 23 aa, Mycobacterium
DMAQRMGAGLVHLHLCDGNGLPA

SEQ ID NO: 646853 - protein, 24 aa, Mycobacterium
DMAQRMGGGLVHLHLCDGSGLPAD

SEQ ID NO: 646854 - protein, 18 aa, Mycobacterium
DMARRGLEPFTFRPALTV

SEQ ID NO: 646855 - protein, 17 aa, Mycobacterium
DMCARLLGQLHQHNLKE

SEQ ID NO: 646856 - protein, 17 aa, Mycobacterium
DMCSQSFCVRAVRITSA

SEQ ID NO: 646857 - protein, 22 aa, Mycobacterium
DMCTFGFRFKPWHSPRFTVDGA

SEQ ID NO: 646858 - protein, 23 aa, Mycobacterium
DMDERLVAMIARIVEAYGKYSSS

SEQ ID NO: 646859 - protein, 22 aa, Mycobacterium
DMDERLVAMVARIVEAYGKYSS

SEQ ID NO: 646860 - protein, 25 aa, Mycobacterium
DMDLAMKAVPLWASRGCMPGKLMPV

SEQ ID NO: 646861 - protein, 24 aa, Mycobacterium
DMDNLRSAFTWSMENSDLEQALRL

SEQ ID NO: 646862 - protein, 25 aa, Mycobacterium
DMDPGMCDAWMGLAVAGDVSLNTMR

SEQ ID NO: 646863 - protein, 23 aa, Mycobacterium
DMFAHAKLGLALSRYESTMRPYI

SEQ ID NO: 646864 - protein, 20 aa, Mycobacterium
DMFTLGFRFKPWTSAKSIAD

SEQ ID NO: 646865 - protein, 20 aa, Mycobacterium
DMFTLGFRFKPWTSEKAIAD

SEQ ID NO: 646866 - protein, 20 aa, Mycobacterium
DMFYNLGIAGRAMRRIGAIE

SEQ ID NO: 646867 - protein, 20 aa, Mycobacterium
DMGIHIPAAFSKLFRSDVDW

SEQ ID NO: 646868 - protein, 28 aa, Mycobacterium
DMGLAERLIEFFGGIPILDGIGSTEVGQ

SEQ ID NO: 646869 - protein, 18 aa, Mycobacterium
DMGTKLYAARSLLLSAAE

SEQ ID NO: 646870 - protein, 27 aa, Mycobacterium
DMGTVAYRFTWHLPKNRTWSYDGQLKM

SEQ ID NO: 646871 - protein, 25 aa, Mycobacterium
DMGWPEYRVAVEFDGAQHWTDSEQR

SEQ ID NO: 646872 - protein, 20 aa, Mycobacterium
DMHDFWSDEFIRDFWKNFVR

SEQ ID NO: 646873 - protein, 22 aa, Mycobacterium
DMHLYFKRAHGSAHLLDTPQEL

SEQ ID NO: 646874 - protein, 25 aa, Mycobacterium
DMHLYLKRAHVFRHLFGEPTDVLAE

SEQ ID NO: 646875 - protein, 17 aa, Mycobacterium
DMHPGHLVTRWLATFTF

SEQ ID NO: 646876 - protein, 25 aa, Mycobacterium
DMHTGYRLLCTKYPQYQSIPLDGPV

SEQ ID NO: 646877 - protein, 24 aa, Mycobacterium
DMIAELLDAFGIPTAGAEGFEADD

SEQ ID NO: 646878 - protein, 17 aa, Mycobacterium
DMIDRMLFAEALETQKC

SEQ ID NO: 646879 - protein, 24 aa, Mycobacterium
DMIELCNLAAIAAAGERITWDDFA

SEQ ID NO: 646880 - protein, 25 aa, Mycobacterium
DMIGAKAVIVSAPFDAAAPVLEEKG

SEQ ID NO: 646881 - protein, 19 aa, Mycobacterium
DMIIRGGYNVYPREIEEVL

SEQ ID NO: 646882 - protein, 17 aa, Mycobacterium
DMILAHPRYRGQVNVPD

SEQ ID NO: 646883 - protein, 24 aa, Mycobacterium
DMILGLRMITPVGVLDLGRVAASA

SEQ ID NO: 646884 - protein, 23 aa, Mycobacterium
DMIMEILDAFGIATAGAAHYEAD

SEQ ID NO: 646885 - protein, 24 aa, Mycobacterium
DMIMELLDAFGIPAAGAAGFEADD

SEQ ID NO: 646886 - protein, 23 aa, Mycobacterium
DMIMELLDAFGIPTAGAEGFEAD

SEQ ID NO: 646887 - protein, 27 aa, Mycobacterium
DMITRYAWGSVWTRPGLDRRSRSMITL

SEQ ID NO: 646888 - protein, 20 aa, Mycobacterium
DMKDMVGMMIVVARQLKRAG

SEQ ID NO: 646889 - protein, 24 aa, Mycobacterium
DMKEIRAAAYWRWAKDNPEEAAAR

SEQ ID NO: 646890 - protein, 20 aa, Mycobacterium
DMLAAAASDLTNIGSTLGAA

SEQ ID NO: 646891 - protein, 26 aa, Mycobacterium
DMLAAPEEFDWLATRLEIARKLRNDP

SEQ ID NO: 646892 - protein, 24 aa, Mycobacterium
DMLAAPEQFDWLATRLEIARKLRN

SEQ ID NO: 646893 - protein, 18 aa, Mycobacterium
DMLAHIALRNEQGLAGLI

SEQ ID NO: 646894 - protein, 26 aa, Mycobacterium
DMLANSQRTIFCWAMGLTQHRHAVAT

SEQ ID NO: 646895 - protein, 18 aa, Mycobacterium
DMLAPWEVLDSVSRLVVA

SEQ ID NO: 646896 - protein, 17 aa, Mycobacterium
DMLARFSTVAGERGSPD

SEQ ID NO: 646897 - protein, 21 aa, Mycobacterium
DMLASAAADVAGIGSSVGAAN

SEQ ID NO: 646898 - protein, 24 aa, Mycobacterium
DMLCARASVRTGVPFFVGTLTSDP

SEQ ID NO: 646899 - protein, 22 aa, Mycobacterium
DMLDLDGLVTWIGERHARGVPV

SEQ ID NO: 646900 - protein, 18 aa, Mycobacterium
DMLDPAWDWGETRYEIVI

SEQ ID NO: 646901 - protein, 17 aa, Mycobacterium
DMLGLHFSSTRPGEDEL

SEQ ID NO: 646902 - protein, 21 aa, Mycobacterium
DMLGRAGALLIDVAIDTVPRG

SEQ ID NO: 646903 - protein, 25 aa, Mycobacterium
DMLGRAGALLLDLAVDTVPRGYRIV

SEQ ID NO: 646904 - protein, 19 aa, Mycobacterium
DMLLRRAGRVLLPVARTTA

SEQ ID NO: 646905 - protein, 26 aa, Mycobacterium
DMLQQWRKARALLMNRPLQNIVARMV

SEQ ID NO: 646906 - protein, 30 aa, Mycobacterium
DMLRCRRWCSGTSNRWCEMRVRIDGRKGGL

SEQ ID NO: 646907 - protein, 31 aa, Mycobacterium
DMLRCRRWCSGTSNRWCEMRVRIDGRKGGLI

SEQ ID NO: 646908 - protein, 29 aa, Mycobacterium
DMLRCRRWCSGTSNRWCEMRVRVDGRKGG

SEQ ID NO: 646909 - protein, 26 aa, Mycobacterium
DMLRDNRFRLPPGITLAAQGITSGPL

SEQ ID NO: 646910 - protein, 23 aa, Mycobacterium
DMLREAIKIIRELFGGQLVDFTG

SEQ ID NO: 646911 - protein, 31 aa, Mycobacterium
DMLRMRRWCSGTSNRWCEMRVRIDGKRKGGL

SEQ ID NO: 646912 - protein, 28 aa, Mycobacterium
DMLSQGRFRFGVGVGWLREEVANHRVDP

SEQ ID NO: 646913 - protein, 21 aa, Mycobacterium
DMLVNPWGLWWQELTASDICT

SEQ ID NO: 646914 - protein, 22 aa, Mycobacterium
DMMANAAFYYGLLRTLSEEDRP

SEQ ID NO: 646915 - protein, 24 aa, Mycobacterium
DMMRLWVEAEVLRLAGERLRQQAA

SEQ ID NO: 646916 - protein, 19 aa, Mycobacterium
DMMRTEIFAPVAAIATFET

SEQ ID NO: 646917 - protein, 22 aa, Mycobacterium
DMMSRYEVWRMYCDPPHWTETV

SEQ ID NO: 646918 - protein, 17 aa, Mycobacterium
DMMTRIWQRPHSPSVDI

SEQ ID NO: 646919 - protein, 20 aa, Mycobacterium
DMPAPSVFVGLELDADAYAG

SEQ ID NO: 646920 - protein, 20 aa, Mycobacterium
DMPAPSVFVGLELDADTYAG

SEQ ID NO: 646921 - protein, 23 aa, Mycobacterium
DMPGELTSGVALVGGGPGDPELI

SEQ ID NO: 646922 - protein, 19 aa, Mycobacterium
DMPTWKDVMIRTWVDDELV

SEQ ID NO: 646923 - protein, 19 aa, Mycobacterium
DMQAAIGRPDLPDWYFTAE

SEQ ID NO: 646924 - protein, 17 aa, Mycobacterium
DMRADLRGEPADYPPPG

SEQ ID NO: 646925 - protein, 26 aa, Mycobacterium
DMRCKWRKWLTFQCNWKVAMEAFNET

SEQ ID NO: 646926 - protein, 19 aa, Mycobacterium
DMRDAFNAYTDAARAVANA

SEQ ID NO: 646927 - protein, 25 aa, Mycobacterium
DMRGRRIWMLATWNVLYNISKAGLD

SEQ ID NO: 646928 - protein, 21 aa, Mycobacterium
DMRMAGWNVGVAFAVAPTGPD

SEQ ID NO: 646929 - protein, 20 aa, Mycobacterium
DMRRCVTTLAAKYGDSPAMR

SEQ ID NO: 646930 - protein, 19 aa, Mycobacterium
DMRRFGAAAVDLCLVAQGS

SEQ ID NO: 646931 - protein, 25 aa, Mycobacterium
DMRRLGSCALDLCMVAAGQLDAYYE

SEQ ID NO: 646932 - protein, 17 aa, Mycobacterium
DMRWPSQWCHGAPGIGL

SEQ ID NO: 646933 - protein, 17 aa, Mycobacterium
DMSEGMLAQARARTGRV

SEQ ID NO: 646934 - protein, 17 aa, Mycobacterium
DMSGCVGCGRCIAWCPT

SEQ ID NO: 646935 - protein, 23 aa, Mycobacterium
DMTCRFPGCDVAAYSCDLDHTIA

SEQ ID NO: 646936 - protein, 24 aa, Mycobacterium
DMTERAHLAFGEIMDLAVGLGGTI

SEQ ID NO: 646937 - protein, 17 aa, Mycobacterium
DMTGLEVLKRLRADGNL

SEQ ID NO: 646938 - protein, 25 aa, Mycobacterium
DMTHWAGKEWDHFLHGTPVGRALNQ

SEQ ID NO: 646939 - protein, 23 aa, Mycobacterium
DMTLWPKFDYASAANAGIDDVTL

SEQ ID NO: 646940 - protein, 25 aa, Mycobacterium
DMTRRLAREEAMLVGGSCGMAVVAA

SEQ ID NO: 646941 - protein, 19 aa, Mycobacterium
DMVDAHWGRIVMISSSSAQ

SEQ ID NO: 646942 - protein, 21 aa, Mycobacterium
DMVGMCLFLLSDKASWITGQV

SEQ ID NO: 646943 - protein, 19 aa, Mycobacterium
DMVGMTLAVARHFKRAGIV

SEQ ID NO: 646944 - protein, 23 aa, Mycobacterium
DMVGPVWRRDQVFEFNGSLIDSE

SEQ ID NO: 646945 - protein, 23 aa, Mycobacterium
DMVKRLRAAVAARRDPNFIICAR

SEQ ID NO: 646946 - protein, 18 aa, Mycobacterium
DMVKRRSGHIINIASLSG

SEQ ID NO: 646947 - protein, 26 aa, Mycobacterium
DMVLAAKADTAWHLHRLTADINLDVF

SEQ ID NO: 646948 - protein, 23 aa, Mycobacterium
DMVLHRCPRPVVVVPNPMLAAEY

SEQ ID NO: 646949 - protein, 24 aa, Mycobacterium
DMVPAGASTVRWPDAAQLPLALLS

SEQ ID NO: 646950 - protein, 27 aa, Mycobacterium
DMWADAPGGWVYEWSRVARDYAERGDH

SEQ ID NO: 646951 - protein, 18 aa, Mycobacterium
DMWTDVFANPGKRTSGTG

SEQ ID NO: 646952 - protein, 17 aa, Mycobacterium
DMYPMFFTGVGSCETLI

SEQ ID NO: 646953 - protein, 24 aa, Mycobacterium
DMYRSVLEAIAFGFRHHTEVFAHM

SEQ ID NO: 646954 - protein, 24 aa, Mycobacterium
DMYRSVLEAIAFGFRHHVDVFGEI

SEQ ID NO: 646955 - protein, 20 aa, Mycobacterium
DNAAQWIGLLSFLMSPGTAA

SEQ ID NO: 646956 - protein, 18 aa, Mycobacterium
DNAAVWPGIVGFDDTVIP

SEQ ID NO: 646957 - protein, 27 aa, Mycobacterium
DNACHELVFRLGFRRAVLSTVDTRGWT

SEQ ID NO: 646958 - protein, 24 aa, Mycobacterium
DNAFSAAELAAWAARVHAEVGDAA

SEQ ID NO: 646959 - protein, 23 aa, Mycobacterium
DNAFSSDELTAWDARVRGDIGQE

SEQ ID NO: 646960 - protein, 21 aa, Mycobacterium
DNAGRLIGFTSAHCGGPGATV

SEQ ID NO: 646961 - protein, 28 aa, Mycobacterium
DNAKPPPALFRLSVNMDRDDGQLKMSKV

SEQ ID NO: 646962 - protein, 35 aa, Mycobacterium
DNALLPWRTVRSNIELALKLGGIARQGRREAAQSW

SEQ ID NO: 646963 - protein, 24 aa, Mycobacterium
DNALLPWRTVRSNIELALRLRGAP

SEQ ID NO: 646964 - protein, 20 aa, Mycobacterium
DNAMRIAREEIFGPVLTVIP

SEQ ID NO: 646965 - protein, 17 aa, Mycobacterium
DNAPGWLTTVTARLCLD

SEQ ID NO: 646966 - protein, 21 aa, Mycobacterium
DNAPRPAGLRNYGPTPTADDV

SEQ ID NO: 646967 - protein, 22 aa, Mycobacterium
DNARFSDPVGLLGIMGVEYHAH

SEQ ID NO: 646968 - protein, 18 aa, Mycobacterium
DNARLHWPPRPEPPRTDE

SEQ ID NO: 646969 - protein, 24 aa, Mycobacterium
DNARLRARIGVMLQGGGGYPAARA

SEQ ID NO: 646970 - protein, 24 aa, Mycobacterium
DNARLRPRIGVMLQGGGGYPAARA

SEQ ID NO: 646971 - protein, 25 aa, Mycobacterium
DNARNHISFGFGVHRCMGNRLAEMQ

SEQ ID NO: 646972 - protein, 32 aa, Mycobacterium
DNAVCKHSSFIYGVGFPTLWSHHHLDEVTHDW

SEQ ID NO: 646973 - protein, 26 aa, Mycobacterium
DNAYLGHVIVLWSWALKQPNEASPGS

SEQ ID NO: 646974 - protein, 22 aa, Mycobacterium
DNCRRLRDGLSLANVVNCQADC

SEQ ID NO: 646975 - protein, 19 aa, Mycobacterium
DNDAFAWLASAAAPSSSPV

SEQ ID NO: 646976 - protein, 20 aa, Mycobacterium
DNDFTRSWLDGMAQQSQGGP

SEQ ID NO: 646977 - protein, 27 aa, Mycobacterium
DNDGYDCCDLLDIMKSWWDLRDEPNVL

SEQ ID NO: 646978 - protein, 23 aa, Mycobacterium
DNDLQHRLGRMVASTTAFGANEN

SEQ ID NO: 646979 - protein, 19 aa, Mycobacterium
DNDLRGCLLAKSAAELSST

SEQ ID NO: 646980 - protein, 19 aa, Mycobacterium
DNEARRITEQIARVNTGLG

SEQ ID NO: 646981 - protein, 20 aa, Mycobacterium
DNEFGFGLWFNRTNHVRYLQ

SEQ ID NO: 646982 - protein, 38 aa, Mycobacterium
DNEFPELPRRLALRGAEVLALPVNWPLVDRPEGEHAPE

SEQ ID NO: 646983 - protein, 20 aa, Mycobacterium
DNEGLGFYQLMEQLARERLI

SEQ ID NO: 646984 - protein, 19 aa, Mycobacterium
DNELLAFTTLARVFGYPST

SEQ ID NO: 646985 - protein, 19 aa, Mycobacterium
DNEPGGFWTAFLIALRTAL

SEQ ID NO: 646986 - protein, 22 aa, Mycobacterium
DNEVYRLAKHLDEKVAKIHVEA

SEQ ID NO: 646987 - protein, 25 aa, Mycobacterium
DNEVYRLAKHLDEKVARIHVEALGG

SEQ ID NO: 646988 - protein, 23 aa, Mycobacterium
DNEVYRLPKHLDEKVARIHVEAL

SEQ ID NO: 646989 - protein, 20 aa, Mycobacterium
DNFAPMRILTGIEVDILEDG

SEQ ID NO: 646990 - protein, 25 aa, Mycobacterium
DNFDRVLGAGGWRVDYLGATTYQAR

SEQ ID NO: 646991 - protein, 25 aa, Mycobacterium
DNFERVFGANGWRIDYLGGTTYQAR

SEQ ID NO: 646992 - protein, 27 aa, Mycobacterium
DNFLPKSIRIFQYWARVPGTDFVLQPF

SEQ ID NO: 646993 - protein, 19 aa, Mycobacterium
DNFRHRRVPTFNADHDRSR

SEQ ID NO: 646994 - protein, 19 aa, Mycobacterium
DNFVFPDGMLLVFEPVVWE

SEQ ID NO: 646995 - protein, 19 aa, Mycobacterium
DNGAGLWGRLRGPDAPDLN

SEQ ID NO: 646996 - protein, 24 aa, Mycobacterium
DNGCVELKAALAKHVGFGPEHIAV

SEQ ID NO: 646997 - protein, 26 aa, Mycobacterium
DNGGWPFYHMEMMLAGIPIPVPPGEA

SEQ ID NO: 646998 - protein, 26 aa, Mycobacterium
DNGGWPFYHMEMMLAGIPIPVPPGEP

SEQ ID NO: 646999 - protein, 21 aa, Mycobacterium
DNGIKIFGPGGHKLDDATEDR

SEQ ID NO: 647000 - protein, 19 aa, Mycobacterium
DNGIKIFGVGGHKLDDDAE

SEQ ID NO: 647001 - protein, 19 aa, Mycobacterium
DNGLVKPVWISGPRSREAI

SEQ ID NO: 647002 - protein, 28 aa, Mycobacterium
DNGNWTWRYDAIRSFPDFASLWDDVDAL

SEQ ID NO: 647003 - protein, 20 aa, Mycobacterium
DNGPAILLLTGWGHDHRAYD

SEQ ID NO: 647004 - protein, 24 aa, Mycobacterium
DNGPELACSAMADWASGQVGLHFI

SEQ ID NO: 647005 - protein, 23 aa, Mycobacterium
DNGRLRVAGAVGINGDVRAKASA

SEQ ID NO: 647006 - protein, 23 aa, Mycobacterium
DNGRQRWCVRLVQGGGFAGPLLD

SEQ ID NO: 647007 - protein, 22 aa, Mycobacterium
DNGSCYRSRIFGETLAGIEHRR

SEQ ID NO: 647008 - protein, 29 aa, Mycobacterium
DNGSWTWRYDAIRTFPDFSGLWDDVDALS

SEQ ID NO: 647009 - protein, 18 aa, Mycobacterium
DNGTFCAGADLKAMGTDR

SEQ ID NO: 647010 - protein, 17 aa, Mycobacterium
DNGVGIERVDWVRDGVI

SEQ ID NO: 647011 - protein, 24 aa, Mycobacterium
DNGVLVFRGLRLAPEAQVDFCRLL

SEQ ID NO: 647012 - protein, 20 aa, Mycobacterium
DNHKCLFPTYSISKIAGEVV

SEQ ID NO: 647013 - protein, 25 aa, Mycobacterium
DNHLWRLTLADGRVITSRFVITAVG

SEQ ID NO: 647014 - protein, 18 aa, Mycobacterium
DNHYASGTAVCWDDPGVR

SEQ ID NO: 647015 - protein, 18 aa, Mycobacterium
DNIDAVMFMVEFAAAANH

SEQ ID NO: 647016 - protein, 20 aa, Mycobacterium
DNIPPLVAVAQHLGLGGADL

SEQ ID NO: 647017 - protein, 30 aa, Mycobacterium
DNIPPLVAVAQHLGVRGADLIRGLATAYEI

SEQ ID NO: 647018 - protein, 18 aa, Mycobacterium
DNISVFLEVPRDARRADA

SEQ ID NO: 647019 - protein, 24 aa, Mycobacterium
DNKGLRWGDTFVCDQHAGVRMDYV

SEQ ID NO: 647020 - protein, 24 aa, Mycobacterium
DNKTTCALALFSTGEQLNIPDYIK

SEQ ID NO: 647021 - protein, 22 aa, Mycobacterium
DNLDRGGAVSFVVDGIHAHDLG

SEQ ID NO: 647022 - protein, 25 aa, Mycobacterium
DNLDTWRLAVATAPHLLSKSVLISE

SEQ ID NO: 647023 - protein, 19 aa, Mycobacterium
DNLETAFFMSRAVAAELVA

SEQ ID NO: 647024 - protein, 24 aa, Mycobacterium
DNLGAWRRIGVQRVYTQLLDLTDL

SEQ ID NO: 647025 - protein, 17 aa, Mycobacterium
DNLIPAWLATPSPVLVG

SEQ ID NO: 647026 - protein, 25 aa, Mycobacterium
DNLIWQCPVVLLADVRSVGVQGDNR

SEQ ID NO: 647027 - protein, 22 aa, Mycobacterium
DNLKAAYRLSIDELDWMTPQTR

SEQ ID NO: 647028 - protein, 21 aa, Mycobacterium
DNLLADFRPATQLERDRYATM

SEQ ID NO: 647029 - protein, 24 aa, Mycobacterium
DNLLERIDLYSARGSRIAMDVDAD

SEQ ID NO: 647030 - protein, 22 aa, Mycobacterium
DNLLLRYGGTRAKHTGDGVFAL

SEQ ID NO: 647031 - protein, 25 aa, Mycobacterium
DNLQAVGVPGGWLYALGDTTGRARL

SEQ ID NO: 647032 - protein, 22 aa, Mycobacterium
DNLRELDCETVVVVTDALTEER

SEQ ID NO: 647033 - protein, 17 aa, Mycobacterium
DNLRIPSGVAYAIVNRR

SEQ ID NO: 647034 - protein, 23 aa, Mycobacterium
DNLRLETLAAHWGVPQERPHDAF

SEQ ID NO: 647035 - protein, 19 aa, Mycobacterium
DNLRLETLAAHWGVTQERP

SEQ ID NO: 647036 - protein, 19 aa, Mycobacterium
DNLRLETLAAHWSVTQERP

SEQ ID NO: 647037 - protein, 22 aa, Mycobacterium
DNLRRGGIQFADTRGYAYDRRD

SEQ ID NO: 647038 - protein, 24 aa, Mycobacterium
DNLSEGTVAYGLTNSFFFGYGENA

SEQ ID NO: 647039 - protein, 17 aa, Mycobacterium
DNLTFVINCNLQRLDGP

SEQ ID NO: 647040 - protein, 24 aa, Mycobacterium
DNLVWKPTVPLGYGRTYTLTVTSR

SEQ ID NO: 647041 - protein, 17 aa, Mycobacterium
DNLWRPSPGSVYPTLQL

SEQ ID NO: 647042 - protein, 17 aa, Mycobacterium
DNMMFARLGGAPPVSVI

SEQ ID NO: 647043 - protein, 23 aa, Mycobacterium
DNNVPTFHGVVVRRQFADQRPEV

SEQ ID NO: 647044 - protein, 17 aa, Mycobacterium
DNNVVQWVPDQFWPAHS

SEQ ID NO: 647045 - protein, 26 aa, Mycobacterium
DNPASIWRFRLAPRDGGTALNYWMQM

SEQ ID NO: 647046 - protein, 18 aa, Mycobacterium
DNPASWFWFEGNFQAYEE

SEQ ID NO: 647047 - protein, 23 aa, Mycobacterium
DNPFERRGFGFGFGPVDRRALHE

SEQ ID NO: 647048 - protein, 19 aa, Mycobacterium
DNPGGLAYTAAKHGLVGLM

SEQ ID NO: 647049 - protein, 20 aa, Mycobacterium
DNPLVGRRVCELDLPANTAL

SEQ ID NO: 647050 - protein, 27 aa, Mycobacterium
DNPQRVWGWYLWRHYLVADVQPNAGHR

SEQ ID NO: 647051 - protein, 23 aa, Mycobacterium
DNPRAAAALDRRLQALGRQLDVY

SEQ ID NO: 647052 - protein, 23 aa, Mycobacterium
DNPRDLADLVVLIRFARSDLSST

SEQ ID NO: 647053 - protein, 22 aa, Mycobacterium
DNPRILPRLQVQLRRRQISITT

SEQ ID NO: 647054 - protein, 17 aa, Mycobacterium
DNPRPGIINALATLRID

SEQ ID NO: 647055 - protein, 17 aa, Mycobacterium
DNPRPGVVNALLEMRID

SEQ ID NO: 647056 - protein, 21 aa, Mycobacterium
DNQAIHWLYECCASRIWAVRV

SEQ ID NO: 647057 - protein, 18 aa, Mycobacterium
DNQIGFGGLNSGTGNVGL

SEQ ID NO: 647058 - protein, 19 aa, Mycobacterium
DNQIGFGGWNSGAGNTGLF

SEQ ID NO: 647059 - protein, 25 aa, Mycobacterium
DNQIWQCPVVLLADVRSVGVQGDNR

SEQ ID NO: 647060 - protein, 25 aa, Mycobacterium
DNQLRRMLADFGIDIDRYGLDDEIQ

SEQ ID NO: 647061 - protein, 21 aa, Mycobacterium
DNQPGFLGFQLLRPIKGENRY

SEQ ID NO: 647062 - protein, 27 aa, Mycobacterium
DNQPGFLGFQLLRPVKGENRYFVVTQW

SEQ ID NO: 647063 - protein, 27 aa, Mycobacterium
DNQPGFLGFQLLRPVKGETRYFVVTQW

SEQ ID NO: 647064 - protein, 19 aa, Mycobacterium
DNQVKIRGFRIEPCEVGAA

SEQ ID NO: 647065 - protein, 24 aa, Mycobacterium
DNRAVHALARIMLHGRIAHIQTSW

SEQ ID NO: 647066 - protein, 24 aa, Mycobacterium
DNRAVHALARIMLHGRIDNIQTSW

SEQ ID NO: 647067 - protein, 18 aa, Mycobacterium
DNRCKRSVVLDLSTDTGR

SEQ ID NO: 647068 - protein, 28 aa, Mycobacterium
DNRIGTAVEEFVRWASPVMTFRRTAATD

SEQ ID NO: 647069 - protein, 18 aa, Mycobacterium
DNRIVPFAHNLSTRQIAR

SEQ ID NO: 647070 - protein, 27 aa, Mycobacterium
DNRLTEVALWGDGWPLGVQRATTRAQH

SEQ ID NO: 647071 - protein, 23 aa, Mycobacterium
DNRMISWPYPKLMNSNNMVDQGA

SEQ ID NO: 647072 - protein, 18 aa, Mycobacterium
DNRRCKRVSLTDEGSELV

SEQ ID NO: 647073 - protein, 24 aa, Mycobacterium
DNRVSLMLPCLPVDIHDPVEQLLT

SEQ ID NO: 647074 - protein, 20 aa, Mycobacterium
DNRYRFVLTNHHIVMDGWSL

SEQ ID NO: 647075 - protein, 18 aa, Mycobacterium
DNSALDWDALGDCDYLYV

SEQ ID NO: 647076 - protein, 25 aa, Mycobacterium
DNSIPWRLPEDLARFKEMTMGHPVV

SEQ ID NO: 647077 - protein, 20 aa, Mycobacterium
DNSMRIAREEIFGPVITVIP

SEQ ID NO: 647078 - protein, 27 aa, Mycobacterium
DNSPGFLGFQLLRPVKGEDRYFVVTHW

SEQ ID NO: 647079 - protein, 17 aa, Mycobacterium
DNSRLSLDVALSNTDAP

SEQ ID NO: 647080 - protein, 19 aa, Mycobacterium
DNSSGFCLPANAFENRQFS

SEQ ID NO: 647081 - protein, 19 aa, Mycobacterium
DNSTLDWDKLGACDYLYVS

SEQ ID NO: 647082 - protein, 18 aa, Mycobacterium
DNSYVHNLIHGFILAAQH

SEQ ID NO: 647083 - protein, 19 aa, Mycobacterium
DNTFYCFGTAAGPHPFPAM

SEQ ID NO: 647084 - protein, 25 aa, Mycobacterium
DNTKELRPLIGVALQEVALDLWMSP

SEQ ID NO: 647085 - protein, 21 aa, Mycobacterium
DNTKLDWARKFGATHTVNARE

SEQ ID NO: 647086 - protein, 22 aa, Mycobacterium
DNTLDVWKRLCDPMAEQISTVW

SEQ ID NO: 647087 - protein, 19 aa, Mycobacterium
DNTSIICTVRHTIGRANAP

SEQ ID NO: 647088 - protein, 19 aa, Mycobacterium
DNTYYCFGTAAGPHPFPAM

SEQ ID NO: 647089 - protein, 20 aa, Mycobacterium
DNVACPFHDWRWGGDGKCKL

SEQ ID NO: 647090 - protein, 25 aa, Mycobacterium
DNVATLRRRGCVVMEPASGRLTGAD

SEQ ID NO: 647091 - protein, 27 aa, Mycobacterium
DNVCERGECDFVWDLAAPLPMAVIGDM

SEQ ID NO: 647092 - protein, 26 aa, Mycobacterium
DNVGRLPWLAGVRVVYWGDIDTHGFA

SEQ ID NO: 647093 - protein, 19 aa, Mycobacterium
DNVSAWRFITPPSAFIGAV

SEQ ID NO: 647094 - protein, 25 aa, Mycobacterium
DNVSAWRFITPPSAFISTVMVDQQG

SEQ ID NO: 647095 - protein, 19 aa, Mycobacterium
DNVVGSWLRLHNRTAYERL

SEQ ID NO: 647096 - protein, 25 aa, Mycobacterium
DNWFWIKVPVGYLFTIANPRTDWCF

SEQ ID NO: 647097 - protein, 20 aa, Mycobacterium
DNWFWIKVPVGYLYTIANPR

SEQ ID NO: 647098 - protein, 23 aa, Mycobacterium
DNWITFGGALGMDVTPFDTVRTS

SEQ ID NO: 647099 - protein, 24 aa, Mycobacterium
DNYQRGPTGWVFTRREPVVVFSED

SEQ ID NO: 647100 - protein, 28 aa, Mycobacterium
DPAAAALRNRRWRAARTEAEVFLRTYRD

SEQ ID NO: 647101 - protein, 20 aa, Mycobacterium
DPAAAFLGSRVIPLDEILAS

SEQ ID NO: 647102 - protein, 20 aa, Mycobacterium
DPAAALAFLRRLHDETRRID

SEQ ID NO: 647103 - protein, 17 aa, Mycobacterium
DPAAAPFVVVDLGGGST

SEQ ID NO: 647104 - protein, 17 aa, Mycobacterium
DPAAHSFRGPTKRNRVM

SEQ ID NO: 647105 - protein, 25 aa, Mycobacterium
DPAAIRRRIGYVFPGQGGQRPGMGQ

SEQ ID NO: 647106 - protein, 19 aa, Mycobacterium
DPAALTWELYRDTVIEQAE

SEQ ID NO: 647107 - protein, 24 aa, Mycobacterium
DPAALYLRMDDFAARLVIVPGESD

SEQ ID NO: 647108 - protein, 17 aa, Mycobacterium
DPAAPAFHVVAPSLPGF

SEQ ID NO: 647109 - protein, 24 aa, Mycobacterium
DPAAPKHRGISCVILDLHSPGVRI

SEQ ID NO: 647110 - protein, 28 aa, Mycobacterium
DPAARDLACRWAREWVDRLSALNRPQAL

SEQ ID NO: 647111 - protein, 20 aa, Mycobacterium
DPAARGRRALAAAQSKYDAA

SEQ ID NO: 647112 - protein, 24 aa, Mycobacterium
DPAARIVAFVGRIQPLKAPDVLLR

SEQ ID NO: 647113 - protein, 26 aa, Mycobacterium
DPAARLLRWVQLCGAETRVFGPRNEL

SEQ ID NO: 647114 - protein, 20 aa, Mycobacterium
DPAARWSFETKQVHAGQQPD

SEQ ID NO: 647115 - protein, 18 aa, Mycobacterium
DPAARWVTPGAKADEDAA

SEQ ID NO: 647116 - protein, 29 aa, Mycobacterium
DPAATFSPVWLRRNGIEYTVDHIVVGGED

SEQ ID NO: 647117 - protein, 26 aa, Mycobacterium
DPAAVGDWMLLAAIEALIDGHEYLTN

SEQ ID NO: 647118 - protein, 24 aa, Mycobacterium
DPACTADAAITGRTAGPAVAAELA

SEQ ID NO: 647119 - protein, 19 aa, Mycobacterium
DPADKRVALVFSAYPTKHA

SEQ ID NO: 647120 - protein, 19 aa, Mycobacterium
DPADLGLLRGFLDADTLDY

SEQ ID NO: 647121 - protein, 17 aa, Mycobacterium
DPAEAMAVWRSTLNDAI

SEQ ID NO: 647122 - protein, 24 aa, Mycobacterium
DPAELPARIRPPLTEFTDSTLCGL

SEQ ID NO: 647123 - protein, 23 aa, Mycobacterium
DPAEWKVFLGVLRERFEQDKTKW

SEQ ID NO: 647124 - protein, 18 aa, Mycobacterium
DPAFPYFRRAIGVLDKAT

SEQ ID NO: 647125 - protein, 23 aa, Mycobacterium
DPAFTSHYYRPAVAGSASVPTIP

SEQ ID NO: 647126 - protein, 18 aa, Mycobacterium
DPAGEWMPAVIAAADRRL

SEQ ID NO: 647127 - protein, 23 aa, Mycobacterium
DPAGLVNAFGYPVAADVALLTLA

SEQ ID NO: 647128 - protein, 21 aa, Mycobacterium
DPAGVRRALMLTGQHAALDDL

SEQ ID NO: 647129 - protein, 25 aa, Mycobacterium
DPAHPDARLGMVLGDAAPIAVITTA

SEQ ID NO: 647130 - protein, 20 aa, Mycobacterium
DPAHPRWFGHPGHRGDDAVR

SEQ ID NO: 647131 - protein, 23 aa, Mycobacterium
DPAHRLITIILMRCGLRITDALR

SEQ ID NO: 647132 - protein, 23 aa, Mycobacterium
DPAIAPVWRGARVAGPAFTVQGV

SEQ ID NO: 647133 - protein, 19 aa, Mycobacterium
DPAIISWPKGIAARGEVRD

SEQ ID NO: 647134 - protein, 17 aa, Mycobacterium
DPAIPFDVACLVGCGVT

SEQ ID NO: 647135 - protein, 21 aa, Mycobacterium
DPAIRPAVQGVMMHGINMLGV

SEQ ID NO: 647136 - protein, 24 aa, Mycobacterium
DPAIWDHPVDHPHVTEPDHHGFGI

SEQ ID NO: 647137 - protein, 25 aa, Mycobacterium
DPAKLDRLTLGLSRRFVRRSYRTPL

SEQ ID NO: 647138 - protein, 23 aa, Mycobacterium
DPAKLKRLIVDLIDKENWSASGT

SEQ ID NO: 647139 - protein, 22 aa, Mycobacterium
DPAKLRFGQEVELTMVPLSTDE

SEQ ID NO: 647140 - protein, 22 aa, Mycobacterium
DPAKLRMALRMADATDVDGHHR

SEQ ID NO: 647141 - protein, 22 aa, Mycobacterium
DPAKRLAQALGIDDLGNTPQRV

SEQ ID NO: 647142 - protein, 22 aa, Mycobacterium
DPAKRLAQALGIESLGNTPQRV

SEQ ID NO: 647143 - protein, 22 aa, Mycobacterium
DPAKRLAQALGIKDLGNTPQRV

SEQ ID NO: 647144 - protein, 20 aa, Mycobacterium
DPAKRMNIFTALAMFSLDSN

SEQ ID NO: 647145 - protein, 20 aa, Mycobacterium
DPALARRIGDAWTVSDVPLL

SEQ ID NO: 647146 - protein, 21 aa, Mycobacterium
DPALCRFEFEYLLNPAPPQAQ

SEQ ID NO: 647147 - protein, 25 aa, Mycobacterium
DPALPAARIEFMLADAAPVAAITTV

SEQ ID NO: 647148 - protein, 26 aa, Mycobacterium
DPALPESRIGFVLSDAAPLAVVTTAD

SEQ ID NO: 647149 - protein, 37 aa, Mycobacterium
DPALPLTLPAVYRWCGLHARYLISWCRRHGHADVLGV

SEQ ID NO: 647150 - protein, 24 aa, Mycobacterium
DPALPTTRIEFMLTDAAPVAAVTT

SEQ ID NO: 647151 - protein, 24 aa, Mycobacterium
DPALRAGAVLSVARRAGELGWHTV

SEQ ID NO: 647152 - protein, 19 aa, Mycobacterium
DPALREELGRAAVAAGKAL

SEQ ID NO: 647153 - protein, 28 aa, Mycobacterium
DPALRSTVVAVIWLDRSPTWEVLADRVD

SEQ ID NO: 647154 - protein, 19 aa, Mycobacterium
DPALSLDVFNRISEVTFNY

SEQ ID NO: 647155 - protein, 27 aa, Mycobacterium
DPANLPPGYEMVTLPGSASLTGQGQTN

SEQ ID NO: 647156 - protein, 20 aa, Mycobacterium
DPAQAVEVVHRFGVTCTAGT

SEQ ID NO: 647157 - protein, 24 aa, Mycobacterium
DPARFNGTVLLEWLNVSGGIDAPA

SEQ ID NO: 647158 - protein, 24 aa, Mycobacterium
DPARLEPGDIGFFVDRHTLALGRD

SEQ ID NO: 647159 - protein, 25 aa, Mycobacterium
DPARRLGVDIVLPWDGRDHYLAGIY

SEQ ID NO: 647160 - protein, 25 aa, Mycobacterium
DPASARGSLRLSLGHTSTEADIEAV

SEQ ID NO: 647161 - protein, 24 aa, Mycobacterium
DPASARGSLRLSLGHTSVDADVDA

SEQ ID NO: 647162 - protein, 25 aa, Mycobacterium
DPASARGSLRLSLGHTTVEADVDAA

SEQ ID NO: 647163 - protein, 23 aa, Mycobacterium
DPASARGSLRMSLGHTSVDADVD

SEQ ID NO: 647164 - protein, 22 aa, Mycobacterium
DPATDWPRRHPDVVFCSITPFG

SEQ ID NO: 647165 - protein, 26 aa, Mycobacterium
DPATGRFLWQNIFGVWPVSGLENGKV

SEQ ID NO: 647166 - protein, 31 aa, Mycobacterium
DPATLTDLVFAWRACRAVKSNAIVIAGGGAT

SEQ ID NO: 647167 - protein, 17 aa, Mycobacterium
DPATPVVLGRDVGGAGE

SEQ ID NO: 647168 - protein, 27 aa, Mycobacterium
DPAVAGWIRTVCRPDRWLELRYVAAGS

SEQ ID NO: 647169 - protein, 25 aa, Mycobacterium
DPAVPAARMEFMLGDAAPVAAVTTA

SEQ ID NO: 647170 - protein, 19 aa, Mycobacterium
DPAVPVFALTTGPRWPDVS

SEQ ID NO: 647171 - protein, 18 aa, Mycobacterium
DPAVVNWIVNRLADTGLT

SEQ ID NO: 647172 - protein, 17 aa, Mycobacterium
DPAWDFGGRGERFEVDI

SEQ ID NO: 647173 - protein, 23 aa, Mycobacterium
DPAWDWGETRYEIVIDGDTPTEL

SEQ ID NO: 647174 - protein, 23 aa, Mycobacterium
DPAWSLQCDIARQVLALDGVPAD

SEQ ID NO: 647175 - protein, 17 aa, Mycobacterium
DPCDFVIFGGTGDLAAR

SEQ ID NO: 647176 - protein, 24 aa, Mycobacterium
DPDAPKHKGISCLIVDMTLPGIEA

SEQ ID NO: 647177 - protein, 24 aa, Mycobacterium
DPDAPKHRGISCLILDLHAPGVRI

SEQ ID NO: 647178 - protein, 24 aa, Mycobacterium
DPDAPKHRGISCLILDLHSPGVRV

SEQ ID NO: 647179 - protein, 19 aa, Mycobacterium
DPDAPVIVLLHGFPTSSFM

SEQ ID NO: 647180 - protein, 20 aa, Mycobacterium
DPDATMKLMFYIDEDADARQ

SEQ ID NO: 647181 - protein, 18 aa, Mycobacterium
DPDAWARLIDAHQVTVLH

SEQ ID NO: 647182 - protein, 18 aa, Mycobacterium
DPDAWARLIDTHRVTVLH

SEQ ID NO: 647183 - protein, 18 aa, Mycobacterium
DPDAWRPVFAGLAELGLF

SEQ ID NO: 647184 - protein, 21 aa, Mycobacterium
DPDAYRSAARIVEAVDYLTFR

SEQ ID NO: 647185 - protein, 18 aa, Mycobacterium
DPDDVLDLDVEWPASELV

SEQ ID NO: 647186 - protein, 23 aa, Mycobacterium
DPDEAWSRFGGFIMNEATEYSGW

SEQ ID NO: 647187 - protein, 21 aa, Mycobacterium
DPDECRPVFRLNGEEADTVAA

SEQ ID NO: 647188 - protein, 18 aa, Mycobacterium
DPDEIYFAALEGIKKVQY

SEQ ID NO: 647189 - protein, 17 aa, Mycobacterium
DPDEMDGVIGLPTGFYD

SEQ ID NO: 647190 - protein, 21 aa, Mycobacterium
DPDERCSLLHAAPMSHGSGLY

SEQ ID NO: 647191 - protein, 25 aa, Mycobacterium
DPDERGMRTVMCILNGQLRPVVVRD

SEQ ID NO: 647192 - protein, 22 aa, Mycobacterium
DPDEVRSRVQALLGQLDSPAGA

SEQ ID NO: 647193 - protein, 19 aa, Mycobacterium
DPDEYGALAVHIVENPMLN

SEQ ID NO: 647194 - protein, 21 aa, Mycobacterium
DPDFAGSCYVHVQKYVHDMSA

SEQ ID NO: 647195 - protein, 18 aa, Mycobacterium
DPDFPILDKKVEVKPAEL

SEQ ID NO: 647196 - protein, 20 aa, Mycobacterium
DPDGGATGRSRWRRKNPKNA

SEQ ID NO: 647197 - protein, 19 aa, Mycobacterium
DPDGWKITSNELVREAGVH

SEQ ID NO: 647198 - protein, 17 aa, Mycobacterium
DPDGWQKARDVLDALPE

SEQ ID NO: 647199 - protein, 26 aa, Mycobacterium
DPDHAAYISCGTWGLVGVELGRQVAT

SEQ ID NO: 647200 - protein, 18 aa, Mycobacterium
DPDHPGLVRIYKEIDSAP

SEQ ID NO: 647201 - protein, 23 aa, Mycobacterium
DPDHPPVGLVVFAGGASSGLDDG

SEQ ID NO: 647202 - protein, 19 aa, Mycobacterium
DPDIAALLGKELGRQRDTL

SEQ ID NO: 647203 - protein, 26 aa, Mycobacterium
DPDKLPMRLGLEISGTIAAVGAGVDG

SEQ ID NO: 647204 - protein, 18 aa, Mycobacterium
DPDLLGLYEGIALTERDS

SEQ ID NO: 647205 - protein, 24 aa, Mycobacterium
DPDLPHPAALLSRIGHKHASLGVT

SEQ ID NO: 647206 - protein, 18 aa, Mycobacterium
DPDLPPSHHYLAAYRWLD

SEQ ID NO: 647207 - protein, 18 aa, Mycobacterium
DPDLPPSHHYLAAYRWLE

SEQ ID NO: 647208 - protein, 18 aa, Mycobacterium
DPDLPPSHHYLAAYRWLS

SEQ ID NO: 647209 - protein, 18 aa, Mycobacterium
DPDLRIVAVTDAYLQATM

SEQ ID NO: 647210 - protein, 21 aa, Mycobacterium
DPDLTPALASLVFVVRPPTAT

SEQ ID NO: 647211 - protein, 18 aa, Mycobacterium
DPDLTPALSSLVFVVRPP

SEQ ID NO: 647212 - protein, 22 aa, Mycobacterium
DPDLTPALSSMVFVARPPTATP

SEQ ID NO: 647213 - protein, 23 aa, Mycobacterium
DPDLTPALSSMVFVARPPTATPT

SEQ ID NO: 647214 - protein, 21 aa, Mycobacterium
DPDLVSDIVLWLASDASSLVT

SEQ ID NO: 647215 - protein, 23 aa, Mycobacterium
DPDPRAADIVETWAHVLDQLERD

SEQ ID NO: 647216 - protein, 25 aa, Mycobacterium
DPDPRASHVIETWANVLDLLERDPM

SEQ ID NO: 647217 - protein, 26 aa, Mycobacterium
DPDPRASHVLETWAHVLDLLERDPME

SEQ ID NO: 647218 - protein, 21 aa, Mycobacterium
DPDPRMLRPTSVREFDGTPTT

SEQ ID NO: 647219 - protein, 20 aa, Mycobacterium
DPDPTRYGNVSTFTAVEDGH

SEQ ID NO: 647220 - protein, 24 aa, Mycobacterium
DPDRARCVTLGLLASAMAGIVQWC

SEQ ID NO: 647221 - protein, 18 aa, Mycobacterium
DPDRFAPDRVRARPAGLY

SEQ ID NO: 647222 - protein, 20 aa, Mycobacterium
DPDRLAALRKVMPRLLNVGP

SEQ ID NO: 647223 - protein, 22 aa, Mycobacterium
DPDRLAGMAPRAKLVSLKVLGP

SEQ ID NO: 647224 - protein, 24 aa, Mycobacterium
DPDRLRLPLVRSRSGEHVQVSWDD

SEQ ID NO: 647225 - protein, 23 aa, Mycobacterium
DPDRLSAPLVRRDGVLREATWDE

SEQ ID NO: 647226 - protein, 19 aa, Mycobacterium
DPDRMLGVILGPTGWLPFG

SEQ ID NO: 647227 - protein, 24 aa, Mycobacterium
DPDRWLPERARAIGRNTYIPFGGG

SEQ ID NO: 647228 - protein, 25 aa, Mycobacterium
DPDRWQPWREFIASVRAQLPLNDPQ

SEQ ID NO: 647229 - protein, 24 aa, Mycobacterium
DPDRYAGEIAHIIGCEPEDVLRVS

SEQ ID NO: 647230 - protein, 24 aa, Mycobacterium
DPDRYAGEIAHIIGCEPGDVLRVS

SEQ ID NO: 647231 - protein, 17 aa, Mycobacterium
DPDSFWSGVDKVVSDLT

SEQ ID NO: 647232 - protein, 32 aa, Mycobacterium
DPDSVELPGWYRPNPGLARDLAFVGFSTIGGE

SEQ ID NO: 647233 - protein, 23 aa, Mycobacterium
DPDSWADFFVRANARYVVLTTKH

SEQ ID NO: 647234 - protein, 26 aa, Mycobacterium
DPDTARAAIADWLYWQHVAGLLGSAL

SEQ ID NO: 647235 - protein, 22 aa, Mycobacterium
DPDTRYALGSVLNHVVLHQSVI

SEQ ID NO: 647236 - protein, 17 aa, Mycobacterium
DPDTVLVGTDFGPDTLT

SEQ ID NO: 647237 - protein, 20 aa, Mycobacterium
DPDVPLVVSEVNFARDAANR

SEQ ID NO: 647238 - protein, 23 aa, Mycobacterium
DPDWAASLQPGWQEERKRNFHNW

SEQ ID NO: 647239 - protein, 25 aa, Mycobacterium
DPDWAASLQPGWQRRRIENFQILTA

SEQ ID NO: 647240 - protein, 29 aa, Mycobacterium
DPEAAWELGIGVLLTGVWNTLQIASAHMM

SEQ ID NO: 647241 - protein, 17 aa, Mycobacterium
DPEACAWVARLAVDFRQ

SEQ ID NO: 647242 - protein, 21 aa, Mycobacterium
DPEAFGGWKQRNSKADHAAVR

SEQ ID NO: 647243 - protein, 20 aa, Mycobacterium
DPEAFPAWKERNAKSASATV

SEQ ID NO: 647244 - protein, 22 aa, Mycobacterium
DPEAFTKLAARFLGPAVTGVQP

SEQ ID NO: 647245 - protein, 28 aa, Mycobacterium
DPEAGDACVLWCSAIRHGVLTGDLDVRV

SEQ ID NO: 647246 - protein, 21 aa, Mycobacterium
DPEALAAFEHLVAARAKRIPL

SEQ ID NO: 647247 - protein, 18 aa, Mycobacterium
DPEALASLIRRHSVAQVT

SEQ ID NO: 647248 - protein, 20 aa, Mycobacterium
DPEANWGLATFEGGDVLVPG

SEQ ID NO: 647249 - protein, 20 aa, Mycobacterium
DPEARRMIRESGRHIGEVLA

SEQ ID NO: 647250 - protein, 25 aa, Mycobacterium
DPEAYLRAAIAWHFGADTGSAFWLR

SEQ ID NO: 647251 - protein, 21 aa, Mycobacterium
DPEAYPADRARAIEPKAGCAT

SEQ ID NO: 647252 - protein, 22 aa, Mycobacterium
DPECDCYTCANYSRAYIRHLFK

SEQ ID NO: 647253 - protein, 21 aa, Mycobacterium
DPEDGYPVFVDALVNIRHTVA

SEQ ID NO: 647254 - protein, 18 aa, Mycobacterium
DPEECLRAIATRKVTTMI

SEQ ID NO: 647255 - protein, 22 aa, Mycobacterium
DPEETCALALVADPLVWVTGQL

SEQ ID NO: 647256 - protein, 24 aa, Mycobacterium
DPEGIELWAPCFGHQDVDPLDADL

SEQ ID NO: 647257 - protein, 23 aa, Mycobacterium
DPEGPYQLLGWSFGGVTAHQVAV

SEQ ID NO: 647258 - protein, 22 aa, Mycobacterium
DPEHHYTAVIAWMGYDAPNGFS

SEQ ID NO: 647259 - protein, 21 aa, Mycobacterium
DPEHPLWLGSVKSNIGHTQAA

SEQ ID NO: 647260 - protein, 21 aa, Mycobacterium
DPEHPLWLGSVKSNIGHTQHA

SEQ ID NO: 647261 - protein, 20 aa, Mycobacterium
DPEIEACLAAGITQVKVRSV

SEQ ID NO: 647262 - protein, 24 aa, Mycobacterium
DPEIIRALDMLLILHADHEQNCST

SEQ ID NO: 647263 - protein, 18 aa, Mycobacterium
DPEIQRIVLLEALAVLGW

SEQ ID NO: 647264 - protein, 24 aa, Mycobacterium
DPEITALARCFAHNDGIQALPDTV

SEQ ID NO: 647265 - protein, 24 aa, Mycobacterium
DPEIVRALDMLFILHADHEQNCST

SEQ ID NO: 647266 - protein, 25 aa, Mycobacterium
DPELARELFIRHALVEGDWQSKHHF

SEQ ID NO: 647267 - protein, 17 aa, Mycobacterium
DPELAWQYVELDAGGDQ

SEQ ID NO: 647268 - protein, 21 aa, Mycobacterium
DPELIPKLMDAGVIEVAPLAY

SEQ ID NO: 647269 - protein, 24 aa, Mycobacterium
DPELIPKLMSAGVIEVAPLAYMRG

SEQ ID NO: 647270 - protein, 20 aa, Mycobacterium
DPELLAGLVTGERVAGLALE

SEQ ID NO: 647271 - protein, 18 aa, Mycobacterium
DPEMIAAMEEFMRDYETR

SEQ ID NO: 647272 - protein, 21 aa, Mycobacterium
DPEMLRYFADVGINLDSRLRV

SEQ ID NO: 647273 - protein, 19 aa, Mycobacterium
DPEMLRYFDSVGINLDSQL

SEQ ID NO: 647274 - protein, 19 aa, Mycobacterium
DPEMLRYFDTVGISLDSRL

SEQ ID NO: 647275 - protein, 19 aa, Mycobacterium
DPEMLRYFDTVGVALDARV

SEQ ID NO: 647276 - protein, 19 aa, Mycobacterium
DPEMLRYFTDVGINLDSRL

SEQ ID NO: 647277 - protein, 21 aa, Mycobacterium
DPEMVKDILALIADLGADGMT

SEQ ID NO: 647278 - protein, 22 aa, Mycobacterium
DPENRLYALAARVPMGQADRYS

SEQ ID NO: 647279 - protein, 19 aa, Mycobacterium
DPEQCKLSEVARVAMVTNL

SEQ ID NO: 647280 - protein, 21 aa, Mycobacterium
DPERDGRAIAMGRRGTPDEQA

SEQ ID NO: 647281 - protein, 25 aa, Mycobacterium
DPERGSLLSARWLRPPSGPGVLLLA

SEQ ID NO: 647282 - protein, 20 aa, Mycobacterium
DPERGSSMWTLAVDPAAGLP

SEQ ID NO: 647283 - protein, 25 aa, Mycobacterium
DPERPTLVMAHGWPDSHVLWDGVVG

SEQ ID NO: 647284 - protein, 19 aa, Mycobacterium
DPERWPAFVPTNGGSVNAV

SEQ ID NO: 647285 - protein, 18 aa, Mycobacterium
DPESAFEAWKKCSAGRPC

SEQ ID NO: 647286 - protein, 24 aa, Mycobacterium
DPESIELWAPCFGERDVAEHESDL

SEQ ID NO: 647287 - protein, 17 aa, Mycobacterium
DPETGEVRHVPPGDTPG

SEQ ID NO: 647288 - protein, 30 aa, Mycobacterium
DPETGMPRLGWRAATLSGFRRDPDAALVFA

SEQ ID NO: 647289 - protein, 29 aa, Mycobacterium
DPETGQGGFSEWPALLTFAEPGEQGGVRV

SEQ ID NO: 647290 - protein, 22 aa, Mycobacterium
DPETKLIVMIGEIGGDAEEKAA

SEQ ID NO: 647291 - protein, 22 aa, Mycobacterium
DPETLLRVGISVWERYTGPYTD

SEQ ID NO: 647292 - protein, 21 aa, Mycobacterium
DPETNYRIGFVPQGIGADLIA

SEQ ID NO: 647293 - protein, 21 aa, Mycobacterium
DPETRPPIGELLRGYEETVPH

SEQ ID NO: 647294 - protein, 25 aa, Mycobacterium
DPEVARGSLRFTFGHTSVPSDVDRA

SEQ ID NO: 647295 - protein, 21 aa, Mycobacterium
DPEVDRIWFAPNVWPDEVPAL

SEQ ID NO: 647296 - protein, 23 aa, Mycobacterium
DPEVEISRILPVVKELAQQGITV

SEQ ID NO: 647297 - protein, 17 aa, Mycobacterium
DPEVLAHNALQLAVYRL

SEQ ID NO: 647298 - protein, 19 aa, Mycobacterium
DPEVMARIIALSMAAAENP

SEQ ID NO: 647299 - protein, 20 aa, Mycobacterium
DPEWAKSLQPGWQKQRQRNF

SEQ ID NO: 647300 - protein, 24 aa, Mycobacterium
DPEWAKSLRPGWQRERQRNFHSWT

SEQ ID NO: 647301 - protein, 25 aa, Mycobacterium
DPFAALILAANIGWRDTVLLRALAR

SEQ ID NO: 647302 - protein, 20 aa, Mycobacterium
DPFAEPGWFRTDDIGVLDAG

SEQ ID NO: 647303 - protein, 20 aa, Mycobacterium
DPFAEPGWFRTDDLGALDDS

SEQ ID NO: 647304 - protein, 20 aa, Mycobacterium
DPFAQLRAGIEAVFASWDSP

SEQ ID NO: 647305 - protein, 20 aa, Mycobacterium
DPFARIGLTVLRGAGLRAGE

SEQ ID NO: 647306 - protein, 17 aa, Mycobacterium
DPFASLNPRARVDTSIA

SEQ ID NO: 647307 - protein, 24 aa, Mycobacterium
DPFCAAHPLVRVRLEVNLRSAGIV

SEQ ID NO: 647308 - protein, 18 aa, Mycobacterium
DPFDWLPLEHRSVHARAD

SEQ ID NO: 647309 - protein, 21 aa, Mycobacterium
DPFEVAALWNALRKGGVPTAG

SEQ ID NO: 647310 - protein, 20 aa, Mycobacterium
DPFGGPGRAPTMLVTDISMR

SEQ ID NO: 647311 - protein, 19 aa, Mycobacterium
DPFGGPGRNPTMLVTDISM

SEQ ID NO: 647312 - protein, 19 aa, Mycobacterium
DPFGHHWSLGQPVRELSMD

SEQ ID NO: 647313 - protein, 24 aa, Mycobacterium
DPFGLLPPLVRWIGKAMAAVPILR

SEQ ID NO: 647314 - protein, 21 aa, Mycobacterium
DPFHHMVVIYALFPNVVLSVT

SEQ ID NO: 647315 - protein, 22 aa, Mycobacterium
DPFKAGTTWTQRIVQQILHNGE

SEQ ID NO: 647316 - protein, 23 aa, Mycobacterium
DPFLEGYTSLGFLAGQTTGIELS

SEQ ID NO: 647317 - protein, 19 aa, Mycobacterium
DPFLRAVIETGYERPDAGV

SEQ ID NO: 647318 - protein, 17 aa, Mycobacterium
DPFPRAGQRGVFERPQV

SEQ ID NO: 647319 - protein, 22 aa, Mycobacterium
DPFRREIFMIGRNTQVTRYEKV

SEQ ID NO: 647320 - protein, 29 aa, Mycobacterium
DPFRRPGWDEITDVLDWVSPLPGGSAVSV

SEQ ID NO: 647321 - protein, 24 aa, Mycobacterium
DPFVERALEPWSFGIYAGGQSILI

SEQ ID NO: 647322 - protein, 19 aa, Mycobacterium
DPFVERALEPWSYGIYAGG

SEQ ID NO: 647323 - protein, 23 aa, Mycobacterium
DPFWERLRFDQALERVEVPILLL

SEQ ID NO: 647324 - protein, 23 aa, Mycobacterium
DPFWTRLRLRDGLERAEVPVLLL

SEQ ID NO: 647325 - protein, 17 aa, Mycobacterium
DPGAALLEFLTEAADQR

SEQ ID NO: 647326 - protein, 20 aa, Mycobacterium
DPGADRFTYTVTRVSGSDRT

SEQ ID NO: 647327 - protein, 24 aa, Mycobacterium
DPGAIRLGLFAGHYRQDRYWSPAV

SEQ ID NO: 647328 - protein, 27 aa, Mycobacterium
DPGCPFAPRCPLAIDECRLEEPELLPV

SEQ ID NO: 647329 - protein, 26 aa, Mycobacterium
DPGCPFAPRCPLVIDECRSAEPELIQ

SEQ ID NO: 647330 - protein, 17 aa, Mycobacterium
DPGCVNGLLTHGIAESA

SEQ ID NO: 647331 - protein, 24 aa, Mycobacterium
DPGEALFDYLRLMVLQCGAADRGL

SEQ ID NO: 647332 - protein, 24 aa, Mycobacterium
DPGEARTALAQRLPGYMVPAAVVG

SEQ ID NO: 647333 - protein, 23 aa, Mycobacterium
DPGEHRLRRLVGWFDHAVELGAS

SEQ ID NO: 647334 - protein, 22 aa, Mycobacterium
DPGEIAAAVAFLASDDASFITA

SEQ ID NO: 647335 - protein, 18 aa, Mycobacterium
DPGELERLYPRTAAELFS

SEQ ID NO: 647336 - protein, 20 aa, Mycobacterium
DPGFAEIFLDDVFVPDEDVI

SEQ ID NO: 647337 - protein, 18 aa, Mycobacterium
DPGFSWTPVILSDGAHHT

SEQ ID NO: 647338 - protein, 23 aa, Mycobacterium
DPGGRFWAGVMAYEPSPEAGALF

SEQ ID NO: 647339 - protein, 27 aa, Mycobacterium
DPGHAFPALELCRRFRAAGDAPTLLTG

SEQ ID NO: 647340 - protein, 26 aa, Mycobacterium
DPGHFWVWSINPCFPNQPGCLQIYAT

SEQ ID NO: 647341 - protein, 24 aa, Mycobacterium
DPGHSFPAIALCQRFADAGDDPTL

SEQ ID NO: 647342 - protein, 25 aa, Mycobacterium
DPGHSFPAIALCQRFQASGDRPTLF

SEQ ID NO: 647343 - protein, 25 aa, Mycobacterium
DPGHSFPAIALCRRFLAAGDIPTLL

SEQ ID NO: 647344 - protein, 20 aa, Mycobacterium
DPGKLPAIRQQIWTLMRAAK

SEQ ID NO: 647345 - protein, 19 aa, Mycobacterium
DPGLLQWIADVLPHTDYLL

SEQ ID NO: 647346 - protein, 23 aa, Mycobacterium
DPGLPDARIRFMIADASPIVALT

SEQ ID NO: 647347 - protein, 30 aa, Mycobacterium
DPGLPTARIEFMLADAIPIAAVTTAGVRSR

SEQ ID NO: 647348 - protein, 20 aa, Mycobacterium
DPGMCDAWLARILAGDQSIE

SEQ ID NO: 647349 - protein, 22 aa, Mycobacterium
DPGPPRPGYLERILDGAMHHGL

SEQ ID NO: 647350 - protein, 19 aa, Mycobacterium
DPGQELVFIGVHIDRDAIG

SEQ ID NO: 647351 - protein, 19 aa, Mycobacterium
DPGQFEWLGLDPTNDQMID

SEQ ID NO: 647352 - protein, 24 aa, Mycobacterium
DPGQLRVALSLKVPFSGFPAQLHP

SEQ ID NO: 647353 - protein, 18 aa, Mycobacterium
DPGQRWSVVLSNPPFGRK

SEQ ID NO: 647354 - protein, 19 aa, Mycobacterium
DPGRAKILLAQHVGSSPLQ

SEQ ID NO: 647355 - protein, 19 aa, Mycobacterium
DPGRGRRLGIDVGSVRIGV

SEQ ID NO: 647356 - protein, 26 aa, Mycobacterium
DPGRWRRWRVDGAAARAAEAIEDTAH

SEQ ID NO: 647357 - protein, 22 aa, Mycobacterium
DPGSVRVWSCFATVGDHLPEEL

SEQ ID NO: 647358 - protein, 24 aa, Mycobacterium
DPGVPGGRGLALFIAGDNLRKGAA

SEQ ID NO: 647359 - protein, 22 aa, Mycobacterium
DPHALLGTTFHEWVQRYFHAER

SEQ ID NO: 647360 - protein, 33 aa, Mycobacterium
DPHETRFATDFGGRVPPIEWRPATFAEEAAARM

SEQ ID NO: 647361 - protein, 23 aa, Mycobacterium
DPHGRRHASPSWLSMVHGEGAAL

SEQ ID NO: 647362 - protein, 25 aa, Mycobacterium
DPHGVRPLCLGRLDTGWVVASETAA

SEQ ID NO: 647363 - protein, 25 aa, Mycobacterium
DPHHPPTRIAFMLTDTTPIAVLTTT

SEQ ID NO: 647364 - protein, 24 aa, Mycobacterium
DPHHQARLLLPVTADLLRGSGRPL

SEQ ID NO: 647365 - protein, 18 aa, Mycobacterium
DPHLARITCPALVINAEA

SEQ ID NO: 647366 - protein, 21 aa, Mycobacterium
DPHLPSARMSPAQMYEHGLAG

SEQ ID NO: 647367 - protein, 22 aa, Mycobacterium
DPHPELLRSWNLGVDVDGLSRF

SEQ ID NO: 647368 - protein, 23 aa, Mycobacterium
DPHPEWFRTGDLGRLDADQNLTY

SEQ ID NO: 647369 - protein, 18 aa, Mycobacterium
DPHPTLRSAVTVNLRRLS

SEQ ID NO: 647370 - protein, 35 aa, Mycobacterium
DPHRADKWAGFPLPSPRPPVLLGVNSVALASLAGA

SEQ ID NO: 647371 - protein, 17 aa, Mycobacterium
DPHRGQMVWRFSEDSND

SEQ ID NO: 647372 - protein, 25 aa, Mycobacterium
DPHTRASALVAEWPARTDAADPDPN

SEQ ID NO: 647373 - protein, 18 aa, Mycobacterium
DPHVSIGLVAGRELVRVS

SEQ ID NO: 647374 - protein, 24 aa, Mycobacterium
DPHYGEPLSDSWNFPDDPVDPSGI

SEQ ID NO: 647375 - protein, 25 aa, Mycobacterium
DPICPFAWVTSRWLLEAAQSTHTPV

SEQ ID NO: 647376 - protein, 21 aa, Mycobacterium
DPIDRFCRRTQKLPTPEEYQD

SEQ ID NO: 647377 - protein, 17 aa, Mycobacterium
DPIECGTMLYADTDNRT

SEQ ID NO: 647378 - protein, 21 aa, Mycobacterium
DPIELWAWVGAYDHVALCQLW

SEQ ID NO: 647379 - protein, 17 aa, Mycobacterium
DPIGCIVARSLQKEPNL

SEQ ID NO: 647380 - protein, 18 aa, Mycobacterium
DPIGFPAAISALGEIDLV

SEQ ID NO: 647381 - protein, 18 aa, Mycobacterium
DPIGGPAFDDAVRTLASE

SEQ ID NO: 647382 - protein, 24 aa, Mycobacterium
DPIHPLQVGLDWASAAAHAALRTV

SEQ ID NO: 647383 - protein, 23 aa, Mycobacterium
DPIHPLQVGVDWVTAAPHAALRT

SEQ ID NO: 647384 - protein, 26 aa, Mycobacterium
DPIIVPGCLDLLFRGEIPDGVDPASL

SEQ ID NO: 647385 - protein, 25 aa, Mycobacterium
DPIIVPGCLDLLFRGEIPEGVDPAS

SEQ ID NO: 647386 - protein, 26 aa, Mycobacterium
DPIIVPGCLDLLFRGEIPEGVDPASL

SEQ ID NO: 647387 - protein, 24 aa, Mycobacterium
DPINGIHWELAWVPKVPTPRQLWA

SEQ ID NO: 647388 - protein, 21 aa, Mycobacterium
DPIPHGLLFERFLNPERTSMP

SEQ ID NO: 647389 - protein, 19 aa, Mycobacterium
DPIPMLTLFDKQIQLRMGQ

SEQ ID NO: 647390 - protein, 24 aa, Mycobacterium
DPIRVDWQAGGAFTTPPGMWHAHY

SEQ ID NO: 647391 - protein, 28 aa, Mycobacterium
DPIRVDWRAGCAFTTPPGMWHAHYNETD

SEQ ID NO: 647392 - protein, 22 aa, Mycobacterium
DPIVIVGMACRYPGGVNSPEDL

SEQ ID NO: 647393 - protein, 23 aa, Mycobacterium
DPIVIVGMSCRYPGGVDSPDDLW

SEQ ID NO: 647394 - protein, 18 aa, Mycobacterium
DPIWPKHAIRIIPGPSSM

SEQ ID NO: 647395 - protein, 30 aa, Mycobacterium
DPIWSAFVVRGRYAGGLVRLLGADDYPNIA

SEQ ID NO: 647396 - protein, 19 aa, Mycobacterium
DPIYGLGPRVAQLFAGAFF

SEQ ID NO: 647397 - protein, 19 aa, Mycobacterium
DPKAGPLIATKLHILTRKT

SEQ ID NO: 647398 - protein, 25 aa, Mycobacterium
DPKGDRQFCYARSGSAGSRLAPEDL

SEQ ID NO: 647399 - protein, 17 aa, Mycobacterium
DPKHPSWYFNVKANPSV

SEQ ID NO: 647400 - protein, 24 aa, Mycobacterium
DPKIRVAVEYYFKMPGDLHERDLI

SEQ ID NO: 647401 - protein, 18 aa, Mycobacterium
DPKIVISAVGPRMTRVAA

SEQ ID NO: 647402 - protein, 23 aa, Mycobacterium
DPKKARCFLRAWMEVPREDRRLP

SEQ ID NO: 647403 - protein, 33 aa, Mycobacterium
DPKLSAVRQRVRWWSAIALLRCLASSPAAAEQT

SEQ ID NO: 647404 - protein, 19 aa, Mycobacterium
DPKRSRRRWHILDVAARDA

SEQ ID NO: 647405 - protein, 19 aa, Mycobacterium
DPKTIPLTFFRKSSSSISG

SEQ ID NO: 647406 - protein, 21 aa, Mycobacterium
DPKTIVWITAGFRPEHRAALD

SEQ ID NO: 647407 - protein, 22 aa, Mycobacterium
DPKVPYYSATLFDPRERPTCDA

SEQ ID NO: 647408 - protein, 18 aa, Mycobacterium
DPKYSSAMLPGGQVQEFK

SEQ ID NO: 647409 - protein, 22 aa, Mycobacterium
DPLACIKSRLKAYSPGDTDLAW

SEQ ID NO: 647410 - protein, 20 aa, Mycobacterium
DPLAGIGPGLGQFIQGQVFA

SEQ ID NO: 647411 - protein, 25 aa, Mycobacterium
DPLALERQVCFALAVTNRAVLAVYR

SEQ ID NO: 647412 - protein, 19 aa, Mycobacterium
DPLAPFGFSGWVGPEPHGA

SEQ ID NO: 647413 - protein, 20 aa, Mycobacterium
DPLAPYGFSGWVGPEPHGAG

SEQ ID NO: 647414 - protein, 24 aa, Mycobacterium
DPLAYRLAVAELRRTLDEQSGATS

SEQ ID NO: 647415 - protein, 22 aa, Mycobacterium
DPLCYVDPYLPIDSFRRRDEAR

SEQ ID NO: 647416 - protein, 19 aa, Mycobacterium
DPLDAIAVAPGVYPAPQSQ

SEQ ID NO: 647417 - protein, 19 aa, Mycobacterium
DPLDELFEIGAVVTRLRGK

SEQ ID NO: 647418 - protein, 19 aa, Mycobacterium
DPLDSVYFAGYAMWNYLTT

SEQ ID NO: 647419 - protein, 25 aa, Mycobacterium
DPLDVASALDWLLYDWLMAHRTDPD

SEQ ID NO: 647420 - protein, 17 aa, Mycobacterium
DPLEPGGRLPIDREPRA

SEQ ID NO: 647421 - protein, 23 aa, Mycobacterium
DPLERVCALLDAMADAWSADPCL

SEQ ID NO: 647422 - protein, 25 aa, Mycobacterium
DPLFTRTASGLAFTPGGLRLASRAV

SEQ ID NO: 647423 - protein, 17 aa, Mycobacterium
DPLFYSSYMHMHRRLTD

SEQ ID NO: 647424 - protein, 19 aa, Mycobacterium
DPLGLRRRTHYLGEGDGVV

SEQ ID NO: 647425 - protein, 20 aa, Mycobacterium
DPLIRACALTFLSDFGPVPA

SEQ ID NO: 647426 - protein, 17 aa, Mycobacterium
DPLKFDIIGLLARHPEM

SEQ ID NO: 647427 - protein, 22 aa, Mycobacterium
DPLKVAVLLGAFAGLRVAEVSG

SEQ ID NO: 647428 - protein, 19 aa, Mycobacterium
DPLLACVLTGFGVTSLSAA

SEQ ID NO: 647429 - protein, 20 aa, Mycobacterium
DPLLACVLVGLGVTSLSAAA

SEQ ID NO: 647430 - protein, 21 aa, Mycobacterium
DPLLADLDCGRWRGKRLQDVP

SEQ ID NO: 647431 - protein, 26 aa, Mycobacterium
DPLLGVPFSAPYSFDTPFGPVALTLN

SEQ ID NO: 647432 - protein, 17 aa, Mycobacterium
DPLLRLATFFDDGSVEL

SEQ ID NO: 647433 - protein, 17 aa, Mycobacterium
DPLLRLSNFFDEGSVEL

SEQ ID NO: 647434 - protein, 23 aa, Mycobacterium
DPLMFKLGVGQVIQGWDQGVQGM

SEQ ID NO: 647435 - protein, 20 aa, Mycobacterium
DPLPAERWREYCLSSVTTHD

SEQ ID NO: 647436 - protein, 19 aa, Mycobacterium
DPLPGARNAVGDDLPDPHK

SEQ ID NO: 647437 - protein, 32 aa, Mycobacterium
DPLPSAALHAGWRALGWWLVGTSRAMLSLARQ

SEQ ID NO: 647438 - protein, 20 aa, Mycobacterium
DPLPSWGPFVPIAFEKWLVP

SEQ ID NO: 647439 - protein, 24 aa, Mycobacterium
DPLQRMWQALGFWELVIDTADSIA

SEQ ID NO: 647440 - protein, 23 aa, Mycobacterium
DPLRGDFKAVVSLDLRRLDELHS

SEQ ID NO: 647441 - protein, 21 aa, Mycobacterium
DPLRLACVFSDGSRAAFDLTG

SEQ ID NO: 647442 - protein, 18 aa, Mycobacterium
DPLRLARAVLDSLASGLV

SEQ ID NO: 647443 - protein, 19 aa, Mycobacterium
DPLRPAALEFSRAVIRPGH

SEQ ID NO: 647444 - protein, 17 aa, Mycobacterium
DPLRPLLEHTRALGEKD

SEQ ID NO: 647445 - protein, 23 aa, Mycobacterium
DPLSFKPDRWLSENSAHVPRHMF

SEQ ID NO: 647446 - protein, 20 aa, Mycobacterium
DPLSMLGPAMAGLGSIPGAL

SEQ ID NO: 647447 - protein, 26 aa, Mycobacterium
DPLSMYLFDLCTLPLNLAGHCGMSVP

SEQ ID NO: 647448 - protein, 20 aa, Mycobacterium
DPLVDHVVLAGGQRDDPRQP

SEQ ID NO: 647449 - protein, 26 aa, Mycobacterium
DPLVDYPEGWLWDLVGRNAPGSATVD

SEQ ID NO: 647450 - protein, 26 aa, Mycobacterium
DPLWLRRRVGMCFQRPTPFPGTVADN

SEQ ID NO: 647451 - protein, 27 aa, Mycobacterium
DPLWLRRRVGMCFQRPTPFPGTVADNL

SEQ ID NO: 647452 - protein, 19 aa, Mycobacterium
DPLYKFVLRQFVGYIVEKR

SEQ ID NO: 647453 - protein, 24 aa, Mycobacterium
DPMDSLRLGKAHRVPLVVGNNAEE

SEQ ID NO: 647454 - protein, 32 aa, Mycobacterium
DPMECAEVLDWPAKLRLLEGFRQRENLSWSAP

SEQ ID NO: 647455 - protein, 23 aa, Mycobacterium
DPMFAFGHGLSYTKFDYRDLTVS

SEQ ID NO: 647456 - protein, 20 aa, Mycobacterium
DPMPGVSWGRIIEVALVARE

SEQ ID NO: 647457 - protein, 24 aa, Mycobacterium
DPMRAIAEVIGRRLGVPVESAPVE

SEQ ID NO: 647458 - protein, 19 aa, Mycobacterium
DPMSYATVVAYVYSAGIST

SEQ ID NO: 647459 - protein, 23 aa, Mycobacterium
DPMVAICGAVTRADRLKRTHQSM

SEQ ID NO: 647460 - protein, 18 aa, Mycobacterium
DPMVFKPDSVLGVAGILN

SEQ ID NO: 647461 - protein, 29 aa, Mycobacterium
DPNAAYLRWWACLERVVLEAGLRGVLIAH

SEQ ID NO: 647462 - protein, 17 aa, Mycobacterium
DPNDLYDVLAINAASAS

SEQ ID NO: 647463 - protein, 27 aa, Mycobacterium
DPNELRQRIGMVFQHFNLFPHLSVLKN

SEQ ID NO: 647464 - protein, 28 aa, Mycobacterium
DPNESFAVLRRGMLLAMIHRGDYWQVAH

SEQ ID NO: 647465 - protein, 19 aa, Mycobacterium
DPNFTCAVRAFAQMFPHRR

SEQ ID NO: 647466 - protein, 25 aa, Mycobacterium
DPNGIPLWAGAAFKHASAGPAADII

SEQ ID NO: 647467 - protein, 25 aa, Mycobacterium
DPNGIPLWAGTSFKEAQPGPAADII

SEQ ID NO: 647468 - protein, 27 aa, Mycobacterium
DPNGPFFLVPWTWRQHLWPTEKFELAH

SEQ ID NO: 647469 - protein, 18 aa, Mycobacterium
DPNGWHLFAEIAKNKAAE

SEQ ID NO: 647470 - protein, 20 aa, Mycobacterium
DPNRCIWHVASYMYVPQEFR

SEQ ID NO: 647471 - protein, 23 aa, Mycobacterium
DPNRLKVFPAVTVVIGDTGTEAQ

SEQ ID NO: 647472 - protein, 17 aa, Mycobacterium
DPNRPPLDVPEGSAGIE

SEQ ID NO: 647473 - protein, 17 aa, Mycobacterium
DPNTMLPDVRFAPNPAD

SEQ ID NO: 647474 - protein, 24 aa, Mycobacterium
DPPAPEWHWEFDPLGRAKVHPDDE

SEQ ID NO: 647475 - protein, 24 aa, Mycobacterium
DPPARLGALAAFLGLSPRDPSASP

SEQ ID NO: 647476 - protein, 25 aa, Mycobacterium
DPPFEGMWWLYLPIAFDDFAVVLII

SEQ ID NO: 647477 - protein, 23 aa, Mycobacterium
DPPFEGMWWLYVPLAFDDFATVL

SEQ ID NO: 647478 - protein, 26 aa, Mycobacterium
DPPFEGMWWLYVPMAFDEFSIVLIIQ

SEQ ID NO: 647479 - protein, 18 aa, Mycobacterium
DPPKAVAHILNLPQVREP

SEQ ID NO: 647480 - protein, 20 aa, Mycobacterium
DPPLAGALLIGGQGRVVEPL

SEQ ID NO: 647481 - protein, 20 aa, Mycobacterium
DPPLFVFASSAAVYGSRNPH

SEQ ID NO: 647482 - protein, 18 aa, Mycobacterium
DPPLKLVLLESPGAGGTL

SEQ ID NO: 647483 - protein, 19 aa, Mycobacterium
DPPMPVARGLGMGFDPPLI

SEQ ID NO: 647484 - protein, 19 aa, Mycobacterium
DPPMPVARGLGMGFDPPVV

SEQ ID NO: 647485 - protein, 17 aa, Mycobacterium
DPPNDDWSLPPIRIRAD

SEQ ID NO: 647486 - protein, 20 aa, Mycobacterium
DPPPEMKAAVITVGPHDFSQ

SEQ ID NO: 647487 - protein, 26 aa, Mycobacterium
DPPPPPGSFGIMIAMGPGFSSEFVLL

SEQ ID NO: 647488 - protein, 17 aa, Mycobacterium
DPPQHWATIPFGVPLRN

SEQ ID NO: 647489 - protein, 20 aa, Mycobacterium
DPPRAGEVLVQLSATGLCHS

SEQ ID NO: 647490 - protein, 20 aa, Mycobacterium
DPPRGVRANMIFSADGAAAF

SEQ ID NO: 647491 - protein, 25 aa, Mycobacterium
DPPRLELAAGLYDMAAWQLDVFLDD

SEQ ID NO: 647492 - protein, 22 aa, Mycobacterium
DPPRSGEVLVRLAATGLCHSDE

SEQ ID NO: 647493 - protein, 28 aa, Mycobacterium
DPPRWRPDHRPPWLAGYLARARQVVPRY

SEQ ID NO: 647494 - protein, 18 aa, Mycobacterium
DPPRWRVIVQEIRSGQIV

SEQ ID NO: 647495 - protein, 25 aa, Mycobacterium
DPPVCEACGGLIRPDVVWFGEALPD

SEQ ID NO: 647496 - protein, 20 aa, Mycobacterium
DPPVSFPSLLREGFAAVAAG

SEQ ID NO: 647497 - protein, 17 aa, Mycobacterium
DPPWHRPLLGIRRTVTH

SEQ ID NO: 647498 - protein, 20 aa, Mycobacterium
DPPWSFGPAGERYEIEVRGH

SEQ ID NO: 647499 - protein, 23 aa, Mycobacterium
DPPYRGRVDMTFNVPPGIDHSAY

SEQ ID NO: 647500 - protein, 39 aa, Mycobacterium
DPQAALQFYGELFLFDYPVHIPQLLTWLSQSPQLLAVAL

SEQ ID NO: 647501 - protein, 22 aa, Mycobacterium
DPQADQVLQVWAKVLDLLERDP

SEQ ID NO: 647502 - protein, 26 aa, Mycobacterium
DPQAEFTSVWGRRDLVEYSVEHAVVG

SEQ ID NO: 647503 - protein, 23 aa, Mycobacterium
DPQELRRSPEFHRLRTEVGEAVK

SEQ ID NO: 647504 - protein, 18 aa, Mycobacterium
DPQGCLTFSLGHDPDKLT

SEQ ID NO: 647505 - protein, 18 aa, Mycobacterium
DPQGCLTFSLGQDPDRLG

SEQ ID NO: 647506 - protein, 23 aa, Mycobacterium
DPQHRILLETSWEAMEHAGLTRE

SEQ ID NO: 647507 - protein, 25 aa, Mycobacterium
DPQHRLFLECAWAAMEDAGYSPQSP

SEQ ID NO: 647508 - protein, 24 aa, Mycobacterium
DPQHRLFLQCAWHALEDANCDPAK

SEQ ID NO: 647509 - protein, 24 aa, Mycobacterium
DPQHRLLLETAWEAMEHAGLTPEK

SEQ ID NO: 647510 - protein, 24 aa, Mycobacterium
DPQHRLLLETAWEAVEHSGLNPAG

SEQ ID NO: 647511 - protein, 18 aa, Mycobacterium
DPQHRLLLETSWDAIEHA

SEQ ID NO: 647512 - protein, 19 aa, Mycobacterium
DPQHRLLLETSWDAVEHAG

SEQ ID NO: 647513 - protein, 24 aa, Mycobacterium
DPQHRLLLETSWEAIEHAGLDPAS

SEQ ID NO: 647514 - protein, 23 aa, Mycobacterium
DPQHRLLLQTSWEAVEHAGMPPM

SEQ ID NO: 647515 - protein, 18 aa, Mycobacterium
DPQHRVLLETSWQAVEHA

SEQ ID NO: 647516 - protein, 24 aa, Mycobacterium
DPQILLPKFFRQYGAKVQGGGILF

SEQ ID NO: 647517 - protein, 25 aa, Mycobacterium
DPQLLLAHGYDHNWVINRADNTELI

SEQ ID NO: 647518 - protein, 31 aa, Mycobacterium
DPQLPTGITRLRFRLRWRGFRVTVEADHDTV

SEQ ID NO: 647519 - protein, 23 aa, Mycobacterium
DPQLRFELSLGVSGVHYPDDSAR

SEQ ID NO: 647520 - protein, 20 aa, Mycobacterium
DPQLRVRGVDGLRVADASVM

SEQ ID NO: 647521 - protein, 19 aa, Mycobacterium
DPQLSYTMEGWEVLYNTYV

SEQ ID NO: 647522 - protein, 22 aa, Mycobacterium
DPQPEWEVAVGRLGHAITEHPE

SEQ ID NO: 647523 - protein, 29 aa, Mycobacterium
DPQPGLALIKSWAAQGWLHRIVDERHGQN

SEQ ID NO: 647524 - protein, 20 aa, Mycobacterium
DPQPSLVIRDGRVVEMDGKA

SEQ ID NO: 647525 - protein, 24 aa, Mycobacterium
DPQQRIVLEVAYEALENAGLAPDT

SEQ ID NO: 647526 - protein, 25 aa, Mycobacterium
DPQQRLFLEVAWEALENAGIPPQTI

SEQ ID NO: 647527 - protein, 18 aa, Mycobacterium
DPQQRLILEVSWEALEHA

SEQ ID NO: 647528 - protein, 18 aa, Mycobacterium
DPQQRLIMEVAWEAADDA

SEQ ID NO: 647529 - protein, 23 aa, Mycobacterium
DPQQRLLLETSWAALEHAGILPK

SEQ ID NO: 647530 - protein, 24 aa, Mycobacterium
DPQQRLLLETSWEALEDAGIDPQA

SEQ ID NO: 647531 - protein, 24 aa, Mycobacterium
DPQQRLLLETSWEAVEHAGLAPKS

SEQ ID NO: 647532 - protein, 18 aa, Mycobacterium
DPQQRLLLETTWEALDDA

SEQ ID NO: 647533 - protein, 23 aa, Mycobacterium
DPQQRLLLQATWEALEDGGIPAD

SEQ ID NO: 647534 - protein, 23 aa, Mycobacterium
DPQQRLMLEIAWETFESAGIDPH

SEQ ID NO: 647535 - protein, 18 aa, Mycobacterium
DPQQRLMLEVSWEALEHA

SEQ ID NO: 647536 - protein, 31 aa, Mycobacterium
DPQQRMALELTWEALEHARIPASSLRGESVG

SEQ ID NO: 647537 - protein, 25 aa, Mycobacterium
DPQQRMMLEICWEALERAGIDPFAL

SEQ ID NO: 647538 - protein, 24 aa, Mycobacterium
DPQQRVALRVAWRALENSGINPDD

SEQ ID NO: 647539 - protein, 24 aa, Mycobacterium
DPQQRVAMRVAWKALENTGLNPGA

SEQ ID NO: 647540 - protein, 24 aa, Mycobacterium
DPQRAAAFAESWLSGLDSEQLETL

SEQ ID NO: 647541 - protein, 18 aa, Mycobacterium
DPQREALTIAFGTRSGPP

SEQ ID NO: 647542 - protein, 23 aa, Mycobacterium
DPQRHLNGVWGLGERPGVFIEFV

SEQ ID NO: 647543 - protein, 25 aa, Mycobacterium
DPQRPTILAIHGWPDNHHLWDPVAE

SEQ ID NO: 647544 - protein, 19 aa, Mycobacterium
DPQRVLTLVAFDQAGTGIQ

SEQ ID NO: 647545 - protein, 20 aa, Mycobacterium
DPQRVWNLVCDIELMPAVSN

SEQ ID NO: 647546 - protein, 20 aa, Mycobacterium
DPQSGLALIKSWAAQGWLHR

SEQ ID NO: 647547 - protein, 25 aa, Mycobacterium
DPQTHIRPPVKFRVKLDSPEGRVEL

SEQ ID NO: 647548 - protein, 17 aa, Mycobacterium
DPQVLIRAGESMLSLGN

SEQ ID NO: 647549 - protein, 25 aa, Mycobacterium
DPQWAGALRPGWQRRRIENFQILTA

SEQ ID NO: 647550 - protein, 22 aa, Mycobacterium
DPQYPYVGKLVHELTLAQIRTL

SEQ ID NO: 647551 - protein, 18 aa, Mycobacterium
DPRAPGWYHNLKARPDID

SEQ ID NO: 647552 - protein, 21 aa, Mycobacterium
DPRCSGELSLHYKEDIPRDVL

SEQ ID NO: 647553 - protein, 17 aa, Mycobacterium
DPRCYHLDTALAVLDDA

SEQ ID NO: 647554 - protein, 23 aa, Mycobacterium
DPRDRFSYRIAVRRIPNGNGGSI

SEQ ID NO: 647555 - protein, 19 aa, Mycobacterium
DPREEPYCDANYWVDNLRH

SEQ ID NO: 647556 - protein, 22 aa, Mycobacterium
DPREIVGAAVFLASDASSFTTG

SEQ ID NO: 647557 - protein, 25 aa, Mycobacterium
DPREVCIGLSPALGRSVWLSLCGLP

SEQ ID NO: 647558 - protein, 24 aa, Mycobacterium
DPREVCIGLSPAWGRSVWLTLCGL

SEQ ID NO: 647559 - protein, 22 aa, Mycobacterium
DPRFATGEARLANRRELVELVA

SEQ ID NO: 647560 - protein, 19 aa, Mycobacterium
DPRFGEIACKLGRTTGYSC

SEQ ID NO: 647561 - protein, 22 aa, Mycobacterium
DPRFNRPHVHAIHRDIRAVIDD

SEQ ID NO: 647562 - protein, 17 aa, Mycobacterium
DPRFVIPAIPPREDYRD

SEQ ID NO: 647563 - protein, 19 aa, Mycobacterium
DPRGGGVRVPLGFLADWMN

SEQ ID NO: 647564 - protein, 27 aa, Mycobacterium
DPRGHPRLRAALAPWLGRTRGLRVDPD

SEQ ID NO: 647565 - protein, 24 aa, Mycobacterium
DPRGRGLMCAFSMPTPEDRDALIR

SEQ ID NO: 647566 - protein, 20 aa, Mycobacterium
DPRGRLELRSALAEYLGRVR

SEQ ID NO: 647567 - protein, 19 aa, Mycobacterium
DPRGWSHSAIRAILDNPTY

SEQ ID NO: 647568 - protein, 20 aa, Mycobacterium
DPRHLAAVLVIAHQGSTMLT

SEQ ID NO: 647569 - protein, 26 aa, Mycobacterium
DPRHPAVRFVCSWATTDQEVDDVLAL

SEQ ID NO: 647570 - protein, 24 aa, Mycobacterium
DPRIDGGPGRRLIPAGSIAGRVVV

SEQ ID NO: 647571 - protein, 20 aa, Mycobacterium
DPRIPYDVHEVIVRLVDGGT

SEQ ID NO: 647572 - protein, 18 aa, Mycobacterium
DPRIRATVLAIADELTHD

SEQ ID NO: 647573 - protein, 19 aa, Mycobacterium
DPRLPEFPGSFDGESIHSH

SEQ ID NO: 647574 - protein, 23 aa, Mycobacterium
DPRMKANVGIRRRLAPLLENDRN

SEQ ID NO: 647575 - protein, 26 aa, Mycobacterium
DPRMVEVFAGFGLDGRFPSSGLTVDS

SEQ ID NO: 647576 - protein, 21 aa, Mycobacterium
DPRPHRGCTRGVQRDVLPRKR

SEQ ID NO: 647577 - protein, 25 aa, Mycobacterium
DPRPPMVTSGLRIGTPALASRGFSH

SEQ ID NO: 647578 - protein, 24 aa, Mycobacterium
DPRPPMVTSGLRIGTPALATRGFG

SEQ ID NO: 647579 - protein, 22 aa, Mycobacterium
DPRPYPELVLAPRDSIFDYTYE

SEQ ID NO: 647580 - protein, 22 aa, Mycobacterium
DPRQIQTMRALKQCDAMIRLGA

SEQ ID NO: 647581 - protein, 18 aa, Mycobacterium
DPRQVWRALCADFDVPRD

SEQ ID NO: 647582 - protein, 18 aa, Mycobacterium
DPRRARALLGAAPLSPTL

SEQ ID NO: 647583 - protein, 18 aa, Mycobacterium
DPRRSRGIALMHALADHC

SEQ ID NO: 647584 - protein, 22 aa, Mycobacterium
DPRRVPIWLPYIRGERTPFHDP

SEQ ID NO: 647585 - protein, 19 aa, Mycobacterium
DPRRWRRWEVDGAADRAAE

SEQ ID NO: 647586 - protein, 18 aa, Mycobacterium
DPRSDFYSEEALQRGVGI

SEQ ID NO: 647587 - protein, 24 aa, Mycobacterium
DPRSELTLLGRYVLAVLDEESQLL

SEQ ID NO: 647588 - protein, 21 aa, Mycobacterium
DPRTAWLRGQVADLQAHMSDI

SEQ ID NO: 647589 - protein, 20 aa, Mycobacterium
DPRTAWLRGQVADLQAHVTD

SEQ ID NO: 647590 - protein, 30 aa, Mycobacterium
DPRTRYGPPAAVLRRHVRVLLASAETSGDL

SEQ ID NO: 647591 - protein, 26 aa, Mycobacterium
DPRTTIVVRAGWQWTTVEGIAEIIGP

SEQ ID NO: 647592 - protein, 20 aa, Mycobacterium
DPRVAQWITTVCRATQWLDL

SEQ ID NO: 647593 - protein, 19 aa, Mycobacterium
DPRVRLRLNGIREEIRAHG

SEQ ID NO: 647594 - protein, 25 aa, Mycobacterium
DPRVRTGRVDLHYRAVLFRVDDKSS

SEQ ID NO: 647595 - protein, 17 aa, Mycobacterium
DPRVVLMGEDVGRYGGT

SEQ ID NO: 647596 - protein, 20 aa, Mycobacterium
DPRVYRVWATCHVDNTRSAR

SEQ ID NO: 647597 - protein, 18 aa, Mycobacterium
DPRWVRNDMDEFIRLTSP

SEQ ID NO: 647598 - protein, 19 aa, Mycobacterium
DPRYRVIALRFLENPDEFA

SEQ ID NO: 647599 - protein, 29 aa, Mycobacterium
DPSASLWMAELWKEAGLPDGVFNVLQGDK

SEQ ID NO: 647600 - protein, 29 aa, Mycobacterium
DPSASPGFRIDPVLARSWLLVNGAQYERF

SEQ ID NO: 647601 - protein, 17 aa, Mycobacterium
DPSDVKPGDIVVFDDHT

SEQ ID NO: 647602 - protein, 25 aa, Mycobacterium
DPSEWKVFLELLRKRFETDKDKWTK

SEQ ID NO: 647603 - protein, 33 aa, Mycobacterium
DPSFSNIVNSFGRFGSDIVNSVINFAWAEARYF

SEQ ID NO: 647604 - protein, 23 aa, Mycobacterium
DPSGNCLEVFHGVALEHRRVVSP

SEQ ID NO: 647605 - protein, 26 aa, Mycobacterium
DPSGSGWRWLASALWGEILLSQHADT

SEQ ID NO: 647606 - protein, 19 aa, Mycobacterium
DPSIGPWITTLRLLKNNGV

SEQ ID NO: 647607 - protein, 20 aa, Mycobacterium
DPSKIPGLLKGRRLTKPLIA

SEQ ID NO: 647608 - protein, 17 aa, Mycobacterium
DPSNLEWALEQGNSSGR

SEQ ID NO: 647609 - protein, 21 aa, Mycobacterium
DPSPLWKSYVDQGWTELNDPE

SEQ ID NO: 647610 - protein, 20 aa, Mycobacterium
DPSPLWKSYVDQGWTELSDP

SEQ ID NO: 647611 - protein, 25 aa, Mycobacterium
DPSPSDVCEPLFRVWPVSGRTAEAL

SEQ ID NO: 647612 - protein, 22 aa, Mycobacterium
DPSRAMPAYNWMTVAKSALESV

SEQ ID NO: 647613 - protein, 19 aa, Mycobacterium
DPSRLKVLPQRELRRGAAK

SEQ ID NO: 647614 - protein, 20 aa, Mycobacterium
DPSRLRDALLSARREAASSF

SEQ ID NO: 647615 - protein, 19 aa, Mycobacterium
DPSRPVVYEDFLPASAAGI

SEQ ID NO: 647616 - protein, 25 aa, Mycobacterium
DPSRRVRFLPYGIAVSVLDTTPRSP

SEQ ID NO: 647617 - protein, 19 aa, Mycobacterium
DPSSTLAFYRRAVQLRSAR

SEQ ID NO: 647618 - protein, 21 aa, Mycobacterium
DPSTARLCLVPNLVADHCYEL

SEQ ID NO: 647619 - protein, 22 aa, Mycobacterium
DPSTFQVLPWASGGHHHSARMF

SEQ ID NO: 647620 - protein, 27 aa, Mycobacterium
DPSVPDTRLEFMLSDAVPIAAVTTAEL

SEQ ID NO: 647621 - protein, 30 aa, Mycobacterium
DPSVPLRLAELFLEAGLPPGVFNVVNGDKT

SEQ ID NO: 647622 - protein, 30 aa, Mycobacterium
DPSVPLRLAELFVEAGLPPGVFQVVHGDKE

SEQ ID NO: 647623 - protein, 17 aa, Mycobacterium
DPSVPVRLAELFIEAGL

SEQ ID NO: 647624 - protein, 17 aa, Mycobacterium
DPSVPVRLAELFVEAGL

SEQ ID NO: 647625 - protein, 23 aa, Mycobacterium
DPSWPPQRAELVLCDCAPSAILT

SEQ ID NO: 647626 - protein, 25 aa, Mycobacterium
DPSYAAAMAPKLVDFGHEVDRAVGQ

SEQ ID NO: 647627 - protein, 17 aa, Mycobacterium
DPSYHGVVFAELGPPAF

SEQ ID NO: 647628 - protein, 17 aa, Mycobacterium
DPSYHGVVFAELGPPAY

SEQ ID NO: 647629 - protein, 21 aa, Mycobacterium
DPSYHGVVFAELGPPAYALKA

SEQ ID NO: 647630 - protein, 17 aa, Mycobacterium
DPTAKRPLFTDFAPRLL

SEQ ID NO: 647631 - protein, 24 aa, Mycobacterium
DPTEGVKLLGRFAAEPTRENIEKF

SEQ ID NO: 647632 - protein, 17 aa, Mycobacterium
DPTELKLSVALHDPVPA

SEQ ID NO: 647633 - protein, 22 aa, Mycobacterium
DPTGVPISAIFFGGRRASTVPL

SEQ ID NO: 647634 - protein, 17 aa, Mycobacterium
DPTLVRGPVYERLVDGA

SEQ ID NO: 647635 - protein, 24 aa, Mycobacterium
DPTPGLYTELDWRVDGPAPVLPYL

SEQ ID NO: 647636 - protein, 28 aa, Mycobacterium
DPTPGVYSELDWRVGPPVGPLPYLTLRL

SEQ ID NO: 647637 - protein, 17 aa, Mycobacterium
DPTRAVRELGIPKVSVA

SEQ ID NO: 647638 - protein, 24 aa, Mycobacterium
DPTRHPEFELARWSVRNLSPTDRA

SEQ ID NO: 647639 - protein, 23 aa, Mycobacterium
DPTRLRVFDLILTHGMATATTLS

SEQ ID NO: 647640 - protein, 23 aa, Mycobacterium
DPTSRRLLLVRGISRPPRDPRTA

SEQ ID NO: 647641 - protein, 21 aa, Mycobacterium
DPTTGQAYGIWQAKYNSSTNT

SEQ ID NO: 647642 - protein, 18 aa, Mycobacterium
DPTVAFNAARSCLEQGVR

SEQ ID NO: 647643 - protein, 24 aa, Mycobacterium
DPTVELAKALTPLYKGLVTPALTP

SEQ ID NO: 647644 - protein, 17 aa, Mycobacterium
DPTWAIDEIVRRYIGKP

SEQ ID NO: 647645 - protein, 17 aa, Mycobacterium
DPTWVYTCAYFERDDMT

SEQ ID NO: 647646 - protein, 19 aa, Mycobacterium
DPVAGFVISAFAIYEGKEA

SEQ ID NO: 647647 - protein, 19 aa, Mycobacterium
DPVAHRLAGRRVVNLTTTS

SEQ ID NO: 647648 - protein, 19 aa, Mycobacterium
DPVAYRLAIVDLQRTLDQR

SEQ ID NO: 647649 - protein, 25 aa, Mycobacterium
DPVCPFAWAASRWLLDAAHKTDTPV

SEQ ID NO: 647650 - protein, 24 aa, Mycobacterium
DPVCPFSWVTAHWLLDAAQSTQTP

SEQ ID NO: 647651 - protein, 19 aa, Mycobacterium
DPVDAGPVSESWRQQPGTP

SEQ ID NO: 647652 - protein, 18 aa, Mycobacterium
DPVEGFAAMWADVRRPEL

SEQ ID NO: 647653 - protein, 23 aa, Mycobacterium
DPVELFPGVTIQPLWEGDNGAKA

SEQ ID NO: 647654 - protein, 19 aa, Mycobacterium
DPVFGAGVNIHIEGVGWVT

SEQ ID NO: 647655 - protein, 21 aa, Mycobacterium
DPVFIKQLLDIGAQNIIVPMI

SEQ ID NO: 647656 - protein, 25 aa, Mycobacterium
DPVGEVAGLYAWLGAPVSDEFEARM

SEQ ID NO: 647657 - protein, 18 aa, Mycobacterium
DPVGEVLRGYTLPNGLHL

SEQ ID NO: 647658 - protein, 19 aa, Mycobacterium
DPVGEVTGLYSWLRAPVSD

SEQ ID NO: 647659 - protein, 17 aa, Mycobacterium
DPVHTFIETCRRAEQWG

SEQ ID NO: 647660 - protein, 18 aa, Mycobacterium
DPVIGPFFEGGLMLRDFE

SEQ ID NO: 647661 - protein, 17 aa, Mycobacterium
DPVILPRNSEGLYLLQR

SEQ ID NO: 647662 - protein, 25 aa, Mycobacterium
DPVIPAKLSLFGGVMVPPKYLADVG

SEQ ID NO: 647663 - protein, 18 aa, Mycobacterium
DPVKAAAKKLAFVEDRAI

SEQ ID NO: 647664 - protein, 18 aa, Mycobacterium
DPVKAAAKKLAFVEDRTI

SEQ ID NO: 647665 - protein, 18 aa, Mycobacterium
DPVKIILQALQGFLNFLR

SEQ ID NO: 647666 - protein, 29 aa, Mycobacterium
DPVKVDLMRRIKRSFDPAGILNPDVLFAG

SEQ ID NO: 647667 - protein, 28 aa, Mycobacterium
DPVLAEWFLRRISLLDSLYMVPSPLIIG

SEQ ID NO: 647668 - protein, 18 aa, Mycobacterium
DPVLAWLYVLDAWEGGLP

SEQ ID NO: 647669 - protein, 24 aa, Mycobacterium
DPVLKIPRLQDAYFKRFPEYPKGI

SEQ ID NO: 647670 - protein, 24 aa, Mycobacterium
DPVLKIPRLQDAYFKRFPGYPKGI

SEQ ID NO: 647671 - protein, 17 aa, Mycobacterium
DPVLRVELWDQFTTLAR

SEQ ID NO: 647672 - protein, 25 aa, Mycobacterium
DPVMAWRYVELDGGTDPDERIRELC

SEQ ID NO: 647673 - protein, 24 aa, Mycobacterium
DPVNPMRIFWELTKRMPPNAIITA

SEQ ID NO: 647674 - protein, 18 aa, Mycobacterium
DPVNRVLLPRADIATETL

SEQ ID NO: 647675 - protein, 25 aa, Mycobacterium
DPVPAKAGAHGWWFREIPGGIDTSE

SEQ ID NO: 647676 - protein, 25 aa, Mycobacterium
DPVPWKREQALKFGATHAFPTMAEA

SEQ ID NO: 647677 - protein, 19 aa, Mycobacterium
DPVRQWKLSPMDLASLDKW

SEQ ID NO: 647678 - protein, 19 aa, Mycobacterium
DPVRQWKLSPTDLASLDKW

SEQ ID NO: 647679 - protein, 17 aa, Mycobacterium
DPVTALVECVSFGVQNL

SEQ ID NO: 647680 - protein, 24 aa, Mycobacterium
DPVTPRAAGAIAHLNADHADSLLA

SEQ ID NO: 647681 - protein, 17 aa, Mycobacterium
DPVTTGWRDWSVRCAAL

SEQ ID NO: 647682 - protein, 22 aa, Mycobacterium
DPWATMWAAMFFTGARQGEIIG

SEQ ID NO: 647683 - protein, 20 aa, Mycobacterium
DPWCRYLAANAGVVVINPDY

SEQ ID NO: 647684 - protein, 23 aa, Mycobacterium
DPWFAKARTGGAIEAREMDEGML

SEQ ID NO: 647685 - protein, 22 aa, Mycobacterium
DPWFAKARTSGAIEAREMDEGM

SEQ ID NO: 647686 - protein, 19 aa, Mycobacterium
DPWGGGIDLLMGCENLPGL

SEQ ID NO: 647687 - protein, 18 aa, Mycobacterium
DPWGVVFILVEKSRPQRP

SEQ ID NO: 647688 - protein, 24 aa, Mycobacterium
DPWIRIADLDGRYLGQFTLPPNLA

SEQ ID NO: 647689 - protein, 19 aa, Mycobacterium
DPWPVVETWAAATEAHAIT

SEQ ID NO: 647690 - protein, 18 aa, Mycobacterium
DPWRGHLVRGEVHDENAV

SEQ ID NO: 647691 - protein, 20 aa, Mycobacterium
DPWRRALHCDVIDRAQTPDN

SEQ ID NO: 647692 - protein, 28 aa, Mycobacterium
DPWYRMRVAPSIFKHVWSVLQIACHGFN

SEQ ID NO: 647693 - protein, 28 aa, Mycobacterium
DPWYRMRVAPSVFKHVWGVLRLACEGFN

SEQ ID NO: 647694 - protein, 23 aa, Mycobacterium
DPYAEIFCRAVGGAAADVLDGKD

SEQ ID NO: 647695 - protein, 21 aa, Mycobacterium
DPYAELFCRAVGGSWADVLDG

SEQ ID NO: 647696 - protein, 22 aa, Mycobacterium
DPYAELFCRAVGGSWADVLDGK

SEQ ID NO: 647697 - protein, 19 aa, Mycobacterium
DPYAKLFLEAAGDGIWRVY

SEQ ID NO: 647698 - protein, 26 aa, Mycobacterium
DPYEAPARPELRLEGGEKPAETLADE

SEQ ID NO: 647699 - protein, 26 aa, Mycobacterium
DPYEAPARPELRLEGGTKDADTLADE

SEQ ID NO: 647700 - protein, 19 aa, Mycobacterium
DPYEAVIAAAQWVRSELDY

SEQ ID NO: 647701 - protein, 20 aa, Mycobacterium
DPYGEGWLVDLRVEAGTLDE

SEQ ID NO: 647702 - protein, 17 aa, Mycobacterium
DPYGIPVARFDYTLCDN

SEQ ID NO: 647703 - protein, 22 aa, Mycobacterium
DPYGLCAQFRKGGALRLPDANL

SEQ ID NO: 647704 - protein, 19 aa, Mycobacterium
DPYLPDFVMCRAEVAPILL

SEQ ID NO: 647705 - protein, 20 aa, Mycobacterium
DPYLPDLLMCRPEVAGRLLD

SEQ ID NO: 647706 - protein, 26 aa, Mycobacterium
DPYLPTRIRHCAVYGPPAEHMTVRAR

SEQ ID NO: 647707 - protein, 24 aa, Mycobacterium
DPYPVWKRMREEAPLYYNEKYNFY

SEQ ID NO: 647708 - protein, 24 aa, Mycobacterium
DQAAALCPVSRLFAGATISVDAEL

SEQ ID NO: 647709 - protein, 20 aa, Mycobacterium
DQAAAVAILQDWLEQRRRCG

SEQ ID NO: 647710 - protein, 18 aa, Mycobacterium
DQAASVWGDALAAGAAKR

SEQ ID NO: 647711 - protein, 18 aa, Mycobacterium
DQAEARGAWDTRIESNLV

SEQ ID NO: 647712 - protein, 24 aa, Mycobacterium
DQAHCAMCGEEIKAWMRELDAALQ

SEQ ID NO: 647713 - protein, 19 aa, Mycobacterium
DQALWLGSGLLDLVSKAGI

SEQ ID NO: 647714 - protein, 23 aa, Mycobacterium
DQAMALLRMLAGRGFVDGPGGQP

SEQ ID NO: 647715 - protein, 29 aa, Mycobacterium
DQAMRLRDLLKFDFYFADSAAFRANIAEE

SEQ ID NO: 647716 - protein, 25 aa, Mycobacterium
DQAPEIPRMGSFEVMNRTIDIAQSA

SEQ ID NO: 647717 - protein, 18 aa, Mycobacterium
DQAPRLVVAASRTIADHR

SEQ ID NO: 647718 - protein, 30 aa, Mycobacterium
DQAPRPGVARGRITCIAHHWSRRGDDLVDV

SEQ ID NO: 647719 - protein, 23 aa, Mycobacterium
DQARATSVWARWDENLTELARMS

SEQ ID NO: 647720 - protein, 19 aa, Mycobacterium
DQAREGMVAAPRRVDAADR

SEQ ID NO: 647721 - protein, 19 aa, Mycobacterium
DQARIRVGVWSYGPQATAS

SEQ ID NO: 647722 - protein, 24 aa, Mycobacterium
DQARLLCEKAAWTIDLQGNKAAHV

SEQ ID NO: 647723 - protein, 24 aa, Mycobacterium
DQARLLCEKAAWTIDQHGNKAAHL

SEQ ID NO: 647724 - protein, 24 aa, Mycobacterium
DQARLLCEKAAWTIDQHGNKEARH

SEQ ID NO: 647725 - protein, 23 aa, Mycobacterium
DQARLLCEKAAWTIDRHGNKEAR

SEQ ID NO: 647726 - protein, 24 aa, Mycobacterium
DQARLLCHKAAWTIDQHGNKAAHT

SEQ ID NO: 647727 - protein, 24 aa, Mycobacterium
DQARRSGASWSEIGSSMGVSKQAA

SEQ ID NO: 647728 - protein, 17 aa, Mycobacterium
DQARVILFLASELSGFV

SEQ ID NO: 647729 - protein, 19 aa, Mycobacterium
DQATAIRQDIDWITHAENP

SEQ ID NO: 647730 - protein, 18 aa, Mycobacterium
DQAVGINHIALWARSRAE

SEQ ID NO: 647731 - protein, 20 aa, Mycobacterium
DQAWWFPAIAPLPGKAPAVM

SEQ ID NO: 647732 - protein, 53 aa, Mycobacterium
DQAYQFIQYWVDYGVDLAQWGAGFVPVIGGLVSAQIGIVYDNLVRPIANSFVY

SEQ ID NO: 647733 - protein, 26 aa, Mycobacterium
DQCAPFCAVQAWPALGRQRLSVAAER

SEQ ID NO: 647734 - protein, 23 aa, Mycobacterium
DQCPPCEGLRGRVHRVQEGLLDI

SEQ ID NO: 647735 - protein, 26 aa, Mycobacterium
DQCQLVCRACPYRAHQHAGAGVQPRA

SEQ ID NO: 647736 - protein, 26 aa, Mycobacterium
DQDGPGWRFGRFHSRVRRVPEVLGQF

SEQ ID NO: 647737 - protein, 20 aa, Mycobacterium
DQDLPCLAELAMKPPSLYDT

SEQ ID NO: 647738 - protein, 27 aa, Mycobacterium
DQEALSWTCGSMSYGELDTAANRLAAV

SEQ ID NO: 647739 - protein, 19 aa, Mycobacterium
DQEGLPFVGPAGRLLQRAL

SEQ ID NO: 647740 - protein, 23 aa, Mycobacterium
DQEGRIALHVFFDVEDVDIAVAE

SEQ ID NO: 647741 - protein, 25 aa, Mycobacterium
DQEIAILDRHAHGFDPRNLSHVTPV

SEQ ID NO: 647742 - protein, 29 aa, Mycobacterium
DQETFVGGALRLRRAWWGIGEAGNLMVRG

SEQ ID NO: 647743 - protein, 20 aa, Mycobacterium
DQEVEGALWVALRSLEEKAK

SEQ ID NO: 647744 - protein, 19 aa, Mycobacterium
DQFPMAVHLLDGIAVGTDR

SEQ ID NO: 647745 - protein, 17 aa, Mycobacterium
DQFRVVLRHELFHAAAR

SEQ ID NO: 647746 - protein, 18 aa, Mycobacterium
DQGACGSCTVLVDGRRIN

SEQ ID NO: 647747 - protein, 20 aa, Mycobacterium
DQGENFAFLGGRDWDPSQTT

SEQ ID NO: 647748 - protein, 22 aa, Mycobacterium
DQGENFAFLGGRDWEPSDVTLP

SEQ ID NO: 647749 - protein, 23 aa, Mycobacterium
DQGIKVIVLRGAGRAFSGGYDFG

SEQ ID NO: 647750 - protein, 23 aa, Mycobacterium
DQGKHLWMIYLMRVVDAQTVLDK

SEQ ID NO: 647751 - protein, 26 aa, Mycobacterium
DQGRSLVDFANAWNDYNFALQGDVKR

SEQ ID NO: 647752 - protein, 23 aa, Mycobacterium
DQGVAPGLARWMVVDLGPDSETP

SEQ ID NO: 647753 - protein, 22 aa, Mycobacterium
DQGYRQAGGYGQPPGGQPGYGG

SEQ ID NO: 647754 - protein, 24 aa, Mycobacterium
DQHLLRPLRDVIWGSDESLLNTTE

SEQ ID NO: 647755 - protein, 23 aa, Mycobacterium
DQHLPMPLREVMWGTDKGLLDST

SEQ ID NO: 647756 - protein, 18 aa, Mycobacterium
DQHLRLPLREVVWGGDAA

SEQ ID NO: 647757 - protein, 18 aa, Mycobacterium
DQHPGLRVGWFEGGIAWV

SEQ ID NO: 647758 - protein, 24 aa, Mycobacterium
DQIAGLKPDLIVAVNAGLDADTYQ

SEQ ID NO: 647759 - protein, 19 aa, Mycobacterium
DQIAYWKAVYADLQASGAA

SEQ ID NO: 647760 - protein, 24 aa, Mycobacterium
DQIDPRAGAMVRAVWFSGGDGGPG

SEQ ID NO: 647761 - protein, 33 aa, Mycobacterium
DQIPVPPQWGGYRIAPDVVEFWQGRENRLHNRI

SEQ ID NO: 647762 - protein, 24 aa, Mycobacterium
DQIPVPPQWGGYVIAPETVEFWQG

SEQ ID NO: 647763 - protein, 17 aa, Mycobacterium
DQIRWLFGKLLAEKPGR

SEQ ID NO: 647764 - protein, 25 aa, Mycobacterium
DQKFGFPLHEGHAIEAARRVLDQPL

SEQ ID NO: 647765 - protein, 25 aa, Mycobacterium
DQKLRGFVNACRHRGNILCNAAAGN

SEQ ID NO: 647766 - protein, 24 aa, Mycobacterium
DQLAGIRRQLGWWLRAADVSDERA

SEQ ID NO: 647767 - protein, 24 aa, Mycobacterium
DQLARLCGLTAAAMERATQALLQA

SEQ ID NO: 647768 - protein, 24 aa, Mycobacterium
DQLDALCALGLQSRIVAAALPDGS

SEQ ID NO: 647769 - protein, 24 aa, Mycobacterium
DQLDALCALGLQSRVVAAALPDGS

SEQ ID NO: 647770 - protein, 26 aa, Mycobacterium
DQLDTGPNFLGWTRVSAPTATTVTSA

SEQ ID NO: 647771 - protein, 17 aa, Mycobacterium
DQLFIAPFHPGYLAQGL

SEQ ID NO: 647772 - protein, 23 aa, Mycobacterium
DQLGSILERFLALYVYNRVPVVA

SEQ ID NO: 647773 - protein, 21 aa, Mycobacterium
DQLKVFPGVTYVLGDTEQEAI

SEQ ID NO: 647774 - protein, 26 aa, Mycobacterium
DQLLDRARYLKALAVAAELPDVESLA

SEQ ID NO: 647775 - protein, 17 aa, Mycobacterium
DQLLMGISMDRLRKTYL

SEQ ID NO: 647776 - protein, 26 aa, Mycobacterium
DQLMRAALPLGLWVPVLPGTRQVTIG

SEQ ID NO: 647777 - protein, 17 aa, Mycobacterium
DQLNAFNRTMCEEMAAA

SEQ ID NO: 647778 - protein, 25 aa, Mycobacterium
DQLNRWRRLGCWVSGHGEGWALYAE

SEQ ID NO: 647779 - protein, 26 aa, Mycobacterium
DQLPAYALPLFVRLVQAMAHTTTFKS

SEQ ID NO: 647780 - protein, 22 aa, Mycobacterium
DQLPAYALPLFVRVVESLEHTT

SEQ ID NO: 647781 - protein, 19 aa, Mycobacterium
DQLPEIWRRLVEGGMESGQ

SEQ ID NO: 647782 - protein, 21 aa, Mycobacterium
DQLPGKWGEYLLASRATTIYG

SEQ ID NO: 647783 - protein, 25 aa, Mycobacterium
DQLPGTWLLASFYFRADVRGLDRIP

SEQ ID NO: 647784 - protein, 22 aa, Mycobacterium
DQLPGVETMVGLFINAVPVVHY

SEQ ID NO: 647785 - protein, 17 aa, Mycobacterium
DQLRGGAPAGLPETVGA

SEQ ID NO: 647786 - protein, 23 aa, Mycobacterium
DQLRLALLLCAVRPEIGGALIRG

SEQ ID NO: 647787 - protein, 24 aa, Mycobacterium
DQLRQRIGMVFQHFNLFPHRTVLD

SEQ ID NO: 647788 - protein, 23 aa, Mycobacterium
DQLRQRIGMVFQQFNLFPHRSVL

SEQ ID NO: 647789 - protein, 25 aa, Mycobacterium
DQLRRHCPDIEFLHLAGAVETISRR

SEQ ID NO: 647790 - protein, 17 aa, Mycobacterium
DQLRWTVRTDRNDTVSA

SEQ ID NO: 647791 - protein, 31 aa, Mycobacterium
DQLSGGFARYSVDPYWVVPHFEKMLYDNALL

SEQ ID NO: 647792 - protein, 23 aa, Mycobacterium
DQLVKAAGYPAVLADQLLILANG

SEQ ID NO: 647793 - protein, 22 aa, Mycobacterium
DQLWPLPSDPRGILPKLTAVGE

SEQ ID NO: 647794 - protein, 19 aa, Mycobacterium
DQMFVLWTAVNRVSRSGEV

SEQ ID NO: 647795 - protein, 19 aa, Mycobacterium
DQMPCALRNPAWTDAQALE

SEQ ID NO: 647796 - protein, 25 aa, Mycobacterium
DQMPKHVSLGLMFGSPVAFTVPDLD

SEQ ID NO: 647797 - protein, 18 aa, Mycobacterium
DQMRWLFTQLIGDRPHWS

SEQ ID NO: 647798 - protein, 24 aa, Mycobacterium
DQMVEPKWVLAMGVCASSGGMFNN

SEQ ID NO: 647799 - protein, 25 aa, Mycobacterium
DQNCWDLAEQLARRGVVDTVLVLAA

SEQ ID NO: 647800 - protein, 26 aa, Mycobacterium
DQNFDHFKVSLSIGVMKMVRSDLASS

SEQ ID NO: 647801 - protein, 23 aa, Mycobacterium
DQNRRVENIFGRYVSEEVKTHLL

SEQ ID NO: 647802 - protein, 26 aa, Mycobacterium
DQPALICELVDWCRTVGFDVVAAGKG

SEQ ID NO: 647803 - protein, 22 aa, Mycobacterium
DQPAWRRVRRSLDQTWFVSADD

SEQ ID NO: 647804 - protein, 32 aa, Mycobacterium
DQPDLKATFDLRVTAPLHWKVISNAAATSLDK

SEQ ID NO: 647805 - protein, 31 aa, Mycobacterium
DQPDLKATFDLRVTAPRHWKVISNGATVSNE

SEQ ID NO: 647806 - protein, 24 aa, Mycobacterium
DQPELRCLMLTSFTSDEAMLEAIL

SEQ ID NO: 647807 - protein, 24 aa, Mycobacterium
DQPESFIDFTRWLMDAMHAPYMRM

SEQ ID NO: 647808 - protein, 24 aa, Mycobacterium
DQPLCWCPERRGMSDRFGAFVAGQ

SEQ ID NO: 647809 - protein, 17 aa, Mycobacterium
DQPLVAFADSWKQTLRA

SEQ ID NO: 647810 - protein, 22 aa, Mycobacterium
DQPNGVGITGVFGGFKQSGIGR

SEQ ID NO: 647811 - protein, 20 aa, Mycobacterium
DQPPAVAARPARSASAAAGA

SEQ ID NO: 647812 - protein, 21 aa, Mycobacterium
DQPRWLAGPAPELASTASVGG

SEQ ID NO: 647813 - protein, 21 aa, Mycobacterium
DQPWRLPVLAQEASDVESVDG

SEQ ID NO: 647814 - protein, 28 aa, Mycobacterium
DQPYWGRPVPSWGAARPRLLIVGLAPAA

SEQ ID NO: 647815 - protein, 25 aa, Mycobacterium
DQQACLRSLGALGLLDTEVLLPGHG

SEQ ID NO: 647816 - protein, 29 aa, Mycobacterium
DQQKEWILHMAKLSASLAKQANFMAQLQL

SEQ ID NO: 647817 - protein, 22 aa, Mycobacterium
DQQRAAGELVRVCRPGGTIGVI

SEQ ID NO: 647818 - protein, 25 aa, Mycobacterium
DQQRIKVALVFGGRSSEHAISCVSA

SEQ ID NO: 647819 - protein, 19 aa, Mycobacterium
DQQTWRAALDELRKREKAA

SEQ ID NO: 647820 - protein, 22 aa, Mycobacterium
DQRAGGPGRVFVYSGQGSQWAG

SEQ ID NO: 647821 - protein, 17 aa, Mycobacterium
DQRDFTLWKGAKPGEPS

SEQ ID NO: 647822 - protein, 26 aa, Mycobacterium
DQRDWDFANTFGLPVQEVISGGDVTK

SEQ ID NO: 647823 - protein, 27 aa, Mycobacterium
DQRDWDFATEFGLPIVEVVAGGDVTVE

SEQ ID NO: 647824 - protein, 17 aa, Mycobacterium
DQRFGWLSLDASDNDPV

SEQ ID NO: 647825 - protein, 18 aa, Mycobacterium
DQRLCAVPDADMFQAIRD

SEQ ID NO: 647826 - protein, 18 aa, Mycobacterium
DQRLCAVPDADMFRAIRE

SEQ ID NO: 647827 - protein, 24 aa, Mycobacterium
DQRLLVKLPSGWSLAQAAGVPVAF

SEQ ID NO: 647828 - protein, 20 aa, Mycobacterium
DQRLRIDLSALRIVGDGLAW

SEQ ID NO: 647829 - protein, 18 aa, Mycobacterium
DQRLRVAVTARCIAAAVF

SEQ ID NO: 647830 - protein, 23 aa, Mycobacterium
DQRMRHGMYWSGDLAYRDADGWI

SEQ ID NO: 647831 - protein, 20 aa, Mycobacterium
DQRMVFGANTYRTFVELLAA

SEQ ID NO: 647832 - protein, 21 aa, Mycobacterium
DQRMVLEYKFFEPAMYMTDVP

SEQ ID NO: 647833 - protein, 18 aa, Mycobacterium
DQRNYRFWADLTDALQTG

SEQ ID NO: 647834 - protein, 23 aa, Mycobacterium
DQRPRGAGLFLMGHSGGCELVLR

SEQ ID NO: 647835 - protein, 17 aa, Mycobacterium
DQRRCVLVLTDVGRKAL

SEQ ID NO: 647836 - protein, 19 aa, Mycobacterium
DQRSVCVSSHFVPGQHAGM

SEQ ID NO: 647837 - protein, 20 aa, Mycobacterium
DQRTFGGWLLADLVTVDGSV

SEQ ID NO: 647838 - protein, 28 aa, Mycobacterium
DQRTRKTLRELIGALILEPDDEAAARTL

SEQ ID NO: 647839 - protein, 20 aa, Mycobacterium
DQRVAFVLHDGFAVPFSAIA

SEQ ID NO: 647840 - protein, 20 aa, Mycobacterium
DQRVAFVLHDGFSVPFADIA

SEQ ID NO: 647841 - protein, 26 aa, Mycobacterium
DQRWPETRIEPSLTRISALLDLLGSP

SEQ ID NO: 647842 - protein, 26 aa, Mycobacterium
DQRWPETRIEPSLTRISALMDLLGSP

SEQ ID NO: 647843 - protein, 32 aa, Mycobacterium
DQSDWARRNPQRWSVVDAWVSLGMRLGARSYS

SEQ ID NO: 647844 - protein, 17 aa, Mycobacterium
DQSGVVVLLTFGTGIGS

SEQ ID NO: 647845 - protein, 24 aa, Mycobacterium
DQTAVCILEHDWATVVMVDTQDGK

SEQ ID NO: 647846 - protein, 18 aa, Mycobacterium
DQTGRIAIVTGANTGLGL

SEQ ID NO: 647847 - protein, 19 aa, Mycobacterium
DQTRPRAGSRHRVIPALGE

SEQ ID NO: 647848 - protein, 18 aa, Mycobacterium
DQTRWRTAVEKVLRGVGL

SEQ ID NO: 647849 - protein, 20 aa, Mycobacterium
DQVARCESGGNWAINTGNGY

SEQ ID NO: 647850 - protein, 23 aa, Mycobacterium
DQVATLFRMWLRDAAGRISEGVL

SEQ ID NO: 647851 - protein, 23 aa, Mycobacterium
DQVATLFRMWLRDAVRRVADAAL

SEQ ID NO: 647852 - protein, 23 aa, Mycobacterium
DQVATLFRMWLRDAVRRVATGVL

SEQ ID NO: 647853 - protein, 22 aa, Mycobacterium
DQVFPKRCGHLPDKRVVDAAVF

SEQ ID NO: 647854 - protein, 23 aa, Mycobacterium
DQVIRLIKQLGFMPPDVQLSGDQ

SEQ ID NO: 647855 - protein, 27 aa, Mycobacterium
DQVLAKCFLLWAGVLGAISLEVFGQYG

SEQ ID NO: 647856 - protein, 18 aa, Mycobacterium
DQVPVRLAPDVLKNTNLK

SEQ ID NO: 647857 - protein, 18 aa, Mycobacterium
DQVRCYRSAVGQRVVVRG

SEQ ID NO: 647858 - protein, 20 aa, Mycobacterium
DQVRFVPGWFKDTLHDAPIE

SEQ ID NO: 647859 - protein, 23 aa, Mycobacterium
DQVRGALMGGYFAGLLNRSVLET

SEQ ID NO: 647860 - protein, 21 aa, Mycobacterium
DQVRVPWSLGPRKRGGGQKRQ

SEQ ID NO: 647861 - protein, 17 aa, Mycobacterium
DQVSAFAEMFFAYLDLI

SEQ ID NO: 647862 - protein, 34 aa, Mycobacterium
DQVSLDAWSQWKWMKNYRIWEANRKIFLYPENWI

SEQ ID NO: 647863 - protein, 31 aa, Mycobacterium
DQVVYRLGTRLVPRLRWRPVTTEPVTLSSDT

SEQ ID NO: 647864 - protein, 24 aa, Mycobacterium
DQWMTRFVLGFGAAVRVLEPPDLA

SEQ ID NO: 647865 - protein, 23 aa, Mycobacterium
DQWRAEEVLHEWVEELVCDAYAV

SEQ ID NO: 647866 - protein, 24 aa, Mycobacterium
DQWRPRPWPDLTRRRLFVRPDAAI

SEQ ID NO: 647867 - protein, 17 aa, Mycobacterium
DQYCRKLSHLAGVAVAA

SEQ ID NO: 647868 - protein, 19 aa, Mycobacterium
DQYFARFGGVRDYLMAVVE

SEQ ID NO: 647869 - protein, 17 aa, Mycobacterium
DQYFELRKHKGMTPDRA

SEQ ID NO: 647870 - protein, 20 aa, Mycobacterium
DRAAAELARRFAAGGRMFTF

SEQ ID NO: 647871 - protein, 19 aa, Mycobacterium
DRAAAIGVSNWLRPWLPSL

SEQ ID NO: 647872 - protein, 18 aa, Mycobacterium
DRAAAQAFEVLKPGGEVR

SEQ ID NO: 647873 - protein, 24 aa, Mycobacterium
DRAAAYRAAGYWAGRPLDTILGDA

SEQ ID NO: 647874 - protein, 24 aa, Mycobacterium
DRAAEYLSALGFQFEAFELEHLGL

SEQ ID NO: 647875 - protein, 20 aa, Mycobacterium
DRAAGLLIRAAVTDTAITGQ

SEQ ID NO: 647876 - protein, 19 aa, Mycobacterium
DRAAGYGMPGVRVDGNDPL

SEQ ID NO: 647877 - protein, 23 aa, Mycobacterium
DRAAKAKALRDFAAQVGVPMQQT

SEQ ID NO: 647878 - protein, 19 aa, Mycobacterium
DRAAPGLGLVRAAAGLGTD

SEQ ID NO: 647879 - protein, 18 aa, Mycobacterium
DRAAPVYIAGHRGLAGSA

SEQ ID NO: 647880 - protein, 19 aa, Mycobacterium
DRAAPWLRDRDGLDLVTEF

SEQ ID NO: 647881 - protein, 25 aa, Mycobacterium
DRAARFGDRVFLKFGDQQMTYGEAN

SEQ ID NO: 647882 - protein, 26 aa, Mycobacterium
DRAARFGDRVFLRFGDQELTYRDANA

SEQ ID NO: 647883 - protein, 27 aa, Mycobacterium
DRAARLEALPGWVWGASGEQRWERGFT

SEQ ID NO: 647884 - protein, 24 aa, Mycobacterium
DRADAVLLLTEWQEFVDFDPDALA

SEQ ID NO: 647885 - protein, 26 aa, Mycobacterium
DRADPRVSPLLAESLAGLAPALIAVA

SEQ ID NO: 647886 - protein, 27 aa, Mycobacterium
DRAEARNAINFQMAWDALEVAKSIAAD

SEQ ID NO: 647887 - protein, 25 aa, Mycobacterium
DRAEAYRRAGYWTGRPLDSILTDAA

SEQ ID NO: 647888 - protein, 27 aa, Mycobacterium
DRAELHRRLAVDIERRAPHAADEHAAL

SEQ ID NO: 647889 - protein, 35 aa, Mycobacterium
DRAERLPVAVSWNYRGKLGYHWVIVGIDYEYNRKF

SEQ ID NO: 647890 - protein, 20 aa, Mycobacterium
DRAGGLISAVSGHTVQVATP

SEQ ID NO: 647891 - protein, 21 aa, Mycobacterium
DRAGLSLADIDAFEVNEAFAS

SEQ ID NO: 647892 - protein, 19 aa, Mycobacterium
DRAGLVIAEDAHWFDPSTI

SEQ ID NO: 647893 - protein, 19 aa, Mycobacterium
DRAGRAAVMAVVKADGYGH

SEQ ID NO: 647894 - protein, 21 aa, Mycobacterium
DRAIVGIEGIFYARYNDDFLI

SEQ ID NO: 647895 - protein, 20 aa, Mycobacterium
DRAKAAVVSQLLHAVDDIER

SEQ ID NO: 647896 - protein, 21 aa, Mycobacterium
DRAKAGVVSQLLGVLDDLERA

SEQ ID NO: 647897 - protein, 18 aa, Mycobacterium
DRAKGIASTSSWVAEDWL

SEQ ID NO: 647898 - protein, 21 aa, Mycobacterium
DRAKMLSLLWQSLRRQRELSK

SEQ ID NO: 647899 - protein, 22 aa, Mycobacterium
DRAKPAVPFGGAYRLIDFVLSN

SEQ ID NO: 647900 - protein, 30 aa, Mycobacterium
DRAKPAVPFGGAYRLIDFVLSNLVNARYLR

SEQ ID NO: 647901 - protein, 22 aa, Mycobacterium
DRAKPAVPFGGGYRLIDFVLSN

SEQ ID NO: 647902 - protein, 18 aa, Mycobacterium
DRALDCLAVTYTGSALLR

SEQ ID NO: 647903 - protein, 22 aa, Mycobacterium
DRALDWHHVYVFTGLSTDELEV

SEQ ID NO: 647904 - protein, 22 aa, Mycobacterium
DRALDWHHVYVFTGRSTEELAA

SEQ ID NO: 647905 - protein, 25 aa, Mycobacterium
DRALHPTQWVRLWFSDGGKLHQRGY

SEQ ID NO: 647906 - protein, 22 aa, Mycobacterium
DRALPVVAPWIHRGLTSQDVLD

SEQ ID NO: 647907 - protein, 17 aa, Mycobacterium
DRALSVMMRARRTTQAP

SEQ ID NO: 647908 - protein, 20 aa, Mycobacterium
DRANAIWKSLQEAVSIPGRS

SEQ ID NO: 647909 - protein, 23 aa, Mycobacterium
DRAPVPFHLLPTVARDLGQHTEI

SEQ ID NO: 647910 - protein, 19 aa, Mycobacterium
DRARADAAYEAALEAVARA

SEQ ID NO: 647911 - protein, 18 aa, Mycobacterium
DRARAIVFTAERALGNDD

SEQ ID NO: 647912 - protein, 22 aa, Mycobacterium
DRARALRVIDWFIDATAQRHYE

SEQ ID NO: 647913 - protein, 26 aa, Mycobacterium
DRARARRMCRELEQFDLVWIEEPLDA

SEQ ID NO: 647914 - protein, 22 aa, Mycobacterium
DRAREYNRVLHLFTDVMDACRH

SEQ ID NO: 647915 - protein, 28 aa, Mycobacterium
DRARHIHDFPALWYVPAAGLVYIAAAGQ

SEQ ID NO: 647916 - protein, 18 aa, Mycobacterium
DRARIARGLERLRHARGS

SEQ ID NO: 647917 - protein, 22 aa, Mycobacterium
DRARLGREGVLALSSDEAMELF

SEQ ID NO: 647918 - protein, 24 aa, Mycobacterium
DRARLRPLLPDSPATVALRQTCRG

SEQ ID NO: 647919 - protein, 17 aa, Mycobacterium
DRARLTSKYAHAYRALG

SEQ ID NO: 647920 - protein, 17 aa, Mycobacterium
DRARRCDPAGPLVGRHV

SEQ ID NO: 647921 - protein, 20 aa, Mycobacterium
DRARRRGISIGRQGADGMSA

SEQ ID NO: 647922 - protein, 18 aa, Mycobacterium
DRARSRGLQAAWELCVPH

SEQ ID NO: 647923 - protein, 17 aa, Mycobacterium
DRARSRGLQAAWELFVP

SEQ ID NO: 647924 - protein, 30 aa, Mycobacterium
DRARTRISWLDSRHSFSFGEHYDPHNTHHG

SEQ ID NO: 647925 - protein, 24 aa, Mycobacterium
DRARVDARHAVFVGDAVWDAHAAA

SEQ ID NO: 647926 - protein, 18 aa, Mycobacterium
DRARVLHSAAFRRLADKT

SEQ ID NO: 647927 - protein, 18 aa, Mycobacterium
DRARYAGIQHARWTVIPI

SEQ ID NO: 647928 - protein, 18 aa, Mycobacterium
DRASCKYMKMITPAALLR

SEQ ID NO: 647929 - protein, 25 aa, Mycobacterium
DRASDAVMCALDLQLAPLEPFALCI

SEQ ID NO: 647930 - protein, 19 aa, Mycobacterium
DRATLSFTIADPSGTPLLD

SEQ ID NO: 647931 - protein, 17 aa, Mycobacterium
DRATPMVTVLDGHPHAL

SEQ ID NO: 647932 - protein, 20 aa, Mycobacterium
DRAVAAWLWSGRRATVAGLS

SEQ ID NO: 647933 - protein, 19 aa, Mycobacterium
DRAVGWWYPAASALARQDS

SEQ ID NO: 647934 - protein, 19 aa, Mycobacterium
DRAVLPPDTFRAERLSMWV

SEQ ID NO: 647935 - protein, 17 aa, Mycobacterium
DRAWHFVAATFDAATGT

SEQ ID NO: 647936 - protein, 23 aa, Mycobacterium
DRAYCVPKAVLLTAACRAAGIPA

SEQ ID NO: 647937 - protein, 21 aa, Mycobacterium
DRAYKPLNWMSPPCWLTETEG

SEQ ID NO: 647938 - protein, 25 aa, Mycobacterium
DRCAIGVPTTTGWRMLSGDETGWLL

SEQ ID NO: 647939 - protein, 26 aa, Mycobacterium
DRCAVGIPAATGWRMLSGDETGWLLG

SEQ ID NO: 647940 - protein, 25 aa, Mycobacterium
DRCAVGIPDKAGWRMLSGDETGWLL

SEQ ID NO: 647941 - protein, 26 aa, Mycobacterium
DRCAVGIPTPDGWRMLSGDETGWLLG

SEQ ID NO: 647942 - protein, 18 aa, Mycobacterium
DRCGHEVRLKCENLQRTG

SEQ ID NO: 647943 - protein, 29 aa, Mycobacterium
DRCKGNPAWDLPLVFGPIALVYNLAGVTN

SEQ ID NO: 647944 - protein, 23 aa, Mycobacterium
DRCLQLHGGYGFMREYPVARAYM

SEQ ID NO: 647945 - protein, 18 aa, Mycobacterium
DRCLQLHGGYGYMREYPV

SEQ ID NO: 647946 - protein, 25 aa, Mycobacterium
DRCNLRCGYCMPAEGLNWLPGEQLL

SEQ ID NO: 647947 - protein, 25 aa, Mycobacterium
DRCNLRCSYCMPAEGLDWLPGEQLL

SEQ ID NO: 647948 - protein, 24 aa, Mycobacterium
DRCNLRCTYCMPAEGLDWLPGEQL

SEQ ID NO: 647949 - protein, 25 aa, Mycobacterium
DRCNLRCTYCMPAEGLDWLRSETLL

SEQ ID NO: 647950 - protein, 25 aa, Mycobacterium
DRCNLRCTYCMPAEGLNWLPGDALL

SEQ ID NO: 647951 - protein, 17 aa, Mycobacterium
DRCPHVADICVTTRPVL

SEQ ID NO: 647952 - protein, 20 aa, Mycobacterium
DRCQTRPYFDGMLLHTRTHL

SEQ ID NO: 647953 - protein, 17 aa, Mycobacterium
DRCRVPMPWSGTTPPFG

SEQ ID NO: 647954 - protein, 19 aa, Mycobacterium
DRCYTRLYTELTWLNEFSD

SEQ ID NO: 647955 - protein, 17 aa, Mycobacterium
DRDAAVIIGDRPKHLIA

SEQ ID NO: 647956 - protein, 26 aa, Mycobacterium
DRDAAWKAKRAVLQQVYRVPRSAGRN

SEQ ID NO: 647957 - protein, 17 aa, Mycobacterium
DRDAEIGVTVAELASVP

SEQ ID NO: 647958 - protein, 18 aa, Mycobacterium
DRDAHALSALVLLHDSRR

SEQ ID NO: 647959 - protein, 19 aa, Mycobacterium
DRDAIAFPRGMTGPRDDPY

SEQ ID NO: 647960 - protein, 17 aa, Mycobacterium
DRDAVSFAGRIDGAIAR

SEQ ID NO: 647961 - protein, 23 aa, Mycobacterium
DRDCLGVPCHLRGEQGRDGRACG

SEQ ID NO: 647962 - protein, 24 aa, Mycobacterium
DRDDALRLARRIAAALNAPGGGAD

SEQ ID NO: 647963 - protein, 25 aa, Mycobacterium
DRDDEVLPFISIRLWQPISENETEV

SEQ ID NO: 647964 - protein, 30 aa, Mycobacterium
DRDDVAALLRWLGNGNFLLLGYQRCHVHDG

SEQ ID NO: 647965 - protein, 40 aa, Mycobacterium
DRDDVAALLRWLGNGNFLLLGYQRCRVHERLVSGDGSPGL

SEQ ID NO: 647966 - protein, 22 aa, Mycobacterium
DRDFSCFYFREGELIAADCVNR

SEQ ID NO: 647967 - protein, 24 aa, Mycobacterium
DRDGFVFGEAGALMLIETEEHAKA

SEQ ID NO: 647968 - protein, 23 aa, Mycobacterium
DRDGFVFGEAGALMLLETEEHAK

SEQ ID NO: 647969 - protein, 19 aa, Mycobacterium
DRDGFVFGEGGALLVIETE

SEQ ID NO: 647970 - protein, 22 aa, Mycobacterium
DRDGFVFGEGGALMVIETEEHA

SEQ ID NO: 647971 - protein, 19 aa, Mycobacterium
DRDGLLWWLQARPITTLPG

SEQ ID NO: 647972 - protein, 19 aa, Mycobacterium
DRDGVRLVDDWDGFGQRRT

SEQ ID NO: 647973 - protein, 18 aa, Mycobacterium
DRDGWRMLHDHADDPVTR

SEQ ID NO: 647974 - protein, 27 aa, Mycobacterium
DRDHPLWECWIIEGLPVGRWATLVKIH

SEQ ID NO: 647975 - protein, 30 aa, Mycobacterium
DRDIAAFSRRFGCTVWDGFGSTETAVIITR

SEQ ID NO: 647976 - protein, 23 aa, Mycobacterium
DRDIKVIVLRGAGRAFSGGYDFG

SEQ ID NO: 647977 - protein, 26 aa, Mycobacterium
DRDIVAYCRGAYCVMAPDAVHIARTA

SEQ ID NO: 647978 - protein, 22 aa, Mycobacterium
DRDLAASLVRRAEAAGFQGIIV

SEQ ID NO: 647979 - protein, 24 aa, Mycobacterium
DRDLLADLYRAWAHGGQIPDEMST

SEQ ID NO: 647980 - protein, 19 aa, Mycobacterium
DRDPKQPLCLMLDAPTAGG

SEQ ID NO: 647981 - protein, 24 aa, Mycobacterium
DRDRLRPRIRAVMDRLDAAIPRGV

SEQ ID NO: 647982 - protein, 20 aa, Mycobacterium
DRDRLVVIVAGYRKDLDAFL

SEQ ID NO: 647983 - protein, 20 aa, Mycobacterium
DRDRLVVIVAGYRKDLDTFL

SEQ ID NO: 647984 - protein, 23 aa, Mycobacterium
DRDRQAIAMGRRGRPEEQAGAIL

SEQ ID NO: 647985 - protein, 35 aa, Mycobacterium
DRDSAAAQCRWCGRAEPALRCARCGSDAVRAVVVG

SEQ ID NO: 647986 - protein, 21 aa, Mycobacterium
DRDTADWALRELVMLHEVAHH

SEQ ID NO: 647987 - protein, 28 aa, Mycobacterium
DRDTALLAWREMFSGFDTPTLVSAQGPG

SEQ ID NO: 647988 - protein, 22 aa, Mycobacterium
DRDTMWRTGINVFFETFGSHKA

SEQ ID NO: 647989 - protein, 24 aa, Mycobacterium
DRDVCVRLGGDFAFGSATWQVAEA

SEQ ID NO: 647990 - protein, 25 aa, Mycobacterium
DRDWAPKVYGAWHLHQATVGQPLDW

SEQ ID NO: 647991 - protein, 23 aa, Mycobacterium
DRDWSPKVYGSWNLHRASTGQPL

SEQ ID NO: 647992 - protein, 26 aa, Mycobacterium
DREAAHLRAFLTFAEHAQRFALDQAH

SEQ ID NO: 647993 - protein, 31 aa, Mycobacterium
DREDTGRAFSGWRPGDLMRSAWEQQPPTGSR

SEQ ID NO: 647994 - protein, 23 aa, Mycobacterium
DREFAYRVLRAWLHTLRDRLTVD

SEQ ID NO: 647995 - protein, 22 aa, Mycobacterium
DREFKVDGFAGVQRKKLRDILS

SEQ ID NO: 647996 - protein, 23 aa, Mycobacterium
DREGAAMPGPWHLDALPMVISAE

SEQ ID NO: 647997 - protein, 20 aa, Mycobacterium
DREIEVLRLLAAGLSNNKIG

SEQ ID NO: 647998 - protein, 19 aa, Mycobacterium
DREKHAALRGSMTVLAVNT

SEQ ID NO: 647999 - protein, 29 aa, Mycobacterium
DRELACALDELILFRGRRVMTTILQHAID

SEQ ID NO: 648000 - protein, 25 aa, Mycobacterium
DRELAMKAYPLWLARGCMPGKLMPV

SEQ ID NO: 648001 - protein, 18 aa, Mycobacterium
DRELETWMVVDMSASLDF

SEQ ID NO: 648002 - protein, 19 aa, Mycobacterium
DRELKAGGLHQSRESRHTV

SEQ ID NO: 648003 - protein, 18 aa, Mycobacterium
DRELQIGSLFGEPEPNVF

SEQ ID NO: 648004 - protein, 22 aa, Mycobacterium
DREPDARIALPTRADQALIYRL

SEQ ID NO: 648005 - protein, 24 aa, Mycobacterium
DREPDARIALPTREDQALIYRLSG

SEQ ID NO: 648006 - protein, 23 aa, Mycobacterium
DRERARHVALTGMAITMVGACQR

SEQ ID NO: 648007 - protein, 25 aa, Mycobacterium
DREREVAELLLLGMPYRDIGAQLFI

SEQ ID NO: 648008 - protein, 25 aa, Mycobacterium
DREREVAELLLLGMPYRDIGNQLFI

SEQ ID NO: 648009 - protein, 25 aa, Mycobacterium
DREREVAELLLLGMPYRDIGSRLFI

SEQ ID NO: 648010 - protein, 22 aa, Mycobacterium
DRERKLLPIAREGISQVNGIVQ

SEQ ID NO: 648011 - protein, 25 aa, Mycobacterium
DRERPRLSLGPLPVADHFLDSTAGL

SEQ ID NO: 648012 - protein, 18 aa, Mycobacterium
DRERVAAVLERVMKGKPF

SEQ ID NO: 648013 - protein, 19 aa, Mycobacterium
DRESIDWATYTCGACPALR

SEQ ID NO: 648014 - protein, 25 aa, Mycobacterium
DREVFLASWPREFRALVEQQREGVG

SEQ ID NO: 648015 - protein, 21 aa, Mycobacterium
DREWLARGGHHAFDPFVSLSF

SEQ ID NO: 648016 - protein, 19 aa, Mycobacterium
DRFAEPLVRAVGVDFFTRW

SEQ ID NO: 648017 - protein, 27 aa, Mycobacterium
DRFAKLEAIDGFRFLAVRELAKQRLAL

SEQ ID NO: 648018 - protein, 20 aa, Mycobacterium
DRFAVSRYTIREALRRLRED

SEQ ID NO: 648019 - protein, 20 aa, Mycobacterium
DRFAYEKSMLINIGDEKGPM

SEQ ID NO: 648020 - protein, 20 aa, Mycobacterium
DRFDAVIIPGVTSFSAASAA

SEQ ID NO: 648021 - protein, 18 aa, Mycobacterium
DRFDRRPLTEHLIRTTWP

SEQ ID NO: 648022 - protein, 18 aa, Mycobacterium
DRFEGWKAVDVADAIRGL

SEQ ID NO: 648023 - protein, 26 aa, Mycobacterium
DRFFWFTTTGWMMWNYLVGGLLVGAT

SEQ ID NO: 648024 - protein, 25 aa, Mycobacterium
DRFGADLPPLEGIYLAAFAGQPVLL

SEQ ID NO: 648025 - protein, 23 aa, Mycobacterium
DRFGDLPVRAVVASPLLRCRATV

SEQ ID NO: 648026 - protein, 19 aa, Mycobacterium
DRFGHFGFGGITVRNADQT

SEQ ID NO: 648027 - protein, 17 aa, Mycobacterium
DRFGIEHPVVLAPMDDV

SEQ ID NO: 648028 - protein, 23 aa, Mycobacterium
DRFGKIWAAMAITEPGFGSDSAA

SEQ ID NO: 648029 - protein, 28 aa, Mycobacterium
DRFGKTAAVDGFRFWAVRELSRQRGALR

SEQ ID NO: 648030 - protein, 25 aa, Mycobacterium
DRFGLRRGGLSFGRLSRDHAHGKVL

SEQ ID NO: 648031 - protein, 18 aa, Mycobacterium
DRFGVRLEAIGARVQQVA

SEQ ID NO: 648032 - protein, 21 aa, Mycobacterium
DRFHVFGNSWGGMLAQQYALD

SEQ ID NO: 648033 - protein, 28 aa, Mycobacterium
DRFIGWPRLPKMAGIAVLYTLRRALQSD

SEQ ID NO: 648034 - protein, 23 aa, Mycobacterium
DRFLSRLRFVSVDLTEPSDYAAV

SEQ ID NO: 648035 - protein, 19 aa, Mycobacterium
DRFLVGLAVLSLMAAAADE

SEQ ID NO: 648036 - protein, 32 aa, Mycobacterium
DRFNELVMRAGLRWQQVVLLRAYAKYLRQASF

SEQ ID NO: 648037 - protein, 27 aa, Mycobacterium
DRFNELVMRAGLTWQQVVLLRAYSRYL

SEQ ID NO: 648038 - protein, 34 aa, Mycobacterium
DRFNLKGERLGAVIAGAVLKLSRDFNLTRESVLG

SEQ ID NO: 648039 - protein, 22 aa, Mycobacterium
DRFPEVRAAGAGSRRDTRVLRG

SEQ ID NO: 648040 - protein, 19 aa, Mycobacterium
DRFPRLQMILGHLGEMLPF

SEQ ID NO: 648041 - protein, 24 aa, Mycobacterium
DRFPTLRIVFVEHAFTWILPLMWR

SEQ ID NO: 648042 - protein, 19 aa, Mycobacterium
DRFPVMPMPNWMDNPIDPI

SEQ ID NO: 648043 - protein, 19 aa, Mycobacterium
DRFRDDLDAWVGILTANGS

SEQ ID NO: 648044 - protein, 25 aa, Mycobacterium
DRFRGEEVFETLGLDVKACAEWVDT

SEQ ID NO: 648045 - protein, 24 aa, Mycobacterium
DRFSDEFRIQLAWMRQSPPDTPNP

SEQ ID NO: 648046 - protein, 25 aa, Mycobacterium
DRFSDEFRIQLAWMRQSPPDTPNPG

SEQ ID NO: 648047 - protein, 17 aa, Mycobacterium
DRFSSPLLQRAWKSMRR

SEQ ID NO: 648048 - protein, 26 aa, Mycobacterium
DRFTAEFLGDCVLLPCTVTGGVATSA

SEQ ID NO: 648049 - protein, 25 aa, Mycobacterium
DRFTAFVPFAARWPVEVHIYPNRFV

SEQ ID NO: 648050 - protein, 19 aa, Mycobacterium
DRFTAGLLAAMLERSPTSL

SEQ ID NO: 648051 - protein, 17 aa, Mycobacterium
DRFTARCLGAADCGHLL

SEQ ID NO: 648052 - protein, 22 aa, Mycobacterium
DRFTPLNLKHRIFRKAIGSHAG

SEQ ID NO: 648053 - protein, 19 aa, Mycobacterium
DRFVYKAHMLEGVPNLFWC

SEQ ID NO: 648054 - protein, 21 aa, Mycobacterium
DRGACAFSIKQAVAAERGAVA

SEQ ID NO: 648055 - protein, 17 aa, Mycobacterium
DRGAGLFLLGHSAGCEL

SEQ ID NO: 648056 - protein, 29 aa, Mycobacterium
DRGALPVKLCYSGPFFRYERPQAGRYRQL

SEQ ID NO: 648057 - protein, 28 aa, Mycobacterium
DRGCSHPGCDVPGYLCEVHHVTDWAHTH

SEQ ID NO: 648058 - protein, 21 aa, Mycobacterium
DRGDVALAFQLLVYPMLDDRT

SEQ ID NO: 648059 - protein, 24 aa, Mycobacterium
DRGEVRPDIDITWAAINGLVLALG

SEQ ID NO: 648060 - protein, 21 aa, Mycobacterium
DRGFYAGAVGWCDAAGDGRWV

SEQ ID NO: 648061 - protein, 22 aa, Mycobacterium
DRGFYAGAVGWCDARGDGRWVV

SEQ ID NO: 648062 - protein, 19 aa, Mycobacterium
DRGGALIALNHTSYVDWVP

SEQ ID NO: 648063 - protein, 23 aa, Mycobacterium
DRGGQLRLGHEVRALRQSIDGSW

SEQ ID NO: 648064 - protein, 25 aa, Mycobacterium
DRGGQLRWFGLDGVEHTGGPLIDLD

SEQ ID NO: 648065 - protein, 17 aa, Mycobacterium
DRGKRTGGGLLAVRGGP

SEQ ID NO: 648066 - protein, 25 aa, Mycobacterium
DRGLLHPPLRVGRVALFNDTHVTRL

SEQ ID NO: 648067 - protein, 24 aa, Mycobacterium
DRGLLPPPLRVGRIALFNDTHLTR

SEQ ID NO: 648068 - protein, 25 aa, Mycobacterium
DRGLLPPPLRVGRIALFNDTHLTRL

SEQ ID NO: 648069 - protein, 18 aa, Mycobacterium
DRGLPIRSIVAIGTPLDY

SEQ ID NO: 648070 - protein, 24 aa, Mycobacterium
DRGMKMGLYYSGGYDWTFDPTVIT

SEQ ID NO: 648071 - protein, 24 aa, Mycobacterium
DRGMKMGLYYSGGYDWTFNPTVIT

SEQ ID NO: 648072 - protein, 33 aa, Mycobacterium
DRGPFTAGLIDFVFGEVWSRPGLSRRDRRFVTL

SEQ ID NO: 648073 - protein, 18 aa, Mycobacterium
DRGPQTWQEFDEWGPQLQ

SEQ ID NO: 648074 - protein, 22 aa, Mycobacterium
DRGPTLLAHGGFDSTVEEMYFA

SEQ ID NO: 648075 - protein, 24 aa, Mycobacterium
DRGQGRRCRRHLGPALRLIDDVGA

SEQ ID NO: 648076 - protein, 29 aa, Mycobacterium
DRGQLPAKLRYAGPFFRYERPQAGRYRQL

SEQ ID NO: 648077 - protein, 17 aa, Mycobacterium
DRGRIARGLDQLRLAEG

SEQ ID NO: 648078 - protein, 24 aa, Mycobacterium
DRGRLAGVADEGGWWPMVDSNEDA

SEQ ID NO: 648079 - protein, 18 aa, Mycobacterium
DRGRPAPTHRRWSQYLNW

SEQ ID NO: 648080 - protein, 17 aa, Mycobacterium
DRGRPCIGDLIERKVRG

SEQ ID NO: 648081 - protein, 18 aa, Mycobacterium
DRGRPCIGDLIERRVRGN

SEQ ID NO: 648082 - protein, 17 aa, Mycobacterium
DRGRPGPLLRAKHALFD

SEQ ID NO: 648083 - protein, 18 aa, Mycobacterium
DRGRRWPVIISGTITDAS

SEQ ID NO: 648084 - protein, 21 aa, Mycobacterium
DRGRWGCVLGGDPLRRVTAMR

SEQ ID NO: 648085 - protein, 19 aa, Mycobacterium
DRGSAGVWRYLARPESRGR

SEQ ID NO: 648086 - protein, 20 aa, Mycobacterium
DRGWQVVGVIAAQDDAVLIR

SEQ ID NO: 648087 - protein, 17 aa, Mycobacterium
DRHGLGVCHAGRLRRLS

SEQ ID NO: 648088 - protein, 17 aa, Mycobacterium
DRHIVRMYDQWRPRPWP

SEQ ID NO: 648089 - protein, 23 aa, Mycobacterium
DRHLDPRSLVAMVEDLRPTVTGA

SEQ ID NO: 648090 - protein, 24 aa, Mycobacterium
DRHLLRPLREVMWGHDESLLNTTE

SEQ ID NO: 648091 - protein, 18 aa, Mycobacterium
DRHLQAAPLVSIIEETQP

SEQ ID NO: 648092 - protein, 23 aa, Mycobacterium
DRHLRPEFFAAMRELCDEFDALL

SEQ ID NO: 648093 - protein, 17 aa, Mycobacterium
DRHPGWHALRKLAARIT

SEQ ID NO: 648094 - protein, 30 aa, Mycobacterium
DRHPNLRAAFWDRDVPKPVQIVPVHAALPW

SEQ ID NO: 648095 - protein, 18 aa, Mycobacterium
DRHPVRPLAHVLIGALDE

SEQ ID NO: 648096 - protein, 23 aa, Mycobacterium
DRHQLRWPRDKTLVEIMLDAGIA

SEQ ID NO: 648097 - protein, 23 aa, Mycobacterium
DRHRPLFRCWVIDGVPDDMFAIY

SEQ ID NO: 648098 - protein, 18 aa, Mycobacterium
DRHRPRYPEPLIAELMSG

SEQ ID NO: 648099 - protein, 21 aa, Mycobacterium
DRHSAEYRSRFKAITEEMHAR

SEQ ID NO: 648100 - protein, 17 aa, Mycobacterium
DRHWIPVHRDWRLNERH

SEQ ID NO: 648101 - protein, 25 aa, Mycobacterium
DRHYPGDVLDLTWIDTLGQTRTGKA

SEQ ID NO: 648102 - protein, 20 aa, Mycobacterium
DRIADVLGRLPGGYQVEGRE

SEQ ID NO: 648103 - protein, 24 aa, Mycobacterium
DRIAEACTRGGSSMFGSGISPGYV

SEQ ID NO: 648104 - protein, 19 aa, Mycobacterium
DRIAECVDDALAMVSMSAY

SEQ ID NO: 648105 - protein, 23 aa, Mycobacterium
DRIAELLGVVGLRREDASRYPAE

SEQ ID NO: 648106 - protein, 22 aa, Mycobacterium
DRIAEMLAELMTLFAGGALAPL

SEQ ID NO: 648107 - protein, 19 aa, Mycobacterium
DRIAFFYYFGVERFSPDGD

SEQ ID NO: 648108 - protein, 18 aa, Mycobacterium
DRIAHKHASLGIVAEQYP

SEQ ID NO: 648109 - protein, 17 aa, Mycobacterium
DRIALKMIEAAEVSGEL

SEQ ID NO: 648110 - protein, 21 aa, Mycobacterium
DRIASLLGMEGGHCIDGSLAV

SEQ ID NO: 648111 - protein, 17 aa, Mycobacterium
DRICDEVAFHLKRCDRG

SEQ ID NO: 648112 - protein, 20 aa, Mycobacterium
DRIDAKLGHPTRDPHGDPIP

SEQ ID NO: 648113 - protein, 24 aa, Mycobacterium
DRIDPRWAKLAGMFDPEADESRGE

SEQ ID NO: 648114 - protein, 19 aa, Mycobacterium
DRIEAYPLVSMEGGDDTVR

SEQ ID NO: 648115 - protein, 21 aa, Mycobacterium
DRIEGFPHWNEHMLATVNKRP

SEQ ID NO: 648116 - protein, 18 aa, Mycobacterium
DRIEIKHAKPTVAEQKYI

SEQ ID NO: 648117 - protein, 18 aa, Mycobacterium
DRIFEIYPTLAGALRPGK

SEQ ID NO: 648118 - protein, 28 aa, Mycobacterium
DRIGGAVEEFIRWASPVMTFRRTAATDY

SEQ ID NO: 648119 - protein, 24 aa, Mycobacterium
DRIGRLAVRLDVSRLVVVGSGRPM

SEQ ID NO: 648120 - protein, 24 aa, Mycobacterium
DRIGRLAVRLDVSRLVVVGSGRSM

SEQ ID NO: 648121 - protein, 18 aa, Mycobacterium
DRIGRRPGARWAADLLAA

SEQ ID NO: 648122 - protein, 18 aa, Mycobacterium
DRIGRRPGARWAADLLSA

SEQ ID NO: 648123 - protein, 20 aa, Mycobacterium
DRIGSLCPIAGVDGAGCCDL

SEQ ID NO: 648124 - protein, 19 aa, Mycobacterium
DRIHPEWQHLAVGDVVRLA

SEQ ID NO: 648125 - protein, 21 aa, Mycobacterium
DRIHQGWILNALWLIDTGVTA

SEQ ID NO: 648126 - protein, 20 aa, Mycobacterium
DRIISFEAFDAFKKERWPAF

SEQ ID NO: 648127 - protein, 23 aa, Mycobacterium
DRIKADKKINVGFANERPYAYRE

SEQ ID NO: 648128 - protein, 21 aa, Mycobacterium
DRIKALTGRIDLVHCNDSRDA

SEQ ID NO: 648129 - protein, 20 aa, Mycobacterium
DRILLLDGLPNYQRLFSLRI

SEQ ID NO: 648130 - protein, 17 aa, Mycobacterium
DRILSWTCLPGVQPNIT

SEQ ID NO: 648131 - protein, 38 aa, Mycobacterium
DRILWTHAVCGRCVMCAKKRPTLCRNKIPYGQATMDQW

SEQ ID NO: 648132 - protein, 24 aa, Mycobacterium
DRIMRLHRLALMRARAEQRQRVIE

SEQ ID NO: 648133 - protein, 22 aa, Mycobacterium
DRIPERLRRAADRGIQAIDLGA

SEQ ID NO: 648134 - protein, 19 aa, Mycobacterium
DRIPFGVVEMKTAWVSDDP

SEQ ID NO: 648135 - protein, 18 aa, Mycobacterium
DRIPLPGRRIRNRPTTRP

SEQ ID NO: 648136 - protein, 23 aa, Mycobacterium
DRIQVLRLGRRVATYPGQGTSVE

SEQ ID NO: 648137 - protein, 22 aa, Mycobacterium
DRIRFASSLPALLAGGGVDTRI

SEQ ID NO: 648138 - protein, 17 aa, Mycobacterium
DRIRFGTEIVSARFEDD

SEQ ID NO: 648139 - protein, 20 aa, Mycobacterium
DRIRVNAVAPTNCATPMITD

SEQ ID NO: 648140 - protein, 20 aa, Mycobacterium
DRIRYHGGDFIELIVGGKTY

SEQ ID NO: 648141 - protein, 20 aa, Mycobacterium
DRIRYHGGDFIELIVGGTTY

SEQ ID NO: 648142 - protein, 26 aa, Mycobacterium
DRIRYHGGEFIELIVGGATYDLAAAA

SEQ ID NO: 648143 - protein, 17 aa, Mycobacterium
DRISGNYFTGVLVSIPV

SEQ ID NO: 648144 - protein, 27 aa, Mycobacterium
DRITFEEWNRFLAVNLTGTFLCMQAAL

SEQ ID NO: 648145 - protein, 23 aa, Mycobacterium
DRIVSIEAFEHFGFERYDDFFKM

SEQ ID NO: 648146 - protein, 21 aa, Mycobacterium
DRIVSIEAFEHFGHENYDDFF

SEQ ID NO: 648147 - protein, 20 aa, Mycobacterium
DRIVSIGAFEAFKAERYPVF

SEQ ID NO: 648148 - protein, 20 aa, Mycobacterium
DRIVSIGAFEHFGADRYDDF

SEQ ID NO: 648149 - protein, 20 aa, Mycobacterium
DRIVSIGAFEHFGFEKYADY

SEQ ID NO: 648150 - protein, 20 aa, Mycobacterium
DRIVSIGAFEHFGFERYPAF

SEQ ID NO: 648151 - protein, 20 aa, Mycobacterium
DRIVSIGAFEHFGHDRHADF

SEQ ID NO: 648152 - protein, 20 aa, Mycobacterium
DRIVSIGAFEHFGHERYDAF

SEQ ID NO: 648153 - protein, 20 aa, Mycobacterium
DRIVSIGAFEHFGHERYDDF

SEQ ID NO: 648154 - protein, 20 aa, Mycobacterium
DRIVSIGAFEHFGHERYDSF

SEQ ID NO: 648155 - protein, 20 aa, Mycobacterium
DRIVSIGAFEHFGRDRYDDF

SEQ ID NO: 648156 - protein, 20 aa, Mycobacterium
DRIVSIGAFEHFGRDRYPDF

SEQ ID NO: 648157 - protein, 20 aa, Mycobacterium
DRIVSIGAFEHFGRLRYAHF

SEQ ID NO: 648158 - protein, 20 aa, Mycobacterium
DRIVSIGAFEHFGRNRYTDF

SEQ ID NO: 648159 - protein, 20 aa, Mycobacterium
DRIVSIGAFEHFGRQRYPRF

SEQ ID NO: 648160 - protein, 20 aa, Mycobacterium
DRIVSIGAFEHFGSDRYDEF

SEQ ID NO: 648161 - protein, 20 aa, Mycobacterium
DRIVSIGAFEHFRHERYDEF

SEQ ID NO: 648162 - protein, 19 aa, Mycobacterium
DRIVSLCAHTENFRAELAA

SEQ ID NO: 648163 - protein, 20 aa, Mycobacterium
DRIVSLGAFEHFADGAGDAG

SEQ ID NO: 648164 - protein, 20 aa, Mycobacterium
DRIVSLGAFEHFADGAGDAS

SEQ ID NO: 648165 - protein, 20 aa, Mycobacterium
DRIVTIGAFEAFKMERYAAF

SEQ ID NO: 648166 - protein, 18 aa, Mycobacterium
DRIVTWLVDKFKGSSGID

SEQ ID NO: 648167 - protein, 20 aa, Mycobacterium
DRIVVIEALEHFGFHRYDDF

SEQ ID NO: 648168 - protein, 24 aa, Mycobacterium
DRIYSVYGRNAWKSRVRAHPDVAA

SEQ ID NO: 648169 - protein, 23 aa, Mycobacterium
DRKAKAGIMSPIMADASGAAAIA

SEQ ID NO: 648170 - protein, 21 aa, Mycobacterium
DRKAVTLGFEPEPGMFVETVE

SEQ ID NO: 648171 - protein, 21 aa, Mycobacterium
DRKDKIMGFGHRVYKNGDSRV

SEQ ID NO: 648172 - protein, 22 aa, Mycobacterium
DRKEVGDGLVAVIVTGEVGAVK

SEQ ID NO: 648173 - protein, 27 aa, Mycobacterium
DRKFGGTCVNYGCIPSKMLSYTAQVAD

SEQ ID NO: 648174 - protein, 24 aa, Mycobacterium
DRKIWSGAATFLFTRTTVGEIGIM

SEQ ID NO: 648175 - protein, 20 aa, Mycobacterium
DRKPVMVWLHGGAYVLGSGS

SEQ ID NO: 648176 - protein, 20 aa, Mycobacterium
DRKPVMVWVHGGAYVLGSAS

SEQ ID NO: 648177 - protein, 20 aa, Mycobacterium
DRKQRILGVAQRLLSRNGWR

SEQ ID NO: 648178 - protein, 21 aa, Mycobacterium
DRKRGSLVGALIVDDDTELYA

SEQ ID NO: 648179 - protein, 17 aa, Mycobacterium
DRKSLYTGLTRGREMNR

SEQ ID NO: 648180 - protein, 21 aa, Mycobacterium
DRKTYLFAFLDDHSRLVVGHR

SEQ ID NO: 648181 - protein, 25 aa, Mycobacterium
DRKVLRRFGKKPADTKTVLVVRHGS

SEQ ID NO: 648182 - protein, 21 aa, Mycobacterium
DRKVVRRFLKLPADTKTVLIV

SEQ ID NO: 648183 - protein, 20 aa, Mycobacterium
DRLAALSAEINRLGGDCRET

SEQ ID NO: 648184 - protein, 19 aa, Mycobacterium
DRLAALWGPTVHLVADGVG

SEQ ID NO: 648185 - protein, 24 aa, Mycobacterium
DRLAARATLSFAILARRDSVHSAA

SEQ ID NO: 648186 - protein, 23 aa, Mycobacterium
DRLADACAHNLLDAIARVPQIPE

SEQ ID NO: 648187 - protein, 22 aa, Mycobacterium
DRLADACAHSLFDAIARVPQIP

SEQ ID NO: 648188 - protein, 24 aa, Mycobacterium
DRLADCGRRVRQLAVSHAFHSPLM

SEQ ID NO: 648189 - protein, 20 aa, Mycobacterium
DRLAEAFAERMHQRVREEFW

SEQ ID NO: 648190 - protein, 20 aa, Mycobacterium
DRLAEAFAERMHQRVRKEFW

SEQ ID NO: 648191 - protein, 20 aa, Mycobacterium
DRLAEAFAERMHQRVRTEFW

SEQ ID NO: 648192 - protein, 18 aa, Mycobacterium
DRLAEALTPGNVVLADQG

SEQ ID NO: 648193 - protein, 25 aa, Mycobacterium
DRLAEELGRPLSLIAESDLNDPRLI

SEQ ID NO: 648194 - protein, 18 aa, Mycobacterium
DRLAELGVTEIFGVPGDY

SEQ ID NO: 648195 - protein, 21 aa, Mycobacterium
DRLAELKALFDAEAEKNHVFP

SEQ ID NO: 648196 - protein, 20 aa, Mycobacterium
DRLAELSIRTVHSILVDPGD

SEQ ID NO: 648197 - protein, 17 aa, Mycobacterium
DRLALLGSRLRGGATAE

SEQ ID NO: 648198 - protein, 25 aa, Mycobacterium
DRLARLGVEDELLRLGAQPGCAVTI

SEQ ID NO: 648199 - protein, 31 aa, Mycobacterium
DRLARLGVEDELLRLGARPGCAVTIGDMTFD

SEQ ID NO: 648200 - protein, 20 aa, Mycobacterium
DRLATALTDFAARVPDRPAR

SEQ ID NO: 648201 - protein, 20 aa, Mycobacterium
DRLCDAMASFVSRHGLDGLV

SEQ ID NO: 648202 - protein, 19 aa, Mycobacterium
DRLCRQFARTLGITVASVE

SEQ ID NO: 648203 - protein, 23 aa, Mycobacterium
DRLDAEILAAIKRRTEVSREIGK

SEQ ID NO: 648204 - protein, 22 aa, Mycobacterium
DRLDAEILAAVKRRTEVSQAIG

SEQ ID NO: 648205 - protein, 19 aa, Mycobacterium
DRLDDLLALAHEVRMRWCG

SEQ ID NO: 648206 - protein, 19 aa, Mycobacterium
DRLDELLALAHEVRMAHCG

SEQ ID NO: 648207 - protein, 19 aa, Mycobacterium
DRLDELLALAHEVRMRWCG

SEQ ID NO: 648208 - protein, 22 aa, Mycobacterium
DRLDEWGNRAILTKPVKAPTSI

SEQ ID NO: 648209 - protein, 21 aa, Mycobacterium
DRLDEWGNRAVLAEPETSAVS

SEQ ID NO: 648210 - protein, 20 aa, Mycobacterium
DRLDEWGNRAVLTAPATGAV

SEQ ID NO: 648211 - protein, 20 aa, Mycobacterium
DRLDEWGNRAVLTEPAAEPV

SEQ ID NO: 648212 - protein, 21 aa, Mycobacterium
DRLDEWGNRAVLTRPAPALES

SEQ ID NO: 648213 - protein, 18 aa, Mycobacterium
DRLDMPRSLREFGVDEQE

SEQ ID NO: 648214 - protein, 21 aa, Mycobacterium
DRLDNFQWVVGSLAAQLDSIP

SEQ ID NO: 648215 - protein, 26 aa, Mycobacterium
DRLDTRLRPGAAVIGWPGEPMAATPG

SEQ ID NO: 648216 - protein, 29 aa, Mycobacterium
DRLEKICRMIMLYHLDRGWADHLAYLADI

SEQ ID NO: 648217 - protein, 18 aa, Mycobacterium
DRLEKICRQIMLYHLDRG

SEQ ID NO: 648218 - protein, 19 aa, Mycobacterium
DRLERCLVSAPEFSGQLAR

SEQ ID NO: 648219 - protein, 24 aa, Mycobacterium
DRLERVAKFGRALGDFSGKFTDFF

SEQ ID NO: 648220 - protein, 22 aa, Mycobacterium
DRLERYCVFPNLGAEPQDAFRF

SEQ ID NO: 648221 - protein, 24 aa, Mycobacterium
DRLETWWRTGLLCIGDAAHAMSPI

SEQ ID NO: 648222 - protein, 27 aa, Mycobacterium
DRLFLPYQVALEFQRNRLNVVQATSAI

SEQ ID NO: 648223 - protein, 25 aa, Mycobacterium
DRLFPRSIFHSLRLAEHNLDELLNR

SEQ ID NO: 648224 - protein, 25 aa, Mycobacterium
DRLFPRSIFYSLRLAEHSLDELMNR

SEQ ID NO: 648225 - protein, 25 aa, Mycobacterium
DRLFPRSVFYSLRLAEHNLDELVRN

SEQ ID NO: 648226 - protein, 20 aa, Mycobacterium
DRLGDAVGRAATVLVETLVE

SEQ ID NO: 648227 - protein, 19 aa, Mycobacterium
DRLGISYRRIRMRQGAARV

SEQ ID NO: 648228 - protein, 23 aa, Mycobacterium
DRLGRHCKVFIAHDLDVDNRRLL

SEQ ID NO: 648229 - protein, 23 aa, Mycobacterium
DRLGYRLITVAGHVTGPAELPPD

SEQ ID NO: 648230 - protein, 23 aa, Mycobacterium
DRLHAFEVKWLCAVVEVARSSFY

SEQ ID NO: 648231 - protein, 37 aa, Mycobacterium
DRLHLLPPLRWRLATVPLDLGHPWWVEGEVDLDFHVR

SEQ ID NO: 648232 - protein, 18 aa, Mycobacterium
DRLIAWTVLGKIQPPIGH

SEQ ID NO: 648233 - protein, 21 aa, Mycobacterium
DRLIIGEVVAFHLDSSVLDPA

SEQ ID NO: 648234 - protein, 18 aa, Mycobacterium
DRLIPDLVRSVVADEPLV

SEQ ID NO: 648235 - protein, 26 aa, Mycobacterium
DRLIWPSLEGELRWCQLFSEPGAGSD

SEQ ID NO: 648236 - protein, 23 aa, Mycobacterium
DRLKDMYICGGFNVYPAEIEQVL

SEQ ID NO: 648237 - protein, 21 aa, Mycobacterium
DRLKELIKYKGYQVPPAELEA

SEQ ID NO: 648238 - protein, 22 aa, Mycobacterium
DRLKEMIKVRGFQVAPAEIETV

SEQ ID NO: 648239 - protein, 23 aa, Mycobacterium
DRLKPWDVIAARLTAAAAADLVL

SEQ ID NO: 648240 - protein, 23 aa, Mycobacterium
DRLKPWEVIAARLGAAAAADLVL

SEQ ID NO: 648241 - protein, 19 aa, Mycobacterium
DRLKTRRIVLTGQVTEQCI

SEQ ID NO: 648242 - protein, 25 aa, Mycobacterium
DRLLADGLAMDWGICGVGVLPDDRR

SEQ ID NO: 648243 - protein, 19 aa, Mycobacterium
DRLLFALLAETGMRMGEAL

SEQ ID NO: 648244 - protein, 24 aa, Mycobacterium
DRLLGLRFGAAAVRALDEGHSGVM

SEQ ID NO: 648245 - protein, 25 aa, Mycobacterium
DRLLGLRFGAAAVRALDEGHYGVMV

SEQ ID NO: 648246 - protein, 25 aa, Mycobacterium
DRLLHCPRCGTGFDVVGAGAGANGA

SEQ ID NO: 648247 - protein, 27 aa, Mycobacterium
DRLLLADFCPAVEWDGRSALLDSRHDG

SEQ ID NO: 648248 - protein, 19 aa, Mycobacterium
DRLLLFLAAELARKHRSAG

SEQ ID NO: 648249 - protein, 19 aa, Mycobacterium
DRLLNLLMDGLRPAARQAH

SEQ ID NO: 648250 - protein, 23 aa, Mycobacterium
DRLLRLRWPCPITGAMPVSEVGD

SEQ ID NO: 648251 - protein, 18 aa, Mycobacterium
DRLLWLPAAEAMRKLDYA

SEQ ID NO: 648252 - protein, 17 aa, Mycobacterium
DRLNPKLSISGILVTRY

SEQ ID NO: 648253 - protein, 26 aa, Mycobacterium
DRLNVADAGLCFGRLDGVDGEHLYIG

SEQ ID NO: 648254 - protein, 22 aa, Mycobacterium
DRLPEVQFIRAYVDSVDLSARS

SEQ ID NO: 648255 - protein, 22 aa, Mycobacterium
DRLPEYMVPAAVVGLQALPLTV

SEQ ID NO: 648256 - protein, 17 aa, Mycobacterium
DRLPFDPPARWTAAESV

SEQ ID NO: 648257 - protein, 17 aa, Mycobacterium
DRLPGVGARSLQLGTVP

SEQ ID NO: 648258 - protein, 21 aa, Mycobacterium
DRLPHNRVWMKAGGKMPDDPV

SEQ ID NO: 648259 - protein, 24 aa, Mycobacterium
DRLPKRRWWGWGINPQFRILRQPG

SEQ ID NO: 648260 - protein, 23 aa, Mycobacterium
DRLPLGAPTAWPTLRSALGRAVT

SEQ ID NO: 648261 - protein, 22 aa, Mycobacterium
DRLPLGRPTYWDLFEPALRGTF

SEQ ID NO: 648262 - protein, 23 aa, Mycobacterium
DRLPMSAYVDWDAFETLLRARLG

SEQ ID NO: 648263 - protein, 33 aa, Mycobacterium
DRLPRRISAAFTRFRCGPGAFKVDFAVEGGVPW

SEQ ID NO: 648264 - protein, 28 aa, Mycobacterium
DRLPSEVFRERFLTCFIADPIGVKLRHD

SEQ ID NO: 648265 - protein, 20 aa, Mycobacterium
DRLPTRVVLLSAFDDSPVVY

SEQ ID NO: 648266 - protein, 21 aa, Mycobacterium
DRLPVEVVKESIPWRRGQRGG

SEQ ID NO: 648267 - protein, 25 aa, Mycobacterium
DRLPVVDCPYSWSVAARLARIPNPG

SEQ ID NO: 648268 - protein, 19 aa, Mycobacterium
DRLRALHAVAIVNENDTVA

SEQ ID NO: 648269 - protein, 22 aa, Mycobacterium
DRLRDRFLFSLLAASGLRVGEA

SEQ ID NO: 648270 - protein, 23 aa, Mycobacterium
DRLREMDFEFPLAGGDEADAGGH

SEQ ID NO: 648271 - protein, 18 aa, Mycobacterium
DRLREWEAAGGPVIERSV

SEQ ID NO: 648272 - protein, 22 aa, Mycobacterium
DRLRFVHGVTIIRRIDLGEVVM

SEQ ID NO: 648273 - protein, 17 aa, Mycobacterium
DRLRLEAYRRLAAAADA

SEQ ID NO: 648274 - protein, 17 aa, Mycobacterium
DRLRLEAYRRLAAAADD

SEQ ID NO: 648275 - protein, 17 aa, Mycobacterium
DRLRLEAYRRLAAAASD

SEQ ID NO: 648276 - protein, 17 aa, Mycobacterium
DRLRLEAYRRLAAASSD

SEQ ID NO: 648277 - protein, 17 aa, Mycobacterium
DRLRLEAYRRLAAATSD

SEQ ID NO: 648278 - protein, 20 aa, Mycobacterium
DRLRMLRSFDPRAGAHTPDV

SEQ ID NO: 648279 - protein, 20 aa, Mycobacterium
DRLRPGGPAFVGRPGPGRRA

SEQ ID NO: 648280 - protein, 21 aa, Mycobacterium
DRLRPQTRRALIELAAVVAQG

SEQ ID NO: 648281 - protein, 19 aa, Mycobacterium
DRLRQSSWRGLRPDKEASE

SEQ ID NO: 648282 - protein, 19 aa, Mycobacterium
DRLRQSSWRGLRPDKEPSE

SEQ ID NO: 648283 - protein, 19 aa, Mycobacterium
DRLRQSSWRGLRPDKNPSE

SEQ ID NO: 648284 - protein, 24 aa, Mycobacterium
DRLRRFHANLGRGLFGRRIQRSRL

SEQ ID NO: 648285 - protein, 23 aa, Mycobacterium
DRLRRRQMSVGEFIGMVQAGLNH

SEQ ID NO: 648286 - protein, 29 aa, Mycobacterium
DRLRRTSIDAGWLLDYWSDRVYRLLRACV

SEQ ID NO: 648287 - protein, 27 aa, Mycobacterium
DRLRSEAAFAHLCGVAPIPASSGKTHR

SEQ ID NO: 648288 - protein, 18 aa, Mycobacterium
DRLRSVFEAALRRHVDTT

SEQ ID NO: 648289 - protein, 21 aa, Mycobacterium
DRLRVAAAAGCTMFGENKVQE

SEQ ID NO: 648290 - protein, 17 aa, Mycobacterium
DRLRVLLADSARSILST

SEQ ID NO: 648291 - protein, 23 aa, Mycobacterium
DRLRVPLRRVIDFEAAYQEDPGL

SEQ ID NO: 648292 - protein, 30 aa, Mycobacterium
DRLRVRGVDGLRVVDCSVLPTMVAGNLNGP

SEQ ID NO: 648293 - protein, 21 aa, Mycobacterium
DRLRVRYVIVSAVSGAMGGSA

SEQ ID NO: 648294 - protein, 20 aa, Mycobacterium
DRLSACADLLMTTSPNVLVY

SEQ ID NO: 648295 - protein, 21 aa, Mycobacterium
DRLSACADLLMTTSPNVLVYS

SEQ ID NO: 648296 - protein, 17 aa, Mycobacterium
DRLSALVAHLVGADALI

SEQ ID NO: 648297 - protein, 17 aa, Mycobacterium
DRLSALVAHLVGADALV

SEQ ID NO: 648298 - protein, 26 aa, Mycobacterium
DRLSDIALKWVIEGAAEHGLLLNIEK

SEQ ID NO: 648299 - protein, 23 aa, Mycobacterium
DRLSKGRTVWFTGLSGSGKSSVA

SEQ ID NO: 648300 - protein, 22 aa, Mycobacterium
DRLSRLLGRPVRLIAQRPEGAT

SEQ ID NO: 648301 - protein, 20 aa, Mycobacterium
DRLTAEKLPDGWDADVPRWE

SEQ ID NO: 648302 - protein, 21 aa, Mycobacterium
DRLTKMGAVFDAVGGDGQVIV

SEQ ID NO: 648303 - protein, 19 aa, Mycobacterium
DRLTPRGAVAAGIGLVPED

SEQ ID NO: 648304 - protein, 19 aa, Mycobacterium
DRLTVPTGTAWTVFTSARW

SEQ ID NO: 648305 - protein, 26 aa, Mycobacterium
DRLVARIDAKLGFPRRDPHGDPIPAS

SEQ ID NO: 648306 - protein, 30 aa, Mycobacterium
DRLVAVLQRLLPMWDRPLRDVSMLLDGQTD

SEQ ID NO: 648307 - protein, 19 aa, Mycobacterium
DRLVDEWLSVTGLDGQTPV

SEQ ID NO: 648308 - protein, 26 aa, Mycobacterium
DRLVLDFYRCAMLPLSENGGDTGYSD

SEQ ID NO: 648309 - protein, 21 aa, Mycobacterium
DRLVPFVIGVAGSVAVGKSTT

SEQ ID NO: 648310 - protein, 17 aa, Mycobacterium
DRLVPRLDLDELRKIVA

SEQ ID NO: 648311 - protein, 26 aa, Mycobacterium
DRLVSRIDAKLGFPQRDPHGDPIPAT

SEQ ID NO: 648312 - protein, 27 aa, Mycobacterium
DRLVWDDGAGQPWFAGGTVLVLRRIRT

SEQ ID NO: 648313 - protein, 19 aa, Mycobacterium
DRLWIPVRRSWRLNERHYG

SEQ ID NO: 648314 - protein, 18 aa, Mycobacterium
DRMAELPPSTSAQIAEAA

SEQ ID NO: 648315 - protein, 17 aa, Mycobacterium
DRMALLVIAERGVGHAG

SEQ ID NO: 648316 - protein, 22 aa, Mycobacterium
DRMGALALHVAKIARRRHPQHA

SEQ ID NO: 648317 - protein, 22 aa, Mycobacterium
DRMGRRPGARWAADLLAAAEAL

SEQ ID NO: 648318 - protein, 24 aa, Mycobacterium
DRMIGIDATHAWAAVWTPQDPGQF

SEQ ID NO: 648319 - protein, 18 aa, Mycobacterium
DRMIPLAAQRVMAQRAGA

SEQ ID NO: 648320 - protein, 24 aa, Mycobacterium
DRMLASRNTLTWVQKYIFPGGLLP

SEQ ID NO: 648321 - protein, 17 aa, Mycobacterium
DRMLGDILRGWTPDDAR

SEQ ID NO: 648322 - protein, 21 aa, Mycobacterium
DRMPFSVPWTRAPQGELPYNT

SEQ ID NO: 648323 - protein, 18 aa, Mycobacterium
DRMPTGVVYTTFHYPVTG

SEQ ID NO: 648324 - protein, 17 aa, Mycobacterium
DRMPWGNPAIGIRNAIA

SEQ ID NO: 648325 - protein, 18 aa, Mycobacterium
DRMTSAFRSWMAVLELDS

SEQ ID NO: 648326 - protein, 21 aa, Mycobacterium
DRMWSWLPSVWGCRYPLDITP

SEQ ID NO: 648327 - protein, 17 aa, Mycobacterium
DRMYRTGDLVSWGADGQ

SEQ ID NO: 648328 - protein, 21 aa, Mycobacterium
DRNEIALGLGVSRVPIQEALV

SEQ ID NO: 648329 - protein, 17 aa, Mycobacterium
DRNGLDLVREFGIRADP

SEQ ID NO: 648330 - protein, 25 aa, Mycobacterium
DRNIWQCPVVLLADVRSVGVQGDGR

SEQ ID NO: 648331 - protein, 36 aa, Mycobacterium
DRNPEVIRFLAYTGLRWGEMAALRVCDFDMLRRRVN

SEQ ID NO: 648332 - protein, 18 aa, Mycobacterium
DRNRILVEGVNRIKKHTA

SEQ ID NO: 648333 - protein, 20 aa, Mycobacterium
DRNTHCYPMIEDASAFDDID

SEQ ID NO: 648334 - protein, 17 aa, Mycobacterium
DRPAFVGTFDQIVEDVH

SEQ ID NO: 648335 - protein, 24 aa, Mycobacterium
DRPAITYREVRAHREVRWAVVVDG

SEQ ID NO: 648336 - protein, 23 aa, Mycobacterium
DRPALHMVERARSRGKLVPGARI

SEQ ID NO: 648337 - protein, 17 aa, Mycobacterium
DRPALWIVEEDGAETQV

SEQ ID NO: 648338 - protein, 24 aa, Mycobacterium
DRPARAWLFTVARNMIIDERRSAR

SEQ ID NO: 648339 - protein, 19 aa, Mycobacterium
DRPAVIVRRVRDALAASRV

SEQ ID NO: 648340 - protein, 20 aa, Mycobacterium
DRPDALVLDVMMPRLDGLEV

SEQ ID NO: 648341 - protein, 18 aa, Mycobacterium
DRPDAYDVITVFDAIHDQ

SEQ ID NO: 648342 - protein, 18 aa, Mycobacterium
DRPDHRIIAAPMISLADP

SEQ ID NO: 648343 - protein, 24 aa, Mycobacterium
DRPDPRFASLLMDQFGGANGELTA

SEQ ID NO: 648344 - protein, 20 aa, Mycobacterium
DRPDVLVAMNPAALKANIGD

SEQ ID NO: 648345 - protein, 20 aa, Mycobacterium
DRPDVLVAMNPAALKANLGD

SEQ ID NO: 648346 - protein, 18 aa, Mycobacterium
DRPEARWDEARQWLDERG

SEQ ID NO: 648347 - protein, 21 aa, Mycobacterium
DRPEDRWPEAREWLGQRGYDS

SEQ ID NO: 648348 - protein, 21 aa, Mycobacterium
DRPEFKRYWIDDTPQLRYAVP

SEQ ID NO: 648349 - protein, 21 aa, Mycobacterium
DRPELAALLDYARRGDVLMVW

SEQ ID NO: 648350 - protein, 19 aa, Mycobacterium
DRPEQRWPEAKEWLSERGY

SEQ ID NO: 648351 - protein, 24 aa, Mycobacterium
DRPGCLRAHGRPTKSAGKTFVGTL

SEQ ID NO: 648352 - protein, 20 aa, Mycobacterium
DRPGGWVGLARLRGEVPDLP

SEQ ID NO: 648353 - protein, 24 aa, Mycobacterium
DRPGHSPNVLPFPDDWHGTGDNPY

SEQ ID NO: 648354 - protein, 28 aa, Mycobacterium
DRPGKAKALRQFAYEAGVPLAQTVAVGD

SEQ ID NO: 648355 - protein, 21 aa, Mycobacterium
DRPGLKDPPFVPATPSAFGER

SEQ ID NO: 648356 - protein, 17 aa, Mycobacterium
DRPGQDVLLQSMAGIAS

SEQ ID NO: 648357 - protein, 17 aa, Mycobacterium
DRPGYKRLVAYVTGTAD

SEQ ID NO: 648358 - protein, 20 aa, Mycobacterium
DRPHACLMTGTPFTNTLAEG

SEQ ID NO: 648359 - protein, 17 aa, Mycobacterium
DRPHARNAIALDTMQQL

SEQ ID NO: 648360 - protein, 21 aa, Mycobacterium
DRPHARNAIGLDTMDQLEKAL

SEQ ID NO: 648361 - protein, 19 aa, Mycobacterium
DRPIPSWLQVVGERQRILI

SEQ ID NO: 648362 - protein, 18 aa, Mycobacterium
DRPIYSRPLAAAMRRADG

SEQ ID NO: 648363 - protein, 29 aa, Mycobacterium
DRPLARFGSWYEMFPRSTGGWDADGKPVH

SEQ ID NO: 648364 - protein, 29 aa, Mycobacterium
DRPLARFGSWYEMFPRSTGGWDADGNPVH

SEQ ID NO: 648365 - protein, 25 aa, Mycobacterium
DRPLHHFPTRRMCNLASVTSFYFHD

SEQ ID NO: 648366 - protein, 20 aa, Mycobacterium
DRPLLLEGPAGVGKTELAKA

SEQ ID NO: 648367 - protein, 18 aa, Mycobacterium
DRPLVVFVGRITRQKGVA

SEQ ID NO: 648368 - protein, 24 aa, Mycobacterium
DRPMEFLGNLLLLIVGGNDTTRNS

SEQ ID NO: 648369 - protein, 18 aa, Mycobacterium
DRPMEFLGNLVLLIVGGN

SEQ ID NO: 648370 - protein, 19 aa, Mycobacterium
DRPMILKRFVKGIDEEAVF

SEQ ID NO: 648371 - protein, 23 aa, Mycobacterium
DRPPTGDVCRLDLPSRDVILTAL

SEQ ID NO: 648372 - protein, 22 aa, Mycobacterium
DRPPVRVGVSLADTVSGLYAVI

SEQ ID NO: 648373 - protein, 23 aa, Mycobacterium
DRPQWRGASGADMIRHVRGLVEN

SEQ ID NO: 648374 - protein, 18 aa, Mycobacterium
DRPREDHGFFGPDSPTWK

SEQ ID NO: 648375 - protein, 26 aa, Mycobacterium
DRPRFMVFGEIALRAHALAAKPLLLI

SEQ ID NO: 648376 - protein, 22 aa, Mycobacterium
DRPRGMSYLVVQGRRGGSAMAA

SEQ ID NO: 648377 - protein, 22 aa, Mycobacterium
DRPRGMSYLVVRGRRGGSAMAA

SEQ ID NO: 648378 - protein, 23 aa, Mycobacterium
DRPRGRTVWFTGLSGAGKSSVAT

SEQ ID NO: 648379 - protein, 20 aa, Mycobacterium
DRPRPTVIFNGGYDSTLEES

SEQ ID NO: 648380 - protein, 22 aa, Mycobacterium
DRPRRAGVSSFGISGTNAHVII

SEQ ID NO: 648381 - protein, 21 aa, Mycobacterium
DRPSSRFAVLIRRAAERVAQQ

SEQ ID NO: 648382 - protein, 23 aa, Mycobacterium
DRPTAWAAEGLFGYLPPDAQDRL

SEQ ID NO: 648383 - protein, 20 aa, Mycobacterium
DRPTIVFADGLFAFLDEDAV

SEQ ID NO: 648384 - protein, 23 aa, Mycobacterium
DRPTLPLTPFIDGWETVAEMEAA

SEQ ID NO: 648385 - protein, 22 aa, Mycobacterium
DRPTTFELFARRLPEGRRYGVV

SEQ ID NO: 648386 - protein, 31 aa, Mycobacterium
DRPVARFGAWYEMFPRSTGGWDDDGKPVHGT

SEQ ID NO: 648387 - protein, 17 aa, Mycobacterium
DRPVQRLLAAGLLQRID

SEQ ID NO: 648388 - protein, 26 aa, Mycobacterium
DRPVRRLMAVSARAGIVVTGTEVLTG

SEQ ID NO: 648389 - protein, 19 aa, Mycobacterium
DRPVSVLDVRWRLDAPDGR

SEQ ID NO: 648390 - protein, 21 aa, Mycobacterium
DRPVWVGDFWDMFAAGHLLEL

SEQ ID NO: 648391 - protein, 23 aa, Mycobacterium
DRPVYICGPGPFMDAAREALESL

SEQ ID NO: 648392 - protein, 23 aa, Mycobacterium
DRPYSRWERWVFAHVPFAARLYR

SEQ ID NO: 648393 - protein, 21 aa, Mycobacterium
DRQAETWWRRINGLPSAKPDQ

SEQ ID NO: 648394 - protein, 27 aa, Mycobacterium
DRQGRALDDFATWCALAERYGDDWHRW

SEQ ID NO: 648395 - protein, 18 aa, Mycobacterium
DRQGWRMLYDRSPAGSPR

SEQ ID NO: 648396 - protein, 18 aa, Mycobacterium
DRQLARLAERIAAKHTEL

SEQ ID NO: 648397 - protein, 20 aa, Mycobacterium
DRQLEAIAAAGRRTGNPPWV

SEQ ID NO: 648398 - protein, 21 aa, Mycobacterium
DRQLNCCLHTMAITQIARDTP

SEQ ID NO: 648399 - protein, 24 aa, Mycobacterium
DRQLVLGAIGEWIARPTSQVAALR

SEQ ID NO: 648400 - protein, 18 aa, Mycobacterium
DRQNRRGALVACRVIAGA

SEQ ID NO: 648401 - protein, 26 aa, Mycobacterium
DRQRCLEWFATIPLWLDLGELRVVHA

SEQ ID NO: 648402 - protein, 18 aa, Mycobacterium
DRQRCLSHELLIEPEAAD

SEQ ID NO: 648403 - protein, 19 aa, Mycobacterium
DRQRLLGALQVAARGIGRL

SEQ ID NO: 648404 - protein, 17 aa, Mycobacterium
DRQRVAIRAELRRAAYR

SEQ ID NO: 648405 - protein, 19 aa, Mycobacterium
DRQSLSWTLESSSLLKSLE

SEQ ID NO: 648406 - protein, 25 aa, Mycobacterium
DRQWAVCVYCASGPTHPELLELAAE

SEQ ID NO: 648407 - protein, 23 aa, Mycobacterium
DRRAEVVSGLAIVSAVSRAWGAA

SEQ ID NO: 648408 - protein, 19 aa, Mycobacterium
DRRAIAMGRRGRPAEVAGA

SEQ ID NO: 648409 - protein, 22 aa, Mycobacterium
DRRAIFKVFRRVSSGISPDIEL

SEQ ID NO: 648410 - protein, 19 aa, Mycobacterium
DRRALLAAVGKAWEYGVDI

SEQ ID NO: 648411 - protein, 18 aa, Mycobacterium
DRRARAGDRPGLSGGQFA

SEQ ID NO: 648412 - protein, 21 aa, Mycobacterium
DRRAREEWLARTIQERYTEAE

SEQ ID NO: 648413 - protein, 25 aa, Mycobacterium
DRRATSAAVGIIWPSILFPDDDPAT

SEQ ID NO: 648414 - protein, 29 aa, Mycobacterium
DRRATSHWLTIPALKAFGAIPVADKRIVQ

SEQ ID NO: 648415 - protein, 17 aa, Mycobacterium
DRRAVIVCFDRDTNGTY

SEQ ID NO: 648416 - protein, 18 aa, Mycobacterium
DRRAVVCRELTKTHEEIV

SEQ ID NO: 648417 - protein, 17 aa, Mycobacterium
DRRERGTGELLLKKIWL

SEQ ID NO: 648418 - protein, 21 aa, Mycobacterium
DRREVAIDFVVHGDTGVAGPW

SEQ ID NO: 648419 - protein, 23 aa, Mycobacterium
DRREVRTALVPDIFGGNMDTPEM

SEQ ID NO: 648420 - protein, 25 aa, Mycobacterium
DRRFTRTRLRAEVLPLLEEVLGGGV

SEQ ID NO: 648421 - protein, 25 aa, Mycobacterium
DRRFTRTRLRQEVLPLLEEVLGGGV

SEQ ID NO: 648422 - protein, 23 aa, Mycobacterium
DRRGEVLAALGPATPRVIGVTGP

SEQ ID NO: 648423 - protein, 27 aa, Mycobacterium
DRRGGTALRFIRSCSAPLTAETAQALQ

SEQ ID NO: 648424 - protein, 23 aa, Mycobacterium
DRRGHVRGFPLGPGYLLEGRPVI

SEQ ID NO: 648425 - protein, 18 aa, Mycobacterium
DRRHRRPYGLERFLHNTW

SEQ ID NO: 648426 - protein, 22 aa, Mycobacterium
DRRIAHVMIPSMIVEDGDRPLE

SEQ ID NO: 648427 - protein, 22 aa, Mycobacterium
DRRKRLMPMFGKRHLSVVSDKF

SEQ ID NO: 648428 - protein, 31 aa, Mycobacterium
DRRKVPGGWWPPLMLEPGWVGAHHDLFDVFH

SEQ ID NO: 648429 - protein, 19 aa, Mycobacterium
DRRLLKRSEIAQLTVVGSH

SEQ ID NO: 648430 - protein, 19 aa, Mycobacterium
DRRLNCVEQTYLKQYCALI

SEQ ID NO: 648431 - protein, 19 aa, Mycobacterium
DRRLPELPTDLSGRDREDD

SEQ ID NO: 648432 - protein, 22 aa, Mycobacterium
DRRPEVFRDIRAIVSPQPVSLR

SEQ ID NO: 648433 - protein, 22 aa, Mycobacterium
DRRPFRAPSEWASLESVLRSSF

SEQ ID NO: 648434 - protein, 32 aa, Mycobacterium
DRRQWWIDRIRACYPLLYRRSGDQPGLRRQRD

SEQ ID NO: 648435 - protein, 22 aa, Mycobacterium
DRRRAGHVISCYIEAGQPVTLE

SEQ ID NO: 648436 - protein, 17 aa, Mycobacterium
DRRRASSQQGRWNTAPE

SEQ ID NO: 648437 - protein, 17 aa, Mycobacterium
DRRRGKLVGALIVDDDS

SEQ ID NO: 648438 - protein, 19 aa, Mycobacterium
DRRRGRLVGALIADDDSEL

SEQ ID NO: 648439 - protein, 23 aa, Mycobacterium
DRRRIWPRRLITPGEAVAEYLFR

SEQ ID NO: 648440 - protein, 25 aa, Mycobacterium
DRRRLSLDLLDRWGTDLLEALVSLD

SEQ ID NO: 648441 - protein, 18 aa, Mycobacterium
DRRSFLIRIGKPGRAFLR

SEQ ID NO: 648442 - protein, 29 aa, Mycobacterium
DRRSGGRLVDSWAGASLVRVGPRGYRDLI

SEQ ID NO: 648443 - protein, 18 aa, Mycobacterium
DRRSVRWYTTTGLVDRPV

SEQ ID NO: 648444 - protein, 23 aa, Mycobacterium
DRRTEGRFALYSLADAAADAAPL

SEQ ID NO: 648445 - protein, 18 aa, Mycobacterium
DRRTRIGLVARDRVRAES

SEQ ID NO: 648446 - protein, 18 aa, Mycobacterium
DRRTRIGLVESDRERVLA

SEQ ID NO: 648447 - protein, 19 aa, Mycobacterium
DRRTVAVDLRDDWPAALKE

SEQ ID NO: 648448 - protein, 20 aa, Mycobacterium
DRRVDGVAAIWYGKSPGLDR

SEQ ID NO: 648449 - protein, 20 aa, Mycobacterium
DRRVLEFGGRLYTAKDSRTT

SEQ ID NO: 648450 - protein, 21 aa, Mycobacterium
DRRVLEFGGRLYTAKDSRTTA

SEQ ID NO: 648451 - protein, 25 aa, Mycobacterium
DRRVNLDAGCDWTRTREQLLDIPGV

SEQ ID NO: 648452 - protein, 25 aa, Mycobacterium
DRRVRIVSQLAWPGRTEEEFVACIE

SEQ ID NO: 648453 - protein, 23 aa, Mycobacterium
DRRVRIVSQLAWPGRTEEELVAC

SEQ ID NO: 648454 - protein, 18 aa, Mycobacterium
DRRVRVLEQMWLNALWGG

SEQ ID NO: 648455 - protein, 21 aa, Mycobacterium
DRRVVAALGPRVLKLSAERSA

SEQ ID NO: 648456 - protein, 27 aa, Mycobacterium
DRSAITFKGRNMWGLVNVKGRFTDFTG

SEQ ID NO: 648457 - protein, 19 aa, Mycobacterium
DRSDLIGVMRQGRIVELGP

SEQ ID NO: 648458 - protein, 24 aa, Mycobacterium
DRSDSRPAAAFLAARLTASTLEKR

SEQ ID NO: 648459 - protein, 20 aa, Mycobacterium
DRSFRLLRRGGRLVTLSAPP

SEQ ID NO: 648460 - protein, 18 aa, Mycobacterium
DRSGAALTGPATFAALTA

SEQ ID NO: 648461 - protein, 24 aa, Mycobacterium
DRSGFVFGEAGALMVIETEEHAKA

SEQ ID NO: 648462 - protein, 21 aa, Mycobacterium
DRSGIPMAIFGDRLGLARRYA

SEQ ID NO: 648463 - protein, 18 aa, Mycobacterium
DRSGMAWCISAFGRDEMV

SEQ ID NO: 648464 - protein, 19 aa, Mycobacterium
DRSGMAWCISNFGREEMLQ

SEQ ID NO: 648465 - protein, 18 aa, Mycobacterium
DRSGMAWCISSFGRDEMV

SEQ ID NO: 648466 - protein, 17 aa, Mycobacterium
DRSGRLLVCRGGADGAW

SEQ ID NO: 648467 - protein, 21 aa, Mycobacterium
DRSGSMGGWKMVAARRAAGRI

SEQ ID NO: 648468 - protein, 20 aa, Mycobacterium
DRSIRAAFLAAHRRSAQRLG

SEQ ID NO: 648469 - protein, 20 aa, Mycobacterium
DRSISTSFAKRGHDASAPLI

SEQ ID NO: 648470 - protein, 24 aa, Mycobacterium
DRSKPLWELWFIEGLEGGRVAVVT

SEQ ID NO: 648471 - protein, 25 aa, Mycobacterium
DRSKRSVVEIGDYVGAYFLDDRAAV

SEQ ID NO: 648472 - protein, 19 aa, Mycobacterium
DRSLITGGFRVRFAEPAET

SEQ ID NO: 648473 - protein, 18 aa, Mycobacterium
DRSLLEIFDEGRLSDLDG

SEQ ID NO: 648474 - protein, 18 aa, Mycobacterium
DRSLPPIPCYPGDLNQVW

SEQ ID NO: 648475 - protein, 17 aa, Mycobacterium
DRSNCFIFADGAASVLV

SEQ ID NO: 648476 - protein, 24 aa, Mycobacterium
DRSPRARVIFVDYLSLLPPEGQPA

SEQ ID NO: 648477 - protein, 18 aa, Mycobacterium
DRSPTWEVLADRVDRASR

SEQ ID NO: 648478 - protein, 19 aa, Mycobacterium
DRSQVPWDQRWTRPQYRSD

SEQ ID NO: 648479 - protein, 18 aa, Mycobacterium
DRSRAVVWVSGRGTAATA

SEQ ID NO: 648480 - protein, 20 aa, Mycobacterium
DRSRPVLRAVDYLRSQGYHE

SEQ ID NO: 648481 - protein, 21 aa, Mycobacterium
DRSRRLGRLFAAVAGQHGPDA

SEQ ID NO: 648482 - protein, 24 aa, Mycobacterium
DRSRVPQSLPFFVQEACRQWELPA

SEQ ID NO: 648483 - protein, 23 aa, Mycobacterium
DRSRWNTDACSIGKALDLLSTKT

SEQ ID NO: 648484 - protein, 23 aa, Mycobacterium
DRSSIELMLQLLLDGHDTLRSIL

SEQ ID NO: 648485 - protein, 21 aa, Mycobacterium
DRSTALVTMCAGGALSTGTII

SEQ ID NO: 648486 - protein, 20 aa, Mycobacterium
DRSVGYAVLANWAWGQDHRD

SEQ ID NO: 648487 - protein, 26 aa, Mycobacterium
DRSWNRPRWTIGELVAAKAGRTISVV

SEQ ID NO: 648488 - protein, 25 aa, Mycobacterium
DRSWTYRQVETFANRLARLLISQGA

SEQ ID NO: 648489 - protein, 23 aa, Mycobacterium
DRSYTADHEWIDIAPGAATPDGP

SEQ ID NO: 648490 - protein, 25 aa, Mycobacterium
DRSYYPWGIPRQFSAVLGSGSLLGY

SEQ ID NO: 648491 - protein, 26 aa, Mycobacterium
DRTACIKAMIEKVVERMYAEIDDNRF

SEQ ID NO: 648492 - protein, 20 aa, Mycobacterium
DRTAEAWGEHGAVMRAAVEL

SEQ ID NO: 648493 - protein, 20 aa, Mycobacterium
DRTDALGIRVLRYGSTGDNL

SEQ ID NO: 648494 - protein, 23 aa, Mycobacterium
DRTDIYIRWGLHHLASESPRVLG

SEQ ID NO: 648495 - protein, 18 aa, Mycobacterium
DRTDVVWLEHEENRGSPR

SEQ ID NO: 648496 - protein, 17 aa, Mycobacterium
DRTEWRDRVEVVRGDLT

SEQ ID NO: 648497 - protein, 22 aa, Mycobacterium
DRTGFVFGEAGALMVIETEEHA

SEQ ID NO: 648498 - protein, 23 aa, Mycobacterium
DRTGLDHIAFRVGSRAELDVAAT

SEQ ID NO: 648499 - protein, 25 aa, Mycobacterium
DRTGLWGRLFPEWDAVRDLPPRDVS

SEQ ID NO: 648500 - protein, 24 aa, Mycobacterium
DRTGLWGRLFPEWGAVRDLPPRDV

SEQ ID NO: 648501 - protein, 25 aa, Mycobacterium
DRTGLWGRLFPEWGAVRDLPPRDVV

SEQ ID NO: 648502 - protein, 26 aa, Mycobacterium
DRTGLWGRLFPEWGPVRDLPPRDIVH

SEQ ID NO: 648503 - protein, 25 aa, Mycobacterium
DRTGLWGRLLPEWDAIRDLPPRDVA

SEQ ID NO: 648504 - protein, 26 aa, Mycobacterium
DRTGLWGRLLPEWGAIRDLPPRDVAH

SEQ ID NO: 648505 - protein, 25 aa, Mycobacterium
DRTGLWGRLLPEWGSIRDLPPRDVA

SEQ ID NO: 648506 - protein, 19 aa, Mycobacterium
DRTGRIGNVVLGFPTLAGY

SEQ ID NO: 648507 - protein, 28 aa, Mycobacterium
DRTLARRPAWLAACAEVGAGAAPGSAAA

SEQ ID NO: 648508 - protein, 17 aa, Mycobacterium
DRTLAVLAALPAWSGRP

SEQ ID NO: 648509 - protein, 24 aa, Mycobacterium
DRTPGGILKHSSWRGLRTDKSVRD

SEQ ID NO: 648510 - protein, 18 aa, Mycobacterium
DRTPVFYCKTGVRSAEVL

SEQ ID NO: 648511 - protein, 22 aa, Mycobacterium
DRTPVRSIMSFRLFGSDKALAA

SEQ ID NO: 648512 - protein, 21 aa, Mycobacterium
DRTQFDLGWNRLGMIGKTATA

SEQ ID NO: 648513 - protein, 22 aa, Mycobacterium
DRTRFARCLIEQVRAEIGANRI

SEQ ID NO: 648514 - protein, 19 aa, Mycobacterium
DRTRLLADHLWQGDELMDA

SEQ ID NO: 648515 - protein, 24 aa, Mycobacterium
DRTRPLRAVGTCHGAGPTGSPGPA

SEQ ID NO: 648516 - protein, 17 aa, Mycobacterium
DRTRQPFQQVIKDAGIS

SEQ ID NO: 648517 - protein, 19 aa, Mycobacterium
DRTRVVACLHSLARRVGVQ

SEQ ID NO: 648518 - protein, 22 aa, Mycobacterium
DRTSYEFAICSAAVALDIQGST

SEQ ID NO: 648519 - protein, 22 aa, Mycobacterium
DRTVGICPMPIAYVKYDVESGE

SEQ ID NO: 648520 - protein, 23 aa, Mycobacterium
DRTVRRFALRKVLRNIDLAIELG

SEQ ID NO: 648521 - protein, 22 aa, Mycobacterium
DRTYEMHHLWTGQDFGDRLPSE

SEQ ID NO: 648522 - protein, 25 aa, Mycobacterium
DRTYIHSLDWLWLNDILHSVEAECW

SEQ ID NO: 648523 - protein, 17 aa, Mycobacterium
DRTYRELMRQAPMVLGE

SEQ ID NO: 648524 - protein, 21 aa, Mycobacterium
DRTYVNIGFWSSVPVGATEGA

SEQ ID NO: 648525 - protein, 19 aa, Mycobacterium
DRVAALLPHCARAESECFD

SEQ ID NO: 648526 - protein, 25 aa, Mycobacterium
DRVADAWIKAQAYRLHTFGTVTRLA

SEQ ID NO: 648527 - protein, 24 aa, Mycobacterium
DRVADAWIKAQAYRLHTFGTVTRV

SEQ ID NO: 648528 - protein, 27 aa, Mycobacterium
DRVAELGRAYVRWAVAHPDHYRVMFGA

SEQ ID NO: 648529 - protein, 23 aa, Mycobacterium
DRVAELLDIVGLRRSDASRYPAE

SEQ ID NO: 648530 - protein, 20 aa, Mycobacterium
DRVAEMAPWLAARTNAIASW

SEQ ID NO: 648531 - protein, 20 aa, Mycobacterium
DRVAEVWATPVERLGAALLQ

SEQ ID NO: 648532 - protein, 18 aa, Mycobacterium
DRVAIHWEGEPGDSRSLT

SEQ ID NO: 648533 - protein, 18 aa, Mycobacterium
DRVAIHWEGEPGDTRTIT

SEQ ID NO: 648534 - protein, 18 aa, Mycobacterium
DRVAIHWEGEPTDHRRTL

SEQ ID NO: 648535 - protein, 18 aa, Mycobacterium
DRVAIHWEGEPVGDARSI

SEQ ID NO: 648536 - protein, 25 aa, Mycobacterium
DRVAIWSPNTWHWVVACLAIHHAGA

SEQ ID NO: 648537 - protein, 20 aa, Mycobacterium
DRVALVWRAYLQEVLESADP

SEQ ID NO: 648538 - protein, 20 aa, Mycobacterium
DRVATWLAALGVGKGDRVIL

SEQ ID NO: 648539 - protein, 33 aa, Mycobacterium
DRVAVGWFGGCCYHCDQCRKGLFIHCANGKVPS

SEQ ID NO: 648540 - protein, 17 aa, Mycobacterium
DRVAVWHGDCAALHALF

SEQ ID NO: 648541 - protein, 25 aa, Mycobacterium
DRVAVWSPNTWHWVVACLAIHHAGA

SEQ ID NO: 648542 - protein, 19 aa, Mycobacterium
DRVDAFRGLYAWSGLERSD

SEQ ID NO: 648543 - protein, 17 aa, Mycobacterium
DRVDIGRTFPVVAERAS

SEQ ID NO: 648544 - protein, 17 aa, Mycobacterium
DRVDPRFADAPPIPAEI

SEQ ID NO: 648545 - protein, 17 aa, Mycobacterium
DRVDRCELFDEADLDAA

SEQ ID NO: 648546 - protein, 19 aa, Mycobacterium
DRVEAIRLALAINKVLVFT

SEQ ID NO: 648547 - protein, 17 aa, Mycobacterium
DRVEVVAPARARAAVLA

SEQ ID NO: 648548 - protein, 20 aa, Mycobacterium
DRVFPGSIVLFTHRDPVPVA

SEQ ID NO: 648549 - protein, 18 aa, Mycobacterium
DRVFPRASFDEGWQSIAR

SEQ ID NO: 648550 - protein, 17 aa, Mycobacterium
DRVFVRRVLEDVVLPLA

SEQ ID NO: 648551 - protein, 26 aa, Mycobacterium
DRVGADWPISYADLRPHYERLELELP

SEQ ID NO: 648552 - protein, 19 aa, Mycobacterium
DRVGARPGRCVVITADAAS

SEQ ID NO: 648553 - protein, 17 aa, Mycobacterium
DRVGCVLGGTSAEKFTD

SEQ ID NO: 648554 - protein, 24 aa, Mycobacterium
DRVGGFSKDGCWRSYLTCDANLAV

SEQ ID NO: 648555 - protein, 25 aa, Mycobacterium
DRVGIWAPNCAEWVLVQYATAKIGA

SEQ ID NO: 648556 - protein, 25 aa, Mycobacterium
DRVGIWAPNRWEWVLVQYATAEIGA

SEQ ID NO: 648557 - protein, 28 aa, Mycobacterium
DRVGTPWRLTWYRGMAALLNGDYDQATK

SEQ ID NO: 648558 - protein, 19 aa, Mycobacterium
DRVGWPFSLAYPNLATHNH

SEQ ID NO: 648559 - protein, 25 aa, Mycobacterium
DRVHFARTELVNWTLVTGDDGVLLI

SEQ ID NO: 648560 - protein, 31 aa, Mycobacterium
DRVHLFTGDCLFPGGVGKTWKEGDFEQLLGD

SEQ ID NO: 648561 - protein, 26 aa, Mycobacterium
DRVIKEALRLLAPVPLVMRKTVRDVA

SEQ ID NO: 648562 - protein, 17 aa, Mycobacterium
DRVIPVFELVTNNSTAA

SEQ ID NO: 648563 - protein, 24 aa, Mycobacterium
DRVKRGSCFAPFHWNDAHGPGLTI

SEQ ID NO: 648564 - protein, 22 aa, Mycobacterium
DRVKSRLSAVARERDRQRRAAA

SEQ ID NO: 648565 - protein, 25 aa, Mycobacterium
DRVKTWLQFPQWFYLNIPVNTMVAP

SEQ ID NO: 648566 - protein, 18 aa, Mycobacterium
DRVLEHWLASARRDDEAR

SEQ ID NO: 648567 - protein, 21 aa, Mycobacterium
DRVLFDAGLSVITWPQKYGGR

SEQ ID NO: 648568 - protein, 26 aa, Mycobacterium
DRVLPDRPGLFFAIDAHSMWANTAAL

SEQ ID NO: 648569 - protein, 24 aa, Mycobacterium
DRVLRSGLFGPWDRPAPITDLEEL

SEQ ID NO: 648570 - protein, 24 aa, Mycobacterium
DRVLRSGLFGPWDRPDVINELGEL

SEQ ID NO: 648571 - protein, 19 aa, Mycobacterium
DRVLSLKSPFHAAVTVPTA

SEQ ID NO: 648572 - protein, 24 aa, Mycobacterium
DRVLTMTYLDGMDWAAAQDAEQEL

SEQ ID NO: 648573 - protein, 27 aa, Mycobacterium
DRVNASGMVPLKWISARNFGCDGEPLP

SEQ ID NO: 648574 - protein, 24 aa, Mycobacterium
DRVPDAFAGVPCVISGRYRGPAAD

SEQ ID NO: 648575 - protein, 19 aa, Mycobacterium
DRVPERLVIITVDVADIGH

SEQ ID NO: 648576 - protein, 20 aa, Mycobacterium
DRVQVPVLLVGGWQDVFVQQ

SEQ ID NO: 648577 - protein, 18 aa, Mycobacterium
DRVRARWAQIINDSGGVM

SEQ ID NO: 648578 - protein, 23 aa, Mycobacterium
DRVREVAAFIPGAMRGITSERQL

SEQ ID NO: 648579 - protein, 17 aa, Mycobacterium
DRVRPFRPFQVNADLLE

SEQ ID NO: 648580 - protein, 18 aa, Mycobacterium
DRVRRWVRDRLDRPPPDA

SEQ ID NO: 648581 - protein, 19 aa, Mycobacterium
DRVSACRKLADTFGATVLL

SEQ ID NO: 648582 - protein, 21 aa, Mycobacterium
DRVSIVATMCERGHADKMVLS

SEQ ID NO: 648583 - protein, 24 aa, Mycobacterium
DRVSRCAIGLLGLGATPKRATATE

SEQ ID NO: 648584 - protein, 18 aa, Mycobacterium
DRVTEFRAQGIIVDVTAV

SEQ ID NO: 648585 - protein, 22 aa, Mycobacterium
DRVTGWGWIPLRVNDAGLAERV

SEQ ID NO: 648586 - protein, 26 aa, Mycobacterium
DRVTQAAVAWVLLTVFARYCEDNALL

SEQ ID NO: 648587 - protein, 22 aa, Mycobacterium
DRVTRCGIGLLGLGSTPLRATA

SEQ ID NO: 648588 - protein, 35 aa, Mycobacterium
DRVTRLAGALNRRGVGFGDRVLILMLNRTEFVEAM

SEQ ID NO: 648589 - protein, 26 aa, Mycobacterium
DRVVALPELLRDAGYLTLMSGKWHLG

SEQ ID NO: 648590 - protein, 17 aa, Mycobacterium
DRVVLGLNYHQIVADDW

SEQ ID NO: 648591 - protein, 20 aa, Mycobacterium
DRVVQILDFLASRPTERYGV

SEQ ID NO: 648592 - protein, 24 aa, Mycobacterium
DRVVTVSSMMHWIGRINLRDLNWK

SEQ ID NO: 648593 - protein, 17 aa, Mycobacterium
DRVWELETYGALFDRTK

SEQ ID NO: 648594 - protein, 20 aa, Mycobacterium
DRVYRLAYRLSGSQQDAEDL

SEQ ID NO: 648595 - protein, 20 aa, Mycobacterium
DRWAILMKIHHCIADGIAAA

SEQ ID NO: 648596 - protein, 25 aa, Mycobacterium
DRWAYLPALEQVAAWHWSLNHPDAS

SEQ ID NO: 648597 - protein, 30 aa, Mycobacterium
DRWGGDAQRRMRFVLEIVRRTKAAVSPGFA

SEQ ID NO: 648598 - protein, 25 aa, Mycobacterium
DRWHSLARLAIRDDIYGSLRALCFD

SEQ ID NO: 648599 - protein, 25 aa, Mycobacterium
DRWHSLARLAIRDDIYSSLRALTMD

SEQ ID NO: 648600 - protein, 19 aa, Mycobacterium
DRWLDLRYIGPASAEGSGE

SEQ ID NO: 648601 - protein, 21 aa, Mycobacterium
DRWMQGTVWLTRCSSYFRAPN

SEQ ID NO: 648602 - protein, 25 aa, Mycobacterium
DRWQALARLAIRDDIYASLRALCFD

SEQ ID NO: 648603 - protein, 21 aa, Mycobacterium
DRWRAAVAGGEIPGFVCRAVA

SEQ ID NO: 648604 - protein, 18 aa, Mycobacterium
DRWRAHGFDLDFTELVFL

SEQ ID NO: 648605 - protein, 21 aa, Mycobacterium
DRWREIMAAVVGVARAGATAA

SEQ ID NO: 648606 - protein, 22 aa, Mycobacterium
DRWREIMSAVVGVARAGATAAE

SEQ ID NO: 648607 - protein, 19 aa, Mycobacterium
DRWREIVDAVLSVTKAGAT

SEQ ID NO: 648608 - protein, 18 aa, Mycobacterium
DRWRRWSRDWPVRELAPA

SEQ ID NO: 648609 - protein, 29 aa, Mycobacterium
DRWVAACAIAKRLDLLAGDAIYQGAPNLV

SEQ ID NO: 648610 - protein, 20 aa, Mycobacterium
DRYAFEHVQVLTADPRQALT

SEQ ID NO: 648611 - protein, 24 aa, Mycobacterium
DRYAGKFDAGWEAYRQRVFTRQRE

SEQ ID NO: 648612 - protein, 19 aa, Mycobacterium
DRYASGAARDIVQRALDLG

SEQ ID NO: 648613 - protein, 20 aa, Mycobacterium
DRYEFSVACEGLYHFAWDEF

SEQ ID NO: 648614 - protein, 17 aa, Mycobacterium
DRYEVHHGVRITDSALV

SEQ ID NO: 648615 - protein, 24 aa, Mycobacterium
DRYGEAVGQLANWLASGELRAREQ

SEQ ID NO: 648616 - protein, 17 aa, Mycobacterium
DRYGQRLEQMYADIAAT

SEQ ID NO: 648617 - protein, 20 aa, Mycobacterium
DRYGYDHLFGCITVPTHPLG

SEQ ID NO: 648618 - protein, 20 aa, Mycobacterium
DRYGYDYVTGCVSVPIGGEP

SEQ ID NO: 648619 - protein, 19 aa, Mycobacterium
DRYLAGSSAMEWEYLLVTA

SEQ ID NO: 648620 - protein, 20 aa, Mycobacterium
DRYLEVWNLVFMQNERGEGT

SEQ ID NO: 648621 - protein, 18 aa, Mycobacterium
DRYLGLWYEIGRLPLRWE

SEQ ID NO: 648622 - protein, 24 aa, Mycobacterium
DRYPNNHLAFGFGTHFCLGNQLAR

SEQ ID NO: 648623 - protein, 22 aa, Mycobacterium
DRYPWLESIGEWLADHPDGGVM

SEQ ID NO: 648624 - protein, 22 aa, Mycobacterium
DRYRCTHCDTTLVYEVACSCAE

SEQ ID NO: 648625 - protein, 22 aa, Mycobacterium
DRYRVRWIPQRAVKGVYYGTPI

SEQ ID NO: 648626 - protein, 17 aa, Mycobacterium
DRYSRYRLSGAEREQLY

SEQ ID NO: 648627 - protein, 22 aa, Mycobacterium
DRYTQLFARNARIWDWPATGES

SEQ ID NO: 648628 - protein, 21 aa, Mycobacterium
DRYVDCAPLEPGMALVNGQVF

SEQ ID NO: 648629 - protein, 20 aa, Mycobacterium
DRYVPVLTDLRLRYLDNHDF

SEQ ID NO: 648630 - protein, 20 aa, Mycobacterium
DRYVPVLTELRLRYLDDHDW

SEQ ID NO: 648631 - protein, 20 aa, Mycobacterium
DRYVPVLTELRMRYLDDATW

SEQ ID NO: 648632 - protein, 33 aa, Mycobacterium
DRYVRAGKWVRDGPFPYARDVSGLQVGILGLGR

SEQ ID NO: 648633 - protein, 22 aa, Mycobacterium
DRYWPAHSTIALTVGQATSEIK

SEQ ID NO: 648634 - protein, 17 aa, Mycobacterium
DRYWRRYFDNFAEVLSG

SEQ ID NO: 648635 - protein, 17 aa, Mycobacterium
DRYWRRYFDNFAEVMAS

SEQ ID NO: 648636 - protein, 24 aa, Mycobacterium
DRYWRRYFDNFAEVMSSASRVGAD

SEQ ID NO: 648637 - protein, 17 aa, Mycobacterium
DSAAALRDWLVLGQWEN

SEQ ID NO: 648638 - protein, 18 aa, Mycobacterium
DSAAQAWLGPVPDEAEGL

SEQ ID NO: 648639 - protein, 17 aa, Mycobacterium
DSAAYAMPGYDGGSQIT

SEQ ID NO: 648640 - protein, 34 aa, Mycobacterium
DSAEFKSAASIALSWRLPVVFVVENIRDGSGVRR

SEQ ID NO: 648641 - protein, 28 aa, Mycobacterium
DSAEGRVAALRRCVPMLARIKDPTLRDE

SEQ ID NO: 648642 - protein, 25 aa, Mycobacterium
DSAELPLFRYIGGPNAHIMPVPMMN

SEQ ID NO: 648643 - protein, 23 aa, Mycobacterium
DSAELPLFRYLGGPNAHILPVPM

SEQ ID NO: 648644 - protein, 18 aa, Mycobacterium
DSAEMQRDLLAAGVPVDD

SEQ ID NO: 648645 - protein, 20 aa, Mycobacterium
DSAFDSYEFSRACEALYHFA

SEQ ID NO: 648646 - protein, 21 aa, Mycobacterium
DSAFDSYEFSRACEALYHFAW

SEQ ID NO: 648647 - protein, 21 aa, Mycobacterium
DSAGEAVAWVGRMEYERFGLP

SEQ ID NO: 648648 - protein, 19 aa, Mycobacterium
DSAGLPFAQIDNGISVVPL

SEQ ID NO: 648649 - protein, 19 aa, Mycobacterium
DSAGLWTFRVDGWGDPVHT

SEQ ID NO: 648650 - protein, 23 aa, Mycobacterium
DSAGRPVQIAGVNWFGMESETFA

SEQ ID NO: 648651 - protein, 25 aa, Mycobacterium
DSAICADCLREVRDPADRRFGHAFI

SEQ ID NO: 648652 - protein, 22 aa, Mycobacterium
DSAKDMLRRGLVEGTAGNISAR

SEQ ID NO: 648653 - protein, 24 aa, Mycobacterium
DSALRPVPCGATGELYLGGGQLAR

SEQ ID NO: 648654 - protein, 17 aa, Mycobacterium
DSALRVAIEALYDAADD

SEQ ID NO: 648655 - protein, 18 aa, Mycobacterium
DSAMKHGLGLTATPAELT

SEQ ID NO: 648656 - protein, 20 aa, Mycobacterium
DSAMLAAVIFERGLDALGDT

SEQ ID NO: 648657 - protein, 23 aa, Mycobacterium
DSAMPWSEFAAIVYGLVMEGRET

SEQ ID NO: 648658 - protein, 26 aa, Mycobacterium
DSAPEGLPHIPVRLHARSWHRYPEPS

SEQ ID NO: 648659 - protein, 23 aa, Mycobacterium
DSARAAMIGAVLQTRCRMPINSN

SEQ ID NO: 648660 - protein, 17 aa, Mycobacterium
DSARAGFVNAVLRTIAD

SEQ ID NO: 648661 - protein, 23 aa, Mycobacterium
DSARCPADVDSYYTLSSRFGGET

SEQ ID NO: 648662 - protein, 25 aa, Mycobacterium
DSARIGCGFITWSLAGNPRALDIAL

SEQ ID NO: 648663 - protein, 24 aa, Mycobacterium
DSARLAADVQNFWVYGSALMEAAA

SEQ ID NO: 648664 - protein, 25 aa, Mycobacterium
DSARLVAARGRLMGRLPAGGVMVAV

SEQ ID NO: 648665 - protein, 17 aa, Mycobacterium
DSARLWDVPDVPVGIGV

SEQ ID NO: 648666 - protein, 40 aa, Mycobacterium
DSARQAAIALDWLRKHGYQDLASRACVAINHVAVGETNVS

SEQ ID NO: 648667 - protein, 25 aa, Mycobacterium
DSARSASATLDWLMQHGYSSLVREA

SEQ ID NO: 648668 - protein, 21 aa, Mycobacterium
DSASIKEWLGHAQAIFVGTPT

SEQ ID NO: 648669 - protein, 24 aa, Mycobacterium
DSASRWGLSDFVFRPETIQRGNAT

SEQ ID NO: 648670 - protein, 25 aa, Mycobacterium
DSATAVQLFICFRQGATPVSVGPDR

SEQ ID NO: 648671 - protein, 21 aa, Mycobacterium
DSATEPVHFVQMWIVPDEAGI

SEQ ID NO: 648672 - protein, 25 aa, Mycobacterium
DSATTSICPWKGVASYYTVVVDGQT

SEQ ID NO: 648673 - protein, 26 aa, Mycobacterium
DSAVPLCFGFHPYLQVPGVARGDWVV

SEQ ID NO: 648674 - protein, 17 aa, Mycobacterium
DSAWKIASDLHRFDDWM

SEQ ID NO: 648675 - protein, 17 aa, Mycobacterium
DSCRCRSGRAANCGRCW

SEQ ID NO: 648676 - protein, 25 aa, Mycobacterium
DSCRGGCMAAKFFTGLPMDGPDPEC

SEQ ID NO: 648677 - protein, 18 aa, Mycobacterium
DSCTRAGITAGFHVIGDA

SEQ ID NO: 648678 - protein, 17 aa, Mycobacterium
DSDAFKNMVAVISGGEA

SEQ ID NO: 648679 - protein, 18 aa, Mycobacterium
DSDAVWPRASDPRIMPGA

SEQ ID NO: 648680 - protein, 23 aa, Mycobacterium
DSDAWSEVLIGWIDKYPIASIED

SEQ ID NO: 648681 - protein, 28 aa, Mycobacterium
DSDCVQLPPRLGGVPVITPALLRAMHAS

SEQ ID NO: 648682 - protein, 18 aa, Mycobacterium
DSDGAIWVLGRIDDVMNV

SEQ ID NO: 648683 - protein, 28 aa, Mycobacterium
DSDGRCVGHPFPGMTDVRIVSRNGQLPS

SEQ ID NO: 648684 - protein, 21 aa, Mycobacterium
DSDHAWSWLPFGCGVRYDEPD

SEQ ID NO: 648685 - protein, 26 aa, Mycobacterium
DSDPLWKVYVDLGWTELNDPASAVEL

SEQ ID NO: 648686 - protein, 23 aa, Mycobacterium
DSDSRIAAQLDFWEETLAGMPEL

SEQ ID NO: 648687 - protein, 18 aa, Mycobacterium
DSDSWRDGLAIMLDELNS

SEQ ID NO: 648688 - protein, 24 aa, Mycobacterium
DSDVFWCTADIGWVTGHTYGVYGP

SEQ ID NO: 648689 - protein, 22 aa, Mycobacterium
DSDWDLAIYYRGDFDPEDLRQI

SEQ ID NO: 648690 - protein, 22 aa, Mycobacterium
DSDYRTRWQVPLGVRESDLTVA

SEQ ID NO: 648691 - protein, 22 aa, Mycobacterium
DSEAGQRLYALASRIPMGTADR

SEQ ID NO: 648692 - protein, 23 aa, Mycobacterium
DSECVSCGACVQACPTATLQERS

SEQ ID NO: 648693 - protein, 20 aa, Mycobacterium
DSEEVLACFVVDPRLEASSG

SEQ ID NO: 648694 - protein, 27 aa, Mycobacterium
DSEEVRTVLDWALEYDKYVITLCHGPG

SEQ ID NO: 648695 - protein, 24 aa, Mycobacterium
DSEGLLPAITFVFSRAGCDAAVQQ

SEQ ID NO: 648696 - protein, 20 aa, Mycobacterium
DSEGRPRQVLDIGMQLADWA

SEQ ID NO: 648697 - protein, 23 aa, Mycobacterium
DSEGVSKWFGTVAATGFDSLVTD

SEQ ID NO: 648698 - protein, 20 aa, Mycobacterium
DSEIRYVFRLGDATHIAVGD

SEQ ID NO: 648699 - protein, 20 aa, Mycobacterium
DSERGVRLAARIARTVNRAA

SEQ ID NO: 648700 - protein, 18 aa, Mycobacterium
DSEVLLLERACAAADTAL

SEQ ID NO: 648701 - protein, 22 aa, Mycobacterium
DSFADRLNRLFAERTSKTGVEL

SEQ ID NO: 648702 - protein, 21 aa, Mycobacterium
DSFAGPSFHSAAWDHSVDLSG

SEQ ID NO: 648703 - protein, 19 aa, Mycobacterium
DSFDRSRGITMYRADPDKV

SEQ ID NO: 648704 - protein, 36 aa, Mycobacterium
DSFISFASGSVFKFVAYAVLDPMIYFGPFTPAISPL

SEQ ID NO: 648705 - protein, 26 aa, Mycobacterium
DSFLFFPNFMLLIWAPGWYLTYHYWP

SEQ ID NO: 648706 - protein, 17 aa, Mycobacterium
DSFREMFSKYVFGGILD

SEQ ID NO: 648707 - protein, 21 aa, Mycobacterium
DSFSMPAVWLRLNQVDPGHLW

SEQ ID NO: 648708 - protein, 21 aa, Mycobacterium
DSFYARGFGVGVRRRGAAVVM

SEQ ID NO: 648709 - protein, 21 aa, Mycobacterium
DSGAHLRSLANYNFGLRALTI

SEQ ID NO: 648710 - protein, 18 aa, Mycobacterium
DSGAMVLSELIPLLDTHN

SEQ ID NO: 648711 - protein, 17 aa, Mycobacterium
DSGAPAWQRLGASALAG

SEQ ID NO: 648712 - protein, 18 aa, Mycobacterium
DSGAQAWLGAAPPKDSAP

SEQ ID NO: 648713 - protein, 19 aa, Mycobacterium
DSGDAVWTRMTVPQSGLGG

SEQ ID NO: 648714 - protein, 17 aa, Mycobacterium
DSGDEWEAFLGKDEDLF

SEQ ID NO: 648715 - protein, 22 aa, Mycobacterium
DSGDFRWAATLLDHAVFTDSEH

SEQ ID NO: 648716 - protein, 17 aa, Mycobacterium
DSGDGYLHFEVRHRGSH

SEQ ID NO: 648717 - protein, 27 aa, Mycobacterium
DSGEARKLAELLTKFADKLDNDDEEED

SEQ ID NO: 648718 - protein, 19 aa, Mycobacterium
DSGEGRWTAIAAIDEGVPS

SEQ ID NO: 648719 - protein, 19 aa, Mycobacterium
DSGEGRWTSIAAIDEGVPA

SEQ ID NO: 648720 - protein, 19 aa, Mycobacterium
DSGEGRWTSIAAIDEGVPS

SEQ ID NO: 648721 - protein, 19 aa, Mycobacterium
DSGEGRWTSIAAIDEGVPT

SEQ ID NO: 648722 - protein, 19 aa, Mycobacterium
DSGEVPFTVVAPIAGDVPF

SEQ ID NO: 648723 - protein, 19 aa, Mycobacterium
DSGFGTGFENVWKNAPLFR

SEQ ID NO: 648724 - protein, 24 aa, Mycobacterium
DSGGPGLHRGGCGVTKGGTLTDCE

SEQ ID NO: 648725 - protein, 25 aa, Mycobacterium
DSGHASWRSVLWARWPGAGPPPQFE

SEQ ID NO: 648726 - protein, 24 aa, Mycobacterium
DSGIGRAVAIAFAREGADVLIAYL

SEQ ID NO: 648727 - protein, 24 aa, Mycobacterium
DSGIGRAVAIAFAREGADVLISYL

SEQ ID NO: 648728 - protein, 17 aa, Mycobacterium
DSGIPHIVELVRSTIPP

SEQ ID NO: 648729 - protein, 17 aa, Mycobacterium
DSGKAIEVSADWEKLAT

SEQ ID NO: 648730 - protein, 28 aa, Mycobacterium
DSGLTWLPPNPAYRCPYIARYLTVAVTY

SEQ ID NO: 648731 - protein, 17 aa, Mycobacterium
DSGRPGTPLSLTKPLGI

SEQ ID NO: 648732 - protein, 18 aa, Mycobacterium
DSGRRLWDTIVVTADPSA

SEQ ID NO: 648733 - protein, 17 aa, Mycobacterium
DSGRSILREEILGGGVI

SEQ ID NO: 648734 - protein, 18 aa, Mycobacterium
DSGSGGFFTPSPGTGGAG

SEQ ID NO: 648735 - protein, 21 aa, Mycobacterium
DSGSSAFGVGSPGGGGGQGGF

SEQ ID NO: 648736 - protein, 18 aa, Mycobacterium
DSGSWKKPAADPGNGGRG

SEQ ID NO: 648737 - protein, 19 aa, Mycobacterium
DSGTLYSWAVCEPTTGELL

SEQ ID NO: 648738 - protein, 24 aa, Mycobacterium
DSGVTYRPGARFGPAAIRQASRLL

SEQ ID NO: 648739 - protein, 24 aa, Mycobacterium
DSGVTYRPGARFGPSAIREASRLL

SEQ ID NO: 648740 - protein, 23 aa, Mycobacterium
DSGYLKIAAMWGGKETFEPFAAP

SEQ ID NO: 648741 - protein, 27 aa, Mycobacterium
DSGYLVPHWPKPWGRAADVLEQLVIEE

SEQ ID NO: 648742 - protein, 29 aa, Mycobacterium
DSGYPRVVKRWRRGTPLAEAETVFEGARS

SEQ ID NO: 648743 - protein, 24 aa, Mycobacterium
DSHALLGTAFHEWVQRYFQAEKLF

SEQ ID NO: 648744 - protein, 23 aa, Mycobacterium
DSHKSIIAGLIFSGVQPRWITPR

SEQ ID NO: 648745 - protein, 24 aa, Mycobacterium
DSHKSIVAGLIFSGVQPRWITPRW

SEQ ID NO: 648746 - protein, 18 aa, Mycobacterium
DSHKVLAMASNRKYGLDT

SEQ ID NO: 648747 - protein, 23 aa, Mycobacterium
DSHPHRPRVINMYGITETTVHAS

SEQ ID NO: 648748 - protein, 23 aa, Mycobacterium
DSIACPYHGWQFDGQTGQCSAIP

SEQ ID NO: 648749 - protein, 25 aa, Mycobacterium
DSIAKGAAFKRLRMTINESDRVMTS

SEQ ID NO: 648750 - protein, 31 aa, Mycobacterium
DSIDALREWAKACGRQAETVYLRGGCIYGSL

SEQ ID NO: 648751 - protein, 18 aa, Mycobacterium
DSIDDAFAGANLQLPPLG

SEQ ID NO: 648752 - protein, 18 aa, Mycobacterium
DSIGKPDNEGMSFDDVLT

SEQ ID NO: 648753 - protein, 25 aa, Mycobacterium
DSIGRLSVPPSWAVKAPAILPDADL

SEQ ID NO: 648754 - protein, 30 aa, Mycobacterium
DSIGWLRDFLKNHTGGLVMISHNVELLEEV

SEQ ID NO: 648755 - protein, 26 aa, Mycobacterium
DSIGWLRDFLRAHTGGLVIISHNVEL

SEQ ID NO: 648756 - protein, 25 aa, Mycobacterium
DSIGWLRDFLRAHTGGLVMISHNVD

SEQ ID NO: 648757 - protein, 25 aa, Mycobacterium
DSIGWLRDFLRSHTGGLVIISHNVE

SEQ ID NO: 648758 - protein, 19 aa, Mycobacterium
DSILGRLPHDVSLEGEDTI

SEQ ID NO: 648759 - protein, 17 aa, Mycobacterium
DSILGRLPQDVSLEGED

SEQ ID NO: 648760 - protein, 22 aa, Mycobacterium
DSILRVLAMHRFAKSPMLVGGQ

SEQ ID NO: 648761 - protein, 24 aa, Mycobacterium
DSIPDNPWRGSFAQLYLAAVQAGI

SEQ ID NO: 648762 - protein, 20 aa, Mycobacterium
DSIQVRFGIEYVESDPPKAT

SEQ ID NO: 648763 - protein, 17 aa, Mycobacterium
DSIRDWRIKTEFNAPPD

SEQ ID NO: 648764 - protein, 26 aa, Mycobacterium
DSIRIMTLAGRWRRQGIAVDFATLAE

SEQ ID NO: 648765 - protein, 29 aa, Mycobacterium
DSIRMMSLSGRWRRQGIDVGFAALAANPT

SEQ ID NO: 648766 - protein, 25 aa, Mycobacterium
DSIRMMTLAGRWRRRGIPVDFATLA

SEQ ID NO: 648767 - protein, 28 aa, Mycobacterium
DSIRSVSWLPLYHDMGLLMILFPLCGGR

SEQ ID NO: 648768 - protein, 17 aa, Mycobacterium
DSISPDELRAWKAEHPG

SEQ ID NO: 648769 - protein, 23 aa, Mycobacterium
DSKEVTAILARIATGSPFNAIHN

SEQ ID NO: 648770 - protein, 21 aa, Mycobacterium
DSKFGFGHFFDWERAALVTDV

SEQ ID NO: 648771 - protein, 19 aa, Mycobacterium
DSKFGVDHYFDWDRCAIVS

SEQ ID NO: 648772 - protein, 21 aa, Mycobacterium
DSKPYGLHRGWITPYLDEDGS

SEQ ID NO: 648773 - protein, 22 aa, Mycobacterium
DSKSIKGANVFFSAAARIGNKV

SEQ ID NO: 648774 - protein, 20 aa, Mycobacterium
DSKTRIAGVILNRVGSARHE

SEQ ID NO: 648775 - protein, 19 aa, Mycobacterium
DSLAAAAVLDWEMVVLASR

SEQ ID NO: 648776 - protein, 18 aa, Mycobacterium
DSLACAYAAVLAENKRYQ

SEQ ID NO: 648777 - protein, 17 aa, Mycobacterium
DSLACAYAAVLAENRRY

SEQ ID NO: 648778 - protein, 24 aa, Mycobacterium
DSLAMVCQAWLGPRYQVTSQVNVV

SEQ ID NO: 648779 - protein, 25 aa, Mycobacterium
DSLAPEFRAAVVLCDIEGLSYEEIG

SEQ ID NO: 648780 - protein, 17 aa, Mycobacterium
DSLARIGHEIAVIDRDA

SEQ ID NO: 648781 - protein, 17 aa, Mycobacterium
DSLASAIGRVLGEPRYR

SEQ ID NO: 648782 - protein, 20 aa, Mycobacterium
DSLATWVCGPAPTPQNAAAV

SEQ ID NO: 648783 - protein, 17 aa, Mycobacterium
DSLAVDFCGTGRSGFAA

SEQ ID NO: 648784 - protein, 17 aa, Mycobacterium
DSLDLVFGSCRFATLTA

SEQ ID NO: 648785 - protein, 24 aa, Mycobacterium
DSLDMKVALRLAARDRRIPVLMAT

SEQ ID NO: 648786 - protein, 17 aa, Mycobacterium
DSLDPFVALGFAAAQTT

SEQ ID NO: 648787 - protein, 21 aa, Mycobacterium
DSLDWPDYLGALQALEADAPS

SEQ ID NO: 648788 - protein, 18 aa, Mycobacterium
DSLGEFLALGACFEDIGI

SEQ ID NO: 648789 - protein, 18 aa, Mycobacterium
DSLGEFLALGACFEDIGT

SEQ ID NO: 648790 - protein, 18 aa, Mycobacterium
DSLGGLWAEGKLADKLYA

SEQ ID NO: 648791 - protein, 19 aa, Mycobacterium
DSLGGLWAEGKLADKVYAA

SEQ ID NO: 648792 - protein, 28 aa, Mycobacterium
DSLGGLWAQGRLADKVYAAFTSSQTAHG

SEQ ID NO: 648793 - protein, 17 aa, Mycobacterium
DSLGLAIAREYSGGTVF

SEQ ID NO: 648794 - protein, 22 aa, Mycobacterium
DSLGRRSGVRVALGRAATGMAG

SEQ ID NO: 648795 - protein, 19 aa, Mycobacterium
DSLHLKHYGFLGVDPDGPV

SEQ ID NO: 648796 - protein, 30 aa, Mycobacterium
DSLIIGGGMCFTFLAAQGFSVGSSLLQEEM

SEQ ID NO: 648797 - protein, 27 aa, Mycobacterium
DSLIIGGGMCFTFLAAQGLSVGSSLLE

SEQ ID NO: 648798 - protein, 17 aa, Mycobacterium
DSLIKHMIGRNLESMYH

SEQ ID NO: 648799 - protein, 25 aa, Mycobacterium
DSLIWKYWGRFDVMYFGSGVLGPIA

SEQ ID NO: 648800 - protein, 27 aa, Mycobacterium
DSLKAKARAAGLWNLFLPDPELGGGLS

SEQ ID NO: 648801 - protein, 21 aa, Mycobacterium
DSLKLRGRNVVLIDDVLATGG

SEQ ID NO: 648802 - protein, 27 aa, Mycobacterium
DSLLFPLTHGTLWYTGVGSFDLHVIYD

SEQ ID NO: 648803 - protein, 17 aa, Mycobacterium
DSLLRRAATAWPGRVAV

SEQ ID NO: 648804 - protein, 22 aa, Mycobacterium
DSLLRRLKQYSGRLATEAVSVM

SEQ ID NO: 648805 - protein, 23 aa, Mycobacterium
DSLLRVEIYRAFRTELVPDDSDV

SEQ ID NO: 648806 - protein, 17 aa, Mycobacterium
DSLLVCLTATPKDEVDH

SEQ ID NO: 648807 - protein, 22 aa, Mycobacterium
DSLPEAFQAAALGVIEVNADNR

SEQ ID NO: 648808 - protein, 17 aa, Mycobacterium
DSLPMAVPVNLRAEDDP

SEQ ID NO: 648809 - protein, 26 aa, Mycobacterium
DSLPYSEKRLRQALAARDCGAVEITV

SEQ ID NO: 648810 - protein, 19 aa, Mycobacterium
DSLQLLGWTEATATPQVEV

SEQ ID NO: 648811 - protein, 20 aa, Mycobacterium
DSLRIFPATHYVAGPERMAH

SEQ ID NO: 648812 - protein, 17 aa, Mycobacterium
DSLSARLSALVESADAQ

SEQ ID NO: 648813 - protein, 23 aa, Mycobacterium
DSLSHARKGLFLVHTDAVDSVLG

SEQ ID NO: 648814 - protein, 18 aa, Mycobacterium
DSLSPVFHLRNGKLGVDA

SEQ ID NO: 648815 - protein, 44 aa, Mycobacterium
DSLTECPQCDGRLRKIFGKVGVVFKGSGFYRTDSREAGKSSSVS

SEQ ID NO: 648816 - protein, 18 aa, Mycobacterium
DSLVARMTAVEAITQGDP

SEQ ID NO: 648817 - protein, 19 aa, Mycobacterium
DSLWGIAWRTADIEASHAR

SEQ ID NO: 648818 - protein, 21 aa, Mycobacterium
DSLYRLRIPGDRAHLLNCYLW

SEQ ID NO: 648819 - protein, 23 aa, Mycobacterium
DSMGAGLQALAWIARGGSGAGSD

SEQ ID NO: 648820 - protein, 20 aa, Mycobacterium
DSMHGLAIYRRNVAIQPLFS

SEQ ID NO: 648821 - protein, 25 aa, Mycobacterium
DSMLVKLTCRGRDFATAAARAHRAL

SEQ ID NO: 648822 - protein, 20 aa, Mycobacterium
DSMLVKLTCRGRDFPTAVNR

SEQ ID NO: 648823 - protein, 20 aa, Mycobacterium
DSMLVKLTCRGRDFQTAVAR

SEQ ID NO: 648824 - protein, 18 aa, Mycobacterium
DSMLVKLTCRGRDFSAAA

SEQ ID NO: 648825 - protein, 18 aa, Mycobacterium
DSMLVKLTCRGRDFSTAV

SEQ ID NO: 648826 - protein, 17 aa, Mycobacterium
DSMMAMDFRVRINSAFS

SEQ ID NO: 648827 - protein, 26 aa, Mycobacterium
DSMPKSVVINPYFDWGVDRPPGHEYA

SEQ ID NO: 648828 - protein, 22 aa, Mycobacterium
DSMRAGLKALAWMARQTAGGQP

SEQ ID NO: 648829 - protein, 23 aa, Mycobacterium
DSMRAGLQALAWIAHGAGAGERR

SEQ ID NO: 648830 - protein, 23 aa, Mycobacterium
DSMRAGLQALAWIAHGGGDRPAE

SEQ ID NO: 648831 - protein, 23 aa, Mycobacterium
DSMRAGLQALAWIARGEAESTAA

SEQ ID NO: 648832 - protein, 21 aa, Mycobacterium
DSMTAGLKALAWMSRQNPEGS

SEQ ID NO: 648833 - protein, 19 aa, Mycobacterium
DSNLLSRILTYHVVQGQLS

SEQ ID NO: 648834 - protein, 24 aa, Mycobacterium
DSNPRFEGLMTFTLAETLWLAGQG

SEQ ID NO: 648835 - protein, 17 aa, Mycobacterium
DSNWPFAPEDIIATMGH

SEQ ID NO: 648836 - protein, 18 aa, Mycobacterium
DSNWPFAPEDVIETMGHL

SEQ ID NO: 648837 - protein, 24 aa, Mycobacterium
DSNYPQMLLRVGWAPINADPLPAT

SEQ ID NO: 648838 - protein, 23 aa, Mycobacterium
DSPAAKEAIQWATREAELRNAPL

SEQ ID NO: 648839 - protein, 25 aa, Mycobacterium
DSPAAVCAFLARLSDQLAVEQDLTN

SEQ ID NO: 648840 - protein, 18 aa, Mycobacterium
DSPDLLVHRYKWLQRRER

SEQ ID NO: 648841 - protein, 22 aa, Mycobacterium
DSPDLPPLWQAFGAGRRADGHW

SEQ ID NO: 648842 - protein, 34 aa, Mycobacterium
DSPDLPPLWRAFGASRRGDGHWVLPELSTELASP

SEQ ID NO: 648843 - protein, 19 aa, Mycobacterium
DSPEIKEWVTFLEGNNGTM

SEQ ID NO: 648844 - protein, 18 aa, Mycobacterium
DSPFCGLLYVGLAITAGG

SEQ ID NO: 648845 - protein, 22 aa, Mycobacterium
DSPFPGLTTHSYLWKPNGHSSS

SEQ ID NO: 648846 - protein, 22 aa, Mycobacterium
DSPFRPSTHGEMYWQNRHYNLD

SEQ ID NO: 648847 - protein, 17 aa, Mycobacterium
DSPGFKGFFRPTEDADD

SEQ ID NO: 648848 - protein, 26 aa, Mycobacterium
DSPGFSWKPLHTMPGVSTYYTFYDDV

SEQ ID NO: 648849 - protein, 18 aa, Mycobacterium
DSPIKLAFLNRFDCQERA

SEQ ID NO: 648850 - protein, 25 aa, Mycobacterium
DSPKPPPRRITLTLPAVQNSREVWL

SEQ ID NO: 648851 - protein, 37 aa, Mycobacterium
DSPLLQQVCDEWAQRGWLAVRYNLPYRRRRPTGPPSG

SEQ ID NO: 648852 - protein, 38 aa, Mycobacterium
DSPLLQQVCDEWARRGWLAVRYNLPYRRRRPTGPPSGS

SEQ ID NO: 648853 - protein, 41 aa, Mycobacterium
DSPMARSTKRVCRDCGFFLPLSGSLGAMFGVCGNELSADGQ

SEQ ID NO: 648854 - protein, 21 aa, Mycobacterium
DSPPRTVVWVAGPGTAEAAGM

SEQ ID NO: 648855 - protein, 23 aa, Mycobacterium
DSPQCLWEALLRGDDFVGEIPAD

SEQ ID NO: 648856 - protein, 21 aa, Mycobacterium
DSPRGRMWATAIQHRLGGSGG

SEQ ID NO: 648857 - protein, 21 aa, Mycobacterium
DSPRLRLVGVSGYEAATGQDV

SEQ ID NO: 648858 - protein, 18 aa, Mycobacterium
DSPVEVFVLRPCIVAGPN

SEQ ID NO: 648859 - protein, 30 aa, Mycobacterium
DSPVEYRWYAGGTWRPADEDWFDDADPWSG

SEQ ID NO: 648860 - protein, 19 aa, Mycobacterium
DSPVRRYIHDFAVADESVG

SEQ ID NO: 648861 - protein, 24 aa, Mycobacterium
DSPWPCPPGALTVAPAGYHLLVGR

SEQ ID NO: 648862 - protein, 20 aa, Mycobacterium
DSPWRSEYLYSRAATIYGGT

SEQ ID NO: 648863 - protein, 20 aa, Mycobacterium
DSQFPTLPFFELGYEVAHVG

SEQ ID NO: 648864 - protein, 23 aa, Mycobacterium
DSQKFAWARIFRPMVQGHPLTPF

SEQ ID NO: 648865 - protein, 19 aa, Mycobacterium
DSQLGLRAAALAGMGVIAH

SEQ ID NO: 648866 - protein, 20 aa, Mycobacterium
DSQPWLADREQLRLLLRDVF

SEQ ID NO: 648867 - protein, 23 aa, Mycobacterium
DSQYPQMLLRVGWAPINADPLPS

SEQ ID NO: 648868 - protein, 21 aa, Mycobacterium
DSRAAIEFYKNAFGAEELGLL

SEQ ID NO: 648869 - protein, 22 aa, Mycobacterium
DSRARDAFEFALVRAALRRAMP

SEQ ID NO: 648870 - protein, 25 aa, Mycobacterium
DSRAYRLDWPAATTIFELDQPQVLD

SEQ ID NO: 648871 - protein, 25 aa, Mycobacterium
DSRAYRLDWPAGTTVFELDQPQVLD

SEQ ID NO: 648872 - protein, 23 aa, Mycobacterium
DSRAYRLDWPAGTTVYEIDQPKV

SEQ ID NO: 648873 - protein, 22 aa, Mycobacterium
DSRAYRLEWPSGTTVFEIDLPQ

SEQ ID NO: 648874 - protein, 23 aa, Mycobacterium
DSRAYRLRWPIGTTVYEIDQPEV

SEQ ID NO: 648875 - protein, 24 aa, Mycobacterium
DSRELALDVTMRFTHQLRMTLREL

SEQ ID NO: 648876 - protein, 20 aa, Mycobacterium
DSRERRLRTGGRVVPEMSVR

SEQ ID NO: 648877 - protein, 25 aa, Mycobacterium
DSRHGKNLPVRWGRRNRAMARRRIA

SEQ ID NO: 648878 - protein, 20 aa, Mycobacterium
DSRIALIDGLTGAQTTLGEL

SEQ ID NO: 648879 - protein, 19 aa, Mycobacterium
DSRIGVVAMCAGGGMGSAM

SEQ ID NO: 648880 - protein, 24 aa, Mycobacterium
DSRKLFIRQGFDRWDELPAQLRIE

SEQ ID NO: 648881 - protein, 19 aa, Mycobacterium
DSRLARRATTVGGVDIPAG

SEQ ID NO: 648882 - protein, 22 aa, Mycobacterium
DSRLGERACAFVVLRQGSEAIE

SEQ ID NO: 648883 - protein, 29 aa, Mycobacterium
DSRLRVLTRREFAGMISVAIESGDGDETT

SEQ ID NO: 648884 - protein, 24 aa, Mycobacterium
DSRLRWLRRGEVPTLGNWFRAAGY

SEQ ID NO: 648885 - protein, 20 aa, Mycobacterium
DSRLVDEWLTVTGLNGHTEV

SEQ ID NO: 648886 - protein, 23 aa, Mycobacterium
DSRTRISPISTMLFDADAKITSM

SEQ ID NO: 648887 - protein, 30 aa, Mycobacterium
DSRTSCAVDRGLRLGGYVFNRLYTDLYQLG

SEQ ID NO: 648888 - protein, 23 aa, Mycobacterium
DSRTYRLDWPSGTTVFEIDLPKV

SEQ ID NO: 648889 - protein, 21 aa, Mycobacterium
DSRVGLPWQTIGAFLRIATHP

SEQ ID NO: 648890 - protein, 17 aa, Mycobacterium
DSSADWVPKAWRDMDMT

SEQ ID NO: 648891 - protein, 27 aa, Mycobacterium
DSSAFGPTGPWAKRLGYGPLVRAAVGF

SEQ ID NO: 648892 - protein, 21 aa, Mycobacterium
DSSEVCGGVWEAAVGGSCVSG

SEQ ID NO: 648893 - protein, 18 aa, Mycobacterium
DSSFIGCRITVDGKLVDQ

SEQ ID NO: 648894 - protein, 19 aa, Mycobacterium
DSSGARLIDWEWVQINLAR

SEQ ID NO: 648895 - protein, 20 aa, Mycobacterium
DSSGARWVVSFFSDRDPGVT

SEQ ID NO: 648896 - protein, 22 aa, Mycobacterium
DSSGPCLEGWTTLTALAQATTR

SEQ ID NO: 648897 - protein, 27 aa, Mycobacterium
DSSGRTRAALRFIRSCSAPLTPETAQA

SEQ ID NO: 648898 - protein, 22 aa, Mycobacterium
DSSLDWLVARFAQDVAGVTHAI

SEQ ID NO: 648899 - protein, 20 aa, Mycobacterium
DSSPRVGLIIAKSVGTAVER

SEQ ID NO: 648900 - protein, 23 aa, Mycobacterium
DSSRRIGDSILIVADPATAVAGI

SEQ ID NO: 648901 - protein, 24 aa, Mycobacterium
DSSRWKKWKRFWGKHRRGGDFALN

SEQ ID NO: 648902 - protein, 20 aa, Mycobacterium
DSSSGWLFVSSWKADADSLR

SEQ ID NO: 648903 - protein, 23 aa, Mycobacterium
DSSVPPDTVRVVLADDYTGPGAG

SEQ ID NO: 648904 - protein, 24 aa, Mycobacterium
DSSWEPMGAIAIGYPHGYPEEGLD

SEQ ID NO: 648905 - protein, 26 aa, Mycobacterium
DSSYEFFCNAGLLLDKRLEELGASRL

SEQ ID NO: 648906 - protein, 21 aa, Mycobacterium
DSTAALRPGRLFRSSELSGLD

SEQ ID NO: 648907 - protein, 22 aa, Mycobacterium
DSTACALPEAMAAARDERIAVV

SEQ ID NO: 648908 - protein, 25 aa, Mycobacterium
DSTDILAPGSFSWHVLSSLTDEVTT

SEQ ID NO: 648909 - protein, 18 aa, Mycobacterium
DSTDWPTDVELRIRCLDQ

SEQ ID NO: 648910 - protein, 22 aa, Mycobacterium
DSTFNLGFADIGIFNAGAANTG

SEQ ID NO: 648911 - protein, 21 aa, Mycobacterium
DSTFYGLNAFRFTNAAGTTVA

SEQ ID NO: 648912 - protein, 17 aa, Mycobacterium
DSTKEWMQLLIVTVRIA

SEQ ID NO: 648913 - protein, 17 aa, Mycobacterium
DSTRFSGTLPAAADLAA

SEQ ID NO: 648914 - protein, 22 aa, Mycobacterium
DSTRGVANFLVLRTRRDGSRNG

SEQ ID NO: 648915 - protein, 22 aa, Mycobacterium
DSTRGVASFLVLRTRRDGSRNG

SEQ ID NO: 648916 - protein, 36 aa, Mycobacterium
DSTRILSNVARRGAHLRGRREPVLVRHRLLQSPNRV

SEQ ID NO: 648917 - protein, 20 aa, Mycobacterium
DSTTETFAAITLEVDTRRWA

SEQ ID NO: 648918 - protein, 23 aa, Mycobacterium
DSTTRRCCGGIGRHSRTCPTRQV

SEQ ID NO: 648919 - protein, 25 aa, Mycobacterium
DSTVNYRCAMVFGRAVPVTERERED

SEQ ID NO: 648920 - protein, 20 aa, Mycobacterium
DSTVRVRYRLTRTGLELDGA

SEQ ID NO: 648921 - protein, 21 aa, Mycobacterium
DSTYRIGPRFLGIAAAALSDA

SEQ ID NO: 648922 - protein, 19 aa, Mycobacterium
DSTYYCFGTAAGPHPFPTM

SEQ ID NO: 648923 - protein, 23 aa, Mycobacterium
DSVAGRLLGSVPAEIARKSKVDI

SEQ ID NO: 648924 - protein, 33 aa, Mycobacterium
DSVAPVVAGALHWDDPESILAWLDAYDPARTYG

SEQ ID NO: 648925 - protein, 17 aa, Mycobacterium
DSVAPYISSWVIVDTGS

SEQ ID NO: 648926 - protein, 22 aa, Mycobacterium
DSVDGWGAECARRAETTLFTKA

SEQ ID NO: 648927 - protein, 22 aa, Mycobacterium
DSVDWPLLVQAGWVGLDAPESL

SEQ ID NO: 648928 - protein, 24 aa, Mycobacterium
DSVFYCVANMPGAVPRTSTFALTN

SEQ ID NO: 648929 - protein, 22 aa, Mycobacterium
DSVIRPRLTVIDSILRTAVEQG

SEQ ID NO: 648930 - protein, 18 aa, Mycobacterium
DSVKGPDAVAAVAPGAAI

SEQ ID NO: 648931 - protein, 21 aa, Mycobacterium
DSVLLTGYFGGYAEYGEGLAR

SEQ ID NO: 648932 - protein, 19 aa, Mycobacterium
DSVLRRLKQYSGRLATEAV

SEQ ID NO: 648933 - protein, 23 aa, Mycobacterium
DSVPDDIATLVWSYGKDGDTPRM

SEQ ID NO: 648934 - protein, 17 aa, Mycobacterium
DSVPLPASMGFEQGAAV

SEQ ID NO: 648935 - protein, 25 aa, Mycobacterium
DSVRACGVAPWARQVTDDDIASAIA

SEQ ID NO: 648936 - protein, 18 aa, Mycobacterium
DSVRIGQRVIAFGPGTVA

SEQ ID NO: 648937 - protein, 24 aa, Mycobacterium
DSVSCPRSGEVIVREPGHWYSTGA

SEQ ID NO: 648938 - protein, 24 aa, Mycobacterium
DSVSCPRSGEVIVREQGHWYSTGA

SEQ ID NO: 648939 - protein, 17 aa, Mycobacterium
DSVSLAALQARVGLDSG

SEQ ID NO: 648940 - protein, 17 aa, Mycobacterium
DSVTFSGPVERIAEVAD

SEQ ID NO: 648941 - protein, 18 aa, Mycobacterium
DSVTRLVGLTGITFTNVF

SEQ ID NO: 648942 - protein, 18 aa, Mycobacterium
DSVTRPMWDSMLQPLRRR

SEQ ID NO: 648943 - protein, 22 aa, Mycobacterium
DSWAVDAHKWLNVPYDCAMAIV

SEQ ID NO: 648944 - protein, 23 aa, Mycobacterium
DSWERTRWTIAHEIGHLVLHRYG

SEQ ID NO: 648945 - protein, 23 aa, Mycobacterium
DSWERTRWTLAHELGHLILHTNV

SEQ ID NO: 648946 - protein, 21 aa, Mycobacterium
DSWLRLRRQAVDLSETAVRLG

SEQ ID NO: 648947 - protein, 30 aa, Mycobacterium
DSWLRRQLTPHFRPGCKRMLMTSDYYPALQ

SEQ ID NO: 648948 - protein, 25 aa, Mycobacterium
DSWTSRPGGGWGWAVEPPGAVVAEV

SEQ ID NO: 648949 - protein, 19 aa, Mycobacterium
DSWVAIAVGTDAQWEALRR

SEQ ID NO: 648950 - protein, 23 aa, Mycobacterium
DSWVRRYPDVPVQVVASGTGARS

SEQ ID NO: 648951 - protein, 22 aa, Mycobacterium
DSYFKVPHIPFFTAGATGAPLG

SEQ ID NO: 648952 - protein, 20 aa, Mycobacterium
DSYLRCLHVLLSGSGYPMVA

SEQ ID NO: 648953 - protein, 24 aa, Mycobacterium
DSYLRCLRVLMAGSGYPMVASHDP

SEQ ID NO: 648954 - protein, 19 aa, Mycobacterium
DSYLRGAQLLDVPAEAAAV

SEQ ID NO: 648955 - protein, 25 aa, Mycobacterium
DSYMAELTLRLCRQSGFEPRVAGRF

SEQ ID NO: 648956 - protein, 19 aa, Mycobacterium
DSYQPAWMYRAPDADDADD

SEQ ID NO: 648957 - protein, 20 aa, Mycobacterium
DSYQPAWVYRSRGHDDHPLR

SEQ ID NO: 648958 - protein, 22 aa, Mycobacterium
DSYRTMGSREFFEASRTAEPAA

SEQ ID NO: 648959 - protein, 24 aa, Mycobacterium
DSYRVSSLYPFLLTIAVSMTLQQT

SEQ ID NO: 648960 - protein, 26 aa, Mycobacterium
DSYVEAPGWGKMKINGVFGDVKLDRM

SEQ ID NO: 648961 - protein, 19 aa, Mycobacterium
DTAAGWERRLRPLGVPAAA

SEQ ID NO: 648962 - protein, 17 aa, Mycobacterium
DTAALPVGYFGASTGAG

SEQ ID NO: 648963 - protein, 26 aa, Mycobacterium
DTAANWRAAGWWENRSIRSLLADAAQ

SEQ ID NO: 648964 - protein, 25 aa, Mycobacterium
DTAARRWGVATAHERIMLCGSGARR

SEQ ID NO: 648965 - protein, 22 aa, Mycobacterium
DTACSSGLMAVHQACGSLAAGE

SEQ ID NO: 648966 - protein, 22 aa, Mycobacterium
DTACSSGLMAVHQACGSLYSGE

SEQ ID NO: 648967 - protein, 24 aa, Mycobacterium
DTACSSSLFATHLACRSLSDGESD

SEQ ID NO: 648968 - protein, 17 aa, Mycobacterium
DTACSSSLFAVHMACRS

SEQ ID NO: 648969 - protein, 27 aa, Mycobacterium
DTACSSSLVAIHWAMASLRSGECDLAL

SEQ ID NO: 648970 - protein, 24 aa, Mycobacterium
DTADSIAFRLVFNTMRDSYVRALD

SEQ ID NO: 648971 - protein, 24 aa, Mycobacterium
DTADYRGALQIATRQEVLERAGGA

SEQ ID NO: 648972 - protein, 22 aa, Mycobacterium
DTAEGVGFRNPWSGETTVLQGV

SEQ ID NO: 648973 - protein, 21 aa, Mycobacterium
DTAEGVIRWQRLGSDSSGDEP

SEQ ID NO: 648974 - protein, 27 aa, Mycobacterium
DTAEIKRVWIAPHVRGLGLGKRILAEL

SEQ ID NO: 648975 - protein, 17 aa, Mycobacterium
DTAELAAGMAFHVILGM

SEQ ID NO: 648976 - protein, 28 aa, Mycobacterium
DTAELDGGYWFRSIRQTVQFAEAVRAAG

SEQ ID NO: 648977 - protein, 17 aa, Mycobacterium
DTAELLAHLALPIPSVV

SEQ ID NO: 648978 - protein, 20 aa, Mycobacterium
DTAELLEWLDAQTKRNLVIT

SEQ ID NO: 648979 - protein, 24 aa, Mycobacterium
DTAEVTESHWLPGWLAADNLLALL

SEQ ID NO: 648980 - protein, 19 aa, Mycobacterium
DTAGRLGIDDVLMAQAAGI

SEQ ID NO: 648981 - protein, 22 aa, Mycobacterium
DTAHAAALFGLSEEGNIYTRIG

SEQ ID NO: 648982 - protein, 21 aa, Mycobacterium
DTAILCDGCAGKGTHGNSAPS

SEQ ID NO: 648983 - protein, 26 aa, Mycobacterium
DTAKPEIWAGVAAPVMIWSIAHAAWP

SEQ ID NO: 648984 - protein, 23 aa, Mycobacterium
DTALAAYLVRPGQRSFSLDDLSL

SEQ ID NO: 648985 - protein, 23 aa, Mycobacterium
DTALAAYLVRPGQRSFSLEDLSL

SEQ ID NO: 648986 - protein, 23 aa, Mycobacterium
DTALAAYLVRPGQRSFTLDDLAV

SEQ ID NO: 648987 - protein, 18 aa, Mycobacterium
DTALKFGATHAFPDAASA

SEQ ID NO: 648988 - protein, 20 aa, Mycobacterium
DTALPPRAERLFALAEQVTG

SEQ ID NO: 648989 - protein, 18 aa, Mycobacterium
DTALRIGLVSEVVPAQQL

SEQ ID NO: 648990 - protein, 18 aa, Mycobacterium
DTALRIGLVTEVVPREQL

SEQ ID NO: 648991 - protein, 23 aa, Mycobacterium
DTALRVLAPLGLVFDENSPWLTV

SEQ ID NO: 648992 - protein, 19 aa, Mycobacterium
DTALTDWQVEFDLPANESI

SEQ ID NO: 648993 - protein, 21 aa, Mycobacterium
DTALTSIQWTSRIAAPNITSK

SEQ ID NO: 648994 - protein, 30 aa, Mycobacterium
DTAPAEWLARGGIMLPIYQREAMWLSFDSD

SEQ ID NO: 648995 - protein, 23 aa, Mycobacterium
DTAPEILEYLVAEGYFATDGPFL

SEQ ID NO: 648996 - protein, 23 aa, Mycobacterium
DTAPGLTSQRGWVFLATGITEGE

SEQ ID NO: 648997 - protein, 25 aa, Mycobacterium
DTAPTLGAGLDWKSSLQELTAARGL

SEQ ID NO: 648998 - protein, 25 aa, Mycobacterium
DTAPTLGAGLDWKSSLQELTASLAL

SEQ ID NO: 648999 - protein, 24 aa, Mycobacterium
DTAQRFCRMLAERNLLCMAWPEEF

SEQ ID NO: 649000 - protein, 25 aa, Mycobacterium
DTARACAEWAHLVAGTSSIREGSRL

SEQ ID NO: 649001 - protein, 18 aa, Mycobacterium
DTARGMWRSDPVDPNHPN

SEQ ID NO: 649002 - protein, 25 aa, Mycobacterium
DTARLKCPFTSLGVAPEAASSYLMP

SEQ ID NO: 649003 - protein, 17 aa, Mycobacterium
DTARRLVFVSGERVDLT

SEQ ID NO: 649004 - protein, 26 aa, Mycobacterium
DTARVLSRFVDAIVWRTFGQDRLDAM

SEQ ID NO: 649005 - protein, 19 aa, Mycobacterium
DTATGSWAMSDVVIVPGHN

SEQ ID NO: 649006 - protein, 18 aa, Mycobacterium
DTATSILGAAAWTGHEGR

SEQ ID NO: 649007 - protein, 20 aa, Mycobacterium
DTAVCGACTVLLDGRTVKSC

SEQ ID NO: 649008 - protein, 18 aa, Mycobacterium
DTAVKWARLDSAPFTDRL

SEQ ID NO: 649009 - protein, 18 aa, Mycobacterium
DTAVLCDRCQGKGTNGDS

SEQ ID NO: 649010 - protein, 22 aa, Mycobacterium
DTAWPTIELVSATPEHVALVID

SEQ ID NO: 649011 - protein, 18 aa, Mycobacterium
DTAYAWAYNLGKGGKTRI

SEQ ID NO: 649012 - protein, 18 aa, Mycobacterium
DTAYAWAYNVEKGEKTRI

SEQ ID NO: 649013 - protein, 20 aa, Mycobacterium
DTCAAVLVWEPRRVVPTYAV

SEQ ID NO: 649014 - protein, 24 aa, Mycobacterium
DTCIQCGNCAFVCPHSVIRTTFYQ

SEQ ID NO: 649015 - protein, 26 aa, Mycobacterium
DTDAAARVLLLWGRRPADPSRIRSRV

SEQ ID NO: 649016 - protein, 17 aa, Mycobacterium
DTDAEWDPLLDSLFADD

SEQ ID NO: 649017 - protein, 24 aa, Mycobacterium
DTDDARPGWTLADTVELAEHIKRI

SEQ ID NO: 649018 - protein, 23 aa, Mycobacterium
DTDEFRYTTAWFGDEQLLGVMDG

SEQ ID NO: 649019 - protein, 24 aa, Mycobacterium
DTDEFRYTTAWFGDEQLLGVMDGA

SEQ ID NO: 649020 - protein, 21 aa, Mycobacterium
DTDFSGSMSRLREVVDSLGYP

SEQ ID NO: 649021 - protein, 17 aa, Mycobacterium
DTDGLGVLEQIRSFGTY

SEQ ID NO: 649022 - protein, 18 aa, Mycobacterium
DTDHLRTAAVSSFGVSGT

SEQ ID NO: 649023 - protein, 23 aa, Mycobacterium
DTDHWCAIATNVLGGCRGSTGPG

SEQ ID NO: 649024 - protein, 25 aa, Mycobacterium
DTDIAWSRITYWRALLASAIDEPPH

SEQ ID NO: 649025 - protein, 19 aa, Mycobacterium
DTDKPVAAKYIVFRNGEPV

SEQ ID NO: 649026 - protein, 23 aa, Mycobacterium
DTDLKALLPESARRAYDVHPLVE

SEQ ID NO: 649027 - protein, 18 aa, Mycobacterium
DTDLKWVITATAELNTLP

SEQ ID NO: 649028 - protein, 21 aa, Mycobacterium
DTDLLRRAKHSGLSDRQIAAL

SEQ ID NO: 649029 - protein, 22 aa, Mycobacterium
DTDLRAAVLYGEGPLFTAGLDL

SEQ ID NO: 649030 - protein, 29 aa, Mycobacterium
DTDMMGAPGTEVWTFTALNRGTTTISTGY

SEQ ID NO: 649031 - protein, 18 aa, Mycobacterium
DTDPAPLVPLYLRRPDAK

SEQ ID NO: 649032 - protein, 18 aa, Mycobacterium
DTDPGYHYPIAVLTMARG

SEQ ID NO: 649033 - protein, 20 aa, Mycobacterium
DTDRLAAVNLRAFNHDDPSL

SEQ ID NO: 649034 - protein, 19 aa, Mycobacterium
DTDRPEVWITLRDQADVLA

SEQ ID NO: 649035 - protein, 19 aa, Mycobacterium
DTDSELFRRYWPADLHMIG

SEQ ID NO: 649036 - protein, 22 aa, Mycobacterium
DTDTATAFARHIAANGINIVLA

SEQ ID NO: 649037 - protein, 27 aa, Mycobacterium
DTDTFKWDPSSSYVRKPPYFDGMGRQP

SEQ ID NO: 649038 - protein, 23 aa, Mycobacterium
DTDTRIATAVARAVAAGMPRPDW

SEQ ID NO: 649039 - protein, 23 aa, Mycobacterium
DTDTRIATAVARGARARLDGDWS

SEQ ID NO: 649040 - protein, 29 aa, Mycobacterium
DTDVFGLRWADFCRFTFFSDLCTALDDDA

SEQ ID NO: 649041 - protein, 33 aa, Mycobacterium
DTDVWAWCHSPAFDFSVWELWGALLHGAQAVVV

SEQ ID NO: 649042 - protein, 25 aa, Mycobacterium
DTEEPEVLGTFVFAPSAPIQAVRDI

SEQ ID NO: 649043 - protein, 25 aa, Mycobacterium
DTEFLRLTLRTTLELGVDPASLVHA

SEQ ID NO: 649044 - protein, 23 aa, Mycobacterium
DTEGKPSLAWRGRRAAHKVTASV

SEQ ID NO: 649045 - protein, 24 aa, Mycobacterium
DTEIPSPAAGVLTKIVAKEDDTVE

SEQ ID NO: 649046 - protein, 25 aa, Mycobacterium
DTEIPSPAAGVLTRIIAQEDDTVEV

SEQ ID NO: 649047 - protein, 23 aa, Mycobacterium
DTEIPSPASGVLKKIVAQEDDTV

SEQ ID NO: 649048 - protein, 19 aa, Mycobacterium
DTELGRAIAQGFRDAGHNV

SEQ ID NO: 649049 - protein, 17 aa, Mycobacterium
DTELGWAQSNGFNAVRV

SEQ ID NO: 649050 - protein, 24 aa, Mycobacterium
DTELIPKLMSAGVIEVAPLAYMRG

SEQ ID NO: 649051 - protein, 20 aa, Mycobacterium
DTELLDFNALAKIFGYPSTT

SEQ ID NO: 649052 - protein, 20 aa, Mycobacterium
DTELLDFTVLAKVFGYPTTA

SEQ ID NO: 649053 - protein, 23 aa, Mycobacterium
DTEPRPGPDLVDLFPAGRAQPGY

SEQ ID NO: 649054 - protein, 23 aa, Mycobacterium
DTEPWRGEPLLNYLRKMVFWAEV

SEQ ID NO: 649055 - protein, 19 aa, Mycobacterium
DTERAAAVAAQLLVGSVAV

SEQ ID NO: 649056 - protein, 23 aa, Mycobacterium
DTERAVFDGCDFGGANLAESRHR

SEQ ID NO: 649057 - protein, 23 aa, Mycobacterium
DTERSRRVLLHGWEEFDEPVDRI

SEQ ID NO: 649058 - protein, 23 aa, Mycobacterium
DTERSRRVLLQGWEQFDEPVDRI

SEQ ID NO: 649059 - protein, 25 aa, Mycobacterium
DTERWWLDRMVSVIASSAGIRVEDL

SEQ ID NO: 649060 - protein, 20 aa, Mycobacterium
DTESAALFRLFQDRITRLEN

SEQ ID NO: 649061 - protein, 24 aa, Mycobacterium
DTETWRLNTLCGLLDAVAAAMTGG

SEQ ID NO: 649062 - protein, 25 aa, Mycobacterium
DTEVRHLICRYSRRAALLQIGLCAA

SEQ ID NO: 649063 - protein, 17 aa, Mycobacterium
DTEWIRTRVTGVSQDAH

SEQ ID NO: 649064 - protein, 21 aa, Mycobacterium
DTEWVTWWLAVSRIGALAVPL

SEQ ID NO: 649065 - protein, 27 aa, Mycobacterium
DTFAREHPHLLPGYVTHTFGVDDVQAA

SEQ ID NO: 649066 - protein, 25 aa, Mycobacterium
DTFARVDGAWRFDTRTMFVDQVGDV

SEQ ID NO: 649067 - protein, 22 aa, Mycobacterium
DTFDLPRFTPILVGGQPSTPRG

SEQ ID NO: 649068 - protein, 27 aa, Mycobacterium
DTFFWYTSPSWMMWNFQVAGLLVGATI

SEQ ID NO: 649069 - protein, 19 aa, Mycobacterium
DTFGFPIDLTLEMAAEAGL

SEQ ID NO: 649070 - protein, 18 aa, Mycobacterium
DTFGPRFVNAIMQRQSIQ

SEQ ID NO: 649071 - protein, 17 aa, Mycobacterium
DTFKRIQASYVIAAEGG

SEQ ID NO: 649072 - protein, 17 aa, Mycobacterium
DTFKRLRARYVIAADGG

SEQ ID NO: 649073 - protein, 19 aa, Mycobacterium
DTFPSTVAVIPRFQELLAE

SEQ ID NO: 649074 - protein, 24 aa, Mycobacterium
DTFRKLRGSFDLILNTVSANLDMG

SEQ ID NO: 649075 - protein, 22 aa, Mycobacterium
DTFTGRLPQRFADRAPRVVETD

SEQ ID NO: 649076 - protein, 20 aa, Mycobacterium
DTFVDLQIHPSVLRAIAGVG

SEQ ID NO: 649077 - protein, 18 aa, Mycobacterium
DTFWLSMRDQTPWVDRYP

SEQ ID NO: 649078 - protein, 30 aa, Mycobacterium; identical to SEQ ID NO: 95609

SEQ ID NO: 649079 - protein, 18 aa, Mycobacterium
DTGAGEFMFRLTGSDSDG

SEQ ID NO: 649080 - protein, 17 aa, Mycobacterium
DTGAWRAIWSYSAKRAR

SEQ ID NO: 649081 - protein, 17 aa, Mycobacterium
DTGCPHAAAALAGPGEE

SEQ ID NO: 649082 - protein, 17 aa, Mycobacterium
DTGCPIEPISGGNFTAI

SEQ ID NO: 649083 - protein, 25 aa, Mycobacterium
DTGDDWTPTGFPVEFLSLGTEGIGV

SEQ ID NO: 649084 - protein, 24 aa, Mycobacterium
DTGDEYWARMADWHRALYDNGFFG

SEQ ID NO: 649085 - protein, 27 aa, Mycobacterium
DTGEIRVPRMLGVFSVGRVINARTLRS

SEQ ID NO: 649086 - protein, 23 aa, Mycobacterium
DTGEQWRALLLAIEQRLVLANKH

SEQ ID NO: 649087 - protein, 18 aa, Mycobacterium
DTGFGVALGENYWAAPGL

SEQ ID NO: 649088 - protein, 24 aa, Mycobacterium
DTGHIPGAIKLDWKTDLQDQVKRD

SEQ ID NO: 649089 - protein, 24 aa, Mycobacterium
DTGHIPGAVKIDWHTDLNDPHVRD

SEQ ID NO: 649090 - protein, 24 aa, Mycobacterium
DTGHIPGAVKIDWHTDLNDPNVRD

SEQ ID NO: 649091 - protein, 24 aa, Mycobacterium
DTGIPRPGLSTIFSPSRSTFGVDL

SEQ ID NO: 649092 - protein, 17 aa, Mycobacterium
DTGKFLAELGALPRDEW

SEQ ID NO: 649093 - protein, 26 aa, Mycobacterium
DTGKTVCARAAAATGAASTGVAPGPT

SEQ ID NO: 649094 - protein, 19 aa, Mycobacterium
DTGLLDRRAPDFAPATVGD

SEQ ID NO: 649095 - protein, 19 aa, Mycobacterium
DTGLLDRRLPDFAPAPPTD

SEQ ID NO: 649096 - protein, 17 aa, Mycobacterium
DTGLRYMVHPGELSSSV

SEQ ID NO: 649097 - protein, 17 aa, Mycobacterium
DTGLSLAAVCALEPFWE

SEQ ID NO: 649098 - protein, 31 aa, Mycobacterium
DTGLSLRAVCDLEPYWEALRKVYAPFESGLP

SEQ ID NO: 649099 - protein, 25 aa, Mycobacterium
DTGPLWKAYVDLGWTELNDPAGAVE

SEQ ID NO: 649100 - protein, 29 aa, Mycobacterium
DTGRAQDDWKLRLIRTLSSRGILFGTVHT

SEQ ID NO: 649101 - protein, 24 aa, Mycobacterium
DTGRFSWRDLIWRISRRDFGPGKG

SEQ ID NO: 649102 - protein, 22 aa, Mycobacterium
DTGRPRRAGVSSFGVSGTNAHV

SEQ ID NO: 649103 - protein, 18 aa, Mycobacterium
DTGSAGLVVPIWDIGLQN

SEQ ID NO: 649104 - protein, 27 aa, Mycobacterium
DTGSVAYRYTWHLPKNRTWTYDGQLNM

SEQ ID NO: 649105 - protein, 26 aa, Mycobacterium
DTGTGWELFGRRAIRQGDWKAVHLPA

SEQ ID NO: 649106 - protein, 37 aa, Mycobacterium
DTGVHCLRLILGGVFDRFPQLQIIVGHHFEALSWMGW

SEQ ID NO: 649107 - protein, 27 aa, Mycobacterium
DTGVPLCCIHDGLGLSWSYRALGNYLD

SEQ ID NO: 649108 - protein, 23 aa, Mycobacterium
DTGVPRPGLSTMFSPSRSTFGVD

SEQ ID NO: 649109 - protein, 24 aa, Mycobacterium
DTGVPRPGLSTVFSPSRSTFGVDL

SEQ ID NO: 649110 - protein, 18 aa, Mycobacterium
DTHARVGILPGGGMTARL

SEQ ID NO: 649111 - protein, 22 aa, Mycobacterium
DTHCTGYERFERYLLGHDDGVA

SEQ ID NO: 649112 - protein, 23 aa, Mycobacterium
DTHFTGPTSITWDGATLSIPGFS

SEQ ID NO: 649113 - protein, 21 aa, Mycobacterium
DTHGRSGLLIGTAGDDTFAAV

SEQ ID NO: 649114 - protein, 25 aa, Mycobacterium
DTHLLRYPLPAAWCDDVDVALYLKD

SEQ ID NO: 649115 - protein, 25 aa, Mycobacterium
DTHLLRYPLPEAWAGNGSDVDVALY

SEQ ID NO: 649116 - protein, 32 aa, Mycobacterium
DTHLLRYPLPSAWCADADVALYLKDETTHITG

SEQ ID NO: 649117 - protein, 24 aa, Mycobacterium
DTHLLRYPLPSAWSNDANVELYLK

SEQ ID NO: 649118 - protein, 25 aa, Mycobacterium
DTHLLRYPLPSAWSTDVDVALYLKD

SEQ ID NO: 649119 - protein, 20 aa, Mycobacterium
DTHLRSADFFDTDNHPKATY

SEQ ID NO: 649120 - protein, 23 aa, Mycobacterium
DTHPRLIASTVQRLAQIGRLTDL

SEQ ID NO: 649121 - protein, 25 aa, Mycobacterium
DTIARAIADGCDRVLNLAAGLDTRP

SEQ ID NO: 649122 - protein, 36 aa, Mycobacterium
DTIARIIAAFPWEPEIEGVHSYVMFCSDPVVLTELA

SEQ ID NO: 649123 - protein, 21 aa, Mycobacterium
DTIARVGFIRRGQAAGFSLAQ

SEQ ID NO: 649124 - protein, 18 aa, Mycobacterium
DTIATMFSGIVLGDVPLS

SEQ ID NO: 649125 - protein, 19 aa, Mycobacterium
DTIDILRYARATYPDASAV

SEQ ID NO: 649126 - protein, 20 aa, Mycobacterium
DTIGGLAPRGELVAVGVSAE

SEQ ID NO: 649127 - protein, 18 aa, Mycobacterium
DTIGPMSVPPSWTTAAPA

SEQ ID NO: 649128 - protein, 22 aa, Mycobacterium
DTIKTTMRFGPESEKKPGDKKD

SEQ ID NO: 649129 - protein, 19 aa, Mycobacterium
DTILRYALMALLIPSVEPL

SEQ ID NO: 649130 - protein, 17 aa, Mycobacterium
DTIPDGYSWIDANDSAN

SEQ ID NO: 649131 - protein, 23 aa, Mycobacterium
DTIRPGTTGVWVIVERRNANSQN

SEQ ID NO: 649132 - protein, 27 aa, Mycobacterium
DTIRYEAGDALGVWPRNSDRLVDEWLS

SEQ ID NO: 649133 - protein, 25 aa, Mycobacterium
DTISVANIFSWRYRDPGVLLGERLG

SEQ ID NO: 649134 - protein, 17 aa, Mycobacterium
DTIVLLESMKMEIPVLA

SEQ ID NO: 649135 - protein, 24 aa, Mycobacterium
DTIVLPGMVVPIALDDAARAAIDA

SEQ ID NO: 649136 - protein, 24 aa, Mycobacterium
DTIVLPGMVVPIALDEAARAAIDA

SEQ ID NO: 649137 - protein, 24 aa, Mycobacterium
DTIVLPGMVVPITLDDAAQAAIDA

SEQ ID NO: 649138 - protein, 25 aa, Mycobacterium
DTKLRPAWTADLHHFLGTRIAEAVI

SEQ ID NO: 649139 - protein, 24 aa, Mycobacterium
DTKRLAALVDRLVSAGVHAIAPLG

SEQ ID NO: 649140 - protein, 22 aa, Mycobacterium
DTKVPLAHGGWVRYANFDYAAS

SEQ ID NO: 649141 - protein, 36 aa, Mycobacterium
DTKVWTFTGPRPGGWWLRRRLHEVVVHRADAALALG

SEQ ID NO: 649142 - protein, 20 aa, Mycobacterium
DTLAAFIAHGVFERFPGVRI

SEQ ID NO: 649143 - protein, 17 aa, Mycobacterium
DTLAGVLCFDIAGDQIA

SEQ ID NO: 649144 - protein, 25 aa, Mycobacterium
DTLALVIRQGRNWAVRQIPLAQVLK

SEQ ID NO: 649145 - protein, 25 aa, Mycobacterium
DTLAPRRARVLFIENVGNLVCPALF

SEQ ID NO: 649146 - protein, 22 aa, Mycobacterium
DTLARIGFSILVGAQQFGTRVD

SEQ ID NO: 649147 - protein, 26 aa, Mycobacterium
DTLDCLKSYLPRLAVTYGAAMATGPG

SEQ ID NO: 649148 - protein, 17 aa, Mycobacterium
DTLDPGHTVGWTLVGDQ

SEQ ID NO: 649149 - protein, 17 aa, Mycobacterium
DTLDTAAAFGFAPATAT

SEQ ID NO: 649150 - protein, 24 aa, Mycobacterium
DTLEAIAERVLWLSTSMVHHANRV

SEQ ID NO: 649151 - protein, 30 aa, Mycobacterium
DTLEETALWLALTCAVPVPVVLTGAQRSGD

SEQ ID NO: 649152 - protein, 19 aa, Mycobacterium
DTLHPDRIVLGVQRDSDRA

SEQ ID NO: 649153 - protein, 23 aa, Mycobacterium
DTLHWLAGLADRYDPARTLATGQ

SEQ ID NO: 649154 - protein, 18 aa, Mycobacterium
DTLIGPLIRERQRARVEA

SEQ ID NO: 649155 - protein, 26 aa, Mycobacterium
DTLIKEKWLTANGVIGFFPANAVGPG

SEQ ID NO: 649156 - protein, 18 aa, Mycobacterium
DTLINCAGIAEPPGSSIL

SEQ ID NO: 649157 - protein, 18 aa, Mycobacterium
DTLLEFARGNGIELPEEH

SEQ ID NO: 649158 - protein, 20 aa, Mycobacterium
DTLLMTGFGFAEPVTTPTWG

SEQ ID NO: 649159 - protein, 21 aa, Mycobacterium
DTLLRGCPRLQIVATSRELLS

SEQ ID NO: 649160 - protein, 17 aa, Mycobacterium
DTLLYALGVGAGIDDLA

SEQ ID NO: 649161 - protein, 22 aa, Mycobacterium
DTLMAAPVWTFDEFTALRDRVA

SEQ ID NO: 649162 - protein, 29 aa, Mycobacterium
DTLPKLAERGDVFDLVFIDADKENNVAYV

SEQ ID NO: 649163 - protein, 19 aa, Mycobacterium
DTLPMLTGIRVEINGDTVV

SEQ ID NO: 649164 - protein, 23 aa, Mycobacterium
DTLPPRQRQLIILRDLVGTSAEE

SEQ ID NO: 649165 - protein, 17 aa, Mycobacterium
DTLPRRSLAFDMPPEYV

SEQ ID NO: 649166 - protein, 17 aa, Mycobacterium
DTLQAHLVVLTRHAVTT

SEQ ID NO: 649167 - protein, 22 aa, Mycobacterium
DTLRAAMGLLDRFGEVLLDERD

SEQ ID NO: 649168 - protein, 25 aa, Mycobacterium
DTLRGWRFYDGFRVDALAPARQPQI

SEQ ID NO: 649169 - protein, 23 aa, Mycobacterium
DTLRHAFAADMAFLRNCGIHPVV

SEQ ID NO: 649170 - protein, 24 aa, Mycobacterium
DTLRHAFAADMAFLRNCGVHPVVV

SEQ ID NO: 649171 - protein, 23 aa, Mycobacterium
DTLRRLTAELVLPVNAIALPDQD

SEQ ID NO: 649172 - protein, 26 aa, Mycobacterium
DTLRRYRAQSGFVFQSHNLFPHKTVL

SEQ ID NO: 649173 - protein, 18 aa, Mycobacterium
DTLSEALVQLGRFSALAA

SEQ ID NO: 649174 - protein, 17 aa, Mycobacterium
DTLSGFWNVGSEGSGFE

SEQ ID NO: 649175 - protein, 22 aa, Mycobacterium
DTLTQWDLMAWTLPKAANRFWM

SEQ ID NO: 649176 - protein, 25 aa, Mycobacterium
DTLVNCVGVFDFYRGVSDIDADILA

SEQ ID NO: 649177 - protein, 23 aa, Mycobacterium
DTLVPRLRRNAVIVGKSTVPVGT

SEQ ID NO: 649178 - protein, 25 aa, Mycobacterium
DTLYGLVNCAGILRDSFLGELDEAK

SEQ ID NO: 649179 - protein, 26 aa, Mycobacterium
DTLYRMPWSTMFPLGISSAVIGIAEG

SEQ ID NO: 649180 - protein, 18 aa, Mycobacterium
DTLYRQGQLLSWGLPATH

SEQ ID NO: 649181 - protein, 22 aa, Mycobacterium
DTMGFKTFGFAFGREDRWEPEQ

SEQ ID NO: 649182 - protein, 18 aa, Mycobacterium
DTMGRAWRNGQIDAAVGA

SEQ ID NO: 649183 - protein, 18 aa, Mycobacterium
DTMGRAWRNGQIDAAVGS

SEQ ID NO: 649184 - protein, 17 aa, Mycobacterium
DTMLTLFAERGGDPDRP

SEQ ID NO: 649185 - protein, 20 aa, Mycobacterium
DTMNLGFVGCRDRLPHLQRL

SEQ ID NO: 649186 - protein, 37 aa, Mycobacterium
DTMRGGKFLNNWRMAELHAKEAPDRVWELETYGALFD

SEQ ID NO: 649187 - protein, 38 aa, Mycobacterium
DTMRGGKFLNNWRMAELHAKEAPDRVWELETYGALFDR

SEQ ID NO: 649188 - protein, 18 aa, Mycobacterium
DTNEWREALLVAPDLLRK

SEQ ID NO: 649189 - protein, 27 aa, Mycobacterium
DTNIYYRRALMLAACFGRHTTYPQRVV

SEQ ID NO: 649190 - protein, 24 aa, Mycobacterium
DTNTRFCAHWGLAREGRVAYVNGF

SEQ ID NO: 649191 - protein, 29 aa, Mycobacterium
DTNVYYRRALLLAACFGRAADHPQQVVDT

SEQ ID NO: 649192 - protein, 27 aa, Mycobacterium
DTNVYYRRALMLAACFGRSVEYPQRVV

SEQ ID NO: 649193 - protein, 24 aa, Mycobacterium
DTNVYYRRALMLAASFGRASEYPQ

SEQ ID NO: 649194 - protein, 24 aa, Mycobacterium
DTNVYYRRALMLAASFGRSSDYPQ

SEQ ID NO: 649195 - protein, 25 aa, Mycobacterium
DTNVYYRRALVLAASFGRASEYPQR

SEQ ID NO: 649196 - protein, 24 aa, Mycobacterium
DTPANLFVAGFIGSPSMNFFPATL

SEQ ID NO: 649197 - protein, 19 aa, Mycobacterium
DTPAPVRGALVSRLGELLA

SEQ ID NO: 649198 - protein, 26 aa, Mycobacterium
DTPAQRWGVATGHERILLCGSGSRRG

SEQ ID NO: 649199 - protein, 24 aa, Mycobacterium
DTPDGRAALLARLDESVTAPAAFV

SEQ ID NO: 649200 - protein, 21 aa, Mycobacterium
DTPDPRWIALLANKYRQYRQA

SEQ ID NO: 649201 - protein, 23 aa, Mycobacterium
DTPDVVHCHGWVYGMAAQLAAKK

SEQ ID NO: 649202 - protein, 28 aa, Mycobacterium
DTPELMPLPIALAHRLARRLTEVRKNGV

SEQ ID NO: 649203 - protein, 28 aa, Mycobacterium
DTPELMPLPIALAHRLSRRLTEVRKNGV

SEQ ID NO: 649204 - protein, 22 aa, Mycobacterium
DTPEQRWTRHAGAQLSDAPSAA

SEQ ID NO: 649205 - protein, 28 aa, Mycobacterium
DTPERMPLPIALAHRLSRRLTEVRKNGV

SEQ ID NO: 649206 - protein, 24 aa, Mycobacterium
DTPERRRARARSQILSLAQTLLRN

SEQ ID NO: 649207 - protein, 23 aa, Mycobacterium
DTPEVRGDLAAFYGAISAADAAV

SEQ ID NO: 649208 - protein, 22 aa, Mycobacterium
DTPGCVAYIGISFLDQAQGKGL

SEQ ID NO: 649209 - protein, 20 aa, Mycobacterium
DTPGLHWTKIEMELISPESQ

SEQ ID NO: 649210 - protein, 25 aa, Mycobacterium
DTPGNFRVGLGWIIDALRRQAPGPR

SEQ ID NO: 649211 - protein, 25 aa, Mycobacterium
DTPGPLQWDCFRFGIIQRTDHFTCY

SEQ ID NO: 649212 - protein, 18 aa, Mycobacterium
DTPKAIAALDGWATDALE

SEQ ID NO: 649213 - protein, 24 aa, Mycobacterium
DTPKALAALDGWCTDALSYGGHDT

SEQ ID NO: 649214 - protein, 18 aa, Mycobacterium
DTPKALAALDGWSTDALE

SEQ ID NO: 649215 - protein, 20 aa, Mycobacterium
DTPLTLALAVNRALHDVLAE

SEQ ID NO: 649216 - protein, 20 aa, Mycobacterium
DTPRALGRFVHVYVDSDART

SEQ ID NO: 649217 - protein, 17 aa, Mycobacterium
DTPRPPLAQGEAKFVGD

SEQ ID NO: 649218 - protein, 18 aa, Mycobacterium
DTPSWRNTIAALDDQPLL

SEQ ID NO: 649219 - protein, 19 aa, Mycobacterium
DTPTPLFAQKGWNPQTQAV

SEQ ID NO: 649220 - protein, 18 aa, Mycobacterium
DTPVANWNRIMDINVDGV

SEQ ID NO: 649221 - protein, 17 aa, Mycobacterium
DTPVANWQRVMDVNVSG

SEQ ID NO: 649222 - protein, 18 aa, Mycobacterium
DTPVGPVRTCIGCRKREL

SEQ ID NO: 649223 - protein, 18 aa, Mycobacterium
DTPVPNWRRVVDVNISGV

SEQ ID NO: 649224 - protein, 26 aa, Mycobacterium
DTPVPTCPDWTLRQLLRHVGRGNRWA

SEQ ID NO: 649225 - protein, 19 aa, Mycobacterium
DTPVRWARLDSAPFTDRLV

SEQ ID NO: 649226 - protein, 25 aa, Mycobacterium
DTPWGRRTTTVWGQGPAWELPHTDY

SEQ ID NO: 649227 - protein, 25 aa, Mycobacterium
DTPWQREMEDAFGFVETVDQLTAIT

SEQ ID NO: 649228 - protein, 24 aa, Mycobacterium
DTPWQVEMEDAFGFTETVDQLTAI

SEQ ID NO: 649229 - protein, 22 aa, Mycobacterium
DTPWRAEYLYSRAATIYGGTAE

SEQ ID NO: 649230 - protein, 23 aa, Mycobacterium
DTPWRPEYLYSRAATIYGGTAEI

SEQ ID NO: 649231 - protein, 22 aa, Mycobacterium
DTPWRSEYLYSRAASIYGGTAE

SEQ ID NO: 649232 - protein, 23 aa, Mycobacterium
DTPWRTEYLYSRAATIYGGTAEV

SEQ ID NO: 649233 - protein, 20 aa, Mycobacterium
DTQFPALPLFELGYEVAHVG

SEQ ID NO: 649234 - protein, 24 aa, Mycobacterium
DTQFYCVANMPSAVPKTSTVALTN

SEQ ID NO: 649235 - protein, 17 aa, Mycobacterium
DTQLLRLSFGRFGDDLA

SEQ ID NO: 649236 - protein, 27 aa, Mycobacterium
DTQRARTVLDWSPRWRSTEVLADVIDG

SEQ ID NO: 649237 - protein, 24 aa, Mycobacterium
DTQSARMDLVFSLAERWTETGEAA

SEQ ID NO: 649238 - protein, 20 aa, Mycobacterium
DTQVAPAYRQSVSASVSASS

SEQ ID NO: 649239 - protein, 17 aa, Mycobacterium
DTQVWAMVGVTPMIGVN

SEQ ID NO: 649240 - protein, 29 aa, Mycobacterium
DTRAYFRGECLRKFGADIAAASWDSVIFD

SEQ ID NO: 649241 - protein, 26 aa, Mycobacterium
DTRAYRLDWPAGTVVYEIDQPEVIDF

SEQ ID NO: 649242 - protein, 26 aa, Mycobacterium
DTRAYRLDWPAGVTVFEIDYPELLEF

SEQ ID NO: 649243 - protein, 25 aa, Mycobacterium
DTRAYRLNWPSGMTVYEIDQPQVIE

SEQ ID NO: 649244 - protein, 27 aa, Mycobacterium
DTRAYRLRWPAGTVVYEIDQPDVIAFK

SEQ ID NO: 649245 - protein, 27 aa, Mycobacterium
DTRAYRLRWPAGTVVYEIDQPQVIAFK

SEQ ID NO: 649246 - protein, 21 aa, Mycobacterium
DTRGALLRGRVERFHRSALIL

SEQ ID NO: 649247 - protein, 19 aa, Mycobacterium
DTRGWLRHPAPLFRTNVEG

SEQ ID NO: 649248 - protein, 24 aa, Mycobacterium
DTRGYRLSWADGTTVFEIDVPQVV

SEQ ID NO: 649249 - protein, 17 aa, Mycobacterium
DTRKTLPGLRVLQKYAV

SEQ ID NO: 649250 - protein, 21 aa, Mycobacterium
DTRLPYSWRGISLHAAAAKRI

SEQ ID NO: 649251 - protein, 18 aa, Mycobacterium
DTRPDPRLPGPDGVIVDV

SEQ ID NO: 649252 - protein, 25 aa, Mycobacterium
DTRPVEFWPTAAIRAALESDDLSVW

SEQ ID NO: 649253 - protein, 17 aa, Mycobacterium
DTRRGWRVSEQLETGMV

SEQ ID NO: 649254 - protein, 24 aa, Mycobacterium
DTRRSRRALLCDWADFSEPVDRIV

SEQ ID NO: 649255 - protein, 19 aa, Mycobacterium
DTRSGRQLWVYGRAGQRCR

SEQ ID NO: 649256 - protein, 25 aa, Mycobacterium
DTRTARMDLAWSLAERWSADGRPEG

SEQ ID NO: 649257 - protein, 26 aa, Mycobacterium
DTRTARTDLAWSLAERWSADGRPAGI

SEQ ID NO: 649258 - protein, 24 aa, Mycobacterium
DTRTDVSLVLRMHHGGDFVIEPLP

SEQ ID NO: 649259 - protein, 19 aa, Mycobacterium
DTRTPVWVCAGDAHRAAEL

SEQ ID NO: 649260 - protein, 20 aa, Mycobacterium
DTRTVLGFCLSVVHNSEIRG

SEQ ID NO: 649261 - protein, 18 aa, Mycobacterium
DTRVFRINPSEMVRWADV

SEQ ID NO: 649262 - protein, 17 aa, Mycobacterium
DTRWDNFTLVTPNWHCR

SEQ ID NO: 649263 - protein, 26 aa, Mycobacterium
DTRWHPVSCLPPMAFDHGPMVTHAHA

SEQ ID NO: 649264 - protein, 20 aa, Mycobacterium
DTRYARTRARLRTNAGGCDR

SEQ ID NO: 649265 - protein, 18 aa, Mycobacterium
DTRYPGMHAFCGPTRKLG

SEQ ID NO: 649266 - protein, 19 aa, Mycobacterium
DTSAAAWAVAHDMVAGLDP

SEQ ID NO: 649267 - protein, 25 aa, Mycobacterium
DTSASVTCGIGFADLSSFTALTQML

SEQ ID NO: 649268 - protein, 26 aa, Mycobacterium
DTSASVVCGIGFADLSGFTVLTRALT

SEQ ID NO: 649269 - protein, 25 aa, Mycobacterium
DTSDRWVTLAFTWTGLRALGVPEES

SEQ ID NO: 649270 - protein, 24 aa, Mycobacterium
DTSELRLGATVIQAHIAKGQLELT

SEQ ID NO: 649271 - protein, 20 aa, Mycobacterium
DTSFSMVMENRWLPMKQTAL

SEQ ID NO: 649272 - protein, 20 aa, Mycobacterium
DTSFSMVMENRWLPMKRTAL

SEQ ID NO: 649273 - protein, 21 aa, Mycobacterium
DTSKPWFAIGGIDEARVPQVV

SEQ ID NO: 649274 - protein, 25 aa, Mycobacterium
DTSLFVRPFLKYQIITVVAPNSPLA

SEQ ID NO: 649275 - protein, 24 aa, Mycobacterium
DTSLPNWWPSILAPAVAGAGALRG

SEQ ID NO: 649276 - protein, 38 aa, Mycobacterium
DTSLPNWWPSILAPIVAGVGAWRGSRKTMIAGAAMSAI

SEQ ID NO: 649277 - protein, 20 aa, Mycobacterium
DTSNCGTCVVDVDGVPVKSC

SEQ ID NO: 649278 - protein, 20 aa, Mycobacterium
DTSNCGTCVVEVDGEPVKSC

SEQ ID NO: 649279 - protein, 21 aa, Mycobacterium
DTSNCGTCVVEVDGVPVKSCT

SEQ ID NO: 649280 - protein, 17 aa, Mycobacterium
DTSRASILAGIDTAVAQ

SEQ ID NO: 649281 - protein, 17 aa, Mycobacterium
DTSRLHPLATLDKMFIP

SEQ ID NO: 649282 - protein, 21 aa, Mycobacterium
DTSSFVIKTLFETVKQLEARM

SEQ ID NO: 649283 - protein, 24 aa, Mycobacterium
DTSTWRLTTLFGLMDAVAAAIEGG

SEQ ID NO: 649284 - protein, 19 aa, Mycobacterium
DTSVKNWLAPIVADGEAGF

SEQ ID NO: 649285 - protein, 27 aa, Mycobacterium
DTSWLDPFTEFRFPRIGTAVLGGVEIE

SEQ ID NO: 649286 - protein, 17 aa, Mycobacterium
DTSYRLDAVPGQRDHSW

SEQ ID NO: 649287 - protein, 24 aa, Mycobacterium
DTTATFEWAFRWLAANRPPASPPR

SEQ ID NO: 649288 - protein, 24 aa, Mycobacterium
DTTATFEWGFRWLAANRPDPTPAV

SEQ ID NO: 649289 - protein, 25 aa, Mycobacterium
DTTGSLPVMVWIPGGAFVYGAGQFQ

SEQ ID NO: 649290 - protein, 22 aa, Mycobacterium
DTTIAWKGDEAIELKSSTEERV

SEQ ID NO: 649291 - protein, 21 aa, Mycobacterium
DTTKAAEHWKAHKLDLTPVLH

SEQ ID NO: 649292 - protein, 27 aa, Mycobacterium
DTTLELWNRIVGVNLTGTFLVVREALP

SEQ ID NO: 649293 - protein, 25 aa, Mycobacterium
DTTLFRLPIRLALGPTHVAVVVGIA

SEQ ID NO: 649294 - protein, 25 aa, Mycobacterium
DTTMFKVMYGWGLRINELCRLDLAD

SEQ ID NO: 649295 - protein, 23 aa, Mycobacterium
DTTMRMLCVFNPPVTGQEIHDET

SEQ ID NO: 649296 - protein, 19 aa, Mycobacterium
DTTMRVFGVDSFAGSVLAD

SEQ ID NO: 649297 - protein, 27 aa, Mycobacterium
DTTMSLEMCRLVEAFGYGWSDLERFTI

SEQ ID NO: 649298 - protein, 24 aa, Mycobacterium
DTTPRVAQMFGVQAVPTVVALAAG

SEQ ID NO: 649299 - protein, 17 aa, Mycobacterium
DTTRIYRQAYEAAGAES

SEQ ID NO: 649300 - protein, 17 aa, Mycobacterium
DTTRLAALVDRLISSGV

SEQ ID NO: 649301 - protein, 20 aa, Mycobacterium
DTTRLVGWGSSFGGGHVLTL

SEQ ID NO: 649302 - protein, 22 aa, Mycobacterium
DTTSAGMLWEWEAMARDMAWDY

SEQ ID NO: 649303 - protein, 24 aa, Mycobacterium
DTTSEEWDRIVAVNTKGQMLGMQA

SEQ ID NO: 649304 - protein, 20 aa, Mycobacterium
DTTSISWLPLYHDMGLMLGL

SEQ ID NO: 649305 - protein, 24 aa, Mycobacterium
DTTTWRLATLFGLLDAVAAALDGG

SEQ ID NO: 649306 - protein, 23 aa, Mycobacterium
DTTYPLHRYFLWAKHNELTLGPA

SEQ ID NO: 649307 - protein, 20 aa, Mycobacterium
DTVAHPWFPDAVRLRRYDDA

SEQ ID NO: 649308 - protein, 19 aa, Mycobacterium
DTVALMLTNRPEFHLCDTA

SEQ ID NO: 649309 - protein, 19 aa, Mycobacterium
DTVALRFLGRSTTWGELDR

SEQ ID NO: 649310 - protein, 20 aa, Mycobacterium
DTVAPMRILTGIEVDILEDG

SEQ ID NO: 649311 - protein, 19 aa, Mycobacterium
DTVCPKGGAIIAPDDLAFD

SEQ ID NO: 649312 - protein, 23 aa, Mycobacterium
DTVDLRRSYPFYGQAHQGGIDTP

SEQ ID NO: 649313 - protein, 25 aa, Mycobacterium
DTVECPVCDGSGLRPEALRVTFAGR

SEQ ID NO: 649314 - protein, 21 aa, Mycobacterium
DTVEGRWCAESDLAKNVHGEA

SEQ ID NO: 649315 - protein, 25 aa, Mycobacterium
DTVFDGGWLLPGLVDAHCHVGIGPQ

SEQ ID NO: 649316 - protein, 17 aa, Mycobacterium
DTVFNRRSGMLGLCGAN

SEQ ID NO: 649317 - protein, 24 aa, Mycobacterium
DTVFRRLCAAMGRPELATDERFSD

SEQ ID NO: 649318 - protein, 23 aa, Mycobacterium
DTVFRRLCEAMGRPELSSDARFA

SEQ ID NO: 649319 - protein, 24 aa, Mycobacterium
DTVFTLSGGHLFSVYDGCREEGIR

SEQ ID NO: 649320 - protein, 24 aa, Mycobacterium
DTVFYCVANMPGAAPRTSTYALTN

SEQ ID NO: 649321 - protein, 24 aa, Mycobacterium
DTVFYCVANMPGAVPRTSTYALTN

SEQ ID NO: 649322 - protein, 23 aa, Mycobacterium
DTVGARLLLLRRLAHPEDTRLGP

SEQ ID NO: 649323 - protein, 25 aa, Mycobacterium
DTVHGGVCALVLDHVLGATAHQPDK

SEQ ID NO: 649324 - protein, 17 aa, Mycobacterium
DTVHPFFAITKEINVQF

SEQ ID NO: 649325 - protein, 19 aa, Mycobacterium
DTVHRLWRGDPITFQRNGI

SEQ ID NO: 649326 - protein, 23 aa, Mycobacterium
DTVKRGGIFHGVQLWVNLPKKDK

SEQ ID NO: 649327 - protein, 17 aa, Mycobacterium
DTVKVPWQAYLGAGHPL

SEQ ID NO: 649328 - protein, 27 aa, Mycobacterium
DTVLTKWKYSEFFRSDLLEILHDANRD

SEQ ID NO: 649329 - protein, 18 aa, Mycobacterium
DTVMEGNETFLVTLSSPA

SEQ ID NO: 649330 - protein, 30 aa, Mycobacterium
DTVNCLRIQLMAFAYDGAWAEYTVAQAAGL

SEQ ID NO: 649331 - protein, 20 aa, Mycobacterium
DTVPCRGLDKLAAGAGALVH

SEQ ID NO: 649332 - protein, 17 aa, Mycobacterium
DTVPVIIDDALGFTDAD

SEQ ID NO: 649333 - protein, 23 aa, Mycobacterium
DTVRACRMLGAALVVVGDPFEMA

SEQ ID NO: 649334 - protein, 21 aa, Mycobacterium
DTVRGGAFVRLSFAGPSSDIE

SEQ ID NO: 649335 - protein, 25 aa, Mycobacterium
DTVRRLEARLAQWAAALEAGTGRGV

SEQ ID NO: 649336 - protein, 19 aa, Mycobacterium
DTVSHVLRAMCLTEDQARG

SEQ ID NO: 649337 - protein, 20 aa, Mycobacterium
DTVSWARLGAVNVTGLDLSP

SEQ ID NO: 649338 - protein, 23 aa, Mycobacterium
DTVVCTFGLCAIPDHSQALTEMT

SEQ ID NO: 649339 - protein, 19 aa, Mycobacterium
DTVVRGRIDAVFADPDGGV

SEQ ID NO: 649340 - protein, 17 aa, Mycobacterium
DTVVRGRIDAVFEDPDG

SEQ ID NO: 649341 - protein, 23 aa, Mycobacterium
DTVWLRLADRTEIEVAVDGVRVG

SEQ ID NO: 649342 - protein, 17 aa, Mycobacterium
DTWFSSALWPFSTLGWP

SEQ ID NO: 649343 - protein, 23 aa, Mycobacterium
DTWFSSALWPFSTLGWPDKTPEL

SEQ ID NO: 649344 - protein, 23 aa, Mycobacterium
DTWFSSALWPFSTLGWPETTPEL

SEQ ID NO: 649345 - protein, 20 aa, Mycobacterium
DTWIPGWRPRDLSTANFPQL

SEQ ID NO: 649346 - protein, 21 aa, Mycobacterium
DTWIPGWRPRDLSTSNFPQLR

SEQ ID NO: 649347 - protein, 22 aa, Mycobacterium
DTWLVHRLCGAFVTDASTASRS

SEQ ID NO: 649348 - protein, 20 aa, Mycobacterium
DTWRRLGLTVPLVVDPVCAS

SEQ ID NO: 649349 - protein, 21 aa, Mycobacterium
DTWYLRQGDVYFIPRAYPHHI

SEQ ID NO: 649350 - protein, 25 aa, Mycobacterium
DTYAGVPCWSGGPSYWAHTTVAVAY

SEQ ID NO: 649351 - protein, 25 aa, Mycobacterium
DTYARTRHNLGFMVADLLAARLGSK

SEQ ID NO: 649352 - protein, 19 aa, Mycobacterium
DTYGFPIELTLEMAAESGL

SEQ ID NO: 649353 - protein, 17 aa, Mycobacterium
DTYKGPWAYAPGAVFTD

SEQ ID NO: 649354 - protein, 29 aa, Mycobacterium
DTYRFYFCSTACLRQFARRVGEVRTPSGN

SEQ ID NO: 649355 - protein, 28 aa, Mycobacterium
DTYRFYFCSTACLRRFADRVGDMSTSPG

SEQ ID NO: 649356 - protein, 26 aa, Mycobacterium
DTYVPEWMWHSPAAVKRVFLQALFEG

SEQ ID NO: 649357 - protein, 34 aa, Mycobacterium
DTYWLGRDRFVLSCGHSSLTLYLQLYLGGFGLEL

SEQ ID NO: 649358 - protein, 24 aa, Mycobacterium
DVAADVWSVTSWGELNRDGISVER

SEQ ID NO: 649359 - protein, 24 aa, Mycobacterium
DVAADVWSVTSWGELNRDGLAIDH

SEQ ID NO: 649360 - protein, 24 aa, Mycobacterium
DVAADVWSVTSWGELNRDGVAVDR

SEQ ID NO: 649361 - protein, 24 aa, Mycobacterium
DVAADVWSVTSWGELNREGVAIEK

SEQ ID NO: 649362 - protein, 20 aa, Mycobacterium
DVAADVWSVTSWSELNRDGV

SEQ ID NO: 649363 - protein, 24 aa, Mycobacterium
DVAAELPALYSRLVASEPRQDATT

SEQ ID NO: 649364 - protein, 29 aa, Mycobacterium
DVAAFDLYSCFPFPVFNICDGTGLATDDP

SEQ ID NO: 649365 - protein, 29 aa, Mycobacterium
DVAAILRFAATEVVPRLAGTAREIDQILR

SEQ ID NO: 649366 - protein, 17 aa, Mycobacterium
DVAARIVALEAKLAAAH

SEQ ID NO: 649367 - protein, 18 aa, Mycobacterium
DVAARLSLTAAQVAALCD

SEQ ID NO: 649368 - protein, 24 aa, Mycobacterium
DVAAWPATLDRLLALGGPEAIYVP

SEQ ID NO: 649369 - protein, 18 aa, Mycobacterium
DVAAWPATLERLLAIGGP

SEQ ID NO: 649370 - protein, 19 aa, Mycobacterium
DVAEALKPLRQVLREMGDL

SEQ ID NO: 649371 - protein, 18 aa, Mycobacterium
DVAEFATGGATNFIQTGR

SEQ ID NO: 649372 - protein, 23 aa, Mycobacterium
DVAEFPRTAWLASARRALSNAPA

SEQ ID NO: 649373 - protein, 24 aa, Mycobacterium
DVAEIELLPVIKFFPASDVLALYR

SEQ ID NO: 649374 - protein, 22 aa, Mycobacterium
DVAELKSRIGLSSAALAQRIPD

SEQ ID NO: 649375 - protein, 25 aa, Mycobacterium
DVAELPRPLTLDSFAGLPPAKQPSV

SEQ ID NO: 649376 - protein, 34 aa, Mycobacterium
DVAELYDGFSFNCLSWIEALGFCGIGEAKDFLDG

SEQ ID NO: 649377 - protein, 25 aa, Mycobacterium
DVAERLRVLIDWTGAHLAEVEVNDK

SEQ ID NO: 649378 - protein, 24 aa, Mycobacterium
DVAERLRVLIDWTSDHLAEVEVSD

SEQ ID NO: 649379 - protein, 19 aa, Mycobacterium
DVAEVIEFVASRPAHVDLD

SEQ ID NO: 649380 - protein, 20 aa, Mycobacterium
DVAEVIGFVAARPSHVDLDL

SEQ ID NO: 649381 - protein, 19 aa, Mycobacterium
DVAEWLAARGWKVQGSHAL

SEQ ID NO: 649382 - protein, 30 aa, Mycobacterium
DVAEWLDAHGWRARGVHALDEMRRLDRLVE

SEQ ID NO: 649383 - protein, 19 aa, Mycobacterium
DVAGCREFVAASLPQDIRQ

SEQ ID NO: 649384 - protein, 19 aa, Mycobacterium
DVAGFDCDFFGMTEREATA

SEQ ID NO: 649385 - protein, 26 aa, Mycobacterium
DVAGGFTLDGLGGWFVDGIEGDPSNV

SEQ ID NO: 649386 - protein, 18 aa, Mycobacterium
DVAGLCSYLCTDAAGYIT

SEQ ID NO: 649387 - protein, 18 aa, Mycobacterium
DVAGLRADADFMIWSHAE

SEQ ID NO: 649388 - protein, 23 aa, Mycobacterium
DVAGLRADADFMIWTHADNVEAL

SEQ ID NO: 649389 - protein, 19 aa, Mycobacterium
DVAGLRADADFMIWTHAER

SEQ ID NO: 649390 - protein, 21 aa, Mycobacterium
DVAGMLGRLADFVRSSRSQGH

SEQ ID NO: 649391 - protein, 19 aa, Mycobacterium
DVAHDIDVFRNWSEASSDD

SEQ ID NO: 649392 - protein, 18 aa, Mycobacterium
DVAISIAQLIPGAEILVV

SEQ ID NO: 649393 - protein, 19 aa, Mycobacterium
DVAKALGARSVRVPAVAAS

SEQ ID NO: 649394 - protein, 25 aa, Mycobacterium
DVAKAWSEFYWLMADELIAREKALY

SEQ ID NO: 649395 - protein, 17 aa, Mycobacterium
DVAKIWVRTHSVILAGS

SEQ ID NO: 649396 - protein, 19 aa, Mycobacterium
DVAKMIGAPIFHVNGDDPE

SEQ ID NO: 649397 - protein, 22 aa, Mycobacterium
DVALDMARLLSPFVETNALADK

SEQ ID NO: 649398 - protein, 24 aa, Mycobacterium
DVALHKLPVTMVLDRAGITGPDGA

SEQ ID NO: 649399 - protein, 23 aa, Mycobacterium
DVALHRLPVTMVLDRAGITGSDG

SEQ ID NO: 649400 - protein, 29 aa, Mycobacterium
DVALRIWRPRWARWTAHVVRSGGLIRDGI

SEQ ID NO: 649401 - protein, 21 aa, Mycobacterium
DVALRRAWETFCYQVKAAGQQ

SEQ ID NO: 649402 - protein, 22 aa, Mycobacterium
DVAPKLPELWGGSADLAGSNNT

SEQ ID NO: 649403 - protein, 28 aa, Mycobacterium
DVAPLRILGLLPHKQRVAIQTNNITGHW

SEQ ID NO: 649404 - protein, 23 aa, Mycobacterium
DVAPPRRFGALSIDVAAREVRID

SEQ ID NO: 649405 - protein, 25 aa, Mycobacterium
DVAPRPGRIWLQITAYDGRRPGFGD

SEQ ID NO: 649406 - protein, 22 aa, Mycobacterium
DVAPVVSCGRYPAKAVVGEVVP

SEQ ID NO: 649407 - protein, 20 aa, Mycobacterium
DVAQHYLHFGGVSPINGINR

SEQ ID NO: 649408 - protein, 25 aa, Mycobacterium
DVAQRINARFPDTFVVPEAMIPKAT

SEQ ID NO: 649409 - protein, 24 aa, Mycobacterium
DVAQRLLTRNGWRSTTLAQIAGEA

SEQ ID NO: 649410 - protein, 25 aa, Mycobacterium
DVAQRLLTRNGWRSTTLAQIAGEAG

SEQ ID NO: 649411 - protein, 18 aa, Mycobacterium
DVAQRYSLGMTEQLITEA

SEQ ID NO: 649412 - protein, 18 aa, Mycobacterium
DVAQRYSLGMTEQMLTEA

SEQ ID NO: 649413 - protein, 26 aa, Mycobacterium
DVARGLRIARQLLLDIIDIGLPVGCE

SEQ ID NO: 649414 - protein, 21 aa, Mycobacterium
DVARIKYHYVEKINHVHTGGN

SEQ ID NO: 649415 - protein, 22 aa, Mycobacterium
DVARRLRVADRVRMMRGDECPE

SEQ ID NO: 649416 - protein, 24 aa, Mycobacterium
DVARRSRNRPVWVKGFGEHVPFKT

SEQ ID NO: 649417 - protein, 28 aa, Mycobacterium
DVARSLRATLRFAQDMYALIPLILAERK

SEQ ID NO: 649418 - protein, 24 aa, Mycobacterium
DVARTTIFEAIRLASIVSGVAQAL

SEQ ID NO: 649419 - protein, 18 aa, Mycobacterium
DVARVVVRLIHTCGQVDV

SEQ ID NO: 649420 - protein, 24 aa, Mycobacterium
DVARWPELRAVLTEAFGRYDRDHW

SEQ ID NO: 649421 - protein, 19 aa, Mycobacterium
DVASAFGGLAGYDEFVDTA

SEQ ID NO: 649422 - protein, 22 aa, Mycobacterium
DVASIKVLAHLLAAAEATTMTP

SEQ ID NO: 649423 - protein, 23 aa, Mycobacterium
DVASRAGQLQGIFDDTSNRTNAL

SEQ ID NO: 649424 - protein, 24 aa, Mycobacterium
DVATDVWSVTSWSELNRDGVSVER

SEQ ID NO: 649425 - protein, 19 aa, Mycobacterium
DVATELFALHGFTSVTTTS

SEQ ID NO: 649426 - protein, 25 aa, Mycobacterium
DVATGLKPMRWGTGYMLGGKRFGPF

SEQ ID NO: 649427 - protein, 17 aa, Mycobacterium
DVATLDMVVRWQGDGGH

SEQ ID NO: 649428 - protein, 20 aa, Mycobacterium
DVAVHSCVYPAFRADGRDVK

SEQ ID NO: 649429 - protein, 17 aa, Mycobacterium
DVAWSLAGRSHFDHRAV

SEQ ID NO: 649430 - protein, 25 aa, Mycobacterium
DVCDCAHCASVYGPAAYLADLLRFL

SEQ ID NO: 649431 - protein, 21 aa, Mycobacterium
DVCLTAGRGRSHFEHRAALVV

SEQ ID NO: 649432 - protein, 24 aa, Mycobacterium
DVCQRFEPWYTPQRIECTMMTVEP

SEQ ID NO: 649433 - protein, 19 aa, Mycobacterium
DVCRALRHTGRRVMLVPTM

SEQ ID NO: 649434 - protein, 20 aa, Mycobacterium
DVCYLAMPLFHSNGVAAGWA

SEQ ID NO: 649435 - protein, 22 aa, Mycobacterium
DVDAALHYLARMLVAGEDPRFI

SEQ ID NO: 649436 - protein, 19 aa, Mycobacterium
DVDACTRAGIAVCNNSGPG

SEQ ID NO: 649437 - protein, 25 aa, Mycobacterium
DVDAGLRPKSLREFIGQPRVREQLE

SEQ ID NO: 649438 - protein, 20 aa, Mycobacterium
DVDAYIHAGGQWEWDSAAPA

SEQ ID NO: 649439 - protein, 26 aa, Mycobacterium
DVDCSATLPGAIGWLKYTIDNELLMN

SEQ ID NO: 649440 - protein, 18 aa, Mycobacterium
DVDDILWQVPYLPIDPKD

SEQ ID NO: 649441 - protein, 25 aa, Mycobacterium
DVDDLKAPLLAAVGAADLALERVNE

SEQ ID NO: 649442 - protein, 23 aa, Mycobacterium
DVDDTRMAMAFDRMGPGWRDVVL

SEQ ID NO: 649443 - protein, 19 aa, Mycobacterium
DVDEICRLLRGGKSVVASG

SEQ ID NO: 649444 - protein, 25 aa, Mycobacterium
DVDEKLWDAAEWSVQVQLNHLHQAG

SEQ ID NO: 649445 - protein, 24 aa, Mycobacterium
DVDFPDALLVPGFVDMHVHGGGGA

SEQ ID NO: 649446 - protein, 26 aa, Mycobacterium
DVDFYKWTQWIFLQIYNAWYDEQARR

SEQ ID NO: 649447 - protein, 19 aa, Mycobacterium
DVDGARKVFKLVEALEDSD

SEQ ID NO: 649448 - protein, 18 aa, Mycobacterium
DVDGCVRLFASDGEFLVY

SEQ ID NO: 649449 - protein, 18 aa, Mycobacterium
DVDGGFVAPGFVDSHIHL

SEQ ID NO: 649450 - protein, 19 aa, Mycobacterium
DVDGMRADLVVARTAVAHA

SEQ ID NO: 649451 - protein, 19 aa, Mycobacterium
DVDGPLFGAALRHGVALVA

SEQ ID NO: 649452 - protein, 25 aa, Mycobacterium
DVDGVLIPGGFGIRGIEGKLGAIRY

SEQ ID NO: 649453 - protein, 25 aa, Mycobacterium
DVDGVLIPGGFGIRGIEGKVGAIRY

SEQ ID NO: 649454 - protein, 20 aa, Mycobacterium
DVDIPLGAFVAVTGVSGSGK

SEQ ID NO: 649455 - protein, 24 aa, Mycobacterium
DVDKPKLVFFFDEAHLLFNDASKA

SEQ ID NO: 649456 - protein, 18 aa, Mycobacterium
DVDLFLRPSGEFRSSNFM

SEQ ID NO: 649457 - protein, 17 aa, Mycobacterium
DVDLPWSQLAALPETYA

SEQ ID NO: 649458 - protein, 23 aa, Mycobacterium
DVDLTVLIDLQFQHDRLHHVLQV

SEQ ID NO: 649459 - protein, 25 aa, Mycobacterium
DVDLYPRLVCNAAYAVLATVIQLAV

SEQ ID NO: 649460 - protein, 18 aa, Mycobacterium
DVDNIFFESGIEPFFQIA

SEQ ID NO: 649461 - protein, 20 aa, Mycobacterium
DVDPDMWETIVLNLLSNAVK

SEQ ID NO: 649462 - protein, 24 aa, Mycobacterium
DVDPRVPLGQALRDALLAFNTFGE

SEQ ID NO: 649463 - protein, 23 aa, Mycobacterium
DVDRARRIACRHLADTQTYVLSG

SEQ ID NO: 649464 - protein, 22 aa, Mycobacterium
DVDRARSAARHAATNAAFAAES

SEQ ID NO: 649465 - protein, 24 aa, Mycobacterium
DVDRLRGTCFGITAGDEIGYAIAQ

SEQ ID NO: 649466 - protein, 26 aa, Mycobacterium
DVDTDLRWRIVIALATAGAIDADGPQ

SEQ ID NO: 649467 - protein, 26 aa, Mycobacterium
DVDVLELYDPFSFEIIRQLEAFGFCG

SEQ ID NO: 649468 - protein, 29 aa, Mycobacterium
DVDVRGASWLPLYHDMGLLMLMFPLCGGR

SEQ ID NO: 649469 - protein, 20 aa, Mycobacterium
DVDVSIRSRAEWRRLYEEKQ

SEQ ID NO: 649470 - protein, 20 aa, Mycobacterium
DVDVVLCATGYAAADYLGQI

SEQ ID NO: 649471 - protein, 27 aa, Mycobacterium
DVDYYKWTQWIFLQIFNAWFDTDQNRA

SEQ ID NO: 649472 - protein, 28 aa, Mycobacterium
DVEAIRWTTWHAAWLIAHGRPLTEAGRA

SEQ ID NO: 649473 - protein, 18 aa, Mycobacterium
DVEAQGWIAPAECVEVRV

SEQ ID NO: 649474 - protein, 24 aa, Mycobacterium
DVEARALPPGHAFRTDDRLVKTLV

SEQ ID NO: 649475 - protein, 20 aa, Mycobacterium
DVEASGLWPGKVVTEVSPAG

SEQ ID NO: 649476 - protein, 28 aa, Mycobacterium
DVEDLGRLCVYLSTRDCYATNAIFHVDG

SEQ ID NO: 649477 - protein, 18 aa, Mycobacterium
DVEFDWAKLPFYYVPNEP

SEQ ID NO: 649478 - protein, 17 aa, Mycobacterium
DVEFDWANLPFHYVPNE

SEQ ID NO: 649479 - protein, 27 aa, Mycobacterium
DVEFPENPRMAALEGVDLLAVPTAQMK

SEQ ID NO: 649480 - protein, 26 aa, Mycobacterium
DVEFYKWTQWIFLQIYNAWFDAAANK

SEQ ID NO: 649481 - protein, 26 aa, Mycobacterium
DVEFYKWTQWIFLQIYNAWFDTAAGK

SEQ ID NO: 649482 - protein, 18 aa, Mycobacterium
DVEGFPYKEIAEIMDTPI

SEQ ID NO: 649483 - protein, 18 aa, Mycobacterium
DVEGFPYKEIAEIMETPI

SEQ ID NO: 649484 - protein, 19 aa, Mycobacterium
DVEGFPYKEIAEIMETPIG

SEQ ID NO: 649485 - protein, 19 aa, Mycobacterium
DVEGGQYFGPDGFLEQRGH

SEQ ID NO: 649486 - protein, 26 aa, Mycobacterium
DVEGLRRFHRNLGCGLLGRRIERSPL

SEQ ID NO: 649487 - protein, 24 aa, Mycobacterium
DVEGPRATILLRLDQAVPDDVRSA

SEQ ID NO: 649488 - protein, 24 aa, Mycobacterium
DVELAELFAPLAKQLVENEDQIVA

SEQ ID NO: 649489 - protein, 26 aa, Mycobacterium
DVELDLGWGRLIFGQTFADSAALADV

SEQ ID NO: 649490 - protein, 26 aa, Mycobacterium
DVELELGWGRLIFGQTFADAHELVEA

SEQ ID NO: 649491 - protein, 25 aa, Mycobacterium
DVELELGWGRLIFGQTFADSQQLVE

SEQ ID NO: 649492 - protein, 24 aa, Mycobacterium
DVENWRWMWEANVMGTLHVTRALL

SEQ ID NO: 649493 - protein, 18 aa, Mycobacterium
DVEPCAAVARELQRRGHD

SEQ ID NO: 649494 - protein, 26 aa, Mycobacterium
DVEPCTAVARELRRRGHEVGMAVPPN

SEQ ID NO: 649495 - protein, 23 aa, Mycobacterium
DVEPDLTNAVAFLAAAVVSGGTV

SEQ ID NO: 649496 - protein, 23 aa, Mycobacterium
DVEPDLTNAVAFLAAAVVTGGTV

SEQ ID NO: 649497 - protein, 24 aa, Mycobacterium
DVEPEVFDALPIAQRTALRQVLVR

SEQ ID NO: 649498 - protein, 20 aa, Mycobacterium
DVEPEWGRKVIDVREDADGV

SEQ ID NO: 649499 - protein, 22 aa, Mycobacterium
DVEPGDVCIIMYSSGTTGRPKG

SEQ ID NO: 649500 - protein, 20 aa, Mycobacterium
DVEPRMLLVHFLRDQLRLTG

SEQ ID NO: 649501 - protein, 18 aa, Mycobacterium
DVEREWVQLLPAYETTFD

SEQ ID NO: 649502 - protein, 26 aa, Mycobacterium
DVESLAMRAEERFGPERVITATTLPD

SEQ ID NO: 649503 - protein, 26 aa, Mycobacterium
DVETRMKLKIAREFTQRPVQPQNKRI

SEQ ID NO: 649504 - protein, 18 aa, Mycobacterium
DVETTWKLLLDSQSGIRV

SEQ ID NO: 649505 - protein, 21 aa, Mycobacterium
DVEVIGWLAGHLTARPARALV

SEQ ID NO: 649506 - protein, 24 aa, Mycobacterium
DVEVKLPVPGPMVKKLAGETLEHL

SEQ ID NO: 649507 - protein, 25 aa, Mycobacterium
DVEVLKLSALRGLFSAVVEGPVTFV

SEQ ID NO: 649508 - protein, 27 aa, Mycobacterium
DVEVLKLSALRGLFSAVVEGPVTFVNA

SEQ ID NO: 649509 - protein, 19 aa, Mycobacterium
DVFAAFGAWAQENGTTLYP

SEQ ID NO: 649510 - protein, 24 aa, Mycobacterium
DVFAAGGLYVQWVLARQAAGDLWA

SEQ ID NO: 649511 - protein, 23 aa, Mycobacterium
DVFEFPTVGLLAGRVDQLSSGEP

SEQ ID NO: 649512 - protein, 22 aa, Mycobacterium
DVFEPLPGMGRWQTVLLVDGNV

SEQ ID NO: 649513 - protein, 19 aa, Mycobacterium
DVFGRFGTDIGVAFQLRDD

SEQ ID NO: 649514 - protein, 22 aa, Mycobacterium
DVFKEKLIRRDISMKAFDAGEP

SEQ ID NO: 649515 - protein, 18 aa, Mycobacterium
DVFLTNFLPAARRRLGIE

SEQ ID NO: 649516 - protein, 18 aa, Mycobacterium
DVFLTNYLPSTRKKLSID

SEQ ID NO: 649517 - protein, 18 aa, Mycobacterium
DVFLVRKLGVPRWSELAM

SEQ ID NO: 649518 - protein, 20 aa, Mycobacterium
DVFPRAKAMLPKAIAAGVRI

SEQ ID NO: 649519 - protein, 25 aa, Mycobacterium
DVFSAGLMLIWACDLIVGSEEVRFA

SEQ ID NO: 649520 - protein, 25 aa, Mycobacterium
DVFSEALAAPLYWIATNAGLDGAVA

SEQ ID NO: 649521 - protein, 24 aa, Mycobacterium
DVFSEALAAPLYWIATNAGLDGSV

SEQ ID NO: 649522 - protein, 24 aa, Mycobacterium
DVFSRRILGWRVMSTKATPLVTSV

SEQ ID NO: 649523 - protein, 24 aa, Mycobacterium
DVFSSPAADDWMCLLEAFDQPHRS

SEQ ID NO: 649524 - protein, 20 aa, Mycobacterium
DVFTEAGALGLLGFAAPEQY

SEQ ID NO: 649525 - protein, 19 aa, Mycobacterium
DVFVGAVFDRVIADIATTT

SEQ ID NO: 649526 - protein, 19 aa, Mycobacterium
DVFVVFSAAAAVLGAPGLA

SEQ ID NO: 649527 - protein, 25 aa, Mycobacterium
DVFYLHSRLLERCAKLSDELGAGSL

SEQ ID NO: 649528 - protein, 25 aa, Mycobacterium
DVFYLHSRLLERCAKLSDELGGGSM

SEQ ID NO: 649529 - protein, 22 aa, Mycobacterium
DVFYPRVFLGLGRSVPAGTVSM

SEQ ID NO: 649530 - protein, 20 aa, Mycobacterium
DVGAAFERLIALVRSTSGDE

SEQ ID NO: 649531 - protein, 17 aa, Mycobacterium
DVGAWVCHPGGPKVIDA

SEQ ID NO: 649532 - protein, 19 aa, Mycobacterium
DVGCFVGASATGYGPEMAR

SEQ ID NO: 649533 - protein, 17 aa, Mycobacterium
DVGCGEGLLAQRLAPVS

SEQ ID NO: 649534 - protein, 25 aa, Mycobacterium
DVGCSWLPLYHDMGLSFLLASSLGG

SEQ ID NO: 649535 - protein, 23 aa, Mycobacterium
DVGDGQLGSWGFPEGGMGAVSAA

SEQ ID NO: 649536 - protein, 35 aa, Mycobacterium
DVGDPEAVAGLLARVPARFPLRGVFHAAGVLDDAV

SEQ ID NO: 649537 - protein, 22 aa, Mycobacterium
DVGDPRLPQMPATPEQIDALAA

SEQ ID NO: 649538 - protein, 19 aa, Mycobacterium
DVGEALALQYFHSAPWVAW

SEQ ID NO: 649539 - protein, 22 aa, Mycobacterium
DVGEICGLGAPVGVTATDDVDA

SEQ ID NO: 649540 - protein, 19 aa, Mycobacterium
DVGELCGIEPLGVSATDDV

SEQ ID NO: 649541 - protein, 19 aa, Mycobacterium
DVGELPTRYARGWHCLGVA

SEQ ID NO: 649542 - protein, 21 aa, Mycobacterium
DVGEWFGRHGWDVTVTPSDEL

SEQ ID NO: 649543 - protein, 24 aa, Mycobacterium
DVGFGGAVGLKFLLDSVGPSGRVH

SEQ ID NO: 649544 - protein, 18 aa, Mycobacterium
DVGFPYRSALWPGRNAEI

SEQ ID NO: 649545 - protein, 19 aa, Mycobacterium
DVGFRLPAPNGVHFHPPRS

SEQ ID NO: 649546 - protein, 19 aa, Mycobacterium
DVGGFDCDFFGMTEREAIA

SEQ ID NO: 649547 - protein, 17 aa, Mycobacterium
DVGGMFLLSRAPGGLGL

SEQ ID NO: 649548 - protein, 20 aa, Mycobacterium
DVGGPGQCQRRGFAGVQRDP

SEQ ID NO: 649549 - protein, 22 aa, Mycobacterium
DVGGRRFELAWTPGGETTDSLV

SEQ ID NO: 649550 - protein, 24 aa, Mycobacterium
DVGHIPGAVKIDWHTDLNDPRVRD

SEQ ID NO: 649551 - protein, 21 aa, Mycobacterium
DVGHIPGAVKVDWHTDLNDPR

SEQ ID NO: 649552 - protein, 21 aa, Mycobacterium
DVGHIPGAVKVDWHTDLNDPT

SEQ ID NO: 649553 - protein, 23 aa, Mycobacterium
DVGLPPALPMALSVSQRYWGKDA

SEQ ID NO: 649554 - protein, 25 aa, Mycobacterium
DVGLRSAYVASWHAAPLLLAGDKGL

SEQ ID NO: 649555 - protein, 24 aa, Mycobacterium
DVGLSEFRVDLVIADHDEPDRALV

SEQ ID NO: 649556 - protein, 18 aa, Mycobacterium
DVGNPVHGRLRILVRDLW

SEQ ID NO: 649557 - protein, 19 aa, Mycobacterium
DVGQLGGLHFFLVVFPQSG

SEQ ID NO: 649558 - protein, 21 aa, Mycobacterium
DVGRHGICHQVIAENGLARPG

SEQ ID NO: 649559 - protein, 32 aa, Mycobacterium
DVGRIVLHLEPWLEADPICWAINTVPVRVGPG

SEQ ID NO: 649560 - protein, 21 aa, Mycobacterium
DVGRLMVSLHMGLRKTSNLDD

SEQ ID NO: 649561 - protein, 27 aa, Mycobacterium
DVGSVLELRADYGVGIVTALVRIEGFA

SEQ ID NO: 649562 - protein, 27 aa, Mycobacterium
DVGSVLELRSDYGVGIVTALVRVGGSA

SEQ ID NO: 649563 - protein, 27 aa, Mycobacterium
DVGSVLQLRADYGVGIVTALVRVEGVP

SEQ ID NO: 649564 - protein, 21 aa, Mycobacterium
DVGWTALRMWRFGLDDREFGG

SEQ ID NO: 649565 - protein, 19 aa, Mycobacterium
DVGYGWAMEDTTGFVKLVG

SEQ ID NO: 649566 - protein, 25 aa, Mycobacterium
DVHAKLGIATEAWSPLGQGSLLADP

SEQ ID NO: 649567 - protein, 17 aa, Mycobacterium
DVHFDWAALPFHYVPGE

SEQ ID NO: 649568 - protein, 26 aa, Mycobacterium
DVHGILIPGGFGIRGIEGKIGAIRYA

SEQ ID NO: 649569 - protein, 24 aa, Mycobacterium
DVHIERRFAHTWKGHTYTPEGVTL

SEQ ID NO: 649570 - protein, 18 aa, Mycobacterium
DVHIKRDLSVAAVQALCD

SEQ ID NO: 649571 - protein, 32 aa, Mycobacterium
DVHLRGAFHVMRPAWRIMREQRYGRVLNTCSA

SEQ ID NO: 649572 - protein, 25 aa, Mycobacterium
DVHLRGAFHVVRPAFGLMCDQLYGR

SEQ ID NO: 649573 - protein, 30 aa, Mycobacterium
DVHLRGAFHVVRPAFPVMCDNGYGRIVLTS

SEQ ID NO: 649574 - protein, 24 aa, Mycobacterium
DVHLRGAFNVVRQAFPVMCRAGYG

SEQ ID NO: 649575 - protein, 25 aa, Mycobacterium
DVHLWDWAAGALIASEAGALVRPPR

SEQ ID NO: 649576 - protein, 22 aa, Mycobacterium
DVHLYWRRAISLAGSIGPANRW

SEQ ID NO: 649577 - protein, 29 aa, Mycobacterium
DVHRAGGIPAILGELWRGGHLHETVHSVH

SEQ ID NO: 649578 - protein, 29 aa, Mycobacterium
DVHREYIDWDLPEVLSLNVIEEDPHSWIT

SEQ ID NO: 649579 - protein, 24 aa, Mycobacterium
DVHRSELLVLLGLSGSGKSTLLRC

SEQ ID NO: 649580 - protein, 17 aa, Mycobacterium
DVHVELVAAGTGRQYAR

SEQ ID NO: 649581 - protein, 22 aa, Mycobacterium
DVHVRPRVVLLGGGEQGRELTI

SEQ ID NO: 649582 - protein, 20 aa, Mycobacterium
DVHYYRHGRIGDFVVNEPMI

SEQ ID NO: 649583 - protein, 21 aa, Mycobacterium
DVIAFLKRWLLVSDERARHML

SEQ ID NO: 649584 - protein, 25 aa, Mycobacterium
DVIARGGFPDGCFQTLLVPSSAVED

SEQ ID NO: 649585 - protein, 25 aa, Mycobacterium
DVIARGGFPDGCFQTLLVSASAVEG

SEQ ID NO: 649586 - protein, 25 aa, Mycobacterium
DVIARGGFPEGCFQTLLVPSSAVER

SEQ ID NO: 649587 - protein, 26 aa, Mycobacterium
DVIARGGFPEGCFQTLLVSASAVERI

SEQ ID NO: 649588 - protein, 22 aa, Mycobacterium
DVIDAFLSWYLPDIDISDPGAL

SEQ ID NO: 649589 - protein, 18 aa, Mycobacterium
DVIDCTPLIGSEIKTDLD

SEQ ID NO: 649590 - protein, 17 aa, Mycobacterium
DVIDSYFAAAGMPPRPL

SEQ ID NO: 649591 - protein, 27 aa, Mycobacterium
DVIEEWKWRGVPVWYHDGMICTGETYK

SEQ ID NO: 649592 - protein, 27 aa, Mycobacterium
DVIEVPGLLDLSALWQIYSVDRPDLKD

SEQ ID NO: 649593 - protein, 30 aa, Mycobacterium
DVIEVPGLLDLSSLWQIYGLDRPALKDRTF

SEQ ID NO: 649594 - protein, 26 aa, Mycobacterium
DVIEVPGLLDLSSLWQIYSLDRPALK

SEQ ID NO: 649595 - protein, 17 aa, Mycobacterium
DVIGCTSVLPGAPGGPE

SEQ ID NO: 649596 - protein, 24 aa, Mycobacterium
DVIGERWTLVALREIMLGNRRFET

SEQ ID NO: 649597 - protein, 24 aa, Mycobacterium
DVIGRRLANRAGHFMPTGLLRSQL

SEQ ID NO: 649598 - protein, 26 aa, Mycobacterium
DVIGYRIDPVLARSWLLVNGAHADRF

SEQ ID NO: 649599 - protein, 17 aa, Mycobacterium
DVIKSGGEWISSVELEN

SEQ ID NO: 649600 - protein, 24 aa, Mycobacterium
DVINHFKKGFAPSGGGSVVPDEHV

SEQ ID NO: 649601 - protein, 18 aa, Mycobacterium
DVIRARTAAEFTDAVKVA

SEQ ID NO: 649602 - protein, 27 aa, Mycobacterium
DVIRKLAEWEAGAGLGNYTRARICASS

SEQ ID NO: 649603 - protein, 19 aa, Mycobacterium
DVIRVRRPGGLAIPAEETD

SEQ ID NO: 649604 - protein, 26 aa, Mycobacterium
DVISEFPADRGWDLGALYDPDPDARH

SEQ ID NO: 649605 - protein, 28 aa, Mycobacterium
DVISRKCGVPYLYRFELMGTQDDVDAVR

SEQ ID NO: 649606 - protein, 23 aa, Mycobacterium
DVISRLIDGWSLDQIRSSFADKA

SEQ ID NO: 649607 - protein, 20 aa, Mycobacterium
DVITARFVVINGCRRLAAAH

SEQ ID NO: 649608 - protein, 26 aa, Mycobacterium
DVITRGGFPEGCFQTLLVSSGAVERI

SEQ ID NO: 649609 - protein, 19 aa, Mycobacterium
DVIYCSITGFGHGGGAALP

SEQ ID NO: 649610 - protein, 17 aa, Mycobacterium
DVKAIADFSRWYAGDTD

SEQ ID NO: 649611 - protein, 21 aa, Mycobacterium
DVKAWLAQVLPAFPMYAHMLG

SEQ ID NO: 649612 - protein, 18 aa, Mycobacterium
DVKFSYDRERVINDPNGP

SEQ ID NO: 649613 - protein, 19 aa, Mycobacterium
DVKGLRLTLTQAAWKVSED

SEQ ID NO: 649614 - protein, 24 aa, Mycobacterium
DVKGLRLTLTQAAWRLSEDLPADV

SEQ ID NO: 649615 - protein, 26 aa, Mycobacterium
DVKGLRLTLTQAAWRVSEDIPAEIDV

SEQ ID NO: 649616 - protein, 22 aa, Mycobacterium
DVKGLRLTLTQAAWRVSEDLPA

SEQ ID NO: 649617 - protein, 18 aa, Mycobacterium
DVKVCGYVDATYWRDMGT

SEQ ID NO: 649618 - protein, 33 aa, Mycobacterium
DVKVDEWRAELPLIEEWFEFVGEKLPTGIKDEF

SEQ ID NO: 649619 - protein, 17 aa, Mycobacterium
DVLAALIPQDWRRREPA

SEQ ID NO: 649620 - protein, 21 aa, Mycobacterium
DVLAELAIKAVRQGSAPAEEV

SEQ ID NO: 649621 - protein, 17 aa, Mycobacterium
DVLAFLGERIASYKLPR

SEQ ID NO: 649622 - protein, 28 aa, Mycobacterium
DVLAHNRLAGALITEFRELPAPQRNQAR

SEQ ID NO: 649623 - protein, 17 aa, Mycobacterium
DVLALPAVRSRWPGVAP

SEQ ID NO: 649624 - protein, 17 aa, Mycobacterium
DVLALYRLGCDAFAESR

SEQ ID NO: 649625 - protein, 17 aa, Mycobacterium
DVLAVLYQISRPVALIG

SEQ ID NO: 649626 - protein, 36 aa, Mycobacterium
DVLCAALRDCVPWLRWTTPDGGLFVWCELADDLSGR

SEQ ID NO: 649627 - protein, 17 aa, Mycobacterium
DVLCRRFAHELGATVAS

SEQ ID NO: 649628 - protein, 20 aa, Mycobacterium
DVLDALSLWTPRHSVTAYDS

SEQ ID NO: 649629 - protein, 17 aa, Mycobacterium
DVLDRLERPLAYTTVMT

SEQ ID NO: 649630 - protein, 19 aa, Mycobacterium
DVLDWCTREQIPAIPYGGG

SEQ ID NO: 649631 - protein, 17 aa, Mycobacterium
DVLEEFSSFYFDTALSS

SEQ ID NO: 649632 - protein, 17 aa, Mycobacterium
DVLEFARQQDIAFVPYF

SEQ ID NO: 649633 - protein, 19 aa, Mycobacterium
DVLEFKGRALTDLRAEPTA

SEQ ID NO: 649634 - protein, 19 aa, Mycobacterium
DVLEITGLDRFVQQRVDGI

SEQ ID NO: 649635 - protein, 20 aa, Mycobacterium
DVLELAGLIRRHDGVSTAEM

SEQ ID NO: 649636 - protein, 25 aa, Mycobacterium
DVLEQYRPGEIITESAFTSTSMDHA

SEQ ID NO: 649637 - protein, 17 aa, Mycobacterium
DVLERRAATFAEVQEHY

SEQ ID NO: 649638 - protein, 17 aa, Mycobacterium
DVLFVGAEVYTWRALDE

SEQ ID NO: 649639 - protein, 19 aa, Mycobacterium
DVLGAHLGPYCWPAAIKMI

SEQ ID NO: 649640 - protein, 25 aa, Mycobacterium
DVLGERWTLLILRELVGGSRRYGDL

SEQ ID NO: 649641 - protein, 24 aa, Mycobacterium
DVLGFKLRDSMRMPPQVVGRPADG

SEQ ID NO: 649642 - protein, 23 aa, Mycobacterium
DVLGQPVVLPFGIAPTGFTRLMH

SEQ ID NO: 649643 - protein, 22 aa, Mycobacterium
DVLGTFGLFGVRPGELTDGDRL

SEQ ID NO: 649644 - protein, 26 aa, Mycobacterium
DVLHDLYQRWPFFRSVLSNMAQVLAK

SEQ ID NO: 649645 - protein, 29 aa, Mycobacterium
DVLIALSYSIPWVLRTVLLARAGFDPATL

SEQ ID NO: 649646 - protein, 18 aa, Mycobacterium
DVLIRAARAADGWRRAGV

SEQ ID NO: 649647 - protein, 27 aa, Mycobacterium
DVLLDPFRPGVCERIGIGPEECAKRNP

SEQ ID NO: 649648 - protein, 19 aa, Mycobacterium
DVLLFKYIIKNTAWQNGKT

SEQ ID NO: 649649 - protein, 26 aa, Mycobacterium
DVLLGKCLTLWAALIGAVGLEVFGQY

SEQ ID NO: 649650 - protein, 27 aa, Mycobacterium
DVLLKIRLRQGLPMSRLDSAERERAKV

SEQ ID NO: 649651 - protein, 25 aa, Mycobacterium
DVLLKVRLRQGLPVGLLNSEERERA

SEQ ID NO: 649652 - protein, 19 aa, Mycobacterium
DVLLPRRGTLVAWTTQGFP

SEQ ID NO: 649653 - protein, 17 aa, Mycobacterium
DVLPELIRRAVVVKAEV

SEQ ID NO: 649654 - protein, 23 aa, Mycobacterium
DVLQESYLRWAAVDLSAVRDTKS

SEQ ID NO: 649655 - protein, 19 aa, Mycobacterium
DVLQRIPSIEVVFVGHRRG

SEQ ID NO: 649656 - protein, 17 aa, Mycobacterium
DVLQVLLAIAVKTISNY

SEQ ID NO: 649657 - protein, 21 aa, Mycobacterium
DVLQWPGPPIYTLTAAGEQLG

SEQ ID NO: 649658 - protein, 21 aa, Mycobacterium
DVLRARLAFVTSHGSDAPPLL

SEQ ID NO: 649659 - protein, 24 aa, Mycobacterium
DVLRCGICGSDIHAKDHADELTEV

SEQ ID NO: 649660 - protein, 24 aa, Mycobacterium
DVLRCGICGSDLHARHHCDELADV

SEQ ID NO: 649661 - protein, 19 aa, Mycobacterium
DVLREARMTQGRTLREVSD

SEQ ID NO: 649662 - protein, 22 aa, Mycobacterium
DVLRKPRNILTFSHGNHHCLGA

SEQ ID NO: 649663 - protein, 18 aa, Mycobacterium
DVLRLGDRTWPIAPGTGD

SEQ ID NO: 649664 - protein, 18 aa, Mycobacterium
DVLRPWRVPTRGLVYAKE

SEQ ID NO: 649665 - protein, 17 aa, Mycobacterium
DVLRQAAGIARDGASGI

SEQ ID NO: 649666 - protein, 24 aa, Mycobacterium
DVLRRAVRLLAQMTRQVAVVQYPT

SEQ ID NO: 649667 - protein, 20 aa, Mycobacterium
DVLRSIRLPGSHFRNDIAQL

SEQ ID NO: 649668 - protein, 23 aa, Mycobacterium
DVLRTVPIADYARRCGVDEDLIR

SEQ ID NO: 649669 - protein, 27 aa, Mycobacterium
DVLSDFPADRGWDLAGLFNPDPDVPGA

SEQ ID NO: 649670 - protein, 20 aa, Mycobacterium
DVLSPAWGLRPEARDLVVSA

SEQ ID NO: 649671 - protein, 20 aa, Mycobacterium
DVLTAMLLMRAIRGERVDAN

SEQ ID NO: 649672 - protein, 17 aa, Mycobacterium
DVLTDWMDASVIDESDP

SEQ ID NO: 649673 - protein, 24 aa, Mycobacterium
DVLTRYEPVLGMEVHVELSTATKM

SEQ ID NO: 649674 - protein, 18 aa, Mycobacterium
DVLVEWMSPLLIAYLEAG

SEQ ID NO: 649675 - protein, 18 aa, Mycobacterium
DVLVHLCGADEWERAQRS

SEQ ID NO: 649676 - protein, 24 aa, Mycobacterium
DVLVNCVGVFDFYRSIEEIDVDVL

SEQ ID NO: 649677 - protein, 25 aa, Mycobacterium
DVLVRRGRCPPVGRVSDTAGIDAQT

SEQ ID NO: 649678 - protein, 20 aa, Mycobacterium
DVLWAAWTRSGLQRRWDGLS

SEQ ID NO: 649679 - protein, 20 aa, Mycobacterium
DVLWRIHQGPLFIAVVELLI

SEQ ID NO: 649680 - protein, 18 aa, Mycobacterium
DVMACDVCSAQAAPWSGL

SEQ ID NO: 649681 - protein, 20 aa, Mycobacterium
DVMDLAQWLIAENGYYTNCI

SEQ ID NO: 649682 - protein, 18 aa, Mycobacterium
DVMGWKIGGDGFRIVLSA

SEQ ID NO: 649683 - protein, 24 aa, Mycobacterium
DVMPRLLSVGPWDSLALVKPDLLR

SEQ ID NO: 649684 - protein, 23 aa, Mycobacterium
DVMREYRVLDALSTAQVRVPRVT

SEQ ID NO: 649685 - protein, 18 aa, Mycobacterium
DVMRTAFAAREFTDDPLP

SEQ ID NO: 649686 - protein, 26 aa, Mycobacterium
DVMSAYRAGGQFLWDALSQAIDAAGL

SEQ ID NO: 649687 - protein, 17 aa, Mycobacterium
DVMSGLVADIAFDATIS

SEQ ID NO: 649688 - protein, 20 aa, Mycobacterium
DVMTQLGGLIGAAPLSSPVP

SEQ ID NO: 649689 - protein, 24 aa, Mycobacterium
DVMTRPGVTQVRFAPHSMLLEHAV

SEQ ID NO: 649690 - protein, 27 aa, Mycobacterium
DVMVGPRKLAGILAEVSGPVIVVGLGL

SEQ ID NO: 649691 - protein, 17 aa, Mycobacterium
DVMWAWQPEGSHFEGAA

SEQ ID NO: 649692 - protein, 22 aa, Mycobacterium
DVNGIWLRANFISSVDGGATVA

SEQ ID NO: 649693 - protein, 24 aa, Mycobacterium
DVNGLAAAVAHVLTGKGFTQGNVG

SEQ ID NO: 649694 - protein, 18 aa, Mycobacterium
DVNIAWPSAQIAVMGASG

SEQ ID NO: 649695 - protein, 17 aa, Mycobacterium
DVNIAWPTAQIAVMGAS

SEQ ID NO: 649696 - protein, 19 aa, Mycobacterium
DVNIFYGDFHAVADVGLSV

SEQ ID NO: 649697 - protein, 21 aa, Mycobacterium
DVNIFYGKFHAVQDVALSVPP

SEQ ID NO: 649698 - protein, 20 aa, Mycobacterium
DVNKGWLVARATLGNERVSI

SEQ ID NO: 649699 - protein, 25 aa, Mycobacterium
DVNVGRLTITLASHGGFKLDSCTSN

SEQ ID NO: 649700 - protein, 21 aa, Mycobacterium
DVNYLVKWGGYAAHHTDDDGH

SEQ ID NO: 649701 - protein, 20 aa, Mycobacterium
DVPAAPYLHLFVTRGRIDLD

SEQ ID NO: 649702 - protein, 25 aa, Mycobacterium
DVPAELKANWLPESQYVNVIQYPDD

SEQ ID NO: 649703 - protein, 19 aa, Mycobacterium
DVPDGFGVAVVREDGKWRC

SEQ ID NO: 649704 - protein, 22 aa, Mycobacterium
DVPDVPVRIAAAVSGERSVAQF

SEQ ID NO: 649705 - protein, 19 aa, Mycobacterium
DVPEVPVGIAVAMGGTKAI

SEQ ID NO: 649706 - protein, 28 aa, Mycobacterium
DVPGIPVPVFLGGAAVRTQYAFGPTIGS

SEQ ID NO: 649707 - protein, 18 aa, Mycobacterium
DVPGIVYQFSFAKNPNWS

SEQ ID NO: 649708 - protein, 24 aa, Mycobacterium
DVPGMPRVLKWLSQFIPLAAGPLP

SEQ ID NO: 649709 - protein, 21 aa, Mycobacterium
DVPGRFAVRTPMQWTSGTNGG

SEQ ID NO: 649710 - protein, 17 aa, Mycobacterium
DVPGSIDNVEFFAGAAR

SEQ ID NO: 649711 - protein, 27 aa, Mycobacterium
DVPGVPVPVFLGGAAVRTQYAFGPTIG

SEQ ID NO: 649712 - protein, 26 aa, Mycobacterium
DVPGVPVPVFLGGAPVRAQYAFGPTI

SEQ ID NO: 649713 - protein, 23 aa, Mycobacterium
DVPHRRPLLAITRVTRNTDGRPF

SEQ ID NO: 649714 - protein, 29 aa, Mycobacterium
DVPKPEVWACGYGRPKFAKAVAHDAFDAV

SEQ ID NO: 649715 - protein, 27 aa, Mycobacterium
DVPLAIDHFRYFAGVLRAQEGSLSQID

SEQ ID NO: 649716 - protein, 17 aa, Mycobacterium
DVPLHFTAFHPDYKMTD

SEQ ID NO: 649717 - protein, 22 aa, Mycobacterium
DVPLRVAVMGCVVNGPGEAREA

SEQ ID NO: 649718 - protein, 25 aa, Mycobacterium
DVPPDRMPYTFGSWVTEASEADRRK

SEQ ID NO: 649719 - protein, 19 aa, Mycobacterium
DVPPLKGIYSGLGVTDLDV

SEQ ID NO: 649720 - protein, 17 aa, Mycobacterium
DVPSGAVSLIISNSTAS

SEQ ID NO: 649721 - protein, 19 aa, Mycobacterium
DVPSLGWQSYTFVPGDQGG

SEQ ID NO: 649722 - protein, 23 aa, Mycobacterium
DVPSTGVGLGAEWDTHLVDTDPG

SEQ ID NO: 649723 - protein, 23 aa, Mycobacterium
DVPTAVVVPYFWSDQYDVKIQCL

SEQ ID NO: 649724 - protein, 18 aa, Mycobacterium
DVPTCLSGMAYPVPFATA

SEQ ID NO: 649725 - protein, 34 aa, Mycobacterium
DVPTRLGSVRAYRFGACGGVPLLLLTGRGGSTPL

SEQ ID NO: 649726 - protein, 18 aa, Mycobacterium
DVPVQFPPIPSFSPEHFA

SEQ ID NO: 649727 - protein, 26 aa, Mycobacterium
DVPVREFATVMPPAMRPAVRLVGKQT

SEQ ID NO: 649728 - protein, 22 aa, Mycobacterium
DVPVVAAAWVDRLEKLLDACVR

SEQ ID NO: 649729 - protein, 19 aa, Mycobacterium
DVPWPCDATKYISHFPSTR

SEQ ID NO: 649730 - protein, 17 aa, Mycobacterium
DVPWPCSDTKYITHFPE

SEQ ID NO: 649731 - protein, 20 aa, Mycobacterium
DVQAAFELACRPVPERVKIA

SEQ ID NO: 649732 - protein, 22 aa, Mycobacterium
DVQAPLRWFRDLYPDLDVDRAT

SEQ ID NO: 649733 - protein, 17 aa, Mycobacterium
DVQCIVHTHAFHVAALS

SEQ ID NO: 649734 - protein, 25 aa, Mycobacterium
DVQGVLIPGGFGIRGIEGKLGAIHY

SEQ ID NO: 649735 - protein, 17 aa, Mycobacterium
DVQGVSLAMPWYHRLPD

SEQ ID NO: 649736 - protein, 18 aa, Mycobacterium
DVQLMRLRALLARARGDE

SEQ ID NO: 649737 - protein, 19 aa, Mycobacterium
DVQLVLCAGAPDTPEIANE

SEQ ID NO: 649738 - protein, 29 aa, Mycobacterium
DVQPMFRKHPAFLGAMTNFAWTFDDDVEL

SEQ ID NO: 649739 - protein, 18 aa, Mycobacterium
DVQRPPLTVYAGFDPTAA

SEQ ID NO: 649740 - protein, 23 aa, Mycobacterium
DVQTCRHLGRRVALVTRQLNIGR

SEQ ID NO: 649741 - protein, 18 aa, Mycobacterium
DVQVMGAAALHFGNVAEM

SEQ ID NO: 649742 - protein, 26 aa, Mycobacterium
DVRAALWPLLVGNIIAARGVLRAIRG

SEQ ID NO: 649743 - protein, 25 aa, Mycobacterium
DVRAGARALTGWVIGTGGHTMMLPR

SEQ ID NO: 649744 - protein, 27 aa, Mycobacterium
DVRAQLRADWGEWDAGGAYLGEIPHTV

SEQ ID NO: 649745 - protein, 21 aa, Mycobacterium
DVRARLRQSWLERGASEAELG

SEQ ID NO: 649746 - protein, 25 aa, Mycobacterium
DVRARTVLCPAPLVEGLVVAAVAAA

SEQ ID NO: 649747 - protein, 19 aa, Mycobacterium
DVRATVLAMNGMDALTRTG

SEQ ID NO: 649748 - protein, 23 aa, Mycobacterium
DVRAVIDVARRALLNGEQTVLFI

SEQ ID NO: 649749 - protein, 26 aa, Mycobacterium
DVRDWARLGFCDGLLHVTDADTPTED

SEQ ID NO: 649750 - protein, 18 aa, Mycobacterium
DVREAWHAVAGKDIPDTP

SEQ ID NO: 649751 - protein, 19 aa, Mycobacterium
DVREGAFLSAGREDLLRLE

SEQ ID NO: 649752 - protein, 18 aa, Mycobacterium
DVREHFGDKVLRTVIPRS

SEQ ID NO: 649753 - protein, 17 aa, Mycobacterium
DVRELLARVDVRPAADL

SEQ ID NO: 649754 - protein, 23 aa, Mycobacterium
DVREMTRRTLAVLSTPAALAALP

SEQ ID NO: 649755 - protein, 18 aa, Mycobacterium
DVRFMRFIGQEIFPGGQL

SEQ ID NO: 649756 - protein, 17 aa, Mycobacterium
DVRFSGGLDTEIADGDS

SEQ ID NO: 649757 - protein, 19 aa, Mycobacterium
DVRGGLLFVWHDHEGNPPD

SEQ ID NO: 649758 - protein, 17 aa, Mycobacterium
DVRGGWRSPEVHEALDL

SEQ ID NO: 649759 - protein, 21 aa, Mycobacterium
DVRGLRGWIRLFANLPAKRLR

SEQ ID NO: 649760 - protein, 24 aa, Mycobacterium
DVRGRGAMIALELVKSGTAEPDAE

SEQ ID NO: 649761 - protein, 27 aa, Mycobacterium
DVRGYRLPWAAGTTVYELDLPKVLEFK

SEQ ID NO: 649762 - protein, 18 aa, Mycobacterium
DVRHEPRAGLGNRGQLRL

SEQ ID NO: 649763 - protein, 18 aa, Mycobacterium
DVRIEIPDLLRWDVQLEN

SEQ ID NO: 649764 - protein, 22 aa, Mycobacterium
DVRIEPKPSWQVSVSSDEVSVT

SEQ ID NO: 649765 - protein, 23 aa, Mycobacterium
DVRLDAVDAFDGFLVVSYRSEAL

SEQ ID NO: 649766 - protein, 26 aa, Mycobacterium
DVRNWPRRRMVLSRTANAYSRILLGV

SEQ ID NO: 649767 - protein, 20 aa, Mycobacterium
DVRPDLVVMLGEYPGRAVIT

SEQ ID NO: 649768 - protein, 18 aa, Mycobacterium
DVRPGGGIAGPFFTGLAT

SEQ ID NO: 649769 - protein, 17 aa, Mycobacterium
DVRRAASTGARATRAPE

SEQ ID NO: 649770 - protein, 21 aa, Mycobacterium
DVRRFPHSFITATRTRAGWTF

SEQ ID NO: 649771 - protein, 17 aa, Mycobacterium
DVRRGDHRWEFESMPAA

SEQ ID NO: 649772 - protein, 24 aa, Mycobacterium
DVRRRAGAIWTRRTDRLPFVAPMN

SEQ ID NO: 649773 - protein, 23 aa, Mycobacterium
DVRRRLRRSWLERGASDAELGWI

SEQ ID NO: 649774 - protein, 17 aa, Mycobacterium
DVRRYGATYANYVGKPL

SEQ ID NO: 649775 - protein, 25 aa, Mycobacterium
DVRTARPGVKVTVTAAQFCGYSSQL

SEQ ID NO: 649776 - protein, 20 aa, Mycobacterium
DVRTPYVLAMVDLEEGPRLM

SEQ ID NO: 649777 - protein, 23 aa, Mycobacterium
DVRTRIQLARFMTRAESPPDTDL

SEQ ID NO: 649778 - protein, 26 aa, Mycobacterium
DVRTRRILLAMGMRYDMPALPGLAEL

SEQ ID NO: 649779 - protein, 25 aa, Mycobacterium
DVRVAALRTSHRFGKSIGTLADAIR

SEQ ID NO: 649780 - protein, 27 aa, Mycobacterium
DVRVMRADRGFFCFPEVDIRIPFTDGM

SEQ ID NO: 649781 - protein, 17 aa, Mycobacterium
DVRVRPHDSGLVTLRSQ

SEQ ID NO: 649782 - protein, 20 aa, Mycobacterium
DVRYPRDMSTLLGPSTAPAV

SEQ ID NO: 649783 - protein, 23 aa, Mycobacterium
DVRYPRIVAANGPKMLALARDAA

SEQ ID NO: 649784 - protein, 24 aa, Mycobacterium
DVSADVWSVTSWGELNREGVAIEK

SEQ ID NO: 649785 - protein, 32 aa, Mycobacterium
DVSCARMFIFIGAAPRTEWLDGVLARDDRGFV

SEQ ID NO: 649786 - protein, 22 aa, Mycobacterium
DVSCLKALLEIRDEIVAAGHTP

SEQ ID NO: 649787 - protein, 22 aa, Mycobacterium
DVSCLKALLEVREEIVAAGHTP

SEQ ID NO: 649788 - protein, 22 aa, Mycobacterium
DVSDAYPLSALQAGMLFHSRVD

SEQ ID NO: 649789 - protein, 22 aa, Mycobacterium
DVSELRARIGLSSSALAQRIPT

SEQ ID NO: 649790 - protein, 23 aa, Mycobacterium
DVSELRARIGLSSSALAQRVPID

SEQ ID NO: 649791 - protein, 22 aa, Mycobacterium
DVSEMRRLISIDAQDRVRVQAG

SEQ ID NO: 649792 - protein, 18 aa, Mycobacterium
DVSGFGRVTQIAWVTDDL

SEQ ID NO: 649793 - protein, 19 aa, Mycobacterium
DVSGGFSWESCNDQGDPPY

SEQ ID NO: 649794 - protein, 20 aa, Mycobacterium
DVSGIRWVGYGGAPIAPSLV

SEQ ID NO: 649795 - protein, 18 aa, Mycobacterium
DVSHGCINISPSNAKWFF

SEQ ID NO: 649796 - protein, 17 aa, Mycobacterium
DVSIIFVPPKFAKDAII

SEQ ID NO: 649797 - protein, 25 aa, Mycobacterium
DVSLAATHRAMWALGDYALMAEEVM

SEQ ID NO: 649798 - protein, 25 aa, Mycobacterium
DVSLKIDKGEFVFLIGPSGSGKSTF

SEQ ID NO: 649799 - protein, 21 aa, Mycobacterium
DVSLLGKARKVVVTKDETTIV

SEQ ID NO: 649800 - protein, 17 aa, Mycobacterium
DVSLLSTAWWAAGASVT

SEQ ID NO: 649801 - protein, 24 aa, Mycobacterium
DVSLPFAGLKVFDLSTFWAGAYLT

SEQ ID NO: 649802 - protein, 21 aa, Mycobacterium
DVSLRRFGIDTTFVGGTDPAD

SEQ ID NO: 649803 - protein, 22 aa, Mycobacterium
DVSLRSAVKLHRELVAHLGSAA

SEQ ID NO: 649804 - protein, 24 aa, Mycobacterium
DVSQRLRLLIDWTGDHLAEVEVND

SEQ ID NO: 649805 - protein, 25 aa, Mycobacterium
DVSRHACKLFWERGVSGTSGDDIAA

SEQ ID NO: 649806 - protein, 20 aa, Mycobacterium
DVSSGWKVVEAVPRPDASVV

SEQ ID NO: 649807 - protein, 25 aa, Mycobacterium
DVSSLRCVIHAAAPCPVDVKHDMMK

SEQ ID NO: 649808 - protein, 25 aa, Mycobacterium
DVSSLRCVIHAAAPCPVDVKRRMME

SEQ ID NO: 649809 - protein, 21 aa, Mycobacterium
DVSSVRWVVYGGAPIAPSLVR

SEQ ID NO: 649810 - protein, 25 aa, Mycobacterium
DVSTLRCVLHAAAPCPVDVKHRMMD

SEQ ID NO: 649811 - protein, 24 aa, Mycobacterium
DVTAEPGFELWAGIANEQGYRSMI

SEQ ID NO: 649812 - protein, 24 aa, Mycobacterium
DVTAWMLEKCRTFYASLSSDTPPE

SEQ ID NO: 649813 - protein, 24 aa, Mycobacterium
DVTDRPALEQAFAKVRSELGAVTV

SEQ ID NO: 649814 - protein, 28 aa, Mycobacterium
DVTEAVLWLVGPRARYVTGVSIPVDAGH

SEQ ID NO: 649815 - protein, 23 aa, Mycobacterium
DVTELRSRIGLSSSALAQRVPGD

SEQ ID NO: 649816 - protein, 36 aa, Mycobacterium
DVTFTEWTLALVIRVWSWLIMRAIHAERILLPQARP

SEQ ID NO: 649817 - protein, 23 aa, Mycobacterium
DVTGARIGDRWHVGTDGLVLEVS

SEQ ID NO: 649818 - protein, 18 aa, Mycobacterium
DVTGPVAEFLVRRDLAAI

SEQ ID NO: 649819 - protein, 23 aa, Mycobacterium
DVTGQFGTPGWIISQGPQVLLDA

SEQ ID NO: 649820 - protein, 19 aa, Mycobacterium
DVTIRLPFRDDLTNDGTYF

SEQ ID NO: 649821 - protein, 20 aa, Mycobacterium
DVTKPEHWTAAAATAVGEFG

SEQ ID NO: 649822 - protein, 18 aa, Mycobacterium
DVTKRFGDTLALDHVSLD

SEQ ID NO: 649823 - protein, 24 aa, Mycobacterium
DVTKRTGIELTESMAMWPGAAVSG

SEQ ID NO: 649824 - protein, 30 aa, Mycobacterium
DVTKRVGVQGIWYAGSHGFELTAPDGTHHQ

SEQ ID NO: 649825 - protein, 17 aa, Mycobacterium
DVTLRMVPVSSRNGAYV

SEQ ID NO: 649826 - protein, 25 aa, Mycobacterium
DVTMEAWNFRWLCVGPVERDDVGLV

SEQ ID NO: 649827 - protein, 30 aa, Mycobacterium
DVTNRVGVPGIWYAGSHGFELTAPDGTHHQ

SEQ ID NO: 649828 - protein, 22 aa, Mycobacterium
DVTRLQERWNQIEAKAVEIKQK

SEQ ID NO: 649829 - protein, 20 aa, Mycobacterium
DVTRRPRNILTFSHGAHHCL

SEQ ID NO: 649830 - protein, 23 aa, Mycobacterium
DVTRRPRNILTFSHGAHHCLGAA

SEQ ID NO: 649831 - protein, 23 aa, Mycobacterium
DVTVPIPSIPVLNLGVTIDNEIG

SEQ ID NO: 649832 - protein, 17 aa, Mycobacterium
DVTWTIVGGMVLEGADA

SEQ ID NO: 649833 - protein, 22 aa, Mycobacterium
DVTYPLHRYFLWAKQIELSLGS

SEQ ID NO: 649834 - protein, 29 aa, Mycobacterium
DVVAAAARWARTFGIGPFHVLPTVEQHTD

SEQ ID NO: 649835 - protein, 18 aa, Mycobacterium
DVVAACRRAGRAHKTVRR

SEQ ID NO: 649836 - protein, 17 aa, Mycobacterium
DVVAASLTAGLAGEIRK

SEQ ID NO: 649837 - protein, 24 aa, Mycobacterium
DVVADLCLRCARSYGPRRAQRMMG

SEQ ID NO: 649838 - protein, 25 aa, Mycobacterium
DVVADLPLGHGFNALTGEYGDMFEE

SEQ ID NO: 649839 - protein, 23 aa, Mycobacterium
DVVAEVRAELLASVDAAVGAGVD

SEQ ID NO: 649840 - protein, 25 aa, Mycobacterium
DVVAMREAYHGWTYGTDAVSTSTAD

SEQ ID NO: 649841 - protein, 19 aa, Mycobacterium
DVVARFCRSLFRAGRRFDL

SEQ ID NO: 649842 - protein, 22 aa, Mycobacterium
DVVAVGEAYHGWTYATDAVSTS

SEQ ID NO: 649843 - protein, 18 aa, Mycobacterium
DVVDTRVSIWRDVPGVRG

SEQ ID NO: 649844 - protein, 20 aa, Mycobacterium
DVVEFPGWRNRGHGDFKDIR

SEQ ID NO: 649845 - protein, 26 aa, Mycobacterium
DVVFASHHWPTWGHDNIVEYLSQQRD

SEQ ID NO: 649846 - protein, 25 aa, Mycobacterium
DVVFASHHWPTWGRDNIVEYLSLQR

SEQ ID NO: 649847 - protein, 31 aa, Mycobacterium
DVVFASHHWPTWGRDSIVEFLSLQRDLYAYL

SEQ ID NO: 649848 - protein, 30 aa, Mycobacterium
DVVFASHHWPTWGREGIVEFLSLQRDLYAY

SEQ ID NO: 649849 - protein, 31 aa, Mycobacterium
DVVFASHHWPTWGRERIVEFLALQRDLYAYL

SEQ ID NO: 649850 - protein, 25 aa, Mycobacterium
DVVFASHHWPTWGSERIVEFLSLQR

SEQ ID NO: 649851 - protein, 24 aa, Mycobacterium
DVVFASHHWPTWGTERLVEYLALQ

SEQ ID NO: 649852 - protein, 20 aa, Mycobacterium
DVVGCYRMLPPPGAIAAGGL

SEQ ID NO: 649853 - protein, 23 aa, Mycobacterium
DVVGEGFLIGRICTGAISAGVMK

SEQ ID NO: 649854 - protein, 21 aa, Mycobacterium
DVVGVPAFLASQGYVAGTRVL

SEQ ID NO: 649855 - protein, 35 aa, Mycobacterium
DVVHSHYWLSGQVGWLARDRWAVPLVHTAHTLAAV

SEQ ID NO: 649856 - protein, 17 aa, Mycobacterium
DVVKAVIVRTVKERRRA

SEQ ID NO: 649857 - protein, 23 aa, Mycobacterium
DVVKRCFEFGQRFGVPVRVITFA

SEQ ID NO: 649858 - protein, 29 aa, Mycobacterium
DVVLREFLDGLQGGFGRTLDTAAKAYASA

SEQ ID NO: 649859 - protein, 19 aa, Mycobacterium
DVVLRRAPWVDVVFGTHNI

SEQ ID NO: 649860 - protein, 21 aa, Mycobacterium
DVVLSKGWTEKQFQRLGQIAD

SEQ ID NO: 649861 - protein, 25 aa, Mycobacterium
DVVLSVPVSATWIDIRFTLPANTVD

SEQ ID NO: 649862 - protein, 20 aa, Mycobacterium
DVVMAAALCSAGRPDDARVV

SEQ ID NO: 649863 - protein, 28 aa, Mycobacterium
DVVNPFALKCFYRAYLMDLRLRRRLNTV

SEQ ID NO: 649864 - protein, 18 aa, Mycobacterium
DVVPVEWARMENRSVLQW

SEQ ID NO: 649865 - protein, 23 aa, Mycobacterium
DVVRAEAGAGWDDVVAASLAHGL

SEQ ID NO: 649866 - protein, 18 aa, Mycobacterium
DVVRAVLEPLGLTAQEPV

SEQ ID NO: 649867 - protein, 27 aa, Mycobacterium
DVVRAVPLVGEVCYHFLHSVKAGIKDS

SEQ ID NO: 649868 - protein, 27 aa, Mycobacterium
DVVRAVPLVGEVCYHFMHSVKAGIKDS

SEQ ID NO: 649869 - protein, 17 aa, Mycobacterium
DVVRCPECGAILLRVKQ

SEQ ID NO: 649870 - protein, 23 aa, Mycobacterium
DVVRFAGGWLFDRAMAGWDVTVL

SEQ ID NO: 649871 - protein, 23 aa, Mycobacterium
DVVRGVLEPLGLTAHEPAGARAR

SEQ ID NO: 649872 - protein, 24 aa, Mycobacterium
DVVRTEGPWKLIIAQHFASADELM

SEQ ID NO: 649873 - protein, 35 aa, Mycobacterium
DVVRTIRGCGAPVMSLRTDRDWIADIVRFVTSRRR

SEQ ID NO: 649874 - protein, 18 aa, Mycobacterium
DVVSAWTGIPTGRLMEGE

SEQ ID NO: 649875 - protein, 19 aa, Mycobacterium
DVVSRGRAVLGLGTGWFEL

SEQ ID NO: 649876 - protein, 20 aa, Mycobacterium
DVVTGLGWYSTKHSVGVWSA

SEQ ID NO: 649877 - protein, 25 aa, Mycobacterium
DVVVAGRPSERWGQEVVAVVALAQG

SEQ ID NO: 649878 - protein, 24 aa, Mycobacterium
DVVVCATGLFGPRKLPDIAGLTDF

SEQ ID NO: 649879 - protein, 21 aa, Mycobacterium
DVVVCAVGLFGSAKLPDIDGL

SEQ ID NO: 649880 - protein, 24 aa, Mycobacterium
DVVVCGRLKDVIIMAGRNIFPADI

SEQ ID NO: 649881 - protein, 19 aa, Mycobacterium
DVVVDIRITGFGVGDRETV

SEQ ID NO: 649882 - protein, 23 aa, Mycobacterium
DVWNFKDRMPIFPVPEGEDQDSW

SEQ ID NO: 649883 - protein, 24 aa, Mycobacterium
DVWPIKPHHWYPALSEEQLVFARA

SEQ ID NO: 649884 - protein, 20 aa, Mycobacterium
DVWRALRASMRSVLEQTTLA

SEQ ID NO: 649885 - protein, 18 aa, Mycobacterium
DVWRRIRAAGDAGVPTSV

SEQ ID NO: 649886 - protein, 22 aa, Mycobacterium
DVYAGLAAAGWGGPWRVVDKDV

SEQ ID NO: 649887 - protein, 17 aa, Mycobacterium
DVYAPDFLRGCASGVQT

SEQ ID NO: 649888 - protein, 33 aa, Mycobacterium
DVYDSAVAWARRYLECPPRALAAAKAVINDVFE

SEQ ID NO: 649889 - protein, 24 aa, Mycobacterium
DVYDSAVGWARRFVDGPPRALAAA

SEQ ID NO: 649890 - protein, 20 aa, Mycobacterium
DVYEFLIRAGHFGLVVGSKA

SEQ ID NO: 649891 - protein, 17 aa, Mycobacterium
DVYGRRSRVIAGDASTY

SEQ ID NO: 649892 - protein, 17 aa, Mycobacterium
DVYIAALGPQLLKIAGR

SEQ ID NO: 649893 - protein, 17 aa, Mycobacterium
DVYKWGGIKATKDLAAH

SEQ ID NO: 649894 - protein, 23 aa, Mycobacterium
DVYLPDGSGIDFVRELRSDSMIL

SEQ ID NO: 649895 - protein, 19 aa, Mycobacterium
DVYRAHFRPSATLTEPYVV

SEQ ID NO: 649896 - protein, 17 aa, Mycobacterium
DVYRRATVVSRVDDPSG

SEQ ID NO: 649897 - protein, 21 aa, Mycobacterium
DVYRTRFGALLTAAADRRAAL

SEQ ID NO: 649898 - protein, 18 aa, Mycobacterium
DVYTLRDGKVVRVQVHTD

SEQ ID NO: 649899 - protein, 24 aa, Mycobacterium
DVYVFRCAILYLRYEVANCHSSRG

SEQ ID NO: 649900 - protein, 20 aa, Mycobacterium
DVYYCVVDARAWLRDPAPLF

SEQ ID NO: 649901 - protein, 18 aa, Mycobacterium
DVYYRTADWAPFDMATVF

SEQ ID NO: 649902 - protein, 23 aa, Mycobacterium
DWAAKGTALLGVYAVIAESYERI

SEQ ID NO: 649903 - protein, 23 aa, Mycobacterium
DWAAKGTLLLGVRVVIAESFERI

SEQ ID NO: 649904 - protein, 21 aa, Mycobacterium
DWAAKGTRLLGVRAVIAESFE

SEQ ID NO: 649905 - protein, 19 aa, Mycobacterium
DWAALSAWVARQGHTLETS

SEQ ID NO: 649906 - protein, 25 aa, Mycobacterium
DWAEGCVGCSMMADHVGPLSHLHAK

SEQ ID NO: 649907 - protein, 20 aa, Mycobacterium
DWAVANGYARLGCSGLQSQM

SEQ ID NO: 649908 - protein, 20 aa, Mycobacterium
DWDAAVAAWSRLRTDEGAEF

SEQ ID NO: 649909 - protein, 22 aa, Mycobacterium
DWDEVRKRFDLISRKLPMFRQR

SEQ ID NO: 649910 - protein, 19 aa, Mycobacterium
DWDEVRQRFDLISREMPMF

SEQ ID NO: 649911 - protein, 21 aa, Mycobacterium
DWDRCAIVSDVPWVKHVAKLS

SEQ ID NO: 649912 - protein, 23 aa, Mycobacterium
DWDVPKHKGITFFIVPMKQPGIE

SEQ ID NO: 649913 - protein, 35 aa, Mycobacterium
DWEPFLRVNLYGVLHCTRAVLPAMITNTWGRILTI

SEQ ID NO: 649914 - protein, 36 aa, Mycobacterium
DWEPFLRVNLYGVLHCTRAVLPSMIDHTWGRVLTIV

SEQ ID NO: 649915 - protein, 27 aa, Mycobacterium
DWEQFSLWAEDIFKIVRFDSDLANEQH

SEQ ID NO: 649916 - protein, 19 aa, Mycobacterium
DWERARPGTNTTYPGPANG

SEQ ID NO: 649917 - protein, 20 aa, Mycobacterium
DWFKDPRLVDDPYPYFNALR

SEQ ID NO: 649918 - protein, 21 aa, Mycobacterium
DWFRPKAMRALKIRVDELAKI

SEQ ID NO: 649919 - protein, 18 aa, Mycobacterium
DWFRPKAMRALKVRVDEL

SEQ ID NO: 649920 - protein, 20 aa, Mycobacterium
DWFRPKAMRALKVRVDELAK

SEQ ID NO: 649921 - protein, 20 aa, Mycobacterium
DWFSPHGMRRACATHNYERG

SEQ ID NO: 649922 - protein, 25 aa, Mycobacterium
DWGATPSWECALAGLDQECGAQIDA

SEQ ID NO: 649923 - protein, 17 aa, Mycobacterium
DWGEHFVNFQGARTKYF

SEQ ID NO: 649924 - protein, 20 aa, Mycobacterium
DWGSALGFYRALRYPEQIAG

SEQ ID NO: 649925 - protein, 21 aa, Mycobacterium
DWGYAAGWRLVRAAPDILARN

SEQ ID NO: 649926 - protein, 18 aa, Mycobacterium
DWGYAVLVGDGIIPEKDH

SEQ ID NO: 649927 - protein, 22 aa, Mycobacterium
DWHARPGAFHRLSPPWQPMRLI

SEQ ID NO: 649928 - protein, 25 aa, Mycobacterium
DWHERETYDFFGIIFDDHPALTRIQ

SEQ ID NO: 649929 - protein, 23 aa, Mycobacterium
DWHRAIVDKWRAAGVRMADERDA

SEQ ID NO: 649930 - protein, 17 aa, Mycobacterium
DWHSGPHGLPILDGATG

SEQ ID NO: 649931 - protein, 18 aa, Mycobacterium
DWHVLLAICGPDAVARAE

SEQ ID NO: 649932 - protein, 25 aa, Mycobacterium
DWKAARCTAHLSVSVMEQVERLARD

SEQ ID NO: 649933 - protein, 23 aa, Mycobacterium
DWLDDGWVALLRKWIDDAEGSGV

SEQ ID NO: 649934 - protein, 20 aa, Mycobacterium
DWLEMSRALLSRIGDHARGL

SEQ ID NO: 649935 - protein, 19 aa, Mycobacterium
DWLGEHGWRASATTSAELL

SEQ ID NO: 649936 - protein, 22 aa, Mycobacterium
DWLGTPYLRFERQGPIAVCTID

SEQ ID NO: 649937 - protein, 18 aa, Mycobacterium
DWLHGMWKGEKFVERLTY

SEQ ID NO: 649938 - protein, 18 aa, Mycobacterium
DWLHGMWKGEKFVERVTY

SEQ ID NO: 649939 - protein, 22 aa, Mycobacterium
DWLLIKIDFLLHAARHPDLAHR

SEQ ID NO: 649940 - protein, 22 aa, Mycobacterium
DWLPTIRRAAALVTETGGMTCH

SEQ ID NO: 649941 - protein, 23 aa, Mycobacterium
DWLREGVRFWMRTALTHQLFTWT

SEQ ID NO: 649942 - protein, 24 aa, Mycobacterium
DWLRRVHPAAAWTTSVCSGSLVLA

SEQ ID NO: 649943 - protein, 18 aa, Mycobacterium
DWLTAMRSTLAGMTASYD

SEQ ID NO: 649944 - protein, 17 aa, Mycobacterium
DWLVTRFAREVPGVAHA

SEQ ID NO: 649945 - protein, 30 aa, Mycobacterium
DWLYGGLRLLFPVEWERFRAGAPERDRDGN

SEQ ID NO: 649946 - protein, 24 aa, Mycobacterium
DWMRRLSGEIDRPVSFALIQVDAD

SEQ ID NO: 649947 - protein, 18 aa, Mycobacterium
DWMYERLAGEYVLDDENR

SEQ ID NO: 649948 - protein, 28 aa, Mycobacterium
DWNRAGSARAWWCLTAAGISGVRILDGG

SEQ ID NO: 649949 - protein, 21 aa, Mycobacterium
DWNSSVPAWCELDLRIAFYPG

SEQ ID NO: 649950 - protein, 21 aa, Mycobacterium
DWPAEAVVVGPLHFEPTDRVL

SEQ ID NO: 649951 - protein, 21 aa, Mycobacterium
DWPAEAVVVGPLHFEPTTELL

SEQ ID NO: 649952 - protein, 21 aa, Mycobacterium
DWPAEAVVVGPLHWEPTDVVL

SEQ ID NO: 649953 - protein, 26 aa, Mycobacterium
DWPEGWRFDDLLPYFMRSEASRGGNP

SEQ ID NO: 649954 - protein, 22 aa, Mycobacterium
DWPELVRRWRAGYFSALDASSG

SEQ ID NO: 649955 - protein, 22 aa, Mycobacterium
DWPQRVRMGRPLSPDLPADLFG

SEQ ID NO: 649956 - protein, 22 aa, Mycobacterium
DWPSELKINVVAYHRHTGRLAR

SEQ ID NO: 649957 - protein, 19 aa, Mycobacterium
DWPVPAAAAAIVGPDGVLA

SEQ ID NO: 649958 - protein, 19 aa, Mycobacterium
DWPVPAAAAAVIGPTGVLA

SEQ ID NO: 649959 - protein, 20 aa, Mycobacterium
DWPYASMLGAGLCFVTGFEP

SEQ ID NO: 649960 - protein, 17 aa, Mycobacterium
DWQCVQATLALGDLAEP

SEQ ID NO: 649961 - protein, 24 aa, Mycobacterium
DWQGVSVLYVCPLRALLNNLQPRI

SEQ ID NO: 649962 - protein, 20 aa, Mycobacterium
DWQPRQGALVAMAAFGKLPV

SEQ ID NO: 649963 - protein, 29 aa, Mycobacterium
DWQQFSLWADDVFKAFSFSVDIREVEPVV

SEQ ID NO: 649964 - protein, 24 aa, Mycobacterium
DWRGWYRGRIAAWTNGLSSLEGPS

SEQ ID NO: 649965 - protein, 26 aa, Mycobacterium
DWRIVLHCPYGLRVNGPLALAISDRL

SEQ ID NO: 649966 - protein, 22 aa, Mycobacterium
DWRPTPGTVISWSASPRAREVA

SEQ ID NO: 649967 - protein, 21 aa, Mycobacterium
DWRQWWTWVPGACWKHPKGPG

SEQ ID NO: 649968 - protein, 21 aa, Mycobacterium
DWRRIRGREVGFVLQDALVSL

SEQ ID NO: 649969 - protein, 24 aa, Mycobacterium
DWSEALSLPMCLLHKGMRDRDRID

SEQ ID NO: 649970 - protein, 22 aa, Mycobacterium
DWSGLFNSFFWIDRTAGIGGVI

SEQ ID NO: 649971 - protein, 17 aa, Mycobacterium
DWSGYWGKQGPELLDHR

SEQ ID NO: 649972 - protein, 19 aa, Mycobacterium
DWSHWPVRVLGHADPTTIG

SEQ ID NO: 649973 - protein, 19 aa, Mycobacterium
DWTDLRVYGALLAVGTELF

SEQ ID NO: 649974 - protein, 21 aa, Mycobacterium
DWTDLRVYGALLAVLTELFSR

SEQ ID NO: 649975 - protein, 19 aa, Mycobacterium
DWTEPGFMGLGMIYTAMPV

SEQ ID NO: 649976 - protein, 28 aa, Mycobacterium
DWTFNGWGGQDWARWDRDAEIGVTVAEL

SEQ ID NO: 649977 - protein, 25 aa, Mycobacterium
DWTHLPLSGGLPWAQPEPRRPRTLD

SEQ ID NO: 649978 - protein, 21 aa, Mycobacterium
DWTIVRPSGLFDLPEPTDYIS

SEQ ID NO: 649979 - protein, 21 aa, Mycobacterium
DWTPTCGNILAGVGPFAIERG

SEQ ID NO: 649980 - protein, 21 aa, Mycobacterium
DWTPTGFPVEFLSLGTGGLGV

SEQ ID NO: 649981 - protein, 20 aa, Mycobacterium
DWTRIALLARFAFGDIEPEQ

SEQ ID NO: 649982 - protein, 25 aa, Mycobacterium
DWTRLPYEVLERISTRITNEVPEVN

SEQ ID NO: 649983 - protein, 19 aa, Mycobacterium
DWVFTKWRYSAFHRSALLE

SEQ ID NO: 649984 - protein, 17 aa, Mycobacterium
DWVLPRWGAEAPGAVGR

SEQ ID NO: 649985 - protein, 19 aa, Mycobacterium
DWVQFDGWTQAIVAANTAE

SEQ ID NO: 649986 - protein, 27 aa, Mycobacterium
DWVQHAIWWQVYPLGFVGAFPVPQSNE

SEQ ID NO: 649987 - protein, 18 aa, Mycobacterium
DWVRINGFGTPWWADDIA

SEQ ID NO: 649988 - protein, 19 aa, Mycobacterium
DWVRPEVVRRLRVEAPGVR

SEQ ID NO: 649989 - protein, 18 aa, Mycobacterium
DWVRVNGFGTPWWADDLD

SEQ ID NO: 649990 - protein, 17 aa, Mycobacterium
DWVSMAVLSDGSYGVPE

SEQ ID NO: 649991 - protein, 18 aa, Mycobacterium
DWVSMSVISDGSYGVPEG

SEQ ID NO: 649992 - protein, 20 aa, Mycobacterium
DWYADLPVASPQVFGDQTDV

SEQ ID NO: 649993 - protein, 20 aa, Mycobacterium
DWYEHLGLCAKGEGEQLLRS

SEQ ID NO: 649994 - protein, 31 aa, Mycobacterium
DYAALAALCDIFYPRVFLRHGGFLPSGTISL

SEQ ID NO: 649995 - protein, 27 aa, Mycobacterium
DYAALIGPRCRAVWLLTARAETVGPGD

SEQ ID NO: 649996 - protein, 25 aa, Mycobacterium
DYAALRRWAHRFYPDTQPAPSDFGY

SEQ ID NO: 649997 - protein, 25 aa, Mycobacterium
DYAALRRWAHRFYPGAQPSAEDFGY

SEQ ID NO: 649998 - protein, 25 aa, Mycobacterium
DYAALRRWAHRFYPGTQPSPSDFGY

SEQ ID NO: 649999 - protein, 24 aa, Mycobacterium
DYAEMLPAFGRRTAVVELRGHGHS

SEQ ID NO: 650000 - protein, 25 aa, Mycobacterium
DYALPGSFTASLGWYRAGAGTVAQS

SEQ ID NO: 650001 - protein, 25 aa, Mycobacterium
DYALSEWRRILDVNLTGVFLGIRAV

SEQ ID NO: 650002 - protein, 19 aa, Mycobacterium
DYAPLMAYLVRSMQTGGDL

SEQ ID NO: 650003 - protein, 40 aa, Mycobacterium
DYAPRPLRRFGLGAAHATELFAVFGLFKRWPALAGKKDRR

SEQ ID NO: 650004 - protein, 18 aa, Mycobacterium
DYAPVVMVNWEFFDNQTC

SEQ ID NO: 650005 - protein, 25 aa, Mycobacterium
DYAQRLATRHLLRYPGLQRAAERGA

SEQ ID NO: 650006 - protein, 21 aa, Mycobacterium
DYARDCFDAIVPDQVQRELPY

SEQ ID NO: 650007 - protein, 20 aa, Mycobacterium
DYARLFPTYGQNLIDLAVGL

SEQ ID NO: 650008 - protein, 19 aa, Mycobacterium
DYASPVPAILTMRLMGLPY

SEQ ID NO: 650009 - protein, 18 aa, Mycobacterium
DYCKERLGLDAALGSIDR

SEQ ID NO: 650010 - protein, 26 aa, Mycobacterium
DYDCGCKRPTLSNTFYPAFAKPHVHL

SEQ ID NO: 650011 - protein, 19 aa, Mycobacterium
DYDEWLARFTAAMKSLPDN

SEQ ID NO: 650012 - protein, 18 aa, Mycobacterium
DYDIKVLILKANGKGFCS

SEQ ID NO: 650013 - protein, 23 aa, Mycobacterium
DYDLSTAAGRSWVDIQGALATWE

SEQ ID NO: 650014 - protein, 23 aa, Mycobacterium
DYDLSTAAGRTWVDIQGALATWE

SEQ ID NO: 650015 - protein, 26 aa, Mycobacterium
DYDMSMARLLYWGCDVWLNNPLRPLE

SEQ ID NO: 650016 - protein, 21 aa, Mycobacterium
DYDPIWPLHGIRIIPGPSSLW

SEQ ID NO: 650017 - protein, 22 aa, Mycobacterium
DYDPPFAFDGRIHRVIVDVSGE

SEQ ID NO: 650018 - protein, 19 aa, Mycobacterium
DYDQWLARFELALKGLPEQ

SEQ ID NO: 650019 - protein, 22 aa, Mycobacterium
DYDRTALVRALRNAGEVLSSGS

SEQ ID NO: 650020 - protein, 23 aa, Mycobacterium
DYDRWAATGLTGWSSSELEPFFE

SEQ ID NO: 650021 - protein, 19 aa, Mycobacterium
DYEACLNVANGHAAWSKEN

SEQ ID NO: 650022 - protein, 23 aa, Mycobacterium
DYEAMRPKILSEHYSGYRVLEGG

SEQ ID NO: 650023 - protein, 26 aa, Mycobacterium
DYEGKWRIIFFWPKDFTFVCPTEIAA

SEQ ID NO: 650024 - protein, 24 aa, Mycobacterium
DYEKTMRLAMEMVDYEGLRAEQAE

SEQ ID NO: 650025 - protein, 21 aa, Mycobacterium
DYEPLCKRQVLSGSFHRAVQK

SEQ ID NO: 650026 - protein, 17 aa, Mycobacterium
DYERFGGVEFYSALEKS

SEQ ID NO: 650027 - protein, 24 aa, Mycobacterium
DYEVEIGLVIGRAIPVGTDISDAN

SEQ ID NO: 650028 - protein, 19 aa, Mycobacterium
DYFCVGPCWPTPTKPDRAA

SEQ ID NO: 650029 - protein, 18 aa, Mycobacterium
DYFDPSLQYEGRMGDYAI

SEQ ID NO: 650030 - protein, 26 aa, Mycobacterium
DYFKFRYYEKWLGGISQFFVDNGYVS

SEQ ID NO: 650031 - protein, 29 aa, Mycobacterium
DYFLKRLRNYGSLFLGRWSTVAYSDKGIA

SEQ ID NO: 650032 - protein, 20 aa, Mycobacterium
DYFLPADKYPAINITSIKGP

SEQ ID NO: 650033 - protein, 19 aa, Mycobacterium
DYFNARFDPMTADRDRAVT

SEQ ID NO: 650034 - protein, 19 aa, Mycobacterium
DYFRAARRGLVPGPFQFLR

SEQ ID NO: 650035 - protein, 19 aa, Mycobacterium
DYFRRVADAGVRQVVLLAA

SEQ ID NO: 650036 - protein, 26 aa, Mycobacterium
DYGADVWRWLDDGAHFYVCGDATRMA

SEQ ID NO: 650037 - protein, 25 aa, Mycobacterium
DYGAPIGWRLALRDPSAITAIISQN

SEQ ID NO: 650038 - protein, 25 aa, Mycobacterium
DYGAPIGWRLALRDPSAITAIITQN

SEQ ID NO: 650039 - protein, 25 aa, Mycobacterium
DYGAPIGWRLALRHPEAISAIVTQN

SEQ ID NO: 650040 - protein, 17 aa, Mycobacterium
DYGDVAYGWAMEDSTGF

SEQ ID NO: 650041 - protein, 26 aa, Mycobacterium
DYGMRLSWDFLARSTAGLRDWEERLG

SEQ ID NO: 650042 - protein, 25 aa, Mycobacterium
DYGRILDILERFYGLVLTDCGPGLL

SEQ ID NO: 650043 - protein, 19 aa, Mycobacterium
DYGRVLVMIGVHSREPIVE

SEQ ID NO: 650044 - protein, 24 aa, Mycobacterium
DYGSLCLLGSFAERTTVSQHSVVK

SEQ ID NO: 650045 - protein, 26 aa, Mycobacterium
DYHKRLTDFMVEFVFPAEAEYHAYRE

SEQ ID NO: 650046 - protein, 20 aa, Mycobacterium
DYHPAIGFYRRLFGWQTEQV

SEQ ID NO: 650047 - protein, 17 aa, Mycobacterium
DYHRSWHTGLVLHGQAD

SEQ ID NO: 650048 - protein, 25 aa, Mycobacterium
DYHSELFWWTADFVATEGIPRSALV

SEQ ID NO: 650049 - protein, 19 aa, Mycobacterium
DYIDFSWFDAVVMALDPAF

SEQ ID NO: 650050 - protein, 25 aa, Mycobacterium
DYIGEQFMQWFLKEQVEEVALMDTL

SEQ ID NO: 650051 - protein, 19 aa, Mycobacterium
DYIGWPLVSAGAFGLAQLA

SEQ ID NO: 650052 - protein, 19 aa, Mycobacterium
DYIKTLAVKPDFSRTRLLS

SEQ ID NO: 650053 - protein, 25 aa, Mycobacterium
DYINGRPAPLVAYWYGPDDENFRSF

SEQ ID NO: 650054 - protein, 18 aa, Mycobacterium
DYLADFFNYITPQFGVTT

SEQ ID NO: 650055 - protein, 19 aa, Mycobacterium
DYLAESVFAPLNLGDTDLD

SEQ ID NO: 650056 - protein, 23 aa, Mycobacterium
DYLDGWPGTLIVVTHDRYFLERV

SEQ ID NO: 650057 - protein, 17 aa, Mycobacterium
DYLELVSDFARHAAIAL

SEQ ID NO: 650058 - protein, 17 aa, Mycobacterium
DYLEMINPLWTTKELRG

SEQ ID NO: 650059 - protein, 17 aa, Mycobacterium
DYLGTKIEFRLGDVNET

SEQ ID NO: 650060 - protein, 23 aa, Mycobacterium
DYLHFSVEWEHRFDHADSLLYMR

SEQ ID NO: 650061 - protein, 24 aa, Mycobacterium
DYLHFTIEWEHRFEYAQSILYMRL

SEQ ID NO: 650062 - protein, 26 aa, Mycobacterium
DYLILDCLRPVLDALGLDENRDAGRF

SEQ ID NO: 650063 - protein, 18 aa, Mycobacterium
DYLILGACDPDLAHRAIE

SEQ ID NO: 650064 - protein, 17 aa, Mycobacterium
DYLILGACNPPLAHRAI

SEQ ID NO: 650065 - protein, 17 aa, Mycobacterium
DYLKASGVQLVPGSTSA

SEQ ID NO: 650066 - protein, 23 aa, Mycobacterium
DYLKRLTADLRRARRRVAELEGK

SEQ ID NO: 650067 - protein, 24 aa, Mycobacterium
DYLKRLTADLRRTRRRVAELEGQL

SEQ ID NO: 650068 - protein, 18 aa, Mycobacterium
DYLLGRLGAKRVILAGQV

SEQ ID NO: 650069 - protein, 17 aa, Mycobacterium
DYLLPRQRDRAALSDDE

SEQ ID NO: 650070 - protein, 19 aa, Mycobacterium
DYLLRDVLELGDPGSPKPR

SEQ ID NO: 650071 - protein, 18 aa, Mycobacterium
DYLRDGWASSDHSATDRR

SEQ ID NO: 650072 - protein, 21 aa, Mycobacterium
DYLRMWIQAATAMSIYHAAVD

SEQ ID NO: 650073 - protein, 19 aa, Mycobacterium
DYLRMWIQAATTMATYQAI

SEQ ID NO: 650074 - protein, 17 aa, Mycobacterium
DYLRQHVHLGYAVTVHA

SEQ ID NO: 650075 - protein, 24 aa, Mycobacterium
DYLSADEALRCGLVTQVVPHAELQ

SEQ ID NO: 650076 - protein, 17 aa, Mycobacterium
DYLSFLPANTFDDAPIV

SEQ ID NO: 650077 - protein, 17 aa, Mycobacterium
DYLSFLPSNTFDYPPIV

SEQ ID NO: 650078 - protein, 29 aa, Mycobacterium
DYLSGRWAQAYGFPLMPIDGILVGTAAMA

SEQ ID NO: 650079 - protein, 24 aa, Mycobacterium
DYLWNVKQIVPFLKVDKGLAEEKD

SEQ ID NO: 650080 - protein, 26 aa, Mycobacterium
DYNHAFCFLRGAGLVQLGEHCWETKA

SEQ ID NO: 650081 - protein, 26 aa, Mycobacterium
DYNNGFLWRGDNQGLIFGEPGFGNST

SEQ ID NO: 650082 - protein, 18 aa, Mycobacterium
DYPAMLLAECARLNRAGL

SEQ ID NO: 650083 - protein, 22 aa, Mycobacterium
DYPAMLRAECARLNQAGLTTCS

SEQ ID NO: 650084 - protein, 18 aa, Mycobacterium
DYPAMLRAECARLNRAGL

SEQ ID NO: 650085 - protein, 22 aa, Mycobacterium
DYPAPNKYVAPIAFNVVPLAGS

SEQ ID NO: 650086 - protein, 21 aa, Mycobacterium
DYPARVVAVGVDRDCRATEIA

SEQ ID NO: 650087 - protein, 24 aa, Mycobacterium
DYPDAVTIGEVWVLDNLLWAEYLR

SEQ ID NO: 650088 - protein, 24 aa, Mycobacterium
DYPDLEVCVYAAPTQTVIGGPPDQ

SEQ ID NO: 650089 - protein, 25 aa, Mycobacterium
DYPERLDEFLTWAGSVRNVLNPLPV

SEQ ID NO: 650090 - protein, 26 aa, Mycobacterium
DYPGLYAPMIHPWSGTGMLEDDNGDP

SEQ ID NO: 650091 - protein, 27 aa, Mycobacterium
DYPMPRRAGCPFAPPPGVMALAEARPL

SEQ ID NO: 650092 - protein, 25 aa, Mycobacterium
DYPNFSICGIPYYVSGEVTHWSNLA

SEQ ID NO: 650093 - protein, 21 aa, Mycobacterium
DYPPERVRAGAGLLDGVSEIG

SEQ ID NO: 650094 - protein, 21 aa, Mycobacterium
DYPPPGGYRGGYGDEPRYGAV

SEQ ID NO: 650095 - protein, 20 aa, Mycobacterium
DYPPPGGYRGGYPDEARFQP

SEQ ID NO: 650096 - protein, 20 aa, Mycobacterium
DYPQAIPVIVDWLQHLDERV

SEQ ID NO: 650097 - protein, 22 aa, Mycobacterium
DYPQAVPIMVDWLRHIDERVPA

SEQ ID NO: 650098 - protein, 28 aa, Mycobacterium
DYPRGNLAFRWFLADEVPARPEVRLVKV

SEQ ID NO: 650099 - protein, 29 aa, Mycobacterium
DYPRGNLAFRWFLADGVPARPEVKLVKLA

SEQ ID NO: 650100 - protein, 23 aa, Mycobacterium
DYPRLVEMGHKIYFGSDFPNIPY

SEQ ID NO: 650101 - protein, 19 aa, Mycobacterium
DYQAFGAIATVFSALAAKH

SEQ ID NO: 650102 - protein, 19 aa, Mycobacterium
DYQDSFGLPDEGWVLDELR

SEQ ID NO: 650103 - protein, 18 aa, Mycobacterium
DYQFGHGLPVITVPWSAL

SEQ ID NO: 650104 - protein, 24 aa, Mycobacterium
DYRDRGCPEPKPLSLDLIREMMDW

SEQ ID NO: 650105 - protein, 17 aa, Mycobacterium
DYREFHIDWDLAAAEKG

SEQ ID NO: 650106 - protein, 21 aa, Mycobacterium
DYRERLEMYLAELREIDMHAP

SEQ ID NO: 650107 - protein, 17 aa, Mycobacterium
DYRGSVLDAVTSAFHDH

SEQ ID NO: 650108 - protein, 19 aa, Mycobacterium
DYRIAIRRIADGGGGSVEM

SEQ ID NO: 650109 - protein, 19 aa, Mycobacterium
DYRIPTDRIEVIPPGVDLD

SEQ ID NO: 650110 - protein, 19 aa, Mycobacterium
DYRMPGMDGAQVAAAVRTQ

SEQ ID NO: 650111 - protein, 24 aa, Mycobacterium
DYRMPQMSGIEFLEAAMDIFPLAR

SEQ ID NO: 650112 - protein, 22 aa, Mycobacterium
DYRMPQMSGIEFLEQAMDLYPA

SEQ ID NO: 650113 - protein, 23 aa, Mycobacterium
DYRMPQMSGIEFLERAMDLYPAA

SEQ ID NO: 650114 - protein, 24 aa, Mycobacterium
DYRMSVWSAESWRPVDKVTETFRN

SEQ ID NO: 650115 - protein, 19 aa, Mycobacterium
DYRTFWTQFGRVVKEGLLS

SEQ ID NO: 650116 - protein, 23 aa, Mycobacterium
DYRTFWTQFGRVVKEGLLSDFDN

SEQ ID NO: 650117 - protein, 20 aa, Mycobacterium
DYRTLLEFFFQIHDPTTPNR

SEQ ID NO: 650118 - protein, 28 aa, Mycobacterium
DYRVMRSDRGFLCFPEVDIHIPFTPGMA

SEQ ID NO: 650119 - protein, 19 aa, Mycobacterium
DYRVPIGEALRLWYELLTE

SEQ ID NO: 650120 - protein, 17 aa, Mycobacterium
DYRYAWVRDSTFALWGL

SEQ ID NO: 650121 - protein, 19 aa, Mycobacterium
DYRYCWIRDQCYAGQAVAA

SEQ ID NO: 650122 - protein, 18 aa, Mycobacterium
DYRYSWVRDSTFALWGLY

SEQ ID NO: 650123 - protein, 19 aa, Mycobacterium
DYSAACGIAAEQQSLEHPV

SEQ ID NO: 650124 - protein, 19 aa, Mycobacterium
DYSAACGIAPQHQALDHPV

SEQ ID NO: 650125 - protein, 19 aa, Mycobacterium
DYSAACGIAPQHQSLDHPI

SEQ ID NO: 650126 - protein, 18 aa, Mycobacterium
DYSCERYAKTGAMMPPDA

SEQ ID NO: 650127 - protein, 19 aa, Mycobacterium
DYSEAIALARLGWAALAVG

SEQ ID NO: 650128 - protein, 20 aa, Mycobacterium
DYSEAIALARLGWAALAVGT

SEQ ID NO: 650129 - protein, 22 aa, Mycobacterium
DYSEGRLLLGLGSQIKPHIEKR

SEQ ID NO: 650130 - protein, 17 aa, Mycobacterium
DYSEMWAQDIVAMDGYA

SEQ ID NO: 650131 - protein, 17 aa, Mycobacterium
DYSRMWVQAATTMSTYQ

SEQ ID NO: 650132 - protein, 20 aa, Mycobacterium
DYTAGLPFLIHAVSDGAHPP

SEQ ID NO: 650133 - protein, 19 aa, Mycobacterium
DYTEGTGWHNARVIGYGPI

SEQ ID NO: 650134 - protein, 19 aa, Mycobacterium
DYTFRLNVGAYFYLAKAAL

SEQ ID NO: 650135 - protein, 24 aa, Mycobacterium
DYTRESTITWARLADEGPFSTISS

SEQ ID NO: 650136 - protein, 19 aa, Mycobacterium
DYTSRGWAMNSLFDGIPAL

SEQ ID NO: 650137 - protein, 23 aa, Mycobacterium
DYTYLRHVEWVKSWFEELRLAEA

SEQ ID NO: 650138 - protein, 19 aa, Mycobacterium
DYVAKVLKDRGFEVQTPEL

SEQ ID NO: 650139 - protein, 24 aa, Mycobacterium
DYVDIAMGFGVNFFGHQAPFIVDA

SEQ ID NO: 650140 - protein, 23 aa, Mycobacterium
DYVGLRESMSFTAVPAALKVVAP

SEQ ID NO: 650141 - protein, 17 aa, Mycobacterium
DYVIPYVKEREAFGEPI

SEQ ID NO: 650142 - protein, 23 aa, Mycobacterium
DYVKAFWNVVNWADVQKRYAAAT

SEQ ID NO: 650143 - protein, 19 aa, Mycobacterium
DYVKAIWNVVNWQDVQVRF

SEQ ID NO: 650144 - protein, 18 aa, Mycobacterium
DYVNEDWPTLGIRTSPYS

SEQ ID NO: 650145 - protein, 23 aa, Mycobacterium
DYVPRAAVDLFLSGVNINNLSQI

SEQ ID NO: 650146 - protein, 24 aa, Mycobacterium
DYVRKRLGLQDVIMTRDRDGQLHL

SEQ ID NO: 650147 - protein, 35 aa, Mycobacterium
DYVVKCAPGIDFAVVGELGFRGEIELVSLGGSVRE

SEQ ID NO: 650148 - protein, 24 aa, Mycobacterium
DYVVLPALSLRRWRRTLAANLTAN

SEQ ID NO: 650149 - protein, 22 aa, Mycobacterium
DYWDTHMCASFMVDRLGLRQID

SEQ ID NO: 650150 - protein, 17 aa, Mycobacterium
DYWPRQWAHAYVDFAAG

SEQ ID NO: 650151 - protein, 18 aa, Mycobacterium
DYYALRLLGSAALGRAAR

SEQ ID NO: 650152 - protein, 18 aa, Mycobacterium
DYYYRPGMDLRPIPEGKN

SEQ ID NO: 650153 - protein, 29 aa, Mycobacterium
EAAAARLPFLPIRAGLGSDVMNFWGDELK

SEQ ID NO: 650154 - protein, 23 aa, Mycobacterium
EAAADFDGLLLLGGGDVDGSCYG

SEQ ID NO: 650155 - protein, 20 aa, Mycobacterium
EAAAEAGVELGLLGTAVREG

SEQ ID NO: 650156 - protein, 17 aa, Mycobacterium
EAAAGLLSVAKIVLCMD

SEQ ID NO: 650157 - protein, 23 aa, Mycobacterium
EAAAIRLGLLAGHYRGDRYWSQQ

SEQ ID NO: 650158 - protein, 23 aa, Mycobacterium
EAAAKACRFGEIVVQGGVTSAIL

SEQ ID NO: 650159 - protein, 18 aa, Mycobacterium
EAAARAGVHIVTGDTKVV

SEQ ID NO: 650160 - protein, 25 aa, Mycobacterium
EAAARLAANLMKWTGISPQHVARTT

SEQ ID NO: 650161 - protein, 17 aa, Mycobacterium
EAACHGVDRFTRVCDVA

SEQ ID NO: 650162 - protein, 17 aa, Mycobacterium
EAACITVDRLIEQATAQ

SEQ ID NO: 650163 - protein, 17 aa, Mycobacterium
EAACRRLGTVRVSACPQ

SEQ ID NO: 650164 - protein, 23 aa, Mycobacterium
EAACTGIDRFTRVHDIAATDFVT

SEQ ID NO: 650165 - protein, 25 aa, Mycobacterium
EAACTRAGARFSGGVFACAALTEYE

SEQ ID NO: 650166 - protein, 17 aa, Mycobacterium
EAADAFEAVRVIGRAVG

SEQ ID NO: 650167 - protein, 23 aa, Mycobacterium
EAADAWQRLGADLEESVRAHDPV

SEQ ID NO: 650168 - protein, 21 aa, Mycobacterium
EAADLVARCDADVAIIDLSMP

SEQ ID NO: 650169 - protein, 24 aa, Mycobacterium
EAADRLAIQLGHRGVGPGDRVILF

SEQ ID NO: 650170 - protein, 19 aa, Mycobacterium
EAADRLGLARVTGQEVLVA

SEQ ID NO: 650171 - protein, 24 aa, Mycobacterium
EAAEDWLCLLEAFDQPHRPGMVRA

SEQ ID NO: 650172 - protein, 19 aa, Mycobacterium
EAAEDWLYLLEAFDQPHRP

SEQ ID NO: 650173 - protein, 19 aa, Mycobacterium
EAAEGRWFANQVKSSSDPF

SEQ ID NO: 650174 - protein, 22 aa, Mycobacterium
EAAEKRAADQAALQRATAEKSR

SEQ ID NO: 650175 - protein, 24 aa, Mycobacterium
EAAELHEIYKLGVVPIPTNRPMVR

SEQ ID NO: 650176 - protein, 23 aa, Mycobacterium
EAAELMINLFWRGLKGTPSDAGT

SEQ ID NO: 650177 - protein, 17 aa, Mycobacterium
EAAEPGPGFGRFLTAMR

SEQ ID NO: 650178 - protein, 20 aa, Mycobacterium
EAAEPLPEWEQELLASAAAS

SEQ ID NO: 650179 - protein, 21 aa, Mycobacterium
EAAEPLPEWEQELLASAAASA

SEQ ID NO: 650180 - protein, 25 aa, Mycobacterium
EAAERLGVLGLPFLFFIDAAQGRAG

SEQ ID NO: 650181 - protein, 23 aa, Mycobacterium
EAAEVSAALVIHHFGSKDGLRKA

SEQ ID NO: 650182 - protein, 24 aa, Mycobacterium
EAAEWHWPVRHLVITRGARGASYV

SEQ ID NO: 650183 - protein, 17 aa, Mycobacterium
EAAFAMTVPPPVIAANR

SEQ ID NO: 650184 - protein, 26 aa, Mycobacterium
EAAFASWKALGARFFALRPVTQLHWT

SEQ ID NO: 650185 - protein, 20 aa, Mycobacterium
EAAFEGFTLIVPGLGEAGAA

SEQ ID NO: 650186 - protein, 17 aa, Mycobacterium
EAAFEYAANLGYDGVEL

SEQ ID NO: 650187 - protein, 22 aa, Mycobacterium
EAAFKLTRLTGRTKVVAAEGAF

SEQ ID NO: 650188 - protein, 18 aa, Mycobacterium
EAAFYRNSLIHAFLETSL

SEQ ID NO: 650189 - protein, 20 aa, Mycobacterium
EAAGASWLSFMDHFFQIEPT

SEQ ID NO: 650190 - protein, 20 aa, Mycobacterium
EAAGDWKPLADFYAPDATYG

SEQ ID NO: 650191 - protein, 22 aa, Mycobacterium
EAAGEWLARILFSLFTTPSPIR

SEQ ID NO: 650192 - protein, 20 aa, Mycobacterium
EAAGLLADLRRLSVGVKLIT

SEQ ID NO: 650193 - protein, 22 aa, Mycobacterium
EAAGLLDLFGPRERWAHTQRTF

SEQ ID NO: 650194 - protein, 19 aa, Mycobacterium
EAAGLPWDAVLAADAAAPE

SEQ ID NO: 650195 - protein, 19 aa, Mycobacterium
EAAGLQWGLVVRRNSELGA

SEQ ID NO: 650196 - protein, 18 aa, Mycobacterium
EAAGLRWLAGVDGGVPLA

SEQ ID NO: 650197 - protein, 21 aa, Mycobacterium
EAAGRLTLMVDRERPTVRYVS

SEQ ID NO: 650198 - protein, 25 aa, Mycobacterium
EAAGRTKGYLDAMLAARLVPHPDWH

SEQ ID NO: 650199 - protein, 27 aa, Mycobacterium
EAAGVHRGYKCSIRTPWWRTPSLWAPD

SEQ ID NO: 650200 - protein, 33 aa, Mycobacterium
EAAGVSRGWLYRHFPDKVSLLGAAIVRLNDAYW

SEQ ID NO: 650201 - protein, 18 aa, Mycobacterium
EAAHGRRLLRIAASSTFA

SEQ ID NO: 650202 - protein, 17 aa, Mycobacterium
EAAIRARGLHFVGAGIS

SEQ ID NO: 650203 - protein, 19 aa, Mycobacterium
EAAKAMAYVARFIAHALQD

SEQ ID NO: 650204 - protein, 24 aa, Mycobacterium
EAAKGVAMPLRLTSPAPCTNCHGS

SEQ ID NO: 650205 - protein, 23 aa, Mycobacterium
EAAKVVAGAACERPSEPAVEGID

SEQ ID NO: 650206 - protein, 17 aa, Mycobacterium
EAALAGLDLRWAAVTLD

SEQ ID NO: 650207 - protein, 25 aa, Mycobacterium
EAALAIRAGALWVAANVDLTLPSER

SEQ ID NO: 650208 - protein, 25 aa, Mycobacterium
EAALAIRSGALWVAANVDPTLPTER

SEQ ID NO: 650209 - protein, 25 aa, Mycobacterium
EAALAIRSGALWVAANVDRTLPSER

SEQ ID NO: 650210 - protein, 19 aa, Mycobacterium
EAALAKRGLHRAALPEKPW

SEQ ID NO: 650211 - protein, 23 aa, Mycobacterium
EAALCVAAALFGRLHSGGGEAVD

SEQ ID NO: 650212 - protein, 24 aa, Mycobacterium
EAALDRFGALLADAPVTPVTERAA

SEQ ID NO: 650213 - protein, 24 aa, Mycobacterium
EAALERLRNQPALEEAATRVETYT

SEQ ID NO: 650214 - protein, 19 aa, Mycobacterium
EAALERLRSQPAFEDASAR

SEQ ID NO: 650215 - protein, 19 aa, Mycobacterium
EAALERLRSQPVFEDASAR

SEQ ID NO: 650216 - protein, 20 aa, Mycobacterium
EAALGKGVAAWQGEASEMWA

SEQ ID NO: 650217 - protein, 29 aa, Mycobacterium
EAALGVALRIAWRALTFAGLHGSDRMRQL

SEQ ID NO: 650218 - protein, 31 aa, Mycobacterium
EAALGVALRIGWRALTFAGLRGNERMRQLDR

SEQ ID NO: 650219 - protein, 17 aa, Mycobacterium
EAALHFVFCELGAQAAT

SEQ ID NO: 650220 - protein, 18 aa, Mycobacterium
EAALKAKGADHWYHELTA

SEQ ID NO: 650221 - protein, 23 aa, Mycobacterium
EAALPSPFCHELAAMATEPVPEP

SEQ ID NO: 650222 - protein, 19 aa, Mycobacterium
EAALQRLRSQTGLDDASAR

SEQ ID NO: 650223 - protein, 27 aa, Mycobacterium
EAALRHENSWEGFEWFVHQMCEITATN

SEQ ID NO: 650224 - protein, 18 aa, Mycobacterium
EAALRRGLVSEVFATEAA

SEQ ID NO: 650225 - protein, 18 aa, Mycobacterium
EAALRRGLVSEVFATESA

SEQ ID NO: 650226 - protein, 20 aa, Mycobacterium
EAALRVARDIAAKDTRVIRA

SEQ ID NO: 650227 - protein, 25 aa, Mycobacterium
EAAMEVFEAGQLCLAISQSGETADV

SEQ ID NO: 650228 - protein, 26 aa, Mycobacterium
EAAMKLARLNGCRRFISMTGGYHGKT

SEQ ID NO: 650229 - protein, 24 aa, Mycobacterium
EAAMKVLRKRGIDVRLGVTLKQAH

SEQ ID NO: 650230 - protein, 18 aa, Mycobacterium
EAAMLRRRLERGSNEPTV

SEQ ID NO: 650231 - protein, 17 aa, Mycobacterium
EAAMPRLRKAAQGPGDI

SEQ ID NO: 650232 - protein, 23 aa, Mycobacterium
EAAMSLAAPTGYRTIAVGIATGA

SEQ ID NO: 650233 - protein, 24 aa, Mycobacterium
EAANASPLLGISQDMLNAVNGPTE

SEQ ID NO: 650234 - protein, 37 aa, Mycobacterium
EAANEVLAGWSRRGQPPIVCGLDLTRRVAMTPDILAR

SEQ ID NO: 650235 - protein, 25 aa, Mycobacterium
EAANGVPIPIAWPDRLVAADYGLEA

SEQ ID NO: 650236 - protein, 24 aa, Mycobacterium
EAANTCAVSNAFNALLAPIENLLA

SEQ ID NO: 650237 - protein, 21 aa, Mycobacterium
EAAPDLPCEVEVDSLEQLDEV

SEQ ID NO: 650238 - protein, 22 aa, Mycobacterium
EAAPHRAVWALGDYALMAEEVM

SEQ ID NO: 650239 - protein, 21 aa, Mycobacterium
EAAPPMTHIVLLGGDFPAAAS

SEQ ID NO: 650240 - protein, 22 aa, Mycobacterium
EAAQAAIVHPAMVAANRNELVA

SEQ ID NO: 650241 - protein, 22 aa, Mycobacterium
EAAQAFSQWRTTPGPIRGALVA

SEQ ID NO: 650242 - protein, 17 aa, Mycobacterium
EAAQMTGSISLMWARKG

SEQ ID NO: 650243 - protein, 20 aa, Mycobacterium
EAAQQTWFRASALAERVGAT

SEQ ID NO: 650244 - protein, 17 aa, Mycobacterium
EAAQRCAHFAEVRRSGG

SEQ ID NO: 650245 - protein, 32 aa, Mycobacterium
EAAQRISGLVSRTPLQFCDRLSEITGATVYLK

SEQ ID NO: 650246 - protein, 24 aa, Mycobacterium
EAAQRISQSVPWPLIREQTPSDAC

SEQ ID NO: 650247 - protein, 17 aa, Mycobacterium
EAARAHNATSFMVIQAG

SEQ ID NO: 650248 - protein, 23 aa, Mycobacterium
EAARARLAAIPVTVETLTAIIAR

SEQ ID NO: 650249 - protein, 30 aa, Mycobacterium
EAARARYGFRDFKLKGGVLPAAEEAKAVTA

SEQ ID NO: 650250 - protein, 17 aa, Mycobacterium
EAARAVTVQPGLVAANR

SEQ ID NO: 650251 - protein, 21 aa, Mycobacterium
EAARKLGLLIVHTREGHRPDL

SEQ ID NO: 650252 - protein, 18 aa, Mycobacterium
EAARLAFERRAAALQPRR

SEQ ID NO: 650253 - protein, 18 aa, Mycobacterium
EAARLMVDAVRRHQAASL

SEQ ID NO: 650254 - protein, 27 aa, Mycobacterium
EAARLRLSRPLPLRVGDIGLLRDPGQH

SEQ ID NO: 650255 - protein, 22 aa, Mycobacterium
EAARMAAAPWSRAIVGSAVAAA

SEQ ID NO: 650256 - protein, 25 aa, Mycobacterium
EAARNPSRFMAMAGCFVDDHADRRV

SEQ ID NO: 650257 - protein, 19 aa, Mycobacterium
EAARPYAFQITAMLTTLSS

SEQ ID NO: 650258 - protein, 24 aa, Mycobacterium
EAARRELLVKLALVPADSGLVETY

SEQ ID NO: 650259 - protein, 27 aa, Mycobacterium
EAARRFGCGFAPSGWDSLTKHLVRKGF

SEQ ID NO: 650260 - protein, 20 aa, Mycobacterium
EAARRLGRRTLVLVPNTAVQ

SEQ ID NO: 650261 - protein, 37 aa, Mycobacterium
EAARSASVPPTLVAANRTRLVSLVLTNLFGQHAPAIA

SEQ ID NO: 650262 - protein, 24 aa, Mycobacterium
EAARSRAGLAHFGAPRPGRRIGLV

SEQ ID NO: 650263 - protein, 23 aa, Mycobacterium
EAARSRVGLAHFAAPTPGRRIGL

SEQ ID NO: 650264 - protein, 17 aa, Mycobacterium
EAARTWADRLIGAAAVG

SEQ ID NO: 650265 - protein, 17 aa, Mycobacterium
EAARTWTDRLIAAAAEG

SEQ ID NO: 650266 - protein, 21 aa, Mycobacterium
EAASIRRCWSTWNTLCAFLYT

SEQ ID NO: 650267 - protein, 25 aa, Mycobacterium
EAASRMTGKPGLCIGTLGPGMANIA

SEQ ID NO: 650268 - protein, 25 aa, Mycobacterium
EAASRMTGKPGLCIGTLGPGMANMA

SEQ ID NO: 650269 - protein, 28 aa, Mycobacterium
EAASSLPEWTPALAIPCPNGLLCWAKPA

SEQ ID NO: 650270 - protein, 26 aa, Mycobacterium
EAATFGIAYLTAWHSLCEVGRLSPGE

SEQ ID NO: 650271 - protein, 26 aa, Mycobacterium
EAATFGVAYLTAWHSLCEVGRLSPGE

SEQ ID NO: 650272 - protein, 20 aa, Mycobacterium
EAATGAGMWRVRDINESDGE

SEQ ID NO: 650273 - protein, 23 aa, Mycobacterium
EAATICRNCPVILECAADALDNR

SEQ ID NO: 650274 - protein, 28 aa, Mycobacterium
EAATLHRFVDRFAHFNFRDHMMRPSYGL

SEQ ID NO: 650275 - protein, 23 aa, Mycobacterium
EAATLTPFMWLRPITNPSGSTLR

SEQ ID NO: 650276 - protein, 24 aa, Mycobacterium
EAATRIGLTPAYNVLDGFEGHPNA

SEQ ID NO: 650277 - protein, 17 aa, Mycobacterium
EAATVADVLLGVVNAPT

SEQ ID NO: 650278 - protein, 25 aa, Mycobacterium
EAAVRELLCAIGEDPDRHGLRETPA

SEQ ID NO: 650279 - protein, 17 aa, Mycobacterium
EAAVRELLYAVGEDPDR

SEQ ID NO: 650280 - protein, 23 aa, Mycobacterium
EAAVVEHSLWWPVDVPPAELAAA

SEQ ID NO: 650281 - protein, 25 aa, Mycobacterium
EAAYPFYYTRFREMSDADFQVLPQE

SEQ ID NO: 650282 - protein, 25 aa, Mycobacterium
EAAYPGRFLLGIGVGHPEAHTEYRK

SEQ ID NO: 650283 - protein, 25 aa, Mycobacterium
EAAYPGRFLLGIGVGHPEAITEYHS

SEQ ID NO: 650284 - protein, 19 aa, Mycobacterium
EAAYRKGLSLAEAIETVEL

SEQ ID NO: 650285 - protein, 18 aa, Mycobacterium
EAAYRPAPAALRDRVPIN

SEQ ID NO: 650286 - protein, 32 aa, Mycobacterium
EAAYTKLKSFGGWLQALAGKWNQLAAEAEKLA

SEQ ID NO: 650287 - protein, 24 aa, Mycobacterium
EACAQAIAWYLAMARRGQGNEEAA

SEQ ID NO: 650288 - protein, 22 aa, Mycobacterium
EACDRLTRHLAYARELTEQLAK

SEQ ID NO: 650289 - protein, 27 aa, Mycobacterium
EACERADAVLILTEWQEFVDLDPDDLA

SEQ ID NO: 650290 - protein, 17 aa, Mycobacterium
EACGGAGYLAENRLIAL

SEQ ID NO: 650291 - protein, 17 aa, Mycobacterium
EACQIAAAMCLHSDDWL

SEQ ID NO: 650292 - protein, 20 aa, Mycobacterium
EACRDELIEVVRLLEQGGLD

SEQ ID NO: 650293 - protein, 19 aa, Mycobacterium
EACSLAVLIERAAKLQLAA

SEQ ID NO: 650294 - protein, 21 aa, Mycobacterium
EACSLAVLIERAAKLQLAAMA

SEQ ID NO: 650295 - protein, 17 aa, Mycobacterium
EACSLGILIERAAKLQL

SEQ ID NO: 650296 - protein, 22 aa, Mycobacterium
EACSRYATDPGRLALTVRHEDG

SEQ ID NO: 650297 - protein, 19 aa, Mycobacterium
EACTNCIEHAYRGHRIGTM

SEQ ID NO: 650298 - protein, 19 aa, Mycobacterium
EACTNCVEHAYSGQRLGTM

SEQ ID NO: 650299 - protein, 27 aa, Mycobacterium
EADAAFGPADIRAWVGHYFDYMDHHGA

SEQ ID NO: 650300 - protein, 29 aa, Mycobacterium
EADAAPARFARGWYCLGLIKDFGDGKPHA

SEQ ID NO: 650301 - protein, 29 aa, Mycobacterium
EADAAPTRFARGWHCLGLIRDFGDGTPHQ

SEQ ID NO: 650302 - protein, 19 aa, Mycobacterium
EADAAVLAVAYRKLPAHQI

SEQ ID NO: 650303 - protein, 29 aa, Mycobacterium
EADCMVGPILQRRAAAAGVIYAMAYGDQP

SEQ ID NO: 650304 - protein, 24 aa, Mycobacterium
EADDLPFRLVESVINSRSDDAVVP

SEQ ID NO: 650305 - protein, 23 aa, Mycobacterium
EADEGSGVFWVWPDSAGDVDHDA

SEQ ID NO: 650306 - protein, 26 aa, Mycobacterium
EADEPGRLLGFHWTKVHPDEPGLGEV

SEQ ID NO: 650307 - protein, 23 aa, Mycobacterium
EADGDAALVRWLTAAIEPGTVGW

SEQ ID NO: 650308 - protein, 23 aa, Mycobacterium
EADGRRPRILVAKMGQDGHDRGQ

SEQ ID NO: 650309 - protein, 21 aa, Mycobacterium
EADGVITICLCHFEDRDAMEK

SEQ ID NO: 650310 - protein, 20 aa, Mycobacterium
EADGWLRPGATILEATSGNT

SEQ ID NO: 650311 - protein, 20 aa, Mycobacterium
EADGYRQYFCSQVCLDSYDA

SEQ ID NO: 650312 - protein, 20 aa, Mycobacterium
EADILWDLASRLEGRMTAIG

SEQ ID NO: 650313 - protein, 27 aa, Mycobacterium
EADKLGGTCLHRGCIPTKALLHTAELA

SEQ ID NO: 650314 - protein, 29 aa, Mycobacterium
EADLDVLGYWQWREGLLRGIAAHHAGMLP

SEQ ID NO: 650315 - protein, 34 aa, Mycobacterium
EADLGRPLIQVGFMRRFDDEYVRLKALLDGGELG

SEQ ID NO: 650316 - protein, 25 aa, Mycobacterium
EADLKSGVLSRVWHGIYGRGELTSG

SEQ ID NO: 650317 - protein, 19 aa, Mycobacterium
EADLTRFPDDVARVVVRLI

SEQ ID NO: 650318 - protein, 17 aa, Mycobacterium
EADLVLLAMGFVGPEKE

SEQ ID NO: 650319 - protein, 18 aa, Mycobacterium
EADLVLLAMGFVGPEKPG

SEQ ID NO: 650320 - protein, 26 aa, Mycobacterium
EADPGRRLVLSWGWEGHGDPAPGEST

SEQ ID NO: 650321 - protein, 23 aa, Mycobacterium
EADPQPWTKMSFATAQDNFLTAA

SEQ ID NO: 650322 - protein, 20 aa, Mycobacterium
EADPRYMPFESLRGRDFTSM

SEQ ID NO: 650323 - protein, 20 aa, Mycobacterium
EADQSCTVWYMITERSVEID

SEQ ID NO: 650324 - protein, 17 aa, Mycobacterium
EADQWRDVIDVNLTGVW

SEQ ID NO: 650325 - protein, 18 aa, Mycobacterium
EADRLAGVDADFHQRDLH

SEQ ID NO: 650326 - protein, 19 aa, Mycobacterium
EADRLGARLDRIDTTRRER

SEQ ID NO: 650327 - protein, 18 aa, Mycobacterium
EADRRPGDILAEVQALVE

SEQ ID NO: 650328 - protein, 24 aa, Mycobacterium
EADTPLYLRYVIFGGERLTSSDLI

SEQ ID NO: 650329 - protein, 21 aa, Mycobacterium
EADVALPVVRTFITRIKERAK

SEQ ID NO: 650330 - protein, 19 aa, Mycobacterium
EADVAVCIGPAAARHSYLD

SEQ ID NO: 650331 - protein, 19 aa, Mycobacterium
EADVFFARRQVHIVNPRIL

SEQ ID NO: 650332 - protein, 19 aa, Mycobacterium
EADVGLLDFTRAVSALRAN

SEQ ID NO: 650333 - protein, 24 aa, Mycobacterium
EADVKRWVTLAAESLATVEKVISE

SEQ ID NO: 650334 - protein, 19 aa, Mycobacterium
EADYARMWVQAATTMTTYQ

SEQ ID NO: 650335 - protein, 19 aa, Mycobacterium
EADYCFLLDPWWNPATETQ

SEQ ID NO: 650336 - protein, 23 aa, Mycobacterium
EAEADLFYADFVQRVAEARNLTT

SEQ ID NO: 650337 - protein, 24 aa, Mycobacterium
EAEADLLYRDFVERAAEGRKLPIE

SEQ ID NO: 650338 - protein, 36 aa, Mycobacterium
EAEAGAWPWRPPHLVTTLGARGARYAGADGAFAVPA

SEQ ID NO: 650339 - protein, 32 aa, Mycobacterium
EAEALELLDQVGLKDKRDAYPFQLSGGQQQRV

SEQ ID NO: 650340 - protein, 26 aa, Mycobacterium
EAEANLGPKVRRLHYLSVPPKAAREV

SEQ ID NO: 650341 - protein, 25 aa, Mycobacterium
EAEARKPQRHRPSAGASGQATGAGG

SEQ ID NO: 650342 - protein, 20 aa, Mycobacterium
EAEATRLLERVGVADKAAQY

SEQ ID NO: 650343 - protein, 26 aa, Mycobacterium
EAEDFAALLIYRLGRLPSDRSSIVQV

SEQ ID NO: 650344 - protein, 23 aa, Mycobacterium
EAEDVYDLIEWAGAAPWSSGSVG

SEQ ID NO: 650345 - protein, 21 aa, Mycobacterium
EAEEKFGFLLEAFMFGAPPHG

SEQ ID NO: 650346 - protein, 21 aa, Mycobacterium
EAEEKFGFLLEAFTFGAPPHG

SEQ ID NO: 650347 - protein, 21 aa, Mycobacterium
EAEELYRACGYTRLPAPQPSE

SEQ ID NO: 650348 - protein, 18 aa, Mycobacterium
EAEFGMFVVTLAVAGNET

SEQ ID NO: 650349 - protein, 36 aa, Mycobacterium
EAEFPGGSHAWFAGYRGDMAFATLIVGGGGSEAAVR

SEQ ID NO: 650350 - protein, 18 aa, Mycobacterium
EAEFVKRRLKVIDDAAAR

SEQ ID NO: 650351 - protein, 25 aa, Mycobacterium
EAEGLKELYTFFTPLLRNLAPCARV

SEQ ID NO: 650352 - protein, 25 aa, Mycobacterium
EAEGPVVVVGHSFGGAIALNLAAAR

SEQ ID NO: 650353 - protein, 43 aa, Mycobacterium
EAEGRGKARIEFKLRDWLFARQRYWGEPFPIVYDSDGRAHALD

SEQ ID NO: 650354 - protein, 19 aa, Mycobacterium
EAEGVLFMSEYVAVTRRFR

SEQ ID NO: 650355 - protein, 19 aa, Mycobacterium
EAEHGRRALPVACNVSSWE

SEQ ID NO: 650356 - protein, 24 aa, Mycobacterium
EAEIRAAVAAAENWGTYVTVHAYT

SEQ ID NO: 650357 - protein, 26 aa, Mycobacterium
EAEISCGPYRFVYRKRFHKRAETHLT

SEQ ID NO: 650358 - protein, 25 aa, Mycobacterium
EAEKGQAFGAMYAYIQELVQRKERE

SEQ ID NO: 650359 - protein, 19 aa, Mycobacterium
EAELFRLQTEFVRLQEWVR

SEQ ID NO: 650360 - protein, 24 aa, Mycobacterium
EAELIDYCRARLAGYKCPRSVEFD

SEQ ID NO: 650361 - protein, 23 aa, Mycobacterium
EAELPGYRGWHWEVVMAAAPGAT

SEQ ID NO: 650362 - protein, 23 aa, Mycobacterium
EAELRAALEAGLAEFGKVDIVVA

SEQ ID NO: 650363 - protein, 21 aa, Mycobacterium
EAELRRGRRYSVARRLAGLFA

SEQ ID NO: 650364 - protein, 22 aa, Mycobacterium
EAELRRGRRYSVARRLAGLFAS

SEQ ID NO: 650365 - protein, 18 aa, Mycobacterium
EAELVSFGLKFLGKPPSD

SEQ ID NO: 650366 - protein, 23 aa, Mycobacterium
EAENSLPRIMWKPAAQVAQAGIE

SEQ ID NO: 650367 - protein, 17 aa, Mycobacterium
EAEPLRVSFFEIDGQVL

SEQ ID NO: 650368 - protein, 22 aa, Mycobacterium
EAEPPGDVLVFLSGEREIRDTA

SEQ ID NO: 650369 - protein, 22 aa, Mycobacterium
EAEQWPGVDVRVIPAMTAAQAV

SEQ ID NO: 650370 - protein, 24 aa, Mycobacterium
EAERIGLVDLVFPRASFDSTDGGW

SEQ ID NO: 650371 - protein, 24 aa, Mycobacterium
EAERLRWARRYTTVPTVLSVNTEG

SEQ ID NO: 650372 - protein, 17 aa, Mycobacterium
EAERRKALDAGYDLDQV

SEQ ID NO: 650373 - protein, 18 aa, Mycobacterium
EAERRKALDAGYDLDQVL

SEQ ID NO: 650374 - protein, 27 aa, Mycobacterium
EAESAAGRFGVPMVWVPPLRERVSDIG

SEQ ID NO: 650375 - protein, 21 aa, Mycobacterium
EAESLPLILSGMLYDDGVIDP

SEQ ID NO: 650376 - protein, 18 aa, Mycobacterium
EAEVKNDRGMVGDHGDAA

SEQ ID NO: 650377 - protein, 19 aa, Mycobacterium
EAFADAGIDAVVFDYRGFG

SEQ ID NO: 650378 - protein, 19 aa, Mycobacterium
EAFADFLSGFHIVDRHFKT

SEQ ID NO: 650379 - protein, 20 aa, Mycobacterium
EAFADFLSGFHIVDRHFKTA

SEQ ID NO: 650380 - protein, 24 aa, Mycobacterium
EAFAKGDFPAMFAAVSEEMIDTMG

SEQ ID NO: 650381 - protein, 25 aa, Mycobacterium
EAFAPTRAAAWLSHHPHTRLINMYG

SEQ ID NO: 650382 - protein, 17 aa, Mycobacterium
EAFAVAREAAWRVLNQK

SEQ ID NO: 650383 - protein, 19 aa, Mycobacterium
EAFDGWKQRNQKGSGASVA

SEQ ID NO: 650384 - protein, 19 aa, Mycobacterium
EAFGAWKERNHKAAGASVA

SEQ ID NO: 650385 - protein, 20 aa, Mycobacterium
EAFGELGFEPHVVGIQPDRE

SEQ ID NO: 650386 - protein, 21 aa, Mycobacterium
EAFGLVKVNPLATWTDEDVET

SEQ ID NO: 650387 - protein, 26 aa, Mycobacterium
EAFGPHCFYCGTHLPANNPIDHVLPW

SEQ ID NO: 650388 - protein, 17 aa, Mycobacterium
EAFGRLDIVVNNVGGTM

SEQ ID NO: 650389 - protein, 21 aa, Mycobacterium
EAFGRPLIKFQHSRFELAQLK

SEQ ID NO: 650390 - protein, 23 aa, Mycobacterium
EAFGTGAAECLGRARAALESSDD

SEQ ID NO: 650391 - protein, 19 aa, Mycobacterium
EAFHSEFTQALAAAGAAYA

SEQ ID NO: 650392 - protein, 19 aa, Mycobacterium
EAFKAKLGESVLFPHRLGK

SEQ ID NO: 650393 - protein, 21 aa, Mycobacterium
EAFKLVKINPLVSWTDQDVQD

SEQ ID NO: 650394 - protein, 19 aa, Mycobacterium
EAFLIKLGLRMAIACPADG

SEQ ID NO: 650395 - protein, 27 aa, Mycobacterium
EAFLKRHRFSPFFIDYFITPLVAAVWS

SEQ ID NO: 650396 - protein, 19 aa, Mycobacterium
EAFNRYSCDQGVTIAADIH

SEQ ID NO: 650397 - protein, 20 aa, Mycobacterium
EAFPGWKERHHKASDASVAD

SEQ ID NO: 650398 - protein, 20 aa, Mycobacterium
EAFRAVYECAVPVVAAVNGF

SEQ ID NO: 650399 - protein, 23 aa, Mycobacterium
EAFRDWMTEFARQWGNFLDTPES

SEQ ID NO: 650400 - protein, 19 aa, Mycobacterium
EAFRGDWFHSGDLGYYDEF

SEQ ID NO: 650401 - protein, 18 aa, Mycobacterium
EAFRRGADVIGFDQSASD

SEQ ID NO: 650402 - protein, 19 aa, Mycobacterium
EAFRRGAHVIGFDQNVADL

SEQ ID NO: 650403 - protein, 29 aa, Mycobacterium
EAFRRGYGPEVYRIMHAHISSVKRRALSE

SEQ ID NO: 650404 - protein, 18 aa, Mycobacterium
EAFRRKSQILAEHCRTVG

SEQ ID NO: 650405 - protein, 19 aa, Mycobacterium
EAFRSEFAQTLAAAGVAYA

SEQ ID NO: 650406 - protein, 17 aa, Mycobacterium
EAFRSGGAWLDALLQGL

SEQ ID NO: 650407 - protein, 19 aa, Mycobacterium
EAFRVLRPGGVFAGSDGVP

SEQ ID NO: 650408 - protein, 24 aa, Mycobacterium
EAFSELIKACDVYRDQLERLYNDA

SEQ ID NO: 650409 - protein, 21 aa, Mycobacterium
EAFSSARGCDLAMVRSEEGPV

SEQ ID NO: 650410 - protein, 37 aa, Mycobacterium
EAFTARPWCLGWHWCGWLENPHRGFGLKDPWDEPYTD

SEQ ID NO: 650411 - protein, 20 aa, Mycobacterium
EAFTLWRRLLTRSDLPENER

SEQ ID NO: 650412 - protein, 20 aa, Mycobacterium
EAFTRPARLFGLAKLGYTQS

SEQ ID NO: 650413 - protein, 20 aa, Mycobacterium
EAFTRPARLYGLAKLGFTQS

SEQ ID NO: 650414 - protein, 21 aa, Mycobacterium
EAFTRPARLYGLARLGFTQSY

SEQ ID NO: 650415 - protein, 19 aa, Mycobacterium
EAFTTWRASTRGELTEVGR

SEQ ID NO: 650416 - protein, 23 aa, Mycobacterium
EAFYSLVSGAGWSINTGRAAPRD

SEQ ID NO: 650417 - protein, 25 aa, Mycobacterium
EAGADRTAAMLAEIQGLLRNCAVRP

SEQ ID NO: 650418 - protein, 29 aa, Mycobacterium
EAGALLFPGARGWITYLWVPPFASEKVRR

SEQ ID NO: 650419 - protein, 23 aa, Mycobacterium
EAGALLRRCPDNVAVHPMIGSAG

SEQ ID NO: 650420 - protein, 26 aa, Mycobacterium
EAGARFAFVCAVDMPGLTVDLIDDLV

SEQ ID NO: 650421 - protein, 26 aa, Mycobacterium
EAGAVSFRFGDRTQINGVPRDEAVEM

SEQ ID NO: 650422 - protein, 25 aa, Mycobacterium
EAGAVSFRFGDRTQINGVPRDQAVE

SEQ ID NO: 650423 - protein, 17 aa, Mycobacterium
EAGAWQGPSGRWYADAH

SEQ ID NO: 650424 - protein, 19 aa, Mycobacterium
EAGDIQWNFEKFLLAADGT

SEQ ID NO: 650425 - protein, 25 aa, Mycobacterium
EAGEAFQVVPSMRFEMETDVDPLEV

SEQ ID NO: 650426 - protein, 17 aa, Mycobacterium
EAGEFGIRVNSIHPYSI

SEQ ID NO: 650427 - protein, 30 aa, Mycobacterium
EAGEGLVRTCVFEVPKYLLTGGRARSWETV

SEQ ID NO: 650428 - protein, 19 aa, Mycobacterium
EAGEGVWAIYTVDDGGGAR

SEQ ID NO: 650429 - protein, 21 aa, Mycobacterium
EAGELAVGYILSGAYDTIPRL

SEQ ID NO: 650430 - protein, 20 aa, Mycobacterium
EAGEVAGLAVRTSAPADQEV

SEQ ID NO: 650431 - protein, 22 aa, Mycobacterium
EAGFFGTSWPKAYGGQDLPPVY

SEQ ID NO: 650432 - protein, 20 aa, Mycobacterium
EAGFRSGYLDVYQWTFERED

SEQ ID NO: 650433 - protein, 20 aa, Mycobacterium
EAGGEIQLCIATAFTCPFDG

SEQ ID NO: 650434 - protein, 19 aa, Mycobacterium
EAGGYPLEFGTISVSDGIS

SEQ ID NO: 650435 - protein, 25 aa, Mycobacterium
EAGIAVFKVAFARWVEVEHETDLRM

SEQ ID NO: 650436 - protein, 21 aa, Mycobacterium
EAGIIRVAEGWAHGPQVDKGA

SEQ ID NO: 650437 - protein, 18 aa, Mycobacterium
EAGIKHVTLELGGKNAMI

SEQ ID NO: 650438 - protein, 18 aa, Mycobacterium
EAGIPVTVVPGVTSAIAV

SEQ ID NO: 650439 - protein, 18 aa, Mycobacterium
EAGIPVTVVPGVTSAIGV

SEQ ID NO: 650440 - protein, 19 aa, Mycobacterium
EAGKARWAAQEEIVDLMAN

SEQ ID NO: 650441 - protein, 19 aa, Mycobacterium
EAGKARWAAQEEIVDLVAN

SEQ ID NO: 650442 - protein, 19 aa, Mycobacterium
EAGKARWAAQEEVVDLVAN

SEQ ID NO: 650443 - protein, 31 aa, Mycobacterium
EAGKDLAVLGFIWEVLGRIGIGRKDAVVSLG

SEQ ID NO: 650444 - protein, 24 aa, Mycobacterium
EAGKRLRLLQQYFFVTCSLQDILS

SEQ ID NO: 650445 - protein, 20 aa, Mycobacterium
EAGKTGGCMTAIYNAANEEA

SEQ ID NO: 650446 - protein, 20 aa, Mycobacterium
EAGLDMAQRGGVLTDSNCVT

SEQ ID NO: 650447 - protein, 18 aa, Mycobacterium
EAGLDWYEVSNWARPGGQ

SEQ ID NO: 650448 - protein, 23 aa, Mycobacterium
EAGLIAPHWPAPWGCDATVRRLL

SEQ ID NO: 650449 - protein, 25 aa, Mycobacterium
EAGLMACLPYTWKQVVDTPLFAENE

SEQ ID NO: 650450 - protein, 22 aa, Mycobacterium
EAGLPAGALNLVIGDSETGTAI

SEQ ID NO: 650451 - protein, 18 aa, Mycobacterium
EAGLPAGAYLNIRAANEQ

SEQ ID NO: 650452 - protein, 21 aa, Mycobacterium
EAGLPLAVFPAGTFNHFAKDI

SEQ ID NO: 650453 - protein, 21 aa, Mycobacterium
EAGLPLAVFPGGTFNHFAKDI

SEQ ID NO: 650454 - protein, 19 aa, Mycobacterium
EAGLPRRGAPDAIVVVRDA

SEQ ID NO: 650455 - protein, 18 aa, Mycobacterium
EAGLPRRGTPDAIVVVRD

SEQ ID NO: 650456 - protein, 21 aa, Mycobacterium
EAGLRPGDRALLVYPPGLEMV

SEQ ID NO: 650457 - protein, 24 aa, Mycobacterium
EAGLRRRRMVVLPWLTPTIASWWV

SEQ ID NO: 650458 - protein, 18 aa, Mycobacterium
EAGMEVCCGGILGMGESL

SEQ ID NO: 650459 - protein, 18 aa, Mycobacterium
EAGMEVCCGGILGMGETL

SEQ ID NO: 650460 - protein, 23 aa, Mycobacterium
EAGMRRVPLTVVHAVTTPTATWP

SEQ ID NO: 650461 - protein, 29 aa, Mycobacterium
EAGMVLAITGYVWRQGVGAVFRRDTVHIT

SEQ ID NO: 650462 - protein, 30 aa, Mycobacterium
EAGPGHIARACARAGAQLIHVSTDYVFNGD

SEQ ID NO: 650463 - protein, 23 aa, Mycobacterium
EAGPHLQANWSWAPSALDHDRVD

SEQ ID NO: 650464 - protein, 18 aa, Mycobacterium
EAGPHLQANWTWAPSALD

SEQ ID NO: 650465 - protein, 25 aa, Mycobacterium
EAGPHLRAGWTWAPSSVTEPQVQRL

SEQ ID NO: 650466 - protein, 20 aa, Mycobacterium
EAGPMLAAYLVPAAAQVDLE

SEQ ID NO: 650467 - protein, 20 aa, Mycobacterium
EAGPMLRQIAERFGTTLHAP

SEQ ID NO: 650468 - protein, 19 aa, Mycobacterium
EAGPPFFDAYGQWMGTPAP

SEQ ID NO: 650469 - protein, 23 aa, Mycobacterium
EAGPQLHAQWTWATSALDRAQLN

SEQ ID NO: 650470 - protein, 24 aa, Mycobacterium
EAGPQLQANWTWARSALHDKQISR

SEQ ID NO: 650471 - protein, 25 aa, Mycobacterium
EAGPTGRFRPLWAHNRADERKALTD

SEQ ID NO: 650472 - protein, 25 aa, Mycobacterium
EAGRAATLRAVRNLTGVPIDYFAEV

SEQ ID NO: 650473 - protein, 24 aa, Mycobacterium
EAGRARLLPLLSKVVERAQEDGYL

SEQ ID NO: 650474 - protein, 19 aa, Mycobacterium
EAGRECARSSFVMTPPTGI

SEQ ID NO: 650475 - protein, 17 aa, Mycobacterium
EAGRGYFNEAVVAQRPA

SEQ ID NO: 650476 - protein, 20 aa, Mycobacterium
EAGRISRVIASYVGENKEFA

SEQ ID NO: 650477 - protein, 17 aa, Mycobacterium
EAGRLLLGVREEFAEAE

SEQ ID NO: 650478 - protein, 26 aa, Mycobacterium
EAGRRAALAMVRRHRLLETFLVNELG

SEQ ID NO: 650479 - protein, 22 aa, Mycobacterium
EAGRRATLNAVHRLTGQPIDYF

SEQ ID NO: 650480 - protein, 21 aa, Mycobacterium
EAGRWSPEWPEVPADFLQDAI

SEQ ID NO: 650481 - protein, 19 aa, Mycobacterium
EAGSDFAGLRTRAERDGDL

SEQ ID NO: 650482 - protein, 20 aa, Mycobacterium
EAGSDFAGLRTRAERDGDVF

SEQ ID NO: 650483 - protein, 24 aa, Mycobacterium
EAGSKVKVTIMFRGREQSRPELGY

SEQ ID NO: 650484 - protein, 21 aa, Mycobacterium
EAGSLLAPMPGAVVRVEVGEG

SEQ ID NO: 650485 - protein, 31 aa, Mycobacterium
EAGSSIDPGYRYVLIYGHRRRVAALEADRQS

SEQ ID NO: 650486 - protein, 31 aa, Mycobacterium
EAGSVFPRTYYLGGLFFLGPINLGASTLTIP

SEQ ID NO: 650487 - protein, 21 aa, Mycobacterium
EAGSVTRLVVRPMSVAELHRL

SEQ ID NO: 650488 - protein, 24 aa, Mycobacterium
EAGTIRMVLPAAAVSLLGDVWWWS

SEQ ID NO: 650489 - protein, 20 aa, Mycobacterium
EAGVDCFVAGSAVYGAADPE

SEQ ID NO: 650490 - protein, 20 aa, Mycobacterium
EAGVDCFVAGSAVYGADNPA

SEQ ID NO: 650491 - protein, 20 aa, Mycobacterium
EAGVDCFVAGSAVYGAEDPE

SEQ ID NO: 650492 - protein, 19 aa, Mycobacterium
EAGVDCFVAGSAVYGAQDP

SEQ ID NO: 650493 - protein, 20 aa, Mycobacterium
EAGVDCFVAGSAVYGAQNPE

SEQ ID NO: 650494 - protein, 20 aa, Mycobacterium
EAGVDCFVAGSAVYSAEDPA

SEQ ID NO: 650495 - protein, 21 aa, Mycobacterium
EAGVDLALISYYFGSKRGLVG

SEQ ID NO: 650496 - protein, 20 aa, Mycobacterium
EAGVGPGRTRLISGRAQEVL

SEQ ID NO: 650497 - protein, 19 aa, Mycobacterium
EAGVLFAGDLLFIGCTPIV

SEQ ID NO: 650498 - protein, 18 aa, Mycobacterium
EAGVRAGTVVSWQLPTTL

SEQ ID NO: 650499 - protein, 19 aa, Mycobacterium
EAGVTLGLVQHHFKTKAGL

SEQ ID NO: 650500 - protein, 20 aa, Mycobacterium
EAGVTLGLVQHHFKTKAGLR

SEQ ID NO: 650501 - protein, 20 aa, Mycobacterium
EAGWRDRRFAARNAGIAHFL

SEQ ID NO: 650502 - protein, 21 aa, Mycobacterium
EAGYAAAGWGTIIDRTGMTKG

SEQ ID NO: 650503 - protein, 24 aa, Mycobacterium
EAGYATACFGKWHIGAEDGRWPTD

SEQ ID NO: 650504 - protein, 26 aa, Mycobacterium
EAGYAYFAGRLGDWMRVDGENLGAAP

SEQ ID NO: 650505 - protein, 17 aa, Mycobacterium
EAGYPIARIDNYTEWFT

SEQ ID NO: 650506 - protein, 23 aa, Mycobacterium
EAHADAAAILAELGGRAPAPGQW

SEQ ID NO: 650507 - protein, 21 aa, Mycobacterium
EAHCKHLGAHIGHGGKVLGDC

SEQ ID NO: 650508 - protein, 20 aa, Mycobacterium
EAHCKHLGAHIGHGGKVVDD

SEQ ID NO: 650509 - protein, 21 aa, Mycobacterium
EAHCKHLGAHIGHGGKVVGDC

SEQ ID NO: 650510 - protein, 20 aa, Mycobacterium
EAHCKHLGAHIGHGGKVVGE

SEQ ID NO: 650511 - protein, 19 aa, Mycobacterium
EAHCYPLLQFREMLQDLGL

SEQ ID NO: 650512 - protein, 20 aa, Mycobacterium
EAHEVLACFVLDPRLESSSG

SEQ ID NO: 650513 - protein, 19 aa, Mycobacterium
EAHGDFPRFYLGGNGAVHG

SEQ ID NO: 650514 - protein, 33 aa, Mycobacterium
EAHGRTPAQVLIRWSLQLGNIVIPRSSSPERIR

SEQ ID NO: 650515 - protein, 17 aa, Mycobacterium
EAHGVVEVRRGRGLFVG

SEQ ID NO: 650516 - protein, 24 aa, Mycobacterium
EAHKAEFARGVAFAQERAQREARL

SEQ ID NO: 650517 - protein, 29 aa, Mycobacterium
EAHLEHPKMPLVPLIDGWETVPEMEAALG

SEQ ID NO: 650518 - protein, 29 aa, Mycobacterium
EAHLISPWGTWEWLGPAAVGATLPARGTV

SEQ ID NO: 650519 - protein, 27 aa, Mycobacterium
EAHLISPWGTWEWLRPNIVGGALPARG

SEQ ID NO: 650520 - protein, 31 aa, Mycobacterium
EAHLISPWGTWEWMAPAAAGAVLPACGSAEL

SEQ ID NO: 650521 - protein, 25 aa, Mycobacterium
EAHLRKAYNGFRRMGLDADTAETAA

SEQ ID NO: 650522 - protein, 20 aa, Mycobacterium
EAHMGINHLGHFALTCLLGD

SEQ ID NO: 650523 - protein, 25 aa, Mycobacterium
EAHPWRWRLIDMYDRDLTHKWYVEI

SEQ ID NO: 650524 - protein, 24 aa, Mycobacterium
EAHRPERRLTLAPRTAHAVAATPA

SEQ ID NO: 650525 - protein, 18 aa, Mycobacterium
EAHRVAALRPRLGVDTDE

SEQ ID NO: 650526 - protein, 21 aa, Mycobacterium
EAHRVPLIIGYNAEEIRLFNR

SEQ ID NO: 650527 - protein, 20 aa, Mycobacterium
EAHRVPLIVGHNADEAKLFT

SEQ ID NO: 650528 - protein, 26 aa, Mycobacterium
EAHSELRFAVAEGFPDYKPELPGGRP

SEQ ID NO: 650529 - protein, 19 aa, Mycobacterium
EAIAAAGAVPREFNTIAVD

SEQ ID NO: 650530 - protein, 25 aa, Mycobacterium
EAIAAKPFEYWRRHLKTMKGQWAPF

SEQ ID NO: 650531 - protein, 20 aa, Mycobacterium
EAIAALDLRADLARITAPTL

SEQ ID NO: 650532 - protein, 20 aa, Mycobacterium
EAIAGIVLIGLLTRPGELEP

SEQ ID NO: 650533 - protein, 17 aa, Mycobacterium
EAIAHGIGVVGLLNVQY

SEQ ID NO: 650534 - protein, 19 aa, Mycobacterium
EAIALWCEANGTLLISDEI

SEQ ID NO: 650535 - protein, 23 aa, Mycobacterium
EAIAPGKCLSARGTTDSGGALQA

SEQ ID NO: 650536 - protein, 26 aa, Mycobacterium
EAIAQGWYRRMRVVLAELRKIGVTGV

SEQ ID NO: 650537 - protein, 28 aa, Mycobacterium
EAIAREVRRGGLPLQRLVNGESMGAVAR

SEQ ID NO: 650538 - protein, 19 aa, Mycobacterium
EAIARRIGRRATDFEVRVF

SEQ ID NO: 650539 - protein, 39 aa, Mycobacterium
EAICDGGFPLDVRYAPTRLRELCKMDGAVVLSTDGSRFI

SEQ ID NO: 650540 - protein, 17 aa, Mycobacterium
EAIDGWKQRNGKPADAT

SEQ ID NO: 650541 - protein, 23 aa, Mycobacterium
EAIEEQFFWPAVRDAMGDGLVDK

SEQ ID NO: 650542 - protein, 30 aa, Mycobacterium
EAIEEQFFWPAVRKALGDGLVDKAVEQEQA

SEQ ID NO: 650543 - protein, 19 aa, Mycobacterium
EAIELQRYVMLNMDAPHHT

SEQ ID NO: 650544 - protein, 22 aa, Mycobacterium
EAIESLPAWLTTAVTNLCLTRL

SEQ ID NO: 650545 - protein, 23 aa, Mycobacterium
EAIFKRAWLNVGRVERLPRTGSY

SEQ ID NO: 650546 - protein, 17 aa, Mycobacterium
EAIGCGFTEAVRGVLSH

SEQ ID NO: 650547 - protein, 17 aa, Mycobacterium
EAIGFHLNRGVLASASR

SEQ ID NO: 650548 - protein, 18 aa, Mycobacterium
EAIGHPFELQQANCSVSA

SEQ ID NO: 650549 - protein, 25 aa, Mycobacterium
EAIGLARSRGVTVVHTYCESHAADV

SEQ ID NO: 650550 - protein, 18 aa, Mycobacterium
EAIGSGWRQLDVVEQTGS

SEQ ID NO: 650551 - protein, 17 aa, Mycobacterium
EAIGYTGAGTVEFMASG

SEQ ID NO: 650552 - protein, 38 aa, Mycobacterium
EAIHCFDRALELDPDFALARWGVAYAIGPNYNKGWEAF

SEQ ID NO: 650553 - protein, 17 aa, Mycobacterium
EAIIAASKWVHSELDYM

SEQ ID NO: 650554 - protein, 27 aa, Mycobacterium
EAIIWRYRTGCPWRDLPAEFGAWKTAW

SEQ ID NO: 650555 - protein, 27 aa, Mycobacterium
EAIKGSGRWVPDFLSLPIAVENSLKNQ

SEQ ID NO: 650556 - protein, 21 aa, Mycobacterium
EAIKSGFFQREITPVTLPDGT

SEQ ID NO: 650557 - protein, 23 aa, Mycobacterium
EAILKQLSTVFVHDGVVAHREGA

SEQ ID NO: 650558 - protein, 17 aa, Mycobacterium
EAILTLRMAEFSEAGPR

SEQ ID NO: 650559 - protein, 24 aa, Mycobacterium
EAINSGFFDREIVPVTLPDGTVVS

SEQ ID NO: 650560 - protein, 23 aa, Mycobacterium
EAIPEARRGASFEANGEGWAIQT

SEQ ID NO: 650561 - protein, 20 aa, Mycobacterium
EAIPRISRAQAMDALSSQGN

SEQ ID NO: 650562 - protein, 30 aa, Mycobacterium
EAIQRFRVADAREAVNLALRTLLREGASDE

SEQ ID NO: 650563 - protein, 25 aa, Mycobacterium
EAIRARDAVTLGLTGHRWGMRRVTA

SEQ ID NO: 650564 - protein, 19 aa, Mycobacterium
EAIRDGWAVLMQNHGILVA

SEQ ID NO: 650565 - protein, 27 aa, Mycobacterium
EAIRGMSKVAALEWGKDNIRVNVICPL

SEQ ID NO: 650566 - protein, 24 aa, Mycobacterium
EAIRGSGLSAGIIDAGLSRGLAGV

SEQ ID NO: 650567 - protein, 24 aa, Mycobacterium
EAIRHAVGLGVRRIVLALGGSAST

SEQ ID NO: 650568 - protein, 17 aa, Mycobacterium
EAIRLARQLAAATDAPE

SEQ ID NO: 650569 - protein, 22 aa, Mycobacterium
EAIRQLKARYCRFLDTKDLESW

SEQ ID NO: 650570 - protein, 17 aa, Mycobacterium
EAIRRQGGIALKPLIAR

SEQ ID NO: 650571 - protein, 20 aa, Mycobacterium
EAIRTGRRQFGFAFTDPGSV

SEQ ID NO: 650572 - protein, 17 aa, Mycobacterium
EAISLLFVIDDLCTAAG

SEQ ID NO: 650573 - protein, 21 aa, Mycobacterium
EAISLPDAVALVVARATVVGR

SEQ ID NO: 650574 - protein, 26 aa, Mycobacterium
EAITRPRWFLQWAKTLHPPELRVPNQ

SEQ ID NO: 650575 - protein, 19 aa, Mycobacterium
EAIVAMFNQFCYIQLGSAR

SEQ ID NO: 650576 - protein, 18 aa, Mycobacterium
EAIVDGWFHTGDLGSVDD

SEQ ID NO: 650577 - protein, 32 aa, Mycobacterium
EAIVPRVARRFLRMMEGFGLPRNAMRPSWGMS

SEQ ID NO: 650578 - protein, 19 aa, Mycobacterium
EAIWEMPPFDSWYQGPQAI

SEQ ID NO: 650579 - protein, 19 aa, Mycobacterium
EAKAGLARPELTVRAHLEL

SEQ ID NO: 650580 - protein, 19 aa, Mycobacterium
EAKALLVRGLATLETVDGV

SEQ ID NO: 650581 - protein, 22 aa, Mycobacterium
EAKASWSPKFMLREATWVADSV

SEQ ID NO: 650582 - protein, 20 aa, Mycobacterium
EAKATLAAFIARHNVELIAV

SEQ ID NO: 650583 - protein, 33 aa, Mycobacterium
EAKAVARESVHRWLTKRAGAVVRINGADTDWYA

SEQ ID NO: 650584 - protein, 20 aa, Mycobacterium
EAKDAIARHALRYVSEGATL

SEQ ID NO: 650585 - protein, 22 aa, Mycobacterium
EAKDAWKQGYPYDEKLSRKEYE

SEQ ID NO: 650586 - protein, 19 aa, Mycobacterium
EAKDFIANGAIELGGKLPI

SEQ ID NO: 650587 - protein, 26 aa, Mycobacterium
EAKELPEHWTAVPYGAPFPNNACRVV

SEQ ID NO: 650588 - protein, 32 aa, Mycobacterium
EAKGLGSGGARGCPPATWCVQNAGGYRGSMSV

SEQ ID NO: 650589 - protein, 25 aa, Mycobacterium
EAKIIAERRLWLAVLRAQAELGVAV

SEQ ID NO: 650590 - protein, 20 aa, Mycobacterium
EAKIKLADMRSGRMNDDDWT

SEQ ID NO: 650591 - protein, 19 aa, Mycobacterium
EAKIKLGDMRSGRMSDDDW

SEQ ID NO: 650592 - protein, 19 aa, Mycobacterium
EAKIKLGDMRSGRMTDDDW

SEQ ID NO: 650593 - protein, 20 aa, Mycobacterium
EAKIKLSDMRSGRMTDDDWT

SEQ ID NO: 650594 - protein, 25 aa, Mycobacterium
EAKIRAGMLHDRFPATFPSGQGSDL

SEQ ID NO: 650595 - protein, 18 aa, Mycobacterium
EAKIRGVLRGHYKIGVMG

SEQ ID NO: 650596 - protein, 21 aa, Mycobacterium
EAKKICLGCEVRHECLEYALE

SEQ ID NO: 650597 - protein, 22 aa, Mycobacterium
EAKLSLELGTTMILPAAVRYQT

SEQ ID NO: 650598 - protein, 22 aa, Mycobacterium
EAKLVRCTRGAIAAVAVDVRPD

SEQ ID NO: 650599 - protein, 24 aa, Mycobacterium
EAKRFARDDFDILLIGHEGHEEVI

SEQ ID NO: 650600 - protein, 19 aa, Mycobacterium
EAKRGAVEVWPLVDCSREF

SEQ ID NO: 650601 - protein, 17 aa, Mycobacterium
EAKRHHHELGWFARQAL

SEQ ID NO: 650602 - protein, 17 aa, Mycobacterium
EAKRHHHELGWFARQSL

SEQ ID NO: 650603 - protein, 22 aa, Mycobacterium
EAKRIAARLDVAAVVERNDRAV

SEQ ID NO: 650604 - protein, 27 aa, Mycobacterium
EAKRRGVALTRVIDWMAAKPAELAGLN

SEQ ID NO: 650605 - protein, 32 aa, Mycobacterium
EAKSALPETQWDVLCGLAAGFTPDEVWADLGA

SEQ ID NO: 650606 - protein, 34 aa, Mycobacterium
EAKSLPLVLVVHGGPWFRDSWGFDGHVQLLANRG

SEQ ID NO: 650607 - protein, 25 aa, Mycobacterium
EAKTISFAGAEAFRDGDDDPKGNIN

SEQ ID NO: 650608 - protein, 21 aa, Mycobacterium
EAKTKLYGVVIVDTAGRLGID

SEQ ID NO: 650609 - protein, 25 aa, Mycobacterium
EAKYAAKRVRKWTRRKYQLLELPQL

SEQ ID NO: 650610 - protein, 26 aa, Mycobacterium
EAKYAAKRVRKWTRRKYQLLEMPQLP

SEQ ID NO: 650611 - protein, 19 aa, Mycobacterium
EALAAAAAIYGYFTDFLAD

SEQ ID NO: 650612 - protein, 20 aa, Mycobacterium
EALAAAGGVPARVLADRMAC

SEQ ID NO: 650613 - protein, 24 aa, Mycobacterium
EALAADIRKSDCQIVVTDAEHRDL

SEQ ID NO: 650614 - protein, 22 aa, Mycobacterium
EALAAEGVEYVFGIPGDENLHF

SEQ ID NO: 650615 - protein, 19 aa, Mycobacterium
EALAALNLEDVVLVGNDTG

SEQ ID NO: 650616 - protein, 24 aa, Mycobacterium
EALAARTLLPVPWVEAVDISNAVV

SEQ ID NO: 650617 - protein, 24 aa, Mycobacterium
EALADGVVRPVVFLAYSGEARWRD

SEQ ID NO: 650618 - protein, 24 aa, Mycobacterium
EALADGVVRPVVFMAYSGEARWRD

SEQ ID NO: 650619 - protein, 18 aa, Mycobacterium
EALAEAGIDAWETDLAEL

SEQ ID NO: 650620 - protein, 19 aa, Mycobacterium
EALAEFRFGPAELESVSTF

SEQ ID NO: 650621 - protein, 31 aa, Mycobacterium
EALAGEIDRGLKFMSACGVVDSNLDTAEIYA

SEQ ID NO: 650622 - protein, 17 aa, Mycobacterium
EALAGLPERLELPTDRP

SEQ ID NO: 650623 - protein, 17 aa, Mycobacterium
EALAGVFDFAFPPAPWM

SEQ ID NO: 650624 - protein, 17 aa, Mycobacterium
EALAHTGAREFVFVGAP

SEQ ID NO: 650625 - protein, 20 aa, Mycobacterium
EALALAEAWDNGKPIRETLN

SEQ ID NO: 650626 - protein, 20 aa, Mycobacterium
EALALAESWDNGKPIRETLN

SEQ ID NO: 650627 - protein, 17 aa, Mycobacterium
EALALVGKRGRVVVTAI

SEQ ID NO: 650628 - protein, 25 aa, Mycobacterium
EALAPHVPKVKGWIVMSDKPLTEID

SEQ ID NO: 650629 - protein, 19 aa, Mycobacterium
EALAPVLADKGITINAVAP

SEQ ID NO: 650630 - protein, 17 aa, Mycobacterium
EALAPVRAVLPAGAGAA

SEQ ID NO: 650631 - protein, 25 aa, Mycobacterium
EALARARRALDEFEVEGLATVIPFH

SEQ ID NO: 650632 - protein, 21 aa, Mycobacterium
EALARMAPVRAVLPAGAGVAE

SEQ ID NO: 650633 - protein, 25 aa, Mycobacterium
EALARSRRALSEFHVEGLATVIPFH

SEQ ID NO: 650634 - protein, 20 aa, Mycobacterium
EALCNLLIERLRAHEPDIET

SEQ ID NO: 650635 - protein, 17 aa, Mycobacterium
EALDDYSAILLESIADR

SEQ ID NO: 650636 - protein, 20 aa, Mycobacterium
EALDGGPFIQVRGIGHDPGG

SEQ ID NO: 650637 - protein, 21 aa, Mycobacterium
EALDRCGMVLGFVDGNHENFE

SEQ ID NO: 650638 - protein, 24 aa, Mycobacterium
EALDRLGYDEAWFGEHHSGGYELI

SEQ ID NO: 650639 - protein, 21 aa, Mycobacterium
EALDTWPMNVALLGKGNTVSS

SEQ ID NO: 650640 - protein, 18 aa, Mycobacterium
EALDVPPARVAVVGAGQS

SEQ ID NO: 650641 - protein, 28 aa, Mycobacterium
EALEAAAKWREIFGPENFFLELMDHGLD

SEQ ID NO: 650642 - protein, 17 aa, Mycobacterium
EALECDFLIAATGVLHH

SEQ ID NO: 650643 - protein, 35 aa, Mycobacterium
EALEEFVLRGGKRLRPAFAYWGFRAVAGTEPEPHI

SEQ ID NO: 650644 - protein, 18 aa, Mycobacterium
EALEHAGIDPLSLRGSAT

SEQ ID NO: 650645 - protein, 21 aa, Mycobacterium
EALEIIPPMLRGERPTFEGKY

SEQ ID NO: 650646 - protein, 20 aa, Mycobacterium
EALELTWRSLGEIGNLSSAS

SEQ ID NO: 650647 - protein, 18 aa, Mycobacterium
EALENARIPASSLKGESV

SEQ ID NO: 650648 - protein, 19 aa, Mycobacterium
EALERAGIDPSGLRGSATG

SEQ ID NO: 650649 - protein, 19 aa, Mycobacterium
EALERSGIDPTGLRGSATG

SEQ ID NO: 650650 - protein, 34 aa, Mycobacterium
EALETWPLSMFERFLPRHLEIIYEINRRFLDEVR

SEQ ID NO: 650651 - protein, 20 aa, Mycobacterium
EALFTLGDRPEQRWPEAKEW

SEQ ID NO: 650652 - protein, 24 aa, Mycobacterium
EALGAELGRPVEWVRVPWVDMIPA

SEQ ID NO: 650653 - protein, 20 aa, Mycobacterium
EALGLARLGATVVVNDIAAA

SEQ ID NO: 650654 - protein, 25 aa, Mycobacterium
EALGPFPTDRGWAVRELLAGSRRSG

SEQ ID NO: 650655 - protein, 20 aa, Mycobacterium
EALGRAAHRPSVLVSASAIG

SEQ ID NO: 650656 - protein, 18 aa, Mycobacterium
EALGRALGSGRVFTTDLR

SEQ ID NO: 650657 - protein, 26 aa, Mycobacterium
EALGRFPRDRGWDIGALFDGSRRDGF

SEQ ID NO: 650658 - protein, 23 aa, Mycobacterium
EALGRLKPAFAAMGETRADGEEL

SEQ ID NO: 650659 - protein, 20 aa, Mycobacterium
EALGRLRGSHGVVLKAQDEP

SEQ ID NO: 650660 - protein, 23 aa, Mycobacterium
EALGSKLSAFVAITPLDPSQPDD

SEQ ID NO: 650661 - protein, 20 aa, Mycobacterium
EALHGFPPVSSGWIDPVSVP

SEQ ID NO: 650662 - protein, 17 aa, Mycobacterium
EALIKVHVLDAERRLDG

SEQ ID NO: 650663 - protein, 18 aa, Mycobacterium
EALIRMDLAEMLREEGYD

SEQ ID NO: 650664 - protein, 18 aa, Mycobacterium
EALKATSATLAFDATGGG

SEQ ID NO: 650665 - protein, 17 aa, Mycobacterium
EALKESFGCDGQPGSYT

SEQ ID NO: 650666 - protein, 21 aa, Mycobacterium
EALKLAEAIGADHCVIADGNQ

SEQ ID NO: 650667 - protein, 24 aa, Mycobacterium
EALKPYYRFLCKRPCTNDDYLQTF

SEQ ID NO: 650668 - protein, 23 aa, Mycobacterium
EALKPYYRFLCKRPLSNDEYLPM

SEQ ID NO: 650669 - protein, 24 aa, Mycobacterium
EALKPYYRFLCKRPLSNDEYLPTF

SEQ ID NO: 650670 - protein, 21 aa, Mycobacterium
EALLAGFARRGRSVSVITNDL

SEQ ID NO: 650671 - protein, 18 aa, Mycobacterium
EALLALKPDCVVYNPMWI

SEQ ID NO: 650672 - protein, 20 aa, Mycobacterium
EALLGRPLIGNGANGTATSP

SEQ ID NO: 650673 - protein, 25 aa, Mycobacterium
EALLKHADEIFALSQVEWGCVTNER

SEQ ID NO: 650674 - protein, 19 aa, Mycobacterium
EALLLEFLGEAAVTVPELG

SEQ ID NO: 650675 - protein, 25 aa, Mycobacterium
EALLLEFLGEAAVTVPELGTFVAER

SEQ ID NO: 650676 - protein, 25 aa, Mycobacterium
EALLLEFLGEAAVTVPELGTFVAPL

SEQ ID NO: 650677 - protein, 17 aa, Mycobacterium
EALLPAMDAVRCAADTL

SEQ ID NO: 650678 - protein, 20 aa, Mycobacterium
EALLREWIAVCYHNKPHDGV

SEQ ID NO: 650679 - protein, 22 aa, Mycobacterium
EALLRRALELGVNHIDTASFYD

SEQ ID NO: 650680 - protein, 19 aa, Mycobacterium
EALLRRIGLAASKYWVCKR

SEQ ID NO: 650681 - protein, 23 aa, Mycobacterium
EALLRTWFAGLFEAGFAGADWPV

SEQ ID NO: 650682 - protein, 18 aa, Mycobacterium
EALLRYMRDSRGFDFTGY

SEQ ID NO: 650683 - protein, 25 aa, Mycobacterium
EALLVLMCGVGLYAGFVQSPDDLLS

SEQ ID NO: 650684 - protein, 18 aa, Mycobacterium
EALMAMLAPDAAWMADSG

SEQ ID NO: 650685 - protein, 20 aa, Mycobacterium
EALMSLPSRVTRQIHRLEVQ

SEQ ID NO: 650686 - protein, 17 aa, Mycobacterium
EALNARADECWSQIQKL

SEQ ID NO: 650687 - protein, 33 aa, Mycobacterium
EALNLEWGHYGIRVIDMWPLYVNTAMTKDVKTG

SEQ ID NO: 650688 - protein, 22 aa, Mycobacterium
EALPAPLFEVWEDLLGSPAYGE

SEQ ID NO: 650689 - protein, 25 aa, Mycobacterium
EALPAPRWTRVGVHIAESGMRRARP

SEQ ID NO: 650690 - protein, 20 aa, Mycobacterium
EALPARYGQAVVDSEVQPLG

SEQ ID NO: 650691 - protein, 28 aa, Mycobacterium
EALPDARPTLWLGVPRVWHKIQAGIETK

SEQ ID NO: 650692 - protein, 17 aa, Mycobacterium
EALPFQAALEFGDVSVG

SEQ ID NO: 650693 - protein, 21 aa, Mycobacterium
EALPGEIADKFHATFDALLYN

SEQ ID NO: 650694 - protein, 21 aa, Mycobacterium
EALPGEIADKFHATFDASLHN

SEQ ID NO: 650695 - protein, 22 aa, Mycobacterium
EALPGEIADKFHATFDSLLHNF

SEQ ID NO: 650696 - protein, 21 aa, Mycobacterium
EALPGELADKFARHFDAELRN

SEQ ID NO: 650697 - protein, 17 aa, Mycobacterium
EALPRIQLWPLSADGDY

SEQ ID NO: 650698 - protein, 19 aa, Mycobacterium
EALPRKILNFAPEMVAAAD

SEQ ID NO: 650699 - protein, 18 aa, Mycobacterium
EALPRLVTALQDAGVTVH

SEQ ID NO: 650700 - protein, 24 aa, Mycobacterium
EALPTADGWIMIAAYDPARWNALC

SEQ ID NO: 650701 - protein, 21 aa, Mycobacterium
EALPVKPDRLLAGGDTVRIGE

SEQ ID NO: 650702 - protein, 19 aa, Mycobacterium
EALPWLKQLHGRVVVIKYG

SEQ ID NO: 650703 - protein, 24 aa, Mycobacterium
EALQKRFGTLTGVERPAENGDFVS

SEQ ID NO: 650704 - protein, 25 aa, Mycobacterium
EALRAIPQANRMVVYYADVEGYPYR

SEQ ID NO: 650705 - protein, 20 aa, Mycobacterium
EALRARTGGDLVIVTAKADQ

SEQ ID NO: 650706 - protein, 19 aa, Mycobacterium
EALRATGYRALGNELAGRP

SEQ ID NO: 650707 - protein, 28 aa, Mycobacterium
EALRATYLRLGHRVEVIEPVRGLPDMVY

SEQ ID NO: 650708 - protein, 27 aa, Mycobacterium
EALRDEFDFRYLVGVVSVMGDKDVDGI

SEQ ID NO: 650709 - protein, 23 aa, Mycobacterium
EALRDYGVRVLVIRPGQVRTTTT

SEQ ID NO: 650710 - protein, 17 aa, Mycobacterium
EALRELFELDPHTVEAV

SEQ ID NO: 650711 - protein, 17 aa, Mycobacterium
EALRELFELDQHAVDAV

SEQ ID NO: 650712 - protein, 25 aa, Mycobacterium
EALREYGVRVLVIRPGQVRTRMSAH

SEQ ID NO: 650713 - protein, 23 aa, Mycobacterium
EALRGADVFLGLSGGVVPEEMIA

SEQ ID NO: 650714 - protein, 22 aa, Mycobacterium
EALRICNVLKIGVAQLADGAEH

SEQ ID NO: 650715 - protein, 25 aa, Mycobacterium
EALRIEPYLRYSAVRSPAHAAALSE

SEQ ID NO: 650716 - protein, 21 aa, Mycobacterium
EALRIRPTWIAGGAEVPGPSG

SEQ ID NO: 650717 - protein, 19 aa, Mycobacterium
EALRLCPPAAGVGRMAVRD

SEQ ID NO: 650718 - protein, 19 aa, Mycobacterium
EALRLKGLVRDSVGLGTSA

SEQ ID NO: 650719 - protein, 18 aa, Mycobacterium
EALRPSAVEEVLRWASPV

SEQ ID NO: 650720 - protein, 19 aa, Mycobacterium
EALRRAGLTVLTRPPRDDD

SEQ ID NO: 650721 - protein, 22 aa, Mycobacterium
EALRRISEGAAMIRSKGEAGTG

SEQ ID NO: 650722 - protein, 18 aa, Mycobacterium
EALRRITEGAAMIRSKGE

SEQ ID NO: 650723 - protein, 21 aa, Mycobacterium
EALRRRTLITAAQYLALGIDP

SEQ ID NO: 650724 - protein, 18 aa, Mycobacterium
EALRSGGVVVVFPGGDYD

SEQ ID NO: 650725 - protein, 18 aa, Mycobacterium
EALRSVPVVVGRTDVDGV

SEQ ID NO: 650726 - protein, 17 aa, Mycobacterium
EALRVMIERTRAVHADQ

SEQ ID NO: 650727 - protein, 19 aa, Mycobacterium
EALRVWPRDGLPDRPGGWL

SEQ ID NO: 650728 - protein, 22 aa, Mycobacterium
EALRWTPDGVREYVAESAQPTT

SEQ ID NO: 650729 - protein, 26 aa, Mycobacterium
EALSAAAADTARIGSAINAATTAAAA

SEQ ID NO: 650730 - protein, 17 aa, Mycobacterium
EALSAATSDAAEIGSAL

SEQ ID NO: 650731 - protein, 21 aa, Mycobacterium
EALSGRPGIVLSRRQLLEIVR

SEQ ID NO: 650732 - protein, 24 aa, Mycobacterium
EALSLADSVALLFDGTVAQHAAPT

SEQ ID NO: 650733 - protein, 21 aa, Mycobacterium
EALSLADSVALLIGGAVAQHG

SEQ ID NO: 650734 - protein, 24 aa, Mycobacterium
EALSPRVAATVPQVVQLAPQAGQM

SEQ ID NO: 650735 - protein, 27 aa, Mycobacterium
EALSRALLLCIERVKLIVEPAGAAAVA

SEQ ID NO: 650736 - protein, 27 aa, Mycobacterium
EALSRGLLLCLERAKLVVEPAGAAAVA

SEQ ID NO: 650737 - protein, 18 aa, Mycobacterium
EALSVCLGEGRGLDLDRV

SEQ ID NO: 650738 - protein, 22 aa, Mycobacterium
EALTFYERWCHELSAVLNPSAK

SEQ ID NO: 650739 - protein, 31 aa, Mycobacterium
EALTGMGVSTCATCDGFFFRDQDIVVVGGGD

SEQ ID NO: 650740 - protein, 27 aa, Mycobacterium
EALTKPRWLWQWGKTMRPPNLRVPNQG

SEQ ID NO: 650741 - protein, 21 aa, Mycobacterium
EALTNWYVRRSRSRFWQEDVD

SEQ ID NO: 650742 - protein, 17 aa, Mycobacterium
EALTPGLQQVFGMAEGL

SEQ ID NO: 650743 - protein, 22 aa, Mycobacterium
EALTSLPGVGVWTAAETAQRAF

SEQ ID NO: 650744 - protein, 20 aa, Mycobacterium
EALTSPKARPNMKMKAFANL

SEQ ID NO: 650745 - protein, 19 aa, Mycobacterium
EALVPLVLAGTSHREQPRV

SEQ ID NO: 650746 - protein, 17 aa, Mycobacterium
EALYGFVKPSLALYIGG

SEQ ID NO: 650747 - protein, 20 aa, Mycobacterium
EALYRPLGMTSTSSRFADFV

SEQ ID NO: 650748 - protein, 18 aa, Mycobacterium
EAMAKAWGPVRVAIAAEQ

SEQ ID NO: 650749 - protein, 26 aa, Mycobacterium
EAMAKRPLTEWSERFATLAGPWAPVQ

SEQ ID NO: 650750 - protein, 28 aa, Mycobacterium
EAMAKWRSDPSVQAWFTASVACRGACRN

SEQ ID NO: 650751 - protein, 27 aa, Mycobacterium
EAMARPEQRLALAFGALERIVGTQDLF

SEQ ID NO: 650752 - protein, 30 aa, Mycobacterium
EAMASAAADIERIGALLTQGNAAAASPTIN

SEQ ID NO: 650753 - protein, 28 aa, Mycobacterium
EAMASLSPRLMMRPATWVADSVADLESE

SEQ ID NO: 650754 - protein, 17 aa, Mycobacterium
EAMAVWRSTLNDAIVRW

SEQ ID NO: 650755 - protein, 24 aa, Mycobacterium
EAMEELREYFGLRPEDLNIDLGPL

SEQ ID NO: 650756 - protein, 18 aa, Mycobacterium
EAMEVLLRQTVEADAAVA

SEQ ID NO: 650757 - protein, 18 aa, Mycobacterium
EAMFARIPLRRFAEPEDF

SEQ ID NO: 650758 - protein, 17 aa, Mycobacterium
EAMFLHDLVDPMASLTL

SEQ ID NO: 650759 - protein, 23 aa, Mycobacterium
EAMGARATAFVVAFGAPGDTPTA

SEQ ID NO: 650760 - protein, 23 aa, Mycobacterium
EAMGELPFGFNVFVPTPDQGADL

SEQ ID NO: 650761 - protein, 17 aa, Mycobacterium
EAMGGRVTAFVVAVGAP

SEQ ID NO: 650762 - protein, 17 aa, Mycobacterium
EAMGRATVMLAQQDASG

SEQ ID NO: 650763 - protein, 17 aa, Mycobacterium
EAMIDRLALNPQRVDGI

SEQ ID NO: 650764 - protein, 25 aa, Mycobacterium
EAMIKKLSIRLGVPAYPNDPMRFTG

SEQ ID NO: 650765 - protein, 19 aa, Mycobacterium
EAMKLVYELAFGKLGLQRV

SEQ ID NO: 650766 - protein, 17 aa, Mycobacterium
EAMLAPLRNILGAIATF

SEQ ID NO: 650767 - protein, 24 aa, Mycobacterium
EAMLDRLALDTARVAGIADGLRQV

SEQ ID NO: 650768 - protein, 23 aa, Mycobacterium
EAMLPSFVFLRRLLLLAWMGSHT

SEQ ID NO: 650769 - protein, 22 aa, Mycobacterium
EAMPAEASTLVAAQQPVGAGSG

SEQ ID NO: 650770 - protein, 18 aa, Mycobacterium
EAMPEFLAAYPPHRVAEI

SEQ ID NO: 650771 - protein, 21 aa, Mycobacterium
EAMPNICLQMLLRGRNTVGYT

SEQ ID NO: 650772 - protein, 23 aa, Mycobacterium
EAMPRPDVIEGITSFLEKRPPQF

SEQ ID NO: 650773 - protein, 17 aa, Mycobacterium
EAMRLAIEQSMLVKGTT

SEQ ID NO: 650774 - protein, 31 aa, Mycobacterium
EAMRRRGVTDFSLAMIDPWPAGYYGAQDHYD

SEQ ID NO: 650775 - protein, 20 aa, Mycobacterium
EAMSGFAHITGQAGAPPTLP

SEQ ID NO: 650776 - protein, 20 aa, Mycobacterium
EAMSSFKVADFAPAQVVYQP

SEQ ID NO: 650777 - protein, 26 aa, Mycobacterium
EAMTAAAGDLAGIGSSVAAANAAAAG

SEQ ID NO: 650778 - protein, 27 aa, Mycobacterium
EAMTPPIARPTLRWVNIVPGPLAGALR

SEQ ID NO: 650779 - protein, 18 aa, Mycobacterium
EAMVFCRELQPDVVLVDI

SEQ ID NO: 650780 - protein, 26 aa, Mycobacterium
EAMVKKLSIRLGVPCFPDDPLHFTGS

SEQ ID NO: 650781 - protein, 26 aa, Mycobacterium
EAMVKKLSIRLGVPCFPDDPLRFTGS

SEQ ID NO: 650782 - protein, 17 aa, Mycobacterium
EAMVLWKSDALLEAPDL

SEQ ID NO: 650783 - protein, 20 aa, Mycobacterium
EAMVRQWALGFRDEANERAQ

SEQ ID NO: 650784 - protein, 19 aa, Mycobacterium
EAMWLSFSASEPAALQIGV

SEQ ID NO: 650785 - protein, 22 aa, Mycobacterium
EANAANARRIWAHAGVADRVTC

SEQ ID NO: 650786 - protein, 25 aa, Mycobacterium
EANALPAEFVAAFVTAISRHRAWER

SEQ ID NO: 650787 - protein, 22 aa, Mycobacterium
EANAPVLLGLIGLWYNNFFGAE

SEQ ID NO: 650788 - protein, 25 aa, Mycobacterium
EANEWPWRAAHLVVTLGSRGARYAG

SEQ ID NO: 650789 - protein, 24 aa, Mycobacterium
EANGLSVPRFPTALSTALRPLLPP

SEQ ID NO: 650790 - protein, 26 aa, Mycobacterium
EANIAPWLRAAHRYGAKVKWAEIDIE

SEQ ID NO: 650791 - protein, 27 aa, Mycobacterium
EANIAPWLRAAHRYGAKVKWAEIDIET

SEQ ID NO: 650792 - protein, 25 aa, Mycobacterium
EANLRLVVSLAKRYTGRGMAFLDLI

SEQ ID NO: 650793 - protein, 18 aa, Mycobacterium
EANLRPGTTDARRIDSTT

SEQ ID NO: 650794 - protein, 27 aa, Mycobacterium
EANRAWRLYRRLGFTDIIRGYYFAGDP

SEQ ID NO: 650795 - protein, 30 aa, Mycobacterium
EANRKIFLYPENWIEPALRDDKSPFFVELE

SEQ ID NO: 650796 - protein, 19 aa, Mycobacterium
EANSARILSGPGPGPLLAA

SEQ ID NO: 650797 - protein, 19 aa, Mycobacterium
EANTRFLLVNNNWRGLVLD

SEQ ID NO: 650798 - protein, 33 aa, Mycobacterium
EAPAAVERRARWTVRVIVSLLMFPGQDEADERA

SEQ ID NO: 650799 - protein, 28 aa, Mycobacterium
EAPAEMHFYFPKFRALCMAENATHNLHN

SEQ ID NO: 650800 - protein, 26 aa, Mycobacterium
EAPALKRLLGHIARPRNCTELNEATL

SEQ ID NO: 650801 - protein, 21 aa, Mycobacterium
EAPARRGCWTWSRAAQNRPSW

SEQ ID NO: 650802 - protein, 19 aa, Mycobacterium
EAPARYIVRALKHLRRKRN

SEQ ID NO: 650803 - protein, 25 aa, Mycobacterium
EAPAYRWPLVPALALVAAMPALGAA

SEQ ID NO: 650804 - protein, 32 aa, Mycobacterium
EAPDYRPAPLPSWPTRLGWAVRDWPETVIGNV

SEQ ID NO: 650805 - protein, 20 aa, Mycobacterium
EAPEGVRFLIRSRLFTDDEV

SEQ ID NO: 650806 - protein, 19 aa, Mycobacterium
EAPEHWFSPCADDVISLRA

SEQ ID NO: 650807 - protein, 19 aa, Mycobacterium
EAPESFPSAPLNTVGLPGA

SEQ ID NO: 650808 - protein, 23 aa, Mycobacterium
EAPESRATFTLEHISDISDDDEH

SEQ ID NO: 650809 - protein, 20 aa, Mycobacterium
EAPGISWRLIDCDGTVDAQT

SEQ ID NO: 650810 - protein, 18 aa, Mycobacterium
EAPGLPCEVEVDSLEQLD

SEQ ID NO: 650811 - protein, 21 aa, Mycobacterium
EAPGMMSALVSFWMNPDSIYL

SEQ ID NO: 650812 - protein, 26 aa, Mycobacterium
EAPGRRDICIYAREPHVIVAEAPNEL

SEQ ID NO: 650813 - protein, 18 aa, Mycobacterium
EAPISFWPAVEYEGFEPG

SEQ ID NO: 650814 - protein, 28 aa, Mycobacterium
EAPLAEVTRYFAAYNLVCGPVIDREDHL

SEQ ID NO: 650815 - protein, 23 aa, Mycobacterium
EAPLKRPSLPAVLAGRGPFVGRE

SEQ ID NO: 650816 - protein, 18 aa, Mycobacterium
EAPLPGLVLAPRPVSLNP

SEQ ID NO: 650817 - protein, 19 aa, Mycobacterium
EAPLPRVSIFLSLLDAHVQ

SEQ ID NO: 650818 - protein, 21 aa, Mycobacterium
EAPLPTWTHRSLLLNRAGHDH

SEQ ID NO: 650819 - protein, 19 aa, Mycobacterium
EAPLVDWSDVDMGELLPTG

SEQ ID NO: 650820 - protein, 20 aa, Mycobacterium
EAPNVLYLVWDDIGIATWDC

SEQ ID NO: 650821 - protein, 26 aa, Mycobacterium
EAPPGEAVLTGWRMLLDNGRMQDGEP

SEQ ID NO: 650822 - protein, 19 aa, Mycobacterium
EAPRGEFLDDLHRRLAEQM

SEQ ID NO: 650823 - protein, 19 aa, Mycobacterium
EAPRGLLYHRYEIDDDGLI

SEQ ID NO: 650824 - protein, 26 aa, Mycobacterium
EAPRSWQLKLDLRRDGDRIKMSKVEF

SEQ ID NO: 650825 - protein, 26 aa, Mycobacterium
EAPRYAFLGVRGCDLAAIATLGGVLG

SEQ ID NO: 650826 - protein, 21 aa, Mycobacterium
EAPSAWIAEGLLIYLPAAAQE

SEQ ID NO: 650827 - protein, 25 aa, Mycobacterium
EAPSKGWRRALLKVSGGLINVGESS

SEQ ID NO: 650828 - protein, 20 aa, Mycobacterium
EAPSPPRPPVPPLPTSQPPA

SEQ ID NO: 650829 - protein, 20 aa, Mycobacterium
EAPTAVPDLGRWCADHPELA

SEQ ID NO: 650830 - protein, 23 aa, Mycobacterium
EAPTVAGLAHWIKANAGRRTRPV

SEQ ID NO: 650831 - protein, 20 aa, Mycobacterium
EAPVDVLTLFSYPLHPPGKP

SEQ ID NO: 650832 - protein, 20 aa, Mycobacterium
EAPVLFAMGHFLGSDRVAGL

SEQ ID NO: 650833 - protein, 18 aa, Mycobacterium
EAPWPRNPVKHWVERDLV

SEQ ID NO: 650834 - protein, 18 aa, Mycobacterium
EAPWPSVIDTAIGIGHVG

SEQ ID NO: 650835 - protein, 22 aa, Mycobacterium
EAPWRLKQNYFIDLRTIRYGKV

SEQ ID NO: 650836 - protein, 25 aa, Mycobacterium
EAPYLGDVIVLWSLALKQDNTADRE

SEQ ID NO: 650837 - protein, 26 aa, Mycobacterium
EAQACARKLDAIGVLVDRHADLGKPD

SEQ ID NO: 650838 - protein, 23 aa, Mycobacterium
EAQAEAYQTFGAHTAALHDQIVR

SEQ ID NO: 650839 - protein, 20 aa, Mycobacterium
EAQALLEFQEHDWQQTVAWL

SEQ ID NO: 650840 - protein, 24 aa, Mycobacterium
EAQARYGRKVSWGVDVGEDPDRIL

SEQ ID NO: 650841 - protein, 19 aa, Mycobacterium
EAQAVLAALVARTPAGRAG

SEQ ID NO: 650842 - protein, 29 aa, Mycobacterium
EAQDFGMRMLKRFDVDWAAYGYDEAAQRE

SEQ ID NO: 650843 - protein, 23 aa, Mycobacterium
EAQDRFVFVESWASGEALAEHGK

SEQ ID NO: 650844 - protein, 24 aa, Mycobacterium
EAQDRYGRKVSWGVDVVSGTGTER

SEQ ID NO: 650845 - protein, 23 aa, Mycobacterium
EAQDRYGRKVSWGVEVGSERILF

SEQ ID NO: 650846 - protein, 24 aa, Mycobacterium
EAQDRYGRKVSWGVEVGSKTGAER

SEQ ID NO: 650847 - protein, 25 aa, Mycobacterium
EAQDSRAGAVLSRILSLTDDEVRAT

SEQ ID NO: 650848 - protein, 24 aa, Mycobacterium
EAQERYARKVSWGVDVVSDAGMER

SEQ ID NO: 650849 - protein, 24 aa, Mycobacterium
EAQHIVSAFSFELGKVSAEAGIRE

SEQ ID NO: 650850 - protein, 19 aa, Mycobacterium
EAQIGWAAWNPQRRARVLM

SEQ ID NO: 650851 - protein, 19 aa, Mycobacterium
EAQKGWAAWNPQRRARVMM

SEQ ID NO: 650852 - protein, 23 aa, Mycobacterium
EAQKLLSRFGISFHISESDRTDV

SEQ ID NO: 650853 - protein, 19 aa, Mycobacterium
EAQLAAGFDPDFHRRDMAD

SEQ ID NO: 650854 - protein, 23 aa, Mycobacterium
EAQLCRKYGAAVVVMAFDEQGQA

SEQ ID NO: 650855 - protein, 26 aa, Mycobacterium
EAQLDQCWDLLRQRRALRAGGGDPDS

SEQ ID NO: 650856 - protein, 26 aa, Mycobacterium
EAQLDRFAIRLELKYLSESEEATMLR

SEQ ID NO: 650857 - protein, 26 aa, Mycobacterium
EAQLDRFAIRLELRYLSEQDETAMLR

SEQ ID NO: 650858 - protein, 26 aa, Mycobacterium
EAQLDRFAIRLELRYLSERDEAAMLR

SEQ ID NO: 650859 - protein, 26 aa, Mycobacterium
EAQLDRFAIRLELRYLSERDETAMLR

SEQ ID NO: 650860 - protein, 26 aa, Mycobacterium
EAQLDRFAIRLELRYLSERDETSMLR

SEQ ID NO: 650861 - protein, 23 aa, Mycobacterium
EAQLDRFAVRLQLGYLAEDLEIE

SEQ ID NO: 650862 - protein, 21 aa, Mycobacterium
EAQLDRFLLKLNVGLPSRESE

SEQ ID NO: 650863 - protein, 22 aa, Mycobacterium
EAQLRFMADQDLDLIITSGGLG

SEQ ID NO: 650864 - protein, 18 aa, Mycobacterium
EAQNNGGEICRIATHCTE

SEQ ID NO: 650865 - protein, 18 aa, Mycobacterium
EAQNNGGSICRIATHCTE

SEQ ID NO: 650866 - protein, 22 aa, Mycobacterium
EAQPWLRRAGARADARGWALPR

SEQ ID NO: 650867 - protein, 19 aa, Mycobacterium
EAQQWYPAAKILLGSAATT

SEQ ID NO: 650868 - protein, 23 aa, Mycobacterium
EAQRAAKLAGYRGAMYPWQSGSD

SEQ ID NO: 650869 - protein, 19 aa, Mycobacterium
EAQRFSSFRLLMRAEVTKL

SEQ ID NO: 650870 - protein, 21 aa, Mycobacterium
EAQRGKQDWALVDVTDIEAFL

SEQ ID NO: 650871 - protein, 17 aa, Mycobacterium
EAQRLRWASAHLTVPAV

SEQ ID NO: 650872 - protein, 25 aa, Mycobacterium
EAQRPRPLYPIPLLLGGSGPRMMRL

SEQ ID NO: 650873 - protein, 19 aa, Mycobacterium
EAQSPILLVGHGVHTSRTQ

SEQ ID NO: 650874 - protein, 20 aa, Mycobacterium
EAQTRLRADRSIRIDLPGTE

SEQ ID NO: 650875 - protein, 24 aa, Mycobacterium
EAQVLAELGVRSFGGLQQGALEEA

SEQ ID NO: 650876 - protein, 27 aa, Mycobacterium
EAQVPRPARAAVRWLRATALERAGDIA

SEQ ID NO: 650877 - protein, 17 aa, Mycobacterium
EAQWQRSPWEAEVVDGW

SEQ ID NO: 650878 - protein, 21 aa, Mycobacterium
EAQYAEMWVQDAIAMDTYASA

SEQ ID NO: 650879 - protein, 25 aa, Mycobacterium
EAQYGEMWAQDALAMYGYAASSAAA

SEQ ID NO: 650880 - protein, 25 aa, Mycobacterium
EARAAGLKAANTWHASRAIQEAREA

SEQ ID NO: 650881 - protein, 26 aa, Mycobacterium
EARAAGLKAANTWHASRAIQESREAC

SEQ ID NO: 650882 - protein, 26 aa, Mycobacterium
EARAAGLKAANTWHASTAIQEAREAC

SEQ ID NO: 650883 - protein, 28 aa, Mycobacterium
EARAALANLGYRGFWMGYFAARSAPLGQ

SEQ ID NO: 650884 - protein, 23 aa, Mycobacterium
EARAGRTAVRFGVTDLADTRAAL

SEQ ID NO: 650885 - protein, 21 aa, Mycobacterium
EARALAEFKAMFQMKFYAVAL

SEQ ID NO: 650886 - protein, 19 aa, Mycobacterium
EARANRLAHHFRNQGLQEG

SEQ ID NO: 650887 - protein, 23 aa, Mycobacterium
EARANRLAHRFRQAGLREGDTVA

SEQ ID NO: 650888 - protein, 27 aa, Mycobacterium
EARANRLAHRFRRAGLREGDAVAILME

SEQ ID NO: 650889 - protein, 17 aa, Mycobacterium
EARARKLIDSQLTQAGW

SEQ ID NO: 650890 - protein, 20 aa, Mycobacterium
EARDPKGLYAKARAGEITHF

SEQ ID NO: 650891 - protein, 19 aa, Mycobacterium
EARDVWPLEDPHALARRAA

SEQ ID NO: 650892 - protein, 22 aa, Mycobacterium
EAREFGVHAGMPLRAAARRCPE

SEQ ID NO: 650893 - protein, 24 aa, Mycobacterium
EAREFVKWDPEHTVIQPLADGSDW

SEQ ID NO: 650894 - protein, 22 aa, Mycobacterium
EAREISRRLAISGEVEITQGGE

SEQ ID NO: 650895 - protein, 28 aa, Mycobacterium
EAREWPAVVGRPRRAGVSSFGVSGTNAH

SEQ ID NO: 650896 - protein, 19 aa, Mycobacterium
EARGRAATMYRLDEDDKLR

SEQ ID NO: 650897 - protein, 28 aa, Mycobacterium
EARGVPMTAGCVVPRGDVLELIDDIKDA

SEQ ID NO: 650898 - protein, 22 aa, Mycobacterium
EARHGYNVVRLIAGDPLSVDAV

SEQ ID NO: 650899 - protein, 30 aa, Mycobacterium
EARIEIEMIRLLTLKAAYLMDTVGNKQART

SEQ ID NO: 650900 - protein, 18 aa, Mycobacterium
EARIKIFAECTITDLLLD

SEQ ID NO: 650901 - protein, 19 aa, Mycobacterium
EARKAIAVLSNRSAFAQVD

SEQ ID NO: 650902 - protein, 31 aa, Mycobacterium
EARKRGWSAGRFSFNVAEGRCATCQGEGFVA

SEQ ID NO: 650903 - protein, 23 aa, Mycobacterium
EARLAQGNPVAWIHATALRTEPL

SEQ ID NO: 650904 - protein, 24 aa, Mycobacterium
EARLAQGQPVAWIHATALRTEPLQ

SEQ ID NO: 650905 - protein, 18 aa, Mycobacterium
EARLHPRDFGPIETLFDD

SEQ ID NO: 650906 - protein, 22 aa, Mycobacterium
EARLKTEIIGAEALLAGPENPE

SEQ ID NO: 650907 - protein, 20 aa, Mycobacterium
EARLPMQRDTIFRIASMTKP

SEQ ID NO: 650908 - protein, 23 aa, Mycobacterium
EARLRAAPLRVLLRHRPISLSGQ

SEQ ID NO: 650909 - protein, 21 aa, Mycobacterium
EARLRPEVVSAFHTPMGIEAL

SEQ ID NO: 650910 - protein, 30 aa, Mycobacterium
EARLSATLARGLKAEGFVVVAVGTGVDGLR

SEQ ID NO: 650911 - protein, 19 aa, Mycobacterium
EARPEIERAVRSCPTQALF

SEQ ID NO: 650912 - protein, 23 aa, Mycobacterium
EARPRAGILRGREFLMKDSYSFD

SEQ ID NO: 650913 - protein, 24 aa, Mycobacterium
EARPRGRTVWFTGLSGSGKSSVAM

SEQ ID NO: 650914 - protein, 26 aa, Mycobacterium
EARPRLPEIYERWCATTAGAVTRNDA

SEQ ID NO: 650915 - protein, 27 aa, Mycobacterium
EARRECTGFIFNRVWAAIKRESLAVVA

SEQ ID NO: 650916 - protein, 22 aa, Mycobacterium
EARRFWRDEYLLNAQIADFAKP

SEQ ID NO: 650917 - protein, 20 aa, Mycobacterium
EARRGLIDSVKGKAKEVFGA

SEQ ID NO: 650918 - protein, 23 aa, Mycobacterium
EARRGLIDSVKGKAKEVVGAVTG

SEQ ID NO: 650919 - protein, 17 aa, Mycobacterium
EARRLRPDLATGLQPMR

SEQ ID NO: 650920 - protein, 19 aa, Mycobacterium
EARRRAATMYRLDDRGRLH

SEQ ID NO: 650921 - protein, 24 aa, Mycobacterium
EARRRVPRSPILVLSQYVEVSYAD

SEQ ID NO: 650922 - protein, 19 aa, Mycobacterium
EARRSRGQSIGRPKALDES

SEQ ID NO: 650923 - protein, 26 aa, Mycobacterium
EARRTGGLLGGFGVLHFDNGKFTVDE

SEQ ID NO: 650924 - protein, 25 aa, Mycobacterium
EARSRLNPAAGVMLSALWVAPTGQL

SEQ ID NO: 650925 - protein, 22 aa, Mycobacterium
EARTRAIARMGSFFSDRRMAAL

SEQ ID NO: 650926 - protein, 24 aa, Mycobacterium
EARVGAAPGRIRCVPPLVDIVSSA

SEQ ID NO: 650927 - protein, 20 aa, Mycobacterium
EARVKLADMRSGRLGDQDWT

SEQ ID NO: 650928 - protein, 21 aa, Mycobacterium
EARVLLARRFHNDAVRDTLAL

SEQ ID NO: 650929 - protein, 17 aa, Mycobacterium
EARVRLRALHGLLADTV

SEQ ID NO: 650930 - protein, 26 aa, Mycobacterium
EARVSRRLVAMLARRGYSQTVACEVV

SEQ ID NO: 650931 - protein, 20 aa, Mycobacterium
EARVTIPARATLLLYTDGLV

SEQ ID NO: 650932 - protein, 20 aa, Mycobacterium
EARVTIPARTTLLLYTDGLV

SEQ ID NO: 650933 - protein, 25 aa, Mycobacterium
EARYRIPVRLAYGATEFAGSLCAWT

SEQ ID NO: 650934 - protein, 25 aa, Mycobacterium
EASAAFQAAHARFVEVSAKVNALLD

SEQ ID NO: 650935 - protein, 26 aa, Mycobacterium
EASADRCARGGLPRRTHVSVLTPTDP

SEQ ID NO: 650936 - protein, 20 aa, Mycobacterium
EASAPPPVLAVVGRPNVGKS

SEQ ID NO: 650937 - protein, 20 aa, Mycobacterium
EASARFSSKIIELNLLGPLS

SEQ ID NO: 650938 - protein, 19 aa, Mycobacterium
EASDAWQRLGADVEESAGA

SEQ ID NO: 650939 - protein, 19 aa, Mycobacterium
EASDLALRLAIAAAGRPDV

SEQ ID NO: 650940 - protein, 26 aa, Mycobacterium
EASDRWPHAGAFGPLIRDPDGAIYPS

SEQ ID NO: 650941 - protein, 25 aa, Mycobacterium
EASEKFPRLHVCTVAGRCADDIAAL

SEQ ID NO: 650942 - protein, 20 aa, Mycobacterium
EASERVRAKYGFACTSAAET

SEQ ID NO: 650943 - protein, 26 aa, Mycobacterium
EASGDFNGGIAFARTFVDGIKDAGGH

SEQ ID NO: 650944 - protein, 23 aa, Mycobacterium
EASGELKPGGTIVEPTSGNTGVG

SEQ ID NO: 650945 - protein, 24 aa, Mycobacterium
EASGGAVVRGRWQTARVQPAHLET

SEQ ID NO: 650946 - protein, 19 aa, Mycobacterium
EASGLPPERIVVVADSAGG

SEQ ID NO: 650947 - protein, 24 aa, Mycobacterium
EASGSRALAFMKYHVPLVARLTST

SEQ ID NO: 650948 - protein, 21 aa, Mycobacterium
EASGSRFLLFPTVAHSHAERV

SEQ ID NO: 650949 - protein, 18 aa, Mycobacterium
EASHCYPSVPRFLAEVAR

SEQ ID NO: 650950 - protein, 27 aa, Mycobacterium
EASIDMESWVCPLPLRDAPAIVTGHGG

SEQ ID NO: 650951 - protein, 18 aa, Mycobacterium
EASIKRVLGAAVPLQPES

SEQ ID NO: 650952 - protein, 26 aa, Mycobacterium
EASLAFYRDVLGFEVRLDVGKGAMRW

SEQ ID NO: 650953 - protein, 20 aa, Mycobacterium
EASLEFSNVVTRVHEDPRVT

SEQ ID NO: 650954 - protein, 18 aa, Mycobacterium
EASLLVLHGRVRLSTSSE

SEQ ID NO: 650955 - protein, 27 aa, Mycobacterium
EASLVERLVPEFLWISTEHTARVSLDA

SEQ ID NO: 650956 - protein, 18 aa, Mycobacterium
EASMRWQAILHRKGWAAP

SEQ ID NO: 650957 - protein, 33 aa, Mycobacterium
EASPSRAFWLDRLQGFQTLRFAGDRLQHVRPKF

SEQ ID NO: 650958 - protein, 18 aa, Mycobacterium
EASPVPWVAVLHGHVVAG

SEQ ID NO: 650959 - protein, 22 aa, Mycobacterium
EASRKMALVIAAKGRAAGLSRT

SEQ ID NO: 650960 - protein, 23 aa, Mycobacterium
EASRKMALVIAGKGRAAGMARQA

SEQ ID NO: 650961 - protein, 23 aa, Mycobacterium
EASRKMALVIAGKGRAAGMTRTG

SEQ ID NO: 650962 - protein, 24 aa, Mycobacterium
EASRLLDRVDIVFSNAGIVVAGPI

SEQ ID NO: 650963 - protein, 19 aa, Mycobacterium
EASRPDGYLTMKINAVEAL

SEQ ID NO: 650964 - protein, 25 aa, Mycobacterium
EASSDDRAGAVLDVAGAAPIPGGKL

SEQ ID NO: 650965 - protein, 18 aa, Mycobacterium
EASWSIFVSARWQVDTPQ

SEQ ID NO: 650966 - protein, 27 aa, Mycobacterium
EASWSPKLMLRPATWVADTVADLERDM

SEQ ID NO: 650967 - protein, 21 aa, Mycobacterium
EASYFGPSFMINWLHNSYSGY

SEQ ID NO: 650968 - protein, 21 aa, Mycobacterium
EASYFGPSFMINWLHNTYGDF

SEQ ID NO: 650969 - protein, 21 aa, Mycobacterium
EASYFGPSFMINWLHNTYGEF

SEQ ID NO: 650970 - protein, 20 aa, Mycobacterium
EASYPPVQYIPLADVDGSVL

SEQ ID NO: 650971 - protein, 24 aa, Mycobacterium
EASYRSAGHLGFDELIAPEETRNA

SEQ ID NO: 650972 - protein, 23 aa, Mycobacterium
EATADAFAGGWFHSGDLVRQDED

SEQ ID NO: 650973 - protein, 24 aa, Mycobacterium
EATAEAFAGGWFHSGDLVRMDADG

SEQ ID NO: 650974 - protein, 24 aa, Mycobacterium
EATAEAFAGGWFHSGDLVRMDEDG

SEQ ID NO: 650975 - protein, 24 aa, Mycobacterium
EATAEAFAGGWFHSGDLVRMDSDG

SEQ ID NO: 650976 - protein, 24 aa, Mycobacterium
EATAETFRDGWLHTGDMAREDEDG

SEQ ID NO: 650977 - protein, 23 aa, Mycobacterium
EATAETFRDGWMHTGDLAREDED

SEQ ID NO: 650978 - protein, 25 aa, Mycobacterium
EATALPANRPLAVLIVSDRGRDALE

SEQ ID NO: 650979 - protein, 26 aa, Mycobacterium
EATDGRSGAIPAIIAEYLGLPQLTHL

SEQ ID NO: 650980 - protein, 19 aa, Mycobacterium
EATDWMLLAAIDALIDGNR

SEQ ID NO: 650981 - protein, 23 aa, Mycobacterium
EATEGKFRLGLGTQVRTHVVRRY

SEQ ID NO: 650982 - protein, 25 aa, Mycobacterium
EATERLSLLGLPFLFFIDAAQGRAS

SEQ ID NO: 650983 - protein, 22 aa, Mycobacterium
EATETAEGLAITGKFDLDTDHG

SEQ ID NO: 650984 - protein, 18 aa, Mycobacterium
EATFRYKLGRMEFERLVV

SEQ ID NO: 650985 - protein, 23 aa, Mycobacterium
EATGLKLGADVALALDVAATEFY

SEQ ID NO: 650986 - protein, 23 aa, Mycobacterium
EATGLKLGSDVALALDVAATEFY

SEQ ID NO: 650987 - protein, 24 aa, Mycobacterium
EATGLVNLSAWPAGTRLILRKERP

SEQ ID NO: 650988 - protein, 25 aa, Mycobacterium
EATKYRLGRAMARIEAAMSTPGMYG

SEQ ID NO: 650989 - protein, 18 aa, Mycobacterium
EATLAISVVRPGEGFRVC

SEQ ID NO: 650990 - protein, 19 aa, Mycobacterium
EATLFPKANSWYMGANVPG

SEQ ID NO: 650991 - protein, 25 aa, Mycobacterium
EATLFPRANSWYMGANVPGKPRVFM

SEQ ID NO: 650992 - protein, 26 aa, Mycobacterium
EATLHIALRLGHNFIGTEHLLLAILS

SEQ ID NO: 650993 - protein, 20 aa, Mycobacterium
EATLKLLRRVASVSEPPLLS

SEQ ID NO: 650994 - protein, 18 aa, Mycobacterium
EATMVRFGVPLGGVAEPF

SEQ ID NO: 650995 - protein, 21 aa, Mycobacterium
EATNAADALLGVINTPTQALL

SEQ ID NO: 650996 - protein, 20 aa, Mycobacterium
EATNLLFLRGMIGKPGAGVC

SEQ ID NO: 650997 - protein, 27 aa, Mycobacterium
EATRAAICRFASWWVVLERHGDLIRLY

SEQ ID NO: 650998 - protein, 23 aa, Mycobacterium
EATRASAGIGLLPCFMADRHDDL

SEQ ID NO: 650999 - protein, 17 aa, Mycobacterium
EATRLSMEAGIAAMIPG

SEQ ID NO: 651000 - protein, 30 aa, Mycobacterium
EATRSLRVCVSGGAALPVQVLTEFETAFGC

SEQ ID NO: 651001 - protein, 21 aa, Mycobacterium
EATRVLGTFLRDVIARNKDRF

SEQ ID NO: 651002 - protein, 21 aa, Mycobacterium
EATRVPFVIARIGADATTART

SEQ ID NO: 651003 - protein, 19 aa, Mycobacterium
EATRVPFVIARIGTEATEA

SEQ ID NO: 651004 - protein, 24 aa, Mycobacterium
EATRVPFVIARSGDRVTRPRRVTA

SEQ ID NO: 651005 - protein, 24 aa, Mycobacterium
EATRVPFVIARTGPDATTARTVTA

SEQ ID NO: 651006 - protein, 22 aa, Mycobacterium
EATRVPFVIARVGDEATTARTV

SEQ ID NO: 651007 - protein, 18 aa, Mycobacterium
EATSVCRGCPDPCQSPQS

SEQ ID NO: 651008 - protein, 22 aa, Mycobacterium
EATTAYLTRDSWVDTALTKTRR

SEQ ID NO: 651009 - protein, 21 aa, Mycobacterium
EATVCATMHLFRGTEDAVPIG

SEQ ID NO: 651010 - protein, 20 aa, Mycobacterium
EATVPVWRSTTPVIPAAELP

SEQ ID NO: 651011 - protein, 21 aa, Mycobacterium
EATVRRFGRMFIAGARLTVPL

SEQ ID NO: 651012 - protein, 20 aa, Mycobacterium
EATYRFPLVVAPRYTTGHPV

SEQ ID NO: 651013 - protein, 21 aa, Mycobacterium
EAVAACGPAGVPVIADGGLQY

SEQ ID NO: 651014 - protein, 17 aa, Mycobacterium
EAVAADRGWVPVSTTST

SEQ ID NO: 651015 - protein, 21 aa, Mycobacterium
EAVAAHAGYPLLVKPVVKAAG

SEQ ID NO: 651016 - protein, 19 aa, Mycobacterium
EAVAAHVGYPLLVKPVAGA

SEQ ID NO: 651017 - protein, 20 aa, Mycobacterium
EAVAGMNSVAGWPGAPRPVA

SEQ ID NO: 651018 - protein, 27 aa, Mycobacterium
EAVAKLGRHRFPIVLTESVEQFLTAVG

SEQ ID NO: 651019 - protein, 20 aa, Mycobacterium
EAVARLGRHQFPLVLTDTVA

SEQ ID NO: 651020 - protein, 20 aa, Mycobacterium
EAVAVCRPAGVPVIADGGLQ

SEQ ID NO: 651021 - protein, 24 aa, Mycobacterium
EAVAVKDGRIVAVGAHDDVVREHL

SEQ ID NO: 651022 - protein, 18 aa, Mycobacterium
EAVCAGLSRRASRYRVVR

SEQ ID NO: 651023 - protein, 23 aa, Mycobacterium
EAVCVSHQLPVWTARQHLLGKKL

SEQ ID NO: 651024 - protein, 17 aa, Mycobacterium
EAVDISNAVLFLASDES

SEQ ID NO: 651025 - protein, 23 aa, Mycobacterium
EAVDMRHLLEMAAVERITAKPTL

SEQ ID NO: 651026 - protein, 23 aa, Mycobacterium
EAVDRGQPFLALVDYAHKPGALA

SEQ ID NO: 651027 - protein, 25 aa, Mycobacterium
EAVEFMLSPRASFITAQTLLVDGGV

SEQ ID NO: 651028 - protein, 22 aa, Mycobacterium
EAVFKAAYRQGLALVLKGPTGC

SEQ ID NO: 651029 - protein, 22 aa, Mycobacterium
EAVFKAAYRQGLSLVLKGPTGC

SEQ ID NO: 651030 - protein, 22 aa, Mycobacterium
EAVFRKGAYCAAYSGFEGVDRH

SEQ ID NO: 651031 - protein, 24 aa, Mycobacterium
EAVGACARGLMSREDVDAIERAIC

SEQ ID NO: 651032 - protein, 26 aa, Mycobacterium
EAVGACSRGLMSRADVDAIERAICPG

SEQ ID NO: 651033 - protein, 20 aa, Mycobacterium
EAVGAHAGYPLLVKPAAAGR

SEQ ID NO: 651034 - protein, 29 aa, Mycobacterium
EAVGGPSTWRLGGAFNCGKAQPGQIAPVS

SEQ ID NO: 651035 - protein, 29 aa, Mycobacterium
EAVGGPSTWRLGGAINCGKAQPGQIAAVS

SEQ ID NO: 651036 - protein, 29 aa, Mycobacterium
EAVGGPSTWRLGGAINCGKAQPGQVAPVS

SEQ ID NO: 651037 - protein, 29 aa, Mycobacterium
EAVGGRSTWRLGGAFNCGKAQPGQIAAVS

SEQ ID NO: 651038 - protein, 18 aa, Mycobacterium
EAVGHFLSAFVAITPLDP

SEQ ID NO: 651039 - protein, 18 aa, Mycobacterium
EAVGHLLSAFVAITPLDP

SEQ ID NO: 651040 - protein, 31 aa, Mycobacterium
EAVGIAAYHCGDWAQALAELRAARRMGSKSP

SEQ ID NO: 651041 - protein, 27 aa, Mycobacterium
EAVGIAAYHCGDWAQALSELRAARRMG

SEQ ID NO: 651042 - protein, 17 aa, Mycobacterium
EAVGIIPPNGVRIHVAG

SEQ ID NO: 651043 - protein, 27 aa, Mycobacterium
EAVGIPDEWFLAGHVVVGWPRGKHGPV

SEQ ID NO: 651044 - protein, 17 aa, Mycobacterium
EAVGLMAGHSAVVTHPA

SEQ ID NO: 651045 - protein, 25 aa, Mycobacterium
EAVGVSWAALDMAVEYAKVREQFGR

SEQ ID NO: 651046 - protein, 20 aa, Mycobacterium
EAVHAPAWITDGVRQKSVKL

SEQ ID NO: 651047 - protein, 27 aa, Mycobacterium
EAVKALRARLGDIWARINDEEYVVRQV

SEQ ID NO: 651048 - protein, 26 aa, Mycobacterium
EAVKPARLGMKAWPVIPKGQDWKHGV

SEQ ID NO: 651049 - protein, 24 aa, Mycobacterium
EAVLAAACRLRILPAGRANAPAAG

SEQ ID NO: 651050 - protein, 21 aa, Mycobacterium
EAVLAAARRLRIIAATPQART

SEQ ID NO: 651051 - protein, 21 aa, Mycobacterium
EAVLAAARRLRILPAASATRA

SEQ ID NO: 651052 - protein, 19 aa, Mycobacterium
EAVLAALATHGWVRTGTVA

SEQ ID NO: 651053 - protein, 26 aa, Mycobacterium
EAVLASWRLLLDIGRLQDGEPYLAGT

SEQ ID NO: 651054 - protein, 17 aa, Mycobacterium
EAVLHDFGEVDYLIHNA

SEQ ID NO: 651055 - protein, 18 aa, Mycobacterium
EAVLHESGRLVVLDNASI

SEQ ID NO: 651056 - protein, 24 aa, Mycobacterium
EAVLPDARLLSVFADPASLIPVTN

SEQ ID NO: 651057 - protein, 18 aa, Mycobacterium
EAVLPRLDVPPLLDELVG

SEQ ID NO: 651058 - protein, 24 aa, Mycobacterium
EAVLPRLEIPHLLSDLVAPTSSDG

SEQ ID NO: 651059 - protein, 17 aa, Mycobacterium
EAVLRCEDMPAYLSTSL

SEQ ID NO: 651060 - protein, 18 aa, Mycobacterium
EAVLRNTAGLAWAVNLGC

SEQ ID NO: 651061 - protein, 20 aa, Mycobacterium
EAVLTMAAVPEFAALQRPYQ

SEQ ID NO: 651062 - protein, 20 aa, Mycobacterium
EAVMMGRWRRLGLLRRPSRA

SEQ ID NO: 651063 - protein, 21 aa, Mycobacterium
EAVMWARERYGSAVVWAVEDC

SEQ ID NO: 651064 - protein, 23 aa, Mycobacterium
EAVNGMAGLMAWCQAPTRALGRF

SEQ ID NO: 651065 - protein, 21 aa, Mycobacterium
EAVPDDIAWCRLRDFRCYATL

SEQ ID NO: 651066 - protein, 22 aa, Mycobacterium
EAVPMRLRFARSVRISMEGNSH

SEQ ID NO: 651067 - protein, 17 aa, Mycobacterium
EAVPRALAMAQRIATNS

SEQ ID NO: 651068 - protein, 19 aa, Mycobacterium
EAVQLAARRGDLIQQCPSG

SEQ ID NO: 651069 - protein, 18 aa, Mycobacterium
EAVQRIEYDWGRMDRTMW

SEQ ID NO: 651070 - protein, 20 aa, Mycobacterium
EAVRAHLIDTARSFIFDTGL

SEQ ID NO: 651071 - protein, 24 aa, Mycobacterium
EAVRRIAPAIWGRPVDVPPPGEYV

SEQ ID NO: 651072 - protein, 20 aa, Mycobacterium
EAVSAAAANVANIGRALSAA

SEQ ID NO: 651073 - protein, 25 aa, Mycobacterium
EAVSGWATKQPKVWWNTGTSTPPIH

SEQ ID NO: 651074 - protein, 18 aa, Mycobacterium
EAVSPVWKAMGSGGSTGR

SEQ ID NO: 651075 - protein, 17 aa, Mycobacterium
EAVSTLLSDAGFGDVRI

SEQ ID NO: 651076 - protein, 22 aa, Mycobacterium
EAVTARTGVTWVTAYGASELPV

SEQ ID NO: 651077 - protein, 23 aa, Mycobacterium
EAVTGLDLVEWQLRVAAGEKLGF

SEQ ID NO: 651078 - protein, 23 aa, Mycobacterium
EAVTGLDLVEWQLRVAAGEKLPF

SEQ ID NO: 651079 - protein, 23 aa, Mycobacterium
EAVTGLDLVEWQLRVAAGEKLTF

SEQ ID NO: 651080 - protein, 20 aa, Mycobacterium
EAVTIDEEWFASRAGELIAT

SEQ ID NO: 651081 - protein, 19 aa, Mycobacterium
EAVVDCRILPGRKEAFEAE

SEQ ID NO: 651082 - protein, 21 aa, Mycobacterium
EAVVRVRLVPGTGQFNLNGRT

SEQ ID NO: 651083 - protein, 17 aa, Mycobacterium
EAVWRLGGCLQERDGQI

SEQ ID NO: 651084 - protein, 23 aa, Mycobacterium
EAVYARKHLKKWMRRRRESLPMA

SEQ ID NO: 651085 - protein, 18 aa, Mycobacterium
EAVYSDNVGWVYRTLFAR

SEQ ID NO: 651086 - protein, 27 aa, Mycobacterium
EAWAALRGAILLLRVGKQMIELGLLPP

SEQ ID NO: 651087 - protein, 25 aa, Mycobacterium
EAWHWPDAFAVIAEGLRDAWRRRDG

SEQ ID NO: 651088 - protein, 18 aa, Mycobacterium
EAWLKEVQDNLAAGRLPR

SEQ ID NO: 651089 - protein, 19 aa, Mycobacterium
EAWLRLSGSSGETIANPDA

SEQ ID NO: 651090 - protein, 20 aa, Mycobacterium
EAWMKRDLAPHLHREAYLHV

SEQ ID NO: 651091 - protein, 19 aa, Mycobacterium
EAWMRDFGPTFVVGENGQL

SEQ ID NO: 651092 - protein, 17 aa, Mycobacterium
EAWRVADRLLAGIDPAD

SEQ ID NO: 651093 - protein, 24 aa, Mycobacterium
EAWTEFCERLRRAGERVFKDPNPT

SEQ ID NO: 651094 - protein, 27 aa, Mycobacterium
EAYAKRFGYNVVRAFTGHGVGPTFHNG

SEQ ID NO: 651095 - protein, 22 aa, Mycobacterium
EAYCAIPSMGAVLHTLNIRLAP

SEQ ID NO: 651096 - protein, 21 aa, Mycobacterium
EAYCAVPSMGAVLHTLNIRLA

SEQ ID NO: 651097 - protein, 22 aa, Mycobacterium
EAYCAVPSMGAVLHTLNIRLTA

SEQ ID NO: 651098 - protein, 22 aa, Mycobacterium
EAYERAASSLAEIAGRNNESSY

SEQ ID NO: 651099 - protein, 18 aa, Mycobacterium
EAYFEGFAALADMTDEER

SEQ ID NO: 651100 - protein, 21 aa, Mycobacterium
EAYHPPFAFAGGRIARVNIDT

SEQ ID NO: 651101 - protein, 17 aa, Mycobacterium
EAYIGSFIQLVRTATTG

SEQ ID NO: 651102 - protein, 27 aa, Mycobacterium
EAYLALVRYLLELDLIDRVVFATLPVD

SEQ ID NO: 651103 - protein, 22 aa, Mycobacterium
EAYLGLLRFLLGLDLVDRVLFW

SEQ ID NO: 651104 - protein, 20 aa, Mycobacterium
EAYLRASALRMIVAYTEGSA

SEQ ID NO: 651105 - protein, 18 aa, Mycobacterium
EAYQHVWFVVARSCDIDT

SEQ ID NO: 651106 - protein, 28 aa, Mycobacterium
EAYQRIFARLQVRYVIVSAVSGAMGGSA

SEQ ID NO: 651107 - protein, 18 aa, Mycobacterium
EAYRAIAQFEEYPQYVED

SEQ ID NO: 651108 - protein, 18 aa, Mycobacterium
EAYRLGMVSKVFPVDELA

SEQ ID NO: 651109 - protein, 18 aa, Mycobacterium
EAYRRGADVVAFDRDADE

SEQ ID NO: 651110 - protein, 18 aa, Mycobacterium
EAYRWMRANEPVFRDRNG

SEQ ID NO: 651111 - protein, 17 aa, Mycobacterium
ECAEARAVIARALEEDL

SEQ ID NO: 651112 - protein, 19 aa, Mycobacterium
ECAHCGCRILGHGLEAAGT

SEQ ID NO: 651113 - protein, 26 aa, Mycobacterium
ECALKTEPAELEWTLARTDHPDAGTE

SEQ ID NO: 651114 - protein, 27 aa, Mycobacterium
ECAQACGLPLLRRPPSVDTAWRAHSTG

SEQ ID NO: 651115 - protein, 24 aa, Mycobacterium
ECAREVAEVVAPILGWSVEDVDRE

SEQ ID NO: 651116 - protein, 20 aa, Mycobacterium
ECARVLRPGGSLVLVDQFSP

SEQ ID NO: 651117 - protein, 27 aa, Mycobacterium
ECDCYTCAHYTRAYMHHLFKAKEILAS

SEQ ID NO: 651118 - protein, 24 aa, Mycobacterium
ECDQALFGWTGWSVGAVVRGEPSA

SEQ ID NO: 651119 - protein, 23 aa, Mycobacterium
ECERLGVRWAPPVHDLSAVEADA

SEQ ID NO: 651120 - protein, 22 aa, Mycobacterium
ECFRVLRPGGVFLVSTPNRITF

SEQ ID NO: 651121 - protein, 27 aa, Mycobacterium
ECGALSEWRATLIVRESACLDVEDRRA

SEQ ID NO: 651122 - protein, 25 aa, Mycobacterium
ECGCGGKVRPSIVWFGEMLPEVEFG

SEQ ID NO: 651123 - protein, 20 aa, Mycobacterium
ECGIPLWLDSPMTGLLTDAD

SEQ ID NO: 651124 - protein, 21 aa, Mycobacterium
ECGKLAVDVPVDMPVDRVLRE

SEQ ID NO: 651125 - protein, 33 aa, Mycobacterium
ECGRQPAAQRLGLRGDLLWSFRRRHTEIHARRP

SEQ ID NO: 651126 - protein, 19 aa, Mycobacterium
ECGRVNLRALPVLVVVEVL

SEQ ID NO: 651127 - protein, 25 aa, Mycobacterium
ECGVWRGGASILMRAVLSAYGDESR

SEQ ID NO: 651128 - protein, 26 aa, Mycobacterium
ECHGLQCGFCTPGFVMSITALLNDNP

SEQ ID NO: 651129 - protein, 26 aa, Mycobacterium
ECHGLQCGFCTPGFVMSLTALLRDNP

SEQ ID NO: 651130 - protein, 27 aa, Mycobacterium
ECHGLQCGFCTPGFVVSITALLRDNPD

SEQ ID NO: 651131 - protein, 18 aa, Mycobacterium
ECITRKGVRTVDGVEHEV

SEQ ID NO: 651132 - protein, 21 aa, Mycobacterium
ECKKLGLLPFANYNRIHVVPP

SEQ ID NO: 651133 - protein, 21 aa, Mycobacterium
ECKNRLAELHEAYRVDYQAYY

SEQ ID NO: 651134 - protein, 19 aa, Mycobacterium
ECLALIGAGVDDWGGVSPL

SEQ ID NO: 651135 - protein, 23 aa, Mycobacterium
ECLELVGAAGLTFQGWLRNSPYY

SEQ ID NO: 651136 - protein, 21 aa, Mycobacterium
ECMHMLVNLFSPRGIPANYRT

SEQ ID NO: 651137 - protein, 23 aa, Mycobacterium
ECMSTGFSVWASRMAVEYLLTAA

SEQ ID NO: 651138 - protein, 18 aa, Mycobacterium
ECMVVAGNAMDWVYRDSG

SEQ ID NO: 651139 - protein, 24 aa, Mycobacterium
ECNGPRPSLPLTVRPDGVIDPTTM

SEQ ID NO: 651140 - protein, 26 aa, Mycobacterium
ECPADLRVCPAHHELSAAARAFKAQA

SEQ ID NO: 651141 - protein, 26 aa, Mycobacterium
ECPFMEFTPGYVLRVIDELPKQGSRK

SEQ ID NO: 651142 - protein, 19 aa, Mycobacterium
ECPKPRTAIRLSGNDFLSE

SEQ ID NO: 651143 - protein, 17 aa, Mycobacterium
ECRACTTTMAGTHADVR

SEQ ID NO: 651144 - protein, 26 aa, Mycobacterium
ECRGALGWVRAWRGDPIGALHQLGEA

SEQ ID NO: 651145 - protein, 25 aa, Mycobacterium
ECRGRRLAADLLRIVSTWQLDADPS

SEQ ID NO: 651146 - protein, 21 aa, Mycobacterium
ECRRVSAQNVAGWSHVPVRVL

SEQ ID NO: 651147 - protein, 20 aa, Mycobacterium
ECTELLRLADRASTEPRITP

SEQ ID NO: 651148 - protein, 23 aa, Mycobacterium
ECVEGTWRFSYRDLTLIDMVGDI

SEQ ID NO: 651149 - protein, 18 aa, Mycobacterium
ECVQRGYTRLSWAVLNWN

SEQ ID NO: 651150 - protein, 18 aa, Mycobacterium
ECVREVAGRGAAVLLSSH

SEQ ID NO: 651151 - protein, 23 aa, Mycobacterium
ECVSPSTALTMFLGCADRPDRVR

SEQ ID NO: 651152 - protein, 21 aa, Mycobacterium
ECWMHLGIDLFWFALPPAQLD

SEQ ID NO: 651153 - protein, 17 aa, Mycobacterium
ECYCSRKDIAQAPRAPH

SEQ ID NO: 651154 - protein, 20 aa, Mycobacterium
ECYGLRVLFTGAQAGRRVAR

SEQ ID NO: 651155 - protein, 18 aa, Mycobacterium
EDAARAGIRQAVILASGL

SEQ ID NO: 651156 - protein, 23 aa, Mycobacterium
EDAARYVLSVALSLLLGLIPGTD

SEQ ID NO: 651157 - protein, 19 aa, Mycobacterium
EDACAKLAANQGVIASFSR

SEQ ID NO: 651158 - protein, 22 aa, Mycobacterium
EDADFEFACMLGIGPLMHAGQG

SEQ ID NO: 651159 - protein, 24 aa, Mycobacterium
EDADFGMACAIGIAPCMHAGQGCA

SEQ ID NO: 651160 - protein, 21 aa, Mycobacterium
EDADFGTACMVGIAPCMHAGQ

SEQ ID NO: 651161 - protein, 24 aa, Mycobacterium
EDAEGPGATILLRLDQDVPNEVRS

SEQ ID NO: 651162 - protein, 24 aa, Mycobacterium
EDAEGPGATILLRLDRDVPGDVRA

SEQ ID NO: 651163 - protein, 18 aa, Mycobacterium
EDAFKAMLGELLRAAQRA

SEQ ID NO: 651164 - protein, 24 aa, Mycobacterium
EDAFRPGVIDAMFARHIAELRRLA

SEQ ID NO: 651165 - protein, 24 aa, Mycobacterium
EDAGFCEKGKGMAFVSDHDLTFRG

SEQ ID NO: 651166 - protein, 21 aa, Mycobacterium
EDAGRCQRGYFIESLGGAQFA

SEQ ID NO: 651167 - protein, 22 aa, Mycobacterium
EDAGRCQRGYFVESLGGAQFAT

SEQ ID NO: 651168 - protein, 22 aa, Mycobacterium
EDAGRCQRGYFVESLGGAQFAV

SEQ ID NO: 651169 - protein, 25 aa, Mycobacterium
EDAHVDAAMVLYLFGSKAELFRESM

SEQ ID NO: 651170 - protein, 19 aa, Mycobacterium
EDAIRLRGLMTHMVHADAP

SEQ ID NO: 651171 - protein, 23 aa, Mycobacterium
EDAKKAVVMTYILNAGTDYEAAE

SEQ ID NO: 651172 - protein, 18 aa, Mycobacterium
EDALKRHLGFAGTVERIW

SEQ ID NO: 651173 - protein, 23 aa, Mycobacterium
EDALRPLPVTTFDVRRAPAALRY

SEQ ID NO: 651174 - protein, 21 aa, Mycobacterium
EDALTRMLIGIPVVYTSDYLV

SEQ ID NO: 651175 - protein, 20 aa, Mycobacterium
EDAMKLLIRASRSGQRHPAP

SEQ ID NO: 651176 - protein, 18 aa, Mycobacterium
EDANCWIGAVNDIRLTLG

SEQ ID NO: 651177 - protein, 23 aa, Mycobacterium
EDAPAGQVLDHWLTSARRDDAAR

SEQ ID NO: 651178 - protein, 28 aa, Mycobacterium
EDAPSLFAAAGRYVLDRAIFDALRRTER

SEQ ID NO: 651179 - protein, 19 aa, Mycobacterium
EDAPSMFAAAGRYVLDRAI

SEQ ID NO: 651180 - protein, 19 aa, Mycobacterium
EDAQNVWLAIALHTTPGIT

SEQ ID NO: 651181 - protein, 19 aa, Mycobacterium
EDARFAAMVVLERLSPDQR

SEQ ID NO: 651182 - protein, 20 aa, Mycobacterium
EDARFAAMVVLERLSPDQRV

SEQ ID NO: 651183 - protein, 17 aa, Mycobacterium
EDARFAVMVVLERLSPD

SEQ ID NO: 651184 - protein, 23 aa, Mycobacterium
EDARGRTSLVITELPYQVNHDNF

SEQ ID NO: 651185 - protein, 21 aa, Mycobacterium
EDARVGKNLVVSLKYGPSRER

SEQ ID NO: 651186 - protein, 17 aa, Mycobacterium
EDARVGKSLIVQLKYGP

SEQ ID NO: 651187 - protein, 18 aa, Mycobacterium
EDASRYPAEFSGGQKQRI

SEQ ID NO: 651188 - protein, 24 aa, Mycobacterium
EDASWRPGLADSKAADLLASALES

SEQ ID NO: 651189 - protein, 19 aa, Mycobacterium
EDATVRFLLTAGAIGSLFK

SEQ ID NO: 651190 - protein, 25 aa, Mycobacterium
EDAVGLRERARWTAEDELVKMGVDF

SEQ ID NO: 651191 - protein, 18 aa, Mycobacterium
EDAVIKLGRGHRYRFDYD

SEQ ID NO: 651192 - protein, 26 aa, Mycobacterium
EDAWRGELPPALALQIVERHGYDIAP

SEQ ID NO: 651193 - protein, 22 aa, Mycobacterium
EDAWSEGRFAYKSVSVAGYPNL

SEQ ID NO: 651194 - protein, 25 aa, Mycobacterium
EDCHFCSQSGLFASPVRSARLDVPS

SEQ ID NO: 651195 - protein, 24 aa, Mycobacterium
EDCHFCSQSGLFASPVRSAWLDIP

SEQ ID NO: 651196 - protein, 24 aa, Mycobacterium
EDCHFCSQSGLFASPVRSAWLDVP

SEQ ID NO: 651197 - protein, 17 aa, Mycobacterium
EDCRRVVETAIERHGGL

SEQ ID NO: 651198 - protein, 18 aa, Mycobacterium
EDCVRDLCELGVTVVTQP

SEQ ID NO: 651199 - protein, 23 aa, Mycobacterium
EDCVRLCKQRKWTPIEYVDNDVG

SEQ ID NO: 651200 - protein, 27 aa, Mycobacterium
EDCYAALRWLSVQGWIDPTRIAVGGAS

SEQ ID NO: 651201 - protein, 18 aa, Mycobacterium
EDDHVWLLLLERAAPQAQ

SEQ ID NO: 651202 - protein, 23 aa, Mycobacterium
EDDIPGIVAGLGYDDCLVMGSDY

SEQ ID NO: 651203 - protein, 25 aa, Mycobacterium
EDDLEFRPPVVTVMGHVDHGKTRLL

SEQ ID NO: 651204 - protein, 18 aa, Mycobacterium
EDDLKRWRISTNRGDDIR

SEQ ID NO: 651205 - protein, 25 aa, Mycobacterium
EDDLPDLLAGVAIVVVRILGGYRAW

SEQ ID NO: 651206 - protein, 26 aa, Mycobacterium
EDDLTGWLALLAPDIIYRAPVRTTRD

SEQ ID NO: 651207 - protein, 25 aa, Mycobacterium
EDDPGFRFALVISHENQHDETMLQA

SEQ ID NO: 651208 - protein, 23 aa, Mycobacterium
EDDRFLLSVTFRLGRLGVPVVAE

SEQ ID NO: 651209 - protein, 25 aa, Mycobacterium
EDDRRADTMWAFLRSKANTIEGGTS

SEQ ID NO: 651210 - protein, 23 aa, Mycobacterium
EDDVPGLVLIPAAADKIEIPMIA

SEQ ID NO: 651211 - protein, 22 aa, Mycobacterium
EDDYVRLGIRAMEVASVPPVVV

SEQ ID NO: 651212 - protein, 18 aa, Mycobacterium
EDECGSAISAAREVTLGK

SEQ ID NO: 651213 - protein, 18 aa, Mycobacterium
EDEDGFYFIVDRTKDMIV

SEQ ID NO: 651214 - protein, 24 aa, Mycobacterium
EDEISTGIAALFGAFGSDYQAISA

SEQ ID NO: 651215 - protein, 21 aa, Mycobacterium
EDEIVSFFILLTIAGNDTTRQ

SEQ ID NO: 651216 - protein, 24 aa, Mycobacterium
EDEKLPPRRAVLTAEVDDAIYRPD

SEQ ID NO: 651217 - protein, 34 aa, Mycobacterium
EDEKVRAGRGFDPRVRREIGHGVGQAHHDAVVGG

SEQ ID NO: 651218 - protein, 26 aa, Mycobacterium
EDELLRWANDTEYGLAAYVFAGRLQD

SEQ ID NO: 651219 - protein, 18 aa, Mycobacterium
EDEMMAVALVGAGEAMAN

SEQ ID NO: 651220 - protein, 17 aa, Mycobacterium
EDEQHAILLNLVRSHIA

SEQ ID NO: 651221 - protein, 38 aa, Mycobacterium
EDERSAGGWHAEWLVLRECLRLAGGAAQTAVELSRGLQ

SEQ ID NO: 651222 - protein, 23 aa, Mycobacterium
EDERWEWCDQVARLHGYEPGTVT

SEQ ID NO: 651223 - protein, 23 aa, Mycobacterium
EDEVSAAIAVLFSSHAQTYQAVS

SEQ ID NO: 651224 - protein, 23 aa, Mycobacterium
EDEVYAFLGGIFRRGLEKEGLAD

SEQ ID NO: 651225 - protein, 21 aa, Mycobacterium
EDFAAIAADLVRRGITTVDQL

SEQ ID NO: 651226 - protein, 24 aa, Mycobacterium
EDFAAVFRYELLPLLQEYLFEDYA

SEQ ID NO: 651227 - protein, 21 aa, Mycobacterium
EDFADVAFRSFHFIYGLKSLE

SEQ ID NO: 651228 - protein, 19 aa, Mycobacterium
EDFALAASECVAFENSSYD

SEQ ID NO: 651229 - protein, 31 aa, Mycobacterium
EDFALRGGKRLRPVFAYWGWHAVTTEEPGPE

SEQ ID NO: 651230 - protein, 21 aa, Mycobacterium
EDFARLVVPELRRRGRVPEHG

SEQ ID NO: 651231 - protein, 24 aa, Mycobacterium
EDFCRVFRPGGRMLATGEVLVQPA

SEQ ID NO: 651232 - protein, 17 aa, Mycobacterium
EDFEHQRALVLMVLAGG

SEQ ID NO: 651233 - protein, 26 aa, Mycobacterium
EDFHCGDEVYGLIGFDRDGAAADFVA

SEQ ID NO: 651234 - protein, 25 aa, Mycobacterium
EDFRARLKAAYAEHPPVPLPGVPDA

SEQ ID NO: 651235 - protein, 27 aa, Mycobacterium
EDFSRALAARGWLGMTVPEEYGGHGRS

SEQ ID NO: 651236 - protein, 25 aa, Mycobacterium
EDFTAALADRGWLGMTVPVEYGGHG

SEQ ID NO: 651237 - protein, 17 aa, Mycobacterium
EDFVRCALLAHEAGYDG

SEQ ID NO: 651238 - protein, 19 aa, Mycobacterium
EDGACEWSWARLRHETGAF

SEQ ID NO: 651239 - protein, 24 aa, Mycobacterium
EDGALLMAERGRLFGSLPSGGRMV

SEQ ID NO: 651240 - protein, 24 aa, Mycobacterium
EDGARLIAERGRLFGGLPAGGRMV

SEQ ID NO: 651241 - protein, 24 aa, Mycobacterium
EDGARLIAERGRLFGSLPAGGRMA

SEQ ID NO: 651242 - protein, 24 aa, Mycobacterium
EDGARLIAERGRLFSSLPAGGRMA

SEQ ID NO: 651243 - protein, 19 aa, Mycobacterium
EDGEKRIPLDVAEGDTVIY

SEQ ID NO: 651244 - protein, 21 aa, Mycobacterium
EDGEKRIPLDVAEGDTVIYSK

SEQ ID NO: 651245 - protein, 23 aa, Mycobacterium
EDGEKRIPLDVAEGDTVIYSKYG

SEQ ID NO: 651246 - protein, 18 aa, Mycobacterium
EDGEKRIPLDVSEGDVVI

SEQ ID NO: 651247 - protein, 19 aa, Mycobacterium
EDGEKRIPLDVSEGDVVIY

SEQ ID NO: 651248 - protein, 17 aa, Mycobacterium
EDGELLVRGGVVFNGYW

SEQ ID NO: 651249 - protein, 17 aa, Mycobacterium
EDGEVRGTLQLGQSAWI

SEQ ID NO: 651250 - protein, 18 aa, Mycobacterium
EDGFWFIVDRVKDMIVTG

SEQ ID NO: 651251 - protein, 18 aa, Mycobacterium
EDGFYFIVDRVKDMIVTG

SEQ ID NO: 651252 - protein, 17 aa, Mycobacterium
EDGGAWGNDQVSGIMGA

SEQ ID NO: 651253 - protein, 18 aa, Mycobacterium
EDGIPVLLVDQARDVGDD

SEQ ID NO: 651254 - protein, 25 aa, Mycobacterium
EDGKEPLVAALLRSFFHPLVRLRNK

SEQ ID NO: 651255 - protein, 17 aa, Mycobacterium
EDGKLLISAVVADREDA

SEQ ID NO: 651256 - protein, 24 aa, Mycobacterium
EDGLLPAITFIFSRAGCDGAVAQC

SEQ ID NO: 651257 - protein, 18 aa, Mycobacterium
EDGLPDIAWFAADGSEMT

SEQ ID NO: 651258 - protein, 17 aa, Mycobacterium
EDGLPLAIVEAKRTTKS

SEQ ID NO: 651259 - protein, 24 aa, Mycobacterium
EDGPLLHANWRWATSALTDEQVNR

SEQ ID NO: 651260 - protein, 23 aa, Mycobacterium
EDGPNLKPAYTITGGAVPGEETL

SEQ ID NO: 651261 - protein, 24 aa, Mycobacterium
EDGPQLHATWTWAPSALDREQVAR

SEQ ID NO: 651262 - protein, 25 aa, Mycobacterium
EDGQLPKMRAIVGFAAETGDANGDV

SEQ ID NO: 651263 - protein, 24 aa, Mycobacterium
EDGQLRGSLFAIHGLGVRGVPEPR

SEQ ID NO: 651264 - protein, 17 aa, Mycobacterium
EDGRAIFWASLGEIRLF

SEQ ID NO: 651265 - protein, 22 aa, Mycobacterium
EDGRFAFYIKVHHTVVDGVAGF

SEQ ID NO: 651266 - protein, 22 aa, Mycobacterium
EDGRIAAGMAWALEHLDETITL

SEQ ID NO: 651267 - protein, 31 aa, Mycobacterium
EDGRIALVVGDCVGHGLAAAAVMGQVRSACR

SEQ ID NO: 651268 - protein, 25 aa, Mycobacterium
EDGRPVLALHGWPQHHWAYRDLLGD

SEQ ID NO: 651269 - protein, 20 aa, Mycobacterium
EDGRRWVVSFTHDRDPGVTY

SEQ ID NO: 651270 - protein, 19 aa, Mycobacterium
EDGRVFTGMSFGAVGQTLG

SEQ ID NO: 651271 - protein, 17 aa, Mycobacterium
EDGRVFTGVSFGAVGQT

SEQ ID NO: 651272 - protein, 23 aa, Mycobacterium
EDGRYRSAAALAVLGASFDNNVR

SEQ ID NO: 651273 - protein, 25 aa, Mycobacterium
EDGSPTPAYRCLDLYYPDYATACEA

SEQ ID NO: 651274 - protein, 22 aa, Mycobacterium
EDGSVWNGVIQRLQSAGHPVVA

SEQ ID NO: 651275 - protein, 24 aa, Mycobacterium
EDGVFRIARRVARDRLISTVDVQA

SEQ ID NO: 651276 - protein, 19 aa, Mycobacterium
EDGVHWGLEYLFGVLEYDR

SEQ ID NO: 651277 - protein, 17 aa, Mycobacterium
EDGVLTVVGFQWQGDHV

SEQ ID NO: 651278 - protein, 20 aa, Mycobacterium
EDGVRLAFCTSPPMDFDLVI

SEQ ID NO: 651279 - protein, 25 aa, Mycobacterium
EDGWRLRTRAMTFIRRSGEHDSGRP

SEQ ID NO: 651280 - protein, 24 aa, Mycobacterium
EDGYPIVLAHGITCAIPVWAHQIA

SEQ ID NO: 651281 - protein, 23 aa, Mycobacterium
EDGYRLTGQLQIRGKSRQHMIDL

SEQ ID NO: 651282 - protein, 18 aa, Mycobacterium
EDHCLLDLLWRNRRGELD

SEQ ID NO: 651283 - protein, 18 aa, Mycobacterium
EDHCLLDLLWRNRRGELP

SEQ ID NO: 651284 - protein, 17 aa, Mycobacterium
EDHGATEFMVYHAALAV

SEQ ID NO: 651285 - protein, 18 aa, Mycobacterium
EDHGRPGALTDLPPGPGA

SEQ ID NO: 651286 - protein, 18 aa, Mycobacterium
EDHLDWHATMAEYTAAKA

SEQ ID NO: 651287 - protein, 18 aa, Mycobacterium
EDHLDWHGGMEGYTRDKA

SEQ ID NO: 651288 - protein, 23 aa, Mycobacterium
EDHLLRSLAPVVGRTRIYCVGVD

SEQ ID NO: 651289 - protein, 26 aa, Mycobacterium
EDHRSRVGRLWAGFNAVAVDNPHAWI

SEQ ID NO: 651290 - protein, 23 aa, Mycobacterium
EDHRVSALIGLFVNTVPLRARVD

SEQ ID NO: 651291 - protein, 17 aa, Mycobacterium
EDHSYARHVEWMRALAF

SEQ ID NO: 651292 - protein, 17 aa, Mycobacterium
EDHWPRQWAHAYVDFAA

SEQ ID NO: 651293 - protein, 20 aa, Mycobacterium
EDHWYRARLNLGPLGPDDWR

SEQ ID NO: 651294 - protein, 23 aa, Mycobacterium
EDHYRPSTALQRFIRSRDITCRF

SEQ ID NO: 651295 - protein, 24 aa, Mycobacterium
EDIAEAALYFAGERSRYVTGTVLP

SEQ ID NO: 651296 - protein, 25 aa, Mycobacterium
EDIAEAALYFASERSRYVTGTVLPV

SEQ ID NO: 651297 - protein, 23 aa, Mycobacterium
EDIAEAIAYIVAQPRRVAVNEIV

SEQ ID NO: 651298 - protein, 20 aa, Mycobacterium
EDIAEVIGFVASRPSHVNLD

SEQ ID NO: 651299 - protein, 22 aa, Mycobacterium
EDIAGAVAWLVSDEAKFITGVA

SEQ ID NO: 651300 - protein, 17 aa, Mycobacterium
EDIEWLWDAVWDYFDIR

SEQ ID NO: 651301 - protein, 26 aa, Mycobacterium
EDIGSRIDPVLARSWLLVNGTHPDRF

SEQ ID NO: 651302 - protein, 26 aa, Mycobacterium
EDIGVDIAFNWDHFFPLYGAPDGAHF

SEQ ID NO: 651303 - protein, 20 aa, Mycobacterium
EDIKFFQGLSFVVGSTEVEA

SEQ ID NO: 651304 - protein, 26 aa, Mycobacterium
EDIKRYPLGKAESFFHVRLENGTVQF

SEQ ID NO: 651305 - protein, 20 aa, Mycobacterium
EDILLQGVSICFDQLHEIAE

SEQ ID NO: 651306 - protein, 18 aa, Mycobacterium
EDINWLANDVFRPVVAIW

SEQ ID NO: 651307 - protein, 23 aa, Mycobacterium
EDIPALFELWRAAGAVDHPTSLV

SEQ ID NO: 651308 - protein, 17 aa, Mycobacterium
EDIPARVVLGLAQSGAR

SEQ ID NO: 651309 - protein, 17 aa, Mycobacterium
EDIPGVVMTDGLPWTWE

SEQ ID NO: 651310 - protein, 21 aa, Mycobacterium
EDIPQLRFQIGRWEYRDLIRE

SEQ ID NO: 651311 - protein, 17 aa, Mycobacterium
EDIRRPLGISHAYPPDA

SEQ ID NO: 651312 - protein, 22 aa, Mycobacterium
EDIRVAAELALPHRRRRDPFDD

SEQ ID NO: 651313 - protein, 21 aa, Mycobacterium
EDISNAVLWLASDESRYVTGM

SEQ ID NO: 651314 - protein, 23 aa, Mycobacterium
EDITFAQGLSFVIGETHRDAVKR

SEQ ID NO: 651315 - protein, 18 aa, Mycobacterium
EDKAWFIEHRFLSTERAK

SEQ ID NO: 651316 - protein, 17 aa, Mycobacterium
EDKEVIETFVLTAALGA

SEQ ID NO: 651317 - protein, 19 aa, Mycobacterium
EDKFGFLLEAFTFGAPPHG

SEQ ID NO: 651318 - protein, 21 aa, Mycobacterium
EDKNIRIAPSFPSLPDLSDAV

SEQ ID NO: 651319 - protein, 19 aa, Mycobacterium
EDKNIRIAPTFPATSDLRA

SEQ ID NO: 651320 - protein, 24 aa, Mycobacterium
EDKPLKYPVMFRAVDVVLLNKIDL

SEQ ID NO: 651321 - protein, 23 aa, Mycobacterium
EDKRGRRKTAIGYVVSDKMQKTI

SEQ ID NO: 651322 - protein, 26 aa, Mycobacterium
EDKSRWGYKFRFGVFRIDDHDLDVIR

SEQ ID NO: 651323 - protein, 30 aa, Mycobacterium
EDLAERVGWQWRLVWYKAVADLLTGDYDSA

SEQ ID NO: 651324 - protein, 25 aa, Mycobacterium
EDLAYRVAVGLYRYSLLDIIDIADI

SEQ ID NO: 651325 - protein, 21 aa, Mycobacterium
EDLAYWRSLMADLPEPLELPG

SEQ ID NO: 651326 - protein, 23 aa, Mycobacterium
EDLCAAGAPFGLRPEAVIPAYGM

SEQ ID NO: 651327 - protein, 24 aa, Mycobacterium
EDLCDAGKPFGFKPSAMVPAYGMA

SEQ ID NO: 651328 - protein, 19 aa, Mycobacterium
EDLDRWEGRLDRELTNGSF

SEQ ID NO: 651329 - protein, 17 aa, Mycobacterium
EDLEFAVRLGVDLVALS

SEQ ID NO: 651330 - protein, 23 aa, Mycobacterium
EDLEVRPPVVTVMGHVDHGKTRL

SEQ ID NO: 651331 - protein, 24 aa, Mycobacterium
EDLFGACLHREMGRFIDAVRADID

SEQ ID NO: 651332 - protein, 17 aa, Mycobacterium
EDLGDRVAVYAFRSRGR

SEQ ID NO: 651333 - protein, 17 aa, Mycobacterium
EDLGFQFERSYFPGKAV

SEQ ID NO: 651334 - protein, 17 aa, Mycobacterium
EDLHAALDHLDRGPFGK

SEQ ID NO: 651335 - protein, 18 aa, Mycobacterium
EDLIAAAMETLVAEEVVW

SEQ ID NO: 651336 - protein, 26 aa, Mycobacterium
EDLIAWSRERMAGYKVPRYVEFLEEL

SEQ ID NO: 651337 - protein, 23 aa, Mycobacterium
EDLKGRAKEAFGAATNNDDLKAE

SEQ ID NO: 651338 - protein, 21 aa, Mycobacterium
EDLKRVAAMRAHLGDTPLMVD

SEQ ID NO: 651339 - protein, 24 aa, Mycobacterium
EDLKYVPNMLAVSFRTGRDAAIGV

SEQ ID NO: 651340 - protein, 17 aa, Mycobacterium
EDLLAGPAIRADATEDA

SEQ ID NO: 651341 - protein, 24 aa, Mycobacterium
EDLLDSWAGTMIVVSHDRYLLERV

SEQ ID NO: 651342 - protein, 27 aa, Mycobacterium
EDLLGWCRERMAGFKVPRSVRFVDALP

SEQ ID NO: 651343 - protein, 25 aa, Mycobacterium
EDLLKRVWRWDFGDLSTVTVHVKRL

SEQ ID NO: 651344 - protein, 19 aa, Mycobacterium
EDLLNFAYLLLVAGNETTR

SEQ ID NO: 651345 - protein, 21 aa, Mycobacterium
EDLLRLFGLDAEQARAICRRP

SEQ ID NO: 651346 - protein, 19 aa, Mycobacterium
EDLLRRCGDRFKLARRTIL

SEQ ID NO: 651347 - protein, 30 aa, Mycobacterium
EDLLRWCDDRWKLARRRIFVDESVLRMQNL

SEQ ID NO: 651348 - protein, 20 aa, Mycobacterium
EDLLSLPYVRDIEHPAVAYQ

SEQ ID NO: 651349 - protein, 19 aa, Mycobacterium
EDLLTRMGLADKRTVYPAE

SEQ ID NO: 651350 - protein, 22 aa, Mycobacterium
EDLPARVFLTYFTRKSAFKRFG

SEQ ID NO: 651351 - protein, 18 aa, Mycobacterium
EDLPLFGAFWDRPAQVPT

SEQ ID NO: 651352 - protein, 20 aa, Mycobacterium
EDLPRFPFTPADPLIVSRIN

SEQ ID NO: 651353 - protein, 25 aa, Mycobacterium
EDLPWFRRRAVELISYSVKYKRAFE

SEQ ID NO: 651354 - protein, 18 aa, Mycobacterium
EDLQRVLVDLVELHLQGK

SEQ ID NO: 651355 - protein, 19 aa, Mycobacterium
EDLRAKFGLVSEDQALRDI

SEQ ID NO: 651356 - protein, 25 aa, Mycobacterium
EDLRALLARRNELWSREPANDKERT

SEQ ID NO: 651357 - protein, 17 aa, Mycobacterium
EDLRAPVLTVVAPGLGT

SEQ ID NO: 651358 - protein, 36 aa, Mycobacterium
EDLRKFLAEKVVRWWLPERWAFVEEIPRTSVGKYDK

SEQ ID NO: 651359 - protein, 20 aa, Mycobacterium
EDLRLLELLPPAPADANPPD

SEQ ID NO: 651360 - protein, 20 aa, Mycobacterium
EDLRTARRLGVGPATAQAIA

SEQ ID NO: 651361 - protein, 22 aa, Mycobacterium
EDLRTTLGPARRIVHARGMELF

SEQ ID NO: 651362 - protein, 20 aa, Mycobacterium
EDLRWWPADELPEGTDHALA

SEQ ID NO: 651363 - protein, 19 aa, Mycobacterium
EDLTLLGVHIFGTSATEMV

SEQ ID NO: 651364 - protein, 17 aa, Mycobacterium
EDLVFRVNYLGGDMPTF

SEQ ID NO: 651365 - protein, 22 aa, Mycobacterium
EDLVGMCLFLLSDEASWITGQI

SEQ ID NO: 651366 - protein, 23 aa, Mycobacterium
EDLVGMCLFLLSDQARWITGQIF

SEQ ID NO: 651367 - protein, 30 aa, Mycobacterium
EDLYKSFFREFRWSSGVADYIAGSAGVFMR

SEQ ID NO: 651368 - protein, 21 aa, Mycobacterium
EDLYVRPSFRRRGLASRLLAT

SEQ ID NO: 651369 - protein, 22 aa, Mycobacterium
EDMELIRPTALALVPRVCDMVF

SEQ ID NO: 651370 - protein, 17 aa, Mycobacterium
EDMGLYLPVIIDDPTEP

SEQ ID NO: 651371 - protein, 31 aa, Mycobacterium
EDMKAAMPQTVWVTGCSSWYLGKDGLPELFP

SEQ ID NO: 651372 - protein, 25 aa, Mycobacterium
EDNARRAAKLLGCTPHDLWPNQYPA

SEQ ID NO: 651373 - protein, 25 aa, Mycobacterium
EDNARRAAKLLGCTPHNLWPNQYPA

SEQ ID NO: 651374 - protein, 19 aa, Mycobacterium
EDNFCGKLLGLPMGVDVCY

SEQ ID NO: 651375 - protein, 28 aa, Mycobacterium
EDNRAWRLYRRLGFTDILRGYYFAGDPR

SEQ ID NO: 651376 - protein, 24 aa, Mycobacterium
EDNSGRRRALLRRLIHQALGVGTA

SEQ ID NO: 651377 - protein, 18 aa, Mycobacterium
EDNYCVYGARKLWKTARR

SEQ ID NO: 651378 - protein, 25 aa, Mycobacterium
EDPAASEVLAWVRAHLTEAHQTDHA

SEQ ID NO: 651379 - protein, 29 aa, Mycobacterium
EDPAKIALMRRIKQSFDPAGILNPGILFP

SEQ ID NO: 651380 - protein, 19 aa, Mycobacterium
EDPAREWQPQAGVMRAFEV

SEQ ID NO: 651381 - protein, 18 aa, Mycobacterium
EDPARGFLPTGGHVLGLR

SEQ ID NO: 651382 - protein, 19 aa, Mycobacterium
EDPARGFLPTGGRALRVFE

SEQ ID NO: 651383 - protein, 19 aa, Mycobacterium
EDPARGFLPTGGRVLQVAE

SEQ ID NO: 651384 - protein, 19 aa, Mycobacterium
EDPARGFLPTGGRVLRVIE

SEQ ID NO: 651385 - protein, 18 aa, Mycobacterium
EDPARGWQPQAGLVHSID

SEQ ID NO: 651386 - protein, 18 aa, Mycobacterium
EDPCWGIDGMARVREKIR

SEQ ID NO: 651387 - protein, 18 aa, Mycobacterium
EDPDRFYLGVQWHPEDTD

SEQ ID NO: 651388 - protein, 17 aa, Mycobacterium
EDPEVPGAVPTPDPTPD

SEQ ID NO: 651389 - protein, 20 aa, Mycobacterium
EDPGLVWAWYQNRRIQLLAV

SEQ ID NO: 651390 - protein, 19 aa, Mycobacterium
EDPKILSYLEEWTAPTKAH

SEQ ID NO: 651391 - protein, 24 aa, Mycobacterium
EDPLRALWEYSWDEATGTLMTEFM

SEQ ID NO: 651392 - protein, 18 aa, Mycobacterium
EDPRGFGGRVVVTPEAVE

SEQ ID NO: 651393 - protein, 21 aa, Mycobacterium
EDPRIRFFGNVVVGEHVTTAE

SEQ ID NO: 651394 - protein, 25 aa, Mycobacterium
EDPRPGLLAHLAFAAGDYGFQRWIR

SEQ ID NO: 651395 - protein, 17 aa, Mycobacterium
EDPRVTLPYTDAAWASI

SEQ ID NO: 651396 - protein, 23 aa, Mycobacterium
EDPTAGPVLDWVREQLRVAAAQT

SEQ ID NO: 651397 - protein, 22 aa, Mycobacterium
EDPWGRCVWGLGTAAAHSDVNV

SEQ ID NO: 651398 - protein, 24 aa, Mycobacterium
EDPYPFYRRLRETAPVWPVGDSGF

SEQ ID NO: 651399 - protein, 25 aa, Mycobacterium
EDQDVWRYFASVAFPSEAMVRNVID

SEQ ID NO: 651400 - protein, 22 aa, Mycobacterium
EDQERWGGGWVRDKKGRLRLRD

SEQ ID NO: 651401 - protein, 23 aa, Mycobacterium
EDQFRLLGLHLGFASSRPDREEN

SEQ ID NO: 651402 - protein, 19 aa, Mycobacterium
EDQGPRRIAVSSFGMSGTN

SEQ ID NO: 651403 - protein, 17 aa, Mycobacterium
EDQKLLRKHAAEFFRKE

SEQ ID NO: 651404 - protein, 20 aa, Mycobacterium
EDQLRPRVLFHDIITDITDQ

SEQ ID NO: 651405 - protein, 17 aa, Mycobacterium
EDQRKLALAASRRLAET

SEQ ID NO: 651406 - protein, 22 aa, Mycobacterium
EDRAGLDHIAFRVGSKDELDSA

SEQ ID NO: 651407 - protein, 19 aa, Mycobacterium
EDRARAWTLVRVVHAAADD

SEQ ID NO: 651408 - protein, 20 aa, Mycobacterium
EDRDRLSLTLSAFTGDAAVD

SEQ ID NO: 651409 - protein, 17 aa, Mycobacterium
EDRGMPRITALHEMTRR

SEQ ID NO: 651410 - protein, 21 aa, Mycobacterium
EDRGRRWPVIISGTITDASGR

SEQ ID NO: 651411 - protein, 28 aa, Mycobacterium
EDRICIPVPFYHCFGMVMGNLAATSHGA

SEQ ID NO: 651412 - protein, 19 aa, Mycobacterium
EDRKHLGLNLMDSIAQSIT

SEQ ID NO: 651413 - protein, 21 aa, Mycobacterium
EDRPGVRELLHHAAGDVLALS

SEQ ID NO: 651414 - protein, 19 aa, Mycobacterium
EDRRKLLWDNVWKPLASRS

SEQ ID NO: 651415 - protein, 19 aa, Mycobacterium
EDRRLALELADAADEITTS

SEQ ID NO: 651416 - protein, 26 aa, Mycobacterium
EDRRMNLLMEVFRPLLSSDSGRIPLQ

SEQ ID NO: 651417 - protein, 20 aa, Mycobacterium
EDRRPVVLFSAGIGATPVLA

SEQ ID NO: 651418 - protein, 18 aa, Mycobacterium
EDRRRELYFLKAGRERGL

SEQ ID NO: 651419 - protein, 25 aa, Mycobacterium
EDRSIVPVRVFWLPPPDRGRLARLT

SEQ ID NO: 651420 - protein, 25 aa, Mycobacterium
EDRSIVPVRVFWLPPPDRSRVAKVA

SEQ ID NO: 651421 - protein, 18 aa, Mycobacterium
EDRSRYLVEVLRALRTAV

SEQ ID NO: 651422 - protein, 24 aa, Mycobacterium
EDRVFKLPDAVPFDAGAGILFNDM

SEQ ID NO: 651423 - protein, 18 aa, Mycobacterium
EDRYPAYGVLASIVQIGR

SEQ ID NO: 651424 - protein, 24 aa, Mycobacterium
EDSARAKGVLSFKLNPREIAELPE

SEQ ID NO: 651425 - protein, 19 aa, Mycobacterium
EDSEFAVLGRQVAIGGQLL

SEQ ID NO: 651426 - protein, 19 aa, Mycobacterium
EDSEWRTEYLYSRAATIYG

SEQ ID NO: 651427 - protein, 21 aa, Mycobacterium
EDSGAGWILARLDTRRPARFF

SEQ ID NO: 651428 - protein, 20 aa, Mycobacterium
EDSMTLYGFVDGETRDLFLT

SEQ ID NO: 651429 - protein, 24 aa, Mycobacterium
EDSWRPRVADLLLGPAGTHLAAPA

SEQ ID NO: 651430 - protein, 23 aa, Mycobacterium
EDTELTGPMALRLYLSADTDDVD

SEQ ID NO: 651431 - protein, 24 aa, Mycobacterium
EDTGALLGFHWTKVHSESLGEVYV

SEQ ID NO: 651432 - protein, 26 aa, Mycobacterium
EDTGYRAPAAFGYRPFEGGLALKRLA

SEQ ID NO: 651433 - protein, 21 aa, Mycobacterium
EDTLKVVDMIGAKAVIVSAPF

SEQ ID NO: 651434 - protein, 24 aa, Mycobacterium
EDTLRRWMAAAALVRPRADGGVVA

SEQ ID NO: 651435 - protein, 24 aa, Mycobacterium
EDTLRRWMAASAMVRSRADGGVVA

SEQ ID NO: 651436 - protein, 18 aa, Mycobacterium
EDTMNVIGMIELKAVIIS

SEQ ID NO: 651437 - protein, 24 aa, Mycobacterium
EDTYRIATTLAVFLAENRSRTRAA

SEQ ID NO: 651438 - protein, 25 aa, Mycobacterium
EDVAARLRLLIAWTGEHLAETEVND

SEQ ID NO: 651439 - protein, 20 aa, Mycobacterium
EDVAEIIAFVASRPPHVNLD

SEQ ID NO: 651440 - protein, 21 aa, Mycobacterium
EDVAKLSYYGLYALQHRGQEA

SEQ ID NO: 651441 - protein, 34 aa, Mycobacterium
EDVASSWQRLVPWPDVPAGLAALRMRAVVATLSN

SEQ ID NO: 651442 - protein, 25 aa, Mycobacterium
EDVAVLKLSALRGLFSSVIEDQVTF

SEQ ID NO: 651443 - protein, 18 aa, Mycobacterium
EDVCRKILGGNAGRLYRF

SEQ ID NO: 651444 - protein, 18 aa, Mycobacterium
EDVDIVLELMGPVEPARK

SEQ ID NO: 651445 - protein, 19 aa, Mycobacterium
EDVDLALLYDGFTFNCVSW

SEQ ID NO: 651446 - protein, 23 aa, Mycobacterium
EDVDPRVSLAIGGLAVIEGPAPD

SEQ ID NO: 651447 - protein, 23 aa, Mycobacterium
EDVDPRVSLAIGGLAVIEGPVPE

SEQ ID NO: 651448 - protein, 25 aa, Mycobacterium
EDVDVAYLRCLRVLMEGDGYPMVAS

SEQ ID NO: 651449 - protein, 24 aa, Mycobacterium
EDVDWKLSLCSYALPLEDDGTIDI

SEQ ID NO: 651450 - protein, 29 aa, Mycobacterium
EDVEILKLSALRGLFSAVVDEQVTFVNAP

SEQ ID NO: 651451 - protein, 28 aa, Mycobacterium
EDVEVLKLSALRGLFSAVVEGPVTFVNA

SEQ ID NO: 651452 - protein, 19 aa, Mycobacterium
EDVGLPLTFTLVVANSGDP

SEQ ID NO: 651453 - protein, 25 aa, Mycobacterium
EDVHRAGGIPAILGELHRAGLLAKD

SEQ ID NO: 651454 - protein, 23 aa, Mycobacterium
EDVKPRLLGHWGTTPGLNFLYAH

SEQ ID NO: 651455 - protein, 17 aa, Mycobacterium
EDVLDVWFDSGSMPYAQ

SEQ ID NO: 651456 - protein, 17 aa, Mycobacterium
EDVLDVWFDSGSMPYGQ

SEQ ID NO: 651457 - protein, 18 aa, Mycobacterium
EDVNRNFAGVYAYLRANP

SEQ ID NO: 651458 - protein, 17 aa, Mycobacterium
EDVNSWVGAEGFYQLGE

SEQ ID NO: 651459 - protein, 23 aa, Mycobacterium
EDVPATGTALIFGQAQRAEASLG

SEQ ID NO: 651460 - protein, 25 aa, Mycobacterium
EDVPLKRFDLMNGIQVRGTYAVSQA

SEQ ID NO: 651461 - protein, 18 aa, Mycobacterium
EDVRARIGVLSQVPGLWA

SEQ ID NO: 651462 - protein, 20 aa, Mycobacterium
EDVRARIGVLSQVPSLWTEF

SEQ ID NO: 651463 - protein, 24 aa, Mycobacterium
EDVRGRVGLPITVGVARTKFLAKV

SEQ ID NO: 651464 - protein, 17 aa, Mycobacterium
EDVRGWLTVVASRLCLD

SEQ ID NO: 651465 - protein, 17 aa, Mycobacterium
EDVRPGDLLGVAATGAY

SEQ ID NO: 651466 - protein, 19 aa, Mycobacterium
EDVRRKALRLMASSLSPQG

SEQ ID NO: 651467 - protein, 17 aa, Mycobacterium
EDVRRTGATLVHPYDDL

SEQ ID NO: 651468 - protein, 22 aa, Mycobacterium
EDVRRYGATYANYVGKPLSYIL

SEQ ID NO: 651469 - protein, 20 aa, Mycobacterium
EDVRYLGSWPRGTTAPTGAN

SEQ ID NO: 651470 - protein, 20 aa, Mycobacterium
EDVSAAIAYLVSDEAKYVTG

SEQ ID NO: 651471 - protein, 18 aa, Mycobacterium
EDVTPFVLSLRFVVIALT

SEQ ID NO: 651472 - protein, 20 aa, Mycobacterium
EDVVALLACHQFQDAVVRVV

SEQ ID NO: 651473 - protein, 19 aa, Mycobacterium
EDVVRRRGPDLVELSHAIH

SEQ ID NO: 651474 - protein, 18 aa, Mycobacterium
EDVVWKASLGELPRQVLG

SEQ ID NO: 651475 - protein, 19 aa, Mycobacterium
EDVYFPTLSSRTMVYKGML

SEQ ID NO: 651476 - protein, 18 aa, Mycobacterium
EDVYVPWVPHLDGRDEFR

SEQ ID NO: 651477 - protein, 17 aa, Mycobacterium
EDWGAGFAKSVAVFLNG

SEQ ID NO: 651478 - protein, 34 aa, Mycobacterium
EDWMACTYHGRILWRPGALPAFSDDRWELYDLSR

SEQ ID NO: 651479 - protein, 20 aa, Mycobacterium
EDWMFSYGWHALDAVADTAR

SEQ ID NO: 651480 - protein, 22 aa, Mycobacterium
EDWMTRLVLGFGSAVRVLEPES

SEQ ID NO: 651481 - protein, 22 aa, Mycobacterium
EDWMTRLVLGLGPAVRVLAPES

SEQ ID NO: 651482 - protein, 23 aa, Mycobacterium
EDWNGGFPTDWGVSAHPKVDDRT

SEQ ID NO: 651483 - protein, 27 aa, Mycobacterium
EDWPVMPVDVVSFWLKPFGFFDRNPAL

SEQ ID NO: 651484 - protein, 30 aa, Mycobacterium
EDWQRFSLWADDVFKAFSFTADLTEVEPVV

SEQ ID NO: 651485 - protein, 18 aa, Mycobacterium
EDWWGRWLGRWTAEEHLH

SEQ ID NO: 651486 - protein, 19 aa, Mycobacterium
EDWWGRWLGRWTAEEHLHA

SEQ ID NO: 651487 - protein, 23 aa, Mycobacterium
EDYARLAISSGLVPDAWETTYVH

SEQ ID NO: 651488 - protein, 20 aa, Mycobacterium
EDYDARWKRLAASGASVHGE

SEQ ID NO: 651489 - protein, 21 aa, Mycobacterium
EDYLRYFACTPRFGSHRGGFR

SEQ ID NO: 651490 - protein, 24 aa, Mycobacterium
EDYPGCWRHGDWVVATERGSFVIQ

SEQ ID NO: 651491 - protein, 17 aa, Mycobacterium
EDYPQFQRWSISLLSWI

SEQ ID NO: 651492 - protein, 23 aa, Mycobacterium
EDYTVKDLRTWHGTVLAAEAFVD

SEQ ID NO: 651493 - protein, 18 aa, Mycobacterium
EDYWGRWLGRWTAEEHLH

SEQ ID NO: 651494 - protein, 18 aa, Mycobacterium
EEAAAALAARFPDLRQVH

SEQ ID NO: 651495 - protein, 22 aa, Mycobacterium
EEAAEFFAPISSIHRYLKTLVD

SEQ ID NO: 651496 - protein, 20 aa, Mycobacterium
EEAARGCVDLALERFGSVDI

SEQ ID NO: 651497 - protein, 19 aa, Mycobacterium
EEAARIAATAKREYEASTG

SEQ ID NO: 651498 - protein, 18 aa, Mycobacterium
EEAARRCVDMTLERFGTL

SEQ ID NO: 651499 - protein, 20 aa, Mycobacterium
EEACALNLVTWVVSAEEIDA

SEQ ID NO: 651500 - protein, 19 aa, Mycobacterium
EEACTLAVLIERAAKLQLA

SEQ ID NO: 651501 - protein, 22 aa, Mycobacterium
EEADALPGLMVKAERNGYRDCD

SEQ ID NO: 651502 - protein, 22 aa, Mycobacterium
EEADRLSARLAKIEAAQRDHDQ

SEQ ID NO: 651503 - protein, 20 aa, Mycobacterium
EEADTEWLRGILASHVDATD

SEQ ID NO: 651504 - protein, 23 aa, Mycobacterium
EEAEARLVLDWAEPLRHPTFYKA

SEQ ID NO: 651505 - protein, 25 aa, Mycobacterium
EEAFGRWKALGAKFVEVRPMSQLRW

SEQ ID NO: 651506 - protein, 18 aa, Mycobacterium
EEAFRLANDSEYGLSAAI

SEQ ID NO: 651507 - protein, 25 aa, Mycobacterium
EEAGDLRAAFTWHMRAGTWLTNRDI

SEQ ID NO: 651508 - protein, 22 aa, Mycobacterium
EEAGRCQRGYFVESLGGAQFAV

SEQ ID NO: 651509 - protein, 25 aa, Mycobacterium
EEAGRRCVLVPGDLADPAHCRAVID

SEQ ID NO: 651510 - protein, 17 aa, Mycobacterium
EEAGWDAIFGWEPVWGV

SEQ ID NO: 651511 - protein, 21 aa, Mycobacterium
EEAHFPGDFIVEYIGQTRGWF

SEQ ID NO: 651512 - protein, 20 aa, Mycobacterium
EEAIASFARLWVADPHWQAA

SEQ ID NO: 651513 - protein, 24 aa, Mycobacterium
EEAIEFHKAGTLVRADGELNREGR

SEQ ID NO: 651514 - protein, 21 aa, Mycobacterium
EEAIRCFERALALDPELAIAR

SEQ ID NO: 651515 - protein, 24 aa, Mycobacterium
EEAKQWPGVEVRVIPAMTAAQAVA

SEQ ID NO: 651516 - protein, 17 aa, Mycobacterium
EEALAAVGARAAAVTAD

SEQ ID NO: 651517 - protein, 27 aa, Mycobacterium
EEALERSRRALAEFTVEGLATVIPFHR

SEQ ID NO: 651518 - protein, 24 aa, Mycobacterium
EEALFYRPVHPLLGQPVRAVHPTW

SEQ ID NO: 651519 - protein, 27 aa, Mycobacterium
EEALRDWLFRVTWALRIWHDLPNCIAT

SEQ ID NO: 651520 - protein, 31 aa, Mycobacterium
EEALRLTTDYLKSRKQFGVTLSKFQTLTQRA

SEQ ID NO: 651521 - protein, 27 aa, Mycobacterium
EEALVRYGLDMCDVWCRQGRGDTCAAT

SEQ ID NO: 651522 - protein, 26 aa, Mycobacterium
EEALVRYGLVVCEEWIARGHQDASTA

SEQ ID NO: 651523 - protein, 18 aa, Mycobacterium
EEAMPFPPAEYGRLRDLA

SEQ ID NO: 651524 - protein, 18 aa, Mycobacterium
EEAMRIAASAKREYEASI

SEQ ID NO: 651525 - protein, 19 aa, Mycobacterium
EEANALLREFVGMTLNLPT

SEQ ID NO: 651526 - protein, 21 aa, Mycobacterium
EEANPALGVRGIRIAEANPGL

SEQ ID NO: 651527 - protein, 22 aa, Mycobacterium
EEARAFTPRVVFVDSDNKQVEL

SEQ ID NO: 651528 - protein, 17 aa, Mycobacterium
EEARASLGKQVPHPSRL

SEQ ID NO: 651529 - protein, 19 aa, Mycobacterium
EEARTGLTAVETSWQQDKA

SEQ ID NO: 651530 - protein, 21 aa, Mycobacterium
EEASWRGAELVALHAWTDAEV

SEQ ID NO: 651531 - protein, 33 aa, Mycobacterium
EEATRVGMPYVNQRWLGGMLTNFSTVHKRLQRL

SEQ ID NO: 651532 - protein, 18 aa, Mycobacterium
EEAVFRIDHYLGKETVRN

SEQ ID NO: 651533 - protein, 18 aa, Mycobacterium
EEAWQALCAADLPGLAHP

SEQ ID NO: 651534 - protein, 24 aa, Mycobacterium
EEAWRASQVEMITWLGELYGLDRY

SEQ ID NO: 651535 - protein, 20 aa, Mycobacterium
EEAYKHLLGVRVIDRDIFET

SEQ ID NO: 651536 - protein, 20 aa, Mycobacterium
EEAYRLGMVSKIFRRDELAE

SEQ ID NO: 651537 - protein, 20 aa, Mycobacterium
EEAYRLGMVSKVFPADELAD

SEQ ID NO: 651538 - protein, 24 aa, Mycobacterium
EECKQLNPRIVWASGTGFGETGPY

SEQ ID NO: 651539 - protein, 34 aa, Mycobacterium
EECSGRLRKLFHAVGVVFKGSGFYRTDSREATKK

SEQ ID NO: 651540 - protein, 18 aa, Mycobacterium
EECVHWGYAAALMCAKSL

SEQ ID NO: 651541 - protein, 22 aa, Mycobacterium
EEDAAAMARRMRSICDQLADFP

SEQ ID NO: 651542 - protein, 19 aa, Mycobacterium
EEDAFAFSVVGDIGAFIRG

SEQ ID NO: 651543 - protein, 27 aa, Mycobacterium
EEDAVFGVFCRRWGVPLIDGGTVRLPR

SEQ ID NO: 651544 - protein, 28 aa, Mycobacterium
EEDAVFGVFCRRWGVPLIDGGTVRLPRL

SEQ ID NO: 651545 - protein, 29 aa, Mycobacterium
EEDAVLGVFCRRWGVPLIDGGTIRLPRLI

SEQ ID NO: 651546 - protein, 17 aa, Mycobacterium
EEDEFSFDFDLLDATKI

SEQ ID NO: 651547 - protein, 17 aa, Mycobacterium
EEDESWFEGMTVDEREV

SEQ ID NO: 651548 - protein, 23 aa, Mycobacterium
EEDLRITRELGVRRASQGVESEK

SEQ ID NO: 651549 - protein, 17 aa, Mycobacterium
EEDRVLAIVPMFHANAW

SEQ ID NO: 651550 - protein, 23 aa, Mycobacterium
EEEAKEALAVFDTCPVIERALVK

SEQ ID NO: 651551 - protein, 23 aa, Mycobacterium
EEEITRVVPFIEWLRSTFPDRLI

SEQ ID NO: 651552 - protein, 23 aa, Mycobacterium
EEFARAGYDYVGFDTQHGYLDDA

SEQ ID NO: 651553 - protein, 21 aa, Mycobacterium
EEFARRFAVQVEDGFGSTENA

SEQ ID NO: 651554 - protein, 17 aa, Mycobacterium
EEFDPFWQACVKAGIPV

SEQ ID NO: 651555 - protein, 24 aa, Mycobacterium
EEFEAWKYGMADSYDDQGNYIFPE

SEQ ID NO: 651556 - protein, 19 aa, Mycobacterium
EEFGAGVAVIGRPAYTPAG

SEQ ID NO: 651557 - protein, 24 aa, Mycobacterium
EEFGISRFKVARMLDEALGSGMVE

SEQ ID NO: 651558 - protein, 17 aa, Mycobacterium
EEFGRLDVVVANAGVLG

SEQ ID NO: 651559 - protein, 18 aa, Mycobacterium
EEFHISSIPIKVQLQQTI

SEQ ID NO: 651560 - protein, 20 aa, Mycobacterium
EEFHPLLSCSACEKEANPGE

SEQ ID NO: 651561 - protein, 17 aa, Mycobacterium
EEFKIAVDQYLAAVEEA

SEQ ID NO: 651562 - protein, 24 aa, Mycobacterium
EEFLEIRGSLLPDDERLLAQQWLS

SEQ ID NO: 651563 - protein, 17 aa, Mycobacterium
EEFLRFFTPAPGDGRTF

SEQ ID NO: 651564 - protein, 19 aa, Mycobacterium
EEFNRLAAQLVEAGTLKKL

SEQ ID NO: 651565 - protein, 26 aa, Mycobacterium
EEFPWLKSRLPSLWTNSYFVATVGGA

SEQ ID NO: 651566 - protein, 24 aa, Mycobacterium
EEFQSRWAPSIVVGLGRLAGRTVG

SEQ ID NO: 651567 - protein, 18 aa, Mycobacterium
EEFRHWMEGPALPPPGVG

SEQ ID NO: 651568 - protein, 18 aa, Mycobacterium
EEFRSWWSDHTVKQRTVG

SEQ ID NO: 651569 - protein, 23 aa, Mycobacterium
EEFTVKDLRTWHGTVLAAAAFAD

SEQ ID NO: 651570 - protein, 20 aa, Mycobacterium
EEFYLFGCCHHIVLDGLGMA

SEQ ID NO: 651571 - protein, 23 aa, Mycobacterium
EEGADIILFDICHDIETNEYPLA

SEQ ID NO: 651572 - protein, 23 aa, Mycobacterium
EEGADLILLDICESIPEIEYPLA

SEQ ID NO: 651573 - protein, 28 aa, Mycobacterium
EEGDRGLSWLPFFHDMGLITALLAPMIG

SEQ ID NO: 651574 - protein, 24 aa, Mycobacterium
EEGELRPQLLDRFGLTVDVTASRD

SEQ ID NO: 651575 - protein, 24 aa, Mycobacterium
EEGESFAYIESWARGDVEKTRKTA

SEQ ID NO: 651576 - protein, 20 aa, Mycobacterium
EEGLLRLGAEAVEQRINEAL

SEQ ID NO: 651577 - protein, 18 aa, Mycobacterium
EEGLTCAILGVPVADLVE

SEQ ID NO: 651578 - protein, 23 aa, Mycobacterium
EEGMRIARGIAREIRRREPATLA

SEQ ID NO: 651579 - protein, 21 aa, Mycobacterium
EEGMVPKIEACLRAIDGGVPS

SEQ ID NO: 651580 - protein, 24 aa, Mycobacterium
EEGPHLHANWTWAASAMDREQISQ

SEQ ID NO: 651581 - protein, 21 aa, Mycobacterium
EEGRIPYDKPGRHRRIRLDAV

SEQ ID NO: 651582 - protein, 19 aa, Mycobacterium
EEGRPSLQYIDQSGRSEVS

SEQ ID NO: 651583 - protein, 34 aa, Mycobacterium
EEGSGFAIAQARLGPGRIHHCMRAIGAAERALAL

SEQ ID NO: 651584 - protein, 20 aa, Mycobacterium
EEHARFAHSRVREFVPLLVE

SEQ ID NO: 651585 - protein, 22 aa, Mycobacterium
EEHAYRATAILELCGEDDPAVD

SEQ ID NO: 651586 - protein, 25 aa, Mycobacterium
EEHGLPFTICRPFNAYGPGELPDTE

SEQ ID NO: 651587 - protein, 21 aa, Mycobacterium
EEHHVRAAKILGLAQDTADRL

SEQ ID NO: 651588 - protein, 34 aa, Mycobacterium
EEHLGAPGFEGAKWVCSTPLRSRAEHHQQHMWQG

SEQ ID NO: 651589 - protein, 19 aa, Mycobacterium
EEHRARVADFVLVVAPEKD

SEQ ID NO: 651590 - protein, 17 aa, Mycobacterium
EEHRPLWYLMPDGVVQY

SEQ ID NO: 651591 - protein, 23 aa, Mycobacterium
EEHRRDAEVWAHLIEQHGVTVLH

SEQ ID NO: 651592 - protein, 24 aa, Mycobacterium
EEHTQWPRWVPVGRMGQPEDQARV

SEQ ID NO: 651593 - protein, 18 aa, Mycobacterium
EEIAALKPDLIVATNAGL

SEQ ID NO: 651594 - protein, 22 aa, Mycobacterium
EEIARVVPFIEWLRGTFPDQVI

SEQ ID NO: 651595 - protein, 24 aa, Mycobacterium
EEIEALGFGALWVNGGQLDRLERL

SEQ ID NO: 651596 - protein, 26 aa, Mycobacterium
EEIEALRWALSIAEKGLAAGVAEVHA

SEQ ID NO: 651597 - protein, 20 aa, Mycobacterium
EEIEPLDFVFPYAVRSPDPR

SEQ ID NO: 651598 - protein, 22 aa, Mycobacterium
EEIEPRTGRHLGNFPQAFTHLA

SEQ ID NO: 651599 - protein, 18 aa, Mycobacterium
EEIFGPVGCVIPFDDEDE

SEQ ID NO: 651600 - protein, 22 aa, Mycobacterium
EEIGARLTRVFFEAWEQPDSRA

SEQ ID NO: 651601 - protein, 22 aa, Mycobacterium
EEILGRPVLDPDADFFRIGGHS

SEQ ID NO: 651602 - protein, 17 aa, Mycobacterium
EEILLELEVGWDDIARA

SEQ ID NO: 651603 - protein, 22 aa, Mycobacterium
EEILRFDGPVNIATWRYATADI

SEQ ID NO: 651604 - protein, 24 aa, Mycobacterium
EEILRYASPVIHFRRTVTRDGVTL

SEQ ID NO: 651605 - protein, 21 aa, Mycobacterium
EEINERVAVHLGKRSTEEWTT

SEQ ID NO: 651606 - protein, 27 aa, Mycobacterium
EEIPGAMARLGVWPGVGPQLDLHQPTF

SEQ ID NO: 651607 - protein, 26 aa, Mycobacterium
EEIPGAMARLGVWSGQGPQLDLHQPT

SEQ ID NO: 651608 - protein, 24 aa, Mycobacterium
EEIPHENLYGFAWNPMTLVGILKN

SEQ ID NO: 651609 - protein, 21 aa, Mycobacterium
EEIPPGFSHCMLLAEGRVVAA

SEQ ID NO: 651610 - protein, 21 aa, Mycobacterium
EEIPPGFSHCMLLSEGRVVAA

SEQ ID NO: 651611 - protein, 28 aa, Mycobacterium
EEIQIPVGPRLGSVVVEVEHLDKGFGGR

SEQ ID NO: 651612 - protein, 22 aa, Mycobacterium
EEIRAFWNPRTGYDMRGMSYAR

SEQ ID NO: 651613 - protein, 22 aa, Mycobacterium
EEIRDRHALSLDEAQRQDPVLK

SEQ ID NO: 651614 - protein, 34 aa, Mycobacterium
EEISRGGIPVQVLGFREHASWALASDTLEFVDLE

SEQ ID NO: 651615 - protein, 27 aa, Mycobacterium
EEISRTLGFWLQLGVAGFRVDAVPFLF

SEQ ID NO: 651616 - protein, 20 aa, Mycobacterium
EEITARFVVNCSGVLSRPKW

SEQ ID NO: 651617 - protein, 17 aa, Mycobacterium
EEITDWQLAANAEHTST

SEQ ID NO: 651618 - protein, 32 aa, Mycobacterium
EEITRFDPPYSFSYRVVKCMPPVRHEGGAVVL

SEQ ID NO: 651619 - protein, 24 aa, Mycobacterium
EEITTHYSPMAWLSVTHRKKGTGV

SEQ ID NO: 651620 - protein, 25 aa, Mycobacterium
EEIYARYQAFTSFTAHVRGPVDIDA

SEQ ID NO: 651621 - protein, 22 aa, Mycobacterium
EEKDDWDALDWGDDDPPDEVSS

SEQ ID NO: 651622 - protein, 25 aa, Mycobacterium
EEKFAGRIAAFIVRRRAVTPFTTTG

SEQ ID NO: 651623 - protein, 27 aa, Mycobacterium
EEKKLFCRMAEVFAGFLSYTDAQIGRI

SEQ ID NO: 651624 - protein, 24 aa, Mycobacterium
EEKLPRYIGGVLARLQEVWMGRQI

SEQ ID NO: 651625 - protein, 26 aa, Mycobacterium
EEKLVKICRLIMLYHLDRAWADHLAF

SEQ ID NO: 651626 - protein, 18 aa, Mycobacterium
EEKMPLGIADRMAGICAG

SEQ ID NO: 651627 - protein, 30 aa, Mycobacterium
EEKTRAKARLSWAGSTLVGVGVARLDPADP

SEQ ID NO: 651628 - protein, 23 aa, Mycobacterium
EELAKRGASLIGFDQSPRMVELA

SEQ ID NO: 651629 - protein, 24 aa, Mycobacterium
EELANYRGHWLVARTIEHIGGWAN

SEQ ID NO: 651630 - protein, 23 aa, Mycobacterium
EELAPAGGFLFIARGLGLPYASE

SEQ ID NO: 651631 - protein, 22 aa, Mycobacterium
EELARALGPGAAFRPTDVSDPE

SEQ ID NO: 651632 - protein, 17 aa, Mycobacterium
EELARGWMSLAGAMGGH

SEQ ID NO: 651633 - protein, 20 aa, Mycobacterium
EELARIDAAVARNGRPRSVI

SEQ ID NO: 651634 - protein, 17 aa, Mycobacterium
EELARTAGVTVLIHDQE

SEQ ID NO: 651635 - protein, 30 aa, Mycobacterium
EELAVRCELLRSAFAAVIARLDTFAPANHA

SEQ ID NO: 651636 - protein, 25 aa, Mycobacterium
EELDCDAVIYATGFMPARLDGILGD

SEQ ID NO: 651637 - protein, 24 aa, Mycobacterium
EELDEVALHFAVHYGWPKGSHLNQ

SEQ ID NO: 651638 - protein, 20 aa, Mycobacterium
EELDRLIARVKRFRDEQGKT

SEQ ID NO: 651639 - protein, 23 aa, Mycobacterium
EELDRRGATIFVHPSHLPGGSIP

SEQ ID NO: 651640 - protein, 20 aa, Mycobacterium
EELDRRLDVLAMAKVEAADD

SEQ ID NO: 651641 - protein, 20 aa, Mycobacterium
EELDRRLDVLAMAKVEATDD

SEQ ID NO: 651642 - protein, 18 aa, Mycobacterium
EELDSAGDLGDWAGPDAL

SEQ ID NO: 651643 - protein, 18 aa, Mycobacterium
EELEELTHYFAPRQPGES

SEQ ID NO: 651644 - protein, 22 aa, Mycobacterium
EELEFEAAIGRNVRQLRQQHGL

SEQ ID NO: 651645 - protein, 25 aa, Mycobacterium
EELEGARGLYQWGPPPPASFLHPED

SEQ ID NO: 651646 - protein, 25 aa, Mycobacterium
EELEGFCSASLMLDRATGRAVSSTT

SEQ ID NO: 651647 - protein, 20 aa, Mycobacterium
EELEQAFIRIGHEVEEIIPA

SEQ ID NO: 651648 - protein, 22 aa, Mycobacterium
EELFKPGLIFLSAATRHIVSGD

SEQ ID NO: 651649 - protein, 17 aa, Mycobacterium
EELGARLFAIWESTPYN

SEQ ID NO: 651650 - protein, 17 aa, Mycobacterium
EELGDRVAIYAFRSHGR

SEQ ID NO: 651651 - protein, 22 aa, Mycobacterium
EELGDRVAVYAFWSHGRRAVHL

SEQ ID NO: 651652 - protein, 17 aa, Mycobacterium
EELGEFIESCFELNLTD

SEQ ID NO: 651653 - protein, 20 aa, Mycobacterium
EELGLDWLVEIGAHGVVAGP

SEQ ID NO: 651654 - protein, 22 aa, Mycobacterium
EELGLTWLCEIGAHGVAAGPDS

SEQ ID NO: 651655 - protein, 20 aa, Mycobacterium
EELGQGLLLVAVGASRSLED

SEQ ID NO: 651656 - protein, 26 aa, Mycobacterium
EELGRALACLPWISSAALGATALVSS

SEQ ID NO: 651657 - protein, 25 aa, Mycobacterium
EELGRRCLPIILDVRAPAQVSAAVE

SEQ ID NO: 651658 - protein, 17 aa, Mycobacterium
EELHAVKWSQFKINFKR

SEQ ID NO: 651659 - protein, 25 aa, Mycobacterium
EELHFGRAAERLHMAQPPLSQQIRQ

SEQ ID NO: 651660 - protein, 19 aa, Mycobacterium
EELHHSAAMLHEIAQDLKT

SEQ ID NO: 651661 - protein, 20 aa, Mycobacterium
EELHSVTVIDRFDEVLRPTW

SEQ ID NO: 651662 - protein, 27 aa, Mycobacterium
EELIAWCRERMAGFKVPRSVEFLDVLP

SEQ ID NO: 651663 - protein, 19 aa, Mycobacterium
EELICAFERSVGLRAPLTE

SEQ ID NO: 651664 - protein, 20 aa, Mycobacterium
EELIENLFLPAFDTADAGPA

SEQ ID NO: 651665 - protein, 20 aa, Mycobacterium
EELKAAKVLQAIGFAPNVEG

SEQ ID NO: 651666 - protein, 17 aa, Mycobacterium
EELKARVLPGVAAGEVL

SEQ ID NO: 651667 - protein, 23 aa, Mycobacterium
EELKELRKTAPIWWQEQPDGVGG

SEQ ID NO: 651668 - protein, 34 aa, Mycobacterium
EELLAESAIALPDKEVVSILDLNADVDVAIDAAS

SEQ ID NO: 651669 - protein, 23 aa, Mycobacterium
EELLCDRHKVAIVHQPVLAETAE

SEQ ID NO: 651670 - protein, 18 aa, Mycobacterium
EELLECWTAASLGIHHKP

SEQ ID NO: 651671 - protein, 19 aa, Mycobacterium
EELLPMLAAMGMDTSRVGF

SEQ ID NO: 651672 - protein, 21 aa, Mycobacterium
EELLRGADMVFVTAGEGGGTG

SEQ ID NO: 651673 - protein, 25 aa, Mycobacterium
EELLRRIKALPGFGAVKAQIFLALL

SEQ ID NO: 651674 - protein, 19 aa, Mycobacterium
EELNRGDAVLVVGTEALAA

SEQ ID NO: 651675 - protein, 21 aa, Mycobacterium
EELRDPRLVRVRPILADVADF

SEQ ID NO: 651676 - protein, 17 aa, Mycobacterium
EELREELILEVGSPRAI

SEQ ID NO: 651677 - protein, 17 aa, Mycobacterium
EELRLKKTVARLATYLQ

SEQ ID NO: 651678 - protein, 22 aa, Mycobacterium
EELRNSLVDQVRRLKSVQQAEQ

SEQ ID NO: 651679 - protein, 21 aa, Mycobacterium
EELRPHLGTLVDAFGIPEALL

SEQ ID NO: 651680 - protein, 23 aa, Mycobacterium
EELRPRIVTIVDELLDAMLAGPM

SEQ ID NO: 651681 - protein, 17 aa, Mycobacterium
EELRTHFNWSASRGASR

SEQ ID NO: 651682 - protein, 26 aa, Mycobacterium
EELRVPRFLWEVGFAAFEIARRHRFH

SEQ ID NO: 651683 - protein, 17 aa, Mycobacterium
EELRYSADRTMAAEDPD

SEQ ID NO: 651684 - protein, 25 aa, Mycobacterium
EELSFLRPLPVQALWGVGSVTAEKL

SEQ ID NO: 651685 - protein, 21 aa, Mycobacterium
EELSGRFGGVVVKSTGDGHLS

SEQ ID NO: 651686 - protein, 26 aa, Mycobacterium
EELTDLLWRMGIRTIGQFAALSATDV

SEQ ID NO: 651687 - protein, 26 aa, Mycobacterium
EELTDLLWRMGIRTIGQFAALSRSDV

SEQ ID NO: 651688 - protein, 27 aa, Mycobacterium
EELWDLLPGYLVFRSLLPVRSPTADTV

SEQ ID NO: 651689 - protein, 19 aa, Mycobacterium
EELWQRLGHTTSLAHGPFP

SEQ ID NO: 651690 - protein, 22 aa, Mycobacterium
EEMAAKLAGFGYVVLVPDVYYR

SEQ ID NO: 651691 - protein, 18 aa, Mycobacterium
EEMARIGLNVDALQIQSI

SEQ ID NO: 651692 - protein, 23 aa, Mycobacterium
EEMESRFSAAWALLSAGDEGDLD

SEQ ID NO: 651693 - protein, 24 aa, Mycobacterium
EEMGIDVFLVMPFTSDFMKLTPER

SEQ ID NO: 651694 - protein, 24 aa, Mycobacterium
EEMGRALVCSPFFATVALATQAIL

SEQ ID NO: 651695 - protein, 31 aa, Mycobacterium
EEMHAKCPMAWSDAYGGHWVAAGSHEVFELA

SEQ ID NO: 651696 - protein, 29 aa, Mycobacterium
EEMHAKCPMAWSETYNGHWVAADSKHVFE

SEQ ID NO: 651697 - protein, 30 aa, Mycobacterium
EEMHARCPMAWSDTYGGHWVAAGSHEVFEL

SEQ ID NO: 651698 - protein, 26 aa, Mycobacterium
EEMHESGCPGGVFASLFTSGIAVPHM

SEQ ID NO: 651699 - protein, 26 aa, Mycobacterium
EEMIRFCAPAQWFARTVRKPFTLHGT

SEQ ID NO: 651700 - protein, 17 aa, Mycobacterium
EEMKRFPEELGKMGFVF

SEQ ID NO: 651701 - protein, 17 aa, Mycobacterium
EEMKVAAAHAIFSVVGD

SEQ ID NO: 651702 - protein, 32 aa, Mycobacterium
EEMLEMAACGAKVLMLRCVEYARRYNIPVHVR

SEQ ID NO: 651703 - protein, 21 aa, Mycobacterium
EEMPPEQVVLITTGTQGEPMS

SEQ ID NO: 651704 - protein, 22 aa, Mycobacterium
EEMSLQLAPRMIRVNGIHPTNC

SEQ ID NO: 651705 - protein, 22 aa, Mycobacterium
EEMWAADVAAMVGYHGGASAAA

SEQ ID NO: 651706 - protein, 21 aa, Mycobacterium
EEMWALDVAVMAAYHSGASTV

SEQ ID NO: 651707 - protein, 27 aa, Mycobacterium
EEMWARDVSAMFGYHVGVSQAWSQLFP

SEQ ID NO: 651708 - protein, 18 aa, Mycobacterium
EEMYKYLVTQSRNPEHDK

SEQ ID NO: 651709 - protein, 26 aa, Mycobacterium
EENRGAPRPVLRVAPLSVAGLLRQRV

SEQ ID NO: 651710 - protein, 20 aa, Mycobacterium
EENRHGIAIRDYLVVTRSVD

SEQ ID NO: 651711 - protein, 17 aa, Mycobacterium
EENRHSIAIRDYLVVTR

SEQ ID NO: 651712 - protein, 19 aa, Mycobacterium
EEPACRPAEIFATNNTAVS

SEQ ID NO: 651713 - protein, 21 aa, Mycobacterium
EEPARLLSQFIHGIKRLPVAW

SEQ ID NO: 651714 - protein, 17 aa, Mycobacterium
EEPDSYLAYGFAVHNCT

SEQ ID NO: 651715 - protein, 23 aa, Mycobacterium
EEPEAFTACVGLGVRGLIPEIAA

SEQ ID NO: 651716 - protein, 25 aa, Mycobacterium
EEPIAVVGMGCRFPGGISGPEALWQ

SEQ ID NO: 651717 - protein, 21 aa, Mycobacterium
EEPILRPGSWIGGDRDGNPNV

SEQ ID NO: 651718 - protein, 20 aa, Mycobacterium
EEPKGVSVFAWKGETLEEYW

SEQ ID NO: 651719 - protein, 26 aa, Mycobacterium
EEPMIFYRDPMRLMTHLGEKHGVEAV

SEQ ID NO: 651720 - protein, 22 aa, Mycobacterium
EEPPEVRTLYSFEPDATTLFES

SEQ ID NO: 651721 - protein, 21 aa, Mycobacterium
EEPQGTPVFAWKGETLEEYWW

SEQ ID NO: 651722 - protein, 22 aa, Mycobacterium
EEPRAAGDTVILGSDEDFWVQV

SEQ ID NO: 651723 - protein, 17 aa, Mycobacterium
EEPRAAVIARLRTPLGT

SEQ ID NO: 651724 - protein, 17 aa, Mycobacterium
EEPRAAVIGRFDTPLGE

SEQ ID NO: 651725 - protein, 24 aa, Mycobacterium
EEPRKEWQLQFTIGSAPRSSSVVA

SEQ ID NO: 651726 - protein, 23 aa, Mycobacterium
EEPTLLRPALRGSDAVLSAVGPR

SEQ ID NO: 651727 - protein, 24 aa, Mycobacterium
EEPWNRPLFAAPHRLNGNGELTGQ

SEQ ID NO: 651728 - protein, 23 aa, Mycobacterium
EEQAGAILFLLSEMSSYITGQTL

SEQ ID NO: 651729 - protein, 20 aa, Mycobacterium
EEQARRLVIRGFFGEIISKI

SEQ ID NO: 651730 - protein, 20 aa, Mycobacterium
EEQKRIALETIADVDASGLW

SEQ ID NO: 651731 - protein, 28 aa, Mycobacterium
EEQKRRWAVPILRAEMTASLGMSEPGAG

SEQ ID NO: 651732 - protein, 19 aa, Mycobacterium
EEQRLPVAPTVNGACELLG

SEQ ID NO: 651733 - protein, 27 aa, Mycobacterium
EEQRRWAAEGVERGWAATMVLTEPDAG

SEQ ID NO: 651734 - protein, 24 aa, Mycobacterium
EEQRTTGYTGWRKAVERTLDWVDV

SEQ ID NO: 651735 - protein, 17 aa, Mycobacterium
EEQSLPGPDGWQVVGSA

SEQ ID NO: 651736 - protein, 27 aa, Mycobacterium
EERAKFGLPEVKRGLIAGAGGVFRIVE

SEQ ID NO: 651737 - protein, 31 aa, Mycobacterium
EERALRTWLLRRLEESRFWFDAQGRPNPKSL

SEQ ID NO: 651738 - protein, 18 aa, Mycobacterium
EERARFAERFGAVATIAV

SEQ ID NO: 651739 - protein, 20 aa, Mycobacterium
EERDAAFAVLRAENPVPWSR

SEQ ID NO: 651740 - protein, 18 aa, Mycobacterium
EERDRWWSDYAGLAPTAV

SEQ ID NO: 651741 - protein, 17 aa, Mycobacterium
EEREIIYRMGVKPPEPK

SEQ ID NO: 651742 - protein, 38 aa, Mycobacterium
EERGLRWIDHSMFFPQRFRSPLSIAFPFVSTHNHFALD

SEQ ID NO: 651743 - protein, 18 aa, Mycobacterium
EERIKLLIATKCKGEKAP

SEQ ID NO: 651744 - protein, 25 aa, Mycobacterium
EERLDDLRLFAGLVGAAGVYATQKT

SEQ ID NO: 651745 - protein, 30 aa, Mycobacterium
EERLPKPGVWPLCHSLAFDASVWEISNALL

SEQ ID NO: 651746 - protein, 21 aa, Mycobacterium
EERLRAVSEWADFAERPRVVA

SEQ ID NO: 651747 - protein, 24 aa, Mycobacterium
EERLYYRKMHPWVPAEPWAPGDLG

SEQ ID NO: 651748 - protein, 23 aa, Mycobacterium
EERRGTWRAAWREHAHSQQSLHQ

SEQ ID NO: 651749 - protein, 18 aa, Mycobacterium
EERRLLVAAMGRARRRLL

SEQ ID NO: 651750 - protein, 17 aa, Mycobacterium
EERSAMITTVFERMGFD

SEQ ID NO: 651751 - protein, 18 aa, Mycobacterium
EERTAAIAEGGWVQPHLP

SEQ ID NO: 651752 - protein, 19 aa, Mycobacterium
EERVNLLIVPYATYSGLAL

SEQ ID NO: 651753 - protein, 35 aa, Mycobacterium
EESALFAADLARMYIRYAERHGWKVTVLDETESDL

SEQ ID NO: 651754 - protein, 29 aa, Mycobacterium
EESALFAADLARMYIRYAERHGWNVTVLD

SEQ ID NO: 651755 - protein, 30 aa, Mycobacterium
EESALFAADLARMYIRYAERHGWTVTLLDE

SEQ ID NO: 651756 - protein, 31 aa, Mycobacterium
EESALFAADLARMYIRYAERHGWTVTMLGET

SEQ ID NO: 651757 - protein, 30 aa, Mycobacterium; identical to SEQ ID NO: 79199

SEQ ID NO: 651758 - protein, 34 aa, Mycobacterium
EESALFAADLARMYIRYAERRGWTVTVLDETTSD

SEQ ID NO: 651759 - protein, 24 aa, Mycobacterium
EESARRVVVASFFHELGHMLIDIY

SEQ ID NO: 651760 - protein, 19 aa, Mycobacterium
EESEFAVLGRQVAVGGQVL

SEQ ID NO: 651761 - protein, 26 aa, Mycobacterium
EESEPPHRLVLCARLGPMGAARITML

SEQ ID NO: 651762 - protein, 20 aa, Mycobacterium
EESFRINGKVFMRVGLEEHE

SEQ ID NO: 651763 - protein, 17 aa, Mycobacterium
EESGMALARSFFTPLGA

SEQ ID NO: 651764 - protein, 21 aa, Mycobacterium
EESIRLRGIMSHFAYADQPGH

SEQ ID NO: 651765 - protein, 23 aa, Mycobacterium
EESIYGWKEYELELMRDGRDNVV

SEQ ID NO: 651766 - protein, 24 aa, Mycobacterium
EESKRFCWNCGKPVGRSTTDSPAQ

SEQ ID NO: 651767 - protein, 22 aa, Mycobacterium
EESLEAFDVLFANGVDAPLTDA

SEQ ID NO: 651768 - protein, 18 aa, Mycobacterium
EESMGLIKECARRFPGGQ

SEQ ID NO: 651769 - protein, 23 aa, Mycobacterium
EESRLEVTGVFVAIGHDPRSELV

SEQ ID NO: 651770 - protein, 28 aa, Mycobacterium
EESRLRAMCAARGLPAVRIGVVDQASDD

SEQ ID NO: 651771 - protein, 17 aa, Mycobacterium
EESRSGKLYSYGPDGTL

SEQ ID NO: 651772 - protein, 21 aa, Mycobacterium
EESRTGAPVTNTWLADQLNLD

SEQ ID NO: 651773 - protein, 17 aa, Mycobacterium
EESVFRIDHYLGKETVQ

SEQ ID NO: 651774 - protein, 29 aa, Mycobacterium
EESWETGPYLRFAPRMLGAVRERFGFDVH

SEQ ID NO: 651775 - protein, 20 aa, Mycobacterium
EESYHTFSYSPLRDDDGAVV

SEQ ID NO: 651776 - protein, 22 aa, Mycobacterium
EETCPACRAAITAESRQRRGYQ

SEQ ID NO: 651777 - protein, 24 aa, Mycobacterium
EETELPRNCLLIFGQEGPGITPEA

SEQ ID NO: 651778 - protein, 31 aa, Mycobacterium
EETFLFPPLRKAGIMKPIFVMLGEHGQLWRT

SEQ ID NO: 651779 - protein, 23 aa, Mycobacterium
EETGLRAAHLVKLGLLDVAAGMS

SEQ ID NO: 651780 - protein, 20 aa, Mycobacterium
EETHPLWIVRRTMIDMVEPI

SEQ ID NO: 651781 - protein, 19 aa, Mycobacterium
EETHPLWIVRRTMIDVIKP

SEQ ID NO: 651782 - protein, 17 aa, Mycobacterium
EETHPLWIVRRTMVDMI

SEQ ID NO: 651783 - protein, 17 aa, Mycobacterium
EETLQICAQMWDPADNG

SEQ ID NO: 651784 - protein, 18 aa, Mycobacterium
EETMKLPRTILMYPMTLA

SEQ ID NO: 651785 - protein, 22 aa, Mycobacterium
EETQPLVICDLGMPRDVDPAVA

SEQ ID NO: 651786 - protein, 23 aa, Mycobacterium
EETRAVFTDGWFHTGDLGAIDDD

SEQ ID NO: 651787 - protein, 20 aa, Mycobacterium
EETRFPVAVRSDLPDKRPDI

SEQ ID NO: 651788 - protein, 25 aa, Mycobacterium
EETRKRWDRYAAFAQKTFNVEIPAI

SEQ ID NO: 651789 - protein, 25 aa, Mycobacterium
EETRYWYYALRGCGLNRYRAGSGQP

SEQ ID NO: 651790 - protein, 20 aa, Mycobacterium
EETSAICDRMLDLGVVIQPT

SEQ ID NO: 651791 - protein, 17 aa, Mycobacterium
EETWTRDGVSRTPVIPS

SEQ ID NO: 651792 - protein, 23 aa, Mycobacterium
EEVAERCRPVFATYADPIVHLGP

SEQ ID NO: 651793 - protein, 29 aa, Mycobacterium
EEVAPWLDLACKLGVLAAALSDEPPVSLS

SEQ ID NO: 651794 - protein, 25 aa, Mycobacterium
EEVAPWLDLVRKLGVLAAALSDGAP

SEQ ID NO: 651795 - protein, 25 aa, Mycobacterium
EEVAPWLDLVRKLGVLAASLSDGPP

SEQ ID NO: 651796 - protein, 25 aa, Mycobacterium
EEVAPWLDLVRKLGVLAATLSDGPP

SEQ ID NO: 651797 - protein, 23 aa, Mycobacterium
EEVAVHWGRLCARLQPEQVVALA

SEQ ID NO: 651798 - protein, 19 aa, Mycobacterium
EEVCVTCSDEGRLGEVVAV

SEQ ID NO: 651799 - protein, 19 aa, Mycobacterium
EEVCVTCSDEGRLGEVVSA

SEQ ID NO: 651800 - protein, 20 aa, Mycobacterium
EEVDPAVALKAELRSKPGEW

SEQ ID NO: 651801 - protein, 28 aa, Mycobacterium
EEVEPLEVLFPGCEFLPLNDERRKIVDP

SEQ ID NO: 651802 - protein, 25 aa, Mycobacterium
EEVERRREISGGKRSFILVPGIDVP

SEQ ID NO: 651803 - protein, 22 aa, Mycobacterium
EEVERWAPCFGYQDVDPLEADL

SEQ ID NO: 651804 - protein, 19 aa, Mycobacterium
EEVGLPVTFSLVVGNVGEP

SEQ ID NO: 651805 - protein, 24 aa, Mycobacterium
EEVHEAVGVIVGWLAEADARARTA

SEQ ID NO: 651806 - protein, 19 aa, Mycobacterium
EEVIACAEAGIPVTVVPGV

SEQ ID NO: 651807 - protein, 17 aa, Mycobacterium
EEVKLAPTIEALGEVVR

SEQ ID NO: 651808 - protein, 19 aa, Mycobacterium
EEVLACADAGIPVTVVPGV

SEQ ID NO: 651809 - protein, 18 aa, Mycobacterium
EEVLACAEAGIPVTVVPG

SEQ ID NO: 651810 - protein, 20 aa, Mycobacterium
EEVLGFMFLMVIAGNETTTK

SEQ ID NO: 651811 - protein, 31 aa, Mycobacterium
EEVLGRALLVRRLDMLPVECVARGYLTGSGL

SEQ ID NO: 651812 - protein, 25 aa, Mycobacterium
EEVLRDFLDWLFGRYQQILDTATSP

SEQ ID NO: 651813 - protein, 22 aa, Mycobacterium
EEVLRWPPGTIARLRQGGSVPT

SEQ ID NO: 651814 - protein, 17 aa, Mycobacterium
EEVMAPLGPALVEATGI

SEQ ID NO: 651815 - protein, 28 aa, Mycobacterium
EEVMLGLRLRQGLPLAHLDAGERERAQA

SEQ ID NO: 651816 - protein, 20 aa, Mycobacterium
EEVMSARGLALVRDDSVTQA

SEQ ID NO: 651817 - protein, 23 aa, Mycobacterium
EEVPARVASLVERLKAAEKELER

SEQ ID NO: 651818 - protein, 23 aa, Mycobacterium
EEVPEAFPFLKACHHPVESDLES

SEQ ID NO: 651819 - protein, 18 aa, Mycobacterium
EEVPEVWHAVTSIFRDYG

SEQ ID NO: 651820 - protein, 24 aa, Mycobacterium
EEVPGAMARLGVWSGSGPQLDIHQ

SEQ ID NO: 651821 - protein, 25 aa, Mycobacterium
EEVPLKRFDLMNGIQIRGTYAVSQA

SEQ ID NO: 651822 - protein, 22 aa, Mycobacterium
EEVPPGFSHCLLLAEGQVVAAG

SEQ ID NO: 651823 - protein, 19 aa, Mycobacterium
EEVRAWIWKTMTSFPGNHM

SEQ ID NO: 651824 - protein, 25 aa, Mycobacterium
EEVRELMAELGFRTVNEMVGQVGAL

SEQ ID NO: 651825 - protein, 25 aa, Mycobacterium
EEVRELMAQLGFRTVNEMVGQVGAL

SEQ ID NO: 651826 - protein, 24 aa, Mycobacterium
EEVREYMAQLGFRTFNEAVGQVGS

SEQ ID NO: 651827 - protein, 24 aa, Mycobacterium
EEVREYMAQLGFRTINEAVGQAGA

SEQ ID NO: 651828 - protein, 24 aa, Mycobacterium
EEVREYMAQLGFRTLNEAIGQVKA

SEQ ID NO: 651829 - protein, 24 aa, Mycobacterium
EEVREYMAQLGFRTVNEAVGQVGA

SEQ ID NO: 651830 - protein, 21 aa, Mycobacterium
EEVRRYFGTKVLRTVIPRSVK

SEQ ID NO: 651831 - protein, 23 aa, Mycobacterium
EEVVLRLRALLRRTGVATATGGA

SEQ ID NO: 651832 - protein, 23 aa, Mycobacterium
EEVVLRLRALLRRTGVTTLDSGA

SEQ ID NO: 651833 - protein, 20 aa, Mycobacterium
EEVVLRLRALLRRTGVTTVD

SEQ ID NO: 651834 - protein, 18 aa, Mycobacterium
EEVVTARPLPGFDQAAID

SEQ ID NO: 651835 - protein, 21 aa, Mycobacterium
EEVYRALLTLQRRGVVRRVHD

SEQ ID NO: 651836 - protein, 25 aa, Mycobacterium
EEWGSRAIAVFGHRPYVGVSANLVA

SEQ ID NO: 651837 - protein, 21 aa, Mycobacterium
EEWMTRLMLGFGSDVQVLAPD

SEQ ID NO: 651838 - protein, 24 aa, Mycobacterium
EEYCKQRLGLDAALGAIDRSKLNV

SEQ ID NO: 651839 - protein, 22 aa, Mycobacterium
EEYCKQRLGLDAALGSIDRSKL

SEQ ID NO: 651840 - protein, 20 aa, Mycobacterium
EEYGLALARHFVDDVEPVAA

SEQ ID NO: 651841 - protein, 23 aa, Mycobacterium
EEYKEFYKHIAHAWDDPLEIIAM

SEQ ID NO: 651842 - protein, 23 aa, Mycobacterium
EEYKEFYKHIAHAWDDPLEVIAM

SEQ ID NO: 651843 - protein, 21 aa, Mycobacterium
EEYLAAAWKRLEEAYGSLSGF

SEQ ID NO: 651844 - protein, 17 aa, Mycobacterium
EEYLEVCYKLWEASWEP

SEQ ID NO: 651845 - protein, 19 aa, Mycobacterium
EEYLRDRLPVFTLNQLEGS

SEQ ID NO: 651846 - protein, 24 aa, Mycobacterium
EEYNALKAWLINVGEDGEWPLFLD

SEQ ID NO: 651847 - protein, 22 aa, Mycobacterium
EEYRPFRALIRAVLRHSGGVRI

SEQ ID NO: 651848 - protein, 27 aa, Mycobacterium
EEYSRRKHIEAGYEFVNTPHITKAQLF

SEQ ID NO: 651849 - protein, 35 aa, Mycobacterium
EEYTDAGDPVWWVVRALEFSQDFRTFARLLPTDPQ

SEQ ID NO: 651850 - protein, 24 aa, Mycobacterium
EEYWRISRDCFRRAMELRSAPVRT

SEQ ID NO: 651851 - protein, 19 aa, Mycobacterium
EFAAAGYDYVGFDVQHGYL

SEQ ID NO: 651852 - protein, 23 aa, Mycobacterium
EFAAHGYTGFRMESVAARAEVGR

SEQ ID NO: 651853 - protein, 18 aa, Mycobacterium
EFAANGKAGITVRDVLRH

SEQ ID NO: 651854 - protein, 25 aa, Mycobacterium
EFAAPVGDPGWFGPDSAVWRVHSHL

SEQ ID NO: 651855 - protein, 20 aa, Mycobacterium
EFAARARAWLADNMPAIDRD

SEQ ID NO: 651856 - protein, 21 aa, Mycobacterium
EFAARARAWLADNMPPIDPES

SEQ ID NO: 651857 - protein, 31 aa, Mycobacterium
EFAATLKARRRGWTAGRFSFNVADGRCPTCQ

SEQ ID NO: 651858 - protein, 20 aa, Mycobacterium
EFAAVGFEYGYSVGNPDAMV

SEQ ID NO: 651859 - protein, 21 aa, Mycobacterium
EFAAVGFEYGYSVGNPNAMVL

SEQ ID NO: 651860 - protein, 24 aa, Mycobacterium
EFADARAPIALALEQEKRVTDQVT

SEQ ID NO: 651861 - protein, 25 aa, Mycobacterium
EFADILAGVTLRPPRVPYLSNVTGT

SEQ ID NO: 651862 - protein, 19 aa, Mycobacterium
EFADLLAWMKDTLADHVKE

SEQ ID NO: 651863 - protein, 17 aa, Mycobacterium
EFADLPKTISGKIRRVE

SEQ ID NO: 651864 - protein, 21 aa, Mycobacterium
EFADRALVMYAGRAVEAAPVS

SEQ ID NO: 651865 - protein, 21 aa, Mycobacterium
EFADRALVMYAGRTVEQAAVG

SEQ ID NO: 651866 - protein, 21 aa, Mycobacterium
EFADRALVMYAGRVVEKATVN

SEQ ID NO: 651867 - protein, 21 aa, Mycobacterium
EFADRALVMYAGRVVESAEVH

SEQ ID NO: 651868 - protein, 21 aa, Mycobacterium
EFADRALVMYAGRVVESAGVN

SEQ ID NO: 651869 - protein, 21 aa, Mycobacterium
EFADRALVMYAGRVVETAGVH

SEQ ID NO: 651870 - protein, 24 aa, Mycobacterium
EFAEFFYRRLHHFEDRADDDRLVG

SEQ ID NO: 651871 - protein, 22 aa, Mycobacterium
EFAEKSRFGGIVSPPVMLQTWT

SEQ ID NO: 651872 - protein, 23 aa, Mycobacterium
EFAELPVPVVAVLGNHDYHADHA

SEQ ID NO: 651873 - protein, 18 aa, Mycobacterium
EFAFRPGPVFTNLMLADE

SEQ ID NO: 651874 - protein, 28 aa, Mycobacterium
EFAGAFKPPLRWGIRMTGHKFLREYPYR

SEQ ID NO: 651875 - protein, 19 aa, Mycobacterium
EFAGLRYVLIITSTYGEGE

SEQ ID NO: 651876 - protein, 26 aa, Mycobacterium
EFAGPEFRRFALSSGVEARHTALPLE

SEQ ID NO: 651877 - protein, 26 aa, Mycobacterium
EFAGSLCAWTPEMLDEFGKTKRESVG

SEQ ID NO: 651878 - protein, 25 aa, Mycobacterium
EFAKAWFKLLHRDMGPVTRYLGPEV

SEQ ID NO: 651879 - protein, 20 aa, Mycobacterium
EFAKRMVGSAAIVYTHNDPV

SEQ ID NO: 651880 - protein, 22 aa, Mycobacterium
EFALIARRHMHVYGTTREQLSL

SEQ ID NO: 651881 - protein, 19 aa, Mycobacterium
EFAPREILRRHPHLTVMSI

SEQ ID NO: 651882 - protein, 21 aa, Mycobacterium
EFAQMYRRFGARVTVVERGSR

SEQ ID NO: 651883 - protein, 23 aa, Mycobacterium
EFARAGYDYVAFDAQHGYLDDAD

SEQ ID NO: 651884 - protein, 23 aa, Mycobacterium
EFARGLVDVPFLGPILADDLAQR

SEQ ID NO: 651885 - protein, 24 aa, Mycobacterium
EFARTGFTGGLNWYRNFDRNWETT

SEQ ID NO: 651886 - protein, 21 aa, Mycobacterium
EFARVYLATGLTSIGKTQLSE

SEQ ID NO: 651887 - protein, 19 aa, Mycobacterium
EFATGYRWDIVLGGGTRTP

SEQ ID NO: 651888 - protein, 21 aa, Mycobacterium
EFAVHGWAGTTIRAVARRADV

SEQ ID NO: 651889 - protein, 20 aa, Mycobacterium
EFAVPPLLGALPLAYTAPQG

SEQ ID NO: 651890 - protein, 18 aa, Mycobacterium
EFAYLRKTEPIWWNAQPR

SEQ ID NO: 651891 - protein, 25 aa, Mycobacterium
EFCDPEIVEALKFHLRDLAVTFRFG

SEQ ID NO: 651892 - protein, 22 aa, Mycobacterium
EFCESFDGVRPAAVRVPQAALA

SEQ ID NO: 651893 - protein, 18 aa, Mycobacterium
EFCTRGYSVMLGYWNDDE

SEQ ID NO: 651894 - protein, 17 aa, Mycobacterium
EFDAEFFGISAREAAAM

SEQ ID NO: 651895 - protein, 25 aa, Mycobacterium
EFDALRRVGGCWVLTNHPFLTGRPS

SEQ ID NO: 651896 - protein, 19 aa, Mycobacterium
EFDAVISAIGIMFAPDHQC

SEQ ID NO: 651897 - protein, 24 aa, Mycobacterium
EFDCLRGECGACVAKVLEGIPDHR

SEQ ID NO: 651898 - protein, 24 aa, Mycobacterium
EFDCPPHWRARSIYFAGPDDAVLE

SEQ ID NO: 651899 - protein, 24 aa, Mycobacterium
EFDDRLILDELLSGWNLSMGTSTT

SEQ ID NO: 651900 - protein, 19 aa, Mycobacterium
EFDGLRLPASALLGPEGQA

SEQ ID NO: 651901 - protein, 22 aa, Mycobacterium
EFDGRIITVPFSFKEIDDDGLI

SEQ ID NO: 651902 - protein, 24 aa, Mycobacterium
EFDGRIITVPFSFKEIDEDGLISY

SEQ ID NO: 651903 - protein, 25 aa, Mycobacterium
EFDGRIITVPFSFKEIDGDGLITYV

SEQ ID NO: 651904 - protein, 25 aa, Mycobacterium
EFDGRIITVPFSFKEIDHEGLISYV

SEQ ID NO: 651905 - protein, 24 aa, Mycobacterium
EFDGRLITVPFSFKEIDDEGLISY

SEQ ID NO: 651906 - protein, 24 aa, Mycobacterium
EFDIFRAHVPHISFAAGEHTCLGL

SEQ ID NO: 651907 - protein, 19 aa, Mycobacterium
EFDRLALSAPRGADGLTLV

SEQ ID NO: 651908 - protein, 17 aa, Mycobacterium
EFDRLVRRLSRFLPSDV

SEQ ID NO: 651909 - protein, 20 aa, Mycobacterium
EFDSPAQISNIWNAEIVSRV

SEQ ID NO: 651910 - protein, 25 aa, Mycobacterium
EFDSRAIGPGGLFLALPGAHVDGHD

SEQ ID NO: 651911 - protein, 26 aa, Mycobacterium
EFDSRAVGPGGLFLALPGARADGHDH

SEQ ID NO: 651912 - protein, 26 aa, Mycobacterium
EFDSRAVGPGGLFLALPGARSDGHDF

SEQ ID NO: 651913 - protein, 25 aa, Mycobacterium
EFDSRAVTAGGLFLALPGARSDGHD

SEQ ID NO: 651914 - protein, 19 aa, Mycobacterium
EFDTELGPVVANFLLADEI

SEQ ID NO: 651915 - protein, 20 aa, Mycobacterium
EFDTPAQIGNIWNAEIVSRV

SEQ ID NO: 651916 - protein, 26 aa, Mycobacterium
EFDVLAALSSRPGIVLSRKQLLDTVW

SEQ ID NO: 651917 - protein, 26 aa, Mycobacterium
EFEFPERPQLGGLTIRTGVGQQPADV

SEQ ID NO: 651918 - protein, 17 aa, Mycobacterium
EFEFRQGPVFTNLLLAD

SEQ ID NO: 651919 - protein, 26 aa, Mycobacterium
EFEKEAWLSMVMLEWGSCGQLAVQAP

SEQ ID NO: 651920 - protein, 26 aa, Mycobacterium
EFEKEAWLSMVMLEWGSCGQVATAIP

SEQ ID NO: 651921 - protein, 18 aa, Mycobacterium
EFEKFRAAVDIPLLANMT

SEQ ID NO: 651922 - protein, 25 aa, Mycobacterium
EFEKKLDWIRGFVRDEVEPLEVLFP

SEQ ID NO: 651923 - protein, 26 aa, Mycobacterium
EFELHARAILGLACDTIMISPGAAEV

SEQ ID NO: 651924 - protein, 18 aa, Mycobacterium
EFELWSFAVSTINGCHYC

SEQ ID NO: 651925 - protein, 18 aa, Mycobacterium
EFEMCADCAREYHDPADR

SEQ ID NO: 651926 - protein, 27 aa, Mycobacterium
EFEPPHKLVLCARLGPLGAARITMLLH

SEQ ID NO: 651927 - protein, 19 aa, Mycobacterium
EFEVEGFPIHAGDYVAASP

SEQ ID NO: 651928 - protein, 18 aa, Mycobacterium
EFEVEGFPIHDGDFVAAS

SEQ ID NO: 651929 - protein, 18 aa, Mycobacterium
EFEVEGFPIHNGDYVAAS

SEQ ID NO: 651930 - protein, 19 aa, Mycobacterium
EFFATPGYGPWLRENLHYS

SEQ ID NO: 651931 - protein, 19 aa, Mycobacterium
EFFDYQVLLGYLASRAGRL

SEQ ID NO: 651932 - protein, 18 aa, Mycobacterium
EFFGHSWHAMQHVPVDEL

SEQ ID NO: 651933 - protein, 18 aa, Mycobacterium
EFFGIEYPILLAPMALVS

SEQ ID NO: 651934 - protein, 18 aa, Mycobacterium
EFFGRPGVNKGEKSAFPQ

SEQ ID NO: 651935 - protein, 20 aa, Mycobacterium
EFFPDNDWSTVLVVNIGHPG

SEQ ID NO: 651936 - protein, 24 aa, Mycobacterium
EFFQDGEEFWRLLFTNPVAAFEFL

SEQ ID NO: 651937 - protein, 23 aa, Mycobacterium
EFFTRLRNASAFHDTVDVRENPV

SEQ ID NO: 651938 - protein, 19 aa, Mycobacterium
EFFTTGIAFDPALRDAALP

SEQ ID NO: 651939 - protein, 26 aa, Mycobacterium
EFGAYAPRLWRYWAQHLDPDRARRDD

SEQ ID NO: 651940 - protein, 21 aa, Mycobacterium
EFGCAAPSDAALICVPPYHIA

SEQ ID NO: 651941 - protein, 19 aa, Mycobacterium
EFGDRALAVALDVTDTGQV

SEQ ID NO: 651942 - protein, 19 aa, Mycobacterium
EFGELRWHDGAAVTVVLAA

SEQ ID NO: 651943 - protein, 25 aa, Mycobacterium
EFGFGTDMMAWVLAMGHSMIRAGFG

SEQ ID NO: 651944 - protein, 20 aa, Mycobacterium
EFGGPAVDSGLVWVVDPIDG

SEQ ID NO: 651945 - protein, 18 aa, Mycobacterium
EFGHGWVQGAGHGVMTVR

SEQ ID NO: 651946 - protein, 19 aa, Mycobacterium
EFGHTAALSAVVSDRVTVL

SEQ ID NO: 651947 - protein, 18 aa, Mycobacterium
EFGLDCILENAARLIEKA

SEQ ID NO: 651948 - protein, 19 aa, Mycobacterium
EFGLGITPWSPLKGGVLSG

SEQ ID NO: 651949 - protein, 20 aa, Mycobacterium
EFGLSNYLGLAVHDGSGNVV

SEQ ID NO: 651950 - protein, 26 aa, Mycobacterium
EFGPLARTRIRPHFFPFTEPSAEVDV

SEQ ID NO: 651951 - protein, 18 aa, Mycobacterium
EFGRKGYEATTIRDIASA

SEQ ID NO: 651952 - protein, 24 aa, Mycobacterium
EFGSGFGVSGMYFGAGIESNGTGH

SEQ ID NO: 651953 - protein, 20 aa, Mycobacterium
EFGSRYGGSALFFANVMRHA

SEQ ID NO: 651954 - protein, 22 aa, Mycobacterium
EFGVFIPQGWRLDLVGIAPERH

SEQ ID NO: 651955 - protein, 20 aa, Mycobacterium
EFGVIAIAGDELWATGQNNA

SEQ ID NO: 651956 - protein, 20 aa, Mycobacterium
EFHFTREWFQQAAVASTDLL

SEQ ID NO: 651957 - protein, 17 aa, Mycobacterium
EFHGRFYDVPSMKVCPV

SEQ ID NO: 651958 - protein, 18 aa, Mycobacterium
EFHLFGLCHHINLDGLGM

SEQ ID NO: 651959 - protein, 27 aa, Mycobacterium
EFHPELQFDKPYLLAMANAGPGTNGSQ

SEQ ID NO: 651960 - protein, 19 aa, Mycobacterium
EFHPPRLGDLRRSRLDNTR

SEQ ID NO: 651961 - protein, 18 aa, Mycobacterium
EFHRIGLFLDEITNTPIP

SEQ ID NO: 651962 - protein, 19 aa, Mycobacterium
EFHYAEMWAQDAAAMYGYA

SEQ ID NO: 651963 - protein, 18 aa, Mycobacterium
EFIAEAISTIGSQVTDGF

SEQ ID NO: 651964 - protein, 26 aa, Mycobacterium
EFIAWEPFSHMAFRFNECSTQAVAAF

SEQ ID NO: 651965 - protein, 29 aa, Mycobacterium
EFIDRLWTGVPYQAIWFVQRRRQSAADHE

SEQ ID NO: 651966 - protein, 33 aa, Mycobacterium
EFIEFSGAYPWEWTARMMDEWSAHLVGSLSRAK

SEQ ID NO: 651967 - protein, 18 aa, Mycobacterium
EFIGDFASPFAMLVIADL

SEQ ID NO: 651968 - protein, 28 aa, Mycobacterium
EFIWCVQGLPSPYLAIAFPNRPLAHERY

SEQ ID NO: 651969 - protein, 21 aa, Mycobacterium
EFKEYDLAELREYIDWQPFFN

SEQ ID NO: 651970 - protein, 23 aa, Mycobacterium
EFKMVPSSLGFQRPGVEPARDGL

SEQ ID NO: 651971 - protein, 19 aa, Mycobacterium
EFLALKVEGILDCAELLVV

SEQ ID NO: 651972 - protein, 18 aa, Mycobacterium
EFLALKVEGILECAELLV

SEQ ID NO: 651973 - protein, 19 aa, Mycobacterium
EFLALKVEGILECAELMVV

SEQ ID NO: 651974 - protein, 24 aa, Mycobacterium
EFLARLCKTAMWIDHGEIKLSGGI

SEQ ID NO: 651975 - protein, 26 aa, Mycobacterium
EFLARLCKTAMWIDHGTIRMTGGIEE

SEQ ID NO: 651976 - protein, 25 aa, Mycobacterium
EFLARLCKTAMWIDHGVIKLTGGIE

SEQ ID NO: 651977 - protein, 26 aa, Mycobacterium
EFLARLCKTAMWIDHGVIRMAGGIED

SEQ ID NO: 651978 - protein, 24 aa, Mycobacterium
EFLARNRLYYTWFRSDEPKGAALL

SEQ ID NO: 651979 - protein, 26 aa, Mycobacterium
EFLAWEPFTHMAFRFNECSTKSVAAF

SEQ ID NO: 651980 - protein, 21 aa, Mycobacterium
EFLDGARCGQVFGTMWHGALE

SEQ ID NO: 651981 - protein, 20 aa, Mycobacterium
EFLDRFAALARRIRVGDPLS

SEQ ID NO: 651982 - protein, 23 aa, Mycobacterium
EFLDRYDARFVVVTNGPIEEALA

SEQ ID NO: 651983 - protein, 29 aa, Mycobacterium
EFLEGLSPWLEFVWKPGYADYYPNLPGGS

SEQ ID NO: 651984 - protein, 29 aa, Mycobacterium
EFLGARFDAGLAWVHFPVGFGGLDLPHTY

SEQ ID NO: 651985 - protein, 20 aa, Mycobacterium
EFLGEKICAVVVFNGPPVSL

SEQ ID NO: 651986 - protein, 30 aa, Mycobacterium
EFLGRLEDMPTFRAIIAMAFKDMDDLVDRP

SEQ ID NO: 651987 - protein, 25 aa, Mycobacterium
EFLGTEGFLALKTVWSYAHQRAIDC

SEQ ID NO: 651988 - protein, 21 aa, Mycobacterium
EFLPKVWRPPTPRCSTMASWW

SEQ ID NO: 651989 - protein, 26 aa, Mycobacterium
EFLPVVWRVIQHYGIDVGGRRYKGDI

SEQ ID NO: 651990 - protein, 20 aa, Mycobacterium
EFLQRAVARVGKIVQGNPLD

SEQ ID NO: 651991 - protein, 19 aa, Mycobacterium
EFNATLQIGYFIMAVRAVG

SEQ ID NO: 651992 - protein, 17 aa, Mycobacterium
EFNELTSSLGWKPENVV

SEQ ID NO: 651993 - protein, 23 aa, Mycobacterium
EFNGFALSKLRGFIYEESRNIFD

SEQ ID NO: 651994 - protein, 20 aa, Mycobacterium
EFPFRLIPRRHQNFMNSSGT

SEQ ID NO: 651995 - protein, 21 aa, Mycobacterium
EFPGAAPPPGTRLRVAPNHLC

SEQ ID NO: 651996 - protein, 19 aa, Mycobacterium
EFPGWEPTTSYLLAEAEID

SEQ ID NO: 651997 - protein, 22 aa, Mycobacterium
EFPRGREEIVEFLTRKWNTELD

SEQ ID NO: 651998 - protein, 22 aa, Mycobacterium
EFPTASGLMGLGVAHAQRGEVS

SEQ ID NO: 651999 - protein, 19 aa, Mycobacterium
EFPTLPGAHNAVRQVVSLL

SEQ ID NO: 652000 - protein, 21 aa, Mycobacterium
EFPWDTLAEAKARAGAHPDGI

SEQ ID NO: 652001 - protein, 25 aa, Mycobacterium
EFPWGCEHYEWTGRMMAADGLEALQ

SEQ ID NO: 652002 - protein, 20 aa, Mycobacterium
EFQQKIDWVRDFVREEVEPL

SEQ ID NO: 652003 - protein, 18 aa, Mycobacterium
EFRAFYSRVLFWTYEPGR

SEQ ID NO: 652004 - protein, 26 aa, Mycobacterium
EFRAKAGVTNVEFRKGTIEDIPLPDA

SEQ ID NO: 652005 - protein, 19 aa, Mycobacterium
EFRASRIMLERARANDKIT

SEQ ID NO: 652006 - protein, 20 aa, Mycobacterium
EFRASRIMLERARANDKITI

SEQ ID NO: 652007 - protein, 31 aa, Mycobacterium
EFRKALRDCQAERRHDMLFDHVAGLAATVMG

SEQ ID NO: 652008 - protein, 22 aa, Mycobacterium
EFRLYELVWQRTVASQMADARG

SEQ ID NO: 652009 - protein, 26 aa, Mycobacterium
EFRPTRAEPLFAIAARYRADGCYQLG

SEQ ID NO: 652010 - protein, 25 aa, Mycobacterium
EFRQMCGTANWYGGTIIDDIVPGHT

SEQ ID NO: 652011 - protein, 25 aa, Mycobacterium
EFRRVHVGAIRLVIQVLPRLDGFGV

SEQ ID NO: 652012 - protein, 21 aa, Mycobacterium
EFRSGFVCLVGRPNTGKSTLT

SEQ ID NO: 652013 - protein, 24 aa, Mycobacterium
EFRSKMRAHFDRARKLAGMDGESL

SEQ ID NO: 652014 - protein, 17 aa, Mycobacterium
EFRTHFFNFASRAAIER

SEQ ID NO: 652015 - protein, 36 aa, Mycobacterium
EFRVGDRVGIAWLRHTCGVCKYCRRGDENLCPKSRY

SEQ ID NO: 652016 - protein, 35 aa, Mycobacterium
EFRVGDRVGIAWLRHTCGVCKYCRRGDENLCPQSR

SEQ ID NO: 652017 - protein, 19 aa, Mycobacterium
EFRVLRDRLFETLAAVEPE

SEQ ID NO: 652018 - protein, 19 aa, Mycobacterium
EFSDADWARTFDVNVRAPF

SEQ ID NO: 652019 - protein, 21 aa, Mycobacterium
EFSDAFRAILGAYRRHAIDAL

SEQ ID NO: 652020 - protein, 19 aa, Mycobacterium
EFSNGATVQLVYLHPDAKT

SEQ ID NO: 652021 - protein, 24 aa, Mycobacterium
EFSRRFGCEVWDGFGSTENAVTIT

SEQ ID NO: 652022 - protein, 24 aa, Mycobacterium
EFSSISWSAPDLWFHRRSTLGERT

SEQ ID NO: 652023 - protein, 19 aa, Mycobacterium
EFSTWTPHWFGAVDEPVEA

SEQ ID NO: 652024 - protein, 18 aa, Mycobacterium
EFSTWTPHWFGAVDGPVE

SEQ ID NO: 652025 - protein, 21 aa, Mycobacterium
EFTAPHFASAWAHANNTPFQW

SEQ ID NO: 652026 - protein, 21 aa, Mycobacterium
EFTAPHFASGWAHANNTPFQW

SEQ ID NO: 652027 - protein, 27 aa, Mycobacterium
EFTCSSCFLVQHRSRLRSSNAGVSICA

SEQ ID NO: 652028 - protein, 17 aa, Mycobacterium
EFTDSYVKLVFVADDVD

SEQ ID NO: 652029 - protein, 17 aa, Mycobacterium
EFTEAWTTFATVEKSWA

SEQ ID NO: 652030 - protein, 20 aa, Mycobacterium
EFTERAAPILADLRQLEAIA

SEQ ID NO: 652031 - protein, 24 aa, Mycobacterium
EFTERELGQIIGMILTINAWNRIA

SEQ ID NO: 652032 - protein, 24 aa, Mycobacterium
EFTGSAFRTWLIRIADDEMRVKRV

SEQ ID NO: 652033 - protein, 26 aa, Mycobacterium
EFTLPAKEFGAAWQLVVFTGPEEETP

SEQ ID NO: 652034 - protein, 25 aa, Mycobacterium
EFTLQCVPAFRLHRSQSVHDLDTVL

SEQ ID NO: 652035 - protein, 18 aa, Mycobacterium
EFTPKGPDWQLTRNTADM

SEQ ID NO: 652036 - protein, 20 aa, Mycobacterium
EFTPLAWQHAVEGWKQIGAP

SEQ ID NO: 652037 - protein, 25 aa, Mycobacterium
EFTRRVPGYHILKAHMSASIKRSQP

SEQ ID NO: 652038 - protein, 19 aa, Mycobacterium
EFTTQFLLGCTGYYRYDEG

SEQ ID NO: 652039 - protein, 24 aa, Mycobacterium
EFVAEAIAKLGAQVMEGFETYHVM

SEQ ID NO: 652040 - protein, 24 aa, Mycobacterium
EFVAEAITALGAQVVDGFATYHVM

SEQ ID NO: 652041 - protein, 18 aa, Mycobacterium
EFVAEAITALGGGAAGSF

SEQ ID NO: 652042 - protein, 17 aa, Mycobacterium
EFVEFEEAAALPVAGVT

SEQ ID NO: 652043 - protein, 18 aa, Mycobacterium
EFVENFFMFIAEEVREYM

SEQ ID NO: 652044 - protein, 19 aa, Mycobacterium
EFVERVIAQQAERGNKIDA

SEQ ID NO: 652045 - protein, 27 aa, Mycobacterium
EFVEVKPEFGWHTGMLIPGATMQVSFL

SEQ ID NO: 652046 - protein, 21 aa, Mycobacterium
EFVGLYRRYHVSAAELQVLAG

SEQ ID NO: 652047 - protein, 17 aa, Mycobacterium
EFVIVAMTVKNTGDQPQ

SEQ ID NO: 652048 - protein, 17 aa, Mycobacterium
EFVKPHLALYIGGMGAK

SEQ ID NO: 652049 - protein, 19 aa, Mycobacterium
EFVLTGVPWGLRREGRKPG

SEQ ID NO: 652050 - protein, 17 aa, Mycobacterium
EFVNFDPIYSWPKPVQK

SEQ ID NO: 652051 - protein, 23 aa, Mycobacterium
EFVNFGPSWAWPKPVQAHIPVLV

SEQ ID NO: 652052 - protein, 17 aa, Mycobacterium
EFVPLPFVHQSSPLYLA

SEQ ID NO: 652053 - protein, 27 aa, Mycobacterium
EFVSATAAALGWPASRIHIEHFGSEAL

SEQ ID NO: 652054 - protein, 19 aa, Mycobacterium
EFVSGVFDWVVAELATTTQ

SEQ ID NO: 652055 - protein, 20 aa, Mycobacterium
EFVVRQESRLNWAVGDLPDG

SEQ ID NO: 652056 - protein, 28 aa, Mycobacterium
EFWDEIFRELSIPYLPVRWRPDNPDSIV

SEQ ID NO: 652057 - protein, 19 aa, Mycobacterium
EFWNKAGAAGLLGLDLPEQ

SEQ ID NO: 652058 - protein, 20 aa, Mycobacterium
EFWTHFFRNFWRVQELIEKR

SEQ ID NO: 652059 - protein, 20 aa, Mycobacterium
EFYALLAARQAERASLPSPQ

SEQ ID NO: 652060 - protein, 24 aa, Mycobacterium
EFYDEIFRALGIPHEPVRWRIDNP

SEQ ID NO: 652061 - protein, 28 aa, Mycobacterium
EFYGYPAKLSGTWLRANFITSLDGGATV

SEQ ID NO: 652062 - protein, 21 aa, Mycobacterium
EFYLFGCCHHIAIDGLGMALV

SEQ ID NO: 652063 - protein, 20 aa, Mycobacterium
EFYRAIADGGWLGMTIPTEY

SEQ ID NO: 652064 - protein, 24 aa, Mycobacterium
EFYRAIADGGWLGMTIPTEYGGHG

SEQ ID NO: 652065 - protein, 21 aa, Mycobacterium
EFYRRCATVTTRLWPTLTEPL

SEQ ID NO: 652066 - protein, 19 aa, Mycobacterium
EGAAFPWRTIRGQECSAYW

SEQ ID NO: 652067 - protein, 17 aa, Mycobacterium
EGAALWRLSCSSGQNLT

SEQ ID NO: 652068 - protein, 34 aa, Mycobacterium
EGAAMVRFIGVDGYRWMIRCVVNGPFERIAELTE

SEQ ID NO: 652069 - protein, 25 aa, Mycobacterium
EGAASRLFLRYVIFGGEMLTFADLI

SEQ ID NO: 652070 - protein, 25 aa, Mycobacterium
EGAATRLGHSVAFFIGTAYGSTETA

SEQ ID NO: 652071 - protein, 21 aa, Mycobacterium
EGADFDHILVIGGGRYTNQLR

SEQ ID NO: 652072 - protein, 25 aa, Mycobacterium
EGADFRAGSQLVVLEAMKMQHVLAA

SEQ ID NO: 652073 - protein, 25 aa, Mycobacterium
EGADGPDLVLRWAALLHDIGKPATR

SEQ ID NO: 652074 - protein, 23 aa, Mycobacterium
EGADIIAIDICKPIREGVLDTAI

SEQ ID NO: 652075 - protein, 20 aa, Mycobacterium
EGADIIAIDVCKNIDHVQLE

SEQ ID NO: 652076 - protein, 21 aa, Mycobacterium
EGADIIAVDVCKPIVENTTIP

SEQ ID NO: 652077 - protein, 25 aa, Mycobacterium
EGADIIAVDVCRRISSNEDIPASTP

SEQ ID NO: 652078 - protein, 22 aa, Mycobacterium
EGADLILVDICESLPEVEYPLA

SEQ ID NO: 652079 - protein, 20 aa, Mycobacterium
EGADLILVDICQSMPQIEYP

SEQ ID NO: 652080 - protein, 18 aa, Mycobacterium
EGADLVFTGPGFPGIAAD

SEQ ID NO: 652081 - protein, 19 aa, Mycobacterium
EGADLVFTGPGFPGVAADV

SEQ ID NO: 652082 - protein, 22 aa, Mycobacterium
EGADVGYRWFARTGQAPMFAFG

SEQ ID NO: 652083 - protein, 27 aa, Mycobacterium
EGADVRYLWPSMFAQVADEYDRRYGLD

SEQ ID NO: 652084 - protein, 23 aa, Mycobacterium
EGADYPLAAAILKMGAKDANPAA

SEQ ID NO: 652085 - protein, 25 aa, Mycobacterium
EGAEARYLWPSMFAEVADEYDRRYG

SEQ ID NO: 652086 - protein, 25 aa, Mycobacterium
EGAEARYLWPSVFTQVADEYDRRYG

SEQ ID NO: 652087 - protein, 17 aa, Mycobacterium
EGAEFVISFGWGPLAVH

SEQ ID NO: 652088 - protein, 18 aa, Mycobacterium
EGAFNYDPIFFPSGVSNI

SEQ ID NO: 652089 - protein, 17 aa, Mycobacterium
EGAFPPDRVKILSTGGM

SEQ ID NO: 652090 - protein, 17 aa, Mycobacterium
EGAGLVLLKPLPAALDD

SEQ ID NO: 652091 - protein, 19 aa, Mycobacterium
EGAGYRINTDFGGHGLGRT

SEQ ID NO: 652092 - protein, 19 aa, Mycobacterium
EGAIAPWSMGNTADYFTRM

SEQ ID NO: 652093 - protein, 20 aa, Mycobacterium
EGAIAPWSMGQNADYFVRLM

SEQ ID NO: 652094 - protein, 18 aa, Mycobacterium
EGAIWLCAEESRVRVKAI

SEQ ID NO: 652095 - protein, 17 aa, Mycobacterium
EGAKGKAKEVFGAVTGR

SEQ ID NO: 652096 - protein, 21 aa, Mycobacterium
EGAKWVCSTPLRARSEGHQDQ

SEQ ID NO: 652097 - protein, 28 aa, Mycobacterium
EGALGRGKEAFVARARELAAKYGDRFLP

SEQ ID NO: 652098 - protein, 19 aa, Mycobacterium
EGALGRLVIEFDNEPDGDA

SEQ ID NO: 652099 - protein, 18 aa, Mycobacterium
EGALHVTLRDGAVVGTQL

SEQ ID NO: 652100 - protein, 20 aa, Mycobacterium
EGALIRGLGEFGRILQNAAA

SEQ ID NO: 652101 - protein, 18 aa, Mycobacterium
EGALKLKELAYMHAEGFA

SEQ ID NO: 652102 - protein, 20 aa, Mycobacterium
EGALPLLAPMSEVAGRLSAQ

SEQ ID NO: 652103 - protein, 18 aa, Mycobacterium
EGALRATLGILDRTVRRG

SEQ ID NO: 652104 - protein, 38 aa, Mycobacterium
EGALSVPIAHDFLLPDLFREWMEAAGIDQLAFDSCAGA

SEQ ID NO: 652105 - protein, 26 aa, Mycobacterium
EGANIWQLLEQLGFPESGIAVAINHT

SEQ ID NO: 652106 - protein, 20 aa, Mycobacterium
EGAPDDGLWVRTGDYGTYFK

SEQ ID NO: 652107 - protein, 20 aa, Mycobacterium
EGAPEMLARHGVADRVQVIP

SEQ ID NO: 652108 - protein, 21 aa, Mycobacterium
EGAPQDRVWMAFPCEGYSLGD

SEQ ID NO: 652109 - protein, 23 aa, Mycobacterium
EGAPRKLELEAPFDGGAVLVQGA

SEQ ID NO: 652110 - protein, 25 aa, Mycobacterium
EGARDWEFSTGRYWKVVNPSKLNEF

SEQ ID NO: 652111 - protein, 21 aa, Mycobacterium
EGARELGRWATGHGAEHLDGG

SEQ ID NO: 652112 - protein, 21 aa, Mycobacterium
EGARFPLGVVSSGMAVLAYLP

SEQ ID NO: 652113 - protein, 17 aa, Mycobacterium
EGARHLELTIGRHDGGL

SEQ ID NO: 652114 - protein, 17 aa, Mycobacterium
EGARIELGLRHFLADGF

SEQ ID NO: 652115 - protein, 17 aa, Mycobacterium
EGARLVCGGGRPEGLDG

SEQ ID NO: 652116 - protein, 17 aa, Mycobacterium
EGARLVCGGGRPEGLDN

SEQ ID NO: 652117 - protein, 17 aa, Mycobacterium
EGARLVCGGGRPEGLDT

SEQ ID NO: 652118 - protein, 23 aa, Mycobacterium
EGASRPTHFAGMLTVVLKLLQIV

SEQ ID NO: 652119 - protein, 18 aa, Mycobacterium
EGAVALVLERSRDATARG

SEQ ID NO: 652120 - protein, 19 aa, Mycobacterium
EGAVAPWSVGQSAEYFTRM

SEQ ID NO: 652121 - protein, 19 aa, Mycobacterium
EGAVAYGHLQIRVEELARA

SEQ ID NO: 652122 - protein, 19 aa, Mycobacterium
EGAVAYGHLQIRVEELGEA

SEQ ID NO: 652123 - protein, 18 aa, Mycobacterium
EGAVHLDKGCYRGQETVA

SEQ ID NO: 652124 - protein, 24 aa, Mycobacterium
EGCGQWPGYVTRLQAPVIPHMGWN

SEQ ID NO: 652125 - protein, 21 aa, Mycobacterium
EGCSFINVLLELGRDHPVGQA

SEQ ID NO: 652126 - protein, 22 aa, Mycobacterium
EGCSGCSMMADHIGPLSHLYAK

SEQ ID NO: 652127 - protein, 22 aa, Mycobacterium
EGDALYLPRGWVHAAQALDTTS

SEQ ID NO: 652128 - protein, 24 aa, Mycobacterium
EGDARTAMNVGWDRDLAMKAYPLW

SEQ ID NO: 652129 - protein, 19 aa, Mycobacterium
EGDARWAEMVRRLAEQRGA

SEQ ID NO: 652130 - protein, 17 aa, Mycobacterium
EGDASGFARLVSVLDEP

SEQ ID NO: 652131 - protein, 19 aa, Mycobacterium
EGDDPVWGSMDFAAAQANF

SEQ ID NO: 652132 - protein, 20 aa, Mycobacterium
EGDLAAWIVGPPMDDTFRAM

SEQ ID NO: 652133 - protein, 19 aa, Mycobacterium
EGDLAKLRASIVNTQALAG

SEQ ID NO: 652134 - protein, 19 aa, Mycobacterium
EGDLAKLRASVVNTQALAD

SEQ ID NO: 652135 - protein, 22 aa, Mycobacterium
EGDLDVRGFFGLDDSVRPGFQQ

SEQ ID NO: 652136 - protein, 24 aa, Mycobacterium
EGDLGSILRWFVAGTLGVGPVENA

SEQ ID NO: 652137 - protein, 23 aa, Mycobacterium
EGDLKMAATLVDVYANPLLTPEQ

SEQ ID NO: 652138 - protein, 24 aa, Mycobacterium
EGDLTPGFHGMHIHQVGKCEPNSV

SEQ ID NO: 652139 - protein, 23 aa, Mycobacterium
EGDPDQWASAPFEPTERDGRLYG

SEQ ID NO: 652140 - protein, 19 aa, Mycobacterium
EGDPFGGPVVMRLGVDGSW

SEQ ID NO: 652141 - protein, 18 aa, Mycobacterium
EGDPHAWAIPRLTGQAKA

SEQ ID NO: 652142 - protein, 19 aa, Mycobacterium
EGDPHAWAIPRLTGQAKAS

SEQ ID NO: 652143 - protein, 26 aa, Mycobacterium
EGDPPCPLRRNCRLREALRSAQDAFF

SEQ ID NO: 652144 - protein, 30 aa, Mycobacterium
EGDPRVTALIDRCRDLAAEIGVDWTATVPV

SEQ ID NO: 652145 - protein, 22 aa, Mycobacterium
EGDPWASFVTYGLLGGAPVLCV

SEQ ID NO: 652146 - protein, 25 aa, Mycobacterium
EGDRGVSWLPFFHDMGLITVLLSPM

SEQ ID NO: 652147 - protein, 20 aa, Mycobacterium
EGDRMAAFWAQATRLRDLLK

SEQ ID NO: 652148 - protein, 24 aa, Mycobacterium
EGDRNVVSVGFNWTMGSHVVPPKP

SEQ ID NO: 652149 - protein, 26 aa, Mycobacterium
EGDSLRRAVTFDAFLDGIDAVRRIAE

SEQ ID NO: 652150 - protein, 19 aa, Mycobacterium
EGDVLWDLASRLEGRMSAI

SEQ ID NO: 652151 - protein, 27 aa, Mycobacterium
EGDWIYIPKACTWRQIPDDESTLLMIQ

SEQ ID NO: 652152 - protein, 24 aa, Mycobacterium
EGDWLRTGDMGFYLDGELYVTGRL

SEQ ID NO: 652153 - protein, 24 aa, Mycobacterium
EGDWQRYTYADLYVRVKRAANALR

SEQ ID NO: 652154 - protein, 23 aa, Mycobacterium
EGDYGPDCPVVVVYRASQPQEIV

SEQ ID NO: 652155 - protein, 18 aa, Mycobacterium
EGEALDWWRVERIDTPRS

SEQ ID NO: 652156 - protein, 25 aa, Mycobacterium
EGEAMLFGDYIRLMALVEYSADELK

SEQ ID NO: 652157 - protein, 26 aa, Mycobacterium
EGEAMLFGEYIRLMALVEYSADEIKT

SEQ ID NO: 652158 - protein, 17 aa, Mycobacterium
EGEEAFYAALEFWSALH

SEQ ID NO: 652159 - protein, 20 aa, Mycobacterium
EGEHCRRCGAVMRREKFMNR

SEQ ID NO: 652160 - protein, 25 aa, Mycobacterium
EGELAIVIGRPCKDVPAARAAENIL

SEQ ID NO: 652161 - protein, 25 aa, Mycobacterium
EGELALKPGWPSMFRGYLHAEDRYR

SEQ ID NO: 652162 - protein, 20 aa, Mycobacterium
EGELALKPGWPSMFRGYLNA

SEQ ID NO: 652163 - protein, 26 aa, Mycobacterium
EGELRLKGPQCFLGYVDATLDAHAFD

SEQ ID NO: 652164 - protein, 27 aa, Mycobacterium
EGELRPQLLDRFGFAVDIHASRDVEVR

SEQ ID NO: 652165 - protein, 22 aa, Mycobacterium
EGELRPQLLDRFGLTVDVAASR

SEQ ID NO: 652166 - protein, 22 aa, Mycobacterium
EGELRPQLLDRFGLTVDVHASR

SEQ ID NO: 652167 - protein, 23 aa, Mycobacterium
EGELRPQLLDRFGLTVDVHASRD

SEQ ID NO: 652168 - protein, 22 aa, Mycobacterium
EGELRPQLLDRFGLTVDVQASR

SEQ ID NO: 652169 - protein, 22 aa, Mycobacterium
EGELTLPGRSLLFVRNVGHLMT

SEQ ID NO: 652170 - protein, 26 aa, Mycobacterium
EGELYFPGSPVLTLRGSFAECVILET

SEQ ID NO: 652171 - protein, 22 aa, Mycobacterium
EGENRFSPDFLDAINERLDDIE

SEQ ID NO: 652172 - protein, 23 aa, Mycobacterium
EGENVWPGILGFEDTVLPQVERA

SEQ ID NO: 652173 - protein, 25 aa, Mycobacterium
EGEPFVLHPGEFVLGSTLELCTLPD

SEQ ID NO: 652174 - protein, 24 aa, Mycobacterium
EGEPFVLHPGEFVLGSTLELITLP

SEQ ID NO: 652175 - protein, 24 aa, Mycobacterium
EGEPFVLHPGEFVLGSTLEVCSLP

SEQ ID NO: 652176 - protein, 19 aa, Mycobacterium
EGEPVLLLHPFMLSQSVWE

SEQ ID NO: 652177 - protein, 25 aa, Mycobacterium
EGESPSARIERWWLGSTTFDELELD

SEQ ID NO: 652178 - protein, 19 aa, Mycobacterium
EGFAGWLRESKAVGVTDTT

SEQ ID NO: 652179 - protein, 17 aa, Mycobacterium
EGFAPRKHAARMTWLQT

SEQ ID NO: 652180 - protein, 23 aa, Mycobacterium
EGFARPGARRSRADFEICATAQV

SEQ ID NO: 652181 - protein, 19 aa, Mycobacterium
EGFCARVGFRDGRNVLRFQ

SEQ ID NO: 652182 - protein, 20 aa, Mycobacterium
EGFDRTAFAAVQFAVTQIGS

SEQ ID NO: 652183 - protein, 20 aa, Mycobacterium
EGFGAPKNRRGHASGINVGL

SEQ ID NO: 652184 - protein, 24 aa, Mycobacterium
EGFHAASVRRIRPGEQLVLGDGAG

SEQ ID NO: 652185 - protein, 26 aa, Mycobacterium
EGFKGWSVEMSRHFDVVDVQDAKFLT

SEQ ID NO: 652186 - protein, 25 aa, Mycobacterium
EGFLTIEPRKGFSVTALSSEDIRDV

SEQ ID NO: 652187 - protein, 17 aa, Mycobacterium
EGFMRDVPCPECDGTRL

SEQ ID NO: 652188 - protein, 22 aa, Mycobacterium
EGFRACKRCRPDASPGSPEWNI

SEQ ID NO: 652189 - protein, 26 aa, Mycobacterium
EGFTIPEIPIGAYGVVSGNIGPETFP

SEQ ID NO: 652190 - protein, 19 aa, Mycobacterium
EGFVLPVLTYTAPRAAADA

SEQ ID NO: 652191 - protein, 20 aa, Mycobacterium
EGGAGAWLIGSAGDGGAGGA

SEQ ID NO: 652192 - protein, 23 aa, Mycobacterium
EGGALPAAIAYFSMEFGVSEVLP

SEQ ID NO: 652193 - protein, 17 aa, Mycobacterium
EGGCAHVVVVLGAAVVD

SEQ ID NO: 652194 - protein, 23 aa, Mycobacterium
EGGDRVAHEFLFQESDSHWMNSY

SEQ ID NO: 652195 - protein, 19 aa, Mycobacterium
EGGEYRWAHAGIVPVLPAD

SEQ ID NO: 652196 - protein, 20 aa, Mycobacterium
EGGFDVTRPTAWSAEGLLPY

SEQ ID NO: 652197 - protein, 26 aa, Mycobacterium
EGGFKPQEMWGPDGGPGWQRNDPTVQ

SEQ ID NO: 652198 - protein, 18 aa, Mycobacterium
EGGFPPNLGPIWRLERDG

SEQ ID NO: 652199 - protein, 33 aa, Mycobacterium
EGGGFAIAQARLGPGRIHHCMRALGGAERALAL

SEQ ID NO: 652200 - protein, 34 aa, Mycobacterium
EGGGFAIAQARLGPGRIHHCMRALGGAERALALM

SEQ ID NO: 652201 - protein, 20 aa, Mycobacterium
EGGGVDYLVARFVAGARVNA

SEQ ID NO: 652202 - protein, 17 aa, Mycobacterium
EGGHAPFSLAWMTAVGE

SEQ ID NO: 652203 - protein, 18 aa, Mycobacterium
EGGHCRAFSSGMAAADCA

SEQ ID NO: 652204 - protein, 18 aa, Mycobacterium
EGGHIGRVTEAWRDQPAL

SEQ ID NO: 652205 - protein, 25 aa, Mycobacterium
EGGLIKAAWIDTWRLPAAPPGTVKI

SEQ ID NO: 652206 - protein, 18 aa, Mycobacterium
EGGLKVVLLEAGRNLDIV

SEQ ID NO: 652207 - protein, 20 aa, Mycobacterium
EGGLMACLAYTWKQVVTTPL

SEQ ID NO: 652208 - protein, 20 aa, Mycobacterium
EGGLNVARMEWLRALAELCQ

SEQ ID NO: 652209 - protein, 22 aa, Mycobacterium
EGGLNWDSLPLKLFAGGNAKFW

SEQ ID NO: 652210 - protein, 20 aa, Mycobacterium
EGGLSSTIWAGPAVIGRSVR

SEQ ID NO: 652211 - protein, 18 aa, Mycobacterium
EGGMIVAWVATGFDVLAS

SEQ ID NO: 652212 - protein, 22 aa, Mycobacterium
EGGPKLGRLAALLRDKRIPFEM

SEQ ID NO: 652213 - protein, 21 aa, Mycobacterium
EGGPQTRVWAHGNLVAARATA

SEQ ID NO: 652214 - protein, 20 aa, Mycobacterium
EGGQGISCFLVDKDTEGLTF

SEQ ID NO: 652215 - protein, 18 aa, Mycobacterium
EGGVGRPARAQPGGPTLT

SEQ ID NO: 652216 - protein, 17 aa, Mycobacterium
EGGWYAETWRSDLTIPQ

SEQ ID NO: 652217 - protein, 17 aa, Mycobacterium
EGGWYGETWRSDVVFEV

SEQ ID NO: 652218 - protein, 30 aa, Mycobacterium
EGGYATTLWARRPATLEAFADTPAQIAGSP

SEQ ID NO: 652219 - protein, 21 aa, Mycobacterium
EGHAGFLGLERIREYIGQQGL

SEQ ID NO: 652220 - protein, 27 aa, Mycobacterium
EGHAWVNGLLCGPGMPTIAALDFEAPL

SEQ ID NO: 652221 - protein, 17 aa, Mycobacterium
EGHFAIYVDEAFDRVVA

SEQ ID NO: 652222 - protein, 26 aa, Mycobacterium
EGHIYRACIKLGVADRDELARMIWTD

SEQ ID NO: 652223 - protein, 24 aa, Mycobacterium
EGHLYRLFAKLGINTREQLICLMR

SEQ ID NO: 652224 - protein, 26 aa, Mycobacterium
EGHSCVKGRFAFGYATHPDRVLRPMV

SEQ ID NO: 652225 - protein, 24 aa, Mycobacterium
EGHSGDELLLRWGETEVDNLRAAF

SEQ ID NO: 652226 - protein, 25 aa, Mycobacterium
EGHSRVAPVYLYRFDYSTPLLKLLL

SEQ ID NO: 652227 - protein, 17 aa, Mycobacterium
EGHSVILDGTWRDPGTR

SEQ ID NO: 652228 - protein, 19 aa, Mycobacterium
EGHTHGFLTSLARPGRTGA

SEQ ID NO: 652229 - protein, 25 aa, Mycobacterium
EGHVPPKLFKPVVALARPPLMALIG

SEQ ID NO: 652230 - protein, 25 aa, Mycobacterium
EGHVYRACMKFGVPDRAALASTVGG

SEQ ID NO: 652231 - protein, 26 aa, Mycobacterium
EGIAHLPVRVRDGTGLVGPLVIPGVT

SEQ ID NO: 652232 - protein, 19 aa, Mycobacterium
EGIAKFRAFVEDSARLVVG

SEQ ID NO: 652233 - protein, 20 aa, Mycobacterium
EGIAMLAPRSRPCVATAMQL

SEQ ID NO: 652234 - protein, 23 aa, Mycobacterium
EGIARPGHFAGVLTVVLKLLQIV

SEQ ID NO: 652235 - protein, 17 aa, Mycobacterium
EGIDAGAMAAAYKDFRA

SEQ ID NO: 652236 - protein, 19 aa, Mycobacterium
EGIDRYIAWAKDQPQHAYE

SEQ ID NO: 652237 - protein, 24 aa, Mycobacterium
EGIDWCKRHLEVLGAGYQLSKEAV

SEQ ID NO: 652238 - protein, 17 aa, Mycobacterium
EGIGCGFTEAVRGVLSH

SEQ ID NO: 652239 - protein, 23 aa, Mycobacterium
EGIGRPRVEPSFLPGVVDCMVSV

SEQ ID NO: 652240 - protein, 24 aa, Mycobacterium
EGIGRPRVEPSFLPGVVDRMVSVP

SEQ ID NO: 652241 - protein, 24 aa, Mycobacterium
EGIGRPRVEPSFLPSVVDRMVSVP

SEQ ID NO: 652242 - protein, 18 aa, Mycobacterium
EGIGSILLGLYRDDGELQ

SEQ ID NO: 652243 - protein, 24 aa, Mycobacterium
EGIIAAAAIRCMGGAIQAQLAPKD

SEQ ID NO: 652244 - protein, 24 aa, Mycobacterium
EGIIAAAAIRCMGGAIQAQLAPTD

SEQ ID NO: 652245 - protein, 20 aa, Mycobacterium
EGIIAAAAIRCMGGEIQATL

SEQ ID NO: 652246 - protein, 20 aa, Mycobacterium
EGIIAAAAMRCMGGAIHGKL

SEQ ID NO: 652247 - protein, 17 aa, Mycobacterium
EGIKRGDRVAVRYPAGM

SEQ ID NO: 652248 - protein, 18 aa, Mycobacterium
EGINPKRMAAMTMQTVMF

SEQ ID NO: 652249 - protein, 18 aa, Mycobacterium
EGIPDEWIEAAQRSPIYA

SEQ ID NO: 652250 - protein, 18 aa, Mycobacterium
EGIPDEWIEAAQRSPVYA

SEQ ID NO: 652251 - protein, 23 aa, Mycobacterium
EGIPKLRIEEAAARTQARIDSGA

SEQ ID NO: 652252 - protein, 23 aa, Mycobacterium
EGIPKLRIEEAAARTQARIDSGM

SEQ ID NO: 652253 - protein, 23 aa, Mycobacterium
EGIPKLRIEEAAARTQARIDSGQ

SEQ ID NO: 652254 - protein, 17 aa, Mycobacterium
EGIPMAEPLGPHRLVAA

SEQ ID NO: 652255 - protein, 19 aa, Mycobacterium
EGIRFLVYGNLDYGLKKAG

SEQ ID NO: 652256 - protein, 26 aa, Mycobacterium
EGIRGFEVLEALPFDERRLRQALNAL

SEQ ID NO: 652257 - protein, 27 aa, Mycobacterium
EGIRGLSKVAALEWGRDNIRVNVICPF

SEQ ID NO: 652258 - protein, 23 aa, Mycobacterium
EGIRKIRAAFGVLDQFREHDLTV

SEQ ID NO: 652259 - protein, 20 aa, Mycobacterium
EGITDWVGFLSHINERHPGL

SEQ ID NO: 652260 - protein, 18 aa, Mycobacterium
EGITWEWESFPEYLDAVG

SEQ ID NO: 652261 - protein, 21 aa, Mycobacterium
EGITWLAGHLQQRWARNSGGL

SEQ ID NO: 652262 - protein, 25 aa, Mycobacterium
EGIVKRLKMGLEHLAGYENHTGVLV

SEQ ID NO: 652263 - protein, 17 aa, Mycobacterium
EGIWNFRDVGGADSPVT

SEQ ID NO: 652264 - protein, 17 aa, Mycobacterium
EGIYAIIDVKAEPATVS

SEQ ID NO: 652265 - protein, 25 aa, Mycobacterium
EGKADKTELGWRMEVDIDGDWRFFD

SEQ ID NO: 652266 - protein, 25 aa, Mycobacterium
EGKALARICALNALAAVDSLVGIDS

SEQ ID NO: 652267 - protein, 18 aa, Mycobacterium
EGKAPYPFTGTIREVVFD

SEQ ID NO: 652268 - protein, 24 aa, Mycobacterium
EGKAQWYRNRWVRTPSVSKTLGET

SEQ ID NO: 652269 - protein, 19 aa, Mycobacterium
EGKDVFLKDIWPSQKDVSD

SEQ ID NO: 652270 - protein, 19 aa, Mycobacterium
EGKHIFGQLVAEADAVFAN

SEQ ID NO: 652271 - protein, 18 aa, Mycobacterium
EGKIRTVYEPVVKTTIIA

SEQ ID NO: 652272 - protein, 24 aa, Mycobacterium
EGKLFKALHLPLNFQGNDRNTFAA

SEQ ID NO: 652273 - protein, 24 aa, Mycobacterium
EGKLYLCAIKDVFSNRIVGYSIDA

SEQ ID NO: 652274 - protein, 24 aa, Mycobacterium
EGKLYLCAIKDVFSNRIVGYSIDS

SEQ ID NO: 652275 - protein, 21 aa, Mycobacterium
EGKLYLCALKDVYSNRIVGYS

SEQ ID NO: 652276 - protein, 22 aa, Mycobacterium
EGKQRFVREWGDKLRADMQATV

SEQ ID NO: 652277 - protein, 24 aa, Mycobacterium
EGKRFMFDYIPSVFKGQYAETEEE

SEQ ID NO: 652278 - protein, 25 aa, Mycobacterium
EGKRFMFDYIPSVFKGQYAETEEEA

SEQ ID NO: 652279 - protein, 22 aa, Mycobacterium
EGKRSYAAAVHRATRPGATLLM

SEQ ID NO: 652280 - protein, 20 aa, Mycobacterium
EGKSHKQALIALARRRINVI

SEQ ID NO: 652281 - protein, 20 aa, Mycobacterium
EGKVKVELALARGKRAYDKR

SEQ ID NO: 652282 - protein, 19 aa, Mycobacterium
EGKVRSVFEPVVKTTVIAP

SEQ ID NO: 652283 - protein, 17 aa, Mycobacterium
EGKWRCAAMGRKALTSL

SEQ ID NO: 652284 - protein, 18 aa, Mycobacterium
EGLAAGPDVVFCVHSEVR

SEQ ID NO: 652285 - protein, 18 aa, Mycobacterium
EGLAAIYERAAWTGSVAR

SEQ ID NO: 652286 - protein, 18 aa, Mycobacterium
EGLAAVLTGAADQARAAV

SEQ ID NO: 652287 - protein, 20 aa, Mycobacterium
EGLADAFVHRTGHGIGLSVH

SEQ ID NO: 652288 - protein, 26 aa, Mycobacterium
EGLAGLRVDAGLARLLGLSRSAVAAI

SEQ ID NO: 652289 - protein, 23 aa, Mycobacterium
EGLAKGRLPAGLVANAELHKLEA

SEQ ID NO: 652290 - protein, 18 aa, Mycobacterium
EGLALLRRVVDRFGTGEL

SEQ ID NO: 652291 - protein, 19 aa, Mycobacterium
EGLARLGGEAALTGVGHVV

SEQ ID NO: 652292 - protein, 22 aa, Mycobacterium
EGLATRIARPPHNWTPDVIWNA

SEQ ID NO: 652293 - protein, 25 aa, Mycobacterium
EGLDGFCSASLLIDRASGRGVSSAT

SEQ ID NO: 652294 - protein, 17 aa, Mycobacterium
EGLDIPKSALGAGLGMR

SEQ ID NO: 652295 - protein, 25 aa, Mycobacterium
EGLEEIRNVLDIFLEREESWVSVSR

SEQ ID NO: 652296 - protein, 22 aa, Mycobacterium
EGLGATLSRYGITGVTDATPDL

SEQ ID NO: 652297 - protein, 25 aa, Mycobacterium
EGLGEIEDLHIWTAESVRSERLDFR

SEQ ID NO: 652298 - protein, 25 aa, Mycobacterium
EGLGEIFAAAGAQWRQAGCSMCLGM

SEQ ID NO: 652299 - protein, 25 aa, Mycobacterium
EGLGEIFTAAGAEWRQAGCSMCLGM

SEQ ID NO: 652300 - protein, 19 aa, Mycobacterium
EGLGLFTQRFRIWGSSDFR

SEQ ID NO: 652301 - protein, 18 aa, Mycobacterium
EGLGQTRQRVCATPPPQP

SEQ ID NO: 652302 - protein, 27 aa, Mycobacterium
EGLHAARRALPVSFAGRSWWVAIEDIG

SEQ ID NO: 652303 - protein, 17 aa, Mycobacterium
EGLHVRSGAIARGGLRF

SEQ ID NO: 652304 - protein, 20 aa, Mycobacterium
EGLLAQQPRRGFIVLPVTRR

SEQ ID NO: 652305 - protein, 18 aa, Mycobacterium
EGLLGRKALAQMKTDAVL

SEQ ID NO: 652306 - protein, 18 aa, Mycobacterium
EGLLPYLPPDAQDRLLDS

SEQ ID NO: 652307 - protein, 18 aa, Mycobacterium
EGLLPYLPPQAQDRLLDN

SEQ ID NO: 652308 - protein, 33 aa, Mycobacterium
EGLLRAAGLLLLWARGYVEPVLAPRSPRHIAAQ

SEQ ID NO: 652309 - protein, 18 aa, Mycobacterium
EGLNWHWETFPEYLDALA

SEQ ID NO: 652310 - protein, 24 aa, Mycobacterium
EGLNYLYRRGEFHDAPRPDLILLD

SEQ ID NO: 652311 - protein, 21 aa, Mycobacterium
EGLPEGFSFHDLRHYLASLLI

SEQ ID NO: 652312 - protein, 23 aa, Mycobacterium
EGLPGRRYYGGCEYVDVVENIAR

SEQ ID NO: 652313 - protein, 21 aa, Mycobacterium
EGLPHIPVRLRARSWHRYPEP

SEQ ID NO: 652314 - protein, 21 aa, Mycobacterium
EGLPTGAALLVVKRGPNAGSR

SEQ ID NO: 652315 - protein, 26 aa, Mycobacterium
EGLPWCDGAFELLERLVAEGTPMALV

SEQ ID NO: 652316 - protein, 22 aa, Mycobacterium
EGLPYFSIGMANNFIQMSKTLG

SEQ ID NO: 652317 - protein, 18 aa, Mycobacterium
EGLQPLIFGLWTMISEYK

SEQ ID NO: 652318 - protein, 23 aa, Mycobacterium
EGLRGAPMVHPYVASKWGVRGLA

SEQ ID NO: 652319 - protein, 22 aa, Mycobacterium
EGLRITPVRIWHEGRFLGDVAK

SEQ ID NO: 652320 - protein, 19 aa, Mycobacterium
EGLRKLFRQFSFPGGIPSH

SEQ ID NO: 652321 - protein, 24 aa, Mycobacterium
EGLRRLFRQFSFPGGIPSHVAAQT

SEQ ID NO: 652322 - protein, 17 aa, Mycobacterium
EGLRTWSEMRAFLGDQA

SEQ ID NO: 652323 - protein, 19 aa, Mycobacterium
EGLRWCADHPEALADGGYR

SEQ ID NO: 652324 - protein, 18 aa, Mycobacterium
EGLSDGNVAIFIKRHNAS

SEQ ID NO: 652325 - protein, 21 aa, Mycobacterium
EGLVAQQPRRGFVVLPVTKRD

SEQ ID NO: 652326 - protein, 19 aa, Mycobacterium
EGLVSRWLSQEITAAEARA

SEQ ID NO: 652327 - protein, 30 aa, Mycobacterium
EGLVVDTDLRWRIVIALARSGEIDADGPET

SEQ ID NO: 652328 - protein, 18 aa, Mycobacterium
EGLYAVVVDREMSALLDG

SEQ ID NO: 652329 - protein, 18 aa, Mycobacterium
EGLYAVVVDREMSALLQG

SEQ ID NO: 652330 - protein, 27 aa, Mycobacterium
EGLYHFAWDEFCDWYLELAKVQMVDRA

SEQ ID NO: 652331 - protein, 22 aa, Mycobacterium
EGMDGCTVVRGHARFEDPHTLR

SEQ ID NO: 652332 - protein, 19 aa, Mycobacterium
EGMDGCTVVRGHAVFTDPH

SEQ ID NO: 652333 - protein, 18 aa, Mycobacterium
EGMEAWYDWLRRFLTAGR

SEQ ID NO: 652334 - protein, 22 aa, Mycobacterium
EGMEGVSFLWGTIIEEYLQRCE

SEQ ID NO: 652335 - protein, 17 aa, Mycobacterium
EGMFCYEELIAGGEVGD

SEQ ID NO: 652336 - protein, 19 aa, Mycobacterium
EGMGLPLSQVRPAYEDPLA

SEQ ID NO: 652337 - protein, 25 aa, Mycobacterium
EGMGVPARRVTTCEEFADALRSAVA

SEQ ID NO: 652338 - protein, 24 aa, Mycobacterium
EGMKEESVGFLFNVTVEAVPTPQV

SEQ ID NO: 652339 - protein, 19 aa, Mycobacterium
EGMNGHWLDRITAALAAQP

SEQ ID NO: 652340 - protein, 19 aa, Mycobacterium
EGMRCYKQFVSALLDVVDN

SEQ ID NO: 652341 - protein, 20 aa, Mycobacterium
EGMTAHWLDRIATALAAQPE

SEQ ID NO: 652342 - protein, 18 aa, Mycobacterium
EGMWRASPQFESWQAVMA

SEQ ID NO: 652343 - protein, 22 aa, Mycobacterium
EGNLTELELQWGRTIGQQPSPY

SEQ ID NO: 652344 - protein, 17 aa, Mycobacterium
EGNLVPVADGFFRLTTG

SEQ ID NO: 652345 - protein, 18 aa, Mycobacterium
EGNPSWIPAASPASPESL

SEQ ID NO: 652346 - protein, 24 aa, Mycobacterium
EGPAGELLPLMSLPAQMQQDLIDL

SEQ ID NO: 652347 - protein, 21 aa, Mycobacterium
EGPAKLTAIVDGGTFLLSTLD

SEQ ID NO: 652348 - protein, 18 aa, Mycobacterium
EGPAVKRGVMASAAAKKA

SEQ ID NO: 652349 - protein, 32 aa, Mycobacterium
EGPAVVLCHGFPGLWYTWRHQLAALSAAGYRA

SEQ ID NO: 652350 - protein, 24 aa, Mycobacterium
EGPELPAYPVYGLLVEFLAYTGLR

SEQ ID NO: 652351 - protein, 23 aa, Mycobacterium
EGPFAEWFASWILNKEGEEHHRL

SEQ ID NO: 652352 - protein, 24 aa, Mycobacterium
EGPGERGVRVVPVMVPDRITDTEG

SEQ ID NO: 652353 - protein, 23 aa, Mycobacterium
EGPGESWIHPTVDLVTGETMTPL

SEQ ID NO: 652354 - protein, 19 aa, Mycobacterium
EGPGESWINPTVDLVNGEP

SEQ ID NO: 652355 - protein, 21 aa, Mycobacterium
EGPHPAPARIKALRGNGFRGM

SEQ ID NO: 652356 - protein, 24 aa, Mycobacterium
EGPKYYKWVRQWLDDLELKESFYT

SEQ ID NO: 652357 - protein, 17 aa, Mycobacterium
EGPLIRRYCHVGTGNYN

SEQ ID NO: 652358 - protein, 25 aa, Mycobacterium
EGPLPQTRFVLRKALSAHLPVILVV

SEQ ID NO: 652359 - protein, 18 aa, Mycobacterium
EGPMDFKKRLIAQINSVV

SEQ ID NO: 652360 - protein, 21 aa, Mycobacterium
EGPMTPGALAIRERVRPPSMT

SEQ ID NO: 652361 - protein, 17 aa, Mycobacterium
EGPPPEFMETFRAGLAD

SEQ ID NO: 652362 - protein, 20 aa, Mycobacterium
EGPPRGAVAVADVILDKIAA

SEQ ID NO: 652363 - protein, 19 aa, Mycobacterium
EGPQLKVGIGLDVGPAYVG

SEQ ID NO: 652364 - protein, 22 aa, Mycobacterium
EGPRFCGHPDLAYALIPSTSPV

SEQ ID NO: 652365 - protein, 26 aa, Mycobacterium
EGPSYTRPPSWRGLDVPEVLLSGDHA

SEQ ID NO: 652366 - protein, 26 aa, Mycobacterium
EGPSYTRPPSWRGLDVPPVLLSGDHA

SEQ ID NO: 652367 - protein, 26 aa, Mycobacterium
EGPSYTRPPTWRGLDVPEVLLSGDHA

SEQ ID NO: 652368 - protein, 18 aa, Mycobacterium
EGPTGIAGVFQYACVAAG

SEQ ID NO: 652369 - protein, 26 aa, Mycobacterium
EGPVSGPLPVMFFIHGGGYFLGSSAT

SEQ ID NO: 652370 - protein, 23 aa, Mycobacterium
EGQGPWPGGMEWEYVEKPESQWL

SEQ ID NO: 652371 - protein, 18 aa, Mycobacterium
EGQGRPGYNEFFPALLDE

SEQ ID NO: 652372 - protein, 26 aa, Mycobacterium
EGQGSLARLSAVWGGTASDAYVAVQN

SEQ ID NO: 652373 - protein, 20 aa, Mycobacterium
EGQLGKWSRMDAELIAEHAE

SEQ ID NO: 652374 - protein, 19 aa, Mycobacterium
EGQLGKWSRMDAELVAEHA

SEQ ID NO: 652375 - protein, 22 aa, Mycobacterium
EGQLKVLPSFGVIPASPMLFDM

SEQ ID NO: 652376 - protein, 25 aa, Mycobacterium
EGQLSRWTRFSAHRVATMDPTRRLA

SEQ ID NO: 652377 - protein, 20 aa, Mycobacterium
EGQPRRAAVSAYGLSGTNVH

SEQ ID NO: 652378 - protein, 23 aa, Mycobacterium
EGQQLRVSVPMGEFTLDDSADPL

SEQ ID NO: 652379 - protein, 19 aa, Mycobacterium
EGQRFSRRVYESVEEAQAE

SEQ ID NO: 652380 - protein, 25 aa, Mycobacterium
EGQRVCALLAGGGYAEYVAVPAGQV

SEQ ID NO: 652381 - protein, 18 aa, Mycobacterium
EGQRVFNRYGSPPVPLVP

SEQ ID NO: 652382 - protein, 24 aa, Mycobacterium
EGQTRPDVFAVHRIDEQLTKAMDR

SEQ ID NO: 652383 - protein, 23 aa, Mycobacterium
EGRAKTGRNGAVWQSEAVTALQG

SEQ ID NO: 652384 - protein, 19 aa, Mycobacterium
EGRAPGGFAQHLRNLSRSD

SEQ ID NO: 652385 - protein, 25 aa, Mycobacterium
EGRARPVTALGHWVHVYVDRTSRKP

SEQ ID NO: 652386 - protein, 21 aa, Mycobacterium
EGRCGSCVATVVAGEVDMVPC

SEQ ID NO: 652387 - protein, 23 aa, Mycobacterium
EGRCSACKSYVLDGEIQMESYST

SEQ ID NO: 652388 - protein, 20 aa, Mycobacterium
EGRELPPPQQARMRDSQRAG

SEQ ID NO: 652389 - protein, 22 aa, Mycobacterium
EGRELYAIEGFGVPGPQAAGAA

SEQ ID NO: 652390 - protein, 17 aa, Mycobacterium
EGREVWASYFYAQVEES

SEQ ID NO: 652391 - protein, 19 aa, Mycobacterium
EGRFDREITPLDAPQVDKE

SEQ ID NO: 652392 - protein, 20 aa, Mycobacterium
EGRGLFFKTLYPALWRFPPI

SEQ ID NO: 652393 - protein, 22 aa, Mycobacterium
EGRGRPAKRYRLTAAGRAKLEH

SEQ ID NO: 652394 - protein, 22 aa, Mycobacterium
EGRGWHDARVIPYGPIELDPSA

SEQ ID NO: 652395 - protein, 25 aa, Mycobacterium
EGRGWRWHTWHLYPLHPGGSGGTVV

SEQ ID NO: 652396 - protein, 21 aa, Mycobacterium
EGRGWWRVVHDAVRAPTGSLT

SEQ ID NO: 652397 - protein, 26 aa, Mycobacterium
EGRIHPECKMNFLASPLLVVAYALAG

SEQ ID NO: 652398 - protein, 22 aa, Mycobacterium
EGRKPGSYFWFKGRNRARQLAE

SEQ ID NO: 652399 - protein, 22 aa, Mycobacterium
EGRKSEFAEHGWDAGEIPDPQD

SEQ ID NO: 652400 - protein, 33 aa, Mycobacterium
EGRKTRIYCPDWVGLFRWLKPVLSTPLGELPVR

SEQ ID NO: 652401 - protein, 19 aa, Mycobacterium
EGRLAGIMRRIHDRCLTTA

SEQ ID NO: 652402 - protein, 23 aa, Mycobacterium
EGRLPQTVSLSFTSYAGMDIGRD

SEQ ID NO: 652403 - protein, 21 aa, Mycobacterium
EGRLRPDVVLVTRSPLPDDGP

SEQ ID NO: 652404 - protein, 18 aa, Mycobacterium
EGRLRRFDCSQMTDGAAG

SEQ ID NO: 652405 - protein, 19 aa, Mycobacterium
EGRLRRFDCSQMTDGGAGL

SEQ ID NO: 652406 - protein, 20 aa, Mycobacterium
EGRLRRLDCSQMTDGGAGVV

SEQ ID NO: 652407 - protein, 20 aa, Mycobacterium
EGRRAIRYIGNFIKDVTAAR

SEQ ID NO: 652408 - protein, 31 aa, Mycobacterium
EGRRIASMIPDARFEVMPGCGHWPQYEDPKT

SEQ ID NO: 652409 - protein, 21 aa, Mycobacterium
EGRRIASMIPGARFEVMPGCG

SEQ ID NO: 652410 - protein, 22 aa, Mycobacterium
EGRRIASMIPGARFEVMPGCGH

SEQ ID NO: 652411 - protein, 19 aa, Mycobacterium
EGRRIAWRPAVAGEQPLGH

SEQ ID NO: 652412 - protein, 19 aa, Mycobacterium
EGRRQRLTVTYQRRGYTPA

SEQ ID NO: 652413 - protein, 19 aa, Mycobacterium
EGRRRWREAQDMLVRSWAE

SEQ ID NO: 652414 - protein, 34 aa, Mycobacterium
EGRRSRVYCPGWVALFRWIKPVLSTPVGELPLHK

SEQ ID NO: 652415 - protein, 27 aa, Mycobacterium
EGRRVHKTVHHYLMRFLGGELSDDDVE

SEQ ID NO: 652416 - protein, 19 aa, Mycobacterium
EGRSGVWVAGDGGRPDRKI

SEQ ID NO: 652417 - protein, 27 aa, Mycobacterium
EGRSRLVTVSSRLAGFFVPMGADSEGP

SEQ ID NO: 652418 - protein, 24 aa, Mycobacterium
EGRSSVATWLFGIVKNTASRHRRR

SEQ ID NO: 652419 - protein, 24 aa, Mycobacterium
EGRSSVATWLFGIVKNTASRYRRR

SEQ ID NO: 652420 - protein, 17 aa, Mycobacterium
EGRSVAGAAHFLEHLLF

SEQ ID NO: 652421 - protein, 28 aa, Mycobacterium
EGRSVLRPDIDLRRTVGWFTTYYPVPLV

SEQ ID NO: 652422 - protein, 21 aa, Mycobacterium
EGRTDWRTVRLVITRTDLVTD

SEQ ID NO: 652423 - protein, 22 aa, Mycobacterium
EGRTRFRPHFFPFTEPSAEVDI

SEQ ID NO: 652424 - protein, 17 aa, Mycobacterium
EGRVVFVRYALPGERVR

SEQ ID NO: 652425 - protein, 25 aa, Mycobacterium
EGRVVGQIPVCWDPDKDAAIARAHD

SEQ ID NO: 652426 - protein, 20 aa, Mycobacterium
EGRYEYRWWDGQSWTDQVSH

SEQ ID NO: 652427 - protein, 24 aa, Mycobacterium
EGRYRPFEPALRWSTEQASQSDHQ

SEQ ID NO: 652428 - protein, 19 aa, Mycobacterium
EGSAEHFCMLVTQRRPPAA

SEQ ID NO: 652429 - protein, 20 aa, Mycobacterium
EGSARARNVLAIKLDAQLVD

SEQ ID NO: 652430 - protein, 19 aa, Mycobacterium
EGSEEAWLLVKRSDDHAVA

SEQ ID NO: 652431 - protein, 18 aa, Mycobacterium
EGSEILLMTGTEREEFVS

SEQ ID NO: 652432 - protein, 26 aa, Mycobacterium
EGSEPPRGVLEVGYQIGCGIDMGANG

SEQ ID NO: 652433 - protein, 18 aa, Mycobacterium
EGSGRGEIYSWTVVYRPV

SEQ ID NO: 652434 - protein, 23 aa, Mycobacterium
EGSHATELLAVFGNYRGPAGPIL

SEQ ID NO: 652435 - protein, 24 aa, Mycobacterium
EGSILARRGCVYVSANYRVGAFGA

SEQ ID NO: 652436 - protein, 20 aa, Mycobacterium
EGSITYNEWSFAQAQHLNMA

SEQ ID NO: 652437 - protein, 22 aa, Mycobacterium
EGSKGVSCFLVPGDLPGLSFGK

SEQ ID NO: 652438 - protein, 20 aa, Mycobacterium
EGSLRDRLVAVVLAQAESVA

SEQ ID NO: 652439 - protein, 26 aa, Mycobacterium
EGSLRGTYRLTVCKPGSGDAPSVAYR

SEQ ID NO: 652440 - protein, 21 aa, Mycobacterium
EGSLRIGDKVVLGRDNVINTY

SEQ ID NO: 652441 - protein, 24 aa, Mycobacterium
EGSLRRLGVDHVDLYYQHRVDPQV

SEQ ID NO: 652442 - protein, 18 aa, Mycobacterium
EGSPEMRVELGFTGGPGF

SEQ ID NO: 652443 - protein, 20 aa, Mycobacterium
EGSQGISCFLVPRDTEGLTF

SEQ ID NO: 652444 - protein, 22 aa, Mycobacterium
EGSRAAPGYAAYAAAKAGVVNY

SEQ ID NO: 652445 - protein, 37 aa, Mycobacterium
EGSRDARVGYVFQDPRLLPWRTVMANLGFVQHERTGC

SEQ ID NO: 652446 - protein, 17 aa, Mycobacterium
EGSRPGVDLMVAAESGM

SEQ ID NO: 652447 - protein, 19 aa, Mycobacterium
EGSTAWLSTLGKLLISGHP

SEQ ID NO: 652448 - protein, 18 aa, Mycobacterium
EGSTPCEIAADQLPQAGQ

SEQ ID NO: 652449 - protein, 20 aa, Mycobacterium
EGSVADRLIVKGAREHNLRG

SEQ ID NO: 652450 - protein, 18 aa, Mycobacterium
EGSVEFVHGPGCPVCVTP

SEQ ID NO: 652451 - protein, 22 aa, Mycobacterium
EGSVTYNEWSFGLAQKLTMARI

SEQ ID NO: 652452 - protein, 19 aa, Mycobacterium
EGTEFRAGVNVGVDISAEQ

SEQ ID NO: 652453 - protein, 21 aa, Mycobacterium
EGTEFRAGVNVGVDITAEQLR

SEQ ID NO: 652454 - protein, 22 aa, Mycobacterium
EGTEFRAGVNVGVDITAEQLRA

SEQ ID NO: 652455 - protein, 19 aa, Mycobacterium
EGTEFRTGVNVGKDITAAQ

SEQ ID NO: 652456 - protein, 33 aa, Mycobacterium
EGTGFAIAQARLGPGRIHHCMRALGGAERALAL

SEQ ID NO: 652457 - protein, 18 aa, Mycobacterium
EGTGPWIAHWEPGPSTQP

SEQ ID NO: 652458 - protein, 19 aa, Mycobacterium
EGTIGLWRALAEVVETNGG

SEQ ID NO: 652459 - protein, 21 aa, Mycobacterium
EGTKYDRVVADLGPMTVNSQS

SEQ ID NO: 652460 - protein, 18 aa, Mycobacterium
EGTMRFGPDPLVGGDSIT

SEQ ID NO: 652461 - protein, 24 aa, Mycobacterium
EGTNLKAWLYRILTNTYINIYRKK

SEQ ID NO: 652462 - protein, 18 aa, Mycobacterium
EGTPADQVLQHWLASARR

SEQ ID NO: 652463 - protein, 24 aa, Mycobacterium
EGTPDSFAPFIFRKQTAEPHEIVV

SEQ ID NO: 652464 - protein, 18 aa, Mycobacterium
EGTPSIFQETAFRFTDGS

SEQ ID NO: 652465 - protein, 19 aa, Mycobacterium
EGTPSIFQETAFRFTDGSG

SEQ ID NO: 652466 - protein, 18 aa, Mycobacterium
EGTQQGWLIEQARKHRVF

SEQ ID NO: 652467 - protein, 18 aa, Mycobacterium
EGTQQGWLVEQARKHRVL

SEQ ID NO: 652468 - protein, 30 aa, Mycobacterium
EGTRPPILDPFDPVTVWGYDECDLTEPSRA

SEQ ID NO: 652469 - protein, 20 aa, Mycobacterium
EGTVGFTMQAFEVVPQDLAK

SEQ ID NO: 652470 - protein, 20 aa, Mycobacterium
EGTVSMRWTLLAMIQEFARH

SEQ ID NO: 652471 - protein, 20 aa, Mycobacterium
EGTVTRWLKEVGDTVEVDEP

SEQ ID NO: 652472 - protein, 19 aa, Mycobacterium
EGTVTRWLKNVGDKVEVDE

SEQ ID NO: 652473 - protein, 20 aa, Mycobacterium
EGTVTRWLKQEGDTVEVDEP

SEQ ID NO: 652474 - protein, 17 aa, Mycobacterium
EGTWWKHRPIFNQEDPG

SEQ ID NO: 652475 - protein, 22 aa, Mycobacterium
EGVALLRRVVERFGSGELQIDF

SEQ ID NO: 652476 - protein, 18 aa, Mycobacterium
EGVDAVIYDEEFTETVDR

SEQ ID NO: 652477 - protein, 25 aa, Mycobacterium
EGVDEARALYEWNHAKQILRIQAGN

SEQ ID NO: 652478 - protein, 18 aa, Mycobacterium
EGVDVPRLAVGIYATSAS

SEQ ID NO: 652479 - protein, 18 aa, Mycobacterium
EGVDVPRLAVGVYATSAS

SEQ ID NO: 652480 - protein, 23 aa, Mycobacterium
EGVDVRLGVGVAEVRGDTRVEAV

SEQ ID NO: 652481 - protein, 22 aa, Mycobacterium
EGVEARLSRYSYLVSLMPRQII

SEQ ID NO: 652482 - protein, 22 aa, Mycobacterium
EGVEAYGRLDVIVANAGICVPA

SEQ ID NO: 652483 - protein, 18 aa, Mycobacterium
EGVEIVFTPTGSDMYPDG

SEQ ID NO: 652484 - protein, 19 aa, Mycobacterium
EGVELLLPLVDKGIRVKAT

SEQ ID NO: 652485 - protein, 21 aa, Mycobacterium
EGVELWTPCFSERDVHPLEAD

SEQ ID NO: 652486 - protein, 17 aa, Mycobacterium
EGVETIGAMLFLHGGPE

SEQ ID NO: 652487 - protein, 18 aa, Mycobacterium
EGVFERFDGLKFVWGDGA

SEQ ID NO: 652488 - protein, 24 aa, Mycobacterium
EGVFPAGVIDAMFAHHIDELLRLA

SEQ ID NO: 652489 - protein, 25 aa, Mycobacterium
EGVGTWLVLCCRAMQAGAKEALAIA

SEQ ID NO: 652490 - protein, 19 aa, Mycobacterium
EGVHTLPMLYALRDTGPDA

SEQ ID NO: 652491 - protein, 18 aa, Mycobacterium
EGVKAADVFAEFGENIEM

SEQ ID NO: 652492 - protein, 20 aa, Mycobacterium
EGVKAEFPDQMLAYNCSPSF

SEQ ID NO: 652493 - protein, 30 aa, Mycobacterium
EGVKLPVVLFFHGGGWSVGDLDSYDATARR

SEQ ID NO: 652494 - protein, 17 aa, Mycobacterium
EGVKRLGKFSVQPTREN

SEQ ID NO: 652495 - protein, 18 aa, Mycobacterium
EGVLLHFAGATSPEESTV

SEQ ID NO: 652496 - protein, 27 aa, Mycobacterium
EGVLPASMGRPEFPTPVGNYTVLSKER

SEQ ID NO: 652497 - protein, 17 aa, Mycobacterium
EGVLPILERKRLWHRPH

SEQ ID NO: 652498 - protein, 19 aa, Mycobacterium
EGVLRFFQYVAARTNIALG

SEQ ID NO: 652499 - protein, 22 aa, Mycobacterium
EGVLRVFELHPLFNPTGYVVAE

SEQ ID NO: 652500 - protein, 34 aa, Mycobacterium
EGVPPAALRPEPRLPVPSGWPFGEDFPRTCGAGR

SEQ ID NO: 652501 - protein, 21 aa, Mycobacterium
EGVPPKPVRLTLLQDLFERLR

SEQ ID NO: 652502 - protein, 19 aa, Mycobacterium
EGVPRIPDDLALAPVETLA

SEQ ID NO: 652503 - protein, 21 aa, Mycobacterium
EGVQLPFMWQQVSLHGVGATR

SEQ ID NO: 652504 - protein, 26 aa, Mycobacterium
EGVRLADPVAAWPHSIPTLAGADAVA

SEQ ID NO: 652505 - protein, 17 aa, Mycobacterium
EGVRLFRFDRIVEASEL

SEQ ID NO: 652506 - protein, 27 aa, Mycobacterium
EGVRLLRSGGIIVVHRAALGGRAGDPA

SEQ ID NO: 652507 - protein, 26 aa, Mycobacterium
EGVRLLRSGGVIVVHRAALGGRAGDP

SEQ ID NO: 652508 - protein, 21 aa, Mycobacterium
EGVSGAFSFASCNDQGDPPFQ

SEQ ID NO: 652509 - protein, 30 aa, Mycobacterium
EGVSTPAEFDRIWVASGMSPIGVFRAIDRV

SEQ ID NO: 652510 - protein, 20 aa, Mycobacterium
EGVTGQWLIFFNNPSRPGGG

SEQ ID NO: 652511 - protein, 21 aa, Mycobacterium
EGVTLRFGSKVPGSAMEVRDV

SEQ ID NO: 652512 - protein, 21 aa, Mycobacterium
EGVTLRFGSKVPGTAMEVRDV

SEQ ID NO: 652513 - protein, 25 aa, Mycobacterium
EGVTSFKFFMAYKGVFLSDDGQILR

SEQ ID NO: 652514 - protein, 23 aa, Mycobacterium
EGVTSFKLFMAYPGVYYSDDGQI

SEQ ID NO: 652515 - protein, 23 aa, Mycobacterium
EGVTSFKLFMAYPGVYYSTDGQI

SEQ ID NO: 652516 - protein, 27 aa, Mycobacterium
EGVTVRPLREMTGGALFNEVFIDDVFV

SEQ ID NO: 652517 - protein, 19 aa, Mycobacterium
EGVVAEWLPESSEAADASP

SEQ ID NO: 652518 - protein, 17 aa, Mycobacterium
EGVVGFRVSGRLTGNEL

SEQ ID NO: 652519 - protein, 23 aa, Mycobacterium
EGVVPILRKRGLFDAGALDCAPA

SEQ ID NO: 652520 - protein, 24 aa, Mycobacterium
EGVVSRIGDLPVRAIVRSPMLRCE

SEQ ID NO: 652521 - protein, 25 aa, Mycobacterium
EGVVWGIDSFDQWGVELGKTQAKAL

SEQ ID NO: 652522 - protein, 20 aa, Mycobacterium
EGVWKPYIRCLTASSEPQTL

SEQ ID NO: 652523 - protein, 20 aa, Mycobacterium
EGVWLRPFRTLIYTMPPYIC

SEQ ID NO: 652524 - protein, 22 aa, Mycobacterium
EGVYQCRACGAELFRSTEKFES

SEQ ID NO: 652525 - protein, 24 aa, Mycobacterium
EGVYRFLLKRNRRLYGVAYTLDNV

SEQ ID NO: 652526 - protein, 23 aa, Mycobacterium
EGVYRFLLRRNRRLYGVAYTLDK

SEQ ID NO: 652527 - protein, 17 aa, Mycobacterium
EGWAVMPPQFQRDLRQK

SEQ ID NO: 652528 - protein, 18 aa, Mycobacterium
EGWRNWRGTTPAERQIAL

SEQ ID NO: 652529 - protein, 19 aa, Mycobacterium
EGYAAASIEGIRSASSNKT

SEQ ID NO: 652530 - protein, 19 aa, Mycobacterium
EGYAAASIEGIRSASSNRP

SEQ ID NO: 652531 - protein, 18 aa, Mycobacterium
EGYACEWKGVLQDPDKLA

SEQ ID NO: 652532 - protein, 19 aa, Mycobacterium
EGYAEDWDLETLWTALKTL

SEQ ID NO: 652533 - protein, 20 aa, Mycobacterium
EGYAGWRKAVQRTLDWVSIT

SEQ ID NO: 652534 - protein, 30 aa, Mycobacterium
EGYAPKGIFPWYAPGRDDFLGEFPLSSESI

SEQ ID NO: 652535 - protein, 24 aa, Mycobacterium
EGYDLADLSLPWGQDEMIAAVAAA

SEQ ID NO: 652536 - protein, 18 aa, Mycobacterium
EGYDMFTAMLDGLKEESV

SEQ ID NO: 652537 - protein, 22 aa, Mycobacterium
EGYFINQHIIWRVGDEDVAEMN

SEQ ID NO: 652538 - protein, 19 aa, Mycobacterium
EGYGAASIEGIRSSSSNPP

SEQ ID NO: 652539 - protein, 24 aa, Mycobacterium
EGYGEGKWSPWQWNSILIEGSHCR

SEQ ID NO: 652540 - protein, 28 aa, Mycobacterium
EGYGKTSWNVRAIWEMYTGWFRHRSTTE

SEQ ID NO: 652541 - protein, 17 aa, Mycobacterium
EGYKMSGNAPIYAILRE

SEQ ID NO: 652542 - protein, 18 aa, Mycobacterium
EGYLKYAESYGEQIAVYV

SEQ ID NO: 652543 - protein, 24 aa, Mycobacterium
EGYNLNMATPWIAAERGYIDAVIQ

SEQ ID NO: 652544 - protein, 21 aa, Mycobacterium
EHAAALGWPGVDHEWHHGWLL

SEQ ID NO: 652545 - protein, 24 aa, Mycobacterium
EHAAVLWRYALRLTGDASQAEDVV

SEQ ID NO: 652546 - protein, 18 aa, Mycobacterium
EHACRRGLDRTAFGKPLV

SEQ ID NO: 652547 - protein, 22 aa, Mycobacterium
EHADRFLVAVTFRMGRLGVPVV

SEQ ID NO: 652548 - protein, 22 aa, Mycobacterium
EHADRIAALMITYPSTHGVYEH

SEQ ID NO: 652549 - protein, 22 aa, Mycobacterium
EHADRLSALMITYPSTHGVYEH

SEQ ID NO: 652550 - protein, 30 aa, Mycobacterium
EHAERHWRELGRPLPLHRILLQRSWIAIFW

SEQ ID NO: 652551 - protein, 29 aa, Mycobacterium
EHAERWMNWASCFEMDFTFIHEGTVRQSA

SEQ ID NO: 652552 - protein, 26 aa, Mycobacterium
EHAFTWILPLMWRMDALYEARKSWVE

SEQ ID NO: 652553 - protein, 23 aa, Mycobacterium
EHAGDCWDLVIAELRRQEPGLRT

SEQ ID NO: 652554 - protein, 23 aa, Mycobacterium
EHAGRSTLWHHWNELDPAERHRL

SEQ ID NO: 652555 - protein, 17 aa, Mycobacterium
EHAHTIASFGWTRDDVR

SEQ ID NO: 652556 - protein, 17 aa, Mycobacterium
EHAHTWALVTEAFAALN

SEQ ID NO: 652557 - protein, 19 aa, Mycobacterium
EHAIALLLAAARQIPAADA

SEQ ID NO: 652558 - protein, 18 aa, Mycobacterium
EHAIRLRGLMSHLVYADA

SEQ ID NO: 652559 - protein, 22 aa, Mycobacterium
EHAKRMVELLAERGAGQWMTFT

SEQ ID NO: 652560 - protein, 27 aa, Mycobacterium
EHALRLAGLRPGMRVLDVGCGPGDVSF

SEQ ID NO: 652561 - protein, 20 aa, Mycobacterium
EHAMALLLAAARQIPAADAS

SEQ ID NO: 652562 - protein, 18 aa, Mycobacterium
EHANMFGLWLCPLGTDLP

SEQ ID NO: 652563 - protein, 20 aa, Mycobacterium
EHAPHGLALDTGRGLLYVSV

SEQ ID NO: 652564 - protein, 19 aa, Mycobacterium
EHAREAIMFRNGLKTYKLP

SEQ ID NO: 652565 - protein, 18 aa, Mycobacterium
EHARRYDHVAARFAESGL

SEQ ID NO: 652566 - protein, 23 aa, Mycobacterium
EHARSTAYHAVWALSDGSDDPAL

SEQ ID NO: 652567 - protein, 22 aa, Mycobacterium
EHAVWALMDFGFRVVISSRFAD

SEQ ID NO: 652568 - protein, 25 aa, Mycobacterium
EHCNFSYRDMEAWGRKMFVTPGVVV

SEQ ID NO: 652569 - protein, 20 aa, Mycobacterium
EHCPARRIVAGPKAIAEALP

SEQ ID NO: 652570 - protein, 23 aa, Mycobacterium
EHCWETKAGTFVKVPAYVVHSLK

SEQ ID NO: 652571 - protein, 29 aa, Mycobacterium
EHDAHLYLKRLLSWSAFLGGPDRYLTELG

SEQ ID NO: 652572 - protein, 24 aa, Mycobacterium
EHDAIEPKPDWEPYYHYRVVIDGD

SEQ ID NO: 652573 - protein, 20 aa, Mycobacterium
EHDGWAGGPERILDLTLRTG

SEQ ID NO: 652574 - protein, 24 aa, Mycobacterium
EHDLGIGDIATWVSHPGGPKVLEA

SEQ ID NO: 652575 - protein, 18 aa, Mycobacterium
EHDLHLYLRRASLNRAMF

SEQ ID NO: 652576 - protein, 19 aa, Mycobacterium
EHDRRYRLGGAPYLLNLMA

SEQ ID NO: 652577 - protein, 17 aa, Mycobacterium
EHDSEVVVPPGFEDDPE

SEQ ID NO: 652578 - protein, 24 aa, Mycobacterium
EHDVAIVLGSGWSPAVAALGTEAI

SEQ ID NO: 652579 - protein, 19 aa, Mycobacterium
EHDVAVVLGSGWSAAIAAL

SEQ ID NO: 652580 - protein, 17 aa, Mycobacterium
EHEAVAADRGWVPVSTT

SEQ ID NO: 652581 - protein, 18 aa, Mycobacterium
EHELAAAIHHCVRAGIAF

SEQ ID NO: 652582 - protein, 18 aa, Mycobacterium
EHELLRKLVRQVFTKAAI

SEQ ID NO: 652583 - protein, 21 aa, Mycobacterium
EHERIRLGLPPHPEFGPMPVV

SEQ ID NO: 652584 - protein, 22 aa, Mycobacterium
EHETEVYSWFAVDSAASDTYKK

SEQ ID NO: 652585 - protein, 22 aa, Mycobacterium
EHEVDCIVFATGFDVAKRGTPF

SEQ ID NO: 652586 - protein, 24 aa, Mycobacterium
EHFARLETTLALATIIRSVVVGSV

SEQ ID NO: 652587 - protein, 25 aa, Mycobacterium
EHFARLETTLALATIVRSMRVTSSD

SEQ ID NO: 652588 - protein, 24 aa, Mycobacterium
EHFERRGAHVVGFSRHVDEVPKSD

SEQ ID NO: 652589 - protein, 23 aa, Mycobacterium
EHFGRQRYGRFFKMAYNALPPGG

SEQ ID NO: 652590 - protein, 23 aa, Mycobacterium
EHFGRQRYGRFFKMAYQALPSDG

SEQ ID NO: 652591 - protein, 25 aa, Mycobacterium
EHFGWGSGIHTCMGGPLARLEVNLA

SEQ ID NO: 652592 - protein, 20 aa, Mycobacterium
EHFHREAVGIIPPNGVRIHV

SEQ ID NO: 652593 - protein, 24 aa, Mycobacterium
EHFIPEYQAGWLLEVDVNVVGADL

SEQ ID NO: 652594 - protein, 31 aa, Mycobacterium
EHGAPLWCRPHMLRHSFALRWYCIATFVAWR

SEQ ID NO: 652595 - protein, 25 aa, Mycobacterium
EHGDIPLGIYCRASLAQYMDAERLF

SEQ ID NO: 652596 - protein, 24 aa, Mycobacterium
EHGEIPLGIFCRGSLARHMDAERL

SEQ ID NO: 652597 - protein, 26 aa, Mycobacterium
EHGEIPLGIYCRASLAPYMDAERLFT

SEQ ID NO: 652598 - protein, 24 aa, Mycobacterium
EHGGDCIWVACTHGDVIKSVLADA

SEQ ID NO: 652599 - protein, 24 aa, Mycobacterium
EHGKALRAATTFELDDVIDPADSR

SEQ ID NO: 652600 - protein, 24 aa, Mycobacterium
EHGKALRAATTFELDDVIDPSASR

SEQ ID NO: 652601 - protein, 23 aa, Mycobacterium
EHGKAPVRRACYAADRTGHMILQ

SEQ ID NO: 652602 - protein, 23 aa, Mycobacterium
EHGNRLRCYVVGVSRGAREPLIT

SEQ ID NO: 652603 - protein, 23 aa, Mycobacterium
EHGPDLKPAYTITGASVPSEETL

SEQ ID NO: 652604 - protein, 25 aa, Mycobacterium
EHGQLPKMRAIVGFAAETGDANGDV

SEQ ID NO: 652605 - protein, 20 aa, Mycobacterium
EHGRRGVLIERVYDIAEALG

SEQ ID NO: 652606 - protein, 18 aa, Mycobacterium
EHGVDRLVAITVPGTPIE

SEQ ID NO: 652607 - protein, 26 aa, Mycobacterium
EHGVGRLKRDWLPKQLGDDVMWVTRR

SEQ ID NO: 652608 - protein, 27 aa, Mycobacterium
EHGVGRLKRPWLAGQLGPEAMELNRRI

SEQ ID NO: 652609 - protein, 22 aa, Mycobacterium
EHGVGRLKRPWLAGYLGPDAMD

SEQ ID NO: 652610 - protein, 23 aa, Mycobacterium
EHGVWLRPFRNLVYAMPPYICAP

SEQ ID NO: 652611 - protein, 17 aa, Mycobacterium
EHGWAGTAIRAVARTAG

SEQ ID NO: 652612 - protein, 19 aa, Mycobacterium
EHHCDFASLLPAARAVRER

SEQ ID NO: 652613 - protein, 19 aa, Mycobacterium
EHHGLKCVVLGHSMGGGIV

SEQ ID NO: 652614 - protein, 23 aa, Mycobacterium
EHHHGGFLLPGFVDTHMHFPQVY

SEQ ID NO: 652615 - protein, 18 aa, Mycobacterium
EHHPHLLPLADRTLEPTE

SEQ ID NO: 652616 - protein, 20 aa, Mycobacterium
EHHPHLTPLAQRVVEPTEPA

SEQ ID NO: 652617 - protein, 19 aa, Mycobacterium
EHHPHLVISTDFIKQRTRR

SEQ ID NO: 652618 - protein, 20 aa, Mycobacterium
EHHPPMRAFLAVPITIRETV

SEQ ID NO: 652619 - protein, 19 aa, Mycobacterium
EHHPPMRAFLGVPIMIRGT

SEQ ID NO: 652620 - protein, 19 aa, Mycobacterium
EHHPPRRFDVVVGADGLHS

SEQ ID NO: 652621 - protein, 20 aa, Mycobacterium
EHIADTFVAMGWELAEGPEV

SEQ ID NO: 652622 - protein, 24 aa, Mycobacterium
EHIEALGFGAVWVGGSPAAELAWV

SEQ ID NO: 652623 - protein, 24 aa, Mycobacterium
EHILFKPRWSAFYRTELEQHLRER

SEQ ID NO: 652624 - protein, 27 aa, Mycobacterium
EHIRRTRCLEMIDGPHVTHVLITSSGG

SEQ ID NO: 652625 - protein, 17 aa, Mycobacterium
EHIRVFPLSNWTEFDIW

SEQ ID NO: 652626 - protein, 19 aa, Mycobacterium
EHKAARLARLYGLGDDDTI

SEQ ID NO: 652627 - protein, 21 aa, Mycobacterium
EHKHRGPIEYLREQMIGTVQG

SEQ ID NO: 652628 - protein, 18 aa, Mycobacterium
EHKNHRYAFAPFGGGAHK

SEQ ID NO: 652629 - protein, 19 aa, Mycobacterium
EHLAHALVILMTVGGIPSI

SEQ ID NO: 652630 - protein, 25 aa, Mycobacterium
EHLARASVMALSYVAQSARGIYQPA

SEQ ID NO: 652631 - protein, 18 aa, Mycobacterium
EHLDRVEGFVKRAEADGA

SEQ ID NO: 652632 - protein, 22 aa, Mycobacterium
EHLEACPGCLKHYGLEERIKLL

SEQ ID NO: 652633 - protein, 19 aa, Mycobacterium
EHLERMLSLDNVFDSDELT

SEQ ID NO: 652634 - protein, 23 aa, Mycobacterium
EHLGHCVSHAVAAGGADADAKLA

SEQ ID NO: 652635 - protein, 18 aa, Mycobacterium
EHLGHCVSQAVAEGGQEA

SEQ ID NO: 652636 - protein, 24 aa, Mycobacterium
EHLIPRMVVVINHVRGYDNREDRR

SEQ ID NO: 652637 - protein, 24 aa, Mycobacterium
EHLIRANGGFAMFYGPRSAELRRG

SEQ ID NO: 652638 - protein, 23 aa, Mycobacterium
EHLKIQWAQAAARHGIALDPKFS

SEQ ID NO: 652639 - protein, 23 aa, Mycobacterium
EHLKIQWAQAAARHGLALDPRFT

SEQ ID NO: 652640 - protein, 19 aa, Mycobacterium
EHLLDVWRRPDLAPGGRAP

SEQ ID NO: 652641 - protein, 23 aa, Mycobacterium
EHLLIERAYRLGVTAPEMTVLVG

SEQ ID NO: 652642 - protein, 26 aa, Mycobacterium
EHLLPAVVRLLEEFGPIVVILDDVHK

SEQ ID NO: 652643 - protein, 19 aa, Mycobacterium
EHLLVERAYLLGVTAPEMT

SEQ ID NO: 652644 - protein, 19 aa, Mycobacterium
EHLPRFPLFGTASEFIGFL

SEQ ID NO: 652645 - protein, 18 aa, Mycobacterium
EHLPRWRRIAEGLRHSKT

SEQ ID NO: 652646 - protein, 17 aa, Mycobacterium
EHLRLPLREVIWGADAS

SEQ ID NO: 652647 - protein, 17 aa, Mycobacterium
EHLRRLVTGEILWAPAI

SEQ ID NO: 652648 - protein, 25 aa, Mycobacterium
EHLSALRAIPRLAVVRPADANETAY

SEQ ID NO: 652649 - protein, 24 aa, Mycobacterium
EHLTALCWDGGAALPFNADDIKTI

SEQ ID NO: 652650 - protein, 23 aa, Mycobacterium
EHMKAVVKRGGRVLVIDPRKTET

SEQ ID NO: 652651 - protein, 25 aa, Mycobacterium
EHMLRSAVIATRIADRLGLDRAERD

SEQ ID NO: 652652 - protein, 18 aa, Mycobacterium
EHMPLAGLILNRTHPTLC

SEQ ID NO: 652653 - protein, 26 aa, Mycobacterium
EHMTFATGIANIWARPAVTAHGGAAM

SEQ ID NO: 652654 - protein, 23 aa, Mycobacterium
EHNGLKPLPRWNELDPESVRFWE

SEQ ID NO: 652655 - protein, 32 aa, Mycobacterium
EHNPMIGFRGCYRYVKEPELFALELEALARVR

SEQ ID NO: 652656 - protein, 21 aa, Mycobacterium
EHNPVLGRRVWVDRWDTGLVD

SEQ ID NO: 652657 - protein, 27 aa, Mycobacterium
EHPATAFPKWLGRSWRRSAMLRYGENP

SEQ ID NO: 652658 - protein, 19 aa, Mycobacterium
EHPELLSGYLTHNFDVEDV

SEQ ID NO: 652659 - protein, 25 aa, Mycobacterium
EHPEVACALHRGMLQGLVAPAESVG

SEQ ID NO: 652660 - protein, 23 aa, Mycobacterium
EHPEVFKQYFGTVIPAGDNKFSA

SEQ ID NO: 652661 - protein, 22 aa, Mycobacterium
EHPFDLLARARFRVTVNTDNRL

SEQ ID NO: 652662 - protein, 18 aa, Mycobacterium
EHPFPVWTEQGGPATIVP

SEQ ID NO: 652663 - protein, 20 aa, Mycobacterium
EHPFPVWTERGGPATIVPMF

SEQ ID NO: 652664 - protein, 18 aa, Mycobacterium
EHPGGLPPWGSLLEIEPA

SEQ ID NO: 652665 - protein, 20 aa, Mycobacterium
EHPIHLLLRRARANSVLVGR

SEQ ID NO: 652666 - protein, 17 aa, Mycobacterium
EHPKEKLSHYSDRTVDI

SEQ ID NO: 652667 - protein, 19 aa, Mycobacterium
EHPLRVGVVEDLPWMATQD

SEQ ID NO: 652668 - protein, 24 aa, Mycobacterium
EHPMPVPAFALALMRRSLSGSNIG

SEQ ID NO: 652669 - protein, 17 aa, Mycobacterium
EHPQGLLGHSSYSLDQY

SEQ ID NO: 652670 - protein, 17 aa, Mycobacterium
EHPRLGPVRNPWNTDYT

SEQ ID NO: 652671 - protein, 18 aa, Mycobacterium
EHPVPLLFVHGGWHGAWC

SEQ ID NO: 652672 - protein, 21 aa, Mycobacterium
EHPYREWLDRNLVPLEKLPQG

SEQ ID NO: 652673 - protein, 24 aa, Mycobacterium
EHPYRPITPESIRRAAQLKDDLPV

SEQ ID NO: 652674 - protein, 23 aa, Mycobacterium
EHPYRPITPESIRRAAQLRDDLP

SEQ ID NO: 652675 - protein, 17 aa, Mycobacterium
EHPYSFSRRMSTLDHLT

SEQ ID NO: 652676 - protein, 23 aa, Mycobacterium
EHQFTVWLAIRLDLLDEVHSAVE

SEQ ID NO: 652677 - protein, 26 aa, Mycobacterium
EHQPIALAGLWALRGLVQAAHGQCGA

SEQ ID NO: 652678 - protein, 25 aa, Mycobacterium
EHRDRSCVVPGCGATRGLHAHHIVH

SEQ ID NO: 652679 - protein, 21 aa, Mycobacterium
EHRFDRIVKLCDGRLCEGQYG

SEQ ID NO: 652680 - protein, 25 aa, Mycobacterium
EHRFPAALDDGWAAVQWIAEHAGEL

SEQ ID NO: 652681 - protein, 17 aa, Mycobacterium
EHRGNVMVITINRPEAR

SEQ ID NO: 652682 - protein, 18 aa, Mycobacterium
EHRGRYLLLVQWDTLEHH

SEQ ID NO: 652683 - protein, 21 aa, Mycobacterium
EHRGVYCGTIGMLSPAAGLEL

SEQ ID NO: 652684 - protein, 19 aa, Mycobacterium
EHRHMRSLLNKAFTPRAVQ

SEQ ID NO: 652685 - protein, 19 aa, Mycobacterium
EHRHWALDVAVNLTREKTL

SEQ ID NO: 652686 - protein, 18 aa, Mycobacterium
EHRLHVFTSAALALRAQD

SEQ ID NO: 652687 - protein, 21 aa, Mycobacterium
EHRPGIPYPEWNMWTRQFMRD

SEQ ID NO: 652688 - protein, 22 aa, Mycobacterium
EHRRAGLPWGTFAERSAQLGET

SEQ ID NO: 652689 - protein, 19 aa, Mycobacterium
EHRRITLTSGDLIVLSSSL

SEQ ID NO: 652690 - protein, 26 aa, Mycobacterium
EHRRRIGELWAQFSAVAAGNPHAWSQ

SEQ ID NO: 652691 - protein, 25 aa, Mycobacterium
EHRSCAKAQALVAERGFEITAAPGG

SEQ ID NO: 652692 - protein, 25 aa, Mycobacterium
EHRSCAKAQALVAERGFEITASAGG

SEQ ID NO: 652693 - protein, 18 aa, Mycobacterium
EHRSCAKTQALAAERGFE

SEQ ID NO: 652694 - protein, 18 aa, Mycobacterium
EHRSCAKTQALVAERGFE

SEQ ID NO: 652695 - protein, 22 aa, Mycobacterium
EHRVTRKLARIRFFTTPQGASK

SEQ ID NO: 652696 - protein, 24 aa, Mycobacterium
EHRWAGVQAHNRWQVDFCSLAPAR

SEQ ID NO: 652697 - protein, 20 aa, Mycobacterium
EHSDLRWFLGTLRDEGAVAK

SEQ ID NO: 652698 - protein, 18 aa, Mycobacterium
EHSGFWQPMDTLREKNLL

SEQ ID NO: 652699 - protein, 28 aa, Mycobacterium
EHSRDHLAPYLKVRRLEFADLPKTISGK

SEQ ID NO: 652700 - protein, 18 aa, Mycobacterium
EHSSRAGFTLTRRQSLQP

SEQ ID NO: 652701 - protein, 21 aa, Mycobacterium
EHSVGAVILGEFEKIEEGQQV

SEQ ID NO: 652702 - protein, 24 aa, Mycobacterium
EHTARGVPMARLTVPVWNMDSQCD

SEQ ID NO: 652703 - protein, 23 aa, Mycobacterium
EHTDEVLAGLGYDADQIEDFHRK

SEQ ID NO: 652704 - protein, 25 aa, Mycobacterium
EHTEIPLGLYCRASLAKYMDAERLF

SEQ ID NO: 652705 - protein, 24 aa, Mycobacterium
EHTEPRWWLGKGFVGEYAGAVQKP

SEQ ID NO: 652706 - protein, 18 aa, Mycobacterium
EHTFTWNTVLLIRQQLTQ

SEQ ID NO: 652707 - protein, 20 aa, Mycobacterium
EHTGEPFVPFDPATDYRRYV

SEQ ID NO: 652708 - protein, 19 aa, Mycobacterium
EHTGSWGGAAAMAGGFIYL

SEQ ID NO: 652709 - protein, 17 aa, Mycobacterium
EHTRLGRYTDFYNRVRY

SEQ ID NO: 652710 - protein, 25 aa, Mycobacterium
EHTRRVPPYHILKAHMSATIKHSQP

SEQ ID NO: 652711 - protein, 20 aa, Mycobacterium
EHTRSLLLDAAENVFSEKGF

SEQ ID NO: 652712 - protein, 25 aa, Mycobacterium
EHTSLRRWSRMLSERALKLDTVDFW

SEQ ID NO: 652713 - protein, 20 aa, Mycobacterium
EHVADTFIAMGWEVADGPEV

SEQ ID NO: 652714 - protein, 18 aa, Mycobacterium
EHVAHALVILLTVGGVPS

SEQ ID NO: 652715 - protein, 23 aa, Mycobacterium
EHVALRSVFTWHDAPGRSGVARP

SEQ ID NO: 652716 - protein, 17 aa, Mycobacterium
EHVDGHVLAAVRTLIDG

SEQ ID NO: 652717 - protein, 25 aa, Mycobacterium
EHVGELLADHGWRLVEQAGPSYYRD

SEQ ID NO: 652718 - protein, 18 aa, Mycobacterium
EHVKGPKIRIHKFKNKTG

SEQ ID NO: 652719 - protein, 23 aa, Mycobacterium
EHVKPRLLGHWGTTPGLNLVYAH

SEQ ID NO: 652720 - protein, 23 aa, Mycobacterium
EHVPTEHLDRLVADGVTVAPPPE

SEQ ID NO: 652721 - protein, 18 aa, Mycobacterium
EHVRTWFAGLGTEHDTRN

SEQ ID NO: 652722 - protein, 26 aa, Mycobacterium
EHVTRLRPDLRPDLPQPAAGDGSYRV

SEQ ID NO: 652723 - protein, 23 aa, Mycobacterium
EHVVPELRRRGLFRHEYESTTLR

SEQ ID NO: 652724 - protein, 29 aa, Mycobacterium
EHWEVVRIGIPPAVARYVVEKGSITVDGI

SEQ ID NO: 652725 - protein, 25 aa, Mycobacterium
EHYEKLEGVPLTFRGKVNRLAIMVR

SEQ ID NO: 652726 - protein, 23 aa, Mycobacterium
EHYLGCKVAAWVVDGYRPRDELS

SEQ ID NO: 652727 - protein, 17 aa, Mycobacterium
EHYPSWKESPPAEIVTW

SEQ ID NO: 652728 - protein, 22 aa, Mycobacterium
EHYRLRVDPERGGGVESLVRDH

SEQ ID NO: 652729 - protein, 22 aa, Mycobacterium
EHYRSVAVPVTFDADGRPHFGA

SEQ ID NO: 652730 - protein, 30 aa, Mycobacterium
EIAALLTGRGYRLEGFENVLGRRVTGETSG

SEQ ID NO: 652731 - protein, 19 aa, Mycobacterium
EIAALRRRAHALLNDPVMP

SEQ ID NO: 652732 - protein, 18 aa, Mycobacterium
EIAARLAVRATGSRITFS

SEQ ID NO: 652733 - protein, 24 aa, Mycobacterium
EIAARYPGVRWIGGTVKMGFAEAF

SEQ ID NO: 652734 - protein, 24 aa, Mycobacterium
EIAAVLAPMGLRLSVEKSRICHVD

SEQ ID NO: 652735 - protein, 18 aa, Mycobacterium
EIADLGIVGDLFKVSPQL

SEQ ID NO: 652736 - protein, 24 aa, Mycobacterium
EIADRAGVSKPVLYQHFPSKLELY

SEQ ID NO: 652737 - protein, 24 aa, Mycobacterium
EIADRAGVSKPVLYQHFTSKLELY

SEQ ID NO: 652738 - protein, 19 aa, Mycobacterium
EIADTLVASFMSGADDEGD

SEQ ID NO: 652739 - protein, 19 aa, Mycobacterium
EIAEAAWFTRDEIRAALDQ

SEQ ID NO: 652740 - protein, 19 aa, Mycobacterium
EIAEAGRAPMGMMPMPMGM

SEQ ID NO: 652741 - protein, 19 aa, Mycobacterium
EIAEAKKLSIRELIKEVTS

SEQ ID NO: 652742 - protein, 19 aa, Mycobacterium
EIAEAQWFTRAEIRDALDQ

SEQ ID NO: 652743 - protein, 24 aa, Mycobacterium
EIAEGGIYTRADWILRHASDISRI

SEQ ID NO: 652744 - protein, 18 aa, Mycobacterium
EIAEHGGMAQAISDGIPK

SEQ ID NO: 652745 - protein, 20 aa, Mycobacterium
EIAEKGKLPAEVLDSAAVTI

SEQ ID NO: 652746 - protein, 18 aa, Mycobacterium
EIAELITMLIRFRTQAVA

SEQ ID NO: 652747 - protein, 18 aa, Mycobacterium
EIAELVVASAAAGKELIW

SEQ ID NO: 652748 - protein, 17 aa, Mycobacterium
EIAENFRMPPALEKAWH

SEQ ID NO: 652749 - protein, 19 aa, Mycobacterium
EIAEQLLRVLARRLRHTNN

SEQ ID NO: 652750 - protein, 21 aa, Mycobacterium
EIAEQLLRVLARRLRRTNDNL

SEQ ID NO: 652751 - protein, 24 aa, Mycobacterium
EIAERAGVSKPVLYQHFSSKLELY

SEQ ID NO: 652752 - protein, 26 aa, Mycobacterium
EIAGYKVPRSLWLVDEIKRSPAGKPD

SEQ ID NO: 652753 - protein, 18 aa, Mycobacterium
EIAILSRHAHGFDPRNLS

SEQ ID NO: 652754 - protein, 26 aa, Mycobacterium
EIAIRAFRAAYELEMATVAVYPYEDR

SEQ ID NO: 652755 - protein, 24 aa, Mycobacterium
EIAIRAFRAAYELGAETVAVYPYE

SEQ ID NO: 652756 - protein, 27 aa, Mycobacterium
EIAIRAFRAAYELGIGTVAVYAYEDRN

SEQ ID NO: 652757 - protein, 27 aa, Mycobacterium
EIAIRAFRAAYELGISTVAVFAYEDRN

SEQ ID NO: 652758 - protein, 26 aa, Mycobacterium
EIAIRAFRAAYELGVGTVAVYAYEDR

SEQ ID NO: 652759 - protein, 33 aa, Mycobacterium
EIAKRLDLIDPNAWAFTWVVDFPMFEAADEATA

SEQ ID NO: 652760 - protein, 19 aa, Mycobacterium
EIAKRLGTPLVIHQPSYSL

SEQ ID NO: 652761 - protein, 23 aa, Mycobacterium
EIALAANVWVDWHEIIRLTGVRA

SEQ ID NO: 652762 - protein, 24 aa, Mycobacterium
EIAMNMGMDGAWGQWVNRWTAEEN

SEQ ID NO: 652763 - protein, 21 aa, Mycobacterium
EIANGLARWTAAGADTLVLQP

SEQ ID NO: 652764 - protein, 22 aa, Mycobacterium
EIANRLCAQILLLAAEDSTKDI

SEQ ID NO: 652765 - protein, 23 aa, Mycobacterium
EIAPELTAAFGIGADTAAEMLIV

SEQ ID NO: 652766 - protein, 20 aa, Mycobacterium
EIAPPPVIVSVVNWADCLVA

SEQ ID NO: 652767 - protein, 33 aa, Mycobacterium
EIAQFKSRDPVMYMGNGKIWLDGQLQPQSALPT

SEQ ID NO: 652768 - protein, 19 aa, Mycobacterium
EIAQGLGAVTGREVTVSFT

SEQ ID NO: 652769 - protein, 23 aa, Mycobacterium
EIAQGRLGPGRVHHAMRLIGLAE

SEQ ID NO: 652770 - protein, 26 aa, Mycobacterium
EIAQTVARWLVLYLRRPGGQTQFAAP

SEQ ID NO: 652771 - protein, 20 aa, Mycobacterium
EIAQVIPLPVFDARKEAESW

SEQ ID NO: 652772 - protein, 17 aa, Mycobacterium
EIARHCRARSAGVSGEW

SEQ ID NO: 652773 - protein, 17 aa, Mycobacterium
EIARMVCRYSRRAQLLH

SEQ ID NO: 652774 - protein, 23 aa, Mycobacterium
EIARRAGAHLVRHPINLGQGAAI

SEQ ID NO: 652775 - protein, 25 aa, Mycobacterium
EIARRNAPCVLFFDELDALGHRRSQ

SEQ ID NO: 652776 - protein, 21 aa, Mycobacterium
EIASAGASVFYTGDIAHDIVA

SEQ ID NO: 652777 - protein, 18 aa, Mycobacterium
EIASRFGVRLSKDDVFES

SEQ ID NO: 652778 - protein, 23 aa, Mycobacterium
EIATGFGRTGAMFAADHAGVCPD

SEQ ID NO: 652779 - protein, 22 aa, Mycobacterium
EIATHLDRGSAITESQWDELAS

SEQ ID NO: 652780 - protein, 18 aa, Mycobacterium
EIATHLDRGTAITESQWD

SEQ ID NO: 652781 - protein, 21 aa, Mycobacterium
EIAYPVLWRNLTELVGTILEA

SEQ ID NO: 652782 - protein, 27 aa, Mycobacterium
EICEDPRFSIARLSLLDRGMVFVIAHV

SEQ ID NO: 652783 - protein, 27 aa, Mycobacterium
EICPVCHFTLPEGWREGHAICIALAGA

SEQ ID NO: 652784 - protein, 30 aa, Mycobacterium
EIDAAEIYVPFSWFEPMWLENLGFMPEGEG

SEQ ID NO: 652785 - protein, 19 aa, Mycobacterium
EIDAETLREICEFPFSRLY

SEQ ID NO: 652786 - protein, 22 aa, Mycobacterium
EIDALTLGSGDWVLVTRPDGTP

SEQ ID NO: 652787 - protein, 25 aa, Mycobacterium
EIDAPLVWCVAALLGQHPMEAAQAE

SEQ ID NO: 652788 - protein, 19 aa, Mycobacterium
EIDCPLINIHHSFLPAFTG

SEQ ID NO: 652789 - protein, 26 aa, Mycobacterium
EIDDCPPILVLTGRADDAWLAKWSRA

SEQ ID NO: 652790 - protein, 25 aa, Mycobacterium
EIDDIELRPPLFIAGLPRTGTTHLH

SEQ ID NO: 652791 - protein, 22 aa, Mycobacterium
EIDDLRAWLTTVVSRLGLDKLR

SEQ ID NO: 652792 - protein, 32 aa, Mycobacterium
EIDDVSAYEALLCRIASLGIAYLHVLVEPSAP

SEQ ID NO: 652793 - protein, 24 aa, Mycobacterium
EIDEGFVAAVYRWATTGDLAASLE

SEQ ID NO: 652794 - protein, 18 aa, Mycobacterium
EIDEKSAAAMCYTSGTTG

SEQ ID NO: 652795 - protein, 23 aa, Mycobacterium
EIDFGGCRCQAFALTGDAARTDP

SEQ ID NO: 652796 - protein, 20 aa, Mycobacterium
EIDGLAWVPADRAWVPDLVA

SEQ ID NO: 652797 - protein, 20 aa, Mycobacterium
EIDKGEFVFLIGPSGSGKST

SEQ ID NO: 652798 - protein, 22 aa, Mycobacterium
EIDKGRPVMVWADIGELPYLRV

SEQ ID NO: 652799 - protein, 24 aa, Mycobacterium
EIDKVFVVACGTAYHSGLLAKYAI

SEQ ID NO: 652800 - protein, 18 aa, Mycobacterium
EIDLALVREECKEFTVLD

SEQ ID NO: 652801 - protein, 24 aa, Mycobacterium
EIDLLEFFAELTIYTSTACLIGVK

SEQ ID NO: 652802 - protein, 25 aa, Mycobacterium
EIDLQRYGLTWKWPQTDCAHPLDDG

SEQ ID NO: 652803 - protein, 25 aa, Mycobacterium
EIDNLSVRAARWLLGQGAGKGTRVG

SEQ ID NO: 652804 - protein, 25 aa, Mycobacterium
EIDPAFPYGALRWSRYCPHCLSDSQ

SEQ ID NO: 652805 - protein, 28 aa, Mycobacterium
EIDRFNELVLRAGLTWQQVAVLRAYAKY

SEQ ID NO: 652806 - protein, 22 aa, Mycobacterium
EIDRGLRFMSACRVDDRNLDTA

SEQ ID NO: 652807 - protein, 27 aa, Mycobacterium
EIDRVFAGKVWGAWHLSEAAADLDLDF

SEQ ID NO: 652808 - protein, 17 aa, Mycobacterium
EIDRVLARELVADGRAT

SEQ ID NO: 652809 - protein, 32 aa, Mycobacterium
EIDSACELADFWRFNVQFARQILAEQPNSGGG

SEQ ID NO: 652810 - protein, 18 aa, Mycobacterium
EIDVLLAEWLRRVPDYAI

SEQ ID NO: 652811 - protein, 25 aa, Mycobacterium
EIEAELFGANGWQPGDAWMADTTLG

SEQ ID NO: 652812 - protein, 24 aa, Mycobacterium
EIEAELFGANGWQPGDAWMAETTL

SEQ ID NO: 652813 - protein, 22 aa, Mycobacterium
EIEAIKQLKARYCRYLDTKRWD

SEQ ID NO: 652814 - protein, 24 aa, Mycobacterium
EIEAIKTLKARYCRYLDTKDWESW

SEQ ID NO: 652815 - protein, 23 aa, Mycobacterium
EIEALGYGAVWVGGSPPAELEWV

SEQ ID NO: 652816 - protein, 23 aa, Mycobacterium
EIEALGYGAVWVGGSPPAELVWV

SEQ ID NO: 652817 - protein, 17 aa, Mycobacterium
EIEALYYLHPLTGDVIR

SEQ ID NO: 652818 - protein, 18 aa, Mycobacterium
EIEALYYLHPLTGDVVRQ

SEQ ID NO: 652819 - protein, 17 aa, Mycobacterium
EIEALYYLHPLTGEVIR

SEQ ID NO: 652820 - protein, 20 aa, Mycobacterium
EIEDSLRYGVVKMNVDTDTQ

SEQ ID NO: 652821 - protein, 21 aa, Mycobacterium
EIEDSLRYGVVKMNVDTDTQY

SEQ ID NO: 652822 - protein, 21 aa, Mycobacterium
EIEEIELLPPVVIAGLPRSGT

SEQ ID NO: 652823 - protein, 21 aa, Mycobacterium
EIEESLRYGVVKMNVDTDTQY

SEQ ID NO: 652824 - protein, 26 aa, Mycobacterium
EIEGALGRIGHGWDVLAHVAGIPGTA

SEQ ID NO: 652825 - protein, 17 aa, Mycobacterium
EIEGAWKPDQYANPEGP

SEQ ID NO: 652826 - protein, 20 aa, Mycobacterium
EIEGPRCLFPPVTNQRHALL

SEQ ID NO: 652827 - protein, 18 aa, Mycobacterium
EIEGSGLFARMLQHETGH

SEQ ID NO: 652828 - protein, 20 aa, Mycobacterium
EIEGSPSMRCEFEMAEDHDH

SEQ ID NO: 652829 - protein, 21 aa, Mycobacterium
EIEIAVVIGKPGYRIERSQAI

SEQ ID NO: 652830 - protein, 20 aa, Mycobacterium
EIEKMQGWLQEWGVSSSPAP

SEQ ID NO: 652831 - protein, 24 aa, Mycobacterium
EIEKRLRLAAASGQIPASINPHGL

SEQ ID NO: 652832 - protein, 17 aa, Mycobacterium
EIELGTIRPPQRLAPFS

SEQ ID NO: 652833 - protein, 21 aa, Mycobacterium
EIELITGIALLIQRDPIITAK

SEQ ID NO: 652834 - protein, 23 aa, Mycobacterium
EIELLDFFSELTIYTSTACLIGL

SEQ ID NO: 652835 - protein, 27 aa, Mycobacterium
EIELPFATVPLRDEWRGSVEEGKVYIA

SEQ ID NO: 652836 - protein, 21 aa, Mycobacterium
EIEPGEVIALLGSSGSGKSTL

SEQ ID NO: 652837 - protein, 21 aa, Mycobacterium
EIEPRTGHQLGNFPQAFTHLA

SEQ ID NO: 652838 - protein, 21 aa, Mycobacterium
EIEPRTGRHLGNFPQAFTHLA

SEQ ID NO: 652839 - protein, 18 aa, Mycobacterium
EIEPRTGRQLGNFPQAFT

SEQ ID NO: 652840 - protein, 19 aa, Mycobacterium
EIERAVRSCPTQALFIKQQ

SEQ ID NO: 652841 - protein, 18 aa, Mycobacterium
EIERRRQITGGKRSFILV

SEQ ID NO: 652842 - protein, 23 aa, Mycobacterium
EIESARGPIYLKVTHLPEETLSA

SEQ ID NO: 652843 - protein, 26 aa, Mycobacterium
EIETRIRDSAGLSFDQLRVLKTIGLL

SEQ ID NO: 652844 - protein, 20 aa, Mycobacterium
EIEWAKASLISPETYADAVA

SEQ ID NO: 652845 - protein, 20 aa, Mycobacterium
EIEWAKASLISPETYPAAAA

SEQ ID NO: 652846 - protein, 17 aa, Mycobacterium
EIEYEEFEVKKAVRVDR

SEQ ID NO: 652847 - protein, 21 aa, Mycobacterium
EIFAPLLRGGRLVIVDEDTAR

SEQ ID NO: 652848 - protein, 20 aa, Mycobacterium
EIFDEGRLSDLDGWTNTFIT

SEQ ID NO: 652849 - protein, 25 aa, Mycobacterium
EIFFDRLPDALGMLAADPSPAAQVR

SEQ ID NO: 652850 - protein, 19 aa, Mycobacterium
EIFGALLHGGRLVIIPDSV

SEQ ID NO: 652851 - protein, 19 aa, Mycobacterium
EIFGALLHGGRLVVIPDSA

SEQ ID NO: 652852 - protein, 18 aa, Mycobacterium
EIFGALLHGGRLVVVPES

SEQ ID NO: 652853 - protein, 19 aa, Mycobacterium
EIFGALLRGARLVVAPEDV

SEQ ID NO: 652854 - protein, 18 aa, Mycobacterium
EIFGALLRGGPAGGGARG

SEQ ID NO: 652855 - protein, 20 aa, Mycobacterium
EIFGDGRIALRFPGDADQKI

SEQ ID NO: 652856 - protein, 19 aa, Mycobacterium
EIFGPVAVIVPFDTEADAV

SEQ ID NO: 652857 - protein, 19 aa, Mycobacterium
EIFGPVLAMIPYDNVEHAI

SEQ ID NO: 652858 - protein, 24 aa, Mycobacterium
EIFGPVLCVIPFDDEEDAIRIAND

SEQ ID NO: 652859 - protein, 19 aa, Mycobacterium
EIFGPVLCVLRYTDDADAI

SEQ ID NO: 652860 - protein, 19 aa, Mycobacterium
EIFICCLNNDIAINKDIRP

SEQ ID NO: 652861 - protein, 24 aa, Mycobacterium
EIFRRRFAQDTTEHFVSRLEEQDI

SEQ ID NO: 652862 - protein, 30 aa, Mycobacterium
EIGAGRGYLTWPVIHALRGLPPGAVEYHVT

SEQ ID NO: 652863 - protein, 31 aa, Mycobacterium
EIGAKGWFGLNWPREYGGLGLGAIHLHLLMS

SEQ ID NO: 652864 - protein, 24 aa, Mycobacterium
EIGALRLAIERALASDNQDETEQT

SEQ ID NO: 652865 - protein, 23 aa, Mycobacterium
EIGCGTGNLAIRVKHAHPAAQLV

SEQ ID NO: 652866 - protein, 21 aa, Mycobacterium
EIGDRLGLAAAGVRRHLDALI

SEQ ID NO: 652867 - protein, 27 aa, Mycobacterium
EIGELCALVPDSMRFCFELATQGTVAD

SEQ ID NO: 652868 - protein, 26 aa, Mycobacterium
EIGFFKLLQPEQWGGLQADPTVFYEA

SEQ ID NO: 652869 - protein, 26 aa, Mycobacterium
EIGFRVRRLAGRVVWMQPPDAPLGAQ

SEQ ID NO: 652870 - protein, 25 aa, Mycobacterium
EIGGMPAPAPLVWAVNEMIYCANPS

SEQ ID NO: 652871 - protein, 27 aa, Mycobacterium
EIGGVGGRGGAAWAQSPTGTPNVTGGA

SEQ ID NO: 652872 - protein, 17 aa, Mycobacterium
EIGHLTSAYSVVILDRY

SEQ ID NO: 652873 - protein, 18 aa, Mycobacterium
EIGLAPVLVLAWLPQLVG

SEQ ID NO: 652874 - protein, 23 aa, Mycobacterium
EIGMAGMWVGPGWLVNGTRQLLE

SEQ ID NO: 652875 - protein, 24 aa, Mycobacterium
EIGNTEWPKWESVMSPDPVDPADL

SEQ ID NO: 652876 - protein, 23 aa, Mycobacterium
EIGNTEWPKWETVMAADPVDPAD

SEQ ID NO: 652877 - protein, 24 aa, Mycobacterium
EIGNTEWPKWETVMAADPVDPAQL

SEQ ID NO: 652878 - protein, 24 aa, Mycobacterium
EIGNTEWPKWETVMAPDPVDPESL

SEQ ID NO: 652879 - protein, 24 aa, Mycobacterium
EIGQTTPGHWAWIDQNGVAHPIDH

SEQ ID NO: 652880 - protein, 26 aa, Mycobacterium
EIGRPSRLKGAGFYEYADGKRTRLWP

SEQ ID NO: 652881 - protein, 26 aa, Mycobacterium
EIGRPSRLKGAGFYEYVDGKRTRLWP

SEQ ID NO: 652882 - protein, 23 aa, Mycobacterium
EIGRRLAPEPVLHAALGPGALIA

SEQ ID NO: 652883 - protein, 20 aa, Mycobacterium
EIGRSLAPVPWIDHVVAARL

SEQ ID NO: 652884 - protein, 17 aa, Mycobacterium
EIGRSLAPVPWIDQVCA

SEQ ID NO: 652885 - protein, 26 aa, Mycobacterium
EIGSGLPVFHPKGGIVRKELEDYSRA

SEQ ID NO: 652886 - protein, 28 aa, Mycobacterium
EIGTKYWMDLGMGWQFFAQEDYIRRLTS

SEQ ID NO: 652887 - protein, 23 aa, Mycobacterium
EIGYCLGRRWWGKGLMVEVLDML

SEQ ID NO: 652888 - protein, 17 aa, Mycobacterium
EIHFPITGGDAVPAELL

SEQ ID NO: 652889 - protein, 17 aa, Mycobacterium
EIHRARATAQRDITRLI

SEQ ID NO: 652890 - protein, 20 aa, Mycobacterium
EIHRDWNARYVWPKFVCALP

SEQ ID NO: 652891 - protein, 17 aa, Mycobacterium
EIHRRIRSAMGPDADPR

SEQ ID NO: 652892 - protein, 24 aa, Mycobacterium
EIHSLPLYHCAQMDNFFITDIYLG

SEQ ID NO: 652893 - protein, 19 aa, Mycobacterium
EIHSVASLFVSRVDTEIDK

SEQ ID NO: 652894 - protein, 19 aa, Mycobacterium
EIHTLASIFTTIRIEGPDY

SEQ ID NO: 652895 - protein, 20 aa, Mycobacterium
EIIAAAATDLAQIGSAISGA

SEQ ID NO: 652896 - protein, 19 aa, Mycobacterium
EIIDHGWALNEASLEKGPR

SEQ ID NO: 652897 - protein, 19 aa, Mycobacterium
EIIEAAAADLAAASQTTQI

SEQ ID NO: 652898 - protein, 24 aa, Mycobacterium
EIIHLMRALWRPGWTEFEGAFYTA

SEQ ID NO: 652899 - protein, 20 aa, Mycobacterium
EIIKNFKKGFAATGGGSVVP

SEQ ID NO: 652900 - protein, 17 aa, Mycobacterium
EIIRELAERRVLVGERG

SEQ ID NO: 652901 - protein, 23 aa, Mycobacterium
EIITEARCGIGYLHTGIEKNLEY

SEQ ID NO: 652902 - protein, 18 aa, Mycobacterium
EIIVGAALDSLPTLQQRG

SEQ ID NO: 652903 - protein, 17 aa, Mycobacterium
EIKFRSVLEEPTYEDGV

SEQ ID NO: 652904 - protein, 23 aa, Mycobacterium
EIKIWPGQMHVFQVATKVVPEAK

SEQ ID NO: 652905 - protein, 19 aa, Mycobacterium
EIKRPRMFYFHRQASDDWD

SEQ ID NO: 652906 - protein, 19 aa, Mycobacterium
EIKSNWKLFIDAFVEFYHA

SEQ ID NO: 652907 - protein, 24 aa, Mycobacterium
EILAHCYRMTGSIHDAEDLVQETY

SEQ ID NO: 652908 - protein, 19 aa, Mycobacterium
EILALMAMGTGAPDPGDLS

SEQ ID NO: 652909 - protein, 29 aa, Mycobacterium
EILARRPGWFDARWLQVAINHRAQRWSDV

SEQ ID NO: 652910 - protein, 26 aa, Mycobacterium
EILATEILDPLGFRWTNFGVAKGDVP

SEQ ID NO: 652911 - protein, 17 aa, Mycobacterium
EILDIFTEYVAACRVLG

SEQ ID NO: 652912 - protein, 18 aa, Mycobacterium
EILDRLRAERPRLVVLGM

SEQ ID NO: 652913 - protein, 24 aa, Mycobacterium
EILDRTGPIIPIKLGAHAKRQRAE

SEQ ID NO: 652914 - protein, 19 aa, Mycobacterium
EILDYLGHVIAHVRRETHP

SEQ ID NO: 652915 - protein, 23 aa, Mycobacterium
EILEPLKFRWTNYGVRPEEVDLV

SEQ ID NO: 652916 - protein, 25 aa, Mycobacterium
EILEYHWGPDWVCWDADQTFQQRGQ

SEQ ID NO: 652917 - protein, 19 aa, Mycobacterium
EILGALLSGGSLIVAPDDV

SEQ ID NO: 652918 - protein, 24 aa, Mycobacterium
EILGRSVWAPSIFGCQAPDTGNAE

SEQ ID NO: 652919 - protein, 18 aa, Mycobacterium
EILHAYCAAINRAPSAIL

SEQ ID NO: 652920 - protein, 20 aa, Mycobacterium
EILHYLPLPVPYTVGDARSF

SEQ ID NO: 652921 - protein, 17 aa, Mycobacterium
EILKWAKKQGISITAEV

SEQ ID NO: 652922 - protein, 18 aa, Mycobacterium
EILMRLTRRYALTSRTDT

SEQ ID NO: 652923 - protein, 17 aa, Mycobacterium
EILPHFDTLLVMSVEPG

SEQ ID NO: 652924 - protein, 18 aa, Mycobacterium
EILPHFDTLLVMSVEPGF

SEQ ID NO: 652925 - protein, 19 aa, Mycobacterium
EILPRIDAEVAELQRAARD

SEQ ID NO: 652926 - protein, 24 aa, Mycobacterium
EILRDGVIPRRLVTSCEHFHREAA

SEQ ID NO: 652927 - protein, 18 aa, Mycobacterium
EILREFDTLLVMSVEPGF

SEQ ID NO: 652928 - protein, 19 aa, Mycobacterium
EILRHGDFGLGTFNHLDGE

SEQ ID NO: 652929 - protein, 25 aa, Mycobacterium
EILRMTLQGCVPLVIGRFSNLAGPG

SEQ ID NO: 652930 - protein, 22 aa, Mycobacterium
EILRRTEAGLGLTSPELATLMA

SEQ ID NO: 652931 - protein, 20 aa, Mycobacterium
EILRTNLAAVILQMSALGLG

SEQ ID NO: 652932 - protein, 19 aa, Mycobacterium
EILSAAAVFVCPSVYEPLG

SEQ ID NO: 652933 - protein, 24 aa, Mycobacterium
EILSMWRPSPLIRARRFEKALNTG

SEQ ID NO: 652934 - protein, 17 aa, Mycobacterium
EILTPDVFREFMSSYPS

SEQ ID NO: 652935 - protein, 18 aa, Mycobacterium
EILTRYLNLVSFGNGAYG

SEQ ID NO: 652936 - protein, 21 aa, Mycobacterium
EILTRYLNLVSFGNNSFGVQD

SEQ ID NO: 652937 - protein, 24 aa, Mycobacterium
EILVALWDLVGYRVPTPIDRITYA

SEQ ID NO: 652938 - protein, 20 aa, Mycobacterium
EILVPFVGAIVTSVSRQNAT

SEQ ID NO: 652939 - protein, 20 aa, Mycobacterium
EILYGYEWELTKSPAGAWQF

SEQ ID NO: 652940 - protein, 18 aa, Mycobacterium
EIMGRDILPEFIERDEKA

SEQ ID NO: 652941 - protein, 18 aa, Mycobacterium
EIMGRSYGGGVLELEPGE

SEQ ID NO: 652942 - protein, 17 aa, Mycobacterium
EIMGRSYGGGVLELEPR

SEQ ID NO: 652943 - protein, 20 aa, Mycobacterium
EIMQVIALEPGFGVDFLQQI

SEQ ID NO: 652944 - protein, 26 aa, Mycobacterium
EIMRLCAALWLDACADPEIQRIVLLE

SEQ ID NO: 652945 - protein, 17 aa, Mycobacterium
EINEAFASVVLSWAAVH

SEQ ID NO: 652946 - protein, 18 aa, Mycobacterium
EINEAFASVVLSWAQVHG

SEQ ID NO: 652947 - protein, 18 aa, Mycobacterium
EINEAFASVVLSWAQVHN

SEQ ID NO: 652948 - protein, 19 aa, Mycobacterium
EINGTLVLDGMESPVRAQG

SEQ ID NO: 652949 - protein, 19 aa, Mycobacterium
EINHLASVRLARLAKSAGV

SEQ ID NO: 652950 - protein, 18 aa, Mycobacterium
EINLRAGDYVNMGLACHA

SEQ ID NO: 652951 - protein, 20 aa, Mycobacterium
EINMPVTVRIPSFGGIGAAE

SEQ ID NO: 652952 - protein, 20 aa, Mycobacterium
EINSALMLAGAGSGPTLAAA

SEQ ID NO: 652953 - protein, 18 aa, Mycobacterium
EINSALMYSGPGSGPMLA

SEQ ID NO: 652954 - protein, 26 aa, Mycobacterium
EINSARLTIGAGLGPMLEAANAWQGL

SEQ ID NO: 652955 - protein, 19 aa, Mycobacterium
EINSARMFVGAGPGPMLSA

SEQ ID NO: 652956 - protein, 18 aa, Mycobacterium
EINSGLMYAGPGSGSMLA

SEQ ID NO: 652957 - protein, 18 aa, Mycobacterium
EINSGLMYAGPGSGSMMA

SEQ ID NO: 652958 - protein, 24 aa, Mycobacterium
EINSGRMYLGPGPESLLAAAAGWE

SEQ ID NO: 652959 - protein, 20 aa, Mycobacterium
EINSLRIFAGAGSAPMLEAA

SEQ ID NO: 652960 - protein, 23 aa, Mycobacterium
EINSLRLFSGAGSTSMLEAAAAW

SEQ ID NO: 652961 - protein, 20 aa, Mycobacterium
EINSLRMFTGAGSAPMLQAA

SEQ ID NO: 652962 - protein, 21 aa, Mycobacterium
EINSLRMFTGAGSAPMLQAAA

SEQ ID NO: 652963 - protein, 20 aa, Mycobacterium
EINSSRMFAGAGAAPMLDAA

SEQ ID NO: 652964 - protein, 20 aa, Mycobacterium
EINTMPGFTTISMYPRMWDA

SEQ ID NO: 652965 - protein, 19 aa, Mycobacterium
EINVMGAIQLFAACQKAPS

SEQ ID NO: 652966 - protein, 18 aa, Mycobacterium
EINVMGAMQLFAACQKSP

SEQ ID NO: 652967 - protein, 24 aa, Mycobacterium
EINVRWRKGQTLQPDWKIDQDGWV

SEQ ID NO: 652968 - protein, 17 aa, Mycobacterium
EINWIRHFFPPFPPLPF

SEQ ID NO: 652969 - protein, 25 aa, Mycobacterium
EIPADRPALEAALAILRDITAGATN

SEQ ID NO: 652970 - protein, 25 aa, Mycobacterium
EIPADRPALEAALGILRDITSGPAN

SEQ ID NO: 652971 - protein, 25 aa, Mycobacterium
EIPADRPALESALAILRDITSGPTN

SEQ ID NO: 652972 - protein, 21 aa, Mycobacterium
EIPANRPGRAVSMEKHHLMIG

SEQ ID NO: 652973 - protein, 23 aa, Mycobacterium
EIPCYPGDLNQVWTNIIDNAIAA

SEQ ID NO: 652974 - protein, 19 aa, Mycobacterium
EIPDRARIVAALSEAPQVT

SEQ ID NO: 652975 - protein, 31 aa, Mycobacterium
EIPDRITRLIFWSAFVPRPGRSITEEVEQPS

SEQ ID NO: 652976 - protein, 17 aa, Mycobacterium
EIPFPLFDADNHLYEPP

SEQ ID NO: 652977 - protein, 20 aa, Mycobacterium
EIPGAPVIGELVPRGEHTIV

SEQ ID NO: 652978 - protein, 18 aa, Mycobacterium
EIPHENLYGLAWNPMTLI

SEQ ID NO: 652979 - protein, 20 aa, Mycobacterium
EIPKGLRLAQLASETTTERE

SEQ ID NO: 652980 - protein, 26 aa, Mycobacterium
EIPLDDWLWTLGINLWGPIHGCHVFT

SEQ ID NO: 652981 - protein, 25 aa, Mycobacterium
EIPPDRPALEAALGILRDLTAAPSN

SEQ ID NO: 652982 - protein, 20 aa, Mycobacterium
EIPPGFSHALLLSEGGIVAQ

SEQ ID NO: 652983 - protein, 22 aa, Mycobacterium
EIPPGFTHCLILSEGAVVDSGL

SEQ ID NO: 652984 - protein, 21 aa, Mycobacterium
EIPRELHRKAAELGLLGAGFP

SEQ ID NO: 652985 - protein, 20 aa, Mycobacterium
EIPVAVKSVLDRRLAGLDPG

SEQ ID NO: 652986 - protein, 22 aa, Mycobacterium
EIQRARSALRRDVSRLISTETE

SEQ ID NO: 652987 - protein, 28 aa, Mycobacterium
EIQTGLGRLGQWWGVDRERVIPDILLSG

SEQ ID NO: 652988 - protein, 26 aa, Mycobacterium
EIQVVADLAWRHARSEVHEFAVEVAR

SEQ ID NO: 652989 - protein, 18 aa, Mycobacterium
EIRAHALAIGDDLVDRGV

SEQ ID NO: 652990 - protein, 17 aa, Mycobacterium
EIRAVGVGELLARIDRL

SEQ ID NO: 652991 - protein, 24 aa, Mycobacterium
EIRCWTGRLNSLFGNVFPITPIAD

SEQ ID NO: 652992 - protein, 27 aa, Mycobacterium
EIRELVYRHKLVVLKGVHPTPEQFIEL

SEQ ID NO: 652993 - protein, 27 aa, Mycobacterium
EIRETGRASGFFAQFDMLILHTVGAKS

SEQ ID NO: 652994 - protein, 17 aa, Mycobacterium
EIRGFDPLRGRSAIAEF

SEQ ID NO: 652995 - protein, 19 aa, Mycobacterium
EIRGGIGYIETWPVARLLR

SEQ ID NO: 652996 - protein, 24 aa, Mycobacterium
EIRKARKSIAQFKLREGMPVGVRA

SEQ ID NO: 652997 - protein, 17 aa, Mycobacterium
EIRKARQALTRGEIDDA

SEQ ID NO: 652998 - protein, 18 aa, Mycobacterium
EIRKEGKIGRAYYPAPYL

SEQ ID NO: 652999 - protein, 18 aa, Mycobacterium
EIRKEGKIGRVYYPAPYL

SEQ ID NO: 653000 - protein, 22 aa, Mycobacterium
EIRLHPRAVAAYRRAEGKVPAD

SEQ ID NO: 653001 - protein, 23 aa, Mycobacterium
EIRLHPRAVSAYRRAKGRIPADA

SEQ ID NO: 653002 - protein, 18 aa, Mycobacterium
EIRLSAVQRGPFARPPVV

SEQ ID NO: 653003 - protein, 27 aa, Mycobacterium
EIRPDRIFELPFDRHLHEGKEITLELL

SEQ ID NO: 653004 - protein, 19 aa, Mycobacterium
EIRQLYLDTLADWPHDELK

SEQ ID NO: 653005 - protein, 21 aa, Mycobacterium
EIRRAHASGLGFDFTVAEPGW

SEQ ID NO: 653006 - protein, 23 aa, Mycobacterium
EIRRAIRTLGRISAEGMHLRGLH

SEQ ID NO: 653007 - protein, 23 aa, Mycobacterium
EIRRARKSIAQFKLREGMPVGVR

SEQ ID NO: 653008 - protein, 19 aa, Mycobacterium
EIRRSCARYFKINPYRRWF

SEQ ID NO: 653009 - protein, 21 aa, Mycobacterium
EIRSALLEVLRRLSPGERVSF

SEQ ID NO: 653010 - protein, 17 aa, Mycobacterium
EIRSWRAFLAANNGALP

SEQ ID NO: 653011 - protein, 21 aa, Mycobacterium
EIRTAVAVALTSRFPIVLWLD

SEQ ID NO: 653012 - protein, 21 aa, Mycobacterium
EIRTFSGLLQRFGRGKGCDIC

SEQ ID NO: 653013 - protein, 19 aa, Mycobacterium
EIRTQLGRRLPGYMVPAAV

SEQ ID NO: 653014 - protein, 25 aa, Mycobacterium
EIRYGSFRRSFRLPAQVTSEAVTAS

SEQ ID NO: 653015 - protein, 24 aa, Mycobacterium
EISAPGVTVAHGWASELAEAEPWL

SEQ ID NO: 653016 - protein, 19 aa, Mycobacterium
EISGAWRAGQAVPAPAQPG

SEQ ID NO: 653017 - protein, 17 aa, Mycobacterium
EISGMVLRRAANAPRGI

SEQ ID NO: 653018 - protein, 18 aa, Mycobacterium
EISGSAWQGPAAAAMAAA

SEQ ID NO: 653019 - protein, 24 aa, Mycobacterium
EISKLRLLPFRLSFDGDEISTQLT

SEQ ID NO: 653020 - protein, 18 aa, Mycobacterium
EISKPMLYLYYGSKEELF

SEQ ID NO: 653021 - protein, 24 aa, Mycobacterium
EISLPWQLPGRLLLARAYAAVGEV

SEQ ID NO: 653022 - protein, 24 aa, Mycobacterium
EISMPELYRYLSPNPGETDVLGLI

SEQ ID NO: 653023 - protein, 25 aa, Mycobacterium
EISRATPPIKWPTVIRHPKTGEEIL

SEQ ID NO: 653024 - protein, 23 aa, Mycobacterium
EISRGRVAAISVPFDSTEKLVTI

SEQ ID NO: 653025 - protein, 19 aa, Mycobacterium
EISVPKGTLLIRAAELMGI

SEQ ID NO: 653026 - protein, 20 aa, Mycobacterium
EISYPVLWRNLTELVGNILE

SEQ ID NO: 653027 - protein, 20 aa, Mycobacterium
EITAAFLFACSGYYDYDQGY

SEQ ID NO: 653028 - protein, 22 aa, Mycobacterium
EITAMFSAAPRFTVHRQLGAGH

SEQ ID NO: 653029 - protein, 24 aa, Mycobacterium
EITAPGVAVARIIPGPNAAQLRDK

SEQ ID NO: 653030 - protein, 19 aa, Mycobacterium
EITATPGLFGPYDDTAVDG

SEQ ID NO: 653031 - protein, 18 aa, Mycobacterium
EITDRILILDGLPNYQRL

SEQ ID NO: 653032 - protein, 23 aa, Mycobacterium
EITELKYRYARTLDNKLWDEFAD

SEQ ID NO: 653033 - protein, 20 aa, Mycobacterium
EITEMARSLIAISTGEPLDQ

SEQ ID NO: 653034 - protein, 19 aa, Mycobacterium
EITGPLARMTLSRDGERAY

SEQ ID NO: 653035 - protein, 19 aa, Mycobacterium
EITILPQVWAMRYTLERVI

SEQ ID NO: 653036 - protein, 24 aa, Mycobacterium
EITLRPRGPVPMRITQRLAQAVDR

SEQ ID NO: 653037 - protein, 20 aa, Mycobacterium
EITNDLRAVGAYDFGGKLAD

SEQ ID NO: 653038 - protein, 22 aa, Mycobacterium
EITRARAAAISVDRDDAEHLVV

SEQ ID NO: 653039 - protein, 26 aa, Mycobacterium
EITRRFRVAARIRPRRSLTGPPVPPE

SEQ ID NO: 653040 - protein, 23 aa, Mycobacterium
EITTEFYRRMFAAHPELLRNLFN

SEQ ID NO: 653041 - protein, 24 aa, Mycobacterium
EITWSGKDVTRWYYSLTDGINPHA

SEQ ID NO: 653042 - protein, 27 aa, Mycobacterium
EIVAAAAADMDGIGSAITAANAAAAIP

SEQ ID NO: 653043 - protein, 20 aa, Mycobacterium
EIVAGVALELQAINSAARAG

SEQ ID NO: 653044 - protein, 18 aa, Mycobacterium
EIVARAWMPPGADAEPAP

SEQ ID NO: 653045 - protein, 19 aa, Mycobacterium
EIVARPAGFLLEMAGTTLA

SEQ ID NO: 653046 - protein, 20 aa, Mycobacterium
EIVARPAGLLLELSGATIAD

SEQ ID NO: 653047 - protein, 19 aa, Mycobacterium
EIVASFALTEPGAGSNPSG

SEQ ID NO: 653048 - protein, 24 aa, Mycobacterium
EIVCAGRPLLEWCVRRRLDDEPRI

SEQ ID NO: 653049 - protein, 17 aa, Mycobacterium
EIVCGASNFAVDDLVVV

SEQ ID NO: 653050 - protein, 17 aa, Mycobacterium
EIVDCALLETCHLSASG

SEQ ID NO: 653051 - protein, 17 aa, Mycobacterium
EIVDRFCILGPAPAHIS

SEQ ID NO: 653052 - protein, 21 aa, Mycobacterium
EIVKKLPPRLIVSRERLQLAI

SEQ ID NO: 653053 - protein, 17 aa, Mycobacterium
EIVKPVAAELVRRGSSF

SEQ ID NO: 653054 - protein, 24 aa, Mycobacterium
EIVLFPGRLPVPAPQLARVAAHAR

SEQ ID NO: 653055 - protein, 19 aa, Mycobacterium
EIVLPVLGVNAIRVPSAKP

SEQ ID NO: 653056 - protein, 17 aa, Mycobacterium
EIVLQLRDPGPITGIAR

SEQ ID NO: 653057 - protein, 25 aa, Mycobacterium
EIVQLRRLLYCGEWIHSHALHIFLL

SEQ ID NO: 653058 - protein, 22 aa, Mycobacterium
EIVQRWASGRVMVNVYGPTEIT

SEQ ID NO: 653059 - protein, 21 aa, Mycobacterium
EIVRMSVGHGVTWSSGVAAKS

SEQ ID NO: 653060 - protein, 22 aa, Mycobacterium
EIVVHAATELRDIGSSVNTANA

SEQ ID NO: 653061 - protein, 19 aa, Mycobacterium
EIVWYPGGHTGFFRSRPVQ

SEQ ID NO: 653062 - protein, 27 aa, Mycobacterium
EIWAKGLELYPGWRKYEVRAGKRHIEA

SEQ ID NO: 653063 - protein, 19 aa, Mycobacterium
EIWDKGKAAVIVTETTTSD

SEQ ID NO: 653064 - protein, 21 aa, Mycobacterium
EIWGALLRGGRLAVVPESITA

SEQ ID NO: 653065 - protein, 17 aa, Mycobacterium
EIWSQLSQWPPLQQLLR

SEQ ID NO: 653066 - protein, 21 aa, Mycobacterium
EIWSSYILERYMAKNVFASLV

SEQ ID NO: 653067 - protein, 18 aa, Mycobacterium
EIYAPLTKLQCSPTSDGS

SEQ ID NO: 653068 - protein, 22 aa, Mycobacterium
EIYDTGHLEACLQLREEDLLAE

SEQ ID NO: 653069 - protein, 34 aa, Mycobacterium
EIYEDLSWFCIRAWRFGAAESLGAGGLGSVETFL

SEQ ID NO: 653070 - protein, 17 aa, Mycobacterium
EIYEWFRNNTVDEIREL

SEQ ID NO: 653071 - protein, 19 aa, Mycobacterium
EIYFRAGRDDVEYLFGDTI

SEQ ID NO: 653072 - protein, 17 aa, Mycobacterium
EIYMRPGPDSAPTYRYV

SEQ ID NO: 653073 - protein, 19 aa, Mycobacterium
EIYRPRLNGPVPHAEDVVA

SEQ ID NO: 653074 - protein, 19 aa, Mycobacterium
EIYRPRLTAPVPQAEDVVA

SEQ ID NO: 653075 - protein, 19 aa, Mycobacterium
EIYRQSFATIRAEADLSAF

SEQ ID NO: 653076 - protein, 19 aa, Mycobacterium
EIYRQSFATIRAEADLTRF

SEQ ID NO: 653077 - protein, 24 aa, Mycobacterium
EIYSMWRPSPLIRARRFEKALNTG

SEQ ID NO: 653078 - protein, 18 aa, Mycobacterium
EKACAWDPATASRRRYPW

SEQ ID NO: 653079 - protein, 22 aa, Mycobacterium
EKADLLLAHLVLRPFLDAYHIV

SEQ ID NO: 653080 - protein, 19 aa, Mycobacterium
EKAGDWRPLADFYARDATY

SEQ ID NO: 653081 - protein, 19 aa, Mycobacterium
EKAGDWRPLADFYTKDATY

SEQ ID NO: 653082 - protein, 33 aa, Mycobacterium
EKAGDWTPLAGFYAADATYGWNIGPKEDVMCVG

SEQ ID NO: 653083 - protein, 19 aa, Mycobacterium
EKAGELLLATSRKLDKAAS

SEQ ID NO: 653084 - protein, 25 aa, Mycobacterium
EKAHPGRFVLGVGVGHPEHTGEYRK

SEQ ID NO: 653085 - protein, 22 aa, Mycobacterium
EKAKSMGAMALFGENYPDEVRV

SEQ ID NO: 653086 - protein, 18 aa, Mycobacterium
EKALAAKTADEWVRLLQD

SEQ ID NO: 653087 - protein, 24 aa, Mycobacterium
EKALARSGLTLSDIDLFEVNEAFA

SEQ ID NO: 653088 - protein, 18 aa, Mycobacterium
EKALPVPVFAQTMAQVTI

SEQ ID NO: 653089 - protein, 21 aa, Mycobacterium
EKALRRWPRDDHRLRLEHVGA

SEQ ID NO: 653090 - protein, 19 aa, Mycobacterium
EKAQDVWGEALATGRAKRN

SEQ ID NO: 653091 - protein, 25 aa, Mycobacterium
EKARANRTPIEWDGYTPPVPAMGAG

SEQ ID NO: 653092 - protein, 25 aa, Mycobacterium
EKARANRTPIEWDGYTPPVPAQGLG

SEQ ID NO: 653093 - protein, 25 aa, Mycobacterium
EKARANRTPIEWDGYTPPVPAQGVG

SEQ ID NO: 653094 - protein, 23 aa, Mycobacterium
EKARDAGAMAYLVKPFSKTDLVP

SEQ ID NO: 653095 - protein, 19 aa, Mycobacterium
EKARLARQLAEKVGQGVLK

SEQ ID NO: 653096 - protein, 25 aa, Mycobacterium
EKARLWPSIVKSFPGYDGYQRNTDR

SEQ ID NO: 653097 - protein, 25 aa, Mycobacterium
EKASPNPLLLAWIFSQMQERHLPKD

SEQ ID NO: 653098 - protein, 19 aa, Mycobacterium
EKATELLAATNRKLDKAAS

SEQ ID NO: 653099 - protein, 20 aa, Mycobacterium
EKATRFWVKLGTQQRDGGRT

SEQ ID NO: 653100 - protein, 34 aa, Mycobacterium
EKAVARASFFPVIPVCSQSGVGTLELLDIISRGF

SEQ ID NO: 653101 - protein, 21 aa, Mycobacterium
EKAYGAGPCSGHLTDIEHIVL

SEQ ID NO: 653102 - protein, 19 aa, Mycobacterium
EKDKASGDFVWDEDESEAL

SEQ ID NO: 653103 - protein, 23 aa, Mycobacterium
EKDLPIDPTVLFDGMSAFVQHAL

SEQ ID NO: 653104 - protein, 23 aa, Mycobacterium
EKDLVVSHILHLLLTGKLRTGDR

SEQ ID NO: 653105 - protein, 28 aa, Mycobacterium
EKDPRWTQGRLRWDHVVVLPNTELPADF

SEQ ID NO: 653106 - protein, 21 aa, Mycobacterium
EKDVPLLGLFKERAEGAGHSY

SEQ ID NO: 653107 - protein, 18 aa, Mycobacterium
EKEFPVTGDAAVLRETVQ

SEQ ID NO: 653108 - protein, 17 aa, Mycobacterium
EKEIVCFEPMTAPTDAL

SEQ ID NO: 653109 - protein, 18 aa, Mycobacterium
EKELERARLAGAKAAATD

SEQ ID NO: 653110 - protein, 19 aa, Mycobacterium
EKELERARLASVRAAAVNA

SEQ ID NO: 653111 - protein, 22 aa, Mycobacterium
EKETPEVIAYLEAENAYVDDQL

SEQ ID NO: 653112 - protein, 21 aa, Mycobacterium
EKEVKEWWAVLDKRAHDKADP

SEQ ID NO: 653113 - protein, 25 aa, Mycobacterium
EKEWMLPLLDLRNALDVADDRHLRD

SEQ ID NO: 653114 - protein, 17 aa, Mycobacterium
EKFAKDFVAAWVKVSDA

SEQ ID NO: 653115 - protein, 21 aa, Mycobacterium
EKFKALMAERVPLYRQVATMR

SEQ ID NO: 653116 - protein, 18 aa, Mycobacterium
EKFLELLPNRVITDSIGS

SEQ ID NO: 653117 - protein, 19 aa, Mycobacterium
EKFLRPVIEGYQRSAFAMT

SEQ ID NO: 653118 - protein, 17 aa, Mycobacterium
EKFPHVAVVDAPVSGGP

SEQ ID NO: 653119 - protein, 17 aa, Mycobacterium
EKFPVLLGGAALTRSYV

SEQ ID NO: 653120 - protein, 23 aa, Mycobacterium
EKFREVMETEYLKRKLIDGPAPE

SEQ ID NO: 653121 - protein, 20 aa, Mycobacterium
EKFSPFSGFGYFAGGLSGFA

SEQ ID NO: 653122 - protein, 18 aa, Mycobacterium
EKGDRLPHNRVWMKAGGK

SEQ ID NO: 653123 - protein, 24 aa, Mycobacterium
EKGDRLPYNRVWLKALGAMPDDPV

SEQ ID NO: 653124 - protein, 30 aa, Mycobacterium
EKGLPGLEGDRRFHLGVAVAAHNPLLLRLL

SEQ ID NO: 653125 - protein, 23 aa, Mycobacterium
EKGLRDVMRYHVSMTSSINFPDE

SEQ ID NO: 653126 - protein, 21 aa, Mycobacterium
EKGRGRGLAMAAALVGESHVR

SEQ ID NO: 653127 - protein, 17 aa, Mycobacterium
EKGRWYLVGHDRDRGAT

SEQ ID NO: 653128 - protein, 17 aa, Mycobacterium
EKHAALRGSMTVLAVNT

SEQ ID NO: 653129 - protein, 25 aa, Mycobacterium
EKHDLAFGTSRWSSKLVHGGLRYLA

SEQ ID NO: 653130 - protein, 21 aa, Mycobacterium
EKHKLALEREMLGLYVSGHPL

SEQ ID NO: 653131 - protein, 19 aa, Mycobacterium
EKHPELLHRAIAIEAKVRQ

SEQ ID NO: 653132 - protein, 23 aa, Mycobacterium
EKIEALLRVLEPYGVREIVQSGV

SEQ ID NO: 653133 - protein, 17 aa, Mycobacterium
EKIESRYATAMGAAELD

SEQ ID NO: 653134 - protein, 17 aa, Mycobacterium
EKIETRYGTAIGSSELA

SEQ ID NO: 653135 - protein, 29 aa, Mycobacterium
EKIFNDFVSRGWLRFVYGGADVGGYLAHH

SEQ ID NO: 653136 - protein, 30 aa, Mycobacterium
EKIGALLPPALKWRLFFASQGKNPKYLHDG

SEQ ID NO: 653137 - protein, 25 aa, Mycobacterium
EKIGPALEDWAKWGQARHDYFLRAA

SEQ ID NO: 653138 - protein, 24 aa, Mycobacterium
EKIHRGDGVIYWQVPKGATLDSTI

SEQ ID NO: 653139 - protein, 24 aa, Mycobacterium
EKILGRPATTFAEAVSTHRDLFAK

SEQ ID NO: 653140 - protein, 21 aa, Mycobacterium
EKILKLAFQFEEGGESANVER

SEQ ID NO: 653141 - protein, 25 aa, Mycobacterium
EKIRSLRLPLLILHSPTDNTVGIEN

SEQ ID NO: 653142 - protein, 23 aa, Mycobacterium
EKISSLPDLLPLLEKVAEAGKPL

SEQ ID NO: 653143 - protein, 22 aa, Mycobacterium
EKKELPAPVKRDFIEDLLEEGT

SEQ ID NO: 653144 - protein, 23 aa, Mycobacterium
EKKIRLAPQYLLDDLPRLASRMD

SEQ ID NO: 653145 - protein, 25 aa, Mycobacterium
EKKLFSRMAEVFAGFLSYTDAQIGR

SEQ ID NO: 653146 - protein, 22 aa, Mycobacterium
EKLAELFEDNWFRSIGEQSSYA

SEQ ID NO: 653147 - protein, 18 aa, Mycobacterium
EKLAELIQSPKWLELVEP

SEQ ID NO: 653148 - protein, 21 aa, Mycobacterium
EKLAGLKPAFVEDGLIHAGNS

SEQ ID NO: 653149 - protein, 18 aa, Mycobacterium
EKLCWRNAAELYGIDISA

SEQ ID NO: 653150 - protein, 17 aa, Mycobacterium
EKLDFIFDATYDCGTHQ

SEQ ID NO: 653151 - protein, 24 aa, Mycobacterium
EKLDYLVDLGVDFVELMPVNAFGG

SEQ ID NO: 653152 - protein, 24 aa, Mycobacterium
EKLDYLVDLGVDFVEVMPVNAFSG

SEQ ID NO: 653153 - protein, 23 aa, Mycobacterium
EKLEAFANFGFPESHSLSFASLV

SEQ ID NO: 653154 - protein, 25 aa, Mycobacterium
EKLEALLRVLEPYGIREIAQSGVVS

SEQ ID NO: 653155 - protein, 28 aa, Mycobacterium
EKLEKVLDWPTGHITRIRRGAAPAPTSG

SEQ ID NO: 653156 - protein, 19 aa, Mycobacterium
EKLELRRAAYFDGTVEAYL

SEQ ID NO: 653157 - protein, 20 aa, Mycobacterium
EKLELRRVANFDGTVEAYLH

SEQ ID NO: 653158 - protein, 19 aa, Mycobacterium
EKLELRRVANFDGTVETYL

SEQ ID NO: 653159 - protein, 19 aa, Mycobacterium
EKLELRRVAYFGGTVEAYL

SEQ ID NO: 653160 - protein, 20 aa, Mycobacterium
EKLELRRVAYFGGTVEAYLH

SEQ ID NO: 653161 - protein, 17 aa, Mycobacterium
EKLGFQRVPVLAVKRKN

SEQ ID NO: 653162 - protein, 21 aa, Mycobacterium
EKLGYGAVWIGGSPAADLSSV

SEQ ID NO: 653163 - protein, 20 aa, Mycobacterium
EKLHIARAVADLLTPQETVI

SEQ ID NO: 653164 - protein, 18 aa, Mycobacterium
EKLITALSSEEWMGPASA

SEQ ID NO: 653165 - protein, 23 aa, Mycobacterium
EKLLALGRLSAGLTHQLNNPAAA

SEQ ID NO: 653166 - protein, 25 aa, Mycobacterium
EKLLEAWELARWAPTSVNTQPLRIL

SEQ ID NO: 653167 - protein, 26 aa, Mycobacterium
EKLLQPWGIVHGGVYCAVIESMASVS

SEQ ID NO: 653168 - protein, 18 aa, Mycobacterium
EKLMGFGHRVYRAEDPRA

SEQ ID NO: 653169 - protein, 23 aa, Mycobacterium
EKLNGHRGCVIWFTGLSGSGKST

SEQ ID NO: 653170 - protein, 19 aa, Mycobacterium
EKLPDGWDADVPRWEPGDK

SEQ ID NO: 653171 - protein, 22 aa, Mycobacterium
EKLPRGDLLAGVSSFGLGGTNV

SEQ ID NO: 653172 - protein, 23 aa, Mycobacterium
EKLPRYISSVLARLQEVWVGRQI

SEQ ID NO: 653173 - protein, 19 aa, Mycobacterium
EKLRATLQHELRQYSTKIH

SEQ ID NO: 653174 - protein, 19 aa, Mycobacterium
EKLRKAAGLLNLEDLADSA

SEQ ID NO: 653175 - protein, 18 aa, Mycobacterium
EKLRYSPGQFLTLRVPSE

SEQ ID NO: 653176 - protein, 18 aa, Mycobacterium
EKLSALLTQPGKTYDVSS

SEQ ID NO: 653177 - protein, 20 aa, Mycobacterium
EKLSGLKPAFTEDGVIHAGN

SEQ ID NO: 653178 - protein, 17 aa, Mycobacterium
EKLTARMGALTIGPGDE

SEQ ID NO: 653179 - protein, 18 aa, Mycobacterium
EKLTGGRLMRLRIPASAV

SEQ ID NO: 653180 - protein, 19 aa, Mycobacterium
EKLTGLFMASFEAIEHRHA

SEQ ID NO: 653181 - protein, 18 aa, Mycobacterium
EKMEKAVAVARDDLSTIR

SEQ ID NO: 653182 - protein, 19 aa, Mycobacterium
EKMEKAVSVARDDLASIRT

SEQ ID NO: 653183 - protein, 17 aa, Mycobacterium
EKMEKAVSVARDDLSTI

SEQ ID NO: 653184 - protein, 19 aa, Mycobacterium
EKMEKAVSVARDDLSTIRT

SEQ ID NO: 653185 - protein, 19 aa, Mycobacterium
EKMEKAVSVARDELGSIRT

SEQ ID NO: 653186 - protein, 17 aa, Mycobacterium
EKMEKAVSVAREDMATI

SEQ ID NO: 653187 - protein, 17 aa, Mycobacterium
EKMEKAVTVARDDFATI

SEQ ID NO: 653188 - protein, 35 aa, Mycobacterium
EKMLCPGLSFLPIAIVVDYELTVSMPARLTADTGV

SEQ ID NO: 653189 - protein, 25 aa, Mycobacterium
EKMRRAGYKLARREGAREGRWTLLD

SEQ ID NO: 653190 - protein, 23 aa, Mycobacterium
EKMRRAGYKPARREGTREGRWTL

SEQ ID NO: 653191 - protein, 24 aa, Mycobacterium
EKMRRAGYKPARREGTREGRWTLL

SEQ ID NO: 653192 - protein, 24 aa, Mycobacterium
EKMRRAGYRPARREGAREGRWTLL

SEQ ID NO: 653193 - protein, 23 aa, Mycobacterium
EKMRWDAPWYRAIRRADDAEVAG

SEQ ID NO: 653194 - protein, 17 aa, Mycobacterium
EKNPWTGQVFKVTGGSI

SEQ ID NO: 653195 - protein, 17 aa, Mycobacterium
EKNRARILIGPDGRVMA

SEQ ID NO: 653196 - protein, 17 aa, Mycobacterium
EKPFFGSLLEFITSGPL

SEQ ID NO: 653197 - protein, 30 aa, Mycobacterium
EKPGALLFSEWRALLMLGDFERADTFAAET

SEQ ID NO: 653198 - protein, 25 aa, Mycobacterium
EKPGRREGWDYPAMAKESGTNALTD

SEQ ID NO: 653199 - protein, 26 aa, Mycobacterium
EKPGRREGWDYPAMVKEAGTKALEDA

SEQ ID NO: 653200 - protein, 24 aa, Mycobacterium
EKPGRREGWDYPDMARESGTNALA

SEQ ID NO: 653201 - protein, 24 aa, Mycobacterium
EKPGRREGWDYPDMARESGTNALR

SEQ ID NO: 653202 - protein, 24 aa, Mycobacterium
EKPGRREGWDYPDMARESGTNALV

SEQ ID NO: 653203 - protein, 21 aa, Mycobacterium
EKPGVGSPFHGGGGGGGGGGG

SEQ ID NO: 653204 - protein, 25 aa, Mycobacterium
EKPGYVAAVPVRWSDIDMYQHVNHA

SEQ ID NO: 653205 - protein, 17 aa, Mycobacterium
EKPHVRITVGLVTGDVE

SEQ ID NO: 653206 - protein, 20 aa, Mycobacterium
EKPKAPLLVMERTAFDDSGR

SEQ ID NO: 653207 - protein, 22 aa, Mycobacterium
EKPPKDRDIAMVFQSYALYPHM

SEQ ID NO: 653208 - protein, 24 aa, Mycobacterium
EKPTEAIAALLARYPDADTVQLHP

SEQ ID NO: 653209 - protein, 19 aa, Mycobacterium
EKPTIVLPGTGGSVSGTAV

SEQ ID NO: 653210 - protein, 17 aa, Mycobacterium
EKQRAGASLAVLNHVPF

SEQ ID NO: 653211 - protein, 21 aa, Mycobacterium
EKQREILILRVVVGMSAEETA

SEQ ID NO: 653212 - protein, 20 aa, Mycobacterium
EKRAAALDLELARVGWGRDD

SEQ ID NO: 653213 - protein, 19 aa, Mycobacterium
EKRAMELLGQVGLAEKAHV

SEQ ID NO: 653214 - protein, 25 aa, Mycobacterium
EKRDFSEPVALNWSQHGTDVDFGSL

SEQ ID NO: 653215 - protein, 23 aa, Mycobacterium
EKRFRTAWEAAREAIGQPELHFH

SEQ ID NO: 653216 - protein, 20 aa, Mycobacterium
EKRGRPPLFEEIPEQLLPQL

SEQ ID NO: 653217 - protein, 20 aa, Mycobacterium
EKRIKRDDTVLVQLATPSRE

SEQ ID NO: 653218 - protein, 19 aa, Mycobacterium
EKRKLKAKFVFVGAGGGAL

SEQ ID NO: 653219 - protein, 21 aa, Mycobacterium
EKRPPPVPVTELYETIRGSLL

SEQ ID NO: 653220 - protein, 36 aa, Mycobacterium
EKRREMAYEGKIDWAFAELLALGSLVAEGKLVRFSG

SEQ ID NO: 653221 - protein, 34 aa, Mycobacterium
EKRREMAYEGKVDWAFAELLALGTFLAEGKTIRF

SEQ ID NO: 653222 - protein, 35 aa, Mycobacterium
EKRREMAYEGKVDWAFGELLALGSLVAEGKLVRLS

SEQ ID NO: 653223 - protein, 28 aa, Mycobacterium
EKRREVVEPFLLCWKDIVGTLTSLAEGA

SEQ ID NO: 653224 - protein, 21 aa, Mycobacterium
EKRRLSVATVLMTRPAVIVAD

SEQ ID NO: 653225 - protein, 23 aa, Mycobacterium
EKRSVSAPLRWDSLTSDQKDTWR

SEQ ID NO: 653226 - protein, 28 aa, Mycobacterium
EKRSWLRARGLQTFPVVAWAERGGKDAL

SEQ ID NO: 653227 - protein, 20 aa, Mycobacterium
EKSAWGYLPPTAFRSRHSAL

SEQ ID NO: 653228 - protein, 23 aa, Mycobacterium
EKSDPRAASLLRSSIGTELTDTQ

SEQ ID NO: 653229 - protein, 20 aa, Mycobacterium
EKSDRLGLQIVRTLVTAELD

SEQ ID NO: 653230 - protein, 33 aa, Mycobacterium
EKSRTAAKTGAGWQPEIWRAFAEELGILGAALP

SEQ ID NO: 653231 - protein, 25 aa, Mycobacterium
EKTACLIAAAGRFGAMFSGADADQV

SEQ ID NO: 653232 - protein, 25 aa, Mycobacterium
EKTACLIAAAGRFGAMFSGADAEQV

SEQ ID NO: 653233 - protein, 25 aa, Mycobacterium
EKTACLIAASGRFGATFSGANDEQI

SEQ ID NO: 653234 - protein, 25 aa, Mycobacterium
EKTDLRLRFKWMGLYTQREQGYDGS

SEQ ID NO: 653235 - protein, 23 aa, Mycobacterium
EKTEQFTALALRLLENTVDDEEL

SEQ ID NO: 653236 - protein, 20 aa, Mycobacterium
EKTFRIGRLCTRRDARGQGH

SEQ ID NO: 653237 - protein, 23 aa, Mycobacterium
EKTGGTGWGCERALMPRSNVVID

SEQ ID NO: 653238 - protein, 22 aa, Mycobacterium
EKTGHPFLQHLLAHRDATRLKV

SEQ ID NO: 653239 - protein, 21 aa, Mycobacterium
EKTGHPFLQHLLAHRDVTRLK

SEQ ID NO: 653240 - protein, 23 aa, Mycobacterium
EKTIKGTLFGSANPQYDIVRLLR

SEQ ID NO: 653241 - protein, 23 aa, Mycobacterium
EKTLDFAKKVGREVGASDSYGDA

SEQ ID NO: 653242 - protein, 22 aa, Mycobacterium
EKTPEGFSWLYNFIKAQGERNY

SEQ ID NO: 653243 - protein, 25 aa, Mycobacterium
EKTPEGFSWLYRFIKAQGERNYGKI

SEQ ID NO: 653244 - protein, 25 aa, Mycobacterium
EKTTAMGKGFFVTWVTTYRDQNGEV

SEQ ID NO: 653245 - protein, 26 aa, Mycobacterium
EKTVCGDRTPPGLAIIAMGKCGAREL

SEQ ID NO: 653246 - protein, 23 aa, Mycobacterium
EKVAPRPTSSFAQTLRLALIDVA

SEQ ID NO: 653247 - protein, 18 aa, Mycobacterium
EKVDAVIYDEEFTDTVDR

SEQ ID NO: 653248 - protein, 18 aa, Mycobacterium
EKVFTRWMVAGDAALTSP

SEQ ID NO: 653249 - protein, 22 aa, Mycobacterium
EKVGRWRFVTLRRSVDTDRDIA

SEQ ID NO: 653250 - protein, 17 aa, Mycobacterium
EKVKEVVVLARALSEGR

SEQ ID NO: 653251 - protein, 28 aa, Mycobacterium
EKVLCGLPALWLRRLCANMLCKLGVFSG

SEQ ID NO: 653252 - protein, 26 aa, Mycobacterium
EKVLDSRINWKLAIDTFSENYHFATV

SEQ ID NO: 653253 - protein, 25 aa, Mycobacterium
EKVLGRPAVPFAQWVAEHRDVFARA

SEQ ID NO: 653254 - protein, 18 aa, Mycobacterium
EKVLRRAGLTLSDVDLFE

SEQ ID NO: 653255 - protein, 21 aa, Mycobacterium
EKVMASPMLWDPIRYDETCPS

SEQ ID NO: 653256 - protein, 18 aa, Mycobacterium
EKVMGFGHRVYKNGDSRV

SEQ ID NO: 653257 - protein, 18 aa, Mycobacterium
EKVMGFGHRVYRNGDSRV

SEQ ID NO: 653258 - protein, 25 aa, Mycobacterium
EKVMGWLRPLIKGYHRAEVHGLDTF

SEQ ID NO: 653259 - protein, 26 aa, Mycobacterium
EKVMSSPMLWDPIRFDETCPSSDGAC

SEQ ID NO: 653260 - protein, 17 aa, Mycobacterium
EKVNLAPGVPWTFETTM

SEQ ID NO: 653261 - protein, 21 aa, Mycobacterium
EKVNLASMVHRLLGLGLAKGH

SEQ ID NO: 653262 - protein, 19 aa, Mycobacterium
EKVRACLFDLDGVLTDTAS

SEQ ID NO: 653263 - protein, 22 aa, Mycobacterium
EKVRATGHQVVWQCDPMHGNTH

SEQ ID NO: 653264 - protein, 17 aa, Mycobacterium
EKVRFGHKVVGAEWSSE

SEQ ID NO: 653265 - protein, 23 aa, Mycobacterium
EKVTLRIAAKYAQYTNFTPEPTA

SEQ ID NO: 653266 - protein, 24 aa, Mycobacterium
EKVTLRIAAKYAQYTNFTSEPDGF

SEQ ID NO: 653267 - protein, 18 aa, Mycobacterium
EKWCLATEPERWETRLNT

SEQ ID NO: 653268 - protein, 23 aa, Mycobacterium
EKWGEAVTAVIVLRPDHPSDDEA

SEQ ID NO: 653269 - protein, 20 aa, Mycobacterium
EKWKPGLPAPRDEFHIALAE

SEQ ID NO: 653270 - protein, 24 aa, Mycobacterium
EKWPRVRVSGPMVHRAMTGWQRLH

SEQ ID NO: 653271 - protein, 17 aa, Mycobacterium
EKYALIVSHTIPFGSVG

SEQ ID NO: 653272 - protein, 27 aa, Mycobacterium
EKYLRRARRRIGMVFQQFNLFPNMTVI

SEQ ID NO: 653273 - protein, 24 aa, Mycobacterium
EKYNVPIVQAWGMTETSPLATVAR

SEQ ID NO: 653274 - protein, 21 aa, Mycobacterium
EKYPGVWCHGDWITITDRGSV

SEQ ID NO: 653275 - protein, 20 aa, Mycobacterium
EKYVAAGLWHSADTLEELAA

SEQ ID NO: 653276 - protein, 21 aa, Mycobacterium
ELAAAGLRRTHWWTDEAGDFG

SEQ ID NO: 653277 - protein, 19 aa, Mycobacterium
ELAAAGWGGPWLVADADVD

SEQ ID NO: 653278 - protein, 26 aa, Mycobacterium
ELAAALLRPERVVGMHFFNPVPTSQL

SEQ ID NO: 653279 - protein, 19 aa, Mycobacterium
ELAAAMWAQQLPFGMAGTG

SEQ ID NO: 653280 - protein, 19 aa, Mycobacterium
ELAAECAWIRENLGVDVPL

SEQ ID NO: 653281 - protein, 18 aa, Mycobacterium
ELAAELQVTGASYNSIIE

SEQ ID NO: 653282 - protein, 20 aa, Mycobacterium
ELAAELYATAAGYRSTLDGL

SEQ ID NO: 653283 - protein, 20 aa, Mycobacterium
ELAAGMAFHVILGMWMDGWG

SEQ ID NO: 653284 - protein, 18 aa, Mycobacterium
ELAAICKRRSRLGLVAVH

SEQ ID NO: 653285 - protein, 18 aa, Mycobacterium
ELAALGINIDLIRGIADY

SEQ ID NO: 653286 - protein, 20 aa, Mycobacterium
ELAALVERVAPVVLSGRRGE

SEQ ID NO: 653287 - protein, 24 aa, Mycobacterium
ELAALWRDGRFRSEVLDAGCGHAE

SEQ ID NO: 653288 - protein, 19 aa, Mycobacterium
ELAARIEAMPWQWVGQELP

SEQ ID NO: 653289 - protein, 18 aa, Mycobacterium
ELAARPARRVVDDADTAG

SEQ ID NO: 653290 - protein, 19 aa, Mycobacterium
ELAARTPLNVALCPEDHAW

SEQ ID NO: 653291 - protein, 20 aa, Mycobacterium
ELAARVSMRTGVVGLGLALP

SEQ ID NO: 653292 - protein, 19 aa, Mycobacterium
ELADAAARCDTPATKVVVL

SEQ ID NO: 653293 - protein, 20 aa, Mycobacterium
ELADALGLFPPTEEQAAVIA

SEQ ID NO: 653294 - protein, 19 aa, Mycobacterium
ELADAVIGFTARRGELDQL

SEQ ID NO: 653295 - protein, 25 aa, Mycobacterium
ELADDPRFCDVLPLIEHAAEAAERI

SEQ ID NO: 653296 - protein, 22 aa, Mycobacterium
ELADGLSYHCPLTYRPLLERDR

SEQ ID NO: 653297 - protein, 20 aa, Mycobacterium
ELADGTVLWMADERAIGDHI

SEQ ID NO: 653298 - protein, 20 aa, Mycobacterium
ELADLLKLLGADRIIMGSDY

SEQ ID NO: 653299 - protein, 21 aa, Mycobacterium
ELADLLPGCAGLEVVDSIRGH

SEQ ID NO: 653300 - protein, 26 aa, Mycobacterium
ELADRFAAHGFAFYALDLDKCGRSRR

SEQ ID NO: 653301 - protein, 20 aa, Mycobacterium
ELADRGLHVLIVDQENSANL

SEQ ID NO: 653302 - protein, 25 aa, Mycobacterium
ELADRVRRAAGAFLAHGIGRGDRVA

SEQ ID NO: 653303 - protein, 27 aa, Mycobacterium
ELAEAALAIRAGALWVAANVDKTLPTE

SEQ ID NO: 653304 - protein, 28 aa, Mycobacterium
ELAEAALAIRAGALWVAANVDPTLPTER

SEQ ID NO: 653305 - protein, 17 aa, Mycobacterium
ELAEAIAGIVLIGLLTR

SEQ ID NO: 653306 - protein, 19 aa, Mycobacterium
ELAEALAAARTYPRSFVGD

SEQ ID NO: 653307 - protein, 20 aa, Mycobacterium
ELAEALVCAAARETFEESGV

SEQ ID NO: 653308 - protein, 24 aa, Mycobacterium
ELAEAQAAVDAMPSRDEFRREHPG

SEQ ID NO: 653309 - protein, 19 aa, Mycobacterium
ELAEEVFTWARAVSAEVDP

SEQ ID NO: 653310 - protein, 28 aa, Mycobacterium
ELAEEVLVIAALARQNGLAAQHSYMLGS

SEQ ID NO: 653311 - protein, 25 aa, Mycobacterium
ELAEGYRYLLGFVHSAVERAFFGDP

SEQ ID NO: 653312 - protein, 22 aa, Mycobacterium
ELAEIKRAPSFFDAADLEVSQF

SEQ ID NO: 653313 - protein, 18 aa, Mycobacterium
ELAELLAAAGYDDDTSEY

SEQ ID NO: 653314 - protein, 18 aa, Mycobacterium
ELAELLSLEHGKTVADSR

SEQ ID NO: 653315 - protein, 22 aa, Mycobacterium
ELAELYAAAGLDGDKETIAYCR

SEQ ID NO: 653316 - protein, 23 aa, Mycobacterium
ELAEMRRSAPIWWNEQPTGCGGF

SEQ ID NO: 653317 - protein, 26 aa, Mycobacterium
ELAENRLRPGVLRGECADPPKTAWLF

SEQ ID NO: 653318 - protein, 23 aa, Mycobacterium
ELAENRLRPGVVRGEHTHHPTTA

SEQ ID NO: 653319 - protein, 27 aa, Mycobacterium
ELAERLGNAGFRWLVDACSPVDDPVVA

SEQ ID NO: 653320 - protein, 25 aa, Mycobacterium
ELAERLGNAGFRWLVESAPVDDPIV

SEQ ID NO: 653321 - protein, 34 aa, Mycobacterium
ELAERPRLSYSLDEACLLIFPRRELSAGEADAAA

SEQ ID NO: 653322 - protein, 19 aa, Mycobacterium
ELAERVRRAAGAFAAAGVN

SEQ ID NO: 653323 - protein, 18 aa, Mycobacterium
ELAETYGAPTYARIDAPA

SEQ ID NO: 653324 - protein, 17 aa, Mycobacterium
ELAEVAAEFGVPMHSDA

SEQ ID NO: 653325 - protein, 24 aa, Mycobacterium
ELAEVHPHWIVLRTVIDVVEPIEL

SEQ ID NO: 653326 - protein, 17 aa, Mycobacterium
ELAEVMLGHALPMPDSG

SEQ ID NO: 653327 - protein, 26 aa, Mycobacterium
ELAEYRRRVELAWPRVEVTDVDSYGL

SEQ ID NO: 653328 - protein, 18 aa, Mycobacterium
ELAFPNAILALFHYPDKS

SEQ ID NO: 653329 - protein, 18 aa, Mycobacterium
ELAFTVKTANKWGIAVSK

SEQ ID NO: 653330 - protein, 30 aa, Mycobacterium
ELAGAVSRASARWCAGARWSVLPEAEHTFW

SEQ ID NO: 653331 - protein, 26 aa, Mycobacterium
ELAGDPACPLRCMVVAGAPVPRNLPA

SEQ ID NO: 653332 - protein, 21 aa, Mycobacterium
ELAGGCAEKARADEPYRRAVR

SEQ ID NO: 653333 - protein, 23 aa, Mycobacterium
ELAGLRLALMHGRLSADEKEAAM

SEQ ID NO: 653334 - protein, 25 aa, Mycobacterium
ELAGLRPASRLNYPISERRDSDGRL

SEQ ID NO: 653335 - protein, 22 aa, Mycobacterium
ELAGNGRILLRPSGTEQLVRVM

SEQ ID NO: 653336 - protein, 17 aa, Mycobacterium
ELAGRFLERVCPPDADP

SEQ ID NO: 653337 - protein, 18 aa, Mycobacterium
ELAGRWELPGGKVAGGET

SEQ ID NO: 653338 - protein, 21 aa, Mycobacterium
ELAGRWELPGGKVATGETERA

SEQ ID NO: 653339 - protein, 24 aa, Mycobacterium
ELAGTRLPVHVRLAGHLDPIDGNY

SEQ ID NO: 653340 - protein, 17 aa, Mycobacterium
ELAGTVGIRSVPTIMAF

SEQ ID NO: 653341 - protein, 25 aa, Mycobacterium
ELAGYKQPRRFVFWREFPLGPAGKI

SEQ ID NO: 653342 - protein, 17 aa, Mycobacterium
ELAKALADFLFDDEHAM

SEQ ID NO: 653343 - protein, 17 aa, Mycobacterium
ELAKALAEFLFDDERAM

SEQ ID NO: 653344 - protein, 24 aa, Mycobacterium
ELAKEQSHGLGLFVRSLVGLDREA

SEQ ID NO: 653345 - protein, 25 aa, Mycobacterium
ELAKGFPKPMGWGVRLTGKKFFRSY

SEQ ID NO: 653346 - protein, 20 aa, Mycobacterium
ELAKLGGPVDRDEWFMTPQT

SEQ ID NO: 653347 - protein, 20 aa, Mycobacterium
ELALARAWTCFARKDPVTAV

SEQ ID NO: 653348 - protein, 19 aa, Mycobacterium
ELALHFAAHYGWPKASHLN

SEQ ID NO: 653349 - protein, 23 aa, Mycobacterium
ELALSAPAGPVWVEIPQDVLTEP

SEQ ID NO: 653350 - protein, 24 aa, Mycobacterium
ELANLRLGLMHGRLSADEKDAAMA

SEQ ID NO: 653351 - protein, 27 aa, Mycobacterium
ELAPDPWLAERVRAEMLRRGRTPVPAE

SEQ ID NO: 653352 - protein, 18 aa, Mycobacterium
ELAPFRLPLTISPQPAPR

SEQ ID NO: 653353 - protein, 24 aa, Mycobacterium
ELAPGSILVPFSWQQVSLHAAGAA

SEQ ID NO: 653354 - protein, 19 aa, Mycobacterium
ELAPKGTGAVLSFELAGGI

SEQ ID NO: 653355 - protein, 34 aa, Mycobacterium
ELAPLAALRFGELCLEAGLPPGLVNILPAAAEGG

SEQ ID NO: 653356 - protein, 34 aa, Mycobacterium
ELAPLAALRFGELCLVAGLPPGLVNILPAASDGG

SEQ ID NO: 653357 - protein, 17 aa, Mycobacterium
ELAPLLCAGIIGYRALM

SEQ ID NO: 653358 - protein, 21 aa, Mycobacterium
ELAPRFSVALMELGATVCTAR

SEQ ID NO: 653359 - protein, 23 aa, Mycobacterium
ELAPRLATPLSRGCFPMLSFLDA

SEQ ID NO: 653360 - protein, 27 aa, Mycobacterium
ELAPTLPLRIYWALLGWARGRTNRNGM

SEQ ID NO: 653361 - protein, 24 aa, Mycobacterium
ELAPTVLGLARWASRSPSMPYDAP

SEQ ID NO: 653362 - protein, 24 aa, Mycobacterium
ELAQAWRPRDIHVIDAPVSGGAPG

SEQ ID NO: 653363 - protein, 17 aa, Mycobacterium
ELAQFGIAPSALVGHSM

SEQ ID NO: 653364 - protein, 21 aa, Mycobacterium
ELAQLPSLLAEKLKAPSVTAG

SEQ ID NO: 653365 - protein, 23 aa, Mycobacterium
ELAQRGWPVFLVSTVTRENLQPL

SEQ ID NO: 653366 - protein, 20 aa, Mycobacterium
ELAQRLGIDPFELRRRNVVR

SEQ ID NO: 653367 - protein, 19 aa, Mycobacterium
ELARHGARVILAVRNTSKG

SEQ ID NO: 653368 - protein, 17 aa, Mycobacterium
ELARHGLGVAILPQSMA

SEQ ID NO: 653369 - protein, 21 aa, Mycobacterium
ELARLSSPIGLDLGGRTPEET

SEQ ID NO: 653370 - protein, 22 aa, Mycobacterium
ELARNSPLWVRAVFDVVAPVLV

SEQ ID NO: 653371 - protein, 22 aa, Mycobacterium
ELARRAAQVIGERTGIAEHDVA

SEQ ID NO: 653372 - protein, 17 aa, Mycobacterium
ELARRGAPIHAECAGLT

SEQ ID NO: 653373 - protein, 25 aa, Mycobacterium
ELARRGIVDAIGFGFPHYFLLPQYS

SEQ ID NO: 653374 - protein, 18 aa, Mycobacterium
ELARRGQCTVVAMDYRLA

SEQ ID NO: 653375 - protein, 26 aa, Mycobacterium
ELARRSDVFLTSFLPAHRKKFGIDIE

SEQ ID NO: 653376 - protein, 26 aa, Mycobacterium
ELARRSDVFLTSFLPAHRNKFGIDVD

SEQ ID NO: 653377 - protein, 25 aa, Mycobacterium
ELARRSDVFLTSFLPDARQKFGIDV

SEQ ID NO: 653378 - protein, 17 aa, Mycobacterium
ELARRVASNSIGFVAPV

SEQ ID NO: 653379 - protein, 17 aa, Mycobacterium
ELARRWPNASVLGLDSS

SEQ ID NO: 653380 - protein, 22 aa, Mycobacterium
ELARTRTLLIARVVETVTRMGT

SEQ ID NO: 653381 - protein, 19 aa, Mycobacterium
ELARWEMIDKALNLGNPDP

SEQ ID NO: 653382 - protein, 19 aa, Mycobacterium
ELASGKSLAAFGLTEPGGG

SEQ ID NO: 653383 - protein, 19 aa, Mycobacterium
ELASKVLARQGDFRPVRTV

SEQ ID NO: 653384 - protein, 23 aa, Mycobacterium
ELASLLRGYGYRPIAVSGDDPLR

SEQ ID NO: 653385 - protein, 25 aa, Mycobacterium
ELASRLRIADVTAFAMESIPRISRA

SEQ ID NO: 653386 - protein, 20 aa, Mycobacterium
ELATLLAHAKLDLKAGLTQC

SEQ ID NO: 653387 - protein, 21 aa, Mycobacterium
ELATLMAHVKLALKDDVLASD

SEQ ID NO: 653388 - protein, 20 aa, Mycobacterium
ELATLMAHVKLALKEEVLTT

SEQ ID NO: 653389 - protein, 21 aa, Mycobacterium
ELATLMAHVKLALKETMLTTE

SEQ ID NO: 653390 - protein, 20 aa, Mycobacterium
ELAVALAVRALRGGSVCVDL

SEQ ID NO: 653391 - protein, 19 aa, Mycobacterium
ELAVKYGIRDEGDRQPPSY

SEQ ID NO: 653392 - protein, 19 aa, Mycobacterium
ELAVRRLVHAMGLRYRVDT

SEQ ID NO: 653393 - protein, 19 aa, Mycobacterium
ELAVSFLLIGSGRAEVTHT

SEQ ID NO: 653394 - protein, 23 aa, Mycobacterium
ELAVTALDRGGCEEVYVTQGAVS

SEQ ID NO: 653395 - protein, 28 aa, Mycobacterium
ELAVTVSRAVKLFAEDQLPLATVGGVAI

SEQ ID NO: 653396 - protein, 20 aa, Mycobacterium
ELCARAFPTEPVIGVLTFVS

SEQ ID NO: 653397 - protein, 21 aa, Mycobacterium
ELCAVFDGFYTLLVSNRDSFA

SEQ ID NO: 653398 - protein, 17 aa, Mycobacterium
ELCDARRTIAEIQVELG

SEQ ID NO: 653399 - protein, 20 aa, Mycobacterium
ELCDAVGQFAARNAPIATTR

SEQ ID NO: 653400 - protein, 20 aa, Mycobacterium
ELCDRVAFVVDGRIVAMNSP

SEQ ID NO: 653401 - protein, 22 aa, Mycobacterium
ELCFPGLVTEWAQWADRRPFVG

SEQ ID NO: 653402 - protein, 27 aa, Mycobacterium
ELCRIFRLDRDVVRVFATRVGGGFGAK

SEQ ID NO: 653403 - protein, 19 aa, Mycobacterium
ELCRIPVVVLTTSSAEEDI

SEQ ID NO: 653404 - protein, 20 aa, Mycobacterium
ELCVCDMAWVVGQSQNLVSH

SEQ ID NO: 653405 - protein, 19 aa, Mycobacterium
ELDAALVPTSRRVVAALGP

SEQ ID NO: 653406 - protein, 20 aa, Mycobacterium
ELDAGHGFNAATLEYGDLIA

SEQ ID NO: 653407 - protein, 29 aa, Mycobacterium
ELDAIRIGRRIVARLNWRKEGPAPGPVVD

SEQ ID NO: 653408 - protein, 23 aa, Mycobacterium
ELDAIRIGRRIVARLNWVKQGPA

SEQ ID NO: 653409 - protein, 22 aa, Mycobacterium
ELDALGWKLNGQFREKDGRQLV

SEQ ID NO: 653410 - protein, 29 aa, Mycobacterium
ELDALRIGRRIVARLNWRKQGPAPKPFTA

SEQ ID NO: 653411 - protein, 23 aa, Mycobacterium
ELDAPEFRCFITGGAPMPEALIR

SEQ ID NO: 653412 - protein, 20 aa, Mycobacterium
ELDAYVVRRLNLPFRDVDWT

SEQ ID NO: 653413 - protein, 17 aa, Mycobacterium
ELDCETVVVITDALTEE

SEQ ID NO: 653414 - protein, 23 aa, Mycobacterium
ELDDCAFPLLAGVEIGADANKIF

SEQ ID NO: 653415 - protein, 23 aa, Mycobacterium
ELDDCAFPLLSGVEIGADANKIF

SEQ ID NO: 653416 - protein, 22 aa, Mycobacterium
ELDDCAFPLLSGVEIGSDANKI

SEQ ID NO: 653417 - protein, 19 aa, Mycobacterium
ELDDLKSQFFANVSHELRT

SEQ ID NO: 653418 - protein, 20 aa, Mycobacterium
ELDEAFPGLLDAILDSSADD

SEQ ID NO: 653419 - protein, 18 aa, Mycobacterium
ELDEASWGAAQRLFPRLA

SEQ ID NO: 653420 - protein, 19 aa, Mycobacterium
ELDEIPVRFNAIDAGVLHL

SEQ ID NO: 653421 - protein, 23 aa, Mycobacterium
ELDELPTHLVIVGGSYIALEFAQ

SEQ ID NO: 653422 - protein, 25 aa, Mycobacterium
ELDELRELLPPWVALASRMAILPPR

SEQ ID NO: 653423 - protein, 22 aa, Mycobacterium
ELDELRVRYAIAPLLPADAAAG

SEQ ID NO: 653424 - protein, 18 aa, Mycobacterium
ELDERRAAVLASIEEQGK

SEQ ID NO: 653425 - protein, 19 aa, Mycobacterium
ELDERRAAVLSSIEEQGKL

SEQ ID NO: 653426 - protein, 18 aa, Mycobacterium
ELDERWGNNLSRPKAIFA

SEQ ID NO: 653427 - protein, 24 aa, Mycobacterium
ELDEWRAKDPLARVEKYLESRGAL

SEQ ID NO: 653428 - protein, 28 aa, Mycobacterium
ELDFAARPALLATFPFPHLLTLDITLAD

SEQ ID NO: 653429 - protein, 20 aa, Mycobacterium
ELDGAVAADCVVLGCDSMLY

SEQ ID NO: 653430 - protein, 29 aa, Mycobacterium
ELDGFPGARVPFRRVHLSTGDHFDLYDTS

SEQ ID NO: 653431 - protein, 21 aa, Mycobacterium
ELDGLRLVTLRGASRAEQGLP

SEQ ID NO: 653432 - protein, 25 aa, Mycobacterium
ELDGTRVTVEWPRNTPLLDVLLARG

SEQ ID NO: 653433 - protein, 20 aa, Mycobacterium
ELDGYWVGAFAMALPNTRVV

SEQ ID NO: 653434 - protein, 25 aa, Mycobacterium
ELDIAPDGTFHWQLRPTSPGQLVIR

SEQ ID NO: 653435 - protein, 19 aa, Mycobacterium
ELDIAPFQVCQFADAGDIA

SEQ ID NO: 653436 - protein, 23 aa, Mycobacterium
ELDIKARAIAAVLQQHGLAGERV

SEQ ID NO: 653437 - protein, 19 aa, Mycobacterium
ELDIPVVAGGVIDHRTALH

SEQ ID NO: 653438 - protein, 19 aa, Mycobacterium
ELDIPVVAGGVLDHRTALH

SEQ ID NO: 653439 - protein, 18 aa, Mycobacterium
ELDIVAAAARAVHVFGPQ

SEQ ID NO: 653440 - protein, 23 aa, Mycobacterium
ELDLQAPVAHYWPEFAQAGKQDI

SEQ ID NO: 653441 - protein, 24 aa, Mycobacterium
ELDLQAPVARYWPEFGQAGKQDIT

SEQ ID NO: 653442 - protein, 24 aa, Mycobacterium
ELDLQAPVARYWPEFGQKGKDAVT

SEQ ID NO: 653443 - protein, 29 aa, Mycobacterium
ELDMLAAFADQAAQAWQLASTQHRLRELG

SEQ ID NO: 653444 - protein, 23 aa, Mycobacterium
ELDMPIPDIKALLAAGDGATRNE

SEQ ID NO: 653445 - protein, 20 aa, Mycobacterium
ELDMSCVWLGVNQQNERAQR

SEQ ID NO: 653446 - protein, 25 aa, Mycobacterium
ELDNCPPLVVLTGRPDDAWLASWSR

SEQ ID NO: 653447 - protein, 24 aa, Mycobacterium
ELDNLRSAFGWSLETRDFDSALEL

SEQ ID NO: 653448 - protein, 20 aa, Mycobacterium
ELDNTLVFYIWGDNGASMEG

SEQ ID NO: 653449 - protein, 23 aa, Mycobacterium
ELDPEHLHQILVNLLSNAFKFTR

SEQ ID NO: 653450 - protein, 20 aa, Mycobacterium
ELDPQIGLRDSWDNISTAAA

SEQ ID NO: 653451 - protein, 33 aa, Mycobacterium
ELDPQRVVAVLLAFGSPHAHNVILLRAKGIPVI

SEQ ID NO: 653452 - protein, 18 aa, Mycobacterium
ELDQALKRLHTLREERSA

SEQ ID NO: 653453 - protein, 17 aa, Mycobacterium
ELDRLGVDVLLDDRQAS

SEQ ID NO: 653454 - protein, 24 aa, Mycobacterium
ELDRRVLEFGGRVYTAKDSRASAE

SEQ ID NO: 653455 - protein, 19 aa, Mycobacterium
ELDTMMSLFEGVADAKSVA

SEQ ID NO: 653456 - protein, 20 aa, Mycobacterium
ELDVAWMIFAHMVFQELAGL

SEQ ID NO: 653457 - protein, 20 aa, Mycobacterium
ELDVTSWVRLLAEAGAADIT

SEQ ID NO: 653458 - protein, 19 aa, Mycobacterium
ELDVVGWIRFRDINGNLWA

SEQ ID NO: 653459 - protein, 24 aa, Mycobacterium
ELDWETYSLWGLVDEDLTYREADI

SEQ ID NO: 653460 - protein, 25 aa, Mycobacterium
ELEALQIPVGVVFFMRNSVLGRVAA

SEQ ID NO: 653461 - protein, 23 aa, Mycobacterium
ELEAMPELIERVISQMDPVADLA

SEQ ID NO: 653462 - protein, 26 aa, Mycobacterium
ELEARPEYWLSQQGRLTHPMVLRPGD

SEQ ID NO: 653463 - protein, 19 aa, Mycobacterium
ELEEARPWARIQDVTATKQ

SEQ ID NO: 653464 - protein, 19 aa, Mycobacterium
ELEEEGAKSDVRRKVRDGG

SEQ ID NO: 653465 - protein, 18 aa, Mycobacterium
ELEERVAGFLGFSTTLTS

SEQ ID NO: 653466 - protein, 28 aa, Mycobacterium
ELEEYSRRKHIAAGYEFVNTPHITKADL

SEQ ID NO: 653467 - protein, 29 aa, Mycobacterium
ELEEYSRRKHIEAGYEFVNTPHITKEQLY

SEQ ID NO: 653468 - protein, 26 aa, Mycobacterium
ELEFGRLHLPVPDWQVLLNVPTELAA

SEQ ID NO: 653469 - protein, 25 aa, Mycobacterium
ELEGIRVLRSFDECMALRSHASAAK

SEQ ID NO: 653470 - protein, 19 aa, Mycobacterium
ELEGLGFALSYQSLTRNIR

SEQ ID NO: 653471 - protein, 18 aa, Mycobacterium
ELEGLKLWTTNGVVAELL

SEQ ID NO: 653472 - protein, 25 aa, Mycobacterium
ELEGLRRWVAPHLDGYKPLFEAVEE

SEQ ID NO: 653473 - protein, 22 aa, Mycobacterium
ELEGRMYACFAAGALATGCEYD

SEQ ID NO: 653474 - protein, 18 aa, Mycobacterium
ELEHGWALNEVSLEKGPR

SEQ ID NO: 653475 - protein, 19 aa, Mycobacterium
ELEHRFSHPLTFGTAGLRG

SEQ ID NO: 653476 - protein, 25 aa, Mycobacterium
ELEIAADGSFEWRVRPTSPGQLVIR

SEQ ID NO: 653477 - protein, 25 aa, Mycobacterium
ELEIHALLYRYARAVDTKDWDLYRS

SEQ ID NO: 653478 - protein, 21 aa, Mycobacterium
ELEITALLNRYARAVDAKDWQ

SEQ ID NO: 653479 - protein, 21 aa, Mycobacterium
ELEKELGIPAGRVAATLERYN

SEQ ID NO: 653480 - protein, 17 aa, Mycobacterium
ELEKFQWFVRAHLENSG

SEQ ID NO: 653481 - protein, 26 aa, Mycobacterium
ELEKRRAHVPWVTWGTTAMVARSVAK

SEQ ID NO: 653482 - protein, 26 aa, Mycobacterium
ELEKRRAHVPWVTWGTTAMVARSVAR

SEQ ID NO: 653483 - protein, 26 aa, Mycobacterium
ELEKRRAHVPWVTWGTTAMVARSVDR

SEQ ID NO: 653484 - protein, 20 aa, Mycobacterium
ELEKRRARVPWVTWGTTAMV

SEQ ID NO: 653485 - protein, 21 aa, Mycobacterium
ELELARGVSRHHHVAERIPIP

SEQ ID NO: 653486 - protein, 17 aa, Mycobacterium
ELELCYAAIALVTDVDA

SEQ ID NO: 653487 - protein, 17 aa, Mycobacterium
ELELKRVFVLTFEVDFF

SEQ ID NO: 653488 - protein, 25 aa, Mycobacterium
ELELYKRLPGDLSILTPSPASDTDT

SEQ ID NO: 653489 - protein, 23 aa, Mycobacterium
ELENLRAASAWLLESSDGESALM

SEQ ID NO: 653490 - protein, 17 aa, Mycobacterium
ELENRIAMMSRFATDFD

SEQ ID NO: 653491 - protein, 19 aa, Mycobacterium
ELEPFVLVVEGSIPNEKIK

SEQ ID NO: 653492 - protein, 20 aa, Mycobacterium
ELEPVFLAEAGFSLHDVIAD

SEQ ID NO: 653493 - protein, 28 aa, Mycobacterium
ELEQAFMFYLPRICEHCLNPSCVASCPS

SEQ ID NO: 653494 - protein, 19 aa, Mycobacterium
ELEQIWRGRVERIDDLIAT

SEQ ID NO: 653495 - protein, 26 aa, Mycobacterium
ELEREAVFKRAWLNVGRVEELPRVGS

SEQ ID NO: 653496 - protein, 37 aa, Mycobacterium
ELERLFPRTAAELFSWGKSWLETCQNAFAGLDVDPDR

SEQ ID NO: 653497 - protein, 17 aa, Mycobacterium
ELERLYVPWSERTGKRW

SEQ ID NO: 653498 - protein, 18 aa, Mycobacterium
ELERRFGLTEAVVATNAG

SEQ ID NO: 653499 - protein, 38 aa, Mycobacterium
ELERRILLKRVPELPASLAEELVRIIGVLRNMQLKKVP

SEQ ID NO: 653500 - protein, 18 aa, Mycobacterium
ELERRILLSRVPELPGHL

SEQ ID NO: 653501 - protein, 18 aa, Mycobacterium
ELERRILLSRVPELPQHL

SEQ ID NO: 653502 - protein, 24 aa, Mycobacterium
ELESLLRGYGYRPITVAGDDPADV

SEQ ID NO: 653503 - protein, 25 aa, Mycobacterium
ELETCPPLVVLTGRPDDAWLASWSR

SEQ ID NO: 653504 - protein, 24 aa, Mycobacterium
ELETICRYRLPVVVVVLNNGGVYR

SEQ ID NO: 653505 - protein, 20 aa, Mycobacterium
ELETYGALFDRLEDGKISQR

SEQ ID NO: 653506 - protein, 21 aa, Mycobacterium
ELEVRDGGKLVREMVGQMRSL

SEQ ID NO: 653507 - protein, 23 aa, Mycobacterium
ELFAEIPTPVGALAIGSDKTVPL

SEQ ID NO: 653508 - protein, 21 aa, Mycobacterium
ELFAGEAPRVLLLGNAMHADA

SEQ ID NO: 653509 - protein, 17 aa, Mycobacterium
ELFAGPTAIAFIKGEPV

SEQ ID NO: 653510 - protein, 18 aa, Mycobacterium
ELFAGPTAIAFVTGEPVD

SEQ ID NO: 653511 - protein, 26 aa, Mycobacterium
ELFARRLPEGRRYGVVAGTGRLLEAL

SEQ ID NO: 653512 - protein, 20 aa, Mycobacterium
ELFDGFRFEIAGSVQVPTSA

SEQ ID NO: 653513 - protein, 24 aa, Mycobacterium
ELFELAAQCLAPGARLVFNAFLAC

SEQ ID NO: 653514 - protein, 17 aa, Mycobacterium
ELFELGARELMWGARQD

SEQ ID NO: 653515 - protein, 17 aa, Mycobacterium
ELFELGARELMWGEGNS

SEQ ID NO: 653516 - protein, 18 aa, Mycobacterium
ELFFANLVDHCLATRRDE

SEQ ID NO: 653517 - protein, 22 aa, Mycobacterium
ELFGACLHRELTRFVDEVNSNI

SEQ ID NO: 653518 - protein, 21 aa, Mycobacterium
ELFGIRFPSPIFMAPIGVIGV

SEQ ID NO: 653519 - protein, 19 aa, Mycobacterium
ELFGPVAVVYRVADAEEAV

SEQ ID NO: 653520 - protein, 17 aa, Mycobacterium
ELFGYKPDWGLPGPADV

SEQ ID NO: 653521 - protein, 17 aa, Mycobacterium
ELFIAAGADGVRQAVIL

SEQ ID NO: 653522 - protein, 27 aa, Mycobacterium
ELFIIGRIKDLLIIYGRNHSPDDIEAT

SEQ ID NO: 653523 - protein, 27 aa, Mycobacterium
ELFIIGRIKDLLIVYGRNHSPDDIEAT

SEQ ID NO: 653524 - protein, 18 aa, Mycobacterium
ELFLAVSDRYWRRYFDNF

SEQ ID NO: 653525 - protein, 18 aa, Mycobacterium
ELFLGQPGDALWFDCNLM

SEQ ID NO: 653526 - protein, 29 aa, Mycobacterium
ELFRESFKTFLDRHAEPYKEEWEKNKIVD

SEQ ID NO: 653527 - protein, 23 aa, Mycobacterium
ELFRESMRLILDGSVLAAAMTGG

SEQ ID NO: 653528 - protein, 19 aa, Mycobacterium
ELFRRYWPADLHMIGKDII

SEQ ID NO: 653529 - protein, 20 aa, Mycobacterium
ELFSNPAPRRSRTRADERAA

SEQ ID NO: 653530 - protein, 19 aa, Mycobacterium
ELFSVAPLLTAKMYRELGK

SEQ ID NO: 653531 - protein, 19 aa, Mycobacterium
ELFSVAPLLTARNYRELGR

SEQ ID NO: 653532 - protein, 19 aa, Mycobacterium
ELFTRAGIRLGQNNPQLTE

SEQ ID NO: 653533 - protein, 17 aa, Mycobacterium
ELFVPYLQPLIANLVTE

SEQ ID NO: 653534 - protein, 17 aa, Mycobacterium
ELFYPGGSFNLHNLLTW

SEQ ID NO: 653535 - protein, 19 aa, Mycobacterium
ELGADPGWDCELAKTPEGY

SEQ ID NO: 653536 - protein, 22 aa, Mycobacterium
ELGAETFVLWGGREGSEYDSAK

SEQ ID NO: 653537 - protein, 24 aa, Mycobacterium
ELGARFTDFAGWQMPVRYGSELTE

SEQ ID NO: 653538 - protein, 30 aa, Mycobacterium
ELGATWSRWGEPLLPIGVLYDPFVERALEP

SEQ ID NO: 653539 - protein, 26 aa, Mycobacterium
ELGATWSRWGQTLFPIGVLYDPFVER

SEQ ID NO: 653540 - protein, 24 aa, Mycobacterium
ELGCGPGRLVARLIQRGVPALGID

SEQ ID NO: 653541 - protein, 24 aa, Mycobacterium
ELGCGPGRLVARLVQRGIPALGID

SEQ ID NO: 653542 - protein, 25 aa, Mycobacterium
ELGCKEALFTLGDRPEDRWPEAREW

SEQ ID NO: 653543 - protein, 17 aa, Mycobacterium
ELGDAASSFSAVTSGLT

SEQ ID NO: 653544 - protein, 21 aa, Mycobacterium
ELGDLLLQVLFHARIAEDAAL

SEQ ID NO: 653545 - protein, 19 aa, Mycobacterium
ELGDRLRAAHAEMDGALIR

SEQ ID NO: 653546 - protein, 22 aa, Mycobacterium
ELGDSIGLLAQGSWTLRSLAAI

SEQ ID NO: 653547 - protein, 26 aa, Mycobacterium
ELGDSWRLSQILSLQTRAAMAAGDPI

SEQ ID NO: 653548 - protein, 17 aa, Mycobacterium
ELGEAIAERGWTLVWGG

SEQ ID NO: 653549 - protein, 22 aa, Mycobacterium
ELGELDAMLLLIALANSVRPAL

SEQ ID NO: 653550 - protein, 22 aa, Mycobacterium
ELGEPFTTVGLCQYRDGTDSVA

SEQ ID NO: 653551 - protein, 21 aa, Mycobacterium
ELGERALICAGWSDFSDVALA

SEQ ID NO: 653552 - protein, 21 aa, Mycobacterium
ELGERFLLMIDKIRYPAGGAS

SEQ ID NO: 653553 - protein, 19 aa, Mycobacterium
ELGERIAPVPVRLVDERFT

SEQ ID NO: 653554 - protein, 22 aa, Mycobacterium
ELGFAVEIWSWHDKDLAALAAT

SEQ ID NO: 653555 - protein, 22 aa, Mycobacterium
ELGFHKKIRCRVHRTSSDTTTD

SEQ ID NO: 653556 - protein, 27 aa, Mycobacterium
ELGFRSSIQKEWEWRVSRGESLKNLEA

SEQ ID NO: 653557 - protein, 27 aa, Mycobacterium
ELGFRSSIQKEWEWRVSRGESLKNLKA

SEQ ID NO: 653558 - protein, 26 aa, Mycobacterium
ELGFRTSIQKEWEWRVSRGESLKNLR

SEQ ID NO: 653559 - protein, 26 aa, Mycobacterium
ELGFRVRRLAGRVVWMRPPDAPLPAQ

SEQ ID NO: 653560 - protein, 18 aa, Mycobacterium
ELGGHVWADGGVRHPRDV

SEQ ID NO: 653561 - protein, 20 aa, Mycobacterium
ELGGRLAAVVASRLRITRSE

SEQ ID NO: 653562 - protein, 20 aa, Mycobacterium
ELGGRWALLLPRGVPAVGAA

SEQ ID NO: 653563 - protein, 22 aa, Mycobacterium
ELGHALSGHAVYRTMLLHLMRL

SEQ ID NO: 653564 - protein, 25 aa, Mycobacterium
ELGHFLYHWHDPRPSQRVVKIAPGE

SEQ ID NO: 653565 - protein, 17 aa, Mycobacterium
ELGHPMLWCTSGLSEFW

SEQ ID NO: 653566 - protein, 18 aa, Mycobacterium
ELGITKADIGFWCSGSSD

SEQ ID NO: 653567 - protein, 20 aa, Mycobacterium
ELGKPAALLRAARASLGRKV

SEQ ID NO: 653568 - protein, 26 aa, Mycobacterium
ELGLARLWQSWGFEPDVVLGHSVGQY

SEQ ID NO: 653569 - protein, 26 aa, Mycobacterium
ELGLARLWQSWGFEPDVVVGHSVGQY

SEQ ID NO: 653570 - protein, 22 aa, Mycobacterium
ELGLASRTAFLAAMTEGCVDVE

SEQ ID NO: 653571 - protein, 21 aa, Mycobacterium
ELGLPEGFDFTDPELYGNRMP

SEQ ID NO: 653572 - protein, 20 aa, Mycobacterium
ELGLPVVVRPSFTMGGLGSG

SEQ ID NO: 653573 - protein, 18 aa, Mycobacterium
ELGLPWTMTYTGRSRESI

SEQ ID NO: 653574 - protein, 18 aa, Mycobacterium
ELGLRVEFDTEVFDQGRI

SEQ ID NO: 653575 - protein, 18 aa, Mycobacterium
ELGLSRVPVQEAVVQLEH

SEQ ID NO: 653576 - protein, 18 aa, Mycobacterium
ELGLSYLLPRAIGSSRAF

SEQ ID NO: 653577 - protein, 17 aa, Mycobacterium
ELGMPLLEIPLRTPFAA

SEQ ID NO: 653578 - protein, 18 aa, Mycobacterium
ELGMSPTTFIRERRLERV

SEQ ID NO: 653579 - protein, 23 aa, Mycobacterium
ELGNRGKRSIAIDIKSEAGRELF

SEQ ID NO: 653580 - protein, 22 aa, Mycobacterium
ELGNRGKRSIAIDVKSETGREL

SEQ ID NO: 653581 - protein, 23 aa, Mycobacterium
ELGNRGKRSIGIDIKSATGRELF

SEQ ID NO: 653582 - protein, 20 aa, Mycobacterium
ELGPEAGDLVLTRWHGLGPM

SEQ ID NO: 653583 - protein, 18 aa, Mycobacterium
ELGPEGFAGWLRESKAVG

SEQ ID NO: 653584 - protein, 23 aa, Mycobacterium
ELGPEPSDLVLRRWHGVGPMGGT

SEQ ID NO: 653585 - protein, 24 aa, Mycobacterium
ELGPINWVIAKGMARAVNAPEMHL

SEQ ID NO: 653586 - protein, 17 aa, Mycobacterium
ELGQLFRLPIAALGNGS

SEQ ID NO: 653587 - protein, 21 aa, Mycobacterium
ELGQRFLLLVDHTRYPPDGVS

SEQ ID NO: 653588 - protein, 22 aa, Mycobacterium
ELGREVPESVPLPAPSGQTEFV

SEQ ID NO: 653589 - protein, 26 aa, Mycobacterium
ELGRFGELRLRLRVNGELRQDMRVAG

SEQ ID NO: 653590 - protein, 20 aa, Mycobacterium
ELGRISLRTQMPLLLDEYTR

SEQ ID NO: 653591 - protein, 22 aa, Mycobacterium
ELGRKLWVRDIETVFAALEHGR

SEQ ID NO: 653592 - protein, 26 aa, Mycobacterium
ELGRSGRLKGAGFYEYVDGKRTGLWP

SEQ ID NO: 653593 - protein, 18 aa, Mycobacterium
ELGRSGSLDILLAAYSLA

SEQ ID NO: 653594 - protein, 21 aa, Mycobacterium
ELGRTDWAVHVALWERTGSGG

SEQ ID NO: 653595 - protein, 22 aa, Mycobacterium
ELGRTLLPLVISLAQWAMAHHE

SEQ ID NO: 653596 - protein, 26 aa, Mycobacterium
ELGRVWSQCHSLAFDFSVWEIFGALL

SEQ ID NO: 653597 - protein, 18 aa, Mycobacterium
ELGSEFGGVVTAVGPGVT

SEQ ID NO: 653598 - protein, 25 aa, Mycobacterium
ELGSGLPVFHPKGGVVRRELEEYSR

SEQ ID NO: 653599 - protein, 25 aa, Mycobacterium
ELGSGLPVFHPRGGVVRRELEDYSR

SEQ ID NO: 653600 - protein, 20 aa, Mycobacterium
ELGTAASFYREVVAELTGGP

SEQ ID NO: 653601 - protein, 18 aa, Mycobacterium
ELGTFFLTGLFALLSTGA

SEQ ID NO: 653602 - protein, 17 aa, Mycobacterium
ELGTLGIDEFVNKQVYV

SEQ ID NO: 653603 - protein, 22 aa, Mycobacterium
ELGTYCGYGALRIARAAPAARV

SEQ ID NO: 653604 - protein, 24 aa, Mycobacterium
ELGTYCGYGALRIARAAPKAKVFS

SEQ ID NO: 653605 - protein, 22 aa, Mycobacterium
ELGTYCGYSALRIARAAPSARV

SEQ ID NO: 653606 - protein, 22 aa, Mycobacterium
ELGTYRFYLDFVGHIDDDAVAG

SEQ ID NO: 653607 - protein, 19 aa, Mycobacterium
ELGVAFAAPSPVTAEAVDV

SEQ ID NO: 653608 - protein, 20 aa, Mycobacterium
ELGVEAFELVVVNLYPFSQT

SEQ ID NO: 653609 - protein, 18 aa, Mycobacterium
ELGVKLILDTSGGGLQHI

SEQ ID NO: 653610 - protein, 17 aa, Mycobacterium
ELGVPCVVGARSATVAL

SEQ ID NO: 653611 - protein, 17 aa, Mycobacterium
ELGVQLVPEEDEFSFDF

SEQ ID NO: 653612 - protein, 21 aa, Mycobacterium
ELGVRLIQVGFMRRFDPEYAE

SEQ ID NO: 653613 - protein, 28 aa, Mycobacterium
ELGVSGARVGLAWILAHAPNTLLIPGTR

SEQ ID NO: 653614 - protein, 27 aa, Mycobacterium
ELHAAASCYRSVIAGLTTGRWLGPSSL

SEQ ID NO: 653615 - protein, 19 aa, Mycobacterium
ELHAVAAVVPLGKPVRQPT

SEQ ID NO: 653616 - protein, 27 aa, Mycobacterium
ELHAVYPLMSITWNRRIMLEVAVPESD

SEQ ID NO: 653617 - protein, 24 aa, Mycobacterium
ELHDACRRHGALMIVDEAHGLGVR

SEQ ID NO: 653618 - protein, 18 aa, Mycobacterium
ELHDCFYNARFLQMAKSY

SEQ ID NO: 653619 - protein, 19 aa, Mycobacterium
ELHDPILLCPCGSADVEVL

SEQ ID NO: 653620 - protein, 20 aa, Mycobacterium
ELHEACRRHRALLIVDEAHG

SEQ ID NO: 653621 - protein, 19 aa, Mycobacterium
ELHEAYGRLDAVAGADDRL

SEQ ID NO: 653622 - protein, 21 aa, Mycobacterium
ELHERLLRRGVPAVVLNAKND

SEQ ID NO: 653623 - protein, 22 aa, Mycobacterium
ELHEVCRRHRALLVVDEAHGLG

SEQ ID NO: 653624 - protein, 24 aa, Mycobacterium
ELHFGHLYLPSSFLSPLINRRRDE

SEQ ID NO: 653625 - protein, 19 aa, Mycobacterium
ELHFGRAAQRLHVAQPALS

SEQ ID NO: 653626 - protein, 19 aa, Mycobacterium
ELHFGRAARRLHISGPALS

SEQ ID NO: 653627 - protein, 23 aa, Mycobacterium
ELHGDPGAAMPVGSPLITVRGND

SEQ ID NO: 653628 - protein, 17 aa, Mycobacterium
ELHGRWLRDTGTTPPGG

SEQ ID NO: 653629 - protein, 18 aa, Mycobacterium
ELHLSLQHTPAFLNAELD

SEQ ID NO: 653630 - protein, 18 aa, Mycobacterium
ELHPAVIERLGLPKRTCA

SEQ ID NO: 653631 - protein, 20 aa, Mycobacterium
ELHPDLPVWVSRFGDGFDLR

SEQ ID NO: 653632 - protein, 18 aa, Mycobacterium
ELHQEFIEASGLTREDEA

SEQ ID NO: 653633 - protein, 20 aa, Mycobacterium
ELHRHGVFWGDCSLANTLFS

SEQ ID NO: 653634 - protein, 19 aa, Mycobacterium
ELHRLRFAPEAERSASRLE

SEQ ID NO: 653635 - protein, 19 aa, Mycobacterium
ELHSRYEVRLEQYALTIAV

SEQ ID NO: 653636 - protein, 18 aa, Mycobacterium
ELHVDPGLQGHGYGEALA

SEQ ID NO: 653637 - protein, 18 aa, Mycobacterium
ELIAAKWNLSRARLDEFS

SEQ ID NO: 653638 - protein, 20 aa, Mycobacterium
ELIADALAPYGIVCGTGNVR

SEQ ID NO: 653639 - protein, 24 aa, Mycobacterium
ELIADCTDIPPGVVNIVTSSEHGL

SEQ ID NO: 653640 - protein, 25 aa, Mycobacterium
ELIAELDAIFARRTLAEWTEVFAAH

SEQ ID NO: 653641 - protein, 19 aa, Mycobacterium
ELIAGGRSNLTFLVFDDAS

SEQ ID NO: 653642 - protein, 22 aa, Mycobacterium
ELIAGLGAYPAYYAHMGVINTE

SEQ ID NO: 653643 - protein, 20 aa, Mycobacterium
ELIAMPALNLDAAFVHMNLG

SEQ ID NO: 653644 - protein, 18 aa, Mycobacterium
ELIARIRAVLRRGADNDD

SEQ ID NO: 653645 - protein, 17 aa, Mycobacterium
ELIARIRAVLRRGGDDD

SEQ ID NO: 653646 - protein, 18 aa, Mycobacterium
ELIARIRAVLRRGGDDDA

SEQ ID NO: 653647 - protein, 23 aa, Mycobacterium
ELIARRGGPMVGRDAELAVFEQA

SEQ ID NO: 653648 - protein, 24 aa, Mycobacterium
ELIDPTPGLACHRVKATHSDPGPD

SEQ ID NO: 653649 - protein, 24 aa, Mycobacterium
ELIDRARMGIGRVITVLTDDPRKA

SEQ ID NO: 653650 - protein, 20 aa, Mycobacterium
ELIDSAAMDLANIGTALNSA

SEQ ID NO: 653651 - protein, 20 aa, Mycobacterium
ELIDYCRAHLAAYKCPRSVD

SEQ ID NO: 653652 - protein, 24 aa, Mycobacterium
ELIESRIKMGLSQNIATVTASTTE

SEQ ID NO: 653653 - protein, 20 aa, Mycobacterium
ELIGWLLDRGVAVDEIRGNP

SEQ ID NO: 653654 - protein, 17 aa, Mycobacterium
ELIGYTEVRPILLWHAL

SEQ ID NO: 653655 - protein, 18 aa, Mycobacterium
ELILAALEFWMDEHHYAG

SEQ ID NO: 653656 - protein, 19 aa, Mycobacterium
ELILPIAVAVQNRITVNEL

SEQ ID NO: 653657 - protein, 18 aa, Mycobacterium
ELINRGGEKISPERVEAV

SEQ ID NO: 653658 - protein, 18 aa, Mycobacterium
ELINRGGEKISPERVEGV

SEQ ID NO: 653659 - protein, 18 aa, Mycobacterium
ELINRGGEKISPERVEHV

SEQ ID NO: 653660 - protein, 19 aa, Mycobacterium
ELINWLLDRGFDVDQIRDA

SEQ ID NO: 653661 - protein, 18 aa, Mycobacterium
ELIQDAWLSRASKKRAES

SEQ ID NO: 653662 - protein, 19 aa, Mycobacterium
ELIQDAWLSRASKRRAAQW

SEQ ID NO: 653663 - protein, 19 aa, Mycobacterium
ELIRPRPAATAALAEAQGL

SEQ ID NO: 653664 - protein, 24 aa, Mycobacterium
ELIRRGVDGWVFFDCTDSPDDPDN

SEQ ID NO: 653665 - protein, 17 aa, Mycobacterium
ELIRRIHEELPFETVAT

SEQ ID NO: 653666 - protein, 21 aa, Mycobacterium
ELISAAATDLAGIGSTISAAN

SEQ ID NO: 653667 - protein, 18 aa, Mycobacterium
ELISGLDTHWLLKTVEPE

SEQ ID NO: 653668 - protein, 19 aa, Mycobacterium
ELISLDPKRSATIIGPQAF

SEQ ID NO: 653669 - protein, 28 aa, Mycobacterium
ELISRLSAILRCSVLLYNELGDVVASSG

SEQ ID NO: 653670 - protein, 22 aa, Mycobacterium
ELISRWAAYFPPAGAEAMFRWM

SEQ ID NO: 653671 - protein, 18 aa, Mycobacterium
ELISVARFVIARMDVNPA

SEQ ID NO: 653672 - protein, 30 aa, Mycobacterium
ELITWVSIPAARYGQGWGFVEYAHQHGDYG

SEQ ID NO: 653673 - protein, 26 aa, Mycobacterium
ELIVESAFTCFGRQGLDKATIVDIAK

SEQ ID NO: 653674 - protein, 18 aa, Mycobacterium
ELIYGPARSGPWKTVEDV

SEQ ID NO: 653675 - protein, 21 aa, Mycobacterium
ELKAAKVLQAIGFAPNVEGYG

SEQ ID NO: 653676 - protein, 30 aa, Mycobacterium
ELKAATTVRCEYCIDLGSQIARQWGITDEE

SEQ ID NO: 653677 - protein, 26 aa, Mycobacterium
ELKARADALGRAFIDQGITFSLSGQE

SEQ ID NO: 653678 - protein, 26 aa, Mycobacterium
ELKARAEALGRAFIDQGITFSLSGQE

SEQ ID NO: 653679 - protein, 31 aa, Mycobacterium
ELKDWRLRISKEMSVPAFVVFTDNTLIAIAE

SEQ ID NO: 653680 - protein, 22 aa, Mycobacterium
ELKEVALFLTHYLGFPLGSKLD

SEQ ID NO: 653681 - protein, 21 aa, Mycobacterium
ELKIARSRRLVRVEYRVTGGD

SEQ ID NO: 653682 - protein, 23 aa, Mycobacterium
ELKIKAKERGLWNLFLPAESGLT

SEQ ID NO: 653683 - protein, 22 aa, Mycobacterium
ELKLRGETVAVFVADYRMPQMS

SEQ ID NO: 653684 - protein, 30 aa, Mycobacterium
ELKNCWAEAILRFATGSARHANLFHADPHP

SEQ ID NO: 653685 - protein, 35 aa, Mycobacterium
ELKNTWAEALWRFSLAPLQHACAFYTDLHPGNYRF

SEQ ID NO: 653686 - protein, 23 aa, Mycobacterium
ELKPCDWDTAMQRIVDRSKQLLD

SEQ ID NO: 653687 - protein, 20 aa, Mycobacterium
ELKPRKAFGPIRVAATGTTV

SEQ ID NO: 653688 - protein, 21 aa, Mycobacterium
ELKPRKAFGPIRVAVTGAAVS

SEQ ID NO: 653689 - protein, 21 aa, Mycobacterium
ELKPRKAFGPVRVAVTGSSIS

SEQ ID NO: 653690 - protein, 17 aa, Mycobacterium
ELKQFMADVVWIEHVGA

SEQ ID NO: 653691 - protein, 21 aa, Mycobacterium
ELKRAESILQRRTDRLAFDRP

SEQ ID NO: 653692 - protein, 24 aa, Mycobacterium
ELKREALALFGGRRVTQAIGARLD

SEQ ID NO: 653693 - protein, 19 aa, Mycobacterium
ELKRQSLRVSRLHAKLFYQ

SEQ ID NO: 653694 - protein, 22 aa, Mycobacterium
ELKSFRDARNIPEGEVIMGYGY

SEQ ID NO: 653695 - protein, 26 aa, Mycobacterium
ELLAAERARLRFLLVDDAQQLDPQAA

SEQ ID NO: 653696 - protein, 19 aa, Mycobacterium
ELLAAGVPVAAHWIADRQI

SEQ ID NO: 653697 - protein, 20 aa, Mycobacterium
ELLAALAGVEHVVYAPPAGK

SEQ ID NO: 653698 - protein, 22 aa, Mycobacterium
ELLADVCDLYALSVIEEDKAWF

SEQ ID NO: 653699 - protein, 18 aa, Mycobacterium
ELLADWRTTRAALHDALL

SEQ ID NO: 653700 - protein, 19 aa, Mycobacterium
ELLADYTVVCIDEFELDDP

SEQ ID NO: 653701 - protein, 20 aa, Mycobacterium
ELLAEAFGGKGYHVTTPTEL

SEQ ID NO: 653702 - protein, 18 aa, Mycobacterium
ELLAGLAEMNIGAMVVMG

SEQ ID NO: 653703 - protein, 24 aa, Mycobacterium
ELLAHCYRMTGSLHDAEDLVQETY

SEQ ID NO: 653704 - protein, 23 aa, Mycobacterium
ELLAHCYRMTGSVHDAEDLVQET

SEQ ID NO: 653705 - protein, 20 aa, Mycobacterium
ELLAIVSAMVCDRIDKITVN

SEQ ID NO: 653706 - protein, 21 aa, Mycobacterium
ELLALCVQLMFAAHGTTVAQI

SEQ ID NO: 653707 - protein, 18 aa, Mycobacterium
ELLARFAPDSAARSDVQV

SEQ ID NO: 653708 - protein, 24 aa, Mycobacterium
ELLARGGRCIAEFEAETIGIRSRW

SEQ ID NO: 653709 - protein, 20 aa, Mycobacterium
ELLARRLALYQADQRMVFGA

SEQ ID NO: 653710 - protein, 19 aa, Mycobacterium
ELLASAAADLEGIGSALST

SEQ ID NO: 653711 - protein, 35 aa, Mycobacterium
ELLAVPRLGWVNLHFSLLPAWRGAAPVQASIAAGD

SEQ ID NO: 653712 - protein, 31 aa, Mycobacterium
ELLAYSAACTARLRLGVGVLVTSLHDPLQLA

SEQ ID NO: 653713 - protein, 28 aa, Mycobacterium
ELLDAASRCARRLIDLHMVDGRLRRASL

SEQ ID NO: 653714 - protein, 25 aa, Mycobacterium
ELLDHLRPSAAVYHRSLGAKFADVL

SEQ ID NO: 653715 - protein, 19 aa, Mycobacterium
ELLDPVRVPAHIEVRHQPA

SEQ ID NO: 653716 - protein, 17 aa, Mycobacterium
ELLDSWRNYQWHQLARA

SEQ ID NO: 653717 - protein, 21 aa, Mycobacterium
ELLDVPFRSAAAFIDTTLAGI

SEQ ID NO: 653718 - protein, 22 aa, Mycobacterium
ELLDVVTPLDWARQGMAAGTPF

SEQ ID NO: 653719 - protein, 18 aa, Mycobacterium
ELLDVVWSPISLPGNGVG

SEQ ID NO: 653720 - protein, 26 aa, Mycobacterium
ELLDYCAARMPYFCVPRFVETVDELP

SEQ ID NO: 653721 - protein, 17 aa, Mycobacterium
ELLEASQSFLAMDPPRH

SEQ ID NO: 653722 - protein, 18 aa, Mycobacterium
ELLEAVWSPVALPDNPDG

SEQ ID NO: 653723 - protein, 18 aa, Mycobacterium
ELLEDFEQFGYYLVHNPA

SEQ ID NO: 653724 - protein, 26 aa, Mycobacterium
ELLEELKGLWFYYAGVYKGLPLDDRT

SEQ ID NO: 653725 - protein, 17 aa, Mycobacterium
ELLEILSRQPLSAGKLS

SEQ ID NO: 653726 - protein, 24 aa, Mycobacterium
ELLEKDAWCNPHLSPQRSGDSRSE

SEQ ID NO: 653727 - protein, 23 aa, Mycobacterium
ELLERFRAMEPWLEGGRVHAPFW

SEQ ID NO: 653728 - protein, 17 aa, Mycobacterium
ELLERGARRVKFVHSAY

SEQ ID NO: 653729 - protein, 20 aa, Mycobacterium
ELLERLGYRDVSVLADGLDG

SEQ ID NO: 653730 - protein, 19 aa, Mycobacterium
ELLERRAADLVAYQDDHTA

SEQ ID NO: 653731 - protein, 20 aa, Mycobacterium
ELLERSGLVALRNVVDQQFA

SEQ ID NO: 653732 - protein, 22 aa, Mycobacterium
ELLEVMRLGARIIERNSGTAQV

SEQ ID NO: 653733 - protein, 24 aa, Mycobacterium
ELLEYHWGPDWMVWDAHKTAQQHG

SEQ ID NO: 653734 - protein, 19 aa, Mycobacterium
ELLEYLAARPDRPTRIREI

SEQ ID NO: 653735 - protein, 21 aa, Mycobacterium
ELLGLPWVELNPHPLYLPSRG

SEQ ID NO: 653736 - protein, 24 aa, Mycobacterium
ELLGLRYLPPFPYFQQDASPNAFT

SEQ ID NO: 653737 - protein, 18 aa, Mycobacterium
ELLGPTVLIAPEHKVVLT

SEQ ID NO: 653738 - protein, 22 aa, Mycobacterium
ELLGRPTAWLFGPESHGLPSEI

SEQ ID NO: 653739 - protein, 19 aa, Mycobacterium
ELLGVPWIELSPHPLYLPS

SEQ ID NO: 653740 - protein, 20 aa, Mycobacterium
ELLHAWRPALAAAERAKVVV

SEQ ID NO: 653741 - protein, 20 aa, Mycobacterium
ELLHGLQIAPRISWADAARI

SEQ ID NO: 653742 - protein, 24 aa, Mycobacterium
ELLHSTPRWCIWIPDDDLPADVAN

SEQ ID NO: 653743 - protein, 20 aa, Mycobacterium
ELLIRGPIVMRGYRHQPEKT

SEQ ID NO: 653744 - protein, 20 aa, Mycobacterium
ELLIRGPIVMRGYRKQPEKT

SEQ ID NO: 653745 - protein, 21 aa, Mycobacterium
ELLKACPQLTILATSREPLGV

SEQ ID NO: 653746 - protein, 20 aa, Mycobacterium
ELLKAMLSADRFVRPDSPLP

SEQ ID NO: 653747 - protein, 17 aa, Mycobacterium
ELLKRVDDPAVQQMFNI

SEQ ID NO: 653748 - protein, 21 aa, Mycobacterium
ELLKTLGAIEVIGRLPADPDA

SEQ ID NO: 653749 - protein, 26 aa, Mycobacterium
ELLLRLKAWRLDVAKEQKVPAYVVFT

SEQ ID NO: 653750 - protein, 25 aa, Mycobacterium
ELLLSRTTAGLSYEQCVGVTYQQLH

SEQ ID NO: 653751 - protein, 20 aa, Mycobacterium
ELLLTHIPPWTSREDVISEA

SEQ ID NO: 653752 - protein, 23 aa, Mycobacterium
ELLLVSRICIDEAIAVKRDGGRT

SEQ ID NO: 653753 - protein, 25 aa, Mycobacterium
ELLNRFPEWDIDYSTARLAPTSTVR

SEQ ID NO: 653754 - protein, 20 aa, Mycobacterium
ELLPDGRLHVIAGGPHGIPV

SEQ ID NO: 653755 - protein, 21 aa, Mycobacterium
ELLPEIAAARCTFAIGMSEPD

SEQ ID NO: 653756 - protein, 29 aa, Mycobacterium
ELLPERTPHVLACIYSVFTEGYWSTAGPS

SEQ ID NO: 653757 - protein, 29 aa, Mycobacterium
ELLPERTPHVLGCVYSVFTEGYWSTAGPS

SEQ ID NO: 653758 - protein, 26 aa, Mycobacterium
ELLPLAVEEMIRWVTPVKEFMRTAQQ

SEQ ID NO: 653759 - protein, 17 aa, Mycobacterium
ELLPMLSSMGFDTSRVG

SEQ ID NO: 653760 - protein, 19 aa, Mycobacterium
ELLPPGGVWAQCYSSAFDL

SEQ ID NO: 653761 - protein, 18 aa, Mycobacterium
ELLPPWDSAAVVFDALAG

SEQ ID NO: 653762 - protein, 26 aa, Mycobacterium
ELLPRADPGLPWPGRLPEPSPAVLLD

SEQ ID NO: 653763 - protein, 17 aa, Mycobacterium
ELLPRLESVECAGEPEL

SEQ ID NO: 653764 - protein, 19 aa, Mycobacterium
ELLPRPGNRVTLADETDPY

SEQ ID NO: 653765 - protein, 17 aa, Mycobacterium
ELLPRSAAAPPLQDGDV

SEQ ID NO: 653766 - protein, 17 aa, Mycobacterium
ELLPVMYSAEALALLAA

SEQ ID NO: 653767 - protein, 19 aa, Mycobacterium
ELLPVQWRTINSYGVRINH

SEQ ID NO: 653768 - protein, 25 aa, Mycobacterium
ELLPWTATAKTHWVRVLPTQITGRR

SEQ ID NO: 653769 - protein, 25 aa, Mycobacterium
ELLQAWRPALAAAERAKAVVIASNS

SEQ ID NO: 653770 - protein, 24 aa, Mycobacterium
ELLQRLHRAAGLVRVYDPDSPLRS

SEQ ID NO: 653771 - protein, 19 aa, Mycobacterium
ELLQRLSAADAMVVTVLAA

SEQ ID NO: 653772 - protein, 17 aa, Mycobacterium
ELLRALAVSDLDPFIDL

SEQ ID NO: 653773 - protein, 19 aa, Mycobacterium
ELLRDIFEVDVPVGVINSV

SEQ ID NO: 653774 - protein, 22 aa, Mycobacterium
ELLRESVDFFAPYLAAAKLTGE

SEQ ID NO: 653775 - protein, 17 aa, Mycobacterium
ELLRFMMRNSKRVLSKA

SEQ ID NO: 653776 - protein, 17 aa, Mycobacterium
ELLRGFLDWLFNRYREI

SEQ ID NO: 653777 - protein, 25 aa, Mycobacterium
ELLRKSGKAVLDWADVVAEESAEFD

SEQ ID NO: 653778 - protein, 25 aa, Mycobacterium
ELLRRFPKIELVGAVDRMRATMVPG

SEQ ID NO: 653779 - protein, 24 aa, Mycobacterium
ELLRRGGECLAEFDTDITGVEANW

SEQ ID NO: 653780 - protein, 20 aa, Mycobacterium
ELLRRGRDLAARKPITSQDV

SEQ ID NO: 653781 - protein, 22 aa, Mycobacterium
ELLRRKLAERGLARPTGAASVT

SEQ ID NO: 653782 - protein, 25 aa, Mycobacterium
ELLRRLARGRAHWPLGTLQLEALAA

SEQ ID NO: 653783 - protein, 23 aa, Mycobacterium
ELLRRLLTWQGWMDAPSSRRTKA

SEQ ID NO: 653784 - protein, 22 aa, Mycobacterium
ELLRRRLAGSGLREQDPAEPVA

SEQ ID NO: 653785 - protein, 22 aa, Mycobacterium
ELLRRTAAQLARNPFRALRVQT

SEQ ID NO: 653786 - protein, 20 aa, Mycobacterium
ELLRRTGVVGKFVDFYGPGV

SEQ ID NO: 653787 - protein, 22 aa, Mycobacterium
ELLRSFLDWLFARYREIVDGEA

SEQ ID NO: 653788 - protein, 17 aa, Mycobacterium
ELLRSGTLVDLYPLVRR

SEQ ID NO: 653789 - protein, 25 aa, Mycobacterium
ELLSAMPPFLTGGSMIENVAMDAST

SEQ ID NO: 653790 - protein, 20 aa, Mycobacterium
ELLSDWRLTRGRLHEALLNV

SEQ ID NO: 653791 - protein, 31 aa, Mycobacterium
ELLSIEAWGGATYDVALRFLKEDPWERLADL

SEQ ID NO: 653792 - protein, 17 aa, Mycobacterium
ELLSLALTHRSYAYEHG

SEQ ID NO: 653793 - protein, 24 aa, Mycobacterium
ELLSPFKVPTRWITVDSARIPTLP

SEQ ID NO: 653794 - protein, 23 aa, Mycobacterium
ELLSRASSKYALVIYAAKRARQI

SEQ ID NO: 653795 - protein, 25 aa, Mycobacterium
ELLSRFAGVRLVRPVEWTRSNRHTG

SEQ ID NO: 653796 - protein, 24 aa, Mycobacterium
ELLSRGGRCVVEFDAQTIGVCSRW

SEQ ID NO: 653797 - protein, 18 aa, Mycobacterium
ELLTAQLYFPGDPHNDDD

SEQ ID NO: 653798 - protein, 17 aa, Mycobacterium
ELLTAQLYFPGDPHNGD

SEQ ID NO: 653799 - protein, 23 aa, Mycobacterium
ELLTHCRSCLAGFKTPKQVFFVE

SEQ ID NO: 653800 - protein, 21 aa, Mycobacterium
ELLTSGLGWAVWSDGRIKFTT

SEQ ID NO: 653801 - protein, 21 aa, Mycobacterium
ELLTSILTYHVVPGQAAPDAV

SEQ ID NO: 653802 - protein, 22 aa, Mycobacterium
ELLVRGGVVFSGYWRNEQATDE

SEQ ID NO: 653803 - protein, 26 aa, Mycobacterium
ELLVSWLPQYHDFGLIFMALQALYLG

SEQ ID NO: 653804 - protein, 29 aa, Mycobacterium
ELLWEHWDRCAFHWFPGNHLLHVSQPDYL

SEQ ID NO: 653805 - protein, 20 aa, Mycobacterium
ELMAAAATDLAGIGSTIGAA

SEQ ID NO: 653806 - protein, 20 aa, Mycobacterium
ELMARAWEIADIVNSNAPLA

SEQ ID NO: 653807 - protein, 24 aa, Mycobacterium
ELMDEINERIGLRPTPLTWPVGIA

SEQ ID NO: 653808 - protein, 19 aa, Mycobacterium
ELMGRRMAFDMLASSGTAE

SEQ ID NO: 653809 - protein, 18 aa, Mycobacterium
ELMINLFWHGLRGAPEER

SEQ ID NO: 653810 - protein, 19 aa, Mycobacterium
ELMLARAWTKAAARDKAGA

SEQ ID NO: 653811 - protein, 18 aa, Mycobacterium
ELMLRKATWLYDNGKPCG

SEQ ID NO: 653812 - protein, 19 aa, Mycobacterium
ELMLRKATWLYDNGKPCGR

SEQ ID NO: 653813 - protein, 19 aa, Mycobacterium
ELMPAIGEISRHLVDVWRR

SEQ ID NO: 653814 - protein, 19 aa, Mycobacterium
ELMPFRLAVLHAAWLIDTA

SEQ ID NO: 653815 - protein, 18 aa, Mycobacterium
ELMRQAPMVLGEETYRHI

SEQ ID NO: 653816 - protein, 22 aa, Mycobacterium
ELMRRLTAPTGRSVSMTPEALE

SEQ ID NO: 653817 - protein, 19 aa, Mycobacterium
ELMRTGAKDELRFTAPPRL

SEQ ID NO: 653818 - protein, 19 aa, Mycobacterium
ELMSGAATDVASIGSLVAT

SEQ ID NO: 653819 - protein, 23 aa, Mycobacterium
ELMSMALRYEGWDISTAGDGATA

SEQ ID NO: 653820 - protein, 19 aa, Mycobacterium
ELNALQAIAALFAQLQARV

SEQ ID NO: 653821 - protein, 20 aa, Mycobacterium
ELNCIAVEFRTHFFNFASRA

SEQ ID NO: 653822 - protein, 23 aa, Mycobacterium
ELNEAGAPSAVWVVTPNGRFTIA

SEQ ID NO: 653823 - protein, 25 aa, Mycobacterium
ELNERPRKRFGWDSPAQVLNRLLSN

SEQ ID NO: 653824 - protein, 24 aa, Mycobacterium
ELNFGRAAQRLHIAQPVLSRQIRA

SEQ ID NO: 653825 - protein, 25 aa, Mycobacterium
ELNIAKLLGKRARVIGTTLRARPVT

SEQ ID NO: 653826 - protein, 25 aa, Mycobacterium
ELNIGKLLAKRARVIGTTLRGRPAT

SEQ ID NO: 653827 - protein, 26 aa, Mycobacterium
ELNLGLPELLGLNALGAPVNAAMAAG

SEQ ID NO: 653828 - protein, 21 aa, Mycobacterium
ELNLMTTKPFLYVFNADESVL

SEQ ID NO: 653829 - protein, 21 aa, Mycobacterium
ELNLMTTKPFLYVFNADETVL

SEQ ID NO: 653830 - protein, 28 aa, Mycobacterium
ELNLPRRDLRMLAARLGSDVPFALHGGT

SEQ ID NO: 653831 - protein, 24 aa, Mycobacterium
ELNPELYEALEWPRDIGEYEAYLK

SEQ ID NO: 653832 - protein, 20 aa, Mycobacterium
ELNRLWPAERAYAAAAKAFD

SEQ ID NO: 653833 - protein, 19 aa, Mycobacterium
ELNRTLLRHGLALPNLGDI

SEQ ID NO: 653834 - protein, 18 aa, Mycobacterium
ELNRWEQIKKFTILDREL

SEQ ID NO: 653835 - protein, 20 aa, Mycobacterium
ELNSALMFSGAGSGPLLDAA

SEQ ID NO: 653836 - protein, 24 aa, Mycobacterium
ELNSDELIYLAGFFTGLPDRPTGV

SEQ ID NO: 653837 - protein, 24 aa, Mycobacterium
ELNVLQLIQSLAWAPAQAATGAAA

SEQ ID NO: 653838 - protein, 19 aa, Mycobacterium
ELNVMGAMQLFAACQKAPT

SEQ ID NO: 653839 - protein, 29 aa, Mycobacterium
ELNVPRRDLRMLAARLGSDVPFALHGGTA

SEQ ID NO: 653840 - protein, 22 aa, Mycobacterium
ELNVPTFHGVVVRRDYATQHPE

SEQ ID NO: 653841 - protein, 20 aa, Mycobacterium
ELPAALAAAARSRRPDIDPA

SEQ ID NO: 653842 - protein, 21 aa, Mycobacterium
ELPADFGLPECPRWKVIDRND

SEQ ID NO: 653843 - protein, 19 aa, Mycobacterium
ELPADTPATIRSGIDDYLA

SEQ ID NO: 653844 - protein, 19 aa, Mycobacterium
ELPAIITRSHWAIQDPVPD

SEQ ID NO: 653845 - protein, 24 aa, Mycobacterium
ELPDDARLLLTIRPGDLLDDEPDA

SEQ ID NO: 653846 - protein, 22 aa, Mycobacterium
ELPDGIAVDPARQNIYWTNMGV

SEQ ID NO: 653847 - protein, 23 aa, Mycobacterium
ELPDRACWALQHLLTRRYISAEA

SEQ ID NO: 653848 - protein, 23 aa, Mycobacterium
ELPDRACWALQHLLTRRYISAES

SEQ ID NO: 653849 - protein, 18 aa, Mycobacterium
ELPDWPVFVKRYDNAVNR

SEQ ID NO: 653850 - protein, 17 aa, Mycobacterium
ELPEELVTLALTHRSYA

SEQ ID NO: 653851 - protein, 26 aa, Mycobacterium
ELPEGSMLVPFSWQRISLHAAGATAV

SEQ ID NO: 653852 - protein, 19 aa, Mycobacterium
ELPEQLAREAHDWTLSPQR

SEQ ID NO: 653853 - protein, 26 aa, Mycobacterium
ELPERLAEELVRIIGVLRGMQLKKLP

SEQ ID NO: 653854 - protein, 20 aa, Mycobacterium
ELPERLLPRVIPRLWRDWGP

SEQ ID NO: 653855 - protein, 24 aa, Mycobacterium
ELPETEFPSLSGLAMDYAIHLDDE

SEQ ID NO: 653856 - protein, 19 aa, Mycobacterium
ELPEVARVVVIDGKGDGSW

SEQ ID NO: 653857 - protein, 21 aa, Mycobacterium
ELPGDLAGALAHFENSTWLPD

SEQ ID NO: 653858 - protein, 19 aa, Mycobacterium
ELPGKWGEYLLASRATTIY

SEQ ID NO: 653859 - protein, 20 aa, Mycobacterium
ELPGNGFVLAVQWHPEKSLD

SEQ ID NO: 653860 - protein, 24 aa, Mycobacterium
ELPGPRLPHDMAFTENYVILNDFP

SEQ ID NO: 653861 - protein, 25 aa, Mycobacterium
ELPGYPFERQRYWIAPSDGIQPIAS

SEQ ID NO: 653862 - protein, 21 aa, Mycobacterium
ELPKSDLVAAMLGRQLDVLDE

SEQ ID NO: 653863 - protein, 21 aa, Mycobacterium
ELPLMEARALLDLGDVAKANS

SEQ ID NO: 653864 - protein, 22 aa, Mycobacterium
ELPLMEVRALLDLGDVAKATRK

SEQ ID NO: 653865 - protein, 19 aa, Mycobacterium
ELPLMFEPYDRKSLRTRAT

SEQ ID NO: 653866 - protein, 25 aa, Mycobacterium
ELPLPYAGNAWVVWDRGGASEATGE

SEQ ID NO: 653867 - protein, 17 aa, Mycobacterium
ELPMCVPQLPAQERGDA

SEQ ID NO: 653868 - protein, 20 aa, Mycobacterium
ELPMKTIGMLAGIPDSEQPA

SEQ ID NO: 653869 - protein, 30 aa, Mycobacterium
ELPNAPAMRDWVACLVCPLTEHLEALGNPT

SEQ ID NO: 653870 - protein, 21 aa, Mycobacterium
ELPNGAGCAVRIAAADGGTLR

SEQ ID NO: 653871 - protein, 19 aa, Mycobacterium
ELPPALGGDAVRPDSRARR

SEQ ID NO: 653872 - protein, 28 aa, Mycobacterium
ELPPELPATALAWREGFLDGQHLRVIQA

SEQ ID NO: 653873 - protein, 21 aa, Mycobacterium
ELPPFKTSYAVPRLVSVNRTG

SEQ ID NO: 653874 - protein, 22 aa, Mycobacterium
ELPPGEVGAVYFERDVAPFEYH

SEQ ID NO: 653875 - protein, 18 aa, Mycobacterium
ELPPGLADFDLSKLNFPG

SEQ ID NO: 653876 - protein, 25 aa, Mycobacterium
ELPPKRRYELFRAFDDDRLADVLAE

SEQ ID NO: 653877 - protein, 20 aa, Mycobacterium
ELPPRAGQPSAWPQWAEPDV

SEQ ID NO: 653878 - protein, 24 aa, Mycobacterium
ELPPRAVFVAVDFPPPSTHNGPRT

SEQ ID NO: 653879 - protein, 19 aa, Mycobacterium
ELPPRCVVDGEIVIATEAG

SEQ ID NO: 653880 - protein, 22 aa, Mycobacterium
ELPPRDRLLAIFDAVPVARFRG

SEQ ID NO: 653881 - protein, 32 aa, Mycobacterium
ELPPRPGRPTGWPEWAAANVVRAFVERGITVP

SEQ ID NO: 653882 - protein, 28 aa, Mycobacterium
ELPQDFALPECPRWKVVDRTDLADLAAR

SEQ ID NO: 653883 - protein, 21 aa, Mycobacterium
ELPRAEIHPELSVHDRTIEGP

SEQ ID NO: 653884 - protein, 24 aa, Mycobacterium
ELPRGCIAAGDRAFFCDYVQEYLS

SEQ ID NO: 653885 - protein, 21 aa, Mycobacterium
ELPRRTRISIPQRKPLLPDRA

SEQ ID NO: 653886 - protein, 18 aa, Mycobacterium
ELPRWRPGAHLDVTLPSG

SEQ ID NO: 653887 - protein, 28 aa, Mycobacterium
ELPRYPWQRQRLRDELPEFVQMKYGTHD

SEQ ID NO: 653888 - protein, 36 aa, Mycobacterium
ELPSDITFRRWCAALSTRWCNMRVQLDGAAGGRIET

SEQ ID NO: 653889 - protein, 26 aa, Mycobacterium
ELPTPWPREVLDDLLVVLLAGPTAVG

SEQ ID NO: 653890 - protein, 24 aa, Mycobacterium
ELPTRAELLAALSVAIDLGLGQPA

SEQ ID NO: 653891 - protein, 24 aa, Mycobacterium
ELPTYGFVHRRFWLDQPDDSRTAA

SEQ ID NO: 653892 - protein, 31 aa, Mycobacterium
ELPTYPFQRRRFWPKASSIAVDGGTAASGIL

SEQ ID NO: 653893 - protein, 29 aa, Mycobacterium
ELPTYPFQRRRFWPKSSGTAIEGGGGLPS

SEQ ID NO: 653894 - protein, 28 aa, Mycobacterium
ELPTYPFQRRRFWPKTSGIAVDGGAGSS

SEQ ID NO: 653895 - protein, 24 aa, Mycobacterium
ELPVAYAVVGPSFWGDGQYPPSDA

SEQ ID NO: 653896 - protein, 21 aa, Mycobacterium
ELPVIPRQRVLVISTGSELVT

SEQ ID NO: 653897 - protein, 23 aa, Mycobacterium
ELPWLRLGRIQQEWGVSDEVMRD

SEQ ID NO: 653898 - protein, 20 aa, Mycobacterium
ELQALTFISGEQWLTHPGSV

SEQ ID NO: 653899 - protein, 19 aa, Mycobacterium
ELQALTFISGTQWLTHPGS

SEQ ID NO: 653900 - protein, 20 aa, Mycobacterium
ELQCYPGDLNQVWTNIIDNA

SEQ ID NO: 653901 - protein, 19 aa, Mycobacterium
ELQDRGAIFVDELDEIPDP

SEQ ID NO: 653902 - protein, 20 aa, Mycobacterium
ELQESVWSYFVEPVEGGSTL

SEQ ID NO: 653903 - protein, 24 aa, Mycobacterium
ELQETAEGWILARLDTRRPARFFG

SEQ ID NO: 653904 - protein, 22 aa, Mycobacterium
ELQFGSNHLGHFALTGHLLPLL

SEQ ID NO: 653905 - protein, 20 aa, Mycobacterium
ELQFGTNHLGHFALTGLLFD

SEQ ID NO: 653906 - protein, 23 aa, Mycobacterium
ELQFGTNHLGHFALTGLLLDRML

SEQ ID NO: 653907 - protein, 20 aa, Mycobacterium
ELQFGTNHLGHFALTGLLLE

SEQ ID NO: 653908 - protein, 23 aa, Mycobacterium
ELQFGTNHLGHFALTGLLLERLL

SEQ ID NO: 653909 - protein, 18 aa, Mycobacterium
ELQIVFQTLLRRVPTMEL

SEQ ID NO: 653910 - protein, 26 aa, Mycobacterium
ELQIVYRTLFRRVPTLELAIPVEDVP

SEQ ID NO: 653911 - protein, 26 aa, Mycobacterium
ELQIVYRTLLRRIPTLALAIPVEDVP

SEQ ID NO: 653912 - protein, 18 aa, Mycobacterium
ELQKRVIAVLGQYLDATR

SEQ ID NO: 653913 - protein, 29 aa, Mycobacterium
ELQLPVLRAQLRWMEAVLATWRGDFDEAQ

SEQ ID NO: 653914 - protein, 25 aa, Mycobacterium
ELQLPVLRAQLRWMEAVLAVWHGDF

SEQ ID NO: 653915 - protein, 24 aa, Mycobacterium
ELQLRTGAVYAELAAAGWGGPWLV

SEQ ID NO: 653916 - protein, 22 aa, Mycobacterium
ELQPAGPVRCCVGGASCLDYDM

SEQ ID NO: 653917 - protein, 17 aa, Mycobacterium
ELQQLWWQEAERNRVLP

SEQ ID NO: 653918 - protein, 17 aa, Mycobacterium
ELQRHGVVHRESYHEVP

SEQ ID NO: 653919 - protein, 25 aa, Mycobacterium
ELQRLGRPVFGPSFEVDIDSDLCIR

SEQ ID NO: 653920 - protein, 23 aa, Mycobacterium
ELQRLGRPVFGPTFEVDIDSDLC

SEQ ID NO: 653921 - protein, 17 aa, Mycobacterium
ELQRLRLATQLRAGLFG

SEQ ID NO: 653922 - protein, 22 aa, Mycobacterium
ELQRRTGVVYAQLAAADWNGRW

SEQ ID NO: 653923 - protein, 23 aa, Mycobacterium
ELQSVPGWSWGPVRPGTWRHAFD

SEQ ID NO: 653924 - protein, 21 aa, Mycobacterium
ELQTAFAVSPWAARTPIDVEV

SEQ ID NO: 653925 - protein, 23 aa, Mycobacterium
ELQTRPPVVTVMGHVDHGKTRLL

SEQ ID NO: 653926 - protein, 21 aa, Mycobacterium
ELQYWQRFYSWAAGDTLSPTI

SEQ ID NO: 653927 - protein, 20 aa, Mycobacterium
ELRAAGSGVDFVSHCAKELP

SEQ ID NO: 653928 - protein, 20 aa, Mycobacterium
ELRAERPVSWHPPVEDALIQ

SEQ ID NO: 653929 - protein, 26 aa, Mycobacterium
ELRAFCARLLGIAAQRVRVIARDTGG

SEQ ID NO: 653930 - protein, 25 aa, Mycobacterium
ELRAFCTSHGYLFPGQVDGHISAEW

SEQ ID NO: 653931 - protein, 20 aa, Mycobacterium
ELRAHIAPLQQLWTSEAAAA

SEQ ID NO: 653932 - protein, 25 aa, Mycobacterium
ELRAPESVQINWVYRGGRADLVSAD

SEQ ID NO: 653933 - protein, 25 aa, Mycobacterium
ELRAQFAAGLSRMYGAEVPAYHTLV

SEQ ID NO: 653934 - protein, 25 aa, Mycobacterium
ELRARFAGALSQMYGTEVPAYNTLV

SEQ ID NO: 653935 - protein, 26 aa, Mycobacterium
ELRARLADRLPAYMVPVAVVTLDALP

SEQ ID NO: 653936 - protein, 22 aa, Mycobacterium
ELRARLDGFDLLVVDVDDPAVA

SEQ ID NO: 653937 - protein, 23 aa, Mycobacterium
ELRARLDGLTIRDAARLGRRLKN

SEQ ID NO: 653938 - protein, 19 aa, Mycobacterium
ELRASWTATTLELGPHVQA

SEQ ID NO: 653939 - protein, 23 aa, Mycobacterium
ELRAWKAEHPGAVVVSYVNTTAA

SEQ ID NO: 653940 - protein, 27 aa, Mycobacterium
ELRAYRSGGSLHLDWWYDTRRIPAATV

SEQ ID NO: 653941 - protein, 20 aa, Mycobacterium
ELRDAIVAFGERKPTVAWAE

SEQ ID NO: 653942 - protein, 20 aa, Mycobacterium
ELRDRIPWRAERRQMYDRVL

SEQ ID NO: 653943 - protein, 25 aa, Mycobacterium
ELRDRLPNVSLWNFYGQTEIAPLAS

SEQ ID NO: 653944 - protein, 17 aa, Mycobacterium
ELREAFVERGIQHGPAF

SEQ ID NO: 653945 - protein, 19 aa, Mycobacterium
ELREAPILDEELLRRAKHY

SEQ ID NO: 653946 - protein, 17 aa, Mycobacterium
ELREARRRIKLLEQENE

SEQ ID NO: 653947 - protein, 33 aa, Mycobacterium
ELREFLADKVVRWWLPERWAFVDQVPRTSVGKY

SEQ ID NO: 653948 - protein, 23 aa, Mycobacterium
ELRELRSAGAVFGILDIDDEFFV

SEQ ID NO: 653949 - protein, 25 aa, Mycobacterium
ELRELRSAGAVFGLLDVDDEFFVIV

SEQ ID NO: 653950 - protein, 19 aa, Mycobacterium
ELRELVPVMTRVLGAEQAD

SEQ ID NO: 653951 - protein, 23 aa, Mycobacterium
ELRERVGAVAMGRVLTLIIAPDS

SEQ ID NO: 653952 - protein, 45 aa, Mycobacterium
ELREWKRLLDRSAWAKRNPRRWSVIDAWAGLGMRLGSRTYGDYLA

SEQ ID NO: 653953 - protein, 19 aa, Mycobacterium
ELRGFLKRWLGGAVLAQGR

SEQ ID NO: 653954 - protein, 18 aa, Mycobacterium
ELRGKRVLLTGASSGIGE

SEQ ID NO: 653955 - protein, 25 aa, Mycobacterium
ELRGRGRGGVRLAVAMTVAAGHPGS

SEQ ID NO: 653956 - protein, 18 aa, Mycobacterium
ELRGRRAALRGMVSRQIP

SEQ ID NO: 653957 - protein, 22 aa, Mycobacterium
ELRGRWIRMLTHCRRARLLAYR

SEQ ID NO: 653958 - protein, 23 aa, Mycobacterium
ELRHACGLGTGGLFVDDVAEPRV

SEQ ID NO: 653959 - protein, 19 aa, Mycobacterium
ELRHQYGNQRLMGMSLDAG

SEQ ID NO: 653960 - protein, 20 aa, Mycobacterium
ELRIDAVCTVGRKAAALQWH

SEQ ID NO: 653961 - protein, 21 aa, Mycobacterium
ELRIGLASADDIRNWSFGEVK

SEQ ID NO: 653962 - protein, 21 aa, Mycobacterium
ELRIGLATADDIRNWSFGEVK

SEQ ID NO: 653963 - protein, 21 aa, Mycobacterium
ELRIGLATADDIRNWSYGEVK

SEQ ID NO: 653964 - protein, 20 aa, Mycobacterium
ELRIGLATAEDIRQWSYGEV

SEQ ID NO: 653965 - protein, 19 aa, Mycobacterium
ELRIIALDHRGHGKSDAAP

SEQ ID NO: 653966 - protein, 23 aa, Mycobacterium
ELRKKRFPFSLDANAMRATTLTE

SEQ ID NO: 653967 - protein, 25 aa, Mycobacterium
ELRKLRYLLNFARLADFEPGAAGPG

SEQ ID NO: 653968 - protein, 23 aa, Mycobacterium
ELRKRLTGLLGAFRAFSYGSLYP

SEQ ID NO: 653969 - protein, 24 aa, Mycobacterium
ELRLHPVPTHSVAALTGFDSLDRL

SEQ ID NO: 653970 - protein, 19 aa, Mycobacterium
ELRMLAAHAPPYNRRSRFP

SEQ ID NO: 653971 - protein, 25 aa, Mycobacterium
ELRMRAEILDGMFTGRVNPMQAAMG

SEQ ID NO: 653972 - protein, 23 aa, Mycobacterium
ELRMSGYNMAAVLAGLPDDLITP

SEQ ID NO: 653973 - protein, 27 aa, Mycobacterium
ELRNGWPNRCLPILIANQSGWELRNQS

SEQ ID NO: 653974 - protein, 18 aa, Mycobacterium
ELRNRLKNATGLTLPPTV

SEQ ID NO: 653975 - protein, 20 aa, Mycobacterium
ELRPLPAHRWLGVRCPDDPC

SEQ ID NO: 653976 - protein, 28 aa, Mycobacterium
ELRQCGLDMLRWLLRVETSNGHLSPTPV

SEQ ID NO: 653977 - protein, 27 aa, Mycobacterium
ELRQRIAALALDLLGPDGLLAHRSEQA

SEQ ID NO: 653978 - protein, 24 aa, Mycobacterium
ELRRAPRLGYSIDFEQAKVGLPLL

SEQ ID NO: 653979 - protein, 19 aa, Mycobacterium
ELRRCAPIWWNEQPDGIGG

SEQ ID NO: 653980 - protein, 22 aa, Mycobacterium
ELRRELRAYFSKLMTPERVEAL

SEQ ID NO: 653981 - protein, 18 aa, Mycobacterium
ELRRICGGPPVAAATTEQ

SEQ ID NO: 653982 - protein, 26 aa, Mycobacterium
ELRRIIPPWVTLGSRLAVLPTPKRNY

SEQ ID NO: 653983 - protein, 21 aa, Mycobacterium
ELRRLIPPWVTLGSRLAAMPK

SEQ ID NO: 653984 - protein, 17 aa, Mycobacterium
ELRRLWRGEPPFEGADP

SEQ ID NO: 653985 - protein, 17 aa, Mycobacterium
ELRRMTIPTFARTEKDF

SEQ ID NO: 653986 - protein, 24 aa, Mycobacterium
ELRRNRPLFRHDLTPGVAKTVQRQ

SEQ ID NO: 653987 - protein, 40 aa, Mycobacterium
ELRRPGERLGVPMSTIALAWLLRRSPVIVPIPGTKSVAHL

SEQ ID NO: 653988 - protein, 23 aa, Mycobacterium
ELRRVSRHRIVIFTWDQAVIDDF

SEQ ID NO: 653989 - protein, 19 aa, Mycobacterium
ELRSFYRIRQSWAGKAVLL

SEQ ID NO: 653990 - protein, 19 aa, Mycobacterium
ELRSLFLFEKLTDDQLQDL

SEQ ID NO: 653991 - protein, 21 aa, Mycobacterium
ELRSMASWLGLGGFSVSGRGD

SEQ ID NO: 653992 - protein, 19 aa, Mycobacterium
ELRSRVGLSSAALSQRIPD

SEQ ID NO: 653993 - protein, 22 aa, Mycobacterium
ELRSVFRPIFARIAEGNVGRER

SEQ ID NO: 653994 - protein, 19 aa, Mycobacterium
ELRTFYRIRQSWAGKAVLL

SEQ ID NO: 653995 - protein, 21 aa, Mycobacterium
ELRTLFLFEHLTDAQLDTLCE

SEQ ID NO: 653996 - protein, 17 aa, Mycobacterium
ELRTLTWINPPGAPAPV

SEQ ID NO: 653997 - protein, 22 aa, Mycobacterium
ELRVAGLLPRVIAESQRRQRAW

SEQ ID NO: 653998 - protein, 18 aa, Mycobacterium
ELRVPLRETFAGNAKGHG

SEQ ID NO: 653999 - protein, 18 aa, Mycobacterium
ELRVPLRETFSGKAKGHG

SEQ ID NO: 654000 - protein, 23 aa, Mycobacterium
ELRVSMGDVMLGRILPALVVDLS

SEQ ID NO: 654001 - protein, 18 aa, Mycobacterium
ELRVWPGQVHDFQVAGPL

SEQ ID NO: 654002 - protein, 24 aa, Mycobacterium
ELSAAIATAAPWLRDGDVVVVTSK

SEQ ID NO: 654003 - protein, 19 aa, Mycobacterium
ELSAARVLAGRGLINAFGG

SEQ ID NO: 654004 - protein, 18 aa, Mycobacterium
ELSALAWTVYSLPGAPAV

SEQ ID NO: 654005 - protein, 18 aa, Mycobacterium
ELSALRILHNAGRLAPQE

SEQ ID NO: 654006 - protein, 28 aa, Mycobacterium
ELSARLRRTLPLMARLTLAKVPGRVALR

SEQ ID NO: 654007 - protein, 18 aa, Mycobacterium
ELSARWQARHDHHQLQVD

SEQ ID NO: 654008 - protein, 21 aa, Mycobacterium
ELSASPGFRRAGLPAVPGALA

SEQ ID NO: 654009 - protein, 19 aa, Mycobacterium
ELSCTIAPRDGRSSYAVLR

SEQ ID NO: 654010 - protein, 20 aa, Mycobacterium
ELSDALWRLDEDSLPLTAAT

SEQ ID NO: 654011 - protein, 24 aa, Mycobacterium
ELSDGRWVTGFGCDHAAPAHGRDI

SEQ ID NO: 654012 - protein, 25 aa, Mycobacterium
ELSDLELYLFFSLLFSAGAETTRNA

SEQ ID NO: 654013 - protein, 24 aa, Mycobacterium
ELSEFAEGLGFAGVMAGPLVRSSY

SEQ ID NO: 654014 - protein, 17 aa, Mycobacterium
ELSEICGHIASLPLDRR

SEQ ID NO: 654015 - protein, 23 aa, Mycobacterium
ELSELRRSGAHAPVLETVSRAAG

SEQ ID NO: 654016 - protein, 25 aa, Mycobacterium
ELSGFFRAADGWVRLHANYPHHARV

SEQ ID NO: 654017 - protein, 20 aa, Mycobacterium
ELSGSIGWAEFIAADGTLDF

SEQ ID NO: 654018 - protein, 19 aa, Mycobacterium
ELSGTVARMVPMRRAGHVD

SEQ ID NO: 654019 - protein, 22 aa, Mycobacterium
ELSIAPPLFVSRSIRAQRSARP

SEQ ID NO: 654020 - protein, 26 aa, Mycobacterium
ELSIDFRPSGPLERDRYASLVMDAYA

SEQ ID NO: 654021 - protein, 26 aa, Mycobacterium
ELSKLRLLPFRLSFDGGDAEDHALTM

SEQ ID NO: 654022 - protein, 17 aa, Mycobacterium
ELSLLRAAGAAGFTAIA

SEQ ID NO: 654023 - protein, 23 aa, Mycobacterium
ELSLPRRDLRLLAERLGSDVPFA

SEQ ID NO: 654024 - protein, 26 aa, Mycobacterium
ELSMPVGMLVDDRWVWLPTVLDGRVF

SEQ ID NO: 654025 - protein, 20 aa, Mycobacterium
ELSNDLLVGAGLFERAASEV

SEQ ID NO: 654026 - protein, 22 aa, Mycobacterium
ELSPPFRGGPALKDGDTIGLDH

SEQ ID NO: 654027 - protein, 19 aa, Mycobacterium
ELSPRYFAFWNKWDPGAIS

SEQ ID NO: 654028 - protein, 26 aa, Mycobacterium
ELSQLRLLPFRLVLDGTREIDADITL

SEQ ID NO: 654029 - protein, 26 aa, Mycobacterium
ELSQLRLLPFRLVLDGTTEIDADITL

SEQ ID NO: 654030 - protein, 21 aa, Mycobacterium
ELSQRALAVGKRVHSETGIDR

SEQ ID NO: 654031 - protein, 24 aa, Mycobacterium
ELSRAGTVSGLYVCEMVTARALVE

SEQ ID NO: 654032 - protein, 17 aa, Mycobacterium
ELSRCALENSWAPDAPL

SEQ ID NO: 654033 - protein, 28 aa, Mycobacterium
ELSRRTECWLVLDIPNLYATAVASGTDP

SEQ ID NO: 654034 - protein, 24 aa, Mycobacterium
ELSRTVFSKGIFPAVDPLASSSTI

SEQ ID NO: 654035 - protein, 21 aa, Mycobacterium
ELSRVPLWVEETLRYDTSSQI

SEQ ID NO: 654036 - protein, 19 aa, Mycobacterium
ELSTGMLLRPVQPPPSDGW

SEQ ID NO: 654037 - protein, 25 aa, Mycobacterium
ELSTGWSRFSVDLIPSLGRAIFSRG

SEQ ID NO: 654038 - protein, 27 aa, Mycobacterium
ELSVARIDSWDGFYCFAAEITSPMAEI

SEQ ID NO: 654039 - protein, 21 aa, Mycobacterium
ELTAACGAALMADDPAVKPIR

SEQ ID NO: 654040 - protein, 26 aa, Mycobacterium
ELTAARAARLKWWTTDLQVRTADRCL

SEQ ID NO: 654041 - protein, 27 aa, Mycobacterium
ELTAARAARLKWWTTELQVRTADRCLQ

SEQ ID NO: 654042 - protein, 19 aa, Mycobacterium
ELTADRQAAVIVATNAAAE

SEQ ID NO: 654043 - protein, 21 aa, Mycobacterium
ELTALLAKVGATFDIAHLSGL

SEQ ID NO: 654044 - protein, 25 aa, Mycobacterium
ELTARLNSLGEAWTGGGSEKALAAA

SEQ ID NO: 654045 - protein, 18 aa, Mycobacterium
ELTARMLATLLDFPFEQR

SEQ ID NO: 654046 - protein, 19 aa, Mycobacterium
ELTARMLATLLDFPYEQRR

SEQ ID NO: 654047 - protein, 18 aa, Mycobacterium
ELTDAAWIGPAAASMMAA

SEQ ID NO: 654048 - protein, 28 aa, Mycobacterium
ELTDLFCAPDRCPLIVGNTLVFRDDNHV

SEQ ID NO: 654049 - protein, 26 aa, Mycobacterium
ELTDRGWRLCRELIDAGPPPRSTGPA

SEQ ID NO: 654050 - protein, 25 aa, Mycobacterium
ELTEAIKLVALVADRGAQVRMEFAE

SEQ ID NO: 654051 - protein, 19 aa, Mycobacterium
ELTELALGVGRQYVAQSRV

SEQ ID NO: 654052 - protein, 20 aa, Mycobacterium
ELTELGRLTVRHLPPAATRT

SEQ ID NO: 654053 - protein, 36 aa, Mycobacterium
ELTELRLHLAALLVERGRYAEALAHCSTVLAQDAGN

SEQ ID NO: 654054 - protein, 24 aa, Mycobacterium
ELTERPDLFPAWDSLSDTQKKLYA

SEQ ID NO: 654055 - protein, 24 aa, Mycobacterium
ELTERPDLFPAWDSLSEAQQKLFA

SEQ ID NO: 654056 - protein, 20 aa, Mycobacterium
ELTESILVRPVDWVQEITRV

SEQ ID NO: 654057 - protein, 20 aa, Mycobacterium
ELTESILVRQVDWVDEITEL

SEQ ID NO: 654058 - protein, 23 aa, Mycobacterium
ELTFRQALRLGHNYIGTEHILLA

SEQ ID NO: 654059 - protein, 18 aa, Mycobacterium
ELTGAKILQFFGSNETGM

SEQ ID NO: 654060 - protein, 24 aa, Mycobacterium
ELTGGRRPLVWLGAPAPGGLALPP

SEQ ID NO: 654061 - protein, 18 aa, Mycobacterium
ELTGLALQRIYLDRVAEL

SEQ ID NO: 654062 - protein, 18 aa, Mycobacterium
ELTGLALQRIYLERVAKL

SEQ ID NO: 654063 - protein, 19 aa, Mycobacterium
ELTGLPVLVLDPMLATGGS

SEQ ID NO: 654064 - protein, 19 aa, Mycobacterium
ELTGRPFAASAPRIGAPRW

SEQ ID NO: 654065 - protein, 17 aa, Mycobacterium
ELTHVCFEHPGLLTTPA

SEQ ID NO: 654066 - protein, 17 aa, Mycobacterium
ELTIGRHDGGLVSNHLY

SEQ ID NO: 654067 - protein, 24 aa, Mycobacterium
ELTKRGVHDFVILEKWGAAGGTWH

SEQ ID NO: 654068 - protein, 27 aa, Mycobacterium
ELTKYAANCFLALKLSYANAMAELAEF

SEQ ID NO: 654069 - protein, 18 aa, Mycobacterium
ELTLEIAEQLFATPQEGR

SEQ ID NO: 654070 - protein, 23 aa, Mycobacterium
ELTLELAEKLFATPQEGRSLGID

SEQ ID NO: 654071 - protein, 18 aa, Mycobacterium
ELTLRNSVVYDRFAETAV

SEQ ID NO: 654072 - protein, 18 aa, Mycobacterium
ELTMGHTVIMGRQTWESL

SEQ ID NO: 654073 - protein, 19 aa, Mycobacterium
ELTPDEWLADVFREEMRRI

SEQ ID NO: 654074 - protein, 23 aa, Mycobacterium
ELTPELAEKLFATPQEGRSLGID

SEQ ID NO: 654075 - protein, 20 aa, Mycobacterium
ELTPSKGAWCGNDVWREVLP

SEQ ID NO: 654076 - protein, 21 aa, Mycobacterium
ELTPYRGAWCGNDVWREALPA

SEQ ID NO: 654077 - protein, 22 aa, Mycobacterium
ELTQVNPIWREVLLGVLGDLAV

SEQ ID NO: 654078 - protein, 25 aa, Mycobacterium
ELTRLGLPVPPGFVIADASGTSLGD

SEQ ID NO: 654079 - protein, 23 aa, Mycobacterium
ELTRLSPELLKAGIDTAHERGLR

SEQ ID NO: 654080 - protein, 24 aa, Mycobacterium
ELTRTIGVTSFVWLHRGLFRDALP

SEQ ID NO: 654081 - protein, 21 aa, Mycobacterium
ELTSSQWLGPASMAMVATIVP

SEQ ID NO: 654082 - protein, 18 aa, Mycobacterium
ELTTLGAWVACIADARSV

SEQ ID NO: 654083 - protein, 18 aa, Mycobacterium
ELTTRATVLQNAWETQLG

SEQ ID NO: 654084 - protein, 19 aa, Mycobacterium
ELTVAMDWYTRCITALRLT

SEQ ID NO: 654085 - protein, 19 aa, Mycobacterium
ELTVPEWNRVVATNQTGTW

SEQ ID NO: 654086 - protein, 17 aa, Mycobacterium
ELTYRWAEHYPAGELKH

SEQ ID NO: 654087 - protein, 18 aa, Mycobacterium
ELVAECLDGGVRRLLGGV

SEQ ID NO: 654088 - protein, 23 aa, Mycobacterium
ELVAEFLRPVFAAHWDQLERGVS

SEQ ID NO: 654089 - protein, 18 aa, Mycobacterium
ELVAEVGCPVMTTESAQL

SEQ ID NO: 654090 - protein, 21 aa, Mycobacterium
ELVAGGCSHFLGPAVVTVDGD

SEQ ID NO: 654091 - protein, 18 aa, Mycobacterium
ELVAPTWTLGEARAKVIE

SEQ ID NO: 654092 - protein, 17 aa, Mycobacterium
ELVAPTWTLGEARAKVV

SEQ ID NO: 654093 - protein, 24 aa, Mycobacterium
ELVARFLADLRWGGFLVTDSSDES

SEQ ID NO: 654094 - protein, 23 aa, Mycobacterium
ELVARIPPRWGSLTRELLAVNMV

SEQ ID NO: 654095 - protein, 19 aa, Mycobacterium
ELVARWAAYMPPVPVEALF

SEQ ID NO: 654096 - protein, 24 aa, Mycobacterium
ELVAVKGGHCAACGGKDFEVGHAL

SEQ ID NO: 654097 - protein, 24 aa, Mycobacterium
ELVAVKGGHCAGCGGRDFAVGHAL

SEQ ID NO: 654098 - protein, 22 aa, Mycobacterium
ELVAVLRYFGELIIDDATAELL

SEQ ID NO: 654099 - protein, 17 aa, Mycobacterium
ELVAWINGHPEFVDFPV

SEQ ID NO: 654100 - protein, 29 aa, Mycobacterium
ELVDAAATDFARIGSAINAAAQAAAIPTT

SEQ ID NO: 654101 - protein, 20 aa, Mycobacterium
ELVDAGGFIFIARGSGLPYA

SEQ ID NO: 654102 - protein, 19 aa, Mycobacterium
ELVDAWAPGRAMINAYGPT

SEQ ID NO: 654103 - protein, 24 aa, Mycobacterium
ELVDHLVYLAAFVPAARPRFTDYI

SEQ ID NO: 654104 - protein, 25 aa, Mycobacterium
ELVDIPFKFHHPMWRENAEVDLDYH

SEQ ID NO: 654105 - protein, 30 aa, Mycobacterium
ELVEMLLDWRRLGIDGARLRPAVNATDLAG

SEQ ID NO: 654106 - protein, 25 aa, Mycobacterium
ELVERLGGLPIRAIVRSPLLRCERT

SEQ ID NO: 654107 - protein, 20 aa, Mycobacterium
ELVFSHGIAVVARLTERAVA

SEQ ID NO: 654108 - protein, 18 aa, Mycobacterium
ELVGAAFHPLRRGEDRDH

SEQ ID NO: 654109 - protein, 19 aa, Mycobacterium
ELVGEGTLFLLKVVGDSMV

SEQ ID NO: 654110 - protein, 19 aa, Mycobacterium
ELVGGPVVRLLESLDPTLS

SEQ ID NO: 654111 - protein, 21 aa, Mycobacterium
ELVGICPIVRVIGDASSPRRL

SEQ ID NO: 654112 - protein, 20 aa, Mycobacterium
ELVGIPWIELNPHPLYLPSK

SEQ ID NO: 654113 - protein, 19 aa, Mycobacterium
ELVGLMGIPPLDWDPDEAF

SEQ ID NO: 654114 - protein, 18 aa, Mycobacterium
ELVGLSWEAMRLGDLALG

SEQ ID NO: 654115 - protein, 24 aa, Mycobacterium
ELVHRLDCAQLPAGMVDGLADMRW

SEQ ID NO: 654116 - protein, 19 aa, Mycobacterium
ELVHSAALMATRGRHDHAR

SEQ ID NO: 654117 - protein, 25 aa, Mycobacterium
ELVIKAEAIGVNFIDTYFRSGSYPR

SEQ ID NO: 654118 - protein, 17 aa, Mycobacterium
ELVILRIGWITGSEYEW

SEQ ID NO: 654119 - protein, 37 aa, Mycobacterium
ELVIPPTFLCILGYAAQKWFLQHCGIAINDKKIAQVD

SEQ ID NO: 654120 - protein, 18 aa, Mycobacterium
ELVKKAARVRVFQRAPDW

SEQ ID NO: 654121 - protein, 22 aa, Mycobacterium
ELVKLRPYFDHPLFVEMFAGAI

SEQ ID NO: 654122 - protein, 20 aa, Mycobacterium
ELVKSAASVKVFQRTPGWVL

SEQ ID NO: 654123 - protein, 38 aa, Mycobacterium
ELVLDPRFKTAATWPPTWKAWRRIRRYRPDVVIAEIVR

SEQ ID NO: 654124 - protein, 33 aa, Mycobacterium
ELVLDPRFRTAATWLPALKAWRRVRRFRPDIVI

SEQ ID NO: 654125 - protein, 30 aa, Mycobacterium
ELVLDPRFRTAATWPASLRAWRRVRDYRPH

SEQ ID NO: 654126 - protein, 22 aa, Mycobacterium
ELVPHQPLRVVVGMREVSSDAK

SEQ ID NO: 654127 - protein, 17 aa, Mycobacterium
ELVPLRGRREVHGLTLD

SEQ ID NO: 654128 - protein, 25 aa, Mycobacterium
ELVPRVERIRMIGAATLDLAFVAEG

SEQ ID NO: 654129 - protein, 26 aa, Mycobacterium
ELVPTYSYCRIYWNGAVLEKHTDGAS

SEQ ID NO: 654130 - protein, 23 aa, Mycobacterium
ELVQLRWAPRVNISAKTGRAVQK

SEQ ID NO: 654131 - protein, 23 aa, Mycobacterium
ELVQLRWAQRVNISAHTGRAVQK

SEQ ID NO: 654132 - protein, 18 aa, Mycobacterium
ELVQRLQFGDIVSIAADE

SEQ ID NO: 654133 - protein, 31 aa, Mycobacterium
ELVRADGQWRFRRRRCQFVTSRGLSDTPEVT

SEQ ID NO: 654134 - protein, 20 aa, Mycobacterium
ELVRAGGASLGFIEGPHAPT

SEQ ID NO: 654135 - protein, 24 aa, Mycobacterium
ELVREHIRLGKLAVVLEQGVNGDQ

SEQ ID NO: 654136 - protein, 18 aa, Mycobacterium
ELVRESGLSVGRVQGALA

SEQ ID NO: 654137 - protein, 30 aa, Mycobacterium
ELVRGGVRDVVLCPGSRNAPLAFALHDADR

SEQ ID NO: 654138 - protein, 19 aa, Mycobacterium
ELVRGMSLIGPRGYVAERM

SEQ ID NO: 654139 - protein, 18 aa, Mycobacterium
ELVRPPALLRTGDSAVVR

SEQ ID NO: 654140 - protein, 23 aa, Mycobacterium
ELVRRCRLVMAGEPLPEAEPTAP

SEQ ID NO: 654141 - protein, 17 aa, Mycobacterium
ELVRRIHGELPFQTLMT

SEQ ID NO: 654142 - protein, 21 aa, Mycobacterium
ELVRRLRAAGAVVIGKTNVPE

SEQ ID NO: 654143 - protein, 19 aa, Mycobacterium
ELVRSWASDVVGLFDPDYQ

SEQ ID NO: 654144 - protein, 17 aa, Mycobacterium
ELVRVAGGLGLFSDPDL

SEQ ID NO: 654145 - protein, 23 aa, Mycobacterium
ELVSMALRYEGWDITTAGDGASA

SEQ ID NO: 654146 - protein, 23 aa, Mycobacterium
ELVSRAKAVGALTVLDACQSAPH

SEQ ID NO: 654147 - protein, 23 aa, Mycobacterium
ELVSRAKAVGALTVLDACQSVPH

SEQ ID NO: 654148 - protein, 24 aa, Mycobacterium
ELVSVARFVIRKMDVNPAAELSMV

SEQ ID NO: 654149 - protein, 24 aa, Mycobacterium
ELVTCLRTGRALRQPRARAQNRPQ

SEQ ID NO: 654150 - protein, 18 aa, Mycobacterium
ELVTLALTHRSYAYENGG

SEQ ID NO: 654151 - protein, 30 aa, Mycobacterium
ELVVALLGIWRRGAIHVPLFTAFAPPAITH

SEQ ID NO: 654152 - protein, 19 aa, Mycobacterium
ELVVIEGYSHYDLYDKPEP

SEQ ID NO: 654153 - protein, 27 aa, Mycobacterium
ELVVRLRVPLRGVAPGQTLVLYRPDPD

SEQ ID NO: 654154 - protein, 17 aa, Mycobacterium
ELVWAPAAFRYVMMVLR

SEQ ID NO: 654155 - protein, 28 aa, Mycobacterium
ELVWAPAAFRYVMMVLRHVPRPIFRKLP

SEQ ID NO: 654156 - protein, 17 aa, Mycobacterium
ELVWAPGAFRYVMMVLR

SEQ ID NO: 654157 - protein, 17 aa, Mycobacterium
ELVWLGAAIIIGAGSTS

SEQ ID NO: 654158 - protein, 26 aa, Mycobacterium
ELWALKELPPRIAGREYGVLSRLEEM

SEQ ID NO: 654159 - protein, 25 aa, Mycobacterium
ELWDVLPGYLMFRFIVPSRPPTRRT

SEQ ID NO: 654160 - protein, 17 aa, Mycobacterium
ELWEFAESGLMARREAS

SEQ ID NO: 654161 - protein, 18 aa, Mycobacterium
ELWEFTPSGLMARREASI

SEQ ID NO: 654162 - protein, 18 aa, Mycobacterium
ELWFGAHPGDPAWLETDG

SEQ ID NO: 654163 - protein, 19 aa, Mycobacterium
ELWFGAHPGDPAWLETGTG

SEQ ID NO: 654164 - protein, 19 aa, Mycobacterium
ELWFGAHPGDPAWLQTDDG

SEQ ID NO: 654165 - protein, 18 aa, Mycobacterium
ELWFSEGAADGFILSTSG

SEQ ID NO: 654166 - protein, 30 aa, Mycobacterium
ELWGDSVFHCPFCHGWEARDRPLAVLADGD

SEQ ID NO: 654167 - protein, 24 aa, Mycobacterium
ELWGKTWAAPMFFAPIGVIALCAQ

SEQ ID NO: 654168 - protein, 19 aa, Mycobacterium
ELWGMARALASTWYHDPAA

SEQ ID NO: 654169 - protein, 27 aa, Mycobacterium
ELWLPWRGQRLPGYWFVPPGSSGPGPT

SEQ ID NO: 654170 - protein, 24 aa, Mycobacterium
ELWLRYRQAAAYAYVATTIVAGLG

SEQ ID NO: 654171 - protein, 24 aa, Mycobacterium
ELWQLAFEVVNGYRGELCTQKTPA

SEQ ID NO: 654172 - protein, 20 aa, Mycobacterium
ELWQLAFEVVNGYRGELRTQ

SEQ ID NO: 654173 - protein, 23 aa, Mycobacterium
ELWQRPDIALALAQRYSFAYADL

SEQ ID NO: 654174 - protein, 21 aa, Mycobacterium
ELWSAVISQAIANTGAIANTV

SEQ ID NO: 654175 - protein, 23 aa, Mycobacterium
ELWSEAGKLGFLGVNLPEEYGGG

SEQ ID NO: 654176 - protein, 20 aa, Mycobacterium
ELWVRGVGVMAGYNKRERSD

SEQ ID NO: 654177 - protein, 19 aa, Mycobacterium
ELYCAANSCAATISAITGQ

SEQ ID NO: 654178 - protein, 19 aa, Mycobacterium
ELYDGFTFNAVSWLEALGF

SEQ ID NO: 654179 - protein, 18 aa, Mycobacterium
ELYDPEVLTARYSVGAHD

SEQ ID NO: 654180 - protein, 22 aa, Mycobacterium
ELYERYPHLVVTAITPFGLDGP

SEQ ID NO: 654181 - protein, 19 aa, Mycobacterium
ELYESPAPTSGRPRKTPAQ

SEQ ID NO: 654182 - protein, 22 aa, Mycobacterium
ELYGKPQFWPIWEAAVDAGLPV

SEQ ID NO: 654183 - protein, 23 aa, Mycobacterium
ELYGKPQFWPLWEAAVDAGLPVA

SEQ ID NO: 654184 - protein, 23 aa, Mycobacterium
ELYGKPQFWPLWEAAVEAGLPVA

SEQ ID NO: 654185 - protein, 18 aa, Mycobacterium
ELYGRLMAYLPTAIAPAA

SEQ ID NO: 654186 - protein, 17 aa, Mycobacterium
ELYGRRFGGPRWSTSQH

SEQ ID NO: 654187 - protein, 23 aa, Mycobacterium
ELYGVCRRHGAVLLVDEAHGLGV

SEQ ID NO: 654188 - protein, 21 aa, Mycobacterium
ELYHRSTIERLVGWLMQVIDA

SEQ ID NO: 654189 - protein, 19 aa, Mycobacterium
ELYISYLRKKIDNGRDPMI

SEQ ID NO: 654190 - protein, 23 aa, Mycobacterium
ELYLRGRVGERFAARNSGALTVV

SEQ ID NO: 654191 - protein, 26 aa, Mycobacterium
ELYPECPRAYGVAVMSDVGRRRWWPL

SEQ ID NO: 654192 - protein, 18 aa, Mycobacterium
ELYPLTGTKSLTLDASVS

SEQ ID NO: 654193 - protein, 22 aa, Mycobacterium
ELYPRLEQRLAQIYDVEAAIIA

SEQ ID NO: 654194 - protein, 23 aa, Mycobacterium
ELYRRLREAGGPVFVRTNRPDSP

SEQ ID NO: 654195 - protein, 25 aa, Mycobacterium
ELYTGVRPKGLWSLTFDEELEDLTR

SEQ ID NO: 654196 - protein, 27 aa, Mycobacterium
ELYVCGRLKDLLILAGRNIHPQDIEES

SEQ ID NO: 654197 - protein, 19 aa, Mycobacterium
ELYVRSANALLGLNTPEEL

SEQ ID NO: 654198 - protein, 19 aa, Mycobacterium
ELYVTGRIADLVVIDGRSH

SEQ ID NO: 654199 - protein, 18 aa, Mycobacterium
EMAAMLLALCDIESKVAA

SEQ ID NO: 654200 - protein, 17 aa, Mycobacterium
EMAARGAGRIVLNSRSA

SEQ ID NO: 654201 - protein, 19 aa, Mycobacterium
EMACFCGWVSCDPDAKLGL

SEQ ID NO: 654202 - protein, 25 aa, Mycobacterium
EMAEVPVSVPMKWLPDSLALAGVFP

SEQ ID NO: 654203 - protein, 21 aa, Mycobacterium
EMAFEPSFRPMLAQLNDAGEL

SEQ ID NO: 654204 - protein, 20 aa, Mycobacterium
EMAFKIAGSQALKKAAAQAQ

SEQ ID NO: 654205 - protein, 20 aa, Mycobacterium
EMAFKIAGSQALKKAAQAAQ

SEQ ID NO: 654206 - protein, 18 aa, Mycobacterium
EMAFKIAGSQVLKKAAAA

SEQ ID NO: 654207 - protein, 19 aa, Mycobacterium
EMAFKIAGSQVLKKAAAQA

SEQ ID NO: 654208 - protein, 18 aa, Mycobacterium
EMAFKVAGSQVLKKAAQA

SEQ ID NO: 654209 - protein, 24 aa, Mycobacterium
EMAFPRLYGVQTRFFDDFFVAAGA

SEQ ID NO: 654210 - protein, 30 aa, Mycobacterium
EMAGALKNVYAIAVGMGYSLGIGENTRAMV

SEQ ID NO: 654211 - protein, 25 aa, Mycobacterium
EMAGLIVSGAIDFEVAATYPLDRVA

SEQ ID NO: 654212 - protein, 21 aa, Mycobacterium
EMAGLKYAYDLIAPTVYPSEE

SEQ ID NO: 654213 - protein, 25 aa, Mycobacterium
EMAPSCALCGCRILGHGAEANGRLY

SEQ ID NO: 654214 - protein, 21 aa, Mycobacterium
EMAQRISARVSLVSFGDETAM

SEQ ID NO: 654215 - protein, 23 aa, Mycobacterium
EMARAWRIVKHDASVNAVVLRAA

SEQ ID NO: 654216 - protein, 24 aa, Mycobacterium
EMARDCVELMAALGHQQFYVAGHD

SEQ ID NO: 654217 - protein, 17 aa, Mycobacterium
EMARIGLTVDALQIQSI

SEQ ID NO: 654218 - protein, 25 aa, Mycobacterium
EMAYFEVLHELKLIVDLIYEGGIAR

SEQ ID NO: 654219 - protein, 25 aa, Mycobacterium
EMAYFEVLHELKLIVDLMYEGGIAR

SEQ ID NO: 654220 - protein, 31 aa, Mycobacterium
EMDGHFPKPWALGIHNVWLRIVPTTITGRRL

SEQ ID NO: 654221 - protein, 17 aa, Mycobacterium
EMDRYPGRIWVIAHKPV

SEQ ID NO: 654222 - protein, 22 aa, Mycobacterium
EMEAIKQLKARYCRYLDTKRWD

SEQ ID NO: 654223 - protein, 17 aa, Mycobacterium
EMEGWFWRLTDSASDRV

SEQ ID NO: 654224 - protein, 18 aa, Mycobacterium
EMEHAGGTLTCLVRGSSH

SEQ ID NO: 654225 - protein, 18 aa, Mycobacterium
EMERLGVVAVLFLGGLDT

SEQ ID NO: 654226 - protein, 20 aa, Mycobacterium
EMFNELWPGFDPAEVPIGSI

SEQ ID NO: 654227 - protein, 24 aa, Mycobacterium
EMFPDAKLGIGPPITDGFYYDFDV

SEQ ID NO: 654228 - protein, 27 aa, Mycobacterium
EMFPRARTSMLAAYRAGVKIAVGTDAP

SEQ ID NO: 654229 - protein, 20 aa, Mycobacterium
EMFRRYWPADLHMIGKDIIR

SEQ ID NO: 654230 - protein, 20 aa, Mycobacterium
EMFRVLVPGGRIGISDVVAE

SEQ ID NO: 654231 - protein, 23 aa, Mycobacterium
EMFWVKYHFKTDQGIEFLTQEDA

SEQ ID NO: 654232 - protein, 20 aa, Mycobacterium
EMGFPFRARTRLAGVRLVAT

SEQ ID NO: 654233 - protein, 20 aa, Mycobacterium
EMGFPGALSTTVTYTLDQNN

SEQ ID NO: 654234 - protein, 20 aa, Mycobacterium
EMGGMNLFFVFGRDGEARLV

SEQ ID NO: 654235 - protein, 26 aa, Mycobacterium
EMGIRSVSWLPLYHDMGLIMIMFPAL

SEQ ID NO: 654236 - protein, 18 aa, Mycobacterium
EMGLAGFEEYTEIKLIAT

SEQ ID NO: 654237 - protein, 25 aa, Mycobacterium
EMGLARLWQSWAIEPDVVLGHSVGQ

SEQ ID NO: 654238 - protein, 25 aa, Mycobacterium
EMGLARLWQSWGIEPDVVLGHSVGQ

SEQ ID NO: 654239 - protein, 25 aa, Mycobacterium
EMGLARLWQSWGIQPDVVLGHSVGQ

SEQ ID NO: 654240 - protein, 24 aa, Mycobacterium
EMGTRIYCAGGWYTGDTLDITTAT

SEQ ID NO: 654241 - protein, 26 aa, Mycobacterium
EMHETFRAIGVDLMFTHIKESLHEFG

SEQ ID NO: 654242 - protein, 20 aa, Mycobacterium
EMHLHLACYQAFDDIGSVIH

SEQ ID NO: 654243 - protein, 18 aa, Mycobacterium
EMHNWRRACFADDEPETN

SEQ ID NO: 654244 - protein, 19 aa, Mycobacterium
EMHQAGAPGGVFASLFTCG

SEQ ID NO: 654245 - protein, 18 aa, Mycobacterium
EMHVHAFSPMEIANGVTK

SEQ ID NO: 654246 - protein, 23 aa, Mycobacterium
EMHYPVWRQSWTGVLPDSTIDVL

SEQ ID NO: 654247 - protein, 18 aa, Mycobacterium
EMIDTCRRLLDTYHDVLR

SEQ ID NO: 654248 - protein, 20 aa, Mycobacterium
EMIDVIKLVLGGGMVEFHGQ

SEQ ID NO: 654249 - protein, 23 aa, Mycobacterium
EMIELMRALWSPGWTEFEGEFYT

SEQ ID NO: 654250 - protein, 24 aa, Mycobacterium
EMIKRLQTRPDLELIGLHCYSPDK

SEQ ID NO: 654251 - protein, 17 aa, Mycobacterium
EMILNFLGEHALKLPRS

SEQ ID NO: 654252 - protein, 17 aa, Mycobacterium
EMILNFLGSHVLKLPRS

SEQ ID NO: 654253 - protein, 23 aa, Mycobacterium
EMIRRLQTRPDLELVGVHCYSAD

SEQ ID NO: 654254 - protein, 25 aa, Mycobacterium
EMIRYCAPAQWFARTARKPFDIHGQ

SEQ ID NO: 654255 - protein, 25 aa, Mycobacterium
EMIRYCAPAQWFARTARKPFTIGDQ

SEQ ID NO: 654256 - protein, 25 aa, Mycobacterium
EMIRYCAPAQWFARTARKPFTIHGQ

SEQ ID NO: 654257 - protein, 25 aa, Mycobacterium
EMIRYCAPAQWFARTLRRPFTLHGT

SEQ ID NO: 654258 - protein, 24 aa, Mycobacterium
EMKPKLDVLDFWSMIKPELPDVKG

SEQ ID NO: 654259 - protein, 19 aa, Mycobacterium
EMKRAGAPLDVRERIENVY

SEQ ID NO: 654260 - protein, 26 aa, Mycobacterium
EMLAAAAAEVSHLGSSLCAANAAAAA

SEQ ID NO: 654261 - protein, 19 aa, Mycobacterium
EMLADIIVREMGKPRDEAL

SEQ ID NO: 654262 - protein, 20 aa, Mycobacterium
EMLAGAATDLAGIGAALQSA

SEQ ID NO: 654263 - protein, 20 aa, Mycobacterium
EMLASAALDLDNIGSTITAA

SEQ ID NO: 654264 - protein, 21 aa, Mycobacterium
EMLDEIKGLVSRPAQLTTPEF

SEQ ID NO: 654265 - protein, 20 aa, Mycobacterium
EMLDLGFLPDIERILKQIPA

SEQ ID NO: 654266 - protein, 21 aa, Mycobacterium
EMLDLGFLPDIERILQLTPDS

SEQ ID NO: 654267 - protein, 22 aa, Mycobacterium
EMLDLGFLPDIERILRQIPVDR

SEQ ID NO: 654268 - protein, 19 aa, Mycobacterium
EMLDMAFAGLYTSAASETS

SEQ ID NO: 654269 - protein, 24 aa, Mycobacterium
EMLDRCRRFLPSLREAHLDAVDPV

SEQ ID NO: 654270 - protein, 21 aa, Mycobacterium
EMLERYGWIVVRVIAEHHPSD

SEQ ID NO: 654271 - protein, 24 aa, Mycobacterium
EMLEVLRASLPKTLALLGTAEEIP

SEQ ID NO: 654272 - protein, 24 aa, Mycobacterium
EMLEVLRASLPRTLALLGTAEEIP

SEQ ID NO: 654273 - protein, 24 aa, Mycobacterium
EMLEYHWGDDWVVWDAEQTSRQRC

SEQ ID NO: 654274 - protein, 34 aa, Mycobacterium
EMLGHRSIYHDGWRAVCPWPGTSFAESTHKFGDV

SEQ ID NO: 654275 - protein, 17 aa, Mycobacterium
EMLGRPWRTERRPTVPG

SEQ ID NO: 654276 - protein, 19 aa, Mycobacterium
EMLGSLWSSTGLQSVSAGA

SEQ ID NO: 654277 - protein, 18 aa, Mycobacterium
EMLIPCFAQLYEELGIER

SEQ ID NO: 654278 - protein, 23 aa, Mycobacterium
EMLLRRLQSLNSFPSDYVLSELD

SEQ ID NO: 654279 - protein, 18 aa, Mycobacterium
EMLPYSDLDLVLLHDENI

SEQ ID NO: 654280 - protein, 20 aa, Mycobacterium
EMLQACVTLAAFGDSSGQIA

SEQ ID NO: 654281 - protein, 19 aa, Mycobacterium
EMLQQMLFDCCSLHAGQAC

SEQ ID NO: 654282 - protein, 22 aa, Mycobacterium
EMLRHRAGTVVARVDAALRNAA

SEQ ID NO: 654283 - protein, 20 aa, Mycobacterium
EMLSMAATDLASVGSAVSAA

SEQ ID NO: 654284 - protein, 19 aa, Mycobacterium
EMLTAAAADIATIGSTISA

SEQ ID NO: 654285 - protein, 18 aa, Mycobacterium
EMLTLLAGELTRTYTASP

SEQ ID NO: 654286 - protein, 24 aa, Mycobacterium
EMLTMGFAEDVERILADTPEYKQV

SEQ ID NO: 654287 - protein, 21 aa, Mycobacterium
EMLTMGFAEDVERILSETPEY

SEQ ID NO: 654288 - protein, 25 aa, Mycobacterium
EMLTMGFAEEVERILADTPEYKQVA

SEQ ID NO: 654289 - protein, 18 aa, Mycobacterium
EMMIDLFWHGLKGAPAER

SEQ ID NO: 654290 - protein, 24 aa, Mycobacterium
EMMRDADFPLPWATMHKVKAPTLL

SEQ ID NO: 654291 - protein, 21 aa, Mycobacterium
EMMRLWVEAEVLRLTGERLRQ

SEQ ID NO: 654292 - protein, 26 aa, Mycobacterium
EMMRNADFPLPWSIMHKVKAPTLLTW

SEQ ID NO: 654293 - protein, 21 aa, Mycobacterium
EMMRRATAKWREHGFDLEFGD

SEQ ID NO: 654294 - protein, 23 aa, Mycobacterium
EMNPNGGLLARFPDLSIPSLGLT

SEQ ID NO: 654295 - protein, 24 aa, Mycobacterium
EMNPNGGMLARFPDLSLPSLGLTF

SEQ ID NO: 654296 - protein, 18 aa, Mycobacterium
EMNTRLQVEHPVTELVTG

SEQ ID NO: 654297 - protein, 19 aa, Mycobacterium
EMNWRILKFKPRAESAPTN

SEQ ID NO: 654298 - protein, 19 aa, Mycobacterium
EMNWRILKFKPRESSEPTS

SEQ ID NO: 654299 - protein, 22 aa, Mycobacterium
EMPAQRWRLVVTAHHIAIDGWS

SEQ ID NO: 654300 - protein, 22 aa, Mycobacterium
EMPASGRGPVASAISAGSSAAA

SEQ ID NO: 654301 - protein, 23 aa, Mycobacterium
EMPEEWARLARGHLPSAVDEDAF

SEQ ID NO: 654302 - protein, 19 aa, Mycobacterium
EMPNIREALQFNLGDCPAR

SEQ ID NO: 654303 - protein, 23 aa, Mycobacterium
EMPPGHVLTSLLAAVPVTATSVD

SEQ ID NO: 654304 - protein, 21 aa, Mycobacterium
EMPPNPAAMVVGWVNDILSEH

SEQ ID NO: 654305 - protein, 25 aa, Mycobacterium
EMPVLERLYRCGGVELTAKVRARFQ

SEQ ID NO: 654306 - protein, 22 aa, Mycobacterium
EMQARLPKAVFKSVLATIDKGA

SEQ ID NO: 654307 - protein, 18 aa, Mycobacterium
EMQDCNFLNSVVPREELE

SEQ ID NO: 654308 - protein, 19 aa, Mycobacterium
EMQNGFLLLMRVGDGSHLA

SEQ ID NO: 654309 - protein, 21 aa, Mycobacterium
EMQRTEGFTALIDANRGCFAA

SEQ ID NO: 654310 - protein, 22 aa, Mycobacterium
EMQRTEGFTALIDANRGCFAAF

SEQ ID NO: 654311 - protein, 22 aa, Mycobacterium
EMRAGLPPALAVAGSYLDGIGV

SEQ ID NO: 654312 - protein, 19 aa, Mycobacterium
EMRARFVSMANGYQAKPKL

SEQ ID NO: 654313 - protein, 21 aa, Mycobacterium
EMREAVLHFAVYAGWPKASQF

SEQ ID NO: 654314 - protein, 26 aa, Mycobacterium
EMRETFRAIGVDLMFTHIKESLHEFG

SEQ ID NO: 654315 - protein, 19 aa, Mycobacterium
EMREVRGLLAQHRFVTLTG

SEQ ID NO: 654316 - protein, 21 aa, Mycobacterium
EMRKPEVRARILADKPGAGHP

SEQ ID NO: 654317 - protein, 22 aa, Mycobacterium
EMRKPEVRARILADKPGQGHPI

SEQ ID NO: 654318 - protein, 18 aa, Mycobacterium
EMRKVYRAALPVLSSKQK

SEQ ID NO: 654319 - protein, 19 aa, Mycobacterium
EMRLPWDAAKQRRFDRLIA

SEQ ID NO: 654320 - protein, 23 aa, Mycobacterium
EMRPGPCAFPDIVPWPTQAAPPP

SEQ ID NO: 654321 - protein, 19 aa, Mycobacterium
EMRQAALAARFRLGPQALD

SEQ ID NO: 654322 - protein, 28 aa, Mycobacterium
EMRRRADAAGWLRYGLPARFGGRDGTNL

SEQ ID NO: 654323 - protein, 28 aa, Mycobacterium
EMRRRADAAGWLRYGLPSQFGGRDGSNL

SEQ ID NO: 654324 - protein, 19 aa, Mycobacterium
EMRRSFAELGPAYVKFGQL

SEQ ID NO: 654325 - protein, 18 aa, Mycobacterium
EMRSRFWMGGPYVGVRHG

SEQ ID NO: 654326 - protein, 24 aa, Mycobacterium
EMRVLRGETDFSWAESPRSRTRHF

SEQ ID NO: 654327 - protein, 19 aa, Mycobacterium
EMRYRAVLEVLDGAVISTV

SEQ ID NO: 654328 - protein, 21 aa, Mycobacterium
EMSAHPSLRYALAELAEDALI

SEQ ID NO: 654329 - protein, 19 aa, Mycobacterium
EMTERAAGGGGGMHVDLDH

SEQ ID NO: 654330 - protein, 20 aa, Mycobacterium
EMTGHFSRFHVGGNHAVHGG

SEQ ID NO: 654331 - protein, 24 aa, Mycobacterium
EMTHANLLFEMYAFDAVLPSRYAD

SEQ ID NO: 654332 - protein, 17 aa, Mycobacterium
EMTKWFDTNYHYIVPEI

SEQ ID NO: 654333 - protein, 29 aa, Mycobacterium
EMTYVICEVLAWRGIWLSEERRRIGNVDV

SEQ ID NO: 654334 - protein, 19 aa, Mycobacterium
EMVAAAAADLTNIGSSMTA

SEQ ID NO: 654335 - protein, 22 aa, Mycobacterium
EMVAAAVEDLAGIGSSISAANA

SEQ ID NO: 654336 - protein, 26 aa, Mycobacterium
EMVARGCPFSGLLYAGLAITANGPAV

SEQ ID NO: 654337 - protein, 17 aa, Mycobacterium
EMVFQRFQAELDRSLAP

SEQ ID NO: 654338 - protein, 17 aa, Mycobacterium
EMVGAFKPDPAVYHMAA

SEQ ID NO: 654339 - protein, 23 aa, Mycobacterium
EMVGQEIFGPVAPLTPFDTEEEA

SEQ ID NO: 654340 - protein, 18 aa, Mycobacterium
EMVLPFISIRQWQPISES

SEQ ID NO: 654341 - protein, 18 aa, Mycobacterium
EMVPLSFAQSRLWFMGQL

SEQ ID NO: 654342 - protein, 17 aa, Mycobacterium
EMVRRGSSFSGLLYAGL

SEQ ID NO: 654343 - protein, 19 aa, Mycobacterium
EMVTQIAAVWGNELFAEIP

SEQ ID NO: 654344 - protein, 19 aa, Mycobacterium
EMVTRILALQAKPTPADAA

SEQ ID NO: 654345 - protein, 18 aa, Mycobacterium
EMWAKDATAMYGYAASSA

SEQ ID NO: 654346 - protein, 20 aa, Mycobacterium
EMWAQDAMAMYGYAGSSAAA

SEQ ID NO: 654347 - protein, 27 aa, Mycobacterium
EMYAAICVAATLAIRGCDHASLMVREN

SEQ ID NO: 654348 - protein, 20 aa, Mycobacterium
EMYDCNFLNSVVPRNELEAE

SEQ ID NO: 654349 - protein, 17 aa, Mycobacterium
EMYKYLVEVSREPELDK

SEQ ID NO: 654350 - protein, 25 aa, Mycobacterium
EMYREARARLGDPVLAWADIQADPE

SEQ ID NO: 654351 - protein, 18 aa, Mycobacterium
ENAARYGLPAHGWTMCVG

SEQ ID NO: 654352 - protein, 17 aa, Mycobacterium
ENAELGVAAAAVAPGEA

SEQ ID NO: 654353 - protein, 29 aa, Mycobacterium
ENAGPHFLPNLWPQRPAGMEAAWTTYFHA

SEQ ID NO: 654354 - protein, 24 aa, Mycobacterium
ENAIWKARTQGIGYLDLTGCMALG

SEQ ID NO: 654355 - protein, 22 aa, Mycobacterium
ENAIWPDLFIAGGGISRKAAKW

SEQ ID NO: 654356 - protein, 23 aa, Mycobacterium
ENAIWPDLFIAGGGISRKADKWI

SEQ ID NO: 654357 - protein, 25 aa, Mycobacterium
ENAIWPDLFIVGGGISRKADKWVHL

SEQ ID NO: 654358 - protein, 18 aa, Mycobacterium
ENAKALFTPEGLQPIYTG

SEQ ID NO: 654359 - protein, 25 aa, Mycobacterium
ENAKMGINYGLNKVRFLSAVTAGSR

SEQ ID NO: 654360 - protein, 25 aa, Mycobacterium
ENALWPDLFIVGGGISRKADKWVPL

SEQ ID NO: 654361 - protein, 18 aa, Mycobacterium
ENAMAVAEFLAGHRAVSA

SEQ ID NO: 654362 - protein, 17 aa, Mycobacterium
ENAMGRFGIEVPDRQLA

SEQ ID NO: 654363 - protein, 25 aa, Mycobacterium
ENAQAAFTSGVWRDAPIHHRAKVMN

SEQ ID NO: 654364 - protein, 21 aa, Mycobacterium
ENARADWRGTFRMFNVTQWSE

SEQ ID NO: 654365 - protein, 20 aa, Mycobacterium
ENARKACMHRSEIMSRIMIA

SEQ ID NO: 654366 - protein, 17 aa, Mycobacterium
ENARPVIVATQMLESMI

SEQ ID NO: 654367 - protein, 36 aa, Mycobacterium
ENARRARLGLSVADYRLAMAELFAPFSKVAAKNPYS

SEQ ID NO: 654368 - protein, 25 aa, Mycobacterium
ENARRARLGLSVSDYRRQMGELFAP

SEQ ID NO: 654369 - protein, 24 aa, Mycobacterium
ENARRAVVVGAGFIGCEVAATLRA

SEQ ID NO: 654370 - protein, 24 aa, Mycobacterium
ENASAATEFVDWAAMNRQQTVAEL

SEQ ID NO: 654371 - protein, 17 aa, Mycobacterium
ENAVCARKLAVMAELFT

SEQ ID NO: 654372 - protein, 21 aa, Mycobacterium
ENAVGPDGRYKISGHGDYHSG

SEQ ID NO: 654373 - protein, 24 aa, Mycobacterium
ENAVWPDLFIAGGGISRKAEKWLP

SEQ ID NO: 654374 - protein, 26 aa, Mycobacterium
ENAVWRNFFLCGAAELRDGKFGTAVQ

SEQ ID NO: 654375 - protein, 24 aa, Mycobacterium
ENAWGIQLAGIWHLAGIYREQSLA

SEQ ID NO: 654376 - protein, 20 aa, Mycobacterium
ENCAVSWVLHPEPWYLEGKL

SEQ ID NO: 654377 - protein, 20 aa, Mycobacterium
ENDIWWCLQPFLNDEPTIPV

SEQ ID NO: 654378 - protein, 21 aa, Mycobacterium
ENDPRVSFVIDDLASIDPWRP

SEQ ID NO: 654379 - protein, 24 aa, Mycobacterium
ENDRRFEAVITFERSRVAQAARSL

SEQ ID NO: 654380 - protein, 20 aa, Mycobacterium
ENEDAMWLLADRVLDGYLAA

SEQ ID NO: 654381 - protein, 25 aa, Mycobacterium
ENEDFMWRLADEVLDDIIGAEPAGR

SEQ ID NO: 654382 - protein, 19 aa, Mycobacterium
ENEDFMWRLADRQLDTFIG

SEQ ID NO: 654383 - protein, 23 aa, Mycobacterium
ENELRTAVLEFMDTVREVEAAVA

SEQ ID NO: 654384 - protein, 24 aa, Mycobacterium
ENENKRFFTMLGTLIRGRVSVAAT

SEQ ID NO: 654385 - protein, 19 aa, Mycobacterium
ENEVLRRAAAYACRPVAAR

SEQ ID NO: 654386 - protein, 22 aa, Mycobacterium
ENEVLRRAAAYLSQANLPGKGS

SEQ ID NO: 654387 - protein, 20 aa, Mycobacterium
ENFDIPGFVNDSYLREMFGD

SEQ ID NO: 654388 - protein, 18 aa, Mycobacterium
ENFFRARGGPIMIKALAG

SEQ ID NO: 654389 - protein, 25 aa, Mycobacterium
ENFGLRPHFRFGVDVRSEEWDEGQH

SEQ ID NO: 654390 - protein, 23 aa, Mycobacterium
ENFLLEGAKWGLGKRDLVSNINF

SEQ ID NO: 654391 - protein, 22 aa, Mycobacterium
ENFNARCAALGFDAYATDNMWA

SEQ ID NO: 654392 - protein, 19 aa, Mycobacterium
ENFNVAPQAIWPRVRRALA

SEQ ID NO: 654393 - protein, 23 aa, Mycobacterium
ENFRCAFSGFDIETVAHYTDADV

SEQ ID NO: 654394 - protein, 25 aa, Mycobacterium
ENFRPGTLEKWGLGYDVLSARNPGI

SEQ ID NO: 654395 - protein, 23 aa, Mycobacterium
ENFSPRVMDHFGLSADVLLQANP

SEQ ID NO: 654396 - protein, 23 aa, Mycobacterium
ENFSPRVMDHFGLTADVLLNINP

SEQ ID NO: 654397 - protein, 23 aa, Mycobacterium
ENFSPRVMEHFGLTAEVLLGVNP

SEQ ID NO: 654398 - protein, 23 aa, Mycobacterium
ENFSPRVMEHFGLTAEVLLKANP

SEQ ID NO: 654399 - protein, 23 aa, Mycobacterium
ENFSPRVVEQFGLDYDALAALNP

SEQ ID NO: 654400 - protein, 23 aa, Mycobacterium
ENFSPRVVEQFGLDYDSIARVNP

SEQ ID NO: 654401 - protein, 17 aa, Mycobacterium
ENGARASFMPKPFGQHP

SEQ ID NO: 654402 - protein, 25 aa, Mycobacterium
ENGGSWAHRLLDVFDRVYRKRPYDF

SEQ ID NO: 654403 - protein, 23 aa, Mycobacterium
ENGIGTAIRFGHKVIEAAWSSRD

SEQ ID NO: 654404 - protein, 17 aa, Mycobacterium
ENGLRVYAMCEIPNNVI

SEQ ID NO: 654405 - protein, 28 aa, Mycobacterium
ENGNWAWRYDAIRAFPDFAVLWDDVDAL

SEQ ID NO: 654406 - protein, 24 aa, Mycobacterium
ENGPQDWSFGFGHAQYVTGELAVP

SEQ ID NO: 654407 - protein, 23 aa, Mycobacterium
ENGQRTAHRLVIRTAPQPDSSPV

SEQ ID NO: 654408 - protein, 26 aa, Mycobacterium
ENGRAAWYRNRWVRTDSFIDPFPLYR

SEQ ID NO: 654409 - protein, 19 aa, Mycobacterium
ENGRVWTPQTIKDFIDHAH

SEQ ID NO: 654410 - protein, 27 aa, Mycobacterium
ENGYVYFAGRLGDWMRVDGENLGTAPI

SEQ ID NO: 654411 - protein, 18 aa, Mycobacterium
ENHFTFFAAMDHVHGDAT

SEQ ID NO: 654412 - protein, 19 aa, Mycobacterium
ENHFTFFAAMDHVHGDATL

SEQ ID NO: 654413 - protein, 19 aa, Mycobacterium
ENHGALLIMDEVMTGFRVS

SEQ ID NO: 654414 - protein, 22 aa, Mycobacterium
ENIACLVKFSWTHIVRHTLVAG

SEQ ID NO: 654415 - protein, 19 aa, Mycobacterium
ENIADTFVAMGWELAEGPE

SEQ ID NO: 654416 - protein, 24 aa, Mycobacterium
ENIDGGAIFAYWVANPSAYGVVEF

SEQ ID NO: 654417 - protein, 26 aa, Mycobacterium
ENILGRPAQSFAAWVADHRELFTRSQ

SEQ ID NO: 654418 - protein, 20 aa, Mycobacterium
ENIRYFPPLLPEVSDEDPAA

SEQ ID NO: 654419 - protein, 17 aa, Mycobacterium
ENKALQITHQWIREHGR

SEQ ID NO: 654420 - protein, 25 aa, Mycobacterium
ENKYRLVFEKLRLKPGDRLLDVGCG

SEQ ID NO: 654421 - protein, 27 aa, Mycobacterium
ENKYRLVFEKLRLRPGDRLLDVGCGWG

SEQ ID NO: 654422 - protein, 17 aa, Mycobacterium
ENLAFKLALVIRGLAAD

SEQ ID NO: 654423 - protein, 17 aa, Mycobacterium
ENLAGLSGRVLEIGAGM

SEQ ID NO: 654424 - protein, 25 aa, Mycobacterium
ENLAREFMELFALGHGNGYTEDDVR

SEQ ID NO: 654425 - protein, 24 aa, Mycobacterium
ENLCGTVRFDLAVQYARACGADTF

SEQ ID NO: 654426 - protein, 17 aa, Mycobacterium
ENLCPKSLYTGWDADGG

SEQ ID NO: 654427 - protein, 24 aa, Mycobacterium
ENLEACGLIDGVLPLDRLPEVVDR

SEQ ID NO: 654428 - protein, 22 aa, Mycobacterium
ENLESIALAESWDNGKPIRETL

SEQ ID NO: 654429 - protein, 20 aa, Mycobacterium
ENLESIAMHHIWTGESVQSD

SEQ ID NO: 654430 - protein, 20 aa, Mycobacterium
ENLFDVGTSFLKVGEARRFG

SEQ ID NO: 654431 - protein, 25 aa, Mycobacterium
ENLGWAGGSDLGFRIAFSEGHSYAM

SEQ ID NO: 654432 - protein, 18 aa, Mycobacterium
ENLIDFHLDFALDESDLI

SEQ ID NO: 654433 - protein, 22 aa, Mycobacterium
ENLKVLHSRSIREHGLIRNSFG

SEQ ID NO: 654434 - protein, 23 aa, Mycobacterium
ENLPDAISLVLSHRAPHRVVVFD

SEQ ID NO: 654435 - protein, 17 aa, Mycobacterium
ENLPLIVGRVHHACPQV

SEQ ID NO: 654436 - protein, 17 aa, Mycobacterium
ENLQAWLTTVVSRLGLD

SEQ ID NO: 654437 - protein, 20 aa, Mycobacterium
ENLREHRKGLLVDLVTAISV

SEQ ID NO: 654438 - protein, 19 aa, Mycobacterium
ENLREHRRGLLVDIVTDVK

SEQ ID NO: 654439 - protein, 27 aa, Mycobacterium
ENLRFELDRYLGWPGQAPSYAIGQRIW

SEQ ID NO: 654440 - protein, 19 aa, Mycobacterium
ENLRKGVDFRPAEPATVFA

SEQ ID NO: 654441 - protein, 24 aa, Mycobacterium
ENLRLETLAAHWGVTQMKPHDALD

SEQ ID NO: 654442 - protein, 23 aa, Mycobacterium
ENLRLETLAAHWGVTQMRPHDAL

SEQ ID NO: 654443 - protein, 20 aa, Mycobacterium
ENLRRLALAPLQFAPGSAWR

SEQ ID NO: 654444 - protein, 17 aa, Mycobacterium
ENLRSFATWDCAVAGLL

SEQ ID NO: 654445 - protein, 21 aa, Mycobacterium
ENLRYTVRFAAAVQAALKDGF

SEQ ID NO: 654446 - protein, 23 aa, Mycobacterium
ENLTPGPTWPPGAPDPAAPADPL

SEQ ID NO: 654447 - protein, 17 aa, Mycobacterium
ENLVKRSIQVLVQELPY

SEQ ID NO: 654448 - protein, 17 aa, Mycobacterium
ENLYAAALLVDQRTTTR

SEQ ID NO: 654449 - protein, 19 aa, Mycobacterium
ENMARLLMVARERYHLFRH

SEQ ID NO: 654450 - protein, 19 aa, Mycobacterium
ENMFPFRADRFFGAGPTSI

SEQ ID NO: 654451 - protein, 19 aa, Mycobacterium
ENMFPFRADRFFGAGQTSI

SEQ ID NO: 654452 - protein, 19 aa, Mycobacterium
ENMFPLRADRLFGAGQTSV

SEQ ID NO: 654453 - protein, 19 aa, Mycobacterium
ENMMSGSVWVKGNASQSAG

SEQ ID NO: 654454 - protein, 19 aa, Mycobacterium
ENMRARMNAALGITEQGFN

SEQ ID NO: 654455 - protein, 19 aa, Mycobacterium
ENMRARMYSALGITEQGFN

SEQ ID NO: 654456 - protein, 20 aa, Mycobacterium
ENNIGVPFAPYLYTVSAMHC

SEQ ID NO: 654457 - protein, 23 aa, Mycobacterium
ENNLGGLSMWSANRDFPGAVGQL

SEQ ID NO: 654458 - protein, 25 aa, Mycobacterium
ENNYPYTYWWLKGYNDAVAEVAVAR

SEQ ID NO: 654459 - protein, 21 aa, Mycobacterium
ENPAAMGYPSFHDEYWNPLWK

SEQ ID NO: 654460 - protein, 22 aa, Mycobacterium
ENPAAMGYPSFHDEYWNPLWKA

SEQ ID NO: 654461 - protein, 21 aa, Mycobacterium
ENPAAMGYPSFHNEYWNPLWK

SEQ ID NO: 654462 - protein, 22 aa, Mycobacterium
ENPAAMGYPSFHNEYWNPLWKA

SEQ ID NO: 654463 - protein, 20 aa, Mycobacterium
ENPEFARACTGAGYTFVGPD

SEQ ID NO: 654464 - protein, 25 aa, Mycobacterium
ENPERVLGLHFFNPVPVLPLVELVS

SEQ ID NO: 654465 - protein, 20 aa, Mycobacterium
ENPFAVAFLSLCDSLGIAEH

SEQ ID NO: 654466 - protein, 21 aa, Mycobacterium
ENPGYTGLHFMAAYELEECWQ

SEQ ID NO: 654467 - protein, 21 aa, Mycobacterium
ENPHLPLLLLEAGSVDSELRE

SEQ ID NO: 654468 - protein, 19 aa, Mycobacterium
ENPLRDISKALGFDEDLST

SEQ ID NO: 654469 - protein, 23 aa, Mycobacterium
ENPLRWTSRHASLATTVYGLGTV

SEQ ID NO: 654470 - protein, 20 aa, Mycobacterium
ENPRVHLFFGGRFPCDLYDL

SEQ ID NO: 654471 - protein, 19 aa, Mycobacterium
ENPRVHLFYGARYPQELYD

SEQ ID NO: 654472 - protein, 19 aa, Mycobacterium
ENQGRLDFRGEFYTHTVMA

SEQ ID NO: 654473 - protein, 19 aa, Mycobacterium
ENQLRFAAPPRLDLTLLTS

SEQ ID NO: 654474 - protein, 21 aa, Mycobacterium
ENQPGFLGFQLLRPVQGEDRY

SEQ ID NO: 654475 - protein, 18 aa, Mycobacterium
ENRARLTAEVVEAVAAEV

SEQ ID NO: 654476 - protein, 18 aa, Mycobacterium
ENRLHAQKALLVWLLEKR

SEQ ID NO: 654477 - protein, 23 aa, Mycobacterium
ENRLVVPVRVFWVPGGLPTRLKV

SEQ ID NO: 654478 - protein, 22 aa, Mycobacterium
ENRPDCIYFGAAGHVLGTGHTL

SEQ ID NO: 654479 - protein, 23 aa, Mycobacterium
ENRPEIIEIMFGVWAAECVYVPI

SEQ ID NO: 654480 - protein, 20 aa, Mycobacterium
ENRPRASLEGHRRIADAIRK

SEQ ID NO: 654481 - protein, 19 aa, Mycobacterium
ENRRRLAVEVVKAVRKAVG

SEQ ID NO: 654482 - protein, 26 aa, Mycobacterium
ENRRWLAAWLAERGFEVRYDRIGNMF

SEQ ID NO: 654483 - protein, 24 aa, Mycobacterium
ENRSGVVCPIHLGLMRGALESWGA

SEQ ID NO: 654484 - protein, 23 aa, Mycobacterium
ENRTAVVCPVHLGLMQGAMDAWG

SEQ ID NO: 654485 - protein, 17 aa, Mycobacterium
ENRTVEIPFYIDTLTGT

SEQ ID NO: 654486 - protein, 34 aa, Mycobacterium
ENRVPRWWSVRDLIMAFLQLRDSVVLHRSEYRLE

SEQ ID NO: 654487 - protein, 24 aa, Mycobacterium
ENSACLSCGSALGFSLDQMALMVI

SEQ ID NO: 654488 - protein, 19 aa, Mycobacterium
ENSLAVGHEFGRRALQEQI

SEQ ID NO: 654489 - protein, 23 aa, Mycobacterium
ENSLRAAILDFIDQVRSAEKAIA

SEQ ID NO: 654490 - protein, 24 aa, Mycobacterium
ENSTCLNCGSALGFSLEQMALLVI

SEQ ID NO: 654491 - protein, 19 aa, Mycobacterium
ENSTLCLDVDWVVGGCMSV

SEQ ID NO: 654492 - protein, 22 aa, Mycobacterium
ENTALLPLKPLLSVSGLDSQIA

SEQ ID NO: 654493 - protein, 25 aa, Mycobacterium
ENTIRWSWELGDVAMWDNRATQHYA

SEQ ID NO: 654494 - protein, 24 aa, Mycobacterium
ENTRISGVLIDLRPAGGPDGARPD

SEQ ID NO: 654495 - protein, 32 aa, Mycobacterium
ENTRRLPAYHLIKYHARIAINQTQPFQFVSES

SEQ ID NO: 654496 - protein, 18 aa, Mycobacterium
ENTTRALLYVAMTRGRSA

SEQ ID NO: 654497 - protein, 18 aa, Mycobacterium
ENTWKLARRTIIADESVL

SEQ ID NO: 654498 - protein, 17 aa, Mycobacterium
ENVALEWAAAINGKSPQ

SEQ ID NO: 654499 - protein, 17 aa, Mycobacterium
ENVCERVSVLGCYEDGT

SEQ ID NO: 654500 - protein, 26 aa, Mycobacterium
ENVDAFLAVCRKWDVLATVIGEVTDG

SEQ ID NO: 654501 - protein, 26 aa, Mycobacterium
ENVDAFLAVCRKWEVLATVIGEVTDG

SEQ ID NO: 654502 - protein, 17 aa, Mycobacterium
ENVGFKLALVVRGLAAD

SEQ ID NO: 654503 - protein, 18 aa, Mycobacterium
ENVHMVSFTLWDMRYAGP

SEQ ID NO: 654504 - protein, 22 aa, Mycobacterium
ENVKTASAFRDSFGEDYGVTIA

SEQ ID NO: 654505 - protein, 18 aa, Mycobacterium
ENVLGGAGGTGGRAGQLI

SEQ ID NO: 654506 - protein, 19 aa, Mycobacterium
ENVMGWKIGTSGFQIVLSV

SEQ ID NO: 654507 - protein, 22 aa, Mycobacterium
ENVPEIWRRLADVGLQTAEACG

SEQ ID NO: 654508 - protein, 19 aa, Mycobacterium
ENVPEIWRRLDAVGLQTAE

SEQ ID NO: 654509 - protein, 18 aa, Mycobacterium
ENVREVHRADLIGQHIGE

SEQ ID NO: 654510 - protein, 24 aa, Mycobacterium
ENVSTEFTAGVPGAPGAGGVTTAV

SEQ ID NO: 654511 - protein, 18 aa, Mycobacterium
ENVTGWPVGTPFAAATKM

SEQ ID NO: 654512 - protein, 20 aa, Mycobacterium
ENWWEWHKLIGPLAADGYRV

SEQ ID NO: 654513 - protein, 17 aa, Mycobacterium
ENYCVYGVRKLWKAARR

SEQ ID NO: 654514 - protein, 17 aa, Mycobacterium
ENYLRWVDDADRTAPRP

SEQ ID NO: 654515 - protein, 24 aa, Mycobacterium
ENYQECYHCSSIHPELSRISPPTS

SEQ ID NO: 654516 - protein, 25 aa, Mycobacterium
ENYWFRRHEVVYERLSSLCAGRRVL

SEQ ID NO: 654517 - protein, 17 aa, Mycobacterium
EPAARPAPEPKPEPATA

SEQ ID NO: 654518 - protein, 19 aa, Mycobacterium
EPADLSVTLRDYFADRDPE

SEQ ID NO: 654519 - protein, 27 aa, Mycobacterium
EPADVPHNWVGAPGYLDTVTWRRQITP

SEQ ID NO: 654520 - protein, 24 aa, Mycobacterium
EPAEIAEVVAWLAGDASGVMTGAQ

SEQ ID NO: 654521 - protein, 25 aa, Mycobacterium
EPAEIAHRAYLRWLHTQGGHPPADV

SEQ ID NO: 654522 - protein, 23 aa, Mycobacterium
EPAEQREAFAWHIDLAKRTGKPL

SEQ ID NO: 654523 - protein, 21 aa, Mycobacterium
EPAFATWQALGARFVAARPQV

SEQ ID NO: 654524 - protein, 30 aa, Mycobacterium
EPAFFGVRPHAVLKGGMIAWAAMGDANASI

SEQ ID NO: 654525 - protein, 19 aa, Mycobacterium
EPAGPGVRVDSGLVRGTVV

SEQ ID NO: 654526 - protein, 20 aa, Mycobacterium
EPAGPIPGFIVKRASEHVLD

SEQ ID NO: 654527 - protein, 24 aa, Mycobacterium
EPAHHWLLTLLVGGARARPRSPRT

SEQ ID NO: 654528 - protein, 20 aa, Mycobacterium
EPAHSLALQRLDLTPLLELD

SEQ ID NO: 654529 - protein, 18 aa, Mycobacterium
EPAIKIARQHGVWAHVDA

SEQ ID NO: 654530 - protein, 21 aa, Mycobacterium
EPAKLKPGYANFAVAQPPLKL

SEQ ID NO: 654531 - protein, 22 aa, Mycobacterium
EPALEGADFVFAAIRVGGVEQR

SEQ ID NO: 654532 - protein, 19 aa, Mycobacterium
EPALFPWLTSAANVELALR

SEQ ID NO: 654533 - protein, 18 aa, Mycobacterium
EPALPAMLSRLVIMGGMF

SEQ ID NO: 654534 - protein, 17 aa, Mycobacterium
EPALPIRAPRVLSPAAV

SEQ ID NO: 654535 - protein, 20 aa, Mycobacterium
EPALRWYWDQYVPALSDRQH

SEQ ID NO: 654536 - protein, 20 aa, Mycobacterium
EPALSWLRDTFPAALVAPVA

SEQ ID NO: 654537 - protein, 20 aa, Mycobacterium
EPAPKVLALAGGVPGVAVTH

SEQ ID NO: 654538 - protein, 17 aa, Mycobacterium
EPAPWSIDWTAPDREHH

SEQ ID NO: 654539 - protein, 21 aa, Mycobacterium
EPARDSGCWMGFSIYPDTKMD

SEQ ID NO: 654540 - protein, 23 aa, Mycobacterium
EPARGAAAIPRRDEKVSAATGLE

SEQ ID NO: 654541 - protein, 20 aa, Mycobacterium
EPARLLLAARPAQLVNAFDR

SEQ ID NO: 654542 - protein, 20 aa, Mycobacterium
EPARLLSQFIHGIKRLPVAW

SEQ ID NO: 654543 - protein, 21 aa, Mycobacterium
EPARLLSQFIHGIKTLPVAWT

SEQ ID NO: 654544 - protein, 19 aa, Mycobacterium
EPARLPFWRGDDVGRPAEL

SEQ ID NO: 654545 - protein, 20 aa, Mycobacterium
EPATVAAFCNTVRTPGGGSH

SEQ ID NO: 654546 - protein, 26 aa, Mycobacterium
EPAVRRLAQRLALAAGRRLDDAQPWV

SEQ ID NO: 654547 - protein, 19 aa, Mycobacterium
EPAVWMRRLPEEGMLPAKL

SEQ ID NO: 654548 - protein, 19 aa, Mycobacterium
EPAVWVIGGGQVYLAALPY

SEQ ID NO: 654549 - protein, 17 aa, Mycobacterium
EPAWNFGGRGERFEVEI

SEQ ID NO: 654550 - protein, 19 aa, Mycobacterium
EPAWSEFLSVLDRPVSPKP

SEQ ID NO: 654551 - protein, 20 aa, Mycobacterium
EPCLRAFCDTVLAQDAEPRV

SEQ ID NO: 654552 - protein, 21 aa, Mycobacterium
EPCSALDPISTLAIEDLIATL

SEQ ID NO: 654553 - protein, 21 aa, Mycobacterium
EPCSALDPISTLAIEDLISEL

SEQ ID NO: 654554 - protein, 20 aa, Mycobacterium
EPCSALDPISTMAIEDLISE

SEQ ID NO: 654555 - protein, 20 aa, Mycobacterium
EPCTECRGSGSIIDNPCDEC

SEQ ID NO: 654556 - protein, 22 aa, Mycobacterium
EPCTECRGSGSIIEHPCQECRG

SEQ ID NO: 654557 - protein, 29 aa, Mycobacterium
EPDAIRIGRRIVARLNWRKQGPAPAEVVE

SEQ ID NO: 654558 - protein, 24 aa, Mycobacterium
EPDAPRLAAIDAVRQHVAVRNEPN

SEQ ID NO: 654559 - protein, 20 aa, Mycobacterium
EPDASGFVHVPWDAVDTWLE

SEQ ID NO: 654560 - protein, 23 aa, Mycobacterium
EPDAWATTLGEVFAADPSTFGRA

SEQ ID NO: 654561 - protein, 18 aa, Mycobacterium
EPDAWVIGGAQIYAMALA

SEQ ID NO: 654562 - protein, 25 aa, Mycobacterium
EPDEPRPGFDPCGALADRYKAKAEQ

SEQ ID NO: 654563 - protein, 25 aa, Mycobacterium
EPDERGMRTVMCILNGQLRPVLVRD

SEQ ID NO: 654564 - protein, 21 aa, Mycobacterium
EPDFVAQVGFSLRDVLTSGET

SEQ ID NO: 654565 - protein, 23 aa, Mycobacterium
EPDGIKFLCPVPGYDRHFAITET

SEQ ID NO: 654566 - protein, 28 aa, Mycobacterium
EPDGPGWHWRTWHLYPRNAFGSGGSGGS

SEQ ID NO: 654567 - protein, 23 aa, Mycobacterium
EPDHKSNILWWIEELARIDRHRY

SEQ ID NO: 654568 - protein, 26 aa, Mycobacterium
EPDIFICSHRSILARSLTKRRRFYAL

SEQ ID NO: 654569 - protein, 20 aa, Mycobacterium
EPDITARPNVVWLDHEDNRG

SEQ ID NO: 654570 - protein, 24 aa, Mycobacterium
EPDLDAWRAAVALGVKRWTSEHSA

SEQ ID NO: 654571 - protein, 19 aa, Mycobacterium
EPDLKMISGTVTFTPSVKE

SEQ ID NO: 654572 - protein, 20 aa, Mycobacterium
EPDLLLSAWDLRPFTDDSDF

SEQ ID NO: 654573 - protein, 23 aa, Mycobacterium
EPDLSCWGKAMGNGFPISALAGK

SEQ ID NO: 654574 - protein, 19 aa, Mycobacterium
EPDPGFGADLQVCCAADVR

SEQ ID NO: 654575 - protein, 22 aa, Mycobacterium
EPDPPIAFNYLGRFEGFDRLGG

SEQ ID NO: 654576 - protein, 23 aa, Mycobacterium
EPDPQLPVALSFSRSRQAALDAK

SEQ ID NO: 654577 - protein, 21 aa, Mycobacterium
EPDRAAWRSAVKIAVQQWNSI

SEQ ID NO: 654578 - protein, 19 aa, Mycobacterium
EPDRIGVTLSEELQLHPEQ

SEQ ID NO: 654579 - protein, 18 aa, Mycobacterium
EPDRLDGLWEEDGPGRAH

SEQ ID NO: 654580 - protein, 17 aa, Mycobacterium
EPDRLRMLRSFDPRAGA

SEQ ID NO: 654581 - protein, 18 aa, Mycobacterium
EPDRPSGPAAQRSASWKF

SEQ ID NO: 654582 - protein, 21 aa, Mycobacterium
EPDRRDWRVLSIMHLADTRDQ

SEQ ID NO: 654583 - protein, 20 aa, Mycobacterium
EPDSRLVVFGAGGVGLAAVM

SEQ ID NO: 654584 - protein, 21 aa, Mycobacterium
EPDTWWSVAAFRAYAAYTRTP

SEQ ID NO: 654585 - protein, 21 aa, Mycobacterium
EPDVLPGFWQRTIDLGPDPDG

SEQ ID NO: 654586 - protein, 20 aa, Mycobacterium
EPDVRLRITMGLRKVDGRWL

SEQ ID NO: 654587 - protein, 24 aa, Mycobacterium
EPDVYAGLVSLRLPSDEELAAAGL

SEQ ID NO: 654588 - protein, 30 aa, Mycobacterium
EPDWVNTIFLSTRFQAWRVGGYNEYLYTFF

SEQ ID NO: 654589 - protein, 24 aa, Mycobacterium
EPEAWVIGGEQVYLLALPHATRCE

SEQ ID NO: 654590 - protein, 24 aa, Mycobacterium
EPEDIANAVLFLASDEARFITGVT

SEQ ID NO: 654591 - protein, 24 aa, Mycobacterium
EPEELTSWLLLLAGSASDFMTGEV

SEQ ID NO: 654592 - protein, 22 aa, Mycobacterium
EPEERYKLCSTVHTKIAVVKSI

SEQ ID NO: 654593 - protein, 19 aa, Mycobacterium
EPEFTRALISLSPGGSDAV

SEQ ID NO: 654594 - protein, 21 aa, Mycobacterium
EPEGGWTPHEILPPEAALASY

SEQ ID NO: 654595 - protein, 34 aa, Mycobacterium
EPEGLPLVLVVHGGPWHRDSWGFDPTVQLLANRG

SEQ ID NO: 654596 - protein, 24 aa, Mycobacterium
EPEHHIRMGRGWRRGTSDALQRDV

SEQ ID NO: 654597 - protein, 27 aa, Mycobacterium
EPEHVGLCWGDSRMSNVLYRPDLTPVA

SEQ ID NO: 654598 - protein, 20 aa, Mycobacterium
EPEIPYYSATLYDPRDYADY

SEQ ID NO: 654599 - protein, 19 aa, Mycobacterium
EPELAFAEHRSCAKTQALA

SEQ ID NO: 654600 - protein, 21 aa, Mycobacterium
EPELLDRLDIVVASVHSKLAM

SEQ ID NO: 654601 - protein, 22 aa, Mycobacterium
EPELLEGLRVIARVSSLCAQMS

SEQ ID NO: 654602 - protein, 26 aa, Mycobacterium
EPELSRTAAVWHLCTPIGGRLRDTST

SEQ ID NO: 654603 - protein, 20 aa, Mycobacterium
EPERAYLIFGNHEFGLPPAD

SEQ ID NO: 654604 - protein, 38 aa, Mycobacterium
EPERHWPALCRAVGRPEWRDDPRFADARSRAANSAALI

SEQ ID NO: 654605 - protein, 18 aa, Mycobacterium
EPERPKLTATLTEPLTSP

SEQ ID NO: 654606 - protein, 23 aa, Mycobacterium
EPERVGVLFLRMVLSVEKVLCGL

SEQ ID NO: 654607 - protein, 27 aa, Mycobacterium
EPERYSLWHPWCHADIWRTDPETETAP

SEQ ID NO: 654608 - protein, 18 aa, Mycobacterium
EPESRLLLETQETVQVVE

SEQ ID NO: 654609 - protein, 23 aa, Mycobacterium
EPESSLDVFDVFDVGAPADEPWD

SEQ ID NO: 654610 - protein, 33 aa, Mycobacterium
EPEVPYYSATLWDPRERPSFTGDYWAENLRYTV

SEQ ID NO: 654611 - protein, 19 aa, Mycobacterium
EPFATLPSMMHITLNAILR

SEQ ID NO: 654612 - protein, 20 aa, Mycobacterium
EPFATLPSMMRITLNAILRA

SEQ ID NO: 654613 - protein, 19 aa, Mycobacterium
EPFCGVAVRGFPNYFFITG

SEQ ID NO: 654614 - protein, 20 aa, Mycobacterium
EPFCGVAVRGFPNYFFITGP

SEQ ID NO: 654615 - protein, 19 aa, Mycobacterium
EPFELPFLYVPPSATDLAA

SEQ ID NO: 654616 - protein, 19 aa, Mycobacterium
EPFEVPKSLVASADPSILD

SEQ ID NO: 654617 - protein, 19 aa, Mycobacterium
EPFGAEVFHVNPVCGDEVT

SEQ ID NO: 654618 - protein, 34 aa, Mycobacterium
EPFGVVGLIIPWNFPLLLAMWKLAPALAAGNTVV

SEQ ID NO: 654619 - protein, 20 aa, Mycobacterium
EPFIMFPRHLGPGLYDIIHS

SEQ ID NO: 654620 - protein, 28 aa, Mycobacterium
EPFLRRFRVKFAGNIAHWNMEVSQNTLL

SEQ ID NO: 654621 - protein, 17 aa, Mycobacterium
EPFPRFSTVRTPRTDSA

SEQ ID NO: 654622 - protein, 20 aa, Mycobacterium
EPFRGWTLGAAWANTVFDLK

SEQ ID NO: 654623 - protein, 22 aa, Mycobacterium
EPFSEPEVFDFPEGIGPVECVN

SEQ ID NO: 654624 - protein, 18 aa, Mycobacterium
EPFSGLHWRCASWLHDHE

SEQ ID NO: 654625 - protein, 19 aa, Mycobacterium
EPFTGVARHHVEWTNYLTP

SEQ ID NO: 654626 - protein, 25 aa, Mycobacterium
EPFVAFEGLEYAPLHIAHERLGDSV

SEQ ID NO: 654627 - protein, 17 aa, Mycobacterium
EPFVYLLPEGQLPRTGS

SEQ ID NO: 654628 - protein, 18 aa, Mycobacterium
EPFWRADGLSGQSAAPGC

SEQ ID NO: 654629 - protein, 19 aa, Mycobacterium
EPGCGALLGSVKSNFGHAQ

SEQ ID NO: 654630 - protein, 20 aa, Mycobacterium
EPGDRIFIFGFSRGAFCARG

SEQ ID NO: 654631 - protein, 17 aa, Mycobacterium
EPGDWLYFVTIDGQGTT

SEQ ID NO: 654632 - protein, 24 aa, Mycobacterium
EPGEIAAAVAWLLSADAAYVSGSV

SEQ ID NO: 654633 - protein, 25 aa, Mycobacterium
EPGEICVSGPLLAGGYWNKPDDTAQ

SEQ ID NO: 654634 - protein, 26 aa, Mycobacterium
EPGEICVSGPLLAGGYWNLPDETAKT

SEQ ID NO: 654635 - protein, 26 aa, Mycobacterium
EPGEICVSGPLLAGGYWNLPEATAET

SEQ ID NO: 654636 - protein, 23 aa, Mycobacterium
EPGELPGQLLFDAFPDNPHDPQS

SEQ ID NO: 654637 - protein, 25 aa, Mycobacterium
EPGELSVHYPFPIDDLVAVDDALKY

SEQ ID NO: 654638 - protein, 31 aa, Mycobacterium
EPGFPPLSGGMVGFFAYDMVRRLERLPELAV

SEQ ID NO: 654639 - protein, 22 aa, Mycobacterium
EPGGVCFCASMGTGPGVGPGYD

SEQ ID NO: 654640 - protein, 21 aa, Mycobacterium
EPGHFLYDGFVHARDLGEKDL

SEQ ID NO: 654641 - protein, 18 aa, Mycobacterium
EPGIPYNIADEMRWDERF

SEQ ID NO: 654642 - protein, 20 aa, Mycobacterium
EPGKFVKAADWVGRAEAEAE

SEQ ID NO: 654643 - protein, 20 aa, Mycobacterium
EPGKFVKAADWVGREEAEAE

SEQ ID NO: 654644 - protein, 20 aa, Mycobacterium
EPGKFVKAADWVGRKEAEAE

SEQ ID NO: 654645 - protein, 18 aa, Mycobacterium
EPGKLADIVLWEPKFFGI

SEQ ID NO: 654646 - protein, 24 aa, Mycobacterium
EPGKPGPRPPRRSWSGAVHILEQP

SEQ ID NO: 654647 - protein, 30 aa, Mycobacterium
EPGLELPVVLGGTMAKYDWTINGEPYSRTK

SEQ ID NO: 654648 - protein, 21 aa, Mycobacterium
EPGLQEKPLSIALREIHADLL

SEQ ID NO: 654649 - protein, 24 aa, Mycobacterium
EPGLQEKPLSIAMREIHADLLEHT

SEQ ID NO: 654650 - protein, 24 aa, Mycobacterium
EPGLQEKPLSIAMREIHGDLLEHT

SEQ ID NO: 654651 - protein, 24 aa, Mycobacterium
EPGLRETGFWRFVSDPDDPSESQA

SEQ ID NO: 654652 - protein, 17 aa, Mycobacterium
EPGLRKILQSNIASGRL

SEQ ID NO: 654653 - protein, 21 aa, Mycobacterium
EPGLYRKPLAATEKFLDAIDA

SEQ ID NO: 654654 - protein, 21 aa, Mycobacterium
EPGMASPLLFALSSTSADGLR

SEQ ID NO: 654655 - protein, 21 aa, Mycobacterium
EPGMVLAITGYVWAEGVGAVL

SEQ ID NO: 654656 - protein, 17 aa, Mycobacterium
EPGMVLAVTGYVWEPGI

SEQ ID NO: 654657 - protein, 20 aa, Mycobacterium
EPGNAYGRWFTPAVPLDVPG

SEQ ID NO: 654658 - protein, 21 aa, Mycobacterium
EPGPLRPVIETAIANSPDRRY

SEQ ID NO: 654659 - protein, 21 aa, Mycobacterium
EPGPPRPGYLERILDGAHHHG

SEQ ID NO: 654660 - protein, 17 aa, Mycobacterium
EPGQCLVLYSDGLVERR

SEQ ID NO: 654661 - protein, 19 aa, Mycobacterium
EPGQFRIGPHTDFGTVTIL

SEQ ID NO: 654662 - protein, 22 aa, Mycobacterium
EPGQHLGGLRVGVRPVEQGGEF

SEQ ID NO: 654663 - protein, 25 aa, Mycobacterium
EPGRGELLVAVLACGVCRTDLHVAE

SEQ ID NO: 654664 - protein, 22 aa, Mycobacterium
EPGRGRIWLRIKGHLDGRPAFG

SEQ ID NO: 654665 - protein, 25 aa, Mycobacterium
EPGRIFAFDVHSIFIPVSRWQYDIV

SEQ ID NO: 654666 - protein, 22 aa, Mycobacterium
EPGRLPPAALRAAYWKAAHDGL

SEQ ID NO: 654667 - protein, 23 aa, Mycobacterium
EPGRRVASPPAIYCPISNTVALD

SEQ ID NO: 654668 - protein, 21 aa, Mycobacterium
EPGRYPVAYFPSGDIEVGTLT

SEQ ID NO: 654669 - protein, 18 aa, Mycobacterium
EPGSALAVHVARLTSRSQ

SEQ ID NO: 654670 - protein, 19 aa, Mycobacterium
EPGSLLARALRRTAREARI

SEQ ID NO: 654671 - protein, 23 aa, Mycobacterium
EPGSRAAVCVGFAKEVLAELDTR

SEQ ID NO: 654672 - protein, 19 aa, Mycobacterium
EPGTACRVMMSMLASGIFS

SEQ ID NO: 654673 - protein, 25 aa, Mycobacterium
EPGTLTAGASWEWKPREDPGQEPGE

SEQ ID NO: 654674 - protein, 26 aa, Mycobacterium
EPGTMGGMRFKLAGMVGGEERVVLEH

SEQ ID NO: 654675 - protein, 27 aa, Mycobacterium
EPGVPGRTVCKWGAFLDNVGDFDPEFF

SEQ ID NO: 654676 - protein, 27 aa, Mycobacterium
EPGVPGRTVCKWGSFLDNVGDFDPEFF

SEQ ID NO: 654677 - protein, 23 aa, Mycobacterium
EPGVPLDFLVEVAAELPMQMICI

SEQ ID NO: 654678 - protein, 21 aa, Mycobacterium
EPGVRLRWPDGVTTTALTSPV

SEQ ID NO: 654679 - protein, 19 aa, Mycobacterium
EPGWTMFMVSHFHYDPVWW

SEQ ID NO: 654680 - protein, 18 aa, Mycobacterium
EPHCRRQVMHAAGRTEGA

SEQ ID NO: 654681 - protein, 18 aa, Mycobacterium
EPHEFAWAVGEPDNPSAT

SEQ ID NO: 654682 - protein, 21 aa, Mycobacterium
EPHEIAELVCFLASDRAAFIT

SEQ ID NO: 654683 - protein, 19 aa, Mycobacterium
EPHGAGLANAGIRRDPLIA

SEQ ID NO: 654684 - protein, 21 aa, Mycobacterium
EPHPGGFMPTGPRVGGTGYPG

SEQ ID NO: 654685 - protein, 19 aa, Mycobacterium
EPHPVLPTTPWQHGQHWIS

SEQ ID NO: 654686 - protein, 24 aa, Mycobacterium
EPHQTRLLLRKSLKLLRDKQKHDR

SEQ ID NO: 654687 - protein, 19 aa, Mycobacterium
EPHRVCRYLEDLAGDYHRF

SEQ ID NO: 654688 - protein, 24 aa, Mycobacterium
EPHYGPPPLLLRMVEAGQLGKKSG

SEQ ID NO: 654689 - protein, 24 aa, Mycobacterium
EPHYRPSAKLAAFIRSRDLFCRFP

SEQ ID NO: 654690 - protein, 19 aa, Mycobacterium
EPIAAICAALDKLAATPGK

SEQ ID NO: 654691 - protein, 19 aa, Mycobacterium
EPIAIVAVACRFPASPDPE

SEQ ID NO: 654692 - protein, 20 aa, Mycobacterium
EPIAIVGMGCRYPGGVSSPA

SEQ ID NO: 654693 - protein, 20 aa, Mycobacterium
EPIAVIGLGLRLPGGDDLDG

SEQ ID NO: 654694 - protein, 20 aa, Mycobacterium
EPIAVIGMACRFSGQVHGVG

SEQ ID NO: 654695 - protein, 17 aa, Mycobacterium
EPIDISNAVLFFASDES

SEQ ID NO: 654696 - protein, 25 aa, Mycobacterium
EPIDISYPYLWRNLTEVVGTVLEAL

SEQ ID NO: 654697 - protein, 18 aa, Mycobacterium
EPIEFSWTSSDIQLYHLG

SEQ ID NO: 654698 - protein, 26 aa, Mycobacterium
EPIEPRLSLQWFVRVESLAKAAGDAV

SEQ ID NO: 654699 - protein, 30 aa, Mycobacterium
EPIEPRLSLQWWVKVESLAKAAGDAVRNGD

SEQ ID NO: 654700 - protein, 17 aa, Mycobacterium
EPIGVCVLIAPWNYPLL

SEQ ID NO: 654701 - protein, 17 aa, Mycobacterium
EPIILMSGAHHFNEVLF

SEQ ID NO: 654702 - protein, 19 aa, Mycobacterium
EPIPLLPNAIWVYEYGEPR

SEQ ID NO: 654703 - protein, 26 aa, Mycobacterium
EPIQAIPIVGPIVWEAIDGIVEKIID

SEQ ID NO: 654704 - protein, 18 aa, Mycobacterium
EPIRLPDRTWPERVIDRA

SEQ ID NO: 654705 - protein, 17 aa, Mycobacterium
EPISALLAVAALDDLDG

SEQ ID NO: 654706 - protein, 24 aa, Mycobacterium
EPIWRLCSELDLTIVQHGGPGSPA

SEQ ID NO: 654707 - protein, 23 aa, Mycobacterium
EPKDTRLLLEFMGLANHRKAIRA

SEQ ID NO: 654708 - protein, 23 aa, Mycobacterium
EPKDTRLLLEFMGLANHRKEIGA

SEQ ID NO: 654709 - protein, 26 aa, Mycobacterium
EPKGPFVDAAERWRTLERAMEARLRR

SEQ ID NO: 654710 - protein, 18 aa, Mycobacterium
EPKHMAWAQIPTASNGSS

SEQ ID NO: 654711 - protein, 23 aa, Mycobacterium
EPKHYYRALALAVRDRMQQRWIE

SEQ ID NO: 654712 - protein, 24 aa, Mycobacterium
EPKLALPTPAGWEYTAAMNSPMIR

SEQ ID NO: 654713 - protein, 19 aa, Mycobacterium
EPKPLKGMPPFSGPQGPFA

SEQ ID NO: 654714 - protein, 23 aa, Mycobacterium
EPKPMVYSGLYPVDGSDYPNLRD

SEQ ID NO: 654715 - protein, 20 aa, Mycobacterium
EPKPSWGHPKYDPIWAAATK

SEQ ID NO: 654716 - protein, 17 aa, Mycobacterium
EPKVIASSVDFLADAVA

SEQ ID NO: 654717 - protein, 23 aa, Mycobacterium
EPKWDGFRSICFRDNDEVELGSR

SEQ ID NO: 654718 - protein, 23 aa, Mycobacterium
EPKWDGFRSICFRDRDEVELGSR

SEQ ID NO: 654719 - protein, 22 aa, Mycobacterium
EPKWDGFRSIVFRDGDEVELGS

SEQ ID NO: 654720 - protein, 29 aa, Mycobacterium
EPLAFASLDRWPGTVAEYLSTMFDPSLTF

SEQ ID NO: 654721 - protein, 24 aa, Mycobacterium
EPLAFASLDRWSGTVGEYLNTMFD

SEQ ID NO: 654722 - protein, 25 aa, Mycobacterium
EPLAFASLDRWSGTVGEYLNTMFDP

SEQ ID NO: 654723 - protein, 26 aa, Mycobacterium
EPLAKMAGYHLGWWDVNGVPVDGSSG

SEQ ID NO: 654724 - protein, 23 aa, Mycobacterium
EPLDELRLLANILGVARDAEVLA

SEQ ID NO: 654725 - protein, 17 aa, Mycobacterium
EPLDILAAVAMLLTQIR

SEQ ID NO: 654726 - protein, 20 aa, Mycobacterium
EPLDPLMSRLEMRRMSYVQR

SEQ ID NO: 654727 - protein, 19 aa, Mycobacterium
EPLDPVRFIGNRSSGKQGY

SEQ ID NO: 654728 - protein, 30 aa, Mycobacterium
EPLELPGPHGSAVPTTWRCRRVTATLSADT

SEQ ID NO: 654729 - protein, 25 aa, Mycobacterium
EPLELPGPHGSVVPGTWRAQRTTRR

SEQ ID NO: 654730 - protein, 27 aa, Mycobacterium
EPLERRAAEIAQRWGVNTYPVQADMSK

SEQ ID NO: 654731 - protein, 20 aa, Mycobacterium
EPLGALTAAGVWGARHAPDF

SEQ ID NO: 654732 - protein, 23 aa, Mycobacterium
EPLGLLTHRFRIWGSSDLQRWLP

SEQ ID NO: 654733 - protein, 26 aa, Mycobacterium
EPLHLRMPEVWGIRLEGELPQWCSAK

SEQ ID NO: 654734 - protein, 24 aa, Mycobacterium
EPLIHIVGTGGLLPIKIPIIDIAA

SEQ ID NO: 654735 - protein, 17 aa, Mycobacterium
EPLILLHGSGPGVTGWR

SEQ ID NO: 654736 - protein, 19 aa, Mycobacterium
EPLLGTWQSVVLVDLNRDN

SEQ ID NO: 654737 - protein, 20 aa, Mycobacterium
EPLLNVTTPWGLVLEPAPVK

SEQ ID NO: 654738 - protein, 19 aa, Mycobacterium
EPLLPPAKWPSRAAASLST

SEQ ID NO: 654739 - protein, 23 aa, Mycobacterium
EPLLRKRRGAWVGWPGVPDADVE

SEQ ID NO: 654740 - protein, 17 aa, Mycobacterium
EPLLRRLAARIAATFPW

SEQ ID NO: 654741 - protein, 23 aa, Mycobacterium
EPLLRRRHGAWIGWPGVPEDADD

SEQ ID NO: 654742 - protein, 22 aa, Mycobacterium
EPLLRRRRGAWVGWAGIAEEET

SEQ ID NO: 654743 - protein, 23 aa, Mycobacterium
EPLLRRRRGAWVGWAGVVENDVD

SEQ ID NO: 654744 - protein, 23 aa, Mycobacterium
EPLLRRRRGAWVGWPGVAEADVD

SEQ ID NO: 654745 - protein, 23 aa, Mycobacterium
EPLLRRRRGAWVGWPGVVDEDVD

SEQ ID NO: 654746 - protein, 19 aa, Mycobacterium
EPLMAPARIDLNALRAHAA

SEQ ID NO: 654747 - protein, 17 aa, Mycobacterium
EPLMFSLGIWHGVRRFL

SEQ ID NO: 654748 - protein, 20 aa, Mycobacterium
EPLMPCGRCRQLLLEHGGPD

SEQ ID NO: 654749 - protein, 20 aa, Mycobacterium
EPLPAGPVRRAPLGILAGAR

SEQ ID NO: 654750 - protein, 24 aa, Mycobacterium
EPLPEGSGFEFVDKVVGGAVPRQF

SEQ ID NO: 654751 - protein, 17 aa, Mycobacterium
EPLPGIVEQPGLTSPTE

SEQ ID NO: 654752 - protein, 22 aa, Mycobacterium
EPLRPWKAEQLGGGYQVSSWVE

SEQ ID NO: 654753 - protein, 22 aa, Mycobacterium
EPLRPWKAEQLGGGYRVSTWVE

SEQ ID NO: 654754 - protein, 20 aa, Mycobacterium
EPLRPWKSEQLGGGYRISTW

SEQ ID NO: 654755 - protein, 17 aa, Mycobacterium
EPLRRNRIVGADLLEPL

SEQ ID NO: 654756 - protein, 22 aa, Mycobacterium
EPLRVLVEAGYRRDIAPGAPTP

SEQ ID NO: 654757 - protein, 18 aa, Mycobacterium
EPLSAAQTARAWRTALDP

SEQ ID NO: 654758 - protein, 50 aa, Mycobacterium
EPLSGADFPAGWQKLNGPQALSFVRQRHGLPRGDLDRVTRQQAFMASLAH

SEQ ID NO: 654759 - protein, 29 aa, Mycobacterium
EPLSLGVAVTEIWNWLAAEQHRPLLKLWV

SEQ ID NO: 654760 - protein, 19 aa, Mycobacterium
EPLSSRTAFFSSVTGSRLD

SEQ ID NO: 654761 - protein, 21 aa, Mycobacterium
EPLVCLLSMLCERPVKWIESR

SEQ ID NO: 654762 - protein, 24 aa, Mycobacterium
EPLVEVTDLIGLRVITYLREDVDT

SEQ ID NO: 654763 - protein, 20 aa, Mycobacterium
EPLYDVIALAQHRARPLSNA

SEQ ID NO: 654764 - protein, 24 aa, Mycobacterium
EPLYSEWLTFIGISVDHAENRNAY

SEQ ID NO: 654765 - protein, 20 aa, Mycobacterium
EPMAALSRMARGDHRQITLT

SEQ ID NO: 654766 - protein, 19 aa, Mycobacterium
EPMAALSRMSRGEHRSITL

SEQ ID NO: 654767 - protein, 20 aa, Mycobacterium
EPMAALSRMSRGEHRSITLT

SEQ ID NO: 654768 - protein, 19 aa, Mycobacterium
EPMFGMAVQGVVSRTVRDS

SEQ ID NO: 654769 - protein, 21 aa, Mycobacterium
EPMGGWCDKCEKPSMVEVQLR

SEQ ID NO: 654770 - protein, 22 aa, Mycobacterium
EPMIPIYIFYSMFGFQRTGDSF

SEQ ID NO: 654771 - protein, 22 aa, Mycobacterium
EPMIPLYIFYSMFGFQRTGDGL

SEQ ID NO: 654772 - protein, 18 aa, Mycobacterium
EPMIVNWPVPPVQGSVTE

SEQ ID NO: 654773 - protein, 24 aa, Mycobacterium
EPMLDEFARIVARLEPRTPQIGLV

SEQ ID NO: 654774 - protein, 20 aa, Mycobacterium
EPMMRITLNVILRAVFGADG

SEQ ID NO: 654775 - protein, 20 aa, Mycobacterium
EPMRPWKAEQLGGGYQVSSW

SEQ ID NO: 654776 - protein, 20 aa, Mycobacterium
EPMRPWKAEQLGGGYRISSW

SEQ ID NO: 654777 - protein, 24 aa, Mycobacterium
EPMTFEWTDRDTLLYALGVGAGID

SEQ ID NO: 654778 - protein, 17 aa, Mycobacterium
EPNAAAVRSMWTTVREK

SEQ ID NO: 654779 - protein, 28 aa, Mycobacterium
EPNLKPGDALFFGHGLNIHFDLIKPPAD

SEQ ID NO: 654780 - protein, 18 aa, Mycobacterium
EPNLTYLVNLGYGDPHFG

SEQ ID NO: 654781 - protein, 18 aa, Mycobacterium
EPNMGIDVPCISFASPAF

SEQ ID NO: 654782 - protein, 28 aa, Mycobacterium
EPNRAWRLYRRLGFTDVIRGYHFAGDPR

SEQ ID NO: 654783 - protein, 26 aa, Mycobacterium
EPNRAWRLYRRLGFTDVIRRYHFAGD

SEQ ID NO: 654784 - protein, 23 aa, Mycobacterium
EPPAAVSVPYFWSDQYDVKIQAL

SEQ ID NO: 654785 - protein, 21 aa, Mycobacterium
EPPAPEAWWYYTFATGQHITF

SEQ ID NO: 654786 - protein, 17 aa, Mycobacterium
EPPAYRAGLAGGMPGGF

SEQ ID NO: 654787 - protein, 21 aa, Mycobacterium
EPPETARLVGFHGAATPAEMA

SEQ ID NO: 654788 - protein, 27 aa, Mycobacterium
EPPKQLEIKLAWAVRREDGWSPRRVTP

SEQ ID NO: 654789 - protein, 19 aa, Mycobacterium
EPPLKLVLIENPGHGGTLN

SEQ ID NO: 654790 - protein, 18 aa, Mycobacterium
EPPLPFADDAFDLVTTRH

SEQ ID NO: 654791 - protein, 22 aa, Mycobacterium
EPPPRAFGPLSIDVAGRQVFID

SEQ ID NO: 654792 - protein, 21 aa, Mycobacterium
EPPPRDSLVLQRFATTRLGKD

SEQ ID NO: 654793 - protein, 21 aa, Mycobacterium
EPPPRLPAPHHRPHWGEDGVL

SEQ ID NO: 654794 - protein, 19 aa, Mycobacterium
EPPQGDWLRRYSATQSPVP

SEQ ID NO: 654795 - protein, 20 aa, Mycobacterium
EPPRPLTHDLIRDVIAALGH

SEQ ID NO: 654796 - protein, 19 aa, Mycobacterium
EPPWLAEIDRPVVLVNTSS

SEQ ID NO: 654797 - protein, 19 aa, Mycobacterium
EPQAGHFVSQYAIDLAHNA

SEQ ID NO: 654798 - protein, 19 aa, Mycobacterium
EPQATPAYYVPPAASPQPD

SEQ ID NO: 654799 - protein, 17 aa, Mycobacterium
EPQGGADPKVFRTTAVQ

SEQ ID NO: 654800 - protein, 20 aa, Mycobacterium
EPQGPPLWEEVLKNPTVKSA

SEQ ID NO: 654801 - protein, 25 aa, Mycobacterium
EPQGRPELRRALAEYLARARGVRAR

SEQ ID NO: 654802 - protein, 28 aa, Mycobacterium
EPQGVAFRPELRVPLLTVVTETDVFGGA

SEQ ID NO: 654803 - protein, 37 aa, Mycobacterium
EPQHPCRRCKQCKAGRYNLCPEIKFYATPPIDGAFCR

SEQ ID NO: 654804 - protein, 20 aa, Mycobacterium
EPQIRQAVILASGLDTRAYR

SEQ ID NO: 654805 - protein, 20 aa, Mycobacterium
EPQLRRAGLDYHDLASVTVH

SEQ ID NO: 654806 - protein, 19 aa, Mycobacterium
EPQPEVQSFLFVTSGALTL

SEQ ID NO: 654807 - protein, 19 aa, Mycobacterium
EPQPEWELALGRLGHALVA

SEQ ID NO: 654808 - protein, 31 aa, Mycobacterium
EPQPTPFTTIAWRLAHVIVGVLAMRNHSHFG

SEQ ID NO: 654809 - protein, 19 aa, Mycobacterium
EPQRLGSAAPYAAPNEALP

SEQ ID NO: 654810 - protein, 17 aa, Mycobacterium
EPQRVAADLGVPDAVKF

SEQ ID NO: 654811 - protein, 21 aa, Mycobacterium
EPQTLLDMARQWAAKNVSAGM

SEQ ID NO: 654812 - protein, 26 aa, Mycobacterium
EPQVARELFIRHALVQGEWQTRHHFL

SEQ ID NO: 654813 - protein, 22 aa, Mycobacterium
EPRATPELLDIVSRDNRRVYDM

SEQ ID NO: 654814 - protein, 23 aa, Mycobacterium
EPRDISNAVLFLASDEARYVTGL

SEQ ID NO: 654815 - protein, 20 aa, Mycobacterium
EPRELTAHWDRWPTSVTWSA

SEQ ID NO: 654816 - protein, 23 aa, Mycobacterium
EPREPRVTTEWLNRLLRSTSALF

SEQ ID NO: 654817 - protein, 26 aa, Mycobacterium
EPRFTRTRLRLDVMPLLEEVLGGGVA

SEQ ID NO: 654818 - protein, 19 aa, Mycobacterium
EPRGMSPAEWRKFAERASL

SEQ ID NO: 654819 - protein, 25 aa, Mycobacterium
EPRGRGLMCAFSLPSAADRDELIRR

SEQ ID NO: 654820 - protein, 26 aa, Mycobacterium
EPRGVPWRRSEFRAVDAVSFRLRRGS

SEQ ID NO: 654821 - protein, 21 aa, Mycobacterium
EPRHLLQALNFLQRTKDRFPW

SEQ ID NO: 654822 - protein, 20 aa, Mycobacterium
EPRKVFDLLEHSPIEVAVLT

SEQ ID NO: 654823 - protein, 22 aa, Mycobacterium
EPRKWARNLIREMSADRLRERL

SEQ ID NO: 654824 - protein, 31 aa, Mycobacterium
EPRLFTCGVDLPLEHPRVYTALIDEDAYDFV

SEQ ID NO: 654825 - protein, 21 aa, Mycobacterium
EPRLIRARRGVILASGGFEHN

SEQ ID NO: 654826 - protein, 26 aa, Mycobacterium
EPRLLPLTIGVLGDWGSGKSSLMRIA

SEQ ID NO: 654827 - protein, 19 aa, Mycobacterium
EPRLRRVAMDSADLPMSVT

SEQ ID NO: 654828 - protein, 17 aa, Mycobacterium
EPRMGGAGLNAGATHTD

SEQ ID NO: 654829 - protein, 18 aa, Mycobacterium
EPRMRKGTWWNRSDTKWV

SEQ ID NO: 654830 - protein, 21 aa, Mycobacterium
EPRNLKAREGMMNAQYIAGQA

SEQ ID NO: 654831 - protein, 18 aa, Mycobacterium
EPRRARLIVDVWAERTKE

SEQ ID NO: 654832 - protein, 20 aa, Mycobacterium
EPRRAWFPIDRSMVLYYCSL

SEQ ID NO: 654833 - protein, 21 aa, Mycobacterium
EPRRGSSPATRMGLMPVTAAG

SEQ ID NO: 654834 - protein, 21 aa, Mycobacterium
EPRRPWKAEQLGGGYRVSSWV

SEQ ID NO: 654835 - protein, 19 aa, Mycobacterium
EPRRTVTAYARPQSNHAFG

SEQ ID NO: 654836 - protein, 20 aa, Mycobacterium
EPRSAEAVEGWEKIAAAGSG

SEQ ID NO: 654837 - protein, 25 aa, Mycobacterium
EPRSRLCCACFDGNYPIELPKETAL

SEQ ID NO: 654838 - protein, 17 aa, Mycobacterium
EPRSWETLQRGWNVVGL

SEQ ID NO: 654839 - protein, 18 aa, Mycobacterium
EPRWAELSDEVLESVETG

SEQ ID NO: 654840 - protein, 22 aa, Mycobacterium
EPSALRPLGVFRAAAANEPGFE

SEQ ID NO: 654841 - protein, 17 aa, Mycobacterium
EPSCPRLATAYRQIPEV

SEQ ID NO: 654842 - protein, 24 aa, Mycobacterium
EPSDFRLWVCLHEVTHRVQFTANP

SEQ ID NO: 654843 - protein, 19 aa, Mycobacterium
EPSDIPARMRWVGDAAPLS

SEQ ID NO: 654844 - protein, 21 aa, Mycobacterium
EPSDIRVIIAYEEAHKNRQRV

SEQ ID NO: 654845 - protein, 21 aa, Mycobacterium
EPSFTGRWALTKSGVEPDSGE

SEQ ID NO: 654846 - protein, 20 aa, Mycobacterium
EPSGTSWWLTGLDAIDGHTL

SEQ ID NO: 654847 - protein, 23 aa, Mycobacterium
EPSGYRFAQLVSDIEAVIDSLGV

SEQ ID NO: 654848 - protein, 17 aa, Mycobacterium
EPSIPLVALYDEQTPGD

SEQ ID NO: 654849 - protein, 26 aa, Mycobacterium
EPSLKAAQQIADWSTKGYLTPGANGV

SEQ ID NO: 654850 - protein, 18 aa, Mycobacterium
EPSLLAWLVRTLPAAISE

SEQ ID NO: 654851 - protein, 21 aa, Mycobacterium
EPSNRVGVNFIPSRLTLELGG

SEQ ID NO: 654852 - protein, 19 aa, Mycobacterium
EPSPAAWHYIRSGEDLDVH

SEQ ID NO: 654853 - protein, 35 aa, Mycobacterium
EPSQWFPYFPVRVGAMTPAWCSGPGRALTQDLSRE

SEQ ID NO: 654854 - protein, 17 aa, Mycobacterium
EPSRIAGVVLVDHSDEN

SEQ ID NO: 654855 - protein, 20 aa, Mycobacterium
EPSTHVIFVLGRPVTAGAFG

SEQ ID NO: 654856 - protein, 20 aa, Mycobacterium
EPSVPPAVVAVVGRPNVGKS

SEQ ID NO: 654857 - protein, 22 aa, Mycobacterium
EPSVRFNPILLKPGSDRTSQLV

SEQ ID NO: 654858 - protein, 20 aa, Mycobacterium
EPSYAMDICLSSRHGDHNHA

SEQ ID NO: 654859 - protein, 26 aa, Mycobacterium
EPSYRYFPVIAESVGTQWRSVPSRAF

SEQ ID NO: 654860 - protein, 27 aa, Mycobacterium
EPTAFPLVLTHGWPGSVLEFLEVLGPL

SEQ ID NO: 654861 - protein, 18 aa, Mycobacterium
EPTFLLRGLTELHIDFIP

SEQ ID NO: 654862 - protein, 17 aa, Mycobacterium
EPTFLLRGLTELHIEFT

SEQ ID NO: 654863 - protein, 20 aa, Mycobacterium
EPTFRRSVIFIVEHNDGGTL

SEQ ID NO: 654864 - protein, 20 aa, Mycobacterium
EPTFRRSVIYIVEHNEGGTL

SEQ ID NO: 654865 - protein, 20 aa, Mycobacterium
EPTFRRSVIYVVEHNDGGTL

SEQ ID NO: 654866 - protein, 20 aa, Mycobacterium
EPTFRRTVIYIVEHNSGGTL

SEQ ID NO: 654867 - protein, 20 aa, Mycobacterium
EPTFVPVLGRIAAGGPILAE

SEQ ID NO: 654868 - protein, 21 aa, Mycobacterium
EPTFVPVLGRIAAGGPILAEE

SEQ ID NO: 654869 - protein, 21 aa, Mycobacterium
EPTGGDMIRHWGPHDRGTSLY

SEQ ID NO: 654870 - protein, 21 aa, Mycobacterium
EPTGPHVARWMARDFECYGTT

SEQ ID NO: 654871 - protein, 19 aa, Mycobacterium
EPTHAEWERGVEFLTAVGH

SEQ ID NO: 654872 - protein, 26 aa, Mycobacterium
EPTIQPKLTFSWRLMPENLSDAGVSW

SEQ ID NO: 654873 - protein, 23 aa, Mycobacterium
EPTLKKRVAGFIGQEVTHGLHHR

SEQ ID NO: 654874 - protein, 21 aa, Mycobacterium
EPTLLPRTYFERVFALQRDVF

SEQ ID NO: 654875 - protein, 22 aa, Mycobacterium
EPTLSRTAALWHLSTSISARLR

SEQ ID NO: 654876 - protein, 20 aa, Mycobacterium
EPTPSFAIIGYAARFPGAAS

SEQ ID NO: 654877 - protein, 20 aa, Mycobacterium
EPTQAVAVFGPLTIDGGHIE

SEQ ID NO: 654878 - protein, 26 aa, Mycobacterium
EPTRAAICRFATWWVVLERHGELVRL

SEQ ID NO: 654879 - protein, 23 aa, Mycobacterium
EPTRLRLVSMIAGHEGAEACVCD

SEQ ID NO: 654880 - protein, 17 aa, Mycobacterium
EPTRRVRMMRWGFVPSW

SEQ ID NO: 654881 - protein, 21 aa, Mycobacterium
EPTSFSFLDGFADLDFNPNPG

SEQ ID NO: 654882 - protein, 24 aa, Mycobacterium
EPTTRGGPDYGRFVEAVRTLQDHA

SEQ ID NO: 654883 - protein, 21 aa, Mycobacterium
EPTTRIEFFFRDTYQCGNEEA

SEQ ID NO: 654884 - protein, 18 aa, Mycobacterium
EPTVCNLLGRLGMPANVQ

SEQ ID NO: 654885 - protein, 25 aa, Mycobacterium
EPTVFPGGVGKTWKAGDFDQLLDDV

SEQ ID NO: 654886 - protein, 24 aa, Mycobacterium
EPVAELAAAFGIGRATAYRYLAAS

SEQ ID NO: 654887 - protein, 18 aa, Mycobacterium
EPVARFLGITNMLTNKFE

SEQ ID NO: 654888 - protein, 20 aa, Mycobacterium
EPVAVVGIGCRLPGNVSGPD

SEQ ID NO: 654889 - protein, 23 aa, Mycobacterium
EPVAVVGMACRFPGGADSPDGLW

SEQ ID NO: 654890 - protein, 23 aa, Mycobacterium
EPVAVVGMACRFPGGVDSPDGLW

SEQ ID NO: 654891 - protein, 19 aa, Mycobacterium
EPVDAVAVYTPIFGLNAMI

SEQ ID NO: 654892 - protein, 23 aa, Mycobacterium
EPVDIANAVLFLASDEARYITGT

SEQ ID NO: 654893 - protein, 24 aa, Mycobacterium
EPVELERVLARSAGILGIELGAEA

SEQ ID NO: 654894 - protein, 19 aa, Mycobacterium
EPVGAFTVDGWDKSFGVNL

SEQ ID NO: 654895 - protein, 17 aa, Mycobacterium
EPVHVVATFPAGVPPDL

SEQ ID NO: 654896 - protein, 18 aa, Mycobacterium
EPVIRRIDVLASQGHEGA

SEQ ID NO: 654897 - protein, 18 aa, Mycobacterium
EPVKSCTMLAAMASGHSV

SEQ ID NO: 654898 - protein, 19 aa, Mycobacterium
EPVLHRLDLVMVPMSAEPD

SEQ ID NO: 654899 - protein, 25 aa, Mycobacterium
EPVLKLLKITGDWQKFKGLPGAEGS

SEQ ID NO: 654900 - protein, 18 aa, Mycobacterium
EPVLSRVFEYWRNVDSDL

SEQ ID NO: 654901 - protein, 20 aa, Mycobacterium
EPVLYRITYDGSIADEPHWV

SEQ ID NO: 654902 - protein, 24 aa, Mycobacterium
EPVMAWRYVELDGGADQDHQLEQL

SEQ ID NO: 654903 - protein, 17 aa, Mycobacterium
EPVMQTFGEPVWIISQG

SEQ ID NO: 654904 - protein, 20 aa, Mycobacterium
EPVPDWRSPTLATLTDDRFS

SEQ ID NO: 654905 - protein, 20 aa, Mycobacterium
EPVPELAKAFGISRATAYRY

SEQ ID NO: 654906 - protein, 26 aa, Mycobacterium
EPVPFRLVPPPTRWVSDAQTVAAGAV

SEQ ID NO: 654907 - protein, 23 aa, Mycobacterium
EPVPLAGATARVFLGGLAGGNSP

SEQ ID NO: 654908 - protein, 19 aa, Mycobacterium
EPVPLRVVETTNWQAVAAE

SEQ ID NO: 654909 - protein, 21 aa, Mycobacterium
EPVQIILADPVIAWQHVELIG

SEQ ID NO: 654910 - protein, 17 aa, Mycobacterium
EPVRLKTGIELPSVTLA

SEQ ID NO: 654911 - protein, 17 aa, Mycobacterium
EPVRPLAPYVLKAAYWM

SEQ ID NO: 654912 - protein, 18 aa, Mycobacterium
EPVRSVLEFLAIDDPLSV

SEQ ID NO: 654913 - protein, 23 aa, Mycobacterium
EPVRVFADVVVFLDDTAAGAQAR

SEQ ID NO: 654914 - protein, 26 aa, Mycobacterium
EPVRWRSRELLTRIASVFQDPEHQFL

SEQ ID NO: 654915 - protein, 18 aa, Mycobacterium
EPVSAVAADEGWSSPEVF

SEQ ID NO: 654916 - protein, 24 aa, Mycobacterium
EPVSDIKGARVLALLGDSVTTDHI

SEQ ID NO: 654917 - protein, 19 aa, Mycobacterium
EPVSVWAPECSEELLYLSD

SEQ ID NO: 654918 - protein, 20 aa, Mycobacterium
EPVTAWALFRYDQVFAAARD

SEQ ID NO: 654919 - protein, 17 aa, Mycobacterium
EPVTLLDVRWRLDEPDG

SEQ ID NO: 654920 - protein, 20 aa, Mycobacterium
EPVVDVWTGWADRRGKRRWT

SEQ ID NO: 654921 - protein, 23 aa, Mycobacterium
EPVWREWVARWPVPSAMAKTSVA

SEQ ID NO: 654922 - protein, 22 aa, Mycobacterium
EPWAVSKLYYIHGFLRARMQLL

SEQ ID NO: 654923 - protein, 28 aa, Mycobacterium
EPWEELAVKLMLKWPNLYYSTSAFAPKY

SEQ ID NO: 654924 - protein, 21 aa, Mycobacterium
EPWEHGAISTAQWYGARLADV

SEQ ID NO: 654925 - protein, 19 aa, Mycobacterium
EPWFARTTDRIRFDRDGWT

SEQ ID NO: 654926 - protein, 22 aa, Mycobacterium
EPWFLDAYRRAWEWADATGWRP

SEQ ID NO: 654927 - protein, 17 aa, Mycobacterium
EPWHVAGGFTLDGLGGW

SEQ ID NO: 654928 - protein, 22 aa, Mycobacterium
EPWLRPQEAFTLSMTRDTVRAV

SEQ ID NO: 654929 - protein, 21 aa, Mycobacterium
EPWSCAGDYVLFRASADLVCA

SEQ ID NO: 654930 - protein, 22 aa, Mycobacterium
EPWVEHFEWLNPLFNERIEIRD

SEQ ID NO: 654931 - protein, 22 aa, Mycobacterium
EPWVPRSRSHVITFPQDLTERA

SEQ ID NO: 654932 - protein, 24 aa, Mycobacterium
EPYAGRPPQIWIGASGPRMLDIAG

SEQ ID NO: 654933 - protein, 18 aa, Mycobacterium
EPYASARRVFWVVDNGSS

SEQ ID NO: 654934 - protein, 23 aa, Mycobacterium
EPYEGRRPPIWVGASGPRSLDIA

SEQ ID NO: 654935 - protein, 19 aa, Mycobacterium
EPYELPGLTDEAKRLKEEG

SEQ ID NO: 654936 - protein, 20 aa, Mycobacterium
EPYGVEWSKPVARFEEGLAT

SEQ ID NO: 654937 - protein, 19 aa, Mycobacterium
EPYGVEWTRPVARFEEALA

SEQ ID NO: 654938 - protein, 18 aa, Mycobacterium
EPYGVVGVIAPWNGALAV

SEQ ID NO: 654939 - protein, 20 aa, Mycobacterium
EPYIPLRARRHLEKGRVVIF

SEQ ID NO: 654940 - protein, 20 aa, Mycobacterium
EPYLDWDLATEPERYAKRLA

SEQ ID NO: 654941 - protein, 20 aa, Mycobacterium
EPYLRLQGPNQWPAALPELP

SEQ ID NO: 654942 - protein, 31 aa, Mycobacterium
EPYPPFYFDGAIPFRTLHAVTEELPDISLVP

SEQ ID NO: 654943 - protein, 20 aa, Mycobacterium
EPYRIVAAPVQFNETPPDPA

SEQ ID NO: 654944 - protein, 22 aa, Mycobacterium
EPYRWRNPRVVFVNSMSDLFHA

SEQ ID NO: 654945 - protein, 20 aa, Mycobacterium
EPYSGLDWRCAQWLHDHEVA

SEQ ID NO: 654946 - protein, 19 aa, Mycobacterium
EPYTGAPMRQVHRGRGITM

SEQ ID NO: 654947 - protein, 23 aa, Mycobacterium
EQAAAIRQDIDWISHAENPAGPR

SEQ ID NO: 654948 - protein, 18 aa, Mycobacterium
EQAARWGLVQKVVAAAEL

SEQ ID NO: 654949 - protein, 20 aa, Mycobacterium
EQAATAACCSARAGRAAKAH

SEQ ID NO: 654950 - protein, 25 aa, Mycobacterium
EQAEDVWFPLFRPVSGAEPGRLPVD

SEQ ID NO: 654951 - protein, 18 aa, Mycobacterium
EQAEVLALAAALKKDPFS

SEQ ID NO: 654952 - protein, 24 aa, Mycobacterium
EQAKLKLAVLAAQLRASGVRVDLA

SEQ ID NO: 654953 - protein, 23 aa, Mycobacterium
EQALERLDRALAHTAILGVQTNV

SEQ ID NO: 654954 - protein, 25 aa, Mycobacterium
EQALERLETLLALVEGWVQTVVTDA

SEQ ID NO: 654955 - protein, 27 aa, Mycobacterium
EQALRGAWFWAHEVMAVGMVWDTAATS

SEQ ID NO: 654956 - protein, 23 aa, Mycobacterium
EQAPRSMAMTDLDLARMIVDPGR

SEQ ID NO: 654957 - protein, 24 aa, Mycobacterium
EQAQRLSARLARIGEVQCDHDRVC

SEQ ID NO: 654958 - protein, 21 aa, Mycobacterium
EQARARAGLPGSTEDKGAQAA

SEQ ID NO: 654959 - protein, 18 aa, Mycobacterium
EQARHAGAEAAVTVAQAG

SEQ ID NO: 654960 - protein, 18 aa, Mycobacterium
EQARKRFDQAWNHQNGDH

SEQ ID NO: 654961 - protein, 18 aa, Mycobacterium
EQARNRWQAATGEALPGL

SEQ ID NO: 654962 - protein, 26 aa, Mycobacterium
EQARRLKIPAERWVYPHAGTDAHDTP

SEQ ID NO: 654963 - protein, 17 aa, Mycobacterium
EQARRLVIRGFFGEIIS

SEQ ID NO: 654964 - protein, 17 aa, Mycobacterium
EQARRRFETSWNRENGA

SEQ ID NO: 654965 - protein, 19 aa, Mycobacterium
EQATADAFTDGWFKTGDLG

SEQ ID NO: 654966 - protein, 18 aa, Mycobacterium
EQAVGINHIALWARGRRE

SEQ ID NO: 654967 - protein, 22 aa, Mycobacterium
EQAVGLFIDRGFHSVKLEDIAE

SEQ ID NO: 654968 - protein, 18 aa, Mycobacterium
EQAVLKLRFFDEMTQTQI

SEQ ID NO: 654969 - protein, 20 aa, Mycobacterium
EQAWFPRARSADELSTVSPA

SEQ ID NO: 654970 - protein, 18 aa, Mycobacterium
EQAWPLIFLNSPRSSYIN

SEQ ID NO: 654971 - protein, 23 aa, Mycobacterium
EQCAGRLAVVFGAGGDRDQGKRE

SEQ ID NO: 654972 - protein, 23 aa, Mycobacterium
EQCLARLKPGPVMISDKKLAWPA

SEQ ID NO: 654973 - protein, 19 aa, Mycobacterium
EQDAHAWASAVNDVRLALG

SEQ ID NO: 654974 - protein, 17 aa, Mycobacterium
EQDAVWSIVELQALLDE

SEQ ID NO: 654975 - protein, 19 aa, Mycobacterium
EQDELALRSHRRAVAAHEN

SEQ ID NO: 654976 - protein, 22 aa, Mycobacterium
EQDGDQFLAWAAKDPAISDAVH

SEQ ID NO: 654977 - protein, 22 aa, Mycobacterium
EQDGHTWLRAGAGIIEASTPER

SEQ ID NO: 654978 - protein, 20 aa, Mycobacterium
EQDIALGVVSWLGCGTSGIT

SEQ ID NO: 654979 - protein, 17 aa, Mycobacterium
EQDRAAAQAAWREVLAG

SEQ ID NO: 654980 - protein, 23 aa, Mycobacterium
EQDSRLLTRELFYTAVTRAKAKV

SEQ ID NO: 654981 - protein, 18 aa, Mycobacterium
EQDWLRRQPTIPLRTDTE

SEQ ID NO: 654982 - protein, 18 aa, Mycobacterium
EQEFRWEDVQSVVDAEPT

SEQ ID NO: 654983 - protein, 17 aa, Mycobacterium
EQELIKLAAQTATNAKI

SEQ ID NO: 654984 - protein, 27 aa, Mycobacterium
EQELLAAKFMGRWRSGAPLVLSPDVDD

SEQ ID NO: 654985 - protein, 23 aa, Mycobacterium
EQELRGILGAFMFSGPQLEQLAG

SEQ ID NO: 654986 - protein, 21 aa, Mycobacterium
EQEMPGLMSLRREYAEVQPLK

SEQ ID NO: 654987 - protein, 22 aa, Mycobacterium
EQEMPGLMSLRREYHDVQPLKG

SEQ ID NO: 654988 - protein, 25 aa, Mycobacterium
EQERLAAEFAYRFATEHTVLRDDDD

SEQ ID NO: 654989 - protein, 25 aa, Mycobacterium
EQERLAAEFAYRFATEHTVLRDDED

SEQ ID NO: 654990 - protein, 20 aa, Mycobacterium
EQFAPMRILTGIEVDILEDG

SEQ ID NO: 654991 - protein, 22 aa, Mycobacterium
EQFCLERFGARPVDYVESLGWL

SEQ ID NO: 654992 - protein, 17 aa, Mycobacterium
EQFGRLDIVVANAGVLS

SEQ ID NO: 654993 - protein, 25 aa, Mycobacterium
EQFLKRLPANQVYRRLNWNLAASPT

SEQ ID NO: 654994 - protein, 20 aa, Mycobacterium
EQFLREGFRAAIEHVASSTD

SEQ ID NO: 654995 - protein, 26 aa, Mycobacterium
EQFMERRLAPRWWPTAMKKFVWPWLV

SEQ ID NO: 654996 - protein, 20 aa, Mycobacterium
EQFMQWFLKEQVEEVAAMTT

SEQ ID NO: 654997 - protein, 21 aa, Mycobacterium
EQFPRPAPRPPYTALSSGQSA

SEQ ID NO: 654998 - protein, 25 aa, Mycobacterium
EQFRPDTPFGFGFGFDPTGRGPGLR

SEQ ID NO: 654999 - protein, 32 aa, Mycobacterium
EQFTEGRTAWEWLVHLYEKWAAGLDFAVPSFA

SEQ ID NO: 655000 - protein, 27 aa, Mycobacterium
EQGAAPGECVALLFSRSAEAIISILAV

SEQ ID NO: 655001 - protein, 25 aa, Mycobacterium
EQGDPRFSDVSSRIFGTPHDVNIGA

SEQ ID NO: 655002 - protein, 23 aa, Mycobacterium
EQGELWFRSPQLMKGYHNKPEAT

SEQ ID NO: 655003 - protein, 24 aa, Mycobacterium
EQGFAEMRGRLDGAAAGQQRIIDL

SEQ ID NO: 655004 - protein, 26 aa, Mycobacterium
EQGGRTILRLGIAFLKEARKHSHAES

SEQ ID NO: 655005 - protein, 18 aa, Mycobacterium
EQGIKNLFGQGGPGAPSV

SEQ ID NO: 655006 - protein, 29 aa, Mycobacterium
EQGIRWDDPEFGISWPIPVTVISEQDASW

SEQ ID NO: 655007 - protein, 20 aa, Mycobacterium
EQGKTEWARQEFEHLAHTPV

SEQ ID NO: 655008 - protein, 50 aa, Mycobacterium
EQGLNEWVDLGINFRYFFVRKTMFVKYAQAFVCLPGGFGTLDELFEALTL

SEQ ID NO: 655009 - protein, 25 aa, Mycobacterium
EQGQRIDPVLARSWLLVNGAHYERF

SEQ ID NO: 655010 - protein, 21 aa, Mycobacterium
EQGQSPFVWGVIGALSEATSL

SEQ ID NO: 655011 - protein, 21 aa, Mycobacterium
EQGRRRFVVIPARHPGVDHVD

SEQ ID NO: 655012 - protein, 17 aa, Mycobacterium
EQGRWADYLLASRATTI

SEQ ID NO: 655013 - protein, 18 aa, Mycobacterium
EQGVELVGPNGLLNQLTK

SEQ ID NO: 655014 - protein, 20 aa, Mycobacterium
EQGWPVLRLEDPRPRGMRPS

SEQ ID NO: 655015 - protein, 17 aa, Mycobacterium
EQHARDVCRSCAVATRC

SEQ ID NO: 655016 - protein, 23 aa, Mycobacterium
EQHGVTVLHFMPGWLEMLTEVGG

SEQ ID NO: 655017 - protein, 25 aa, Mycobacterium
EQHLAEYKGAILAVTHDRYFLDNVA

SEQ ID NO: 655018 - protein, 21 aa, Mycobacterium
EQHPIPEWIVVGAGTGGTSAT

SEQ ID NO: 655019 - protein, 25 aa, Mycobacterium
EQHRGRLGVQLDRQAPGAGVGVHVG

SEQ ID NO: 655020 - protein, 18 aa, Mycobacterium
EQHRTVLALRYMDDCSVP

SEQ ID NO: 655021 - protein, 26 aa, Mycobacterium
EQIAGTGRRAHIVVADLARPEDTAGL

SEQ ID NO: 655022 - protein, 17 aa, Mycobacterium
EQIARAGAQGIRQADVL

SEQ ID NO: 655023 - protein, 26 aa, Mycobacterium
EQIDFWRFNVAFARQILAQQPISGPG

SEQ ID NO: 655024 - protein, 18 aa, Mycobacterium
EQIEAIKALWTQEPAEYH

SEQ ID NO: 655025 - protein, 20 aa, Mycobacterium
EQIEDVWLPLFRPATAEASA

SEQ ID NO: 655026 - protein, 19 aa, Mycobacterium
EQIGRPTVLIGASMGGLTG

SEQ ID NO: 655027 - protein, 24 aa, Mycobacterium
EQIKRFVVLTTQWLPGSDELTPTM

SEQ ID NO: 655028 - protein, 19 aa, Mycobacterium
EQILPRPGWVEHNPVEIWE

SEQ ID NO: 655029 - protein, 23 aa, Mycobacterium
EQILQRLVDWVAFTPLQNATGDP

SEQ ID NO: 655030 - protein, 18 aa, Mycobacterium
EQILRTCYSFVIYSRDFS

SEQ ID NO: 655031 - protein, 17 aa, Mycobacterium
EQIRFWAHVTHGAPAEV

SEQ ID NO: 655032 - protein, 18 aa, Mycobacterium
EQIVEDFRDAGLRLNAQT

SEQ ID NO: 655033 - protein, 19 aa, Mycobacterium
EQIVLPRLRAAAAQSDDVV

SEQ ID NO: 655034 - protein, 21 aa, Mycobacterium
EQKAKIFLALLGKQYGVDAKG

SEQ ID NO: 655035 - protein, 21 aa, Mycobacterium
EQKKHWLANLTFFGPKDNSDT

SEQ ID NO: 655036 - protein, 26 aa, Mycobacterium
EQKKWAKLAADRGWGSTMVLTEPDAG

SEQ ID NO: 655037 - protein, 18 aa, Mycobacterium
EQKRIALDTIADVEASGL

SEQ ID NO: 655038 - protein, 24 aa, Mycobacterium
EQKRRADAILVRRTDRLPLSAPRD

SEQ ID NO: 655039 - protein, 19 aa, Mycobacterium
EQLAARPPWSIGQPQPEIL

SEQ ID NO: 655040 - protein, 19 aa, Mycobacterium
EQLAIVARLAGASLVAKED

SEQ ID NO: 655041 - protein, 19 aa, Mycobacterium
EQLAMYFATVGHDFEVLEP

SEQ ID NO: 655042 - protein, 25 aa, Mycobacterium
EQLARASVMALSYVAQSARGIYQPA

SEQ ID NO: 655043 - protein, 17 aa, Mycobacterium
EQLCGRWHRGDRVLLRM

SEQ ID NO: 655044 - protein, 30 aa, Mycobacterium
EQLFAIGYAACFHSALRMIGRQEKADITDS

SEQ ID NO: 655045 - protein, 31 aa, Mycobacterium
EQLFAVGYAACFHSALRVVARQQKADVSDSA

SEQ ID NO: 655046 - protein, 17 aa, Mycobacterium
EQLFTLAKFIGVSRPGY

SEQ ID NO: 655047 - protein, 17 aa, Mycobacterium
EQLGGGYRISSWVEKTA

SEQ ID NO: 655048 - protein, 18 aa, Mycobacterium
EQLGILARFAGAALVAKE

SEQ ID NO: 655049 - protein, 32 aa, Mycobacterium
EQLLAELARVWKLLPFEADWFSSNELARHRAM

SEQ ID NO: 655050 - protein, 17 aa, Mycobacterium
EQLLPRPLEHSSVHVAV

SEQ ID NO: 655051 - protein, 18 aa, Mycobacterium
EQLLRRIEDAAAMVDRIG

SEQ ID NO: 655052 - protein, 19 aa, Mycobacterium
EQLPEIWRRLVEGGMESGH

SEQ ID NO: 655053 - protein, 17 aa, Mycobacterium
EQLPRKGSYLTRELKVV

SEQ ID NO: 655054 - protein, 28 aa, Mycobacterium
EQLPVYRPPLDMARLFGESRLGAGPGAD

SEQ ID NO: 655055 - protein, 27 aa, Mycobacterium
EQLRALLVRRNELWAPHHVEPHNVEEA

SEQ ID NO: 655056 - protein, 17 aa, Mycobacterium
EQLRELAELTGIPVVTT

SEQ ID NO: 655057 - protein, 20 aa, Mycobacterium
EQLRFLAPVPLEPWEGVRDA

SEQ ID NO: 655058 - protein, 23 aa, Mycobacterium
EQLRGFVNACRHRGNALCVTDTG

SEQ ID NO: 655059 - protein, 22 aa, Mycobacterium
EQLRHRRFFEFVGHPVNPAAAH

SEQ ID NO: 655060 - protein, 25 aa, Mycobacterium
EQLRRAEYPGAITIVSDEDHLPYDR

SEQ ID NO: 655061 - protein, 17 aa, Mycobacterium
EQLRSGASLADVMGYLG

SEQ ID NO: 655062 - protein, 17 aa, Mycobacterium
EQLRVGIGAVFTSWNSP

SEQ ID NO: 655063 - protein, 17 aa, Mycobacterium
EQLRYAAMLDPEELLNG

SEQ ID NO: 655064 - protein, 29 aa, Mycobacterium
EQLSDRGKYQLGIGVSRLARARSGHSDLV

SEQ ID NO: 655065 - protein, 23 aa, Mycobacterium
EQLSEQVLEQFGMAADDLIAEYG

SEQ ID NO: 655066 - protein, 18 aa, Mycobacterium
EQLSYLGFLSELVIAECD

SEQ ID NO: 655067 - protein, 17 aa, Mycobacterium
EQLTAAATNLAGVGSTI

SEQ ID NO: 655068 - protein, 17 aa, Mycobacterium
EQLTLVSWVFGEHLGAV

SEQ ID NO: 655069 - protein, 19 aa, Mycobacterium
EQLVGAVLDYLGTHLTELL

SEQ ID NO: 655070 - protein, 24 aa, Mycobacterium
EQLVLRYHKDRGLPAVAMCVSNTY

SEQ ID NO: 655071 - protein, 23 aa, Mycobacterium
EQLWAQDVAVMAGYHAGVSAIAQ

SEQ ID NO: 655072 - protein, 25 aa, Mycobacterium
EQLYITSGHLEWYADGMFPPMQIDA

SEQ ID NO: 655073 - protein, 24 aa, Mycobacterium
EQMAAELAAVWARVRDDEDIRAAV

SEQ ID NO: 655074 - protein, 19 aa, Mycobacterium
EQMAALLMAILLRGMDRGE

SEQ ID NO: 655075 - protein, 17 aa, Mycobacterium
EQMCGRWKVKHPDLVEL

SEQ ID NO: 655076 - protein, 24 aa, Mycobacterium
EQMELVGGTLICLVRADSDEEARR

SEQ ID NO: 655077 - protein, 17 aa, Mycobacterium
EQMFPGYYKRPEITAEM

SEQ ID NO: 655078 - protein, 37 aa, Mycobacterium
EQMGWASGKGRLWGATDPRYWFPLDLKRGSKNTLLVL

SEQ ID NO: 655079 - protein, 27 aa, Mycobacterium
EQMKAGMWLRDYLRALIDERRRTPGED

SEQ ID NO: 655080 - protein, 25 aa, Mycobacterium
EQMKHFGGLVSFELADAAAVNALVE

SEQ ID NO: 655081 - protein, 17 aa, Mycobacterium
EQMLRHFTVLLDNALAD

SEQ ID NO: 655082 - protein, 23 aa, Mycobacterium
EQMREYFVHRSLYHLKEGDPHAW

SEQ ID NO: 655083 - protein, 20 aa, Mycobacterium
EQMSALLMAIFLRGMDDGET

SEQ ID NO: 655084 - protein, 20 aa, Mycobacterium
EQMSALLMAIFLRGMTPGEI

SEQ ID NO: 655085 - protein, 17 aa, Mycobacterium
EQMSCGRSPAAPIAAAL

SEQ ID NO: 655086 - protein, 24 aa, Mycobacterium
EQMWAQDVAAMFGYHSGASSAAAS

SEQ ID NO: 655087 - protein, 27 aa, Mycobacterium
EQMWAQDVAAMFGYRSGAESIAAALTP

SEQ ID NO: 655088 - protein, 24 aa, Mycobacterium
EQMWAQDVVAMLGYHADTSAAAAA

SEQ ID NO: 655089 - protein, 24 aa, Mycobacterium
EQNAPALLGLIGLWYSNFFGAQSR

SEQ ID NO: 655090 - protein, 24 aa, Mycobacterium
EQNAWWWDVLRHGRSSAYASYFDI

SEQ ID NO: 655091 - protein, 17 aa, Mycobacterium
EQNGFPFEAFLVNTVQL

SEQ ID NO: 655092 - protein, 18 aa, Mycobacterium
EQPCRTVPELAEVRRRVD

SEQ ID NO: 655093 - protein, 22 aa, Mycobacterium
EQPCVPEAHVLDTLVHIWVSSI

SEQ ID NO: 655094 - protein, 28 aa, Mycobacterium
EQPETAFPHWFARNWRRQAILRYGENPH

SEQ ID NO: 655095 - protein, 28 aa, Mycobacterium
EQPETDFPRWFGRNWRRQAMLRYGENPH

SEQ ID NO: 655096 - protein, 24 aa, Mycobacterium
EQPETLHAIMWLMSDRALPRSYRM

SEQ ID NO: 655097 - protein, 26 aa, Mycobacterium
EQPPGPRFTTTVAMPEVPRADSVPDD

SEQ ID NO: 655098 - protein, 24 aa, Mycobacterium
EQPRGRRKTAIGYVVSDKMQKTIV

SEQ ID NO: 655099 - protein, 17 aa, Mycobacterium
EQPTLGLIRAFLTAPPA

SEQ ID NO: 655100 - protein, 17 aa, Mycobacterium
EQPTVAAPRSWEELDDP

SEQ ID NO: 655101 - protein, 20 aa, Mycobacterium
EQPVEFWPTSAIRAALQGGD

SEQ ID NO: 655102 - protein, 20 aa, Mycobacterium
EQPWQPDIVHAHDWLVAHPA

SEQ ID NO: 655103 - protein, 25 aa, Mycobacterium
EQQADCFAGVYLFWVADGKSPRFTL

SEQ ID NO: 655104 - protein, 26 aa, Mycobacterium
EQQADCFAGVYLRWVAAGNSPRFALS

SEQ ID NO: 655105 - protein, 18 aa, Mycobacterium
EQQDRFWVRDEITGEEYQ

SEQ ID NO: 655106 - protein, 18 aa, Mycobacterium
EQQFQVFLDDVRVPGDAL

SEQ ID NO: 655107 - protein, 23 aa, Mycobacterium
EQQGLGWKCPFGTGNGNDTVTSG

SEQ ID NO: 655108 - protein, 17 aa, Mycobacterium
EQQKLKVLVSIFGRETP

SEQ ID NO: 655109 - protein, 24 aa, Mycobacterium
EQQKLKVLVSIFGRETPVELTFSQ

SEQ ID NO: 655110 - protein, 25 aa, Mycobacterium
EQQLTLPFGAPRTMFNVKIGGARRV

SEQ ID NO: 655111 - protein, 25 aa, Mycobacterium
EQQLTLPFGAPRTMLNVKIGGARRC

SEQ ID NO: 655112 - protein, 25 aa, Mycobacterium
EQQRRFLASDGWIAWSGPAISELLK

SEQ ID NO: 655113 - protein, 25 aa, Mycobacterium
EQQRRFLASEGWIAWSGPAISELLK

SEQ ID NO: 655114 - protein, 20 aa, Mycobacterium
EQQRRICLTPQSAHGTNAAS

SEQ ID NO: 655115 - protein, 25 aa, Mycobacterium
EQQSWIIMRRGRFGIACNLGTEATT

SEQ ID NO: 655116 - protein, 19 aa, Mycobacterium
EQQVCFALSVTNRAVLAVY

SEQ ID NO: 655117 - protein, 18 aa, Mycobacterium
EQQWALSAGAIVVIEDPA

SEQ ID NO: 655118 - protein, 20 aa, Mycobacterium
EQRAALPPMHEGRVDVIGGG

SEQ ID NO: 655119 - protein, 20 aa, Mycobacterium
EQRAAWDLSSLQVVMSAAEP

SEQ ID NO: 655120 - protein, 25 aa, Mycobacterium
EQRAREIDTIYGLVAETMKERSTAE

SEQ ID NO: 655121 - protein, 19 aa, Mycobacterium
EQRARHLLAGTGIDILNGL

SEQ ID NO: 655122 - protein, 28 aa, Mycobacterium
EQRCAAAGLTLRIPGPRLCTDNGAMIAS

SEQ ID NO: 655123 - protein, 19 aa, Mycobacterium
EQRDILGLLISARGDDGEQ

SEQ ID NO: 655124 - protein, 18 aa, Mycobacterium
EQRELCAQFATSGGDKFR

SEQ ID NO: 655125 - protein, 18 aa, Mycobacterium
EQRGALDRFAKAAPALER

SEQ ID NO: 655126 - protein, 21 aa, Mycobacterium
EQRGRRWPIIISGTITDASGR

SEQ ID NO: 655127 - protein, 19 aa, Mycobacterium
EQRIPCIEMLIANASSPWE

SEQ ID NO: 655128 - protein, 17 aa, Mycobacterium
EQRIPLIAKAIEASSVH

SEQ ID NO: 655129 - protein, 18 aa, Mycobacterium
EQRIWRVDDVNSETRWPV

SEQ ID NO: 655130 - protein, 31 aa, Mycobacterium
EQRKLEWADLFVLQFPLWWYSVPAILKGWID

SEQ ID NO: 655131 - protein, 28 aa, Mycobacterium
EQRLLHGLPVRRLWGIGPVAEEKLHRLG

SEQ ID NO: 655132 - protein, 21 aa, Mycobacterium
EQRPGEVLAIGQVLDTPVRVN

SEQ ID NO: 655133 - protein, 20 aa, Mycobacterium
EQRPVLVLGAGTLGARIALM

SEQ ID NO: 655134 - protein, 21 aa, Mycobacterium
EQRQYLLGGRFIFAMTGSAPT

SEQ ID NO: 655135 - protein, 31 aa, Mycobacterium
EQRRALSRSAFRRMCRNDFLHYLRIREWQDL

SEQ ID NO: 655136 - protein, 18 aa, Mycobacterium
EQRRELVADPSLIPGAIE

SEQ ID NO: 655137 - protein, 23 aa, Mycobacterium
EQRRGDLPNALRVDSSTGNPETG

SEQ ID NO: 655138 - protein, 26 aa, Mycobacterium
EQRRVFAHALTWLFGELIAQRAEDPI

SEQ ID NO: 655139 - protein, 27 aa, Mycobacterium
EQRRWDAPWYRRVPRAGADDLAALCGP

SEQ ID NO: 655140 - protein, 24 aa, Mycobacterium
EQRTNWLNNFYFGGEHGVEGSIAR

SEQ ID NO: 655141 - protein, 19 aa, Mycobacterium
EQRVAAQFHGLVDEDLVGL

SEQ ID NO: 655142 - protein, 24 aa, Mycobacterium
EQRWAGVQAHNRWQVDFCSLAPAR

SEQ ID NO: 655143 - protein, 34 aa, Mycobacterium
EQRYEGGSTLFGRWELPAFMQIVAGLAEAMRDGR

SEQ ID NO: 655144 - protein, 35 aa, Mycobacterium
EQSDDVWVAGFSARFADSVAMLAIDPHMFDRNSLA

SEQ ID NO: 655145 - protein, 24 aa, Mycobacterium
EQSGFKTAGFAFGREDIWEPEEML

SEQ ID NO: 655146 - protein, 19 aa, Mycobacterium
EQSIRAHLEDLGWLEKLAR

SEQ ID NO: 655147 - protein, 18 aa, Mycobacterium
EQSLREFLGPMITALEGY

SEQ ID NO: 655148 - protein, 18 aa, Mycobacterium
EQSLREFLGPMITGLEGY

SEQ ID NO: 655149 - protein, 24 aa, Mycobacterium
EQSLREFLGPMITNLEGYPFDRMT

SEQ ID NO: 655150 - protein, 19 aa, Mycobacterium
EQSNINWGKAGRMRWKGKR

SEQ ID NO: 655151 - protein, 17 aa, Mycobacterium
EQSRRLATVMLTALEGA

SEQ ID NO: 655152 - protein, 19 aa, Mycobacterium
EQSVAINLLGPMRLTASLL

SEQ ID NO: 655153 - protein, 25 aa, Mycobacterium
EQSVFTRSCKRWFGTTPSAYRSDRR

SEQ ID NO: 655154 - protein, 18 aa, Mycobacterium
EQTARAWLACGPAIVALT

SEQ ID NO: 655155 - protein, 25 aa, Mycobacterium
EQTARLCLQHPILEWSGGSDAAEWL

SEQ ID NO: 655156 - protein, 22 aa, Mycobacterium
EQTDWTAICAAYDRLLQLTDSP

SEQ ID NO: 655157 - protein, 17 aa, Mycobacterium
EQTFIRIGHEVEEIITA

SEQ ID NO: 655158 - protein, 18 aa, Mycobacterium
EQTFLLRLLGGELRQGAL

SEQ ID NO: 655159 - protein, 24 aa, Mycobacterium
EQTGSLLGFHWTKIHDASLGEVYV

SEQ ID NO: 655160 - protein, 19 aa, Mycobacterium
EQTKLIFPKVWGGGPSPML

SEQ ID NO: 655161 - protein, 18 aa, Mycobacterium
EQTLNASQALAFVRQRHG

SEQ ID NO: 655162 - protein, 27 aa, Mycobacterium
EQTMKVGLWSVWWGMQTAFPLLKDRGG

SEQ ID NO: 655163 - protein, 37 aa, Mycobacterium
EQTPRSRLLALFKSPRPGTAPLRGCPFHNAAVEAAGA

SEQ ID NO: 655164 - protein, 17 aa, Mycobacterium
EQTRGAIDFNRPGIPIV

SEQ ID NO: 655165 - protein, 22 aa, Mycobacterium
EQTRGAIDFNRPGIPIVASLPS

SEQ ID NO: 655166 - protein, 19 aa, Mycobacterium
EQTRPTLMLLDGNSLAFRA

SEQ ID NO: 655167 - protein, 22 aa, Mycobacterium
EQTWRLAKMNLAVHGIDDTGLG

SEQ ID NO: 655168 - protein, 24 aa, Mycobacterium
EQVADFLAEYGWRLVEQAGPDELV

SEQ ID NO: 655169 - protein, 18 aa, Mycobacterium
EQVAELYLEVAAMDDAAV

SEQ ID NO: 655170 - protein, 26 aa, Mycobacterium
EQVDWMLGNGGLEWAVKRTADSSQRL

SEQ ID NO: 655171 - protein, 21 aa, Mycobacterium
EQVEGKLICLVRARSDEDAWR

SEQ ID NO: 655172 - protein, 18 aa, Mycobacterium
EQVFPVLTPLAVDPAHPF

SEQ ID NO: 655173 - protein, 18 aa, Mycobacterium
EQVGACERVLEIATDYAR

SEQ ID NO: 655174 - protein, 22 aa, Mycobacterium
EQVKIRGYRIECGEVAAALTTL

SEQ ID NO: 655175 - protein, 30 aa, Mycobacterium
EQVKIRGYRIECGEVTAALAALDGVQQAVV

SEQ ID NO: 655176 - protein, 29 aa, Mycobacterium
EQVKIRGYRIECGEVTAALATLDGVDQAV

SEQ ID NO: 655177 - protein, 29 aa, Mycobacterium
EQVKIRGYRIECGEVTAALTALDGVQQAV

SEQ ID NO: 655178 - protein, 28 aa, Mycobacterium
EQVKIRGYRIECGEVTAALTTLDGVQQA

SEQ ID NO: 655179 - protein, 28 aa, Mycobacterium
EQVKIRGYRIECGEVTTALTTLDGVQQA

SEQ ID NO: 655180 - protein, 29 aa, Mycobacterium
EQVLARKSLPRVIVCGSDVIALGAISALR

SEQ ID NO: 655181 - protein, 22 aa, Mycobacterium
EQVLRINLIGTFLVTRESLAAL

SEQ ID NO: 655182 - protein, 25 aa, Mycobacterium
EQVLRPKLDAALLLHELTQDLDLSA

SEQ ID NO: 655183 - protein, 21 aa, Mycobacterium
EQVPVPPGWGGYLLAPEEVEF

SEQ ID NO: 655184 - protein, 25 aa, Mycobacterium
EQVRFAPRAEFEFHHPLTRTVAYEA

SEQ ID NO: 655185 - protein, 17 aa, Mycobacterium
EQVRLALGKRIHPELPE

SEQ ID NO: 655186 - protein, 25 aa, Mycobacterium
EQVRPWIWKTMESFPGNYMTSFPSL

SEQ ID NO: 655187 - protein, 17 aa, Mycobacterium
EQVRTILDLCAVQDRSG

SEQ ID NO: 655188 - protein, 20 aa, Mycobacterium
EQWDAPSLCTQWRVRDVVTH

SEQ ID NO: 655189 - protein, 26 aa, Mycobacterium
EQWRHTFAVNIDSFFYVTKAALEYLP

SEQ ID NO: 655190 - protein, 24 aa, Mycobacterium
EQWSKASGLDLVRLGTTATAEEIT

SEQ ID NO: 655191 - protein, 17 aa, Mycobacterium
EQWWERSPIFSALNTNK

SEQ ID NO: 655192 - protein, 19 aa, Mycobacterium
EQYFARFGGVRDYLMAVVE

SEQ ID NO: 655193 - protein, 29 aa, Mycobacterium
EQYGFQCGFCLPGMLLAATDLLDRDPNPS

SEQ ID NO: 655194 - protein, 22 aa, Mycobacterium
EQYKLVWKNRLGFARLAIQHGY

SEQ ID NO: 655195 - protein, 19 aa, Mycobacterium
EQYLRAAVRREWPLLVQAI

SEQ ID NO: 655196 - protein, 19 aa, Mycobacterium
EQYLSYVRCCAAILRHINR

SEQ ID NO: 655197 - protein, 28 aa, Mycobacterium
EQYPPGQVPLPFAWNGVRLPGRGASALR

SEQ ID NO: 655198 - protein, 25 aa, Mycobacterium
ERAAAAWVLADLPLDVFLNEELVPY

SEQ ID NO: 655199 - protein, 19 aa, Mycobacterium
ERAAAAWVLADMPLTTFLS

SEQ ID NO: 655200 - protein, 19 aa, Mycobacterium
ERAAARKGGKVSFSAAVDD

SEQ ID NO: 655201 - protein, 17 aa, Mycobacterium
ERAAAWGATPIMAPAAE

SEQ ID NO: 655202 - protein, 20 aa, Mycobacterium
ERAAGCRVIRASGVESEMEL

SEQ ID NO: 655203 - protein, 25 aa, Mycobacterium
ERAALDLSKWLLAVCAAEPVRAATL

SEQ ID NO: 655204 - protein, 23 aa, Mycobacterium
ERAAMPLIIVISAINQRLIEEGL

SEQ ID NO: 655205 - protein, 26 aa, Mycobacterium
ERAARYGDRIFLRFGDQQLTYRDANA

SEQ ID NO: 655206 - protein, 17 aa, Mycobacterium
ERAAVIANALKLMEERK

SEQ ID NO: 655207 - protein, 17 aa, Mycobacterium
ERACAGAGCPIKVRLLV

SEQ ID NO: 655208 - protein, 21 aa, Mycobacterium
ERADIAFTVCDAGWKYLSTGA

SEQ ID NO: 655209 - protein, 21 aa, Mycobacterium
ERADSVALPVVYVHLPDMSIT

SEQ ID NO: 655210 - protein, 27 aa, Mycobacterium
ERADWLSVTRWANWLASVRYSGRTHPR

SEQ ID NO: 655211 - protein, 22 aa, Mycobacterium
ERAEAQLGYLLDRAHTAAIVWS

SEQ ID NO: 655212 - protein, 24 aa, Mycobacterium
ERAEGVPLPGARLVTVAFADIVGF

SEQ ID NO: 655213 - protein, 25 aa, Mycobacterium
ERAEPWGVWGGEIFERGSIVNRKRP

SEQ ID NO: 655214 - protein, 25 aa, Mycobacterium
ERAERELDEFIGLRRVKEHVKELKF

SEQ ID NO: 655215 - protein, 23 aa, Mycobacterium
ERAEVCKRDGKLIGKPAALPATD

SEQ ID NO: 655216 - protein, 18 aa, Mycobacterium
ERAEVFLAALADLLLERE

SEQ ID NO: 655217 - protein, 18 aa, Mycobacterium
ERAFLLCYRQRRWYLEGS

SEQ ID NO: 655218 - protein, 28 aa, Mycobacterium
ERAFTVFWRAMVGLPALGAVAADELLEL

SEQ ID NO: 655219 - protein, 18 aa, Mycobacterium
ERAGHGWFTSLALAEAGA

SEQ ID NO: 655220 - protein, 18 aa, Mycobacterium
ERAGNRWDISAPRNTYRT

SEQ ID NO: 655221 - protein, 19 aa, Mycobacterium
ERAHRVAYAALKHSYEKVG

SEQ ID NO: 655222 - protein, 19 aa, Mycobacterium
ERAILLAAFAGVAANAVAQ

SEQ ID NO: 655223 - protein, 23 aa, Mycobacterium
ERAKEAFELRASRHSWREVADRL

SEQ ID NO: 655224 - protein, 29 aa, Mycobacterium
ERALAGLAWPDARLVAAAVSFDVCTAPDP

SEQ ID NO: 655225 - protein, 17 aa, Mycobacterium
ERALALFGTCPVADRAL

SEQ ID NO: 655226 - protein, 18 aa, Mycobacterium
ERALASALHVSRTTVTTA

SEQ ID NO: 655227 - protein, 18 aa, Mycobacterium
ERALELGADYAFDTRDDG

SEQ ID NO: 655228 - protein, 19 aa, Mycobacterium
ERALLAGDFVRGFVGLDNH

SEQ ID NO: 655229 - protein, 18 aa, Mycobacterium
ERAMSPSVWSYVAGGAGD

SEQ ID NO: 655230 - protein, 18 aa, Mycobacterium
ERAMSPSVWSYVTGGAGD

SEQ ID NO: 655231 - protein, 20 aa, Mycobacterium
ERANDLWLSAPRPLLATAEA

SEQ ID NO: 655232 - protein, 28 aa, Mycobacterium
ERANRKDLRWHDLRHSGAVLAAATGATL

SEQ ID NO: 655233 - protein, 19 aa, Mycobacterium
ERAPAPALHRLTVSALRAV

SEQ ID NO: 655234 - protein, 19 aa, Mycobacterium
ERAPAVALHRLTVGALRAI

SEQ ID NO: 655235 - protein, 17 aa, Mycobacterium
ERAPFPFEGRIHTVHVA

SEQ ID NO: 655236 - protein, 24 aa, Mycobacterium
ERARDVWYNRILPFAHNLSERRIV

SEQ ID NO: 655237 - protein, 23 aa, Mycobacterium
ERAREAVAYADWMTRNGYDAFET

SEQ ID NO: 655238 - protein, 17 aa, Mycobacterium
ERARGAVVSGALNPAQQ

SEQ ID NO: 655239 - protein, 19 aa, Mycobacterium
ERARLVDRLGRFADLADEY

SEQ ID NO: 655240 - protein, 18 aa, Mycobacterium
ERARRKFDEYSRVDWQVI

SEQ ID NO: 655241 - protein, 24 aa, Mycobacterium
ERARSEFSATAWLARLRTTYLEAM

SEQ ID NO: 655242 - protein, 22 aa, Mycobacterium
ERARSRGKLVPGARIVESTSGT

SEQ ID NO: 655243 - protein, 19 aa, Mycobacterium
ERARVRLCYSAPAPAPARH

SEQ ID NO: 655244 - protein, 17 aa, Mycobacterium
ERASEKELLAWALDDLA

SEQ ID NO: 655245 - protein, 18 aa, Mycobacterium
ERASFCRFDIPTRLLDQR

SEQ ID NO: 655246 - protein, 21 aa, Mycobacterium
ERATAGFGWSRPGRSALADNT

SEQ ID NO: 655247 - protein, 26 aa, Mycobacterium
ERATCAPWLAAEWRLVGPSVAVIVAL

SEQ ID NO: 655248 - protein, 21 aa, Mycobacterium
ERATTGFGWSRPGRSALAGNI

SEQ ID NO: 655249 - protein, 21 aa, Mycobacterium
ERATTGFGWSRPGRSALAGNT

SEQ ID NO: 655250 - protein, 32 aa, Mycobacterium; identical to SEQ ID NO: 96250

SEQ ID NO: 655251 - protein, 32 aa, Mycobacterium
ERAVARGSFFPVIPVCSTTGVGTYELLEVATR

SEQ ID NO: 655252 - protein, 27 aa, Mycobacterium
ERAVEAWRGFSRWLMRAYDVLVDEDQI

SEQ ID NO: 655253 - protein, 21 aa, Mycobacterium
ERAVFVLREVFGFDYAEIADA

SEQ ID NO: 655254 - protein, 24 aa, Mycobacterium
ERAVFVLREVFGFDYDEIADAVGK

SEQ ID NO: 655255 - protein, 24 aa, Mycobacterium
ERAVFVLREVFGFDYGEIAEAVGK

SEQ ID NO: 655256 - protein, 24 aa, Mycobacterium
ERAVFVLREVFGFDYGEIAQAVGK

SEQ ID NO: 655257 - protein, 20 aa, Mycobacterium
ERAVFVLREVFGFGHDEIAA

SEQ ID NO: 655258 - protein, 25 aa, Mycobacterium
ERAVFVLREVFGFGYDEIAGAVSKS

SEQ ID NO: 655259 - protein, 26 aa, Mycobacterium
ERAVPVLACGAYRLVELHRLADVAVP

SEQ ID NO: 655260 - protein, 29 aa, Mycobacterium
ERAVRAWRSFSCWLMRAYDILVDEDQIAQ

SEQ ID NO: 655261 - protein, 29 aa, Mycobacterium
ERAVRAWRSFSCWLMRAYDVLVDEDQIAQ

SEQ ID NO: 655262 - protein, 19 aa, Mycobacterium
ERAVTEWGRQNWRLPDYET

SEQ ID NO: 655263 - protein, 19 aa, Mycobacterium
ERCAGWDPVARMQYLDLFT

SEQ ID NO: 655264 - protein, 22 aa, Mycobacterium
ERCARVAGIALRHAKLRSIPPG

SEQ ID NO: 655265 - protein, 23 aa, Mycobacterium
ERCEGFEEWAEFIAREENSPEAV

SEQ ID NO: 655266 - protein, 21 aa, Mycobacterium
ERDARAAGVEWGRELLDERNH

SEQ ID NO: 655267 - protein, 25 aa, Mycobacterium
ERDAWYEAYFAWELALLKETEGDPF

SEQ ID NO: 655268 - protein, 22 aa, Mycobacterium
ERDCAYYTTLIMWVGCHADSHE

SEQ ID NO: 655269 - protein, 19 aa, Mycobacterium
ERDEALLILLRAGVTNEAV

SEQ ID NO: 655270 - protein, 17 aa, Mycobacterium
ERDEALVRLADAYGQEA

SEQ ID NO: 655271 - protein, 18 aa, Mycobacterium
ERDGIAFVPYFPLATGGL

SEQ ID NO: 655272 - protein, 18 aa, Mycobacterium
ERDGIDWRTLGDRETQLF

SEQ ID NO: 655273 - protein, 17 aa, Mycobacterium
ERDGQWVLASGVQAMVE

SEQ ID NO: 655274 - protein, 24 aa, Mycobacterium
ERDGRIWLERGCPTHGLVRTLYDE

SEQ ID NO: 655275 - protein, 24 aa, Mycobacterium
ERDKEFYARLEAAGFELDFGDDDS

SEQ ID NO: 655276 - protein, 17 aa, Mycobacterium
ERDKWWANFDRLAPTAV

SEQ ID NO: 655277 - protein, 23 aa, Mycobacterium
ERDLRETGFWRFVNDPDDPSESQ

SEQ ID NO: 655278 - protein, 23 aa, Mycobacterium
ERDRELFAALVVPIFTSTDTTVL

SEQ ID NO: 655279 - protein, 24 aa, Mycobacterium
ERDRLAALRWRHFDAEQVGTTLGA

SEQ ID NO: 655280 - protein, 19 aa, Mycobacterium
ERDRMAAASEAKRQNLMRK

SEQ ID NO: 655281 - protein, 24 aa, Mycobacterium
ERDRPLWLMWVVEGLAEGKVALVM

SEQ ID NO: 655282 - protein, 21 aa, Mycobacterium
ERDRRAIAMGRRGRPDEVAGV

SEQ ID NO: 655283 - protein, 18 aa, Mycobacterium
ERDRVLARMAARSVTKSR

SEQ ID NO: 655284 - protein, 20 aa, Mycobacterium
ERDRVREVIDPVVVVDEASR

SEQ ID NO: 655285 - protein, 27 aa, Mycobacterium
ERDTCWPWLQAEWQLVADHVRVVVALG

SEQ ID NO: 655286 - protein, 20 aa, Mycobacterium
ERDVFWCTADIGWVTGHTYG

SEQ ID NO: 655287 - protein, 23 aa, Mycobacterium
ERDWAPKVYGAWNLHTATASQPL

SEQ ID NO: 655288 - protein, 20 aa, Mycobacterium
EREAFCSGPGELLDALIEHW

SEQ ID NO: 655289 - protein, 17 aa, Mycobacterium
ERECAQLGAYLVTESVP

SEQ ID NO: 655290 - protein, 20 aa, Mycobacterium
EREEVFTPDGYYRTGDCGVE

SEQ ID NO: 655291 - protein, 29 aa, Mycobacterium
EREFADAFPKFMWKPSREVARAGVDALES

SEQ ID NO: 655292 - protein, 22 aa, Mycobacterium
EREFTEVFTVLFPGGEGRLRLT

SEQ ID NO: 655293 - protein, 23 aa, Mycobacterium
EREGRAVWRPTGYDNVRLPFNNQ

SEQ ID NO: 655294 - protein, 29 aa, Mycobacterium
EREGVNLTFLPFFAKAAVEALKTHPNVNA

SEQ ID NO: 655295 - protein, 18 aa, Mycobacterium
EREHANLLAAQRAAAADT

SEQ ID NO: 655296 - protein, 25 aa, Mycobacterium
EREHWWKLAVEAYPPYAEYQTKTDR

SEQ ID NO: 655297 - protein, 18 aa, Mycobacterium
ERELDVTLIHRGQNFEGL

SEQ ID NO: 655298 - protein, 24 aa, Mycobacterium
ERELKAALQSNARAGGAHRVAVVN

SEQ ID NO: 655299 - protein, 22 aa, Mycobacterium
ERELLEGLSVLAKVTALCTEMT

SEQ ID NO: 655300 - protein, 21 aa, Mycobacterium
ERELSQLIAMIVTINAWNRIN

SEQ ID NO: 655301 - protein, 25 aa, Mycobacterium
ERELWSGDATFVFTRTTAGEIGILP

SEQ ID NO: 655302 - protein, 21 aa, Mycobacterium
ERENGAILLCCTFARSDLVIE

SEQ ID NO: 655303 - protein, 23 aa, Mycobacterium
EREPETMWEWVLQRHRRAMKALK

SEQ ID NO: 655304 - protein, 24 aa, Mycobacterium
ERERITGIVGWPAFTQRLREHPTF

SEQ ID NO: 655305 - protein, 19 aa, Mycobacterium
ERERLVAIESLWDAGSQAL

SEQ ID NO: 655306 - protein, 24 aa, Mycobacterium
ERERPRISLGPLTVAEHLRDYTAG

SEQ ID NO: 655307 - protein, 20 aa, Mycobacterium
ERESGELYLFSGRLENSVFI

SEQ ID NO: 655308 - protein, 22 aa, Mycobacterium
ERESGIEFGRYLAEAVFQPLGM

SEQ ID NO: 655309 - protein, 25 aa, Mycobacterium
ERESRAALVGADLAHRVNVARRRTP

SEQ ID NO: 655310 - protein, 24 aa, Mycobacterium
ERESRGMLHHRWVEKEAAGVVGAI

SEQ ID NO: 655311 - protein, 26 aa, Mycobacterium
ERETWSRFARRSFLSEGRRSVSNMGS

SEQ ID NO: 655312 - protein, 24 aa, Mycobacterium
EREVLGPFPTDRGWAVRDLLDGSR

SEQ ID NO: 655313 - protein, 18 aa, Mycobacterium
EREVRFYGDIAPRLGGPI

SEQ ID NO: 655314 - protein, 23 aa, Mycobacterium
EREYWIRRSWRSTGASIREILLV

SEQ ID NO: 655315 - protein, 19 aa, Mycobacterium
ERFAASRYTIREALRRLRE

SEQ ID NO: 655316 - protein, 31 aa, Mycobacterium
ERFAEFYRRWSLVTTRVWPTLLQPLRTRAQM

SEQ ID NO: 655317 - protein, 18 aa, Mycobacterium
ERFARLAVDLITEVVEGR

SEQ ID NO: 655318 - protein, 24 aa, Mycobacterium
ERFARRIAAHIVRRRARQPFASTA

SEQ ID NO: 655319 - protein, 19 aa, Mycobacterium
ERFARRIADEIVRRRANEP

SEQ ID NO: 655320 - protein, 18 aa, Mycobacterium
ERFARRIAERIVRQRAHT

SEQ ID NO: 655321 - protein, 20 aa, Mycobacterium
ERFAVSRYTIREALRRLRED

SEQ ID NO: 655322 - protein, 21 aa, Mycobacterium
ERFDGCWPALVDRAKHEKVVA

SEQ ID NO: 655323 - protein, 25 aa, Mycobacterium
ERFDGLKFVWGDGAADFVTPFIWRM

SEQ ID NO: 655324 - protein, 21 aa, Mycobacterium
ERFDIDAIAAFGLLAKLSQDT

SEQ ID NO: 655325 - protein, 20 aa, Mycobacterium
ERFDINAVAAFELLRRLSQE

SEQ ID NO: 655326 - protein, 19 aa, Mycobacterium
ERFGIPLAALHFFPAAALE

SEQ ID NO: 655327 - protein, 20 aa, Mycobacterium
ERFGLFAAFEIANTRDGDEA

SEQ ID NO: 655328 - protein, 28 aa, Mycobacterium
ERFGRMSFQPDLCAQVPIVGLVGESSFT

SEQ ID NO: 655329 - protein, 18 aa, Mycobacterium
ERFLRGGRLYTLGNGGSS

SEQ ID NO: 655330 - protein, 20 aa, Mycobacterium
ERFNAALAPLGWAPTYMQPS

SEQ ID NO: 655331 - protein, 22 aa, Mycobacterium
ERFPEVRAAGAGSRRDTRVLRG

SEQ ID NO: 655332 - protein, 25 aa, Mycobacterium
ERFQAARWMWDYFIDLIASRRRNLG

SEQ ID NO: 655333 - protein, 17 aa, Mycobacterium
ERFRHWAATLLTHQHEA

SEQ ID NO: 655334 - protein, 27 aa, Mycobacterium
ERFRLKSEPHWYPYVPRMSRLQKRLIR

SEQ ID NO: 655335 - protein, 25 aa, Mycobacterium
ERFRRGRDRIPLTGRIAVIVDDGIA

SEQ ID NO: 655336 - protein, 17 aa, Mycobacterium
ERFSIPIAQVSPREVAE

SEQ ID NO: 655337 - protein, 20 aa, Mycobacterium
ERFSPFSGFGYFAGGMSGFA

SEQ ID NO: 655338 - protein, 20 aa, Mycobacterium
ERFTLLRPLLFTIAYEILGS

SEQ ID NO: 655339 - protein, 25 aa, Mycobacterium
ERFTMLRPLLFTIAYEILGSVTEAD

SEQ ID NO: 655340 - protein, 17 aa, Mycobacterium
ERFVLRPRHIEVQVLAD

SEQ ID NO: 655341 - protein, 20 aa, Mycobacterium
ERGADGWRLDAAYTVPERFW

SEQ ID NO: 655342 - protein, 20 aa, Mycobacterium
ERGAQFPVWAGHYGGDAVWD

SEQ ID NO: 655343 - protein, 25 aa, Mycobacterium
ERGARPGRCVAVLMERSAPAIVAIV

SEQ ID NO: 655344 - protein, 18 aa, Mycobacterium
ERGARWRPWRSYATQYLW

SEQ ID NO: 655345 - protein, 23 aa, Mycobacterium
ERGCLKLSSRLLLNLIRGLPEDS

SEQ ID NO: 655346 - protein, 23 aa, Mycobacterium
ERGDFPSWTLKMQIMGFEEAKSY

SEQ ID NO: 655347 - protein, 19 aa, Mycobacterium
ERGDYRWTAGNSRFNPGMF

SEQ ID NO: 655348 - protein, 23 aa, Mycobacterium
ERGEALAAIAHPQFRDALRAAAT

SEQ ID NO: 655349 - protein, 24 aa, Mycobacterium
ERGEALLPQVVDWDSAGILPANPD

SEQ ID NO: 655350 - protein, 21 aa, Mycobacterium
ERGEEVCAVLVPSGDTVDTAT

SEQ ID NO: 655351 - protein, 17 aa, Mycobacterium
ERGEIPVAVKSVLDRRL

SEQ ID NO: 655352 - protein, 22 aa, Mycobacterium
ERGEITIDFVVHGELGVAGPWA

SEQ ID NO: 655353 - protein, 17 aa, Mycobacterium
ERGELRADLDFELAQDL

SEQ ID NO: 655354 - protein, 17 aa, Mycobacterium
ERGEVRGKLALVTGAGA

SEQ ID NO: 655355 - protein, 23 aa, Mycobacterium
ERGEWTAAGLTDCYLRRIREIDQ

SEQ ID NO: 655356 - protein, 18 aa, Mycobacterium
ERGFKAVMADAVGEALAK

SEQ ID NO: 655357 - protein, 17 aa, Mycobacterium
ERGGLRASVYAAVDAAK

SEQ ID NO: 655358 - protein, 23 aa, Mycobacterium
ERGHFAVDIVVVFADGVVRKRID

SEQ ID NO: 655359 - protein, 17 aa, Mycobacterium
ERGHFGGAAVSEIYSTG

SEQ ID NO: 655360 - protein, 23 aa, Mycobacterium
ERGIPGAIYRPGMVSGLSDGTYH

SEQ ID NO: 655361 - protein, 18 aa, Mycobacterium
ERGIPLTMEMAKFIRFIV

SEQ ID NO: 655362 - protein, 24 aa, Mycobacterium
ERGIPYRRGEVLVAVAGEHLSAVV

SEQ ID NO: 655363 - protein, 34 aa, Mycobacterium
ERGKKLTFELARFVKFMITEIFPGGRLPTTQMMV

SEQ ID NO: 655364 - protein, 23 aa, Mycobacterium
ERGKQSAVALCVWHDAVRLGDTR

SEQ ID NO: 655365 - protein, 20 aa, Mycobacterium
ERGLHHMVWEVVDNGVDEAM

SEQ ID NO: 655366 - protein, 18 aa, Mycobacterium
ERGLLLTTLWYIREVDPA

SEQ ID NO: 655367 - protein, 18 aa, Mycobacterium
ERGLLLTTLWYIREVDPT

SEQ ID NO: 655368 - protein, 21 aa, Mycobacterium
ERGLLLTTLWYIRVVDPTVLL

SEQ ID NO: 655369 - protein, 31 aa, Mycobacterium
ERGLLRRYLTFDLDGGAAWEPIADVHLQRDE

SEQ ID NO: 655370 - protein, 24 aa, Mycobacterium
ERGLPITMTKLRFMKFIMDEIFPG

SEQ ID NO: 655371 - protein, 24 aa, Mycobacterium
ERGLRETGFWRFVSDPDDPSESQA

SEQ ID NO: 655372 - protein, 19 aa, Mycobacterium
ERGLRLSGFEVNTASDGAE

SEQ ID NO: 655373 - protein, 17 aa, Mycobacterium
ERGLRRVLTEGGPGILG

SEQ ID NO: 655374 - protein, 19 aa, Mycobacterium
ERGMPIKTLHVPAGLVQVS

SEQ ID NO: 655375 - protein, 33 aa, Mycobacterium
ERGNAVLRYELQWPSPRAGFGACHDSCLALVFG

SEQ ID NO: 655376 - protein, 20 aa, Mycobacterium
ERGPEMLSFVLKHTPLKMCW

SEQ ID NO: 655377 - protein, 25 aa, Mycobacterium
ERGPMPPYAVAAVLRPVLGGLAAAH

SEQ ID NO: 655378 - protein, 33 aa, Mycobacterium
ERGRDALRALPLVGRLAYRVMHSVKAGIKDSLS

SEQ ID NO: 655379 - protein, 17 aa, Mycobacterium
ERGRDGCRVPLPWSGDA

SEQ ID NO: 655380 - protein, 24 aa, Mycobacterium
ERGRDGCRVPMPWAGTAPPFGFSS

SEQ ID NO: 655381 - protein, 28 aa, Mycobacterium
ERGRIKQMLLKIGWPAEDLAGYVDGEAH

SEQ ID NO: 655382 - protein, 17 aa, Mycobacterium
ERGRLGLPLDTVAISGR

SEQ ID NO: 655383 - protein, 18 aa, Mycobacterium
ERGRPRWVQAGVQRLEPA

SEQ ID NO: 655384 - protein, 26 aa, Mycobacterium
ERGRSARAWLFTVARNMIIDDRRSAR

SEQ ID NO: 655385 - protein, 17 aa, Mycobacterium
ERGRVGGALVTEIYSVG

SEQ ID NO: 655386 - protein, 28 aa, Mycobacterium
ERGRVKQLLLKIGWPAEDLAGYVNGEAH

SEQ ID NO: 655387 - protein, 18 aa, Mycobacterium
ERGRVLGEAVALLRDMLN

SEQ ID NO: 655388 - protein, 26 aa, Mycobacterium
ERGTPPWWPMRQLVRALGADADEVLE

SEQ ID NO: 655389 - protein, 18 aa, Mycobacterium
ERGTRVAVLAVDPSSPFS

SEQ ID NO: 655390 - protein, 18 aa, Mycobacterium
ERGVPVAALVGAREHALK

SEQ ID NO: 655391 - protein, 18 aa, Mycobacterium
ERGVRIGAQVGYRDLAGF

SEQ ID NO: 655392 - protein, 19 aa, Mycobacterium
ERGWACVREELEVGLNAVA

SEQ ID NO: 655393 - protein, 19 aa, Mycobacterium
ERGYFLDRSFRMHPAVCHA

SEQ ID NO: 655394 - protein, 17 aa, Mycobacterium
ERHAKAGVMTPVSACAS

SEQ ID NO: 655395 - protein, 19 aa, Mycobacterium
ERHEDGFFYIKGRSSEMII

SEQ ID NO: 655396 - protein, 25 aa, Mycobacterium
ERHGAGWRWRNDRLGITQDFVIGDE

SEQ ID NO: 655397 - protein, 19 aa, Mycobacterium
ERHGDGVFTVVIGVPEASR

SEQ ID NO: 655398 - protein, 25 aa, Mycobacterium
ERHGPEFAKRFGLGFSAEDREENIR

SEQ ID NO: 655399 - protein, 24 aa, Mycobacterium
ERHPEIFRLASPIAQVHADAPPFL

SEQ ID NO: 655400 - protein, 26 aa, Mycobacterium
ERHPIGAQVLDWSRAQTAIMAPTAQA

SEQ ID NO: 655401 - protein, 22 aa, Mycobacterium
ERHQELDGSGFVRSVDHADRIQ

SEQ ID NO: 655402 - protein, 23 aa, Mycobacterium
ERHQRLWPLVALAAARADISTFY

SEQ ID NO: 655403 - protein, 18 aa, Mycobacterium
ERHTAAAVRRELDQTRRA

SEQ ID NO: 655404 - protein, 20 aa, Mycobacterium
ERHTWACGPEGMLTQAEKIW

SEQ ID NO: 655405 - protein, 30 aa, Mycobacterium
ERHVSRGKLLPRDRVDGLLDPGSPFLELAA

SEQ ID NO: 655406 - protein, 24 aa, Mycobacterium
ERHYRDCRILGIGGGTNEIMNEVI

SEQ ID NO: 655407 - protein, 19 aa, Mycobacterium
ERIAPLGVVVVGVIPMVDR

SEQ ID NO: 655408 - protein, 24 aa, Mycobacterium
ERIAPRPTTPFAQALRLALIDAAP

SEQ ID NO: 655409 - protein, 27 aa, Mycobacterium
ERIARLPVDLFRYEVLMTLRPLPDEAI

SEQ ID NO: 655410 - protein, 26 aa, Mycobacterium
ERIASAAGVLAEWMAGAGAEVEVAEV

SEQ ID NO: 655411 - protein, 22 aa, Mycobacterium
ERIDAEYALYFTGTGRPTGEWA

SEQ ID NO: 655412 - protein, 17 aa, Mycobacterium
ERIDEIADNAAVLVSVR

SEQ ID NO: 655413 - protein, 18 aa, Mycobacterium
ERIDRVAVITLNRPKALN

SEQ ID NO: 655414 - protein, 17 aa, Mycobacterium
ERIELFENIYVPVAPDA

SEQ ID NO: 655415 - protein, 23 aa, Mycobacterium
ERIETVLPFSWQGVSLYAAGASR

SEQ ID NO: 655416 - protein, 25 aa, Mycobacterium
ERIGCTPAQVALAWTLSVAPNVLLI

SEQ ID NO: 655417 - protein, 24 aa, Mycobacterium
ERIGFAARHIWDGSAGRVLAHATS

SEQ ID NO: 655418 - protein, 19 aa, Mycobacterium
ERIGNVWLVAQRMSSEMTP

SEQ ID NO: 655419 - protein, 18 aa, Mycobacterium
ERIGSLVPLGRPGDIDEI

SEQ ID NO: 655420 - protein, 19 aa, Mycobacterium
ERIKALIATKCRGEKAPEG

SEQ ID NO: 655421 - protein, 17 aa, Mycobacterium
ERIKLLIATKCQGEKAP

SEQ ID NO: 655422 - protein, 18 aa, Mycobacterium
ERILLCGSGSRRGGAVSG

SEQ ID NO: 655423 - protein, 24 aa, Mycobacterium
ERILRGRTGALIVIGYDDSVETIC

SEQ ID NO: 655424 - protein, 24 aa, Mycobacterium
ERILRGRTGALIVLGYDDKVESIC

SEQ ID NO: 655425 - protein, 18 aa, Mycobacterium
ERILRQTVIALREGAELG

SEQ ID NO: 655426 - protein, 27 aa, Mycobacterium
ERILTWRHVYDLEELPEHLIIVGSGVT

SEQ ID NO: 655427 - protein, 21 aa, Mycobacterium
ERILTWRQLYDLDELPEHLIV

SEQ ID NO: 655428 - protein, 17 aa, Mycobacterium
ERILYYTGVNYKIGETH

SEQ ID NO: 655429 - protein, 18 aa, Mycobacterium
ERILYYTGVNYKIGETHD

SEQ ID NO: 655430 - protein, 18 aa, Mycobacterium
ERINRWRVATAEASYSVV

SEQ ID NO: 655431 - protein, 21 aa, Mycobacterium
ERIPAALLAPFITRGAFIATF

SEQ ID NO: 655432 - protein, 23 aa, Mycobacterium
ERIPEIVEALVIGAEQPDGGYWM

SEQ ID NO: 655433 - protein, 17 aa, Mycobacterium
ERIPISIAALGPKNVEL

SEQ ID NO: 655434 - protein, 23 aa, Mycobacterium
ERIPPRTALELFFGTAQDPAHPR

SEQ ID NO: 655435 - protein, 19 aa, Mycobacterium
ERIQTWAAPYYERSGDAFS

SEQ ID NO: 655436 - protein, 26 aa, Mycobacterium
ERIRACPRFAQRLRRYPFDLGAPQWV

SEQ ID NO: 655437 - protein, 26 aa, Mycobacterium
ERIRACPRFGQRLRLHPLDLGAPEWV

SEQ ID NO: 655438 - protein, 21 aa, Mycobacterium
ERIRELVILRTAYRAGCVYEW

SEQ ID NO: 655439 - protein, 23 aa, Mycobacterium
ERIRERLAKKGWPLDDPREPADH

SEQ ID NO: 655440 - protein, 25 aa, Mycobacterium
ERIRLCPRFGQRLRTRPFDLGAPVW

SEQ ID NO: 655441 - protein, 28 aa, Mycobacterium
ERIRNGWYWTGDLGYRDEAGFLYFAGRR

SEQ ID NO: 655442 - protein, 23 aa, Mycobacterium
ERIRRLCAAERAAVCDLANQPPF

SEQ ID NO: 655443 - protein, 22 aa, Mycobacterium
ERISTRTAAEWVRILNDVDVPV

SEQ ID NO: 655444 - protein, 31 aa, Mycobacterium
ERISVPYFFNPRLDAAIPVLALPDELAAQAR

SEQ ID NO: 655445 - protein, 23 aa, Mycobacterium
ERITAEGGRRAEIYRALKDLADT

SEQ ID NO: 655446 - protein, 20 aa, Mycobacterium
ERITARLAGLNDRSGPSAGR

SEQ ID NO: 655447 - protein, 26 aa, Mycobacterium
ERIYPGRFRLGIGAGHPESAKRYDKP

SEQ ID NO: 655448 - protein, 21 aa, Mycobacterium
ERIYREVRLLRLYEGTSEIQR

SEQ ID NO: 655449 - protein, 31 aa, Mycobacterium
ERKDGEMRYTRTLTIQACWEAGKQPPNTDDN

SEQ ID NO: 655450 - protein, 20 aa, Mycobacterium
ERKDRMFGTWHYWWQAHLLD

SEQ ID NO: 655451 - protein, 25 aa, Mycobacterium
ERKEVAALLRWLADGHFVLLGYQQC

SEQ ID NO: 655452 - protein, 27 aa, Mycobacterium
ERKFADAFPKFMWMPSREVARAGVDAL

SEQ ID NO: 655453 - protein, 22 aa, Mycobacterium
ERKGSLKGLRLAYFGDGANNMA

SEQ ID NO: 655454 - protein, 25 aa, Mycobacterium
ERKKAATRLAIRREAFRLFEDQGYA

SEQ ID NO: 655455 - protein, 23 aa, Mycobacterium
ERKLIGGTCVNNGCIPTKTLVAS

SEQ ID NO: 655456 - protein, 23 aa, Mycobacterium
ERKLIGGTCVNTGCIPTKTLVAS

SEQ ID NO: 655457 - protein, 26 aa, Mycobacterium
ERKLVGGTCVNYGCIPTKTLVASAHA

SEQ ID NO: 655458 - protein, 25 aa, Mycobacterium
ERKNKLRGGAVFAPVFDPVQVEVGF

SEQ ID NO: 655459 - protein, 26 aa, Mycobacterium
ERKPTGYDWFVLWTLSPDSLHVLEVY

SEQ ID NO: 655460 - protein, 20 aa, Mycobacterium
ERKPTVAWAETYPGTMSYYL

SEQ ID NO: 655461 - protein, 19 aa, Mycobacterium
ERKTLRLVAQYGDACNLFA

SEQ ID NO: 655462 - protein, 25 aa, Mycobacterium
ERKVMRCFEAGALASGAELIVTPES

SEQ ID NO: 655463 - protein, 17 aa, Mycobacterium
ERKWRWYYLPIARPRGH

SEQ ID NO: 655464 - protein, 19 aa, Mycobacterium
ERLAALVGRLVSSGVHAIA

SEQ ID NO: 655465 - protein, 18 aa, Mycobacterium
ERLAELDAAFLDFLTTWN

SEQ ID NO: 655466 - protein, 20 aa, Mycobacterium
ERLAEWKDKGGLAIVTFSAL

SEQ ID NO: 655467 - protein, 32 aa, Mycobacterium
ERLAFYRTLYRDHARYGAALWVVAANMASYSD

SEQ ID NO: 655468 - protein, 20 aa, Mycobacterium
ERLAKAFGPVRVAIAAEQAH

SEQ ID NO: 655469 - protein, 17 aa, Mycobacterium
ERLALAFGNFNKTSERP

SEQ ID NO: 655470 - protein, 18 aa, Mycobacterium
ERLARREAPVAASEAALA

SEQ ID NO: 655471 - protein, 24 aa, Mycobacterium
ERLARSTGGISVRAPGPAGGDDMP

SEQ ID NO: 655472 - protein, 24 aa, Mycobacterium
ERLATEGARFGLRRDAIVPAYGMA

SEQ ID NO: 655473 - protein, 19 aa, Mycobacterium
ERLATGHGWRIGVVAQAHA

SEQ ID NO: 655474 - protein, 24 aa, Mycobacterium
ERLDDLHCLDAFAGQVDAPLVVKA

SEQ ID NO: 655475 - protein, 22 aa, Mycobacterium
ERLDDLRLFRAVVEAARTYATE

SEQ ID NO: 655476 - protein, 22 aa, Mycobacterium
ERLDEWGNRAVLAQRPTGQESI

SEQ ID NO: 655477 - protein, 24 aa, Mycobacterium
ERLDLDALTAWIAGCHHAGRPVAV

SEQ ID NO: 655478 - protein, 17 aa, Mycobacterium
ERLDRWASSQGETVTVV

SEQ ID NO: 655479 - protein, 25 aa, Mycobacterium
ERLDVWSLTDIVAFSRGTYGGASIV

SEQ ID NO: 655480 - protein, 18 aa, Mycobacterium
ERLEELLGLAHEVRMRWC

SEQ ID NO: 655481 - protein, 25 aa, Mycobacterium
ERLEKICRLIMLYHLDRGWCEHLAF

SEQ ID NO: 655482 - protein, 19 aa, Mycobacterium
ERLERGWRALGERKGPLLV

SEQ ID NO: 655483 - protein, 19 aa, Mycobacterium
ERLERLTAHLHDRWQRDPR

SEQ ID NO: 655484 - protein, 29 aa, Mycobacterium
ERLGAGIPKAFCEVAGRTLLDRAVEGLLE

SEQ ID NO: 655485 - protein, 21 aa, Mycobacterium
ERLGALVLTSCDAFEHFPPPI

SEQ ID NO: 655486 - protein, 24 aa, Mycobacterium
ERLGLDPQVFWEICSVSSARSWAQ

SEQ ID NO: 655487 - protein, 26 aa, Mycobacterium
ERLGMAVRILERFPSRLALPKAHVVG

SEQ ID NO: 655488 - protein, 24 aa, Mycobacterium
ERLGRRCGHPEWIAAGRFARQYEQ

SEQ ID NO: 655489 - protein, 30 aa, Mycobacterium
ERLGVRPAGLWAFEALRVAATRPRLTLDTD

SEQ ID NO: 655490 - protein, 24 aa, Mycobacterium
ERLHTRIAAVMGYADRSAVDASMP

SEQ ID NO: 655491 - protein, 18 aa, Mycobacterium
ERLHWRRQLAGANFGADP

SEQ ID NO: 655492 - protein, 24 aa, Mycobacterium
ERLIGRPLFGSSLEASSASGAVGA

SEQ ID NO: 655493 - protein, 18 aa, Mycobacterium
ERLIVAVGAVAAMELALQ

SEQ ID NO: 655494 - protein, 17 aa, Mycobacterium
ERLIVAVGAVAAMELAV

SEQ ID NO: 655495 - protein, 22 aa, Mycobacterium
ERLKAAVDVFKEKLVRRDISMK

SEQ ID NO: 655496 - protein, 18 aa, Mycobacterium
ERLKGLFMASFEAIEHRH

SEQ ID NO: 655497 - protein, 19 aa, Mycobacterium
ERLKGLFMASFEAIEHRHA

SEQ ID NO: 655498 - protein, 17 aa, Mycobacterium
ERLLAAIAQRNRGGVNS

SEQ ID NO: 655499 - protein, 17 aa, Mycobacterium
ERLLGERGFSLGHFPQS

SEQ ID NO: 655500 - protein, 18 aa, Mycobacterium
ERLLGLDLANGGHLTHGM

SEQ ID NO: 655501 - protein, 26 aa, Mycobacterium
ERLLRAHRGLKLLLMAWARYEDEQPS

SEQ ID NO: 655502 - protein, 17 aa, Mycobacterium
ERLLRARLGEARPQDSV

SEQ ID NO: 655503 - protein, 24 aa, Mycobacterium
ERLLRGFLTPALWDAGLYCRADDR

SEQ ID NO: 655504 - protein, 24 aa, Mycobacterium
ERLLRGFLTPALWEAGLYCRADDR

SEQ ID NO: 655505 - protein, 20 aa, Mycobacterium
ERLLRLGARPADIGQTGQEQ

SEQ ID NO: 655506 - protein, 20 aa, Mycobacterium
ERLLRPLLELVPIHHVAFGR

SEQ ID NO: 655507 - protein, 17 aa, Mycobacterium
ERLLRSRLAQLRPGDPI

SEQ ID NO: 655508 - protein, 18 aa, Mycobacterium
ERLMRDAPFLLIGEGTSE

SEQ ID NO: 655509 - protein, 20 aa, Mycobacterium
ERLMRLPALSTRATPEGRER

SEQ ID NO: 655510 - protein, 24 aa, Mycobacterium
ERLMSTGFLPAVWRSDDVVVRNAE

SEQ ID NO: 655511 - protein, 21 aa, Mycobacterium
ERLNAWGPDISRGFYASIDRA

SEQ ID NO: 655512 - protein, 23 aa, Mycobacterium
ERLNGHRGCVIWFTGLSASGKST

SEQ ID NO: 655513 - protein, 19 aa, Mycobacterium
ERLPAYMVPVAVVVLDALP

SEQ ID NO: 655514 - protein, 18 aa, Mycobacterium
ERLPKVLIHHNVAGQPIH

SEQ ID NO: 655515 - protein, 17 aa, Mycobacterium
ERLPKVLIHHNVEGQPI

SEQ ID NO: 655516 - protein, 25 aa, Mycobacterium
ERLPLSSSQLSMWFECQMEGVTDIG

SEQ ID NO: 655517 - protein, 23 aa, Mycobacterium
ERLPRYIGSVLARLQEVWIGRQI

SEQ ID NO: 655518 - protein, 25 aa, Mycobacterium
ERLPSMPQLRWRVTDVPLGLDRPWF

SEQ ID NO: 655519 - protein, 18 aa, Mycobacterium
ERLQDIPMSAPVVVVGGG

SEQ ID NO: 655520 - protein, 29 aa, Mycobacterium
ERLQRISERWQRFGFNLNAADLFYRGERN

SEQ ID NO: 655521 - protein, 21 aa, Mycobacterium
ERLRARVDLLRECRCRLQQFD

SEQ ID NO: 655522 - protein, 24 aa, Mycobacterium
ERLRDAVPCPLVLHGSSGVPDETV

SEQ ID NO: 655523 - protein, 24 aa, Mycobacterium
ERLREILSALVSRCSGVVGHYGGT

SEQ ID NO: 655524 - protein, 20 aa, Mycobacterium
ERLRERFGFYIDRFDVHAES

SEQ ID NO: 655525 - protein, 17 aa, Mycobacterium
ERLRGAIEVARRVPARL

SEQ ID NO: 655526 - protein, 22 aa, Mycobacterium
ERLRGWRFYDGFRVDAGAPARH

SEQ ID NO: 655527 - protein, 17 aa, Mycobacterium
ERLRIGMQLPTTTQGAL

SEQ ID NO: 655528 - protein, 24 aa, Mycobacterium
ERLRLAFHAASLIMSRGPSSVAQA

SEQ ID NO: 655529 - protein, 21 aa, Mycobacterium
ERLRMLRSFDPRSGAHVLDVE

SEQ ID NO: 655530 - protein, 30 aa, Mycobacterium
ERLRNGPLEGLRLGLMHGRLSGDEKDEVMS

SEQ ID NO: 655531 - protein, 21 aa, Mycobacterium
ERLRNWRFYDGFRADADAPAR

SEQ ID NO: 655532 - protein, 23 aa, Mycobacterium
ERLRPHIRREGFGLIYETPTDEF

SEQ ID NO: 655533 - protein, 26 aa, Mycobacterium
ERLRQALEVFGPIFIQTYAGTEPGYV

SEQ ID NO: 655534 - protein, 23 aa, Mycobacterium
ERLRRHPAARALRVDKLTLAALE

SEQ ID NO: 655535 - protein, 23 aa, Mycobacterium
ERLRRHPEVLSRLVDEIDAGQTG

SEQ ID NO: 655536 - protein, 29 aa, Mycobacterium
ERLRRISERWQRFGFDLNAADLFYRGERN

SEQ ID NO: 655537 - protein, 25 aa, Mycobacterium
ERLRRWADEWRRMAAVAVSSADGPK

SEQ ID NO: 655538 - protein, 23 aa, Mycobacterium
ERLRSGAPLEEVLDYLGIPTSAR

SEQ ID NO: 655539 - protein, 18 aa, Mycobacterium
ERLRSLGARALGVPTHTG

SEQ ID NO: 655540 - protein, 20 aa, Mycobacterium
ERLRVDVGRDFPVRSHHQRR

SEQ ID NO: 655541 - protein, 18 aa, Mycobacterium
ERLSFAFVGAAEMAGCIM

SEQ ID NO: 655542 - protein, 17 aa, Mycobacterium
ERLSINLRWSWHKPTQD

SEQ ID NO: 655543 - protein, 18 aa, Mycobacterium
ERLSQRFLAYEGVMQKDK

SEQ ID NO: 655544 - protein, 23 aa, Mycobacterium
ERLSRLGGIVGTAFQIADDIIDI

SEQ ID NO: 655545 - protein, 30 aa, Mycobacterium
ERLSWARRTYRRWAAKHLHQARSLIRHNIR

SEQ ID NO: 655546 - protein, 25 aa, Mycobacterium
ERLTEGRFALFSGDFNGDPDVPKTD

SEQ ID NO: 655547 - protein, 21 aa, Mycobacterium
ERLTFDPAAFGFARAHVSELT

SEQ ID NO: 655548 - protein, 20 aa, Mycobacterium
ERLTGRRVYGTLPWHPDIWL

SEQ ID NO: 655549 - protein, 25 aa, Mycobacterium
ERLTRAEVNAGLYAHPERIGTLIGW

SEQ ID NO: 655550 - protein, 26 aa, Mycobacterium
ERLTRAWTGLRAMRSYALATLEAPAV

SEQ ID NO: 655551 - protein, 23 aa, Mycobacterium
ERLTRLLGMVRDCFALAPDAEIT

SEQ ID NO: 655552 - protein, 18 aa, Mycobacterium
ERLTWIMPRDSWLLDRAT

SEQ ID NO: 655553 - protein, 25 aa, Mycobacterium
ERLVAAMVARFHRWISPNHIVAVPY

SEQ ID NO: 655554 - protein, 19 aa, Mycobacterium
ERLVKAGVPAVVLNAKNDA

SEQ ID NO: 655555 - protein, 26 aa, Mycobacterium
ERLVQSWTGLQAMRSYALATMDVEQP

SEQ ID NO: 655556 - protein, 22 aa, Mycobacterium
ERLYPGRPGYRMVPASVTDPSW

SEQ ID NO: 655557 - protein, 26 aa, Mycobacterium
ERLYPRTAAELSSWGQGWLATCQQAF

SEQ ID NO: 655558 - protein, 19 aa, Mycobacterium
ERLYRLVDLVLPRVPGDSR

SEQ ID NO: 655559 - protein, 19 aa, Mycobacterium
ERMAFHSASYWDVTAELDA

SEQ ID NO: 655560 - protein, 25 aa, Mycobacterium
ERMASLRGLLKFKTGVRPPVPLDEV

SEQ ID NO: 655561 - protein, 23 aa, Mycobacterium
ERMCKTLPREAPWEATQAAAWDR

SEQ ID NO: 655562 - protein, 20 aa, Mycobacterium
ERMGVVLQMRDFVSAGTLTG

SEQ ID NO: 655563 - protein, 22 aa, Mycobacterium
ERMKPLRIEDHVVQQIWMPYHW

SEQ ID NO: 655564 - protein, 19 aa, Mycobacterium
ERMKTMSALVPHLQQALCT

SEQ ID NO: 655565 - protein, 17 aa, Mycobacterium
ERMKVAAAEAIFSVVEP

SEQ ID NO: 655566 - protein, 18 aa, Mycobacterium
ERMLPRGSGQVINVASLA

SEQ ID NO: 655567 - protein, 18 aa, Mycobacterium
ERMLRLITEQAPTAVLRL

SEQ ID NO: 655568 - protein, 20 aa, Mycobacterium
ERMNAMAFDVMLPFKQMLVD

SEQ ID NO: 655569 - protein, 28 aa, Mycobacterium
ERMQEVSARWRAHGFDVDMVGLVYFGDR

SEQ ID NO: 655570 - protein, 24 aa, Mycobacterium
ERMQFCSEFEWIAPSGRGLLTHYM

SEQ ID NO: 655571 - protein, 18 aa, Mycobacterium
ERMRLGALARHIAEELPR

SEQ ID NO: 655572 - protein, 19 aa, Mycobacterium
ERMRLGALARHIAQELPTL

SEQ ID NO: 655573 - protein, 21 aa, Mycobacterium
ERMSAGRAYELGLISEIVEHE

SEQ ID NO: 655574 - protein, 23 aa, Mycobacterium
ERMSARRFWVRYAAESAGSLTLD

SEQ ID NO: 655575 - protein, 17 aa, Mycobacterium
ERMSLGSLRLMRAEAPV

SEQ ID NO: 655576 - protein, 20 aa, Mycobacterium
ERMSNALVAMAIHSLGASAR

SEQ ID NO: 655577 - protein, 19 aa, Mycobacterium
ERMTRAGAVGLVVELGTRV

SEQ ID NO: 655578 - protein, 17 aa, Mycobacterium
ERMWPKVWQLACMLDHV

SEQ ID NO: 655579 - protein, 18 aa, Mycobacterium
ERNARLTAQFLETAAGGD

SEQ ID NO: 655580 - protein, 26 aa, Mycobacterium
ERNECGRLLLKFTVSSPYRCGLLHAD

SEQ ID NO: 655581 - protein, 18 aa, Mycobacterium
ERNHAAGFEGAMRALERG

SEQ ID NO: 655582 - protein, 26 aa, Mycobacterium
ERNHAMMLVRYLLDRDVHAEIPAIDP

SEQ ID NO: 655583 - protein, 24 aa, Mycobacterium
ERNLAWRAAELMAEHVGRAPDVEI

SEQ ID NO: 655584 - protein, 18 aa, Mycobacterium
ERNPRLVYARMTGYGQDG

SEQ ID NO: 655585 - protein, 23 aa, Mycobacterium
ERNRIKLLLVDDAQHLDPQAARL

SEQ ID NO: 655586 - protein, 30 aa, Mycobacterium
ERNTRGHIAFGHGIHYCLGAPLARMEGVTA

SEQ ID NO: 655587 - protein, 27 aa, Mycobacterium
ERNWGTGFPEHWWWGQAHDFDNADASV

SEQ ID NO: 655588 - protein, 30 aa, Mycobacterium
ERNWSALPLEWPLRGWINGALGVIRPRRRP

SEQ ID NO: 655589 - protein, 20 aa, Mycobacterium
ERNYYALERLWRDCPTIPVD

SEQ ID NO: 655590 - protein, 26 aa, Mycobacterium
ERPACIKAMIEKVVDRMYAEIDDNRF

SEQ ID NO: 655591 - protein, 24 aa, Mycobacterium
ERPAEAIAALLQRYPDAESVKLHP

SEQ ID NO: 655592 - protein, 28 aa, Mycobacterium
ERPAGAGALRFIRSCSAPLTAETAQALQ

SEQ ID NO: 655593 - protein, 41 aa, Mycobacterium
ERPANLFVAGFIGSPAMNFFPAVLTPTGLTLPFGEVTLDPQ

SEQ ID NO: 655594 - protein, 23 aa, Mycobacterium
ERPARPPVPYVLGNPSAAARRAC

SEQ ID NO: 655595 - protein, 28 aa, Mycobacterium
ERPATAADEIVRWATPVTSFQRTALEDY

SEQ ID NO: 655596 - protein, 23 aa, Mycobacterium
ERPATELLCRVVAELPRRLAQEP

SEQ ID NO: 655597 - protein, 24 aa, Mycobacterium
ERPDHGITIGFVFRALTGESELLP

SEQ ID NO: 655598 - protein, 17 aa, Mycobacterium
ERPDRIDPALVLVPADQ

SEQ ID NO: 655599 - protein, 25 aa, Mycobacterium
ERPEILRLVCRQLPGQTATELLKPL

SEQ ID NO: 655600 - protein, 24 aa, Mycobacterium
ERPERRRSGGAFSTYRISVGKRHK

SEQ ID NO: 655601 - protein, 23 aa, Mycobacterium
ERPESRAPLLAILRGAATHEEST

SEQ ID NO: 655602 - protein, 30 aa, Mycobacterium
ERPETAADEIVRWATPVSAFQRTALEDTEL

SEQ ID NO: 655603 - protein, 30 aa, Mycobacterium
ERPETAADEIVRWATPVSAFQRTALEDVEL

SEQ ID NO: 655604 - protein, 23 aa, Mycobacterium
ERPEVPVLPWVVSAKSPSALRSQ

SEQ ID NO: 655605 - protein, 30 aa, Mycobacterium
ERPFPLDLVPRVIAAAEWSRLERGIAQRVR

SEQ ID NO: 655606 - protein, 29 aa, Mycobacterium
ERPFPLDLVPRVISAAEWARLERGITQRV

SEQ ID NO: 655607 - protein, 24 aa, Mycobacterium
ERPFPLDLVPRVISAAEWTRLERG

SEQ ID NO: 655608 - protein, 25 aa, Mycobacterium
ERPFPLDLVPRVISAAEWTRLERGI

SEQ ID NO: 655609 - protein, 18 aa, Mycobacterium
ERPGPRLRDYLFAVKACF

SEQ ID NO: 655610 - protein, 27 aa, Mycobacterium
ERPGRRDICIYARESHVLVARSPAELF

SEQ ID NO: 655611 - protein, 17 aa, Mycobacterium
ERPHHDYFVLSRHADIW

SEQ ID NO: 655612 - protein, 19 aa, Mycobacterium
ERPIPSWLQVVGERQRILV

SEQ ID NO: 655613 - protein, 33 aa, Mycobacterium
ERPITAVDEIVRWATPVHCFQRTAVVDTEIGGV

SEQ ID NO: 655614 - protein, 28 aa, Mycobacterium
ERPITAVDEIVRWATPVTSFQRTALTDY

SEQ ID NO: 655615 - protein, 18 aa, Mycobacterium
ERPLRWSSLDELRAPNAL

SEQ ID NO: 655616 - protein, 20 aa, Mycobacterium
ERPLVHLAARPGRIDAEALA

SEQ ID NO: 655617 - protein, 21 aa, Mycobacterium
ERPLWDCFMIEGLSDDRWAVL

SEQ ID NO: 655618 - protein, 25 aa, Mycobacterium
ERPPHLKAIFPLAVTSDLYEGANHH

SEQ ID NO: 655619 - protein, 17 aa, Mycobacterium
ERPPLERLLNGPSDDPF

SEQ ID NO: 655620 - protein, 22 aa, Mycobacterium
ERPRGMSYLVVTGRRGGSAMAA

SEQ ID NO: 655621 - protein, 22 aa, Mycobacterium
ERPRLPSVGRLGLFDPHAPAHL

SEQ ID NO: 655622 - protein, 26 aa, Mycobacterium
ERPRSCSHVPEWARRWQRLLFDNGWL

SEQ ID NO: 655623 - protein, 23 aa, Mycobacterium
ERPRSEILTFLAAREAAHHRLFS

SEQ ID NO: 655624 - protein, 21 aa, Mycobacterium
ERPRSGGLAAVRQRGRDQRRY

SEQ ID NO: 655625 - protein, 25 aa, Mycobacterium
ERPRSVSHLPQWARRWQRLLFDNGW

SEQ ID NO: 655626 - protein, 24 aa, Mycobacterium
ERPRVRWKILDAWQAAAAESGIAP

SEQ ID NO: 655627 - protein, 24 aa, Mycobacterium
ERPRVRWKILDAWQAAAAQFGITP

SEQ ID NO: 655628 - protein, 25 aa, Mycobacterium
ERPSAIFRRHVRVVPYPEDDIPGIV

SEQ ID NO: 655629 - protein, 32 aa, Mycobacterium
ERPSYSLKEIRHWLQVFAQRFYSFSQFKRSAM

SEQ ID NO: 655630 - protein, 18 aa, Mycobacterium
ERPTMAALLVKDSVNAAA

SEQ ID NO: 655631 - protein, 25 aa, Mycobacterium
ERPTMPLVPLIDGWETVAEMEAALG

SEQ ID NO: 655632 - protein, 25 aa, Mycobacterium
ERPVKWIESRAECFLGGGREQIHRV

SEQ ID NO: 655633 - protein, 25 aa, Mycobacterium
ERQADLRAGFWTSVRECPHCDDRGM

SEQ ID NO: 655634 - protein, 18 aa, Mycobacterium
ERQAQVLPSRLMPLTANT

SEQ ID NO: 655635 - protein, 30 aa, Mycobacterium
ERQEQRYQRFAAFWRSRPVNWVWDHLPMSV

SEQ ID NO: 655636 - protein, 21 aa, Mycobacterium
ERQHPRPIAAGLYGDLSQILA

SEQ ID NO: 655637 - protein, 21 aa, Mycobacterium
ERQLKTLPLVERFYQADRSVA

SEQ ID NO: 655638 - protein, 20 aa, Mycobacterium
ERQLSIARDEEGMWTVQNHE

SEQ ID NO: 655639 - protein, 24 aa, Mycobacterium
ERQNESGFAWAFLGAALATTKLPF

SEQ ID NO: 655640 - protein, 19 aa, Mycobacterium
ERQPGRLARRGNHQHPIVG

SEQ ID NO: 655641 - protein, 20 aa, Mycobacterium
ERQPWPGGRAGRLDIDGYRI

SEQ ID NO: 655642 - protein, 18 aa, Mycobacterium
ERQREIFGAFATSRAARR

SEQ ID NO: 655643 - protein, 18 aa, Mycobacterium
ERQRTALNRIIDILTEHT

SEQ ID NO: 655644 - protein, 19 aa, Mycobacterium
ERQSMLFSATMPGPIITLA

SEQ ID NO: 655645 - protein, 19 aa, Mycobacterium
ERQVRRWGSQWDLVKRDDD

SEQ ID NO: 655646 - protein, 19 aa, Mycobacterium
ERQVRRWGSQWEHVRLPDD

SEQ ID NO: 655647 - protein, 20 aa, Mycobacterium
ERQWRIARLSGIRGVAPQFV

SEQ ID NO: 655648 - protein, 21 aa, Mycobacterium
ERQWSWADWAARIRRTAGALR

SEQ ID NO: 655649 - protein, 19 aa, Mycobacterium
ERRAIQGFLESGVDLDDVL

SEQ ID NO: 655650 - protein, 19 aa, Mycobacterium
ERRAPCFGERDVGPLDADL

SEQ ID NO: 655651 - protein, 26 aa, Mycobacterium
ERRASGALPSRANWVEECLYRKRTMH

SEQ ID NO: 655652 - protein, 19 aa, Mycobacterium
ERRAVPLPLPQKIFDAEWI

SEQ ID NO: 655653 - protein, 24 aa, Mycobacterium
ERRDELLERVGLGGTAGRRIWEIS

SEQ ID NO: 655654 - protein, 17 aa, Mycobacterium
ERREFDDVLSIIASRLQ

SEQ ID NO: 655655 - protein, 22 aa, Mycobacterium
ERREFDEVLSIIASRLQSTSQG

SEQ ID NO: 655656 - protein, 17 aa, Mycobacterium
ERREIAAHFGAEVTAES

SEQ ID NO: 655657 - protein, 21 aa, Mycobacterium
ERREILVPFVSAIVTSISLAD

SEQ ID NO: 655658 - protein, 21 aa, Mycobacterium
ERREITIDFVVHGDHGVAGPW

SEQ ID NO: 655659 - protein, 26 aa, Mycobacterium
ERREVPGLDGIEAWAVHAQPGHIVAA

SEQ ID NO: 655660 - protein, 22 aa, Mycobacterium
ERRFANRRVDVMQNGQLLTTVL

SEQ ID NO: 655661 - protein, 18 aa, Mycobacterium
ERRGCGLGTAGTASVAAA

SEQ ID NO: 655662 - protein, 22 aa, Mycobacterium
ERRGDMVICHPFAGSAPRSSDP

SEQ ID NO: 655663 - protein, 22 aa, Mycobacterium
ERRGEKRPAGGNRRGNRLPRDE

SEQ ID NO: 655664 - protein, 21 aa, Mycobacterium
ERRGEPWFDPAGLILAFDASP

SEQ ID NO: 655665 - protein, 17 aa, Mycobacterium
ERRGFLEVETPMLQTLA

SEQ ID NO: 655666 - protein, 25 aa, Mycobacterium
ERRGLKRALITLCVGGGMGVATIIE

SEQ ID NO: 655667 - protein, 19 aa, Mycobacterium
ERRGLPLTIFAVATALQRN

SEQ ID NO: 655668 - protein, 19 aa, Mycobacterium
ERRGSAWWDPSLRVLEEGA

SEQ ID NO: 655669 - protein, 18 aa, Mycobacterium
ERRHFRLDWASPHQIGRK

SEQ ID NO: 655670 - protein, 19 aa, Mycobacterium
ERRKEICGRAYRILTEKVG

SEQ ID NO: 655671 - protein, 19 aa, Mycobacterium
ERRKEICGRAYRILTEQVG

SEQ ID NO: 655672 - protein, 23 aa, Mycobacterium
ERRKEMLHNAALRGEQMKGHAAT

SEQ ID NO: 655673 - protein, 23 aa, Mycobacterium
ERRKEMLHNSALRGEQMKGHAAT

SEQ ID NO: 655674 - protein, 23 aa, Mycobacterium
ERRKEMLHNSALRGEQMKGHAST

SEQ ID NO: 655675 - protein, 23 aa, Mycobacterium
ERRKEMLHNSALRGEQMKGHATT

SEQ ID NO: 655676 - protein, 24 aa, Mycobacterium
ERRLFAELMWEYRFGDRHTAMTVL

SEQ ID NO: 655677 - protein, 23 aa, Mycobacterium
ERRLGPVVFRDMLGLHFAPTRPV

SEQ ID NO: 655678 - protein, 25 aa, Mycobacterium
ERRLRLLELARDWGSMILDDDPYGL

SEQ ID NO: 655679 - protein, 17 aa, Mycobacterium
ERRLVCDTVAWTRTIRP

SEQ ID NO: 655680 - protein, 19 aa, Mycobacterium
ERRPVIVAGASSGIGEATA

SEQ ID NO: 655681 - protein, 20 aa, Mycobacterium
ERRQLLLAGEHAIAFDPAAD

SEQ ID NO: 655682 - protein, 18 aa, Mycobacterium
ERRQWWIDRVKACHRLLV

SEQ ID NO: 655683 - protein, 20 aa, Mycobacterium
ERRRIFCVRADIAVEGTAVT

SEQ ID NO: 655684 - protein, 17 aa, Mycobacterium
ERRRLGAAGRQRALDVF

SEQ ID NO: 655685 - protein, 17 aa, Mycobacterium
ERRRQLEEWLRSYRPDE

SEQ ID NO: 655686 - protein, 18 aa, Mycobacterium
ERRRRPDLVDALYRDVFG

SEQ ID NO: 655687 - protein, 18 aa, Mycobacterium
ERRRTGLTVGHYDGTWSL

SEQ ID NO: 655688 - protein, 24 aa, Mycobacterium
ERRRYTRAGAYGASKLANLLFTKE

SEQ ID NO: 655689 - protein, 19 aa, Mycobacterium
ERRSDCAYIGPVYAELTAG

SEQ ID NO: 655690 - protein, 19 aa, Mycobacterium
ERRVARVIGVDRMLLRRWS

SEQ ID NO: 655691 - protein, 24 aa, Mycobacterium
ERRVREGLIEIGRKLDIPPLATND

SEQ ID NO: 655692 - protein, 25 aa, Mycobacterium
ERRVREGLLEIGQKLGIPPLATNDC

SEQ ID NO: 655693 - protein, 25 aa, Mycobacterium
ERRVREGLLEVGKKLGIPPLATNDC

SEQ ID NO: 655694 - protein, 22 aa, Mycobacterium
ERRVRRGRIQFVRQEPLFAPSV

SEQ ID NO: 655695 - protein, 21 aa, Mycobacterium
ERSALREFLAFHQSAYFAVSY

SEQ ID NO: 655696 - protein, 20 aa, Mycobacterium
ERSARPGLIVAAEFRGADQA

SEQ ID NO: 655697 - protein, 19 aa, Mycobacterium
ERSASWVPRLLWRRWSPTY

SEQ ID NO: 655698 - protein, 21 aa, Mycobacterium
ERSCALTAVALSGQRRTGVHL

SEQ ID NO: 655699 - protein, 21 aa, Mycobacterium
ERSEGDAFGRLILLHDPEGAE

SEQ ID NO: 655700 - protein, 17 aa, Mycobacterium
ERSEHRFGQVMTGLTVN

SEQ ID NO: 655701 - protein, 18 aa, Mycobacterium
ERSEVAGVAPVLVVELDA

SEQ ID NO: 655702 - protein, 27 aa, Mycobacterium
ERSGLPFSRIRVLRRLARRPMSVKEVA

SEQ ID NO: 655703 - protein, 17 aa, Mycobacterium
ERSHLLANLSSLLVKST

SEQ ID NO: 655704 - protein, 19 aa, Mycobacterium
ERSLAPIIVTRRGKIARLE

SEQ ID NO: 655705 - protein, 25 aa, Mycobacterium
ERSLFRRLAVFLGGFDLDAAQTVAG

SEQ ID NO: 655706 - protein, 17 aa, Mycobacterium
ERSLGMTAGNIFHDALR

SEQ ID NO: 655707 - protein, 27 aa, Mycobacterium
ERSLHFAMGLARGYSLAVVEGSTSLAE

SEQ ID NO: 655708 - protein, 28 aa, Mycobacterium
ERSLLGGLPVRRLWGIGPVAEEKLHRLG

SEQ ID NO: 655709 - protein, 28 aa, Mycobacterium
ERSLLGGLPVRRLWGIGPVAEEKLNRLG

SEQ ID NO: 655710 - protein, 23 aa, Mycobacterium
ERSLRWVAVHTVHELQHHLLDIR

SEQ ID NO: 655711 - protein, 22 aa, Mycobacterium
ERSLVKVHDWIPLEAASLVSCG

SEQ ID NO: 655712 - protein, 17 aa, Mycobacterium
ERSPAGKADYRWAREQA

SEQ ID NO: 655713 - protein, 21 aa, Mycobacterium
ERSPLPFARHRWVCDRGPAEM

SEQ ID NO: 655714 - protein, 18 aa, Mycobacterium
ERSRTCLLYSEPGAGSDL

SEQ ID NO: 655715 - protein, 21 aa, Mycobacterium
ERSSHTWFVLQEILGHQNVKN

SEQ ID NO: 655716 - protein, 21 aa, Mycobacterium
ERSSHTWFVLQELLGHKNVKN

SEQ ID NO: 655717 - protein, 22 aa, Mycobacterium
ERSSHTWFVLTHLLGLPGVRNY

SEQ ID NO: 655718 - protein, 22 aa, Mycobacterium
ERSSHTWFVLTHLLGMPGVRNY

SEQ ID NO: 655719 - protein, 22 aa, Mycobacterium
ERSSHTWFVLTHLLGVEGVRNY

SEQ ID NO: 655720 - protein, 26 aa, Mycobacterium
ERSTPPWWPMRQLVRALGADADEVLE

SEQ ID NO: 655721 - protein, 18 aa, Mycobacterium
ERTARWLVRQAMHEGVHH

SEQ ID NO: 655722 - protein, 24 aa, Mycobacterium
ERTDWKKRMISIGVHVNPDIAPWI

SEQ ID NO: 655723 - protein, 17 aa, Mycobacterium
ERTGEVLAEGWVNTGDL

SEQ ID NO: 655724 - protein, 24 aa, Mycobacterium
ERTGRRCLRLPGDLSEVEQCRAIV

SEQ ID NO: 655725 - protein, 19 aa, Mycobacterium
ERTLLAGDFVRGFVGLDSQ

SEQ ID NO: 655726 - protein, 24 aa, Mycobacterium
ERTLRGRPALDIAGNGRYARQLVE

SEQ ID NO: 655727 - protein, 18 aa, Mycobacterium
ERTPFAAVTWFRPDHTID

SEQ ID NO: 655728 - protein, 26 aa, Mycobacterium
ERTPHVLSCIYSVFTEGYWSTGGPSA

SEQ ID NO: 655729 - protein, 21 aa, Mycobacterium
ERTQLTWPRPPVLCTVKLARR

SEQ ID NO: 655730 - protein, 20 aa, Mycobacterium
ERTRAGLALLQARGTNVLVL

SEQ ID NO: 655731 - protein, 23 aa, Mycobacterium
ERTRRAMALLAIRNFESYLDTGE

SEQ ID NO: 655732 - protein, 31 aa, Mycobacterium
ERTTQGMPAYWCRRLANDMVDYVNSYRSHAL

SEQ ID NO: 655733 - protein, 19 aa, Mycobacterium
ERTTRIGLGPGVLVPSLRH

SEQ ID NO: 655734 - protein, 20 aa, Mycobacterium
ERTVPFGAFSHLVEIAELGK

SEQ ID NO: 655735 - protein, 17 aa, Mycobacterium
ERTYFWVARTTTTEPSR

SEQ ID NO: 655736 - protein, 25 aa, Mycobacterium
ERVAALRTSHRFGAAIGALAAAVRD

SEQ ID NO: 655737 - protein, 25 aa, Mycobacterium
ERVAASDPRFGWAKQVEYTVFGLEN

SEQ ID NO: 655738 - protein, 20 aa, Mycobacterium
ERVADAWIAAQAYRLHTFGT

SEQ ID NO: 655739 - protein, 22 aa, Mycobacterium
ERVAEGLRRIYGPKADYADVAV

SEQ ID NO: 655740 - protein, 20 aa, Mycobacterium
ERVAELLEVVGLRRTDAARY

SEQ ID NO: 655741 - protein, 17 aa, Mycobacterium
ERVAGFLGFSTTLTSVG

SEQ ID NO: 655742 - protein, 17 aa, Mycobacterium
ERVALLIPRSAGAVAAM

SEQ ID NO: 655743 - protein, 17 aa, Mycobacterium
ERVAPSILMGRRDGLKR

SEQ ID NO: 655744 - protein, 25 aa, Mycobacterium
ERVCDLHRRACRWYAGQRLVREAVD

SEQ ID NO: 655745 - protein, 24 aa, Mycobacterium
ERVDEFKSLFLASRAAYRQMEEDN

SEQ ID NO: 655746 - protein, 18 aa, Mycobacterium
ERVDETWSTAGIRSSAYS

SEQ ID NO: 655747 - protein, 28 aa, Mycobacterium
ERVGAFKEVMRWPDYVEFLTQWATSSQW

SEQ ID NO: 655748 - protein, 23 aa, Mycobacterium
ERVGNPVDVMWMIFDQRYRNSYL

SEQ ID NO: 655749 - protein, 19 aa, Mycobacterium
ERVGQLLSLVERRMLLPDA

SEQ ID NO: 655750 - protein, 25 aa, Mycobacterium
ERVHGRLRLGPGWVSHILQDLAVRL

SEQ ID NO: 655751 - protein, 25 aa, Mycobacterium
ERVHGRLRLGPGWVSHLLQDLAVSL

SEQ ID NO: 655752 - protein, 20 aa, Mycobacterium
ERVKATLPRLGELPIGGTAV

SEQ ID NO: 655753 - protein, 26 aa, Mycobacterium
ERVKGPDFPTAGLIVGSQGIADAYKT

SEQ ID NO: 655754 - protein, 26 aa, Mycobacterium
ERVKGPDFPTSGLIVGTQGIEDTYKT

SEQ ID NO: 655755 - protein, 23 aa, Mycobacterium
ERVLARLAGPQSLSGRHLLRTQL

SEQ ID NO: 655756 - protein, 18 aa, Mycobacterium
ERVLDMRAGVLTRQVDWT

SEQ ID NO: 655757 - protein, 18 aa, Mycobacterium
ERVLKAVGAVLSRFPGLA

SEQ ID NO: 655758 - protein, 17 aa, Mycobacterium
ERVLPAVLLLKAVGLAA

SEQ ID NO: 655759 - protein, 18 aa, Mycobacterium
ERVLPAVLLLKAVGLAAQ

SEQ ID NO: 655760 - protein, 23 aa, Mycobacterium
ERVLRRWPAVQVLATAGVAADHY

SEQ ID NO: 655761 - protein, 26 aa, Mycobacterium
ERVLVHPRPRLSVMAVGGELVDICRT

SEQ ID NO: 655762 - protein, 26 aa, Mycobacterium
ERVLVHPRPRLSVMAVGGELVDISRT

SEQ ID NO: 655763 - protein, 26 aa, Mycobacterium
ERVLVHPRPRLSVMCVGGELVDISRT

SEQ ID NO: 655764 - protein, 25 aa, Mycobacterium
ERVLVHPRPRVTIMALGGELVDISR

SEQ ID NO: 655765 - protein, 24 aa, Mycobacterium
ERVLVHPRPRVTVMTVGGELVDIS

SEQ ID NO: 655766 - protein, 21 aa, Mycobacterium
ERVPLSLAQHRMWSVVQLQGP

SEQ ID NO: 655767 - protein, 17 aa, Mycobacterium
ERVRALAIEDMAFYENI

SEQ ID NO: 655768 - protein, 23 aa, Mycobacterium
ERVREVASFIPGAMRGITSERQL

SEQ ID NO: 655769 - protein, 19 aa, Mycobacterium
ERVRFTSPHPAEFTDDVIE

SEQ ID NO: 655770 - protein, 25 aa, Mycobacterium
ERVRIALRAERRARPQPARDDKVIA

SEQ ID NO: 655771 - protein, 27 aa, Mycobacterium
ERVRSSLGLLAMRRLRKLLAGRMSVRA

SEQ ID NO: 655772 - protein, 18 aa, Mycobacterium
ERVRVCKRDGQFLERPHA

SEQ ID NO: 655773 - protein, 21 aa, Mycobacterium
ERVSAELTRMGYRVIPSDANF

SEQ ID NO: 655774 - protein, 19 aa, Mycobacterium
ERVSAFGVLGCYAEKVAVP

SEQ ID NO: 655775 - protein, 18 aa, Mycobacterium
ERVSEWEVLGEDLARVLG

SEQ ID NO: 655776 - protein, 21 aa, Mycobacterium
ERVSGDSFLLCFNAYDEPLDF

SEQ ID NO: 655777 - protein, 24 aa, Mycobacterium
ERVSRLVLCGAYARGRAVRAVGDE

SEQ ID NO: 655778 - protein, 27 aa, Mycobacterium
ERVTELGRAYVRWAIAHPDHYQVMFGA

SEQ ID NO: 655779 - protein, 24 aa, Mycobacterium
ERVTLAAVAWVLTTVFIRFCEDNG

SEQ ID NO: 655780 - protein, 21 aa, Mycobacterium
ERVTVDFPYREGLFQGVLQER

SEQ ID NO: 655781 - protein, 17 aa, Mycobacterium
ERVVDVLDALPLGEPFN

SEQ ID NO: 655782 - protein, 23 aa, Mycobacterium
ERVVRALRHGTVWLNDFGYYTAA

SEQ ID NO: 655783 - protein, 20 aa, Mycobacterium
ERWADIALRTGNSFGADGTE

SEQ ID NO: 655784 - protein, 19 aa, Mycobacterium
ERWEPSVIGPVCDQLVDEI

SEQ ID NO: 655785 - protein, 18 aa, Mycobacterium
ERWHCRGVAFTPKDGGRI

SEQ ID NO: 655786 - protein, 20 aa, Mycobacterium
ERWITFRSHYGFEAWYCQPG

SEQ ID NO: 655787 - protein, 17 aa, Mycobacterium
ERWLPKFVSGEYIGSIA

SEQ ID NO: 655788 - protein, 20 aa, Mycobacterium
ERWRGGWVRDKRGRLKLRGG

SEQ ID NO: 655789 - protein, 26 aa, Mycobacterium
ERWRHWASCFEFDFTYVHGGGSVRQS

SEQ ID NO: 655790 - protein, 23 aa, Mycobacterium
ERWRSGAVQPVFAGPMRTMVTWE

SEQ ID NO: 655791 - protein, 18 aa, Mycobacterium
ERWRSWRWDSLVANGPAW

SEQ ID NO: 655792 - protein, 23 aa, Mycobacterium
ERYADARGRLCAALSARGVAAHG

SEQ ID NO: 655793 - protein, 18 aa, Mycobacterium
ERYAPFFKMCSSVLPEGG

SEQ ID NO: 655794 - protein, 18 aa, Mycobacterium
ERYAPIPVVEVILPAVRR

SEQ ID NO: 655795 - protein, 21 aa, Mycobacterium
ERYARCLGSAVNPVLRQGNSD

SEQ ID NO: 655796 - protein, 18 aa, Mycobacterium
ERYDSFFAMAHRVLPSDG

SEQ ID NO: 655797 - protein, 20 aa, Mycobacterium
ERYFPHAAHQVVLLSTDTEV

SEQ ID NO: 655798 - protein, 17 aa, Mycobacterium
ERYFRDAPLMIVGEGTN

SEQ ID NO: 655799 - protein, 20 aa, Mycobacterium
ERYFRDAPLMIVGEGTNEIQ

SEQ ID NO: 655800 - protein, 17 aa, Mycobacterium
ERYGHTRAWQIAEEQSG

SEQ ID NO: 655801 - protein, 25 aa, Mycobacterium
ERYGVDDVRAFELLRRLSQESQTKL

SEQ ID NO: 655802 - protein, 17 aa, Mycobacterium
ERYIPMVNAERSPTFYR

SEQ ID NO: 655803 - protein, 21 aa, Mycobacterium
ERYKLVWKNRLGFARLAIQHA

SEQ ID NO: 655804 - protein, 22 aa, Mycobacterium
ERYMKLLAPRWQMMDDPELKGY

SEQ ID NO: 655805 - protein, 19 aa, Mycobacterium
ERYPVFFERAYSILPDDGR

SEQ ID NO: 655806 - protein, 17 aa, Mycobacterium
ERYRFRFPRQQRGRFLC

SEQ ID NO: 655807 - protein, 18 aa, Mycobacterium
ERYRHVRDSAIVMQQALL

SEQ ID NO: 655808 - protein, 18 aa, Mycobacterium
ERYRRHWIDHLDALERHL

SEQ ID NO: 655809 - protein, 23 aa, Mycobacterium
ERYTETFLRIHGRPGANRSAIAD

SEQ ID NO: 655810 - protein, 23 aa, Mycobacterium
ERYWETAAGLIAPVLDLLLEAPD

SEQ ID NO: 655811 - protein, 33 aa, Mycobacterium
ESAAAFQGAHARFVEAAARVNALLDIAQANLGD

SEQ ID NO: 655812 - protein, 28 aa, Mycobacterium
ESAAAKSGIPWTVVRATQFHELAEPITE

SEQ ID NO: 655813 - protein, 24 aa, Mycobacterium
ESAARLAATAMKWTGVSADSVARG

SEQ ID NO: 655814 - protein, 25 aa, Mycobacterium
ESAARLAVLPERWREIARPRANSAD

SEQ ID NO: 655815 - protein, 17 aa, Mycobacterium
ESAAWNHDWSTTSVVVG

SEQ ID NO: 655816 - protein, 18 aa, Mycobacterium
ESADEFKTLLKLETGQPQ

SEQ ID NO: 655817 - protein, 22 aa, Mycobacterium
ESADLLLAHLVLRPFLDAYHIV

SEQ ID NO: 655818 - protein, 17 aa, Mycobacterium
ESADVLAWRQRTLTGRR

SEQ ID NO: 655819 - protein, 17 aa, Mycobacterium
ESAELRLLGGATVRTAY

SEQ ID NO: 655820 - protein, 20 aa, Mycobacterium
ESAELRWVAEDEVTNLPLHP

SEQ ID NO: 655821 - protein, 26 aa, Mycobacterium
ESAENGRSWSRWSFIGAGSPSALTVR

SEQ ID NO: 655822 - protein, 17 aa, Mycobacterium
ESAFAHFGRRYDDLHTE

SEQ ID NO: 655823 - protein, 24 aa, Mycobacterium
ESAFPRAVFTGALYGPELAAAYAS

SEQ ID NO: 655824 - protein, 24 aa, Mycobacterium
ESAGDRYLPIWIGQSEAAAIALEQ

SEQ ID NO: 655825 - protein, 22 aa, Mycobacterium
ESAGLARWLLHTATEYAKVREQ

SEQ ID NO: 655826 - protein, 26 aa, Mycobacterium
ESAHPGRFLLGIGVGHPEAHQQYRRP

SEQ ID NO: 655827 - protein, 25 aa, Mycobacterium
ESAHPGRFLLGVGVGHPEHTQEYQK

SEQ ID NO: 655828 - protein, 17 aa, Mycobacterium
ESAIRIGLALNCEIAPW

SEQ ID NO: 655829 - protein, 26 aa, Mycobacterium
ESAKDTLLNLGWRGLRGRPRDEPVAK

SEQ ID NO: 655830 - protein, 17 aa, Mycobacterium
ESAKLGAFVEVKNSTVG

SEQ ID NO: 655831 - protein, 18 aa, Mycobacterium
ESAKRFGLEESRYEGPTG

SEQ ID NO: 655832 - protein, 19 aa, Mycobacterium
ESAKYWLAVLTELKNRGVA

SEQ ID NO: 655833 - protein, 21 aa, Mycobacterium
ESALAEEIFVIADLARQKARA

SEQ ID NO: 655834 - protein, 20 aa, Mycobacterium
ESALAFQGAHARYMEAASKV

SEQ ID NO: 655835 - protein, 24 aa, Mycobacterium
ESALDPSTRCWELGSDGQWTASPQ

SEQ ID NO: 655836 - protein, 29 aa, Mycobacterium
ESALFAADLARMYIRYAERHGWTVTVLGE

SEQ ID NO: 655837 - protein, 24 aa, Mycobacterium
ESALRCSAELPFDVSVPANERVLH

SEQ ID NO: 655838 - protein, 24 aa, Mycobacterium
ESALRKAPLYELVKRTGAVVDRVQ

SEQ ID NO: 655839 - protein, 18 aa, Mycobacterium
ESALSAAARTPRLLVASD

SEQ ID NO: 655840 - protein, 25 aa, Mycobacterium
ESALWAASSVFCFVLGEALEQQGAT

SEQ ID NO: 655841 - protein, 25 aa, Mycobacterium
ESAPELRTPWPREALKDLLVLLESG

SEQ ID NO: 655842 - protein, 17 aa, Mycobacterium
ESAPEVNSFTFTVDEDG

SEQ ID NO: 655843 - protein, 23 aa, Mycobacterium
ESAPGRWALTREGGHTRRRIIHA

SEQ ID NO: 655844 - protein, 19 aa, Mycobacterium
ESAPLARRLCEQRNADVIR

SEQ ID NO: 655845 - protein, 17 aa, Mycobacterium
ESAQICLAISQSGETAD

SEQ ID NO: 655846 - protein, 17 aa, Mycobacterium
ESAQLASLFGVSAECVR

SEQ ID NO: 655847 - protein, 23 aa, Mycobacterium
ESAQRIAVLPVWQEAELFSDVER

SEQ ID NO: 655848 - protein, 18 aa, Mycobacterium
ESAQRLRYALADLPLAAP

SEQ ID NO: 655849 - protein, 22 aa, Mycobacterium
ESARLAEFLDHVDVAVSLHGYG

SEQ ID NO: 655850 - protein, 21 aa, Mycobacterium
ESARLLGQIDVVFSNAGIVVA

SEQ ID NO: 655851 - protein, 17 aa, Mycobacterium
ESARPVVQIPLGNDLIH

SEQ ID NO: 655852 - protein, 26 aa, Mycobacterium
ESARRLGVPESKWVYLHGHSDLVEQP

SEQ ID NO: 655853 - protein, 26 aa, Mycobacterium
ESARRLRRPVRWTATRSESFLSDTQG

SEQ ID NO: 655854 - protein, 20 aa, Mycobacterium
ESARSWPLVAADASSPSTLN

SEQ ID NO: 655855 - protein, 17 aa, Mycobacterium
ESARVAEIIARSGVPVQ

SEQ ID NO: 655856 - protein, 23 aa, Mycobacterium
ESARYRAAGWWSDTTLSDAVRRN

SEQ ID NO: 655857 - protein, 20 aa, Mycobacterium
ESASGFAIVGYAARFPGAAD

SEQ ID NO: 655858 - protein, 20 aa, Mycobacterium
ESATGGAFDDGWYRTGDIGF

SEQ ID NO: 655859 - protein, 28 aa, Mycobacterium
ESATLRRFVDRFAHFNFRDHMMRPAYGL

SEQ ID NO: 655860 - protein, 18 aa, Mycobacterium
ESATMMLALARFGNQPAV

SEQ ID NO: 655861 - protein, 28 aa, Mycobacterium
ESAVKARWQTPASAVFSGEFDGLESDVD

SEQ ID NO: 655862 - protein, 23 aa, Mycobacterium
ESAVLRLATAVAVAKSVDELLSI

SEQ ID NO: 655863 - protein, 24 aa, Mycobacterium
ESAVLRLATAVAVARSVDELLSIT

SEQ ID NO: 655864 - protein, 19 aa, Mycobacterium
ESAVLRLATSVSVAKSVSE

SEQ ID NO: 655865 - protein, 17 aa, Mycobacterium
ESAWPDLFDAIRAAGYT

SEQ ID NO: 655866 - protein, 19 aa, Mycobacterium
ESCADRMASNAIPRDPDLG

SEQ ID NO: 655867 - protein, 18 aa, Mycobacterium
ESCGFGGDRRQFGRPQPA

SEQ ID NO: 655868 - protein, 24 aa, Mycobacterium
ESCGKCTPCREGTFWLDKIYERLE

SEQ ID NO: 655869 - protein, 26 aa, Mycobacterium
ESCGQAFAEFVDWSLLDVLRGAAGAP

SEQ ID NO: 655870 - protein, 45 aa, Mycobacterium
ESCKESLDRLGLDYLDLYLIHWPAPKLGKYVESFEGMKVARDEGH

SEQ ID NO: 655871 - protein, 22 aa, Mycobacterium
ESCSLAVLIERGAKLQLAAMAA

SEQ ID NO: 655872 - protein, 19 aa, Mycobacterium
ESCTAGLLAARLTDRPGSS

SEQ ID NO: 655873 - protein, 19 aa, Mycobacterium
ESCTAGLLGARIADVPGSS

SEQ ID NO: 655874 - protein, 23 aa, Mycobacterium
ESDEFKFPFDLLDSTKIIPEEQV

SEQ ID NO: 655875 - protein, 20 aa, Mycobacterium
ESDEFNFGFDLLDATKIIPE

SEQ ID NO: 655876 - protein, 24 aa, Mycobacterium
ESDFARFVIRRALLALERVEYRIL

SEQ ID NO: 655877 - protein, 25 aa, Mycobacterium
ESDFVRHLGCYQAHFTTGNVLGLRN

SEQ ID NO: 655878 - protein, 22 aa, Mycobacterium
ESDLAFAAGVYVMLEPRRFASG

SEQ ID NO: 655879 - protein, 26 aa, Mycobacterium
ESDLALAGGCALLLEPNGSVSLSSQG

SEQ ID NO: 655880 - protein, 18 aa, Mycobacterium
ESDLLVAECLRAGAWDGL

SEQ ID NO: 655881 - protein, 29 aa, Mycobacterium
ESDLLVAECLRAGVWEELDAAELVAALSS

SEQ ID NO: 655882 - protein, 27 aa, Mycobacterium
ESDLLVAECLRRGLWAGLKPAELAAVA

SEQ ID NO: 655883 - protein, 24 aa, Mycobacterium
ESDLPPRRAVVVADVPGAQPRPDL

SEQ ID NO: 655884 - protein, 19 aa, Mycobacterium
ESDMFLADGRAFVMSAPGD

SEQ ID NO: 655885 - protein, 17 aa, Mycobacterium
ESDPDRMRAALAAHDAV

SEQ ID NO: 655886 - protein, 23 aa, Mycobacterium
ESDQFRALVLIDFFGNAVAQGLV

SEQ ID NO: 655887 - protein, 24 aa, Mycobacterium
ESDQPASILILFAPGAPREDYFEG

SEQ ID NO: 655888 - protein, 22 aa, Mycobacterium
ESDQRTAAVLARNIEALGLAGA

SEQ ID NO: 655889 - protein, 23 aa, Mycobacterium
ESDRAEFGWQPGVDSWLAGWDEE

SEQ ID NO: 655890 - protein, 27 aa, Mycobacterium
ESDRVNFRIALWAARNMGMREQGGEAA

SEQ ID NO: 655891 - protein, 24 aa, Mycobacterium
ESDVYWCTADIGWVTGHTYIVYGP

SEQ ID NO: 655892 - protein, 17 aa, Mycobacterium
ESDWDAWLNPDAPLDPE

SEQ ID NO: 655893 - protein, 23 aa, Mycobacterium
ESDWNALNLFTGWVDVGLTEKGQ

SEQ ID NO: 655894 - protein, 17 aa, Mycobacterium
ESEFRKALRDCQAERRH

SEQ ID NO: 655895 - protein, 18 aa, Mycobacterium
ESELMERFGVSRPTLREA

SEQ ID NO: 655896 - protein, 23 aa, Mycobacterium
ESELNVPLVRRGQRFEGLTPEGE

SEQ ID NO: 655897 - protein, 20 aa, Mycobacterium
ESEPMIIGKAFGVKVNANIG

SEQ ID NO: 655898 - protein, 20 aa, Mycobacterium
ESEPMVIGKAFAVKVNANIG

SEQ ID NO: 655899 - protein, 26 aa, Mycobacterium
ESEQRWPAYCRQALLETPIRSVVAFQ

SEQ ID NO: 655900 - protein, 26 aa, Mycobacterium
ESERWEWSDAVARMHGYRPGEVRPST

SEQ ID NO: 655901 - protein, 17 aa, Mycobacterium
ESESIVLPSLYYAHQRN

SEQ ID NO: 655902 - protein, 25 aa, Mycobacterium
ESETRSAPFRVCLEHDSAVSLGDKL

SEQ ID NO: 655903 - protein, 25 aa, Mycobacterium
ESEVARGRHAEWPMVLAASPHIADP

SEQ ID NO: 655904 - protein, 23 aa, Mycobacterium
ESEWNSLNLFTGWVDVGLTDKGR

SEQ ID NO: 655905 - protein, 19 aa, Mycobacterium
ESFAALLREATRVPSVIAR

SEQ ID NO: 655906 - protein, 21 aa, Mycobacterium
ESFAATTGMGHTRWATHGAPT

SEQ ID NO: 655907 - protein, 23 aa, Mycobacterium
ESFARFLERWRVRHPRVVFTEVS

SEQ ID NO: 655908 - protein, 24 aa, Mycobacterium
ESFAWTHRNHRAFGVDLRRNEGKH

SEQ ID NO: 655909 - protein, 25 aa, Mycobacterium
ESFCKLLAAEDLLALAWPKEHGGGG

SEQ ID NO: 655910 - protein, 20 aa, Mycobacterium
ESFDGVRPAAVRVPDSALDS

SEQ ID NO: 655911 - protein, 25 aa, Mycobacterium
ESFDWPESLFAERTWHIARPLPERA

SEQ ID NO: 655912 - protein, 21 aa, Mycobacterium
ESFEFLWCSMVNRLAEAAIPR

SEQ ID NO: 655913 - protein, 20 aa, Mycobacterium
ESFGLPGLARYCRDAIHANA

SEQ ID NO: 655914 - protein, 20 aa, Mycobacterium
ESFGYKYGLPMDADTVMDVR

SEQ ID NO: 655915 - protein, 18 aa, Mycobacterium
ESFHKCVAVFLNGDAITA

SEQ ID NO: 655916 - protein, 24 aa, Mycobacterium
ESFKAMARQTMIRDGVPPNQIEAR

SEQ ID NO: 655917 - protein, 22 aa, Mycobacterium
ESFPEETFPVLVAVLTNVFDGA

SEQ ID NO: 655918 - protein, 25 aa, Mycobacterium
ESFPLHCCANGKALLAGLPPERLPS

SEQ ID NO: 655919 - protein, 25 aa, Mycobacterium
ESFPLYCCANGKALLASLPPERQAQ

SEQ ID NO: 655920 - protein, 18 aa, Mycobacterium
ESFRDYWNPLAIAGATGG

SEQ ID NO: 655921 - protein, 23 aa, Mycobacterium
ESFRGELRLLYLASTDPATGKLF

SEQ ID NO: 655922 - protein, 18 aa, Mycobacterium
ESFRHGGYVPVLASGDAS

SEQ ID NO: 655923 - protein, 19 aa, Mycobacterium
ESFRINGKVFMQVGIENHE

SEQ ID NO: 655924 - protein, 32 aa, Mycobacterium
ESFRPGVMDRLGLGWERLRERNSRLVYCSLSG

SEQ ID NO: 655925 - protein, 17 aa, Mycobacterium
ESFRSAAAFATEASPDG

SEQ ID NO: 655926 - protein, 27 aa, Mycobacterium
ESFRYLDCPCCAGILKPDIVYFGENVP

SEQ ID NO: 655927 - protein, 23 aa, Mycobacterium
ESFSEVHPLPGRDLMPVVSGESA

SEQ ID NO: 655928 - protein, 23 aa, Mycobacterium
ESFTEVHPLPGRDLMAVVDGAPA

SEQ ID NO: 655929 - protein, 23 aa, Mycobacterium
ESFTEVHPLPGRDLMPVVDGAPA

SEQ ID NO: 655930 - protein, 17 aa, Mycobacterium
ESFTEVHPLPGRNLMPV

SEQ ID NO: 655931 - protein, 25 aa, Mycobacterium
ESFVKRRMGVALAFDDDVQTARRNA

SEQ ID NO: 655932 - protein, 17 aa, Mycobacterium
ESFVKRYLDTVAGGSAA

SEQ ID NO: 655933 - protein, 25 aa, Mycobacterium
ESGAGCVPCSSMGRLFDAVASILGV

SEQ ID NO: 655934 - protein, 18 aa, Mycobacterium
ESGAPVPDYRSWLDDQDF

SEQ ID NO: 655935 - protein, 22 aa, Mycobacterium
ESGDASGGWSLLVPDTGTVDAR

SEQ ID NO: 655936 - protein, 23 aa, Mycobacterium
ESGDTLWAIAERFYGDGNQYQKI

SEQ ID NO: 655937 - protein, 24 aa, Mycobacterium
ESGEIRFDPALWRELAASDLLGIA

SEQ ID NO: 655938 - protein, 21 aa, Mycobacterium
ESGESFATLVARRDPKLADAV

SEQ ID NO: 655939 - protein, 22 aa, Mycobacterium
ESGFKMSVRMIADHMGFHIDPT

SEQ ID NO: 655940 - protein, 22 aa, Mycobacterium
ESGGSPGWWRGRRADFRAVDGV

SEQ ID NO: 655941 - protein, 24 aa, Mycobacterium
ESGHFPASLLYTAAKLYYTEDATQ

SEQ ID NO: 655942 - protein, 18 aa, Mycobacterium
ESGIGYAAGDAVAACAYG

SEQ ID NO: 655943 - protein, 32 aa, Mycobacterium
ESGIIGFAVGMAMGGFRPVVEMQFDAFAYPAF

SEQ ID NO: 655944 - protein, 21 aa, Mycobacterium
ESGLANLFITGFDVTPGSDAV

SEQ ID NO: 655945 - protein, 22 aa, Mycobacterium
ESGLGWHPLVPFADGAARTIEY

SEQ ID NO: 655946 - protein, 18 aa, Mycobacterium
ESGLLRLPHWDTDHVWHL

SEQ ID NO: 655947 - protein, 22 aa, Mycobacterium
ESGLVFQQFQGGVITARNDAAG

SEQ ID NO: 655948 - protein, 25 aa, Mycobacterium
ESGMPRLYREAPLMGIWEGSGNVSA

SEQ ID NO: 655949 - protein, 17 aa, Mycobacterium
ESGNRVRVYVPFGTQWY

SEQ ID NO: 655950 - protein, 24 aa, Mycobacterium
ESGRAAEINTCIACNQACLDHAFA

SEQ ID NO: 655951 - protein, 22 aa, Mycobacterium
ESGRLAMAMAAVRARKSLDDAA

SEQ ID NO: 655952 - protein, 17 aa, Mycobacterium
ESGRRRASLESDIETLL

SEQ ID NO: 655953 - protein, 20 aa, Mycobacterium
ESGRRVPIVFTPDDIHLFVA

SEQ ID NO: 655954 - protein, 17 aa, Mycobacterium
ESGVPFCTQVGHTGPLR

SEQ ID NO: 655955 - protein, 23 aa, Mycobacterium
ESGWKLEHMPAAMAARTRFFDAF

SEQ ID NO: 655956 - protein, 24 aa, Mycobacterium
ESGWKLEHMPAAMAARTRFFDSFF

SEQ ID NO: 655957 - protein, 18 aa, Mycobacterium
ESGWTFDHFYPIFSDPSG

SEQ ID NO: 655958 - protein, 17 aa, Mycobacterium
ESGWTFDHFYPIFSDSA

SEQ ID NO: 655959 - protein, 18 aa, Mycobacterium
ESGWTFDHFYPIFSDSDG

SEQ ID NO: 655960 - protein, 17 aa, Mycobacterium
ESGWTFDHFYPIFSDSS

SEQ ID NO: 655961 - protein, 25 aa, Mycobacterium
ESGYPRIVKRWRRGTPLSDAEMIFQ

SEQ ID NO: 655962 - protein, 24 aa, Mycobacterium
ESGYPRVAKRWRRGEPLENAETVY

SEQ ID NO: 655963 - protein, 20 aa, Mycobacterium
ESGYRAGLLASIAASCTASY

SEQ ID NO: 655964 - protein, 19 aa, Mycobacterium
ESHCGWPSFFDPSASEAVI

SEQ ID NO: 655965 - protein, 24 aa, Mycobacterium
ESHGYCFQIDLTLRTIAHGFEVAE

SEQ ID NO: 655966 - protein, 25 aa, Mycobacterium
ESHLRKAYNGFRRMGLDADTAETAA

SEQ ID NO: 655967 - protein, 21 aa, Mycobacterium
ESHPLMLRSYFQARSGPGGKR

SEQ ID NO: 655968 - protein, 21 aa, Mycobacterium
ESHPRVMRLSVPGRHMALNAL

SEQ ID NO: 655969 - protein, 30 aa, Mycobacterium
ESHQYVDLVAMFRPITRWADGVPTARAIPE

SEQ ID NO: 655970 - protein, 21 aa, Mycobacterium
ESHWPVARWHRYLRAQLDGGF

SEQ ID NO: 655971 - protein, 37 aa, Mycobacterium
ESIADLERWGMAFARERDGRISQRFFGAHTYRRTAFA

SEQ ID NO: 655972 - protein, 25 aa, Mycobacterium
ESIEFPLSALIKGWQDGIPGMKVGG

SEQ ID NO: 655973 - protein, 19 aa, Mycobacterium
ESIHKCVAVFLNGEAISAP

SEQ ID NO: 655974 - protein, 18 aa, Mycobacterium
ESIICTWTTNLALATDAV

SEQ ID NO: 655975 - protein, 20 aa, Mycobacterium
ESILRLKARLWFVHRGVEKL

SEQ ID NO: 655976 - protein, 26 aa, Mycobacterium
ESINLAGELGRWVMRSACTDFARWRA

SEQ ID NO: 655977 - protein, 19 aa, Mycobacterium
ESIRKFRILPVDFTEDTGE

SEQ ID NO: 655978 - protein, 17 aa, Mycobacterium
ESIRKVLSWLPGRGTNR

SEQ ID NO: 655979 - protein, 22 aa, Mycobacterium
ESIYGWKEYELELMRDGRDNVV

SEQ ID NO: 655980 - protein, 26 aa, Mycobacterium
ESKAALDALVTRWKAESSWASRVSLA

SEQ ID NO: 655981 - protein, 21 aa, Mycobacterium
ESKCSYLAPVAYPDDLRAGLR

SEQ ID NO: 655982 - protein, 20 aa, Mycobacterium
ESKFDAAEVFRACRDSGTAI

SEQ ID NO: 655983 - protein, 29 aa, Mycobacterium
ESKIASWTDPKGGYFVSLDVWPGTAKRTV

SEQ ID NO: 655984 - protein, 20 aa, Mycobacterium
ESKLAVPIHFGGGYGGSPDW

SEQ ID NO: 655985 - protein, 20 aa, Mycobacterium
ESKLAVPIHVGGGYGGDSDW

SEQ ID NO: 655986 - protein, 24 aa, Mycobacterium
ESKNFPGGYGIQISIGRGRPRWAM

SEQ ID NO: 655987 - protein, 22 aa, Mycobacterium
ESKQAIAVLVRLMGELFLQPLV

SEQ ID NO: 655988 - protein, 17 aa, Mycobacterium
ESKRFVVGVTDCPKPPP

SEQ ID NO: 655989 - protein, 22 aa, Mycobacterium
ESKRPLGDGVVTGFGTIDGRDV

SEQ ID NO: 655990 - protein, 22 aa, Mycobacterium
ESKSVYQLTIFISRFPTETTLM

SEQ ID NO: 655991 - protein, 26 aa, Mycobacterium
ESKTLPGMFAGVVPLVLNTSPTASVA

SEQ ID NO: 655992 - protein, 25 aa, Mycobacterium
ESKTVIGLNMLRLWDDRGTLEPWIA

SEQ ID NO: 655993 - protein, 32 aa, Mycobacterium
ESKVPRPARVACRWLRAVALERLGDIEAAERE

SEQ ID NO: 655994 - protein, 24 aa, Mycobacterium
ESLADRLAEAFAERMHERVRTEFW

SEQ ID NO: 655995 - protein, 24 aa, Mycobacterium
ESLADRLAEAFAERMHQRVRKEFW

SEQ ID NO: 655996 - protein, 24 aa, Mycobacterium
ESLADRLAEAFAERMHQRVRTELW

SEQ ID NO: 655997 - protein, 18 aa, Mycobacterium
ESLAEVWRTEGYCHCMFT

SEQ ID NO: 655998 - protein, 19 aa, Mycobacterium
ESLAEWLAGLQERYPDVGV

SEQ ID NO: 655999 - protein, 25 aa, Mycobacterium
ESLAFYRDVLGFEVRLDVGKGKMRW

SEQ ID NO: 656000 - protein, 19 aa, Mycobacterium
ESLAMLFASEALIYGRFGY

SEQ ID NO: 656001 - protein, 22 aa, Mycobacterium
ESLAVVNIMSLFGLHRRLRGAA

SEQ ID NO: 656002 - protein, 26 aa, Mycobacterium
ESLAVVNLMSLFGLHRSLRGAAIGHF

SEQ ID NO: 656003 - protein, 17 aa, Mycobacterium
ESLCDSEAILIERADSD

SEQ ID NO: 656004 - protein, 28 aa, Mycobacterium
ESLDDLRCGGRPMLPLDAERPADAAPDP

SEQ ID NO: 656005 - protein, 24 aa, Mycobacterium
ESLDLRWWPLDALPDGTDFGLDQL

SEQ ID NO: 656006 - protein, 21 aa, Mycobacterium
ESLDRWHDVERTIALNYYAPL

SEQ ID NO: 656007 - protein, 17 aa, Mycobacterium
ESLEAWTTPAIEGALKS

SEQ ID NO: 656008 - protein, 17 aa, Mycobacterium
ESLGDLGHDVMLIVDGD

SEQ ID NO: 656009 - protein, 24 aa, Mycobacterium
ESLGGLTTSLGYRDMIKAVQSNAA

SEQ ID NO: 656010 - protein, 19 aa, Mycobacterium
ESLGLFTQRLRIWGSSDFR

SEQ ID NO: 656011 - protein, 18 aa, Mycobacterium
ESLGLIEACAKRFPGGQM

SEQ ID NO: 656012 - protein, 24 aa, Mycobacterium
ESLGLLTHRFRIWGSSDLRRWLPM

SEQ ID NO: 656013 - protein, 18 aa, Mycobacterium
ESLGRAGTFVGQHIYTSR

SEQ ID NO: 656014 - protein, 24 aa, Mycobacterium
ESLGVCTRGLIGIAGVAAERIHRA

SEQ ID NO: 656015 - protein, 19 aa, Mycobacterium
ESLGVEFTERGNVARDDAY

SEQ ID NO: 656016 - protein, 20 aa, Mycobacterium
ESLHGSADFHALKYRHGRVY

SEQ ID NO: 656017 - protein, 20 aa, Mycobacterium
ESLHRLRGLGPRMVLPGHGP

SEQ ID NO: 656018 - protein, 19 aa, Mycobacterium
ESLHRLRGLGQRTVLPGHG

SEQ ID NO: 656019 - protein, 28 aa, Mycobacterium
ESLHRLRGLGRRAVLPGHGPELSDLEAV

SEQ ID NO: 656020 - protein, 26 aa, Mycobacterium
ESLHVEALAWYDHWLKGRDTGILDGP

SEQ ID NO: 656021 - protein, 30 aa, Mycobacterium
ESLLHAVPLFGFTGCHGLMLLSIRAGVTQI

SEQ ID NO: 656022 - protein, 23 aa, Mycobacterium
ESLLPRYLTTRVYAALLESAASE

SEQ ID NO: 656023 - protein, 23 aa, Mycobacterium
ESLLPRYLTTRVYAAMLESAASE

SEQ ID NO: 656024 - protein, 24 aa, Mycobacterium
ESLLPRYLTTRVYEALLESAASEL

SEQ ID NO: 656025 - protein, 24 aa, Mycobacterium
ESLLPRYVTTRVYAALLESAASEL

SEQ ID NO: 656026 - protein, 27 aa, Mycobacterium
ESLLRAVRMDFPFIWEALSAHTAGGAS

SEQ ID NO: 656027 - protein, 21 aa, Mycobacterium
ESLLRELVCADAARPIDITTD

SEQ ID NO: 656028 - protein, 18 aa, Mycobacterium
ESLLTIPLAESRHDWTAE

SEQ ID NO: 656029 - protein, 19 aa, Mycobacterium
ESLMQLMLARIIHRRTLEL

SEQ ID NO: 656030 - protein, 20 aa, Mycobacterium
ESLPDRASRKIAPTIVRGID

SEQ ID NO: 656031 - protein, 20 aa, Mycobacterium
ESLPEKFRPLPGRRNVVLTR

SEQ ID NO: 656032 - protein, 22 aa, Mycobacterium
ESLPKLNSFVLPGGSPLSAYLH

SEQ ID NO: 656033 - protein, 18 aa, Mycobacterium
ESLPRTGTVYTHTTVRIP

SEQ ID NO: 656034 - protein, 24 aa, Mycobacterium
ESLQRWHDIERTIALNYYAPLRLI

SEQ ID NO: 656035 - protein, 33 aa, Mycobacterium
ESLRAALRAVPAERLWVNPDCGLKTRNSDEVTA

SEQ ID NO: 656036 - protein, 23 aa, Mycobacterium
ESLREFPSALPASRESAYAAWVS

SEQ ID NO: 656037 - protein, 21 aa, Mycobacterium
ESLRIFPATHYVAGPERMAAA

SEQ ID NO: 656038 - protein, 17 aa, Mycobacterium
ESLRLTMYYTAIVGMSC

SEQ ID NO: 656039 - protein, 23 aa, Mycobacterium
ESLRLTTDYLKTRKQFGVTLNKF

SEQ ID NO: 656040 - protein, 21 aa, Mycobacterium
ESLRPKREYSAVSFDAVNTVF

SEQ ID NO: 656041 - protein, 17 aa, Mycobacterium
ESLRRFICDSLSSYYHS

SEQ ID NO: 656042 - protein, 18 aa, Mycobacterium
ESLRRLSVDVVEGSAREV

SEQ ID NO: 656043 - protein, 21 aa, Mycobacterium
ESLRVTMPINIRTAADAGTWG

SEQ ID NO: 656044 - protein, 25 aa, Mycobacterium
ESLSEFTSAVAMSRCDDKRQTRRIV

SEQ ID NO: 656045 - protein, 24 aa, Mycobacterium
ESLSGAPMPDWLAAALATAPPARD

SEQ ID NO: 656046 - protein, 19 aa, Mycobacterium
ESLSREFRGLLDRVPPADP

SEQ ID NO: 656047 - protein, 18 aa, Mycobacterium
ESLSRYVLDAALDSRLDA

SEQ ID NO: 656048 - protein, 25 aa, Mycobacterium
ESLSSLPGCWLLVGADEMRRDVDLV

SEQ ID NO: 656049 - protein, 20 aa, Mycobacterium
ESLTGRELIGNGAAGVAGVD

SEQ ID NO: 656050 - protein, 22 aa, Mycobacterium
ESLVAWRPALAAADRAKVVVVA

SEQ ID NO: 656051 - protein, 24 aa, Mycobacterium
ESLWRLLCEQVGAAALVIPEELGG

SEQ ID NO: 656052 - protein, 22 aa, Mycobacterium
ESLWTALKTLYPVGIDHAPLTH

SEQ ID NO: 656053 - protein, 18 aa, Mycobacterium
ESLYAGMMRVLRTIFQPW

SEQ ID NO: 656054 - protein, 26 aa, Mycobacterium
ESMASMAAFTWLSTRGGGGVVGVNNS

SEQ ID NO: 656055 - protein, 19 aa, Mycobacterium
ESMDVCFELAGRILNAMAG

SEQ ID NO: 656056 - protein, 17 aa, Mycobacterium
ESMFCRLCCSNLRVRRI

SEQ ID NO: 656057 - protein, 20 aa, Mycobacterium
ESMKMEIPVLAEVAGTVTKV

SEQ ID NO: 656058 - protein, 19 aa, Mycobacterium
ESMKMEIPVLAEVDGTVSK

SEQ ID NO: 656059 - protein, 19 aa, Mycobacterium
ESMLNHRSGILGLAGERDF

SEQ ID NO: 656060 - protein, 22 aa, Mycobacterium
ESMSLWARFGRADGVEFVVGDF

SEQ ID NO: 656061 - protein, 20 aa, Mycobacterium
ESMYKLMAYKDEYETARLFL

SEQ ID NO: 656062 - protein, 24 aa, Mycobacterium
ESNAPALLGLIGLWYSNFLGAQSR

SEQ ID NO: 656063 - protein, 24 aa, Mycobacterium
ESNAPALLGLIGLWYSNFMGAQSR

SEQ ID NO: 656064 - protein, 21 aa, Mycobacterium
ESNESFWSILAAFPKPVIAAV

SEQ ID NO: 656065 - protein, 26 aa, Mycobacterium
ESNKEYWRRFGVVPDWAGKRVLDVGC

SEQ ID NO: 656066 - protein, 28 aa, Mycobacterium
ESNKEYWRRLGVAAPDWTGKRVLDVGCG

SEQ ID NO: 656067 - protein, 28 aa, Mycobacterium
ESNPERVWGWYLWRHYLVATVEPNEGHR

SEQ ID NO: 656068 - protein, 26 aa, Mycobacterium
ESNRAWRLYRRLGFTDVIRQHQFAGD

SEQ ID NO: 656069 - protein, 36 aa, Mycobacterium
ESNRYTAAWKRFGQAVPRPRAILVVSAHWYINATAV

SEQ ID NO: 656070 - protein, 26 aa, Mycobacterium
ESPAILLRFCTAPSPSVRSRRRPLAE

SEQ ID NO: 656071 - protein, 17 aa, Mycobacterium
ESPAVAHAVFFGMGSDG

SEQ ID NO: 656072 - protein, 23 aa, Mycobacterium
ESPCGLAELCERTGLPRATAHRL

SEQ ID NO: 656073 - protein, 23 aa, Mycobacterium
ESPCGLAELCERTGLPRATAYRL

SEQ ID NO: 656074 - protein, 21 aa, Mycobacterium
ESPDAPLLLIFPHAGAGASAY

SEQ ID NO: 656075 - protein, 24 aa, Mycobacterium
ESPGFDWTRWLGGLGADRDKAADV

SEQ ID NO: 656076 - protein, 20 aa, Mycobacterium
ESPGLMIAMGPGFCSELVLL

SEQ ID NO: 656077 - protein, 18 aa, Mycobacterium
ESPIVFLRLRKAARKHKV

SEQ ID NO: 656078 - protein, 18 aa, Mycobacterium
ESPIVFLRLRKAARKNGL

SEQ ID NO: 656079 - protein, 20 aa, Mycobacterium
ESPIVFLRLRKGVRKNGVQV

SEQ ID NO: 656080 - protein, 29 aa, Mycobacterium
ESPLPPPTIHRLLRTLVGLGYVRQLPNRR

SEQ ID NO: 656081 - protein, 21 aa, Mycobacterium
ESPPEMMARTSVPTGNVYHVD

SEQ ID NO: 656082 - protein, 25 aa, Mycobacterium
ESPRETWLRLEVIRGGFPRPQTQIP

SEQ ID NO: 656083 - protein, 25 aa, Mycobacterium
ESPRETWLRLLLIDAGYPAPQTQMA

SEQ ID NO: 656084 - protein, 17 aa, Mycobacterium
ESPRPVVQIPLGNHLIH

SEQ ID NO: 656085 - protein, 25 aa, Mycobacterium
ESPWKCWRLLTLETRMQVCRRNSRL

SEQ ID NO: 656086 - protein, 27 aa, Mycobacterium
ESPYGATIAHGFLTLSLIPGVSKDNYR

SEQ ID NO: 656087 - protein, 24 aa, Mycobacterium
ESQALLGYQLWLAVHERGERDLGA

SEQ ID NO: 656088 - protein, 25 aa, Mycobacterium
ESQAPRGSLYFHFPGGKEELATEVV

SEQ ID NO: 656089 - protein, 18 aa, Mycobacterium
ESQARGTPVFGLFLTAGT

SEQ ID NO: 656090 - protein, 27 aa, Mycobacterium
ESQCGWCKDRFGLSWQIVPDRLYELIS

SEQ ID NO: 656091 - protein, 27 aa, Mycobacterium
ESQCGWCKDRFGLSWQIVPDRLYELLS

SEQ ID NO: 656092 - protein, 27 aa, Mycobacterium
ESQCGWLKDKFGLSWQVVSRELIDLIF

SEQ ID NO: 656093 - protein, 27 aa, Mycobacterium
ESQCGWLKDRFGLSWQIVPDRLYELIG

SEQ ID NO: 656094 - protein, 24 aa, Mycobacterium
ESQEPASILILFTPGAPREGYFEG

SEQ ID NO: 656095 - protein, 20 aa, Mycobacterium
ESQLALPQWLADLLPAPLPR

SEQ ID NO: 656096 - protein, 17 aa, Mycobacterium
ESQQILQMFDRVYETGE

SEQ ID NO: 656097 - protein, 20 aa, Mycobacterium
ESQRGNVIPVEISVYEDRSF

SEQ ID NO: 656098 - protein, 17 aa, Mycobacterium
ESQRITPRLGVADDTDS

SEQ ID NO: 656099 - protein, 20 aa, Mycobacterium
ESQVAWILANSFPALSTARL

SEQ ID NO: 656100 - protein, 24 aa, Mycobacterium
ESQWNAKNLFTGWVDVDLTEKGRS

SEQ ID NO: 656101 - protein, 18 aa, Mycobacterium
ESQYPAFGLFGLGPVGGF

SEQ ID NO: 656102 - protein, 25 aa, Mycobacterium
ESRAAGLKAANTWHATRAIQEAREA

SEQ ID NO: 656103 - protein, 19 aa, Mycobacterium
ESRGQWYLRQMLGSANFEG

SEQ ID NO: 656104 - protein, 26 aa, Mycobacterium
ESRIPLDEVDGFVWHAYLPNITPGQR

SEQ ID NO: 656105 - protein, 26 aa, Mycobacterium
ESRITLPEVDGFIWHAYIPNIEPGQR

SEQ ID NO: 656106 - protein, 20 aa, Mycobacterium
ESRLDNVVYRAGLARTRRMA

SEQ ID NO: 656107 - protein, 21 aa, Mycobacterium
ESRPRAGTTVVPRPTTNSYAQ

SEQ ID NO: 656108 - protein, 20 aa, Mycobacterium
ESRRGGGELFAFGHQDGYAL

SEQ ID NO: 656109 - protein, 18 aa, Mycobacterium
ESRRLRRGFTAFGQTQWS

SEQ ID NO: 656110 - protein, 27 aa, Mycobacterium
ESRSALEGLGFRGFWQGYFAARSAPLG

SEQ ID NO: 656111 - protein, 17 aa, Mycobacterium
ESRSWRLSATGDYQERD

SEQ ID NO: 656112 - protein, 23 aa, Mycobacterium
ESRTFTGGHDWLAEHGVKVTVVD

SEQ ID NO: 656113 - protein, 19 aa, Mycobacterium
ESRTRLDSVTGLDEQIAAG

SEQ ID NO: 656114 - protein, 24 aa, Mycobacterium
ESRVIGQLPICWDTDREAAIKRAH

SEQ ID NO: 656115 - protein, 20 aa, Mycobacterium
ESRYGAAVGQAMIQQHEGAG

SEQ ID NO: 656116 - protein, 32 aa, Mycobacterium; identical to SEQ ID NO: 87944

SEQ ID NO: 656117 - protein, 19 aa, Mycobacterium
ESSAARMLKGFKTDLPAAE

SEQ ID NO: 656118 - protein, 20 aa, Mycobacterium
ESSALRMVVFGGEALDPSRL

SEQ ID NO: 656119 - protein, 18 aa, Mycobacterium
ESSAMFALLSGQHVGTAL

SEQ ID NO: 656120 - protein, 21 aa, Mycobacterium
ESSARMATLLKVLPEKQREIL

SEQ ID NO: 656121 - protein, 22 aa, Mycobacterium
ESSDGAAAWAFEEAAMRETELV

SEQ ID NO: 656122 - protein, 17 aa, Mycobacterium
ESSEQRGAGSLSEESTG

SEQ ID NO: 656123 - protein, 18 aa, Mycobacterium
ESSGADLAAERVRELMAE

SEQ ID NO: 656124 - protein, 18 aa, Mycobacterium
ESSGLPCVVTSMWETTIG

SEQ ID NO: 656125 - protein, 25 aa, Mycobacterium
ESSGPLRPTALWAPVLETQIADHVT

SEQ ID NO: 656126 - protein, 20 aa, Mycobacterium
ESSGSFFGYDFKEFRVDPAW

SEQ ID NO: 656127 - protein, 19 aa, Mycobacterium
ESSGWAMVGLHNFGADGCL

SEQ ID NO: 656128 - protein, 23 aa, Mycobacterium
ESSHLYPHFPVFLTEVARVLRPG

SEQ ID NO: 656129 - protein, 20 aa, Mycobacterium
ESSIVTALREQLRTQKQRYQ

SEQ ID NO: 656130 - protein, 20 aa, Mycobacterium
ESSLFGYHAPNPTSLADLRS

SEQ ID NO: 656131 - protein, 18 aa, Mycobacterium
ESSLPPIFSALISTRPQA

SEQ ID NO: 656132 - protein, 24 aa, Mycobacterium
ESSLRPVFERFGADLPPLKGVYLA

SEQ ID NO: 656133 - protein, 18 aa, Mycobacterium
ESSMAAVFDRFGKDLPPL

SEQ ID NO: 656134 - protein, 17 aa, Mycobacterium
ESSRAAFTMLLRQLRGT

SEQ ID NO: 656135 - protein, 22 aa, Mycobacterium
ESSRFLSKMLRAMHTRDLEAAR

SEQ ID NO: 656136 - protein, 19 aa, Mycobacterium
ESSRLQIQASRCMDCGIPF

SEQ ID NO: 656137 - protein, 18 aa, Mycobacterium
ESSTFPWGTTDPRTVADT

SEQ ID NO: 656138 - protein, 29 aa, Mycobacterium
ESSVPPGRLGWNWARFAFNGWKALSWMDA

SEQ ID NO: 656139 - protein, 22 aa, Mycobacterium
ESSVRTAFHYVRTGVTVIPDEL

SEQ ID NO: 656140 - protein, 18 aa, Mycobacterium
ESSWRRPPRPTAHSEDGP

SEQ ID NO: 656141 - protein, 22 aa, Mycobacterium
ESSYLLTLRSAWQADNNVPNSM

SEQ ID NO: 656142 - protein, 23 aa, Mycobacterium
ESTAASLQAQWRGAAGTAAQAAV

SEQ ID NO: 656143 - protein, 19 aa, Mycobacterium
ESTAQLALMIHHLAVDGVS

SEQ ID NO: 656144 - protein, 19 aa, Mycobacterium
ESTARIAVIGGHAHVGVPA

SEQ ID NO: 656145 - protein, 26 aa, Mycobacterium
ESTATFEWAFRWLDAHRPAGSAPVLV

SEQ ID NO: 656146 - protein, 24 aa, Mycobacterium
ESTDLRRARSFAVDYAGWVGLSQD

SEQ ID NO: 656147 - protein, 24 aa, Mycobacterium
ESTIAGSIPWTVGEKQIVGFREML

SEQ ID NO: 656148 - protein, 17 aa, Mycobacterium
ESTLRFLLSGKSAYVDG

SEQ ID NO: 656149 - protein, 18 aa, Mycobacterium
ESTLRLRYPTLLDGQPVR

SEQ ID NO: 656150 - protein, 26 aa, Mycobacterium
ESTNLAMELGRWVMRSACADFSRWQA

SEQ ID NO: 656151 - protein, 37 aa, Mycobacterium
ESTPVDAKVGWKGFHAIERDLWQGGAITPATKAFSTE

SEQ ID NO: 656152 - protein, 20 aa, Mycobacterium
ESTRFFPMLTTAAGTVKPAT

SEQ ID NO: 656153 - protein, 30 aa, Mycobacterium
ESTVPYALRGLLFCAACGRRMQGAARPGKQ

SEQ ID NO: 656154 - protein, 18 aa, Mycobacterium
ESTVSPSFEGIAAVAHVE

SEQ ID NO: 656155 - protein, 18 aa, Mycobacterium
ESTVSPSFEGIAAVARVD

SEQ ID NO: 656156 - protein, 20 aa, Mycobacterium
ESTVVVCWADIQTGKVDHLG

SEQ ID NO: 656157 - protein, 23 aa, Mycobacterium
ESTWPEFFDAIRAAGYTRVSLGM

SEQ ID NO: 656158 - protein, 17 aa, Mycobacterium
ESTWPEFFDAIRSAGYT

SEQ ID NO: 656159 - protein, 24 aa, Mycobacterium
ESTYLRSLREGKLVGARTVGPNGE

SEQ ID NO: 656160 - protein, 21 aa, Mycobacterium
ESVAACLRAVTALPVPVIGAV

SEQ ID NO: 656161 - protein, 22 aa, Mycobacterium
ESVAGIPSYRDVLPGALQTSGT

SEQ ID NO: 656162 - protein, 21 aa, Mycobacterium
ESVAPYARRLLLPTGAPKVDD

SEQ ID NO: 656163 - protein, 26 aa, Mycobacterium
ESVARALGRKFVRVALGGVRDEAEIR

SEQ ID NO: 656164 - protein, 18 aa, Mycobacterium
ESVARLLIPGGVLMIYVA

SEQ ID NO: 656165 - protein, 24 aa, Mycobacterium
ESVCGAGLVTCRFTHVYPDGPAPY

SEQ ID NO: 656166 - protein, 17 aa, Mycobacterium
ESVCVTCSDEGRPGEAV

SEQ ID NO: 656167 - protein, 31 aa, Mycobacterium
ESVEEWTARLAAAGRPMFPVRVSVQDENDRI

SEQ ID NO: 656168 - protein, 27 aa, Mycobacterium
ESVEGPRLLLLGGRSWKVTHIDWERRR

SEQ ID NO: 656169 - protein, 17 aa, Mycobacterium
ESVEPGFSLAVEHRGDY

SEQ ID NO: 656170 - protein, 23 aa, Mycobacterium
ESVEPRVAAATRKELADQRDSLK

SEQ ID NO: 656171 - protein, 18 aa, Mycobacterium
ESVFGGYFKRPDVTADVF

SEQ ID NO: 656172 - protein, 20 aa, Mycobacterium
ESVFGWPVLLEVPDNADEAT

SEQ ID NO: 656173 - protein, 17 aa, Mycobacterium
ESVFRIDHYLGKETVRN

SEQ ID NO: 656174 - protein, 23 aa, Mycobacterium
ESVGFDWAGWATALGAGTEGLAE

SEQ ID NO: 656175 - protein, 24 aa, Mycobacterium
ESVGITRAALYFYFGSKQEVLTAL

SEQ ID NO: 656176 - protein, 18 aa, Mycobacterium
ESVKRFAAVLSNAKTIFW

SEQ ID NO: 656177 - protein, 23 aa, Mycobacterium
ESVKRSIAVISILRQGDQTRVGS

SEQ ID NO: 656178 - protein, 17 aa, Mycobacterium
ESVKWQYVTGVADESLV

SEQ ID NO: 656179 - protein, 18 aa, Mycobacterium
ESVLARFANTALPHTTLQ

SEQ ID NO: 656180 - protein, 19 aa, Mycobacterium
ESVLRRLKQYSGRLATEAV

SEQ ID NO: 656181 - protein, 25 aa, Mycobacterium
ESVLRSRFGFLAIHGGGLERMTDVV

SEQ ID NO: 656182 - protein, 25 aa, Mycobacterium
ESVLSGLTSMYWAGPASESMAAKAA

SEQ ID NO: 656183 - protein, 24 aa, Mycobacterium
ESVMMRLAPVLGRQAAHDQLETLV

SEQ ID NO: 656184 - protein, 17 aa, Mycobacterium
ESVPEFVDAGTGLVDKS

SEQ ID NO: 656185 - protein, 25 aa, Mycobacterium
ESVRELADIPAIEVITKAIVMLMSS

SEQ ID NO: 656186 - protein, 19 aa, Mycobacterium
ESVRHLAFRQGQEILSELI

SEQ ID NO: 656187 - protein, 26 aa, Mycobacterium
ESVRIVREFLVRGVAAAIGRGEVAAD

SEQ ID NO: 656188 - protein, 26 aa, Mycobacterium
ESVRKSDGGWVWKFDPAIYGGEYLDP

SEQ ID NO: 656189 - protein, 17 aa, Mycobacterium
ESVRLAFVAALQYLPPR

SEQ ID NO: 656190 - protein, 23 aa, Mycobacterium
ESVRRAAEIAGDITVLVNNAGIS

SEQ ID NO: 656191 - protein, 27 aa, Mycobacterium
ESVRRTLKGWVWKFDPAIFGGHLAEQT

SEQ ID NO: 656192 - protein, 22 aa, Mycobacterium
ESVRSSGVLPWSRRLSEGELPK

SEQ ID NO: 656193 - protein, 17 aa, Mycobacterium
ESVRVYLATGLSAAEQP

SEQ ID NO: 656194 - protein, 17 aa, Mycobacterium
ESVRVYLATGLTDVGRP

SEQ ID NO: 656195 - protein, 24 aa, Mycobacterium
ESVSFPEVLALAAEALRVRAERDG

SEQ ID NO: 656196 - protein, 17 aa, Mycobacterium
ESVSLRGAIAAAFEVAR

SEQ ID NO: 656197 - protein, 26 aa, Mycobacterium
ESVSREVAEFGIRLTLVEPGGTRTGF

SEQ ID NO: 656198 - protein, 19 aa, Mycobacterium
ESVVIAAPHARVWSVLSDI

SEQ ID NO: 656199 - protein, 22 aa, Mycobacterium
ESVVLRTGFGGTRIVDMLVGDP

SEQ ID NO: 656200 - protein, 24 aa, Mycobacterium
ESVVLSRRGKLWSYTENRYAPPPP

SEQ ID NO: 656201 - protein, 21 aa, Mycobacterium
ESVVRASVVPWVLSAQSRQAL

SEQ ID NO: 656202 - protein, 24 aa, Mycobacterium
ESVVRASVVPWVLSAQSRQALVAQ

SEQ ID NO: 656203 - protein, 18 aa, Mycobacterium
ESVYRLRLALPQLDPGSL

SEQ ID NO: 656204 - protein, 23 aa, Mycobacterium
ESWKQLGKEVTHWDDWSRSPGEA

SEQ ID NO: 656205 - protein, 26 aa, Mycobacterium
ESWKQTLKDTVHWDDWARNPAEAYGE

SEQ ID NO: 656206 - protein, 23 aa, Mycobacterium
ESWNGRFPSDWGVSAHPKVDNKT

SEQ ID NO: 656207 - protein, 23 aa, Mycobacterium
ESWNGRFPTAWGVSAHPKVDNAT

SEQ ID NO: 656208 - protein, 20 aa, Mycobacterium
ESWPRIRVSGRLVRDLMSAW

SEQ ID NO: 656209 - protein, 24 aa, Mycobacterium
ESWQKILIDRLVRYDVDGETARSL

SEQ ID NO: 656210 - protein, 23 aa, Mycobacterium
ESWRLAPVLPKSVTVVNLLPQES

SEQ ID NO: 656211 - protein, 22 aa, Mycobacterium
ESWRVDVARSFPVRSHADRRGE

SEQ ID NO: 656212 - protein, 20 aa, Mycobacterium
ESWWRKLVLDSGFPPPRTQI

SEQ ID NO: 656213 - protein, 24 aa, Mycobacterium
ESWWWRVTHPGLYVSIGRKTANTV

SEQ ID NO: 656214 - protein, 28 aa, Mycobacterium
ESYAAILDALRWLGMDWDEGPEVGGPYE

SEQ ID NO: 656215 - protein, 20 aa, Mycobacterium
ESYAWIPFGGGIHRCIGAAF

SEQ ID NO: 656216 - protein, 19 aa, Mycobacterium
ESYCYIPLLEELGFMPSKK

SEQ ID NO: 656217 - protein, 19 aa, Mycobacterium
ESYLLIPHVGGRRAILDWH

SEQ ID NO: 656218 - protein, 18 aa, Mycobacterium
ESYLPRLALTHGASMATG

SEQ ID NO: 656219 - protein, 20 aa, Mycobacterium
ESYPSIAEVRLSAPNKHHFV

SEQ ID NO: 656220 - protein, 21 aa, Mycobacterium
ESYRNLLVAPYGVRRGIIERI

SEQ ID NO: 656221 - protein, 20 aa, Mycobacterium
ESYRVWRCTANHFELRRIEN

SEQ ID NO: 656222 - protein, 19 aa, Mycobacterium
ETAAICDRMLELGVIIQPT

SEQ ID NO: 656223 - protein, 20 aa, Mycobacterium
ETAAQWIGLISFLMSPGTAR

SEQ ID NO: 656224 - protein, 23 aa, Mycobacterium
ETAARLATRLVDAGCDGLVVSGT

SEQ ID NO: 656225 - protein, 29 aa, Mycobacterium
ETAARLRAAAAWMRTMFAVVPLAVGDRAR

SEQ ID NO: 656226 - protein, 17 aa, Mycobacterium
ETAATVWSNVVMTGGLR

SEQ ID NO: 656227 - protein, 29 aa, Mycobacterium
ETACPLIAGCRLRHALARAKEAFYAELDN

SEQ ID NO: 656228 - protein, 18 aa, Mycobacterium
ETAEGLYARLSSRELANL

SEQ ID NO: 656229 - protein, 19 aa, Mycobacterium
ETAELLYGTALLAEGGAPD

SEQ ID NO: 656230 - protein, 25 aa, Mycobacterium
ETAEYSLRGANLWDEVKDRLDKPGG

SEQ ID NO: 656231 - protein, 25 aa, Mycobacterium
ETAEYSLRGANLWDEVKDRLDRPGG

SEQ ID NO: 656232 - protein, 19 aa, Mycobacterium
ETAFHDLRQLLAVHETAEE

SEQ ID NO: 656233 - protein, 17 aa, Mycobacterium
ETAFRFTDGSGRDAAAA

SEQ ID NO: 656234 - protein, 23 aa, Mycobacterium
ETAIKVGRDLFRKHSHINGEVPS

SEQ ID NO: 656235 - protein, 18 aa, Mycobacterium
ETAILSRELGFAVRVIVN

SEQ ID NO: 656236 - protein, 21 aa, Mycobacterium
ETAIRLGMRAQEFYRESGDRF

SEQ ID NO: 656237 - protein, 24 aa, Mycobacterium
ETAKTFKDGWLHTGDMAREDEDGF

SEQ ID NO: 656238 - protein, 20 aa, Mycobacterium
ETALERYGRIDILIHNAGNV

SEQ ID NO: 656239 - protein, 23 aa, Mycobacterium
ETALPRECLLVFGQEGPGITDDT

SEQ ID NO: 656240 - protein, 23 aa, Mycobacterium
ETALPRECLLVFGQEGPGITDDV

SEQ ID NO: 656241 - protein, 24 aa, Mycobacterium
ETALRLGISKDRWIFPLAGAQAND

SEQ ID NO: 656242 - protein, 26 aa, Mycobacterium
ETALVLGCGPIGMSIIAALHLRGVET

SEQ ID NO: 656243 - protein, 19 aa, Mycobacterium
ETAMLRRRLDRGSAEPTVN

SEQ ID NO: 656244 - protein, 18 aa, Mycobacterium
ETAPEDWEPFLRVNLYGV

SEQ ID NO: 656245 - protein, 34 aa, Mycobacterium
ETAPYNDIVNWKWTDIPGALGFTDHLAFRVRTYG

SEQ ID NO: 656246 - protein, 26 aa, Mycobacterium
ETAPYNDIVSWKWTDVPHALGVTDHL

SEQ ID NO: 656247 - protein, 17 aa, Mycobacterium
ETARELARVGAHVIMAV

SEQ ID NO: 656248 - protein, 19 aa, Mycobacterium
ETARGAVFAAEIAAADDTV

SEQ ID NO: 656249 - protein, 17 aa, Mycobacterium
ETARLAHYVLPAASQFE

SEQ ID NO: 656250 - protein, 17 aa, Mycobacterium
ETARLAHYVLPAATQFE

SEQ ID NO: 656251 - protein, 17 aa, Mycobacterium
ETARLGTSVLVAGLHTP

SEQ ID NO: 656252 - protein, 32 aa, Mycobacterium
ETARPSGQPLLRIWPVSAHTPAALTAQAERLS

SEQ ID NO: 656253 - protein, 17 aa, Mycobacterium
ETARRAVAVATALAPLN

SEQ ID NO: 656254 - protein, 23 aa, Mycobacterium
ETARSAVDAVTFASSGNDLVLEL

SEQ ID NO: 656255 - protein, 22 aa, Mycobacterium
ETARTATVPLEMLAQNRSRLVS

SEQ ID NO: 656256 - protein, 20 aa, Mycobacterium
ETARTIPGFEQFPQNESRHE

SEQ ID NO: 656257 - protein, 17 aa, Mycobacterium
ETARVFAEFTLPEIFDR

SEQ ID NO: 656258 - protein, 25 aa, Mycobacterium
ETATRLGLDLTHVIMRDNSYDMVGF

SEQ ID NO: 656259 - protein, 31 aa, Mycobacterium
ETATYNDIVSWRWTDVPGALGVTNHLAMRAE

SEQ ID NO: 656260 - protein, 31 aa, Mycobacterium
ETAVGPWEWDVKRLVTSMAILGHDFGMSDDD

SEQ ID NO: 656261 - protein, 23 aa, Mycobacterium
ETAWACAGVGWTPITADQLRAAL

SEQ ID NO: 656262 - protein, 23 aa, Mycobacterium
ETAWKVAKQYFKLTGKPGKHKVI

SEQ ID NO: 656263 - protein, 30 aa, Mycobacterium
ETAWRCGQWYTARLSPMPLRPEERKTTVVE

SEQ ID NO: 656264 - protein, 24 aa, Mycobacterium
ETAWRNDEWHTARLSPAPLLPEER

SEQ ID NO: 656265 - protein, 19 aa, Mycobacterium
ETAYAWKSIIARGNGSGPV

SEQ ID NO: 656266 - protein, 18 aa, Mycobacterium
ETAYCLGVEKLLGITDDI

SEQ ID NO: 656267 - protein, 17 aa, Mycobacterium
ETAYCLGVEKLLGITDE

SEQ ID NO: 656268 - protein, 18 aa, Mycobacterium
ETAYCLGVEKLLGITEEI

SEQ ID NO: 656269 - protein, 20 aa, Mycobacterium
ETCDAMLALVAKLEPDQRAT

SEQ ID NO: 656270 - protein, 21 aa, Mycobacterium
ETCGGCVYDGVALDGVEVRIG

SEQ ID NO: 656271 - protein, 26 aa, Mycobacterium
ETCRELAKRAGAVGVSIVDAPVSGGG

SEQ ID NO: 656272 - protein, 21 aa, Mycobacterium
ETCRTEVFFFPAAGHVEKAGT

SEQ ID NO: 656273 - protein, 25 aa, Mycobacterium
ETCWRDYRLGVLQAPLISALGFAFA

SEQ ID NO: 656274 - protein, 21 aa, Mycobacterium
ETDALAGIALEIFGEDRVVVA

SEQ ID NO: 656275 - protein, 26 aa, Mycobacterium
ETDHYGLPIARFDYHLSDNDKANMEY

SEQ ID NO: 656276 - protein, 18 aa, Mycobacterium
ETDLRPEQGLPYQRMAPV

SEQ ID NO: 656277 - protein, 26 aa, Mycobacterium
ETDLSDRADLVWRSTAATALPALLQA

SEQ ID NO: 656278 - protein, 21 aa, Mycobacterium
ETDPVLAEWFLRRTSLLDSLY

SEQ ID NO: 656279 - protein, 22 aa, Mycobacterium
ETDQVFGWIAFEFGVYRYGLQQ

SEQ ID NO: 656280 - protein, 24 aa, Mycobacterium
ETDQVFGWVAFEFGLYRYGLQARL

SEQ ID NO: 656281 - protein, 17 aa, Mycobacterium
ETDRLAALSAEINRLGG

SEQ ID NO: 656282 - protein, 27 aa, Mycobacterium
ETDRPFLMPVEDVFTITGRGTVVTGRV

SEQ ID NO: 656283 - protein, 18 aa, Mycobacterium
ETDRPIWILLDSDENGRH

SEQ ID NO: 656284 - protein, 31 aa, Mycobacterium
ETDRWPRQPGRYFTVRAGSLVAWNSQLATGT

SEQ ID NO: 656285 - protein, 23 aa, Mycobacterium
ETDTWWRIDWNTLIDPSVPLGLF

SEQ ID NO: 656286 - protein, 23 aa, Mycobacterium
ETDVKRQLLLDALADELEVQVGQ

SEQ ID NO: 656287 - protein, 20 aa, Mycobacterium
ETDVLAGFVLARASAGLVDS

SEQ ID NO: 656288 - protein, 27 aa, Mycobacterium
ETDVNARWQANMAEFFVSDGSNPDQLM

SEQ ID NO: 656289 - protein, 25 aa, Mycobacterium
ETDVYWCTADIGWVTGHTYIVYGPL

SEQ ID NO: 656290 - protein, 25 aa, Mycobacterium
ETEGRPRLRYWLDRLSTDGILAHAA

SEQ ID NO: 656291 - protein, 22 aa, Mycobacterium
ETEGVGAFIAWGRAATPPPATV

SEQ ID NO: 656292 - protein, 26 aa, Mycobacterium
ETEGWLRLYPKRGALVVPITPEERRH

SEQ ID NO: 656293 - protein, 19 aa, Mycobacterium
ETEHLRTGAVSAFGVSGTN

SEQ ID NO: 656294 - protein, 23 aa, Mycobacterium
ETELARLASPIGLDLGARTPEET

SEQ ID NO: 656295 - protein, 24 aa, Mycobacterium
ETELGPLVPCWHGDIPVATQDSIE

SEQ ID NO: 656296 - protein, 20 aa, Mycobacterium
ETELRSLLIHDADHGEDDMA

SEQ ID NO: 656297 - protein, 24 aa, Mycobacterium
ETEQRIYLLNAWAEAGDIYTDREK

SEQ ID NO: 656298 - protein, 17 aa, Mycobacterium
ETERLRLGTSVVQMSAR

SEQ ID NO: 656299 - protein, 25 aa, Mycobacterium
ETERWLRERLAVLRPGEHVLGEEEG

SEQ ID NO: 656300 - protein, 25 aa, Mycobacterium
ETESGKSWFALACAAAELATGAYVV

SEQ ID NO: 656301 - protein, 19 aa, Mycobacterium
ETEWIPPPHLDRGQPRTNS

SEQ ID NO: 656302 - protein, 20 aa, Mycobacterium
ETFAPMRILTGIEVDILDDG

SEQ ID NO: 656303 - protein, 25 aa, Mycobacterium
ETFAREFARLGSFVAAVDALRGTGR

SEQ ID NO: 656304 - protein, 27 aa, Mycobacterium
ETFARSFRLTGRMFRRRPEESGVVLSH

SEQ ID NO: 656305 - protein, 27 aa, Mycobacterium
ETFAVSFRLTGRLFRRRGLETDILLAT

SEQ ID NO: 656306 - protein, 24 aa, Mycobacterium
ETFDAIVIGAGFSGLAILHHLREI

SEQ ID NO: 656307 - protein, 24 aa, Mycobacterium
ETFDAVCCFGALYLMPEPFDITRE

SEQ ID NO: 656308 - protein, 27 aa, Mycobacterium
ETFELRPHFEWRGLGFISQSALKIHPD

SEQ ID NO: 656309 - protein, 27 aa, Mycobacterium
ETFERWLECKGSVRLTALALDRHVNTV

SEQ ID NO: 656310 - protein, 17 aa, Mycobacterium
ETFHMAQLIPWIEANFR

SEQ ID NO: 656311 - protein, 18 aa, Mycobacterium
ETFPFPFAADTYRYTTNV

SEQ ID NO: 656312 - protein, 18 aa, Mycobacterium
ETFRYLYVDIDGNPIATR

SEQ ID NO: 656313 - protein, 18 aa, Mycobacterium
ETFSEPAPKVLALAGGVP

SEQ ID NO: 656314 - protein, 20 aa, Mycobacterium
ETFSVALSFEDGVTRFITCR

SEQ ID NO: 656315 - protein, 20 aa, Mycobacterium
ETGDAVTRSVFCRRTASADQ

SEQ ID NO: 656316 - protein, 24 aa, Mycobacterium
ETGEPLWGSWYVGRPILVTANDYG

SEQ ID NO: 656317 - protein, 22 aa, Mycobacterium
ETGERSLLLGQFVKSFQDLPSA

SEQ ID NO: 656318 - protein, 18 aa, Mycobacterium
ETGEVWVSGPAVVRGYLA

SEQ ID NO: 656319 - protein, 18 aa, Mycobacterium
ETGKPWSGRHLVECLEVG

SEQ ID NO: 656320 - protein, 20 aa, Mycobacterium
ETGKRLGATINDMVLAMSTG

SEQ ID NO: 656321 - protein, 19 aa, Mycobacterium
ETGLCAASLELLGRLDTAP

SEQ ID NO: 656322 - protein, 20 aa, Mycobacterium
ETGLPVTFSLLVLNAGEPLW

SEQ ID NO: 656323 - protein, 24 aa, Mycobacterium
ETGLREGFELMAMGRALLREPDLV

SEQ ID NO: 656324 - protein, 20 aa, Mycobacterium
ETGLSPMQWLTEQRLHRACE

SEQ ID NO: 656325 - protein, 18 aa, Mycobacterium
ETGPESWLTTPVGPGRQE

SEQ ID NO: 656326 - protein, 30 aa, Mycobacterium
ETGPIVVVGHSFGGAIALHLAARRPDLVKS

SEQ ID NO: 656327 - protein, 23 aa, Mycobacterium
ETGQQRWRFVITAHHIVIDGWSL

SEQ ID NO: 656328 - protein, 18 aa, Mycobacterium
ETGQRVVSIFSRPDTGSG

SEQ ID NO: 656329 - protein, 18 aa, Mycobacterium
ETGRELFGRLLASADVFL

SEQ ID NO: 656330 - protein, 24 aa, Mycobacterium
ETGRLRLARCVVEDGWPLRRAAER

SEQ ID NO: 656331 - protein, 24 aa, Mycobacterium
ETGRRFSGVRILTALALGRLQRSP

SEQ ID NO: 656332 - protein, 22 aa, Mycobacterium
ETGRTIYQFAVREVYKGDVGPT

SEQ ID NO: 656333 - protein, 24 aa, Mycobacterium
ETGSRLPLTLSMLLFDSSGVNKDA

SEQ ID NO: 656334 - protein, 26 aa, Mycobacterium
ETGTGCVPCSSMGRLFDAVASLLGVR

SEQ ID NO: 656335 - protein, 25 aa, Mycobacterium
ETGTGCVPCTSMGRLFDAVASLLGV

SEQ ID NO: 656336 - protein, 20 aa, Mycobacterium
ETGVAFALVHNRLLTPLVAT

SEQ ID NO: 656337 - protein, 19 aa, Mycobacterium
ETGVGKEIPVTLVMDHPRL

SEQ ID NO: 656338 - protein, 21 aa, Mycobacterium
ETGVRRFALRPVTGIDPAAAS

SEQ ID NO: 656339 - protein, 18 aa, Mycobacterium
ETHAAFTRSGKGGVAQVD

SEQ ID NO: 656340 - protein, 23 aa, Mycobacterium
ETHAFLKRCRKAIDDEYPGRVLL

SEQ ID NO: 656341 - protein, 17 aa, Mycobacterium
ETHAGFVAPDWMSNGPI

SEQ ID NO: 656342 - protein, 18 aa, Mycobacterium
ETHLRRHTPWGARVSIHR

SEQ ID NO: 656343 - protein, 26 aa, Mycobacterium
ETHPAVSWVRYPYLSSHPQYDLAKRQ

SEQ ID NO: 656344 - protein, 22 aa, Mycobacterium
ETHPEPTGGRRARRRADQAADA

SEQ ID NO: 656345 - protein, 23 aa, Mycobacterium
ETHPIPAWIVVGAGTGGTSATIG

SEQ ID NO: 656346 - protein, 20 aa, Mycobacterium
ETHPRLELDQALKRLHTLRE

SEQ ID NO: 656347 - protein, 18 aa, Mycobacterium
ETHRARAVILAMGAAARY

SEQ ID NO: 656348 - protein, 23 aa, Mycobacterium
ETHRFDFCFIGAGYEDQVDEFLS

SEQ ID NO: 656349 - protein, 24 aa, Mycobacterium
ETHWWSHRALWHLIFSGALDRHPD

SEQ ID NO: 656350 - protein, 26 aa, Mycobacterium
ETIGGWSAQSRFLLNVPLFHRESVHP

SEQ ID NO: 656351 - protein, 20 aa, Mycobacterium
ETIGQLLFRRWRIRLCGVEL

SEQ ID NO: 656352 - protein, 22 aa, Mycobacterium
ETIIEARCGIGYLHTGIEKNLE

SEQ ID NO: 656353 - protein, 20 aa, Mycobacterium
ETIKSALLTAYRHTQGHQTD

SEQ ID NO: 656354 - protein, 18 aa, Mycobacterium
ETILIAWLPLLRALTAAT

SEQ ID NO: 656355 - protein, 21 aa, Mycobacterium
ETIRLPKTILMYPMTLASQAA

SEQ ID NO: 656356 - protein, 28 aa, Mycobacterium
ETISGLKFKIRFLRVNRRHHSVAIAATN

SEQ ID NO: 656357 - protein, 24 aa, Mycobacterium
ETITFPQFRTLVILFNEGPINLAT

SEQ ID NO: 656358 - protein, 22 aa, Mycobacterium
ETITVTPLRAFPVIRDLVTDVS

SEQ ID NO: 656359 - protein, 25 aa, Mycobacterium
ETIVSLDPWGAMVADAFRGQIADGV

SEQ ID NO: 656360 - protein, 24 aa, Mycobacterium
ETIYHFTRRLLVGIASDIERAAVY

SEQ ID NO: 656361 - protein, 20 aa, Mycobacterium
ETKAGVGGAHIVMIGILPTL

SEQ ID NO: 656362 - protein, 19 aa, Mycobacterium
ETKASPWLTRHPEMPDWHL

SEQ ID NO: 656363 - protein, 23 aa, Mycobacterium
ETKEILGAAVFGVGGDEAIHCIL

SEQ ID NO: 656364 - protein, 18 aa, Mycobacterium
ETKGEWYLRQMLGAANFK

SEQ ID NO: 656365 - protein, 23 aa, Mycobacterium
ETKGVFPGLGMPTAAGMGQAVPV

SEQ ID NO: 656366 - protein, 37 aa, Mycobacterium
ETKQALTEAVLWPLQHPETFQRLGVEPPRGVLLYGPP

SEQ ID NO: 656367 - protein, 26 aa, Mycobacterium
ETKVAWDFIHATGFLGGQITLQTTWS

SEQ ID NO: 656368 - protein, 19 aa, Mycobacterium
ETLARRALFAASLGQDARS

SEQ ID NO: 656369 - protein, 22 aa, Mycobacterium
ETLARSGARVVAVDLPNANTDA

SEQ ID NO: 656370 - protein, 17 aa, Mycobacterium
ETLCRRYEFLDVVRVGV

SEQ ID NO: 656371 - protein, 20 aa, Mycobacterium
ETLDDGRIARIWLNRPEAHN

SEQ ID NO: 656372 - protein, 19 aa, Mycobacterium
ETLDEGRIARIWLNRPEAH

SEQ ID NO: 656373 - protein, 20 aa, Mycobacterium
ETLDEGRIARIWLNRPEAHN

SEQ ID NO: 656374 - protein, 33 aa, Mycobacterium
ETLDHFLGVMLRAPFRLARDVIVHMQPGSAIIN

SEQ ID NO: 656375 - protein, 18 aa, Mycobacterium
ETLDTMPFWLSQLQGEDP

SEQ ID NO: 656376 - protein, 17 aa, Mycobacterium
ETLFVRRAIDLHHKQAV

SEQ ID NO: 656377 - protein, 19 aa, Mycobacterium
ETLGFFAGVGIPIAEIWGM

SEQ ID NO: 656378 - protein, 26 aa, Mycobacterium
ETLGFKSRGAFRVPVPPEFGPVRVRF

SEQ ID NO: 656379 - protein, 26 aa, Mycobacterium
ETLGGEPLEIYPFLGSYLLGEAIDQA

SEQ ID NO: 656380 - protein, 23 aa, Mycobacterium
ETLGLEVCEVLSPVPSGPSLDKW

SEQ ID NO: 656381 - protein, 25 aa, Mycobacterium
ETLHELYERWPFFRSVLSNMAQVLA

SEQ ID NO: 656382 - protein, 22 aa, Mycobacterium
ETLHPGRIDLGLGRAPGTDQVT

SEQ ID NO: 656383 - protein, 20 aa, Mycobacterium
ETLHSFDWSAPRPTPEPDVL

SEQ ID NO: 656384 - protein, 20 aa, Mycobacterium
ETLIIRSELDFWSRPEDVED

SEQ ID NO: 656385 - protein, 25 aa, Mycobacterium
ETLLGCPRCGTQFDVVHAGAGAGGT

SEQ ID NO: 656386 - protein, 19 aa, Mycobacterium
ETLLMKAIYEFHPDYVDSR

SEQ ID NO: 656387 - protein, 25 aa, Mycobacterium
ETLLRAWKAYDRFEGKSSIRTWLHR

SEQ ID NO: 656388 - protein, 26 aa, Mycobacterium
ETLLRAWKSYDRFEGKSSLRTWLHRI

SEQ ID NO: 656389 - protein, 24 aa, Mycobacterium
ETLLRAWRAYDRFEGKSSMRTWLH

SEQ ID NO: 656390 - protein, 25 aa, Mycobacterium
ETLLVIICGVGLYAGYVESYQQMLA

SEQ ID NO: 656391 - protein, 20 aa, Mycobacterium
ETLNLTHLPGYRVGGTIHII

SEQ ID NO: 656392 - protein, 17 aa, Mycobacterium
ETLNRSSLRGVDVGARV

SEQ ID NO: 656393 - protein, 22 aa, Mycobacterium
ETLPPGVVNAVFGGRETGQYMV

SEQ ID NO: 656394 - protein, 22 aa, Mycobacterium
ETLPRNEIVAGMAEIVKAGFIA

SEQ ID NO: 656395 - protein, 21 aa, Mycobacterium
ETLPSIFGLEPFSGRGRADIQ

SEQ ID NO: 656396 - protein, 17 aa, Mycobacterium
ETLPTMPPWHVQENKWR

SEQ ID NO: 656397 - protein, 19 aa, Mycobacterium
ETLQLLPLTPFIPQRAVAR

SEQ ID NO: 656398 - protein, 17 aa, Mycobacterium
ETLREICEFPFSRLYEK

SEQ ID NO: 656399 - protein, 25 aa, Mycobacterium
ETLRLHPPLIILMRVAKGEFEVEGY

SEQ ID NO: 656400 - protein, 25 aa, Mycobacterium
ETLRLHPPLIILMRVAKGEFQVEGY

SEQ ID NO: 656401 - protein, 23 aa, Mycobacterium
ETLRLHPPLIILMRVAQDEFEVA

SEQ ID NO: 656402 - protein, 18 aa, Mycobacterium
ETLRLYPPGWIISRVATA

SEQ ID NO: 656403 - protein, 23 aa, Mycobacterium
ETLRPDIWVKGGDYVAAELPEAD

SEQ ID NO: 656404 - protein, 22 aa, Mycobacterium
ETLRPVPVGAIGEIYIAGTHLA

SEQ ID NO: 656405 - protein, 23 aa, Mycobacterium
ETLRTLGLRRIRHSVIREDNPQT

SEQ ID NO: 656406 - protein, 24 aa, Mycobacterium
ETLSEPIPLPGMVASQLSISAGGS

SEQ ID NO: 656407 - protein, 18 aa, Mycobacterium
ETLSILRRPDGVVVASEP

SEQ ID NO: 656408 - protein, 23 aa, Mycobacterium
ETLSRLFHRIAFTSPESASRAIL

SEQ ID NO: 656409 - protein, 20 aa, Mycobacterium
ETLTTLVIRGEGGFGGEPGQ

SEQ ID NO: 656410 - protein, 20 aa, Mycobacterium
ETLTTLVIRGEGGFGGMPGQ

SEQ ID NO: 656411 - protein, 17 aa, Mycobacterium
ETLVPYAVDHGVRLALE

SEQ ID NO: 656412 - protein, 18 aa, Mycobacterium
ETLVRHTYDWSKVTDKKL

SEQ ID NO: 656413 - protein, 25 aa, Mycobacterium
ETLWTALKTLYPVGIDHRDLIDSDA

SEQ ID NO: 656414 - protein, 24 aa, Mycobacterium
ETMDVCFELATKLVAAMGAITVVD

SEQ ID NO: 656415 - protein, 20 aa, Mycobacterium
ETMRHLRRAIQIPGAAHSAL

SEQ ID NO: 656416 - protein, 19 aa, Mycobacterium
ETMSRWRPTLSGERSAYVY

SEQ ID NO: 656417 - protein, 39 aa, Mycobacterium
ETMVKAFAGFRSFRAGTNLKAWLYRILTNTYINSYRKRQ

SEQ ID NO: 656418 - protein, 39 aa, Mycobacterium; identical to SEQ ID NO: 87956

SEQ ID NO: 656419 - protein, 25 aa, Mycobacterium
ETMVKAYSGFRSFREGTNLKAWLYR

SEQ ID NO: 656420 - protein, 21 aa, Mycobacterium
ETNAADICRLLAAGSTVITTT

SEQ ID NO: 656421 - protein, 21 aa, Mycobacterium
ETNLRVGISVWERYTGPYTEE

SEQ ID NO: 656422 - protein, 31 aa, Mycobacterium
ETNPVLAEWFLRRFSLLDSLYMIPPPRIVGR

SEQ ID NO: 656423 - protein, 18 aa, Mycobacterium
ETPAAVVAFASWPQQAVL

SEQ ID NO: 656424 - protein, 24 aa, Mycobacterium
ETPARLFYERSFGKLDETVGGALG

SEQ ID NO: 656425 - protein, 22 aa, Mycobacterium
ETPDCRRQFLLAYFGDHLPRPC

SEQ ID NO: 656426 - protein, 25 aa, Mycobacterium
ETPEPTFRGAVLVGDEPESRLILEH

SEQ ID NO: 656427 - protein, 19 aa, Mycobacterium
ETPGFRVSPAPTFSVSRPQ

SEQ ID NO: 656428 - protein, 17 aa, Mycobacterium
ETPPAAVPHGGEPGAPP

SEQ ID NO: 656429 - protein, 25 aa, Mycobacterium
ETPPRWRRMAEGVLHSKTRDAEAIH

SEQ ID NO: 656430 - protein, 17 aa, Mycobacterium
ETPPWQGGGNMIADVTL

SEQ ID NO: 656431 - protein, 17 aa, Mycobacterium
ETPRPATPVADAEAVLN

SEQ ID NO: 656432 - protein, 21 aa, Mycobacterium
ETPTIATLVAWANEAGLGREV

SEQ ID NO: 656433 - protein, 19 aa, Mycobacterium
ETPTPYFAVGQGYDNFTQT

SEQ ID NO: 656434 - protein, 19 aa, Mycobacterium
ETPVAVVAFASWPQETVLR

SEQ ID NO: 656435 - protein, 26 aa, Mycobacterium
ETPVEMIFRDMRAFRLYDGPTEVHKY

SEQ ID NO: 656436 - protein, 35 aa, Mycobacterium
ETPVPVPPAPWFPKDVDAWNVRWVALHLVEELARH

SEQ ID NO: 656437 - protein, 21 aa, Mycobacterium
ETPWSSLLPVGSRFAAGNGVV

SEQ ID NO: 656438 - protein, 20 aa, Mycobacterium
ETQPAAADPIVFITGGPGED

SEQ ID NO: 656439 - protein, 20 aa, Mycobacterium
ETQPGAFAFEGMMVDAPVLR

SEQ ID NO: 656440 - protein, 22 aa, Mycobacterium
ETQSGTTLAEFVAIQAGQLAGQ

SEQ ID NO: 656441 - protein, 23 aa, Mycobacterium
ETQTVLWARMLDRLAGASPPAIV

SEQ ID NO: 656442 - protein, 25 aa, Mycobacterium
ETQTVLWMRMLDRLAGPNPPAIVCI

SEQ ID NO: 656443 - protein, 18 aa, Mycobacterium
ETRAGFANLDRDYFTMVA

SEQ ID NO: 656444 - protein, 22 aa, Mycobacterium
ETRARGWTFTWEGYDPPNEKLR

SEQ ID NO: 656445 - protein, 21 aa, Mycobacterium
ETRARKVLVATEVGMLHQLRR

SEQ ID NO: 656446 - protein, 17 aa, Mycobacterium
ETRCVSMVADLFHAEGL

SEQ ID NO: 656447 - protein, 23 aa, Mycobacterium
ETREIMSYGSGYGGNALLGKKCY

SEQ ID NO: 656448 - protein, 19 aa, Mycobacterium
ETREIWSYGSGYGGNALLG

SEQ ID NO: 656449 - protein, 27 aa, Mycobacterium
ETRERVRRWARARLDRPPGDAFLAEIL

SEQ ID NO: 656450 - protein, 23 aa, Mycobacterium
ETREVFTPAAWIEMRIDQWNGPT

SEQ ID NO: 656451 - protein, 24 aa, Mycobacterium
ETRGCGQWPGAVTRLDAPVIPHMG

SEQ ID NO: 656452 - protein, 17 aa, Mycobacterium
ETRIELFTQATDTRPDE

SEQ ID NO: 656453 - protein, 17 aa, Mycobacterium
ETRIELFTQSTDTRPQE

SEQ ID NO: 656454 - protein, 17 aa, Mycobacterium
ETRIEVFTQSTDTRPEE

SEQ ID NO: 656455 - protein, 18 aa, Mycobacterium
ETRKRRRGILGYDDLLLR

SEQ ID NO: 656456 - protein, 24 aa, Mycobacterium
ETRPGDRWRLAAPHGAMHVDREAG

SEQ ID NO: 656457 - protein, 25 aa, Mycobacterium
ETRPKEFATVLAPLHRLLGDILRRG

SEQ ID NO: 656458 - protein, 26 aa, Mycobacterium
ETRPRWKRDLAWWFGGKVLATARASA

SEQ ID NO: 656459 - protein, 25 aa, Mycobacterium
ETRRLFAGGFGRRFNQGGGGFGGGF

SEQ ID NO: 656460 - protein, 23 aa, Mycobacterium
ETRRLLKATVDWFEERGKTRLLQ

SEQ ID NO: 656461 - protein, 17 aa, Mycobacterium
ETRRSSVQTGIDRVTAA

SEQ ID NO: 656462 - protein, 22 aa, Mycobacterium
ETRTGDIWLFRGASGPDRAIRT

SEQ ID NO: 656463 - protein, 24 aa, Mycobacterium
ETRTGDLWLFRGRSGPDRAIQTLT

SEQ ID NO: 656464 - protein, 17 aa, Mycobacterium
ETRVHRLAVGIYDDDVA

SEQ ID NO: 656465 - protein, 23 aa, Mycobacterium
ETRYPAFRLSAARNRDIAGRPQE

SEQ ID NO: 656466 - protein, 25 aa, Mycobacterium
ETRYWSVALESIWHECLEPDSRHSS

SEQ ID NO: 656467 - protein, 19 aa, Mycobacterium
ETSDRLGLQIVRTLVSAEI

SEQ ID NO: 656468 - protein, 17 aa, Mycobacterium
ETSFRVFQAPYVGAVVM

SEQ ID NO: 656469 - protein, 21 aa, Mycobacterium
ETSHEGVDWLLARDEKPDMVF

SEQ ID NO: 656470 - protein, 23 aa, Mycobacterium
ETSKEFAGRIAAAIDGASLTLLL

SEQ ID NO: 656471 - protein, 18 aa, Mycobacterium
ETSLLWGLLQTASAGGLT

SEQ ID NO: 656472 - protein, 17 aa, Mycobacterium
ETSMMRYLRELADKDIA

SEQ ID NO: 656473 - protein, 20 aa, Mycobacterium
ETSPGRWALTREGGHSQRRI

SEQ ID NO: 656474 - protein, 22 aa, Mycobacterium
ETSRALRFWEVMYPSPPPGPAV

SEQ ID NO: 656475 - protein, 22 aa, Mycobacterium
ETSSDVWELYPFFDTSDKKRLK

SEQ ID NO: 656476 - protein, 23 aa, Mycobacterium
ETSTGRWALTREGGHSRRRIVHA

SEQ ID NO: 656477 - protein, 17 aa, Mycobacterium
ETSWLDPFTEFRFPRIG

SEQ ID NO: 656478 - protein, 20 aa, Mycobacterium
ETSYGLKMVVDGVVESPCGR

SEQ ID NO: 656479 - protein, 20 aa, Mycobacterium
ETTALGLLAGVPAAYVANTI

SEQ ID NO: 656480 - protein, 22 aa, Mycobacterium
ETTDALVVWLPQERILFTGNLF

SEQ ID NO: 656481 - protein, 26 aa, Mycobacterium
ETTDGAAFHRLCFGLAAGGVGNRFYD

SEQ ID NO: 656482 - protein, 29 aa, Mycobacterium
ETTETMLPFCWRGVSLHAGGAGRVRARLA

SEQ ID NO: 656483 - protein, 23 aa, Mycobacterium
ETTFAAGVVPDFALTRGNGDPLY

SEQ ID NO: 656484 - protein, 22 aa, Mycobacterium
ETTGALKSRLMIAAVAAGATAA

SEQ ID NO: 656485 - protein, 19 aa, Mycobacterium
ETTGEAGDGVWAIFTVDGE

SEQ ID NO: 656486 - protein, 21 aa, Mycobacterium
ETTIRFRYNRLLESNAARVMC

SEQ ID NO: 656487 - protein, 18 aa, Mycobacterium
ETTIRKTAEFGFLRQLRG

SEQ ID NO: 656488 - protein, 24 aa, Mycobacterium
ETTKGEAECAHWVAEQLAEAGYQP

SEQ ID NO: 656489 - protein, 24 aa, Mycobacterium
ETTKGEAECAQWVAEQLAEVGYAP

SEQ ID NO: 656490 - protein, 24 aa, Mycobacterium
ETTKGEAECARWIQQQLEEVGYTC

SEQ ID NO: 656491 - protein, 25 aa, Mycobacterium
ETTKGEAECARWVAEQLAEVGYQTE

SEQ ID NO: 656492 - protein, 23 aa, Mycobacterium
ETTLPRECLLLFGQEGPGITADA

SEQ ID NO: 656493 - protein, 19 aa, Mycobacterium
ETTMDLQVAHAIAPDARKV

SEQ ID NO: 656494 - protein, 18 aa, Mycobacterium
ETTPLPAVDVRYPRIVAA

SEQ ID NO: 656495 - protein, 20 aa, Mycobacterium
ETTPQHWDAILGINVGGVIS

SEQ ID NO: 656496 - protein, 24 aa, Mycobacterium
ETTRGEAECAQWVAEQLAQVGYLP

SEQ ID NO: 656497 - protein, 23 aa, Mycobacterium
ETTRPLVICDLGMPRDVDPAVAG

SEQ ID NO: 656498 - protein, 27 aa, Mycobacterium
ETTRYEAWSFPDFTTGVAALRAVTQTG

SEQ ID NO: 656499 - protein, 17 aa, Mycobacterium
ETTRYETGVAFSFSVFP

SEQ ID NO: 656500 - protein, 22 aa, Mycobacterium
ETTSVFRADFLNELDAPAQAGT

SEQ ID NO: 656501 - protein, 21 aa, Mycobacterium
ETTTRLIGWAAKTLAEHPDQR

SEQ ID NO: 656502 - protein, 21 aa, Mycobacterium
ETTTRLIGWAGKVLAEHPDQR

SEQ ID NO: 656503 - protein, 22 aa, Mycobacterium
ETTTRLIGWSGKVLAEHPDQRR

SEQ ID NO: 656504 - protein, 22 aa, Mycobacterium
ETTVCASISKPLIPGSGVVPIG

SEQ ID NO: 656505 - protein, 28 aa, Mycobacterium
ETTVEASMIWQWFIDPVVREQFPDVEHD

SEQ ID NO: 656506 - protein, 22 aa, Mycobacterium
ETVAGLLAPLAIEHTLQYRRGV

SEQ ID NO: 656507 - protein, 27 aa, Mycobacterium
ETVAPSPARPGAPIPVASAGSGGGGGA

SEQ ID NO: 656508 - protein, 25 aa, Mycobacterium
ETVDPEIWVPWGYAVVRVDSRGAGR

SEQ ID NO: 656509 - protein, 18 aa, Mycobacterium
ETVGFAVRFRQLHENSTG

SEQ ID NO: 656510 - protein, 23 aa, Mycobacterium
ETVGMLFSPGYPGFLRGVVAVGG

SEQ ID NO: 656511 - protein, 23 aa, Mycobacterium
ETVGRYNLRLEVGSVQDDIDSGA

SEQ ID NO: 656512 - protein, 24 aa, Mycobacterium
ETVIAVLTGDGWLGPASESMEAAV

SEQ ID NO: 656513 - protein, 20 aa, Mycobacterium
ETVLAGYGFRTDRRAHAEIS

SEQ ID NO: 656514 - protein, 17 aa, Mycobacterium
ETVLHFAVYAGWPKASR

SEQ ID NO: 656515 - protein, 18 aa, Mycobacterium
ETVPGVWAHLALDPPVAH

SEQ ID NO: 656516 - protein, 23 aa, Mycobacterium
ETVPIDMTPFFAAADLLYNGALV

SEQ ID NO: 656517 - protein, 17 aa, Mycobacterium
ETVREVHRADLIGQHIG

SEQ ID NO: 656518 - protein, 21 aa, Mycobacterium
ETVRKCARTFSNMVDLMDRHP

SEQ ID NO: 656519 - protein, 25 aa, Mycobacterium
ETVRLIRDFGRRCVSRVVDVRDEAQ

SEQ ID NO: 656520 - protein, 23 aa, Mycobacterium
ETVTDARCGIGYLHTGIEKNLEY

SEQ ID NO: 656521 - protein, 23 aa, Mycobacterium
ETVTEARCGIGYLHTGIEKNLEY

SEQ ID NO: 656522 - protein, 19 aa, Mycobacterium
ETWCLATETARWERRVSSS

SEQ ID NO: 656523 - protein, 18 aa, Mycobacterium
ETWHIKRYGFHGTSHEYV

SEQ ID NO: 656524 - protein, 22 aa, Mycobacterium
ETWRRIPSWKFHLANVDPGRAR

SEQ ID NO: 656525 - protein, 22 aa, Mycobacterium
ETWTRVSRTPVIPSHEVSGVVA

SEQ ID NO: 656526 - protein, 25 aa, Mycobacterium
ETYDIYMHYLRGCSDLFRDHYTDVC

SEQ ID NO: 656527 - protein, 22 aa, Mycobacterium
ETYDLAAAAAREDVERTGATLV

SEQ ID NO: 656528 - protein, 19 aa, Mycobacterium
ETYGLIVYQEQIMFIAQKV

SEQ ID NO: 656529 - protein, 21 aa, Mycobacterium
ETYLRAWKSYQGFQGRSSVRT

SEQ ID NO: 656530 - protein, 23 aa, Mycobacterium
ETYLRGWKAYARFEGKSSVRTWL

SEQ ID NO: 656531 - protein, 20 aa, Mycobacterium
ETYLSGYPFWPSRTQGALFD

SEQ ID NO: 656532 - protein, 17 aa, Mycobacterium
EVAAAVLECDHLPLSAD

SEQ ID NO: 656533 - protein, 19 aa, Mycobacterium
EVAAEFGAGLVCSHTGNAQ

SEQ ID NO: 656534 - protein, 19 aa, Mycobacterium
EVAAEFGVPMHSDAVQAVG

SEQ ID NO: 656535 - protein, 17 aa, Mycobacterium
EVAAFVCHGHVTKDDYE

SEQ ID NO: 656536 - protein, 25 aa, Mycobacterium
EVAAHLRAPLDVFLVRKLGVPQWQE

SEQ ID NO: 656537 - protein, 21 aa, Mycobacterium
EVAAIKLRLHAIRDSARDYHL

SEQ ID NO: 656538 - protein, 18 aa, Mycobacterium
EVAALGVNIDFIRGISDY

SEQ ID NO: 656539 - protein, 32 aa, Mycobacterium
EVAALYFIYFRLCTPRHGIRSLLMQKLQGGAE

SEQ ID NO: 656540 - protein, 18 aa, Mycobacterium
EVAARLTLIGSRSKAGWA

SEQ ID NO: 656541 - protein, 30 aa, Mycobacterium
EVAARPAKQFKWPVLRSDGTSQVFVGDVRG

SEQ ID NO: 656542 - protein, 23 aa, Mycobacterium
EVAASEGIPCRYEAVKPADLIAA

SEQ ID NO: 656543 - protein, 18 aa, Mycobacterium
EVAASKYLHALREGTVPL

SEQ ID NO: 656544 - protein, 22 aa, Mycobacterium
EVAASWLLERRLGLVAEAYTTG

SEQ ID NO: 656545 - protein, 21 aa, Mycobacterium
EVAATCRLLGLDVVLVEKASG

SEQ ID NO: 656546 - protein, 32 aa, Mycobacterium
EVACIPSLYEGFSLPAVEAMASGTPIVASRVG

SEQ ID NO: 656547 - protein, 18 aa, Mycobacterium
EVACPFHDWRWGGDGKCK

SEQ ID NO: 656548 - protein, 18 aa, Mycobacterium
EVACPFHDWRWGGDGRCT

SEQ ID NO: 656549 - protein, 29 aa, Mycobacterium
EVADGFMSHPFCTPDYLAQVTRPALGRGA

SEQ ID NO: 656550 - protein, 19 aa, Mycobacterium
EVADGLWYPLWDANIRLDH

SEQ ID NO: 656551 - protein, 19 aa, Mycobacterium
EVADKLVFMDGGVIVESGD

SEQ ID NO: 656552 - protein, 18 aa, Mycobacterium
EVADKLWYPLWDANIRLD

SEQ ID NO: 656553 - protein, 29 aa, Mycobacterium
EVADLLWQRCGLAPGDRAVLVYPPGLDFV

SEQ ID NO: 656554 - protein, 19 aa, Mycobacterium
EVADLYFTLMDDLRVDDLL

SEQ ID NO: 656555 - protein, 19 aa, Mycobacterium
EVADRFALDEVIFVPTGQP

SEQ ID NO: 656556 - protein, 28 aa, Mycobacterium
EVADRLAAIKARLVPIIGEDVAEGTVAN

SEQ ID NO: 656557 - protein, 19 aa, Mycobacterium
EVADTIAFLASRRSSYTSG

SEQ ID NO: 656558 - protein, 25 aa, Mycobacterium
EVADWFRREFGVWLTPQTGNFLFGV

SEQ ID NO: 656559 - protein, 24 aa, Mycobacterium
EVAEALRLGVKIAGALASAHQIEI

SEQ ID NO: 656560 - protein, 19 aa, Mycobacterium
EVAEALVIGAELPDGGYWM

SEQ ID NO: 656561 - protein, 23 aa, Mycobacterium
EVAEAQMSALLMAIFLRGMTGHE

SEQ ID NO: 656562 - protein, 18 aa, Mycobacterium
EVAEHGGMAQAISEGIPK

SEQ ID NO: 656563 - protein, 25 aa, Mycobacterium
EVAEKISALGRRVLLCQGDIADPAV

SEQ ID NO: 656564 - protein, 23 aa, Mycobacterium
EVAELELFRRNWGCFDDHDNYLH

SEQ ID NO: 656565 - protein, 17 aa, Mycobacterium
EVAELGAKFGVMDSGAA

SEQ ID NO: 656566 - protein, 19 aa, Mycobacterium
EVAELLLRGLPYRDIGAQL

SEQ ID NO: 656567 - protein, 38 aa, Mycobacterium
EVAEMLRRPAPWRGAMEIDRLNVAIGLRERVNEHYLSD

SEQ ID NO: 656568 - protein, 17 aa, Mycobacterium
EVAERAGSIALQTRQRL

SEQ ID NO: 656569 - protein, 21 aa, Mycobacterium
EVAEVIRFLISPAASYIQGAA

SEQ ID NO: 656570 - protein, 28 aa, Mycobacterium
EVAEVWRRGSVIGSWLLDLTAIALHDSP

SEQ ID NO: 656571 - protein, 22 aa, Mycobacterium
EVAFKLSRLTGRTKLVAAQGGF

SEQ ID NO: 656572 - protein, 24 aa, Mycobacterium
EVAFKMSRLTGRTKLVAAHEAFHG

SEQ ID NO: 656573 - protein, 19 aa, Mycobacterium
EVAGAVLFLLSDLSSYITG

SEQ ID NO: 656574 - protein, 24 aa, Mycobacterium
EVAGPEFRGAPGYEGYLNDRVVAL

SEQ ID NO: 656575 - protein, 23 aa, Mycobacterium
EVAGRIRSAGAIFVGPYAPVSLG

SEQ ID NO: 656576 - protein, 23 aa, Mycobacterium
EVAGRLGAQVGAYHLMKPAGGRG

SEQ ID NO: 656577 - protein, 20 aa, Mycobacterium
EVAGRPTVTMKVGFLPPPDF

SEQ ID NO: 656578 - protein, 22 aa, Mycobacterium
EVAIKQLVEYAADEGLDVIGQI

SEQ ID NO: 656579 - protein, 25 aa, Mycobacterium
EVAIPKLRAGSFFPSLLERRRRIDR

SEQ ID NO: 656580 - protein, 21 aa, Mycobacterium
EVAKDLGGLPVHEDSSIPAGS

SEQ ID NO: 656581 - protein, 22 aa, Mycobacterium
EVAKRVGVSRVTAWRYLERLAD

SEQ ID NO: 656582 - protein, 20 aa, Mycobacterium
EVAKTADHLYVFQRTPVYSV

SEQ ID NO: 656583 - protein, 26 aa, Mycobacterium
EVALAAAMGCLERGVRVGCFRPPTVP

SEQ ID NO: 656584 - protein, 20 aa, Mycobacterium
EVALAALWRSWGVTPDVVIG

SEQ ID NO: 656585 - protein, 19 aa, Mycobacterium
EVALAALWRSWGVTPDVVL

SEQ ID NO: 656586 - protein, 24 aa, Mycobacterium
EVALARAGLRLSDIDLIELNEAFA

SEQ ID NO: 656587 - protein, 19 aa, Mycobacterium
EVALDFPVSRRVRPESKTL

SEQ ID NO: 656588 - protein, 23 aa, Mycobacterium
EVALHWGRLCGRLSPGQVRALAE

SEQ ID NO: 656589 - protein, 17 aa, Mycobacterium
EVALIEGPAGWGEFGAF

SEQ ID NO: 656590 - protein, 28 aa, Mycobacterium
EVALIEGPAGWGEFGAFLEYAPPEAAHW

SEQ ID NO: 656591 - protein, 22 aa, Mycobacterium
EVALRGGVRVHDAFRAVEAISN

SEQ ID NO: 656592 - protein, 18 aa, Mycobacterium
EVALRLPDIAYIGAMGSR

SEQ ID NO: 656593 - protein, 20 aa, Mycobacterium
EVALSLPLGAGRLTREWLPD

SEQ ID NO: 656594 - protein, 24 aa, Mycobacterium
EVALSLPLGAGRLTREWLPDDPPG

SEQ ID NO: 656595 - protein, 31 aa, Mycobacterium
EVALYRLLESWGVRPDFVMGHSVGELSAAHV

SEQ ID NO: 656596 - protein, 17 aa, Mycobacterium
EVANAQAALRIEQVEQM

SEQ ID NO: 656597 - protein, 21 aa, Mycobacterium
EVANASPLQAVLDVVNAPAQA

SEQ ID NO: 656598 - protein, 25 aa, Mycobacterium
EVANRLQIRPEWILDVHNGGCVSFV

SEQ ID NO: 656599 - protein, 20 aa, Mycobacterium
EVAPFAAVLLRSESTASSNI

SEQ ID NO: 656600 - protein, 24 aa, Mycobacterium
EVAPILCAGVTVYKGLKVTDTRPG

SEQ ID NO: 656601 - protein, 21 aa, Mycobacterium
EVAPWGIKVVMIEPASINSGA

SEQ ID NO: 656602 - protein, 18 aa, Mycobacterium
EVAQPFAVIGVGLNVTQD

SEQ ID NO: 656603 - protein, 20 aa, Mycobacterium
EVAQRWPAAGAVGPLIREPD

SEQ ID NO: 656604 - protein, 20 aa, Mycobacterium
EVARCAAAVAEVDDAVHRHQ

SEQ ID NO: 656605 - protein, 17 aa, Mycobacterium
EVARDWNIRRYGFHGTS

SEQ ID NO: 656606 - protein, 17 aa, Mycobacterium
EVARGTLRRMFPTITDN

SEQ ID NO: 656607 - protein, 19 aa, Mycobacterium
EVARHVRLLLERSGLGEQE

SEQ ID NO: 656608 - protein, 17 aa, Mycobacterium
EVARLAADISRTDGVEL

SEQ ID NO: 656609 - protein, 20 aa, Mycobacterium
EVARLDPSVTGMVLTGNGPS

SEQ ID NO: 656610 - protein, 21 aa, Mycobacterium
EVARLRVVLIDQLRHSPEQAL

SEQ ID NO: 656611 - protein, 17 aa, Mycobacterium
EVARPCFTLHHRDASGT

SEQ ID NO: 656612 - protein, 19 aa, Mycobacterium
EVARQGFEALMRGDRQVVA

SEQ ID NO: 656613 - protein, 23 aa, Mycobacterium
EVARRACAAGADLINDTWAGVDP

SEQ ID NO: 656614 - protein, 24 aa, Mycobacterium
EVARRELAQQIAFYSSVKSYETVL

SEQ ID NO: 656615 - protein, 17 aa, Mycobacterium
EVARRLHARGARLVLTD

SEQ ID NO: 656616 - protein, 24 aa, Mycobacterium
EVARSELDGILVLPSTAQAKIERG

SEQ ID NO: 656617 - protein, 19 aa, Mycobacterium
EVASAILFMACDLSSGITG

SEQ ID NO: 656618 - protein, 23 aa, Mycobacterium
EVASLAEACARAADTDPDPMWPE

SEQ ID NO: 656619 - protein, 20 aa, Mycobacterium
EVASLLRFAGGLHIVAGRVV

SEQ ID NO: 656620 - protein, 19 aa, Mycobacterium
EVASLLRFAGGLHIVSGRV

SEQ ID NO: 656621 - protein, 20 aa, Mycobacterium
EVASLLRFAGGLHIVSGRVV

SEQ ID NO: 656622 - protein, 19 aa, Mycobacterium
EVASLRKGQTVRLNEALTV

SEQ ID NO: 656623 - protein, 18 aa, Mycobacterium
EVASSITSLGGRAIAAAV

SEQ ID NO: 656624 - protein, 21 aa, Mycobacterium
EVASVALFLACDLSSYMTGTV

SEQ ID NO: 656625 - protein, 18 aa, Mycobacterium
EVATSIPWQARYRALGDM

SEQ ID NO: 656626 - protein, 25 aa, Mycobacterium
EVAVCSTGLIGDRLPMDKVLAGVEH

SEQ ID NO: 656627 - protein, 26 aa, Mycobacterium
EVAVCSTGLIGDRLPMDKVLAGVQEI

SEQ ID NO: 656628 - protein, 19 aa, Mycobacterium
EVAVLKILALQFIMSDPRH

SEQ ID NO: 656629 - protein, 26 aa, Mycobacterium
EVAVNFPLYVIMSLLGIPESDFGRML

SEQ ID NO: 656630 - protein, 17 aa, Mycobacterium
EVCAEYAPELDIVGAVL

SEQ ID NO: 656631 - protein, 22 aa, Mycobacterium
EVCCYFPGYTPAAADLADLIGA

SEQ ID NO: 656632 - protein, 19 aa, Mycobacterium
EVCCYFPGYTPRDADIADL

SEQ ID NO: 656633 - protein, 24 aa, Mycobacterium
EVCEEARGGVLFIDEAYRLVPKTE

SEQ ID NO: 656634 - protein, 27 aa, Mycobacterium
EVCEIDLRVGGTWRYVVRQPCESEPDR

SEQ ID NO: 656635 - protein, 24 aa, Mycobacterium
EVCNSCPLPDLLTYVGESAGLGVN

SEQ ID NO: 656636 - protein, 21 aa, Mycobacterium
EVCRTCSWNHLVKSYVLGAAR

SEQ ID NO: 656637 - protein, 21 aa, Mycobacterium
EVDAAAVRRYHSGKAEVKGFD

SEQ ID NO: 656638 - protein, 23 aa, Mycobacterium
EVDAAKADGRWDAAYSSQATIEV

SEQ ID NO: 656639 - protein, 27 aa, Mycobacterium
EVDAALRAKAGWLWTGRRGVVAGFSAA

SEQ ID NO: 656640 - protein, 27 aa, Mycobacterium
EVDALCARFRISGLPVVDAQGALVGII

SEQ ID NO: 656641 - protein, 25 aa, Mycobacterium
EVDALELAPGVALRCAEAIARGDAS

SEQ ID NO: 656642 - protein, 20 aa, Mycobacterium
EVDEPICMIVPQRRAELEEF

SEQ ID NO: 656643 - protein, 21 aa, Mycobacterium
EVDEVSSFVVFLASDESRYAT

SEQ ID NO: 656644 - protein, 18 aa, Mycobacterium
EVDFGVCRDGHFYAAGRA

SEQ ID NO: 656645 - protein, 22 aa, Mycobacterium
EVDGDIGAVFAFTDLTERHAAE

SEQ ID NO: 656646 - protein, 18 aa, Mycobacterium
EVDGFVWHAYIPSIEPGQ

SEQ ID NO: 656647 - protein, 17 aa, Mycobacterium
EVDGRLLADGGILDPLP

SEQ ID NO: 656648 - protein, 19 aa, Mycobacterium
EVDGRPLSILEWLRSGGSV

SEQ ID NO: 656649 - protein, 18 aa, Mycobacterium
EVDLPKVLEFKAHVLARH

SEQ ID NO: 656650 - protein, 18 aa, Mycobacterium
EVDLPKVLEFKARVLDEQ

SEQ ID NO: 656651 - protein, 24 aa, Mycobacterium
EVDLPVNIARKFKTVRRVLGEPPL

SEQ ID NO: 656652 - protein, 18 aa, Mycobacterium
EVDLRVAASVTHLGLIAR

SEQ ID NO: 656653 - protein, 25 aa, Mycobacterium
EVDLSGPTAWLFGPEAHGLPAEVAA

SEQ ID NO: 656654 - protein, 20 aa, Mycobacterium
EVDPAVALKAELRSKPGDWY

SEQ ID NO: 656655 - protein, 17 aa, Mycobacterium
EVDPQVLIRAGESMLSL

SEQ ID NO: 656656 - protein, 24 aa, Mycobacterium
EVDPRMVLEAGFFMPEPGQEKAWF

SEQ ID NO: 656657 - protein, 25 aa, Mycobacterium
EVDPRRSRIVGAYELGLPIRDVALS

SEQ ID NO: 656658 - protein, 19 aa, Mycobacterium
EVDQAWPLIEAALDEATAA

SEQ ID NO: 656659 - protein, 20 aa, Mycobacterium
EVDRDCFARIAPGLPSNVIR

SEQ ID NO: 656660 - protein, 22 aa, Mycobacterium
EVDRDCFARIAPGLPTNVIKIA

SEQ ID NO: 656661 - protein, 19 aa, Mycobacterium
EVDRLAGRIATIERHQREL

SEQ ID NO: 656662 - protein, 23 aa, Mycobacterium
EVDRRKAFVSAELCDAHGVVLAD

SEQ ID NO: 656663 - protein, 18 aa, Mycobacterium
EVDRRPGDILAEVQSLVD

SEQ ID NO: 656664 - protein, 21 aa, Mycobacterium
EVDRRPGDVLAEVQALVDQGV

SEQ ID NO: 656665 - protein, 27 aa, Mycobacterium
EVDRVFAGKVWGAWHLSEAAAGLKLDF

SEQ ID NO: 656666 - protein, 27 aa, Mycobacterium
EVDRVFAGKVWGAWHLSEALTDLRTDL

SEQ ID NO: 656667 - protein, 27 aa, Mycobacterium
EVDRVFAGKVWGAWHLSEATSDLQLDF

SEQ ID NO: 656668 - protein, 26 aa, Mycobacterium
EVDRVFAGKVWGAWNLSEAAAELSLD

SEQ ID NO: 656669 - protein, 34 aa, Mycobacterium
EVDVTKIAALRARAKAAFAEREGVNLTFLPFFAK

SEQ ID NO: 656670 - protein, 26 aa, Mycobacterium
EVDYLKPFWDTHPWERADLRRLIAEG

SEQ ID NO: 656671 - protein, 22 aa, Mycobacterium
EVDYLKPYWDAHPEDRADLRRF

SEQ ID NO: 656672 - protein, 32 aa, Mycobacterium
EVEALRWADRPEFADLLGGVVLIDQAVLDHAH

SEQ ID NO: 656673 - protein, 21 aa, Mycobacterium
EVEAPAGGQCRIFDGELDENW

SEQ ID NO: 656674 - protein, 20 aa, Mycobacterium
EVEAPLLINLVVGGLTPRVP

SEQ ID NO: 656675 - protein, 22 aa, Mycobacterium
EVEARTTLLDWLRETLGLTGAK

SEQ ID NO: 656676 - protein, 25 aa, Mycobacterium
EVEEPRKEWVLQFSIGAAPRSSTVV

SEQ ID NO: 656677 - protein, 19 aa, Mycobacterium
EVEFDPAYHELMRTAIGHG

SEQ ID NO: 656678 - protein, 24 aa, Mycobacterium
EVEGGIIRVAEGWAHGPQVDKGAR

SEQ ID NO: 656679 - protein, 25 aa, Mycobacterium
EVEGGKIRIAEGWAHGPEIDKGARW

SEQ ID NO: 656680 - protein, 24 aa, Mycobacterium
EVEGGKIRVAEGWAHGPQIDKGAR

SEQ ID NO: 656681 - protein, 23 aa, Mycobacterium
EVEGGVIRVAEGWAHGPEVDKGA

SEQ ID NO: 656682 - protein, 18 aa, Mycobacterium
EVEIKRDGHEWSQVYEKS

SEQ ID NO: 656683 - protein, 22 aa, Mycobacterium
EVEINIACSLGMLSAQQVEQLS

SEQ ID NO: 656684 - protein, 18 aa, Mycobacterium
EVEINVACSLGMLTAEQV

SEQ ID NO: 656685 - protein, 19 aa, Mycobacterium
EVEKAYQLLAPESRSAAIA

SEQ ID NO: 656686 - protein, 23 aa, Mycobacterium
EVELAWQILDPVLDNWAAGGKPE

SEQ ID NO: 656687 - protein, 22 aa, Mycobacterium
EVELFPGWIRLATKMSGKFKAS

SEQ ID NO: 656688 - protein, 24 aa, Mycobacterium
EVELGRAEIRAMFRSSKVGNIAGC

SEQ ID NO: 656689 - protein, 17 aa, Mycobacterium
EVELLLDQGWRPEDVAL

SEQ ID NO: 656690 - protein, 26 aa, Mycobacterium
EVELRGPDRYRWRLLAGPKTVWDSEL

SEQ ID NO: 656691 - protein, 22 aa, Mycobacterium
EVELRRAIGCLLFCLESRTACI

SEQ ID NO: 656692 - protein, 27 aa, Mycobacterium
EVEPLEVVFPGCEFLPLNDERRRIVDP

SEQ ID NO: 656693 - protein, 25 aa, Mycobacterium
EVEPLRARGMRRYRRLDLAEVGTGS

SEQ ID NO: 656694 - protein, 22 aa, Mycobacterium
EVEPRMLLVHFLRDQLGLTGTH

SEQ ID NO: 656695 - protein, 20 aa, Mycobacterium
EVEPRMLLVHFLRDQLRLTG

SEQ ID NO: 656696 - protein, 18 aa, Mycobacterium
EVEPRRPLLEQGADSMVL

SEQ ID NO: 656697 - protein, 23 aa, Mycobacterium
EVEQRWGELYAYADSYTGQRLAM

SEQ ID NO: 656698 - protein, 18 aa, Mycobacterium
EVERRMGPVDILVANAAV

SEQ ID NO: 656699 - protein, 20 aa, Mycobacterium
EVERSGLFTGTRGRQLAGRC

SEQ ID NO: 656700 - protein, 20 aa, Mycobacterium
EVERSWRPSGLPPIGDVTRP

SEQ ID NO: 656701 - protein, 24 aa, Mycobacterium
EVERVAVDSGVAWVSLRPTVFATN

SEQ ID NO: 656702 - protein, 20 aa, Mycobacterium
EVESALRLIPGIRHAVAAVV

SEQ ID NO: 656703 - protein, 29 aa, Mycobacterium
EVEVLRLSALRGLFSAVIDEPVTFVNAPA

SEQ ID NO: 656704 - protein, 29 aa, Mycobacterium
EVEVLRLSALRGLFSAVIEDQVTFVNAPA

SEQ ID NO: 656705 - protein, 20 aa, Mycobacterium
EVEVRRSRRLVISMICTVGN

SEQ ID NO: 656706 - protein, 21 aa, Mycobacterium
EVEVRRSRRLVISMICTVGNY

SEQ ID NO: 656707 - protein, 19 aa, Mycobacterium
EVEWSIAGQMLYAAAGITT

SEQ ID NO: 656708 - protein, 25 aa, Mycobacterium
EVEYRKLRLERVVLVGVWTDGSAAD

SEQ ID NO: 656709 - protein, 18 aa, Mycobacterium
EVFAEWHAPAPRDPGPAP

SEQ ID NO: 656710 - protein, 19 aa, Mycobacterium
EVFCDTPLDDCERRDPKGL

SEQ ID NO: 656711 - protein, 17 aa, Mycobacterium
EVFDAGGSSELVLSHFL

SEQ ID NO: 656712 - protein, 22 aa, Mycobacterium
EVFDVAELRPTFTADNTDTALR

SEQ ID NO: 656713 - protein, 18 aa, Mycobacterium
EVFEAEFGDGSKLGLQID

SEQ ID NO: 656714 - protein, 27 aa, Mycobacterium
EVFEGLKAYRWADGSIVSFRAWANAAR

SEQ ID NO: 656715 - protein, 25 aa, Mycobacterium
EVFEGLKAYRWTDGSIVSFRAEANA

SEQ ID NO: 656716 - protein, 19 aa, Mycobacterium
EVFEMPSVRHWPHFEDPEA

SEQ ID NO: 656717 - protein, 17 aa, Mycobacterium
EVFFRLEDFEALNASLV

SEQ ID NO: 656718 - protein, 19 aa, Mycobacterium
EVFGPVLAVIAFDDDDDAV

SEQ ID NO: 656719 - protein, 19 aa, Mycobacterium
EVFGPVLVVIGFDDDDHAV

SEQ ID NO: 656720 - protein, 19 aa, Mycobacterium
EVFLRNQFYLRGNRAGAAH

SEQ ID NO: 656721 - protein, 19 aa, Mycobacterium
EVFRAMPALDPERCVRGQY

SEQ ID NO: 656722 - protein, 29 aa, Mycobacterium
EVFRGVQKWRIKSNWKFVSENFLGDTYHG

SEQ ID NO: 656723 - protein, 19 aa, Mycobacterium
EVFRLRDLLEAELIRDAMP

SEQ ID NO: 656724 - protein, 24 aa, Mycobacterium
EVFSEALAAPLYWIAANAGLDGAV

SEQ ID NO: 656725 - protein, 19 aa, Mycobacterium
EVFSSRIAYDDMISPVPLV

SEQ ID NO: 656726 - protein, 18 aa, Mycobacterium
EVFTSAGEFTARFGEIAG

SEQ ID NO: 656727 - protein, 24 aa, Mycobacterium
EVFVLRPCIVAGPNATVLADAMPW

SEQ ID NO: 656728 - protein, 26 aa, Mycobacterium
EVGAGEAVLAGWRMLLDNARMQDGEP

SEQ ID NO: 656729 - protein, 21 aa, Mycobacterium
EVGALSLLPAALIYRAGMHVH

SEQ ID NO: 656730 - protein, 22 aa, Mycobacterium
EVGDLGVAVLRAVKATLDPAGI

SEQ ID NO: 656731 - protein, 20 aa, Mycobacterium
EVGDPRLPQIPANDVQLQAL

SEQ ID NO: 656732 - protein, 24 aa, Mycobacterium
EVGEAGVLAGLMAVISLPVAFTPE

SEQ ID NO: 656733 - protein, 17 aa, Mycobacterium
EVGEFSRSLKLLAKELD

SEQ ID NO: 656734 - protein, 23 aa, Mycobacterium
EVGEVWLRGPTVVRGYLGDPKIT

SEQ ID NO: 656735 - protein, 19 aa, Mycobacterium
EVGFFKGVMQLTHPAFLIL

SEQ ID NO: 656736 - protein, 19 aa, Mycobacterium
EVGFFKNVMQLTHPAFLIL

SEQ ID NO: 656737 - protein, 23 aa, Mycobacterium
EVGGLPIKAGEQILVRFDSANRD

SEQ ID NO: 656738 - protein, 17 aa, Mycobacterium
EVGKGEFGTYFIGYSRT

SEQ ID NO: 656739 - protein, 25 aa, Mycobacterium
EVGKLADLVLWEPAFFGVRPDLVLK

SEQ ID NO: 656740 - protein, 18 aa, Mycobacterium
EVGLAVRVIVGGTWGFAS

SEQ ID NO: 656741 - protein, 19 aa, Mycobacterium
EVGLGRRWVMSGWGRAEAA

SEQ ID NO: 656742 - protein, 24 aa, Mycobacterium
EVGLRYYAAAFFKVIPQVNAEVRD

SEQ ID NO: 656743 - protein, 23 aa, Mycobacterium
EVGLRYYAAAFFQVIPQVNAEVR

SEQ ID NO: 656744 - protein, 17 aa, Mycobacterium
EVGPTCHYVMGGIEVDP

SEQ ID NO: 656745 - protein, 23 aa, Mycobacterium
EVGRKALEIYLDLANYLNSWKRL

SEQ ID NO: 656746 - protein, 18 aa, Mycobacterium
EVGRLRAVVLHRPGDELK

SEQ ID NO: 656747 - protein, 23 aa, Mycobacterium
EVGRRLAPEPVLHAALGPGALVA

SEQ ID NO: 656748 - protein, 24 aa, Mycobacterium
EVGRRLAPEPVVHAALAPGALIAE

SEQ ID NO: 656749 - protein, 27 aa, Mycobacterium
EVGRRWGMADGCAFDAAGNLWVTLVLA

SEQ ID NO: 656750 - protein, 25 aa, Mycobacterium
EVGRSGRLKGAGFYEYPEGKRAGLW

SEQ ID NO: 656751 - protein, 28 aa, Mycobacterium
EVGSRLTTALARHGIVLSLQFETDDDRN

SEQ ID NO: 656752 - protein, 20 aa, Mycobacterium
EVHAEACRWEHVMSEDVERR

SEQ ID NO: 656753 - protein, 20 aa, Mycobacterium
EVHAEACRWEHVMSEEVERR

SEQ ID NO: 656754 - protein, 17 aa, Mycobacterium
EVHDLLSACGIPGDEKG

SEQ ID NO: 656755 - protein, 19 aa, Mycobacterium
EVHDPFCYLLPDGVVDMGG

SEQ ID NO: 656756 - protein, 29 aa, Mycobacterium
EVHEAPRFRGSEVMHTLKITPQGAEAIAR

SEQ ID NO: 656757 - protein, 22 aa, Mycobacterium
EVHKATVARRLLRDYSPQQHPY

SEQ ID NO: 656758 - protein, 19 aa, Mycobacterium
EVHQAGAPGGVFASLFTCG

SEQ ID NO: 656759 - protein, 19 aa, Mycobacterium
EVHRICLPYMSKGSLPHSV

SEQ ID NO: 656760 - protein, 18 aa, Mycobacterium
EVHRLPGRDLMAVVDGAP

SEQ ID NO: 656761 - protein, 18 aa, Mycobacterium
EVHSALLSSGPGPGPLLA

SEQ ID NO: 656762 - protein, 17 aa, Mycobacterium
EVHSLHGYFLRPGDARA

SEQ ID NO: 656763 - protein, 22 aa, Mycobacterium
EVHTFLNTRCLTIAGGTEQILL

SEQ ID NO: 656764 - protein, 32 aa, Mycobacterium
EVHVRIASPPVRWPCFYGIDFASPAELIANAV

SEQ ID NO: 656765 - protein, 31 aa, Mycobacterium
EVHVRIASPPVRWPCFYGIDFATPAELIANA

SEQ ID NO: 656766 - protein, 21 aa, Mycobacterium
EVHVVLDLRSGLLDVAARVRQ

SEQ ID NO: 656767 - protein, 25 aa, Mycobacterium
EVIAAQLRRRSCAAAGTSAQTPDAR

SEQ ID NO: 656768 - protein, 24 aa, Mycobacterium
EVIADGPIPLARLIPAGVDVRGNA

SEQ ID NO: 656769 - protein, 24 aa, Mycobacterium
EVIAIGITPQGSWVLTDGNPDALA

SEQ ID NO: 656770 - protein, 20 aa, Mycobacterium
EVIARFDPVLGLEVHVELST

SEQ ID NO: 656771 - protein, 18 aa, Mycobacterium
EVIASPTPASAGRVQSWV

SEQ ID NO: 656772 - protein, 18 aa, Mycobacterium
EVIDICRQVWRREPVNHQ

SEQ ID NO: 656773 - protein, 24 aa, Mycobacterium
EVIDLGDAILLPGLMDMEVNLLMG

SEQ ID NO: 656774 - protein, 17 aa, Mycobacterium
EVIDNFQALLRNAGWVG

SEQ ID NO: 656775 - protein, 20 aa, Mycobacterium
EVIEAGGLYVLGTERHESRR

SEQ ID NO: 656776 - protein, 24 aa, Mycobacterium
EVIEKMRVAGRIAAGALAEAGRAV

SEQ ID NO: 656777 - protein, 24 aa, Mycobacterium
EVIEKMRVAGRIAAGALVEAGKAV

SEQ ID NO: 656778 - protein, 23 aa, Mycobacterium
EVIEKMRVAGRIAARALALAGEA

SEQ ID NO: 656779 - protein, 25 aa, Mycobacterium
EVIELRPDIDWDKGKTLRWVIDHLP

SEQ ID NO: 656780 - protein, 25 aa, Mycobacterium
EVIELRPDIDWDKGKTLRWVIEHLR

SEQ ID NO: 656781 - protein, 33 aa, Mycobacterium
EVIELRPDLDWDKGKTLRWVIDHLHRAGSGSLT

SEQ ID NO: 656782 - protein, 19 aa, Mycobacterium
EVIELRPDMDWDKGKTLRW

SEQ ID NO: 656783 - protein, 24 aa, Mycobacterium
EVIELRPDMDWDKGKTLRWVLDHL

SEQ ID NO: 656784 - protein, 19 aa, Mycobacterium
EVIEPLRKLRIVLDETDGI

SEQ ID NO: 656785 - protein, 17 aa, Mycobacterium
EVIEPLRKLRLVLDETE

SEQ ID NO: 656786 - protein, 23 aa, Mycobacterium
EVIERARWTGARAHILHLSSSDA

SEQ ID NO: 656787 - protein, 22 aa, Mycobacterium
EVIEVRRVLGLLGARDQEALRA

SEQ ID NO: 656788 - protein, 19 aa, Mycobacterium
EVIEWARRTGGYVIDDDYD

SEQ ID NO: 656789 - protein, 21 aa, Mycobacterium
EVIFRNGPLRWTEVDYHNPAD

SEQ ID NO: 656790 - protein, 21 aa, Mycobacterium
EVIGESVLRRGKLRSATVTTT

SEQ ID NO: 656791 - protein, 19 aa, Mycobacterium
EVIGPKGKIINAITEETGA

SEQ ID NO: 656792 - protein, 18 aa, Mycobacterium
EVIGRYRDLVVENREFLM

SEQ ID NO: 656793 - protein, 17 aa, Mycobacterium
EVIGSFSCRGFDTVGPF

SEQ ID NO: 656794 - protein, 23 aa, Mycobacterium
EVIPDVLRHRLVLTYDALADEIT

SEQ ID NO: 656795 - protein, 25 aa, Mycobacterium
EVIQDAEVGWSFFLGKKVVDRLEWI

SEQ ID NO: 656796 - protein, 18 aa, Mycobacterium
EVIRGIWTTDDFTYEGMH

SEQ ID NO: 656797 - protein, 23 aa, Mycobacterium
EVIRLCKSAGFALEEIQLLFADD

SEQ ID NO: 656798 - protein, 17 aa, Mycobacterium
EVISSLGEELGSFEADQ

SEQ ID NO: 656799 - protein, 21 aa, Mycobacterium
EVITALFARCVEVLHEKSRAA

SEQ ID NO: 656800 - protein, 27 aa, Mycobacterium
EVITKPRWFLQWAKTMRPPELRVPNQG

SEQ ID NO: 656801 - protein, 18 aa, Mycobacterium
EVIVCLGATAAQSLLGTT

SEQ ID NO: 656802 - protein, 24 aa, Mycobacterium
EVIWKREWLVDALRIFEGCRVWMV

SEQ ID NO: 656803 - protein, 19 aa, Mycobacterium
EVKANWKLYMDAFQEFYHA

SEQ ID NO: 656804 - protein, 21 aa, Mycobacterium
EVKDECLEYALANDERFGIWG

SEQ ID NO: 656805 - protein, 20 aa, Mycobacterium
EVKLYPEGHFAIYVDEAFDR

SEQ ID NO: 656806 - protein, 19 aa, Mycobacterium
EVKNIRQWIYPSAPELYQL

SEQ ID NO: 656807 - protein, 21 aa, Mycobacterium
EVKPGSGVRGFIAKKGNIPVG

SEQ ID NO: 656808 - protein, 21 aa, Mycobacterium
EVKPGSGVRGVIAKRGHIPLG

SEQ ID NO: 656809 - protein, 22 aa, Mycobacterium
EVKQAAAEHGLWYPPDPSSFEI

SEQ ID NO: 656810 - protein, 18 aa, Mycobacterium
EVKQAAAEHSLWYPPDPA

SEQ ID NO: 656811 - protein, 22 aa, Mycobacterium
EVKRMWPKVWQLACMVDHVAEP

SEQ ID NO: 656812 - protein, 27 aa, Mycobacterium
EVKRVLRPGGYFAYADIRPCTEIAEWE

SEQ ID NO: 656813 - protein, 18 aa, Mycobacterium
EVLAALAYHRKWGTGYFK

SEQ ID NO: 656814 - protein, 29 aa, Mycobacterium
EVLAARPLAEWVSRFAGMDGQWAIAQDPW

SEQ ID NO: 656815 - protein, 17 aa, Mycobacterium
EVLACSEAGIPVTVVPG

SEQ ID NO: 656816 - protein, 18 aa, Mycobacterium
EVLACTEAGIPVIVVPGV

SEQ ID NO: 656817 - protein, 19 aa, Mycobacterium
EVLAEGVELVLLDNFPVWQ

SEQ ID NO: 656818 - protein, 19 aa, Mycobacterium
EVLAERIFEPLGMTDTGFS

SEQ ID NO: 656819 - protein, 26 aa, Mycobacterium
EVLAGLRGWFSAPVIVLSARSDSSDK

SEQ ID NO: 656820 - protein, 19 aa, Mycobacterium
EVLAHPHGWVLGPREFGHF

SEQ ID NO: 656821 - protein, 17 aa, Mycobacterium
EVLALRRAGDLAAGGTA

SEQ ID NO: 656822 - protein, 30 aa, Mycobacterium
EVLAPLRLHYLRWLLFDVGSGLHFQYQGIF

SEQ ID NO: 656823 - protein, 22 aa, Mycobacterium
EVLARAAGHPVAVRQGRNLATA

SEQ ID NO: 656824 - protein, 18 aa, Mycobacterium
EVLARCNRPLPLHPGAVT

SEQ ID NO: 656825 - protein, 17 aa, Mycobacterium
EVLAWAGDSGRAVLLNE

SEQ ID NO: 656826 - protein, 17 aa, Mycobacterium
EVLCSTAIRTRETLARS

SEQ ID NO: 656827 - protein, 27 aa, Mycobacterium
EVLDAGIPLFGICFGNQILGRALGLST

SEQ ID NO: 656828 - protein, 20 aa, Mycobacterium
EVLDAMASWWTAVHGHGHPV

SEQ ID NO: 656829 - protein, 18 aa, Mycobacterium
EVLDEFKKGPEFADIMQR

SEQ ID NO: 656830 - protein, 20 aa, Mycobacterium
EVLDGAAPLASGSWKDAVGL

SEQ ID NO: 656831 - protein, 22 aa, Mycobacterium
EVLDGMSSWWSCIHGHGHPVLD

SEQ ID NO: 656832 - protein, 19 aa, Mycobacterium
EVLDLVFDYGVERLVDTLA

SEQ ID NO: 656833 - protein, 25 aa, Mycobacterium
EVLDPGCGTGWHAIEYARAGCSVTG

SEQ ID NO: 656834 - protein, 26 aa, Mycobacterium
EVLEAYPGHIARMFGLVFGGDPESHI

SEQ ID NO: 656835 - protein, 17 aa, Mycobacterium
EVLEEAGEFEARRRTQQ

SEQ ID NO: 656836 - protein, 24 aa, Mycobacterium
EVLERLKPGIVLCREKQDATSARL

SEQ ID NO: 656837 - protein, 18 aa, Mycobacterium
EVLERSLVHLGLKHYFLV

SEQ ID NO: 656838 - protein, 30 aa, Mycobacterium
EVLESVGTRVGRIIRIITRTVGEVAQEVSG

SEQ ID NO: 656839 - protein, 21 aa, Mycobacterium
EVLEYADTVSVLRDGRHIVTA

SEQ ID NO: 656840 - protein, 17 aa, Mycobacterium
EVLFCPDQFLGAHVRRI

SEQ ID NO: 656841 - protein, 20 aa, Mycobacterium
EVLFGWRSFETYPLVVRVAG

SEQ ID NO: 656842 - protein, 32 aa, Mycobacterium
EVLGDRFGVCGYCMGGRMSLVVAGRVPDRVAA

SEQ ID NO: 656843 - protein, 19 aa, Mycobacterium
EVLGFMFLMVIAGNETTTK

SEQ ID NO: 656844 - protein, 20 aa, Mycobacterium
EVLGQLGARIQHALRAFTPD

SEQ ID NO: 656845 - protein, 19 aa, Mycobacterium
EVLIKADAIGVNFIDTYFR

SEQ ID NO: 656846 - protein, 20 aa, Mycobacterium
EVLISAAFACFRTHGLRKTT

SEQ ID NO: 656847 - protein, 18 aa, Mycobacterium
EVLKASAVPLYVHAPYLI

SEQ ID NO: 656848 - protein, 21 aa, Mycobacterium
EVLKATWLHGYSLTYLQPNEN

SEQ ID NO: 656849 - protein, 30 aa, Mycobacterium
EVLLELARRADVFLTSFLPGHRQKFGIDVD

SEQ ID NO: 656850 - protein, 20 aa, Mycobacterium
EVLLGHVMLTKGEFDAAATL

SEQ ID NO: 656851 - protein, 19 aa, Mycobacterium
EVLLGVNPRLVFARMPAFG

SEQ ID NO: 656852 - protein, 23 aa, Mycobacterium
EVLLPRRGTVVAWTTQGFPPGAP

SEQ ID NO: 656853 - protein, 20 aa, Mycobacterium
EVLNAAAAEVSTIGSSLQTA

SEQ ID NO: 656854 - protein, 22 aa, Mycobacterium
EVLPEKPELILLDNFPVWQTQM

SEQ ID NO: 656855 - protein, 22 aa, Mycobacterium
EVLPPVRVAEEFGDAPDVKDVD

SEQ ID NO: 656856 - protein, 17 aa, Mycobacterium
EVLPYDVQERFLATLDA

SEQ ID NO: 656857 - protein, 23 aa, Mycobacterium
EVLQCPFHGWQWNQLGRNVCIPY

SEQ ID NO: 656858 - protein, 23 aa, Mycobacterium
EVLQCPFHGWQWNQQGRNVCIPY

SEQ ID NO: 656859 - protein, 20 aa, Mycobacterium
EVLQRIPSIDVVFIGHQRGE

SEQ ID NO: 656860 - protein, 23 aa, Mycobacterium
EVLRAGGDAIGWLDTDDAADALR

SEQ ID NO: 656861 - protein, 21 aa, Mycobacterium
EVLRDAIAIAAEYDRTPRNFD

SEQ ID NO: 656862 - protein, 19 aa, Mycobacterium
EVLRGIDLEVRRGEVVCLL

SEQ ID NO: 656863 - protein, 21 aa, Mycobacterium
EVLRHATWCHPRCAQDHVDIV

SEQ ID NO: 656864 - protein, 22 aa, Mycobacterium
EVLRILRRRSLAALRAQIEPVS

SEQ ID NO: 656865 - protein, 17 aa, Mycobacterium
EVLRIRDVLSYQADLAG

SEQ ID NO: 656866 - protein, 20 aa, Mycobacterium
EVLRPFDVICTLRERMALPR

SEQ ID NO: 656867 - protein, 21 aa, Mycobacterium
EVLRPGLLVLPVRGAARYFGS

SEQ ID NO: 656868 - protein, 17 aa, Mycobacterium
EVLRRAAAYLSQANLPG

SEQ ID NO: 656869 - protein, 19 aa, Mycobacterium
EVLRRAAAYLSQANLPGKG

SEQ ID NO: 656870 - protein, 27 aa, Mycobacterium
EVLRVVKFWVSHGVKVFRVDNPHTKPP

SEQ ID NO: 656871 - protein, 26 aa, Mycobacterium
EVLRVVRHWMDHGVKFFRVDNPHTKP

SEQ ID NO: 656872 - protein, 23 aa, Mycobacterium
EVLRVVRHWMDHGVKVFRVDNPH

SEQ ID NO: 656873 - protein, 27 aa, Mycobacterium
EVLSAATVFVCPSIYEPLGIVNLEAMA

SEQ ID NO: 656874 - protein, 20 aa, Mycobacterium
EVLSSPGYRGAAQQAAAGAA

SEQ ID NO: 656875 - protein, 17 aa, Mycobacterium
EVLTFLSTVTTFGTALD

SEQ ID NO: 656876 - protein, 19 aa, Mycobacterium
EVLTGMGLDVSGLTDSQMV

SEQ ID NO: 656877 - protein, 20 aa, Mycobacterium
EVLTRVGYELANHGESLLVL

SEQ ID NO: 656878 - protein, 22 aa, Mycobacterium
EVLVPFVSAIVLSVSLDDQLIT

SEQ ID NO: 656879 - protein, 19 aa, Mycobacterium
EVLVSPGLGESVRHGVTSV

SEQ ID NO: 656880 - protein, 17 aa, Mycobacterium
EVLYKLWEGSWEDDAVV

SEQ ID NO: 656881 - protein, 17 aa, Mycobacterium
EVMAAVLGVDVSTISDD

SEQ ID NO: 656882 - protein, 18 aa, Mycobacterium
EVMAEFKRATGLPTATNM

SEQ ID NO: 656883 - protein, 23 aa, Mycobacterium
EVMARAGASLDIVVLPKVTDVSH

SEQ ID NO: 656884 - protein, 24 aa, Mycobacterium
EVMPARGVGVIELRGEPVTPGYIT

SEQ ID NO: 656885 - protein, 19 aa, Mycobacterium
EVMPGGLAGAELERFVRDG

SEQ ID NO: 656886 - protein, 21 aa, Mycobacterium
EVMPLLGSRGFTRSQNTFRRS

SEQ ID NO: 656887 - protein, 21 aa, Mycobacterium
EVMPRLNARIAKKPGGPHKPP

SEQ ID NO: 656888 - protein, 19 aa, Mycobacterium
EVMRGTGFLGAHADEVYRL

SEQ ID NO: 656889 - protein, 23 aa, Mycobacterium
EVMRHVPGFISANIHLSADGTRV

SEQ ID NO: 656890 - protein, 20 aa, Mycobacterium
EVMRVLKPGGRFVFAGEPTT

SEQ ID NO: 656891 - protein, 33 aa, Mycobacterium
EVMSGELLAGALSRLDPAAGVMVSAVWVSSTAQ

SEQ ID NO: 656892 - protein, 21 aa, Mycobacterium
EVNAGVYAFDIAALRSALNRL

SEQ ID NO: 656893 - protein, 17 aa, Mycobacterium
EVNAGVYAFEITALQSA

SEQ ID NO: 656894 - protein, 23 aa, Mycobacterium
EVNGEVRASLQFAGTTVDGETST

SEQ ID NO: 656895 - protein, 19 aa, Mycobacterium
EVNGGWTVMRFALDAEHGI

SEQ ID NO: 656896 - protein, 21 aa, Mycobacterium
EVNGVWQFRGPTVIPSGLAEL

SEQ ID NO: 656897 - protein, 17 aa, Mycobacterium
EVNRRFGTPIPPDTGEI

SEQ ID NO: 656898 - protein, 18 aa, Mycobacterium
EVNRRIRAALAPYPDDLV

SEQ ID NO: 656899 - protein, 29 aa, Mycobacterium
EVNSARILRGPGPAPLRAAATAWATLSED

SEQ ID NO: 656900 - protein, 19 aa, Mycobacterium
EVNSARMFAGAGSGPTLTA

SEQ ID NO: 656901 - protein, 20 aa, Mycobacterium
EVNSGLMYAGPGAGPMLAAA

SEQ ID NO: 656902 - protein, 20 aa, Mycobacterium
EVNSGRMWAGPGAGSLHAAA

SEQ ID NO: 656903 - protein, 19 aa, Mycobacterium
EVNSGRMYAGPGPGPMLAA

SEQ ID NO: 656904 - protein, 33 aa, Mycobacterium
EVNSGRMYCGLGAGPMLAAATAWDELAAELHSA

SEQ ID NO: 656905 - protein, 19 aa, Mycobacterium
EVNSVLLLDGPGPGPMLEA

SEQ ID NO: 656906 - protein, 19 aa, Mycobacterium
EVNVRIWIHPDYRKRGYGT

SEQ ID NO: 656907 - protein, 26 aa, Mycobacterium
EVPADRPAVIIADGLVAFLRQHDFAA

SEQ ID NO: 656908 - protein, 25 aa, Mycobacterium
EVPAFAEQSFTEWFTGRTPVTGGAK

SEQ ID NO: 656909 - protein, 20 aa, Mycobacterium
EVPAGGMLVNHVAFQVSTAK

SEQ ID NO: 656910 - protein, 18 aa, Mycobacterium
EVPARLDIVESLPHTAKG

SEQ ID NO: 656911 - protein, 19 aa, Mycobacterium
EVPDDLRLAVEERRKTVTL

SEQ ID NO: 656912 - protein, 25 aa, Mycobacterium
EVPDNLRWGVYVTFEAVTDYAVQCF

SEQ ID NO: 656913 - protein, 24 aa, Mycobacterium
EVPDPRPAPGEVLISIEASGVGYV

SEQ ID NO: 656914 - protein, 23 aa, Mycobacterium
EVPDRPVPMLSYIDIRKLPFGDY

SEQ ID NO: 656915 - protein, 25 aa, Mycobacterium
EVPESPRLAALLGLGDLPEVTNPRE

SEQ ID NO: 656916 - protein, 17 aa, Mycobacterium
EVPEVRNGGTWDALARC

SEQ ID NO: 656917 - protein, 17 aa, Mycobacterium
EVPEVWEAVTSIFRDYG

SEQ ID NO: 656918 - protein, 23 aa, Mycobacterium
EVPFAELEPDFSKAYKELAQQVR

SEQ ID NO: 656919 - protein, 24 aa, Mycobacterium
EVPGAMARLGVWSGDGPQLDLHQP

SEQ ID NO: 656920 - protein, 26 aa, Mycobacterium
EVPGAMARLGVWSGQGPQLDLHQPTF

SEQ ID NO: 656921 - protein, 24 aa, Mycobacterium
EVPGAMGRLGVWSGDGPQLDLHQP

SEQ ID NO: 656922 - protein, 24 aa, Mycobacterium
EVPGEAFVLGVQWHPEERLDDLRL

SEQ ID NO: 656923 - protein, 21 aa, Mycobacterium
EVPGMMAMLVEFWMHPDAVYL

SEQ ID NO: 656924 - protein, 21 aa, Mycobacterium
EVPGRVATLVERLKVAEKELE

SEQ ID NO: 656925 - protein, 43 aa, Mycobacterium
EVPIDLRQDWPAALVATGFDPARPTAWLAEGLLMYLPADAQDR

SEQ ID NO: 656926 - protein, 21 aa, Mycobacterium
EVPLDRVLELVPWLRKGQWGA

SEQ ID NO: 656927 - protein, 26 aa, Mycobacterium
EVPPLRQHIRFCYAADGVRLAYAATG

SEQ ID NO: 656928 - protein, 19 aa, Mycobacterium
EVPRYGFKPTVVMHPPAAG

SEQ ID NO: 656929 - protein, 24 aa, Mycobacterium
EVPSAGDARFTWEYDEGRARLLSL

SEQ ID NO: 656930 - protein, 21 aa, Mycobacterium
EVPTEALVKVIRDFRPHVMTT

SEQ ID NO: 656931 - protein, 19 aa, Mycobacterium
EVPTHWYNLAAELDEPIPP

SEQ ID NO: 656932 - protein, 23 aa, Mycobacterium
EVPTHWYNLAAELDQPIPPHLHP

SEQ ID NO: 656933 - protein, 19 aa, Mycobacterium
EVPTMIPRESFGFDPAIAP

SEQ ID NO: 656934 - protein, 24 aa, Mycobacterium
EVPVPDVEAAFVLKMLARTVRDSE

SEQ ID NO: 656935 - protein, 32 aa, Mycobacterium
EVPVPPNWGGYRIAPEVVEFWQGRENRVHNRI

SEQ ID NO: 656936 - protein, 19 aa, Mycobacterium
EVQEAGGLYVLGTERHESR

SEQ ID NO: 656937 - protein, 22 aa, Mycobacterium
EVQEFIAGFWYHYDQGHFEELA

SEQ ID NO: 656938 - protein, 21 aa, Mycobacterium
EVQEFIARFWYHYDQGQFDVL

SEQ ID NO: 656939 - protein, 25 aa, Mycobacterium
EVQFGFRKVKVGAFPISIDSAELDQ

SEQ ID NO: 656940 - protein, 24 aa, Mycobacterium
EVQGRPTIKTTLSFLPPPDFEGTT

SEQ ID NO: 656941 - protein, 26 aa, Mycobacterium
EVQIPKLRAGSFFPSLLERRRRIDRA

SEQ ID NO: 656942 - protein, 17 aa, Mycobacterium
EVQKLPLNVTWVNLTTG

SEQ ID NO: 656943 - protein, 18 aa, Mycobacterium
EVQPGDVILIKASNSAGL

SEQ ID NO: 656944 - protein, 20 aa, Mycobacterium
EVQRLIRFMPKPVICLVNGW

SEQ ID NO: 656945 - protein, 35 aa, Mycobacterium
EVQRLIRFMPKVVICLVNGWAAGGGHSLHVTCDLT

SEQ ID NO: 656946 - protein, 18 aa, Mycobacterium
EVQRREGQDWARVADDGD

SEQ ID NO: 656947 - protein, 26 aa, Mycobacterium
EVQTGFARTGAWFASEHEGIVPDIVT

SEQ ID NO: 656948 - protein, 26 aa, Mycobacterium
EVQTGIARTGAWFACEHEDLVPDLIT

SEQ ID NO: 656949 - protein, 25 aa, Mycobacterium
EVQTGIARTGAWFASEHEQLVPDLV

SEQ ID NO: 656950 - protein, 20 aa, Mycobacterium
EVQTVLRWAGTHRIAVVPRG

SEQ ID NO: 656951 - protein, 28 aa, Mycobacterium
EVQVGYGRLGEWFWGFQQQGVVPDIVSM

SEQ ID NO: 656952 - protein, 28 aa, Mycobacterium
EVQVGYGRLGKWFWGFEQQGVVPDIVAI

SEQ ID NO: 656953 - protein, 26 aa, Mycobacterium
EVQVGYGRLGQWFWGFQQQDAVPDIV

SEQ ID NO: 656954 - protein, 20 aa, Mycobacterium
EVRAAALGCESLREDLWRLV

SEQ ID NO: 656955 - protein, 23 aa, Mycobacterium
EVRACAASALVARAVRTTNPNVG

SEQ ID NO: 656956 - protein, 28 aa, Mycobacterium
EVRAEFEDILAFWFDRGVDGFRIDVAHG

SEQ ID NO: 656957 - protein, 22 aa, Mycobacterium
EVRAELCAALGLTPDDLPYAGE

SEQ ID NO: 656958 - protein, 20 aa, Mycobacterium
EVRAGLPPTLAVAGSYLDGI

SEQ ID NO: 656959 - protein, 17 aa, Mycobacterium
EVRAHALAIGDDLVGRG

SEQ ID NO: 656960 - protein, 17 aa, Mycobacterium
EVRARESLAEWLAGLQE

SEQ ID NO: 656961 - protein, 19 aa, Mycobacterium
EVRARVKAGAAVIAPPARQ

SEQ ID NO: 656962 - protein, 17 aa, Mycobacterium
EVRAVPAAAQAAILVLP

SEQ ID NO: 656963 - protein, 32 aa, Mycobacterium
EVRAWKNDPFKPFLVARTRPVAFQKAVVMKYI

SEQ ID NO: 656964 - protein, 20 aa, Mycobacterium
EVRAYLRATARTVLAAHWRE

SEQ ID NO: 656965 - protein, 20 aa, Mycobacterium
EVRAYLRVTARTVLAAHWRE

SEQ ID NO: 656966 - protein, 25 aa, Mycobacterium
EVRDNRFGVCGYCRGGRISMIVAGR

SEQ ID NO: 656967 - protein, 20 aa, Mycobacterium
EVRDRPALHRVKAALEGAGT

SEQ ID NO: 656968 - protein, 20 aa, Mycobacterium
EVREALQVMIERTRAVHADQ

SEQ ID NO: 656969 - protein, 19 aa, Mycobacterium
EVREGILAPSAWSEDDTPE

SEQ ID NO: 656970 - protein, 17 aa, Mycobacterium
EVREMTANAPLMLDHLS

SEQ ID NO: 656971 - protein, 22 aa, Mycobacterium
EVRGAEVVDLLAALNTGHEGGA

SEQ ID NO: 656972 - protein, 22 aa, Mycobacterium
EVRGAEVVELLTALNTGHDGGA

SEQ ID NO: 656973 - protein, 25 aa, Mycobacterium
EVRGDLGGFAGLFALRGDYREPLLA

SEQ ID NO: 656974 - protein, 19 aa, Mycobacterium
EVRGGLGGFAGLFALRGDY

SEQ ID NO: 656975 - protein, 19 aa, Mycobacterium
EVRGGLGGFAGLFALRNDY

SEQ ID NO: 656976 - protein, 20 aa, Mycobacterium
EVRGPWIAGSYYLGHDESKF

SEQ ID NO: 656977 - protein, 24 aa, Mycobacterium
EVRGRGAMIAVELVKPGTTEPDAD

SEQ ID NO: 656978 - protein, 20 aa, Mycobacterium
EVRGWLAANLVGEFATLKGL

SEQ ID NO: 656979 - protein, 20 aa, Mycobacterium
EVRHLWSTFMQKWISYTAEV

SEQ ID NO: 656980 - protein, 19 aa, Mycobacterium
EVRHRIAFLPDYDMSMARL

SEQ ID NO: 656981 - protein, 19 aa, Mycobacterium
EVRHRIAFLPNYDMSMARF

SEQ ID NO: 656982 - protein, 20 aa, Mycobacterium
EVRIGLGAVRHIGDDLAQAI

SEQ ID NO: 656983 - protein, 34 aa, Mycobacterium
EVRIPEIPQWSSGEWTDWKWNTMLIEGSNCREII

SEQ ID NO: 656984 - protein, 24 aa, Mycobacterium
EVRKRFGERGIRLSSAFAGLTAAH

SEQ ID NO: 656985 - protein, 20 aa, Mycobacterium
EVRKSEPIFWVDVPGGTGGF

SEQ ID NO: 656986 - protein, 22 aa, Mycobacterium
EVRKYAAPSFVPGRPLVEVLRE

SEQ ID NO: 656987 - protein, 32 aa, Mycobacterium
EVRLRAAQHLPWHPGRCAEVLVGDTVVGHAGQ

SEQ ID NO: 656988 - protein, 21 aa, Mycobacterium
EVRLRLPWDPSNVTIGDMVHG

SEQ ID NO: 656989 - protein, 19 aa, Mycobacterium
EVRLSTRLTDSPACLITDA

SEQ ID NO: 656990 - protein, 35 aa, Mycobacterium; identical to SEQ ID NO: 79548

SEQ ID NO: 656991 - protein, 19 aa, Mycobacterium
EVRMLRMLGADLVGMSTVH

SEQ ID NO: 656992 - protein, 19 aa, Mycobacterium
EVRNRNAFTATWMGGDDRT

SEQ ID NO: 656993 - protein, 22 aa, Mycobacterium
EVRRARIPINATVPAVPADAVP

SEQ ID NO: 656994 - protein, 32 aa, Mycobacterium
EVRRARKSIAQFKLREGMPIGARVTLRGDRMW

SEQ ID NO: 656995 - protein, 24 aa, Mycobacterium
EVRRFARERSRWIFSNPDMIHLSL

SEQ ID NO: 656996 - protein, 25 aa, Mycobacterium
EVRRYILDCALRWMRDFHADGLRLD

SEQ ID NO: 656997 - protein, 31 aa, Mycobacterium
EVRSALLSLTCPWNLTGHPALSVPAGVVSGL

SEQ ID NO: 656998 - protein, 22 aa, Mycobacterium
EVRSRLSGSGFPGHAAEFDDTV

SEQ ID NO: 656999 - protein, 25 aa, Mycobacterium
EVRSRSDLLAALPERLHDRAVALEV

SEQ ID NO: 657000 - protein, 25 aa, Mycobacterium
EVRSRSDLLAALPERVLGRAVPLKV

SEQ ID NO: 657001 - protein, 18 aa, Mycobacterium
EVRSRSDLVSALPQRVAR

SEQ ID NO: 657002 - protein, 31 aa, Mycobacterium
EVRSSRLCCFIGATPRTEWLDGVVARDEHGF

SEQ ID NO: 657003 - protein, 20 aa, Mycobacterium
EVRVGMAVEVVFESRGNLAL

SEQ ID NO: 657004 - protein, 23 aa, Mycobacterium
EVRVPKDALWRAQTQRAVENFPI

SEQ ID NO: 657005 - protein, 18 aa, Mycobacterium
EVRWDIRPSPHLGTLEMR

SEQ ID NO: 657006 - protein, 22 aa, Mycobacterium
EVRYRFARDGLRLPDDENVALV

SEQ ID NO: 657007 - protein, 26 aa, Mycobacterium
EVSAAIAALFGAHAWQYQAISAQVAV

SEQ ID NO: 657008 - protein, 21 aa, Mycobacterium
EVSAAIAALFGAHGQAYQEAS

SEQ ID NO: 657009 - protein, 26 aa, Mycobacterium
EVSAFSRPATWWSKAGGPVVRVAQRL

SEQ ID NO: 657010 - protein, 20 aa, Mycobacterium
EVSAIGLGFMSFRAGSGPDD

SEQ ID NO: 657011 - protein, 21 aa, Mycobacterium
EVSALQAALFTAYGTLYQQVS

SEQ ID NO: 657012 - protein, 23 aa, Mycobacterium
EVSALTAAQFAAHAQMYQAVSAQ

SEQ ID NO: 657013 - protein, 28 aa, Mycobacterium
EVSAQLAAVFGDYARQFQALSARAEQFH

SEQ ID NO: 657014 - protein, 18 aa, Mycobacterium
EVSARIGSDLVMSASARL

SEQ ID NO: 657015 - protein, 17 aa, Mycobacterium
EVSARIGSELVMAATAR

SEQ ID NO: 657016 - protein, 23 aa, Mycobacterium
EVSDGVPVTGIWLDAEEDGEIVH

SEQ ID NO: 657017 - protein, 21 aa, Mycobacterium
EVSEIDDWFGRSLKTLRDAVT

SEQ ID NO: 657018 - protein, 21 aa, Mycobacterium
EVSETMLSRAARRYRRDIATG

SEQ ID NO: 657019 - protein, 27 aa, Mycobacterium
EVSGAFLAKLGCTFVVVGHSERRTYHH

SEQ ID NO: 657020 - protein, 23 aa, Mycobacterium
EVSGAFLAKLGVTYVVVGHSERR

SEQ ID NO: 657021 - protein, 21 aa, Mycobacterium
EVSGAIAALFGANAQEYQAAA

SEQ ID NO: 657022 - protein, 23 aa, Mycobacterium
EVSGELKPGGTIVEPTSGNTGVG

SEQ ID NO: 657023 - protein, 26 aa, Mycobacterium
EVSGERFGVCGYCMGGRTSLIVAGRV

SEQ ID NO: 657024 - protein, 26 aa, Mycobacterium
EVSGFLQSRGHGFSRFASLGNQADLG

SEQ ID NO: 657025 - protein, 24 aa, Mycobacterium
EVSGPLLRREFRLGNSAMVPLRTA

SEQ ID NO: 657026 - protein, 21 aa, Mycobacterium
EVSGPVIVVGLGLNVEMTVDE

SEQ ID NO: 657027 - protein, 17 aa, Mycobacterium
EVSIRCMIEEPFSGFDG

SEQ ID NO: 657028 - protein, 17 aa, Mycobacterium
EVSIRCMIEEPFTGFHG

SEQ ID NO: 657029 - protein, 25 aa, Mycobacterium
EVSLPRECLLIFGAEGPGITEDAKT

SEQ ID NO: 657030 - protein, 25 aa, Mycobacterium
EVSMLLQRRCVWMVEQGDIPVAEGS

SEQ ID NO: 657031 - protein, 20 aa, Mycobacterium
EVSPHPLLSYAIKDTLTGPH

SEQ ID NO: 657032 - protein, 20 aa, Mycobacterium
EVSQRGMLVLVHHLDTDNQY

SEQ ID NO: 657033 - protein, 19 aa, Mycobacterium
EVSQSFFRSQCALLRGAFE

SEQ ID NO: 657034 - protein, 23 aa, Mycobacterium
EVSRDLFIRHALVEGDWRTKHHF

SEQ ID NO: 657035 - protein, 26 aa, Mycobacterium
EVSSFSRPATWWSKAGGPFVALTQRI

SEQ ID NO: 657036 - protein, 20 aa, Mycobacterium
EVSSFTDSYAKLIFLPQSHE

SEQ ID NO: 657037 - protein, 19 aa, Mycobacterium
EVSSRVIPGSGLAVERIGE

SEQ ID NO: 657038 - protein, 22 aa, Mycobacterium
EVSTAIAALFGSHGQAFQALSA

SEQ ID NO: 657039 - protein, 21 aa, Mycobacterium
EVSTAVAALFGGHAQEYQALV

SEQ ID NO: 657040 - protein, 22 aa, Mycobacterium
EVSTLVAVACRELLLTEDVRAR

SEQ ID NO: 657041 - protein, 25 aa, Mycobacterium
EVSVALRVLGKHGALTPALATLGFG

SEQ ID NO: 657042 - protein, 19 aa, Mycobacterium
EVSVGLLYKYFGGKEDLLL

SEQ ID NO: 657043 - protein, 27 aa, Mycobacterium
EVSVVLPVGCGKSGLLALTPFAAQSHR

SEQ ID NO: 657044 - protein, 23 aa, Mycobacterium
EVSWGDVALVLSIPYQGLGNAAI

SEQ ID NO: 657045 - protein, 25 aa, Mycobacterium
EVTACLRALVRRRVAVAHPGYDSED

SEQ ID NO: 657046 - protein, 24 aa, Mycobacterium
EVTADAGGLGGNIGVAATAIGGGN

SEQ ID NO: 657047 - protein, 18 aa, Mycobacterium
EVTASMVYDGRPVHDHFK

SEQ ID NO: 657048 - protein, 20 aa, Mycobacterium
EVTAVPAALPAVMPGLDTYA

SEQ ID NO: 657049 - protein, 20 aa, Mycobacterium
EVTDIIPFSEFSKAFDQFAA

SEQ ID NO: 657050 - protein, 20 aa, Mycobacterium
EVTDLAGLLAGPGQVVVSGA

SEQ ID NO: 657051 - protein, 21 aa, Mycobacterium
EVTDMLVSWLRFNIAEDSPAD

SEQ ID NO: 657052 - protein, 28 aa, Mycobacterium
EVTEGVGFDKGFISAYFVTDFDSQEAVL

SEQ ID NO: 657053 - protein, 23 aa, Mycobacterium
EVTEKKAGAAVALYEEPDVLVKV

SEQ ID NO: 657054 - protein, 25 aa, Mycobacterium
EVTEPKGQFLAPVVFSGVPHDHPLV

SEQ ID NO: 657055 - protein, 17 aa, Mycobacterium
EVTEPPQGVAVFDTAPT

SEQ ID NO: 657056 - protein, 21 aa, Mycobacterium
EVTEVGRILGYTPYRMNTPDL

SEQ ID NO: 657057 - protein, 23 aa, Mycobacterium
EVTEVPESLLVIGGGYVALEQAQ

SEQ ID NO: 657058 - protein, 18 aa, Mycobacterium
EVTFCGFAQSVSDIVMTN

SEQ ID NO: 657059 - protein, 18 aa, Mycobacterium
EVTGFALAEVCDGSDFPR

SEQ ID NO: 657060 - protein, 17 aa, Mycobacterium
EVTGRWSVAAVNPKVTV

SEQ ID NO: 657061 - protein, 23 aa, Mycobacterium
EVTLGGMSFRVIGGDVVVAVTGA

SEQ ID NO: 657062 - protein, 22 aa, Mycobacterium
EVTLRFSDGEVVTMHVISIVEE

SEQ ID NO: 657063 - protein, 19 aa, Mycobacterium
EVTQLFGPELPQVHVIRNG

SEQ ID NO: 657064 - protein, 18 aa, Mycobacterium
EVTRKEYGQDLAFTAEVD

SEQ ID NO: 657065 - protein, 29 aa, Mycobacterium
EVTRPIEVTRLARILRPYPSVGEAVAAPE

SEQ ID NO: 657066 - protein, 21 aa, Mycobacterium
EVTSRAAALVGTRACSGYGEH

SEQ ID NO: 657067 - protein, 19 aa, Mycobacterium
EVTTARFYLYVNQVTNNVP

SEQ ID NO: 657068 - protein, 17 aa, Mycobacterium
EVTTCAAIRSIHTLPAE

SEQ ID NO: 657069 - protein, 22 aa, Mycobacterium
EVTVSSYVRWPEAVRPLVRPQA

SEQ ID NO: 657070 - protein, 19 aa, Mycobacterium
EVVAAHLVNLCWNGLTHLE

SEQ ID NO: 657071 - protein, 24 aa, Mycobacterium
EVVAAHLVNLMWNGLIGLEADPRL

SEQ ID NO: 657072 - protein, 20 aa, Mycobacterium
EVVAAHLVNLMWNGLTHLEA

SEQ ID NO: 657073 - protein, 18 aa, Mycobacterium
EVVAAHVVNLAWNGLTHL

SEQ ID NO: 657074 - protein, 18 aa, Mycobacterium
EVVAFHLDSSVLDPAGRV

SEQ ID NO: 657075 - protein, 26 aa, Mycobacterium
EVVAGLKFYGDRGWLDHPKRFFRPPP

SEQ ID NO: 657076 - protein, 22 aa, Mycobacterium
EVVAIARPLLAPAVESVGAVVD

SEQ ID NO: 657077 - protein, 24 aa, Mycobacterium
EVVAIGITPDGSWVLTDGRPETLA

SEQ ID NO: 657078 - protein, 24 aa, Mycobacterium
EVVAIGITPQGSWVLTDGDPDALA

SEQ ID NO: 657079 - protein, 17 aa, Mycobacterium
EVVALGRRAEMLLDNPV

SEQ ID NO: 657080 - protein, 17 aa, Mycobacterium
EVVARFCGRELILDTAV

SEQ ID NO: 657081 - protein, 18 aa, Mycobacterium
EVVARWGPSGGWQRALPV

SEQ ID NO: 657082 - protein, 24 aa, Mycobacterium
EVVCLETPPLFFAVGQGYHNFAQT

SEQ ID NO: 657083 - protein, 24 aa, Mycobacterium
EVVDAPEMHFCIFFDQPTPGDIGY

SEQ ID NO: 657084 - protein, 19 aa, Mycobacterium
EVVDLAVGFRIPVAPIATP

SEQ ID NO: 657085 - protein, 17 aa, Mycobacterium
EVVDLRTLVPLDVETVV

SEQ ID NO: 657086 - protein, 23 aa, Mycobacterium
EVVDRWAPGRVMINAYGPTEGTV

SEQ ID NO: 657087 - protein, 23 aa, Mycobacterium
EVVDRWAPGRVMINGYGPTETTI

SEQ ID NO: 657088 - protein, 22 aa, Mycobacterium
EVVDRWAPGRVMVNAYGPTETT

SEQ ID NO: 657089 - protein, 20 aa, Mycobacterium
EVVDRWAPGRVMVNQYGPTE

SEQ ID NO: 657090 - protein, 22 aa, Mycobacterium
EVVDRWAPGRVMVNVYGPTETT

SEQ ID NO: 657091 - protein, 24 aa, Mycobacterium
EVVDTWREGYPYDERMHRADYEEQ

SEQ ID NO: 657092 - protein, 25 aa, Mycobacterium
EVVEICRKVWRRERVSYDGKYYQLP

SEQ ID NO: 657093 - protein, 20 aa, Mycobacterium
EVVELYNLVVWNEQNLELAE

SEQ ID NO: 657094 - protein, 25 aa, Mycobacterium
EVVEPLRIALAYAVRRATRPLRAPR

SEQ ID NO: 657095 - protein, 18 aa, Mycobacterium
EVVERWAPGRVMINAYGP

SEQ ID NO: 657096 - protein, 22 aa, Mycobacterium
EVVETLAVIATRFATTRGSAWR

SEQ ID NO: 657097 - protein, 21 aa, Mycobacterium
EVVEVAPRLDHRFSGADPRIA

SEQ ID NO: 657098 - protein, 17 aa, Mycobacterium
EVVEYGAANGFALTEMT

SEQ ID NO: 657099 - protein, 18 aa, Mycobacterium
EVVGEGPAAVAVHHVANS

SEQ ID NO: 657100 - protein, 18 aa, Mycobacterium
EVVGFTVHVPHYLTQTDY

SEQ ID NO: 657101 - protein, 17 aa, Mycobacterium
EVVGHPRFELVGVGVSN

SEQ ID NO: 657102 - protein, 17 aa, Mycobacterium
EVVGIFYNRELLSSLGL

SEQ ID NO: 657103 - protein, 19 aa, Mycobacterium
EVVGRFLALLELYRSRAVA

SEQ ID NO: 657104 - protein, 24 aa, Mycobacterium
EVVHDYLFSRCLTIAGGTSEIVRN

SEQ ID NO: 657105 - protein, 18 aa, Mycobacterium
EVVHQMFVSTMGISSADY

SEQ ID NO: 657106 - protein, 26 aa, Mycobacterium
EVVHRNGLRLAKLVNTLLDFSRIEAG

SEQ ID NO: 657107 - protein, 19 aa, Mycobacterium
EVVIKSDFLLKEYWNRPDA

SEQ ID NO: 657108 - protein, 19 aa, Mycobacterium
EVVIPILVPDGAHSYPDAA

SEQ ID NO: 657109 - protein, 18 aa, Mycobacterium
EVVIPMLVPEGAHAYPDA

SEQ ID NO: 657110 - protein, 19 aa, Mycobacterium
EVVIPMLVPEGAHAYPDAA

SEQ ID NO: 657111 - protein, 17 aa, Mycobacterium
EVVKDALAKQVDFVKVA

SEQ ID NO: 657112 - protein, 24 aa, Mycobacterium
EVVKDRPDRFGFFASLPLPDVDGA

SEQ ID NO: 657113 - protein, 17 aa, Mycobacterium
EVVKEIKDAGGRAVANY

SEQ ID NO: 657114 - protein, 24 aa, Mycobacterium
EVVKEIKDAGGRAVANYDSVAEPE

SEQ ID NO: 657115 - protein, 19 aa, Mycobacterium
EVVKLKMGRGTVWESAYAA

SEQ ID NO: 657116 - protein, 18 aa, Mycobacterium
EVVLDFPVNRRVRPEAKT

SEQ ID NO: 657117 - protein, 26 aa, Mycobacterium
EVVLDPRLRAAASWPAGVAAGRRVRG

SEQ ID NO: 657118 - protein, 21 aa, Mycobacterium
EVVLEAFTTLMGRDSDRMADI

SEQ ID NO: 657119 - protein, 23 aa, Mycobacterium
EVVLMELGLDWDRIGKLKDVGAI

SEQ ID NO: 657120 - protein, 20 aa, Mycobacterium
EVVLRLRALLRRTGIAGDSG

SEQ ID NO: 657121 - protein, 22 aa, Mycobacterium
EVVLRLRALLRRTGVTSEDGGA

SEQ ID NO: 657122 - protein, 17 aa, Mycobacterium
EVVLSLRNPEPTSGLAR

SEQ ID NO: 657123 - protein, 25 aa, Mycobacterium
EVVNPDAGLVLREVGLEVMGSARRV

SEQ ID NO: 657124 - protein, 19 aa, Mycobacterium
EVVPLSFAQSRLWFLDQLH

SEQ ID NO: 657125 - protein, 32 aa, Mycobacterium
EVVQAAVKVLASWDWETRPSAVMAVDSDTHPQ

SEQ ID NO: 657126 - protein, 19 aa, Mycobacterium
EVVQATLALPVSDLVADGE

SEQ ID NO: 657127 - protein, 17 aa, Mycobacterium
EVVREIADSVARLDGGR

SEQ ID NO: 657128 - protein, 27 aa, Mycobacterium
EVVRLLKPGGVFAFSSWVRSVSNPLFD

SEQ ID NO: 657129 - protein, 18 aa, Mycobacterium
EVVRMAANVRFDAPGGDA

SEQ ID NO: 657130 - protein, 20 aa, Mycobacterium
EVVRRLKAAGAVIVGKTNTC

SEQ ID NO: 657131 - protein, 20 aa, Mycobacterium
EVVRRLRAAGAVILGKTNVP

SEQ ID NO: 657132 - protein, 19 aa, Mycobacterium
EVVRRLRLPFHMLSDPDFT

SEQ ID NO: 657133 - protein, 27 aa, Mycobacterium
EVVRRLRVEAPGVRFAGLGGATETPVH

SEQ ID NO: 657134 - protein, 23 aa, Mycobacterium
EVVRTEGPWRLIIAQHFASADEL

SEQ ID NO: 657135 - protein, 19 aa, Mycobacterium
EVVSVFLAPPSWDELVRRL

SEQ ID NO: 657136 - protein, 18 aa, Mycobacterium
EVVTELIDRGALRSLRDA

SEQ ID NO: 657137 - protein, 23 aa, Mycobacterium
EVVTVPTTMPWGNRALLLRDPDG

SEQ ID NO: 657138 - protein, 24 aa, Mycobacterium
EVWGKRRLAYEIAKHTEGIYAVID

SEQ ID NO: 657139 - protein, 20 aa, Mycobacterium
EVWGPAYAKETHYLRVYLAQ

SEQ ID NO: 657140 - protein, 20 aa, Mycobacterium
EVWLTARWGAHTRKAGRTWW

SEQ ID NO: 657141 - protein, 20 aa, Mycobacterium
EVWPFAPAEHRAMLANPDLD

SEQ ID NO: 657142 - protein, 19 aa, Mycobacterium
EVWSGGEAEGVRFAYYEPP

SEQ ID NO: 657143 - protein, 21 aa, Mycobacterium
EVWSQVKAALIERGMSHRAFA

SEQ ID NO: 657144 - protein, 20 aa, Mycobacterium
EVYAFLGGIFGRGLEKEGLG

SEQ ID NO: 657145 - protein, 22 aa, Mycobacterium
EVYELLDPGGQRWVMQTWSQVA

SEQ ID NO: 657146 - protein, 35 aa, Mycobacterium
EVYFELRLADAWVWDMYRPARFVKQVRVITFKDVN

SEQ ID NO: 657147 - protein, 35 aa, Mycobacterium
EVYFELRLGDAWVWDMYRPARFVKQVRVITFKDVN

SEQ ID NO: 657148 - protein, 37 aa, Mycobacterium
EVYFELRLSDAWVWDLFRPARFVKHVRVITFKDVNIE

SEQ ID NO: 657149 - protein, 17 aa, Mycobacterium
EVYGIALDRGRKMRDLG

SEQ ID NO: 657150 - protein, 23 aa, Mycobacterium
EVYGKPQFWPLWEAAADANLPVA

SEQ ID NO: 657151 - protein, 24 aa, Mycobacterium
EVYGKPQFWPLWEAAVDAGWPVAV

SEQ ID NO: 657152 - protein, 20 aa, Mycobacterium
EVYLRGRVGERFCARNSGAL

SEQ ID NO: 657153 - protein, 31 aa, Mycobacterium
EVYPDSTDALGWRLGDDGFRIVLTAELADVV

SEQ ID NO: 657154 - protein, 24 aa, Mycobacterium
EVYPVEYPASLAFATAADGVIDAS

SEQ ID NO: 657155 - protein, 18 aa, Mycobacterium
EVYRARAVILAMGAAPRY

SEQ ID NO: 657156 - protein, 18 aa, Mycobacterium
EVYRRMGYGEVVDEVTEL

SEQ ID NO: 657157 - protein, 23 aa, Mycobacterium
EVYRYLAGIFRRGLENEDLANRL

SEQ ID NO: 657158 - protein, 17 aa, Mycobacterium
EVYSIRSPLGAAIAGAR

SEQ ID NO: 657159 - protein, 19 aa, Mycobacterium
EWADRYKGRFDMGYERYRE

SEQ ID NO: 657160 - protein, 23 aa, Mycobacterium
EWAESRRYLGLDVLSKSRAVNDT

SEQ ID NO: 657161 - protein, 25 aa, Mycobacterium
EWAGRWPFVGSLTMELPTDADDEVT

SEQ ID NO: 657162 - protein, 19 aa, Mycobacterium
EWAPAPGALFSWHPSPAAR

SEQ ID NO: 657163 - protein, 22 aa, Mycobacterium
EWAPASEELTLWASTQTPHELR

SEQ ID NO: 657164 - protein, 17 aa, Mycobacterium
EWARLAQGHLPSAVDED

SEQ ID NO: 657165 - protein, 18 aa, Mycobacterium
EWASSSPFQFFSSHPEPE

SEQ ID NO: 657166 - protein, 21 aa, Mycobacterium
EWAVPAGGVGPWVGDLPDDLR

SEQ ID NO: 657167 - protein, 19 aa, Mycobacterium
EWCRDEALSTVAGRRQRAD

SEQ ID NO: 657168 - protein, 29 aa, Mycobacterium
EWDAVIAVHLRGHFLLTRNAATYWRSKAK

SEQ ID NO: 657169 - protein, 21 aa, Mycobacterium
EWDIRNGVIIRKARAHGLPTP

SEQ ID NO: 657170 - protein, 23 aa, Mycobacterium
EWDPKKPLPLIGVDRLYDYFLES

SEQ ID NO: 657171 - protein, 19 aa, Mycobacterium
EWDRICGSLSHQRCSAAHP

SEQ ID NO: 657172 - protein, 20 aa, Mycobacterium
EWDSAAPAGVLWAAGLHASR

SEQ ID NO: 657173 - protein, 19 aa, Mycobacterium
EWEAFLGKDDDLYVFESVA

SEQ ID NO: 657174 - protein, 19 aa, Mycobacterium
EWEAFLGKDEDLFAFETVA

SEQ ID NO: 657175 - protein, 19 aa, Mycobacterium
EWEAFLGKDEDLFVFDSLA

SEQ ID NO: 657176 - protein, 19 aa, Mycobacterium
EWEAFLGKDEDLFVFSSVA

SEQ ID NO: 657177 - protein, 19 aa, Mycobacterium
EWEAFLGKDEDLYAFENVA

SEQ ID NO: 657178 - protein, 19 aa, Mycobacterium
EWEAFLGKDEDLYVFDSVA

SEQ ID NO: 657179 - protein, 20 aa, Mycobacterium
EWEKACAWDPVAGARRRFPW

SEQ ID NO: 657180 - protein, 21 aa, Mycobacterium
EWEKACAWDPVTNSRRRYPWG

SEQ ID NO: 657181 - protein, 19 aa, Mycobacterium
EWELMPLAAAEGVGALVWS

SEQ ID NO: 657182 - protein, 31 aa, Mycobacterium
EWELQEADGGLCIWARLPAPMSTALAAAAAR

SEQ ID NO: 657183 - protein, 17 aa, Mycobacterium
EWEPVPLPTAAGLPGAL

SEQ ID NO: 657184 - protein, 23 aa, Mycobacterium
EWERKLEVVADIRPELVSFTFGA

SEQ ID NO: 657185 - protein, 24 aa, Mycobacterium
EWESRAIAVFGHRPYVGVSANIVA

SEQ ID NO: 657186 - protein, 19 aa, Mycobacterium
EWFATAYVDGFRWVMPTNV

SEQ ID NO: 657187 - protein, 19 aa, Mycobacterium
EWFLRRTSLLDSLYLAPSP

SEQ ID NO: 657188 - protein, 22 aa, Mycobacterium
EWGCFTYGIVQHADYFTFYASV

SEQ ID NO: 657189 - protein, 17 aa, Mycobacterium
EWGFAGYVRHFIDKPTI

SEQ ID NO: 657190 - protein, 25 aa, Mycobacterium
EWGNGFRIDAVWERVALTRKTGWAV

SEQ ID NO: 657191 - protein, 19 aa, Mycobacterium
EWHLRKVFAKLGITSRRQL

SEQ ID NO: 657192 - protein, 19 aa, Mycobacterium
EWHLRKVFAKRGITSRRQL

SEQ ID NO: 657193 - protein, 19 aa, Mycobacterium
EWHLRKVFVKLGIGSRRQL

SEQ ID NO: 657194 - protein, 19 aa, Mycobacterium
EWHRFPIVERVEAATGLPV

SEQ ID NO: 657195 - protein, 30 aa, Mycobacterium
EWIDAREALRMGLVWRVCEPAALLPEARRH

SEQ ID NO: 657196 - protein, 25 aa, Mycobacterium
EWIGDSWAVLFSHPRDFTPVCTTEL

SEQ ID NO: 657197 - protein, 17 aa, Mycobacterium
EWILEHWTFNHADRLFT

SEQ ID NO: 657198 - protein, 17 aa, Mycobacterium
EWIWGRATVLAAGYLTG

SEQ ID NO: 657199 - protein, 23 aa, Mycobacterium
EWKHGICQALGWPHRDQADIAQA

SEQ ID NO: 657200 - protein, 17 aa, Mycobacterium
EWKSMSALSDTRAPSDI

SEQ ID NO: 657201 - protein, 19 aa, Mycobacterium
EWLAEALAARPASESLFDA

SEQ ID NO: 657202 - protein, 18 aa, Mycobacterium
EWLAHWPSGASLVDAAPA

SEQ ID NO: 657203 - protein, 26 aa, Mycobacterium
EWLDDPRFADAYARFVNATELIAELD

SEQ ID NO: 657204 - protein, 22 aa, Mycobacterium
EWLEDRRQLLAFIDFIDSQMGV

SEQ ID NO: 657205 - protein, 17 aa, Mycobacterium
EWLEFEVNNGIVYNGPD

SEQ ID NO: 657206 - protein, 22 aa, Mycobacterium
EWLHPFEKFWRARLAGLAETAE

SEQ ID NO: 657207 - protein, 19 aa, Mycobacterium
EWLLFGPFAGWSPKFLKMG

SEQ ID NO: 657208 - protein, 23 aa, Mycobacterium
EWLLVELRSDWFFGGTTYGAGSL

SEQ ID NO: 657209 - protein, 22 aa, Mycobacterium
EWLNRQLSPYANWARSNNSLLI

SEQ ID NO: 657210 - protein, 23 aa, Mycobacterium
EWLPGSRELRAWTLAAGTPEADD

SEQ ID NO: 657211 - protein, 22 aa, Mycobacterium
EWLPREKYIGLIMAPGGSTHVQ

SEQ ID NO: 657212 - protein, 24 aa, Mycobacterium
EWLPRLASGDAIGCFGLTEPDFGS

SEQ ID NO: 657213 - protein, 20 aa, Mycobacterium
EWLRDEGYHQLLSRTVLVIN

SEQ ID NO: 657214 - protein, 21 aa, Mycobacterium
EWLRRCAEVNRHAVEAVRGQL

SEQ ID NO: 657215 - protein, 24 aa, Mycobacterium
EWMLDIRLKALRTFDKKPMPTWGS

SEQ ID NO: 657216 - protein, 23 aa, Mycobacterium
EWMNRPHLAEAWEYDRPVEWWDG

SEQ ID NO: 657217 - protein, 24 aa, Mycobacterium
EWMNRPHLAEAWEYDWPTPRWRQH

SEQ ID NO: 657218 - protein, 24 aa, Mycobacterium
EWMNRPHLVEAWEYPWPPQRWRRY

SEQ ID NO: 657219 - protein, 22 aa, Mycobacterium
EWMQMCFERSAGLLDVPRLRQV

SEQ ID NO: 657220 - protein, 18 aa, Mycobacterium
EWNASNQFTGWVDVDLTE

SEQ ID NO: 657221 - protein, 21 aa, Mycobacterium
EWNHTCYGLWCNDGQTPPPYL

SEQ ID NO: 657222 - protein, 20 aa, Mycobacterium
EWNKEIASVDILQRLPDGRP

SEQ ID NO: 657223 - protein, 20 aa, Mycobacterium
EWNLDFATALTRLLTATCIG

SEQ ID NO: 657224 - protein, 19 aa, Mycobacterium
EWNMWTRQFMRDHVAVIEC

SEQ ID NO: 657225 - protein, 23 aa, Mycobacterium
EWPAELRFPYLGLAKTFIADNVL

SEQ ID NO: 657226 - protein, 24 aa, Mycobacterium
EWPEDPRFLMITPLSHAGAAYFLP

SEQ ID NO: 657227 - protein, 27 aa, Mycobacterium
EWPEHPRFLMCTPLSHAGAAFFTPTLV

SEQ ID NO: 657228 - protein, 27 aa, Mycobacterium
EWPENPRFLMCTPLSHAGAAFFTPTVI

SEQ ID NO: 657229 - protein, 28 aa, Mycobacterium
EWPENPRFLMCTPLSHAGAAFFVPTIIK

SEQ ID NO: 657230 - protein, 27 aa, Mycobacterium
EWPENPRFLMCTPLSHAGAAFFVPTIV

SEQ ID NO: 657231 - protein, 19 aa, Mycobacterium
EWPHLAFAAFRGVDHARRP

SEQ ID NO: 657232 - protein, 22 aa, Mycobacterium
EWPLDRRIEGFLRREGLVRLAE

SEQ ID NO: 657233 - protein, 22 aa, Mycobacterium
EWPLIAAAVARGWAVSISDHEG

SEQ ID NO: 657234 - protein, 20 aa, Mycobacterium
EWPPGSSIADFWPQIRPDEW

SEQ ID NO: 657235 - protein, 18 aa, Mycobacterium
EWPRLAFDPLDRLAKRTG

SEQ ID NO: 657236 - protein, 23 aa, Mycobacterium
EWPRTRTTVAFIFDDVAPKASRW

SEQ ID NO: 657237 - protein, 22 aa, Mycobacterium
EWQECLHKAAPIVGMAVPATAT

SEQ ID NO: 657238 - protein, 22 aa, Mycobacterium
EWQRFPIVDRVAAATGLPVRLG

SEQ ID NO: 657239 - protein, 18 aa, Mycobacterium
EWRAHWRQAPADPAAATE

SEQ ID NO: 657240 - protein, 26 aa, Mycobacterium
EWRGAAERVLRGFALSLLVPQPHYDA

SEQ ID NO: 657241 - protein, 20 aa, Mycobacterium
EWRHGAAVSVGLVFAAELAR

SEQ ID NO: 657242 - protein, 18 aa, Mycobacterium
EWRLSARENPQCVSAASF

SEQ ID NO: 657243 - protein, 28 aa, Mycobacterium
EWRRGSLPPGRLGWRRAQEITTRSAALA

SEQ ID NO: 657244 - protein, 21 aa, Mycobacterium
EWRRGTLPPGRIGVRKTKEIL

SEQ ID NO: 657245 - protein, 22 aa, Mycobacterium
EWRTAEAWPPSMTPHRELALRA

SEQ ID NO: 657246 - protein, 19 aa, Mycobacterium
EWSDEVARMHGYEPGAVVP

SEQ ID NO: 657247 - protein, 20 aa, Mycobacterium
EWSERWPDLVAPFTAATRAE

SEQ ID NO: 657248 - protein, 23 aa, Mycobacterium
EWSERWPEFVASFTAATRAEDGN

SEQ ID NO: 657249 - protein, 19 aa, Mycobacterium
EWSLKPGTVTSWQPTAAAR

SEQ ID NO: 657250 - protein, 23 aa, Mycobacterium
EWSPETVRARWLAPDRFRAWNRR

SEQ ID NO: 657251 - protein, 17 aa, Mycobacterium
EWSSGDWLTAPTPGPGE

SEQ ID NO: 657252 - protein, 19 aa, Mycobacterium
EWTAEFVDWQLSRAWSEDL

SEQ ID NO: 657253 - protein, 17 aa, Mycobacterium
EWTLPAWAPVPVSELAL

SEQ ID NO: 657254 - protein, 25 aa, Mycobacterium
EWTQHWRIATLLGVASDDLLAVRDW

SEQ ID NO: 657255 - protein, 25 aa, Mycobacterium
EWTQHWRIATLLGVPERDLLAVRDW

SEQ ID NO: 657256 - protein, 24 aa, Mycobacterium
EWTQHWRVASGLGVSAEDLLGVRD

SEQ ID NO: 657257 - protein, 24 aa, Mycobacterium
EWTVEHLHTLLAVRCTPAPWWSYD

SEQ ID NO: 657258 - protein, 26 aa, Mycobacterium
EWVARLAVDFRQEFHKDVVIDMLCYR

SEQ ID NO: 657259 - protein, 18 aa, Mycobacterium
EWVGATVGRFGEPDRGPA

SEQ ID NO: 657260 - protein, 24 aa, Mycobacterium
EWVGLSVTMPGKFAALRCADEATE

SEQ ID NO: 657261 - protein, 25 aa, Mycobacterium
EWVGPSRLFITIFRDLEGLSHSMAP

SEQ ID NO: 657262 - protein, 18 aa, Mycobacterium
EWVLPPEDIPFIYPDERI

SEQ ID NO: 657263 - protein, 24 aa, Mycobacterium
EWVRRTGDTTVRIGITDYAQSQLG

SEQ ID NO: 657264 - protein, 20 aa, Mycobacterium
EYAAANGWLERSGIMSLISD

SEQ ID NO: 657265 - protein, 20 aa, Mycobacterium
EYAALGFEYGYSVGNPDAMV

SEQ ID NO: 657266 - protein, 20 aa, Mycobacterium
EYAAVGFEYGYTVGNPDALV

SEQ ID NO: 657267 - protein, 38 aa, Mycobacterium
EYAAVTGLRYGNCVPLTYPFALTFPALMSLVTGFDFPF

SEQ ID NO: 657268 - protein, 36 aa, Mycobacterium
EYAAVTGLRYGNNVPLTYPFALTFPTMMSLVTGFDF

SEQ ID NO: 657269 - protein, 19 aa, Mycobacterium
EYADGGVLEHRFVGLFTVA

SEQ ID NO: 657270 - protein, 24 aa, Mycobacterium
EYADRKSVILGFEPEPGMFVETVQ

SEQ ID NO: 657271 - protein, 29 aa, Mycobacterium
EYADSGIGFSCLWPETYIATAAVANGAGG

SEQ ID NO: 657272 - protein, 29 aa, Mycobacterium
EYADTGIGFSCLWPETYIATSAVTNLSDG

SEQ ID NO: 657273 - protein, 17 aa, Mycobacterium
EYADVGYGWAMEDTTGF

SEQ ID NO: 657274 - protein, 19 aa, Mycobacterium
EYAEGHFTAAVSAPGGQLV

SEQ ID NO: 657275 - protein, 19 aa, Mycobacterium
EYAKAFGMDVIAWSQNLTA

SEQ ID NO: 657276 - protein, 17 aa, Mycobacterium
EYAKLVAAIVDNPMLNG

SEQ ID NO: 657277 - protein, 18 aa, Mycobacterium
EYALKRALAKLADRFDVV

SEQ ID NO: 657278 - protein, 25 aa, Mycobacterium
EYAPMLGKRVRLVVDSAVRIDAPAR

SEQ ID NO: 657279 - protein, 22 aa, Mycobacterium
EYARRLQFIGCTTLVSQLPLLA

SEQ ID NO: 657280 - protein, 18 aa, Mycobacterium
EYASRLGLHSAPSPFVPP

SEQ ID NO: 657281 - protein, 25 aa, Mycobacterium
EYATPRLAAIPGVRIVGTAQEKASV

SEQ ID NO: 657282 - protein, 25 aa, Mycobacterium
EYATPRLAAIPGVTLVGTADHKASV

SEQ ID NO: 657283 - protein, 17 aa, Mycobacterium
EYAVLRFSGDRGPGAVA

SEQ ID NO: 657284 - protein, 20 aa, Mycobacterium
EYAWKPTVHEGSEPWVQTPE

SEQ ID NO: 657285 - protein, 20 aa, Mycobacterium
EYCDGCARWVHPASGECREC

SEQ ID NO: 657286 - protein, 18 aa, Mycobacterium
EYCKERLGLDKALGSIDR

SEQ ID NO: 657287 - protein, 21 aa, Mycobacterium
EYCVVRSGFGLDVAKTADVAV

SEQ ID NO: 657288 - protein, 19 aa, Mycobacterium
EYCVVRSGFSLDVAKTADV

SEQ ID NO: 657289 - protein, 24 aa, Mycobacterium
EYDALRDVGFWRLTVPREYGGLGF

SEQ ID NO: 657290 - protein, 29 aa, Mycobacterium
EYDGAADLPDRWWNFLALANAIAGGLFVH

SEQ ID NO: 657291 - protein, 21 aa, Mycobacterium
EYDGAIAWLVGEEGRGVPTII

SEQ ID NO: 657292 - protein, 18 aa, Mycobacterium
EYDPELVVIFSPDHYNGF

SEQ ID NO: 657293 - protein, 21 aa, Mycobacterium
EYDRHIRLVRARHRARRDALL

SEQ ID NO: 657294 - protein, 17 aa, Mycobacterium
EYDRLIPGRGVGVLLDD

SEQ ID NO: 657295 - protein, 20 aa, Mycobacterium
EYDRRYGLDESHLRAIADLN

SEQ ID NO: 657296 - protein, 18 aa, Mycobacterium
EYDTEVFDAPAIETLIER

SEQ ID NO: 657297 - protein, 17 aa, Mycobacterium
EYDTIKTTMRFGPESEK

SEQ ID NO: 657298 - protein, 24 aa, Mycobacterium
EYEAMWAADVAAMVGYHGGASAAA

SEQ ID NO: 657299 - protein, 21 aa, Mycobacterium
EYEGLGWRMVHVGADLLRYRQ

SEQ ID NO: 657300 - protein, 30 aa, Mycobacterium
EYEKAHLPEGGWPPTGWFEGWANGLDVFDV

SEQ ID NO: 657301 - protein, 22 aa, Mycobacterium
EYELDCIIYASGFEITTEISRR

SEQ ID NO: 657302 - protein, 22 aa, Mycobacterium
EYELDCIIYASGFEITTQISRR

SEQ ID NO: 657303 - protein, 23 aa, Mycobacterium
EYELLRRNQILFTYLHLAASRAC

SEQ ID NO: 657304 - protein, 17 aa, Mycobacterium
EYERRQIEFARVGGTIQ

SEQ ID NO: 657305 - protein, 25 aa, Mycobacterium
EYETARLFLDPGFEQSVRETFGDDA

SEQ ID NO: 657306 - protein, 23 aa, Mycobacterium
EYEVDCIIFASGFEITTEIRRRF

SEQ ID NO: 657307 - protein, 22 aa, Mycobacterium
EYEVDCIIYASGFEITTDISRR

SEQ ID NO: 657308 - protein, 22 aa, Mycobacterium
EYEVDCIIYASGFEITTEISRR

SEQ ID NO: 657309 - protein, 19 aa, Mycobacterium
EYFANYFLHMSDVTFDMSL

SEQ ID NO: 657310 - protein, 18 aa, Mycobacterium
EYFSQAWAVRKERLQAQG

SEQ ID NO: 657311 - protein, 18 aa, Mycobacterium
EYGARGWAMNALFDGIEA

SEQ ID NO: 657312 - protein, 18 aa, Mycobacterium
EYGARGWAMNTLFDGIAP

SEQ ID NO: 657313 - protein, 18 aa, Mycobacterium
EYGDGWWPTGSAGPETYA

SEQ ID NO: 657314 - protein, 18 aa, Mycobacterium
EYGGRGASVLEQLVYTEE

SEQ ID NO: 657315 - protein, 19 aa, Mycobacterium
EYGGRGFSAIEQFIFSEEA

SEQ ID NO: 657316 - protein, 21 aa, Mycobacterium
EYGIGAAVAKWTATGRTVHYA

SEQ ID NO: 657317 - protein, 22 aa, Mycobacterium
EYGIQMPIAREVDGVINQGSTV

SEQ ID NO: 657318 - protein, 32 aa, Mycobacterium
EYGKTASQVLLRWNLQLGNAVVFRSAKEEHIA

SEQ ID NO: 657319 - protein, 32 aa, Mycobacterium
EYGKTPAQVLLRWNLQLGNAVVFRSANAEHIS

SEQ ID NO: 657320 - protein, 32 aa, Mycobacterium
EYGKTPAQVLLRWNLQLGNAVVFRSSQPEHIA

SEQ ID NO: 657321 - protein, 18 aa, Mycobacterium
EYGLELKGTFMPRPPSAG

SEQ ID NO: 657322 - protein, 18 aa, Mycobacterium
EYGPALIRARLAELGAAA

SEQ ID NO: 657323 - protein, 27 aa, Mycobacterium
EYGRTPAQVLVRWNLQLDNVVVSRSSK

SEQ ID NO: 657324 - protein, 24 aa, Mycobacterium
EYGSEGYAGLRFEDLSANRPTPEL

SEQ ID NO: 657325 - protein, 18 aa, Mycobacterium
EYGSRGWAMNTLFDGIEP

SEQ ID NO: 657326 - protein, 17 aa, Mycobacterium
EYHALGFDEFILSGYPH

SEQ ID NO: 657327 - protein, 25 aa, Mycobacterium
EYHHGDRLRCYVVGVSRGAREPLIT

SEQ ID NO: 657328 - protein, 19 aa, Mycobacterium
EYHRAHGPAAVQLLGVAQQ

SEQ ID NO: 657329 - protein, 26 aa, Mycobacterium
EYHRLWEPKIPLGRIGRPEELTGLYL

SEQ ID NO: 657330 - protein, 25 aa, Mycobacterium
EYHRLWEPKIPLGRLGRPDELTGLY

SEQ ID NO: 657331 - protein, 23 aa, Mycobacterium
EYIFRLAGPTGIYGGTLEVFRNM

SEQ ID NO: 657332 - protein, 23 aa, Mycobacterium
EYIPEPWRSSYFGTHDVGELIYY

SEQ ID NO: 657333 - protein, 18 aa, Mycobacterium
EYIRLIGIAVTRLGIDSV

SEQ ID NO: 657334 - protein, 21 aa, Mycobacterium
EYKELKALVRREGLHTVCEEA

SEQ ID NO: 657335 - protein, 19 aa, Mycobacterium
EYLDGLLPLLAGEPAAAPG

SEQ ID NO: 657336 - protein, 17 aa, Mycobacterium
EYLEMMKTAWGPVRVAI

SEQ ID NO: 657337 - protein, 22 aa, Mycobacterium
EYLEMWAQDAAAMYAYAGSSAT

SEQ ID NO: 657338 - protein, 25 aa, Mycobacterium
EYLLHHVPRPPALQVGTCTALPPAG

SEQ ID NO: 657339 - protein, 24 aa, Mycobacterium
EYLLLGLRFDRIESGYVDSFTGDP

SEQ ID NO: 657340 - protein, 18 aa, Mycobacterium
EYLLRSGVTGLRVAVQLH

SEQ ID NO: 657341 - protein, 24 aa, Mycobacterium
EYLPDAVDGWTWAVALVTDAAQDR

SEQ ID NO: 657342 - protein, 21 aa, Mycobacterium
EYLQGGSIYPAMQNFYLAARA

SEQ ID NO: 657343 - protein, 20 aa, Mycobacterium
EYLRLLPKWMDASEFGNGGR

SEQ ID NO: 657344 - protein, 20 aa, Mycobacterium
EYLRRIRLERAHRELMSADP

SEQ ID NO: 657345 - protein, 20 aa, Mycobacterium
EYLRRIRLHRAHQDLISGDR

SEQ ID NO: 657346 - protein, 22 aa, Mycobacterium
EYLRSREVLLVFDNCEHVLEAA

SEQ ID NO: 657347 - protein, 27 aa, Mycobacterium
EYLSGRWAQAYGFPLMPIDGILVGTAA

SEQ ID NO: 657348 - protein, 21 aa, Mycobacterium
EYLSGRWAQSYGFPLMPIDGI

SEQ ID NO: 657349 - protein, 29 aa, Mycobacterium
EYLSGRWARAYGFPLMPIDGILVGTAAMA

SEQ ID NO: 657350 - protein, 23 aa, Mycobacterium
EYLWAEADRHLWIADDRGAWHLR

SEQ ID NO: 657351 - protein, 17 aa, Mycobacterium
EYLYNFWRDAANPRGLW

SEQ ID NO: 657352 - protein, 21 aa, Mycobacterium
EYMRRVRLRRAHLELIAASAG

SEQ ID NO: 657353 - protein, 19 aa, Mycobacterium
EYMVPRANDLPDFVIRHHE

SEQ ID NO: 657354 - protein, 36 aa, Mycobacterium
EYNALKAWLISVGADGEWPLFLDVWVEHVVEDVATD

SEQ ID NO: 657355 - protein, 26 aa, Mycobacterium
EYNHSFKFVLLESLNADVLKAIYGAS

SEQ ID NO: 657356 - protein, 30 aa, Mycobacterium
EYNLDWKPVGGFPITLGWINAIRRGQAQLH

SEQ ID NO: 657357 - protein, 18 aa, Mycobacterium
EYNVRFTAVVPVPNDGKG

SEQ ID NO: 657358 - protein, 18 aa, Mycobacterium
EYNVRFTSFVTVPNDGVG

SEQ ID NO: 657359 - protein, 20 aa, Mycobacterium
EYPAKLIVSRTMSKAFAFAG

SEQ ID NO: 657360 - protein, 19 aa, Mycobacterium
EYPGRAMLTVERLAQNIND

SEQ ID NO: 657361 - protein, 21 aa, Mycobacterium
EYPGRAVITVERLAQNINDCG

SEQ ID NO: 657362 - protein, 17 aa, Mycobacterium
EYPIEVVQLVIFAIQIA

SEQ ID NO: 657363 - protein, 19 aa, Mycobacterium
EYPPVAISMLIAQVARSLC

SEQ ID NO: 657364 - protein, 24 aa, Mycobacterium
EYPTKLIVSRTMSKAFAFAGGRLG

SEQ ID NO: 657365 - protein, 21 aa, Mycobacterium
EYPTPVTFCEIFPPDNFPLYF

SEQ ID NO: 657366 - protein, 28 aa, Mycobacterium
EYQLLSARAAVFYEQFVQALSTASGAYA

SEQ ID NO: 657367 - protein, 19 aa, Mycobacterium
EYQQMLIRRGEEWVAKAVE

SEQ ID NO: 657368 - protein, 25 aa, Mycobacterium
EYQRRLRAANALDFDDLIGETVGIL

SEQ ID NO: 657369 - protein, 23 aa, Mycobacterium
EYQVSDLYAMKWKAALDRDDYTR

SEQ ID NO: 657370 - protein, 23 aa, Mycobacterium
EYRCGPYGVLIVRGDDGVLRAFQ

SEQ ID NO: 657371 - protein, 20 aa, Mycobacterium
EYRDPSALGGFASYTPALKA

SEQ ID NO: 657372 - protein, 17 aa, Mycobacterium
EYRFTRKGLELPGDESV

SEQ ID NO: 657373 - protein, 17 aa, Mycobacterium
EYRHTSRTMWLGHEDGM

SEQ ID NO: 657374 - protein, 19 aa, Mycobacterium
EYRIPLVPNARRFSAGHRI

SEQ ID NO: 657375 - protein, 19 aa, Mycobacterium
EYRKRYLAPAGRSDPLSEI

SEQ ID NO: 657376 - protein, 22 aa, Mycobacterium
EYRLAPEAPFPAALEDASEAWR

SEQ ID NO: 657377 - protein, 25 aa, Mycobacterium
EYRLRQRFWAGRVIHTIRLSQDGPR

SEQ ID NO: 657378 - protein, 19 aa, Mycobacterium
EYRPGRFTKTLAALQTLII

SEQ ID NO: 657379 - protein, 17 aa, Mycobacterium
EYRRCLDLLDDCDPTAR

SEQ ID NO: 657380 - protein, 25 aa, Mycobacterium
EYRRFPELPGTLVALKAVVDQLSSG

SEQ ID NO: 657381 - protein, 24 aa, Mycobacterium
EYRRYRPMVERTIAWLTRDNRQVR

SEQ ID NO: 657382 - protein, 23 aa, Mycobacterium
EYRVARAYVDGRIQTIFGGTTEI

SEQ ID NO: 657383 - protein, 25 aa, Mycobacterium
EYRYLPEWLASNGWETVERDVGELF

SEQ ID NO: 657384 - protein, 24 aa, Mycobacterium
EYSPEGWKRLTALRRELSALRARL

SEQ ID NO: 657385 - protein, 22 aa, Mycobacterium
EYSRKRLAQVAAETGRSAEIRM

SEQ ID NO: 657386 - protein, 18 aa, Mycobacterium
EYTFRAAVADTWRQGNVF

SEQ ID NO: 657387 - protein, 19 aa, Mycobacterium
EYVAAHAPYLVWLEQARGK

SEQ ID NO: 657388 - protein, 19 aa, Mycobacterium
EYVDAMAPMTGWAGGEEQL

SEQ ID NO: 657389 - protein, 19 aa, Mycobacterium
EYVDAMAPTTGWAGTEDEL

SEQ ID NO: 657390 - protein, 20 aa, Mycobacterium
EYVDVRFCDLPGVVQHFSIP

SEQ ID NO: 657391 - protein, 18 aa, Mycobacterium
EYVFIEMNPRIQVEHTVT

SEQ ID NO: 657392 - protein, 29 aa, Mycobacterium
EYVGFDIPNEFVVGYGLDYAERYRDLPFI

SEQ ID NO: 657393 - protein, 25 aa, Mycobacterium
EYVLKFDWLSMSGLTARIYIGHVDG

SEQ ID NO: 657394 - protein, 25 aa, Mycobacterium
EYVNARPAPLVTYWFGPDDHDFRSF

SEQ ID NO: 657395 - protein, 19 aa, Mycobacterium
EYVRTCIDASLQRLQTDVV

SEQ ID NO: 657396 - protein, 25 aa, Mycobacterium
EYVWPPDRTSVTWSLVSSSLLRSLN

SEQ ID NO: 657397 - protein, 25 aa, Mycobacterium
EYWDLRIPGQHGYSFADFATASGYA

SEQ ID NO: 657398 - protein, 19 aa, Mycobacterium
EYWHIPYFDHLIRVGHAFT

SEQ ID NO: 657399 - protein, 21 aa, Mycobacterium
EYWKGQAKAGADIKATVVNTA

SEQ ID NO: 657400 - protein, 21 aa, Mycobacterium
EYWNHYQLTFALYSVSDRAIP

SEQ ID NO: 657401 - protein, 21 aa, Mycobacterium
EYWPKLDAIYPDFVNYRTYTD

SEQ ID NO: 657402 - protein, 21 aa, Mycobacterium
EYWYRNIRQTVQFDQAVRSAC

SEQ ID NO: 657403 - protein, 19 aa, Mycobacterium
EYYHVPSLHSQQVPAEVRD

SEQ ID NO: 657404 - protein, 19 aa, Mycobacterium
EYYHVPSLHTQQVPPEVRD

SEQ ID NO: 657405 - protein, 19 aa, Mycobacterium
EYYPELIRMAGVPDPTVVW

SEQ ID NO: 657406 - protein, 19 aa, Mycobacterium
FAAAAGFPKPILHGLCTYG

SEQ ID NO: 657407 - protein, 19 aa, Mycobacterium
FAAAAGFPRPILHGLCSYG

SEQ ID NO: 657408 - protein, 18 aa, Mycobacterium
FAAACERAGVAFLGPSAR

SEQ ID NO: 657409 - protein, 26 aa, Mycobacterium
FAAACKKAGLWPFTHFNRTHVAPPLI

SEQ ID NO: 657410 - protein, 18 aa, Mycobacterium
FAAADAFHEAVTTAHTQH

SEQ ID NO: 657411 - protein, 25 aa, Mycobacterium
FAAADFELGMMWREVYKLRQPVLLI

SEQ ID NO: 657412 - protein, 26 aa, Mycobacterium
FAAAGAKFATAFPRRGLIGEYGITWI

SEQ ID NO: 657413 - protein, 23 aa, Mycobacterium
FAAAGIQLLAPRSRPCVATALTL

SEQ ID NO: 657414 - protein, 21 aa, Mycobacterium
FAAAGRYVLDRAIFDALRRIE

SEQ ID NO: 657415 - protein, 21 aa, Mycobacterium
FAAAGRYVLDRAIFDALRRVD

SEQ ID NO: 657416 - protein, 21 aa, Mycobacterium
FAAAGRYVLDRAIFDALRRVP

SEQ ID NO: 657417 - protein, 22 aa, Mycobacterium
FAAAHVPYLAWLLRASADSAGV

SEQ ID NO: 657418 - protein, 19 aa, Mycobacterium
FAAAIALFVEKGFEETTMD

SEQ ID NO: 657419 - protein, 20 aa, Mycobacterium
FAAAPTRELPCRDVRQYCSD

SEQ ID NO: 657420 - protein, 24 aa, Mycobacterium
FAAARPSTAVGIAISKSGLGLPQI

SEQ ID NO: 657421 - protein, 17 aa, Mycobacterium
FAAASAVIRFARENGLR

SEQ ID NO: 657422 - protein, 20 aa, Mycobacterium
FAAASLKPAFTQISEQFTKD

SEQ ID NO: 657423 - protein, 26 aa, Mycobacterium
FAACADHSALVFVHPWQVLGSDRLTK

SEQ ID NO: 657424 - protein, 19 aa, Mycobacterium
FAACGRILPDPALTDTDIS

SEQ ID NO: 657425 - protein, 22 aa, Mycobacterium
FAADHLRLVGLHSHIGSQIFDV

SEQ ID NO: 657426 - protein, 20 aa, Mycobacterium
FAADVLRRAYAAAGDIATDD

SEQ ID NO: 657427 - protein, 17 aa, Mycobacterium
FAADYGLCLARTDWNVP

SEQ ID NO: 657428 - protein, 22 aa, Mycobacterium
FAADYGLLLARTDWTVPKHEGL

SEQ ID NO: 657429 - protein, 17 aa, Mycobacterium
FAAEGAKVAVIGRDADR

SEQ ID NO: 657430 - protein, 17 aa, Mycobacterium
FAAEGASVMLAARTEAQ

SEQ ID NO: 657431 - protein, 24 aa, Mycobacterium
FAAELGRLAGGLGDQTADRHRSVL

SEQ ID NO: 657432 - protein, 18 aa, Mycobacterium
FAAELGRYNIRVNSLNPG

SEQ ID NO: 657433 - protein, 20 aa, Mycobacterium
FAAGCTRIEQGIKNGFSGNH

SEQ ID NO: 657434 - protein, 20 aa, Mycobacterium
FAAGCTRIEQGIRNGFSGNH

SEQ ID NO: 657435 - protein, 20 aa, Mycobacterium
FAAGDIEKVMSLFDDNIEWV

SEQ ID NO: 657436 - protein, 44 aa, Mycobacterium
FAAGDRVGVAWLRYTCGRCAYCLRGRENLCPESRYTGWDADGGY

SEQ ID NO: 657437 - protein, 17 aa, Mycobacterium
FAAGISICGMSDLNTFY

SEQ ID NO: 657438 - protein, 21 aa, Mycobacterium
FAAGLDIGWPAALAGSGGRRV

SEQ ID NO: 657439 - protein, 17 aa, Mycobacterium
FAAGNGMTTMFGHDVRD

SEQ ID NO: 657440 - protein, 26 aa, Mycobacterium
FAAGVLKPLPVRAFDIRCAADAYRFV

SEQ ID NO: 657441 - protein, 18 aa, Mycobacterium
FAAHAWDAMADLIAEDFC

SEQ ID NO: 657442 - protein, 25 aa, Mycobacterium
FAAIARKVLPRKASHLTIRTYNALL

SEQ ID NO: 657443 - protein, 18 aa, Mycobacterium
FAAIPLDISDFPTRHNYG

SEQ ID NO: 657444 - protein, 19 aa, Mycobacterium
FAAIVTHAGLWALDQFGAT

SEQ ID NO: 657445 - protein, 17 aa, Mycobacterium
FAAKLSGPWDVDALIAA

SEQ ID NO: 657446 - protein, 19 aa, Mycobacterium
FAALLRRLDVKKTDVDPSQ

SEQ ID NO: 657447 - protein, 18 aa, Mycobacterium
FAALLSNAKTIFWNGPMG

SEQ ID NO: 657448 - protein, 18 aa, Mycobacterium
FAALPQVRLCCSLTGPRN

SEQ ID NO: 657449 - protein, 19 aa, Mycobacterium
FAALQAIRADIVMVRMPGF

SEQ ID NO: 657450 - protein, 24 aa, Mycobacterium
FAALRHPCCGDLVYGADPKLAKKL

SEQ ID NO: 657451 - protein, 21 aa, Mycobacterium
FAALRLAPYRLRVMPGTVMTA

SEQ ID NO: 657452 - protein, 17 aa, Mycobacterium
FAALRWLTALPSVDPAR

SEQ ID NO: 657453 - protein, 17 aa, Mycobacterium
FAALVERYDCSIGAIRE

SEQ ID NO: 657454 - protein, 26 aa, Mycobacterium
FAANCRRASWKRAMRANVPLNEESLE

SEQ ID NO: 657455 - protein, 18 aa, Mycobacterium
FAAPFFAVVPYEWDRYVP

SEQ ID NO: 657456 - protein, 18 aa, Mycobacterium
FAAPGLGASPSWHAFAID

SEQ ID NO: 657457 - protein, 29 aa, Mycobacterium
FAAPIEWQQRLWPTEEFELARSRVPARLP

SEQ ID NO: 657458 - protein, 31 aa, Mycobacterium
FAAPIEWQQRLWPTEEFELARSRVPVRLPED

SEQ ID NO: 657459 - protein, 26 aa, Mycobacterium
FAAPLLGVLCSISWQRPVPTVRVHGE

SEQ ID NO: 657460 - protein, 17 aa, Mycobacterium
FAAPPVVDGRPFRVAAA

SEQ ID NO: 657461 - protein, 20 aa, Mycobacterium
FAAPRRRPEYLAARRVAPVT

SEQ ID NO: 657462 - protein, 20 aa, Mycobacterium
FAAPRYGFKPTMVVHPPAGG

SEQ ID NO: 657463 - protein, 30 aa, Mycobacterium
FAAPSVRRITERAGLTWGVVQYHFGDLGGL

SEQ ID NO: 657464 - protein, 18 aa, Mycobacterium
FAAQALAVMREWKFGEAD

SEQ ID NO: 657465 - protein, 17 aa, Mycobacterium
FAAQALAVMREWNFGAA

SEQ ID NO: 657466 - protein, 18 aa, Mycobacterium
FAAQALAVMREWNFGAAD

SEQ ID NO: 657467 - protein, 17 aa, Mycobacterium
FAAQALAVMREWNFGAV

SEQ ID NO: 657468 - protein, 18 aa, Mycobacterium
FAAQALAVMREWNFGDAD

SEQ ID NO: 657469 - protein, 18 aa, Mycobacterium
FAAQAVWTLSGERTNITF

SEQ ID NO: 657470 - protein, 17 aa, Mycobacterium
FAAQAWNYMFPLTDPPN

SEQ ID NO: 657471 - protein, 18 aa, Mycobacterium
FAAQFIMRRTPRAGVADS

SEQ ID NO: 657472 - protein, 24 aa, Mycobacterium
FAAQPGIFTFGWGPVLHQLAAGLG

SEQ ID NO: 657473 - protein, 18 aa, Mycobacterium
FAAQSHRALLVAPNLKIA

SEQ ID NO: 657474 - protein, 34 aa, Mycobacterium
FAAQVARAPEAIAITCGERSWSYGELDATANRLA

SEQ ID NO: 657475 - protein, 17 aa, Mycobacterium
FAAQVLAVLAEWKVDPL

SEQ ID NO: 657476 - protein, 19 aa, Mycobacterium
FAARARAWLADNMPSVDPM

SEQ ID NO: 657477 - protein, 22 aa, Mycobacterium
FAARARAWLAGNMPRIDPDNPP

SEQ ID NO: 657478 - protein, 22 aa, Mycobacterium
FAARARGGVGLITLGATGIDHH

SEQ ID NO: 657479 - protein, 17 aa, Mycobacterium
FAARLSGPCDVDALIAA

SEQ ID NO: 657480 - protein, 18 aa, Mycobacterium
FAARRLLDDAVRRAGPRP

SEQ ID NO: 657481 - protein, 17 aa, Mycobacterium
FAARRPRTGPAELLYLG

SEQ ID NO: 657482 - protein, 20 aa, Mycobacterium
FAARSLRTIAHMTRLRGADT

SEQ ID NO: 657483 - protein, 17 aa, Mycobacterium
FAASAPTIGAPRWDTAI

SEQ ID NO: 657484 - protein, 24 aa, Mycobacterium
FAASFRLTGRLFRRRPQESEILLA

SEQ ID NO: 657485 - protein, 20 aa, Mycobacterium
FAASHLRDGAVLLDVSRLDH

SEQ ID NO: 657486 - protein, 22 aa, Mycobacterium
FAASLYRRGTPYIRIPTTLIGL

SEQ ID NO: 657487 - protein, 20 aa, Mycobacterium
FAASMACTIITRRKFDPEAT

SEQ ID NO: 657488 - protein, 20 aa, Mycobacterium
FAASSRFGGIVSPPVMLQTW

SEQ ID NO: 657489 - protein, 17 aa, Mycobacterium
FAASSWLGSLRSRGGTV

SEQ ID NO: 657490 - protein, 17 aa, Mycobacterium
FAASVFTTRGCPYRCTF

SEQ ID NO: 657491 - protein, 26 aa, Mycobacterium
FAASWQRLRTAPALLPLGHGDERRQY

SEQ ID NO: 657492 - protein, 17 aa, Mycobacterium
FAATEVVPRLAGSSAEI

SEQ ID NO: 657493 - protein, 18 aa, Mycobacterium
FAATEVVPRLAGTEAEID

SEQ ID NO: 657494 - protein, 19 aa, Mycobacterium
FAATEVVPRLAGTECEIDQ

SEQ ID NO: 657495 - protein, 18 aa, Mycobacterium
FAATRIKPNLDFPTGPAY

SEQ ID NO: 657496 - protein, 20 aa, Mycobacterium
FAAVAPRLVAYGADSDAVDD

SEQ ID NO: 657497 - protein, 20 aa, Mycobacterium
FAAVLRWVEHDPPQFDLKDE

SEQ ID NO: 657498 - protein, 18 aa, Mycobacterium
FAAVLSNAKTIFWNGPMG

SEQ ID NO: 657499 - protein, 17 aa, Mycobacterium
FAAVNGRLIEWEKGDFV

SEQ ID NO: 657500 - protein, 18 aa, Mycobacterium
FAAVNTVFRDSRAFTSKT

SEQ ID NO: 657501 - protein, 25 aa, Mycobacterium
FAAVPAPLLRWGINQFDLDQRPTQV

SEQ ID NO: 657502 - protein, 31 aa, Mycobacterium
FAAVRQFRASVCVLGPLVGRCKKARVALPGG

SEQ ID NO: 657503 - protein, 32 aa, Mycobacterium
FAAVRQFRASVCVLGPLVGRCKKARVALPGGD

SEQ ID NO: 657504 - protein, 36 aa, Mycobacterium
FAAVRQFRASVCVLGPLVGRCRRAKVALPGGDAIGS

SEQ ID NO: 657505 - protein, 19 aa, Mycobacterium
FAAVTARSAGAAGSAAAVG

SEQ ID NO: 657506 - protein, 19 aa, Mycobacterium
FAAVTGIPCAPVRDIIGAD

SEQ ID NO: 657507 - protein, 25 aa, Mycobacterium
FAAVVRRLAADFPQSRSDWVITNSF

SEQ ID NO: 657508 - protein, 17 aa, Mycobacterium
FAAWRNDPSFILNLSPF

SEQ ID NO: 657509 - protein, 17 aa, Mycobacterium
FACGGGRPADRDVGFFI

SEQ ID NO: 657510 - protein, 21 aa, Mycobacterium
FACGGGRPAGRQVGYFIEPTV

SEQ ID NO: 657511 - protein, 21 aa, Mycobacterium
FACGPHHRMLNPGGWTTRKNT

SEQ ID NO: 657512 - protein, 19 aa, Mycobacterium
FACRRRYFTQPDFQSIAVT

SEQ ID NO: 657513 - protein, 22 aa, Mycobacterium
FADAAARLGDRLSIHNQPNLGG

SEQ ID NO: 657514 - protein, 17 aa, Mycobacterium
FADAAGYGDCGRPPTVG

SEQ ID NO: 657515 - protein, 19 aa, Mycobacterium
FADACTRVAGGGSIVDPEL

SEQ ID NO: 657516 - protein, 25 aa, Mycobacterium
FADADLDSAVSWSIRAIFSNAGQVC

SEQ ID NO: 657517 - protein, 17 aa, Mycobacterium
FADAERGPRVSRAAFER

SEQ ID NO: 657518 - protein, 17 aa, Mycobacterium
FADAVAWVARSLPTRPT

SEQ ID NO: 657519 - protein, 21 aa, Mycobacterium
FADDARVLLVFGGSQGAQSLN

SEQ ID NO: 657520 - protein, 25 aa, Mycobacterium
FADDGIGVNCLWPETYIATAAVTNM

SEQ ID NO: 657521 - protein, 17 aa, Mycobacterium
FADDLLFGLSEESIDSI

SEQ ID NO: 657522 - protein, 26 aa, Mycobacterium
FADDRWEWSDEVAMLHGYEPGTITPT

SEQ ID NO: 657523 - protein, 23 aa, Mycobacterium
FADEARLVRWWGPNGFTSTFQSF

SEQ ID NO: 657524 - protein, 21 aa, Mycobacterium
FADEPVHVVATFPAGVPDGLP

SEQ ID NO: 657525 - protein, 19 aa, Mycobacterium
FADFLRVRGPLLPDDERAL

SEQ ID NO: 657526 - protein, 35 aa, Mycobacterium
FADFPRYPINFLADLNAFMGIQFVHTDYSYLDPNN

SEQ ID NO: 657527 - protein, 26 aa, Mycobacterium
FADFPRYPINLLADINAVMGIPFVHA

SEQ ID NO: 657528 - protein, 33 aa, Mycobacterium
FADFPRYPLNFIADLNAVMGIPFVHVKYLDLTA

SEQ ID NO: 657529 - protein, 33 aa, Mycobacterium
FADFPRYPLNFISDLNAVMGIVYVHPTYLDLTQ

SEQ ID NO: 657530 - protein, 17 aa, Mycobacterium
FADGGVVYLEVRTDNEA

SEQ ID NO: 657531 - protein, 21 aa, Mycobacterium
FADGLTYLGFVPFAMTSTKIG

SEQ ID NO: 657532 - protein, 17 aa, Mycobacterium
FADHARLSAGEALPMDT

SEQ ID NO: 657533 - protein, 19 aa, Mycobacterium
FADHNGVDWKGTLTGLAGY

SEQ ID NO: 657534 - protein, 17 aa, Mycobacterium
FADIVGFTGGDRAATGD

SEQ ID NO: 657535 - protein, 22 aa, Mycobacterium
FADKAELLASVAEQGFRELHAE

SEQ ID NO: 657536 - protein, 18 aa, Mycobacterium
FADLAEVMAGVFAARRSS

SEQ ID NO: 657537 - protein, 20 aa, Mycobacterium
FADLDFNPNPGLPVSRNVYT

SEQ ID NO: 657538 - protein, 19 aa, Mycobacterium
FADLLPYFMRSETATHGDP

SEQ ID NO: 657539 - protein, 17 aa, Mycobacterium
FADLPAPHARLVIEAWR

SEQ ID NO: 657540 - protein, 17 aa, Mycobacterium
FADLRKFDYPLLSDTDG

SEQ ID NO: 657541 - protein, 17 aa, Mycobacterium
FADLSGFTVLTRALTPA

SEQ ID NO: 657542 - protein, 18 aa, Mycobacterium
FADLSSFTALTQMLTPAQ

SEQ ID NO: 657543 - protein, 17 aa, Mycobacterium
FADLVLREARLHLDIAD

SEQ ID NO: 657544 - protein, 18 aa, Mycobacterium
FADMKMWFEAARATTTGA

SEQ ID NO: 657545 - protein, 27 aa, Mycobacterium
FADNLVGALGCRYSMFMYPLAPEHDHR

SEQ ID NO: 657546 - protein, 24 aa, Mycobacterium
FADNPHVDACFIVRSQSVHRIQES

SEQ ID NO: 657547 - protein, 24 aa, Mycobacterium
FADPGNPLAILVPFSAAVMDVAAI

SEQ ID NO: 657548 - protein, 17 aa, Mycobacterium
FADPGWDIEALTTTYYR

SEQ ID NO: 657549 - protein, 24 aa, Mycobacterium
FADPQRFHPVAGFGQAAAALEAYS

SEQ ID NO: 657550 - protein, 29 aa, Mycobacterium
FADPRGRIRLAQFMLRSDLEPDLEVVIDA

SEQ ID NO: 657551 - protein, 24 aa, Mycobacterium
FADPVEAFHVLWFSGEAHVLRGYG

SEQ ID NO: 657552 - protein, 18 aa, Mycobacterium
FADPVSYVSLWTSDAGES

SEQ ID NO: 657553 - protein, 25 aa, Mycobacterium
FADQRPEVMAAFLRAMRSTTDAIVA

SEQ ID NO: 657554 - protein, 18 aa, Mycobacterium
FADREGREPLVLGAVKTN

SEQ ID NO: 657555 - protein, 20 aa, Mycobacterium
FADRGYRQLQTWWGATAAAI

SEQ ID NO: 657556 - protein, 24 aa, Mycobacterium
FADRIRGLHVYGGKVVQAPGVLVF

SEQ ID NO: 657557 - protein, 24 aa, Mycobacterium
FADRKPVCYRMHPDNMAVLTALRP

SEQ ID NO: 657558 - protein, 17 aa, Mycobacterium
FADRLAREFPAVEVDRD

SEQ ID NO: 657559 - protein, 17 aa, Mycobacterium
FADSLKEQGSSREEFDA

SEQ ID NO: 657560 - protein, 19 aa, Mycobacterium
FADSPCRDFFLWCSSPQSP

SEQ ID NO: 657561 - protein, 17 aa, Mycobacterium
FADSVAWVARSLPSRPT

SEQ ID NO: 657562 - protein, 18 aa, Mycobacterium
FADSVLMMADCFDLTLDE

SEQ ID NO: 657563 - protein, 25 aa, Mycobacterium
FADTHARVGILPTWGLTTLLPLSVG

SEQ ID NO: 657564 - protein, 26 aa, Mycobacterium
FADTHARVGLLPTWGLSVRLPQKVGV

SEQ ID NO: 657565 - protein, 26 aa, Mycobacterium
FADTHARVGLMPTWGLSVRLPQKVGV

SEQ ID NO: 657566 - protein, 25 aa, Mycobacterium
FADTLRFWLDRGIDGFRLDVAHGMA

SEQ ID NO: 657567 - protein, 18 aa, Mycobacterium
FADTPVFNVNFMPLNHLG

SEQ ID NO: 657568 - protein, 17 aa, Mycobacterium
FADTPVLNVNFMPLNHL

SEQ ID NO: 657569 - protein, 18 aa, Mycobacterium
FADTQGYAYSRRDVTGRQ

SEQ ID NO: 657570 - protein, 19 aa, Mycobacterium
FADVAASLSREFRGADRLY

SEQ ID NO: 657571 - protein, 25 aa, Mycobacterium
FADVDGGTIFAYWVSEPSAYGVVEF

SEQ ID NO: 657572 - protein, 18 aa, Mycobacterium
FADVLILNKVDLVNERTL

SEQ ID NO: 657573 - protein, 25 aa, Mycobacterium
FADVLPRTGVEVMISIDDGSDAPEL

SEQ ID NO: 657574 - protein, 21 aa, Mycobacterium
FADVRRELAVRAVARAATVTD

SEQ ID NO: 657575 - protein, 21 aa, Mycobacterium
FADWADGRAVLGGRRPTEADL

SEQ ID NO: 657576 - protein, 20 aa, Mycobacterium
FADYAVAYVERVWRGIAEHQ

SEQ ID NO: 657577 - protein, 17 aa, Mycobacterium
FAEAAARAAGHGGTVWV

SEQ ID NO: 657578 - protein, 22 aa, Mycobacterium
FAEAFRLLRPGGVFAGSDGVPS

SEQ ID NO: 657579 - protein, 25 aa, Mycobacterium
FAEAGFIDLFIAYPLWVTAQKARRL

SEQ ID NO: 657580 - protein, 18 aa, Mycobacterium
FAEARIPLGNALETTAVL

SEQ ID NO: 657581 - protein, 21 aa, Mycobacterium
FAEAVAEYRARVHRVAASDIA

SEQ ID NO: 657582 - protein, 21 aa, Mycobacterium
FAEAVARAATHPTGFVDEGAA

SEQ ID NO: 657583 - protein, 17 aa, Mycobacterium
FAEDVERILSETPEYKQ

SEQ ID NO: 657584 - protein, 18 aa, Mycobacterium
FAEELGLPVPAGPRVDLG

SEQ ID NO: 657585 - protein, 24 aa, Mycobacterium
FAEELRKVWYRSWVFVGHESEVSQ

SEQ ID NO: 657586 - protein, 17 aa, Mycobacterium
FAEFDWDAHPLGPPQEW

SEQ ID NO: 657587 - protein, 19 aa, Mycobacterium
FAEGEALLTWIPLDPANIA

SEQ ID NO: 657588 - protein, 17 aa, Mycobacterium
FAEGMADNRFALIGKVH

SEQ ID NO: 657589 - protein, 22 aa, Mycobacterium
FAEHGIDALILVGGDGSMAIGQ

SEQ ID NO: 657590 - protein, 22 aa, Mycobacterium
FAEHGWAGTAIRAVARAADVDP

SEQ ID NO: 657591 - protein, 17 aa, Mycobacterium
FAEHLYATIGFDLRGRR

SEQ ID NO: 657592 - protein, 19 aa, Mycobacterium
FAEILPHAQLVNLYGPTET

SEQ ID NO: 657593 - protein, 23 aa, Mycobacterium
FAEKRITPYALEWDDKHHFPTDV

SEQ ID NO: 657594 - protein, 23 aa, Mycobacterium
FAEKYGISMPIAREVDGVVNHGS

SEQ ID NO: 657595 - protein, 18 aa, Mycobacterium
FAELEPDFQRAYKELAKQ

SEQ ID NO: 657596 - protein, 19 aa, Mycobacterium
FAELEPDFQRAYRELAKQV

SEQ ID NO: 657597 - protein, 44 aa, Mycobacterium
FAELGLAVVEEFQEWPAVVGRPRRAGVSSFGFGGTNAHVIVEQA

SEQ ID NO: 657598 - protein, 22 aa, Mycobacterium
FAELLAIVSAMVCNRIDKVTVN

SEQ ID NO: 657599 - protein, 22 aa, Mycobacterium
FAELLRACGRIDGLERVRFTSP

SEQ ID NO: 657600 - protein, 33 aa, Mycobacterium
FAELLRACGRIPGLERVRFTSPHPAEFTDDVIE

SEQ ID NO: 657601 - protein, 24 aa, Mycobacterium
FAELRAERPVSWHPPVEDALMPDP

SEQ ID NO: 657602 - protein, 17 aa, Mycobacterium
FAELRSERNALAERRQE

SEQ ID NO: 657603 - protein, 17 aa, Mycobacterium
FAEMFFAYLDLISAAGV

SEQ ID NO: 657604 - protein, 25 aa, Mycobacterium
FAENLKWHMHIGAIALCDPSDVPDF

SEQ ID NO: 657605 - protein, 18 aa, Mycobacterium
FAEPAVWLRLQQVDAGHL

SEQ ID NO: 657606 - protein, 18 aa, Mycobacterium
FAEPFPVAGDDLGHAAQR

SEQ ID NO: 657607 - protein, 27 aa, Mycobacterium
FAEPGLGASPVWHVFAIDQTGIVFGES

SEQ ID NO: 657608 - protein, 21 aa, Mycobacterium
FAEPWFDPRGLFLAHDVQTAK

SEQ ID NO: 657609 - protein, 21 aa, Mycobacterium
FAEQFLVQCGHAFQQATTFHR

SEQ ID NO: 657610 - protein, 18 aa, Mycobacterium
FAEQGWYFAGDGARYDSD

SEQ ID NO: 657611 - protein, 18 aa, Mycobacterium
FAEQYAELRQHKGVTLDR

SEQ ID NO: 657612 - protein, 22 aa, Mycobacterium
FAERCPPESVAGVYDAQPQDFS

SEQ ID NO: 657613 - protein, 23 aa, Mycobacterium
FAERCPPESVVAAYDSPPADFAK

SEQ ID NO: 657614 - protein, 20 aa, Mycobacterium
FAERENRIIIAYSPLAQGLL

SEQ ID NO: 657615 - protein, 22 aa, Mycobacterium
FAERENRLVIAYSPLAQGLLGG

SEQ ID NO: 657616 - protein, 19 aa, Mycobacterium
FAERFRCLILEFPGFGVSD

SEQ ID NO: 657617 - protein, 17 aa, Mycobacterium
FAERGFAGTSLQDIADA

SEQ ID NO: 657618 - protein, 24 aa, Mycobacterium
FAERGFRRARTWLAATAAAIEACE

SEQ ID NO: 657619 - protein, 24 aa, Mycobacterium
FAERGFRRARTWLGATAAAIEACE

SEQ ID NO: 657620 - protein, 24 aa, Mycobacterium
FAERGFRRARTWLGATASAIEACE

SEQ ID NO: 657621 - protein, 17 aa, Mycobacterium
FAERIGVSAPAVSRALK

SEQ ID NO: 657622 - protein, 19 aa, Mycobacterium
FAERISRANGADWEDLDSR

SEQ ID NO: 657623 - protein, 17 aa, Mycobacterium
FAERRPRTGPAELLYLG

SEQ ID NO: 657624 - protein, 25 aa, Mycobacterium
FAESAEVACGYYVFEAENLDEALAL

SEQ ID NO: 657625 - protein, 21 aa, Mycobacterium
FAESCLHAGSAKCTYGTGAFL

SEQ ID NO: 657626 - protein, 17 aa, Mycobacterium
FAESGLMARREASINDV

SEQ ID NO: 657627 - protein, 17 aa, Mycobacterium
FAESLWLELRDHGVDVL

SEQ ID NO: 657628 - protein, 19 aa, Mycobacterium
FAESPDRAPSLGVITFNAQ

SEQ ID NO: 657629 - protein, 20 aa, Mycobacterium
FAESRIRPSTIAAEDLLHDI

SEQ ID NO: 657630 - protein, 17 aa, Mycobacterium
FAESVFDSVMYVSFQEL

SEQ ID NO: 657631 - protein, 17 aa, Mycobacterium
FAETAPEDWEPFLRVNL

SEQ ID NO: 657632 - protein, 22 aa, Mycobacterium
FAETCPQYLYLSLEEQLGAGGF

SEQ ID NO: 657633 - protein, 19 aa, Mycobacterium
FAETTTLPMLPRTWTDADP

SEQ ID NO: 657634 - protein, 27 aa, Mycobacterium
FAEVLWLARRARQCWEGVQIALGNVIA

SEQ ID NO: 657635 - protein, 18 aa, Mycobacterium
FAEVPPLPGYPTEGLLQW

SEQ ID NO: 657636 - protein, 22 aa, Mycobacterium
FAFGHGLSYTSFEYRDLAVTGG

SEQ ID NO: 657637 - protein, 18 aa, Mycobacterium
FAFIEGLATRIARPPHNW

SEQ ID NO: 657638 - protein, 36 aa, Mycobacterium
FAFNGWKALSWADANVWRRVVPKGWFYNVMVTGVKP

SEQ ID NO: 657639 - protein, 20 aa, Mycobacterium
FAFSGHKVYGPTGIGVLYGR

SEQ ID NO: 657640 - protein, 25 aa, Mycobacterium
FAFTGWKTLSWVDANVWRHLAPKGW

SEQ ID NO: 657641 - protein, 32 aa, Mycobacterium
FAGACRAAGVGFSFGYPVDWRVQDADTGPPNV

SEQ ID NO: 657642 - protein, 25 aa, Mycobacterium
FAGADFELGMMWRDVYKLRQRVLLI

SEQ ID NO: 657643 - protein, 36 aa, Mycobacterium
FAGADFELGMMWREVYKLRQPVLLIWGREDRVNPLD

SEQ ID NO: 657644 - protein, 18 aa, Mycobacterium
FAGADWPVEYGGRDDYHP

SEQ ID NO: 657645 - protein, 18 aa, Mycobacterium
FAGAELRAAAEAAAERAP

SEQ ID NO: 657646 - protein, 18 aa, Mycobacterium
FAGAERWADIALRTGNSF

SEQ ID NO: 657647 - protein, 18 aa, Mycobacterium
FAGAFLLPYKQFHHAAES

SEQ ID NO: 657648 - protein, 17 aa, Mycobacterium
FAGAGAPARRMYRSGDL

SEQ ID NO: 657649 - protein, 17 aa, Mycobacterium
FAGANLIPLRGAPADLS

SEQ ID NO: 657650 - protein, 17 aa, Mycobacterium
FAGANLIPLRGAPEDMD

SEQ ID NO: 657651 - protein, 24 aa, Mycobacterium
FAGCEGDSLLMLLDANGIECSTGS

SEQ ID NO: 657652 - protein, 23 aa, Mycobacterium
FAGDGGLWLAVMSPAALARIEAI

SEQ ID NO: 657653 - protein, 21 aa, Mycobacterium
FAGEPDFFWSPVNTLEDVVAD

SEQ ID NO: 657654 - protein, 20 aa, Mycobacterium
FAGEWYRFERPDADAEQIFA

SEQ ID NO: 657655 - protein, 18 aa, Mycobacterium
FAGEYEFAVARLNGKAYA

SEQ ID NO: 657656 - protein, 18 aa, Mycobacterium
FAGFAVVKPQVAFFEAYG

SEQ ID NO: 657657 - protein, 17 aa, Mycobacterium
FAGFFAVAIRFTGLLGG

SEQ ID NO: 657658 - protein, 17 aa, Mycobacterium
FAGGCYVHVQKYVHRMD

SEQ ID NO: 657659 - protein, 20 aa, Mycobacterium
FAGGDLKGMINLGPENAGEA

SEQ ID NO: 657660 - protein, 19 aa, Mycobacterium
FAGGEFAESFTLADVRVTG

SEQ ID NO: 657661 - protein, 17 aa, Mycobacterium
FAGGGAYGAKDDPRTKE

SEQ ID NO: 657662 - protein, 17 aa, Mycobacterium
FAGGPWSNYVMHSIATM

SEQ ID NO: 657663 - protein, 18 aa, Mycobacterium
FAGGPWSNYVMHSIATMA

SEQ ID NO: 657664 - protein, 28 aa, Mycobacterium
FAGHPIVGVSWWLRERGMPIKTLHVPAG

SEQ ID NO: 657665 - protein, 24 aa, Mycobacterium
FAGHPTVGAAWYLRDIGRPIKTLQ

SEQ ID NO: 657666 - protein, 17 aa, Mycobacterium
FAGIGTDEVHLIPTSSD

SEQ ID NO: 657667 - protein, 19 aa, Mycobacterium
FAGINWRPSGLGSPIINGS

SEQ ID NO: 657668 - protein, 18 aa, Mycobacterium
FAGIRSMFDTRLMRLEDE

SEQ ID NO: 657669 - protein, 22 aa, Mycobacterium
FAGKHAELMFLSAYSLETIAAQ

SEQ ID NO: 657670 - protein, 19 aa, Mycobacterium
FAGKQGGCLTAVYNSANEE

SEQ ID NO: 657671 - protein, 18 aa, Mycobacterium
FAGKVIKWMTTVNVWLYQ

SEQ ID NO: 657672 - protein, 17 aa, Mycobacterium
FAGKVNRLAIMVRGNLA

SEQ ID NO: 657673 - protein, 20 aa, Mycobacterium
FAGKVSPVHFFWGAMDIACT

SEQ ID NO: 657674 - protein, 17 aa, Mycobacterium
FAGLGQRGLVSRMHEQL

SEQ ID NO: 657675 - protein, 20 aa, Mycobacterium
FAGLNSGVGNFGIGNSGTNN

SEQ ID NO: 657676 - protein, 18 aa, Mycobacterium
FAGLPAYQQGLGRKVRFM

SEQ ID NO: 657677 - protein, 18 aa, Mycobacterium
FAGLPAYQQRLGRKVRFM

SEQ ID NO: 657678 - protein, 21 aa, Mycobacterium
FAGLSLPSLGVEFFGATPADT

SEQ ID NO: 657679 - protein, 17 aa, Mycobacterium
FAGLTLMVPATAWETRP

SEQ ID NO: 657680 - protein, 21 aa, Mycobacterium
FAGLVSPSLGKTFWGATPDNY

SEQ ID NO: 657681 - protein, 18 aa, Mycobacterium
FAGMISVAVENPGSSGGS

SEQ ID NO: 657682 - protein, 17 aa, Mycobacterium
FAGMISVTIESGDGAPT

SEQ ID NO: 657683 - protein, 24 aa, Mycobacterium
FAGMQPRWITPRWDAERHFSHPPS

SEQ ID NO: 657684 - protein, 18 aa, Mycobacterium
FAGPLAMAAAAAAGVAWG

SEQ ID NO: 657685 - protein, 18 aa, Mycobacterium
FAGPLLDGFDNLYVGQPG

SEQ ID NO: 657686 - protein, 21 aa, Mycobacterium
FAGPRFLMRIAELEMHPLDTM

SEQ ID NO: 657687 - protein, 19 aa, Mycobacterium
FAGPVGDPGWFGPGSAVWH

SEQ ID NO: 657688 - protein, 26 aa, Mycobacterium
FAGPVLRPSTTLVRRSRVFAEARADS

SEQ ID NO: 657689 - protein, 17 aa, Mycobacterium
FAGQRVAAVVADTPAIA

SEQ ID NO: 657690 - protein, 19 aa, Mycobacterium
FAGQTWWAAIEDIGRLRDG

SEQ ID NO: 657691 - protein, 21 aa, Mycobacterium
FAGQVFPAAGIRKVDLTATAG

SEQ ID NO: 657692 - protein, 18 aa, Mycobacterium
FAGRAVVLEAARALADAA

SEQ ID NO: 657693 - protein, 19 aa, Mycobacterium
FAGRIGAAFDDLVAAGNHE

SEQ ID NO: 657694 - protein, 22 aa, Mycobacterium
FAGRLPDGWFSGAPEVIVDREE

SEQ ID NO: 657695 - protein, 20 aa, Mycobacterium
FAGRLPRKFADRAPKVVDTD

SEQ ID NO: 657696 - protein, 19 aa, Mycobacterium
FAGRLPRKFADRAPRVVET

SEQ ID NO: 657697 - protein, 17 aa, Mycobacterium
FAGRPALMAALEELAVA

SEQ ID NO: 657698 - protein, 20 aa, Mycobacterium
FAGRPMKDWVTDLAGAAQIV

SEQ ID NO: 657699 - protein, 19 aa, Mycobacterium
FAGRSWWVAIEDIGRLRDG

SEQ ID NO: 657700 - protein, 20 aa, Mycobacterium
FAGRWVPGLLALYTELNCER

SEQ ID NO: 657701 - protein, 24 aa, Mycobacterium
FAGSETFAGPIIHPQYWPEELDYS

SEQ ID NO: 657702 - protein, 19 aa, Mycobacterium
FAGSLLRDHGLLLPIEPDT

SEQ ID NO: 657703 - protein, 19 aa, Mycobacterium
FAGSLWSRTVDRVAQEYPD

SEQ ID NO: 657704 - protein, 25 aa, Mycobacterium
FAGTDFELGMMWREVHRLRQPVLLI

SEQ ID NO: 657705 - protein, 25 aa, Mycobacterium
FAGTDLRPYFTYSRDKLSFGVSASR

SEQ ID NO: 657706 - protein, 17 aa, Mycobacterium
FAGTILKSASWDQRVDL

SEQ ID NO: 657707 - protein, 19 aa, Mycobacterium
FAGTVRAPLGLHKRHTQEL

SEQ ID NO: 657708 - protein, 17 aa, Mycobacterium
FAGVAKYPARVKCALLG

SEQ ID NO: 657709 - protein, 25 aa, Mycobacterium
FAGYEPRPEYIAARDFTPLTPKSPS

SEQ ID NO: 657710 - protein, 25 aa, Mycobacterium
FAHDLSSLRLLGSVGEPINPEAWRW

SEQ ID NO: 657711 - protein, 32 aa, Mycobacterium
FAHGLLRDHLMAGLPALRRQRLHAQVAEVLAG

SEQ ID NO: 657712 - protein, 17 aa, Mycobacterium
FAHGRPTAATVRHFLSH

SEQ ID NO: 657713 - protein, 25 aa, Mycobacterium
FAHIAARAGSHPIILDHGPRPLKGF

SEQ ID NO: 657714 - protein, 26 aa, Mycobacterium
FAHIAARAGSHPIILDHGPRPLKGFD

SEQ ID NO: 657715 - protein, 17 aa, Mycobacterium
FAHKLRQKRLMTLIHLW

SEQ ID NO: 657716 - protein, 19 aa, Mycobacterium
FAHRPEWAAETAVGKTAVS

SEQ ID NO: 657717 - protein, 20 aa, Mycobacterium
FAHVTFFYYLLIRVVEQLHF

SEQ ID NO: 657718 - protein, 20 aa, Mycobacterium
FAIAALRAEPVDRYGVGTSV

SEQ ID NO: 657719 - protein, 21 aa, Mycobacterium
FAIAHVRGGGEMGRLWYEHGK

SEQ ID NO: 657720 - protein, 19 aa, Mycobacterium
FAIAKEINIQFVLAYGPDE

SEQ ID NO: 657721 - protein, 18 aa, Mycobacterium
FAIAQRFIAEGARVVLGD

SEQ ID NO: 657722 - protein, 19 aa, Mycobacterium
FAIAQRFVDEGARVVLGDV

SEQ ID NO: 657723 - protein, 22 aa, Mycobacterium
FAIAQTRLGGGRIHHAMRTIGL

SEQ ID NO: 657724 - protein, 23 aa, Mycobacterium
FAIAQTRLGGGRVHHAMRTVAQV

SEQ ID NO: 657725 - protein, 19 aa, Mycobacterium
FAICCATILDMGSEEQKRA

SEQ ID NO: 657726 - protein, 21 aa, Mycobacterium
FAIDVEWTLLASLARLGRPDG

SEQ ID NO: 657727 - protein, 22 aa, Mycobacterium
FAIDYPHMYRLMFGVTSAHGVN

SEQ ID NO: 657728 - protein, 20 aa, Mycobacterium
FAIEVEWMLLHALSRLGRPD

SEQ ID NO: 657729 - protein, 17 aa, Mycobacterium
FAIKLAGLGDQWFEGPP

SEQ ID NO: 657730 - protein, 24 aa, Mycobacterium
FAIKQPRMSKLVWKITELEPGTSW

SEQ ID NO: 657731 - protein, 18 aa, Mycobacterium
FAIRAEDGIALDAQEGSG

SEQ ID NO: 657732 - protein, 17 aa, Mycobacterium
FAITQMAGILVGRYIMA

SEQ ID NO: 657733 - protein, 18 aa, Mycobacterium
FAKAAGFDRPILHGLCTY

SEQ ID NO: 657734 - protein, 18 aa, Mycobacterium
FAKAAYRINRVEDIGLGV

SEQ ID NO: 657735 - protein, 18 aa, Mycobacterium
FAKAAYRINRVEDVGLGI

SEQ ID NO: 657736 - protein, 18 aa, Mycobacterium
FAKALARAAGGVAVDEQT

SEQ ID NO: 657737 - protein, 23 aa, Mycobacterium
FAKARAAQRGWAHRPVAERAAIM

SEQ ID NO: 657738 - protein, 21 aa, Mycobacterium
FAKAWYKLLHRDMGPVSRYLG

SEQ ID NO: 657739 - protein, 18 aa, Mycobacterium
FAKGNADGWPDTKNPLYA

SEQ ID NO: 657740 - protein, 17 aa, Mycobacterium
FAKGSADSWPDTKNSLF

SEQ ID NO: 657741 - protein, 17 aa, Mycobacterium
FAKIPIGLGPDIVCVVP

SEQ ID NO: 657742 - protein, 23 aa, Mycobacterium
FAKKAVSCLLNPRAGHETTLVLS

SEQ ID NO: 657743 - protein, 18 aa, Mycobacterium
FAKKGLRSSKRYRVPPMP

SEQ ID NO: 657744 - protein, 25 aa, Mycobacterium
FAKLNPRVPRIWNVVRLPPQMALAS

SEQ ID NO: 657745 - protein, 24 aa, Mycobacterium
FAKLREPLEVPGLLDVQTDSFEWL

SEQ ID NO: 657746 - protein, 24 aa, Mycobacterium
FAKLREPLEVPGLLDVQTESFEWL

SEQ ID NO: 657747 - protein, 17 aa, Mycobacterium
FAKMREIADEVGATLMV

SEQ ID NO: 657748 - protein, 18 aa, Mycobacterium
FAKMREIADEVGATLMVD

SEQ ID NO: 657749 - protein, 18 aa, Mycobacterium
FAKNFLPLLASTREVIET

SEQ ID NO: 657750 - protein, 21 aa, Mycobacterium
FAKRPAFNFKHLVTEDDLPCV

SEQ ID NO: 657751 - protein, 18 aa, Mycobacterium
FAKRPALVRPSLNIAEWI

SEQ ID NO: 657752 - protein, 29 aa, Mycobacterium
FAKRPGLVRPSLNIAEWILPSVLAAAPKD

SEQ ID NO: 657753 - protein, 17 aa, Mycobacterium
FAKSVRTLAEMNCKLLL

SEQ ID NO: 657754 - protein, 18 aa, Mycobacterium
FAKTELMALIAYAELHPE

SEQ ID NO: 657755 - protein, 25 aa, Mycobacterium
FAKTRLAVAVGDRIAADIAAAALLD

SEQ ID NO: 657756 - protein, 18 aa, Mycobacterium
FAKYYYPFITRHGADDVA

SEQ ID NO: 657757 - protein, 24 aa, Mycobacterium
FALAAELRAEFDIYLLDFPGYGLS

SEQ ID NO: 657758 - protein, 24 aa, Mycobacterium
FALACRSMGIHGRVYVPAKTPRQK

SEQ ID NO: 657759 - protein, 25 aa, Mycobacterium
FALAEAAGWAAGPWAAAKTLSPMAS

SEQ ID NO: 657760 - protein, 17 aa, Mycobacterium
FALAGFTVFVYEVNEQV

SEQ ID NO: 657761 - protein, 17 aa, Mycobacterium
FALAIAKIHGAEVIVSA

SEQ ID NO: 657762 - protein, 20 aa, Mycobacterium
FALAITNRAVLAVYRPLLEP

SEQ ID NO: 657763 - protein, 23 aa, Mycobacterium
FALDGFQHRACAALERGHGVLVC

SEQ ID NO: 657764 - protein, 27 aa, Mycobacterium
FALDHHINLRPAKLYPGVTGPLAGNPA

SEQ ID NO: 657765 - protein, 25 aa, Mycobacterium
FALDVDYAPAPGFRVIQLTPEGSHA

SEQ ID NO: 657766 - protein, 20 aa, Mycobacterium
FALELARPLISLGTRGLLLG

SEQ ID NO: 657767 - protein, 18 aa, Mycobacterium
FALELCLREDKLPSSELE

SEQ ID NO: 657768 - protein, 20 aa, Mycobacterium
FALELLRPATVSAQLHAEAT

SEQ ID NO: 657769 - protein, 19 aa, Mycobacterium
FALEPGGIHDWVLLTPGGL

SEQ ID NO: 657770 - protein, 17 aa, Mycobacterium
FALEVGLWALLEHWGIR

SEQ ID NO: 657771 - protein, 23 aa, Mycobacterium
FALFGASGGRLFVQGQAGDRFAV

SEQ ID NO: 657772 - protein, 17 aa, Mycobacterium
FALGGGFEMALMTDISV

SEQ ID NO: 657773 - protein, 19 aa, Mycobacterium
FALGYSHPVLIEAPEGITF

SEQ ID NO: 657774 - protein, 20 aa, Mycobacterium
FALIARRHMHVYGTTREQLS

SEQ ID NO: 657775 - protein, 26 aa, Mycobacterium
FALIERLARLDGHLLDTLLVMTLSPG

SEQ ID NO: 657776 - protein, 19 aa, Mycobacterium
FALLHGDYRLDNLLFDPAR

SEQ ID NO: 657777 - protein, 25 aa, Mycobacterium
FALLRAGVVPVMCLTGHRTAELGHF

SEQ ID NO: 657778 - protein, 18 aa, Mycobacterium
FALMCGDLSVPVTFAVGR

SEQ ID NO: 657779 - protein, 18 aa, Mycobacterium
FALNGAEGIDVATLERLA

SEQ ID NO: 657780 - protein, 24 aa, Mycobacterium
FALPDPRPAGYVIVGDAASLPAIN

SEQ ID NO: 657781 - protein, 18 aa, Mycobacterium
FALPGALGVKLARPDSKV

SEQ ID NO: 657782 - protein, 21 aa, Mycobacterium
FALPICRRPGAKTVTALGGGY

SEQ ID NO: 657783 - protein, 26 aa, Mycobacterium
FALPWYYRSGYDVVMYTLPFHGKRAE

SEQ ID NO: 657784 - protein, 19 aa, Mycobacterium
FALRREREIGSWRLIGQAL

SEQ ID NO: 657785 - protein, 20 aa, Mycobacterium
FALSALRDIYSAALGHPVDA

SEQ ID NO: 657786 - protein, 19 aa, Mycobacterium
FALSLPRSVTTAVPLVDES

SEQ ID NO: 657787 - protein, 20 aa, Mycobacterium
FALSTLRDIYGAALGYQVDA

SEQ ID NO: 657788 - protein, 18 aa, Mycobacterium
FALTCLLGDRIRDRVVLV

SEQ ID NO: 657789 - protein, 25 aa, Mycobacterium
FALTEARIGVAPAIISLTLLPKLSA

SEQ ID NO: 657790 - protein, 25 aa, Mycobacterium
FALTEARIGVAPAIISLTLLPKLSP

SEQ ID NO: 657791 - protein, 17 aa, Mycobacterium
FALWPATAWTDVTFASL

SEQ ID NO: 657792 - protein, 20 aa, Mycobacterium
FAMLRGELDLARSLAEQTLA

SEQ ID NO: 657793 - protein, 23 aa, Mycobacterium
FAMREALFALSHIEAELVDPASR

SEQ ID NO: 657794 - protein, 21 aa, Mycobacterium
FAMTAELLGAVIPGAIAEVIT

SEQ ID NO: 657795 - protein, 19 aa, Mycobacterium
FANELFAADSYRDYLEVHG

SEQ ID NO: 657796 - protein, 29 aa, Mycobacterium
FANELRNLLARCFERGVDPWDLERLGRRC

SEQ ID NO: 657797 - protein, 17 aa, Mycobacterium
FANFFPLGGDSATAMAD

SEQ ID NO: 657798 - protein, 22 aa, Mycobacterium
FANIAPYFKRIEAVEGATESDE

SEQ ID NO: 657799 - protein, 29 aa, Mycobacterium
FANKKGGADWVEWGGCGMVHPNVLRAAGI

SEQ ID NO: 657800 - protein, 17 aa, Mycobacterium
FANPLALRIEDIDAYRR

SEQ ID NO: 657801 - protein, 17 aa, Mycobacterium
FANPLGTLHGGICATLL

SEQ ID NO: 657802 - protein, 18 aa, Mycobacterium
FANSMVRPVAARQLPDPR

SEQ ID NO: 657803 - protein, 18 aa, Mycobacterium
FANVSAQIVALRLVTASG

SEQ ID NO: 657804 - protein, 19 aa, Mycobacterium
FAPALAAGCTVVLKPSDTT

SEQ ID NO: 657805 - protein, 17 aa, Mycobacterium
FAPDPAFMAAARRRAED

SEQ ID NO: 657806 - protein, 22 aa, Mycobacterium
FAPDRVRARPAGLYKPFGTGPR

SEQ ID NO: 657807 - protein, 23 aa, Mycobacterium
FAPDVQLVLCAGAPDTPQIAEEV

SEQ ID NO: 657808 - protein, 17 aa, Mycobacterium
FAPDVSLAFYRALEDGK

SEQ ID NO: 657809 - protein, 17 aa, Mycobacterium
FAPEAERSASRLERYRR

SEQ ID NO: 657810 - protein, 20 aa, Mycobacterium
FAPEAFKPAYGLAEATLLAS

SEQ ID NO: 657811 - protein, 18 aa, Mycobacterium
FAPELHIDAGLTLDDVMD

SEQ ID NO: 657812 - protein, 18 aa, Mycobacterium
FAPELHIDGGLSLDDVVD

SEQ ID NO: 657813 - protein, 18 aa, Mycobacterium
FAPELHINQGLTFDEIVD

SEQ ID NO: 657814 - protein, 24 aa, Mycobacterium
FAPEPSRRLGVLVDHLVAGSKEAR

SEQ ID NO: 657815 - protein, 26 aa, Mycobacterium
FAPEVYRAPLSYPYRDGLIDKELATD

SEQ ID NO: 657816 - protein, 26 aa, Mycobacterium
FAPEVYRAPMAHPYRWPSGAENCASD

SEQ ID NO: 657817 - protein, 27 aa, Mycobacterium
FAPEVYRAPMAYPYRWPSGPENCAAEA

SEQ ID NO: 657818 - protein, 18 aa, Mycobacterium
FAPFKPKPLFYRQPIYYM

SEQ ID NO: 657819 - protein, 18 aa, Mycobacterium
FAPGAVLRGRPRSGAERE

SEQ ID NO: 657820 - protein, 18 aa, Mycobacterium
FAPGCTRVEQGVKNGFSG

SEQ ID NO: 657821 - protein, 23 aa, Mycobacterium
FAPGIPEWNLRGTISTGDDGAFR

SEQ ID NO: 657822 - protein, 22 aa, Mycobacterium
FAPGLWCSPGLSNAYLLTTGDG

SEQ ID NO: 657823 - protein, 24 aa, Mycobacterium
FAPGPGRRLGVLVDHLVTGSKEAR

SEQ ID NO: 657824 - protein, 27 aa, Mycobacterium
FAPHFHPSYRYASAVRREIGVPTVFNL

SEQ ID NO: 657825 - protein, 17 aa, Mycobacterium
FAPHLDWIVANLDKPHT

SEQ ID NO: 657826 - protein, 18 aa, Mycobacterium
FAPIDCVDTLITDAEIDP

SEQ ID NO: 657827 - protein, 17 aa, Mycobacterium
FAPILYVLTYDDLDDAI

SEQ ID NO: 657828 - protein, 18 aa, Mycobacterium
FAPINMRALYTGEDIDDA

SEQ ID NO: 657829 - protein, 18 aa, Mycobacterium
FAPINSWPDNVSLDKARR

SEQ ID NO: 657830 - protein, 18 aa, Mycobacterium
FAPKGVRSSSRYRVPPMP

SEQ ID NO: 657831 - protein, 17 aa, Mycobacterium
FAPLNSWPDNANLDKAR

SEQ ID NO: 657832 - protein, 18 aa, Mycobacterium
FAPLNSWPDNVSLDKARR

SEQ ID NO: 657833 - protein, 25 aa, Mycobacterium
FAPLRAAIQMSLQLPARVAPEGDMA

SEQ ID NO: 657834 - protein, 23 aa, Mycobacterium
FAPLRPGHVSIYLCGATVQGLPH

SEQ ID NO: 657835 - protein, 19 aa, Mycobacterium
FAPLTWKMVLVSLGSVIPG

SEQ ID NO: 657836 - protein, 19 aa, Mycobacterium
FAPMVRYLLHSVQSGGEPG

SEQ ID NO: 657837 - protein, 27 aa, Mycobacterium
FAPNLPEWNLRGSFSTGADGVFEINTI

SEQ ID NO: 657838 - protein, 17 aa, Mycobacterium
FAPPTLHAMGVRVATSY

SEQ ID NO: 657839 - protein, 17 aa, Mycobacterium
FAPQFGRNIDVAKPTIA

SEQ ID NO: 657840 - protein, 19 aa, Mycobacterium
FAPRELVELAVAAEAHGMD

SEQ ID NO: 657841 - protein, 21 aa, Mycobacterium
FAPRELVELAVAAEEHGMDSA

SEQ ID NO: 657842 - protein, 18 aa, Mycobacterium
FAPRELVELAVATESHGF

SEQ ID NO: 657843 - protein, 19 aa, Mycobacterium
FAPRELVELGVAAEAHGMD

SEQ ID NO: 657844 - protein, 17 aa, Mycobacterium
FAPRVAAIRDRLPNLAV

SEQ ID NO: 657845 - protein, 17 aa, Mycobacterium
FAPVTVFRMIDSADPTV

SEQ ID NO: 657846 - protein, 21 aa, Mycobacterium
FAPVYRPPWDSFPRSEPYVVV

SEQ ID NO: 657847 - protein, 18 aa, Mycobacterium
FAPYSFTDFHLTKLPTLN

SEQ ID NO: 657848 - protein, 17 aa, Mycobacterium
FAQACAVFEECGADPRR

SEQ ID NO: 657849 - protein, 18 aa, Mycobacterium
FAQAISRGDPEAAMRSDD

SEQ ID NO: 657850 - protein, 19 aa, Mycobacterium
FAQEGYRAATIEDIAARAG

SEQ ID NO: 657851 - protein, 22 aa, Mycobacterium
FAQGFPSPWLIVVAALHAQAEG

SEQ ID NO: 657852 - protein, 30 aa, Mycobacterium
FAQGLALLLTREWGESFTVGGQTTYVEEAA

SEQ ID NO: 657853 - protein, 18 aa, Mycobacterium
FAQKALRGVLRNEAIIVV

SEQ ID NO: 657854 - protein, 18 aa, Mycobacterium
FAQLAGFRRPILHGLCTY

SEQ ID NO: 657855 - protein, 17 aa, Mycobacterium
FAQLDFRDVEDTDERMV

SEQ ID NO: 657856 - protein, 19 aa, Mycobacterium
FAQLGSWSGHIVVDGEEIT

SEQ ID NO: 657857 - protein, 18 aa, Mycobacterium
FAQLGSWSGHLTIDGEHI

SEQ ID NO: 657858 - protein, 19 aa, Mycobacterium
FAQLGSWSGRMAIDGEEVA

SEQ ID NO: 657859 - protein, 24 aa, Mycobacterium
FAQLRAERPVSWHPPVEDALMHDP

SEQ ID NO: 657860 - protein, 18 aa, Mycobacterium
FAQPAARVAGWGVSGRAR

SEQ ID NO: 657861 - protein, 22 aa, Mycobacterium
FAQPSPQPGVHWSKDVRMDKIA

SEQ ID NO: 657862 - protein, 27 aa, Mycobacterium
FAQQALHAFRKFGFQLVIVATVQNATT

SEQ ID NO: 657863 - protein, 17 aa, Mycobacterium
FAQRAQVGLPAFMMRAF

SEQ ID NO: 657864 - protein, 17 aa, Mycobacterium
FAQRRLPGGIVRTPQEW

SEQ ID NO: 657865 - protein, 22 aa, Mycobacterium
FAQSIARLLVFSTYRLAVLDRL

SEQ ID NO: 657866 - protein, 17 aa, Mycobacterium
FAQTLAAAAASYAGMEA

SEQ ID NO: 657867 - protein, 18 aa, Mycobacterium
FAQVGSWSGQLSIDGTDI

SEQ ID NO: 657868 - protein, 25 aa, Mycobacterium
FAQYWSEICAIPLSFITETVQRAQS

SEQ ID NO: 657869 - protein, 20 aa, Mycobacterium
FARAANWPADLNILRDNDFR

SEQ ID NO: 657870 - protein, 19 aa, Mycobacterium
FARACAGAGYTFVGPSADA

SEQ ID NO: 657871 - protein, 18 aa, Mycobacterium
FARAELRALSGAFDSTAA

SEQ ID NO: 657872 - protein, 25 aa, Mycobacterium
FARAEPMRSYCMAFDVPGELTRSMY

SEQ ID NO: 657873 - protein, 51 aa, Mycobacterium
FARAGLRRGDRVAGLLTRQVESWITALAAWRSGLVYVPLFGGFGPEPIALR

SEQ ID NO: 657874 - protein, 21 aa, Mycobacterium
FARAIALECAKPIKTARAEVL

SEQ ID NO: 657875 - protein, 25 aa, Mycobacterium
FARAMLRKFDVDWAGLGFGDDDLDE

SEQ ID NO: 657876 - protein, 19 aa, Mycobacterium
FARARGFRVVVTIHGSDFP

SEQ ID NO: 657877 - protein, 32 aa, Mycobacterium
FARAVNLASRFSYWIPFSIPVLAPALMRRGAA

SEQ ID NO: 657878 - protein, 21 aa, Mycobacterium
FARDLSRLCDLARARGLDSDP

SEQ ID NO: 657879 - protein, 22 aa, Mycobacterium
FARELDAPLVVKAVRGGYDGRG

SEQ ID NO: 657880 - protein, 24 aa, Mycobacterium
FARELRLKLLREHLDLDGKNDDAA

SEQ ID NO: 657881 - protein, 21 aa, Mycobacterium
FARFRRAVTDTGLYKDSDRLA

SEQ ID NO: 657882 - protein, 17 aa, Mycobacterium
FARHGAGITPPVIARGD

SEQ ID NO: 657883 - protein, 24 aa, Mycobacterium
FARILRPGGWVVISLDHPFGAPLP

SEQ ID NO: 657884 - protein, 18 aa, Mycobacterium
FARIWPFIVAHEAEPVRA

SEQ ID NO: 657885 - protein, 23 aa, Mycobacterium
FARKCSASPFMVLLAAYGVLVRR

SEQ ID NO: 657886 - protein, 20 aa, Mycobacterium
FARLLIMEILMGYKALVQGG

SEQ ID NO: 657887 - protein, 21 aa, Mycobacterium
FARLRSLVAIEDLDARQSRPI

SEQ ID NO: 657888 - protein, 26 aa, Mycobacterium
FARNFKPPLSWGMRMTGKKFMREYPY

SEQ ID NO: 657889 - protein, 20 aa, Mycobacterium
FARNYAWMRGALDSGRMTFG

SEQ ID NO: 657890 - protein, 22 aa, Mycobacterium
FARPDCVLLDLNLPDANGMDAL

SEQ ID NO: 657891 - protein, 20 aa, Mycobacterium
FARPDHILFGSDFPYATAEI

SEQ ID NO: 657892 - protein, 24 aa, Mycobacterium
FARPLRFGTAGLRGPVRGGPDAMN

SEQ ID NO: 657893 - protein, 26 aa, Mycobacterium
FARQALRLFDDLRLVHGRLDQPIPVG

SEQ ID NO: 657894 - protein, 25 aa, Mycobacterium
FARQKGLGRLAMWSANRDSQCPAEL

SEQ ID NO: 657895 - protein, 19 aa, Mycobacterium
FARQKRLGVIPADAELTER

SEQ ID NO: 657896 - protein, 21 aa, Mycobacterium
FARQRLRALAKIEGKHHDGKP

SEQ ID NO: 657897 - protein, 20 aa, Mycobacterium
FARQRLRALARVEGKSADGR

SEQ ID NO: 657898 - protein, 24 aa, Mycobacterium
FARQRYWGEPFPIVYDSDGRPHAL

SEQ ID NO: 657899 - protein, 24 aa, Mycobacterium
FARRARAGAVMLIDGAPGIVIAIH

SEQ ID NO: 657900 - protein, 17 aa, Mycobacterium
FARRGIRTHVLASSATY

SEQ ID NO: 657901 - protein, 24 aa, Mycobacterium
FARRGKRMDECIDIIRGLTSGDYF

SEQ ID NO: 657902 - protein, 17 aa, Mycobacterium
FARRLFGDVDARIKKGL

SEQ ID NO: 657903 - protein, 17 aa, Mycobacterium
FARRLPDGRRYGVVAGT

SEQ ID NO: 657904 - protein, 17 aa, Mycobacterium
FARRLPEGRRYGVVAGT

SEQ ID NO: 657905 - protein, 17 aa, Mycobacterium
FARRLPPGRRYGVVAGT

SEQ ID NO: 657906 - protein, 18 aa, Mycobacterium
FARRQWGGLLAPPALLMG

SEQ ID NO: 657907 - protein, 17 aa, Mycobacterium
FARRTRRPALLAHSVAI

SEQ ID NO: 657908 - protein, 28 aa, Mycobacterium
FARSKLRGSRTPDRIVFRDELPTTPTGK

SEQ ID NO: 657909 - protein, 21 aa, Mycobacterium
FARSTGRRFLVRVEDLDDRTF

SEQ ID NO: 657910 - protein, 19 aa, Mycobacterium
FARTFTRFLIFGEDGKVRE

SEQ ID NO: 657911 - protein, 17 aa, Mycobacterium
FARTLRSVVDWRGQVVT

SEQ ID NO: 657912 - protein, 24 aa, Mycobacterium
FARVPAALLRWGVSQFDADMRPDQ

SEQ ID NO: 657913 - protein, 19 aa, Mycobacterium
FARVVGGSFARIQFTPDLV

SEQ ID NO: 657914 - protein, 17 aa, Mycobacterium
FARVVGGTFARIQFTPD

SEQ ID NO: 657915 - protein, 19 aa, Mycobacterium
FASAARRALSELCDGSADL

SEQ ID NO: 657916 - protein, 26 aa, Mycobacterium
FASADKFDSGTGWPSFTRPLDDGYVV

SEQ ID NO: 657917 - protein, 23 aa, Mycobacterium
FASALSAPLYWIATNAGLDGSVV

SEQ ID NO: 657918 - protein, 20 aa, Mycobacterium
FASAVAIIGVACRFPGAANP

SEQ ID NO: 657919 - protein, 20 aa, Mycobacterium
FASAVGRSFYTQILPSNTVS

SEQ ID NO: 657920 - protein, 23 aa, Mycobacterium
FASCGVCDRCGAGSPAYCDHSTD

SEQ ID NO: 657921 - protein, 22 aa, Mycobacterium
FASEALIYGRFGYGVATESAEL

SEQ ID NO: 657922 - protein, 17 aa, Mycobacterium
FASGAPHGVAFADGAGP

SEQ ID NO: 657923 - protein, 23 aa, Mycobacterium
FASGRVAYALGLHGPAVTVDTAC

SEQ ID NO: 657924 - protein, 22 aa, Mycobacterium
FASKALILYEIYFKAAEETLAC

SEQ ID NO: 657925 - protein, 17 aa, Mycobacterium
FASLLPAARAVRERVDW

SEQ ID NO: 657926 - protein, 18 aa, Mycobacterium
FASLNPRARVDTSIAEPL

SEQ ID NO: 657927 - protein, 18 aa, Mycobacterium
FASLSDRDALAILGRAPT

SEQ ID NO: 657928 - protein, 18 aa, Mycobacterium
FASMCVATVKMLDLNPDR

SEQ ID NO: 657929 - protein, 24 aa, Mycobacterium
FASPAASFGAVFIRHGVSNCDMGT

SEQ ID NO: 657930 - protein, 18 aa, Mycobacterium
FASPFAMLVIADLLGVPE

SEQ ID NO: 657931 - protein, 22 aa, Mycobacterium
FASQARFGLLVLDEALHLTRSV

SEQ ID NO: 657932 - protein, 28 aa, Mycobacterium
FASRAAKDWLCLLEAFDAPQRSGLVRAA

SEQ ID NO: 657933 - protein, 17 aa, Mycobacterium
FASRDGRHSVALHEQII

SEQ ID NO: 657934 - protein, 17 aa, Mycobacterium
FASRFRECAARALLLPR

SEQ ID NO: 657935 - protein, 18 aa, Mycobacterium
FASRIGVQVEDLTAYLDG

SEQ ID NO: 657936 - protein, 21 aa, Mycobacterium
FASRLPSYFPTTLRERFGPDI

SEQ ID NO: 657937 - protein, 22 aa, Mycobacterium
FASRLPYYFPTRLREELHGEIR

SEQ ID NO: 657938 - protein, 17 aa, Mycobacterium
FASRLVTTGRGYSYPTA

SEQ ID NO: 657939 - protein, 18 aa, Mycobacterium
FASVHGRGATVARAADLT

SEQ ID NO: 657940 - protein, 17 aa, Mycobacterium
FASVPIAVNSLWPATTI

SEQ ID NO: 657941 - protein, 20 aa, Mycobacterium
FASVTSGLTGQAWQGAAAKA

SEQ ID NO: 657942 - protein, 25 aa, Mycobacterium
FASVTSGLVGQAWQGPASAAMAAAV

SEQ ID NO: 657943 - protein, 25 aa, Mycobacterium
FASVTSGLVGQAWQGPASAAMTAAA

SEQ ID NO: 657944 - protein, 17 aa, Mycobacterium
FASVVAEPGRIVVSGDV

SEQ ID NO: 657945 - protein, 17 aa, Mycobacterium
FASVWNAVVSELNGELN

SEQ ID NO: 657946 - protein, 23 aa, Mycobacterium
FATAETRQWWGGMWADRILQSDL

SEQ ID NO: 657947 - protein, 18 aa, Mycobacterium
FATAGSWFSIAWSDPDGR

SEQ ID NO: 657948 - protein, 21 aa, Mycobacterium
FATAHQCARATEALAAVLADP

SEQ ID NO: 657949 - protein, 25 aa, Mycobacterium
FATARAGVVLVPINFMLTAEEIAYI

SEQ ID NO: 657950 - protein, 17 aa, Mycobacterium
FATAVGVDIKSVRRWLA

SEQ ID NO: 657951 - protein, 21 aa, Mycobacterium
FATCCRALGIAVYDRKRPADL

SEQ ID NO: 657952 - protein, 23 aa, Mycobacterium
FATDGKPAPGIQLAGAGGLEATP

SEQ ID NO: 657953 - protein, 18 aa, Mycobacterium
FATDLPFALDGFQHRACA

SEQ ID NO: 657954 - protein, 24 aa, Mycobacterium
FATELRNLLARCAERGVDPMELER

SEQ ID NO: 657955 - protein, 26 aa, Mycobacterium
FATELTWGVGVDKAFEAIATPETIGQ

SEQ ID NO: 657956 - protein, 17 aa, Mycobacterium
FATFASVLCQAEATEFT

SEQ ID NO: 657957 - protein, 17 aa, Mycobacterium
FATFASVLCQAEATEYK

SEQ ID NO: 657958 - protein, 17 aa, Mycobacterium
FATFASVLCQAEATEYT

SEQ ID NO: 657959 - protein, 17 aa, Mycobacterium
FATFASVLCQAESTEYT

SEQ ID NO: 657960 - protein, 22 aa, Mycobacterium
FATGEPRSGTTLLHALLAEDET

SEQ ID NO: 657961 - protein, 26 aa, Mycobacterium
FATGHLRGAVNIGLAGRYAEFAGSVV

SEQ ID NO: 657962 - protein, 18 aa, Mycobacterium
FATHGYQGMSMRTLNREL

SEQ ID NO: 657963 - protein, 17 aa, Mycobacterium
FATHVARGRNQDELDNI

SEQ ID NO: 657964 - protein, 17 aa, Mycobacterium
FATIAAAAFTPRPVPTV

SEQ ID NO: 657965 - protein, 17 aa, Mycobacterium
FATIAARVLGPGDEMIK

SEQ ID NO: 657966 - protein, 20 aa, Mycobacterium
FATIPAWMFTDPVAVPEDPD

SEQ ID NO: 657967 - protein, 26 aa, Mycobacterium
FATIRAEANLARFPEDVARVVVRLIH

SEQ ID NO: 657968 - protein, 17 aa, Mycobacterium
FATLCSVALEPDSGRFT

SEQ ID NO: 657969 - protein, 19 aa, Mycobacterium
FATLLPLRIIDTMLGVPRE

SEQ ID NO: 657970 - protein, 18 aa, Mycobacterium
FATLPRSAFEATLDLLSG

SEQ ID NO: 657971 - protein, 21 aa, Mycobacterium
FATPRPGRRIGLVYRSSSGRD

SEQ ID NO: 657972 - protein, 17 aa, Mycobacterium
FATRAELDLCAPDLDSA

SEQ ID NO: 657973 - protein, 18 aa, Mycobacterium
FATRDDLILAALEYWMQK

SEQ ID NO: 657974 - protein, 22 aa, Mycobacterium
FATRPLDEWAQIFAGEPDFFWS

SEQ ID NO: 657975 - protein, 20 aa, Mycobacterium
FATRVIRLLGLVPLGPSGLG

SEQ ID NO: 657976 - protein, 23 aa, Mycobacterium
FATSFRLTGRLFRRRPQESRILL

SEQ ID NO: 657977 - protein, 19 aa, Mycobacterium
FATSRRRMMDWLSRRNGDV

SEQ ID NO: 657978 - protein, 22 aa, Mycobacterium
FATTVPTEFQSLVVHDATGDPV

SEQ ID NO: 657979 - protein, 18 aa, Mycobacterium
FAVAAADDRAYVSVVTAG

SEQ ID NO: 657980 - protein, 28 aa, Mycobacterium
FAVAPVRPEAWLGYFLSRLLPGLNRHFM

SEQ ID NO: 657981 - protein, 17 aa, Mycobacterium
FAVASGLVHLYAESAGE

SEQ ID NO: 657982 - protein, 24 aa, Mycobacterium
FAVCGLGDSFYPYFNNAGKLVDAR

SEQ ID NO: 657983 - protein, 20 aa, Mycobacterium
FAVELARRGGRVVCADIDGI

SEQ ID NO: 657984 - protein, 20 aa, Mycobacterium
FAVELARRGGRVVCADKDPI

SEQ ID NO: 657985 - protein, 20 aa, Mycobacterium
FAVELARRGGRVVCADRDPV

SEQ ID NO: 657986 - protein, 20 aa, Mycobacterium
FAVELARRGGRVVCADVDLP

SEQ ID NO: 657987 - protein, 17 aa, Mycobacterium
FAVFHVVALPITVPVQF

SEQ ID NO: 657988 - protein, 34 aa, Mycobacterium
FAVGDRVAVGWFGGCCYRCDPCRKGIFIHCVNGK

SEQ ID NO: 657989 - protein, 35 aa, Mycobacterium
FAVGDRVGIAWLRHTCGACRYCTRGDENLCPQSRY

SEQ ID NO: 657990 - protein, 21 aa, Mycobacterium
FAVGNGEIFGFLGPSGAGKST

SEQ ID NO: 657991 - protein, 21 aa, Mycobacterium
FAVLEPRADGFRNYIRPGEKA

SEQ ID NO: 657992 - protein, 21 aa, Mycobacterium
FAVLEPRADGFRNYVRPGEKV

SEQ ID NO: 657993 - protein, 18 aa, Mycobacterium
FAVLRAENPVPWSRPAES

SEQ ID NO: 657994 - protein, 21 aa, Mycobacterium
FAVNDFLGWSYLVSRQEESGP

SEQ ID NO: 657995 - protein, 19 aa, Mycobacterium
FAVNYLRGFATDPGERNPR

SEQ ID NO: 657996 - protein, 25 aa, Mycobacterium
FAVPAAMGAKFARPEAEVWAIDGDG

SEQ ID NO: 657997 - protein, 17 aa, Mycobacterium
FAVPRIVASAPKVVIQE

SEQ ID NO: 657998 - protein, 19 aa, Mycobacterium
FAVPVPNAPTLTAISVSGP

SEQ ID NO: 657999 - protein, 17 aa, Mycobacterium
FAVQVLAVLAGWGVKLD

SEQ ID NO: 658000 - protein, 23 aa, Mycobacterium
FAVRARRSRPDFVVGEDNRAPVE

SEQ ID NO: 658001 - protein, 17 aa, Mycobacterium
FAVTLGGDVARLTGRVR

SEQ ID NO: 658002 - protein, 24 aa, Mycobacterium
FAVWEIFGSLLYGGRLVMVPDSVV

SEQ ID NO: 658003 - protein, 18 aa, Mycobacterium
FAWIPFGGGMMRCIGASF

SEQ ID NO: 658004 - protein, 17 aa, Mycobacterium
FAWLPFGGGAHKRIGMH

SEQ ID NO: 658005 - protein, 25 aa, Mycobacterium
FAYAEAKAAADAHLRASDLDWTVLG

SEQ ID NO: 658006 - protein, 18 aa, Mycobacterium
FAYDGAWAEYTLAQAAGL

SEQ ID NO: 658007 - protein, 26 aa, Mycobacterium
FAYHDRCAWCGSTFAGAVLTGQVLRC

SEQ ID NO: 658008 - protein, 25 aa, Mycobacterium
FAYHGYPWLIHRLTYRHANHAQLHV

SEQ ID NO: 658009 - protein, 22 aa, Mycobacterium
FAYHGYPWLIHRLTYRRAGHDN

SEQ ID NO: 658010 - protein, 20 aa, Mycobacterium
FAYHGYPWLIHRLTYSRTNH

SEQ ID NO: 658011 - protein, 17 aa, Mycobacterium
FAYKHTRIRTIVVDGRR

SEQ ID NO: 658012 - protein, 19 aa, Mycobacterium
FAYLDTEFDQGTVIEISDI

SEQ ID NO: 658013 - protein, 25 aa, Mycobacterium
FAYPLPVAVICRMLGVPIEDEPEFG

SEQ ID NO: 658014 - protein, 22 aa, Mycobacterium
FCAAIRRELRNPKFLDTDIDCL

SEQ ID NO: 658015 - protein, 19 aa, Mycobacterium
FCAGADLGALGAAGGGAAE

SEQ ID NO: 658016 - protein, 17 aa, Mycobacterium
FCAHPLLARLGAPGGAL

SEQ ID NO: 658017 - protein, 25 aa, Mycobacterium
FCAIPEDADRAAIAASIHDVVSQVQ

SEQ ID NO: 658018 - protein, 25 aa, Mycobacterium
FCAPRVEPEVAFLLREPLRGPGVTA

SEQ ID NO: 658019 - protein, 17 aa, Mycobacterium
FCAQAAVRRTPLLLDGM

SEQ ID NO: 658020 - protein, 22 aa, Mycobacterium
FCARDPFGIKPLYLATAPGGTI

SEQ ID NO: 658021 - protein, 20 aa, Mycobacterium
FCATRCGYCDFNTYTADELG

SEQ ID NO: 658022 - protein, 22 aa, Mycobacterium
FCDAMIAIRGEIDRVGSGEWPV

SEQ ID NO: 658023 - protein, 19 aa, Mycobacterium
FCDDALRARIVAAVEHLDE

SEQ ID NO: 658024 - protein, 18 aa, Mycobacterium
FCDLPGVMQHFTIPISFF

SEQ ID NO: 658025 - protein, 18 aa, Mycobacterium
FCDNNGWVVAALQAAWSA

SEQ ID NO: 658026 - protein, 25 aa, Mycobacterium
FCEAMIAIRGEIDRVGAGEWPVDDN

SEQ ID NO: 658027 - protein, 22 aa, Mycobacterium
FCEQARPAPRGHSVPVPGELGG

SEQ ID NO: 658028 - protein, 26 aa, Mycobacterium
FCGAGRWGTKLIRAFLAQGAAPAGFV

SEQ ID NO: 658029 - protein, 23 aa, Mycobacterium
FCGDGTPTWLPALTVTEAVLVGR

SEQ ID NO: 658030 - protein, 17 aa, Mycobacterium
FCGPLAHPAQWWVTLSC

SEQ ID NO: 658031 - protein, 20 aa, Mycobacterium
FCGTAPLAAEMRAFVETCLD

SEQ ID NO: 658032 - protein, 20 aa, Mycobacterium
FCGTAPLAAEMRGFVETCLD

SEQ ID NO: 658033 - protein, 19 aa, Mycobacterium
FCGTVGPGFADGAVVGNIF

SEQ ID NO: 658034 - protein, 21 aa, Mycobacterium
FCGWVSCDPDAKLGLPELELG

SEQ ID NO: 658035 - protein, 26 aa, Mycobacterium
FCHNGCPLGNLIPEWNDLVRQGRWRD

SEQ ID NO: 658036 - protein, 26 aa, Mycobacterium
FCHNGCPLGNLIPEWNDLVRRDQWQA

SEQ ID NO: 658037 - protein, 26 aa, Mycobacterium
FCHNGCPLGNLIPEWNDLVRRGRWRD

SEQ ID NO: 658038 - protein, 27 aa, Mycobacterium
FCHNGCPLGNLIPEWNDLVRTGRWRDA

SEQ ID NO: 658039 - protein, 25 aa, Mycobacterium
FCIPAVEAKGSLLLEDVGVPLPALG

SEQ ID NO: 658040 - protein, 20 aa, Mycobacterium
FCITRCGYCDFNTYTPAELG

SEQ ID NO: 658041 - protein, 17 aa, Mycobacterium
FCIVPSLRGKEIDRSPA

SEQ ID NO: 658042 - protein, 17 aa, Mycobacterium
FCIVPSLRGKEVDRRPG

SEQ ID NO: 658043 - protein, 26 aa, Mycobacterium
FCMASGRISYALGVHGPSLTVDAGCA

SEQ ID NO: 658044 - protein, 18 aa, Mycobacterium
FCNLHPKANVSISSRLSS

SEQ ID NO: 658045 - protein, 20 aa, Mycobacterium
FCPDQFLGAHVRRITGRTNL

SEQ ID NO: 658046 - protein, 20 aa, Mycobacterium
FCPDQFLGAHVRRVTGRKNM

SEQ ID NO: 658047 - protein, 18 aa, Mycobacterium
FCQACLDPLQGGDRFDFT

SEQ ID NO: 658048 - protein, 18 aa, Mycobacterium
FCQAGKLIDTRLEQLGAS

SEQ ID NO: 658049 - protein, 18 aa, Mycobacterium
FCRICEPLCGMVATVEGG

SEQ ID NO: 658050 - protein, 18 aa, Mycobacterium
FCRSVIRWLQVGYPNGVP

SEQ ID NO: 658051 - protein, 29 aa, Mycobacterium
FCSAHPLVKAQICSRLASTELYRRLRDFE

SEQ ID NO: 658052 - protein, 17 aa, Mycobacterium
FCSTCDRTRLTADGQIR

SEQ ID NO: 658053 - protein, 20 aa, Mycobacterium
FCTALGCRAPLIVVTNSATR

SEQ ID NO: 658054 - protein, 25 aa, Mycobacterium
FCTPEGPAILDCLEFDDTLRYVDGV

SEQ ID NO: 658055 - protein, 20 aa, Mycobacterium
FCVGRLNFGMGAGRHEAEHH

SEQ ID NO: 658056 - protein, 20 aa, Mycobacterium
FCVTRCGYCDFNTYTPAELG

SEQ ID NO: 658057 - protein, 21 aa, Mycobacterium
FCVVAEGIADIYPRLNPTMEW

SEQ ID NO: 658058 - protein, 19 aa, Mycobacterium
FCYAPLSALLGGLGSGWAT

SEQ ID NO: 658059 - protein, 18 aa, Mycobacterium
FDAAAAHHFGCGFAPSGW

SEQ ID NO: 658060 - protein, 24 aa, Mycobacterium
FDAAARTAIEWSTALDTGGPRLLL

SEQ ID NO: 658061 - protein, 21 aa, Mycobacterium
FDAAEHNLDWAVVSDGATVTI

SEQ ID NO: 658062 - protein, 19 aa, Mycobacterium
FDAAGIPFPSPAQRVSIVG

SEQ ID NO: 658063 - protein, 17 aa, Mycobacterium
FDAAKIATVYANYEALK

SEQ ID NO: 658064 - protein, 25 aa, Mycobacterium
FDAALALDVIERFRITNFTATPTML

SEQ ID NO: 658065 - protein, 24 aa, Mycobacterium
FDAALALDVIERFRVTNFTATPTM

SEQ ID NO: 658066 - protein, 22 aa, Mycobacterium
FDAALLLGVCDKIVPGMLIGAL

SEQ ID NO: 658067 - protein, 24 aa, Mycobacterium
FDAALVVDVIERFRVTNFTATPTM

SEQ ID NO: 658068 - protein, 17 aa, Mycobacterium
FDAARAATVHPLMVAIN

SEQ ID NO: 658069 - protein, 18 aa, Mycobacterium
FDAARPTAWLAEGLLHYL

SEQ ID NO: 658070 - protein, 18 aa, Mycobacterium
FDACRVPASAILGGTPGK

SEQ ID NO: 658071 - protein, 19 aa, Mycobacterium
FDADGIAAMIERFRRVLEA

SEQ ID NO: 658072 - protein, 17 aa, Mycobacterium
FDADGWYRTGDVAVVDA

SEQ ID NO: 658073 - protein, 17 aa, Mycobacterium
FDADPEASVAVLWGDNG

SEQ ID NO: 658074 - protein, 24 aa, Mycobacterium
FDAEARARLALRRFAPLLTDRSVT

SEQ ID NO: 658075 - protein, 22 aa, Mycobacterium
FDAEAVAWMWRHYGGDASLPDE

SEQ ID NO: 658076 - protein, 23 aa, Mycobacterium
FDAELRFAMPGVRVADPKACQCG

SEQ ID NO: 658077 - protein, 22 aa, Mycobacterium
FDAELRFGVGHLQVAESAECRS

SEQ ID NO: 658078 - protein, 23 aa, Mycobacterium
FDAELRLTYVIVVEGNLLSRVEV

SEQ ID NO: 658079 - protein, 24 aa, Mycobacterium
FDAEQRSRLSIDFGADPLTAPLSG

SEQ ID NO: 658080 - protein, 19 aa, Mycobacterium
FDAEWRVILVGIVEGDLLS

SEQ ID NO: 658081 - protein, 25 aa, Mycobacterium
FDAFKKERWPAFWDWAYETLPNDSR

SEQ ID NO: 658082 - protein, 25 aa, Mycobacterium
FDAFKKERWPAFWDWAYKTLPDDSR

SEQ ID NO: 658083 - protein, 18 aa, Mycobacterium
FDAGDHFGWVASSTRTTR

SEQ ID NO: 658084 - protein, 17 aa, Mycobacterium
FDAGHLARGVRARFTVA

SEQ ID NO: 658085 - protein, 18 aa, Mycobacterium
FDAGNPWIAQEWADGALY

SEQ ID NO: 658086 - protein, 18 aa, Mycobacterium
FDAGQRCDMEAGMAKLFA

SEQ ID NO: 658087 - protein, 20 aa, Mycobacterium
FDAHGESVVFLRPDRCIAGA

SEQ ID NO: 658088 - protein, 24 aa, Mycobacterium
FDAIERILGCGVRDHCDPELCRYD

SEQ ID NO: 658089 - protein, 18 aa, Mycobacterium
FDAISGFLADAARRITAP

SEQ ID NO: 658090 - protein, 19 aa, Mycobacterium
FDAISGFLAEGARRIAAPT

SEQ ID NO: 658091 - protein, 18 aa, Mycobacterium
FDAISGFLAEGARRITAP

SEQ ID NO: 658092 - protein, 25 aa, Mycobacterium
FDAKKAVVFDDRWASAREDLVKLWL

SEQ ID NO: 658093 - protein, 25 aa, Mycobacterium
FDAKKSVVFDDRWASAREDLVKLWL

SEQ ID NO: 658094 - protein, 17 aa, Mycobacterium
FDAKLGRGPAAPVADEL

SEQ ID NO: 658095 - protein, 17 aa, Mycobacterium
FDAKLGRGPATAIEDEL

SEQ ID NO: 658096 - protein, 18 aa, Mycobacterium
FDAKLGWAPAPPRDDELL

SEQ ID NO: 658097 - protein, 17 aa, Mycobacterium
FDAKVRLLESFSPKTLN

SEQ ID NO: 658098 - protein, 20 aa, Mycobacterium
FDALCAHLATMHPSRYHALI

SEQ ID NO: 658099 - protein, 23 aa, Mycobacterium
FDALGARLSIWRGPLPFDAAEND

SEQ ID NO: 658100 - protein, 20 aa, Mycobacterium
FDALGRWLLAYTAELADGVG

SEQ ID NO: 658101 - protein, 18 aa, Mycobacterium
FDALPEALLPVAAPNWNY

SEQ ID NO: 658102 - protein, 21 aa, Mycobacterium
FDALTAWFGRPAVPSPRLRAS

SEQ ID NO: 658103 - protein, 17 aa, Mycobacterium
FDAPAALIFRALTEPEL

SEQ ID NO: 658104 - protein, 22 aa, Mycobacterium
FDAQWVEHWLRDHIVSRIPGGR

SEQ ID NO: 658105 - protein, 27 aa, Mycobacterium
FDAQWWGRAAELGWAGLLVPEDLGGGS

SEQ ID NO: 658106 - protein, 17 aa, Mycobacterium
FDARWFGWVNPADKAVR

SEQ ID NO: 658107 - protein, 30 aa, Mycobacterium
FDASGLCLTLAPAIAVAWNPLIDSLTATTA

SEQ ID NO: 658108 - protein, 30 aa, Mycobacterium
FDASKPCAWSAEGLLRYLPATAQDLLFDRI

SEQ ID NO: 658109 - protein, 19 aa, Mycobacterium
FDASLERLGTDYVDLYLIH

SEQ ID NO: 658110 - protein, 22 aa, Mycobacterium
FDASLRLPWRQLQPVDPATLGP

SEQ ID NO: 658111 - protein, 17 aa, Mycobacterium
FDASVAQWPACREYTHT

SEQ ID NO: 658112 - protein, 24 aa, Mycobacterium
FDASYTRWGPIQWVPPETFVTLGE

SEQ ID NO: 658113 - protein, 26 aa, Mycobacterium
FDATAGVLRIAHWLTPGQRAFQMATQ

SEQ ID NO: 658114 - protein, 26 aa, Mycobacterium
FDATRPSAWIAEGLLIYLPAAAQQQL

SEQ ID NO: 658115 - protein, 18 aa, Mycobacterium
FDAVELHFGHLYLPSSFL

SEQ ID NO: 658116 - protein, 32 aa, Mycobacterium
FDAVELHFGHLYLPSSFLSPLINRRKDEYGGD

SEQ ID NO: 658117 - protein, 20 aa, Mycobacterium
FDAVELHGAHGYLLDQFLWE

SEQ ID NO: 658118 - protein, 17 aa, Mycobacterium
FDAVFFADGLNFGPKAT

SEQ ID NO: 658119 - protein, 18 aa, Mycobacterium
FDAVFTRDKPVIFAYHGY

SEQ ID NO: 658120 - protein, 17 aa, Mycobacterium
FDAVSALGYLAACTDRV

SEQ ID NO: 658121 - protein, 17 aa, Mycobacterium
FDAVSALGYLAASTDRV

SEQ ID NO: 658122 - protein, 17 aa, Mycobacterium
FDAVSALGYLAASTQRV

SEQ ID NO: 658123 - protein, 20 aa, Mycobacterium
FDAVSGLGYLAARTDRVQLA

SEQ ID NO: 658124 - protein, 18 aa, Mycobacterium
FDAYSAASKLVFEVFRDT

SEQ ID NO: 658125 - protein, 20 aa, Mycobacterium
FDCPGCAWPEEPGGRKLAEF

SEQ ID NO: 658126 - protein, 25 aa, Mycobacterium
FDCSDPARLAGWWAEHFGGTAHELL

SEQ ID NO: 658127 - protein, 25 aa, Mycobacterium
FDDAEIRWSVGFPDHPEPGLAEQPL

SEQ ID NO: 658128 - protein, 18 aa, Mycobacterium
FDDAELGGAIARFDQLSR

SEQ ID NO: 658129 - protein, 17 aa, Mycobacterium
FDDAGAIGRRYRRQDEI

SEQ ID NO: 658130 - protein, 26 aa, Mycobacterium
FDDAGFKQFAEWDVCIVPRERLQLTP

SEQ ID NO: 658131 - protein, 30 aa, Mycobacterium
FDDAGRLGLIPLRWALACLLIDTESVTLPV

SEQ ID NO: 658132 - protein, 18 aa, Mycobacterium
FDDARPVLERASARETAA

SEQ ID NO: 658133 - protein, 17 aa, Mycobacterium
FDDARTAADLVVGEPGD

SEQ ID NO: 658134 - protein, 18 aa, Mycobacterium
FDDAVGFRPLRPAMTATF

SEQ ID NO: 658135 - protein, 19 aa, Mycobacterium
FDDCGWSWFMADLGAVVSW

SEQ ID NO: 658136 - protein, 23 aa, Mycobacterium
FDDDLPPAWAFAGRGGAPARDGA

SEQ ID NO: 658137 - protein, 28 aa, Mycobacterium
FDDDTAELKRIWTHSAYRKRGLAKALLT

SEQ ID NO: 658138 - protein, 19 aa, Mycobacterium
FDDFERWIDLNMRYLRRIG

SEQ ID NO: 658139 - protein, 18 aa, Mycobacterium
FDDFERWLNLTVRQLRKI

SEQ ID NO: 658140 - protein, 28 aa, Mycobacterium
FDDGSGRPGRFLLTDTVGFVRHLPTQLV

SEQ ID NO: 658141 - protein, 17 aa, Mycobacterium
FDDGVLVWARLDRIGGE

SEQ ID NO: 658142 - protein, 17 aa, Mycobacterium
FDDLFLMAAQKRFLSVE

SEQ ID NO: 658143 - protein, 18 aa, Mycobacterium
FDDLKMHYVRAGAGEPVV

SEQ ID NO: 658144 - protein, 18 aa, Mycobacterium
FDDLSVGQVFDWAPALTL

SEQ ID NO: 658145 - protein, 18 aa, Mycobacterium
FDDLSVGQVFDWAPSMTL

SEQ ID NO: 658146 - protein, 21 aa, Mycobacterium
FDDMARLGAQITIFRLGSDPG

SEQ ID NO: 658147 - protein, 22 aa, Mycobacterium
FDDMARLGAQITIFRLGSDPGL

SEQ ID NO: 658148 - protein, 21 aa, Mycobacterium
FDDMARLGAQITIFRLGSDRG

SEQ ID NO: 658149 - protein, 25 aa, Mycobacterium
FDDMLIELDIHFRIEDDLYYPALKD

SEQ ID NO: 658150 - protein, 24 aa, Mycobacterium
FDDMLIELDIHFRIEDDLYYPALR

SEQ ID NO: 658151 - protein, 23 aa, Mycobacterium
FDDRIDPRFPIFSAGNLSGALPG

SEQ ID NO: 658152 - protein, 23 aa, Mycobacterium
FDDRQPLMWMPRELHPPSRWIRP

SEQ ID NO: 658153 - protein, 22 aa, Mycobacterium
FDDSFLLCFNAHYEPIEFTLPA

SEQ ID NO: 658154 - protein, 26 aa, Mycobacterium
FDDSRLRWLRAGEVPTLGNWFRAAGY

SEQ ID NO: 658155 - protein, 25 aa, Mycobacterium
FDDVFKRMWELYLAYSEAGFRSGYL

SEQ ID NO: 658156 - protein, 17 aa, Mycobacterium
FDDVLSIIASRLQSSPT

SEQ ID NO: 658157 - protein, 27 aa, Mycobacterium
FDDVVERIRCAAGAFADLGIGKGDRAA

SEQ ID NO: 658158 - protein, 17 aa, Mycobacterium
FDDVVQLLLDMAARARP

SEQ ID NO: 658159 - protein, 26 aa, Mycobacterium
FDDWTLAQCRVFQRIAPDGSRLTDLA

SEQ ID NO: 658160 - protein, 26 aa, Mycobacterium
FDDYDLRTAFTWKFLRSADRRQVAAV

SEQ ID NO: 658161 - protein, 18 aa, Mycobacterium
FDEACRRGVDLVAVHTWS

SEQ ID NO: 658162 - protein, 19 aa, Mycobacterium
FDEAFAALRRWEAEGRLKH

SEQ ID NO: 658163 - protein, 17 aa, Mycobacterium
FDEAFAHLRQWEAEGRL

SEQ ID NO: 658164 - protein, 18 aa, Mycobacterium
FDEALALWRGIPELPDGR

SEQ ID NO: 658165 - protein, 17 aa, Mycobacterium
FDEALGLQLALAMRRGS

SEQ ID NO: 658166 - protein, 22 aa, Mycobacterium
FDEASWRGAELVALHAWTDAEV

SEQ ID NO: 658167 - protein, 25 aa, Mycobacterium
FDEASWRGAELVALYAWTDAELPDI

SEQ ID NO: 658168 - protein, 19 aa, Mycobacterium
FDEAVKLGDRIAILREGSQ

SEQ ID NO: 658169 - protein, 19 aa, Mycobacterium
FDEDDCEVFLDLAGQADIV

SEQ ID NO: 658170 - protein, 18 aa, Mycobacterium
FDEDPCLFVETIRLQGKR

SEQ ID NO: 658171 - protein, 17 aa, Mycobacterium
FDEEVYYSLTRVADTMS

SEQ ID NO: 658172 - protein, 23 aa, Mycobacterium
FDEGFKLVKINPLVTWTDEDMQN

SEQ ID NO: 658173 - protein, 17 aa, Mycobacterium
FDEGFKLVKVNPMATWS

SEQ ID NO: 658174 - protein, 17 aa, Mycobacterium
FDEGLPWCDGAFELLER

SEQ ID NO: 658175 - protein, 25 aa, Mycobacterium
FDEGPCRQAALADLVVRTEDFRAEQ

SEQ ID NO: 658176 - protein, 20 aa, Mycobacterium
FDEGWLRTGDVGKIDAEGYL

SEQ ID NO: 658177 - protein, 20 aa, Mycobacterium
FDEGWLRTGDVGKIEAEGYL

SEQ ID NO: 658178 - protein, 19 aa, Mycobacterium
FDEHVRWYRMYGMSMRPVP

SEQ ID NO: 658179 - protein, 20 aa, Mycobacterium
FDEHVRWYRMYGMSMRPVPG

SEQ ID NO: 658180 - protein, 17 aa, Mycobacterium
FDEKFVLQPGMVLVLEP

SEQ ID NO: 658181 - protein, 17 aa, Mycobacterium
FDELFIAAGADGVRQAV

SEQ ID NO: 658182 - protein, 20 aa, Mycobacterium
FDELRLLAELSSRSTTLTEH

SEQ ID NO: 658183 - protein, 23 aa, Mycobacterium
FDELYAAGATAIFPPGTVIADAA

SEQ ID NO: 658184 - protein, 20 aa, Mycobacterium
FDENYSWVMSPRWFDGKDHL

SEQ ID NO: 658185 - protein, 23 aa, Mycobacterium
FDEQANIRWARELEQAGVHVVYG

SEQ ID NO: 658186 - protein, 25 aa, Mycobacterium
FDESYTRWGPIQWMAPETLLTLGAH

SEQ ID NO: 658187 - protein, 23 aa, Mycobacterium
FDEVFARMWEFYLAYSEAGFRSG

SEQ ID NO: 658188 - protein, 17 aa, Mycobacterium
FDEVIARLVELAYTRVD

SEQ ID NO: 658189 - protein, 17 aa, Mycobacterium
FDEVLALGGEVRCTPAS

SEQ ID NO: 658190 - protein, 23 aa, Mycobacterium
FDEVPASAWARLDSSLPAPRHVV

SEQ ID NO: 658191 - protein, 19 aa, Mycobacterium
FDEVPVRNPGLLAFVPIID

SEQ ID NO: 658192 - protein, 17 aa, Mycobacterium
FDEYSRVDWQVIAVDTR

SEQ ID NO: 658193 - protein, 26 aa, Mycobacterium
FDFAVPRPLSALLRLAPGAQIAARGA

SEQ ID NO: 658194 - protein, 18 aa, Mycobacterium
FDFESGLSVARRAALGPI

SEQ ID NO: 658195 - protein, 29 aa, Mycobacterium
FDFFRTLRSRGVVGYDRCFMAQKGESKVV

SEQ ID NO: 658196 - protein, 26 aa, Mycobacterium
FDFGRPEVRNFLVANALFWLDQFHID

SEQ ID NO: 658197 - protein, 28 aa, Mycobacterium
FDFGRPEVRNFLVANALYWIEQFHIDGL

SEQ ID NO: 658198 - protein, 19 aa, Mycobacterium
FDFPVSRRVQPESMTFTGL

SEQ ID NO: 658199 - protein, 25 aa, Mycobacterium
FDFRGTDTTIAWKGDEVIELTSSTE

SEQ ID NO: 658200 - protein, 20 aa, Mycobacterium
FDFRHLVGVVSVMGDKDVDG

SEQ ID NO: 658201 - protein, 20 aa, Mycobacterium
FDFRSLVGVIAVMADKDVNG

SEQ ID NO: 658202 - protein, 18 aa, Mycobacterium
FDFRVCGVEPGVPLRTTV

SEQ ID NO: 658203 - protein, 24 aa, Mycobacterium
FDFRVMTPTAWWRVPMQSLVGGLA

SEQ ID NO: 658204 - protein, 17 aa, Mycobacterium
FDFTFAGLPAYLQKQGR

SEQ ID NO: 658205 - protein, 17 aa, Mycobacterium
FDFYFADSAAFHQNVAE

SEQ ID NO: 658206 - protein, 17 aa, Mycobacterium
FDGAALRHVLTETARRD

SEQ ID NO: 658207 - protein, 18 aa, Mycobacterium
FDGADSFAGPSFHSAAWD

SEQ ID NO: 658208 - protein, 18 aa, Mycobacterium
FDGADTFEGPSFHSAAWD

SEQ ID NO: 658209 - protein, 18 aa, Mycobacterium
FDGAGLPVAVQLVGRPYD

SEQ ID NO: 658210 - protein, 20 aa, Mycobacterium
FDGARFRDATALTITDIETG

SEQ ID NO: 658211 - protein, 23 aa, Mycobacterium
FDGARFRDATALVMTDVKTGLQQ

SEQ ID NO: 658212 - protein, 18 aa, Mycobacterium
FDGDDPWPAAAFNRELAS

SEQ ID NO: 658213 - protein, 23 aa, Mycobacterium
FDGDDPWPAVAFERELASARNHY

SEQ ID NO: 658214 - protein, 18 aa, Mycobacterium
FDGDGLFDDMMWDADGDG

SEQ ID NO: 658215 - protein, 20 aa, Mycobacterium
FDGDGMVHVVGFRDGKSFYR

SEQ ID NO: 658216 - protein, 23 aa, Mycobacterium
FDGDGRSSVFFDYPPHPRTIAHT

SEQ ID NO: 658217 - protein, 18 aa, Mycobacterium
FDGDLALVEALLAAADAV

SEQ ID NO: 658218 - protein, 18 aa, Mycobacterium
FDGDTPVERVLRVAERLM

SEQ ID NO: 658219 - protein, 26 aa, Mycobacterium
FDGGPWGRLGPEGRAGCLNQLGEALL

SEQ ID NO: 658220 - protein, 21 aa, Mycobacterium
FDGGTLPPMFVDLINAPTRRQ

SEQ ID NO: 658221 - protein, 25 aa, Mycobacterium
FDGHIERFENFHGFEVAGQPPAGGV

SEQ ID NO: 658222 - protein, 22 aa, Mycobacterium
FDGHLRPGGVVDIQEMSPKVRR

SEQ ID NO: 658223 - protein, 22 aa, Mycobacterium
FDGHRIRSGRLLIFSAYVTHRL

SEQ ID NO: 658224 - protein, 17 aa, Mycobacterium
FDGIWLPEHCGTPYGMT

SEQ ID NO: 658225 - protein, 18 aa, Mycobacterium
FDGIWLPEHCGTPYGMTP

SEQ ID NO: 658226 - protein, 25 aa, Mycobacterium
FDGKKAVVFDDRWASAREDLARLWI

SEQ ID NO: 658227 - protein, 25 aa, Mycobacterium
FDGKKAVVFDDRWASAREDLVKLWL

SEQ ID NO: 658228 - protein, 17 aa, Mycobacterium
FDGMVAWQTCINPPGPR

SEQ ID NO: 658229 - protein, 24 aa, Mycobacterium
FDGPELPGPLSTVSPWLDQTIRPI

SEQ ID NO: 658230 - protein, 23 aa, Mycobacterium
FDGPEVVKTLMLTLFDSAFTAGT

SEQ ID NO: 658231 - protein, 17 aa, Mycobacterium
FDGQCRNMGNHKGEGQW

SEQ ID NO: 658232 - protein, 18 aa, Mycobacterium
FDGQPAWSGKPEVAAAAE

SEQ ID NO: 658233 - protein, 17 aa, Mycobacterium
FDGQPSWSSKPEVAATA

SEQ ID NO: 658234 - protein, 25 aa, Mycobacterium
FDGRAKKALELTFRHALRLGHNYIG

SEQ ID NO: 658235 - protein, 20 aa, Mycobacterium
FDGRFARLLGADAWASDART

SEQ ID NO: 658236 - protein, 18 aa, Mycobacterium
FDGRIHRVIVDVSGEHVE

SEQ ID NO: 658237 - protein, 31 aa, Mycobacterium
FDGRIKVAMDEFVRWTTPVMTFRRTATQDTE

SEQ ID NO: 658238 - protein, 19 aa, Mycobacterium
FDGRPQLGGYSLWTASDTP

SEQ ID NO: 658239 - protein, 18 aa, Mycobacterium
FDGRRLRADLPRILELLA

SEQ ID NO: 658240 - protein, 30 aa, Mycobacterium
FDGRSGEPFPYPVTVGYMYILKLHHLVDDK

SEQ ID NO: 658241 - protein, 31 aa, Mycobacterium
FDGRSGEPFPYPVTVGYMYIMKLHHLVDDKI

SEQ ID NO: 658242 - protein, 22 aa, Mycobacterium
FDGSDTVTLVWLGQRRIPGIDS

SEQ ID NO: 658243 - protein, 24 aa, Mycobacterium
FDGTDSVMLVWLGQRRIPGIESGR

SEQ ID NO: 658244 - protein, 17 aa, Mycobacterium
FDGTDTVVLVWLGQRRI

SEQ ID NO: 658245 - protein, 18 aa, Mycobacterium
FDGTPWADRVQLIDAKYA

SEQ ID NO: 658246 - protein, 18 aa, Mycobacterium
FDGVDAWPSAIAANAAGE

SEQ ID NO: 658247 - protein, 18 aa, Mycobacterium
FDGVDAWPSIIAANAAGE

SEQ ID NO: 658248 - protein, 18 aa, Mycobacterium
FDGVEIHAANGYLLDQFL

SEQ ID NO: 658249 - protein, 21 aa, Mycobacterium
FDGVGSLLGRGDFMGVAGAEA

SEQ ID NO: 658250 - protein, 29 aa, Mycobacterium
FDGVTCSLALHYLRDWQVPLASFARILRP

SEQ ID NO: 658251 - protein, 17 aa, Mycobacterium
FDGYRFEIAGSVQFPTS

SEQ ID NO: 658252 - protein, 20 aa, Mycobacterium
FDHDLPWRKEQQPIVDQDWS

SEQ ID NO: 658253 - protein, 18 aa, Mycobacterium
FDHFKRVDGSTLFGIMNG

SEQ ID NO: 658254 - protein, 17 aa, Mycobacterium
FDHGKALALYHSKRLAC

SEQ ID NO: 658255 - protein, 21 aa, Mycobacterium
FDHGPWPLLDPHERMSKIEQL

SEQ ID NO: 658256 - protein, 19 aa, Mycobacterium
FDHNSYDPAASHTPVQSDP

SEQ ID NO: 658257 - protein, 17 aa, Mycobacterium
FDHRAVVVGADRDQLLA

SEQ ID NO: 658258 - protein, 19 aa, Mycobacterium
FDHVEVWWNRPVMSCAETG

SEQ ID NO: 658259 - protein, 24 aa, Mycobacterium
FDHVFYISVWWGWQDHFREIVNVD

SEQ ID NO: 658260 - protein, 25 aa, Mycobacterium
FDHVQVRWGSPMAGCREDADGVTVE

SEQ ID NO: 658261 - protein, 19 aa, Mycobacterium
FDIAALLAEAVDQAGVGDD

SEQ ID NO: 658262 - protein, 17 aa, Mycobacterium
FDIAGWRHRVLLIDAKY

SEQ ID NO: 658263 - protein, 23 aa, Mycobacterium
FDIAKLRYHKIVLMADADVDGQH

SEQ ID NO: 658264 - protein, 23 aa, Mycobacterium
FDIARLRYHKIVLMADADVDGQH

SEQ ID NO: 658265 - protein, 21 aa, Mycobacterium
FDIAVAASFSPTGPRGAGRHG

SEQ ID NO: 658266 - protein, 18 aa, Mycobacterium
FDICRPRQAHIAFAGGIH

SEQ ID NO: 658267 - protein, 17 aa, Mycobacterium
FDIDRHGGLSGLEARVD

SEQ ID NO: 658268 - protein, 17 aa, Mycobacterium
FDIESLPEWSSVHQKVE

SEQ ID NO: 658269 - protein, 37 aa, Mycobacterium
FDIFMWEIFGPLVAGARLVFNPGEWDPHSIVQRVRQS

SEQ ID NO: 658270 - protein, 19 aa, Mycobacterium
FDIFRERIPHISFAAGEHT

SEQ ID NO: 658271 - protein, 27 aa, Mycobacterium
FDIFRQARAHLGWGHGVHVCLGMHLAR

SEQ ID NO: 658272 - protein, 18 aa, Mycobacterium
FDIFTLVPPPAGVGLGRI

SEQ ID NO: 658273 - protein, 19 aa, Mycobacterium
FDIIKDFGAIMPMRVISAL

SEQ ID NO: 658274 - protein, 29 aa, Mycobacterium
FDILAALSSRPAVVFSRRQLLEAVWGDSW

SEQ ID NO: 658275 - protein, 25 aa, Mycobacterium
FDINGRRALSFLIYKNDPTACAIDV

SEQ ID NO: 658276 - protein, 20 aa, Mycobacterium
FDIPESVIGFLRGELGDPPG

SEQ ID NO: 658277 - protein, 25 aa, Mycobacterium
FDIRRPPEEWLFKAAFSVDGPVLID

SEQ ID NO: 658278 - protein, 23 aa, Mycobacterium
FDITRARGAAVMFGAGIHYCLGA

SEQ ID NO: 658279 - protein, 18 aa, Mycobacterium
FDIWSYIGAEQIKLPSIY

SEQ ID NO: 658280 - protein, 23 aa, Mycobacterium
FDKAAGCGADLVFLDLEDATPAA

SEQ ID NO: 658281 - protein, 38 aa, Mycobacterium
FDKARLNRLLEFVVRQEPRLSWAIGDRADGTTVLVTDL

SEQ ID NO: 658282 - protein, 24 aa, Mycobacterium
FDKDRDGFVFGEAGALLLIETEEH

SEQ ID NO: 658283 - protein, 17 aa, Mycobacterium
FDKDRDGFVFGEAGALM

SEQ ID NO: 658284 - protein, 18 aa, Mycobacterium
FDKDRDGFVFGEAGAMML

SEQ ID NO: 658285 - protein, 22 aa, Mycobacterium
FDKGVTCGADLVFLDLEDATPV

SEQ ID NO: 658286 - protein, 18 aa, Mycobacterium
FDKGVVRIHIVWRGDSAI

SEQ ID NO: 658287 - protein, 29 aa, Mycobacterium
FDKHSWLSAWADFYLRAATEWKEAQRDPA

SEQ ID NO: 658288 - protein, 20 aa, Mycobacterium
FDKKELRKLLSDGQLPGRQP

SEQ ID NO: 658289 - protein, 22 aa, Mycobacterium
FDKPVVYWLVALPLDREKGSWD

SEQ ID NO: 658290 - protein, 19 aa, Mycobacterium
FDKPYLLAMANAGPGTNGS

SEQ ID NO: 658291 - protein, 25 aa, Mycobacterium
FDLAARKRLPVVLFAEGGGGRPGDT

SEQ ID NO: 658292 - protein, 22 aa, Mycobacterium
FDLAFRCVQLLQARGAVGTASA

SEQ ID NO: 658293 - protein, 29 aa, Mycobacterium
FDLALERELWRWVPAEVSLHLARTPYEPV

SEQ ID NO: 658294 - protein, 17 aa, Mycobacterium
FDLARYKIGVTVVVPGA

SEQ ID NO: 658295 - protein, 20 aa, Mycobacterium
FDLATGRRARRGRSALAALA

SEQ ID NO: 658296 - protein, 17 aa, Mycobacterium
FDLAWALADLHLAALDD

SEQ ID NO: 658297 - protein, 18 aa, Mycobacterium
FDLAWALTDLHLSALQDE

SEQ ID NO: 658298 - protein, 17 aa, Mycobacterium
FDLCAMVGHPEWIDEDS

SEQ ID NO: 658299 - protein, 17 aa, Mycobacterium
FDLCAMVGHPEWIDEQS

SEQ ID NO: 658300 - protein, 23 aa, Mycobacterium
FDLDERALAIGLRVLVNIIEQAA

SEQ ID NO: 658301 - protein, 24 aa, Mycobacterium
FDLDERALAIGLRVMVNIVEQSAA

SEQ ID NO: 658302 - protein, 17 aa, Mycobacterium
FDLDFTELVFLGDRADV

SEQ ID NO: 658303 - protein, 21 aa, Mycobacterium
FDLDRIGEWAGRITSFPADWS

SEQ ID NO: 658304 - protein, 17 aa, Mycobacterium
FDLDRLKAINDYLGHTA

SEQ ID NO: 658305 - protein, 22 aa, Mycobacterium
FDLDVPVFGICYGFQAMAQALG

SEQ ID NO: 658306 - protein, 25 aa, Mycobacterium
FDLDVPVFGICYGFQAMAQVLGGTV

SEQ ID NO: 658307 - protein, 18 aa, Mycobacterium
FDLDWHLHRVSAPQPRTF

SEQ ID NO: 658308 - protein, 20 aa, Mycobacterium
FDLEGCAAVAMAEIDAPITH

SEQ ID NO: 658309 - protein, 26 aa, Mycobacterium
FDLENQWPIRVAVLSIPGEHALSVVV

SEQ ID NO: 658310 - protein, 21 aa, Mycobacterium
FDLEPGYVPEITWPSATCTLT

SEQ ID NO: 658311 - protein, 27 aa, Mycobacterium
FDLFGRRWAILVVWELRSGTKTLPELK

SEQ ID NO: 658312 - protein, 20 aa, Mycobacterium
FDLGELVARLHALLRRAHHS

SEQ ID NO: 658313 - protein, 29 aa, Mycobacterium
FDLGELVARLRALLRRRGAGSGGLADSAI

SEQ ID NO: 658314 - protein, 21 aa, Mycobacterium
FDLGRGPAMRFLLLETGQQRW

SEQ ID NO: 658315 - protein, 22 aa, Mycobacterium
FDLGVPVFGICYGFQAMAQALG

SEQ ID NO: 658316 - protein, 23 aa, Mycobacterium
FDLIERMKLPTVFFAEGGGGRPG

SEQ ID NO: 658317 - protein, 20 aa, Mycobacterium
FDLIHRLWLDLGHDVQYVQN

SEQ ID NO: 658318 - protein, 23 aa, Mycobacterium
FDLIHRLWLDLGHEVRYVQNVTD

SEQ ID NO: 658319 - protein, 17 aa, Mycobacterium
FDLKPSLVIEFGSRYGG

SEQ ID NO: 658320 - protein, 22 aa, Mycobacterium
FDLKRGEILAVVGESGSGKSVT

SEQ ID NO: 658321 - protein, 20 aa, Mycobacterium
FDLKSGILAARATLEAARER

SEQ ID NO: 658322 - protein, 19 aa, Mycobacterium
FDLLMLVAPILRKLADSDT

SEQ ID NO: 658323 - protein, 25 aa, Mycobacterium
FDLPAPQANFVWLPLGARTRDFFER

SEQ ID NO: 658324 - protein, 19 aa, Mycobacterium
FDLRGRRFAPFYVADVEGA

SEQ ID NO: 658325 - protein, 21 aa, Mycobacterium
FDLRRGGHVGFGLGLHRCLGA

SEQ ID NO: 658326 - protein, 23 aa, Mycobacterium
FDLRRHLMLSARVRSIRWDEDTW

SEQ ID NO: 658327 - protein, 19 aa, Mycobacterium
FDLSGKRVRAVTVSVGAAV

SEQ ID NO: 658328 - protein, 23 aa, Mycobacterium
FDLTFCAPKSVSLIRALRAGDVA

SEQ ID NO: 658329 - protein, 23 aa, Mycobacterium
FDLTFCAPKSVSLVRALRANEVA

SEQ ID NO: 658330 - protein, 25 aa, Mycobacterium
FDLTKVWPHRDYPLIDVGKLTLDRN

SEQ ID NO: 658331 - protein, 25 aa, Mycobacterium
FDLTNELPLRITVIRTRADELVLLL

SEQ ID NO: 658332 - protein, 25 aa, Mycobacterium
FDLTRELPLRISLIRTGADEFVLLL

SEQ ID NO: 658333 - protein, 26 aa, Mycobacterium
FDLTVDLVAPVPGFLVKRGAKTLMDT

SEQ ID NO: 658334 - protein, 18 aa, Mycobacterium
FDLVLFAQSFHWVEPTTA

SEQ ID NO: 658335 - protein, 27 aa, Mycobacterium
FDLYSTHPWVLLAYAVPRNGMQPETLV

SEQ ID NO: 658336 - protein, 17 aa, Mycobacterium
FDMDPSRPILHGLLGDI

SEQ ID NO: 658337 - protein, 21 aa, Mycobacterium
FDMPSELIGGGTAEIQLTVIA

SEQ ID NO: 658338 - protein, 19 aa, Mycobacterium
FDMSGCVGCGRCIAWCPTG

SEQ ID NO: 658339 - protein, 17 aa, Mycobacterium
FDMSRPAAWSAEGFLPF

SEQ ID NO: 658340 - protein, 26 aa, Mycobacterium
FDMVLGETVVRGRIDAVFAEPDGTTM

SEQ ID NO: 658341 - protein, 18 aa, Mycobacterium
FDNARAGDRIFFDDGKIS

SEQ ID NO: 658342 - protein, 27 aa, Mycobacterium
FDNARRNAPCVLFFDEVDALGHRRSAL

SEQ ID NO: 658343 - protein, 20 aa, Mycobacterium
FDNDAGWRIDYHLATADLGR

SEQ ID NO: 658344 - protein, 24 aa, Mycobacterium
FDNDAGWRIDYHLATPGLAARATS

SEQ ID NO: 658345 - protein, 20 aa, Mycobacterium
FDNDAGWRIDYHLVTPGLAG

SEQ ID NO: 658346 - protein, 19 aa, Mycobacterium
FDNELIPIAGLATDEIIRP

SEQ ID NO: 658347 - protein, 20 aa, Mycobacterium
FDNFCDILLRVADARAQVSS

SEQ ID NO: 658348 - protein, 23 aa, Mycobacterium
FDNGALAPHAWRRKPMSVDAILS

SEQ ID NO: 658349 - protein, 23 aa, Mycobacterium
FDNGDFRWAATLLDHAVFADSGH

SEQ ID NO: 658350 - protein, 20 aa, Mycobacterium
FDNGRLVGVASMYQWEDAPI

SEQ ID NO: 658351 - protein, 27 aa, Mycobacterium
FDNLNWWLGEWSWVFDKYSTMFVQWTA

SEQ ID NO: 658352 - protein, 23 aa, Mycobacterium
FDNLRRGGIQFADTRGYAYDRRD

SEQ ID NO: 658353 - protein, 20 aa, Mycobacterium
FDNPLVRCINFIGSVPTGRM

SEQ ID NO: 658354 - protein, 17 aa, Mycobacterium
FDPAIFGGHLAEQTPAE

SEQ ID NO: 658355 - protein, 17 aa, Mycobacterium
FDPAQAVIPEPQPIDDD

SEQ ID NO: 658356 - protein, 19 aa, Mycobacterium
FDPARRWPVAADFGVAHIL

SEQ ID NO: 658357 - protein, 21 aa, Mycobacterium
FDPATGLGWAGGYVGHGVTAT

SEQ ID NO: 658358 - protein, 29 aa, Mycobacterium
FDPDAADATVLWCCAIRHAVHTTELDVRI

SEQ ID NO: 658359 - protein, 20 aa, Mycobacterium
FDPDKGPSFIGFAVPTMMGE

SEQ ID NO: 658360 - protein, 22 aa, Mycobacterium
FDPDLPTAWLAEALISHLPGPS

SEQ ID NO: 658361 - protein, 17 aa, Mycobacterium
FDPEKGASFLGFAVPTM

SEQ ID NO: 658362 - protein, 19 aa, Mycobacterium
FDPEKKFEVRDEVIAHTRK

SEQ ID NO: 658363 - protein, 24 aa, Mycobacterium
FDPELQLWVAACMCKGAADVHRIF

SEQ ID NO: 658364 - protein, 27 aa, Mycobacterium
FDPEPRARLIFNFPKPATLARILRDAD

SEQ ID NO: 658365 - protein, 25 aa, Mycobacterium
FDPEPRARLIFNVPRPETMARHLRE

SEQ ID NO: 658366 - protein, 17 aa, Mycobacterium
FDPERFQWWKVLGTLWW

SEQ ID NO: 658367 - protein, 23 aa, Mycobacterium
FDPEVLTIGFARRVPTYKRLTLM

SEQ ID NO: 658368 - protein, 17 aa, Mycobacterium
FDPFVSLSFAAAATTRI

SEQ ID NO: 658369 - protein, 20 aa, Mycobacterium
FDPGAGFGFGPGGPRGRRGH

SEQ ID NO: 658370 - protein, 17 aa, Mycobacterium
FDPGAPFTRSDTQKLRG

SEQ ID NO: 658371 - protein, 24 aa, Mycobacterium
FDPGGRMWLGPDVYLYRDDPVYHR

SEQ ID NO: 658372 - protein, 18 aa, Mycobacterium
FDPGRIDTELGWAQSNGF

SEQ ID NO: 658373 - protein, 19 aa, Mycobacterium
FDPLRGRSAIAEFLGGVTG

SEQ ID NO: 658374 - protein, 25 aa, Mycobacterium
FDPNAGWFSYFSTWGNQFISSGFPI

SEQ ID NO: 658375 - protein, 23 aa, Mycobacterium
FDPNDGWFGYWSTWGNQTIAGGM

SEQ ID NO: 658376 - protein, 19 aa, Mycobacterium
FDPNNRPAFTAFRDDVKPI

SEQ ID NO: 658377 - protein, 18 aa, Mycobacterium
FDPPARWTAAESVLRRVV

SEQ ID NO: 658378 - protein, 20 aa, Mycobacterium
FDPREEPYCDGSYWVDNLRH

SEQ ID NO: 658379 - protein, 21 aa, Mycobacterium
FDPRERPRCDARYWVDNLRHA

SEQ ID NO: 658380 - protein, 25 aa, Mycobacterium
FDPRERPTCDAAYWVDNLRNTVQFA

SEQ ID NO: 658381 - protein, 25 aa, Mycobacterium
FDPRRIDTELGWAQFYGHNTARVFL

SEQ ID NO: 658382 - protein, 20 aa, Mycobacterium
FDPRTGRFVLILEDLADASA

SEQ ID NO: 658383 - protein, 21 aa, Mycobacterium
FDPRVADAFLRDADAILAGPP

SEQ ID NO: 658384 - protein, 17 aa, Mycobacterium
FDPSQAVIPDPQPIDDG

SEQ ID NO: 658385 - protein, 18 aa, Mycobacterium
FDPSQAVIPEPAPVDNPP

SEQ ID NO: 658386 - protein, 17 aa, Mycobacterium
FDPSSPVLARCRAIEHT

SEQ ID NO: 658387 - protein, 18 aa, Mycobacterium
FDPSSRGWLKTTYQQGDI

SEQ ID NO: 658388 - protein, 18 aa, Mycobacterium
FDPSSRGWLKTTYQRGDI

SEQ ID NO: 658389 - protein, 23 aa, Mycobacterium
FDPTQRLLWCTNTYHTGYYHANA

SEQ ID NO: 658390 - protein, 23 aa, Mycobacterium
FDPTRAMPAYNWMTVAKSALESV

SEQ ID NO: 658391 - protein, 19 aa, Mycobacterium
FDPYFPRIDLRHALRGARG

SEQ ID NO: 658392 - protein, 25 aa, Mycobacterium
FDQARRIAADIGYPVLVRPSYVLGG

SEQ ID NO: 658393 - protein, 25 aa, Mycobacterium
FDQARRIAAEIGYPVLVRPSYVLGG

SEQ ID NO: 658394 - protein, 17 aa, Mycobacterium
FDQEHRKPYGVDFVHNT

SEQ ID NO: 658395 - protein, 23 aa, Mycobacterium
FDQVWKRFFPVPPPRTTVGVGAE

SEQ ID NO: 658396 - protein, 24 aa, Mycobacterium
FDRAARLGVHVSLAPFQYYYWGDL

SEQ ID NO: 658397 - protein, 17 aa, Mycobacterium
FDRARKGLFEEGISTSR

SEQ ID NO: 658398 - protein, 17 aa, Mycobacterium
FDRARRAFTEACGAAQA

SEQ ID NO: 658399 - protein, 17 aa, Mycobacterium
FDRCHASVLSPRPARVG

SEQ ID NO: 658400 - protein, 28 aa, Mycobacterium
FDRDRGGTHLAFGFGMHRCLGAFLAPVE

SEQ ID NO: 658401 - protein, 25 aa, Mycobacterium
FDRFPTLRIVFVEHAFTWILPLMWR

SEQ ID NO: 658402 - protein, 38 aa, Mycobacterium
FDRFPTLRIVLVEHAFTWILPLMWRMDALYDARKSRMD

SEQ ID NO: 658403 - protein, 17 aa, Mycobacterium
FDRHFKLQADGAIYSGL

SEQ ID NO: 658404 - protein, 31 aa, Mycobacterium
FDRHPRLRVAFLEAGVGWVPFFVDRLHEHYE

SEQ ID NO: 658405 - protein, 20 aa, Mycobacterium
FDRIDYRGAAEPNLEVLQDL

SEQ ID NO: 658406 - protein, 17 aa, Mycobacterium
FDRLAGRLSYLHGDVTD

SEQ ID NO: 658407 - protein, 21 aa, Mycobacterium
FDRLATPFGLVRTGVAPDHQH

SEQ ID NO: 658408 - protein, 17 aa, Mycobacterium
FDRLDIDGACSTNDTVL

SEQ ID NO: 658409 - protein, 20 aa, Mycobacterium
FDRLEPVHAVTYFSGESRSA

SEQ ID NO: 658410 - protein, 22 aa, Mycobacterium
FDRLKAELDQLIANRPVIAAEI

SEQ ID NO: 658411 - protein, 18 aa, Mycobacterium
FDRLRLIQRITDRLPEKA

SEQ ID NO: 658412 - protein, 21 aa, Mycobacterium
FDRLRQLAAIKNATARQTKTI

SEQ ID NO: 658413 - protein, 21 aa, Mycobacterium
FDRLRRLAAIKDETARQTKTI

SEQ ID NO: 658414 - protein, 19 aa, Mycobacterium
FDRLSGWATDRAMVAACPL

SEQ ID NO: 658415 - protein, 18 aa, Mycobacterium
FDRPEVRNAFRPHTVDEL

SEQ ID NO: 658416 - protein, 19 aa, Mycobacterium
FDRPILHGLCTYGIGCKAI

SEQ ID NO: 658417 - protein, 24 aa, Mycobacterium
FDRPSFKTCVAHGIVLGSDGQKMS

SEQ ID NO: 658418 - protein, 17 aa, Mycobacterium
FDRQWPLRVGDIDRTGR

SEQ ID NO: 658419 - protein, 20 aa, Mycobacterium
FDRRCAYPHGGHMINLHIAA

SEQ ID NO: 658420 - protein, 21 aa, Mycobacterium
FDRRGLRIGGLDAQLAELLSD

SEQ ID NO: 658421 - protein, 21 aa, Mycobacterium
FDRSRPSVLMMHGGGQNRFSW

SEQ ID NO: 658422 - protein, 21 aa, Mycobacterium
FDRSSPAVLYRATPQTFTDRS

SEQ ID NO: 658423 - protein, 21 aa, Mycobacterium
FDRVIGINLRGAWLCTKHAAP

SEQ ID NO: 658424 - protein, 18 aa, Mycobacterium
FDRVIRLSMENVKHPSEQ

SEQ ID NO: 658425 - protein, 18 aa, Mycobacterium
FDRVLRFAGQRVAAVVAD

SEQ ID NO: 658426 - protein, 22 aa, Mycobacterium
FDSAASALCYQIGCRIFALSEL

SEQ ID NO: 658427 - protein, 28 aa, Mycobacterium
FDSAVTYRPGARFGPNAIRQASRLVRGY

SEQ ID NO: 658428 - protein, 27 aa, Mycobacterium
FDSCGGCDRCRSGIPTQCREFVNRNFT

SEQ ID NO: 658429 - protein, 22 aa, Mycobacterium
FDSEAAGLMWAHYLGERAGSES

SEQ ID NO: 658430 - protein, 28 aa, Mycobacterium
FDSEAYFGGKGCGFVALQQLAIEHLMGA

SEQ ID NO: 658431 - protein, 17 aa, Mycobacterium
FDSGIEFGVQTTGCGQW

SEQ ID NO: 658432 - protein, 23 aa, Mycobacterium
FDSGTGWPSFWQPLPHAVSERPD

SEQ ID NO: 658433 - protein, 24 aa, Mycobacterium
FDSIERILGCGVRDNCDPELCRYD

SEQ ID NO: 658434 - protein, 25 aa, Mycobacterium
FDSILGRLPFDVSLEGQDTIVVGPH

SEQ ID NO: 658435 - protein, 19 aa, Mycobacterium
FDSILGRLPQDVSLEGDDT

SEQ ID NO: 658436 - protein, 18 aa, Mycobacterium
FDSLIGWERYRASQFGIA

SEQ ID NO: 658437 - protein, 18 aa, Mycobacterium
FDSLLGFTAFKLSGSKAQ

SEQ ID NO: 658438 - protein, 18 aa, Mycobacterium
FDSNIAFQAAKELILEGK

SEQ ID NO: 658439 - protein, 24 aa, Mycobacterium
FDSPGADVLFAFTGTAANTIALAS

SEQ ID NO: 658440 - protein, 17 aa, Mycobacterium
FDSPISPFGSWAELTQL

SEQ ID NO: 658441 - protein, 17 aa, Mycobacterium
FDSQLGFAVRAHCAPAL

SEQ ID NO: 658442 - protein, 17 aa, Mycobacterium
FDSRGPFGAGMTTAIAN

SEQ ID NO: 658443 - protein, 25 aa, Mycobacterium
FDSYEPRSGRVWARLPRANSTDIDR

SEQ ID NO: 658444 - protein, 20 aa, Mycobacterium
FDSYVGWSIARIGRDRGVDA

SEQ ID NO: 658445 - protein, 26 aa, Mycobacterium
FDTACSSGLMAVHLACRSLHDGESDL

SEQ ID NO: 658446 - protein, 17 aa, Mycobacterium
FDTAIGSCAIAWSDRGI

SEQ ID NO: 658447 - protein, 18 aa, Mycobacterium
FDTFKPLGPCLVTADEFS

SEQ ID NO: 658448 - protein, 17 aa, Mycobacterium
FDTGAFITGNMANGVFW

SEQ ID NO: 658449 - protein, 22 aa, Mycobacterium
FDTGFRDAWAAGYRNLKPATDY

SEQ ID NO: 658450 - protein, 27 aa, Mycobacterium
FDTGVSYRPGARFGPTHVRESSRLLRP

SEQ ID NO: 658451 - protein, 17 aa, Mycobacterium
FDTLLVYENFPPGGLVG

SEQ ID NO: 658452 - protein, 17 aa, Mycobacterium
FDTLRFDLNVVAAGDEH

SEQ ID NO: 658453 - protein, 26 aa, Mycobacterium
FDTPFPYWKRFAGYEGGVADPLIVSW

SEQ ID NO: 658454 - protein, 19 aa, Mycobacterium
FDTPLAESGIIGFAVGMAM

SEQ ID NO: 658455 - protein, 19 aa, Mycobacterium
FDTQLGFAVRAHCAPVLGL

SEQ ID NO: 658456 - protein, 22 aa, Mycobacterium
FDTRRAAARFGWTLPEDTELTG

SEQ ID NO: 658457 - protein, 24 aa, Mycobacterium
FDTTRSALDMALRGVPRRYPRMRV

SEQ ID NO: 658458 - protein, 22 aa, Mycobacterium
FDTVDRLACVAGLAPVPRDSGR

SEQ ID NO: 658459 - protein, 17 aa, Mycobacterium
FDTVGPFGFIGGINRGR

SEQ ID NO: 658460 - protein, 17 aa, Mycobacterium
FDTVIRNGRWFDGTGAP

SEQ ID NO: 658461 - protein, 23 aa, Mycobacterium
FDTVVDCAFYHTFGTAPELQRSY

SEQ ID NO: 658462 - protein, 20 aa, Mycobacterium
FDTVVDCAFYHTFSTAPELQ

SEQ ID NO: 658463 - protein, 19 aa, Mycobacterium
FDTVVDCAFYHTFSTEPEL

SEQ ID NO: 658464 - protein, 20 aa, Mycobacterium
FDTYPGVWRHGDWITLTDRG

SEQ ID NO: 658465 - protein, 19 aa, Mycobacterium
FDVAACRDIGLDHAFAQPV

SEQ ID NO: 658466 - protein, 21 aa, Mycobacterium
FDVAAGLPWPARYPSRVLAND

SEQ ID NO: 658467 - protein, 19 aa, Mycobacterium
FDVADRLAIINLFGAYAYT

SEQ ID NO: 658468 - protein, 23 aa, Mycobacterium
FDVAKGLPWPARFPSRVLANEFV

SEQ ID NO: 658469 - protein, 17 aa, Mycobacterium
FDVCPVRIDIPSMLVHL

SEQ ID NO: 658470 - protein, 17 aa, Mycobacterium
FDVCTSTIWARRVLAGG

SEQ ID NO: 658471 - protein, 23 aa, Mycobacterium
FDVDPRAAVSPLLPAPLIQDRRT

SEQ ID NO: 658472 - protein, 17 aa, Mycobacterium
FDVFDSFGTYFLTVDPR

SEQ ID NO: 658473 - protein, 17 aa, Mycobacterium
FDVGRGEVLGLLGPNGA

SEQ ID NO: 658474 - protein, 17 aa, Mycobacterium
FDVKRVEDVIGEADIII

SEQ ID NO: 658475 - protein, 19 aa, Mycobacterium
FDVLAGFIADEMEYVSRSD

SEQ ID NO: 658476 - protein, 20 aa, Mycobacterium
FDVLDIRRPDDFPDFVDVDV

SEQ ID NO: 658477 - protein, 20 aa, Mycobacterium
FDVLMKHIPPPSGDPEAPLQ

SEQ ID NO: 658478 - protein, 17 aa, Mycobacterium
FDVLRRHSQSLNIKLAD

SEQ ID NO: 658479 - protein, 17 aa, Mycobacterium
FDVNLWAPLMWTSLVVK

SEQ ID NO: 658480 - protein, 27 aa, Mycobacterium
FDVRIWLDPVCPFSWNTARWLDAVAIG

SEQ ID NO: 658481 - protein, 24 aa, Mycobacterium
FDVRRGRAALRYLSQARHIGKVVM

SEQ ID NO: 658482 - protein, 26 aa, Mycobacterium
FDVRSAVIPVARWQYDIVASGGGCRV

SEQ ID NO: 658483 - protein, 17 aa, Mycobacterium
FDVSEPAALMVPTSVQR

SEQ ID NO: 658484 - protein, 19 aa, Mycobacterium
FDVSTHWTRVSGSIDTPLV

SEQ ID NO: 658485 - protein, 23 aa, Mycobacterium
FDVTGEAPDSVFYSTGDAEELLW

SEQ ID NO: 658486 - protein, 21 aa, Mycobacterium
FDVVRRSAPFTSLPRSAFDAV

SEQ ID NO: 658487 - protein, 30 aa, Mycobacterium
FDVYRAVGGPEWLRRAVMAVIWTGTVPFAT

SEQ ID NO: 658488 - protein, 22 aa, Mycobacterium
FDVYRSRFGKLLAAGLDSRSAK

SEQ ID NO: 658489 - protein, 22 aa, Mycobacterium
FDWPEIDERSAAAMCYTSGTTG

SEQ ID NO: 658490 - protein, 24 aa, Mycobacterium
FDYAEGRLGWRTLDFELEVLETGD

SEQ ID NO: 658491 - protein, 24 aa, Mycobacterium
FDYAEGRLGWRTLDFEVEVLDTGD

SEQ ID NO: 658492 - protein, 30 aa, Mycobacterium
FDYALVCADGDWRRADIPARSAEFSQPLLA

SEQ ID NO: 658493 - protein, 25 aa, Mycobacterium
FDYALVCGAGDWRRVGLPARSAQFS

SEQ ID NO: 658494 - protein, 17 aa, Mycobacterium
FDYKPSRTEDIDGVWAS

SEQ ID NO: 658495 - protein, 17 aa, Mycobacterium
FDYNFPFTLDAITDLLD

SEQ ID NO: 658496 - protein, 19 aa, Mycobacterium
FDYRAVAIAAVDGFLSTFS

SEQ ID NO: 658497 - protein, 23 aa, Mycobacterium
FDYRDPSGLWQRSYINMAAQQER

SEQ ID NO: 658498 - protein, 25 aa, Mycobacterium
FDYSVWEIWAPLLYGARLLIVPDGV

SEQ ID NO: 658499 - protein, 22 aa, Mycobacterium
FDYTSEWKIRSLVKKYSDFIAW

SEQ ID NO: 658500 - protein, 17 aa, Mycobacterium
FEAALLDALSRRRDAEL

SEQ ID NO: 658501 - protein, 25 aa, Mycobacterium
FEAARPRLGALAYRMLGSFEDAQDA

SEQ ID NO: 658502 - protein, 25 aa, Mycobacterium
FEAARPRLGAVAYRMLGSIDDAQDA

SEQ ID NO: 658503 - protein, 28 aa, Mycobacterium
FEAAVPPGRLGWGWAKFAFGSWTTLSWV

SEQ ID NO: 658504 - protein, 19 aa, Mycobacterium
FEADLSKPVAEVMTKAPLI

SEQ ID NO: 658505 - protein, 25 aa, Mycobacterium
FEAFGKSRYKAFFDTTYRVMPDDGR

SEQ ID NO: 658506 - protein, 17 aa, Mycobacterium
FEAFRMERYAAFFERAY

SEQ ID NO: 658507 - protein, 20 aa, Mycobacterium
FEAGDFVARITFRDDRTIAG

SEQ ID NO: 658508 - protein, 38 aa, Mycobacterium
FEAGDWTRLGPLCLFGHCMGAVVAFEFARVAERNGVAV

SEQ ID NO: 658509 - protein, 17 aa, Mycobacterium
FEAGVPMTSQVVGLGAA

SEQ ID NO: 658510 - protein, 18 aa, Mycobacterium
FEALAGFRPAARSVELMT

SEQ ID NO: 658511 - protein, 18 aa, Mycobacterium
FEALAGFRQVSRTVELLR

SEQ ID NO: 658512 - protein, 19 aa, Mycobacterium
FEALEKAFLPSVVPTSTAD

SEQ ID NO: 658513 - protein, 25 aa, Mycobacterium
FEALKRFHHTLGYGLLGRRIERSPL

SEQ ID NO: 658514 - protein, 19 aa, Mycobacterium
FEALLRYMRDSRGFDFTGY

SEQ ID NO: 658515 - protein, 18 aa, Mycobacterium
FEALTGICAHVRAGGGGM

SEQ ID NO: 658516 - protein, 24 aa, Mycobacterium
FEAMTIDCPDEFVGAITQLMAARK

SEQ ID NO: 658517 - protein, 24 aa, Mycobacterium
FEAMTIDCPDEFVGAITQLMAGRK

SEQ ID NO: 658518 - protein, 19 aa, Mycobacterium
FEAPLQFADFAVWQRNTFD

SEQ ID NO: 658519 - protein, 24 aa, Mycobacterium
FEARFRFVEEMMRLGADARTDGHH

SEQ ID NO: 658520 - protein, 19 aa, Mycobacterium
FEARLGMAVDHLVQPATRS

SEQ ID NO: 658521 - protein, 17 aa, Mycobacterium
FEARMRAPREFDRTPPR

SEQ ID NO: 658522 - protein, 18 aa, Mycobacterium
FEATLRLTGRTAMVADAD

SEQ ID NO: 658523 - protein, 26 aa, Mycobacterium
FEAVGACARGLMPREDVDAIERAICP

SEQ ID NO: 658524 - protein, 25 aa, Mycobacterium
FEAVGACVRGLMSREDVDIIERAIC

SEQ ID NO: 658525 - protein, 17 aa, Mycobacterium
FEAVIALMADGVYDTTG

SEQ ID NO: 658526 - protein, 21 aa, Mycobacterium
FEAVRVIGRAVGVDFTLRADQ

SEQ ID NO: 658527 - protein, 18 aa, Mycobacterium
FEAYRCGADVVAFDRDAA

SEQ ID NO: 658528 - protein, 19 aa, Mycobacterium
FEAYRRGADVVAFDRDEDE

SEQ ID NO: 658529 - protein, 21 aa, Mycobacterium
FECDGEPLLVMASGAARVDTD

SEQ ID NO: 658530 - protein, 23 aa, Mycobacterium
FEDAGRCQRGYFVESLGGAQFAV

SEQ ID NO: 658531 - protein, 17 aa, Mycobacterium
FEDGGWIWFDITTDAKS

SEQ ID NO: 658532 - protein, 17 aa, Mycobacterium
FEDGTSLGQVARLDTMV

SEQ ID NO: 658533 - protein, 19 aa, Mycobacterium
FEDHIAWVLQDKFEDPIAH

SEQ ID NO: 658534 - protein, 18 aa, Mycobacterium
FEDLLGPRTKLVAATQVS

SEQ ID NO: 658535 - protein, 23 aa, Mycobacterium
FEDRAGRPARLWRRDVKAGHVTP

SEQ ID NO: 658536 - protein, 18 aa, Mycobacterium
FEDVPYDAAMRLVDVNYK

SEQ ID NO: 658537 - protein, 26 aa, Mycobacterium
FEDWQRWADLNVRYLRKIGYRGTATY

SEQ ID NO: 658538 - protein, 20 aa, Mycobacterium
FEEACAVLTGLLSQETTNFD

SEQ ID NO: 658539 - protein, 21 aa, Mycobacterium
FEEACAVLTSLLSRETTDFDG

SEQ ID NO: 658540 - protein, 21 aa, Mycobacterium
FEEACEVLKGLLTQETTTFDG

SEQ ID NO: 658541 - protein, 19 aa, Mycobacterium
FEEAGRLGLRTVAEAFADR

SEQ ID NO: 658542 - protein, 19 aa, Mycobacterium
FEEAIRIAGGVSIADHRAA

SEQ ID NO: 658543 - protein, 25 aa, Mycobacterium
FEEAPRPPEFLAMLHRSEDAVIAAA

SEQ ID NO: 658544 - protein, 17 aa, Mycobacterium
FEEAWNRQNSERPINDS

SEQ ID NO: 658545 - protein, 17 aa, Mycobacterium
FEEEYFKAGAPARISQN

SEQ ID NO: 658546 - protein, 18 aa, Mycobacterium
FEEFDPFWQACIKAGIPV

SEQ ID NO: 658547 - protein, 19 aa, Mycobacterium
FEEHGVSFTRHYTGSLACV

SEQ ID NO: 658548 - protein, 22 aa, Mycobacterium
FEELAGPFLRKDISACREAAAE

SEQ ID NO: 658549 - protein, 18 aa, Mycobacterium
FEELKKTLTLEVAQHLGD

SEQ ID NO: 658550 - protein, 27 aa, Mycobacterium
FEELLGRFGAVLVGQPVEWTRSNRHTG

SEQ ID NO: 658551 - protein, 27 aa, Mycobacterium
FEELLSRFGAVQVVRPVEWARSNRHTG

SEQ ID NO: 658552 - protein, 27 aa, Mycobacterium
FEELQRQWRFACLFISHDLAVVDRLAD

SEQ ID NO: 658553 - protein, 21 aa, Mycobacterium
FEELRVLSLLPSRTTTLNEDE

SEQ ID NO: 658554 - protein, 19 aa, Mycobacterium
FEESKEWYSLLGVDDSAQP

SEQ ID NO: 658555 - protein, 24 aa, Mycobacterium
FEESKEWYSMWGVDDGPQPDTYDD

SEQ ID NO: 658556 - protein, 18 aa, Mycobacterium
FEESKVWYSLYGVSARNQ

SEQ ID NO: 658557 - protein, 21 aa, Mycobacterium
FEETHPLWIVRRTMIDLIRPV

SEQ ID NO: 658558 - protein, 21 aa, Mycobacterium
FEETHPLWIVRRTMLDLIRPI

SEQ ID NO: 658559 - protein, 24 aa, Mycobacterium
FEEVLKRWTDWEVDYDNASRARTS

SEQ ID NO: 658560 - protein, 24 aa, Mycobacterium
FEEVLTRWPDWEVDYDNAERARTS

SEQ ID NO: 658561 - protein, 24 aa, Mycobacterium
FEEVRAAGLLPSWQETQAFIAGMR

SEQ ID NO: 658562 - protein, 18 aa, Mycobacterium
FEFDAIVFATGFDAVTGA

SEQ ID NO: 658563 - protein, 21 aa, Mycobacterium
FEFERKFFLRELPAVAASDPS

SEQ ID NO: 658564 - protein, 23 aa, Mycobacterium
FEFLDAAACTLEYKTKDTARLAG

SEQ ID NO: 658565 - protein, 17 aa, Mycobacterium
FEFPGYAAGTRGVAEAI

SEQ ID NO: 658566 - protein, 25 aa, Mycobacterium
FEFPTHCPECGTELAPAKEGDADIR

SEQ ID NO: 658567 - protein, 21 aa, Mycobacterium
FEFPTRIISTLLGLPAEDLDL

SEQ ID NO: 658568 - protein, 21 aa, Mycobacterium
FEFPTRIISTLLGLPPEDLDF

SEQ ID NO: 658569 - protein, 22 aa, Mycobacterium
FEFPTRIISTLLGLPRDDLDLF

SEQ ID NO: 658570 - protein, 18 aa, Mycobacterium
FEFRCARCNKPYTDSLPQ

SEQ ID NO: 658571 - protein, 18 aa, Mycobacterium
FEGAGAVSKWTIALKKAH

SEQ ID NO: 658572 - protein, 23 aa, Mycobacterium
FEGDRINRCELFDESDLDTALAR

SEQ ID NO: 658573 - protein, 25 aa, Mycobacterium
FEGELAAVIGRPCKDVPASRAAENI

SEQ ID NO: 658574 - protein, 32 aa, Mycobacterium
FEGELAAVIGRPCKDVSAAEAADSILGYTIGN

SEQ ID NO: 658575 - protein, 28 aa, Mycobacterium
FEGELAIVIGRPCKDVSAAQAVDNILGY

SEQ ID NO: 658576 - protein, 27 aa, Mycobacterium
FEGELAVVIGRPCKDVSAAQAADNILG

SEQ ID NO: 658577 - protein, 24 aa, Mycobacterium
FEGFDRLGGSGGWHLSGAGLMLAE

SEQ ID NO: 658578 - protein, 25 aa, Mycobacterium
FEGFLPAVRPTFLVLQSAMCLGLAR

SEQ ID NO: 658579 - protein, 20 aa, Mycobacterium
FEGFPLLLLTSEGARSGAQR

SEQ ID NO: 658580 - protein, 17 aa, Mycobacterium
FEGGLMLRDFEDHMYHR

SEQ ID NO: 658581 - protein, 18 aa, Mycobacterium
FEGGWVLEQIVGPAPLLA

SEQ ID NO: 658582 - protein, 17 aa, Mycobacterium
FEGHPEAALAYWTAEAE

SEQ ID NO: 658583 - protein, 17 aa, Mycobacterium
FEGITGLAAILITHQHP

SEQ ID NO: 658584 - protein, 17 aa, Mycobacterium
FEGLGLTSVRANTVGTI

SEQ ID NO: 658585 - protein, 19 aa, Mycobacterium
FEGLHLRFGLVARGGLRWS

SEQ ID NO: 658586 - protein, 22 aa, Mycobacterium
FEGLMIEHLEIFNAEDRFWARF

SEQ ID NO: 658587 - protein, 18 aa, Mycobacterium
FEGPVHRANFDAVDASPV

SEQ ID NO: 658588 - protein, 17 aa, Mycobacterium
FEGPVHRANFDAVDCSP

SEQ ID NO: 658589 - protein, 18 aa, Mycobacterium
FEGPVHRANFDAVDNSPV

SEQ ID NO: 658590 - protein, 18 aa, Mycobacterium
FEGPVHRANFDAVDSSPV

SEQ ID NO: 658591 - protein, 19 aa, Mycobacterium
FEGQQGWVRLDRVLDVPEE

SEQ ID NO: 658592 - protein, 17 aa, Mycobacterium
FEGRMRAPREFDRPAPA

SEQ ID NO: 658593 - protein, 30 aa, Mycobacterium
FEGRPDDAASLCFAVGVYVDFMEATGRLVG

SEQ ID NO: 658594 - protein, 18 aa, Mycobacterium
FEGRRVGLGDGAWRDLRV

SEQ ID NO: 658595 - protein, 23 aa, Mycobacterium
FEGRSEFSYGSFVRTVSLPDGAD

SEQ ID NO: 658596 - protein, 28 aa, Mycobacterium
FEGSWRVNCLGPFLGIRTALPHLRRVDG

SEQ ID NO: 658597 - protein, 33 aa, Mycobacterium
FEGTLELGYQVGFPWSLGVGINFSYTTPNILID

SEQ ID NO: 658598 - protein, 22 aa, Mycobacterium
FEGVDVRLSRYSYLVSLLPPRI

SEQ ID NO: 658599 - protein, 22 aa, Mycobacterium
FEGVMMPELFMADAIGATGKPM

SEQ ID NO: 658600 - protein, 19 aa, Mycobacterium
FEGWGNKRVEAEAKKIAAR

SEQ ID NO: 658601 - protein, 21 aa, Mycobacterium
FEHAKSAILYVAKHLPAPGRE

SEQ ID NO: 658602 - protein, 26 aa, Mycobacterium
FEHFGRLRYAHFFKMAYQALPADGIM

SEQ ID NO: 658603 - protein, 20 aa, Mycobacterium
FEHPYPFARRLSTLDHLTGG

SEQ ID NO: 658604 - protein, 17 aa, Mycobacterium
FEHTVAQLREERASAEA

SEQ ID NO: 658605 - protein, 24 aa, Mycobacterium
FEHVSGGAIFAYWVANPSAYGVVE

SEQ ID NO: 658606 - protein, 17 aa, Mycobacterium
FEHVWTCLGDPVFDLPN

SEQ ID NO: 658607 - protein, 18 aa, Mycobacterium
FEHYKARLAAGDWIIGRI

SEQ ID NO: 658608 - protein, 20 aa, Mycobacterium
FEIADLGIVGDLFKVTPQLT

SEQ ID NO: 658609 - protein, 17 aa, Mycobacterium
FEIDSVGAFDLLKRLSQ

SEQ ID NO: 658610 - protein, 23 aa, Mycobacterium
FEIERRAIEALDCPVMHDDQHGT

SEQ ID NO: 658611 - protein, 18 aa, Mycobacterium
FEIERRLVEALDCPVMHD

SEQ ID NO: 658612 - protein, 19 aa, Mycobacterium
FEIFVGEILHRIFNKSPHL

SEQ ID NO: 658613 - protein, 38 aa, Mycobacterium
FEIGDRVAVGWFGGHCNRCGPCRKGTFIHCANMKVPGW

SEQ ID NO: 658614 - protein, 24 aa, Mycobacterium
FEIKEFKSGAARMAIAANVPIVPH

SEQ ID NO: 658615 - protein, 25 aa, Mycobacterium
FEIKEFKSGAARMAIEAGVPIVPHV

SEQ ID NO: 658616 - protein, 24 aa, Mycobacterium
FEIKEFKSGAARMALEAGVPIVPH

SEQ ID NO: 658617 - protein, 24 aa, Mycobacterium
FEIKEFKSGAARMAVEAGVPIVPH

SEQ ID NO: 658618 - protein, 24 aa, Mycobacterium
FEIKELKSGAARMAIEADVPIIPH

SEQ ID NO: 658619 - protein, 22 aa, Mycobacterium
FEIPARYGLNQSIGDTIGIGGI

SEQ ID NO: 658620 - protein, 25 aa, Mycobacterium
FEIREDAGWVIGQWTAPPGVTAVHV

SEQ ID NO: 658621 - protein, 17 aa, Mycobacterium
FEIRGMVAGEPVIVIEH

SEQ ID NO: 658622 - protein, 21 aa, Mycobacterium
FEISGSPYLALLGTGVAVPYR

SEQ ID NO: 658623 - protein, 25 aa, Mycobacterium
FEKGRSWPRERTRAKLEEVLQWPAG

SEQ ID NO: 658624 - protein, 25 aa, Mycobacterium
FEKGRSWPRERTRAKLEEVLQWPPG

SEQ ID NO: 658625 - protein, 20 aa, Mycobacterium
FEKGRSWPRERTRARLEEIL

SEQ ID NO: 658626 - protein, 23 aa, Mycobacterium
FEKHFPADFIVEYIGQTRGWFYV

SEQ ID NO: 658627 - protein, 18 aa, Mycobacterium
FEKKLDWIREFVREEVEP

SEQ ID NO: 658628 - protein, 25 aa, Mycobacterium
FEKLRVWNATMADAGWAAVSWPREY

SEQ ID NO: 658629 - protein, 24 aa, Mycobacterium
FEKMVASPAFKSAMRSAGTVIGRE

SEQ ID NO: 658630 - protein, 17 aa, Mycobacterium
FEKNTHRAMVNRLEDGS

SEQ ID NO: 658631 - protein, 19 aa, Mycobacterium
FEKYLRHGPVFTVKMPYQT

SEQ ID NO: 658632 - protein, 23 aa, Mycobacterium
FELAAQCLAPGGRLVFNVFMPRP

SEQ ID NO: 658633 - protein, 17 aa, Mycobacterium
FELAEKVSIDNLSMPLL

SEQ ID NO: 658634 - protein, 37 aa, Mycobacterium
FELAELVSRVGAVLRRRGRLPQVIQFGDLMLDTDAGV

SEQ ID NO: 658635 - protein, 26 aa, Mycobacterium
FELAELVSRVGAVLRRRGRLPQVVQV

SEQ ID NO: 658636 - protein, 26 aa, Mycobacterium
FELAELVSRVGAVLRRRGRLPRVVQV

SEQ ID NO: 658637 - protein, 18 aa, Mycobacterium
FELANRIYSGYADYRDKA

SEQ ID NO: 658638 - protein, 17 aa, Mycobacterium
FELDAGILYPDQQDTAD

SEQ ID NO: 658639 - protein, 17 aa, Mycobacterium
FELDALWHDIHAAGLSP

SEQ ID NO: 658640 - protein, 21 aa, Mycobacterium
FELDFPSTYRVARRHNTPVRS

SEQ ID NO: 658641 - protein, 18 aa, Mycobacterium
FELDYDYLIYAVGSTGAT

SEQ ID NO: 658642 - protein, 24 aa, Mycobacterium
FELELSLLLCFTGITRDSARVIED

SEQ ID NO: 658643 - protein, 24 aa, Mycobacterium
FELELSLLLCYTGITRDSARVIED

SEQ ID NO: 658644 - protein, 26 aa, Mycobacterium
FELERGRYGPVFPRTPACHGFSIIAK

SEQ ID NO: 658645 - protein, 17 aa, Mycobacterium
FELGGHSLLVPRLQERV

SEQ ID NO: 658646 - protein, 19 aa, Mycobacterium
FELHEELISAIGLTREEAA

SEQ ID NO: 658647 - protein, 19 aa, Mycobacterium
FELHEELIVAVGLTREEAA

SEQ ID NO: 658648 - protein, 19 aa, Mycobacterium
FELILACTFPVLSTKASMG

SEQ ID NO: 658649 - protein, 22 aa, Mycobacterium
FELKADLVLLAMGFVGPEKEGL

SEQ ID NO: 658650 - protein, 24 aa, Mycobacterium
FELKEFKSGAARMALEADVPIVPV

SEQ ID NO: 658651 - protein, 23 aa, Mycobacterium
FELKEFKTGAARMAHEAGVPIVP

SEQ ID NO: 658652 - protein, 24 aa, Mycobacterium
FELKEFKTGAARMAIEAEVPIVPV

SEQ ID NO: 658653 - protein, 23 aa, Mycobacterium
FELKEFKTGAARMALDADVPIVP

SEQ ID NO: 658654 - protein, 23 aa, Mycobacterium
FELKEFKTGAARMALEANVPIVP

SEQ ID NO: 658655 - protein, 18 aa, Mycobacterium
FELLRFLMRNPRRALSRS

SEQ ID NO: 658656 - protein, 24 aa, Mycobacterium
FELLRFLMRNPRRALSRTEILDRV

SEQ ID NO: 658657 - protein, 18 aa, Mycobacterium
FELLRGSLRRNLQLMRSF

SEQ ID NO: 658658 - protein, 17 aa, Mycobacterium
FELPEEMAELSGDSGYL

SEQ ID NO: 658659 - protein, 17 aa, Mycobacterium
FELPNHYLRLTGLENLQ

SEQ ID NO: 658660 - protein, 18 aa, Mycobacterium
FELPRPGGEAVPMRLSTR

SEQ ID NO: 658661 - protein, 25 aa, Mycobacterium
FELQFGTNHLGHFAFTGLLLDNLLD

SEQ ID NO: 658662 - protein, 23 aa, Mycobacterium
FELQFGTNHLGHFALTGRLLSLL

SEQ ID NO: 658663 - protein, 25 aa, Mycobacterium
FELQIGTNHFGHFELTRLLIPQLTA

SEQ ID NO: 658664 - protein, 22 aa, Mycobacterium
FELRAGEVLAVVGDNGAGKSSL

SEQ ID NO: 658665 - protein, 21 aa, Mycobacterium
FELSEHFSRHFGVFREAQAGA

SEQ ID NO: 658666 - protein, 25 aa, Mycobacterium
FELTVDPLIPLPGFVLKRAIKGAME

SEQ ID NO: 658667 - protein, 19 aa, Mycobacterium
FELWSKFAATRTPTIAAVA

SEQ ID NO: 658668 - protein, 19 aa, Mycobacterium
FEMMSAFLVDGARQVSAPA

SEQ ID NO: 658669 - protein, 18 aa, Mycobacterium
FENAIAVVMAFGGSTNAV

SEQ ID NO: 658670 - protein, 26 aa, Mycobacterium
FENAKFGIFIHWGLYSVPGWAPLEAD

SEQ ID NO: 658671 - protein, 27 aa, Mycobacterium
FENFARTWLDYRLKLLEATDRFGPFQR

SEQ ID NO: 658672 - protein, 17 aa, Mycobacterium
FENGDVDAGIWTVGTAM

SEQ ID NO: 658673 - protein, 24 aa, Mycobacterium
FENGWKPGDAWTAETTLGRVMFNE

SEQ ID NO: 658674 - protein, 18 aa, Mycobacterium
FENKAAAVAALLEPMHEA

SEQ ID NO: 658675 - protein, 17 aa, Mycobacterium
FENKAAAVAALLEPMYD

SEQ ID NO: 658676 - protein, 29 aa, Mycobacterium
FENKKGGAGWVEWGGCGMVNPNVLRASGI

SEQ ID NO: 658677 - protein, 21 aa, Mycobacterium
FENLPRLLFAAMRRPRVGVMI

SEQ ID NO: 658678 - protein, 18 aa, Mycobacterium
FENPTLYRCTLKPGSVFA

SEQ ID NO: 658679 - protein, 24 aa, Mycobacterium
FENRLAGEVAFHLVRCGRVRDPDD

SEQ ID NO: 658680 - protein, 26 aa, Mycobacterium
FENSLCLSCGSALGFSLSDMALLVIT

SEQ ID NO: 658681 - protein, 25 aa, Mycobacterium
FENSVCLSCGSALGFSLDRMALLVI

SEQ ID NO: 658682 - protein, 21 aa, Mycobacterium
FENTCRWRDLRKITIAQVQGN

SEQ ID NO: 658683 - protein, 17 aa, Mycobacterium
FEPDLLVFKELRVLGSL

SEQ ID NO: 658684 - protein, 17 aa, Mycobacterium
FEPELIIVSAGFDAHER

SEQ ID NO: 658685 - protein, 22 aa, Mycobacterium
FEPETLRIAPGVTGAFVDGGVS

SEQ ID NO: 658686 - protein, 17 aa, Mycobacterium
FEPGATVPLHYHTGTAE

SEQ ID NO: 658687 - protein, 18 aa, Mycobacterium
FEPGEDWFWDYAENAYID

SEQ ID NO: 658688 - protein, 24 aa, Mycobacterium
FEPGELPSAIARLGPGRKYASMVA

SEQ ID NO: 658689 - protein, 25 aa, Mycobacterium
FEPGTPWLLRFFDQINWYPVSGEEL

SEQ ID NO: 658690 - protein, 17 aa, Mycobacterium
FEPHPMFIAAAETRAHQ

SEQ ID NO: 658691 - protein, 18 aa, Mycobacterium
FEPISHQECMVVAGNAMD

SEQ ID NO: 658692 - protein, 25 aa, Mycobacterium
FEPKKAVLFDDRWASAREDLVKLWL

SEQ ID NO: 658693 - protein, 19 aa, Mycobacterium
FEPKPDWHNPFSYQPEIWD

SEQ ID NO: 658694 - protein, 20 aa, Mycobacterium
FEPLEPLSVVLAGGGTAGHV

SEQ ID NO: 658695 - protein, 18 aa, Mycobacterium
FEPLIAIRPGYWRPANFA

SEQ ID NO: 658696 - protein, 17 aa, Mycobacterium
FEPNPGWTHTYSGSAEI

SEQ ID NO: 658697 - protein, 18 aa, Mycobacterium
FEPNPGWTRAYSGSAEIL

SEQ ID NO: 658698 - protein, 17 aa, Mycobacterium
FEPNPYWSRLYAPGSEL

SEQ ID NO: 658699 - protein, 17 aa, Mycobacterium
FEPNPYWSRLYAPGTEL

SEQ ID NO: 658700 - protein, 17 aa, Mycobacterium
FEPPAPHVARYVTRDVE

SEQ ID NO: 658701 - protein, 17 aa, Mycobacterium
FEPRFSLDAGMRATEIW

SEQ ID NO: 658702 - protein, 20 aa, Mycobacterium
FEPRYAALVRHCLDTGDPFG

SEQ ID NO: 658703 - protein, 21 aa, Mycobacterium
FEPRYSALVRHCLDTGDPFGV

SEQ ID NO: 658704 - protein, 26 aa, Mycobacterium
FEPSRLGEWASRITSFPPDWSNVGFD

SEQ ID NO: 658705 - protein, 19 aa, Mycobacterium
FEPTDHWEHHYATQPEILR

SEQ ID NO: 658706 - protein, 22 aa, Mycobacterium
FEPTGPHVARWMARDFEGYGTT

SEQ ID NO: 658707 - protein, 24 aa, Mycobacterium
FEPTGPHVARWVARDFEAYGQTVP

SEQ ID NO: 658708 - protein, 17 aa, Mycobacterium
FEPTLDYVVVKSPRFAF

SEQ ID NO: 658709 - protein, 17 aa, Mycobacterium
FEPVALCARTPDRLERA

SEQ ID NO: 658710 - protein, 17 aa, Mycobacterium
FEPWEIGNPAYGYEPGS

SEQ ID NO: 658711 - protein, 17 aa, Mycobacterium
FEPWKDQATIIGQAVFK

SEQ ID NO: 658712 - protein, 24 aa, Mycobacterium
FEQAADAVLRWGMQRGSGLRVQAS

SEQ ID NO: 658713 - protein, 17 aa, Mycobacterium
FEQARTVAVDVLRPLLE

SEQ ID NO: 658714 - protein, 22 aa, Mycobacterium
FEQHLRAVLDYPLGDTDAIAPV

SEQ ID NO: 658715 - protein, 22 aa, Mycobacterium
FEQHLRAVLDYPLGDTDAIVPV

SEQ ID NO: 658716 - protein, 22 aa, Mycobacterium
FEQHLRAVLDYPLGDTDALAPV

SEQ ID NO: 658717 - protein, 22 aa, Mycobacterium
FEQHLRAVLDYPLGDTEAIAPV

SEQ ID NO: 658718 - protein, 22 aa, Mycobacterium
FEQHLRAVLDYPLGDTSALAPT

SEQ ID NO: 658719 - protein, 23 aa, Mycobacterium
FEQHLRAVLDYPLGETSARAEIV

SEQ ID NO: 658720 - protein, 22 aa, Mycobacterium
FEQPSPQPGVHWSKDVRMDKIA

SEQ ID NO: 658721 - protein, 18 aa, Mycobacterium
FEQRWRRETGAGVMLINL

SEQ ID NO: 658722 - protein, 17 aa, Mycobacterium
FEQSRHWSRTYAPGREL

SEQ ID NO: 658723 - protein, 17 aa, Mycobacterium
FEQVAYLLWHGELPDEQ

SEQ ID NO: 658724 - protein, 18 aa, Mycobacterium
FEQVLPRLPLPSIEETLQ

SEQ ID NO: 658725 - protein, 29 aa, Mycobacterium
FERAAQCRSIWPRAMAFAAIGAAELLAVK

SEQ ID NO: 658726 - protein, 33 aa, Mycobacterium
FERALDLDPGLAIARWGIAYAVGPNYNKPWVAF

SEQ ID NO: 658727 - protein, 19 aa, Mycobacterium
FERARDCLRRAASATDDLQ

SEQ ID NO: 658728 - protein, 20 aa, Mycobacterium
FERDGKKLLGHFDKNGYFFV

SEQ ID NO: 658729 - protein, 18 aa, Mycobacterium
FERELSWEALVNGGVTAL

SEQ ID NO: 658730 - protein, 24 aa, Mycobacterium
FERFADAMGPFGFDAGAATPSYGL

SEQ ID NO: 658731 - protein, 18 aa, Mycobacterium
FERGGPRPARRAEAVCFD

SEQ ID NO: 658732 - protein, 20 aa, Mycobacterium
FERHPRLRVAFLEAGAGWVP

SEQ ID NO: 658733 - protein, 23 aa, Mycobacterium
FERIEDVWLPLFRPRTDAQPRPL

SEQ ID NO: 658734 - protein, 30 aa, Mycobacterium
FERIGAFKEVMKWPDYVEFLTNWATSSEWE

SEQ ID NO: 658735 - protein, 23 aa, Mycobacterium
FERIPDLRLATSVDEIEFKQNSI

SEQ ID NO: 658736 - protein, 24 aa, Mycobacterium
FERISGELKGVIAQVESTGSALAA

SEQ ID NO: 658737 - protein, 23 aa, Mycobacterium
FERKLWPTEDFELAKSRVPTSTP

SEQ ID NO: 658738 - protein, 26 aa, Mycobacterium
FERLARGVPISAPWDAPRAHELDGVS

SEQ ID NO: 658739 - protein, 19 aa, Mycobacterium
FERLFEPAISHGRKGFPVS

SEQ ID NO: 658740 - protein, 17 aa, Mycobacterium
FERLLVRAAGYLRGEAL

SEQ ID NO: 658741 - protein, 22 aa, Mycobacterium
FERLRVRYVIVSAVSGAMGGSA

SEQ ID NO: 658742 - protein, 25 aa, Mycobacterium
FERMPDLKFVWADGAADLLTPFMWR

SEQ ID NO: 658743 - protein, 21 aa, Mycobacterium
FERPLRPVARVAHVDFEEPAK

SEQ ID NO: 658744 - protein, 38 aa, Mycobacterium
FERQLSVDACRAFKPSPAVYRYVCDALGVAPADCMMVA

SEQ ID NO: 658745 - protein, 17 aa, Mycobacterium
FERRAAALQPRRDALST

SEQ ID NO: 658746 - protein, 36 aa, Mycobacterium
FERRCWRLAMDILSCFAVRLGFDREFFARAHDPDAP

SEQ ID NO: 658747 - protein, 21 aa, Mycobacterium
FERRPRVGDHVSIVEEIASIS

SEQ ID NO: 658748 - protein, 22 aa, Mycobacterium
FERRPRVGDHVSIVEEIASISE

SEQ ID NO: 658749 - protein, 17 aa, Mycobacterium
FERRSWRTNSGPHGVQF

SEQ ID NO: 658750 - protein, 20 aa, Mycobacterium
FERSKYKSGEFFDKYTDQVW

SEQ ID NO: 658751 - protein, 21 aa, Mycobacterium
FERVHALSPPASWFALNAPGI

SEQ ID NO: 658752 - protein, 20 aa, Mycobacterium
FERVHSLSAQGSWLASNVPG

SEQ ID NO: 658753 - protein, 24 aa, Mycobacterium
FERYGIPILVVYGATEFSGAVAGW

SEQ ID NO: 658754 - protein, 18 aa, Mycobacterium
FERYPAFFDMAYNALPDD

SEQ ID NO: 658755 - protein, 26 aa, Mycobacterium
FESEFGVPILQAWGMTETSPLATVAR

SEQ ID NO: 658756 - protein, 21 aa, Mycobacterium
FESGARQRLVFGRNEPGLQHR

SEQ ID NO: 658757 - protein, 17 aa, Mycobacterium
FESGIEPFFQIAAQTIA

SEQ ID NO: 658758 - protein, 23 aa, Mycobacterium
FESGWTFDHFYPIVGDSSGPCLE

SEQ ID NO: 658759 - protein, 19 aa, Mycobacterium
FESHCGWPSFFDPADSDAV

SEQ ID NO: 658760 - protein, 20 aa, Mycobacterium
FESHCGWPSFFDPADSDAVI

SEQ ID NO: 658761 - protein, 19 aa, Mycobacterium
FESHCGWPSFFDPAKSDAV

SEQ ID NO: 658762 - protein, 19 aa, Mycobacterium
FESHCGWPSFFDPANSDAV

SEQ ID NO: 658763 - protein, 20 aa, Mycobacterium
FESHCGWPSFFDPANSDAVI

SEQ ID NO: 658764 - protein, 21 aa, Mycobacterium
FESHCGWPSFYDPASSEAVIL

SEQ ID NO: 658765 - protein, 17 aa, Mycobacterium
FESKFWGQYRVVKSALP

SEQ ID NO: 658766 - protein, 21 aa, Mycobacterium
FESLALNARIALHVRTLYGRD

SEQ ID NO: 658767 - protein, 21 aa, Mycobacterium
FESLTGRELIGNGAAGVAGVD

SEQ ID NO: 658768 - protein, 25 aa, Mycobacterium
FESSDRIGGNWAFGNPNGHSSAYRS

SEQ ID NO: 658769 - protein, 25 aa, Mycobacterium
FESVTSGLAGQVWQGAAAAAMAAAA

SEQ ID NO: 658770 - protein, 25 aa, Mycobacterium
FETAFGCPVLEGYGLSESSPVAAFN

SEQ ID NO: 658771 - protein, 23 aa, Mycobacterium
FETAGDCLLELDAGHLPPDVRRF

SEQ ID NO: 658772 - protein, 17 aa, Mycobacterium
FETAHAAMIHPVAVAAN

SEQ ID NO: 658773 - protein, 29 aa, Mycobacterium
FETAHALGCTIKLLSICERITDDDGQQRV

SEQ ID NO: 658774 - protein, 20 aa, Mycobacterium
FETFCDLVLRVADARAQVSS

SEQ ID NO: 658775 - protein, 18 aa, Mycobacterium
FETLLALAGYYFAVGDLA

SEQ ID NO: 658776 - protein, 18 aa, Mycobacterium
FETLRAAGYANYGGADLG

SEQ ID NO: 658777 - protein, 17 aa, Mycobacterium
FETMAAFMLVEHANGAM

SEQ ID NO: 658778 - protein, 17 aa, Mycobacterium
FETMLAQASFDFEKPLT

SEQ ID NO: 658779 - protein, 19 aa, Mycobacterium
FETSILLDDCAKAALRYTD

SEQ ID NO: 658780 - protein, 18 aa, Mycobacterium
FETVLGFIERASRDGARL

SEQ ID NO: 658781 - protein, 18 aa, Mycobacterium
FEVAAAKYLHALRDGALP

SEQ ID NO: 658782 - protein, 19 aa, Mycobacterium
FEVAAGDFLLFPTVAHSHA

SEQ ID NO: 658783 - protein, 18 aa, Mycobacterium
FEVAAGEFLLFPTVAHSH

SEQ ID NO: 658784 - protein, 21 aa, Mycobacterium
FEVADVLPLTPLQQGLLFQAG

SEQ ID NO: 658785 - protein, 17 aa, Mycobacterium
FEVALRFQSAGYRILAL

SEQ ID NO: 658786 - protein, 19 aa, Mycobacterium
FEVARKLDKMGWRSSDTAE

SEQ ID NO: 658787 - protein, 17 aa, Mycobacterium
FEVDFFAKHGFREIDGT

SEQ ID NO: 658788 - protein, 17 aa, Mycobacterium
FEVDRPRTLAFKQQTLT

SEQ ID NO: 658789 - protein, 21 aa, Mycobacterium
FEVDYLEHFAWALTDEPDGLV

SEQ ID NO: 658790 - protein, 17 aa, Mycobacterium
FEVDYVDHFVWVMTDGA

SEQ ID NO: 658791 - protein, 19 aa, Mycobacterium
FEVFDVLRREAPVWWHPPT

SEQ ID NO: 658792 - protein, 24 aa, Mycobacterium
FEVFVGGILHRIFDKCPHLTTIVD

SEQ ID NO: 658793 - protein, 17 aa, Mycobacterium
FEVGDRVMGLFPDGTGT

SEQ ID NO: 658794 - protein, 17 aa, Mycobacterium
FEVGGFPIHDGDMVAAS

SEQ ID NO: 658795 - protein, 18 aa, Mycobacterium
FEVIGEAGTPVWHQLTTR

SEQ ID NO: 658796 - protein, 20 aa, Mycobacterium
FEVISKFIAGMPILGLARLL

SEQ ID NO: 658797 - protein, 17 aa, Mycobacterium
FEVLDQVAFSERHLRQA

SEQ ID NO: 658798 - protein, 32 aa, Mycobacterium
FEVLHRRRGWTWSGFRIMNVLWVFGTVEQRDV

SEQ ID NO: 658799 - protein, 17 aa, Mycobacterium
FEVLRAIVADFVATHEP

SEQ ID NO: 658800 - protein, 17 aa, Mycobacterium
FEVLRAIVADFVATQEP

SEQ ID NO: 658801 - protein, 18 aa, Mycobacterium
FEVLRRWLDGELDFSTDE

SEQ ID NO: 658802 - protein, 17 aa, Mycobacterium
FEVLRRWLDGELEFTTD

SEQ ID NO: 658803 - protein, 22 aa, Mycobacterium
FEVNEAFASVVLAWQAETGADL

SEQ ID NO: 658804 - protein, 31 aa, Mycobacterium
FEVNRALRFDRAVTFGMRLDIPSGTAVRFEP

SEQ ID NO: 658805 - protein, 23 aa, Mycobacterium
FEVQLMGAAALHLGNVAEMKTGE

SEQ ID NO: 658806 - protein, 26 aa, Mycobacterium
FEVRYDRIGNMFGLYELVPGAPYVLA

SEQ ID NO: 658807 - protein, 19 aa, Mycobacterium
FEVSPRFGSPPAAGLLRQQ

SEQ ID NO: 658808 - protein, 19 aa, Mycobacterium
FEVSRKLDKMGWRSSDTAE

SEQ ID NO: 658809 - protein, 25 aa, Mycobacterium
FEVVPVRTAHTWVGVAGTFTTLAAL

SEQ ID NO: 658810 - protein, 24 aa, Mycobacterium
FEWHSRPGAFSRLSPPWQPMRLVT

SEQ ID NO: 658811 - protein, 22 aa, Mycobacterium
FEWLIGSQRWRDSAIARGEAAG

SEQ ID NO: 658812 - protein, 22 aa, Mycobacterium
FEWLIGSQRWRESAAQRGDATP

SEQ ID NO: 658813 - protein, 21 aa, Mycobacterium
FEYDFRLLLGQRHGGQAWSDA

SEQ ID NO: 658814 - protein, 28 aa, Mycobacterium
FEYDLFFPPALCAEAARFIPAAEFVAIP

SEQ ID NO: 658815 - protein, 23 aa, Mycobacterium
FEYLRGMGMRSRFFDEFFLEAAA

SEQ ID NO: 658816 - protein, 26 aa, Mycobacterium
FEYVDGLAGFMPRIGISANIEPVRLE

SEQ ID NO: 658817 - protein, 23 aa, Mycobacterium
FEYWKNVDPELGKAVEEGVRAGL

SEQ ID NO: 658818 - protein, 20 aa, Mycobacterium
FFAARWPFRSGRWADRLNSL

SEQ ID NO: 658819 - protein, 17 aa, Mycobacterium
FFAASGFAALFNVNVVC

SEQ ID NO: 658820 - protein, 19 aa, Mycobacterium
FFAGHGAQGFFDAQAQMLS

SEQ ID NO: 658821 - protein, 28 aa, Mycobacterium
FFAGRTQCIDRLWAEVCEHVRGLENQTS

SEQ ID NO: 658822 - protein, 26 aa, Mycobacterium
FFAGVGIPIAEIWGMSELSCVATACH

SEQ ID NO: 658823 - protein, 18 aa, Mycobacterium
FFAIAGVLPVDAAIAQIK

SEQ ID NO: 658824 - protein, 22 aa, Mycobacterium
FFAKNMLPRLVSLRKVIESIDD

SEQ ID NO: 658825 - protein, 18 aa, Mycobacterium
FFAPIGVIALCAQDGHGD

SEQ ID NO: 658826 - protein, 29 aa, Mycobacterium
FFARDFPDLTALTRPGFPIAEIHADGTSV

SEQ ID NO: 658827 - protein, 26 aa, Mycobacterium
FFARGDYQNLIGWSYSITVSEFPAYG

SEQ ID NO: 658828 - protein, 17 aa, Mycobacterium
FFARVWPFVANHEAEAI

SEQ ID NO: 658829 - protein, 23 aa, Mycobacterium
FFAVRAGSLIAWRSNTDSAAAPF

SEQ ID NO: 658830 - protein, 17 aa, Mycobacterium
FFAYAISAAVDWLYSGL

SEQ ID NO: 658831 - protein, 17 aa, Mycobacterium
FFAYLPFQAPHWPLQAP

SEQ ID NO: 658832 - protein, 17 aa, Mycobacterium
FFDDFFLNAARDGVRQS

SEQ ID NO: 658833 - protein, 17 aa, Mycobacterium
FFDEIFRELGIPYEPVR

SEQ ID NO: 658834 - protein, 19 aa, Mycobacterium
FFDGFPRNAHPMPVLSSVV

SEQ ID NO: 658835 - protein, 22 aa, Mycobacterium
FFDRFEPVHAVTYFAPEARAAL

SEQ ID NO: 658836 - protein, 19 aa, Mycobacterium
FFDRRNACANCFATEFTTV

SEQ ID NO: 658837 - protein, 22 aa, Mycobacterium
FFDSAPCGLLLTSPDGRIIRAN

SEQ ID NO: 658838 - protein, 17 aa, Mycobacterium
FFEAFNVGRSLDDYPNV

SEQ ID NO: 658839 - protein, 19 aa, Mycobacterium
FFEAKRAAKEILLDGPVPT

SEQ ID NO: 658840 - protein, 18 aa, Mycobacterium
FFEARKLPFIVAVNEFDG

SEQ ID NO: 658841 - protein, 17 aa, Mycobacterium
FFEEFGIEDVPLVGGKN

SEQ ID NO: 658842 - protein, 24 aa, Mycobacterium
FFEFLTDLLDAWVAYFAEHPRERA

SEQ ID NO: 658843 - protein, 25 aa, Mycobacterium
FFEFLTDWLDAWVAYFADHPHERAL

SEQ ID NO: 658844 - protein, 23 aa, Mycobacterium
FFEGVMMPELFMADAMGASGKPL

SEQ ID NO: 658845 - protein, 23 aa, Mycobacterium
FFEGVMMPELFMADAMGATGKPL

SEQ ID NO: 658846 - protein, 22 aa, Mycobacterium
FFEGVMMPELFMADATGATGKP

SEQ ID NO: 658847 - protein, 18 aa, Mycobacterium
FFEKVFPAFWGLKATKNY

SEQ ID NO: 658848 - protein, 23 aa, Mycobacterium
FFELSTSPSVIWVEFDHLELPAA

SEQ ID NO: 658849 - protein, 18 aa, Mycobacterium
FFELVRTEAPLLYEYTYD

SEQ ID NO: 658850 - protein, 17 aa, Mycobacterium
FFERAYDILPNDGRMLL

SEQ ID NO: 658851 - protein, 22 aa, Mycobacterium
FFERHRAGLLAYVEYVRSNPGH

SEQ ID NO: 658852 - protein, 17 aa, Mycobacterium
FFEYMRRTDPVWHGALA

SEQ ID NO: 658853 - protein, 19 aa, Mycobacterium
FFFDGELFIIGRIKDLLIV

SEQ ID NO: 658854 - protein, 26 aa, Mycobacterium
FFFGHSMGGLLAFEVARRFEDAGRPI

SEQ ID NO: 658855 - protein, 19 aa, Mycobacterium
FFFKVLDLLTEYSAAHPQT

SEQ ID NO: 658856 - protein, 22 aa, Mycobacterium
FFFLEMNTRLQVEHPVTECTTG

SEQ ID NO: 658857 - protein, 17 aa, Mycobacterium
FFFLRPKDIAIYVGSGE

SEQ ID NO: 658858 - protein, 20 aa, Mycobacterium
FFFLRPKDIAIYVGSGELDF

SEQ ID NO: 658859 - protein, 20 aa, Mycobacterium
FFFLRPKDIAIYVGSGQLDF

SEQ ID NO: 658860 - protein, 18 aa, Mycobacterium
FFFPAYMGPFGWLGLDLT

SEQ ID NO: 658861 - protein, 19 aa, Mycobacterium
FFGAFARRHGVPLIERPHF

SEQ ID NO: 658862 - protein, 19 aa, Mycobacterium
FFGDRRKAFLDDLAIVTGG

SEQ ID NO: 658863 - protein, 19 aa, Mycobacterium
FFGDRRKAFLDDLAVVTGG

SEQ ID NO: 658864 - protein, 18 aa, Mycobacterium
FFGGGCTTQSIVMRSKSG

SEQ ID NO: 658865 - protein, 18 aa, Mycobacterium
FFGKLTYIRVYSGTVESG

SEQ ID NO: 658866 - protein, 21 aa, Mycobacterium
FFGNGNFGFGNSFSSGNLGSG

SEQ ID NO: 658867 - protein, 21 aa, Mycobacterium
FFGNLAYRFMHSVKAGIKDSL

SEQ ID NO: 658868 - protein, 18 aa, Mycobacterium
FFGQMLATIRPYRPSLSQ

SEQ ID NO: 658869 - protein, 24 aa, Mycobacterium
FFGRDFDGVLAWGLMFLLSAEDQR

SEQ ID NO: 658870 - protein, 17 aa, Mycobacterium
FFGRPLKASMFFSPGGV

SEQ ID NO: 658871 - protein, 25 aa, Mycobacterium
FFGRRRAVSTISEWIEASHYGIYLI

SEQ ID NO: 658872 - protein, 20 aa, Mycobacterium
FFGSLLEFITSGPLVAAIVE

SEQ ID NO: 658873 - protein, 20 aa, Mycobacterium
FFGSLLEFITSGPLVAAVLE

SEQ ID NO: 658874 - protein, 24 aa, Mycobacterium
FFGTLRVARAFAPVLADNGGGAFL

SEQ ID NO: 658875 - protein, 18 aa, Mycobacterium
FFGVRLRSPVLIGAMTGG

SEQ ID NO: 658876 - protein, 20 aa, Mycobacterium
FFHCAKAFLRSDTWKPETWN

SEQ ID NO: 658877 - protein, 25 aa, Mycobacterium
FFHRGQDFVYHWALGDRLPADAGLA

SEQ ID NO: 658878 - protein, 18 aa, Mycobacterium
FFIEEWAEHIGFVYPPAL

SEQ ID NO: 658879 - protein, 22 aa, Mycobacterium
FFKDPVKGFFRALDYTLPWDVE

SEQ ID NO: 658880 - protein, 23 aa, Mycobacterium
FFLESSSLFGRRRGVRMSLLVSA

SEQ ID NO: 658881 - protein, 30 aa, Mycobacterium
FFLHIPFPPVELFMQLPWRTEIIEGLLGAD

SEQ ID NO: 658882 - protein, 30 aa, Mycobacterium
FFLHIPFPPVELFMQMPWRTEIVDGLLGAD

SEQ ID NO: 658883 - protein, 29 aa, Mycobacterium
FFLHIPFPPVELFMQMPWRTEIVEGLLGA

SEQ ID NO: 658884 - protein, 19 aa, Mycobacterium
FFLLAAVRLRRCIEQVSRY

SEQ ID NO: 658885 - protein, 18 aa, Mycobacterium
FFLLPNNHGRIFGPDPVE

SEQ ID NO: 658886 - protein, 25 aa, Mycobacterium
FFLPKIAAGDLHFSIGYSEPGAGTD

SEQ ID NO: 658887 - protein, 17 aa, Mycobacterium
FFLPKIAAGELHFSIGY

SEQ ID NO: 658888 - protein, 18 aa, Mycobacterium
FFLPKIAAGELHFSIGYS

SEQ ID NO: 658889 - protein, 26 aa, Mycobacterium
FFLPKIAAGKLHFSIGYSEPGAGTDL

SEQ ID NO: 658890 - protein, 17 aa, Mycobacterium
FFLPKIASGELHFSIGY

SEQ ID NO: 658891 - protein, 17 aa, Mycobacterium
FFMVPDRDFAMTVLTNS

SEQ ID NO: 658892 - protein, 23 aa, Mycobacterium
FFNPDHLWAAFAQRVGTTPSGYR

SEQ ID NO: 658893 - protein, 20 aa, Mycobacterium
FFPDPWPKARHHKRRLLQPA

SEQ ID NO: 658894 - protein, 26 aa, Mycobacterium
FFPSVREYSSRFGLSDRRQAMLPGHA

SEQ ID NO: 658895 - protein, 25 aa, Mycobacterium
FFPSVREYSTLYGLSDRRQAMLGGH

SEQ ID NO: 658896 - protein, 19 aa, Mycobacterium
FFRALDYTLPWDVDGVEDA

SEQ ID NO: 658897 - protein, 18 aa, Mycobacterium
FFRALEFTLPRDVDGVQD

SEQ ID NO: 658898 - protein, 19 aa, Mycobacterium
FFRALEFTLPYDVDGVQDA

SEQ ID NO: 658899 - protein, 17 aa, Mycobacterium
FFRDSRHLAIHVDSVDV

SEQ ID NO: 658900 - protein, 19 aa, Mycobacterium
FFREFCGKFETTGSVMPST

SEQ ID NO: 658901 - protein, 24 aa, Mycobacterium
FFRHFPTKEAVLFQDYENQLEWLA

SEQ ID NO: 658902 - protein, 20 aa, Mycobacterium
FFRISREITCAQANLMPATA

SEQ ID NO: 658903 - protein, 26 aa, Mycobacterium
FFRYFPTKESVLFFGEYDFIDAVSGV

SEQ ID NO: 658904 - protein, 24 aa, Mycobacterium
FFRYFPTKESVLFSDDLFNPIIEE

SEQ ID NO: 658905 - protein, 17 aa, Mycobacterium
FFSELLDGYMVRLGATR

SEQ ID NO: 658906 - protein, 17 aa, Mycobacterium
FFSFGIMHYYMTGIHTP

SEQ ID NO: 658907 - protein, 25 aa, Mycobacterium
FFSHGGALKSSWYGDCLPERDFPTL

SEQ ID NO: 658908 - protein, 26 aa, Mycobacterium
FFSLPWYYRAGYDVLMYTLPFHGKRA

SEQ ID NO: 658909 - protein, 17 aa, Mycobacterium
FFSLRGLALLTDTVEKV

SEQ ID NO: 658910 - protein, 22 aa, Mycobacterium
FFSMTARLLGKVVPGAVAEVIT

SEQ ID NO: 658911 - protein, 25 aa, Mycobacterium
FFSRGGALKSSWYGDCLPERDFPTL

SEQ ID NO: 658912 - protein, 25 aa, Mycobacterium
FFTAGGMVRTVSWLYLGQTMVIHQR

SEQ ID NO: 658913 - protein, 17 aa, Mycobacterium
FFTALRERRILGVRGSD

SEQ ID NO: 658914 - protein, 17 aa, Mycobacterium
FFTGLPMDGPDPECVQG

SEQ ID NO: 658915 - protein, 29 aa, Mycobacterium
FFTGTRFECNLTWLELQWGRTIGQTPSPC

SEQ ID NO: 658916 - protein, 18 aa, Mycobacterium
FFTPADIDTVLGHDYEVH

SEQ ID NO: 658917 - protein, 18 aa, Mycobacterium
FFTPLGMHTRAALDGVAD

SEQ ID NO: 658918 - protein, 17 aa, Mycobacterium
FFTPLLRNLGHSARVAV

SEQ ID NO: 658919 - protein, 18 aa, Mycobacterium
FFTPLLRNLGHSGRVVVI

SEQ ID NO: 658920 - protein, 24 aa, Mycobacterium
FFTTKGRVYRAKAYDLPEAARTAR

SEQ ID NO: 658921 - protein, 20 aa, Mycobacterium
FFVGPAGAIAKSAFDKLIEE

SEQ ID NO: 658922 - protein, 17 aa, Mycobacterium
FFVHDPFTLEPYSRDPR

SEQ ID NO: 658923 - protein, 17 aa, Mycobacterium
FFVILGPSGAGKTTTLK

SEQ ID NO: 658924 - protein, 18 aa, Mycobacterium
FFVMPGGGHQLMLFDTTV

SEQ ID NO: 658925 - protein, 23 aa, Mycobacterium
FFVQEACRQWELPAADTVITVGK

SEQ ID NO: 658926 - protein, 28 aa, Mycobacterium
FFWQTALSWMMWNFRLAGLLVGATVVCY

SEQ ID NO: 658927 - protein, 22 aa, Mycobacterium
FFWYTSPSWMMWNFQVAGLLVG

SEQ ID NO: 658928 - protein, 19 aa, Mycobacterium
FFYIKGRSSEMIISGGVNI

SEQ ID NO: 658929 - protein, 17 aa, Mycobacterium
FGAAIAAAADFRRPNLF

SEQ ID NO: 658930 - protein, 20 aa, Mycobacterium
FGAALAELDGAFGVGDAAPA

SEQ ID NO: 658931 - protein, 27 aa, Mycobacterium
FGAALPDKFEQMWGYIYEQNIAPIYLG

SEQ ID NO: 658932 - protein, 17 aa, Mycobacterium
FGAAMSMRQRHELHERY

SEQ ID NO: 658933 - protein, 19 aa, Mycobacterium
FGADALRFTLARGASPGGD

SEQ ID NO: 658934 - protein, 17 aa, Mycobacterium
FGADEKAAWIAEIAAYL

SEQ ID NO: 658935 - protein, 25 aa, Mycobacterium
FGADGDGGWVLPGLVDAHCHVGLGP

SEQ ID NO: 658936 - protein, 22 aa, Mycobacterium
FGADLLALLGVDAVPRDLVEAE

SEQ ID NO: 658937 - protein, 17 aa, Mycobacterium
FGAEFPLDDALRLLEAH

SEQ ID NO: 658938 - protein, 19 aa, Mycobacterium
FGAEGDWKTSAMVRTVKTM

SEQ ID NO: 658939 - protein, 22 aa, Mycobacterium
FGAEGWRPGLHRLTDGLINDAR

SEQ ID NO: 658940 - protein, 22 aa, Mycobacterium
FGAEGWRPGLHRVTDGLINDAR

SEQ ID NO: 658941 - protein, 17 aa, Mycobacterium
FGAEIGRQSGRAAEGLG

SEQ ID NO: 658942 - protein, 27 aa, Mycobacterium
FGAELFPRMRVPQAWYDAGIAARADNL

SEQ ID NO: 658943 - protein, 17 aa, Mycobacterium
FGAFLPKGITLRVYGDA

SEQ ID NO: 658944 - protein, 24 aa, Mycobacterium
FGAFRELERLIGLHRTPPPLPEVP

SEQ ID NO: 658945 - protein, 19 aa, Mycobacterium
FGAGIFQLGTLFAQQLLPD

SEQ ID NO: 658946 - protein, 18 aa, Mycobacterium
FGAGIGMALGRANSGRPA

SEQ ID NO: 658947 - protein, 21 aa, Mycobacterium
FGAGIRPPWSLGEPQPELATL

SEQ ID NO: 658948 - protein, 17 aa, Mycobacterium
FGAGLAMHLAAARPNQV

SEQ ID NO: 658949 - protein, 25 aa, Mycobacterium
FGAGNRGNGNFGFGNSQATGGGNIG

SEQ ID NO: 658950 - protein, 25 aa, Mycobacterium
FGAGNRYNGNIGFGNIGNPATSPNP

SEQ ID NO: 658951 - protein, 24 aa, Mycobacterium
FGAGPIGIGLWFALRGKGLDDVFV

SEQ ID NO: 658952 - protein, 25 aa, Mycobacterium
FGAGPIGIGLWFALRGKGLESVYVA

SEQ ID NO: 658953 - protein, 17 aa, Mycobacterium
FGAGVCQGGPEMLDIAS

SEQ ID NO: 658954 - protein, 25 aa, Mycobacterium
FGAGWKVRAGEVFSRDGTVLDESTV

SEQ ID NO: 658955 - protein, 17 aa, Mycobacterium
FGAGYAKAMEKMLEVNQ

SEQ ID NO: 658956 - protein, 19 aa, Mycobacterium
FGAITPSVCNLRPSSRGHV

SEQ ID NO: 658957 - protein, 25 aa, Mycobacterium
FGAITSPELAEWGIPTAEALVEVHA

SEQ ID NO: 658958 - protein, 17 aa, Mycobacterium
FGAKADQLRSIFLGDPQ

SEQ ID NO: 658959 - protein, 23 aa, Mycobacterium
FGAKHADALFTIHSSIPAGQKYY

SEQ ID NO: 658960 - protein, 19 aa, Mycobacterium
FGALAARPADAPVVMVNLL

SEQ ID NO: 658961 - protein, 17 aa, Mycobacterium
FGALLGEAWTQKKRMSP

SEQ ID NO: 658962 - protein, 19 aa, Mycobacterium
FGALLSNAKTVFWNGPMGV

SEQ ID NO: 658963 - protein, 17 aa, Mycobacterium
FGALNVMVNNAGISSPL

SEQ ID NO: 658964 - protein, 18 aa, Mycobacterium
FGALPLARRPRGVVAGLV

SEQ ID NO: 658965 - protein, 23 aa, Mycobacterium
FGALRVAKAFAPVLADNGGGALV

SEQ ID NO: 658966 - protein, 25 aa, Mycobacterium
FGAPAAEALDAWLADGRPALVNADS

SEQ ID NO: 658967 - protein, 17 aa, Mycobacterium
FGAPDWDEFMSVVKGFG

SEQ ID NO: 658968 - protein, 18 aa, Mycobacterium
FGAPERKMGWHAQPTAQV

SEQ ID NO: 658969 - protein, 26 aa, Mycobacterium
FGAPMEKRTRFGLAAAQQALEDGGVT

SEQ ID NO: 658970 - protein, 18 aa, Mycobacterium
FGARAERIFMYLRTRDDY

SEQ ID NO: 658971 - protein, 17 aa, Mycobacterium
FGARRVVADAFERARRR

SEQ ID NO: 658972 - protein, 21 aa, Mycobacterium
FGARYAIHGHEYFAHRAGLSE

SEQ ID NO: 658973 - protein, 24 aa, Mycobacterium
FGASGPRSSWRATDAVLYAMSGSL

SEQ ID NO: 658974 - protein, 23 aa, Mycobacterium
FGASNFPLAFSVAGGDTASALAA

SEQ ID NO: 658975 - protein, 20 aa, Mycobacterium
FGASSAFGGPCRTPVAERLA

SEQ ID NO: 658976 - protein, 19 aa, Mycobacterium
FGASTALFCYLDRDMPPPQ

SEQ ID NO: 658977 - protein, 26 aa, Mycobacterium
FGATDCALPMMWALRRGVKVDTFHIY

SEQ ID NO: 658978 - protein, 18 aa, Mycobacterium
FGATEILAGLAPAGDGAG

SEQ ID NO: 658979 - protein, 18 aa, Mycobacterium
FGATESHAAGGLGSIENF

SEQ ID NO: 658980 - protein, 18 aa, Mycobacterium
FGATGIHRCPERELSPCP

SEQ ID NO: 658981 - protein, 17 aa, Mycobacterium
FGATHAFPDAASAAAKV

SEQ ID NO: 658982 - protein, 25 aa, Mycobacterium
FGAVEMARLPGPNGKLMHAAFQING

SEQ ID NO: 658983 - protein, 17 aa, Mycobacterium
FGAVTGRDDVKREGQAQ

SEQ ID NO: 658984 - protein, 26 aa, Mycobacterium
FGCADPDTGVGFAYVMNRLGFHLWSD

SEQ ID NO: 658985 - protein, 18 aa, Mycobacterium
FGCAGRAELENWVTRLGE

SEQ ID NO: 658986 - protein, 17 aa, Mycobacterium
FGCGDKISLAAVGQKAS

SEQ ID NO: 658987 - protein, 23 aa, Mycobacterium
FGCKRPSMHNEWFSTFTKPNVDL

SEQ ID NO: 658988 - protein, 18 aa, Mycobacterium
FGCRFGCVVQDGFGSTEG

SEQ ID NO: 658989 - protein, 24 aa, Mycobacterium
FGCRMGICQSCVVGLVDGHVRDLR

SEQ ID NO: 658990 - protein, 19 aa, Mycobacterium
FGDAPACRALFASAHHVVR

SEQ ID NO: 658991 - protein, 17 aa, Mycobacterium
FGDAVAVDVRYPRDMST

SEQ ID NO: 658992 - protein, 25 aa, Mycobacterium
FGDDGSMMACVFNFSGAEHSRYRLG

SEQ ID NO: 658993 - protein, 24 aa, Mycobacterium
FGDEAKRPLAVYLSDWGTEEFTRG

SEQ ID NO: 658994 - protein, 25 aa, Mycobacterium
FGDGEFPDSAALFWEAISAESADQL

SEQ ID NO: 658995 - protein, 25 aa, Mycobacterium
FGDGNRGSNNFGFGNTNSGNVGFGN

SEQ ID NO: 658996 - protein, 22 aa, Mycobacterium
FGDGPLVVGICAEYDALPEIGH

SEQ ID NO: 658997 - protein, 19 aa, Mycobacterium
FGDIDGFWAAVLHRTAQRR

SEQ ID NO: 658998 - protein, 31 aa, Mycobacterium
FGDKVLPLYLPTGLPSCRGLIGLLSQARYEY

SEQ ID NO: 658999 - protein, 17 aa, Mycobacterium
FGDLNLDAVPGLPDGAS

SEQ ID NO: 659000 - protein, 18 aa, Mycobacterium
FGDMALAGMAGRALGSTA

SEQ ID NO: 659001 - protein, 23 aa, Mycobacterium
FGDPAGAVVLWFHGTPGARRQFP

SEQ ID NO: 659002 - protein, 20 aa, Mycobacterium
FGDPEVMQWTQVADLPAPGP

SEQ ID NO: 659003 - protein, 18 aa, Mycobacterium
FGDPTGDVVLWFHGTPGG

SEQ ID NO: 659004 - protein, 17 aa, Mycobacterium
FGDRLPVILLDGREHSY

SEQ ID NO: 659005 - protein, 18 aa, Mycobacterium
FGDRLPVVLLDGQEHSYW

SEQ ID NO: 659006 - protein, 18 aa, Mycobacterium
FGDRVLILMLNRTEFMES

SEQ ID NO: 659007 - protein, 19 aa, Mycobacterium
FGDSAFPSGGFAFSSGLEG

SEQ ID NO: 659008 - protein, 18 aa, Mycobacterium
FGDSEFDTVISAIGVMFA

SEQ ID NO: 659009 - protein, 18 aa, Mycobacterium
FGDTEPWHISRTLTNAVL

SEQ ID NO: 659010 - protein, 18 aa, Mycobacterium
FGDTEPWNVTRTVTNAVL

SEQ ID NO: 659011 - protein, 18 aa, Mycobacterium
FGDVDGFWAAVLHRTAER

SEQ ID NO: 659012 - protein, 25 aa, Mycobacterium
FGDYFKKGAIELAWSLLTNPVSEGG

SEQ ID NO: 659013 - protein, 25 aa, Mycobacterium
FGDYFKREAIELAWTLLTNGVSEGG

SEQ ID NO: 659014 - protein, 25 aa, Mycobacterium
FGDYFKREAIRLAWTLLTNPVSEGG

SEQ ID NO: 659015 - protein, 26 aa, Mycobacterium
FGDYFKRGAIELAWALLTNSVADGGY

SEQ ID NO: 659016 - protein, 26 aa, Mycobacterium
FGDYFKRGAIELAWSLLTNGVAAGGY

SEQ ID NO: 659017 - protein, 26 aa, Mycobacterium
FGDYFKRGAIELAWTLLTNPVEEGGY

SEQ ID NO: 659018 - protein, 26 aa, Mycobacterium
FGDYFKRRAIELAWTLLTNSVEQGGY

SEQ ID NO: 659019 - protein, 23 aa, Mycobacterium
FGDYRCRADASALVCVNFAHQSG

SEQ ID NO: 659020 - protein, 23 aa, Mycobacterium
FGDYRCRADQAGVFCVNYAHQSA

SEQ ID NO: 659021 - protein, 17 aa, Mycobacterium
FGEALPRHLELIYEIND

SEQ ID NO: 659022 - protein, 21 aa, Mycobacterium
FGEALPVRVCPLRTDPWNVAA

SEQ ID NO: 659023 - protein, 22 aa, Mycobacterium
FGEAVKLGDRIAILTTGSKVVQ

SEQ ID NO: 659024 - protein, 23 aa, Mycobacterium
FGEAVKLGDRIAVLGQQSKVLQY

SEQ ID NO: 659025 - protein, 23 aa, Mycobacterium
FGEDGIRCTWLETSHAFHSELLD

SEQ ID NO: 659026 - protein, 18 aa, Mycobacterium
FGEFKGWAKAQGKHSNIG

SEQ ID NO: 659027 - protein, 24 aa, Mycobacterium
FGEFNLILCRNVFIYFEDMLQHRV

SEQ ID NO: 659028 - protein, 25 aa, Mycobacterium
FGEGPRWFEGLLWFSDMLGEAVHTV

SEQ ID NO: 659029 - protein, 24 aa, Mycobacterium
FGEGPRWFEGLVWFSDMLGEAVHT

SEQ ID NO: 659030 - protein, 20 aa, Mycobacterium
FGEHAVLPVLRRDQPERRAV

SEQ ID NO: 659031 - protein, 32 aa, Mycobacterium
FGEIDYRNTIDILQRYYNIILTDCGTGIMHSA

SEQ ID NO: 659032 - protein, 18 aa, Mycobacterium
FGEKVCLYAELTGSATID

SEQ ID NO: 659033 - protein, 18 aa, Mycobacterium
FGELRRRGATTFEVTEEA

SEQ ID NO: 659034 - protein, 25 aa, Mycobacterium
FGELTQLAGVFGFAECVDLLGAYTA

SEQ ID NO: 659035 - protein, 25 aa, Mycobacterium
FGELTQLAGVFGFMECIELLSDYAL

SEQ ID NO: 659036 - protein, 17 aa, Mycobacterium
FGEMFARQGHLGAMPAT

SEQ ID NO: 659037 - protein, 25 aa, Mycobacterium
FGENMRRWGLLGSFGTVGDCFDNAA

SEQ ID NO: 659038 - protein, 23 aa, Mycobacterium
FGEPAHAALTAWLTEGRPQLSIP

SEQ ID NO: 659039 - protein, 22 aa, Mycobacterium
FGEPELRPDDLLRVDGQGRGII

SEQ ID NO: 659040 - protein, 18 aa, Mycobacterium
FGEPGGRELDLWLHRASV

SEQ ID NO: 659041 - protein, 19 aa, Mycobacterium
FGEPIARRQAVAFMCANIA

SEQ ID NO: 659042 - protein, 25 aa, Mycobacterium
FGEPLHPFAAITPSVCNLRPTSRGH

SEQ ID NO: 659043 - protein, 20 aa, Mycobacterium
FGEPRAVSLKGLRGTQNVYP

SEQ ID NO: 659044 - protein, 19 aa, Mycobacterium
FGERFPDRLFDVGIAEQHA

SEQ ID NO: 659045 - protein, 18 aa, Mycobacterium
FGERGFLPHDERYRLAEE

SEQ ID NO: 659046 - protein, 21 aa, Mycobacterium
FGERQRLAIRLHDSVGATLFS

SEQ ID NO: 659047 - protein, 20 aa, Mycobacterium
FGESSFCRFAQIGDFEAIVS

SEQ ID NO: 659048 - protein, 19 aa, Mycobacterium
FGETGCVKARSVIIAAGGF

SEQ ID NO: 659049 - protein, 18 aa, Mycobacterium
FGEVEARGVALTRRGRER

SEQ ID NO: 659050 - protein, 32 aa, Mycobacterium
FGEVLRRAGLPAPRFGMATSFDQARRIAAEIG

SEQ ID NO: 659051 - protein, 24 aa, Mycobacterium
FGEVVPGLRIPGKIDKLGYKGIET

SEQ ID NO: 659052 - protein, 26 aa, Mycobacterium
FGFAPLRLPPDLDFAALFHGVDERVP

SEQ ID NO: 659053 - protein, 27 aa, Mycobacterium
FGFAPLRLPPDLDFAALFHGVDERVPV

SEQ ID NO: 659054 - protein, 18 aa, Mycobacterium
FGFAPPVATPSWGILERP

SEQ ID NO: 659055 - protein, 19 aa, Mycobacterium
FGFATRLSRRSEVLGTVAL

SEQ ID NO: 659056 - protein, 17 aa, Mycobacterium
FGFAYQQSPGFFNSTTD

SEQ ID NO: 659057 - protein, 17 aa, Mycobacterium
FGFDPGAGFGFGPGGPR

SEQ ID NO: 659058 - protein, 18 aa, Mycobacterium
FGFELAMRKTTAEQRAGW

SEQ ID NO: 659059 - protein, 18 aa, Mycobacterium
FGFGFVMFVNGYRADEVL

SEQ ID NO: 659060 - protein, 28 aa, Mycobacterium
FGFGPGGPRGGWRRGGRGRGRRGDIRSA

SEQ ID NO: 659061 - protein, 19 aa, Mycobacterium
FGFHEYLEVKSTLGYAPGK

SEQ ID NO: 659062 - protein, 26 aa, Mycobacterium
FGFIACAVVRGGSWRRKREFWRQAVA

SEQ ID NO: 659063 - protein, 23 aa, Mycobacterium
FGFKCKEGATFGMTQLLYSDAIV

SEQ ID NO: 659064 - protein, 17 aa, Mycobacterium
FGFLLMCGQACESGTRL

SEQ ID NO: 659065 - protein, 17 aa, Mycobacterium
FGFPEIQIGILPSSGGV

SEQ ID NO: 659066 - protein, 17 aa, Mycobacterium
FGFPHYFLLPQYSSASS

SEQ ID NO: 659067 - protein, 19 aa, Mycobacterium
FGFPRADLDDLLGGDAQAN

SEQ ID NO: 659068 - protein, 17 aa, Mycobacterium
FGFSAAIPPNLPLPTKI

SEQ ID NO: 659069 - protein, 26 aa, Mycobacterium
FGFSPLRLPPDLDFTSLFHGVDERVP

SEQ ID NO: 659070 - protein, 27 aa, Mycobacterium
FGFSPLRLPPELDFAALFHGVDERVPI

SEQ ID NO: 659071 - protein, 17 aa, Mycobacterium
FGFSTAIGIGGDPVIGT

SEQ ID NO: 659072 - protein, 19 aa, Mycobacterium
FGGAFTISATAVFDYPTIS

SEQ ID NO: 659073 - protein, 17 aa, Mycobacterium
FGGAGGVGGISGNDTGG

SEQ ID NO: 659074 - protein, 21 aa, Mycobacterium
FGGAGSEQWCDAEVLRILRRR

SEQ ID NO: 659075 - protein, 22 aa, Mycobacterium
FGGAKPWFAIGGIDEARLPEVL

SEQ ID NO: 659076 - protein, 26 aa, Mycobacterium
FGGALSRAVADFVLINVTGGIAAEEA

SEQ ID NO: 659077 - protein, 18 aa, Mycobacterium
FGGARVVLTAGYPALSPV

SEQ ID NO: 659078 - protein, 20 aa, Mycobacterium
FGGATIRLTRDAGWGNAMRW

SEQ ID NO: 659079 - protein, 21 aa, Mycobacterium
FGGAVALRLSVVRPDLIAALV

SEQ ID NO: 659080 - protein, 20 aa, Mycobacterium
FGGCEGDALLMLLDANGIEC

SEQ ID NO: 659081 - protein, 23 aa, Mycobacterium
FGGDLIWGVEDCRNLSQRLERDL

SEQ ID NO: 659082 - protein, 24 aa, Mycobacterium
FGGDPRDGFPRSPASELAQGPPGT

SEQ ID NO: 659083 - protein, 17 aa, Mycobacterium
FGGEHGVEGSIAREGGL

SEQ ID NO: 659084 - protein, 18 aa, Mycobacterium
FGGEVERGLSMVDGVVLL

SEQ ID NO: 659085 - protein, 18 aa, Mycobacterium
FGGFAARVRGSDVDIAVT

SEQ ID NO: 659086 - protein, 20 aa, Mycobacterium
FGGFGGWGGQSGLIGSGGNG

SEQ ID NO: 659087 - protein, 17 aa, Mycobacterium
FGGFSVPGHGGAGGVGG

SEQ ID NO: 659088 - protein, 27 aa, Mycobacterium
FGGGAKRCLGAAFSMRELVTVLHVLLR

SEQ ID NO: 659089 - protein, 26 aa, Mycobacterium
FGGGARRCLGATFALVEMRVVLREVL

SEQ ID NO: 659090 - protein, 17 aa, Mycobacterium
FGGGCTTQSIVMRSKSG

SEQ ID NO: 659091 - protein, 17 aa, Mycobacterium
FGGGFQHWGESMMSDGK

SEQ ID NO: 659092 - protein, 18 aa, Mycobacterium
FGGGFQHWGETMMTDGQW

SEQ ID NO: 659093 - protein, 17 aa, Mycobacterium
FGGGGGGGGAGGHGGNG

SEQ ID NO: 659094 - protein, 18 aa, Mycobacterium
FGGGHGHGGFGPHIGIPG

SEQ ID NO: 659095 - protein, 23 aa, Mycobacterium
FGGGMMRCIGASFATMEMDVTLR

SEQ ID NO: 659096 - protein, 21 aa, Mycobacterium
FGGGPRMPMVPGTWEQDAVNG

SEQ ID NO: 659097 - protein, 26 aa, Mycobacterium
FGGGSRRCLGAAFAMAEMRVVLREIL

SEQ ID NO: 659098 - protein, 21 aa, Mycobacterium
FGGGVRRCLGATFAECEMRIV

SEQ ID NO: 659099 - protein, 34 aa, Mycobacterium
FGGHAQEYQALVARAEAFHQQFVQLMTTGAGSYA

SEQ ID NO: 659100 - protein, 28 aa, Mycobacterium
FGGHCGTCVPCRKGLFIHCVNGQVPSLS

SEQ ID NO: 659101 - protein, 17 aa, Mycobacterium
FGGIEMIQQATVLLSSM

SEQ ID NO: 659102 - protein, 19 aa, Mycobacterium
FGGIKRSGFGRELGRFGME

SEQ ID NO: 659103 - protein, 26 aa, Mycobacterium
FGGIKRSGFGRELGTLGIDEFVNKQV

SEQ ID NO: 659104 - protein, 18 aa, Mycobacterium
FGGIPQPWLRDLAKRWAR

SEQ ID NO: 659105 - protein, 23 aa, Mycobacterium
FGGKSELFLAIFEQLADDVERRI

SEQ ID NO: 659106 - protein, 18 aa, Mycobacterium
FGGLAGRLHYDADHFDDT

SEQ ID NO: 659107 - protein, 18 aa, Mycobacterium
FGGLDVFFANAGIAYPTP

SEQ ID NO: 659108 - protein, 19 aa, Mycobacterium
FGGLHAWADRVDHCCLLNS

SEQ ID NO: 659109 - protein, 18 aa, Mycobacterium
FGGLPAYQQRLGRKVRFM

SEQ ID NO: 659110 - protein, 17 aa, Mycobacterium
FGGMKLDFLLTIDPEYY

SEQ ID NO: 659111 - protein, 19 aa, Mycobacterium
FGGPAAVGALLLRRDVACV

SEQ ID NO: 659112 - protein, 19 aa, Mycobacterium
FGGPAGVGALLLRRDTACV

SEQ ID NO: 659113 - protein, 25 aa, Mycobacterium
FGGPAYPRGFMRLGGVGSREPFEAP

SEQ ID NO: 659114 - protein, 23 aa, Mycobacterium
FGGPGRRALGFTPSYSMHPIISD

SEQ ID NO: 659115 - protein, 18 aa, Mycobacterium
FGGPLLDGFDNLYVGQPG

SEQ ID NO: 659116 - protein, 22 aa, Mycobacterium
FGGQAGTPLAVYAANNSLTAAQ

SEQ ID NO: 659117 - protein, 20 aa, Mycobacterium
FGGQPILLDVCRIAEDAGAE

SEQ ID NO: 659118 - protein, 23 aa, Mycobacterium
FGGRAEFAGPISTVRCFQDNALL

SEQ ID NO: 659119 - protein, 24 aa, Mycobacterium
FGGRAEFAGPISTVRCFQDNALLK

SEQ ID NO: 659120 - protein, 17 aa, Mycobacterium
FGGRAKEVIRYKGENLS

SEQ ID NO: 659121 - protein, 25 aa, Mycobacterium
FGGRPVLRDVEWRIAPGERTGIVGA

SEQ ID NO: 659122 - protein, 25 aa, Mycobacterium
FGGSAYPQMLLRVGWAPINADPLPA

SEQ ID NO: 659123 - protein, 25 aa, Mycobacterium
FGGSLIHGLLHDWPLEKTLRYANAA

SEQ ID NO: 659124 - protein, 17 aa, Mycobacterium
FGGSLIRRAAEVLRRPT

SEQ ID NO: 659125 - protein, 19 aa, Mycobacterium
FGGSTALSGGGIWVPGAPS

SEQ ID NO: 659126 - protein, 22 aa, Mycobacterium
FGGTGGNGGLLFGNGGTGGAAG

SEQ ID NO: 659127 - protein, 26 aa, Mycobacterium
FGGTIAHGLLTLSLLPRFTHQLYTVD

SEQ ID NO: 659128 - protein, 17 aa, Mycobacterium
FGGTVCIHPSQIPVVRE

SEQ ID NO: 659129 - protein, 19 aa, Mycobacterium
FGGVVPEIASRAHLEALGV

SEQ ID NO: 659130 - protein, 17 aa, Mycobacterium
FGGYDGRFGTIVDSTLF

SEQ ID NO: 659131 - protein, 17 aa, Mycobacterium
FGGYLSGPRVIDAGTKD

SEQ ID NO: 659132 - protein, 17 aa, Mycobacterium
FGHAVKTFYRDAFAKHQ

SEQ ID NO: 659133 - protein, 27 aa, Mycobacterium
FGHDIGYRIAHHADLDAPPPVEVHEYT

SEQ ID NO: 659134 - protein, 22 aa, Mycobacterium
FGHDRYDDFFAMAYRVLPADGV

SEQ ID NO: 659135 - protein, 18 aa, Mycobacterium
FGHEPMRLLTVVQAPLQR

SEQ ID NO: 659136 - protein, 18 aa, Mycobacterium
FGHGDPWTAMRAAVHRTT

SEQ ID NO: 659137 - protein, 18 aa, Mycobacterium
FGHGLWGFTDALRAAGWD

SEQ ID NO: 659138 - protein, 19 aa, Mycobacterium
FGHGSDAWLAELAALPLVH

SEQ ID NO: 659139 - protein, 18 aa, Mycobacterium
FGHIGLGGSMGWADPKRK

SEQ ID NO: 659140 - protein, 17 aa, Mycobacterium
FGHLEAAAGLLSVAKIV

SEQ ID NO: 659141 - protein, 31 aa, Mycobacterium
FGHPSFRYYGWGPRMWWWAQTMGIRKFQEMV

SEQ ID NO: 659142 - protein, 18 aa, Mycobacterium
FGHQEFEGGVGRPARAQP

SEQ ID NO: 659143 - protein, 24 aa, Mycobacterium
FGHSMGAVVAFEFARVAETHGAAV

SEQ ID NO: 659144 - protein, 26 aa, Mycobacterium
FGHSMGAVVSFEFARLAEAAGLDVHQ

SEQ ID NO: 659145 - protein, 17 aa, Mycobacterium
FGHSRFAGSAPRRNAQL

SEQ ID NO: 659146 - protein, 27 aa, Mycobacterium
FGHSRFDSGGLIFAEFEPGRALLGTVE

SEQ ID NO: 659147 - protein, 26 aa, Mycobacterium
FGIAERRGPICYLVHAGVGMDFGRNA

SEQ ID NO: 659148 - protein, 23 aa, Mycobacterium
FGIAGLRPRLARRVDDADSTRRR

SEQ ID NO: 659149 - protein, 19 aa, Mycobacterium
FGICAKHAPGYFSLDDWGY

SEQ ID NO: 659150 - protein, 17 aa, Mycobacterium
FGIDIVVASVRRAQEQG

SEQ ID NO: 659151 - protein, 18 aa, Mycobacterium
FGIEPDLAEALVCAAARE

SEQ ID NO: 659152 - protein, 24 aa, Mycobacterium
FGIEVPDRQLACVPVNSPEGRAYL

SEQ ID NO: 659153 - protein, 20 aa, Mycobacterium
FGIPEVKRGLVAAGGGLLRL

SEQ ID NO: 659154 - protein, 18 aa, Mycobacterium
FGIPEVKRGLVAGAGGLL

SEQ ID NO: 659155 - protein, 20 aa, Mycobacterium
FGIPEVKRGLVAGGGGLLRL

SEQ ID NO: 659156 - protein, 23 aa, Mycobacterium
FGIPEVKRGLVAGGGGLLRLPER

SEQ ID NO: 659157 - protein, 19 aa, Mycobacterium
FGIPGEALSPVAQSVAHSL

SEQ ID NO: 659158 - protein, 22 aa, Mycobacterium
FGIPGGAVLPVYDPLFDSKKLR

SEQ ID NO: 659159 - protein, 20 aa, Mycobacterium
FGIRADPALWQEVLVRLTPR

SEQ ID NO: 659160 - protein, 21 aa, Mycobacterium
FGIRLYPMGNIEQGIVHVVGP

SEQ ID NO: 659161 - protein, 23 aa, Mycobacterium
FGISEACLHRWLKIADREDGRGQ

SEQ ID NO: 659162 - protein, 23 aa, Mycobacterium
FGISEACLHRWLKIADRQDGGDR

SEQ ID NO: 659163 - protein, 26 aa, Mycobacterium
FGISGEATFDYGVAFDRSRKVADGRV

SEQ ID NO: 659164 - protein, 26 aa, Mycobacterium
FGISGEATFDYGVAFDRSRKVAEGRV

SEQ ID NO: 659165 - protein, 17 aa, Mycobacterium
FGIVKGLMTTIHAYTQD

SEQ ID NO: 659166 - protein, 17 aa, Mycobacterium
FGIVKGLMTTVHAYTQD

SEQ ID NO: 659167 - protein, 17 aa, Mycobacterium
FGIVLVEAMAAGTAVVA

SEQ ID NO: 659168 - protein, 24 aa, Mycobacterium
FGKAKEILGTVIGRNDLVNEGQAQ

SEQ ID NO: 659169 - protein, 17 aa, Mycobacterium
FGKFVLCQLDDLWRQFD

SEQ ID NO: 659170 - protein, 17 aa, Mycobacterium
FGKKRKMSFPAAIRSNF

SEQ ID NO: 659171 - protein, 21 aa, Mycobacterium
FGKKVEAGWVNVLRSDATPIE

SEQ ID NO: 659172 - protein, 25 aa, Mycobacterium
FGKNTFHGLALLRHVNDLVNTGWPV

SEQ ID NO: 659173 - protein, 27 aa, Mycobacterium
FGKNTYHGLSLLRHVKDLVNTGWPVLM

SEQ ID NO: 659174 - protein, 27 aa, Mycobacterium
FGKNTYHGLSLLRHVKELVNTGWPVLM

SEQ ID NO: 659175 - protein, 25 aa, Mycobacterium
FGKRDVMVIHTLLWPDEIRDPDFPI

SEQ ID NO: 659176 - protein, 22 aa, Mycobacterium
FGKSPRDAERWALGPDERNAQL

SEQ ID NO: 659177 - protein, 20 aa, Mycobacterium
FGKVMLALPLQIGFPTAIDG

SEQ ID NO: 659178 - protein, 19 aa, Mycobacterium
FGLAHIRPDDVLAAFSDLS

SEQ ID NO: 659179 - protein, 25 aa, Mycobacterium
FGLAIPEPYGFGAVSMPCYVQVAEE

SEQ ID NO: 659180 - protein, 24 aa, Mycobacterium
FGLARRLSAAGADVVMAIRNRAKG

SEQ ID NO: 659181 - protein, 19 aa, Mycobacterium
FGLARRLSASGAEVVMAIR

SEQ ID NO: 659182 - protein, 18 aa, Mycobacterium
FGLARVLDGLEPVINRTA

SEQ ID NO: 659183 - protein, 17 aa, Mycobacterium
FGLCAKQAPGYFTLDDW

SEQ ID NO: 659184 - protein, 19 aa, Mycobacterium
FGLDGPWRNNVGFAQTMEQ

SEQ ID NO: 659185 - protein, 17 aa, Mycobacterium
FGLDKFPLWTGQPYDID

SEQ ID NO: 659186 - protein, 21 aa, Mycobacterium
FGLEGPWRDNPAFAYVIEAAS

SEQ ID NO: 659187 - protein, 18 aa, Mycobacterium
FGLERIIVNSAADWGRSD

SEQ ID NO: 659188 - protein, 18 aa, Mycobacterium
FGLFPEVDPKVVAQQLVI

SEQ ID NO: 659189 - protein, 18 aa, Mycobacterium
FGLGCVAGAAGIARMHDY

SEQ ID NO: 659190 - protein, 18 aa, Mycobacterium
FGLGCVAGAAGVARLHDY

SEQ ID NO: 659191 - protein, 18 aa, Mycobacterium
FGLGCVAGAAGVARLNDY

SEQ ID NO: 659192 - protein, 17 aa, Mycobacterium
FGLGCVAGAAGVARMHD

SEQ ID NO: 659193 - protein, 17 aa, Mycobacterium
FGLGLWLVDWRFPNRLN

SEQ ID NO: 659194 - protein, 18 aa, Mycobacterium
FGLHPDKVLAELKEAQEL

SEQ ID NO: 659195 - protein, 24 aa, Mycobacterium
FGLHRMTRAVLPHMRARGRGRILN

SEQ ID NO: 659196 - protein, 17 aa, Mycobacterium
FGLIPDVAHDIDVFRNW

SEQ ID NO: 659197 - protein, 28 aa, Mycobacterium
FGLIPEFIGRLPIVASVTNLDRESLIKI

SEQ ID NO: 659198 - protein, 25 aa, Mycobacterium
FGLIPEFIGRLPVVASVTNLDKASL

SEQ ID NO: 659199 - protein, 17 aa, Mycobacterium
FGLIVYQEQIMFIAQKV

SEQ ID NO: 659200 - protein, 18 aa, Mycobacterium
FGLLDHIEFGNGVVHAER

SEQ ID NO: 659201 - protein, 18 aa, Mycobacterium
FGLLRAGAIPVMCLPGHR

SEQ ID NO: 659202 - protein, 17 aa, Mycobacterium
FGLMLPVEPDTRLLGET

SEQ ID NO: 659203 - protein, 17 aa, Mycobacterium
FGLNMPIAREVDAVINH

SEQ ID NO: 659204 - protein, 18 aa, Mycobacterium
FGLPELQLGLIPGAGGTL

SEQ ID NO: 659205 - protein, 19 aa, Mycobacterium
FGLPHPDWQVFLDVSPELA

SEQ ID NO: 659206 - protein, 19 aa, Mycobacterium
FGLPPHRYLTGRRVDEARR

SEQ ID NO: 659207 - protein, 20 aa, Mycobacterium
FGLQYCHGVGLSVWEKPLMS

SEQ ID NO: 659208 - protein, 17 aa, Mycobacterium
FGLRLLRHVREAQQAGR

SEQ ID NO: 659209 - protein, 17 aa, Mycobacterium
FGLRPVTGIDPAAVSPW

SEQ ID NO: 659210 - protein, 23 aa, Mycobacterium
FGLSGYSGGLTYLYATYHAPVDF

SEQ ID NO: 659211 - protein, 19 aa, Mycobacterium
FGLSRIPIREALKTLEAEE

SEQ ID NO: 659212 - protein, 20 aa, Mycobacterium
FGLTEAMASYSTRLKITPTR

SEQ ID NO: 659213 - protein, 19 aa, Mycobacterium
FGLVAMAWRDEDFVQAWLH

SEQ ID NO: 659214 - protein, 17 aa, Mycobacterium
FGLVDLYNAPSMRELDT

SEQ ID NO: 659215 - protein, 17 aa, Mycobacterium
FGLVKINPIAAWTDEDM

SEQ ID NO: 659216 - protein, 19 aa, Mycobacterium
FGMEGMKVVLADVLAEPLD

SEQ ID NO: 659217 - protein, 23 aa, Mycobacterium
FGMLDAFHPGRIDLGVGRSAQRR

SEQ ID NO: 659218 - protein, 28 aa, Mycobacterium
FGMLDAFYPGRIDLGLGRSAQRRGIKPR

SEQ ID NO: 659219 - protein, 19 aa, Mycobacterium
FGMNCHWSQGQSCGSTTRL

SEQ ID NO: 659220 - protein, 23 aa, Mycobacterium
FGMPAADALRAWLDDGRPALVTA

SEQ ID NO: 659221 - protein, 19 aa, Mycobacterium
FGMRADAVVPAYGMAEATL

SEQ ID NO: 659222 - protein, 17 aa, Mycobacterium
FGMRFPSPIFMAPIGVI

SEQ ID NO: 659223 - protein, 24 aa, Mycobacterium
FGMSEERVRLISPFVGGAFGSAGR

SEQ ID NO: 659224 - protein, 19 aa, Mycobacterium
FGMSMRFIKSRAAFVDKVR

SEQ ID NO: 659225 - protein, 17 aa, Mycobacterium
FGMTVLLTTHYMGEADA

SEQ ID NO: 659226 - protein, 19 aa, Mycobacterium
FGNAGRLNAGYGNAGILNA

SEQ ID NO: 659227 - protein, 17 aa, Mycobacterium
FGNAGSRTHGYGQVAKE

SEQ ID NO: 659228 - protein, 19 aa, Mycobacterium
FGNFAARTSGFLNVGSGSS

SEQ ID NO: 659229 - protein, 26 aa, Mycobacterium
FGNGLWMSLRVARRLEQRDIAVRVVD

SEQ ID NO: 659230 - protein, 25 aa, Mycobacterium
FGNGMLLRRGIRLVAAFDHRHIFVD

SEQ ID NO: 659231 - protein, 24 aa, Mycobacterium
FGNGNRGNLNWGSGNLGNANVGFG

SEQ ID NO: 659232 - protein, 20 aa, Mycobacterium
FGNLGARTSGFLNVGSGISG

SEQ ID NO: 659233 - protein, 17 aa, Mycobacterium
FGNLGLVNIAIWADPAR

SEQ ID NO: 659234 - protein, 17 aa, Mycobacterium
FGNLGWDNVGFFNSGVG

SEQ ID NO: 659235 - protein, 17 aa, Mycobacterium
FGNRAIYHEGWIASCFH

SEQ ID NO: 659236 - protein, 17 aa, Mycobacterium
FGNRGPWSTRLGYGPLV

SEQ ID NO: 659237 - protein, 25 aa, Mycobacterium
FGNRLLRTPLRGVGMALVELGLGGA

SEQ ID NO: 659238 - protein, 19 aa, Mycobacterium
FGNTGAWNVGIGNIGNYNL

SEQ ID NO: 659239 - protein, 23 aa, Mycobacterium
FGNTGSWNLGMGNIGDFNPGSGN

SEQ ID NO: 659240 - protein, 24 aa, Mycobacterium
FGNTGVPGIIFGPALSGGNSGLFN

SEQ ID NO: 659241 - protein, 19 aa, Mycobacterium
FGNVIRLLPPLTITDELLA

SEQ ID NO: 659242 - protein, 23 aa, Mycobacterium
FGNVLRFLPPLSISDELLTEAFD

SEQ ID NO: 659243 - protein, 24 aa, Mycobacterium
FGNVLRFLPPLTITDELLVDAFGV

SEQ ID NO: 659244 - protein, 24 aa, Mycobacterium
FGPACPQPVFPNMPLDLGAPQGED

SEQ ID NO: 659245 - protein, 17 aa, Mycobacterium
FGPALRLDAVRIGATPA

SEQ ID NO: 659246 - protein, 23 aa, Mycobacterium
FGPDFPFEFDAWISHPDGLGQVP

SEQ ID NO: 659247 - protein, 18 aa, Mycobacterium
FGPDMLAALGADVSMQAL

SEQ ID NO: 659248 - protein, 17 aa, Mycobacterium
FGPDRVISADNLRDAID

SEQ ID NO: 659249 - protein, 17 aa, Mycobacterium
FGPERVITATTLPDAIE

SEQ ID NO: 659250 - protein, 23 aa, Mycobacterium
FGPEVRRKLVLKQLVDLYGEQAN

SEQ ID NO: 659251 - protein, 26 aa, Mycobacterium
FGPGDLEKAWPLWEADGYLTRMSGTH

SEQ ID NO: 659252 - protein, 19 aa, Mycobacterium
FGPGEVLWTAMPLFHLSAA

SEQ ID NO: 659253 - protein, 18 aa, Mycobacterium
FGPGGARGGGRRGGPGRG

SEQ ID NO: 659254 - protein, 30 aa, Mycobacterium
FGPGGLGTFSWPGAYGTWWQADPGADLILL

SEQ ID NO: 659255 - protein, 17 aa, Mycobacterium
FGPGKGLGVIPREGYFQ

SEQ ID NO: 659256 - protein, 20 aa, Mycobacterium
FGPGLRPWPGLPGRARDALM

SEQ ID NO: 659257 - protein, 18 aa, Mycobacterium
FGPGSFGPGFGFGPGSRR

SEQ ID NO: 659258 - protein, 20 aa, Mycobacterium
FGPHPTWYAAPGIPHDGFLA

SEQ ID NO: 659259 - protein, 28 aa, Mycobacterium
FGPIGAHYLGAFAMTSAKQGLDVGQLAM

SEQ ID NO: 659260 - protein, 25 aa, Mycobacterium
FGPLARTRIRPHFFPFTEPSAEVDV

SEQ ID NO: 659261 - protein, 18 aa, Mycobacterium
FGPLEARDELAACEILAD

SEQ ID NO: 659262 - protein, 18 aa, Mycobacterium
FGPLEAREELAACEILAD

SEQ ID NO: 659263 - protein, 17 aa, Mycobacterium
FGPLRFGHSRFDRGGMI

SEQ ID NO: 659264 - protein, 26 aa, Mycobacterium
FGPLRLQFWVCGVFEVHNGRITLWRD

SEQ ID NO: 659265 - protein, 28 aa, Mycobacterium
FGPMTRRLACLRGISTLTGFALAVEIGD

SEQ ID NO: 659266 - protein, 18 aa, Mycobacterium
FGPNLMIMNHFGFTPVWL

SEQ ID NO: 659267 - protein, 24 aa, Mycobacterium
FGPNPLDPGCRVASARAGREQGRR

SEQ ID NO: 659268 - protein, 18 aa, Mycobacterium
FGPPELRQSYAEAIAAAE

SEQ ID NO: 659269 - protein, 20 aa, Mycobacterium
FGPSAIREASRLLKPYHPAL

SEQ ID NO: 659270 - protein, 18 aa, Mycobacterium
FGPTLAEALERYDRRPRL

SEQ ID NO: 659271 - protein, 17 aa, Mycobacterium
FGPTLAETLEKAGGEPQ

SEQ ID NO: 659272 - protein, 24 aa, Mycobacterium
FGPVARGGLRWSDRRDDFRTEILG

SEQ ID NO: 659273 - protein, 25 aa, Mycobacterium
FGPVARGGLRWSDRREDFRTEILGL

SEQ ID NO: 659274 - protein, 17 aa, Mycobacterium
FGPVLAVIPFRDSDEAL

SEQ ID NO: 659275 - protein, 19 aa, Mycobacterium
FGPVLPILRYSRVDEAVER

SEQ ID NO: 659276 - protein, 17 aa, Mycobacterium
FGPVLTVLRCRDDDDAV

SEQ ID NO: 659277 - protein, 17 aa, Mycobacterium
FGPVLVVIGYDGDEQAI

SEQ ID NO: 659278 - protein, 23 aa, Mycobacterium
FGPVQLRVGPGVFIPRPETEALL

SEQ ID NO: 659279 - protein, 23 aa, Mycobacterium
FGPYARAMIRVCKEESFHQRQAY

SEQ ID NO: 659280 - protein, 21 aa, Mycobacterium
FGQDRLEAMAEAATVPVVNAL

SEQ ID NO: 659281 - protein, 24 aa, Mycobacterium
FGQIARGGVRWSDRLDDYRTEVLG

SEQ ID NO: 659282 - protein, 25 aa, Mycobacterium
FGQLGRDRVPVFLLPANPVSALVVF

SEQ ID NO: 659283 - protein, 20 aa, Mycobacterium
FGQLPLRPTVAFECVGVPGL

SEQ ID NO: 659284 - protein, 26 aa, Mycobacterium
FGQPLCWDDLSWLRSLTELPLIVKGI

SEQ ID NO: 659285 - protein, 20 aa, Mycobacterium
FGQPLVLHCVHRNAAVPPSF

SEQ ID NO: 659286 - protein, 23 aa, Mycobacterium
FGQPRPMPGYWREVEKQVEAKRK

SEQ ID NO: 659287 - protein, 18 aa, Mycobacterium
FGQRFPDRLFDVGIAEQH

SEQ ID NO: 659288 - protein, 27 aa, Mycobacterium
FGQRVKWNLMAWWSAKMLMAARNDIAI

SEQ ID NO: 659289 - protein, 21 aa, Mycobacterium
FGQSGTFLWVDPVADLALLVL

SEQ ID NO: 659290 - protein, 18 aa, Mycobacterium
FGQVQTRLVGNAGVQADS

SEQ ID NO: 659291 - protein, 25 aa, Mycobacterium
FGRAADFARPLTVIAGAATRWVWVA

SEQ ID NO: 659292 - protein, 17 aa, Mycobacterium
FGRAEVRNFLVANALYW

SEQ ID NO: 659293 - protein, 19 aa, Mycobacterium
FGRALGFAGEAARAREISD

SEQ ID NO: 659294 - protein, 20 aa, Mycobacterium
FGRAMLRDRVGVSAGCGLAG

SEQ ID NO: 659295 - protein, 26 aa, Mycobacterium
FGRDIGYRIAHHADLNAPPPIEVHEY

SEQ ID NO: 659296 - protein, 23 aa, Mycobacterium
FGRDRLAPFEVPASFQQAAELPH

SEQ ID NO: 659297 - protein, 17 aa, Mycobacterium
FGREGMRVVLADVLAEP

SEQ ID NO: 659298 - protein, 26 aa, Mycobacterium
FGRELFIDKVWDWKRESGGTIGAQMR

SEQ ID NO: 659299 - protein, 24 aa, Mycobacterium
FGREVRLTGFWLGNWYASEPRHEI

SEQ ID NO: 659300 - protein, 17 aa, Mycobacterium
FGRFEGKTAMQMGVDAI

SEQ ID NO: 659301 - protein, 22 aa, Mycobacterium
FGRFTPRARGAVVAAQNAAHEA

SEQ ID NO: 659302 - protein, 22 aa, Mycobacterium
FGRFTPRARSAVVAAQNAAHQG

SEQ ID NO: 659303 - protein, 17 aa, Mycobacterium
FGRGGDWSILKKMTAAL

SEQ ID NO: 659304 - protein, 21 aa, Mycobacterium
FGRHLPFGLTVTMDGRQGADL

SEQ ID NO: 659305 - protein, 19 aa, Mycobacterium
FGRHVMKHVDEIGGVPVVM

SEQ ID NO: 659306 - protein, 20 aa, Mycobacterium
FGRIDGRPVGIVANQPTQFA

SEQ ID NO: 659307 - protein, 20 aa, Mycobacterium
FGRIEGRPVGIVANQPTHFA

SEQ ID NO: 659308 - protein, 17 aa, Mycobacterium
FGRIRDVVISISIVRQQ

SEQ ID NO: 659309 - protein, 20 aa, Mycobacterium
FGRLPTAYPYTLMISQADTE

SEQ ID NO: 659310 - protein, 17 aa, Mycobacterium
FGRMGLRLPATVVAVDG

SEQ ID NO: 659311 - protein, 26 aa, Mycobacterium
FGRNEVRNFLVANALYWLEEYHVDGL

SEQ ID NO: 659312 - protein, 17 aa, Mycobacterium
FGRPGGAPRRGRKSKRA

SEQ ID NO: 659313 - protein, 18 aa, Mycobacterium
FGRPLSKFQAIQHLIADI

SEQ ID NO: 659314 - protein, 28 aa, Mycobacterium
FGRPMILKRFVKGIATEAIFQKRAPEKR

SEQ ID NO: 659315 - protein, 27 aa, Mycobacterium
FGRQLRYDLSAGFPLLTTKKVHLKSVV

SEQ ID NO: 659316 - protein, 17 aa, Mycobacterium
FGRRPRREGVLTLPNEA

SEQ ID NO: 659317 - protein, 17 aa, Mycobacterium
FGRRVAVLVHHCHRELW

SEQ ID NO: 659318 - protein, 25 aa, Mycobacterium
FGRRVAVVACEFDFLAGSIGVAAAE

SEQ ID NO: 659319 - protein, 25 aa, Mycobacterium
FGRRVAVVVCEFGFLGGSIGVAAAE

SEQ ID NO: 659320 - protein, 19 aa, Mycobacterium
FGRTVLRDRVGVAPGCGLA

SEQ ID NO: 659321 - protein, 21 aa, Mycobacterium
FGRVDGRPVGIVANQPTQFAG

SEQ ID NO: 659322 - protein, 26 aa, Mycobacterium
FGRVIGRWSALPGVDAIRVYRVPAEL

SEQ ID NO: 659323 - protein, 18 aa, Mycobacterium
FGRYWPANIHMIGKDIIR

SEQ ID NO: 659324 - protein, 20 aa, Mycobacterium
FGSAAWRVAEAHGRYAPTYF

SEQ ID NO: 659325 - protein, 27 aa, Mycobacterium
FGSAAYWKRHVRDAVRFADSIRFAQSA

SEQ ID NO: 659326 - protein, 25 aa, Mycobacterium
FGSAQLSRRGFIGAGIAGGLALAGC

SEQ ID NO: 659327 - protein, 24 aa, Mycobacterium
FGSARSASALSSRIADWEKESAEH

SEQ ID NO: 659328 - protein, 24 aa, Mycobacterium
FGSASILPITWAYIRMMGADGLRT

SEQ ID NO: 659329 - protein, 26 aa, Mycobacterium
FGSCQAIWRLEHGYLAASDPRRDGQA

SEQ ID NO: 659330 - protein, 17 aa, Mycobacterium
FGSCRFATLTATAGNTH

SEQ ID NO: 659331 - protein, 17 aa, Mycobacterium
FGSDFSRERYDRLGSVS

SEQ ID NO: 659332 - protein, 22 aa, Mycobacterium
FGSERIVAAPVTFVDIAGLVKG

SEQ ID NO: 659333 - protein, 20 aa, Mycobacterium
FGSEVVRRADIPQNDPGVRV

SEQ ID NO: 659334 - protein, 25 aa, Mycobacterium
FGSFLIPRTDYRIDDVWNVVGLKAT

SEQ ID NO: 659335 - protein, 17 aa, Mycobacterium
FGSFNFGDGNRGSNNFG

SEQ ID NO: 659336 - protein, 26 aa, Mycobacterium
FGSGELFDAATLRRLYPGGSTEYLER

SEQ ID NO: 659337 - protein, 19 aa, Mycobacterium
FGSGGIGGPGGFAVAASGN

SEQ ID NO: 659338 - protein, 24 aa, Mycobacterium
FGSGGRYRLGLDGTELDSDAWSEV

SEQ ID NO: 659339 - protein, 18 aa, Mycobacterium
FGSGNRGGNVNFGNGNNG

SEQ ID NO: 659340 - protein, 29 aa, Mycobacterium
FGSGVSPGFAELLAIVAGTACDRIDKVVI

SEQ ID NO: 659341 - protein, 21 aa, Mycobacterium
FGSGVSPGFAELLAIVSAMVC

SEQ ID NO: 659342 - protein, 21 aa, Mycobacterium
FGSLEGILGCVAADMGVSLLP

SEQ ID NO: 659343 - protein, 25 aa, Mycobacterium
FGSLHMPDFPLLPVRVETWEGLVFV

SEQ ID NO: 659344 - protein, 18 aa, Mycobacterium
FGSLKKVNPGIVVVDSSA

SEQ ID NO: 659345 - protein, 29 aa, Mycobacterium
FGSLNLVGGLARSMAKAGYCDLKEFQKVG

SEQ ID NO: 659346 - protein, 24 aa, Mycobacterium
FGSLPEGGRMVAVFADAKRVEQVA

SEQ ID NO: 659347 - protein, 17 aa, Mycobacterium
FGSLRPLLDTAVANGRG

SEQ ID NO: 659348 - protein, 24 aa, Mycobacterium
FGSLTSGLAAQAWQGPASTAMVAA

SEQ ID NO: 659349 - protein, 17 aa, Mycobacterium
FGSMVMSLLGFDDQVAT

SEQ ID NO: 659350 - protein, 27 aa, Mycobacterium
FGSPHGGTWLPWLTDRGFTAVHSQADV

SEQ ID NO: 659351 - protein, 26 aa, Mycobacterium
FGSRAIYRDGWWACARLDRAPWDLSP

SEQ ID NO: 659352 - protein, 17 aa, Mycobacterium
FGSRQGLAQGYALRLAD

SEQ ID NO: 659353 - protein, 17 aa, Mycobacterium
FGSRQGLAQGYALRLTD

SEQ ID NO: 659354 - protein, 23 aa, Mycobacterium
FGSRQGLAQGYAMRLADRLVDQI

SEQ ID NO: 659355 - protein, 24 aa, Mycobacterium
FGSSGLRTTVQFIGPLSVVDNVLA

SEQ ID NO: 659356 - protein, 25 aa, Mycobacterium
FGSSLRFYANTALRIARVRTHRRLK

SEQ ID NO: 659357 - protein, 29 aa, Mycobacterium
FGSSSFRYAAPAGRDWKIADLAGKRVATA

SEQ ID NO: 659358 - protein, 19 aa, Mycobacterium
FGSSYPHWQCHDVGDIRQL

SEQ ID NO: 659359 - protein, 20 aa, Mycobacterium
FGSSYPHWQCYDLRDVRNLP

SEQ ID NO: 659360 - protein, 17 aa, Mycobacterium
FGSTAAIFPIDDVTIEY

SEQ ID NO: 659361 - protein, 17 aa, Mycobacterium
FGSVAAQLREFLDSLGG

SEQ ID NO: 659362 - protein, 18 aa, Mycobacterium
FGSVKGFNDDSTWNDLKV

SEQ ID NO: 659363 - protein, 19 aa, Mycobacterium
FGSVTSGLVGSSWQGAAAA

SEQ ID NO: 659364 - protein, 18 aa, Mycobacterium
FGSWDWRLYSAEAVAEIR

SEQ ID NO: 659365 - protein, 18 aa, Mycobacterium
FGSYRRQLSLGEGIDTSA

SEQ ID NO: 659366 - protein, 18 aa, Mycobacterium
FGTAAGPHPFPMMVRDFQ

SEQ ID NO: 659367 - protein, 26 aa, Mycobacterium
FGTAGCNLACKFCQNWDISKSRETDT

SEQ ID NO: 659368 - protein, 18 aa, Mycobacterium
FGTDCFAERARDKAGNAD

SEQ ID NO: 659369 - protein, 29 aa, Mycobacterium
FGTDEQKLRWAVPILRAQITASLGMSEPS

SEQ ID NO: 659370 - protein, 17 aa, Mycobacterium
FGTDIGVAFQLRDDVLG

SEQ ID NO: 659371 - protein, 23 aa, Mycobacterium
FGTDLLERFRDLIVLQAVPDAVE

SEQ ID NO: 659372 - protein, 17 aa, Mycobacterium
FGTDWGQPVIPEHPDMG

SEQ ID NO: 659373 - protein, 18 aa, Mycobacterium
FGTEAPRVVFLHGGGQNA

SEQ ID NO: 659374 - protein, 20 aa, Mycobacterium
FGTEVKALWWDEGRRQWQIH

SEQ ID NO: 659375 - protein, 23 aa, Mycobacterium
FGTFREIERLMGLHDTPPEQPVV

SEQ ID NO: 659376 - protein, 17 aa, Mycobacterium
FGTGAFRANLQAASEAA

SEQ ID NO: 659377 - protein, 27 aa, Mycobacterium
FGTGRGHLAALIAHAGFDCYSTDVMDY

SEQ ID NO: 659378 - protein, 18 aa, Mycobacterium
FGTIPLLGLDVFEHAYYL

SEQ ID NO: 659379 - protein, 21 aa, Mycobacterium
FGTKIMRYMHDHGITEETLAR

SEQ ID NO: 659380 - protein, 17 aa, Mycobacterium
FGTLVAGKNLLGCLVGS

SEQ ID NO: 659381 - protein, 17 aa, Mycobacterium
FGTNGWHPGEPWIADTT

SEQ ID NO: 659382 - protein, 23 aa, Mycobacterium
FGTPDSWVIWNLTGGVRSGVHVT

SEQ ID NO: 659383 - protein, 17 aa, Mycobacterium
FGTPGMPGMPGMPGMPA

SEQ ID NO: 659384 - protein, 34 aa, Mycobacterium
FGTPNFTGRSWPLADVRLLAPILASKVVCIGKNY

SEQ ID NO: 659385 - protein, 17 aa, Mycobacterium
FGTPRTMLNVAVGGARR

SEQ ID NO: 659386 - protein, 23 aa, Mycobacterium
FGTPSGRGGAAFLSRVPPAQLPD

SEQ ID NO: 659387 - protein, 23 aa, Mycobacterium
FGTPSGRGGAAFLSRVPPNQLPD

SEQ ID NO: 659388 - protein, 23 aa, Mycobacterium
FGTSGPRSSWRATDPVLYAMSGS

SEQ ID NO: 659389 - protein, 22 aa, Mycobacterium
FGTTALMMLKCVMAKNCNIKCP

SEQ ID NO: 659390 - protein, 19 aa, Mycobacterium
FGTTLGRRGNRGLGGALQN

SEQ ID NO: 659391 - protein, 26 aa, Mycobacterium
FGTTQRFGVPMGFGGPHAGYLAVHSK

SEQ ID NO: 659392 - protein, 26 aa, Mycobacterium
FGTTQRFGVPMGFGGPHAGYLAVHTA

SEQ ID NO: 659393 - protein, 21 aa, Mycobacterium
FGVADARLGQRVAAAVVTTPE

SEQ ID NO: 659394 - protein, 18 aa, Mycobacterium
FGVCRDGHFYAAGRAALC

SEQ ID NO: 659395 - protein, 17 aa, Mycobacterium
FGVDGLMEAVRAIADGD

SEQ ID NO: 659396 - protein, 25 aa, Mycobacterium
FGVDQLRYFLLREVPFGQDGSYSED

SEQ ID NO: 659397 - protein, 24 aa, Mycobacterium
FGVDQLRYFLLREVSFGQDGSYSE

SEQ ID NO: 659398 - protein, 22 aa, Mycobacterium
FGVDQVRYFLLREVPFGQDGSF

SEQ ID NO: 659399 - protein, 17 aa, Mycobacterium
FGVDSFAGSVLADVGVD

SEQ ID NO: 659400 - protein, 22 aa, Mycobacterium
FGVEPPVALILQGASLHDLTVD

SEQ ID NO: 659401 - protein, 22 aa, Mycobacterium
FGVEPPVALLLQGATLNDVALD

SEQ ID NO: 659402 - protein, 21 aa, Mycobacterium
FGVGATECLGRARAALESTDD

SEQ ID NO: 659403 - protein, 17 aa, Mycobacterium
FGVGIAFPGFRTDPTGL

SEQ ID NO: 659404 - protein, 18 aa, Mycobacterium
FGVGKTHLLASIYHTVPG

SEQ ID NO: 659405 - protein, 18 aa, Mycobacterium
FGVITKVRLRVHRIPETT

SEQ ID NO: 659406 - protein, 17 aa, Mycobacterium
FGVKILLDVLGYDRLIG

SEQ ID NO: 659407 - protein, 26 aa, Mycobacterium
FGVLPRLDAPTGRRTVLCVRRLEHRM

SEQ ID NO: 659408 - protein, 23 aa, Mycobacterium
FGVLSRFTAFVAIDPERTEAGPI

SEQ ID NO: 659409 - protein, 17 aa, Mycobacterium
FGVPLLHRIATGVEDRP

SEQ ID NO: 659410 - protein, 19 aa, Mycobacterium
FGVPPLEFFDPRATPHPRA

SEQ ID NO: 659411 - protein, 18 aa, Mycobacterium
FGVPRVVARINDIRNQWL

SEQ ID NO: 659412 - protein, 18 aa, Mycobacterium
FGVPYAFGKYDQLFVPEF

SEQ ID NO: 659413 - protein, 23 aa, Mycobacterium
FGVRCGTALPGLPELAVGRLNDC

SEQ ID NO: 659414 - protein, 17 aa, Mycobacterium
FGVRKLESEPGLDGAPA

SEQ ID NO: 659415 - protein, 23 aa, Mycobacterium
FGVSFDPNSGWFGLANTYANQFI

SEQ ID NO: 659416 - protein, 21 aa, Mycobacterium
FGVSRITVRRALADLAEQGYI

SEQ ID NO: 659417 - protein, 22 aa, Mycobacterium
FGVTQQPAWAFISANGEVEVVK

SEQ ID NO: 659418 - protein, 18 aa, Mycobacterium
FGVVPKWGFYLSSKAAFD

SEQ ID NO: 659419 - protein, 17 aa, Mycobacterium
FGWAGPFAERAASEFTL

SEQ ID NO: 659420 - protein, 17 aa, Mycobacterium
FGWDRKAPGSSVLIAAS

SEQ ID NO: 659421 - protein, 17 aa, Mycobacterium
FGWKSSFGSGKGKDAIT

SEQ ID NO: 659422 - protein, 24 aa, Mycobacterium
FGWLGDAFPLSALTQIYLSGGESN

SEQ ID NO: 659423 - protein, 23 aa, Mycobacterium
FGWTGPFADRAATEFTLQAWAGS

SEQ ID NO: 659424 - protein, 26 aa, Mycobacterium
FGYAEHREILCAAGADVVTFDPLCDP

SEQ ID NO: 659425 - protein, 27 aa, Mycobacterium
FGYAIPQQWGGLGLNLAQDVELAMEFG

SEQ ID NO: 659426 - protein, 26 aa, Mycobacterium
FGYDFKEFRVDPAWVPPEEEALAMEM

SEQ ID NO: 659427 - protein, 19 aa, Mycobacterium
FGYDRPVYTLGHYGLFMGP

SEQ ID NO: 659428 - protein, 22 aa, Mycobacterium
FGYDRYDDFFAMAHRLLPDDGV

SEQ ID NO: 659429 - protein, 17 aa, Mycobacterium
FGYGPATVWENVSVERE

SEQ ID NO: 659430 - protein, 23 aa, Mycobacterium
FGYMSGALKHFFDTVYYPVLDHV

SEQ ID NO: 659431 - protein, 17 aa, Mycobacterium
FGYRGADPVLLRDDTHP

SEQ ID NO: 659432 - protein, 21 aa, Mycobacterium
FGYRVSRYELDLEYKTTINRL

SEQ ID NO: 659433 - protein, 24 aa, Mycobacterium
FGYRVSRYELDLEYKVAINRLSGT

SEQ ID NO: 659434 - protein, 17 aa, Mycobacterium
FGYRYLVEEARDAGEPM

SEQ ID NO: 659435 - protein, 17 aa, Mycobacterium
FGYRYLVEEAREAGEPM

SEQ ID NO: 659436 - protein, 18 aa, Mycobacterium
FGYVVARAVVSARETLLR

SEQ ID NO: 659437 - protein, 17 aa, Mycobacterium
FHAAALAHLALLDLAAG

SEQ ID NO: 659438 - protein, 26 aa, Mycobacterium
FHAALEFWSALHGFVLLEMTGLMEEI

SEQ ID NO: 659439 - protein, 26 aa, Mycobacterium
FHAALEFWSALHGFVLLEMTGVMDDI

SEQ ID NO: 659440 - protein, 26 aa, Mycobacterium
FHAALEFWSAMHGFVLLEMTGVMDDI

SEQ ID NO: 659441 - protein, 19 aa, Mycobacterium
FHADHIVTAQQWRSRIAAR

SEQ ID NO: 659442 - protein, 18 aa, Mycobacterium
FHAIVSRFYAQVAEDEIL

SEQ ID NO: 659443 - protein, 17 aa, Mycobacterium
FHAKAIVLATGGSGRMY

SEQ ID NO: 659444 - protein, 19 aa, Mycobacterium
FHAMYPRIDEWIAVRRNVD

SEQ ID NO: 659445 - protein, 33 aa, Mycobacterium
FHAPIEWQQRLWPTEEFELARARVPVTLPEDDL

SEQ ID NO: 659446 - protein, 27 aa, Mycobacterium
FHAQPVCCPNCGPTLRLLTTEGEHATG

SEQ ID NO: 659447 - protein, 19 aa, Mycobacterium
FHATRITAVIQWSDMLPAL

SEQ ID NO: 659448 - protein, 19 aa, Mycobacterium
FHCAKAFLRSDAWDPQSWD

SEQ ID NO: 659449 - protein, 29 aa, Mycobacterium
FHDGRLFIGECREGGRLLEFDLSGGPPRV

SEQ ID NO: 659450 - protein, 17 aa, Mycobacterium
FHDQFVRALTASGGSYA

SEQ ID NO: 659451 - protein, 24 aa, Mycobacterium
FHEAANMAALWDLPLVFVCQNNLY

SEQ ID NO: 659452 - protein, 24 aa, Mycobacterium
FHEAANMAALWDLPLVFVCQNNRY

SEQ ID NO: 659453 - protein, 24 aa, Mycobacterium
FHEAANMAALWDLPMVFLCQNNLY

SEQ ID NO: 659454 - protein, 23 aa, Mycobacterium
FHEAVHWDIPVAELTTDDAGQTT

SEQ ID NO: 659455 - protein, 18 aa, Mycobacterium
FHEMAPDLSCARAVVVGN

SEQ ID NO: 659456 - protein, 18 aa, Mycobacterium
FHERITLRFGAAYGASVL

SEQ ID NO: 659457 - protein, 20 aa, Mycobacterium
FHERPRTVIEWLRDGGEVDK

SEQ ID NO: 659458 - protein, 22 aa, Mycobacterium
FHFPERRALCMAENATHTLHNL

SEQ ID NO: 659459 - protein, 24 aa, Mycobacterium
FHGCEGDSLLMLLDAKGVECSTGS

SEQ ID NO: 659460 - protein, 23 aa, Mycobacterium
FHGDDPRFCTVIFGVITAAPDGF

SEQ ID NO: 659461 - protein, 19 aa, Mycobacterium
FHGDFTFGQALFSYDMKAV

SEQ ID NO: 659462 - protein, 25 aa, Mycobacterium
FHGFLLRTAGKWTLKHPLRPMPMLR

SEQ ID NO: 659463 - protein, 19 aa, Mycobacterium
FHGGLSWPFADDDDPLDTP

SEQ ID NO: 659464 - protein, 17 aa, Mycobacterium
FHGLHVHGFPNCFIESI

SEQ ID NO: 659465 - protein, 22 aa, Mycobacterium
FHGPADMVYLGIGQDYTITGHG

SEQ ID NO: 659466 - protein, 17 aa, Mycobacterium
FHGWEWNRDGRNVCIPY

SEQ ID NO: 659467 - protein, 31 aa, Mycobacterium
FHHAGTKGPIPWWWRPSGALFDQFLGAAETE

SEQ ID NO: 659468 - protein, 27 aa, Mycobacterium
FHHAGTKGPVPWWWRPSGALFDQFLGA

SEQ ID NO: 659469 - protein, 26 aa, Mycobacterium
FHHGVTGPVPWWWRPSGALFDQFLGA

SEQ ID NO: 659470 - protein, 22 aa, Mycobacterium
FHHPCDLGRAGLPEEVASITAY

SEQ ID NO: 659471 - protein, 18 aa, Mycobacterium
FHHREVFGQVGFGTGGWD

SEQ ID NO: 659472 - protein, 17 aa, Mycobacterium
FHIDRVAALLPHCARAE

SEQ ID NO: 659473 - protein, 28 aa, Mycobacterium
FHIFGYKAGCIASLIRGATIIPVRVFVL

SEQ ID NO: 659474 - protein, 21 aa, Mycobacterium
FHKDVVIDMLCYRRRGHNEGD

SEQ ID NO: 659475 - protein, 17 aa, Mycobacterium
FHKPESPDAPLLLIFPH

SEQ ID NO: 659476 - protein, 22 aa, Mycobacterium
FHKRADIVLSGLRKLRSALTEA

SEQ ID NO: 659477 - protein, 17 aa, Mycobacterium
FHLAGIPSYLVVGELAI

SEQ ID NO: 659478 - protein, 19 aa, Mycobacterium
FHLGYHGLPIPGLLPGFGH

SEQ ID NO: 659479 - protein, 29 aa, Mycobacterium
FHLLERYGTWRLSDVLGYAAEYAERGIEC

SEQ ID NO: 659480 - protein, 25 aa, Mycobacterium
FHLRNRLVVAALHWDGDITGLVRSH

SEQ ID NO: 659481 - protein, 22 aa, Mycobacterium
FHLRNRLVVAALHWDGDVKGLI

SEQ ID NO: 659482 - protein, 26 aa, Mycobacterium
FHLRNRLVVAALHWDGPVSGLIASHL

SEQ ID NO: 659483 - protein, 22 aa, Mycobacterium
FHLRNRLVVAALHWDNNIRGLL

SEQ ID NO: 659484 - protein, 25 aa, Mycobacterium
FHLRNRLVVAAMHWNGDVTGLVRSH

SEQ ID NO: 659485 - protein, 18 aa, Mycobacterium
FHLSGAVASMMVVPPQSS

SEQ ID NO: 659486 - protein, 18 aa, Mycobacterium
FHLSRQWWSYLADHALLR

SEQ ID NO: 659487 - protein, 18 aa, Mycobacterium
FHLSYVFVSHNLAVVRKL

SEQ ID NO: 659488 - protein, 22 aa, Mycobacterium
FHLYSECRSVLDAARTADGGAW

SEQ ID NO: 659489 - protein, 20 aa, Mycobacterium
FHMAGFGWALAGLWEGAVTV

SEQ ID NO: 659490 - protein, 17 aa, Mycobacterium
FHMKQGEGFLAHMHDPF

SEQ ID NO: 659491 - protein, 25 aa, Mycobacterium
FHNDVEQVWRWPARRTKDNSTSTRL

SEQ ID NO: 659492 - protein, 18 aa, Mycobacterium
FHNFGYKAGILACLQTGA

SEQ ID NO: 659493 - protein, 18 aa, Mycobacterium
FHNICRHRGNKLVWNDFP

SEQ ID NO: 659494 - protein, 24 aa, Mycobacterium
FHNTRGAGLASAFAAVSAGVTRLD

SEQ ID NO: 659495 - protein, 19 aa, Mycobacterium
FHNVCRHRGNKLVWNDFPS

SEQ ID NO: 659496 - protein, 17 aa, Mycobacterium
FHPELFAAGISICGMSD

SEQ ID NO: 659497 - protein, 19 aa, Mycobacterium
FHPELQFDKPYLLAMANAG

SEQ ID NO: 659498 - protein, 20 aa, Mycobacterium
FHPELQFDKPYLLAMANAGP

SEQ ID NO: 659499 - protein, 18 aa, Mycobacterium
FHPGVTYHHYRLGQAGKT

SEQ ID NO: 659500 - protein, 20 aa, Mycobacterium
FHPHIAKLKLADGVATVERI

SEQ ID NO: 659501 - protein, 19 aa, Mycobacterium
FHPLFGSPMWNAADEARRS

SEQ ID NO: 659502 - protein, 23 aa, Mycobacterium
FHPLRLHAAIDMLLDGVIRTRGR

SEQ ID NO: 659503 - protein, 18 aa, Mycobacterium
FHPSYRHAGAVRREIGVP

SEQ ID NO: 659504 - protein, 22 aa, Mycobacterium
FHQCRPAVVFEAVGAPGIIDDI

SEQ ID NO: 659505 - protein, 20 aa, Mycobacterium
FHQLRPGWADGVSPGDILVA

SEQ ID NO: 659506 - protein, 17 aa, Mycobacterium
FHQPAAVLIDLATLESL

SEQ ID NO: 659507 - protein, 26 aa, Mycobacterium
FHQPRPPWLMSRCAPAPVGRTAAPGA

SEQ ID NO: 659508 - protein, 17 aa, Mycobacterium
FHRAINIAADSPKLAQL

SEQ ID NO: 659509 - protein, 18 aa, Mycobacterium
FHRGKRLVNLDVKKDPEA

SEQ ID NO: 659510 - protein, 20 aa, Mycobacterium
FHRGRLLAMGPRCLMTSMEL

SEQ ID NO: 659511 - protein, 23 aa, Mycobacterium
FHRMAVDAFGSLAADAIEAAQQT

SEQ ID NO: 659512 - protein, 19 aa, Mycobacterium
FHRRGEVLGALGVAGTDFT

SEQ ID NO: 659513 - protein, 20 aa, Mycobacterium
FHSARWDYDYTGGDADGGLH

SEQ ID NO: 659514 - protein, 18 aa, Mycobacterium
FHSPDCPYPVTWDEADAK

SEQ ID NO: 659515 - protein, 18 aa, Mycobacterium
FHSPHLLEAIERFCADKT

SEQ ID NO: 659516 - protein, 17 aa, Mycobacterium
FHSPLMEPMMGDFAAVV

SEQ ID NO: 659517 - protein, 18 aa, Mycobacterium
FHSSRWDYSYTGGDTTGN

SEQ ID NO: 659518 - protein, 22 aa, Mycobacterium
FHTAVYPGVWVPREAELSPVQR

SEQ ID NO: 659519 - protein, 25 aa, Mycobacterium
FHTFGYKAGLIASFIRGATMFPVPV

SEQ ID NO: 659520 - protein, 17 aa, Mycobacterium
FHVKGDPSASVTIADIA

SEQ ID NO: 659521 - protein, 17 aa, Mycobacterium
FHVKGDPSASVTIQDVA

SEQ ID NO: 659522 - protein, 26 aa, Mycobacterium
FHVLAHDWGAAVAWQLAGNHADRVQT

SEQ ID NO: 659523 - protein, 20 aa, Mycobacterium
FHVPVAPAITGRQFIELIAS

SEQ ID NO: 659524 - protein, 17 aa, Mycobacterium
FHVVPVLAYSPDPGPVH

SEQ ID NO: 659525 - protein, 20 aa, Mycobacterium
FHYFPGGKDQLMLAVAEHEA

SEQ ID NO: 659526 - protein, 25 aa, Mycobacterium
FHYLESWLLPALHLRVTVFHFNPGH

SEQ ID NO: 659527 - protein, 17 aa, Mycobacterium
FHYLTIFGDDGRPLHLG

SEQ ID NO: 659528 - protein, 23 aa, Mycobacterium
FHYTRKWLQRMTVGQIDRSVSQI

SEQ ID NO: 659529 - protein, 23 aa, Mycobacterium
FHYTRKWLQRMTVSQFDRSVAQI

SEQ ID NO: 659530 - protein, 22 aa, Mycobacterium
FIAAEALIAMDLLPTAILRKLT

SEQ ID NO: 659531 - protein, 25 aa, Mycobacterium
FIAAWKGLPSFAFRSQFRTWLYSLA

SEQ ID NO: 659532 - protein, 24 aa, Mycobacterium
FIADFVPRVRAGLEALGIGSQYLG

SEQ ID NO: 659533 - protein, 23 aa, Mycobacterium
FIAELRSGLLADEIGRLEADGAA

SEQ ID NO: 659534 - protein, 21 aa, Mycobacterium
FIAEVLPKVGIARRLVDSGEL

SEQ ID NO: 659535 - protein, 27 aa, Mycobacterium
FIAGARLTVPLGMIILRKGYGLGAMAM

SEQ ID NO: 659536 - protein, 22 aa, Mycobacterium
FIAGRPDPWAGIDDNAQSIDTL

SEQ ID NO: 659537 - protein, 18 aa, Mycobacterium
FIAKEIFPGGSVPGEENI

SEQ ID NO: 659538 - protein, 18 aa, Mycobacterium
FIALKVGIDNWRWAGVPI

SEQ ID NO: 659539 - protein, 18 aa, Mycobacterium
FIALRPATQLHWTGHDHP

SEQ ID NO: 659540 - protein, 23 aa, Mycobacterium
FIANILKNLGINWDPSEGTVNGL

SEQ ID NO: 659541 - protein, 17 aa, Mycobacterium
FIASISLSYLGDMQLEL

SEQ ID NO: 659542 - protein, 33 aa, Mycobacterium
FIDAAKAYVRFALDHPGHYAVMFDKSLYDDTDP

SEQ ID NO: 659543 - protein, 17 aa, Mycobacterium
FIDAEVMPVERAVLAHH

SEQ ID NO: 659544 - protein, 22 aa, Mycobacterium
FIDAFVEFYHAPILHMKQATPE

SEQ ID NO: 659545 - protein, 23 aa, Mycobacterium
FIDAGVSGGIWGLTEGYGLMVGG

SEQ ID NO: 659546 - protein, 18 aa, Mycobacterium
FIDDGGYDQPRWWSPRGW

SEQ ID NO: 659547 - protein, 20 aa, Mycobacterium
FIDDRPHLLTSRSPADRGTR

SEQ ID NO: 659548 - protein, 20 aa, Mycobacterium
FIDELRVCLHGCGVTNLAGL

SEQ ID NO: 659549 - protein, 20 aa, Mycobacterium
FIDERPQLLTARSSADRGTK

SEQ ID NO: 659550 - protein, 18 aa, Mycobacterium
FIDERPQLLTARTSADRG

SEQ ID NO: 659551 - protein, 17 aa, Mycobacterium
FIDFGYATGLPGPFQSI

SEQ ID NO: 659552 - protein, 19 aa, Mycobacterium
FIDGQCLFGPVLVDPPTGT

SEQ ID NO: 659553 - protein, 28 aa, Mycobacterium
FIDHAGFQCGFCTAGMVLTAATLTGDQT

SEQ ID NO: 659554 - protein, 20 aa, Mycobacterium
FIDHAVELGCQALLGALDEA

SEQ ID NO: 659555 - protein, 19 aa, Mycobacterium
FIDLPYRPGHEAVGVVETL

SEQ ID NO: 659556 - protein, 18 aa, Mycobacterium
FIDRAPFRFVSTVDLPIT

SEQ ID NO: 659557 - protein, 22 aa, Mycobacterium
FIDRIRVSAPMLVDGRTVHVIA

SEQ ID NO: 659558 - protein, 18 aa, Mycobacterium
FIDYCINMLYITAAPYVP

SEQ ID NO: 659559 - protein, 24 aa, Mycobacterium
FIEDAAHFYFEFHMKQGEGFLAHM

SEQ ID NO: 659560 - protein, 18 aa, Mycobacterium
FIEDGGYREPRWWSERGW

SEQ ID NO: 659561 - protein, 25 aa, Mycobacterium
FIEDWAETWPAQGLTYPKELADDLE

SEQ ID NO: 659562 - protein, 21 aa, Mycobacterium
FIEERPQLLTARSSADRGTKI

SEQ ID NO: 659563 - protein, 17 aa, Mycobacterium
FIEGASWAESSVGTNGI

SEQ ID NO: 659564 - protein, 26 aa, Mycobacterium
FIEGYNLNMAIPWIAAERGFIDAVVD

SEQ ID NO: 659565 - protein, 30 aa, Mycobacterium
FIEGYNLNMAIPWTAAERGFIDAVIDPHQT

SEQ ID NO: 659566 - protein, 30 aa, Mycobacterium
FIEGYNLNMAIPWTAAERGFIDAVVDPHET

SEQ ID NO: 659567 - protein, 25 aa, Mycobacterium
FIEHLDALGFDEVWMGEHHSAGSEI

SEQ ID NO: 659568 - protein, 20 aa, Mycobacterium
FIEHRLPHFGRYEDAMMGQD

SEQ ID NO: 659569 - protein, 24 aa, Mycobacterium
FIELCVDLANTVWLFLHSGSRGVG

SEQ ID NO: 659570 - protein, 24 aa, Mycobacterium
FIELLAWQFASPVRWIETQDLLFI

SEQ ID NO: 659571 - protein, 18 aa, Mycobacterium
FIEMAWQAPIYLIAGGLG

SEQ ID NO: 659572 - protein, 26 aa, Mycobacterium
FIERPMRWLEALSRYGGTITAAPNFA

SEQ ID NO: 659573 - protein, 18 aa, Mycobacterium
FIESCFELNLTDGYGSTE

SEQ ID NO: 659574 - protein, 18 aa, Mycobacterium
FIETCRRAEQWGYDAVFA

SEQ ID NO: 659575 - protein, 24 aa, Mycobacterium
FIEVPGRGLFAVECNPRATSGILL

SEQ ID NO: 659576 - protein, 23 aa, Mycobacterium
FIEVRRAGIALAREVERRAPDAV

SEQ ID NO: 659577 - protein, 23 aa, Mycobacterium
FIEVRRAGIALAREVERRAPEAV

SEQ ID NO: 659578 - protein, 18 aa, Mycobacterium
FIEVTFRGANSLGDHVSG

SEQ ID NO: 659579 - protein, 17 aa, Mycobacterium
FIGDGAQRWPAVHRDDA

SEQ ID NO: 659580 - protein, 19 aa, Mycobacterium
FIGKRLMQTAGVDRLSALY

SEQ ID NO: 659581 - protein, 30 aa, Mycobacterium
FIGLGPGHRAVFWVPPYHDFGLISGILSAL

SEQ ID NO: 659582 - protein, 25 aa, Mycobacterium
FIGNGRFDFVREFAGPFVGNALSRA

SEQ ID NO: 659583 - protein, 18 aa, Mycobacterium
FIGRGMLTAACPGLIFTS

SEQ ID NO: 659584 - protein, 25 aa, Mycobacterium
FIGRMGGVPPSAWGGPAATRFKDVI

SEQ ID NO: 659585 - protein, 26 aa, Mycobacterium
FIGRMGGVPPSVWGGTAAARFKDVLD

SEQ ID NO: 659586 - protein, 23 aa, Mycobacterium
FIGRVASPFALLVIADLLGVPEE

SEQ ID NO: 659587 - protein, 17 aa, Mycobacterium
FIGSPAMNLVKLPIVPD

SEQ ID NO: 659588 - protein, 18 aa, Mycobacterium
FIGTAGFSALHRINVVCS

SEQ ID NO: 659589 - protein, 18 aa, Mycobacterium
FIHRLRKYIGAYLAVLGH

SEQ ID NO: 659590 - protein, 17 aa, Mycobacterium
FIIDRAWTQVDVIELDP

SEQ ID NO: 659591 - protein, 23 aa, Mycobacterium
FIILRPAPSGTRLLLSDATAALD

SEQ ID NO: 659592 - protein, 17 aa, Mycobacterium
FIKHGYDGASMDAIAKA

SEQ ID NO: 659593 - protein, 19 aa, Mycobacterium
FIKRDPIHRSFHHGEITFS

SEQ ID NO: 659594 - protein, 24 aa, Mycobacterium
FILAEIFPGGWLPTIPTVEEHATA

SEQ ID NO: 659595 - protein, 17 aa, Mycobacterium
FILAELGHERIIYSEDY

SEQ ID NO: 659596 - protein, 17 aa, Mycobacterium
FILALFVDLRGKPCAKL

SEQ ID NO: 659597 - protein, 27 aa, Mycobacterium
FILALPCPMCLGALYYCSPDEVVFLTT

SEQ ID NO: 659598 - protein, 19 aa, Mycobacterium
FILGEVFRRITGRTIGHYL

SEQ ID NO: 659599 - protein, 19 aa, Mycobacterium
FILGEVFRRITGRTVGQYL

SEQ ID NO: 659600 - protein, 19 aa, Mycobacterium
FILQLADPAIVQWTVGRVR

SEQ ID NO: 659601 - protein, 23 aa, Mycobacterium
FILRGIALLGMDSCRCRSGRAAN

SEQ ID NO: 659602 - protein, 22 aa, Mycobacterium
FILRGIALLGMDSVLMPIGPRR

SEQ ID NO: 659603 - protein, 17 aa, Mycobacterium
FILRRWLSTDTKTSPPL

SEQ ID NO: 659604 - protein, 19 aa, Mycobacterium
FILTEIFPGGQLPSSEMVH

SEQ ID NO: 659605 - protein, 23 aa, Mycobacterium
FILTEIFPGGWLPTPQTVGEYAV

SEQ ID NO: 659606 - protein, 20 aa, Mycobacterium
FIMDEIFPGGMLPKVDDVEK

SEQ ID NO: 659607 - protein, 23 aa, Mycobacterium
FIMTEIFPGGRLPSVVMEQEKAI

SEQ ID NO: 659608 - protein, 26 aa, Mycobacterium
FINLSRKGVRFIPLHGPLPYRPLALA

SEQ ID NO: 659609 - protein, 25 aa, Mycobacterium
FINSRPKPLAAYAFTESKYTANRYA

SEQ ID NO: 659610 - protein, 26 aa, Mycobacterium
FIPEGLLNYLALLGWAIADDHDLFSL

SEQ ID NO: 659611 - protein, 26 aa, Mycobacterium
FIPEGLLNYLALLGWGIADDHDVFSL

SEQ ID NO: 659612 - protein, 26 aa, Mycobacterium
FIPEGLLNYLALLGWSIADDRDLFSL

SEQ ID NO: 659613 - protein, 19 aa, Mycobacterium
FIPVSRWQYDIVGADGGCR

SEQ ID NO: 659614 - protein, 25 aa, Mycobacterium
FIQPDLRVLVDLGYSDWGSGQDYAN

SEQ ID NO: 659615 - protein, 21 aa, Mycobacterium
FIQQRVDGVRLREEHIAGKPA

SEQ ID NO: 659616 - protein, 24 aa, Mycobacterium
FIQRPALWFEVMDRVRATVTVAPN

SEQ ID NO: 659617 - protein, 23 aa, Mycobacterium
FIQRPRFLAISEFGPDAFIYHEG

SEQ ID NO: 659618 - protein, 22 aa, Mycobacterium
FIQVRRAGIALARELERRTPDT

SEQ ID NO: 659619 - protein, 20 aa, Mycobacterium
FIRDYSRGFADQAIRRTSVM

SEQ ID NO: 659620 - protein, 26 aa, Mycobacterium
FIRFCDSFQIPLVFVVDTPGFLPGAE

SEQ ID NO: 659621 - protein, 24 aa, Mycobacterium
FIRFCDSYNLPLVFVVDTPGAMPG

SEQ ID NO: 659622 - protein, 19 aa, Mycobacterium
FIRHRARGLALTAAGEEML

SEQ ID NO: 659623 - protein, 19 aa, Mycobacterium
FIRLELTPGIGSVRPAIQV

SEQ ID NO: 659624 - protein, 23 aa, Mycobacterium
FIRVARKFWDSWAPDAVIADVDA

SEQ ID NO: 659625 - protein, 17 aa, Mycobacterium
FIRVFAQRIRICAPNST

SEQ ID NO: 659626 - protein, 29 aa, Mycobacterium
FISARTVEWHLSKIFAKLGVTSRRELRAI

SEQ ID NO: 659627 - protein, 27 aa, Mycobacterium
FISDWPRLADGILQLSVRDFEYPRSDL

SEQ ID NO: 659628 - protein, 29 aa, Mycobacterium
FISGDYSNGAFWRGDHQGLADISYGITIP

SEQ ID NO: 659629 - protein, 32 aa, Mycobacterium
FISGDYSNGAFWRGDHQGLVGFSYAINIPETP

SEQ ID NO: 659630 - protein, 33 aa, Mycobacterium
FISGDYSNGAFWRGDHQGLVGFSYGFTIPALPA

SEQ ID NO: 659631 - protein, 24 aa, Mycobacterium
FISGNYSNGAFWRGDHQGTGISYS

SEQ ID NO: 659632 - protein, 33 aa, Mycobacterium
FISGNYSNGFLWRGDYQGLITISYSSTIPEIPW

SEQ ID NO: 659633 - protein, 21 aa, Mycobacterium
FISQRLGRVIDHFPTQVLGKT

SEQ ID NO: 659634 - protein, 23 aa, Mycobacterium
FISRQMDLRKWFADAGASGAEQD

SEQ ID NO: 659635 - protein, 26 aa, Mycobacterium
FISSGFPINLLGVWAQLATAQGVASV

SEQ ID NO: 659636 - protein, 17 aa, Mycobacterium
FISSVAGMGWENDLDLM

SEQ ID NO: 659637 - protein, 26 aa, Mycobacterium
FISVFGYKAQSAFFKHANIGVSDQQI

SEQ ID NO: 659638 - protein, 17 aa, Mycobacterium
FITAGVSIGERLVFLFG

SEQ ID NO: 659639 - protein, 25 aa, Mycobacterium
FITCTNCGPRFTVIRTLPYDRPGTT

SEQ ID NO: 659640 - protein, 50 aa, Mycobacterium
FITGNMANGVFWRADSMGQLSAHYAITVNRIPAFMTIDAPVNIPITGTIT

SEQ ID NO: 659641 - protein, 17 aa, Mycobacterium
FITKGWLELQFENGESK

SEQ ID NO: 659642 - protein, 17 aa, Mycobacterium
FITQLGRNFQVIHEQAN

SEQ ID NO: 659643 - protein, 17 aa, Mycobacterium
FITQLGRNFQVIYEQAN

SEQ ID NO: 659644 - protein, 25 aa, Mycobacterium
FITSEFPVTLLLVGIGLENIGLFPR

SEQ ID NO: 659645 - protein, 18 aa, Mycobacterium
FITSGPLVAAVLEGPRAI

SEQ ID NO: 659646 - protein, 18 aa, Mycobacterium
FIVADRAGKVFVDATRAG

SEQ ID NO: 659647 - protein, 17 aa, Mycobacterium
FIVAGGLATTVKAGLGL

SEQ ID NO: 659648 - protein, 24 aa, Mycobacterium
FIVDEFTGRMLVGRRYNEGLHQAI

SEQ ID NO: 659649 - protein, 24 aa, Mycobacterium
FIVEDHGGWKVCEIRRGNGVFGPL

SEQ ID NO: 659650 - protein, 19 aa, Mycobacterium
FIVEYQHSYSGVRMVDVEP

SEQ ID NO: 659651 - protein, 25 aa, Mycobacterium
FIVGRIKDLLIIRGRNHYPEDIEAT

SEQ ID NO: 659652 - protein, 23 aa, Mycobacterium
FIVGRTAVIARFAYPQRAPEADA

SEQ ID NO: 659653 - protein, 17 aa, Mycobacterium
FIVHGHFINSSDGTERL

SEQ ID NO: 659654 - protein, 18 aa, Mycobacterium
FIVHTDIYDAFVDKFTER

SEQ ID NO: 659655 - protein, 30 aa, Mycobacterium
FIVPADGFLPALLDWCRSNDVVFIADEVQT

SEQ ID NO: 659656 - protein, 31 aa, Mycobacterium
FIVPAEGFLPALLDWCRKNDVVFIADEVQTG

SEQ ID NO: 659657 - protein, 21 aa, Mycobacterium
FIVTDIFPGGRLPMIETVEEH

SEQ ID NO: 659658 - protein, 24 aa, Mycobacterium
FIVTEIFPGGRLPSIEKVEEHAGK

SEQ ID NO: 659659 - protein, 19 aa, Mycobacterium
FIVTEIFPGGRLPSTGMMV

SEQ ID NO: 659660 - protein, 23 aa, Mycobacterium
FIVTEIFPGGRLPTVDMVIDHAT

SEQ ID NO: 659661 - protein, 26 aa, Mycobacterium
FIVVGKIRDAWNIQRDADGTPSITGN

SEQ ID NO: 659662 - protein, 20 aa, Mycobacterium
FIYFAGRRGDWIRVDGENMS

SEQ ID NO: 659663 - protein, 17 aa, Mycobacterium
FKAAARRAVAAGYDGIE

SEQ ID NO: 659664 - protein, 17 aa, Mycobacterium
FKAALTYSFLWRMLAGS

SEQ ID NO: 659665 - protein, 20 aa, Mycobacterium
FKAAVIHFTRSLAVQVGNHG

SEQ ID NO: 659666 - protein, 21 aa, Mycobacterium
FKAAYRQGLSIVLKGPTGCGK

SEQ ID NO: 659667 - protein, 18 aa, Mycobacterium
FKAELRGDELVRMVPQKA

SEQ ID NO: 659668 - protein, 18 aa, Mycobacterium
FKAHKRSGAEIVSGRLLG

SEQ ID NO: 659669 - protein, 22 aa, Mycobacterium
FKAKLGESVLYPRRLGKPEELA

SEQ ID NO: 659670 - protein, 21 aa, Mycobacterium
FKAPKAFIVVEHIQRLGNGKP

SEQ ID NO: 659671 - protein, 17 aa, Mycobacterium
FKASARKARILRYRFEP

SEQ ID NO: 659672 - protein, 21 aa, Mycobacterium
FKCPRSVAFEAQLPRTDTGKL

SEQ ID NO: 659673 - protein, 22 aa, Mycobacterium
FKEARTVACDVLKPLLDELGLV

SEQ ID NO: 659674 - protein, 25 aa, Mycobacterium
FKEGERLWISWAMANRDPAVFHDPD

SEQ ID NO: 659675 - protein, 25 aa, Mycobacterium
FKEGERLWISWAMANRDPAVFKDPD

SEQ ID NO: 659676 - protein, 25 aa, Mycobacterium
FKEGERLWISWAMANRDPAVFPDPD

SEQ ID NO: 659677 - protein, 25 aa, Mycobacterium
FKEGERLWISWAMANRDPQVFPDPD

SEQ ID NO: 659678 - protein, 18 aa, Mycobacterium
FKEKLIRRDISMKAFDAG

SEQ ID NO: 659679 - protein, 22 aa, Mycobacterium
FKENIKRQWWRAVVSGRDDVVG

SEQ ID NO: 659680 - protein, 20 aa, Mycobacterium
FKEPLYAAPPLLLRMVEAGQ

SEQ ID NO: 659681 - protein, 27 aa, Mycobacterium
FKEQYGSSLVTGWARLHGYPIGILANA

SEQ ID NO: 659682 - protein, 30 aa, Mycobacterium
FKERAEGAGHSYGTTAVRGFVDMTEESISF

SEQ ID NO: 659683 - protein, 24 aa, Mycobacterium
FKERHIFRIDHFLGKEAAQNILAF

SEQ ID NO: 659684 - protein, 17 aa, Mycobacterium
FKEVMNWAEYAEFLTNW

SEQ ID NO: 659685 - protein, 17 aa, Mycobacterium
FKFVPVVGEILADLVTE

SEQ ID NO: 659686 - protein, 19 aa, Mycobacterium
FKGDERWRNLPTPGGNTFE

SEQ ID NO: 659687 - protein, 19 aa, Mycobacterium
FKGDERWRNLPTPSGNTFD

SEQ ID NO: 659688 - protein, 19 aa, Mycobacterium
FKGDPEFYVSPVVASAPKV

SEQ ID NO: 659689 - protein, 17 aa, Mycobacterium
FKGGKRAAQLPAEQQAA

SEQ ID NO: 659690 - protein, 21 aa, Mycobacterium
FKGGLRFHPSVYLGIVKFLGF

SEQ ID NO: 659691 - protein, 20 aa, Mycobacterium
FKGIIRWIQTQGQYSALNVF

SEQ ID NO: 659692 - protein, 31 aa, Mycobacterium
FKGLEAATRARGLRTLDMFVSGLVASGGLPE

SEQ ID NO: 659693 - protein, 24 aa, Mycobacterium
FKGLPGAEGRLKVKPAKPSKLELF

SEQ ID NO: 659694 - protein, 27 aa, Mycobacterium
FKGMYGSSLVTGWARLHGYPLGILANA

SEQ ID NO: 659695 - protein, 26 aa, Mycobacterium
FKGQLTAARASHDWAKGMRDQLLGRA

SEQ ID NO: 659696 - protein, 26 aa, Mycobacterium
FKGRNVEIPDHFRIYVSQKLARLERF

SEQ ID NO: 659697 - protein, 24 aa, Mycobacterium
FKGRNVEIPDHFRTYVSQKLSRLE

SEQ ID NO: 659698 - protein, 17 aa, Mycobacterium
FKGSGFYRTDSRETDKK

SEQ ID NO: 659699 - protein, 19 aa, Mycobacterium
FKGSGFYRTDSRSGSVDAA

SEQ ID NO: 659700 - protein, 19 aa, Mycobacterium
FKGVKGYEAYAAREASATA

SEQ ID NO: 659701 - protein, 20 aa, Mycobacterium
FKGVKGYEAYAAREASATAV

SEQ ID NO: 659702 - protein, 24 aa, Mycobacterium
FKGVLDRRGGQFIRFTRTAGGATA

SEQ ID NO: 659703 - protein, 21 aa, Mycobacterium
FKHITDAGGRVFLELEERSEV

SEQ ID NO: 659704 - protein, 23 aa, Mycobacterium
FKHLHKAGLRRVFVGLETGSYDQ

SEQ ID NO: 659705 - protein, 22 aa, Mycobacterium
FKHLHRAGLRRVFVGLETGSYD

SEQ ID NO: 659706 - protein, 24 aa, Mycobacterium
FKHLSVRDNVAFGLKIRKRPKAEI

SEQ ID NO: 659707 - protein, 31 aa, Mycobacterium
FKHMSRMTWRSMISDGLAMRHGKELTWSQVV

SEQ ID NO: 659708 - protein, 32 aa, Mycobacterium
FKHPKPRLEVNLNRLGGWPTIKGTRVPYDTIV

SEQ ID NO: 659709 - protein, 21 aa, Mycobacterium
FKHVAEMFAELEAAALRSYPR

SEQ ID NO: 659710 - protein, 21 aa, Mycobacterium
FKHVAEMFAELEAAAMRSYPR

SEQ ID NO: 659711 - protein, 20 aa, Mycobacterium
FKHVAEMFAELEATALRSYP

SEQ ID NO: 659712 - protein, 24 aa, Mycobacterium
FKIKHRRTADCVVAGYRLHKSGDD

SEQ ID NO: 659713 - protein, 19 aa, Mycobacterium
FKIKQGVKFHDGTPLDAEA

SEQ ID NO: 659714 - protein, 21 aa, Mycobacterium
FKISPHPSIPHAPDAEAQRDT

SEQ ID NO: 659715 - protein, 18 aa, Mycobacterium
FKITNRLDLLLAHAVVRG

SEQ ID NO: 659716 - protein, 18 aa, Mycobacterium
FKITNRLDLLLAQAVVRG

SEQ ID NO: 659717 - protein, 25 aa, Mycobacterium
FKIVKDEGVEFVDVRFCDLPGTMQH

SEQ ID NO: 659718 - protein, 20 aa, Mycobacterium
FKKDVVIDMLCYRKRGHNEG

SEQ ID NO: 659719 - protein, 17 aa, Mycobacterium
FKKGFAATGGGSVVPDE

SEQ ID NO: 659720 - protein, 18 aa, Mycobacterium
FKKGKLVFKQAGVANPAV

SEQ ID NO: 659721 - protein, 19 aa, Mycobacterium
FKKGKLVFNQAGALPPAAL

SEQ ID NO: 659722 - protein, 27 aa, Mycobacterium
FKKGPEFADIMQRWGFDAEAALGVTTA

SEQ ID NO: 659723 - protein, 22 aa, Mycobacterium
FKKLRSSFDLMLNTVSANLNLN

SEQ ID NO: 659724 - protein, 21 aa, Mycobacterium
FKKRSYQAYLMCFGSTGMFEQ

SEQ ID NO: 659725 - protein, 25 aa, Mycobacterium
FKKSMRALFDGGWDKVGLAEHLGGI

SEQ ID NO: 659726 - protein, 21 aa, Mycobacterium
FKLAAELAYLEYGDLIDTMVD

SEQ ID NO: 659727 - protein, 17 aa, Mycobacterium
FKLARAALFQQQLTLPF

SEQ ID NO: 659728 - protein, 17 aa, Mycobacterium
FKLGADVALALDAAATE

SEQ ID NO: 659729 - protein, 17 aa, Mycobacterium
FKLHEDWGTTPAAIDAC

SEQ ID NO: 659730 - protein, 18 aa, Mycobacterium
FKLHEDWGTTPAVIDACL

SEQ ID NO: 659731 - protein, 20 aa, Mycobacterium
FKLSGEIKPGVTATDVVLTV

SEQ ID NO: 659732 - protein, 23 aa, Mycobacterium
FKLVLLTHNFDFFRTLRSRGVVG

SEQ ID NO: 659733 - protein, 21 aa, Mycobacterium
FKMAAELAYLEFGDLIDAMVT

SEQ ID NO: 659734 - protein, 21 aa, Mycobacterium
FKMAAELAYLEFGDLIDDLVA

SEQ ID NO: 659735 - protein, 21 aa, Mycobacterium
FKMAAELAYLEYGDLIDTLVE

SEQ ID NO: 659736 - protein, 19 aa, Mycobacterium
FKMSARGGLLLYGPPGCGK

SEQ ID NO: 659737 - protein, 23 aa, Mycobacterium
FKNFIRGPVKLIREAWEPVLKNW

SEQ ID NO: 659738 - protein, 18 aa, Mycobacterium
FKPAYGLAEATLLASGQG

SEQ ID NO: 659739 - protein, 21 aa, Mycobacterium
FKPGTLTALGFSYDELRALNP

SEQ ID NO: 659740 - protein, 22 aa, Mycobacterium
FKPGTLTALGFSYDNLRAANPR

SEQ ID NO: 659741 - protein, 22 aa, Mycobacterium
FKPGTLTSLGFNYDKLRGLNPG

SEQ ID NO: 659742 - protein, 24 aa, Mycobacterium
FKPGVAQALGMDFGSLKKVNPGIV

SEQ ID NO: 659743 - protein, 17 aa, Mycobacterium
FKPKPLFYRQPIYYMSN

SEQ ID NO: 659744 - protein, 21 aa, Mycobacterium
FKPKPLFYRQPIYYMSNAQTF

SEQ ID NO: 659745 - protein, 25 aa, Mycobacterium
FKPLRLDIENGEWLVLATFEPGATV

SEQ ID NO: 659746 - protein, 25 aa, Mycobacterium
FKPLRLDIENGEWVVLATFAPGARI

SEQ ID NO: 659747 - protein, 25 aa, Mycobacterium
FKPLYGGSLVTGWATLHGYPLGILA

SEQ ID NO: 659748 - protein, 25 aa, Mycobacterium
FKPLYGSSLVTGWAQLHGYPIGILA

SEQ ID NO: 659749 - protein, 27 aa, Mycobacterium
FKPLYGSSLVTGWARLHGYPLGILANA

SEQ ID NO: 659750 - protein, 28 aa, Mycobacterium
FKPLYGSSLVTGWARLHGYPVGILANAR

SEQ ID NO: 659751 - protein, 31 aa, Mycobacterium
FKPLYGSSLVTGWARLWGYPVGILANARGVL

SEQ ID NO: 659752 - protein, 20 aa, Mycobacterium
FKPLYGTSLVTGWASIHGYP

SEQ ID NO: 659753 - protein, 17 aa, Mycobacterium
FKPMPSYERGAVVHLGP

SEQ ID NO: 659754 - protein, 26 aa, Mycobacterium
FKPPYLPFATLWNFVSELAAHPLPPA

SEQ ID NO: 659755 - protein, 28 aa, Mycobacterium
FKPSPAVYRYVCDELRVTPGDCMMVAAH

SEQ ID NO: 659756 - protein, 21 aa, Mycobacterium
FKPSYGIAEATLFIANIAPDA

SEQ ID NO: 659757 - protein, 21 aa, Mycobacterium
FKPSYGIAEATLFVATIAPDA

SEQ ID NO: 659758 - protein, 23 aa, Mycobacterium
FKPTRPRVMSVAGRAECVKLLVV

SEQ ID NO: 659759 - protein, 25 aa, Mycobacterium
FKPYLGAGLHLASWGFGVETGTHAL

SEQ ID NO: 659760 - protein, 18 aa, Mycobacterium
FKQCPLLYRLRAIDRLPE

SEQ ID NO: 659761 - protein, 20 aa, Mycobacterium
FKQFDEWDVRIVPRERLGVR

SEQ ID NO: 659762 - protein, 20 aa, Mycobacterium
FKQFEEWDVCIVPRDQLRLS

SEQ ID NO: 659763 - protein, 20 aa, Mycobacterium
FKQKSALRFGATHTAATAAE

SEQ ID NO: 659764 - protein, 17 aa, Mycobacterium
FKQPYIALMPQWDFLDF

SEQ ID NO: 659765 - protein, 22 aa, Mycobacterium
FKQSVRMIADHMGFRIDPNIRT

SEQ ID NO: 659766 - protein, 20 aa, Mycobacterium
FKQYAETLARDFAPTKNPAT

SEQ ID NO: 659767 - protein, 22 aa, Mycobacterium
FKQYRVGSVADYRAMREDPSHP

SEQ ID NO: 659768 - protein, 17 aa, Mycobacterium
FKREIAPTFGATHAAAD

SEQ ID NO: 659769 - protein, 19 aa, Mycobacterium
FKRIRGYEVDEANAVRVHS

SEQ ID NO: 659770 - protein, 18 aa, Mycobacterium
FKRIRGYEVDEDNAVRVH

SEQ ID NO: 659771 - protein, 21 aa, Mycobacterium
FKRKWAPHVIEPEYLAFANGP

SEQ ID NO: 659772 - protein, 18 aa, Mycobacterium
FKRLAWWPYSVAMRQVNV

SEQ ID NO: 659773 - protein, 17 aa, Mycobacterium
FKRLTALQYEYGSTAAH

SEQ ID NO: 659774 - protein, 21 aa, Mycobacterium
FKRSFDVAVGAQWTGEGAEAA

SEQ ID NO: 659775 - protein, 17 aa, Mycobacterium
FKRSMQWPYAPSVPNAL

SEQ ID NO: 659776 - protein, 21 aa, Mycobacterium
FKRTLWWPYSVAMRVANYAFT

SEQ ID NO: 659777 - protein, 19 aa, Mycobacterium
FKRTMWLPYSIAMKQVNPL

SEQ ID NO: 659778 - protein, 20 aa, Mycobacterium
FKRVLDINVLGVFHTVRAAL

SEQ ID NO: 659779 - protein, 20 aa, Mycobacterium
FKSAMRSAGTVIGREITRSI

SEQ ID NO: 659780 - protein, 17 aa, Mycobacterium
FKSIHLDQARLLQVPAA

SEQ ID NO: 659781 - protein, 21 aa, Mycobacterium
FKSKHKYYYCGDQVTAEPEYV

SEQ ID NO: 659782 - protein, 18 aa, Mycobacterium
FKTALRLARHRELVDEAG

SEQ ID NO: 659783 - protein, 21 aa, Mycobacterium
FKTERAGVIIAGLEVPHLHVH

SEQ ID NO: 659784 - protein, 17 aa, Mycobacterium
FKTGPKVIGVANITDHT

SEQ ID NO: 659785 - protein, 18 aa, Mycobacterium
FKTIQPWLTDGIAHVPFW

SEQ ID NO: 659786 - protein, 17 aa, Mycobacterium
FKTLPRLHLARHVVTIV

SEQ ID NO: 659787 - protein, 24 aa, Mycobacterium
FKVDDVDVMWKWLGKHRDGLHSIG

SEQ ID NO: 659788 - protein, 19 aa, Mycobacterium
FKVDFAIEDGVPWTNPDAG

SEQ ID NO: 659789 - protein, 25 aa, Mycobacterium
FKVDFAIEGAVPWTNPQARRAGTVH

SEQ ID NO: 659790 - protein, 21 aa, Mycobacterium
FKVDFAIEGDIPWTNPDCARA

SEQ ID NO: 659791 - protein, 21 aa, Mycobacterium
FKVDFAIEGDIPWTNPDCRRA

SEQ ID NO: 659792 - protein, 24 aa, Mycobacterium
FKVDKPGTVAITFTPADGSEPMVH

SEQ ID NO: 659793 - protein, 23 aa, Mycobacterium
FKVDKPGTVSITFTPSDGSEPMV

SEQ ID NO: 659794 - protein, 23 aa, Mycobacterium
FKVEKPGTVTLTFTPADGSQPIV

SEQ ID NO: 659795 - protein, 18 aa, Mycobacterium
FKVGDHVGVGCMVNSCGR

SEQ ID NO: 659796 - protein, 20 aa, Mycobacterium
FKVHLDAFNLLPYLTGEVEE

SEQ ID NO: 659797 - protein, 25 aa, Mycobacterium
FKVLLKELQSLCLNVEVLSKDGAAI

SEQ ID NO: 659798 - protein, 25 aa, Mycobacterium
FKYRSVDKWHRCPAPTLGQHNASIL

SEQ ID NO: 659799 - protein, 18 aa, Mycobacterium
FLAADCLYVDMPVPALAA

SEQ ID NO: 659800 - protein, 19 aa, Mycobacterium
FLACGEMLSSFLLDATLAG

SEQ ID NO: 659801 - protein, 23 aa, Mycobacterium
FLADCGRGVLQRAAAVGVGAAGL

SEQ ID NO: 659802 - protein, 17 aa, Mycobacterium
FLADDFTILDGLLAFYA

SEQ ID NO: 659803 - protein, 20 aa, Mycobacterium
FLADEIVRPLGLDMHIGLPD

SEQ ID NO: 659804 - protein, 33 aa, Mycobacterium
FLADRYPKWWQAPLRWAFRTALGARASLVVRRS

SEQ ID NO: 659805 - protein, 17 aa, Mycobacterium
FLAEAGFSLHDVIADGK

SEQ ID NO: 659806 - protein, 21 aa, Mycobacterium
FLAEEISPWLSPAYGAANVVM

SEQ ID NO: 659807 - protein, 18 aa, Mycobacterium
FLAEGLRLREHRGKIHDL

SEQ ID NO: 659808 - protein, 17 aa, Mycobacterium
FLAEGWNVVATMRNPRP

SEQ ID NO: 659809 - protein, 20 aa, Mycobacterium
FLAEHRHELFPDSFIADLFR

SEQ ID NO: 659810 - protein, 17 aa, Mycobacterium
FLAELERELPAAPAQQG

SEQ ID NO: 659811 - protein, 17 aa, Mycobacterium
FLAELMSVFADGPVVIG

SEQ ID NO: 659812 - protein, 21 aa, Mycobacterium
FLAELNPGFASFVEDKIEQPI

SEQ ID NO: 659813 - protein, 22 aa, Mycobacterium
FLAELPAPMLLGKVELSDGRWV

SEQ ID NO: 659814 - protein, 33 aa, Mycobacterium
FLAESGFMQAIRPELVVPLVIFLASRACTFSHR

SEQ ID NO: 659815 - protein, 18 aa, Mycobacterium
FLAESGFMQAIRPKLVVP

SEQ ID NO: 659816 - protein, 19 aa, Mycobacterium
FLAGFRRLGARHQQFARAF

SEQ ID NO: 659817 - protein, 25 aa, Mycobacterium
FLAGGKRFRPLFTVLSAQVGPNPGA

SEQ ID NO: 659818 - protein, 18 aa, Mycobacterium
FLAGLSPETVHEMVLADP

SEQ ID NO: 659819 - protein, 21 aa, Mycobacterium
FLAGRGGEFIGRVASPFALLV

SEQ ID NO: 659820 - protein, 17 aa, Mycobacterium
FLAHGRLPDRVQRFAAD

SEQ ID NO: 659821 - protein, 25 aa, Mycobacterium
FLAHLPGYQGWQWAAVVASYVGADR

SEQ ID NO: 659822 - protein, 25 aa, Mycobacterium
FLAHLPGYQGWQWAVVVAAHAGADR

SEQ ID NO: 659823 - protein, 26 aa, Mycobacterium
FLAHLPGYQGWQWAVVVAAHPGADHA

SEQ ID NO: 659824 - protein, 29 aa, Mycobacterium
FLAHLPGYQGWQWAVVVAAYAGADHATVS

SEQ ID NO: 659825 - protein, 19 aa, Mycobacterium
FLAIAGRRVQLEIFNKFNI

SEQ ID NO: 659826 - protein, 32 aa, Mycobacterium; identical to SEQ ID NO: 79766

SEQ ID NO: 659827 - protein, 18 aa, Mycobacterium
FLALAAIRTKAVRQGDPL

SEQ ID NO: 659828 - protein, 17 aa, Mycobacterium
FLANWVREAGPKIVEPS

SEQ ID NO: 659829 - protein, 17 aa, Mycobacterium
FLAPAAAIAAEITDAPT

SEQ ID NO: 659830 - protein, 18 aa, Mycobacterium
FLAPDDWTLPTGKFPGAK

SEQ ID NO: 659831 - protein, 18 aa, Mycobacterium
FLAPEIEAAATMVGTGAM

SEQ ID NO: 659832 - protein, 27 aa, Mycobacterium
FLAPLPLAAITPRWVARRLVGMAAGGP

SEQ ID NO: 659833 - protein, 19 aa, Mycobacterium
FLAQLQWRPAGLGPEAMVS

SEQ ID NO: 659834 - protein, 17 aa, Mycobacterium
FLARALAFAAGVAIDNA

SEQ ID NO: 659835 - protein, 18 aa, Mycobacterium
FLAREVVPHQHDWDRDHR

SEQ ID NO: 659836 - protein, 24 aa, Mycobacterium
FLARLCKTAMWIDHGVIRMTGGIE

SEQ ID NO: 659837 - protein, 24 aa, Mycobacterium
FLASQRFAALTGRDHDGVLWISPL

SEQ ID NO: 659838 - protein, 17 aa, Mycobacterium
FLASRPTERYGVSDLAR

SEQ ID NO: 659839 - protein, 20 aa, Mycobacterium
FLATGCGITGRDGHPASTVF

SEQ ID NO: 659840 - protein, 19 aa, Mycobacterium
FLATLGQFVEFVRDGQFDP

SEQ ID NO: 659841 - protein, 18 aa, Mycobacterium
FLATLPQFVEFVRDGHFD

SEQ ID NO: 659842 - protein, 18 aa, Mycobacterium
FLATLSQFVEFVRDGQFD

SEQ ID NO: 659843 - protein, 17 aa, Mycobacterium
FLATRIGGQWGGAFGTM

SEQ ID NO: 659844 - protein, 17 aa, Mycobacterium
FLATRLAGDWGGAFGTL

SEQ ID NO: 659845 - protein, 19 aa, Mycobacterium
FLAVAGRRVQLDLFDKFDV

SEQ ID NO: 659846 - protein, 25 aa, Mycobacterium
FLAWEPFSHMAFRFNDCSTQAVAAF

SEQ ID NO: 659847 - protein, 24 aa, Mycobacterium
FLAWEPFSRMAFRFNTTTSGAISA

SEQ ID NO: 659848 - protein, 18 aa, Mycobacterium
FLCDTAASDDLWILPEKW

SEQ ID NO: 659849 - protein, 23 aa, Mycobacterium
FLCGEVRSLADLIAELPERVAER

SEQ ID NO: 659850 - protein, 18 aa, Mycobacterium
FLCGSVIFVDGGTDAYFR

SEQ ID NO: 659851 - protein, 17 aa, Mycobacterium
FLCGTVIFVDGGTDAYF

SEQ ID NO: 659852 - protein, 20 aa, Mycobacterium
FLCVDGAVAAIEFYTEVFGA

SEQ ID NO: 659853 - protein, 17 aa, Mycobacterium
FLDADGYPTTVDPPAAE

SEQ ID NO: 659854 - protein, 19 aa, Mycobacterium
FLDALAWRLRGQGIFAVSV

SEQ ID NO: 659855 - protein, 31 aa, Mycobacterium
FLDEFGIDTPEVWLPDSFGYSAAMPQIVAAS

SEQ ID NO: 659856 - protein, 18 aa, Mycobacterium
FLDELRAAGAEVVPIRVY

SEQ ID NO: 659857 - protein, 18 aa, Mycobacterium
FLDEPRIAERVKKARTRG

SEQ ID NO: 659858 - protein, 20 aa, Mycobacterium
FLDERLAHWATVNPDGEAMD

SEQ ID NO: 659859 - protein, 18 aa, Mycobacterium
FLDGARVPDVHRVGAVND

SEQ ID NO: 659860 - protein, 18 aa, Mycobacterium
FLDGKAFIEAFVLASALC

SEQ ID NO: 659861 - protein, 24 aa, Mycobacterium
FLDGKEFIETFVLTAALGAVTTKL

SEQ ID NO: 659862 - protein, 24 aa, Mycobacterium
FLDGKEFIETFVLTSALGAVTSKL

SEQ ID NO: 659863 - protein, 24 aa, Mycobacterium
FLDGKEIIETFVLTAALGAVTKTL

SEQ ID NO: 659864 - protein, 33 aa, Mycobacterium
FLDGKVATWWIPERWAFVPEIPRTSVGKYDKKV

SEQ ID NO: 659865 - protein, 19 aa, Mycobacterium
FLDGLAWRLREQGIAGTSV

SEQ ID NO: 659866 - protein, 18 aa, Mycobacterium
FLDGLAWRLREQGVAGVS

SEQ ID NO: 659867 - protein, 18 aa, Mycobacterium
FLDGLAWRLRERGVTAVS

SEQ ID NO: 659868 - protein, 23 aa, Mycobacterium
FLDGLRAARLFGVRTAGGHVLCP

SEQ ID NO: 659869 - protein, 17 aa, Mycobacterium
FLDGLSWRLREQGVPGV

SEQ ID NO: 659870 - protein, 19 aa, Mycobacterium
FLDHIIAHPSLRWVGNANE

SEQ ID NO: 659871 - protein, 18 aa, Mycobacterium
FLDKVVGGAVPRQFIPSV

SEQ ID NO: 659872 - protein, 27 aa, Mycobacterium
FLDLMLRAPFRLARDVLPHMRPGSAII

SEQ ID NO: 659873 - protein, 18 aa, Mycobacterium
FLDLPIPIDGLYLAGAGC

SEQ ID NO: 659874 - protein, 20 aa, Mycobacterium
FLDLSYRMHPAVCAAVSALS

SEQ ID NO: 659875 - protein, 17 aa, Mycobacterium
FLDPELRHLNDDGSDSA

SEQ ID NO: 659876 - protein, 19 aa, Mycobacterium
FLDPSALKPAGSLTAPMPG

SEQ ID NO: 659877 - protein, 17 aa, Mycobacterium
FLDQGITFSLSGQERPF

SEQ ID NO: 659878 - protein, 30 aa, Mycobacterium
FLDRGLRDTGRWRVPLILRLDPKVGSEDVR

SEQ ID NO: 659879 - protein, 26 aa, Mycobacterium
FLDRHGHRGYRELCMRDPSWADDPDG

SEQ ID NO: 659880 - protein, 17 aa, Mycobacterium
FLDRNLIGHIPLIGGGL

SEQ ID NO: 659881 - protein, 29 aa, Mycobacterium
FLDRRRHVYPWVGWLVCHGVVPGDVLVCT

SEQ ID NO: 659882 - protein, 17 aa, Mycobacterium
FLDTIGIERRWHLEDGR

SEQ ID NO: 659883 - protein, 18 aa, Mycobacterium
FLDVGGLRRLCGTPVEIA

SEQ ID NO: 659884 - protein, 28 aa, Mycobacterium
FLDYHANVIARYCARKARIREIEQLLSS

SEQ ID NO: 659885 - protein, 29 aa, Mycobacterium
FLDYHPRWAPSPFPAVLCVSVNDAVVHGI

SEQ ID NO: 659886 - protein, 20 aa, Mycobacterium
FLDYRETLGFEVLALTGDAS

SEQ ID NO: 659887 - protein, 29 aa, Mycobacterium
FLEAGELINAIPFPSIVADDFTFLDGVMA

SEQ ID NO: 659888 - protein, 17 aa, Mycobacterium
FLECAWEAVESAGYDLQ

SEQ ID NO: 659889 - protein, 18 aa, Mycobacterium
FLECAYHVFEQAGYDPDR

SEQ ID NO: 659890 - protein, 19 aa, Mycobacterium
FLEDCKPYAKALYNAIVTI

SEQ ID NO: 659891 - protein, 21 aa, Mycobacterium
FLEFARGAVLVAHNAGFDIGF

SEQ ID NO: 659892 - protein, 19 aa, Mycobacterium
FLEGCGRTDFPGGDVDDMF

SEQ ID NO: 659893 - protein, 19 aa, Mycobacterium
FLEGCGRTDFPGGNVDDMF

SEQ ID NO: 659894 - protein, 25 aa, Mycobacterium
FLEGKEFIEPFVLAAYLGALTRRIR

SEQ ID NO: 659895 - protein, 30 aa, Mycobacterium
FLEGLSAWLEFVWKPGYADYYPELPGGSVL

SEQ ID NO: 659896 - protein, 18 aa, Mycobacterium
FLEHSRILHFRAIDEFWI

SEQ ID NO: 659897 - protein, 17 aa, Mycobacterium
FLEHWDEGAEFEPLLTL

SEQ ID NO: 659898 - protein, 18 aa, Mycobacterium
FLELCPLAAWGSDFTVGA

SEQ ID NO: 659899 - protein, 25 aa, Mycobacterium
FLELWTSNMFGEFDIGPQAHLLITG

SEQ ID NO: 659900 - protein, 29 aa, Mycobacterium
FLENLSPWLEFVWKPGYADYYPELPGGSA

SEQ ID NO: 659901 - protein, 17 aa, Mycobacterium
FLERDAWLRCMHTAVAE

SEQ ID NO: 659902 - protein, 20 aa, Mycobacterium
FLEREESWVSVSRAAVADVE

SEQ ID NO: 659903 - protein, 23 aa, Mycobacterium
FLERLDPSIYWMGVHHSRLVKPE

SEQ ID NO: 659904 - protein, 29 aa, Mycobacterium
FLERLSGWFEFVWKPGYADYYPELPGGSE

SEQ ID NO: 659905 - protein, 17 aa, Mycobacterium
FLESEWADRTPVEVEVP

SEQ ID NO: 659906 - protein, 22 aa, Mycobacterium
FLETFRFLRQFSVDPALIRCPA

SEQ ID NO: 659907 - protein, 24 aa, Mycobacterium
FLETVPIAPIWLCPLRLRDNDGWP

SEQ ID NO: 659908 - protein, 25 aa, Mycobacterium
FLEVVSRPILRSSFVAVLDGCAAAL

SEQ ID NO: 659909 - protein, 25 aa, Mycobacterium
FLEYDRELFKAATAERLAAELVATI

SEQ ID NO: 659910 - protein, 25 aa, Mycobacterium
FLFADAHAYAGLGMITASLLARLSD

SEQ ID NO: 659911 - protein, 25 aa, Mycobacterium
FLFAVAYQAFSWVGASLTYPQLILD

SEQ ID NO: 659912 - protein, 17 aa, Mycobacterium
FLFCAVLAFSRWRFVRF

SEQ ID NO: 659913 - protein, 26 aa, Mycobacterium
FLFEFADPRRLFGLGGQIHREQPPVG

SEQ ID NO: 659914 - protein, 17 aa, Mycobacterium
FLFGLSLDDETRRRAEI

SEQ ID NO: 659915 - protein, 20 aa, Mycobacterium
FLFRGPMLWIAALVGEEIFD

SEQ ID NO: 659916 - protein, 18 aa, Mycobacterium
FLGAECRPGVEVIAETVG

SEQ ID NO: 659917 - protein, 18 aa, Mycobacterium
FLGAEVKAMYPLGPIFHG

SEQ ID NO: 659918 - protein, 18 aa, Mycobacterium
FLGAGEIRTCPRCHNTTQ

SEQ ID NO: 659919 - protein, 17 aa, Mycobacterium
FLGCPDVIALARDQRAA

SEQ ID NO: 659920 - protein, 27 aa, Mycobacterium
FLGDILLWPRLIHKYRGTMTAAPNFAY

SEQ ID NO: 659921 - protein, 22 aa, Mycobacterium
FLGGGGNGGRAFLLGDGGTGGD

SEQ ID NO: 659922 - protein, 18 aa, Mycobacterium
FLGKEIFPGGQMCGEADI

SEQ ID NO: 659923 - protein, 18 aa, Mycobacterium
FLGKKVVDRLEWIYNSDP

SEQ ID NO: 659924 - protein, 18 aa, Mycobacterium
FLGLKAHSYPSCGPLIEP

SEQ ID NO: 659925 - protein, 20 aa, Mycobacterium
FLGLRHFTEALIPRMPAGSA

SEQ ID NO: 659926 - protein, 18 aa, Mycobacterium
FLGLVPFPATPALPDDTQ

SEQ ID NO: 659927 - protein, 22 aa, Mycobacterium
FLGNELLPGLDLIVPAIPPGTT

SEQ ID NO: 659928 - protein, 18 aa, Mycobacterium
FLGPMITALEGYPFDKMT

SEQ ID NO: 659929 - protein, 18 aa, Mycobacterium
FLGPMITGLEGYPFDKMV

SEQ ID NO: 659930 - protein, 17 aa, Mycobacterium
FLGPMVTGLDDYPFEKL

SEQ ID NO: 659931 - protein, 17 aa, Mycobacterium
FLGPMVTGLDDYPFGKL

SEQ ID NO: 659932 - protein, 18 aa, Mycobacterium
FLGPVAKLNGILVRPHDI

SEQ ID NO: 659933 - protein, 29 aa, Mycobacterium
FLGREIPRPGLLGRFGFMDEKTMRKQAAA

SEQ ID NO: 659934 - protein, 27 aa, Mycobacterium
FLGRFDEPRKGMAVLLGALPAVVEPFP

SEQ ID NO: 659935 - protein, 24 aa, Mycobacterium
FLGRFPLELINPFPRPSDAEEART

SEQ ID NO: 659936 - protein, 24 aa, Mycobacterium
FLGSSCIYPKFAEQPIKESALLTG

SEQ ID NO: 659937 - protein, 25 aa, Mycobacterium
FLGSSCIYPKFAEQPIREDSLLTGH

SEQ ID NO: 659938 - protein, 19 aa, Mycobacterium
FLGSSCIYPKYAPQPISEN

SEQ ID NO: 659939 - protein, 25 aa, Mycobacterium
FLGTVTRPALPRVDVVSLYPGADAV

SEQ ID NO: 659940 - protein, 24 aa, Mycobacterium
FLHADRLYSGRIVDEIDRDTVWAF

SEQ ID NO: 659941 - protein, 17 aa, Mycobacterium
FLHDFAGIGARWTPANI

SEQ ID NO: 659942 - protein, 18 aa, Mycobacterium
FLHDFAGLGADWTAANIA

SEQ ID NO: 659943 - protein, 19 aa, Mycobacterium
FLHGLGLNRRVYIRLLSRV

SEQ ID NO: 659944 - protein, 25 aa, Mycobacterium
FLHGLPDSWWQWHYALEGLGRRYHC

SEQ ID NO: 659945 - protein, 29 aa, Mycobacterium
FLHIPFPPVELFLQMPWRTEIIEGLLGAD

SEQ ID NO: 659946 - protein, 27 aa, Mycobacterium
FLHIPFPPVELFMQMPWRTEIVEGLLG

SEQ ID NO: 659947 - protein, 20 aa, Mycobacterium
FLHRRFCDVVTLATKVLPKR

SEQ ID NO: 659948 - protein, 17 aa, Mycobacterium
FLHRVRIRVGDVPVGTW

SEQ ID NO: 659949 - protein, 24 aa, Mycobacterium
FLHRVRVRVGAVVPGEWTPKFGAA

SEQ ID NO: 659950 - protein, 17 aa, Mycobacterium
FLHRVRVRVGGVEPGEW

SEQ ID NO: 659951 - protein, 18 aa, Mycobacterium
FLHRVRVRVGGVEPGQWT

SEQ ID NO: 659952 - protein, 25 aa, Mycobacterium
FLHVDYRRIALIGAQLQVEAAIDDI

SEQ ID NO: 659953 - protein, 17 aa, Mycobacterium
FLIGANMAIRAQAWKSV

SEQ ID NO: 659954 - protein, 20 aa, Mycobacterium
FLIIDGWPAFVSEFPDLEGQ

SEQ ID NO: 659955 - protein, 20 aa, Mycobacterium
FLIIDGWPAFVSEFPDLELQ

SEQ ID NO: 659956 - protein, 20 aa, Mycobacterium
FLIKHAKAIPVDRSAGHGAY

SEQ ID NO: 659957 - protein, 18 aa, Mycobacterium
FLIMPKLIPALIAGCAVI

SEQ ID NO: 659958 - protein, 20 aa, Mycobacterium
FLKDLLEAFSDGPVVIGPTA

SEQ ID NO: 659959 - protein, 20 aa, Mycobacterium
FLKELRLERGPLDHDEAVEA

SEQ ID NO: 659960 - protein, 24 aa, Mycobacterium
FLKELRVPRDGRLYGIERALAAGV

SEQ ID NO: 659961 - protein, 20 aa, Mycobacterium
FLKNPALEAVRFTARSAPKL

SEQ ID NO: 659962 - protein, 24 aa, Mycobacterium
FLKSKLRTGGLLLNHCITRHDNKS

SEQ ID NO: 659963 - protein, 24 aa, Mycobacterium
FLKSKLRTGGLLLNHCITRHDNTS

SEQ ID NO: 659964 - protein, 24 aa, Mycobacterium
FLKSKLRTGGLLLNHCITRPDNRS

SEQ ID NO: 659965 - protein, 19 aa, Mycobacterium
FLKVEWRTIQHYGVQVDNR

SEQ ID NO: 659966 - protein, 18 aa, Mycobacterium
FLLAMGLKVGRGMGVAEM

SEQ ID NO: 659967 - protein, 19 aa, Mycobacterium
FLLAPSWRYRPAADKREFV

SEQ ID NO: 659968 - protein, 17 aa, Mycobacterium
FLLAQQCDLVIAAEHAR

SEQ ID NO: 659969 - protein, 26 aa, Mycobacterium
FLLARARGGVALAFADVAQVHWSSPA

SEQ ID NO: 659970 - protein, 18 aa, Mycobacterium
FLLARPLIGNGADGTAAN

SEQ ID NO: 659971 - protein, 19 aa, Mycobacterium
FLLEETYELLDAVGSGNAD

SEQ ID NO: 659972 - protein, 18 aa, Mycobacterium
FLLEETYELLDAVRSGSA

SEQ ID NO: 659973 - protein, 17 aa, Mycobacterium
FLLEGMPVQVAFHDGAP

SEQ ID NO: 659974 - protein, 27 aa, Mycobacterium
FLLERLRDWGVEHVFAYPGDGINGLLA

SEQ ID NO: 659975 - protein, 18 aa, Mycobacterium
FLLGAGYAPTVVDLPHPA

SEQ ID NO: 659976 - protein, 17 aa, Mycobacterium
FLLGIGVSHAPLIDSKE

SEQ ID NO: 659977 - protein, 21 aa, Mycobacterium
FLLGLDLIDRVVFWMLPMDDP

SEQ ID NO: 659978 - protein, 23 aa, Mycobacterium
FLLGLDLIDRVVFWMLPVDDLLP

SEQ ID NO: 659979 - protein, 20 aa, Mycobacterium
FLLGQCLFGPVLVDPPTGPK

SEQ ID NO: 659980 - protein, 19 aa, Mycobacterium
FLLGRPLIGNGADGTATSP

SEQ ID NO: 659981 - protein, 18 aa, Mycobacterium
FLLGVGIHDITAGYRAYR

SEQ ID NO: 659982 - protein, 20 aa, Mycobacterium
FLLIAAALAEGWAVSVPDHE

SEQ ID NO: 659983 - protein, 18 aa, Mycobacterium
FLLIRAALPHMYRNEFGR

SEQ ID NO: 659984 - protein, 24 aa, Mycobacterium
FLLMRHVFGLGYRRYEWKCDSLNE

SEQ ID NO: 659985 - protein, 21 aa, Mycobacterium
FLLNRNRLNVAVSRAKYAAVI

SEQ ID NO: 659986 - protein, 20 aa, Mycobacterium
FLLNRNRLNVAVSRAKYLAV

SEQ ID NO: 659987 - protein, 20 aa, Mycobacterium
FLLNRNRLNVAVSRAQYAAV

SEQ ID NO: 659988 - protein, 20 aa, Mycobacterium
FLLNTGRLAHQWHTLTKTGK

SEQ ID NO: 659989 - protein, 23 aa, Mycobacterium
FLLPSNMVTPFLGMLGTAAVADA

SEQ ID NO: 659990 - protein, 17 aa, Mycobacterium
FLLQFEFDGHRLTDEQL

SEQ ID NO: 659991 - protein, 17 aa, Mycobacterium
FLLQGGDCAETFADNTE

SEQ ID NO: 659992 - protein, 17 aa, Mycobacterium
FLLQGGDCAETFTENTE

SEQ ID NO: 659993 - protein, 17 aa, Mycobacterium
FLLQGGDCAETFVDNTE

SEQ ID NO: 659994 - protein, 18 aa, Mycobacterium
FLLQRPLLTAIRRTDPTV

SEQ ID NO: 659995 - protein, 18 aa, Mycobacterium
FLLREQKVTLGFAGPEAP

SEQ ID NO: 659996 - protein, 17 aa, Mycobacterium
FLLSREGEWINGQVVNI

SEQ ID NO: 659997 - protein, 24 aa, Mycobacterium
FLLSVGDLLLAWLLLQQAEIALNA

SEQ ID NO: 659998 - protein, 18 aa, Mycobacterium
FLLTAGAIGSLYKERASI

SEQ ID NO: 659999 - protein, 17 aa, Mycobacterium
FLLTRPLLTAIRRTEPT

SEQ ID NO: 660000 - protein, 17 aa, Mycobacterium
FLLVGGLLGDLANHVAR

SEQ ID NO: 660001 - protein, 17 aa, Mycobacterium
FLMQEANPWGYSNKELL

SEQ ID NO: 660002 - protein, 25 aa, Mycobacterium
FLMSVGDLIIGWLLQRQAAVAVAAL

SEQ ID NO: 660003 - protein, 27 aa, Mycobacterium
FLMSVGDLLIGWLLQRQAAVAIEALDA

SEQ ID NO: 660004 - protein, 24 aa, Mycobacterium
FLMSVGDLVIAWLLQRQAAVAVAA

SEQ ID NO: 660005 - protein, 24 aa, Mycobacterium
FLMSVGDLVIGWLLQQQAAVAIEK

SEQ ID NO: 660006 - protein, 24 aa, Mycobacterium
FLMSVGDLVIGWLLQQQAAVAVQA

SEQ ID NO: 660007 - protein, 25 aa, Mycobacterium
FLMSVGDLVIGWLLQRQAAVAVAAL

SEQ ID NO: 660008 - protein, 17 aa, Mycobacterium
FLMVCTGYYRYDGGYLP

SEQ ID NO: 660009 - protein, 17 aa, Mycobacterium
FLMWLLADLFAVLPEVG

SEQ ID NO: 660010 - protein, 17 aa, Mycobacterium
FLMWVLADLFTFLPEVG

SEQ ID NO: 660011 - protein, 17 aa, Mycobacterium
FLMWVLADLFTYLPEVG

SEQ ID NO: 660012 - protein, 18 aa, Mycobacterium
FLNCLGGYTYSRHSYSLG

SEQ ID NO: 660013 - protein, 26 aa, Mycobacterium
FLNGEVTLPLLLPLGLGLVVLDIPFD

SEQ ID NO: 660014 - protein, 19 aa, Mycobacterium
FLNGNLFGRDGFILSNLIP

SEQ ID NO: 660015 - protein, 17 aa, Mycobacterium
FLNGVFPLDRNRLTREW

SEQ ID NO: 660016 - protein, 28 aa, Mycobacterium
FLNLMLRAPFRLTREVLPHMPAGSGIVN

SEQ ID NO: 660017 - protein, 26 aa, Mycobacterium
FLNLMPRWYIGSVLRHVDFLTSDVPG

SEQ ID NO: 660018 - protein, 17 aa, Mycobacterium
FLNNLLLKHRSAKRRGA

SEQ ID NO: 660019 - protein, 19 aa, Mycobacterium
FLNRAQFADGTFRNRMSAD

SEQ ID NO: 660020 - protein, 18 aa, Mycobacterium
FLNRDFSVYAVDLLGKRE

SEQ ID NO: 660021 - protein, 17 aa, Mycobacterium
FLNTRCLSIAGGTEQIL

SEQ ID NO: 660022 - protein, 18 aa, Mycobacterium
FLPAVARMRALDPVTSEL

SEQ ID NO: 660023 - protein, 25 aa, Mycobacterium
FLPDLGLRRENIVFISGIGCSSRFP

SEQ ID NO: 660024 - protein, 20 aa, Mycobacterium
FLPERLRSLIAGRVGVDEGQ

SEQ ID NO: 660025 - protein, 22 aa, Mycobacterium
FLPFKPTPFRSFAMGHRPILDA

SEQ ID NO: 660026 - protein, 22 aa, Mycobacterium
FLPGARRKFGIDLEDIRAVNPS

SEQ ID NO: 660027 - protein, 17 aa, Mycobacterium
FLPGHREKFGIDVDDIR

SEQ ID NO: 660028 - protein, 17 aa, Mycobacterium
FLPGHRQKFGIDVDDIR

SEQ ID NO: 660029 - protein, 28 aa, Mycobacterium
FLPGYSFPRLPLSAFIPAERRTRNGEGD

SEQ ID NO: 660030 - protein, 26 aa, Mycobacterium
FLPLLRRAAGRIVVIASIGDRFTPPF

SEQ ID NO: 660031 - protein, 18 aa, Mycobacterium
FLPLRYGQVTLKEKMPRR

SEQ ID NO: 660032 - protein, 21 aa, Mycobacterium
FLPNFLWDFINEVITVHPLGG

SEQ ID NO: 660033 - protein, 26 aa, Mycobacterium
FLPPTAAVDIWWCQGFSEPEAGSDLA

SEQ ID NO: 660034 - protein, 27 aa, Mycobacterium
FLPRGIPGRAYWFFARTAHHAGMRALA

SEQ ID NO: 660035 - protein, 29 aa, Mycobacterium
FLPSCGHCSYCARGMGNLCDMGAAIMMGP

SEQ ID NO: 660036 - protein, 27 aa, Mycobacterium
FLPSCGHCSYCARGMGNMCDLGAALMM

SEQ ID NO: 660037 - protein, 18 aa, Mycobacterium
FLPSNTFDYPPIVNPGLE

SEQ ID NO: 660038 - protein, 22 aa, Mycobacterium
FLPSRLTVDLFRAARGVETTTK

SEQ ID NO: 660039 - protein, 22 aa, Mycobacterium
FLPSVPNLLLLASEMEAQRNHV

SEQ ID NO: 660040 - protein, 26 aa, Mycobacterium
FLPVEELIAAFLPVLFPGMEIVEHHA

SEQ ID NO: 660041 - protein, 23 aa, Mycobacterium
FLPVFAEGALFYVGDPHMAMGDG

SEQ ID NO: 660042 - protein, 17 aa, Mycobacterium
FLQAGLVERAMVVSGEY

SEQ ID NO: 660043 - protein, 21 aa, Mycobacterium
FLQDLERSWQLVLPGIANPDR

SEQ ID NO: 660044 - protein, 22 aa, Mycobacterium
FLQDRIEHVYRFRSELAKDAGV

SEQ ID NO: 660045 - protein, 25 aa, Mycobacterium
FLQFFRAGAEWDVLAAIPASLLPYA

SEQ ID NO: 660046 - protein, 19 aa, Mycobacterium
FLQGAFDFVGAGYDKPVPL

SEQ ID NO: 660047 - protein, 17 aa, Mycobacterium
FLQPGALLDSLETRLAD

SEQ ID NO: 660048 - protein, 18 aa, Mycobacterium
FLQPGALLESLETRLAGL

SEQ ID NO: 660049 - protein, 23 aa, Mycobacterium
FLQPGHPYRMWPARLRRPEPAPR

SEQ ID NO: 660050 - protein, 28 aa, Mycobacterium
FLQPRVEPEIALVIKRDLAGPGVTVAEA

SEQ ID NO: 660051 - protein, 19 aa, Mycobacterium
FLQQWVYRPPHDEVIAQLR

SEQ ID NO: 660052 - protein, 20 aa, Mycobacterium
FLQRHVEAGQRIVAEVRAAA

SEQ ID NO: 660053 - protein, 19 aa, Mycobacterium
FLQRPARWLQMLATSSHAF

SEQ ID NO: 660054 - protein, 20 aa, Mycobacterium
FLQRPARWMQLLASNCQVFS

SEQ ID NO: 660055 - protein, 24 aa, Mycobacterium
FLQRTKDRFPWADLVADPVPLDRI

SEQ ID NO: 660056 - protein, 18 aa, Mycobacterium
FLQYPWQVIPDELVKPLE

SEQ ID NO: 660057 - protein, 18 aa, Mycobacterium
FLQYPWQVLPEELVKPIE

SEQ ID NO: 660058 - protein, 20 aa, Mycobacterium
FLRAADLARAITFVAETPRG

SEQ ID NO: 660059 - protein, 21 aa, Mycobacterium
FLRAADLARAITFVAETPRGG

SEQ ID NO: 660060 - protein, 19 aa, Mycobacterium
FLRAGGIEVVTMGSHGIIT

SEQ ID NO: 660061 - protein, 24 aa, Mycobacterium
FLRDAWKPGDRIFLFGAGTGGHLA

SEQ ID NO: 660062 - protein, 17 aa, Mycobacterium
FLRDLPLHTDVNETTKT

SEQ ID NO: 660063 - protein, 17 aa, Mycobacterium
FLRDMFGDVRMLCHDTG

SEQ ID NO: 660064 - protein, 19 aa, Mycobacterium
FLRDPRSGLRVEVVSVKGR

SEQ ID NO: 660065 - protein, 25 aa, Mycobacterium
FLRDRCREVPFLPGATYHFVATSAA

SEQ ID NO: 660066 - protein, 19 aa, Mycobacterium
FLREGFPVNVLNPVKAVPE

SEQ ID NO: 660067 - protein, 17 aa, Mycobacterium
FLREGRAVHDFRHPDRL

SEQ ID NO: 660068 - protein, 22 aa, Mycobacterium
FLRENLCAVGIELSDDHLRRLE

SEQ ID NO: 660069 - protein, 24 aa, Mycobacterium
FLREYPYREAYLLRDAKLFRAELK

SEQ ID NO: 660070 - protein, 23 aa, Mycobacterium
FLREYPYREAYLLREAKQFRAEL

SEQ ID NO: 660071 - protein, 30 aa, Mycobacterium
FLREYPYREAYLLRHAKLFRAELTMPLILL

SEQ ID NO: 660072 - protein, 21 aa, Mycobacterium
FLRFGEMLEPVFAAAKNPRTG

SEQ ID NO: 660073 - protein, 17 aa, Mycobacterium
FLRHFDSKLGRGPAISA

SEQ ID NO: 660074 - protein, 19 aa, Mycobacterium
FLRLGRDGYTQVMHALADT

SEQ ID NO: 660075 - protein, 18 aa, Mycobacterium
FLRMSREITCAQANLVPA

SEQ ID NO: 660076 - protein, 19 aa, Mycobacterium
FLRNWRDALQLPKEKHPDT

SEQ ID NO: 660077 - protein, 17 aa, Mycobacterium
FLRRHAVLPDERITAVQ

SEQ ID NO: 660078 - protein, 17 aa, Mycobacterium
FLRRLLGSSPGSPGSSS

SEQ ID NO: 660079 - protein, 19 aa, Mycobacterium
FLRSLRRKKRNPDEGEPND

SEQ ID NO: 660080 - protein, 19 aa, Mycobacterium
FLRVFGFRGGTARAVQEAM

SEQ ID NO: 660081 - protein, 21 aa, Mycobacterium
FLRWGQGAFDDFKVVPPGTGI

SEQ ID NO: 660082 - protein, 26 aa, Mycobacterium
FLSAANWAGFGLHPRGNFEAFTQAAS

SEQ ID NO: 660083 - protein, 25 aa, Mycobacterium
FLSADGKTARFAIESSYNPYSSEAM

SEQ ID NO: 660084 - protein, 26 aa, Mycobacterium
FLSCQVRLLIVDDVHFLQPRSRNGVE

SEQ ID NO: 660085 - protein, 18 aa, Mycobacterium
FLSDDCLYVDMPVPALSA

SEQ ID NO: 660086 - protein, 23 aa, Mycobacterium
FLSDRMDFDRSYHHVLFNQDFTS

SEQ ID NO: 660087 - protein, 25 aa, Mycobacterium
FLSDRSATLPGVWQGLYESLLTERL

SEQ ID NO: 660088 - protein, 17 aa, Mycobacterium
FLSEGFAHLTLDEIAAR

SEQ ID NO: 660089 - protein, 19 aa, Mycobacterium
FLSFSGPDVREGLAAHREK

SEQ ID NO: 660090 - protein, 18 aa, Mycobacterium
FLSGQLWESAGSPEVDPD

SEQ ID NO: 660091 - protein, 18 aa, Mycobacterium
FLSGRPGRAAALREFIAE

SEQ ID NO: 660092 - protein, 18 aa, Mycobacterium
FLSGWQIVALQPYGGAWL

SEQ ID NO: 660093 - protein, 20 aa, Mycobacterium
FLSLHLARLMAAAGHDVLIT

SEQ ID NO: 660094 - protein, 18 aa, Mycobacterium
FLSLLKDRADALVVGDPT

SEQ ID NO: 660095 - protein, 26 aa, Mycobacterium
FLSPDARKLFADWDVQARSVVENLRL

SEQ ID NO: 660096 - protein, 19 aa, Mycobacterium
FLSPDCLYVDMPVPALSAR

SEQ ID NO: 660097 - protein, 21 aa, Mycobacterium
FLSRFVEKMAALRVGDPTDPA

SEQ ID NO: 660098 - protein, 23 aa, Mycobacterium
FLSTYASAAWLWTGRTGIIAGEA

SEQ ID NO: 660099 - protein, 24 aa, Mycobacterium
FLTAGPKEARAWVIHQGDTAPKAA

SEQ ID NO: 660100 - protein, 18 aa, Mycobacterium
FLTAGPKESRAWVIHQGD

SEQ ID NO: 660101 - protein, 23 aa, Mycobacterium
FLTARPGICLTTSGPGFLNGLPA

SEQ ID NO: 660102 - protein, 21 aa, Mycobacterium
FLTDFPALRLIGLDRDPNALA

SEQ ID NO: 660103 - protein, 17 aa, Mycobacterium
FLTDIGYLLPEPEDFTI

SEQ ID NO: 660104 - protein, 18 aa, Mycobacterium
FLTEPWWCRMVVLSAERI

SEQ ID NO: 660105 - protein, 17 aa, Mycobacterium
FLTEVARVLRPNGHFLY

SEQ ID NO: 660106 - protein, 25 aa, Mycobacterium
FLTGFRRAGARRKTLVTTFLDAVGR

SEQ ID NO: 660107 - protein, 17 aa, Mycobacterium
FLTGGSMIETVTMEAST

SEQ ID NO: 660108 - protein, 25 aa, Mycobacterium
FLTGPWPVGFVRLRRLRGISLHGTD

SEQ ID NO: 660109 - protein, 26 aa, Mycobacterium
FLTIARLLAPVAVPLVYRASIAARGV

SEQ ID NO: 660110 - protein, 26 aa, Mycobacterium
FLTKRDARSWLSLRQAEIVARAWMPP

SEQ ID NO: 660111 - protein, 17 aa, Mycobacterium
FLTLKVAASEFAYHATD

SEQ ID NO: 660112 - protein, 31 aa, Mycobacterium
FLTPDGRPFFCGTYYPKANFLQLLTAVAETW

SEQ ID NO: 660113 - protein, 28 aa, Mycobacterium
FLTPDGRPFFCGTYYPKVSFLQLLAAVS

SEQ ID NO: 660114 - protein, 17 aa, Mycobacterium
FLTPQLPAPLIRVYGTT

SEQ ID NO: 660115 - protein, 17 aa, Mycobacterium
FLTPRIASLWVGTVTPI

SEQ ID NO: 660116 - protein, 17 aa, Mycobacterium
FLTQCWQEVSSTLRSQA

SEQ ID NO: 660117 - protein, 22 aa, Mycobacterium
FLTRRWPDLLTWTSQASSSSGG

SEQ ID NO: 660118 - protein, 25 aa, Mycobacterium
FLTSDGRPFFCGTYYPKDAFLQLLS

SEQ ID NO: 660119 - protein, 18 aa, Mycobacterium
FLTSLSLPQMVVGSPETI

SEQ ID NO: 660120 - protein, 19 aa, Mycobacterium
FLTTPGLQTPVFVRFSTVA

SEQ ID NO: 660121 - protein, 25 aa, Mycobacterium
FLTTPGLRTPVFVRFSTVAGSRGSA

SEQ ID NO: 660122 - protein, 17 aa, Mycobacterium
FLTTRLDGQWGGAYGTM

SEQ ID NO: 660123 - protein, 23 aa, Mycobacterium
FLTVARKFWDSWAPGAVLADVEN

SEQ ID NO: 660124 - protein, 18 aa, Mycobacterium
FLTVHFSNPAPFIPGVEL

SEQ ID NO: 660125 - protein, 17 aa, Mycobacterium
FLVANALFWLEEFHIDG

SEQ ID NO: 660126 - protein, 19 aa, Mycobacterium
FLVAVARSCAGQACSVVVR

SEQ ID NO: 660127 - protein, 24 aa, Mycobacterium
FLVEDCAPRVLVTEAVLAPVATGV

SEQ ID NO: 660128 - protein, 18 aa, Mycobacterium
FLVHAAMALVVDLGRMVD

SEQ ID NO: 660129 - protein, 27 aa, Mycobacterium
FLVHAWDYAVATGQEFEPMDALTDGVL

SEQ ID NO: 660130 - protein, 18 aa, Mycobacterium
FLVMPYCGLGCIQDRIHR

SEQ ID NO: 660131 - protein, 19 aa, Mycobacterium
FLVPFELDPTVLLSSDGSN

SEQ ID NO: 660132 - protein, 17 aa, Mycobacterium
FLVQLAVTTTVGNAIAE

SEQ ID NO: 660133 - protein, 20 aa, Mycobacterium
FLVRDELCRIFRLDRDVVRV

SEQ ID NO: 660134 - protein, 23 aa, Mycobacterium
FLVRHLAAKRIRAIEQFAAQTAS

SEQ ID NO: 660135 - protein, 21 aa, Mycobacterium
FLVVDECHYYRGVFGSNVAMV

SEQ ID NO: 660136 - protein, 22 aa, Mycobacterium
FLVVVPDRWEPLANNLFHGIRS

SEQ ID NO: 660137 - protein, 20 aa, Mycobacterium
FLWQHCTAMVPGFAGNTTVA

SEQ ID NO: 660138 - protein, 17 aa, Mycobacterium
FLWYRGRQLGGRLHTWS

SEQ ID NO: 660139 - protein, 20 aa, Mycobacterium
FLYFSPREYIVIFGSPTGTQ

SEQ ID NO: 660140 - protein, 17 aa, Mycobacterium
FLYHQMNPWDVPIGGMG

SEQ ID NO: 660141 - protein, 18 aa, Mycobacterium
FLYHRARDGGSAWFTVDD

SEQ ID NO: 660142 - protein, 18 aa, Mycobacterium
FLYLDRLVGRHARSAKRA

SEQ ID NO: 660143 - protein, 19 aa, Mycobacterium
FLYLDRLVGRYARAAKKAV

SEQ ID NO: 660144 - protein, 25 aa, Mycobacterium
FLYRRGPYADAPRPDLILLDLNLPK

SEQ ID NO: 660145 - protein, 34 aa, Mycobacterium
FLYTHFEELCEILARYDVTFSLGDGLRPGSIADA

SEQ ID NO: 660146 - protein, 19 aa, Mycobacterium
FMAAQPGFVSFRIHRAVVP

SEQ ID NO: 660147 - protein, 28 aa, Mycobacterium
FMADIALPLPIAIIGEWLGLDDSSAAVL

SEQ ID NO: 660148 - protein, 18 aa, Mycobacterium
FMADLCWIENIGARGFAA

SEQ ID NO: 660149 - protein, 17 aa, Mycobacterium
FMADVKANRLPQVSWVV

SEQ ID NO: 660150 - protein, 18 aa, Mycobacterium
FMAGFAGMQGHVIDAILA

SEQ ID NO: 660151 - protein, 31 aa, Mycobacterium
FMAQLQLWARRGHPTLADIVELERLAKDPDY

SEQ ID NO: 660152 - protein, 17 aa, Mycobacterium
FMATRTAFFDEFFLGAA

SEQ ID NO: 660153 - protein, 25 aa, Mycobacterium
FMAVCAAASAWIRIGQIQAAEVAAA

SEQ ID NO: 660154 - protein, 19 aa, Mycobacterium
FMDCVRAVIGGTSMDEFAD

SEQ ID NO: 660155 - protein, 22 aa, Mycobacterium
FMEAIVRPVTWAEWPESAAGIF

SEQ ID NO: 660156 - protein, 19 aa, Mycobacterium
FMETFRAGLADLKRKGNAV

SEQ ID NO: 660157 - protein, 27 aa, Mycobacterium
FMEVAKLRAGRLLWSDLVAQFGPQNPK

SEQ ID NO: 660158 - protein, 27 aa, Mycobacterium
FMEVAKLRAGRLLWSELVAEFDPKSSK

SEQ ID NO: 660159 - protein, 27 aa, Mycobacterium
FMEVAKLRAGRLLWSELVAKFEPKNSK

SEQ ID NO: 660160 - protein, 27 aa, Mycobacterium
FMEVAKLRAGRLLWSELVAQFDPKSSK

SEQ ID NO: 660161 - protein, 27 aa, Mycobacterium
FMEVAKLRAGRLLWSELVAQFHPKNPK

SEQ ID NO: 660162 - protein, 27 aa, Mycobacterium
FMEVAKLRAGRLLWSELVSEFEPKSEK

SEQ ID NO: 660163 - protein, 27 aa, Mycobacterium
FMEVAKLRAGRLLWSELVSQFDPKSAK

SEQ ID NO: 660164 - protein, 23 aa, Mycobacterium
FMGNPILCDLILIRAALSPKAAR

SEQ ID NO: 660165 - protein, 24 aa, Mycobacterium
FMGNPILCDLILIRAALSPKAARM

SEQ ID NO: 660166 - protein, 18 aa, Mycobacterium
FMGNPILCDLILIRSALS

SEQ ID NO: 660167 - protein, 17 aa, Mycobacterium
FMGRRAVACLGTAAALY

SEQ ID NO: 660168 - protein, 23 aa, Mycobacterium
FMGSRLRAPVLIGAMTGGAALSG

SEQ ID NO: 660169 - protein, 19 aa, Mycobacterium
FMHVLPVGWVEPRDISNAV

SEQ ID NO: 660170 - protein, 18 aa, Mycobacterium
FMKYLRRGSGYYIDVGAS

SEQ ID NO: 660171 - protein, 17 aa, Mycobacterium
FMLIGAAFYRDTYRRTT

SEQ ID NO: 660172 - protein, 17 aa, Mycobacterium
FMLKDPIYGLGPRLAQL

SEQ ID NO: 660173 - protein, 17 aa, Mycobacterium
FMLKEIVRYPSVADEVE

SEQ ID NO: 660174 - protein, 17 aa, Mycobacterium
FMMLYAFGVGEAAISIS

SEQ ID NO: 660175 - protein, 19 aa, Mycobacterium
FMMRNARCVLSKAQILDRV

SEQ ID NO: 660176 - protein, 17 aa, Mycobacterium
FMMRVRCDGGALSAAAL

SEQ ID NO: 660177 - protein, 25 aa, Mycobacterium
FMPACGHCRWCASGNSVLCDYGAVI

SEQ ID NO: 660178 - protein, 17 aa, Mycobacterium
FMPAYLHDAQDLPVPGV

SEQ ID NO: 660179 - protein, 22 aa, Mycobacterium
FMPVVWALFEWGRRHIPNDSPL

SEQ ID NO: 660180 - protein, 23 aa, Mycobacterium
FMRDVLLWGRLIDKYKGTMTAAP

SEQ ID NO: 660181 - protein, 21 aa, Mycobacterium
FMRDVPCPECDGTRLKPEILA

SEQ ID NO: 660182 - protein, 18 aa, Mycobacterium
FMRPFRADEWLLYDQSSP

SEQ ID NO: 660183 - protein, 24 aa, Mycobacterium
FMSAQRLAVVGARDDAGRVWAGPL

SEQ ID NO: 660184 - protein, 19 aa, Mycobacterium
FMSDLVWIENVGARGFAAL

SEQ ID NO: 660185 - protein, 27 aa, Mycobacterium
FMSREMLRLVEAFGYGWSDLERFTINA

SEQ ID NO: 660186 - protein, 18 aa, Mycobacterium
FMSYLNLWHYLRGQRKSL

SEQ ID NO: 660187 - protein, 18 aa, Mycobacterium
FMSYLNLWRYLREQRTEM

SEQ ID NO: 660188 - protein, 17 aa, Mycobacterium
FMVNYLRLFATDPAERV

SEQ ID NO: 660189 - protein, 25 aa, Mycobacterium
FMVPPQWFAMWARRHQHEYGSTSED

SEQ ID NO: 660190 - protein, 20 aa, Mycobacterium
FMWRLADRQLDEFLGAGECE

SEQ ID NO: 660191 - protein, 17 aa, Mycobacterium
FNAARSCLEQGVRVGCF

SEQ ID NO: 660192 - protein, 17 aa, Mycobacterium
FNADKPFMMYWASGCLH

SEQ ID NO: 660193 - protein, 19 aa, Mycobacterium
FNAEKGFGFIAPEDGSADV

SEQ ID NO: 660194 - protein, 30 aa, Mycobacterium
FNAFPASYWRRWSICASVVLRVELTGTGRV

SEQ ID NO: 660195 - protein, 29 aa, Mycobacterium
FNAFPASYWRRWSICKSVVLRVELSGAGR

SEQ ID NO: 660196 - protein, 30 aa, Mycobacterium
FNAFPASYWRRWSICSSVVLRVELTGTGRV

SEQ ID NO: 660197 - protein, 29 aa, Mycobacterium
FNAFPASYWRRWSICTSVVLRVELIGAGR

SEQ ID NO: 660198 - protein, 24 aa, Mycobacterium
FNAFPASYWRRWSTLDTVVLRVEL

SEQ ID NO: 660199 - protein, 24 aa, Mycobacterium
FNAFPASYWRRWSTLESVVLRVEL

SEQ ID NO: 660200 - protein, 18 aa, Mycobacterium
FNAGCPVVAAAIGSDDDD

SEQ ID NO: 660201 - protein, 20 aa, Mycobacterium
FNAHYEPIDFMLPAAEFGGA

SEQ ID NO: 660202 - protein, 19 aa, Mycobacterium
FNAIRCVDAPAPTDAASWV

SEQ ID NO: 660203 - protein, 17 aa, Mycobacterium
FNAIRCVDAPNPTDQAS

SEQ ID NO: 660204 - protein, 19 aa, Mycobacterium
FNALDEWGRFDEAFTALRR

SEQ ID NO: 660205 - protein, 22 aa, Mycobacterium
FNALLQWGPMIFALGYTAAEGG

SEQ ID NO: 660206 - protein, 24 aa, Mycobacterium
FNALPIRRLGVLPGSGESVTVPVV

SEQ ID NO: 660207 - protein, 17 aa, Mycobacterium
FNATRFALMNGAALGEL

SEQ ID NO: 660208 - protein, 17 aa, Mycobacterium
FNATRFALMNGAAPAPL

SEQ ID NO: 660209 - protein, 24 aa, Mycobacterium
FNAVSWLEALGFCGVGEAADFLDG

SEQ ID NO: 660210 - protein, 24 aa, Mycobacterium
FNCLAPGMWPAWWLSNDDPGRSGE

SEQ ID NO: 660211 - protein, 17 aa, Mycobacterium
FNCLTSYSDASKMRDDL

SEQ ID NO: 660212 - protein, 18 aa, Mycobacterium
FNDEWVLAHAEFHQALLD

SEQ ID NO: 660213 - protein, 17 aa, Mycobacterium
FNDGWMSSYGFLRTRLD

SEQ ID NO: 660214 - protein, 20 aa, Mycobacterium
FNDPQWKGITDWRAELSPHY

SEQ ID NO: 660215 - protein, 24 aa, Mycobacterium
FNDRGACLAGAVLDEGLRRQVVQL

SEQ ID NO: 660216 - protein, 18 aa, Mycobacterium
FNDTIFKRTTGLAYFSNG

SEQ ID NO: 660217 - protein, 25 aa, Mycobacterium
FNDVDLRWVILAARIGILRQPLNIK

SEQ ID NO: 660218 - protein, 17 aa, Mycobacterium
FNDYEIVAANLLDGDPR

SEQ ID NO: 660219 - protein, 26 aa, Mycobacterium
FNEALELARGFGLRYELAHLSNSAAT

SEQ ID NO: 660220 - protein, 23 aa, Mycobacterium
FNEALPALNSFILPGGTPLSALL

SEQ ID NO: 660221 - protein, 22 aa, Mycobacterium
FNEDFAGLIVSGDEAWTTINDY

SEQ ID NO: 660222 - protein, 22 aa, Mycobacterium
FNEDFAGLIVSGDEAWTTITDY

SEQ ID NO: 660223 - protein, 21 aa, Mycobacterium
FNEMTFLNGIVLDADHQLQLI

SEQ ID NO: 660224 - protein, 30 aa, Mycobacterium
FNEPFPGFVWEGCLNPVLGCPIQDHKLTNF

SEQ ID NO: 660225 - protein, 25 aa, Mycobacterium
FNEPICPPCGSFIRSNAGDIDTAVN

SEQ ID NO: 660226 - protein, 25 aa, Mycobacterium
FNEPICPPCGTFIRSNGADIDAAVN

SEQ ID NO: 660227 - protein, 21 aa, Mycobacterium
FNEPLPALNSFILPGGTTLSA

SEQ ID NO: 660228 - protein, 23 aa, Mycobacterium
FNEVRARRGLPGPAVVFECVGAP

SEQ ID NO: 660229 - protein, 18 aa, Mycobacterium
FNGAPRLARHVQNSQTVL

SEQ ID NO: 660230 - protein, 20 aa, Mycobacterium
FNGDKGFGFIAPDNASEDVF

SEQ ID NO: 660231 - protein, 29 aa, Mycobacterium
FNGDRALCIKAMIEKVVDRMYAEIDDNRF

SEQ ID NO: 660232 - protein, 20 aa, Mycobacterium
FNGEKGFGFIAPDDGSKDVF

SEQ ID NO: 660233 - protein, 19 aa, Mycobacterium
FNGEKGFGFIAPDGGAPDV

SEQ ID NO: 660234 - protein, 19 aa, Mycobacterium
FNGEKGFGFITPDDGTKDL

SEQ ID NO: 660235 - protein, 17 aa, Mycobacterium
FNGGFANMMNIGMGNWA

SEQ ID NO: 660236 - protein, 17 aa, Mycobacterium
FNGGMAGAGGNGGSALL

SEQ ID NO: 660237 - protein, 20 aa, Mycobacterium
FNGGVLNTGFFSATTHAGPN

SEQ ID NO: 660238 - protein, 22 aa, Mycobacterium
FNGKGRAAIAIGNPDRAQNTSV

SEQ ID NO: 660239 - protein, 17 aa, Mycobacterium
FNGKNMRAYEDITEQEV

SEQ ID NO: 660240 - protein, 26 aa, Mycobacterium
FNGKPEFVENFFLFIAEEVRELMAEL

SEQ ID NO: 660241 - protein, 22 aa, Mycobacterium
FNGRGGRVLPMLHPGGRVNMAK

SEQ ID NO: 660242 - protein, 18 aa, Mycobacterium
FNGRHYALPYARSTPLFY

SEQ ID NO: 660243 - protein, 18 aa, Mycobacterium
FNGSLMVMPGSHRTFYPC

SEQ ID NO: 660244 - protein, 34 aa, Mycobacterium
FNHASGRIKLAWFLLHVARYLPALIYSTDPGWGQ

SEQ ID NO: 660245 - protein, 18 aa, Mycobacterium
FNHPMLILARSLSAALAN

SEQ ID NO: 660246 - protein, 18 aa, Mycobacterium
FNHPSVRGLATMLSDGEG

SEQ ID NO: 660247 - protein, 23 aa, Mycobacterium
FNHSRRVFFFGALQGLRRGIHPN

SEQ ID NO: 660248 - protein, 17 aa, Mycobacterium
FNIDAPAAFVLLTQLSA

SEQ ID NO: 660249 - protein, 29 aa, Mycobacterium
FNIFCGSCYFCARGLYSNCHNVNPNATAV

SEQ ID NO: 660250 - protein, 21 aa, Mycobacterium
FNKAFAPYGLRPTAFKPSYGI

SEQ ID NO: 660251 - protein, 20 aa, Mycobacterium
FNKDVVIDMICYRRRGHNEG

SEQ ID NO: 660252 - protein, 22 aa, Mycobacterium
FNKGGPYLARGAQDLVPSAQLL

SEQ ID NO: 660253 - protein, 20 aa, Mycobacterium
FNLCSGSIGMCEHAFYEAIT

SEQ ID NO: 660254 - protein, 17 aa, Mycobacterium
FNLDEMPNPVASIYKTR

SEQ ID NO: 660255 - protein, 17 aa, Mycobacterium
FNLFPHLSVLKNVAMAP

SEQ ID NO: 660256 - protein, 29 aa, Mycobacterium
FNLKNLYVYFWRWGTWKVFDANADQPNGD

SEQ ID NO: 660257 - protein, 17 aa, Mycobacterium
FNLNAADLFYRGERNVI

SEQ ID NO: 660258 - protein, 17 aa, Mycobacterium
FNLQWKPLGGFPVTAGW

SEQ ID NO: 660259 - protein, 18 aa, Mycobacterium
FNLSALRFAMGGGSPVPL

SEQ ID NO: 660260 - protein, 19 aa, Mycobacterium
FNLSALRFAMGGGSPVPLT

SEQ ID NO: 660261 - protein, 22 aa, Mycobacterium
FNLSDMFTRMVLSLVATGIAPR

SEQ ID NO: 660262 - protein, 25 aa, Mycobacterium
FNMGSGNRGSRNFGAGNRGNGNFGF

SEQ ID NO: 660263 - protein, 18 aa, Mycobacterium
FNMPEEFGGGGTDDFRFN

SEQ ID NO: 660264 - protein, 18 aa, Mycobacterium
FNMRERLREAGHEVIGYD

SEQ ID NO: 660265 - protein, 24 aa, Mycobacterium
FNNELGHPWTVLRATRGTDYLILE

SEQ ID NO: 660266 - protein, 25 aa, Mycobacterium
FNPEARLFIDGRLRDSSTGKTVDNI

SEQ ID NO: 660267 - protein, 17 aa, Mycobacterium
FNPEIVCVAMTGFGLDG

SEQ ID NO: 660268 - protein, 22 aa, Mycobacterium
FNPELVCEITLQPIRRHRVDAA

SEQ ID NO: 660269 - protein, 18 aa, Mycobacterium
FNPFDFSSGNNFGDANQG

SEQ ID NO: 660270 - protein, 19 aa, Mycobacterium
FNPNPGLPVSRNVYTFTEH

SEQ ID NO: 660271 - protein, 18 aa, Mycobacterium
FNPPLDRWADAAREIHSL

SEQ ID NO: 660272 - protein, 25 aa, Mycobacterium
FNPTGKFVVGGPMGDAGLTGRKIIV

SEQ ID NO: 660273 - protein, 17 aa, Mycobacterium
FNQPNFIGFVFARTEVD

SEQ ID NO: 660274 - protein, 17 aa, Mycobacterium
FNRACEALYHFAWDEFC

SEQ ID NO: 660275 - protein, 31 aa, Mycobacterium
FNRACEALYHFAWDEFCDWYVELAKVQLGQE

SEQ ID NO: 660276 - protein, 23 aa, Mycobacterium
FNRAMCREMRDAWHLVKSDESIN

SEQ ID NO: 660277 - protein, 29 aa, Mycobacterium
FNRDAVFGIQLYVKRVFIMGDCDQLMPEY

SEQ ID NO: 660278 - protein, 26 aa, Mycobacterium
FNRDLFRQFAEWDIRIVPDELMDRNP

SEQ ID NO: 660279 - protein, 25 aa, Mycobacterium
FNRELCARFGVPPIDFDGRTDALLH

SEQ ID NO: 660280 - protein, 19 aa, Mycobacterium
FNRIFPTAIKATAGNSLSL

SEQ ID NO: 660281 - protein, 28 aa, Mycobacterium
FNRLAIPSWMARTGFQMMDPLKTAKARL

SEQ ID NO: 660282 - protein, 22 aa, Mycobacterium
FNRLRVRYVIVSAVSGAMGGSA

SEQ ID NO: 660283 - protein, 23 aa, Mycobacterium
FNSARMYAGPGPLSLVAAAVAWD

SEQ ID NO: 660284 - protein, 35 aa, Mycobacterium
FNSCGACPTCATGEPAYCHDFLAYNFGGVRPDGSS

SEQ ID NO: 660285 - protein, 20 aa, Mycobacterium
FNSDKGFGFIAPDGGEKDVF

SEQ ID NO: 660286 - protein, 19 aa, Mycobacterium
FNSGSGWSNSGLFNSGDGG

SEQ ID NO: 660287 - protein, 19 aa, Mycobacterium
FNSLFFRNAVNAGLPAMTV

SEQ ID NO: 660288 - protein, 17 aa, Mycobacterium
FNSLFLDPYLWKLQIGG

SEQ ID NO: 660289 - protein, 22 aa, Mycobacterium
FNSRFPDTFVVPDLLIPKATAK

SEQ ID NO: 660290 - protein, 18 aa, Mycobacterium
FNSSIFSEQVWFLGDALG

SEQ ID NO: 660291 - protein, 17 aa, Mycobacterium
FNSVLALELHNDKPMSP

SEQ ID NO: 660292 - protein, 18 aa, Mycobacterium
FNTAALFSAFSMVTHAGQ

SEQ ID NO: 660293 - protein, 24 aa, Mycobacterium
FNTGEKTEMYWAIRAYEIAMEEGI

SEQ ID NO: 660294 - protein, 27 aa, Mycobacterium
FNTGYSEAIGPFALGQVSGFNSGFFNW

SEQ ID NO: 660295 - protein, 23 aa, Mycobacterium
FNTLEQWGRFDEAFAHLRQWEAE

SEQ ID NO: 660296 - protein, 24 aa, Mycobacterium
FNVDWKGRVPGRYRLTVLEKLSRI

SEQ ID NO: 660297 - protein, 17 aa, Mycobacterium
FNVEGLATVIPFHRAVT

SEQ ID NO: 660298 - protein, 18 aa, Mycobacterium
FNVTGWKIGWACGPSDLI

SEQ ID NO: 660299 - protein, 24 aa, Mycobacterium
FNWMPLEHVGGIVMSHLQDVYVHC

SEQ ID NO: 660300 - protein, 19 aa, Mycobacterium
FNWPALPVAMADTIVPDFP

SEQ ID NO: 660301 - protein, 19 aa, Mycobacterium
FNYAVVVEFCERLTQLLPD

SEQ ID NO: 660302 - protein, 20 aa, Mycobacterium
FNYPAPAHWYFPTQADGSVN

SEQ ID NO: 660303 - protein, 19 aa, Mycobacterium
FNYQDRIFPVPAISLNDPA

SEQ ID NO: 660304 - protein, 25 aa, Mycobacterium
FPAAEAIAALKPIFFGAVALGGSTG

SEQ ID NO: 660305 - protein, 17 aa, Mycobacterium
FPAAEEVVVDWPHRYLA

SEQ ID NO: 660306 - protein, 23 aa, Mycobacterium
FPAAELTRILGMPVDDPDGDYLV

SEQ ID NO: 660307 - protein, 19 aa, Mycobacterium
FPADELLVAGTRYWNGFDF

SEQ ID NO: 660308 - protein, 20 aa, Mycobacterium
FPADERRPGQTVAELIAERT

SEQ ID NO: 660309 - protein, 25 aa, Mycobacterium
FPADYAGKWVIFFSHPADFTPVCTS

SEQ ID NO: 660310 - protein, 17 aa, Mycobacterium
FPAEWRLSKKARKKAKA

SEQ ID NO: 660311 - protein, 24 aa, Mycobacterium
FPAGSELRRALAMVKTLDELDSLL

SEQ ID NO: 660312 - protein, 23 aa, Mycobacterium
FPAHTSLLDGLRADFVRLLAPAR

SEQ ID NO: 660313 - protein, 24 aa, Mycobacterium
FPAIIDMWLPLSWSLNMVNRSMGH

SEQ ID NO: 660314 - protein, 21 aa, Mycobacterium
FPAKQGCLIATLREFMADEDI

SEQ ID NO: 660315 - protein, 18 aa, Mycobacterium
FPALHKRTRLAFLELAAE

SEQ ID NO: 660316 - protein, 17 aa, Mycobacterium
FPALMSLVTGFDFPFAA

SEQ ID NO: 660317 - protein, 18 aa, Mycobacterium
FPALPLTLGEAIEAFRAD

SEQ ID NO: 660318 - protein, 17 aa, Mycobacterium
FPANPLNLLAFANALAG

SEQ ID NO: 660319 - protein, 21 aa, Mycobacterium
FPAPDLRTTFGVIELDTSDSA

SEQ ID NO: 660320 - protein, 17 aa, Mycobacterium
FPAPQLSTSDGRGPVLV

SEQ ID NO: 660321 - protein, 33 aa, Mycobacterium
FPAPVSLVAGGIWLWGDVAGWARSRNYEVEDVS

SEQ ID NO: 660322 - protein, 22 aa, Mycobacterium
FPAQRAAPMVTVLDGHPHTLAF

SEQ ID NO: 660323 - protein, 28 aa, Mycobacterium
FPARELPKARVADGVGIPISMPAYARAF

SEQ ID NO: 660324 - protein, 20 aa, Mycobacterium
FPARLFRLGPEDEPVAAFQD

SEQ ID NO: 660325 - protein, 22 aa, Mycobacterium
FPARLQRGAGVPAVERLAYFAE

SEQ ID NO: 660326 - protein, 23 aa, Mycobacterium
FPARTCSNGVFKRHKQIDRPCLL

SEQ ID NO: 660327 - protein, 22 aa, Mycobacterium
FPARTCSNGVFKRHSQIDRPCL

SEQ ID NO: 660328 - protein, 21 aa, Mycobacterium
FPARTCSTGVFKRHKQIERPC

SEQ ID NO: 660329 - protein, 17 aa, Mycobacterium
FPARVVAVGTDRPCAAL

SEQ ID NO: 660330 - protein, 19 aa, Mycobacterium
FPASDPVSLSFADDGAPDM

SEQ ID NO: 660331 - protein, 22 aa, Mycobacterium
FPASRRRGWRRPRQLRSPIYDA

SEQ ID NO: 660332 - protein, 17 aa, Mycobacterium
FPASVLATVGLDRPATQ

SEQ ID NO: 660333 - protein, 17 aa, Mycobacterium
FPATHYVAGPERMGKAL

SEQ ID NO: 660334 - protein, 22 aa, Mycobacterium
FPATLTPIGLTLPFGEVMLTPD

SEQ ID NO: 660335 - protein, 17 aa, Mycobacterium
FPAVALAREAGKTGGCM

SEQ ID NO: 660336 - protein, 17 aa, Mycobacterium
FPAVFTLLRGPRSIKPL

SEQ ID NO: 660337 - protein, 17 aa, Mycobacterium
FPAVTRPPVGWIAQDEG

SEQ ID NO: 660338 - protein, 33 aa, Mycobacterium
FPAYGTLDIPVYIPFTGAIGPITIQEFTIPSLP

SEQ ID NO: 660339 - protein, 24 aa, Mycobacterium
FPCGLAELCQRTGLPRATAYRLAA

SEQ ID NO: 660340 - protein, 22 aa, Mycobacterium
FPCLGRGGTDLNTWWDENRYQA

SEQ ID NO: 660341 - protein, 21 aa, Mycobacterium
FPCNPDIPAWSIAGTTGSLTF

SEQ ID NO: 660342 - protein, 26 aa, Mycobacterium
FPCVVFAHGFSGTMDWILPDFAAVFC

SEQ ID NO: 660343 - protein, 18 aa, Mycobacterium
FPDAKLGIGPPITDGFYY

SEQ ID NO: 660344 - protein, 19 aa, Mycobacterium
FPDARIVNVSATPGRADGR

SEQ ID NO: 660345 - protein, 17 aa, Mycobacterium
FPDAVIRTGLDSIVIEA

SEQ ID NO: 660346 - protein, 22 aa, Mycobacterium
FPDAYKAIWDFSGQKATSRHIP

SEQ ID NO: 660347 - protein, 22 aa, Mycobacterium
FPDAYKAIWDFSGQTATSRHVP

SEQ ID NO: 660348 - protein, 19 aa, Mycobacterium
FPDCEGLQRITREIFERGG

SEQ ID NO: 660349 - protein, 22 aa, Mycobacterium
FPDDALKEYSIRALHPDDFLLD

SEQ ID NO: 660350 - protein, 24 aa, Mycobacterium
FPDDTAHYLWAWTDRAAGALRVRM

SEQ ID NO: 660351 - protein, 24 aa, Mycobacterium
FPDDTAHYLWAWTDRNAGSLRARM

SEQ ID NO: 660352 - protein, 17 aa, Mycobacterium
FPDGGGMRTTNYNIAAV

SEQ ID NO: 660353 - protein, 19 aa, Mycobacterium
FPDGMLLVFEPVVWEDGTG

SEQ ID NO: 660354 - protein, 20 aa, Mycobacterium
FPDGMLLVFEPVVWEDGTGG

SEQ ID NO: 660355 - protein, 20 aa, Mycobacterium
FPDGRLPEVGDVVRVATNVF

SEQ ID NO: 660356 - protein, 25 aa, Mycobacterium
FPDHLRPGSVGQRLPYQQVKIARKS

SEQ ID NO: 660357 - protein, 17 aa, Mycobacterium
FPDHPWRSYLQSSALVL

SEQ ID NO: 660358 - protein, 26 aa, Mycobacterium
FPDHRAVFLTSGRRLPVAIKEHDADS

SEQ ID NO: 660359 - protein, 20 aa, Mycobacterium
FPDKERTVVRLALTGTLSVT

SEQ ID NO: 660360 - protein, 24 aa, Mycobacterium
FPDKSELLGAAIVRLNDAFWTESR

SEQ ID NO: 660361 - protein, 18 aa, Mycobacterium
FPDKSVRSAHAVFSRAVT

SEQ ID NO: 660362 - protein, 23 aa, Mycobacterium
FPDLEVCVYAAPSQTVIGGPPAQ

SEQ ID NO: 660363 - protein, 19 aa, Mycobacterium
FPDLRLTAPPQPRGLINLH

SEQ ID NO: 660364 - protein, 20 aa, Mycobacterium
FPDPWPKARHHKRRLIQPST

SEQ ID NO: 660365 - protein, 19 aa, Mycobacterium
FPDPWPKARHHKRRLLQPG

SEQ ID NO: 660366 - protein, 26 aa, Mycobacterium
FPDQMLAYNCSPSFNWKKHLDDATIA

SEQ ID NO: 660367 - protein, 26 aa, Mycobacterium
FPDQMLAYNCSPSFNWKKHLDDETIA

SEQ ID NO: 660368 - protein, 26 aa, Mycobacterium
FPDQMLAYNCSPSFNWKKHLDDSTIA

SEQ ID NO: 660369 - protein, 26 aa, Mycobacterium
FPDQMLAYNCSPSFNWKQHLDDATIA

SEQ ID NO: 660370 - protein, 27 aa, Mycobacterium
FPDQMLAYNCSPSFNWRKHLDDSTIAK

SEQ ID NO: 660371 - protein, 20 aa, Mycobacterium
FPDQRAWLLEDFDNRIGTAV

SEQ ID NO: 660372 - protein, 20 aa, Mycobacterium
FPDQRAWLMEDFDGRIKGAV

SEQ ID NO: 660373 - protein, 19 aa, Mycobacterium
FPDRARIKSRREWEQHPRI

SEQ ID NO: 660374 - protein, 17 aa, Mycobacterium
FPDRFPTVANQLFQLAS

SEQ ID NO: 660375 - protein, 17 aa, Mycobacterium
FPDRGVVVVSGANEVGK

SEQ ID NO: 660376 - protein, 36 aa, Mycobacterium
FPDSAWGWRKFAPILAEHGFRVVAPFSRGYAPTGPA

SEQ ID NO: 660377 - protein, 17 aa, Mycobacterium
FPDTRVRVVDADGGVLP

SEQ ID NO: 660378 - protein, 28 aa, Mycobacterium
FPDVKAWLAEVLPNFPAYYHMLGNVDVR

SEQ ID NO: 660379 - protein, 17 aa, Mycobacterium
FPDVLFIAGKYQIKIPP

SEQ ID NO: 660380 - protein, 20 aa, Mycobacterium
FPDVRAAGAGSRRDTRVLRG

SEQ ID NO: 660381 - protein, 21 aa, Mycobacterium
FPDVVRYTAAGMRRVRSSGQK

SEQ ID NO: 660382 - protein, 17 aa, Mycobacterium
FPDYKPELPGGRPGGGR

SEQ ID NO: 660383 - protein, 25 aa, Mycobacterium
FPDYRPELPGGQPAGGRSLGPAAFE

SEQ ID NO: 660384 - protein, 24 aa, Mycobacterium
FPDYRPELPGGQPAGGRSLSAAPF

SEQ ID NO: 660385 - protein, 22 aa, Mycobacterium
FPEAARLMALGGAQIIASLSAW

SEQ ID NO: 660386 - protein, 18 aa, Mycobacterium
FPEDLKDKAPRIWYEDGA

SEQ ID NO: 660387 - protein, 25 aa, Mycobacterium
FPEDREPRAAIAVGNPDTAEHVTVT

SEQ ID NO: 660388 - protein, 18 aa, Mycobacterium
FPEEFARTQASAFRSGTD

SEQ ID NO: 660389 - protein, 18 aa, Mycobacterium
FPEEHGGMGGDYFALSLA

SEQ ID NO: 660390 - protein, 20 aa, Mycobacterium
FPEEIGKMGFVFNFITYGGH

SEQ ID NO: 660391 - protein, 23 aa, Mycobacterium
FPEELGKMGFVFNFITYGGHQVD

SEQ ID NO: 660392 - protein, 21 aa, Mycobacterium
FPEELKGAAPRIWYEDGAYMV

SEQ ID NO: 660393 - protein, 17 aa, Mycobacterium
FPEFARSRPRFVGATLK

SEQ ID NO: 660394 - protein, 19 aa, Mycobacterium
FPELAAHLPAVPAAARTAP

SEQ ID NO: 660395 - protein, 17 aa, Mycobacterium
FPELKFSLTEGDVGWIP

SEQ ID NO: 660396 - protein, 20 aa, Mycobacterium
FPENARMSALAGAHLLAVPT

SEQ ID NO: 660397 - protein, 22 aa, Mycobacterium
FPEPTRRLLLVAAAEPTGDPLL

SEQ ID NO: 660398 - protein, 18 aa, Mycobacterium
FPEQKALLAQDFDGRIKV

SEQ ID NO: 660399 - protein, 28 aa, Mycobacterium
FPEQPGLYAARGWSMFPTIDRVYVNARA

SEQ ID NO: 660400 - protein, 19 aa, Mycobacterium
FPEQWRTTWQRTLTAAMPG

SEQ ID NO: 660401 - protein, 42 aa, Mycobacterium
FPESHALSFASLVFYSAWFKLHHPAAFCAALLRAQPMGFYSP

SEQ ID NO: 660402 - protein, 43 aa, Mycobacterium
FPESHAQSFASLVFYSSWFKLHHPAAFCAALLRAQPMGFYSPQ

SEQ ID NO: 660403 - protein, 42 aa, Mycobacterium
FPESHSLSFASLVFYSSWFKLHHPAAFCAALLRAQPMGFYSP

SEQ ID NO: 660404 - protein, 43 aa, Mycobacterium
FPESHSLSFASLVFYSSWFKLHHPAAFCAALLRAQPMGFYSPQ

SEQ ID NO: 660405 - protein, 21 aa, Mycobacterium
FPESLPIKGFLSFDDTRIDVI

SEQ ID NO: 660406 - protein, 19 aa, Mycobacterium
FPESSRLVLSVRREDVLGS

SEQ ID NO: 660407 - protein, 22 aa, Mycobacterium
FPESYNRRALMRFVTSVKSGSD

SEQ ID NO: 660408 - protein, 23 aa, Mycobacterium
FPESYNRRALMRFVTSVKSGSEY

SEQ ID NO: 660409 - protein, 18 aa, Mycobacterium
FPEYQPREAAAWLASAVE

SEQ ID NO: 660410 - protein, 20 aa, Mycobacterium
FPFALITGRTLYHFHTRTKT

SEQ ID NO: 660411 - protein, 27 aa, Mycobacterium
FPFAPAGAALLCKWTDDVGGLGPVSWL

SEQ ID NO: 660412 - protein, 27 aa, Mycobacterium
FPFEHARIRLAYGMRLRRLRRYRNARV

SEQ ID NO: 660413 - protein, 20 aa, Mycobacterium
FPFETVRTMARIVSAVEDNS

SEQ ID NO: 660414 - protein, 26 aa, Mycobacterium
FPFLAPEDWNLPTGRFAGATTPDAFR

SEQ ID NO: 660415 - protein, 21 aa, Mycobacterium
FPFLRGLCLTNYVTDPVFQKK

SEQ ID NO: 660416 - protein, 34 aa, Mycobacterium
FPFPDNSGLDWDRLGDCDYLYLSHLHKDHFDAKN

SEQ ID NO: 660417 - protein, 17 aa, Mycobacterium
FPFPDNTGLDWPALGAV

SEQ ID NO: 660418 - protein, 21 aa, Mycobacterium
FPFSAAGAALLCGWSTDDYGL

SEQ ID NO: 660419 - protein, 20 aa, Mycobacterium
FPFVGTEPEFTGYMAHVDIA

SEQ ID NO: 660420 - protein, 26 aa, Mycobacterium
FPGACAGCGETPYLKLLSQLFGDRLM

SEQ ID NO: 660421 - protein, 20 aa, Mycobacterium
FPGALWLQVRDVYETQTELE

SEQ ID NO: 660422 - protein, 17 aa, Mycobacterium
FPGCAVVISHDRWFLDR

SEQ ID NO: 660423 - protein, 18 aa, Mycobacterium
FPGCAVVISHDRWFLDRT

SEQ ID NO: 660424 - protein, 17 aa, Mycobacterium
FPGCDVSADRCDIDHVV

SEQ ID NO: 660425 - protein, 19 aa, Mycobacterium
FPGDPRLARNPVTLEITDS

SEQ ID NO: 660426 - protein, 21 aa, Mycobacterium
FPGDPWTVPKVYWTVFGLSAF

SEQ ID NO: 660427 - protein, 21 aa, Mycobacterium
FPGDWRVIRGLTQPQLAAAAG

SEQ ID NO: 660428 - protein, 25 aa, Mycobacterium
FPGEISGGMRKRAGLARALVLDPEI

SEQ ID NO: 660429 - protein, 22 aa, Mycobacterium
FPGEMFADLFPSRRGRPSVPAE

SEQ ID NO: 660430 - protein, 27 aa, Mycobacterium
FPGEPWQVPKFYWAVMADSAFEAGWRA

SEQ ID NO: 660431 - protein, 26 aa, Mycobacterium
FPGEQEILFPAGSKFYVISKTVDPRT

SEQ ID NO: 660432 - protein, 36 aa, Mycobacterium
FPGGHCKGVCLGGYLLQGGYGWNSRIFGPACESVIG

SEQ ID NO: 660433 - protein, 17 aa, Mycobacterium
FPGGLELPPHYHTGIVI

SEQ ID NO: 660434 - protein, 30 aa, Mycobacterium
FPGGPVSLSRWMMRPNPEFDGRTPREEAIT

SEQ ID NO: 660435 - protein, 24 aa, Mycobacterium
FPGGQLPPIEMVEFHASKMGFNLV

SEQ ID NO: 660436 - protein, 17 aa, Mycobacterium
FPGGRSGGHLSANQVGL

SEQ ID NO: 660437 - protein, 17 aa, Mycobacterium
FPGGVLGVALNLDEHNV

SEQ ID NO: 660438 - protein, 18 aa, Mycobacterium
FPGGVLGVALNLDEHSVG

SEQ ID NO: 660439 - protein, 18 aa, Mycobacterium
FPGGVLGVALNLDERSVG

SEQ ID NO: 660440 - protein, 19 aa, Mycobacterium
FPGIESFGGVVVHPQHWPE

SEQ ID NO: 660441 - protein, 18 aa, Mycobacterium
FPGISWPLTPGHEIAGKV

SEQ ID NO: 660442 - protein, 25 aa, Mycobacterium
FPGKRAPTVQLCRDPKGYVPIGRNP

SEQ ID NO: 660443 - protein, 20 aa, Mycobacterium
FPGKVMKTRAKIAAGAPISD

SEQ ID NO: 660444 - protein, 18 aa, Mycobacterium
FPGLAAEWAEWGDRRPFV

SEQ ID NO: 660445 - protein, 18 aa, Mycobacterium
FPGLDSFAGEVYHTAYWP

SEQ ID NO: 660446 - protein, 26 aa, Mycobacterium
FPGLRWGVTECGAFWANDLLWLMDTR

SEQ ID NO: 660447 - protein, 17 aa, Mycobacterium
FPGMALPHLLGSEDRLH

SEQ ID NO: 660448 - protein, 23 aa, Mycobacterium
FPGNPDPVGFIRRLGDEVIPKLT

SEQ ID NO: 660449 - protein, 17 aa, Mycobacterium
FPGPFPGYSTVKPQSCA

SEQ ID NO: 660450 - protein, 17 aa, Mycobacterium
FPGPQLSTPDGRGPVLI

SEQ ID NO: 660451 - protein, 19 aa, Mycobacterium
FPGQSATGGNGGMGGRGGD

SEQ ID NO: 660452 - protein, 25 aa, Mycobacterium
FPGSDLSLAGWTRKITGIPVIGVGS

SEQ ID NO: 660453 - protein, 17 aa, Mycobacterium
FPGTGFLELVIRAGDVV

SEQ ID NO: 660454 - protein, 20 aa, Mycobacterium
FPGVEQFGGPVIHPQHWPAD

SEQ ID NO: 660455 - protein, 20 aa, Mycobacterium
FPGVFRGALAAGARRITEKM

SEQ ID NO: 660456 - protein, 19 aa, Mycobacterium
FPGVKALDGVDFRLLPGEV

SEQ ID NO: 660457 - protein, 21 aa, Mycobacterium
FPGVVPTGWVPIGRVTVGEPG

SEQ ID NO: 660458 - protein, 19 aa, Mycobacterium
FPGYFLVVHDIARFCRDNN

SEQ ID NO: 660459 - protein, 17 aa, Mycobacterium
FPGYFLVVHDITRFCRE

SEQ ID NO: 660460 - protein, 19 aa, Mycobacterium
FPHAVRWKGTTYLEDGLHR

SEQ ID NO: 660461 - protein, 24 aa, Mycobacterium
FPHHCAYGAAKWALRGLTQTAAAE

SEQ ID NO: 660462 - protein, 17 aa, Mycobacterium
FPHHEFTAAHAECVRGE

SEQ ID NO: 660463 - protein, 17 aa, Mycobacterium
FPHHPLMLARFGTPTVL

SEQ ID NO: 660464 - protein, 25 aa, Mycobacterium
FPHKKIAGPGIEWYIMPGSDKPMRR

SEQ ID NO: 660465 - protein, 18 aa, Mycobacterium
FPHLSVAANVVFGPFSRR

SEQ ID NO: 660466 - protein, 18 aa, Mycobacterium
FPHMRFPSDWTAYDEDND

SEQ ID NO: 660467 - protein, 19 aa, Mycobacterium
FPHMRFPSDWTAYDEDNDA

SEQ ID NO: 660468 - protein, 23 aa, Mycobacterium
FPHPGSNVVLCLGMCGQMIYVNR

SEQ ID NO: 660469 - protein, 21 aa, Mycobacterium
FPHVYCELDFTNPLELAVATI

SEQ ID NO: 660470 - protein, 21 aa, Mycobacterium
FPHVYCELDFTSPLELAVATI

SEQ ID NO: 660471 - protein, 20 aa, Mycobacterium
FPIACTEGALATGKKAAETV

SEQ ID NO: 660472 - protein, 17 aa, Mycobacterium
FPIAVLNLKGGVGKTAV

SEQ ID NO: 660473 - protein, 21 aa, Mycobacterium
FPIDPPFGLVAMAWRDEDFVQ

SEQ ID NO: 660474 - protein, 21 aa, Mycobacterium
FPIEELMYYELLGVCAAGEGD

SEQ ID NO: 660475 - protein, 19 aa, Mycobacterium
FPIEEVVGAFEAVFRAEHM

SEQ ID NO: 660476 - protein, 20 aa, Mycobacterium
FPIEVWKQPRVLDSGAAYIN

SEQ ID NO: 660477 - protein, 21 aa, Mycobacterium
FPIIYRFSQWKANAYDARIAE

SEQ ID NO: 660478 - protein, 18 aa, Mycobacterium
FPIKMPGLGRVGMVSAGM

SEQ ID NO: 660479 - protein, 19 aa, Mycobacterium
FPILRGMSIKRVLINPGAM

SEQ ID NO: 660480 - protein, 34 aa, Mycobacterium
FPISAHYFTVFPLARWSAVLGRRYLRQQVEDPRV

SEQ ID NO: 660481 - protein, 33 aa, Mycobacterium
FPISAHYFTVFPLARWSAVLGRRYLRQRVNDPV

SEQ ID NO: 660482 - protein, 23 aa, Mycobacterium
FPISALTDPLAWYGASDQQQLSE

SEQ ID NO: 660483 - protein, 17 aa, Mycobacterium
FPITPLFPLAGPAGLVP

SEQ ID NO: 660484 - protein, 17 aa, Mycobacterium
FPIVLSAGERRAYTAND

SEQ ID NO: 660485 - protein, 18 aa, Mycobacterium
FPIVLSAGERRAYTANDI

SEQ ID NO: 660486 - protein, 33 aa, Mycobacterium
FPKASVMTHHRWLRALAVFGGLGLRLKSSDTLY

SEQ ID NO: 660487 - protein, 33 aa, Mycobacterium
FPKASVMTHHRWLRALAVFGGMGLRLKSSDTLY

SEQ ID NO: 660488 - protein, 20 aa, Mycobacterium
FPKKRGMRIDFVLGSPEFAK

SEQ ID NO: 660489 - protein, 18 aa, Mycobacterium
FPKPTISQIHGYCMGGGI

SEQ ID NO: 660490 - protein, 18 aa, Mycobacterium
FPKQIWRQIWSNNPQERL

SEQ ID NO: 660491 - protein, 23 aa, Mycobacterium
FPLACPPSAPAEHVASFIETNLS

SEQ ID NO: 660492 - protein, 20 aa, Mycobacterium
FPLCGGRITLMSPVSFVRRP

SEQ ID NO: 660493 - protein, 17 aa, Mycobacterium
FPLFPQGGGFPRNNDDK

SEQ ID NO: 660494 - protein, 21 aa, Mycobacterium
FPLGLGLVSQFFGRYFTPDEA

SEQ ID NO: 660495 - protein, 17 aa, Mycobacterium
FPLHPGFAASWQGLRCA

SEQ ID NO: 660496 - protein, 17 aa, Mycobacterium
FPLIARSYALQYAQNEL

SEQ ID NO: 660497 - protein, 21 aa, Mycobacterium
FPLIRRYALAYHVVFIPSHEV

SEQ ID NO: 660498 - protein, 21 aa, Mycobacterium
FPLIRRYAVAFHVVFIPSVEV

SEQ ID NO: 660499 - protein, 17 aa, Mycobacterium
FPLMPRIFMAVRRESRI

SEQ ID NO: 660500 - protein, 24 aa, Mycobacterium
FPLPRELVGEGSLFLLKVVGDSMV

SEQ ID NO: 660501 - protein, 24 aa, Mycobacterium
FPLPRELVGEGSLFLLKVVGESMV

SEQ ID NO: 660502 - protein, 19 aa, Mycobacterium
FPLPRELVGEGTLFLLKVV

SEQ ID NO: 660503 - protein, 24 aa, Mycobacterium
FPLPRELVGQGTLFLLKVVGESMI

SEQ ID NO: 660504 - protein, 17 aa, Mycobacterium
FPLRAWRSSAQEYLVWR

SEQ ID NO: 660505 - protein, 17 aa, Mycobacterium
FPLRDRVAAMVPDVPVR

SEQ ID NO: 660506 - protein, 21 aa, Mycobacterium
FPLRRGLSWRRYVSELRVEAE

SEQ ID NO: 660507 - protein, 21 aa, Mycobacterium
FPLRRGLVWRRLTSELRTDSS

SEQ ID NO: 660508 - protein, 20 aa, Mycobacterium
FPLRRGLVWRRRASELRTEA

SEQ ID NO: 660509 - protein, 20 aa, Mycobacterium
FPLRRGLVWRRRASELRTEE

SEQ ID NO: 660510 - protein, 17 aa, Mycobacterium
FPLTHMPTGPGEVWTQA

SEQ ID NO: 660511 - protein, 18 aa, Mycobacterium
FPLTNRWWERPYVAAGIF

SEQ ID NO: 660512 - protein, 17 aa, Mycobacterium
FPLVIIVHADPEVRVKR

SEQ ID NO: 660513 - protein, 17 aa, Mycobacterium
FPMASFRPTDIDLDGGK

SEQ ID NO: 660514 - protein, 17 aa, Mycobacterium
FPMAVGVLAALHQRGIA

SEQ ID NO: 660515 - protein, 27 aa, Mycobacterium
FPMKKTPKKVCHRITLGSGRNKVTATF

SEQ ID NO: 660516 - protein, 27 aa, Mycobacterium
FPNADSIAGNGVWVFDAGVTRTADGSG

SEQ ID NO: 660517 - protein, 23 aa, Mycobacterium
FPNAPMRTVHLWAAPEPPIEAPP

SEQ ID NO: 660518 - protein, 18 aa, Mycobacterium
FPNCGHWVMIEAKAAFER

SEQ ID NO: 660519 - protein, 22 aa, Mycobacterium
FPNCNGRIPFDTALLSEVLSEN

SEQ ID NO: 660520 - protein, 17 aa, Mycobacterium
FPNETLEKWLRGDYGNM

SEQ ID NO: 660521 - protein, 21 aa, Mycobacterium
FPNFFTVFGPYGYVGSSYFAL

SEQ ID NO: 660522 - protein, 17 aa, Mycobacterium
FPNGMVITPDRRTLIVA

SEQ ID NO: 660523 - protein, 21 aa, Mycobacterium
FPNLCVPTGGLPPIVGTAGSP

SEQ ID NO: 660524 - protein, 21 aa, Mycobacterium
FPNLFTVFGPYGYVGSSYFAL

SEQ ID NO: 660525 - protein, 18 aa, Mycobacterium
FPNLSWPLTPGHEIAGTI

SEQ ID NO: 660526 - protein, 24 aa, Mycobacterium
FPNMFSITGPYGFVLGSYLWMIEA

SEQ ID NO: 660527 - protein, 26 aa, Mycobacterium
FPNYLSLASPYAFIGLNFFNTMEYQM

SEQ ID NO: 660528 - protein, 17 aa, Mycobacterium
FPPAALPVRAVRAARAH

SEQ ID NO: 660529 - protein, 19 aa, Mycobacterium
FPPAGTLTGIAKRELRGTP

SEQ ID NO: 660530 - protein, 19 aa, Mycobacterium
FPPAGTLTGIAKRELRGVA

SEQ ID NO: 660531 - protein, 20 aa, Mycobacterium
FPPDHMDEMELVQWGIPRLS

SEQ ID NO: 660532 - protein, 23 aa, Mycobacterium
FPPDVVVELDLAGGAWADHLIKL

SEQ ID NO: 660533 - protein, 17 aa, Mycobacterium
FPPERITFHGNNKSVAE

SEQ ID NO: 660534 - protein, 17 aa, Mycobacterium
FPPERITLHGNNKSVAE

SEQ ID NO: 660535 - protein, 21 aa, Mycobacterium
FPPEVHSMLLSSGPGPGPLLA

SEQ ID NO: 660536 - protein, 19 aa, Mycobacterium
FPPGGRFGVPGIDHPEIER

SEQ ID NO: 660537 - protein, 17 aa, Mycobacterium
FPPGQDGGGGGIGGSGG

SEQ ID NO: 660538 - protein, 21 aa, Mycobacterium
FPPHACADCGCPEHRPVETAD

SEQ ID NO: 660539 - protein, 18 aa, Mycobacterium
FPPIPSFSPEHFAVARGT

SEQ ID NO: 660540 - protein, 18 aa, Mycobacterium
FPPIPSFSPEHFSVARGT

SEQ ID NO: 660541 - protein, 17 aa, Mycobacterium
FPPNAEFGPRPFTEQQL

SEQ ID NO: 660542 - protein, 17 aa, Mycobacterium
FPPNAKARMEILVDNLR

SEQ ID NO: 660543 - protein, 25 aa, Mycobacterium
FPPNHPPMRTFLGVPVRIRDEVFGN

SEQ ID NO: 660544 - protein, 28 aa, Mycobacterium
FPPNLGPIWRLERDGMWDELIPLMRAEG

SEQ ID NO: 660545 - protein, 20 aa, Mycobacterium
FPPQPVWASEALDLINDIQP

SEQ ID NO: 660546 - protein, 19 aa, Mycobacterium
FPPRYRVGADGALATHYEL

SEQ ID NO: 660547 - protein, 22 aa, Mycobacterium
FPPSPVRAGGFPARGEIISAYG

SEQ ID NO: 660548 - protein, 25 aa, Mycobacterium
FPPVVAVGAKGAWLTVIDPSDGARI

SEQ ID NO: 660549 - protein, 20 aa, Mycobacterium
FPQDVLELQAFLGDQSRVPG

SEQ ID NO: 660550 - protein, 21 aa, Mycobacterium
FPQELRWEHGRRVVAGQRIMQ

SEQ ID NO: 660551 - protein, 21 aa, Mycobacterium
FPQGAGHWALTRHDDVFYASR

SEQ ID NO: 660552 - protein, 20 aa, Mycobacterium
FPQLAALVKVPAQFIAGDHE

SEQ ID NO: 660553 - protein, 20 aa, Mycobacterium
FPQLRGLCLSNYTSDPIFRA

SEQ ID NO: 660554 - protein, 20 aa, Mycobacterium
FPQLRGLCLSNYTSDPVFRA

SEQ ID NO: 660555 - protein, 28 aa, Mycobacterium
FPQNWWEWRELIGPLAADGYRVLCPDLR

SEQ ID NO: 660556 - protein, 19 aa, Mycobacterium
FPQQPALELDGWAVARPLP

SEQ ID NO: 660557 - protein, 18 aa, Mycobacterium
FPQTFYPTNSFNFASYQP

SEQ ID NO: 660558 - protein, 24 aa, Mycobacterium
FPQYRELGVYLVRGIPPGHVGAAW

SEQ ID NO: 660559 - protein, 19 aa, Mycobacterium
FPRDLRIIDTIEIGSSVRD

SEQ ID NO: 660560 - protein, 29 aa, Mycobacterium
FPRGIPGRLSWLVLRHLYAAALRALARDV

SEQ ID NO: 660561 - protein, 17 aa, Mycobacterium
FPRGMTGPRDARHSFSF

SEQ ID NO: 660562 - protein, 21 aa, Mycobacterium
FPRIGHLPYLLTLPGHGFYWF

SEQ ID NO: 660563 - protein, 22 aa, Mycobacterium
FPRLRAGVACGRAVSRAGDWFG

SEQ ID NO: 660564 - protein, 22 aa, Mycobacterium
FPRPAELTALLTQAGFEQLPRR

SEQ ID NO: 660565 - protein, 19 aa, Mycobacterium
FPRSPFVTAATAWELQEAT

SEQ ID NO: 660566 - protein, 25 aa, Mycobacterium
FPRTADCRILLCSSVAATVGGRGLI

SEQ ID NO: 660567 - protein, 22 aa, Mycobacterium
FPRTDGCRIVLCSSARATIGGR

SEQ ID NO: 660568 - protein, 17 aa, Mycobacterium
FPRTGEHTGRMAVFDLL

SEQ ID NO: 660569 - protein, 17 aa, Mycobacterium
FPRTRMTAVDAATYNES

SEQ ID NO: 660570 - protein, 18 aa, Mycobacterium
FPSACGKTNLAMIQPTIP

SEQ ID NO: 660571 - protein, 18 aa, Mycobacterium
FPSACGKTNLAMLQPTIE

SEQ ID NO: 660572 - protein, 24 aa, Mycobacterium
FPSAREYSVRYGLSEKRQAMLPDR

SEQ ID NO: 660573 - protein, 23 aa, Mycobacterium
FPSGDDLISAWLYRPPGDGPAPL

SEQ ID NO: 660574 - protein, 30 aa, Mycobacterium
FPSIEHWPARAIKHHRRILSALAKHDDKLA

SEQ ID NO: 660575 - protein, 20 aa, Mycobacterium
FPSINWAPIEWSNIKDQEEE

SEQ ID NO: 660576 - protein, 17 aa, Mycobacterium
FPSIPALFDAHVAGTPD

SEQ ID NO: 660577 - protein, 21 aa, Mycobacterium
FPSKDAVLFTLFERVIMEADS

SEQ ID NO: 660578 - protein, 23 aa, Mycobacterium
FPSLPLVRARLDPNYGAPIKGKR

SEQ ID NO: 660579 - protein, 17 aa, Mycobacterium
FPSLPQWPGEPEPVDTT

SEQ ID NO: 660580 - protein, 18 aa, Mycobacterium
FPSLRCELGENGVLTLVL

SEQ ID NO: 660581 - protein, 17 aa, Mycobacterium
FPSSCGKTNMAMLQPAL

SEQ ID NO: 660582 - protein, 23 aa, Mycobacterium
FPSSREYSVRYGLSEKRQSTLAD

SEQ ID NO: 660583 - protein, 24 aa, Mycobacterium
FPSVREYSVRYGLSDRRQAMLPGH

SEQ ID NO: 660584 - protein, 20 aa, Mycobacterium
FPTAPMRAVHLWATPEPLPP

SEQ ID NO: 660585 - protein, 24 aa, Mycobacterium
FPTAYRYGWSEAEATRFALQELDY

SEQ ID NO: 660586 - protein, 19 aa, Mycobacterium
FPTDRGWDVEGLFDPDPDA

SEQ ID NO: 660587 - protein, 18 aa, Mycobacterium
FPTEPVIGVLTFVSHGTD

SEQ ID NO: 660588 - protein, 20 aa, Mycobacterium
FPTFDWPRIDAPYIRPGADV

SEQ ID NO: 660589 - protein, 20 aa, Mycobacterium
FPTGIRRWGGGRSINAMAEE

SEQ ID NO: 660590 - protein, 23 aa, Mycobacterium
FPTGLRIASRLSRRVPSIARKAR

SEQ ID NO: 660591 - protein, 19 aa, Mycobacterium
FPTGPAYYLMDFPIESFTP

SEQ ID NO: 660592 - protein, 24 aa, Mycobacterium
FPTIIDMWLPLSWSLNMVNRSMGH

SEQ ID NO: 660593 - protein, 23 aa, Mycobacterium
FPTKESLVMAVIEWQTEQVMRFY

SEQ ID NO: 660594 - protein, 25 aa, Mycobacterium
FPTKFDAICKPEWIPEGTRVVNELD

SEQ ID NO: 660595 - protein, 18 aa, Mycobacterium
FPTLIDLYLQGRLPLDKF

SEQ ID NO: 660596 - protein, 17 aa, Mycobacterium
FPTLPSWISLRLLENRT

SEQ ID NO: 660597 - protein, 17 aa, Mycobacterium
FPTLRAAQFGGPDSARW

SEQ ID NO: 660598 - protein, 17 aa, Mycobacterium
FPTMPFAALGYDVVHCG

SEQ ID NO: 660599 - protein, 26 aa, Mycobacterium
FPTMVRDFQRIIGMEARVQIQDQAGR

SEQ ID NO: 660600 - protein, 19 aa, Mycobacterium
FPTPAPCGKTPLIAKGLTK

SEQ ID NO: 660601 - protein, 18 aa, Mycobacterium
FPTPEMERRILLSRVPEL

SEQ ID NO: 660602 - protein, 20 aa, Mycobacterium
FPTRIISTLLGLPREDLDLF

SEQ ID NO: 660603 - protein, 22 aa, Mycobacterium
FPTRLERGAGIPAVDRLAYFAE

SEQ ID NO: 660604 - protein, 20 aa, Mycobacterium
FPTRVIARLLGLPADDLPTF

SEQ ID NO: 660605 - protein, 24 aa, Mycobacterium
FPTTTKRLMGWGRTAPTVASVLST

SEQ ID NO: 660606 - protein, 25 aa, Mycobacterium
FPTVTGATIVRWIIYQDTGTAGTSQ

SEQ ID NO: 660607 - protein, 19 aa, Mycobacterium
FPVAAHFHTAIPLASAIER

SEQ ID NO: 660608 - protein, 25 aa, Mycobacterium
FPVDFLRMINDVFLLRNGAREPGAC

SEQ ID NO: 660609 - protein, 17 aa, Mycobacterium
FPVDVPFTTVAKGPIRA

SEQ ID NO: 660610 - protein, 19 aa, Mycobacterium
FPVECWKQPRVPDSGASTL

SEQ ID NO: 660611 - protein, 19 aa, Mycobacterium
FPVECWKQPRVPDSGATWL

SEQ ID NO: 660612 - protein, 20 aa, Mycobacterium
FPVEIFPKAAALGMGGIYVN

SEQ ID NO: 660613 - protein, 18 aa, Mycobacterium
FPVFAGRKDTIVKVAGKR

SEQ ID NO: 660614 - protein, 23 aa, Mycobacterium
FPVGDPRAPLLPLDEAGRGELKG

SEQ ID NO: 660615 - protein, 22 aa, Mycobacterium
FPVGDPRAPLLPLDEEGRARLK

SEQ ID NO: 660616 - protein, 22 aa, Mycobacterium
FPVGDPRPPLLPLDERGRAELR

SEQ ID NO: 660617 - protein, 17 aa, Mycobacterium
FPVGDPWTPGIMQGPQI

SEQ ID NO: 660618 - protein, 18 aa, Mycobacterium
FPVGDPWTPGVMQGPQIS

SEQ ID NO: 660619 - protein, 23 aa, Mycobacterium
FPVHPKNRFDARVVHQWTDYGAL

SEQ ID NO: 660620 - protein, 25 aa, Mycobacterium
FPVIGRGGVDLGRFWSEQRYQSYQG

SEQ ID NO: 660621 - protein, 21 aa, Mycobacterium
FPVKACANAYVARAPDKRTGS

SEQ ID NO: 660622 - protein, 23 aa, Mycobacterium
FPVLTHHGVGLWVPEVGGAVDPG

SEQ ID NO: 660623 - protein, 17 aa, Mycobacterium
FPVNLLSYLAQNTSAQA

SEQ ID NO: 660624 - protein, 18 aa, Mycobacterium
FPVNLVVLPASAAFAAGN

SEQ ID NO: 660625 - protein, 20 aa, Mycobacterium
FPVQGFKRRGDYGIITVLGL

SEQ ID NO: 660626 - protein, 18 aa, Mycobacterium
FPVSLHFEAPYGVSAPAF

SEQ ID NO: 660627 - protein, 17 aa, Mycobacterium
FPVTGDAAVLRETVQDT

SEQ ID NO: 660628 - protein, 26 aa, Mycobacterium
FPVTQWTRWRRPVIGMPATPRFLGHG

SEQ ID NO: 660629 - protein, 17 aa, Mycobacterium
FPVTVGWIHAIRRGQAA

SEQ ID NO: 660630 - protein, 17 aa, Mycobacterium
FPVVTKAPVGWIGQDDG

SEQ ID NO: 660631 - protein, 18 aa, Mycobacterium
FPVWQAQVAVQRRDARAP

SEQ ID NO: 660632 - protein, 20 aa, Mycobacterium
FPWAERRQGVLGEAHVRRAP

SEQ ID NO: 660633 - protein, 21 aa, Mycobacterium
FPWTERRQGVLGEVHLRRAPV

SEQ ID NO: 660634 - protein, 21 aa, Mycobacterium
FPYAGEWKSLVAAMEGTLRLH

SEQ ID NO: 660635 - protein, 20 aa, Mycobacterium
FPYAVMIVIHMSRGAPSLLA

SEQ ID NO: 660636 - protein, 19 aa, Mycobacterium
FPYAWPRKPVLAENVVCTS

SEQ ID NO: 660637 - protein, 18 aa, Mycobacterium
FQAAGGMAFLVRSLLDAG

SEQ ID NO: 660638 - protein, 17 aa, Mycobacterium
FQAASLLDIELETGRTH

SEQ ID NO: 660639 - protein, 25 aa, Mycobacterium
FQAEFARTLAAAGLVYAQSEATNAA

SEQ ID NO: 660640 - protein, 18 aa, Mycobacterium
FQAETGQTPMQWVTGVRI

SEQ ID NO: 660641 - protein, 17 aa, Mycobacterium
FQAFEGIAVPKFPNLLT

SEQ ID NO: 660642 - protein, 19 aa, Mycobacterium
FQAHPIPQMVSAGMIPFSL

SEQ ID NO: 660643 - protein, 19 aa, Mycobacterium
FQAKLDWVEDFCREEIEPL

SEQ ID NO: 660644 - protein, 20 aa, Mycobacterium
FQALACFKSAATWSLIVKHN

SEQ ID NO: 660645 - protein, 19 aa, Mycobacterium
FQALLGFRSLFSGDPLQDT

SEQ ID NO: 660646 - protein, 18 aa, Mycobacterium
FQANAWGLIYAALMAGAE

SEQ ID NO: 660647 - protein, 20 aa, Mycobacterium
FQARVAPFNVNFRYVKSELQ

SEQ ID NO: 660648 - protein, 18 aa, Mycobacterium
FQAVAMLRGKLSEMLRGD

SEQ ID NO: 660649 - protein, 17 aa, Mycobacterium
FQAWIRRSDTVLDLGCG

SEQ ID NO: 660650 - protein, 22 aa, Mycobacterium
FQCGYCTPGQIVSAVACIAEGY

SEQ ID NO: 660651 - protein, 19 aa, Mycobacterium
FQDAFPGYPGRAVSQMWGR

SEQ ID NO: 660652 - protein, 19 aa, Mycobacterium
FQDAISWGRAERAGGELSA

SEQ ID NO: 660653 - protein, 25 aa, Mycobacterium
FQDKALEGFTMFAFNQGEVCTCPSR

SEQ ID NO: 660654 - protein, 17 aa, Mycobacterium
FQDPFASLNPRARVDTS

SEQ ID NO: 660655 - protein, 22 aa, Mycobacterium
FQEAGLPPGVLSVMIGSGSAIG

SEQ ID NO: 660656 - protein, 22 aa, Mycobacterium
FQEISGWSVIAELLRPQADSRV

SEQ ID NO: 660657 - protein, 26 aa, Mycobacterium
FQELMPDVLHWLGIRKIHRLVSMSNM

SEQ ID NO: 660658 - protein, 28 aa, Mycobacterium
FQELMPDVLHWLGIRTIHRLVSMSNMKY

SEQ ID NO: 660659 - protein, 18 aa, Mycobacterium
FQETAFRFTDGSGRDAAT

SEQ ID NO: 660660 - protein, 19 aa, Mycobacterium
FQETAFRFTDGSGRDPATA

SEQ ID NO: 660661 - protein, 23 aa, Mycobacterium
FQEVQELAARFGVLNSGAAAGRP

SEQ ID NO: 660662 - protein, 18 aa, Mycobacterium
FQFVLARLEVLLGPLHVA

SEQ ID NO: 660663 - protein, 24 aa, Mycobacterium
FQGGRVFISMKQPLYIAISPDNMG

SEQ ID NO: 660664 - protein, 25 aa, Mycobacterium
FQGLCANGFPNCFIESIAQAGLTVN

SEQ ID NO: 660665 - protein, 20 aa, Mycobacterium
FQGLCTTEFPNCFIESIAQA

SEQ ID NO: 660666 - protein, 17 aa, Mycobacterium
FQGLIGSIGEKIGLRGF

SEQ ID NO: 660667 - protein, 17 aa, Mycobacterium
FQGRGSFVLAVPEPTAF

SEQ ID NO: 660668 - protein, 19 aa, Mycobacterium
FQHFIARLYGVLVDDAAED

SEQ ID NO: 660669 - protein, 17 aa, Mycobacterium
FQHFNLVGRLSCLENVL

SEQ ID NO: 660670 - protein, 18 aa, Mycobacterium
FQHIEDFMPTAVIPRGAG

SEQ ID NO: 660671 - protein, 17 aa, Mycobacterium
FQHPGTEFIYMLEGVMD

SEQ ID NO: 660672 - protein, 17 aa, Mycobacterium
FQHRMYPPAANFTAPNP

SEQ ID NO: 660673 - protein, 20 aa, Mycobacterium
FQHVEDFMPTALISRGTNPA

SEQ ID NO: 660674 - protein, 33 aa, Mycobacterium
FQHWSEAMMTDGRWDPGKDFAMVSARETGPTQK

SEQ ID NO: 660675 - protein, 17 aa, Mycobacterium
FQIGQGLTSALCYGARP

SEQ ID NO: 660676 - protein, 17 aa, Mycobacterium
FQIGQGLTSALCYSARP

SEQ ID NO: 660677 - protein, 21 aa, Mycobacterium
FQIRCVGTLIFGRPRPLSRSR

SEQ ID NO: 660678 - protein, 28 aa, Mycobacterium
FQISCGHCFMCDMKLYTQCETTQVREQG

SEQ ID NO: 660679 - protein, 25 aa, Mycobacterium
FQKWADKNLREILGDQVGGAISDII

SEQ ID NO: 660680 - protein, 20 aa, Mycobacterium
FQLDIMRVPGIIVARTDAEA

SEQ ID NO: 660681 - protein, 17 aa, Mycobacterium
FQLIDPVSGMSRAAGNI

SEQ ID NO: 660682 - protein, 18 aa, Mycobacterium
FQLLRPIKGENRYFVVTQ

SEQ ID NO: 660683 - protein, 18 aa, Mycobacterium
FQLLRVLMRHPRKALSRD

SEQ ID NO: 660684 - protein, 29 aa, Mycobacterium
FQLSRTNIFTGMVGRTWVTPEGQVIIAYQ

SEQ ID NO: 660685 - protein, 20 aa, Mycobacterium
FQLTDLGARWVGPIRTATKY

SEQ ID NO: 660686 - protein, 17 aa, Mycobacterium
FQMGLSMADALAKLGAV

SEQ ID NO: 660687 - protein, 17 aa, Mycobacterium
FQMKFYGVALFRSRGVL

SEQ ID NO: 660688 - protein, 23 aa, Mycobacterium
FQMMGLCQMLRDGVIPPNRSLDC

SEQ ID NO: 660689 - protein, 17 aa, Mycobacterium
FQNACRHRGNSVCVGSG

SEQ ID NO: 660690 - protein, 28 aa, Mycobacterium
FQNPRVGPLALCYRVFMLPDTKQTMIAY

SEQ ID NO: 660691 - protein, 36 aa, Mycobacterium
FQPDLNVDLVYRFIRDTTWVSVRWYQPGGPLTAQQV

SEQ ID NO: 660692 - protein, 24 aa, Mycobacterium
FQPESKTLYLARWLNRGQRAFQLA

SEQ ID NO: 660693 - protein, 20 aa, Mycobacterium
FQPEWWQRAAELGWASLLVP

SEQ ID NO: 660694 - protein, 19 aa, Mycobacterium
FQPFYRWHVSDDVRQPVQA

SEQ ID NO: 660695 - protein, 20 aa, Mycobacterium
FQPHIAKLKLADGVATVERT

SEQ ID NO: 660696 - protein, 28 aa, Mycobacterium
FQPLLHPRLREFALREGLADAAQRFGHA

SEQ ID NO: 660697 - protein, 17 aa, Mycobacterium
FQPRLGDGRALLLGEIE

SEQ ID NO: 660698 - protein, 17 aa, Mycobacterium
FQQFNLFRSRTVAGNIA

SEQ ID NO: 660699 - protein, 25 aa, Mycobacterium
FQQGLEMWKAIIDGIIEYAESLIKE

SEQ ID NO: 660700 - protein, 17 aa, Mycobacterium
FQQMFWRGGPTPTADFN

SEQ ID NO: 660701 - protein, 22 aa, Mycobacterium
FQQPSPQPGVHWSKDVRIDKVA

SEQ ID NO: 660702 - protein, 23 aa, Mycobacterium
FQQVRAAMIAQGWNEGAPPGQHY

SEQ ID NO: 660703 - protein, 19 aa, Mycobacterium
FQRAKSLAPTRPHPLAPDH

SEQ ID NO: 660704 - protein, 17 aa, Mycobacterium
FQRRRFWLDGTSRAGDV

SEQ ID NO: 660705 - protein, 24 aa, Mycobacterium
FQRRVWRALLTIPYGETRSYGEIA

SEQ ID NO: 660706 - protein, 23 aa, Mycobacterium
FQRRVWRALQTIPYGETRSYGEI

SEQ ID NO: 660707 - protein, 19 aa, Mycobacterium
FQRTPGWVLPRVNFRHPAW

SEQ ID NO: 660708 - protein, 19 aa, Mycobacterium
FQRTPGWVLPRVNLKHPAW

SEQ ID NO: 660709 - protein, 24 aa, Mycobacterium
FQRTPIWCLPKLDFPVPRLARGFL

SEQ ID NO: 660710 - protein, 18 aa, Mycobacterium
FQRTPIWVGPKFDLEIGP

SEQ ID NO: 660711 - protein, 24 aa, Mycobacterium
FQRWLADAELTDWLSSARLNLLAE

SEQ ID NO: 660712 - protein, 28 aa, Mycobacterium
FQRYRLHLRPGWQPRQFFSLSTLVKGGV

SEQ ID NO: 660713 - protein, 23 aa, Mycobacterium
FQSAFAMALSFGGTVALKAAARD

SEQ ID NO: 660714 - protein, 25 aa, Mycobacterium
FQSFALEPGRIWTFVMHGPDGRDYK

SEQ ID NO: 660715 - protein, 24 aa, Mycobacterium
FQSFPAVAGSSLFARLQDSAVPER

SEQ ID NO: 660716 - protein, 18 aa, Mycobacterium
FQSGLAWITILRKREGFR

SEQ ID NO: 660717 - protein, 17 aa, Mycobacterium
FQSLVVHDATGDPVRIL

SEQ ID NO: 660718 - protein, 28 aa, Mycobacterium
FQSQLRAKRAWDEGRFDREISPIEAPVL

SEQ ID NO: 660719 - protein, 22 aa, Mycobacterium
FQSRFETVLARNPGEAEFHQAV

SEQ ID NO: 660720 - protein, 19 aa, Mycobacterium
FQSRRGLARHYALRLTDSI

SEQ ID NO: 660721 - protein, 18 aa, Mycobacterium
FQSRRGLARSYALRLTDT

SEQ ID NO: 660722 - protein, 18 aa, Mycobacterium
FQTISGGAVFAYWVANPS

SEQ ID NO: 660723 - protein, 18 aa, Mycobacterium
FQTLVARTTLFHNEFSRA

SEQ ID NO: 660724 - protein, 24 aa, Mycobacterium
FQTRDEQFYLFGLGHHISVDGLGM

SEQ ID NO: 660725 - protein, 25 aa, Mycobacterium
FQTVGKRISTAWEHNRMTAPLHSSA

SEQ ID NO: 660726 - protein, 17 aa, Mycobacterium
FQVAQVFEKAILDGQLK

SEQ ID NO: 660727 - protein, 20 aa, Mycobacterium
FQVLCQRSGITIDVGPGESI

SEQ ID NO: 660728 - protein, 17 aa, Mycobacterium
FQVLPWVTDAGHHHSAR

SEQ ID NO: 660729 - protein, 22 aa, Mycobacterium
FQVSRPSLREAVRVLESDRLVE

SEQ ID NO: 660730 - protein, 17 aa, Mycobacterium
FQWLDKMPGAWSHGGAR

SEQ ID NO: 660731 - protein, 17 aa, Mycobacterium
FQYACVAAGIPAVTFWA

SEQ ID NO: 660732 - protein, 19 aa, Mycobacterium
FQYAKTWRTLAKLSLPNKY

SEQ ID NO: 660733 - protein, 23 aa, Mycobacterium
FQYCATCQTGGKVLADRRMSRLL

SEQ ID NO: 660734 - protein, 17 aa, Mycobacterium
FQYCPTCQTGGKVLADR

SEQ ID NO: 660735 - protein, 26 aa, Mycobacterium
FQYLFPRLKAGGVYVVEDVCANYWTS

SEQ ID NO: 660736 - protein, 17 aa, Mycobacterium
FRAANFIELAAYPLRPS

SEQ ID NO: 660737 - protein, 19 aa, Mycobacterium
FRAAWSPAPMRSPRGRQRP

SEQ ID NO: 660738 - protein, 19 aa, Mycobacterium
FRADMEALRVLPPHDYVAA

SEQ ID NO: 660739 - protein, 19 aa, Mycobacterium
FRAEGRFKSTSAVLTDIKT

SEQ ID NO: 660740 - protein, 25 aa, Mycobacterium
FRAELERLGRMVFGPTFEVDIDSDL

SEQ ID NO: 660741 - protein, 27 aa, Mycobacterium
FRAEQRWPRYSPASVELGVLSGLSFKL

SEQ ID NO: 660742 - protein, 20 aa, Mycobacterium
FRAEVREFLVSNVPNPPLPS

SEQ ID NO: 660743 - protein, 18 aa, Mycobacterium
FRAEWLWHKDLPDPDQAA

SEQ ID NO: 660744 - protein, 18 aa, Mycobacterium
FRAGCPVVAVAVESGDPD

SEQ ID NO: 660745 - protein, 33 aa, Mycobacterium
FRAGGTEAAFLFAITVGGAMRIEPIEVMTFNAD

SEQ ID NO: 660746 - protein, 17 aa, Mycobacterium
FRAGLDVIIAGIKARAE

SEQ ID NO: 660747 - protein, 29 aa, Mycobacterium
FRAGPGALWRIPKEFEIWESQQTDFGPLL

SEQ ID NO: 660748 - protein, 17 aa, Mycobacterium
FRAGRAICVATFDKLVN

SEQ ID NO: 660749 - protein, 17 aa, Mycobacterium
FRAGVNVGVDISAEQLR

SEQ ID NO: 660750 - protein, 26 aa, Mycobacterium
FRAIDRLGPELSVREIAEEAGTAKPK

SEQ ID NO: 660751 - protein, 17 aa, Mycobacterium
FRAIDVRSILAAGAGTP

SEQ ID NO: 660752 - protein, 17 aa, Mycobacterium
FRALLAGAVDNMPATLD

SEQ ID NO: 660753 - protein, 25 aa, Mycobacterium
FRALSACNRLVCLLSDIGPELLKNQ

SEQ ID NO: 660754 - protein, 17 aa, Mycobacterium
FRALTGLSRKQLMRQLD

SEQ ID NO: 660755 - protein, 18 aa, Mycobacterium
FRALTGRTATTWRAGIEQ

SEQ ID NO: 660756 - protein, 21 aa, Mycobacterium
FRANPWLADHMSQALAVLTQD

SEQ ID NO: 660757 - protein, 23 aa, Mycobacterium
FRANPWLAEHMSGALAVLTEDGG

SEQ ID NO: 660758 - protein, 24 aa, Mycobacterium
FRAPAGELRAHFGALQVIAENERD

SEQ ID NO: 660759 - protein, 24 aa, Mycobacterium
FRAPFVHALAMSWTGRLEQAHQEL

SEQ ID NO: 660760 - protein, 17 aa, Mycobacterium
FRAPQAVVLSRLADIEM

SEQ ID NO: 660761 - protein, 18 aa, Mycobacterium
FRAPQPLQPWSGVREAVE

SEQ ID NO: 660762 - protein, 18 aa, Mycobacterium
FRAQFIKDMGGFMMNGLW

SEQ ID NO: 660763 - protein, 20 aa, Mycobacterium
FRARARPGGEKLRRQKQFGL

SEQ ID NO: 660764 - protein, 26 aa, Mycobacterium
FRASKLRSMCREFGRDPTELKLSVAL

SEQ ID NO: 660765 - protein, 19 aa, Mycobacterium
FRASLKQAQLVKAVVRAGG

SEQ ID NO: 660766 - protein, 18 aa, Mycobacterium
FRASVDIAVEIAKRLGTK

SEQ ID NO: 660767 - protein, 17 aa, Mycobacterium
FRAVTGPLLRTAEQGAD

SEQ ID NO: 660768 - protein, 17 aa, Mycobacterium
FRCEPTRSPDKWIALAH

SEQ ID NO: 660769 - protein, 18 aa, Mycobacterium
FRCHDDSWESLHCATQVV

SEQ ID NO: 660770 - protein, 17 aa, Mycobacterium
FRCHGWDSERTELLDYL

SEQ ID NO: 660771 - protein, 18 aa, Mycobacterium
FRCLTEYRRGGAEQFVGY

SEQ ID NO: 660772 - protein, 17 aa, Mycobacterium
FRCPQSFDETKFYRHRP

SEQ ID NO: 660773 - protein, 20 aa, Mycobacterium
FRDAEAWEYVSTEVIPRMLA

SEQ ID NO: 660774 - protein, 18 aa, Mycobacterium
FRDAGGHVFHSARWDYDY

SEQ ID NO: 660775 - protein, 26 aa, Mycobacterium
FRDATGHAPFNLGLGNIGFGNVGSAN

SEQ ID NO: 660776 - protein, 19 aa, Mycobacterium
FRDDPYGRFREMRESGCPV

SEQ ID NO: 660777 - protein, 17 aa, Mycobacterium
FRDELRSIYTTKIPQEL

SEQ ID NO: 660778 - protein, 19 aa, Mycobacterium
FRDELRTFYRTEIPEDIRA

SEQ ID NO: 660779 - protein, 17 aa, Mycobacterium
FRDELRTFYTTQIPQDI

SEQ ID NO: 660780 - protein, 17 aa, Mycobacterium
FRDELRTIYTTKIPEEL

SEQ ID NO: 660781 - protein, 24 aa, Mycobacterium
FRDEMRLPWDAGRQRCFDRLMAVI

SEQ ID NO: 660782 - protein, 20 aa, Mycobacterium
FRDEVREFLAAVVTDDVIRR

SEQ ID NO: 660783 - protein, 19 aa, Mycobacterium
FRDGGGLHYGEFPRFHALM

SEQ ID NO: 660784 - protein, 26 aa, Mycobacterium
FRDGKSFYRNRFVQTEGFLAENEAGG

SEQ ID NO: 660785 - protein, 20 aa, Mycobacterium
FRDHIYGCFIEDDFGAANLD

SEQ ID NO: 660786 - protein, 17 aa, Mycobacterium
FRDKYGVDGADTRRKAV

SEQ ID NO: 660787 - protein, 17 aa, Mycobacterium
FRDLTRLSAAGIPTIAV

SEQ ID NO: 660788 - protein, 27 aa, Mycobacterium
FRDPALYAHLWKIVQHYDINIISAVPT

SEQ ID NO: 660789 - protein, 18 aa, Mycobacterium
FRDPVGYLARRVPGVRVK

SEQ ID NO: 660790 - protein, 17 aa, Mycobacterium
FRDQRLLSIGGGADEVM

SEQ ID NO: 660791 - protein, 24 aa, Mycobacterium
FRDRFPDRFFDVGIAEQHAMTSAA

SEQ ID NO: 660792 - protein, 18 aa, Mycobacterium
FRDRMLKVLYKRAQGPGH

SEQ ID NO: 660793 - protein, 17 aa, Mycobacterium
FRDSVIPNPALNAVAGR

SEQ ID NO: 660794 - protein, 18 aa, Mycobacterium
FRDVGIAAVSIWMGSLLT

SEQ ID NO: 660795 - protein, 19 aa, Mycobacterium
FRDVVAALGMYPGQAPPLG

SEQ ID NO: 660796 - protein, 24 aa, Mycobacterium
FREAEAYDGPSLVIAYSHCIAHGF

SEQ ID NO: 660797 - protein, 33 aa, Mycobacterium
FREAHLRGAPILAMGVWRWGLGEIRYEQLNRRL

SEQ ID NO: 660798 - protein, 31 aa, Mycobacterium
FREAQLRGAPILAMGVWRWGLGEIAYEQLHR

SEQ ID NO: 660799 - protein, 18 aa, Mycobacterium
FREARLREAPILALGIWR

SEQ ID NO: 660800 - protein, 17 aa, Mycobacterium
FREEAGKTGPFEIHVIS

SEQ ID NO: 660801 - protein, 18 aa, Mycobacterium
FREGIMGPDLMDQMREQA

SEQ ID NO: 660802 - protein, 17 aa, Mycobacterium
FREHGYTGTAMSDVIAE

SEQ ID NO: 660803 - protein, 25 aa, Mycobacterium
FRENRMAVRFQYEWHDEAGQWWRSY

SEQ ID NO: 660804 - protein, 24 aa, Mycobacterium
FREPLPRIGLDSLPDQGAWLQPFR

SEQ ID NO: 660805 - protein, 19 aa, Mycobacterium
FRESAARALLLPRRHPGRR

SEQ ID NO: 660806 - protein, 18 aa, Mycobacterium
FRESLRLIIDPNMLLGAL

SEQ ID NO: 660807 - protein, 19 aa, Mycobacterium
FRESLVWAQAQLPRGARID

SEQ ID NO: 660808 - protein, 19 aa, Mycobacterium
FRESVKAFVQRHVDPRAET

SEQ ID NO: 660809 - protein, 21 aa, Mycobacterium
FRESYRAFLDRHVAPHHDEWE

SEQ ID NO: 660810 - protein, 19 aa, Mycobacterium
FRETGGKAGGLFEGSPLVL

SEQ ID NO: 660811 - protein, 17 aa, Mycobacterium
FRETSRILAGLPDERPD

SEQ ID NO: 660812 - protein, 28 aa, Mycobacterium
FREVAAECARRGIKVVVNAGGLNPAGMA

SEQ ID NO: 660813 - protein, 22 aa, Mycobacterium
FREVEELAARFGVMNSGAAAGR

SEQ ID NO: 660814 - protein, 17 aa, Mycobacterium
FREVGRLAGSPAPTAQE

SEQ ID NO: 660815 - protein, 24 aa, Mycobacterium
FREVIPHLAGQAWVTMDFLGFGLS

SEQ ID NO: 660816 - protein, 31 aa, Mycobacterium
FRFDCAVSSWLYRIVVNACLDRLRRTRTQPS

SEQ ID NO: 660817 - protein, 22 aa, Mycobacterium
FRFDLASTLAREFYDVDRLSAF

SEQ ID NO: 660818 - protein, 19 aa, Mycobacterium
FRFDLASTLARELHDVDRL

SEQ ID NO: 660819 - protein, 25 aa, Mycobacterium
FRFDSWKRGVGIKMRAYDNHWASRP

SEQ ID NO: 660820 - protein, 17 aa, Mycobacterium
FRFELLRTRHDLRQRAH

SEQ ID NO: 660821 - protein, 23 aa, Mycobacterium
FRFFAAPGSWTLRALSAAGNGNA

SEQ ID NO: 660822 - protein, 24 aa, Mycobacterium
FRFFAAPGSWTLRALSAVGNGNAV

SEQ ID NO: 660823 - protein, 22 aa, Mycobacterium
FRFFAAPGTWTLRALSPSGNGD

SEQ ID NO: 660824 - protein, 18 aa, Mycobacterium
FRFFSDHVRLKYGAEPGF

SEQ ID NO: 660825 - protein, 21 aa, Mycobacterium
FRFGCVCGGASLYAPQAQNNL

SEQ ID NO: 660826 - protein, 18 aa, Mycobacterium
FRFGIIQRTDHFTCYMSV

SEQ ID NO: 660827 - protein, 26 aa, Mycobacterium
FRFLKSKLRPGGLLLNHCITRNNNRS

SEQ ID NO: 660828 - protein, 20 aa, Mycobacterium
FRFPRFRAAQYLMKPILVFK

SEQ ID NO: 660829 - protein, 20 aa, Mycobacterium
FRFPYGAVVDDGRLAVADTA

SEQ ID NO: 660830 - protein, 20 aa, Mycobacterium
FRFSSAFGSTLSRLVRHGIG

SEQ ID NO: 660831 - protein, 20 aa, Mycobacterium
FRFTEAVSFMVDCKDQDEVD

SEQ ID NO: 660832 - protein, 19 aa, Mycobacterium
FRFVECSRLVDGRPDGDVT

SEQ ID NO: 660833 - protein, 33 aa, Mycobacterium
FRGAAQHKRCLVPMDGWYEWRANPDVLSGAGSK

SEQ ID NO: 660834 - protein, 17 aa, Mycobacterium
FRGAEMIAEKWDISREE

SEQ ID NO: 660835 - protein, 17 aa, Mycobacterium
FRGAEMIASQWKLSRED

SEQ ID NO: 660836 - protein, 22 aa, Mycobacterium
FRGARGRLAFDTGRQAAEKDGF

SEQ ID NO: 660837 - protein, 17 aa, Mycobacterium
FRGERLVNSMFTLSTMV

SEQ ID NO: 660838 - protein, 17 aa, Mycobacterium
FRGERLVNSMFTLSTVV

SEQ ID NO: 660839 - protein, 18 aa, Mycobacterium
FRGFHRFLEVRKAAEIEA

SEQ ID NO: 660840 - protein, 23 aa, Mycobacterium
FRGFPRRSGLIVPARPVLEPMLE

SEQ ID NO: 660841 - protein, 26 aa, Mycobacterium
FRGFWKIQEMRGMWREMWDLSDQCWA

SEQ ID NO: 660842 - protein, 20 aa, Mycobacterium
FRGGDIYTYLKAARTADARY

SEQ ID NO: 660843 - protein, 18 aa, Mycobacterium
FRGGEPAGLLGGPLDGGP

SEQ ID NO: 660844 - protein, 17 aa, Mycobacterium
FRGGPDYALHLYRTRGP

SEQ ID NO: 660845 - protein, 26 aa, Mycobacterium
FRGHSFHSARWDYEYTGGDSTGGLTG

SEQ ID NO: 660846 - protein, 17 aa, Mycobacterium
FRGMHDVEVGFPLVEDV

SEQ ID NO: 660847 - protein, 17 aa, Mycobacterium
FRGMVDMAKGLSALWHD

SEQ ID NO: 660848 - protein, 18 aa, Mycobacterium
FRGMVDMAKGLSALWHDK

SEQ ID NO: 660849 - protein, 17 aa, Mycobacterium
FRGRGFYWHSDFETWHT

SEQ ID NO: 660850 - protein, 25 aa, Mycobacterium
FRGSAPDGPGFWFPPTVLTPSRDDR

SEQ ID NO: 660851 - protein, 31 aa, Mycobacterium
FRGSWLALIRLLKCGPWHRGGWDPIPERTSH

SEQ ID NO: 660852 - protein, 23 aa, Mycobacterium
FRGTAPSGRGFWFPPTVLTPQRT

SEQ ID NO: 660853 - protein, 18 aa, Mycobacterium
FRGTDTKIAWKGEEAVEL

SEQ ID NO: 660854 - protein, 26 aa, Mycobacterium
FRGTGKYYSGVKWTWYRPIYAGRPVL

SEQ ID NO: 660855 - protein, 28 aa, Mycobacterium
FRGVGQGRLYFGIGLPELTLPPLDVPGI

SEQ ID NO: 660856 - protein, 19 aa, Mycobacterium
FRHGGGLPYSEYPRFHRLM

SEQ ID NO: 660857 - protein, 17 aa, Mycobacterium
FRHNFGVAYDRSLLFGY

SEQ ID NO: 660858 - protein, 18 aa, Mycobacterium
FRHPGIRAATIGEYPLGV

SEQ ID NO: 660859 - protein, 17 aa, Mycobacterium
FRHPLIRAAVYHSSSAA

SEQ ID NO: 660860 - protein, 24 aa, Mycobacterium
FRHRCVGFVFQFFNLLPTLSAWEN

SEQ ID NO: 660861 - protein, 25 aa, Mycobacterium
FRIEDDLYYPALRAATKLIAVAHAE

SEQ ID NO: 660862 - protein, 17 aa, Mycobacterium
FRIEGVRTNIDFLHALL

SEQ ID NO: 660863 - protein, 21 aa, Mycobacterium
FRIELEHFIRLPMTGAVTFNI

SEQ ID NO: 660864 - protein, 30 aa, Mycobacterium
FRIGDEVLCHPVPLRDQGTWAPYLIAPVGS

SEQ ID NO: 660865 - protein, 20 aa, Mycobacterium
FRIGGHSLAALRVIMRVRER

SEQ ID NO: 660866 - protein, 19 aa, Mycobacterium
FRIPELLASTGSRLREVGT

SEQ ID NO: 660867 - protein, 20 aa, Mycobacterium
FRIPGWREALMRMGVVEGTR

SEQ ID NO: 660868 - protein, 20 aa, Mycobacterium
FRIPPPGALGRHFPFDPSQV

SEQ ID NO: 660869 - protein, 21 aa, Mycobacterium
FRIQDAIWRGVYYTPGGAQPS

SEQ ID NO: 660870 - protein, 17 aa, Mycobacterium
FRITIGPGVVRLGWTSP

SEQ ID NO: 660871 - protein, 25 aa, Mycobacterium
FRIVDCPSCGGMLKPDIVYFGENVP

SEQ ID NO: 660872 - protein, 26 aa, Mycobacterium
FRIVNQLPRKLAMELLLTGEPITAAD

SEQ ID NO: 660873 - protein, 18 aa, Mycobacterium
FRKAELELSASGVEVPAA

SEQ ID NO: 660874 - protein, 19 aa, Mycobacterium
FRKCLKRQQNNFLFTPACA

SEQ ID NO: 660875 - protein, 24 aa, Mycobacterium
FRKHPRARAGLDRASGRIPLDTPL

SEQ ID NO: 660876 - protein, 19 aa, Mycobacterium
FRKLVSRGFTPRQVTAVEP

SEQ ID NO: 660877 - protein, 17 aa, Mycobacterium
FRKRAVQLISYHVDYER

SEQ ID NO: 660878 - protein, 24 aa, Mycobacterium
FRKRFPDRFFDVGIAEQHAMTSAA

SEQ ID NO: 660879 - protein, 19 aa, Mycobacterium
FRKVMRFIAVDSGQSIEEL

SEQ ID NO: 660880 - protein, 18 aa, Mycobacterium
FRLARPELEFLCTDSDPI

SEQ ID NO: 660881 - protein, 19 aa, Mycobacterium
FRLDLPPSVSWFDVDQPSV

SEQ ID NO: 660882 - protein, 21 aa, Mycobacterium
FRLDWSSPHDVGRKAIAQNAA

SEQ ID NO: 660883 - protein, 20 aa, Mycobacterium
FRLDWSTPHDVGRKAIAQNA

SEQ ID NO: 660884 - protein, 21 aa, Mycobacterium
FRLEIGGVLVSWAIPSGPSTN

SEQ ID NO: 660885 - protein, 18 aa, Mycobacterium
FRLERDGVLVSWAVPKNL

SEQ ID NO: 660886 - protein, 19 aa, Mycobacterium
FRLERDGVLVSWAVPKNLP

SEQ ID NO: 660887 - protein, 17 aa, Mycobacterium
FRLGGHWEQDYVMVRPA

SEQ ID NO: 660888 - protein, 25 aa, Mycobacterium
FRLGITTDWKSRWYADKQYADYIKE

SEQ ID NO: 660889 - protein, 20 aa, Mycobacterium
FRLGTGAARIDTAAANPFRV

SEQ ID NO: 660890 - protein, 18 aa, Mycobacterium
FRLIAAVAAALAFPAYAR

SEQ ID NO: 660891 - protein, 19 aa, Mycobacterium
FRLIDKVFSQWGIRHTPVP

SEQ ID NO: 660892 - protein, 25 aa, Mycobacterium
FRLKGKRPYTEFDISHSLRAFGWQV

SEQ ID NO: 660893 - protein, 22 aa, Mycobacterium
FRLLDGPNRYRAAVISGSPLIP

SEQ ID NO: 660894 - protein, 25 aa, Mycobacterium
FRLLPEARHALRLSGAFLADSAERK

SEQ ID NO: 660895 - protein, 25 aa, Mycobacterium
FRLLPPRTMRGLIGRICEQEGVVID

SEQ ID NO: 660896 - protein, 25 aa, Mycobacterium
FRLLQRLGADVADYGFVETSAKQDG

SEQ ID NO: 660897 - protein, 19 aa, Mycobacterium
FRLLRELADVIVVGAGTVR

SEQ ID NO: 660898 - protein, 17 aa, Mycobacterium
FRLLSQPCAIDDYSDLR

SEQ ID NO: 660899 - protein, 27 aa, Mycobacterium
FRLLTPRELGGWAAPLPTALSVYEKFG

SEQ ID NO: 660900 - protein, 31 aa, Mycobacterium
FRLMMSTGTGLRWIMQNGMWNFGLDSPAALA

SEQ ID NO: 660901 - protein, 20 aa, Mycobacterium
FRLNDDLLIEWQRDFFDFGH

SEQ ID NO: 660902 - protein, 21 aa, Mycobacterium
FRLNPGPGIEWYDIDYPDVAR

SEQ ID NO: 660903 - protein, 20 aa, Mycobacterium
FRLPAPDVPIVMVGPGTGIA

SEQ ID NO: 660904 - protein, 20 aa, Mycobacterium
FRLPEGFPTTYFEDLTQPFD

SEQ ID NO: 660905 - protein, 17 aa, Mycobacterium
FRLPENVSFEAGAGLLF

SEQ ID NO: 660906 - protein, 21 aa, Mycobacterium
FRLQIDKRKAAALNLFADAPN

SEQ ID NO: 660907 - protein, 17 aa, Mycobacterium
FRLSAYTDRLLALYAER

SEQ ID NO: 660908 - protein, 17 aa, Mycobacterium
FRLSAYTDRLLALYEEH

SEQ ID NO: 660909 - protein, 18 aa, Mycobacterium
FRLSCDPQLVFGPHRGDA

SEQ ID NO: 660910 - protein, 20 aa, Mycobacterium
FRLTEGLAAWEAQLADAPMR

SEQ ID NO: 660911 - protein, 21 aa, Mycobacterium
FRLVAAEALTLTGADGTLVAV

SEQ ID NO: 660912 - protein, 19 aa, Mycobacterium
FRLVDVGSMNRTYLNREPV

SEQ ID NO: 660913 - protein, 18 aa, Mycobacterium
FRLVEQFRYPLGERRWEF

SEQ ID NO: 660914 - protein, 18 aa, Mycobacterium
FRLVEQFRYPVGARRWEF

SEQ ID NO: 660915 - protein, 20 aa, Mycobacterium
FRMIGATGRVYLSGSESDIR

SEQ ID NO: 660916 - protein, 19 aa, Mycobacterium
FRMPRHIDTPLLILTALRD

SEQ ID NO: 660917 - protein, 18 aa, Mycobacterium
FRMRIPKPKFVLMPTPIW

SEQ ID NO: 660918 - protein, 19 aa, Mycobacterium
FRMWLDAVGITEDLQGYLD

SEQ ID NO: 660919 - protein, 26 aa, Mycobacterium
FRNARELREAVPLIPLDQLLVETDAP

SEQ ID NO: 660920 - protein, 23 aa, Mycobacterium
FRNEVQRLGRLVFGEDFEVDVDS

SEQ ID NO: 660921 - protein, 19 aa, Mycobacterium
FRNINEFWIGSADMMHRNL

SEQ ID NO: 660922 - protein, 27 aa, Mycobacterium
FRNRACKGSRSPTWRWRASHCRSPPMR

SEQ ID NO: 660923 - protein, 19 aa, Mycobacterium
FRNRVTWTVTKWDPPHEVA

SEQ ID NO: 660924 - protein, 18 aa, Mycobacterium
FRPADVVIYGTGFRATDF

SEQ ID NO: 660925 - protein, 18 aa, Mycobacterium
FRPATQLERDRYATMVMD

SEQ ID NO: 660926 - protein, 21 aa, Mycobacterium
FRPDEAFPLDRCDPDLLGHDD

SEQ ID NO: 660927 - protein, 18 aa, Mycobacterium
FRPDEVRPSLSQQQALAE

SEQ ID NO: 660928 - protein, 36 aa, Mycobacterium
FRPDIDVDLVYRFIRDTTWVSVRWYQPGGPLTAEQV

SEQ ID NO: 660929 - protein, 21 aa, Mycobacterium
FRPDLDTARIDAVFRKGAYSA

SEQ ID NO: 660930 - protein, 37 aa, Mycobacterium
FRPDLDVAVVYRFIRDATWVSVRWFRPGGSRTAQEVA

SEQ ID NO: 660931 - protein, 23 aa, Mycobacterium
FRPDLEHPTRADAEPVFYVQQAM

SEQ ID NO: 660932 - protein, 18 aa, Mycobacterium
FRPDLRVPLITIITETDL

SEQ ID NO: 660933 - protein, 19 aa, Mycobacterium
FRPDLRVPLLTLITETDLF

SEQ ID NO: 660934 - protein, 17 aa, Mycobacterium
FRPEFFAAMRELCDEFD

SEQ ID NO: 660935 - protein, 22 aa, Mycobacterium
FRPEQLAGLAATIADCLNPDGI

SEQ ID NO: 660936 - protein, 17 aa, Mycobacterium
FRPGATLVGYGHYHETY

SEQ ID NO: 660937 - protein, 29 aa, Mycobacterium
FRPGDERVASLFLWHFVEEVEHRSSALVI

SEQ ID NO: 660938 - protein, 17 aa, Mycobacterium
FRPGEYFGGSLGLHSEV

SEQ ID NO: 660939 - protein, 21 aa, Mycobacterium
FRPGGICLHAAPMFHLADLMS

SEQ ID NO: 660940 - protein, 24 aa, Mycobacterium
FRPGPGRRLGVLVDHLVAGSKEAR

SEQ ID NO: 660941 - protein, 20 aa, Mycobacterium
FRPGSSPAYHIEHLERNRPI

SEQ ID NO: 660942 - protein, 27 aa, Mycobacterium
FRPGTLEKWDLGYDVLRERNPGIILVR

SEQ ID NO: 660943 - protein, 28 aa, Mycobacterium
FRPGTLEKWDLGYDVLRQHNKGVILVRV

SEQ ID NO: 660944 - protein, 28 aa, Mycobacterium
FRPGTLEKWNLGYDVLRERNRGIILVRV

SEQ ID NO: 660945 - protein, 23 aa, Mycobacterium
FRPGTLEKWNLGYDVLSERNPGI

SEQ ID NO: 660946 - protein, 25 aa, Mycobacterium
FRPGTLERWGLGYDVLAQRNKGIIL

SEQ ID NO: 660947 - protein, 20 aa, Mycobacterium
FRPKLKAFMADLCWIENVGA

SEQ ID NO: 660948 - protein, 28 aa, Mycobacterium
FRPKVWPPVRRIDGAYGDRHLVCSCPPV

SEQ ID NO: 660949 - protein, 20 aa, Mycobacterium
FRPLKALAARMACPYANPGR

SEQ ID NO: 660950 - protein, 20 aa, Mycobacterium
FRPLPGNGLSSVAPGEGGLF

SEQ ID NO: 660951 - protein, 18 aa, Mycobacterium
FRPLRPAMTATFTRFEGG

SEQ ID NO: 660952 - protein, 31 aa, Mycobacterium
FRPNPSRLCDWCPHQAHCPAFGGTPPPYPGW

SEQ ID NO: 660953 - protein, 39 aa, Mycobacterium
FRPREYWRGPVWPVLTWLFCWAFERRGWSERAFLLRQEG

SEQ ID NO: 660954 - protein, 25 aa, Mycobacterium
FRPREYWRGPVWPVMTWLFAWCFAR

SEQ ID NO: 660955 - protein, 18 aa, Mycobacterium
FRPSCPIAGSVAVRSNPV

SEQ ID NO: 660956 - protein, 34 aa, Mycobacterium
FRPVLPRVSAFTVRDGRVLAVWDVSNPDKFSGTP

SEQ ID NO: 660957 - protein, 36 aa, Mycobacterium
FRPVNPRIAALAVIGMCNWVAWWFHEDDAASAEQVA

SEQ ID NO: 660958 - protein, 39 aa, Mycobacterium
FRQAAPFLSYGQFTGFAPRDLCALWPVPATSTPHAASPA

SEQ ID NO: 660959 - protein, 20 aa, Mycobacterium
FRQAELRPDAPAVLAGSGDL

SEQ ID NO: 660960 - protein, 30 aa, Mycobacterium
FRQDCAVSSWLYRIVVNACLDRLRRNKTRA

SEQ ID NO: 660961 - protein, 20 aa, Mycobacterium
FRQFEEWDVRIVPRDLLAPL

SEQ ID NO: 660962 - protein, 20 aa, Mycobacterium
FRQFEEWDVRIVPREQLQCL

SEQ ID NO: 660963 - protein, 21 aa, Mycobacterium
FRQFLRRRATLAINTSSTDDD

SEQ ID NO: 660964 - protein, 18 aa, Mycobacterium
FRQFSFPGGIPSHVAAET

SEQ ID NO: 660965 - protein, 19 aa, Mycobacterium
FRQLAPRPVTAAWGAAAGR

SEQ ID NO: 660966 - protein, 21 aa, Mycobacterium
FRQLWFGWSDPARVLVEYAQQ

SEQ ID NO: 660967 - protein, 18 aa, Mycobacterium
FRQQWARHDVRHEVAGGL

SEQ ID NO: 660968 - protein, 18 aa, Mycobacterium
FRQRTGIGPLEFQQQLRM

SEQ ID NO: 660969 - protein, 25 aa, Mycobacterium
FRQRYWARNHVGWRHMDDTLPNAGH

SEQ ID NO: 660970 - protein, 20 aa, Mycobacterium
FRQSFLLSYAARIGERLTAT

SEQ ID NO: 660971 - protein, 17 aa, Mycobacterium
FRQSRVFTKGPFRRFGP

SEQ ID NO: 660972 - protein, 24 aa, Mycobacterium
FRQTELFRLLLPARFGGLQASFPE

SEQ ID NO: 660973 - protein, 18 aa, Mycobacterium
FRQYGAKVQGGGILFNSV

SEQ ID NO: 660974 - protein, 32 aa, Mycobacterium
FRRADRFLPNGWCMLPPLQSCDKGNACLTCSV

SEQ ID NO: 660975 - protein, 22 aa, Mycobacterium
FRRAFAGFDFEKVAGYTEADVQ

SEQ ID NO: 660976 - protein, 20 aa, Mycobacterium
FRRAFSWLPSQFASQSDAPV

SEQ ID NO: 660977 - protein, 19 aa, Mycobacterium
FRRAFSWLPSQSDSPVGPR

SEQ ID NO: 660978 - protein, 19 aa, Mycobacterium
FRRAFSWLPTQFASQSDAP

SEQ ID NO: 660979 - protein, 21 aa, Mycobacterium
FRRARDSAPSLVFLDEVDALA

SEQ ID NO: 660980 - protein, 21 aa, Mycobacterium
FRRDSWGRGWAYAAAAALIGA

SEQ ID NO: 660981 - protein, 20 aa, Mycobacterium
FRREFGLAVDVVRGVAAGEV

SEQ ID NO: 660982 - protein, 24 aa, Mycobacterium
FRREHPGWNGAQLNAAYNKMMFER

SEQ ID NO: 660983 - protein, 17 aa, Mycobacterium
FRRESLRSVDWGGDPHN

SEQ ID NO: 660984 - protein, 17 aa, Mycobacterium
FRRFAALVRALNPLINR

SEQ ID NO: 660985 - protein, 17 aa, Mycobacterium
FRRFGMDIIAASVRHAQ

SEQ ID NO: 660986 - protein, 17 aa, Mycobacterium
FRRGGGLQYQDYPRFHA

SEQ ID NO: 660987 - protein, 17 aa, Mycobacterium
FRRGNLTYRHMLEGEPA

SEQ ID NO: 660988 - protein, 17 aa, Mycobacterium
FRRGVYVAPFWEDDFGK

SEQ ID NO: 660989 - protein, 19 aa, Mycobacterium
FRRHGMSATFMAKVDDHWA

SEQ ID NO: 660990 - protein, 24 aa, Mycobacterium
FRRIAGGDIKAVWIICTNPVASVA

SEQ ID NO: 660991 - protein, 17 aa, Mycobacterium
FRRIEESVIRQALDQQD

SEQ ID NO: 660992 - protein, 17 aa, Mycobacterium
FRRIGALGDGWLGSFLT

SEQ ID NO: 660993 - protein, 19 aa, Mycobacterium
FRRIQCTPDLLPSDIIGTQ

SEQ ID NO: 660994 - protein, 17 aa, Mycobacterium
FRRKLRMRLYGAPSACT

SEQ ID NO: 660995 - protein, 17 aa, Mycobacterium
FRRLAERPIQVHRVHGD

SEQ ID NO: 660996 - protein, 19 aa, Mycobacterium
FRRLDVADLEDWRQFTDWV

SEQ ID NO: 660997 - protein, 19 aa, Mycobacterium
FRRLGVFMGGFDLDACRKV

SEQ ID NO: 660998 - protein, 17 aa, Mycobacterium
FRRLMRADIFGAHSSII

SEQ ID NO: 660999 - protein, 19 aa, Mycobacterium
FRRLPHHHATVLGDRLRRL

SEQ ID NO: 661000 - protein, 22 aa, Mycobacterium
FRRLRSPEPWIERFERCWEVLD

SEQ ID NO: 661001 - protein, 22 aa, Mycobacterium
FRRNIWVSPFWEGCVADVVDTV

SEQ ID NO: 661002 - protein, 22 aa, Mycobacterium
FRRNIWVSPFWEGCVADVVETV

SEQ ID NO: 661003 - protein, 22 aa, Mycobacterium
FRRNIWVSPFWEGCVSDVVTTV

SEQ ID NO: 661004 - protein, 18 aa, Mycobacterium
FRRPILHGLCTYGVAGRA

SEQ ID NO: 661005 - protein, 22 aa, Mycobacterium
FRRPPEYQILPGYDLRRQYLVM

SEQ ID NO: 661006 - protein, 21 aa, Mycobacterium
FRRRAEAGLRVQDRALGSAQP

SEQ ID NO: 661007 - protein, 33 aa, Mycobacterium
FRRRARAWLADNLPRLDSGDAMVLQRDELTSWR

SEQ ID NO: 661008 - protein, 17 aa, Mycobacterium
FRRRGGGLVCALNAGRH

SEQ ID NO: 661009 - protein, 17 aa, Mycobacterium
FRRRQGILGAERAPDSG

SEQ ID NO: 661010 - protein, 19 aa, Mycobacterium
FRRRRCLRANGSNFGTNAP

SEQ ID NO: 661011 - protein, 19 aa, Mycobacterium
FRRRRLWITRPPKPLDRNG

SEQ ID NO: 661012 - protein, 17 aa, Mycobacterium
FRRRVFTPHGGIGPDQI

SEQ ID NO: 661013 - protein, 17 aa, Mycobacterium
FRRSHLEALTTQRMVAG

SEQ ID NO: 661014 - protein, 18 aa, Mycobacterium
FRRSHLEALTTQRTLARL

SEQ ID NO: 661015 - protein, 18 aa, Mycobacterium
FRRTSLWHSTFRHCSFLG

SEQ ID NO: 661016 - protein, 18 aa, Mycobacterium
FRRTTALGRISDPVWSSV

SEQ ID NO: 661017 - protein, 17 aa, Mycobacterium
FRRVEVHEAPRFRGSEV

SEQ ID NO: 661018 - protein, 22 aa, Mycobacterium
FRRYCAPDVKWINTGIPSVEGL

SEQ ID NO: 661019 - protein, 18 aa, Mycobacterium
FRRYGTDDLVWWNSGRGA

SEQ ID NO: 661020 - protein, 21 aa, Mycobacterium
FRRYVEHWTMGPGTVIEGDGA

SEQ ID NO: 661021 - protein, 24 aa, Mycobacterium
FRRYVGVPVKWVLCRYRLQQAALE

SEQ ID NO: 661022 - protein, 17 aa, Mycobacterium
FRSAAAFATEASPDGYI

SEQ ID NO: 661023 - protein, 17 aa, Mycobacterium
FRSALLERWRGELVEVV

SEQ ID NO: 661024 - protein, 19 aa, Mycobacterium
FRSARRLEVAADVPAGDAV

SEQ ID NO: 661025 - protein, 34 aa, Mycobacterium
FRSCRECDSCGRGEYRRCSSNGLATMFGFVDVNI

SEQ ID NO: 661026 - protein, 22 aa, Mycobacterium
FRSDALQIIAFGRYARTVSAAE

SEQ ID NO: 661027 - protein, 17 aa, Mycobacterium
FRSEKNTNWEGAFRIPE

SEQ ID NO: 661028 - protein, 17 aa, Mycobacterium
FRSEVDWDYLTEPQPEL

SEQ ID NO: 661029 - protein, 19 aa, Mycobacterium
FRSGGAWLDALLQGLEDNR

SEQ ID NO: 661030 - protein, 23 aa, Mycobacterium
FRSGRPLLTETFRRPIPAFTDVG

SEQ ID NO: 661031 - protein, 17 aa, Mycobacterium
FRSHGRHAVHLPAIKTF

SEQ ID NO: 661032 - protein, 18 aa, Mycobacterium
FRSIMFERLIPNLEYIGL

SEQ ID NO: 661033 - protein, 27 aa, Mycobacterium
FRSKESCVEPLLARSAERFIEVLRRWP

SEQ ID NO: 661034 - protein, 17 aa, Mycobacterium
FRSLRMWESQAPTPPPE

SEQ ID NO: 661035 - protein, 17 aa, Mycobacterium
FRSMYFPGVLATVQGDT

SEQ ID NO: 661036 - protein, 21 aa, Mycobacterium
FRSRCRDISSAFGGGEYVHYA

SEQ ID NO: 661037 - protein, 21 aa, Mycobacterium
FRSRCRDMAAAFGGAARVHYA

SEQ ID NO: 661038 - protein, 20 aa, Mycobacterium
FRSSCTNGKCVATIVSGPPP

SEQ ID NO: 661039 - protein, 25 aa, Mycobacterium
FRSVIPYLAGQAWLTMDFLGFGLSD

SEQ ID NO: 661040 - protein, 20 aa, Mycobacterium
FRTAEGTKLFLAVTNSPVAF

SEQ ID NO: 661041 - protein, 20 aa, Mycobacterium
FRTAEGTKLFLAVTSSPVAF

SEQ ID NO: 661042 - protein, 19 aa, Mycobacterium
FRTAEQRERACAREVELNS

SEQ ID NO: 661043 - protein, 17 aa, Mycobacterium
FRTAGERGLSILTNLVG

SEQ ID NO: 661044 - protein, 30 aa, Mycobacterium
FRTDIMPISIGFPFGLSVVAPVNMPLPTKI

SEQ ID NO: 661045 - protein, 22 aa, Mycobacterium
FRTFDFLGIRNWTAGKPIIVVM

SEQ ID NO: 661046 - protein, 19 aa, Mycobacterium
FRTGEHYRSLMVSSIKTML

SEQ ID NO: 661047 - protein, 19 aa, Mycobacterium
FRTGGYVIDFWGVGYQVAK

SEQ ID NO: 661048 - protein, 19 aa, Mycobacterium
FRTIHGYQRAYRIAGDGPA

SEQ ID NO: 661049 - protein, 20 aa, Mycobacterium
FRTIHGYRRAYRIAGSGPAI

SEQ ID NO: 661050 - protein, 20 aa, Mycobacterium
FRTLCRDFGSMRGDPLRPAS

SEQ ID NO: 661051 - protein, 19 aa, Mycobacterium
FRTLFPRRSKGLAGALDFA

SEQ ID NO: 661052 - protein, 25 aa, Mycobacterium
FRTLRASLHVRRWPPGNHMHSTMYV

SEQ ID NO: 661053 - protein, 21 aa, Mycobacterium
FRTNVIAPFLLTGALAPAMAE

SEQ ID NO: 661054 - protein, 19 aa, Mycobacterium
FRTRCWKATDICAQTTPPH

SEQ ID NO: 661055 - protein, 17 aa, Mycobacterium
FRTSGGWVVVPAGAMSQ

SEQ ID NO: 661056 - protein, 24 aa, Mycobacterium
FRTSPHLPMSWQRKLFQMMQPLMS

SEQ ID NO: 661057 - protein, 18 aa, Mycobacterium
FRTVALIINRTELVDDEA

SEQ ID NO: 661058 - protein, 29 aa, Mycobacterium
FRTVLYTTLEVVRIASLLLQPVMPESTAK

SEQ ID NO: 661059 - protein, 29 aa, Mycobacterium
FRVAIGLTETHTWWRVDWNTLVDATVPIA

SEQ ID NO: 661060 - protein, 17 aa, Mycobacterium
FRVAILTGAGRGFCAGA

SEQ ID NO: 661061 - protein, 20 aa, Mycobacterium
FRVAYIDTVADFGFYTEVVD

SEQ ID NO: 661062 - protein, 24 aa, Mycobacterium
FRVDAVPFLFARDGAPGDPGVFDP

SEQ ID NO: 661063 - protein, 20 aa, Mycobacterium
FRVEGWGDPIHTWRHGLVAK

SEQ ID NO: 661064 - protein, 20 aa, Mycobacterium
FRVGNLLFLMLSDRNEPTQT

SEQ ID NO: 661065 - protein, 19 aa, Mycobacterium
FRVGVLPTLRAVRAIAGYS

SEQ ID NO: 661066 - protein, 19 aa, Mycobacterium
FRVGVLPTLRAVRAIAGYT

SEQ ID NO: 661067 - protein, 18 aa, Mycobacterium
FRVLLELPGGVAGTAVEE

SEQ ID NO: 661068 - protein, 32 aa, Mycobacterium
FRVLPWADRTGWVLSEMYYRSGERVPFDTRGV

SEQ ID NO: 661069 - protein, 18 aa, Mycobacterium
FRVLRPGGRLHLVDMGGD

SEQ ID NO: 661070 - protein, 18 aa, Mycobacterium
FRVLRPGGRLHLVDVGGD

SEQ ID NO: 661071 - protein, 17 aa, Mycobacterium
FRVMTRLLRAVGQASGL

SEQ ID NO: 661072 - protein, 27 aa, Mycobacterium
FRVPAWSEFVEVHWSRRGEAYVTPVEP

SEQ ID NO: 661073 - protein, 20 aa, Mycobacterium
FRVPCLPSDRLLNLLHYVKW

SEQ ID NO: 661074 - protein, 17 aa, Mycobacterium
FRVRMTAYFIFDDAETL

SEQ ID NO: 661075 - protein, 20 aa, Mycobacterium
FRVSRSGWYGIDQVAGDLVT

SEQ ID NO: 661076 - protein, 19 aa, Mycobacterium
FRVTALRTAANTALIADTC

SEQ ID NO: 661077 - protein, 18 aa, Mycobacterium
FRVVAGRITEVWNCGYQQ

SEQ ID NO: 661078 - protein, 22 aa, Mycobacterium
FRVVLEELFRGTAHIAPDPDRA

SEQ ID NO: 661079 - protein, 17 aa, Mycobacterium
FRVVLGADRPDTRVGAL

SEQ ID NO: 661080 - protein, 21 aa, Mycobacterium
FRVVLRHELFHAAARTVTGDH

SEQ ID NO: 661081 - protein, 26 aa, Mycobacterium
FRWTNSYYDDMAWLALALERAARVAG

SEQ ID NO: 661082 - protein, 18 aa, Mycobacterium
FRYGLKASLNGYLGAHPR

SEQ ID NO: 661083 - protein, 26 aa, Mycobacterium
FRYLDCPRCGGMLKPDIVYFGESVAK

SEQ ID NO: 661084 - protein, 19 aa, Mycobacterium
FRYLDCVRCAGMLKPDIVY

SEQ ID NO: 661085 - protein, 24 aa, Mycobacterium
FRYNEVIHYWALEGGWECFANHYP

SEQ ID NO: 661086 - protein, 19 aa, Mycobacterium
FRYNMVGAYDAVVEVGDAW

SEQ ID NO: 661087 - protein, 17 aa, Mycobacterium
FRYNTIITEETTAGRYS

SEQ ID NO: 661088 - protein, 17 aa, Mycobacterium
FRYNTIITEETTFGRYS

SEQ ID NO: 661089 - protein, 17 aa, Mycobacterium
FRYNTIITEEVTKGRHT

SEQ ID NO: 661090 - protein, 21 aa, Mycobacterium
FRYPHDHGWESVTWEQVGERV

SEQ ID NO: 661091 - protein, 18 aa, Mycobacterium
FRYQDRIFTVPVVSLPIV

SEQ ID NO: 661092 - protein, 19 aa, Mycobacterium
FRYQRRVMQLLQWGEPERP

SEQ ID NO: 661093 - protein, 17 aa, Mycobacterium
FRYRGHDSAMTMSVALA

SEQ ID NO: 661094 - protein, 28 aa, Mycobacterium
FRYYPSKSALPWGDFDAHLDHMRALLAD

SEQ ID NO: 661095 - protein, 23 aa, Mycobacterium
FSAAAARLGNRLSLHDQPNLGGS

SEQ ID NO: 661096 - protein, 24 aa, Mycobacterium
FSAANGMAVLGVWQPGAPAAVLVG

SEQ ID NO: 661097 - protein, 17 aa, Mycobacterium
FSAASFERGETPIRLAY

SEQ ID NO: 661098 - protein, 25 aa, Mycobacterium
FSAATCFPNLSFVHNWPKLPGSDSE

SEQ ID NO: 661099 - protein, 20 aa, Mycobacterium
FSADWYGRVLHFGIREHAMG

SEQ ID NO: 661100 - protein, 26 aa, Mycobacterium
FSAFPRPENYPSLPTVSFVIPNADND

SEQ ID NO: 661101 - protein, 22 aa, Mycobacterium
FSAGGPVLWPDLEAILVVPNNA

SEQ ID NO: 661102 - protein, 20 aa, Mycobacterium
FSALLPRLESIEVDGNIERT

SEQ ID NO: 661103 - protein, 24 aa, Mycobacterium
FSANEFLLYEALGLCGEGEAGKLI

SEQ ID NO: 661104 - protein, 17 aa, Mycobacterium
FSAPVVCAFGMTEATHQ

SEQ ID NO: 661105 - protein, 21 aa, Mycobacterium
FSAQEPWVLAKSFQTDGSAAD

SEQ ID NO: 661106 - protein, 23 aa, Mycobacterium
FSARVCGGDVAIAVTGADTDPAV

SEQ ID NO: 661107 - protein, 20 aa, Mycobacterium
FSASAIWRIRRAAPLLPTVL

SEQ ID NO: 661108 - protein, 18 aa, Mycobacterium
FSAVAARVAAVVSAGDVV

SEQ ID NO: 661109 - protein, 35 aa, Mycobacterium
FSAVRRRIWELEIGRAHTPWFHWGTTAMAAHTVEK

SEQ ID NO: 661110 - protein, 24 aa, Mycobacterium
FSAVTSGLAGQAWQGAASAAMTAA

SEQ ID NO: 661111 - protein, 28 aa, Mycobacterium
FSAWAVRLLSRLPQRAVVALATNVPGPR

SEQ ID NO: 661112 - protein, 17 aa, Mycobacterium
FSAWSLRSGDDATLRLL

SEQ ID NO: 661113 - protein, 23 aa, Mycobacterium
FSDALGVPVANTFHGKGVMPDDH

SEQ ID NO: 661114 - protein, 22 aa, Mycobacterium
FSDCLRAELAHAGIGVTTLCPG

SEQ ID NO: 661115 - protein, 23 aa, Mycobacterium
FSDEFRIQLAWMRQSPPDTPNPG

SEQ ID NO: 661116 - protein, 23 aa, Mycobacterium
FSDELAMTFPQWRTQVRLQHALV

SEQ ID NO: 661117 - protein, 17 aa, Mycobacterium
FSDELQQEWTWTEKYAT

SEQ ID NO: 661118 - protein, 17 aa, Mycobacterium
FSDELQQEWTWTERYAT

SEQ ID NO: 661119 - protein, 27 aa, Mycobacterium
FSDFTELSRWVGRHISETGGFSLERIE

SEQ ID NO: 661120 - protein, 20 aa, Mycobacterium
FSDGLNTLAQFKVKRLDRQT

SEQ ID NO: 661121 - protein, 24 aa, Mycobacterium
FSDGRIAARVCMWVNRFHEETTVT

SEQ ID NO: 661122 - protein, 17 aa, Mycobacterium
FSDHPEWVLPTDWTVAP

SEQ ID NO: 661123 - protein, 26 aa, Mycobacterium
FSDMFGSDFFSAWGKLGAVRTPTIAA

SEQ ID NO: 661124 - protein, 24 aa, Mycobacterium
FSDNLCLRDQLAALQWVRDNIAAF

SEQ ID NO: 661125 - protein, 27 aa, Mycobacterium
FSDPETYRPGAILGRNGFDLASYYGEN

SEQ ID NO: 661126 - protein, 18 aa, Mycobacterium
FSDPGVWLRLQQVDAGHL

SEQ ID NO: 661127 - protein, 18 aa, Mycobacterium
FSDPLVFGTAGLRGPVRG

SEQ ID NO: 661128 - protein, 25 aa, Mycobacterium
FSDPTGPCLEGWVTLTALAQATQRL

SEQ ID NO: 661129 - protein, 25 aa, Mycobacterium
FSDPTGPCLEGWVTLTALAQATTRL

SEQ ID NO: 661130 - protein, 18 aa, Mycobacterium
FSDQVWLVELSELRDGDM

SEQ ID NO: 661131 - protein, 18 aa, Mycobacterium
FSDRHCVALFAPAAAAVP

SEQ ID NO: 661132 - protein, 31 aa, Mycobacterium
FSDRTWWPGISEAITDCWLVTVGGEAVVADD

SEQ ID NO: 661133 - protein, 24 aa, Mycobacterium
FSDSAGPCLEGWTTLTALAQATER

SEQ ID NO: 661134 - protein, 21 aa, Mycobacterium
FSDTAFRIFVLMATRRLEADR

SEQ ID NO: 661135 - protein, 21 aa, Mycobacterium
FSDTAFRIFVLMATRRLKSDR

SEQ ID NO: 661136 - protein, 20 aa, Mycobacterium
FSDTRIADVAKRAGVSSALV

SEQ ID NO: 661137 - protein, 24 aa, Mycobacterium
FSDVDFRPGDVLMFGPEPTGLDAA

SEQ ID NO: 661138 - protein, 17 aa, Mycobacterium
FSDVRVRPHDSGLVTLR

SEQ ID NO: 661139 - protein, 17 aa, Mycobacterium
FSDVVAVRLGMPGVEYY

SEQ ID NO: 661140 - protein, 17 aa, Mycobacterium
FSEAPLVLMEFVDGLVV

SEQ ID NO: 661141 - protein, 18 aa, Mycobacterium
FSECGAGLVVDEVDADLL

SEQ ID NO: 661142 - protein, 18 aa, Mycobacterium
FSECGAGLVVDEVDADLM

SEQ ID NO: 661143 - protein, 26 aa, Mycobacterium
FSEDDLRGKFARMVCGTAEAITAELR

SEQ ID NO: 661144 - protein, 23 aa, Mycobacterium
FSEDPRRGAAILNRPDLVILRGR

SEQ ID NO: 661145 - protein, 19 aa, Mycobacterium
FSEELGLSVPAGHRLDLGQ

SEQ ID NO: 661146 - protein, 24 aa, Mycobacterium
FSEELGVPVANTFHGKGAMPDDHP

SEQ ID NO: 661147 - protein, 17 aa, Mycobacterium
FSEGELFIIGRIKDLLI

SEQ ID NO: 661148 - protein, 18 aa, Mycobacterium
FSEGGCWRNFLTCNANLA

SEQ ID NO: 661149 - protein, 17 aa, Mycobacterium
FSEHGPLGARVDRVASR

SEQ ID NO: 661150 - protein, 20 aa, Mycobacterium
FSEHSGHLLAGTALSVISGR

SEQ ID NO: 661151 - protein, 17 aa, Mycobacterium
FSEIVAYLAALGDALAL

SEQ ID NO: 661152 - protein, 24 aa, Mycobacterium
FSEKVDVVCGIGWDNVDADNPAFR

SEQ ID NO: 661153 - protein, 18 aa, Mycobacterium
FSEMFKFELKSLPFILGA

SEQ ID NO: 661154 - protein, 20 aa, Mycobacterium
FSEPCADCRGTGSIIENPCT

SEQ ID NO: 661155 - protein, 24 aa, Mycobacterium
FSEPCTDCRGSGSIIEHPCEECKG

SEQ ID NO: 661156 - protein, 22 aa, Mycobacterium
FSEPGACAPAWSDVSALLAAAE

SEQ ID NO: 661157 - protein, 19 aa, Mycobacterium
FSESFSYSSAAEVFEEIKR

SEQ ID NO: 661158 - protein, 24 aa, Mycobacterium
FSESMCQAVHDFRIFVNYLRGTGV

SEQ ID NO: 661159 - protein, 28 aa, Mycobacterium
FSETEAALFRGACAAAALAISNATLYRV

SEQ ID NO: 661160 - protein, 17 aa, Mycobacterium
FSETGAIKAKSVIIAAG

SEQ ID NO: 661161 - protein, 17 aa, Mycobacterium
FSETSFRVFQAPYVGAV

SEQ ID NO: 661162 - protein, 25 aa, Mycobacterium
FSEVPRLAAIGARAAELCGLGPHRF

SEQ ID NO: 661163 - protein, 20 aa, Mycobacterium
FSFACANIFSGVSLLGALCS

SEQ ID NO: 661164 - protein, 20 aa, Mycobacterium
FSFAPNASWTRTYARQPEIL

SEQ ID NO: 661165 - protein, 22 aa, Mycobacterium
FSFDNAMCYPKPVGRLPIHIGG

SEQ ID NO: 661166 - protein, 21 aa, Mycobacterium
FSFEKRSSWSRTYAHGNELKD

SEQ ID NO: 661167 - protein, 24 aa, Mycobacterium
FSFEPKADWSHMWSFQPEIQEYLL

SEQ ID NO: 661168 - protein, 19 aa, Mycobacterium
FSFLPRFGPGKGLGVIPRE

SEQ ID NO: 661169 - protein, 18 aa, Mycobacterium
FSFLRLLLPAGVETTYRS

SEQ ID NO: 661170 - protein, 23 aa, Mycobacterium
FSFNHCPELGWLRDELSLPLEQW

SEQ ID NO: 661171 - protein, 35 aa, Mycobacterium
FSFNVADGRCPTCQGEGFVSVELLFLPGTYATCPA

SEQ ID NO: 661172 - protein, 20 aa, Mycobacterium
FSFSGLKTAVARYVEAHPEA

SEQ ID NO: 661173 - protein, 19 aa, Mycobacterium
FSFSGLKTAVARYVESHPE

SEQ ID NO: 661174 - protein, 26 aa, Mycobacterium
FSGACAGCGETPYLKLLSQLFGDRLM

SEQ ID NO: 661175 - protein, 27 aa, Mycobacterium
FSGALPVPLVYSLGGFNFGTEGAGFTL

SEQ ID NO: 661176 - protein, 27 aa, Mycobacterium
FSGAPAVAAGIPWTLVDGTDRAHPELL

SEQ ID NO: 661177 - protein, 23 aa, Mycobacterium
FSGARYMGEMDWDEPLEPDGHAA

SEQ ID NO: 661178 - protein, 19 aa, Mycobacterium
FSGAWPYLRVLSRLTGIAD

SEQ ID NO: 661179 - protein, 19 aa, Mycobacterium
FSGEPLLADVCRVARDAGA

SEQ ID NO: 661180 - protein, 20 aa, Mycobacterium
FSGEVGVCLATSGPGAIHLL

SEQ ID NO: 661181 - protein, 17 aa, Mycobacterium
FSGGHEWLADNGVSVTL

SEQ ID NO: 661182 - protein, 26 aa, Mycobacterium
FSGGMRQRLLIAMAVALNPTVLIADE

SEQ ID NO: 661183 - protein, 20 aa, Mycobacterium
FSGGRGRPSVIANRLTFDRE

SEQ ID NO: 661184 - protein, 20 aa, Mycobacterium
FSGGVFACAALAEYELTGSR

SEQ ID NO: 661185 - protein, 26 aa, Mycobacterium
FSGGYDFGGGFVHWGDAMMTDGRWDP

SEQ ID NO: 661186 - protein, 22 aa, Mycobacterium
FSGHGFKFVPVVGEILADLAIS

SEQ ID NO: 661187 - protein, 20 aa, Mycobacterium
FSGHGFKFVPVVGEILADLV

SEQ ID NO: 661188 - protein, 26 aa, Mycobacterium
FSGHGFKIAPAVGRLVADLVVDGHGS

SEQ ID NO: 661189 - protein, 27 aa, Mycobacterium
FSGHGFKIAPAVGRLVADLVVDGHSSD

SEQ ID NO: 661190 - protein, 25 aa, Mycobacterium
FSGHLPTGFAFIPGHEIIGVIEGIG

SEQ ID NO: 661191 - protein, 22 aa, Mycobacterium
FSGHPPWGIGRPQPQIADLIRQ

SEQ ID NO: 661192 - protein, 23 aa, Mycobacterium
FSGKADILAAGFRRAADRLSADM

SEQ ID NO: 661193 - protein, 17 aa, Mycobacterium
FSGKAGRQLAKDYVAFP

SEQ ID NO: 661194 - protein, 17 aa, Mycobacterium
FSGKAQIGKGMWAMTEL

SEQ ID NO: 661195 - protein, 17 aa, Mycobacterium
FSGKILAPAHLPQEQSQ

SEQ ID NO: 661196 - protein, 17 aa, Mycobacterium
FSGLGMAIELQRRGVDF

SEQ ID NO: 661197 - protein, 19 aa, Mycobacterium
FSGLIERFGTGKGCDICKP

SEQ ID NO: 661198 - protein, 25 aa, Mycobacterium
FSGPLPLPPSKHVAVVACMDARLDV

SEQ ID NO: 661199 - protein, 26 aa, Mycobacterium
FSGPLPLPPSKHVAVVACMDARLDVY

SEQ ID NO: 661200 - protein, 17 aa, Mycobacterium
FSGQAHGGAGGDGSQGG

SEQ ID NO: 661201 - protein, 21 aa, Mycobacterium
FSGRPARSISNAFQRDMEAVA

SEQ ID NO: 661202 - protein, 18 aa, Mycobacterium
FSGRVSDSGEGRWTAIAA

SEQ ID NO: 661203 - protein, 18 aa, Mycobacterium
FSGRVSDSGEGRWTSIAA

SEQ ID NO: 661204 - protein, 18 aa, Mycobacterium
FSGTYPYWGFQKATSEDL

SEQ ID NO: 661205 - protein, 26 aa, Mycobacterium
FSGVDPRWEWDIGLLNLRRRMEEDFL

SEQ ID NO: 661206 - protein, 19 aa, Mycobacterium
FSGVVWRAAGPGATESTTE

SEQ ID NO: 661207 - protein, 19 aa, Mycobacterium
FSGVVWRSTAPNGKESSAD

SEQ ID NO: 661208 - protein, 23 aa, Mycobacterium
FSGWRSTRQRVWGQMDAARCGPI

SEQ ID NO: 661209 - protein, 20 aa, Mycobacterium
FSGWRSTRQRVWGQMDDGRC

SEQ ID NO: 661210 - protein, 17 aa, Mycobacterium
FSHEPNQGFLRCVAALA

SEQ ID NO: 661211 - protein, 30 aa, Mycobacterium
FSHFGHGILTWHVPMLFRTPPGYNLLVRGP

SEQ ID NO: 661212 - protein, 17 aa, Mycobacterium
FSHPGIATAVPRYFHSS

SEQ ID NO: 661213 - protein, 17 aa, Mycobacterium
FSHPLTFGTAGLRGPLR

SEQ ID NO: 661214 - protein, 17 aa, Mycobacterium
FSHPMFGEAVRRRVGTA

SEQ ID NO: 661215 - protein, 20 aa, Mycobacterium
FSIAALRAEPVDRYGVGTSL

SEQ ID NO: 661216 - protein, 24 aa, Mycobacterium
FSIAAQGCTYWNGEAMQGTDYTDL

SEQ ID NO: 661217 - protein, 27 aa, Mycobacterium
FSIEPGIYFPGRWGARIEDIVVVTKDG

SEQ ID NO: 661218 - protein, 28 aa, Mycobacterium
FSIEPGIYVPGRWGARIEDIVVVTEDGA

SEQ ID NO: 661219 - protein, 26 aa, Mycobacterium
FSIEPRPDQTFEFTVDVPGQVDIELH

SEQ ID NO: 661220 - protein, 17 aa, Mycobacterium
FSIPRDDWVPAEGIPGY

SEQ ID NO: 661221 - protein, 25 aa, Mycobacterium
FSISGAPIATLWVSVNGGAPVAVPS

SEQ ID NO: 661222 - protein, 23 aa, Mycobacterium
FSITGRAALPFTGSMRVSADLAL

SEQ ID NO: 661223 - protein, 24 aa, Mycobacterium
FSKAYGLAGLRIGYGLAAAELAAA

SEQ ID NO: 661224 - protein, 24 aa, Mycobacterium
FSKIVAPGLRVGWVDTDPELQPLL

SEQ ID NO: 661225 - protein, 21 aa, Mycobacterium
FSKKRRRGLAFGEAAGGVTYF

SEQ ID NO: 661226 - protein, 19 aa, Mycobacterium
FSKLFRSEVDWDYLTEPQP

SEQ ID NO: 661227 - protein, 25 aa, Mycobacterium
FSKLNPRIPRIWNVISLPVEMALTS

SEQ ID NO: 661228 - protein, 22 aa, Mycobacterium
FSKVRWRASTIGGLPILYEDAH

SEQ ID NO: 661229 - protein, 18 aa, Mycobacterium
FSKYFGAAGFVPLSNATD

SEQ ID NO: 661230 - protein, 18 aa, Mycobacterium
FSKYFGAAGFVPLSNTVE

SEQ ID NO: 661231 - protein, 25 aa, Mycobacterium
FSLADPPAVCDFVRRLAADLHDAAA

SEQ ID NO: 661232 - protein, 21 aa, Mycobacterium
FSLAEICRGLGISRATGHAIL

SEQ ID NO: 661233 - protein, 19 aa, Mycobacterium
FSLAGEFLVHGRIVYAAGP

SEQ ID NO: 661234 - protein, 20 aa, Mycobacterium
FSLALLLATERLKVIAAVHP

SEQ ID NO: 661235 - protein, 25 aa, Mycobacterium
FSLASGRIAYALGVHGPAITVDTAC

SEQ ID NO: 661236 - protein, 26 aa, Mycobacterium
FSLASGRIAYALGVHGPALTVDTACS

SEQ ID NO: 661237 - protein, 18 aa, Mycobacterium
FSLCAKAIQALTRISPRS

SEQ ID NO: 661238 - protein, 23 aa, Mycobacterium
FSLEAPEGMRFLSRGRVFTGEEQ

SEQ ID NO: 661239 - protein, 20 aa, Mycobacterium
FSLEARAMRDWTAGLAGSRY

SEQ ID NO: 661240 - protein, 25 aa, Mycobacterium
FSLGDSRFPPAPAHSASRTTASVGS

SEQ ID NO: 661241 - protein, 19 aa, Mycobacterium
FSLGPALAVVAARTDTARP

SEQ ID NO: 661242 - protein, 17 aa, Mycobacterium
FSLKMIPLRVKQMRLHR

SEQ ID NO: 661243 - protein, 18 aa, Mycobacterium
FSLLRTALVSGTRGARLF

SEQ ID NO: 661244 - protein, 18 aa, Mycobacterium
FSLLTGWGRDRPIPPGPI

SEQ ID NO: 661245 - protein, 24 aa, Mycobacterium
FSLLVSHVLVPPAIAAIMESPTCR

SEQ ID NO: 661246 - protein, 18 aa, Mycobacterium
FSLPSLRRGRDVAAAEIL

SEQ ID NO: 661247 - protein, 17 aa, Mycobacterium
FSLVGFARRDWETQDFR

SEQ ID NO: 661248 - protein, 17 aa, Mycobacterium
FSLWATRTLLSGRGDEL

SEQ ID NO: 661249 - protein, 20 aa, Mycobacterium
FSLWNLPGSEHYQFVANMAT

SEQ ID NO: 661250 - protein, 17 aa, Mycobacterium
FSMAGYSAFLAHNAASI

SEQ ID NO: 661251 - protein, 25 aa, Mycobacterium
FSMASGRISYALGLRGPAVSLDTAC

SEQ ID NO: 661252 - protein, 26 aa, Mycobacterium
FSMASGRVSYALGLRGPAMTVDTACS

SEQ ID NO: 661253 - protein, 19 aa, Mycobacterium
FSMDSAWRGVLPPEKGFVY

SEQ ID NO: 661254 - protein, 19 aa, Mycobacterium
FSNATLWPLYHDVIVKPEY

SEQ ID NO: 661255 - protein, 18 aa, Mycobacterium
FSNEGGRFLSGFENIGQL

SEQ ID NO: 661256 - protein, 24 aa, Mycobacterium
FSNIGVGMSGFFNTAAGGTTNHNI

SEQ ID NO: 661257 - protein, 24 aa, Mycobacterium
FSNIVCLGGPFPPLPFEPEGDDIS

SEQ ID NO: 661258 - protein, 18 aa, Mycobacterium
FSNLIVSGDQAWKTIDDY

SEQ ID NO: 661259 - protein, 23 aa, Mycobacterium
FSNMALSGLAGRAMVPTGGTAAR

SEQ ID NO: 661260 - protein, 17 aa, Mycobacterium
FSNREYNHYPLAVQATP

SEQ ID NO: 661261 - protein, 21 aa, Mycobacterium
FSNRLGVCAATSGPGAIHLLN

SEQ ID NO: 661262 - protein, 24 aa, Mycobacterium
FSPDAVGLWTFRVDGWSDPIATWR

SEQ ID NO: 661263 - protein, 17 aa, Mycobacterium
FSPDPSIRREDFYLCAG

SEQ ID NO: 661264 - protein, 32 aa, Mycobacterium
FSPDSGSTWLLPRLVGLARARRMLLLGEQVTA

SEQ ID NO: 661265 - protein, 18 aa, Mycobacterium
FSPELTRPFEPPPTFMNH

SEQ ID NO: 661266 - protein, 19 aa, Mycobacterium
FSPEVQLILCAGEPDTPEI

SEQ ID NO: 661267 - protein, 18 aa, Mycobacterium
FSPFFNALPIRRLGLHEQ

SEQ ID NO: 661268 - protein, 17 aa, Mycobacterium
FSPFSGYGYFANGLAGF

SEQ ID NO: 661269 - protein, 18 aa, Mycobacterium
FSPGSAERFRESAIEMTN

SEQ ID NO: 661270 - protein, 20 aa, Mycobacterium
FSPLRHWNAGPGKRIAVIGL

SEQ ID NO: 661271 - protein, 20 aa, Mycobacterium
FSPLRHWNAGPGKRVAVVGL

SEQ ID NO: 661272 - protein, 19 aa, Mycobacterium
FSPLVAKLVAELGFDGVYV

SEQ ID NO: 661273 - protein, 24 aa, Mycobacterium
FSPMDIESVHRWDAYTEAKEAMFD

SEQ ID NO: 661274 - protein, 24 aa, Mycobacterium
FSPPGGRVLLVWDAPNLDMGLGSI

SEQ ID NO: 661275 - protein, 23 aa, Mycobacterium
FSPPGVTCRRAELRGQITQLPLG

SEQ ID NO: 661276 - protein, 17 aa, Mycobacterium
FSPPPPMPAACCSTSPR

SEQ ID NO: 661277 - protein, 17 aa, Mycobacterium
FSPPSGHPAEMPAPSGG

SEQ ID NO: 661278 - protein, 18 aa, Mycobacterium
FSPQGWSMHPSLSMFLSR

SEQ ID NO: 661279 - protein, 17 aa, Mycobacterium
FSPRLRADIVLNNLVGH

SEQ ID NO: 661280 - protein, 25 aa, Mycobacterium
FSPSGPRLAGKLGAGLLSLSASIPG

SEQ ID NO: 661281 - protein, 19 aa, Mycobacterium
FSPTGPRGAGRHGIGMLSI

SEQ ID NO: 661282 - protein, 22 aa, Mycobacterium
FSPTRRRLAAAMGAHVTLDPAQ

SEQ ID NO: 661283 - protein, 18 aa, Mycobacterium
FSPVSLGPVTLRNRVIKA

SEQ ID NO: 661284 - protein, 17 aa, Mycobacterium
FSPWYVVESDIKKHARL

SEQ ID NO: 661285 - protein, 26 aa, Mycobacterium
FSQAKTRWSGCANRSLTVTSPGHAPV

SEQ ID NO: 661286 - protein, 19 aa, Mycobacterium
FSQDGWSFLIDAFFHRGLM

SEQ ID NO: 661287 - protein, 21 aa, Mycobacterium
FSQFKRSALPNGPKVSHGGAL

SEQ ID NO: 661288 - protein, 17 aa, Mycobacterium
FSQFKRSAMPNGPKVSH

SEQ ID NO: 661289 - protein, 21 aa, Mycobacterium
FSQIETLVFMAFFERSHAVFC

SEQ ID NO: 661290 - protein, 18 aa, Mycobacterium
FSQIGAGFKSMFGGELQG

SEQ ID NO: 661291 - protein, 18 aa, Mycobacterium
FSQKGWHPVIGPFFNRGL

SEQ ID NO: 661292 - protein, 24 aa, Mycobacterium
FSQMGLSSLLGRAVASSATHSVGA

SEQ ID NO: 661293 - protein, 18 aa, Mycobacterium
FSQRAWDPVIGPFFEGGL

SEQ ID NO: 661294 - protein, 19 aa, Mycobacterium
FSQRGWHPVIGPFFNRGLM

SEQ ID NO: 661295 - protein, 23 aa, Mycobacterium
FSRAEAGSGWSLHAEGVLRAGSV

SEQ ID NO: 661296 - protein, 25 aa, Mycobacterium
FSRCSDCGRIYWAGSHHARLAGLVQ

SEQ ID NO: 661297 - protein, 23 aa, Mycobacterium
FSRDPWRVRCLEIRGTAEQVMTS

SEQ ID NO: 661298 - protein, 19 aa, Mycobacterium
FSREDRARADAAYEAALEA

SEQ ID NO: 661299 - protein, 21 aa, Mycobacterium
FSRFRRAVTDTGLYKDSDRLA

SEQ ID NO: 661300 - protein, 20 aa, Mycobacterium
FSRGAFCARGLAGLLNSVGM

SEQ ID NO: 661301 - protein, 20 aa, Mycobacterium
FSRGGLMVHDVFDHTSQLKL

SEQ ID NO: 661302 - protein, 24 aa, Mycobacterium
FSRGGSLKSSWYGDCLPERDFPTL

SEQ ID NO: 661303 - protein, 25 aa, Mycobacterium
FSRGGSLKSSWYGDCLPERDFPTLI

SEQ ID NO: 661304 - protein, 17 aa, Mycobacterium
FSRMYQEMINFCKTHGQ

SEQ ID NO: 661305 - protein, 18 aa, Mycobacterium
FSRNLKLLAKELEVPVIA

SEQ ID NO: 661306 - protein, 28 aa, Mycobacterium
FSRNWNVDVAQAFHWTRHALRRPLAPGG

SEQ ID NO: 661307 - protein, 26 aa, Mycobacterium
FSRPARGRPVAAWSLAADEAVVTALG

SEQ ID NO: 661308 - protein, 22 aa, Mycobacterium
FSRPLNHPLVWSITQAAASEIG

SEQ ID NO: 661309 - protein, 17 aa, Mycobacterium
FSRPLSHPLVWSITQAA

SEQ ID NO: 661310 - protein, 31 aa, Mycobacterium
FSRRCGTPGAPALVLVHGFPTSSIDYFALAA

SEQ ID NO: 661311 - protein, 19 aa, Mycobacterium
FSRRCRAVRLVPFDPHLEE

SEQ ID NO: 661312 - protein, 21 aa, Mycobacterium
FSRSFFKQQIDYVRALGDTVI

SEQ ID NO: 661313 - protein, 17 aa, Mycobacterium
FSRSMPRQAEIYAKELR

SEQ ID NO: 661314 - protein, 28 aa, Mycobacterium
FSRWNAGKDLSFVPLRPERVVEVRYDHM

SEQ ID NO: 661315 - protein, 17 aa, Mycobacterium
FSSAAAMLGSPGQGAYA

SEQ ID NO: 661316 - protein, 22 aa, Mycobacterium
FSSADPRRGRVLFTDARANPVL

SEQ ID NO: 661317 - protein, 22 aa, Mycobacterium
FSSADPRRGRVLFTDARSNPVL

SEQ ID NO: 661318 - protein, 22 aa, Mycobacterium
FSSADPRRGRVLFTDARTNPVL

SEQ ID NO: 661319 - protein, 19 aa, Mycobacterium
FSSAHIAEFFSSVRHGQDL

SEQ ID NO: 661320 - protein, 18 aa, Mycobacterium
FSSCGYLAGFPGQGAYAC

SEQ ID NO: 661321 - protein, 31 aa, Mycobacterium
FSSDAAMARECVAAGWLLSLSGTVSFRNARE

SEQ ID NO: 661322 - protein, 21 aa, Mycobacterium
FSSEFAIGVGTMMSVRNPDPL

SEQ ID NO: 661323 - protein, 26 aa, Mycobacterium
FSSGELQALAAIRCLDEGVDIPATRR

SEQ ID NO: 661324 - protein, 30 aa, Mycobacterium
FSSGMAATDCALRAVLRPGDHVVIPDDAYG

SEQ ID NO: 661325 - protein, 18 aa, Mycobacterium
FSSGMAATDCVLRALLRP

SEQ ID NO: 661326 - protein, 25 aa, Mycobacterium
FSSIEYRGLLRLQYAVRIGRDPNGF

SEQ ID NO: 661327 - protein, 23 aa, Mycobacterium
FSSKAEIVQACLRDMGATRAVPP

SEQ ID NO: 661328 - protein, 24 aa, Mycobacterium
FSSKLELYLAVLARHVENLVSGVQ

SEQ ID NO: 661329 - protein, 26 aa, Mycobacterium
FSSKLELYLAVLKRHVDNLVCGVQQA

SEQ ID NO: 661330 - protein, 24 aa, Mycobacterium
FSSKLELYLAVLNRHVDKLVAGVQ

SEQ ID NO: 661331 - protein, 25 aa, Mycobacterium
FSSKLELYLAVLQRHVDNLVSGVRQ

SEQ ID NO: 661332 - protein, 25 aa, Mycobacterium
FSSKQDLLDAFVVWERRGYEQAVAQ

SEQ ID NO: 661333 - protein, 25 aa, Mycobacterium
FSSLFPGGEGRLVLTDPNDMLTTGI

SEQ ID NO: 661334 - protein, 22 aa, Mycobacterium
FSSPRRRALVTAELAGLTVAEE

SEQ ID NO: 661335 - protein, 23 aa, Mycobacterium
FSSRLRRWRLAGGADAGLATDYR

SEQ ID NO: 661336 - protein, 23 aa, Mycobacterium
FSSRRLRRVRLLKRVAPADTLLK

SEQ ID NO: 661337 - protein, 20 aa, Mycobacterium
FSSSLDWNIERVKGGSMVAG

SEQ ID NO: 661338 - protein, 19 aa, Mycobacterium
FSSSLDWNIERVRGGSMVA

SEQ ID NO: 661339 - protein, 18 aa, Mycobacterium
FSSSRGCDLAMVKGDEPP

SEQ ID NO: 661340 - protein, 20 aa, Mycobacterium
FSSTVCYKGMMLDGIPNFAF

SEQ ID NO: 661341 - protein, 20 aa, Mycobacterium
FSSVASGLVDGSWRGPASAA

SEQ ID NO: 661342 - protein, 24 aa, Mycobacterium
FSSVEIRVVPKLVGGTLRVLQMIE

SEQ ID NO: 661343 - protein, 25 aa, Mycobacterium
FSSVTAGLASGAWQGPASAAMSAVA

SEQ ID NO: 661344 - protein, 19 aa, Mycobacterium
FSTAALFSAFSMVTHAGQG

SEQ ID NO: 661345 - protein, 29 aa, Mycobacterium
FSTAPLVVAGCIMMRVCHLDTCPVGVATQ

SEQ ID NO: 661346 - protein, 18 aa, Mycobacterium
FSTARLVTLVGVGGVGKT

SEQ ID NO: 661347 - protein, 31 aa, Mycobacterium
FSTDPGRLAAPWEFVDAGWVRAPRGSEPGLR

SEQ ID NO: 661348 - protein, 31 aa, Mycobacterium
FSTDRLESRWCGGDLLLQICADDPLVVAHTA

SEQ ID NO: 661349 - protein, 17 aa, Mycobacterium
FSTGVAALRAITQTGTG

SEQ ID NO: 661350 - protein, 17 aa, Mycobacterium
FSTILAGLGSEVTHLVR

SEQ ID NO: 661351 - protein, 17 aa, Mycobacterium
FSTLGARVTLVIRGSCL

SEQ ID NO: 661352 - protein, 17 aa, Mycobacterium
FSTNPQRVAHRDVLCPL

SEQ ID NO: 661353 - protein, 17 aa, Mycobacterium
FSTPASGTWAATILARQ

SEQ ID NO: 661354 - protein, 19 aa, Mycobacterium
FSTPDGIGCMFRASPNMTP

SEQ ID NO: 661355 - protein, 17 aa, Mycobacterium
FSTPLGLLARRIAFDDP

SEQ ID NO: 661356 - protein, 28 aa, Mycobacterium
FSTRAESRWFASAGFALVNMTGYPEAVL

SEQ ID NO: 661357 - protein, 28 aa, Mycobacterium
FSTRAESRWFASAGFSLVNMTGYPEAVL

SEQ ID NO: 661358 - protein, 27 aa, Mycobacterium
FSTRAESRWFASQGFTLVNMTGYPEAV

SEQ ID NO: 661359 - protein, 30 aa, Mycobacterium
FSTRGCPYRCTFCGTGAMSAMLGRNSYRAK

SEQ ID NO: 661360 - protein, 17 aa, Mycobacterium
FSTRRLVDCIKQGSTDF

SEQ ID NO: 661361 - protein, 17 aa, Mycobacterium
FSTSMKMFGVPYRITST

SEQ ID NO: 661362 - protein, 30 aa, Mycobacterium
FSTTVLRPGTFATMTLDWASFIRAGVPVEQ

SEQ ID NO: 661363 - protein, 17 aa, Mycobacterium
FSTWAHHMSLRYLNASS

SEQ ID NO: 661364 - protein, 21 aa, Mycobacterium
FSTWGNQFISSGFPINMLSYL

SEQ ID NO: 661365 - protein, 17 aa, Mycobacterium
FSTWTPHWFGVVDGPVE

SEQ ID NO: 661366 - protein, 22 aa, Mycobacterium
FSVDLDPRWVKKIATRGVGAEV

SEQ ID NO: 661367 - protein, 28 aa, Mycobacterium
FSVEPGIYFPGQWGARIEDIVVVTADGA

SEQ ID NO: 661368 - protein, 27 aa, Mycobacterium
FSVEPGIYFPGRWGARIEDIVVVTEDG

SEQ ID NO: 661369 - protein, 27 aa, Mycobacterium
FSVEPGVYFPGQWGARIEDIVIVTEDG

SEQ ID NO: 661370 - protein, 19 aa, Mycobacterium
FSVIRAAELSKWIDRGEYG

SEQ ID NO: 661371 - protein, 21 aa, Mycobacterium
FSVITCRDITKLGSDGVIERI

SEQ ID NO: 661372 - protein, 17 aa, Mycobacterium
FSVPHARVEDAELGEPV

SEQ ID NO: 661373 - protein, 17 aa, Mycobacterium
FSVPHGRANGIFLPHVL

SEQ ID NO: 661374 - protein, 25 aa, Mycobacterium
FSVQVEALHDQFVRAVTSGAASYAG

SEQ ID NO: 661375 - protein, 19 aa, Mycobacterium
FSVRLELKYLSEQDETAML

SEQ ID NO: 661376 - protein, 17 aa, Mycobacterium
FSWTWWRSGRGRRLGGR

SEQ ID NO: 661377 - protein, 19 aa, Mycobacterium
FSYAHVMAIMAFIKGIGSG

SEQ ID NO: 661378 - protein, 19 aa, Mycobacterium
FSYDELRALNPRIVLAESS

SEQ ID NO: 661379 - protein, 23 aa, Mycobacterium
FSYGTGVAELFPTVVKQVREAEA

SEQ ID NO: 661380 - protein, 19 aa, Mycobacterium
FSYQFSFEQSRHWSRTYAP

SEQ ID NO: 661381 - protein, 25 aa, Mycobacterium
FTAAAKAFESWRWSTPSERQRALLR

SEQ ID NO: 661382 - protein, 18 aa, Mycobacterium
FTAAGAEWRQAGCSMCLG

SEQ ID NO: 661383 - protein, 19 aa, Mycobacterium
FTAAGAEWRQAGCSMCLGM

SEQ ID NO: 661384 - protein, 25 aa, Mycobacterium
FTAALRAGLGWGMMPEQLGREGLVE

SEQ ID NO: 661385 - protein, 25 aa, Mycobacterium
FTAAMSVQALIDWGIAPDAGDIVVT

SEQ ID NO: 661386 - protein, 24 aa, Mycobacterium
FTAAMSVQALIDWGIAPEAGAVVV

SEQ ID NO: 661387 - protein, 18 aa, Mycobacterium
FTADFPTRNYPGTDEIDF

SEQ ID NO: 661388 - protein, 19 aa, Mycobacterium
FTADGDLLFLAARPTADDD

SEQ ID NO: 661389 - protein, 17 aa, Mycobacterium
FTAEAAWRHEVARLPAE

SEQ ID NO: 661390 - protein, 17 aa, Mycobacterium
FTAEFSGIVRSALDGAR

SEQ ID NO: 661391 - protein, 17 aa, Mycobacterium
FTAELPFALDGFQQRAC

SEQ ID NO: 661392 - protein, 23 aa, Mycobacterium
FTAERLEQVRAWLAENPQTSVLI

SEQ ID NO: 661393 - protein, 24 aa, Mycobacterium
FTAERLRQVESWLADKPETSVLIA

SEQ ID NO: 661394 - protein, 26 aa, Mycobacterium
FTAFAAKLAERVGCRRADDGRIRVGI

SEQ ID NO: 661395 - protein, 20 aa, Mycobacterium
FTAFCGHRFDVRQANCSVSS

SEQ ID NO: 661396 - protein, 23 aa, Mycobacterium
FTAFPKAHWQKIWSNNPIERLNK

SEQ ID NO: 661397 - protein, 23 aa, Mycobacterium
FTAFPRTHWQKIWSNNPIVICSA

SEQ ID NO: 661398 - protein, 24 aa, Mycobacterium
FTAFVPFAARWPVEVHIYPNRFAH

SEQ ID NO: 661399 - protein, 18 aa, Mycobacterium
FTAGCPVAAAALGSADDG

SEQ ID NO: 661400 - protein, 18 aa, Mycobacterium
FTAGDAGYEFALESISKI

SEQ ID NO: 661401 - protein, 18 aa, Mycobacterium
FTAGQLVICPGAWAPQLL

SEQ ID NO: 661402 - protein, 17 aa, Mycobacterium
FTAGRIEILRAFLTTTT

SEQ ID NO: 661403 - protein, 19 aa, Mycobacterium
FTAHWPTSRDVWLPDGTPP

SEQ ID NO: 661404 - protein, 21 aa, Mycobacterium
FTAKFGIPVLTSYAATEFGGG

SEQ ID NO: 661405 - protein, 18 aa, Mycobacterium
FTALCAQSPAVHRFPGSM

SEQ ID NO: 661406 - protein, 18 aa, Mycobacterium
FTALDFIGPYEVLRFIPD

SEQ ID NO: 661407 - protein, 27 aa, Mycobacterium
FTALPEVRSQLALTWGTETFIVPQMSN

SEQ ID NO: 661408 - protein, 19 aa, Mycobacterium
FTANPWLAGYMQEALGLLT

SEQ ID NO: 661409 - protein, 21 aa, Mycobacterium
FTAQLLPRPIGLIIGLQLSAN

SEQ ID NO: 661410 - protein, 18 aa, Mycobacterium
FTARCLGAADCGHLLDEE

SEQ ID NO: 661411 - protein, 21 aa, Mycobacterium
FTARTVPWVVLTSNDTRELSS

SEQ ID NO: 661412 - protein, 17 aa, Mycobacterium
FTATVRGVFTYKVNDAG

SEQ ID NO: 661413 - protein, 25 aa, Mycobacterium
FTAVLPRLTPATGLGAAAVAAYAER

SEQ ID NO: 661414 - protein, 20 aa, Mycobacterium
FTAVTTLRILDGVRLPKGST

SEQ ID NO: 661415 - protein, 25 aa, Mycobacterium
FTAYFIGPLVHRFHSAHPGITLTVR

SEQ ID NO: 661416 - protein, 20 aa, Mycobacterium
FTCTYHGWAYDLEGKLISVP

SEQ ID NO: 661417 - protein, 19 aa, Mycobacterium
FTDAALRVTDEFAALRPPG

SEQ ID NO: 661418 - protein, 24 aa, Mycobacterium
FTDAMRADWMWRVFGEAGHVAVVE

SEQ ID NO: 661419 - protein, 26 aa, Mycobacterium
FTDAVVQHWGPPPGELFVDRSNDPDG

SEQ ID NO: 661420 - protein, 17 aa, Mycobacterium
FTDEGIRAAALLRSQNP

SEQ ID NO: 661421 - protein, 18 aa, Mycobacterium
FTDFTGYQHRVFAMHNGQ

SEQ ID NO: 661422 - protein, 17 aa, Mycobacterium
FTDGWFRTGDLGAIDDD

SEQ ID NO: 661423 - protein, 18 aa, Mycobacterium
FTDIEWRSPFVAKAGLDE

SEQ ID NO: 661424 - protein, 18 aa, Mycobacterium
FTDKDVFVGAVFDRVIAD

SEQ ID NO: 661425 - protein, 26 aa, Mycobacterium
FTDKFVKRMSEFTLGKGLDEKSTLGP

SEQ ID NO: 661426 - protein, 18 aa, Mycobacterium
FTDLGLKYVGPVDGHDER

SEQ ID NO: 661427 - protein, 19 aa, Mycobacterium
FTDPFVRDLLDDWPVTSQR

SEQ ID NO: 661428 - protein, 21 aa, Mycobacterium
FTDQLRWLFGKLIGDRPRWSL

SEQ ID NO: 661429 - protein, 19 aa, Mycobacterium
FTDRAGFRIEIPGPALARF

SEQ ID NO: 661430 - protein, 19 aa, Mycobacterium
FTDVAGLMGPYLMHPIHWA

SEQ ID NO: 661431 - protein, 23 aa, Mycobacterium
FTDVSRADWLWRVVGETGHVALA

SEQ ID NO: 661432 - protein, 24 aa, Mycobacterium
FTDWPDPWVLAGALAQVTTRLRFV

SEQ ID NO: 661433 - protein, 20 aa, Mycobacterium
FTEAKFRSVLEEPTYTEGTG

SEQ ID NO: 661434 - protein, 23 aa, Mycobacterium
FTEELVMWWNFVGRNHDEIVTYR

SEQ ID NO: 661435 - protein, 22 aa, Mycobacterium
FTEELVMWWNFVGRSHDDIVAY

SEQ ID NO: 661436 - protein, 22 aa, Mycobacterium
FTEELVMWWNFVGRSHEDIVNY

SEQ ID NO: 661437 - protein, 19 aa, Mycobacterium
FTEFVPLPFVHQSSPLYLA

SEQ ID NO: 661438 - protein, 17 aa, Mycobacterium
FTEGMGGFTIDKVAALS

SEQ ID NO: 661439 - protein, 17 aa, Mycobacterium
FTEGYWSTAGPSAIRDE

SEQ ID NO: 661440 - protein, 17 aa, Mycobacterium
FTEGYWSTGGPSAIRDE

SEQ ID NO: 661441 - protein, 19 aa, Mycobacterium
FTEHLPATFVYAGIDVERS

SEQ ID NO: 661442 - protein, 25 aa, Mycobacterium
FTEHVVPILVRRGLFRAEYTGSTLR

SEQ ID NO: 661443 - protein, 19 aa, Mycobacterium
FTEIKFRSVLEEPTYEDGI

SEQ ID NO: 661444 - protein, 25 aa, Mycobacterium
FTEILPTPFLPAGVFDLWGLAADDP

SEQ ID NO: 661445 - protein, 27 aa, Mycobacterium
FTEKVLIECCLELYAADLVVGIQDLGG

SEQ ID NO: 661446 - protein, 29 aa, Mycobacterium
FTEKVLIECCLELYAAHLVVGIQDLGGAG

SEQ ID NO: 661447 - protein, 29 aa, Mycobacterium
FTEKVLIECCLELYAGGLVIGIQDLGGAG

SEQ ID NO: 661448 - protein, 25 aa, Mycobacterium
FTELKFPGRLVVGLAVSRLGTSSVT

SEQ ID NO: 661449 - protein, 25 aa, Mycobacterium
FTENPAGSVLIEFGRTKVLCTASVT

SEQ ID NO: 661450 - protein, 25 aa, Mycobacterium
FTENPAGSVLIEFGRTKVMCTASVT

SEQ ID NO: 661451 - protein, 25 aa, Mycobacterium
FTEPDPSYHGVVFAELGAPAYALKA

SEQ ID NO: 661452 - protein, 21 aa, Mycobacterium
FTEPSAEVDIWFPDKKGGPGW

SEQ ID NO: 661453 - protein, 39 aa, Mycobacterium
FTEPSAEVDIWFPGKKGGPGWVEWGGCGMVNPNVLRACG

SEQ ID NO: 661454 - protein, 22 aa, Mycobacterium
FTEPVFRAALISGLGGAEDGEV

SEQ ID NO: 661455 - protein, 21 aa, Mycobacterium
FTERRSFLLPPTWSQLDAVSS

SEQ ID NO: 661456 - protein, 21 aa, Mycobacterium
FTEVHPLPGRNLMPVVDGGPA

SEQ ID NO: 661457 - protein, 27 aa, Mycobacterium
FTEVVERIRCAAGAFAELGIDKGDRVA

SEQ ID NO: 661458 - protein, 20 aa, Mycobacterium
FTEYWPDQGDFEFNYSNEGR

SEQ ID NO: 661459 - protein, 26 aa, Mycobacterium
FTFADCARCVVDLLNGLGIDRAHFVG

SEQ ID NO: 661460 - protein, 20 aa, Mycobacterium
FTFAGLPAYLQKQGRKVRFM

SEQ ID NO: 661461 - protein, 25 aa, Mycobacterium
FTFMPIGELWYRKSGTYRNKVQNLT

SEQ ID NO: 661462 - protein, 28 aa, Mycobacterium
FTFMTPAAFVRRPGRWIREMARKPDDEP

SEQ ID NO: 661463 - protein, 28 aa, Mycobacterium
FTFMTPAAFVRRPGRWIREMARKPEDAP

SEQ ID NO: 661464 - protein, 17 aa, Mycobacterium
FTFNGARGAILADKALR

SEQ ID NO: 661465 - protein, 26 aa, Mycobacterium
FTFRGCEGDALLMLLDANGIECSTGS

SEQ ID NO: 661466 - protein, 27 aa, Mycobacterium
FTFRGCEGDSLLMLLDAKGIECSTGSA

SEQ ID NO: 661467 - protein, 22 aa, Mycobacterium
FTFVGRPKPALVAGEEPAADLA

SEQ ID NO: 661468 - protein, 19 aa, Mycobacterium
FTGAALWLAGQGREQQAYT

SEQ ID NO: 661469 - protein, 18 aa, Mycobacterium
FTGALTYYGLTPRDSRKA

SEQ ID NO: 661470 - protein, 23 aa, Mycobacterium
FTGDRVLAAILFEQTMDREIEGK

SEQ ID NO: 661471 - protein, 23 aa, Mycobacterium
FTGDRVLAAILFEQTMDRQIAGK

SEQ ID NO: 661472 - protein, 24 aa, Mycobacterium
FTGEAPPAAGLEVSVLTEWLRAVP

SEQ ID NO: 661473 - protein, 17 aa, Mycobacterium
FTGELPPAEPIGFTVRT

SEQ ID NO: 661474 - protein, 23 aa, Mycobacterium
FTGELRGAALAAAYASMDVFVHP

SEQ ID NO: 661475 - protein, 19 aa, Mycobacterium
FTGEVGFLHYARSADEACY

SEQ ID NO: 661476 - protein, 19 aa, Mycobacterium
FTGFPRLYITVSDTESLYA

SEQ ID NO: 661477 - protein, 22 aa, Mycobacterium
FTGGEPLIFKDLEKLVAAVAGM

SEQ ID NO: 661478 - protein, 19 aa, Mycobacterium
FTGGPGFNAEGLVYRPDGT

SEQ ID NO: 661479 - protein, 24 aa, Mycobacterium
FTGHPYPRACSGFAASDRLGGEAI

SEQ ID NO: 661480 - protein, 19 aa, Mycobacterium
FTGHRLCLDLSSAPAPSNG

SEQ ID NO: 661481 - protein, 17 aa, Mycobacterium
FTGHSLSINAEFERPLS

SEQ ID NO: 661482 - protein, 19 aa, Mycobacterium
FTGIGDTGADIFLREVQDV

SEQ ID NO: 661483 - protein, 17 aa, Mycobacterium
FTGKAQIGKGMWAMTEL

SEQ ID NO: 661484 - protein, 27 aa, Mycobacterium
FTGLAPRDLCALWPVPATSVPHAASPA

SEQ ID NO: 661485 - protein, 21 aa, Mycobacterium
FTGLDDWTIWWGANLGAAGER

SEQ ID NO: 661486 - protein, 17 aa, Mycobacterium
FTGLEIRADRIVLSPHW

SEQ ID NO: 661487 - protein, 17 aa, Mycobacterium
FTGLEIRGDRIVLSPLW

SEQ ID NO: 661488 - protein, 26 aa, Mycobacterium
FTGLNRPAGLALDVSGGIYLVDAYNN

SEQ ID NO: 661489 - protein, 17 aa, Mycobacterium
FTGPITIVSSETHLPYD

SEQ ID NO: 661490 - protein, 27 aa, Mycobacterium
FTGPSISAPGWFLPTIITPTVSPIPPF

SEQ ID NO: 661491 - protein, 26 aa, Mycobacterium
FTGPSLRPSATLVRRTRPVVEARSES

SEQ ID NO: 661492 - protein, 18 aa, Mycobacterium
FTGRIEAIADDLDVEVVV

SEQ ID NO: 661493 - protein, 23 aa, Mycobacterium
FTGSCKSCPSSAVTLELAVQDAV

SEQ ID NO: 661494 - protein, 19 aa, Mycobacterium
FTGSEAYRADVPVTDPKIL

SEQ ID NO: 661495 - protein, 21 aa, Mycobacterium
FTGSPQVGWGIAEAAPKKKVR

SEQ ID NO: 661496 - protein, 19 aa, Mycobacterium
FTGSTRAGIDVARNAAPTV

SEQ ID NO: 661497 - protein, 29 aa, Mycobacterium
FTGTGRPTGEWARAGARLTAAEDALASAR

SEQ ID NO: 661498 - protein, 26 aa, Mycobacterium
FTGTLPKPGVRAGGLITLAGDQPGDG

SEQ ID NO: 661499 - protein, 19 aa, Mycobacterium
FTGTRSVLLTTMLGEQVTD

SEQ ID NO: 661500 - protein, 23 aa, Mycobacterium
FTGVPCIVDLATMREAIADLGGK

SEQ ID NO: 661501 - protein, 22 aa, Mycobacterium
FTGVPCIVDLATMREAIGELGG

SEQ ID NO: 661502 - protein, 23 aa, Mycobacterium
FTGVPCIVDLATMREAVAALGGD

SEQ ID NO: 661503 - protein, 23 aa, Mycobacterium
FTGVPCVVDLATMREAVAALGGD

SEQ ID NO: 661504 - protein, 17 aa, Mycobacterium
FTGYKLLIADVIGGTLK

SEQ ID NO: 661505 - protein, 17 aa, Mycobacterium
FTHAASLAQLWRSCGVL

SEQ ID NO: 661506 - protein, 24 aa, Mycobacterium
FTHAIEAFQAFAPQIAAFALALPA

SEQ ID NO: 661507 - protein, 18 aa, Mycobacterium
FTHELRMTLRELGSRRVA

SEQ ID NO: 661508 - protein, 19 aa, Mycobacterium
FTHLLGYALVQAIKKFPNM

SEQ ID NO: 661509 - protein, 17 aa, Mycobacterium
FTHLLGYALVQATKQFP

SEQ ID NO: 661510 - protein, 19 aa, Mycobacterium
FTHLLGYALVQAVKKFPNM

SEQ ID NO: 661511 - protein, 19 aa, Mycobacterium
FTHLLGYALVQAVKQFPNM

SEQ ID NO: 661512 - protein, 18 aa, Mycobacterium
FTHRLRKYIGAYLAVLGH

SEQ ID NO: 661513 - protein, 18 aa, Mycobacterium
FTHRLRKYVGAYLAVLGH

SEQ ID NO: 661514 - protein, 18 aa, Mycobacterium
FTHTCFMVTPYEGYVAVA

SEQ ID NO: 661515 - protein, 18 aa, Mycobacterium
FTHTCFMVTPYEQYVAVA

SEQ ID NO: 661516 - protein, 17 aa, Mycobacterium
FTHTCFMVTPYESYVAV

SEQ ID NO: 661517 - protein, 17 aa, Mycobacterium
FTHTCFMVVPYEQYVAV

SEQ ID NO: 661518 - protein, 17 aa, Mycobacterium
FTHVPREQATVGALRKA

SEQ ID NO: 661519 - protein, 25 aa, Mycobacterium
FTIAGVPYLLGIQSYLLPQNVANVA

SEQ ID NO: 661520 - protein, 22 aa, Mycobacterium
FTIANPRTDWCFNTEPDPGLAG

SEQ ID NO: 661521 - protein, 17 aa, Mycobacterium
FTIKPDRWFTADFSGEL

SEQ ID NO: 661522 - protein, 19 aa, Mycobacterium
FTILDGLLAFYATIGSIKN

SEQ ID NO: 661523 - protein, 19 aa, Mycobacterium
FTILDGLLAFYATIGSMQN

SEQ ID NO: 661524 - protein, 21 aa, Mycobacterium
FTINGTKTFRLGAGIENDYVM

SEQ ID NO: 661525 - protein, 26 aa, Mycobacterium
FTIPSLPLDALVYINGTPIPIFYDFG

SEQ ID NO: 661526 - protein, 20 aa, Mycobacterium
FTKARLSDGVLGVRPEYLAA

SEQ ID NO: 661527 - protein, 17 aa, Mycobacterium
FTKGGPYLARGAADLVP

SEQ ID NO: 661528 - protein, 18 aa, Mycobacterium
FTKKCCAPLSIPIGTQTL

SEQ ID NO: 661529 - protein, 21 aa, Mycobacterium
FTKKLWSAAGLPIGPHAVLRP

SEQ ID NO: 661530 - protein, 17 aa, Mycobacterium
FTKPIGVTYPWTPPLAE

SEQ ID NO: 661531 - protein, 26 aa, Mycobacterium
FTKRGLRQGVERCLRALARRATERAH

SEQ ID NO: 661532 - protein, 19 aa, Mycobacterium
FTKTAGRSAIWAKDGSVLA

SEQ ID NO: 661533 - protein, 17 aa, Mycobacterium
FTKVMAFEMLISNLGVQ

SEQ ID NO: 661534 - protein, 18 aa, Mycobacterium
FTKYAGFHLSALRAIVGD

SEQ ID NO: 661535 - protein, 19 aa, Mycobacterium
FTLADSRFLFFPTAVHGHA

SEQ ID NO: 661536 - protein, 20 aa, Mycobacterium
FTLAERKKLAALAFQHTAEY

SEQ ID NO: 661537 - protein, 18 aa, Mycobacterium
FTLDPEANIVFAYLATQS

SEQ ID NO: 661538 - protein, 26 aa, Mycobacterium
FTLEARKVLAAKAFRHTAEYDVAVAG

SEQ ID NO: 661539 - protein, 24 aa, Mycobacterium
FTLKGSHSVRVFIGSGMPAGLWKR

SEQ ID NO: 661540 - protein, 19 aa, Mycobacterium
FTLKMYDFMFGDRDPVAEP

SEQ ID NO: 661541 - protein, 17 aa, Mycobacterium
FTLPELIGLTSSCDVVL

SEQ ID NO: 661542 - protein, 24 aa, Mycobacterium
FTLPPKEFGAAWQVVVYTGPDETT

SEQ ID NO: 661543 - protein, 22 aa, Mycobacterium
FTLPPVEFGSGWRVVVATAAAT

SEQ ID NO: 661544 - protein, 20 aa, Mycobacterium
FTLPTGWRHGHAICLAMAGA

SEQ ID NO: 661545 - protein, 23 aa, Mycobacterium
FTLRRTDGLPVWIYQFKISPHPS

SEQ ID NO: 661546 - protein, 17 aa, Mycobacterium
FTLRVGRPVGPMLAQTA

SEQ ID NO: 661547 - protein, 19 aa, Mycobacterium
FTLRVGRPVGPMLAQTATG

SEQ ID NO: 661548 - protein, 21 aa, Mycobacterium
FTLSGGHLFSVYDGCREEGIR

SEQ ID NO: 661549 - protein, 20 aa, Mycobacterium
FTLTGTKVWCSGAGFCTHAL

SEQ ID NO: 661550 - protein, 20 aa, Mycobacterium
FTLTKGLVFRRRIGEVRAVD

SEQ ID NO: 661551 - protein, 17 aa, Mycobacterium
FTLVLHTHLPWLAHHGR

SEQ ID NO: 661552 - protein, 26 aa, Mycobacterium
FTMNCLSWIEALGFCGIGEAREFLDG

SEQ ID NO: 661553 - protein, 24 aa, Mycobacterium
FTNAARADWLWRVVGESGHVAVLS

SEQ ID NO: 661554 - protein, 19 aa, Mycobacterium
FTNDYEWDLLLSKTGWTEA

SEQ ID NO: 661555 - protein, 19 aa, Mycobacterium
FTNDYEWELLLSKTGWSEA

SEQ ID NO: 661556 - protein, 19 aa, Mycobacterium
FTNHMFLPAPAAVPPPPDP

SEQ ID NO: 661557 - protein, 25 aa, Mycobacterium
FTNICYTGCRFCAFAQRKGDADAFS

SEQ ID NO: 661558 - protein, 20 aa, Mycobacterium
FTNLLPAGSVPELVSQNFTN

SEQ ID NO: 661559 - protein, 27 aa, Mycobacterium
FTNYALRMEAAWGREYRRGRIMHKLIG

SEQ ID NO: 661560 - protein, 18 aa, Mycobacterium
FTPDGWMRMGDICEIDAD

SEQ ID NO: 661561 - protein, 29 aa, Mycobacterium
FTPDYYCLDYRAAGLTPQSWFARQAGLVD

SEQ ID NO: 661562 - protein, 24 aa, Mycobacterium
FTPGDEVYGLIGFDRDGAAAEFVC

SEQ ID NO: 661563 - protein, 18 aa, Mycobacterium
FTPGMSALCQGRMTPQAA

SEQ ID NO: 661564 - protein, 24 aa, Mycobacterium
FTPGSWRSEPLPGVPDNATTQIVA

SEQ ID NO: 661565 - protein, 20 aa, Mycobacterium
FTPGYVLRVLEWMPRQGSRN

SEQ ID NO: 661566 - protein, 24 aa, Mycobacterium
FTPHEVALEYAIAASLVHHGLGTI

SEQ ID NO: 661567 - protein, 22 aa, Mycobacterium
FTPKIGYPATWRDYSTITIRRD

SEQ ID NO: 661568 - protein, 17 aa, Mycobacterium
FTPLGRLTLNRVLGPDQ

SEQ ID NO: 661569 - protein, 18 aa, Mycobacterium
FTPLNFEATDLAWSENDS

SEQ ID NO: 661570 - protein, 27 aa, Mycobacterium
FTPLPEVRSQLALTWGTETFIVPVMET

SEQ ID NO: 661571 - protein, 26 aa, Mycobacterium
FTPPAPRYKTGVLAKYVKLVGSAAIG

SEQ ID NO: 661572 - protein, 19 aa, Mycobacterium
FTPPSPRYQTGVLAKYVKL

SEQ ID NO: 661573 - protein, 18 aa, Mycobacterium
FTPPYAVAHIQLRGADTR

SEQ ID NO: 661574 - protein, 20 aa, Mycobacterium
FTPRLWDAAIHYNLTQVFYL

SEQ ID NO: 661575 - protein, 17 aa, Mycobacterium
FTPRRMAALEDQIRQYC

SEQ ID NO: 661576 - protein, 17 aa, Mycobacterium
FTPSPSLGIPALRQLAA

SEQ ID NO: 661577 - protein, 25 aa, Mycobacterium
FTPTELLRWVHPSLVASTQGTGMGG

SEQ ID NO: 661578 - protein, 17 aa, Mycobacterium
FTPTLAFVRDTVPDAAH

SEQ ID NO: 661579 - protein, 18 aa, Mycobacterium
FTPTPAVSHAILAYNRGR

SEQ ID NO: 661580 - protein, 26 aa, Mycobacterium
FTPVFLRNATAFGFSPRLRADIVLNN

SEQ ID NO: 661581 - protein, 23 aa, Mycobacterium
FTQERLDQVQAWLADKPGTSVLI

SEQ ID NO: 661582 - protein, 19 aa, Mycobacterium
FTQGIPTTAGMAIHRDFRP

SEQ ID NO: 661583 - protein, 18 aa, Mycobacterium
FTQGRALAELEFDGPAEI

SEQ ID NO: 661584 - protein, 20 aa, Mycobacterium
FTQLRPLLFTIAYEILGSAT

SEQ ID NO: 661585 - protein, 24 aa, Mycobacterium
FTQRARAGAVMLIDGAPGIVIAPR

SEQ ID NO: 661586 - protein, 23 aa, Mycobacterium
FTQRLYAVVWHGHRLAKRRSIGF

SEQ ID NO: 661587 - protein, 24 aa, Mycobacterium
FTQRRYNRMTAYRASKLACMLFGS

SEQ ID NO: 661588 - protein, 18 aa, Mycobacterium
FTQVGAPRAGLTCDTDAP

SEQ ID NO: 661589 - protein, 21 aa, Mycobacterium
FTRAALPGMVERGAGAVLNIA

SEQ ID NO: 661590 - protein, 19 aa, Mycobacterium
FTRAGYRCVTFDNRGIGAT

SEQ ID NO: 661591 - protein, 22 aa, Mycobacterium
FTRAQLLHEVWGYDFFGGTRTV

SEQ ID NO: 661592 - protein, 22 aa, Mycobacterium
FTRARISAGLSRQDLARLSRTG

SEQ ID NO: 661593 - protein, 26 aa, Mycobacterium
FTRDSSIWIGPRFVIPSLAMRARVRE

SEQ ID NO: 661594 - protein, 24 aa, Mycobacterium
FTREKPGWLARGWERIAEEVAAGR

SEQ ID NO: 661595 - protein, 17 aa, Mycobacterium
FTRHDFAEPVSFVDFTI

SEQ ID NO: 661596 - protein, 18 aa, Mycobacterium
FTRIAAFRGGVAGNMDAC

SEQ ID NO: 661597 - protein, 22 aa, Mycobacterium
FTRIGCERIIRYAFELAASAGF

SEQ ID NO: 661598 - protein, 17 aa, Mycobacterium
FTRLPVRTAAGSRLAAL

SEQ ID NO: 661599 - protein, 17 aa, Mycobacterium
FTRLWSGARELLRTMSY

SEQ ID NO: 661600 - protein, 18 aa, Mycobacterium
FTRMGADAFAARAHRELL

SEQ ID NO: 661601 - protein, 17 aa, Mycobacterium
FTRMLKLPDRVRNSYDI

SEQ ID NO: 661602 - protein, 19 aa, Mycobacterium
FTRNKIKAAPVLWTQQVLT

SEQ ID NO: 661603 - protein, 24 aa, Mycobacterium
FTRNRLRIGGLDVQLAQLLTDKLG

SEQ ID NO: 661604 - protein, 25 aa, Mycobacterium
FTRPQGKFVIRRGAPYHVFAGEETA

SEQ ID NO: 661605 - protein, 30 aa, Mycobacterium
FTRRCGTPDAPALVLVHGFPTSSIDYFALA

SEQ ID NO: 661606 - protein, 17 aa, Mycobacterium
FTRRGIATELIRHQLRD

SEQ ID NO: 661607 - protein, 17 aa, Mycobacterium
FTRTLRAVVDWRGQIVT

SEQ ID NO: 661608 - protein, 17 aa, Mycobacterium
FTRTMPRVYPCRTCATP

SEQ ID NO: 661609 - protein, 21 aa, Mycobacterium
FTRTRLRQEVLPLLEDVLGGG

SEQ ID NO: 661610 - protein, 17 aa, Mycobacterium
FTRYAFPPNELGYCGPD

SEQ ID NO: 661611 - protein, 40 aa, Mycobacterium
FTSADRWTMFHSIAFDFSVWELWGPLLYGGCVVMVPYLET

SEQ ID NO: 661612 - protein, 18 aa, Mycobacterium
FTSAPGMQCNRRMFEEIV

SEQ ID NO: 661613 - protein, 25 aa, Mycobacterium
FTSDIKNLLPLFAVFKPTVVVSVPR

SEQ ID NO: 661614 - protein, 24 aa, Mycobacterium
FTSDIKNLVPMFAVFQPTLVVSVP

SEQ ID NO: 661615 - protein, 18 aa, Mycobacterium
FTSDPAFRQRYWARNHVG

SEQ ID NO: 661616 - protein, 20 aa, Mycobacterium
FTSDPVFRQRYWARNHVGWR

SEQ ID NO: 661617 - protein, 31 aa, Mycobacterium
FTSDPVFRRRYWARNHLGWRHMDDTQPNAGH

SEQ ID NO: 661618 - protein, 30 aa, Mycobacterium
FTSDQEVRWCPGCGDYVILNTIRGFLPELG

SEQ ID NO: 661619 - protein, 30 aa, Mycobacterium; identical to SEQ ID NO: 79901

SEQ ID NO: 661620 - protein, 18 aa, Mycobacterium
FTSGLLLGSSAQVFNSGQ

SEQ ID NO: 661621 - protein, 17 aa, Mycobacterium
FTSGVFSSGAFTSGFFN

SEQ ID NO: 661622 - protein, 19 aa, Mycobacterium
FTSKEDFAFDLSARNVAAL

SEQ ID NO: 661623 - protein, 24 aa, Mycobacterium
FTSKLELYLAVLARHVENLVSGVQ

SEQ ID NO: 661624 - protein, 17 aa, Mycobacterium
FTSLKIPFFTDGVPPFF

SEQ ID NO: 661625 - protein, 18 aa, Mycobacterium
FTSLMAIYDTMQYVRSDI

SEQ ID NO: 661626 - protein, 27 aa, Mycobacterium
FTSLPEVRSQLALTWGTETFIVPHIDT

SEQ ID NO: 661627 - protein, 29 aa, Mycobacterium
FTSRGGLMGQAWLRAGRRFLAVQTALVDD

SEQ ID NO: 661628 - protein, 17 aa, Mycobacterium
FTSSFVFDEDGAFSYTS

SEQ ID NO: 661629 - protein, 17 aa, Mycobacterium
FTSSIGTIGLRAGGPAD

SEQ ID NO: 661630 - protein, 20 aa, Mycobacterium
FTSSKVMCWVALDRGAKLAA

SEQ ID NO: 661631 - protein, 20 aa, Mycobacterium
FTSSVWRIAQAHQHFAPVYV

SEQ ID NO: 661632 - protein, 24 aa, Mycobacterium
FTSVRGGAYFFLPGISALRYLAAL

SEQ ID NO: 661633 - protein, 25 aa, Mycobacterium
FTTEPRPRIDLEVGSWYVSTHPGSH

SEQ ID NO: 661634 - protein, 19 aa, Mycobacterium
FTTGFPLTLALDALGAPIV

SEQ ID NO: 661635 - protein, 20 aa, Mycobacterium
FTTHCLLRVQGRTSGRTYIK

SEQ ID NO: 661636 - protein, 23 aa, Mycobacterium
FTTHGLPFLHDWTPDAVPPGWSV

SEQ ID NO: 661637 - protein, 17 aa, Mycobacterium
FTTKYPAALSITGGLSW

SEQ ID NO: 661638 - protein, 29 aa, Mycobacterium
FTTLGYRQSLFWAWLIYGGRLLRGRLPRI

SEQ ID NO: 661639 - protein, 17 aa, Mycobacterium
FTTLMGRDSDRMADIKL

SEQ ID NO: 661640 - protein, 17 aa, Mycobacterium
FTTQVLFTPEQLWPFTS

SEQ ID NO: 661641 - protein, 30 aa, Mycobacterium
FTTRGCPYRCTFCGTGAMSAILGRNSYRAK

SEQ ID NO: 661642 - protein, 29 aa, Mycobacterium
FTTRGCPYRCTFCGTGAVSAMLGRTSYRV

SEQ ID NO: 661643 - protein, 20 aa, Mycobacterium
FTTTLFSRFWRVRDISRSGL

SEQ ID NO: 661644 - protein, 20 aa, Mycobacterium
FTTVIWRKLVLNALAGLMAL

SEQ ID NO: 661645 - protein, 17 aa, Mycobacterium
FTTVWNAVVSELNGDPT

SEQ ID NO: 661646 - protein, 18 aa, Mycobacterium
FTVADAYQGKGIGSFLIG

SEQ ID NO: 661647 - protein, 18 aa, Mycobacterium
FTVADAYQGRGIGSFLIG

SEQ ID NO: 661648 - protein, 18 aa, Mycobacterium
FTVADAYQGRGIGTFLIN

SEQ ID NO: 661649 - protein, 17 aa, Mycobacterium
FTVADAYQGRGIGTYLI

SEQ ID NO: 661650 - protein, 25 aa, Mycobacterium
FTVAERELARLGLERTPGSALNVII

SEQ ID NO: 661651 - protein, 18 aa, Mycobacterium
FTVDGRGFIPTKYAQSHW

SEQ ID NO: 661652 - protein, 17 aa, Mycobacterium
FTVDGWDKSFGVNLRGP

SEQ ID NO: 661653 - protein, 17 aa, Mycobacterium
FTVDPFAALILAANIGW

SEQ ID NO: 661654 - protein, 22 aa, Mycobacterium
FTVEGGKLWLLQTRDAERSAQA

SEQ ID NO: 661655 - protein, 19 aa, Mycobacterium
FTVEGLATVIPFHRAVVSD

SEQ ID NO: 661656 - protein, 29 aa, Mycobacterium
FTVEIPDRADLAFLPGQYVNITVPGTDIT

SEQ ID NO: 661657 - protein, 22 aa, Mycobacterium
FTVESGKLWLLQTRAAERSAQA

SEQ ID NO: 661658 - protein, 22 aa, Mycobacterium
FTVESGKLWLLQTRSAERSAQA

SEQ ID NO: 661659 - protein, 18 aa, Mycobacterium
FTVFPGSDADVIGRPDEL

SEQ ID NO: 661660 - protein, 25 aa, Mycobacterium
FTVGDTLWAPTFVRDFPVETTPLTR

SEQ ID NO: 661661 - protein, 18 aa, Mycobacterium
FTVPPAWAAFTGKTLVLV

SEQ ID NO: 661662 - protein, 17 aa, Mycobacterium
FTVRMDLGGAPLFGPVG

SEQ ID NO: 661663 - protein, 18 aa, Mycobacterium
FTVVCKFAAGALTGEQAE

SEQ ID NO: 661664 - protein, 19 aa, Mycobacterium
FTVVLPRSEGIEYAIEHAV

SEQ ID NO: 661665 - protein, 21 aa, Mycobacterium
FTVVWPRRDGVEYSIEHAVVG

SEQ ID NO: 661666 - protein, 31 aa, Mycobacterium
FTWEHPAHLFVRRARTGLQLFGSSAQHRERY

SEQ ID NO: 661667 - protein, 21 aa, Mycobacterium
FTWEHPCHLYVRRARSGLQLF

SEQ ID NO: 661668 - protein, 20 aa, Mycobacterium
FTWENDVQFALKRAKAGELL

SEQ ID NO: 661669 - protein, 17 aa, Mycobacterium
FTWQGRRELVSQIHEQL

SEQ ID NO: 661670 - protein, 17 aa, Mycobacterium
FTYGLLYQREADLAQRC

SEQ ID NO: 661671 - protein, 18 aa, Mycobacterium
FTYLCPGAGHAPHHVFKE

SEQ ID NO: 661672 - protein, 21 aa, Mycobacterium
FTYRFSVPHSGTYWAHPHVGL

SEQ ID NO: 661673 - protein, 25 aa, Mycobacterium
FTYTERKKLAALAFRHTAEYDVAVA

SEQ ID NO: 661674 - protein, 18 aa, Mycobacterium
FVAAAATDLARIGTTITS

SEQ ID NO: 661675 - protein, 28 aa, Mycobacterium
FVAADPSCGWGWLPYRAAPERAVAAVAD

SEQ ID NO: 661676 - protein, 21 aa, Mycobacterium
FVAAGIRKTWIFQAFDDEHEV

SEQ ID NO: 661677 - protein, 21 aa, Mycobacterium
FVAAGPRPAWRARTDGRPTIC

SEQ ID NO: 661678 - protein, 21 aa, Mycobacterium
FVAAHVPYLAWLLQNSANATA

SEQ ID NO: 661679 - protein, 24 aa, Mycobacterium
FVAALERPRRVLIMVKAGDPTDAV

SEQ ID NO: 661680 - protein, 19 aa, Mycobacterium
FVAALHAIWSAWRDGGKLR

SEQ ID NO: 661681 - protein, 20 aa, Mycobacterium
FVAALHAIWSVWKDGGKLRF

SEQ ID NO: 661682 - protein, 31 aa, Mycobacterium
FVAARRFAIPAVESKGSLLLEDVGVPLPALA

SEQ ID NO: 661683 - protein, 21 aa, Mycobacterium
FVAATGRPLIGNGANGAPGTG

SEQ ID NO: 661684 - protein, 17 aa, Mycobacterium
FVACEALGLAGDDPRGV

SEQ ID NO: 661685 - protein, 23 aa, Mycobacterium
FVACLRRELGRFVEAVRGDIDLT

SEQ ID NO: 661686 - protein, 19 aa, Mycobacterium
FVACPFGEPGARMYRTGDL

SEQ ID NO: 661687 - protein, 20 aa, Mycobacterium
FVACPFGEPGTRMYRTGDLV

SEQ ID NO: 661688 - protein, 17 aa, Mycobacterium
FVACPFGGEGARMYRTG

SEQ ID NO: 661689 - protein, 17 aa, Mycobacterium
FVACPFGGTAGSRMYRT

SEQ ID NO: 661690 - protein, 24 aa, Mycobacterium
FVADLLPQVFRWARSVDPIQPLTS

SEQ ID NO: 661691 - protein, 17 aa, Mycobacterium
FVADRCGTGTAALCAFG

SEQ ID NO: 661692 - protein, 17 aa, Mycobacterium
FVADRCRCRVTAVDLTD

SEQ ID NO: 661693 - protein, 18 aa, Mycobacterium
FVADVAGFDAEFFGISAR

SEQ ID NO: 661694 - protein, 23 aa, Mycobacterium
FVADVGAAFARLVRDSLEQPATQ

SEQ ID NO: 661695 - protein, 17 aa, Mycobacterium
FVADVVIRTRAWENQIY

SEQ ID NO: 661696 - protein, 25 aa, Mycobacterium
FVAEFLPHDVLLPLVDVLVTNGGYG

SEQ ID NO: 661697 - protein, 17 aa, Mycobacterium
FVAEMKAAGLSRLLEAK

SEQ ID NO: 661698 - protein, 23 aa, Mycobacterium
FVAESRLGTEIAVARATNALVPE

SEQ ID NO: 661699 - protein, 19 aa, Mycobacterium
FVAEWTMTAEDRWLQFSSV

SEQ ID NO: 661700 - protein, 17 aa, Mycobacterium
FVAGVGRPLSESSQNDE

SEQ ID NO: 661701 - protein, 19 aa, Mycobacterium
FVAHLPAAVDPGTRVAAEK

SEQ ID NO: 661702 - protein, 19 aa, Mycobacterium
FVAHSVWQRMGDAFLGAVA

SEQ ID NO: 661703 - protein, 17 aa, Mycobacterium
FVAIPLANTLKGVHAVR

SEQ ID NO: 661704 - protein, 17 aa, Mycobacterium
FVALPLLAGYDLDDPNP

SEQ ID NO: 661705 - protein, 25 aa, Mycobacterium
FVANPFGGPGARMYRTGDLVCWGED

SEQ ID NO: 661706 - protein, 25 aa, Mycobacterium
FVANPFGGPGARMYRTGDLVCWGPD

SEQ ID NO: 661707 - protein, 18 aa, Mycobacterium
FVAQLGFAVAPRVREAIE

SEQ ID NO: 661708 - protein, 25 aa, Mycobacterium
FVARASTLFLRRGEQPPGPRFTTTV

SEQ ID NO: 661709 - protein, 29 aa, Mycobacterium
FVARRLLAERVMIVFACREKITELRGFPE

SEQ ID NO: 661710 - protein, 18 aa, Mycobacterium
FVASALRAREGGIDGIEL

SEQ ID NO: 661711 - protein, 28 aa, Mycobacterium
FVASEANVIWKLRYTMRSQIFSRGLPLP

SEQ ID NO: 661712 - protein, 17 aa, Mycobacterium
FVASRRWTTSRLAKKYG

SEQ ID NO: 661713 - protein, 27 aa, Mycobacterium
FVATVYERLWRPAAFYLASGVTTRAEQ

SEQ ID NO: 661714 - protein, 17 aa, Mycobacterium
FVAWQAARCVASWNGSR

SEQ ID NO: 661715 - protein, 18 aa, Mycobacterium
FVAYAVRDWCRFNSAGSL

SEQ ID NO: 661716 - protein, 21 aa, Mycobacterium
FVCAVDMPLVAPALIDELAAG

SEQ ID NO: 661717 - protein, 17 aa, Mycobacterium
FVCDQLAAATPWWEPGT

SEQ ID NO: 661718 - protein, 19 aa, Mycobacterium
FVCLLTCPEGIAAVQEAHP

SEQ ID NO: 661719 - protein, 17 aa, Mycobacterium
FVCLVTCPEGVAALTGA

SEQ ID NO: 661720 - protein, 21 aa, Mycobacterium
FVCSIRAWAYQIADLATDYRV

SEQ ID NO: 661721 - protein, 25 aa, Mycobacterium
FVDAGFRTGFVVARNAATGAALADR

SEQ ID NO: 661722 - protein, 17 aa, Mycobacterium
FVDAMVAIRGEIDLVMW

SEQ ID NO: 661723 - protein, 27 aa, Mycobacterium
FVDDISRPGMLHACFVRSPFARATIRG

SEQ ID NO: 661724 - protein, 18 aa, Mycobacterium
FVDEFGRTWQSVIPEETD

SEQ ID NO: 661725 - protein, 24 aa, Mycobacterium
FVDEPRWRRLWVGVQGMVRATWLV

SEQ ID NO: 661726 - protein, 18 aa, Mycobacterium
FVDEYLWALDSLHRHGAR

SEQ ID NO: 661727 - protein, 22 aa, Mycobacterium
FVDFPMDYVFSMSDDDGRPGAL

SEQ ID NO: 661728 - protein, 23 aa, Mycobacterium
FVDGKGVPCLIAIDQDPKGEGQA

SEQ ID NO: 661729 - protein, 17 aa, Mycobacterium
FVDMALAVGDYVGCPAV

SEQ ID NO: 661730 - protein, 17 aa, Mycobacterium
FVDPDVLIRTNWQVTNR

SEQ ID NO: 661731 - protein, 19 aa, Mycobacterium
FVDPFAMVLPIRLSGTRPP

SEQ ID NO: 661732 - protein, 18 aa, Mycobacterium
FVDRARALGISRVALAAA

SEQ ID NO: 661733 - protein, 18 aa, Mycobacterium
FVDRGYHAAGMDEIADRA

SEQ ID NO: 661734 - protein, 17 aa, Mycobacterium
FVDRIKPVGALVVCVDD

SEQ ID NO: 661735 - protein, 26 aa, Mycobacterium
FVDRLVKRAATIVVGPTRDWDTDLGP

SEQ ID NO: 661736 - protein, 20 aa, Mycobacterium
FVDSLLRWGLTRWWQGHRFY

SEQ ID NO: 661737 - protein, 25 aa, Mycobacterium
FVEACKGVSVPLRLTSPAPCTTCHG

SEQ ID NO: 661738 - protein, 22 aa, Mycobacterium
FVEDRLKDMIISGGENIYSIEV

SEQ ID NO: 661739 - protein, 17 aa, Mycobacterium
FVEEFILDQTMEPALAD

SEQ ID NO: 661740 - protein, 22 aa, Mycobacterium
FVEELLARYGIAPSPEAGAERI

SEQ ID NO: 661741 - protein, 18 aa, Mycobacterium
FVEETGTTPMQWITDQRV

SEQ ID NO: 661742 - protein, 18 aa, Mycobacterium
FVEFSRQRGVAVDGRCKS

SEQ ID NO: 661743 - protein, 23 aa, Mycobacterium
FVEHLKGMFAFAIAERDTGRVLL

SEQ ID NO: 661744 - protein, 17 aa, Mycobacterium
FVEHMGLLLQRPVVTIS

SEQ ID NO: 661745 - protein, 19 aa, Mycobacterium
FVEIAGRYGYLLATPEENA

SEQ ID NO: 661746 - protein, 26 aa, Mycobacterium
FVEILPTPFLPAGIFDQWGLDADDRR

SEQ ID NO: 661747 - protein, 22 aa, Mycobacterium
FVEIRRAAGLSAELTVIEAAMA

SEQ ID NO: 661748 - protein, 19 aa, Mycobacterium
FVELPARGDSPGVVRFLPM

SEQ ID NO: 661749 - protein, 18 aa, Mycobacterium
FVELSAYAEGLGFAGVLA

SEQ ID NO: 661750 - protein, 24 aa, Mycobacterium
FVEMFTKLGGLMAERVTDLRDIRD

SEQ ID NO: 661751 - protein, 23 aa, Mycobacterium
FVEQRVRVQLARWTYPLEGEEGA

SEQ ID NO: 661752 - protein, 18 aa, Mycobacterium
FVERAVTFTTCPECDGTR

SEQ ID NO: 661753 - protein, 17 aa, Mycobacterium
FVERIRLHQLAVGNHSA

SEQ ID NO: 661754 - protein, 17 aa, Mycobacterium
FVERLARRIFNFQTRNY

SEQ ID NO: 661755 - protein, 17 aa, Mycobacterium
FVERLTLAPAQQRKKLL

SEQ ID NO: 661756 - protein, 17 aa, Mycobacterium
FVERWRSPVRRVLTADL

SEQ ID NO: 661757 - protein, 24 aa, Mycobacterium
FVESRLAPRLYRRNQYVTVSLPSA

SEQ ID NO: 661758 - protein, 19 aa, Mycobacterium
FVESVPPHILIAIDEAYVE

SEQ ID NO: 661759 - protein, 24 aa, Mycobacterium
FVETLGLGRYVIWLHDYGSQFGFQ

SEQ ID NO: 661760 - protein, 23 aa, Mycobacterium
FVEVRRAGIALAREVERRAPDAV

SEQ ID NO: 661761 - protein, 23 aa, Mycobacterium
FVEVRRAGIALAREVERRAPEAV

SEQ ID NO: 661762 - protein, 27 aa, Mycobacterium
FVEYAEFLPGALLVPAIHLVRAAHLGQ

SEQ ID NO: 661763 - protein, 18 aa, Mycobacterium
FVEYARRRGSVLATGEVL

SEQ ID NO: 661764 - protein, 20 aa, Mycobacterium
FVFAEVWQRPALTRRQRRFV

SEQ ID NO: 661765 - protein, 20 aa, Mycobacterium
FVFAEVWQRPGLTRRERRFV

SEQ ID NO: 661766 - protein, 18 aa, Mycobacterium
FVFARAASTLDNLSNGRI

SEQ ID NO: 661767 - protein, 21 aa, Mycobacterium
FVFDSLADLVAFVRSDTDNDL

SEQ ID NO: 661768 - protein, 17 aa, Mycobacterium
FVFHSAQVREDRLHQQL

SEQ ID NO: 661769 - protein, 25 aa, Mycobacterium
FVFPTHCPECGSELAPAKEGDADIR

SEQ ID NO: 661770 - protein, 23 aa, Mycobacterium
FVFTVPKLRAAEQVTAAVWVCEA

SEQ ID NO: 661771 - protein, 23 aa, Mycobacterium
FVFTVPKLRAGDQVGAAVQLCEA

SEQ ID NO: 661772 - protein, 18 aa, Mycobacterium
FVGAPAHREHWSRLTDAV

SEQ ID NO: 661773 - protein, 36 aa, Mycobacterium
FVGATSRPSALSLDDVVKFLLPRGAAKKAAKGAAST

SEQ ID NO: 661774 - protein, 35 aa, Mycobacterium
FVGATSRPSALTLDDVVKFLLPRGAAKKTAKAAST

SEQ ID NO: 661775 - protein, 36 aa, Mycobacterium
FVGATSRPSALTLDDVVKFLLPRGATKKAAKGAATT

SEQ ID NO: 661776 - protein, 20 aa, Mycobacterium
FVGAWPRSGGKIDYDAMRAE

SEQ ID NO: 661777 - protein, 19 aa, Mycobacterium
FVGECRDGGRLMELPLDGG

SEQ ID NO: 661778 - protein, 23 aa, Mycobacterium
FVGELRAGLRAADCALFVIAANE

SEQ ID NO: 661779 - protein, 24 aa, Mycobacterium
FVGELRAGLRAADCALFVIAANET

SEQ ID NO: 661780 - protein, 20 aa, Mycobacterium
FVGEVEYLLSTGLRDGVTAS

SEQ ID NO: 661781 - protein, 17 aa, Mycobacterium
FVGFRAREIILSLFESI

SEQ ID NO: 661782 - protein, 18 aa, Mycobacterium
FVGFRGREIVLTLFEKIS

SEQ ID NO: 661783 - protein, 18 aa, Mycobacterium
FVGFRGREIVLTLFESIT

SEQ ID NO: 661784 - protein, 23 aa, Mycobacterium
FVGFRRACEAIARVEVPVIAAVE

SEQ ID NO: 661785 - protein, 18 aa, Mycobacterium
FVGHLEHAELLAVLHRAD

SEQ ID NO: 661786 - protein, 24 aa, Mycobacterium
FVGREMKHKLSLRASNTSELHLDD

SEQ ID NO: 661787 - protein, 31 aa, Mycobacterium
FVHAAAVRHLWTLAPGRVFLGLGSGTSRMNK

SEQ ID NO: 661788 - protein, 20 aa, Mycobacterium
FVHAHPRWIAQAFADALGPA

SEQ ID NO: 661789 - protein, 19 aa, Mycobacterium
FVHFQWRAQHDDLKNLPFP

SEQ ID NO: 661790 - protein, 19 aa, Mycobacterium
FVHFQWRAQHEDLKKLPFP

SEQ ID NO: 661791 - protein, 19 aa, Mycobacterium
FVHFQWRAQHEDLKTLPFP

SEQ ID NO: 661792 - protein, 17 aa, Mycobacterium
FVHLTLILLRSMGIPGR

SEQ ID NO: 661793 - protein, 20 aa, Mycobacterium
FVIATPEILTAASSDLAAVG

SEQ ID NO: 661794 - protein, 25 aa, Mycobacterium
FVIEPLEPGFGYTLGNSLRRTLLSS

SEQ ID NO: 661795 - protein, 23 aa, Mycobacterium
FVIGASNRFAHAAALAIAEAPAR

SEQ ID NO: 661796 - protein, 21 aa, Mycobacterium
FVIGASNRFAHAASLAIAEAP

SEQ ID NO: 661797 - protein, 20 aa, Mycobacterium
FVIGASNRFSHAAAVAVSEA

SEQ ID NO: 661798 - protein, 29 aa, Mycobacterium
FVIGHDWGAPVAWTFAWLYPQRCAGVVGI

SEQ ID NO: 661799 - protein, 31 aa, Mycobacterium
FVILNWRAVCGQCRACKRGRPHLCFDTHNAA

SEQ ID NO: 661800 - protein, 18 aa, Mycobacterium
FVILRPAPSGTRLLLSDA

SEQ ID NO: 661801 - protein, 23 aa, Mycobacterium
FVILRPAPSGTRLLLSDATAALD

SEQ ID NO: 661802 - protein, 18 aa, Mycobacterium
FVIRRAILAIERVELRLL

SEQ ID NO: 661803 - protein, 18 aa, Mycobacterium
FVISGRWPDSTKEWAQLL

SEQ ID NO: 661804 - protein, 20 aa, Mycobacterium
FVISPYSRGGLMVHDQFDHT

SEQ ID NO: 661805 - protein, 21 aa, Mycobacterium
FVKAVAGGGGRGMRRVAERDQ

SEQ ID NO: 661806 - protein, 24 aa, Mycobacterium
FVKDKPAWLDRAWRRITEEVSAGR

SEQ ID NO: 661807 - protein, 19 aa, Mycobacterium
FVKEQVCRFTITWLAAEAR

SEQ ID NO: 661808 - protein, 19 aa, Mycobacterium
FVKIFCRPATGVVIGGVVV

SEQ ID NO: 661809 - protein, 24 aa, Mycobacterium
FVKLQEWVRHSGARLVVVFEGRDG

SEQ ID NO: 661810 - protein, 17 aa, Mycobacterium
FVKLVARCANVEGVGEV

SEQ ID NO: 661811 - protein, 26 aa, Mycobacterium
FVKNNGWPLAHTVIRHYKLHARASAD

SEQ ID NO: 661812 - protein, 33 aa, Mycobacterium
FVKPARAGSSFGVSRVTAWEELPAAIAHARQYD

SEQ ID NO: 661813 - protein, 17 aa, Mycobacterium
FVKPVLNLWEFAKPTIA

SEQ ID NO: 661814 - protein, 17 aa, Mycobacterium
FVLADTGLLDGRRATTH

SEQ ID NO: 661815 - protein, 24 aa, Mycobacterium
FVLDGWLRPVPPGTVGELYVAGTG

SEQ ID NO: 661816 - protein, 17 aa, Mycobacterium
FVLDLLADYGLDDFYLE

SEQ ID NO: 661817 - protein, 26 aa, Mycobacterium
FVLDRMRDAAAFVCTDTGIMLAQNAM

SEQ ID NO: 661818 - protein, 19 aa, Mycobacterium
FVLEGRLARHAVYPNLGVE

SEQ ID NO: 661819 - protein, 20 aa, Mycobacterium
FVLEIGWISGGWVPRLRPLV

SEQ ID NO: 661820 - protein, 30 aa, Mycobacterium
FVLGARLTVPVGMIILRKGYGLGAMAMAGG

SEQ ID NO: 661821 - protein, 27 aa, Mycobacterium
FVLLDGWKDLYLPVIELLEPRLSTGAL

SEQ ID NO: 661822 - protein, 31 aa, Mycobacterium
FVLLDGWKDLYLPVVRLLEPVLPAGALILAD

SEQ ID NO: 661823 - protein, 17 aa, Mycobacterium
FVLMLKLVQQMMVSSSA

SEQ ID NO: 661824 - protein, 18 aa, Mycobacterium
FVLPARPAENILFVSGGS

SEQ ID NO: 661825 - protein, 19 aa, Mycobacterium
FVLPLVRSDVRAMHSGATV

SEQ ID NO: 661826 - protein, 20 aa, Mycobacterium
FVLPPAVLEKMRFVHTVIDE

SEQ ID NO: 661827 - protein, 20 aa, Mycobacterium
FVLPPDRLAAAVLALTTAPG

SEQ ID NO: 661828 - protein, 20 aa, Mycobacterium
FVLRELRAGVHFNALSISGI

SEQ ID NO: 661829 - protein, 26 aa, Mycobacterium
FVLRELRGGVHFNLLALSGVTPVEAH

SEQ ID NO: 661830 - protein, 18 aa, Mycobacterium
FVLRGDSTLRGHVFAETE

SEQ ID NO: 661831 - protein, 31 aa, Mycobacterium
FVLRGGKRVRPAFAYWGWRSVIEPADAVAGP

SEQ ID NO: 661832 - protein, 17 aa, Mycobacterium
FVLTAGAGWTLAEAEVD

SEQ ID NO: 661833 - protein, 25 aa, Mycobacterium
FVLTLRLLTVALRRHVVLNATWMET

SEQ ID NO: 661834 - protein, 24 aa, Mycobacterium
FVLTLRLLVIALRHNEILNSAWVE

SEQ ID NO: 661835 - protein, 17 aa, Mycobacterium
FVLTRPCVLFSKLNPRI

SEQ ID NO: 661836 - protein, 17 aa, Mycobacterium
FVMCTNGMFVVPRRTPG

SEQ ID NO: 661837 - protein, 25 aa, Mycobacterium
FVMLAAEFGRWVGPFAAPSANRRRA

SEQ ID NO: 661838 - protein, 34 aa, Mycobacterium
FVMPTKGVWTSGFGYRWGVLHGGIDIANSIGTPI

SEQ ID NO: 661839 - protein, 25 aa, Mycobacterium
FVMPTTCPECGTPLAPEKEGDADIR

SEQ ID NO: 661840 - protein, 24 aa, Mycobacterium
FVMPTTCPECGTTLAPAKEGDADI

SEQ ID NO: 661841 - protein, 25 aa, Mycobacterium
FVMPTTCPECGTVLAPEKEGDADIR

SEQ ID NO: 661842 - protein, 19 aa, Mycobacterium
FVMRGGAFVGELDREALDH

SEQ ID NO: 661843 - protein, 21 aa, Mycobacterium
FVMSEGCVMVLLKRLDDAVRD

SEQ ID NO: 661844 - protein, 19 aa, Mycobacterium
FVNAARLARDAGFDGVEIH

SEQ ID NO: 661845 - protein, 18 aa, Mycobacterium
FVNCEVIGFVVTAPDSPT

SEQ ID NO: 661846 - protein, 20 aa, Mycobacterium
FVNDLLPAPVRAFPFNALLK

SEQ ID NO: 661847 - protein, 22 aa, Mycobacterium
FVNRFIPGFLRQGGSHVLLADV

SEQ ID NO: 661848 - protein, 26 aa, Mycobacterium
FVNRHGWRSLPQWPPATTERVLYLQP

SEQ ID NO: 661849 - protein, 25 aa, Mycobacterium
FVNSRPKPLSAYLFTKRRETRERVI

SEQ ID NO: 661850 - protein, 25 aa, Mycobacterium
FVNSRPKPLSAYLFTKSREIRERVI

SEQ ID NO: 661851 - protein, 25 aa, Mycobacterium
FVNSRPKPLSAYLFTKTRETRERVI

SEQ ID NO: 661852 - protein, 17 aa, Mycobacterium
FVNTFGVFATRRPYEQV

SEQ ID NO: 661853 - protein, 20 aa, Mycobacterium
FVNVCTWALHANTFPRFSAY

SEQ ID NO: 661854 - protein, 25 aa, Mycobacterium
FVNVYRVVSNLGVFDFGGPEHTMRA

SEQ ID NO: 661855 - protein, 25 aa, Mycobacterium
FVNVYRVVTNLGVFDFGGPDHTMRA

SEQ ID NO: 661856 - protein, 25 aa, Mycobacterium
FVNVYRVVTNLGVFDFNGPDHQMRA

SEQ ID NO: 661857 - protein, 24 aa, Mycobacterium
FVPAFSGLFAPYWRSDARGAIVGL

SEQ ID NO: 661858 - protein, 17 aa, Mycobacterium
FVPCHRVFRIGGALGGF

SEQ ID NO: 661859 - protein, 23 aa, Mycobacterium
FVPDPFVPGARMYRTGDVVRRAV

SEQ ID NO: 661860 - protein, 20 aa, Mycobacterium
FVPDVAGFDAEFFGITPREA

SEQ ID NO: 661861 - protein, 25 aa, Mycobacterium
FVPGDEVYGLIAFDRDGAAADFVAV

SEQ ID NO: 661862 - protein, 18 aa, Mycobacterium
FVPMPGLPLEAAITARQA

SEQ ID NO: 661863 - protein, 18 aa, Mycobacterium
FVPNPAAAALEAQVYPSP

SEQ ID NO: 661864 - protein, 25 aa, Mycobacterium
FVPPIPDRVDVVWLEHDEGPARAGG

SEQ ID NO: 661865 - protein, 20 aa, Mycobacterium
FVPPTLRGELTWCQLFSEPG

SEQ ID NO: 661866 - protein, 24 aa, Mycobacterium
FVPSAGAVLAEWGAEVIKVEPREG

SEQ ID NO: 661867 - protein, 18 aa, Mycobacterium
FVPSAGAVLGEWGADVIK

SEQ ID NO: 661868 - protein, 26 aa, Mycobacterium
FVPSHRWAVEGGWNIADCVERAYDLE

SEQ ID NO: 661869 - protein, 25 aa, Mycobacterium
FVPTWAGVAYVCFIVDAYSRMIVGW

SEQ ID NO: 661870 - protein, 19 aa, Mycobacterium
FVPVVGEILADLAISGATA

SEQ ID NO: 661871 - protein, 18 aa, Mycobacterium
FVPYFLGARTPEYPTATS

SEQ ID NO: 661872 - protein, 20 aa, Mycobacterium
FVQDWGSLIGLRIAAEQDAR

SEQ ID NO: 661873 - protein, 17 aa, Mycobacterium
FVQDWGSLIGLRVAAEH

SEQ ID NO: 661874 - protein, 18 aa, Mycobacterium
FVQIGAMTGETISVNAST

SEQ ID NO: 661875 - protein, 17 aa, Mycobacterium
FVQLLAALGRRYDGDER

SEQ ID NO: 661876 - protein, 18 aa, Mycobacterium
FVRDGELFIIGRIKDLLI

SEQ ID NO: 661877 - protein, 24 aa, Mycobacterium
FVRDWSEMFTMWPTKQTPGSRTQL

SEQ ID NO: 661878 - protein, 19 aa, Mycobacterium
FVRFCDSFNTPLVFVVDTP

SEQ ID NO: 661879 - protein, 22 aa, Mycobacterium
FVRGEGAGVVVLKRLTDALRDQ

SEQ ID NO: 661880 - protein, 21 aa, Mycobacterium
FVRGEGAGVVVLKRLTDAQQD

SEQ ID NO: 661881 - protein, 25 aa, Mycobacterium
FVRGLPRDRRPRVVAVDSVPDSVAA

SEQ ID NO: 661882 - protein, 18 aa, Mycobacterium
FVRGRPADFDGWAVSGWS

SEQ ID NO: 661883 - protein, 17 aa, Mycobacterium
FVRKVFNRLAMAANIGE

SEQ ID NO: 661884 - protein, 19 aa, Mycobacterium
FVRLLRYLPGGTLLESGYL

SEQ ID NO: 661885 - protein, 25 aa, Mycobacterium
FVRLQEWVRHAGARVVVIFEGRDAA

SEQ ID NO: 661886 - protein, 26 aa, Mycobacterium
FVRLRARVAAELSTTFASHYTREVSL

SEQ ID NO: 661887 - protein, 19 aa, Mycobacterium
FVRMLKLPKAVRERYDVSS

SEQ ID NO: 661888 - protein, 17 aa, Mycobacterium
FVRRGARWLAYDRETRA

SEQ ID NO: 661889 - protein, 18 aa, Mycobacterium
FVRRLVARASTLVVGDPM

SEQ ID NO: 661890 - protein, 21 aa, Mycobacterium
FVRRLWWRTVVDLPEDPLLHT

SEQ ID NO: 661891 - protein, 25 aa, Mycobacterium
FVRRPERWIRELARKEGDTGGTISV

SEQ ID NO: 661892 - protein, 25 aa, Mycobacterium
FVRRVRAALPPTSWGVRASGDPDAV

SEQ ID NO: 661893 - protein, 26 aa, Mycobacterium
FVRSACRWTPRVAFVNGHGGNVDALR

SEQ ID NO: 661894 - protein, 18 aa, Mycobacterium
FVRSCSAPLDPATAEAAE

SEQ ID NO: 661895 - protein, 24 aa, Mycobacterium
FVRSEGCAMVLLKRLPDALRDGNR

SEQ ID NO: 661896 - protein, 22 aa, Mycobacterium
FVRSPFARARINSIDASAALAL

SEQ ID NO: 661897 - protein, 20 aa, Mycobacterium
FVRSPFARATIRGIDTSAAL

SEQ ID NO: 661898 - protein, 29 aa, Mycobacterium
FVRSRPGLDLPDLELIFAPAPFYDEGLPA

SEQ ID NO: 661899 - protein, 26 aa, Mycobacterium
FVRSRRPGEIASIFVPSVPNLLQLAS

SEQ ID NO: 661900 - protein, 22 aa, Mycobacterium
FVRTSGYLAGPHDVYVSMNMVR

SEQ ID NO: 661901 - protein, 25 aa, Mycobacterium
FVSAIDVLVGLNWLAPSRLDIWRQG

SEQ ID NO: 661902 - protein, 17 aa, Mycobacterium
FVSDTIVLPGMVVPITL

SEQ ID NO: 661903 - protein, 18 aa, Mycobacterium
FVSEELFKVTDRCVQVLG

SEQ ID NO: 661904 - protein, 26 aa, Mycobacterium
FVSEGKCLRSTFMYLGWLCGAGPNNA

SEQ ID NO: 661905 - protein, 17 aa, Mycobacterium
FVSENFLGDTYHGATTH

SEQ ID NO: 661906 - protein, 26 aa, Mycobacterium
FVSGGKCLRSTFVYLGWLCGAPADPA

SEQ ID NO: 661907 - protein, 18 aa, Mycobacterium
FVSGGSRRNLEWVSPHID

SEQ ID NO: 661908 - protein, 23 aa, Mycobacterium
FVSGLGFKVSDLVKGHGAFLRCS

SEQ ID NO: 661909 - protein, 26 aa, Mycobacterium
FVSGPGDRPAWSMIFEDLGHRRRPAP

SEQ ID NO: 661910 - protein, 18 aa, Mycobacterium
FVSMANRIPFPLTAWAVR

SEQ ID NO: 661911 - protein, 17 aa, Mycobacterium
FVSNLRALVALRGAGSR

SEQ ID NO: 661912 - protein, 18 aa, Mycobacterium
FVSQLGFAVAPRVRDAIE

SEQ ID NO: 661913 - protein, 18 aa, Mycobacterium
FVSQLGFSVAPRVLEALI

SEQ ID NO: 661914 - protein, 18 aa, Mycobacterium
FVSQLGFTVAPRVLEALH

SEQ ID NO: 661915 - protein, 18 aa, Mycobacterium
FVSQLGFTVAPRVRAAIE

SEQ ID NO: 661916 - protein, 18 aa, Mycobacterium
FVSQLGFTVAPRVRRALE

SEQ ID NO: 661917 - protein, 18 aa, Mycobacterium
FVSQLGFTVAPRVRTAIE

SEQ ID NO: 661918 - protein, 26 aa, Mycobacterium
FVSRGKCLRSTFMYLGWLCGAAPSRA

SEQ ID NO: 661919 - protein, 22 aa, Mycobacterium
FVSRVGAVLPQTSWGVRAAGDP

SEQ ID NO: 661920 - protein, 19 aa, Mycobacterium
FVSTWKVFEEFARDGRARS

SEQ ID NO: 661921 - protein, 31 aa, Mycobacterium
FVSVWRAGAFGTLEWASLMFASIYLGMQQRI

SEQ ID NO: 661922 - protein, 17 aa, Mycobacterium
FVSYRQQRILAVADIGR

SEQ ID NO: 661923 - protein, 18 aa, Mycobacterium
FVTALGRAVVNRGATLRT

SEQ ID NO: 661924 - protein, 24 aa, Mycobacterium
FVTCTNCGPRFTIIRDLPYDRPGT

SEQ ID NO: 661925 - protein, 27 aa, Mycobacterium
FVTDPDTLRPMGWQDGVGIAFADVVTG

SEQ ID NO: 661926 - protein, 24 aa, Mycobacterium
FVTELRPELSVAVLEAKHVGAGAT

SEQ ID NO: 661927 - protein, 18 aa, Mycobacterium
FVTESYTTLAGRAEDDGE

SEQ ID NO: 661928 - protein, 25 aa, Mycobacterium
FVTGRLKDLIIIRGRNYYPEDIEAA

SEQ ID NO: 661929 - protein, 26 aa, Mycobacterium
FVTKDRWSMEWYYPILGGALRGPRAQ

SEQ ID NO: 661930 - protein, 17 aa, Mycobacterium
FVTKHVSLRGCVFDVAT

SEQ ID NO: 661931 - protein, 17 aa, Mycobacterium
FVTLPMRYLPPEREAEV

SEQ ID NO: 661932 - protein, 18 aa, Mycobacterium
FVTPFIWRMDTFGRPHLE

SEQ ID NO: 661933 - protein, 17 aa, Mycobacterium
FVTSGWFIGHLPLAVPV

SEQ ID NO: 661934 - protein, 19 aa, Mycobacterium
FVTYLGWLYSWGSPLTLIG

SEQ ID NO: 661935 - protein, 18 aa, Mycobacterium
FVVAGGFDDLTLEAIIGF

SEQ ID NO: 661936 - protein, 18 aa, Mycobacterium
FVVAPVRSVPGVASMVGY

SEQ ID NO: 661937 - protein, 29 aa, Mycobacterium
FVVATGRPPRWIRPVVDALGFAPIAVCAN

SEQ ID NO: 661938 - protein, 28 aa, Mycobacterium
FVVATGRPPRWIRPVVDALGFAPTAVCA

SEQ ID NO: 661939 - protein, 27 aa, Mycobacterium
FVVCNEILPRWGVETVFVDGDDLAQWE

SEQ ID NO: 661940 - protein, 27 aa, Mycobacterium
FVVCNEILPRWGVETVFVDGDDLEQWE

SEQ ID NO: 661941 - protein, 27 aa, Mycobacterium
FVVCNEILPRWGVETVFVDGEDISQWE

SEQ ID NO: 661942 - protein, 27 aa, Mycobacterium
FVVCNEILPRWGVETVFVDGEDLAQWE

SEQ ID NO: 661943 - protein, 18 aa, Mycobacterium
FVVDITMWIDLADAARSD

SEQ ID NO: 661944 - protein, 18 aa, Mycobacterium
FVVESGADIGLAFDGDAD

SEQ ID NO: 661945 - protein, 24 aa, Mycobacterium
FVVFEPNLLWGLWEEGVAVRGAAA

SEQ ID NO: 661946 - protein, 19 aa, Mycobacterium
FVVGMSLGGLTAIRLGAVA

SEQ ID NO: 661947 - protein, 18 aa, Mycobacterium
FVVIAGLQDGLWPNTVPR

SEQ ID NO: 661948 - protein, 21 aa, Mycobacterium
FVVINGCRRLAAAHKYGRTDL

SEQ ID NO: 661949 - protein, 17 aa, Mycobacterium
FVVIPARHPGVDHVDDW

SEQ ID NO: 661950 - protein, 18 aa, Mycobacterium
FVVLAGLQEGLWPNVSPR

SEQ ID NO: 661951 - protein, 19 aa, Mycobacterium
FVVLLVVHHICWDDNSWEV

SEQ ID NO: 661952 - protein, 17 aa, Mycobacterium
FVVLRSPEQRAVVAAAA

SEQ ID NO: 661953 - protein, 17 aa, Mycobacterium
FVVPNWMWHAHMNRSSE

SEQ ID NO: 661954 - protein, 26 aa, Mycobacterium
FVVPRGRSVPAFRQLWTSNLPALDDT

SEQ ID NO: 661955 - protein, 23 aa, Mycobacterium
FVVRLKGGDPFVFARGYEEVLAC

SEQ ID NO: 661956 - protein, 17 aa, Mycobacterium
FVVSGRWPDSTKEWAQL

SEQ ID NO: 661957 - protein, 18 aa, Mycobacterium
FVVSGRWPDSTKEWAQLL

SEQ ID NO: 661958 - protein, 18 aa, Mycobacterium
FVVSLEVRRSAVTDRADV

SEQ ID NO: 661959 - protein, 20 aa, Mycobacterium
FVWDAWTVGLQWWRRFGQDR

SEQ ID NO: 661960 - protein, 20 aa, Mycobacterium
FVWDAWTVGLQWWRRFGQER

SEQ ID NO: 661961 - protein, 24 aa, Mycobacterium
FVWIRKRYEVAEGHTPSVQFGNER

SEQ ID NO: 661962 - protein, 17 aa, Mycobacterium
FVYAVVPHDEWSEARPE

SEQ ID NO: 661963 - protein, 20 aa, Mycobacterium
FWAAGALRLPTDDGLTLLAD

SEQ ID NO: 661964 - protein, 25 aa, Mycobacterium
FWAAYCRPCQAFAPIYEKSARTHPD

SEQ ID NO: 661965 - protein, 18 aa, Mycobacterium
FWADPEIFETTDYNFETV

SEQ ID NO: 661966 - protein, 18 aa, Mycobacterium
FWADPEIFETTNYDFETI

SEQ ID NO: 661967 - protein, 18 aa, Mycobacterium
FWADPEIFETTQYDFETV

SEQ ID NO: 661968 - protein, 18 aa, Mycobacterium
FWADPEIFETTTYDFETV

SEQ ID NO: 661969 - protein, 21 aa, Mycobacterium
FWAFPRSCNPTGGLMSTARDQ

SEQ ID NO: 661970 - protein, 17 aa, Mycobacterium
FWAPLSLSAEQKRSIGD

SEQ ID NO: 661971 - protein, 17 aa, Mycobacterium
FWAPLSLTAEQKHSIDD

SEQ ID NO: 661972 - protein, 19 aa, Mycobacterium
FWAQDATAMYCYASTSTSF

SEQ ID NO: 661973 - protein, 18 aa, Mycobacterium
FWASLGWEPFYDSRPGPA

SEQ ID NO: 661974 - protein, 17 aa, Mycobacterium
FWAVTKHADIMAIERAN

SEQ ID NO: 661975 - protein, 22 aa, Mycobacterium
FWDYTGKEYLDFASQLVNLNLG

SEQ ID NO: 661976 - protein, 18 aa, Mycobacterium
FWERSESTVEGFVLPGYA

SEQ ID NO: 661977 - protein, 18 aa, Mycobacterium
FWETVLFRAGLYRGSALH

SEQ ID NO: 661978 - protein, 27 aa, Mycobacterium
FWFDPLCPWAWITSRWILEVEKVRDIE

SEQ ID NO: 661979 - protein, 28 aa, Mycobacterium
FWFDPLCPWAWITSRWVLEAEKVRDIEV

SEQ ID NO: 661980 - protein, 30 aa, Mycobacterium
FWFDPLCPWCWITSRWILEVEKVRDIEVQF

SEQ ID NO: 661981 - protein, 18 aa, Mycobacterium
FWFGEGVVPILRKRGLFD

SEQ ID NO: 661982 - protein, 18 aa, Mycobacterium
FWFSPALLHCQRRTNRVA

SEQ ID NO: 661983 - protein, 20 aa, Mycobacterium
FWFTEERLRTSSDPVSQRWL

SEQ ID NO: 661984 - protein, 17 aa, Mycobacterium
FWGGAGSLACQEFITQL

SEQ ID NO: 661985 - protein, 19 aa, Mycobacterium
FWGGPDGWRERQLPDGTVL

SEQ ID NO: 661986 - protein, 22 aa, Mycobacterium
FWGSLLPAVWSFMLALRSRGLG

SEQ ID NO: 661987 - protein, 34 aa, Mycobacterium
FWGSMEAVGGPSTWRLGGAFNCGKAQPGQVAPVS

SEQ ID NO: 661988 - protein, 25 aa, Mycobacterium
FWHSFRAEIALACGNVAGAKRCADE

SEQ ID NO: 661989 - protein, 17 aa, Mycobacterium
FWHWAVANLPATVTQLP

SEQ ID NO: 661990 - protein, 21 aa, Mycobacterium
FWLDYADGMQPYFTVAATGIE

SEQ ID NO: 661991 - protein, 18 aa, Mycobacterium
FWLLERFAPALGSRWATE

SEQ ID NO: 661992 - protein, 18 aa, Mycobacterium
FWLQQRPGISTAEEAFSG

SEQ ID NO: 661993 - protein, 22 aa, Mycobacterium
FWLREDTELVAPWAGDVVASTG

SEQ ID NO: 661994 - protein, 17 aa, Mycobacterium
FWLTLAPTNRLVTARNR

SEQ ID NO: 661995 - protein, 17 aa, Mycobacterium
FWMLPLDDPLPWLLVDR

SEQ ID NO: 661996 - protein, 24 aa, Mycobacterium
FWMLPVDDLLPWLLVDRRAAKVTR

SEQ ID NO: 661997 - protein, 25 aa, Mycobacterium
FWNGFEMDGCYPASIPIDGVALNIT

SEQ ID NO: 661998 - protein, 21 aa, Mycobacterium
FWNREYDILVCTTIIETGLDI

SEQ ID NO: 661999 - protein, 22 aa, Mycobacterium
FWNREYDILVCTTIVETGLDIS

SEQ ID NO: 662000 - protein, 22 aa, Mycobacterium
FWNRRLTAVEAIVQRALVRGEV

SEQ ID NO: 662001 - protein, 25 aa, Mycobacterium
FWPDFPADGLYKFRVHGADGVVSER

SEQ ID NO: 662002 - protein, 25 aa, Mycobacterium
FWPDFPTNGLYKFRVHGADGVVTER

SEQ ID NO: 662003 - protein, 20 aa, Mycobacterium
FWPHGEVSRAYGVFNDDAGY

SEQ ID NO: 662004 - protein, 18 aa, Mycobacterium
FWPTSAIRAALQGGDIAT

SEQ ID NO: 662005 - protein, 24 aa, Mycobacterium
FWPVVSRPRMRGHDGPSSGPEADG

SEQ ID NO: 662006 - protein, 19 aa, Mycobacterium
FWQSARAGILESLGRPGGE

SEQ ID NO: 662007 - protein, 18 aa, Mycobacterium
FWQSYLQHRDQLLPFYES

SEQ ID NO: 662008 - protein, 17 aa, Mycobacterium
FWRAEVVEVIDPSPDRV

SEQ ID NO: 662009 - protein, 18 aa, Mycobacterium
FWRDNRFQAFEGIAVPKF

SEQ ID NO: 662010 - protein, 21 aa, Mycobacterium
FWREFPLGPAGKILKREIANQ

SEQ ID NO: 662011 - protein, 18 aa, Mycobacterium
FWRGLCPHMTIEGASAVT

SEQ ID NO: 662012 - protein, 20 aa, Mycobacterium
FWRHQLQGLIPCLFPATRSG

SEQ ID NO: 662013 - protein, 20 aa, Mycobacterium
FWRPNYRSTALVDGKASVTA

SEQ ID NO: 662014 - protein, 22 aa, Mycobacterium
FWSELPEVFAALDADRDVRAIV

SEQ ID NO: 662015 - protein, 17 aa, Mycobacterium
FWSELPVVFRELDADPD

SEQ ID NO: 662016 - protein, 18 aa, Mycobacterium
FWSTAAIRAALEGGDIAT

SEQ ID NO: 662017 - protein, 21 aa, Mycobacterium
FWSVVTGVYSPQSWTTIPGGP

SEQ ID NO: 662018 - protein, 18 aa, Mycobacterium
FWTAEPIDLVGPTAARHP

SEQ ID NO: 662019 - protein, 19 aa, Mycobacterium
FWTGDPSNLEWALEQGNSS

SEQ ID NO: 662020 - protein, 17 aa, Mycobacterium
FWTPPGIYTVLDKGNPV

SEQ ID NO: 662021 - protein, 19 aa, Mycobacterium
FWTQFGRVVKEGLLSDFDN

SEQ ID NO: 662022 - protein, 18 aa, Mycobacterium
FWTVMHGFVMLELAGFWG

SEQ ID NO: 662023 - protein, 21 aa, Mycobacterium
FWTYPEWAPRRVGADQFVVHA

SEQ ID NO: 662024 - protein, 20 aa, Mycobacterium
FWVQVGIDPIRIMTSSGTFY

SEQ ID NO: 662025 - protein, 22 aa, Mycobacterium
FWYQIPISLPVIGPRMISDLES

SEQ ID NO: 662026 - protein, 26 aa, Mycobacterium
FYAALEFWSALHGFVLLEMTGVMDDV

SEQ ID NO: 662027 - protein, 17 aa, Mycobacterium
FYAAVLHHWPDSAWWNW

SEQ ID NO: 662028 - protein, 17 aa, Mycobacterium
FYADLIFDRDIKVSARP

SEQ ID NO: 662029 - protein, 28 aa, Mycobacterium
FYAEVAPRLGGPIAPCYHAAVDAQTGAF

SEQ ID NO: 662030 - protein, 17 aa, Mycobacterium
FYAGLLASYPLVSIEDP

SEQ ID NO: 662031 - protein, 21 aa, Mycobacterium
FYAKRGFTVSGTRTFQLGPHQ

SEQ ID NO: 662032 - protein, 19 aa, Mycobacterium
FYAKSGFRISGTRTFRLGA

SEQ ID NO: 662033 - protein, 18 aa, Mycobacterium
FYAQCAIDAKVAFVNALP

SEQ ID NO: 662034 - protein, 18 aa, Mycobacterium
FYAVALLRSREVMPSRLR

SEQ ID NO: 662035 - protein, 19 aa, Mycobacterium
FYAVCGWDAVNDAISRPED

SEQ ID NO: 662036 - protein, 21 aa, Mycobacterium
FYDADREAAAWMRAGAPEGRM

SEQ ID NO: 662037 - protein, 19 aa, Mycobacterium
FYDAIARGGWLGMTIPTEY

SEQ ID NO: 662038 - protein, 18 aa, Mycobacterium
FYDDVRIPLSNVVGDVGE

SEQ ID NO: 662039 - protein, 23 aa, Mycobacterium
FYDELRAAGPLVKGRVSYLTADH

SEQ ID NO: 662040 - protein, 19 aa, Mycobacterium
FYDFLGRHGDSWTIVRRQP

SEQ ID NO: 662041 - protein, 26 aa, Mycobacterium
FYDGVIFHRVIEGFMIQGGDPTGTGR

SEQ ID NO: 662042 - protein, 23 aa, Mycobacterium
FYDIPKTKMCPAPTAPIPILVGG

SEQ ID NO: 662043 - protein, 18 aa, Mycobacterium
FYDLIVVGGGPAGLAAAV

SEQ ID NO: 662044 - protein, 22 aa, Mycobacterium
FYDPQHPYTWGLLGSLPRVEDT

SEQ ID NO: 662045 - protein, 21 aa, Mycobacterium
FYDQLYKLLGLEQLTDAINLL

SEQ ID NO: 662046 - protein, 25 aa, Mycobacterium
FYDRTLEGFTMFALNQGETCTCPSR

SEQ ID NO: 662047 - protein, 18 aa, Mycobacterium
FYDSCRVLPQGDEQPTDL

SEQ ID NO: 662048 - protein, 18 aa, Mycobacterium
FYDVPSMKVCPVPTHPIP

SEQ ID NO: 662049 - protein, 19 aa, Mycobacterium
FYEAALLDALARRRDAELE

SEQ ID NO: 662050 - protein, 31 aa, Mycobacterium
FYELASGRFGWSFEHLHKVQAFHFKGGQGAK

SEQ ID NO: 662051 - protein, 20 aa, Mycobacterium
FYEPRWEPLEEEIEGQPAPT

SEQ ID NO: 662052 - protein, 19 aa, Mycobacterium
FYERDGWNFDGTRRTEIIG

SEQ ID NO: 662053 - protein, 17 aa, Mycobacterium
FYFGGEHGVEGSIARAG

SEQ ID NO: 662054 - protein, 17 aa, Mycobacterium
FYFGGEHGVEGSIAREG

SEQ ID NO: 662055 - protein, 18 aa, Mycobacterium
FYFLEMNTRLQVEHPVTE

SEQ ID NO: 662056 - protein, 17 aa, Mycobacterium
FYFLTGRGALLQLGLLQ

SEQ ID NO: 662057 - protein, 18 aa, Mycobacterium
FYFVYRVDLQTDDGAAQQ

SEQ ID NO: 662058 - protein, 28 aa, Mycobacterium
FYGDIAPRLGGPIAPCYHAAVDTATGVF

SEQ ID NO: 662059 - protein, 28 aa, Mycobacterium
FYGDIAPRLGGPIAPCYHAAVDTSTGVF

SEQ ID NO: 662060 - protein, 24 aa, Mycobacterium
FYGKRAYHALTFGWLLAGLARSVT

SEQ ID NO: 662061 - protein, 20 aa, Mycobacterium
FYGPLHEYFIRRAVDAVRPG

SEQ ID NO: 662062 - protein, 20 aa, Mycobacterium
FYGRRLYDLMSDYWPTADED

SEQ ID NO: 662063 - protein, 17 aa, Mycobacterium
FYHAPVLHQGQYTKDEA

SEQ ID NO: 662064 - protein, 18 aa, Mycobacterium
FYHAPVLHQGQYTKEEAA

SEQ ID NO: 662065 - protein, 24 aa, Mycobacterium
FYHHYNAAFAKRNGMDPLWRDLHT

SEQ ID NO: 662066 - protein, 25 aa, Mycobacterium
FYHLGWLCVWAVLEAVAEPGSAAMA

SEQ ID NO: 662067 - protein, 24 aa, Mycobacterium
FYHYPAEHWIHLRTTNPIESTFAT

SEQ ID NO: 662068 - protein, 40 aa, Mycobacterium
FYLAVEPWVQYGFNLASWAVGWVPWIGILAPQINFFYYLF

SEQ ID NO: 662069 - protein, 20 aa, Mycobacterium
FYLDELEAIIREWIAVIYHH

SEQ ID NO: 662070 - protein, 22 aa, Mycobacterium
FYLEGRLARHAVYPTMGPEPQD

SEQ ID NO: 662071 - protein, 17 aa, Mycobacterium
FYLLAEQKLRGSHHLGH

SEQ ID NO: 662072 - protein, 22 aa, Mycobacterium
FYLSRLQVINWGVFDGYHSIPF

SEQ ID NO: 662073 - protein, 17 aa, Mycobacterium
FYNFPVKLLKRVRDAQR

SEQ ID NO: 662074 - protein, 18 aa, Mycobacterium
FYNLGLAGRAMRRIGAIE

SEQ ID NO: 662075 - protein, 19 aa, Mycobacterium
FYNMCRHRGNKLVWNDYPG

SEQ ID NO: 662076 - protein, 18 aa, Mycobacterium
FYNRRLRAATTRFSVRMK

SEQ ID NO: 662077 - protein, 18 aa, Mycobacterium
FYNSGLRLLRHARDAEKS

SEQ ID NO: 662078 - protein, 17 aa, Mycobacterium
FYNSGLRLLRHVRDAGF

SEQ ID NO: 662079 - protein, 26 aa, Mycobacterium
FYNTRIEALLIAKLGVRFAETPAKRG

SEQ ID NO: 662080 - protein, 18 aa, Mycobacterium
FYNVCRHRGNKLVWNDFP

SEQ ID NO: 662081 - protein, 18 aa, Mycobacterium
FYNVCRHRGNKLVWNDYP

SEQ ID NO: 662082 - protein, 17 aa, Mycobacterium
FYQALGYELDFETDHNS

SEQ ID NO: 662083 - protein, 18 aa, Mycobacterium
FYQCDSHVLALGYIGMTL

SEQ ID NO: 662084 - protein, 25 aa, Mycobacterium
FYQFLGADTGMWAQWLTLPAAAGPI

SEQ ID NO: 662085 - protein, 26 aa, Mycobacterium
FYQVTRLIGALPRLEGTVHVNVAQIL

SEQ ID NO: 662086 - protein, 22 aa, Mycobacterium
FYRELVGLPLFETFGDSFGSNG

SEQ ID NO: 662087 - protein, 23 aa, Mycobacterium
FYRELVGLPLFETFGESYGSNGA

SEQ ID NO: 662088 - protein, 18 aa, Mycobacterium
FYRGVGLTIHEGYGLTET

SEQ ID NO: 662089 - protein, 19 aa, Mycobacterium
FYRGVGLTIHEGYGLTETS

SEQ ID NO: 662090 - protein, 19 aa, Mycobacterium
FYRIAEQKLAAALPAPGTG

SEQ ID NO: 662091 - protein, 17 aa, Mycobacterium
FYRLRHARLDTEPYEGR

SEQ ID NO: 662092 - protein, 17 aa, Mycobacterium
FYRRLDAGQPWTWETVS

SEQ ID NO: 662093 - protein, 19 aa, Mycobacterium
FYRVLELVPQLSWPRPYHP

SEQ ID NO: 662094 - protein, 18 aa, Mycobacterium
FYSFAGMVVDPCAVQDRV

SEQ ID NO: 662095 - protein, 22 aa, Mycobacterium
FYSFRNAYSYPKPVRPQGVPLY

SEQ ID NO: 662096 - protein, 19 aa, Mycobacterium
FYSGADLPELGYTYREYRA

SEQ ID NO: 662097 - protein, 20 aa, Mycobacterium
FYSLDDPWITSAMAEMQQNG

SEQ ID NO: 662098 - protein, 18 aa, Mycobacterium
FYSQFAPGIPEWNLRGTI

SEQ ID NO: 662099 - protein, 22 aa, Mycobacterium
FYSSAPLRFGDYVAKLQYVPLS

SEQ ID NO: 662100 - protein, 21 aa, Mycobacterium
FYSSGVLHIWTRKKLNPSVLR

SEQ ID NO: 662101 - protein, 26 aa, Mycobacterium
FYSTGDAEELLWLQAPPPATGSGTSG

SEQ ID NO: 662102 - protein, 18 aa, Mycobacterium
FYTEGSGYAFEKETRTAE

SEQ ID NO: 662103 - protein, 29 aa, Mycobacterium
FYTPGNFFGTMCDFFGLSSFSAMDAAEDA

SEQ ID NO: 662104 - protein, 18 aa, Mycobacterium
FYTYRYFASEGFLPGYSF

SEQ ID NO: 662105 - protein, 20 aa, Mycobacterium
FYVNIWKLDGVSGDWALVHH

SEQ ID NO: 662106 - protein, 18 aa, Mycobacterium
FYVRAPGGWDIEFGTDGM

SEQ ID NO: 662107 - protein, 18 aa, Mycobacterium
FYWAHATFFMLIIKTAEY

SEQ ID NO: 662108 - protein, 19 aa, Mycobacterium
FYWAHATFFMLIIKTAEYF

SEQ ID NO: 662109 - protein, 17 aa, Mycobacterium
FYYDFDVAEPFTPEHLQ

SEQ ID NO: 662110 - protein, 18 aa, Mycobacterium
GAAAAPYVAWLGATATRA

SEQ ID NO: 662111 - protein, 17 aa, Mycobacterium
GAAAARMQSRIALEELL

SEQ ID NO: 662112 - protein, 24 aa, Mycobacterium
GAAAAVELACWDLAAKLNDEPAYA

SEQ ID NO: 662113 - protein, 25 aa, Mycobacterium
GAAACLRAADWLFPQYRELGVYLVR

SEQ ID NO: 662114 - protein, 26 aa, Mycobacterium
GAAADRLDAILARRPIRLHPDRPNNY

SEQ ID NO: 662115 - protein, 19 aa, Mycobacterium
GAAADSFASVTSGLVGQAW

SEQ ID NO: 662116 - protein, 18 aa, Mycobacterium
GAAADWPLVIADADNPST

SEQ ID NO: 662117 - protein, 19 aa, Mycobacterium
GAAAGRAAVAPSVRQPAGQ

SEQ ID NO: 662118 - protein, 24 aa, Mycobacterium
GAAAGRGGGQLVLPSGKTVQEVLD

SEQ ID NO: 662119 - protein, 17 aa, Mycobacterium
GAAAHLPAAPYLHLFLA

SEQ ID NO: 662120 - protein, 24 aa, Mycobacterium
GAAAHNCRLCRSLREGTALDAGGS

SEQ ID NO: 662121 - protein, 25 aa, Mycobacterium
GAAAIKRRGGLVIAQSPTDALFPAM

SEQ ID NO: 662122 - protein, 23 aa, Mycobacterium
GAAAKLWRGAMQLGIEMRVGPVG

SEQ ID NO: 662123 - protein, 25 aa, Mycobacterium
GAAALLHRVEVDAGRRADELLLAAL

SEQ ID NO: 662124 - protein, 19 aa, Mycobacterium
GAAALWFALETNLPVIVDA

SEQ ID NO: 662125 - protein, 17 aa, Mycobacterium
GAAAMAGGFIYLGGGTA

SEQ ID NO: 662126 - protein, 17 aa, Mycobacterium
GAAAMAGGFIYLGGGTP

SEQ ID NO: 662127 - protein, 20 aa, Mycobacterium
GAAAPLALLARRARGAGAKR

SEQ ID NO: 662128 - protein, 18 aa, Mycobacterium
GAAARIVADMSGPHQVGG

SEQ ID NO: 662129 - protein, 26 aa, Mycobacterium
GAAARVALDIATRYALQRKQFSAPDD

SEQ ID NO: 662130 - protein, 26 aa, Mycobacterium
GAAARVALDIATRYALQRRQFEDPDG

SEQ ID NO: 662131 - protein, 18 aa, Mycobacterium
GAAARYLGAIGMAAVEAH

SEQ ID NO: 662132 - protein, 18 aa, Mycobacterium
GAAATRLRPQDGLYTVTE

SEQ ID NO: 662133 - protein, 27 aa, Mycobacterium
GAAATSRPAVRMGWVSSELAMFRGDGP

SEQ ID NO: 662134 - protein, 20 aa, Mycobacterium
GAAAVVMCRADLAHKYTNKP

SEQ ID NO: 662135 - protein, 22 aa, Mycobacterium
GAAAWRGLFERNDVDPGAVDDV

SEQ ID NO: 662136 - protein, 21 aa, Mycobacterium
GAACAKALAERGVTVTVADID

SEQ ID NO: 662137 - protein, 21 aa, Mycobacterium
GAACPTCAEQPGIAASATVAA

SEQ ID NO: 662138 - protein, 25 aa, Mycobacterium
GAACWDARAWLGRPGLEHGASADLL

SEQ ID NO: 662139 - protein, 17 aa, Mycobacterium
GAADADQGPAWWDGTVI

SEQ ID NO: 662140 - protein, 20 aa, Mycobacterium
GAADKLMRPGGIVDLLTAPG

SEQ ID NO: 662141 - protein, 19 aa, Mycobacterium
GAADLRFGSARVAVTAGYP

SEQ ID NO: 662142 - protein, 19 aa, Mycobacterium
GAADLSFGGAPVVLTAGYP

SEQ ID NO: 662143 - protein, 19 aa, Mycobacterium
GAADLSFGGARVVLTAGYP

SEQ ID NO: 662144 - protein, 25 aa, Mycobacterium
GAADQCPLLAVGHAYSQWLDNSDRV

SEQ ID NO: 662145 - protein, 20 aa, Mycobacterium
GAADRLAAWSQISGLDLTTL

SEQ ID NO: 662146 - protein, 28 aa, Mycobacterium
GAADRLTGRPGYRFVPHDICDPSVVDEV

SEQ ID NO: 662147 - protein, 28 aa, Mycobacterium
GAADRLVMLGLPFLFFIHADYGCAGVLY

SEQ ID NO: 662148 - protein, 18 aa, Mycobacterium
GAADVALFGIQQVVQPTD

SEQ ID NO: 662149 - protein, 19 aa, Mycobacterium
GAADWSKRPLPAEWLNYAA

SEQ ID NO: 662150 - protein, 22 aa, Mycobacterium
GAAEAEAAVLFLGLTADEESEG

SEQ ID NO: 662151 - protein, 17 aa, Mycobacterium
GAAEALIALATLPSTAA

SEQ ID NO: 662152 - protein, 23 aa, Mycobacterium
GAAEALRLGIVDVVAADVHSAAD

SEQ ID NO: 662153 - protein, 22 aa, Mycobacterium
GAAEALRWAMLAGEPHVVLADA

SEQ ID NO: 662154 - protein, 21 aa, Mycobacterium
GAAEALRWAMMAGEPHVVLAD

SEQ ID NO: 662155 - protein, 22 aa, Mycobacterium
GAAEKARFRPGPGPRTIDLDGW

SEQ ID NO: 662156 - protein, 17 aa, Mycobacterium
GAAELPGAVSLDDALAT

SEQ ID NO: 662157 - protein, 25 aa, Mycobacterium
GAAELRARLRLAVTRRRRARKGTLE

SEQ ID NO: 662158 - protein, 22 aa, Mycobacterium
GAAELRSLRIARFGDNMRDVAV

SEQ ID NO: 662159 - protein, 24 aa, Mycobacterium
GAAELSLATAEWVAFYNRQRPNGY

SEQ ID NO: 662160 - protein, 25 aa, Mycobacterium
GAAERALTLAVEWAKDRVQGGQPLI

SEQ ID NO: 662161 - protein, 26 aa, Mycobacterium
GAAERWPRAGALGPLIRDPDGSVYPS

SEQ ID NO: 662162 - protein, 26 aa, Mycobacterium
GAAEYVFRFAPLVGIYGGTLEVFRNM

SEQ ID NO: 662163 - protein, 18 aa, Mycobacterium
GAAFAIELARRGGALVCS

SEQ ID NO: 662164 - protein, 24 aa, Mycobacterium
GAAFDCILAMPVLADRMLRTARQR

SEQ ID NO: 662165 - protein, 17 aa, Mycobacterium
GAAFFMPTLMKGGSMVV

SEQ ID NO: 662166 - protein, 29 aa, Mycobacterium
GAAFGGRLPELAARLSAALSASLSGSLSA

SEQ ID NO: 662167 - protein, 18 aa, Mycobacterium
GAAFRWIRVHLLRRWCRG

SEQ ID NO: 662168 - protein, 29 aa, Mycobacterium
GAAGAAHPACAAVAKQPRTSTATPATATS

SEQ ID NO: 662169 - protein, 19 aa, Mycobacterium
GAAGARLAAAVSEAGGLGM

SEQ ID NO: 662170 - protein, 29 aa, Mycobacterium
GAAGAVTVPVNFLAHAGSDGGIGTGGNGG

SEQ ID NO: 662171 - protein, 24 aa, Mycobacterium
GAAGDLASGVGLPGGAGGHAGLFG

SEQ ID NO: 662172 - protein, 36 aa, Mycobacterium
GAAGEAGETGTWGNAGLPGKAGDAGGAGAVGAAGAA

SEQ ID NO: 662173 - protein, 19 aa, Mycobacterium
GAAGFKLHEDWGTTPAVID

SEQ ID NO: 662174 - protein, 30 aa, Mycobacterium
GAAGGAGGSAWLLGTGGTGGAGGWAAAGAT

SEQ ID NO: 662175 - protein, 29 aa, Mycobacterium
GAAGGKGGNAVLFGAGGNGGIGGTGAVGG

SEQ ID NO: 662176 - protein, 28 aa, Mycobacterium
GAAGGLGGRGGLLLGNGGAGGVGGVGAT

SEQ ID NO: 662177 - protein, 18 aa, Mycobacterium
GAAGGVVRAKYGWTDVSR

SEQ ID NO: 662178 - protein, 19 aa, Mycobacterium
GAAGIALLAGMPPRPGERD

SEQ ID NO: 662179 - protein, 18 aa, Mycobacterium
GAAGLCFGTGDAHDAVPD

SEQ ID NO: 662180 - protein, 19 aa, Mycobacterium
GAAGLECWTGAADGECCGS

SEQ ID NO: 662181 - protein, 25 aa, Mycobacterium
GAAGLLGADPWEWVLTGGEDHALVG

SEQ ID NO: 662182 - protein, 19 aa, Mycobacterium
GAAGLLWGTAGAGGAGGSA

SEQ ID NO: 662183 - protein, 24 aa, Mycobacterium
GAAGLRAAWLTMIAVASTHQGLGV

SEQ ID NO: 662184 - protein, 17 aa, Mycobacterium
GAAGLWGDGGAGGAGGQ

SEQ ID NO: 662185 - protein, 17 aa, Mycobacterium
GAAGLWGTGGTGGAGAR

SEQ ID NO: 662186 - protein, 23 aa, Mycobacterium
GAAGPAGGNGYDGGQGGAGGTGG

SEQ ID NO: 662187 - protein, 20 aa, Mycobacterium
GAAGRAWVTEQWRWDHHAAR

SEQ ID NO: 662188 - protein, 24 aa, Mycobacterium
GAAGRISHGLGLIGPSVCVDSACA

SEQ ID NO: 662189 - protein, 24 aa, Mycobacterium
GAAGRLPVSYSRKVFIPVTHLCRD

SEQ ID NO: 662190 - protein, 20 aa, Mycobacterium
GAAGRSRAQSRFAWERIALD

SEQ ID NO: 662191 - protein, 27 aa, Mycobacterium
GAAGRVALDIATRYALQRRQFSAPDDG

SEQ ID NO: 662192 - protein, 28 aa, Mycobacterium
GAAGTAATARPAISCDATDCVGVTAGAP

SEQ ID NO: 662193 - protein, 17 aa, Mycobacterium
GAAGVAMGTRFLLTSDS

SEQ ID NO: 662194 - protein, 19 aa, Mycobacterium
GAAGVAMGTRFLLTSDSTV

SEQ ID NO: 662195 - protein, 26 aa, Mycobacterium
GAAGVCFPDLLLLRGEYQMRLDPPFI

SEQ ID NO: 662196 - protein, 26 aa, Mycobacterium
GAAGVCFPDLLMLRGEYQMKVPAPFV

SEQ ID NO: 662197 - protein, 18 aa, Mycobacterium
GAAHGGAVAHLFDSLLGF

SEQ ID NO: 662198 - protein, 18 aa, Mycobacterium
GAAHGGLARELLGDFPVR

SEQ ID NO: 662199 - protein, 17 aa, Mycobacterium
GAAIALAFAEAGADVVI

SEQ ID NO: 662200 - protein, 18 aa, Mycobacterium
GAAIFVGRVLARDSYLLT

SEQ ID NO: 662201 - protein, 19 aa, Mycobacterium
GAAIGDVRFEYPIVADAPK

SEQ ID NO: 662202 - protein, 28 aa, Mycobacterium
GAAIKEAICKGTVWSIRHEAAKPGSYFW

SEQ ID NO: 662203 - protein, 18 aa, Mycobacterium
GAAIWHMAWSDKDDAIDW

SEQ ID NO: 662204 - protein, 20 aa, Mycobacterium
GAAKHARKVAAWGADAMIVQ

SEQ ID NO: 662205 - protein, 22 aa, Mycobacterium
GAAKLGNAVGYVYPHNDRDGVV

SEQ ID NO: 662206 - protein, 21 aa, Mycobacterium
GAAKPVMVWLHGGAYMLGSAS

SEQ ID NO: 662207 - protein, 17 aa, Mycobacterium
GAAKRGANVVLLAKTAQ

SEQ ID NO: 662208 - protein, 17 aa, Mycobacterium
GAALAGGLARIGHEVAI

SEQ ID NO: 662209 - protein, 17 aa, Mycobacterium
GAALALVKEITWGVMAD

SEQ ID NO: 662210 - protein, 21 aa, Mycobacterium
GAALARLEARIVLAMLLERTT

SEQ ID NO: 662211 - protein, 25 aa, Mycobacterium
GAALARLESTIALERLLDFMPRYEV

SEQ ID NO: 662212 - protein, 17 aa, Mycobacterium
GAALARMESRIALGALL

SEQ ID NO: 662213 - protein, 23 aa, Mycobacterium
GAALARRGCVYVSVNYRLGALGC

SEQ ID NO: 662214 - protein, 21 aa, Mycobacterium
GAALDHLRVAMAAAQWQPSIS

SEQ ID NO: 662215 - protein, 24 aa, Mycobacterium
GAALEALATILARRGTASPPVASP

SEQ ID NO: 662216 - protein, 20 aa, Mycobacterium
GAALEALATILTRRAVTSPP

SEQ ID NO: 662217 - protein, 18 aa, Mycobacterium
GAALEYKAGERLPVEIPE

SEQ ID NO: 662218 - protein, 24 aa, Mycobacterium
GAALFPVHCWFEGDGWGMRVYPEL

SEQ ID NO: 662219 - protein, 17 aa, Mycobacterium
GAALFPVLGTPTGELNL

SEQ ID NO: 662220 - protein, 19 aa, Mycobacterium
GAALFVLDGWLRPVPPGTV

SEQ ID NO: 662221 - protein, 19 aa, Mycobacterium
GAALGIGGALHPEWDVFNN

SEQ ID NO: 662222 - protein, 24 aa, Mycobacterium
GAALGNGIGRYALNKACTYARERR

SEQ ID NO: 662223 - protein, 18 aa, Mycobacterium
GAALGQRAVALVHERADV

SEQ ID NO: 662224 - protein, 17 aa, Mycobacterium
GAALLQLLLASWADDEI

SEQ ID NO: 662225 - protein, 26 aa, Mycobacterium
GAALPRNSRVLLLWGAANRDPAHFDA

SEQ ID NO: 662226 - protein, 19 aa, Mycobacterium
GAALPYKRRLFGQIVAAAV

SEQ ID NO: 662227 - protein, 20 aa, Mycobacterium
GAALRIAFRALTLAGVHGGQ

SEQ ID NO: 662228 - protein, 26 aa, Mycobacterium
GAALRKARTALAEFRIEGVRTNIDFL

SEQ ID NO: 662229 - protein, 21 aa, Mycobacterium
GAALRRGAPVVVTRHGEPRLC

SEQ ID NO: 662230 - protein, 17 aa, Mycobacterium
GAALRRLDLDDVPAGTP

SEQ ID NO: 662231 - protein, 25 aa, Mycobacterium
GAALRVPLIAVILRRGYGLGAQAMA

SEQ ID NO: 662232 - protein, 20 aa, Mycobacterium
GAALSDWGADVIKVEGVAAG

SEQ ID NO: 662233 - protein, 20 aa, Mycobacterium
GAALSDWGADVIKVEGVASG

SEQ ID NO: 662234 - protein, 20 aa, Mycobacterium
GAALSDWGADVIKVEGVTSG

SEQ ID NO: 662235 - protein, 19 aa, Mycobacterium
GAAMKLGQALSVFEAAIPP

SEQ ID NO: 662236 - protein, 32 aa, Mycobacterium
GAAMSRLSALAGYRWITPMSYTLPFRTPTGVR

SEQ ID NO: 662237 - protein, 20 aa, Mycobacterium
GAANRGDYNTGWYNTGNYST

SEQ ID NO: 662238 - protein, 17 aa, Mycobacterium
GAAPGMPVCHFGVVTGE

SEQ ID NO: 662239 - protein, 17 aa, Mycobacterium
GAAPKLGVVGVLKGPLR

SEQ ID NO: 662240 - protein, 25 aa, Mycobacterium
GAAPLRAAALAWKGLAHELSSHALA

SEQ ID NO: 662241 - protein, 29 aa, Mycobacterium
GAAPSTWMPATRVSRADWRELFTANLETM

SEQ ID NO: 662242 - protein, 21 aa, Mycobacterium
GAAPVRLGPTVLRTSSAAAVA

SEQ ID NO: 662243 - protein, 19 aa, Mycobacterium
GAAPYLIKRGYIEVMVDVR

SEQ ID NO: 662244 - protein, 17 aa, Mycobacterium
GAAQHNCRLCKSLREGT

SEQ ID NO: 662245 - protein, 17 aa, Mycobacterium
GAAQHNCRLCKSLREST

SEQ ID NO: 662246 - protein, 18 aa, Mycobacterium
GAAQHNCRLCNSLREGGA

SEQ ID NO: 662247 - protein, 18 aa, Mycobacterium
GAAQLLGKRCGACRLEID

SEQ ID NO: 662248 - protein, 25 aa, Mycobacterium
GAAQRAGIELLAFGGRFIELGKRDI

SEQ ID NO: 662249 - protein, 29 aa, Mycobacterium
GAAQRAGLELLAWGGRFVEIGKRDIYGDT

SEQ ID NO: 662250 - protein, 30 aa, Mycobacterium
GAAQRAGLELLAWGGRFVEIGKRDIYGDTK

SEQ ID NO: 662251 - protein, 29 aa, Mycobacterium
GAAQRAGLELLSWGGRFVEIGKRDIYGDT

SEQ ID NO: 662252 - protein, 25 aa, Mycobacterium
GAAQRAGVELLAFGGRFVEIGKRDI

SEQ ID NO: 662253 - protein, 26 aa, Mycobacterium
GAAQRAGVELLTFGGRFIEIGKRDIY

SEQ ID NO: 662254 - protein, 17 aa, Mycobacterium
GAAQRCPDRPGLIDELG

SEQ ID NO: 662255 - protein, 17 aa, Mycobacterium
GAAQVIGSGGSGGAAGT

SEQ ID NO: 662256 - protein, 23 aa, Mycobacterium
GAARAAGFALVIGVDRAGHGDAL

SEQ ID NO: 662257 - protein, 17 aa, Mycobacterium
GAARAAGVFDRLPDGVS

SEQ ID NO: 662258 - protein, 17 aa, Mycobacterium
GAARAALDSGPWGKADP

SEQ ID NO: 662259 - protein, 19 aa, Mycobacterium
GAARAIKWAHAIELNDPTP

SEQ ID NO: 662260 - protein, 23 aa, Mycobacterium
GAARGPWTAAVSRCAEYRAETRV

SEQ ID NO: 662261 - protein, 24 aa, Mycobacterium
GAARIAAGFTHWADGNGWTSAAVR

SEQ ID NO: 662262 - protein, 22 aa, Mycobacterium
GAARISHSLGLIGPSISVDTAC

SEQ ID NO: 662263 - protein, 17 aa, Mycobacterium
GAARLYAEMQVRLEELV

SEQ ID NO: 662264 - protein, 17 aa, Mycobacterium
GAARMFGFTAADALGQS

SEQ ID NO: 662265 - protein, 21 aa, Mycobacterium
GAARMFKGYALAAEGISDATV

SEQ ID NO: 662266 - protein, 24 aa, Mycobacterium
GAARRLGVPEERWVFLHGHADMVD

SEQ ID NO: 662267 - protein, 26 aa, Mycobacterium
GAARSGIGIVEGWRGTIVHRVEIDAG

SEQ ID NO: 662268 - protein, 19 aa, Mycobacterium
GAARYRADIGIKDGKIVDV

SEQ ID NO: 662269 - protein, 23 aa, Mycobacterium
GAASAWPVVPWVVSGKSDQALAA

SEQ ID NO: 662270 - protein, 18 aa, Mycobacterium
GAASGFAGDGGRGGQGAV

SEQ ID NO: 662271 - protein, 23 aa, Mycobacterium
GAASGSIGVEWCLSGPGCGAIAF

SEQ ID NO: 662272 - protein, 24 aa, Mycobacterium
GAASNLKAVILFDSVADGDATTGM

SEQ ID NO: 662273 - protein, 24 aa, Mycobacterium
GAASPWPAVPWVVSGKSGQALAAQ

SEQ ID NO: 662274 - protein, 34 aa, Mycobacterium
GAASQFLIGIGTKMAERGVQYGFQLAGIGGDALA

SEQ ID NO: 662275 - protein, 19 aa, Mycobacterium
GAASTPWGLGIAARSAALL

SEQ ID NO: 662276 - protein, 17 aa, Mycobacterium
GAASVAAPRAYRAAGAN

SEQ ID NO: 662277 - protein, 20 aa, Mycobacterium
GAATARLFARHGAHVVIADI

SEQ ID NO: 662278 - protein, 20 aa, Mycobacterium
GAATARLFARHGAHVVIVDI

SEQ ID NO: 662279 - protein, 19 aa, Mycobacterium
GAATARPVIPVFINAIGLP

SEQ ID NO: 662280 - protein, 19 aa, Mycobacterium
GAATARRALAEGADVVISD

SEQ ID NO: 662281 - protein, 24 aa, Mycobacterium
GAATMKRLFLELGGKSATIVLEDA

SEQ ID NO: 662282 - protein, 18 aa, Mycobacterium
GAATRTVIWRGSRREVDI

SEQ ID NO: 662283 - protein, 24 aa, Mycobacterium
GAAVGFGCALALACDLVVAAPASY

SEQ ID NO: 662284 - protein, 25 aa, Mycobacterium
GAAVHSCVFPAFRAAGRTVTTVAGL

SEQ ID NO: 662285 - protein, 19 aa, Mycobacterium
GAAVKAFLATAVNSGQSGL

SEQ ID NO: 662286 - protein, 28 aa, Mycobacterium
GAAVKETICKGTLWALRREAAKPGSYFW

SEQ ID NO: 662287 - protein, 25 aa, Mycobacterium
GAAVKRLKVGAARSFAATTQESLAA

SEQ ID NO: 662288 - protein, 28 aa, Mycobacterium
GAAVLTRLRGMFAFALWDTATLELFCAR

SEQ ID NO: 662289 - protein, 20 aa, Mycobacterium
GAAVPLLVAVVGFPELLVAG

SEQ ID NO: 662290 - protein, 19 aa, Mycobacterium
GAAVQRLAVVAGMDGGVEA

SEQ ID NO: 662291 - protein, 18 aa, Mycobacterium
GAAVRAGLGWGMYPEDLV
